United States Patent 11,421,016 (CANCER NEOEPITOPES) - sequence listing, part 5

SEQ ID NO: 184633 - protein, 9 aa, Homo Sapiens
PRSCVVDQT

SEQ ID NO: 184634 - protein, 9 aa, Homo Sapiens
SHQQLGDYR

SEQ ID NO: 184635 - protein, 9 aa, Homo Sapiens
VVEGGLNVT

SEQ ID NO: 184636 - protein, 9 aa, Homo Sapiens
LPYSAYYYP

SEQ ID NO: 184637 - protein, 9 aa, Homo Sapiens
GSNVNRIKK

SEQ ID NO: 184638 - protein, 9 aa, Homo Sapiens
FLQQEHQPF

SEQ ID NO: 184639 - protein, 9 aa, Homo Sapiens
FQTGVLAHL

SEQ ID NO: 184640 - protein, 9 aa, Homo Sapiens
DDEDFLEPP

SEQ ID NO: 184641 - protein, 9 aa, Homo Sapiens
NMLKKYYHH

SEQ ID NO: 184642 - protein, 9 aa, Homo Sapiens
QVLNLTYRF

SEQ ID NO: 184643 - protein, 9 aa, Homo Sapiens
HHPLTVQSQ

SEQ ID NO: 184644 - protein, 9 aa, Homo Sapiens
AILWLPVVL

SEQ ID NO: 184645 - protein, 9 aa, Homo Sapiens
AAVPSTPRP

SEQ ID NO: 184646 - protein, 9 aa, Homo Sapiens
VSTRAGRII

SEQ ID NO: 184647 - protein, 9 aa, Homo Sapiens
GVGETRRPY

SEQ ID NO: 184648 - protein, 9 aa, Homo Sapiens
KKRPQIADE

SEQ ID NO: 184649 - protein, 9 aa, Homo Sapiens
SEGKYRALE

SEQ ID NO: 184650 - protein, 9 aa, Homo Sapiens
MVSVSQTSP

SEQ ID NO: 184651 - protein, 9 aa, Homo Sapiens
IHRVQRIPK

SEQ ID NO: 184652 - protein, 9 aa, Homo Sapiens
ELDGNNMGW

SEQ ID NO: 184653 - protein, 9 aa, Homo Sapiens
SGDNVDVLP

SEQ ID NO: 184654 - protein, 9 aa, Homo Sapiens
EVEERQRVL

SEQ ID NO: 184655 - protein, 9 aa, Homo Sapiens
GVTTSTHRP

SEQ ID NO: 184656 - protein, 9 aa, Homo Sapiens
KHLMEKKIN

SEQ ID NO: 184657 - protein, 9 aa, Homo Sapiens
RSAEERHNR

SEQ ID NO: 184658 - protein, 9 aa, Homo Sapiens
KTKIQTSRR

SEQ ID NO: 184659 - protein, 9 aa, Homo Sapiens
FGEKLKGAN

SEQ ID NO: 184660 - protein, 9 aa, Homo Sapiens
VLLMSPQPL

SEQ ID NO: 184661 - protein, 9 aa, Homo Sapiens
VGPRPGAPC

SEQ ID NO: 184662 - protein, 9 aa, Homo Sapiens
TPTGMLEFE

SEQ ID NO: 184663 - protein, 9 aa, Homo Sapiens
TSSSGLQGC

SEQ ID NO: 184664 - protein, 9 aa, Homo Sapiens
IIPWREHKH

SEQ ID NO: 184665 - protein, 9 aa, Homo Sapiens
GHILETRYA

SEQ ID NO: 184666 - protein, 9 aa, Homo Sapiens
RGQCGEADR

SEQ ID NO: 184667 - protein, 9 aa, Homo Sapiens
PNTCNLRKN

SEQ ID NO: 184668 - protein, 9 aa, Homo Sapiens
PSSCWAPTT

SEQ ID NO: 184669 - protein, 9 aa, Homo Sapiens
DPVLMALEL

SEQ ID NO: 184670 - protein, 9 aa, Homo Sapiens
ASRGPPAPR

SEQ ID NO: 184671 - protein, 9 aa, Homo Sapiens
LTPLCQAMS

SEQ ID NO: 184672 - protein, 9 aa, Homo Sapiens
SKTVRAEPL

SEQ ID NO: 184673 - protein, 9 aa, Homo Sapiens
LERYLDPSM

SEQ ID NO: 184674 - protein, 9 aa, Homo Sapiens
RRNLILRKP

SEQ ID NO: 184675 - protein, 9 aa, Homo Sapiens
GGHRPDLEE

SEQ ID NO: 184676 - protein, 9 aa, Homo Sapiens
LHQFPRSLL

SEQ ID NO: 184677 - protein, 9 aa, Homo Sapiens
STGNASGTR

SEQ ID NO: 184678 - protein, 9 aa, Homo Sapiens
MRWTAQGHV

SEQ ID NO: 184679 - protein, 9 aa, Homo Sapiens
SARRQSSLF

SEQ ID NO: 184680 - protein, 9 aa, Homo Sapiens
LHRHAVLLA

SEQ ID NO: 184681 - protein, 9 aa, Homo Sapiens
QRGRPGRPR

SEQ ID NO: 184682 - protein, 9 aa, Homo Sapiens
YSCYTCDCD

SEQ ID NO: 184683 - protein, 9 aa, Homo Sapiens
SLLGCVSTS

SEQ ID NO: 184684 - protein, 9 aa, Homo Sapiens
LDKENALDQ

SEQ ID NO: 184685 - protein, 9 aa, Homo Sapiens
PSACTRPQS

SEQ ID NO: 184686 - protein, 9 aa, Homo Sapiens
AEHTNWLKN

SEQ ID NO: 184687 - protein, 9 aa, Homo Sapiens
CCCFDVLYC

SEQ ID NO: 184688 - protein, 9 aa, Homo Sapiens
SSSFIRFDV

SEQ ID NO: 184689 - protein, 9 aa, Homo Sapiens
TNNEGLFSL

SEQ ID NO: 184690 - protein, 9 aa, Homo Sapiens
SPRQTPELV

SEQ ID NO: 184691 - protein, 9 aa, Homo Sapiens
IQEACWSCL

SEQ ID NO: 184692 - protein, 9 aa, Homo Sapiens
RPSDMTKKT

SEQ ID NO: 184693 - protein, 9 aa, Homo Sapiens
QQKEKLLCP

SEQ ID NO: 184694 - protein, 9 aa, Homo Sapiens
LAEVREGEE

SEQ ID NO: 184695 - protein, 9 aa, Homo Sapiens
EEYGGFTEA

SEQ ID NO: 184696 - protein, 9 aa, Homo Sapiens
HPWRSGDEA

SEQ ID NO: 184697 - protein, 9 aa, Homo Sapiens
AIMALCNLD

SEQ ID NO: 184698 - protein, 9 aa, Homo Sapiens
EYHTTTGTW

SEQ ID NO: 184699 - protein, 9 aa, Homo Sapiens
TKVKMSLLL

SEQ ID NO: 184700 - protein, 9 aa, Homo Sapiens
LLLQLVQLL

SEQ ID NO: 184701 - protein, 9 aa, Homo Sapiens
ITKLESRLR

SEQ ID NO: 184702 - protein, 9 aa, Homo Sapiens
VIPPTTLNS

SEQ ID NO: 184703 - protein, 9 aa, Homo Sapiens
VNKKRKTAN

SEQ ID NO: 184704 - protein, 9 aa, Homo Sapiens
YPAEITLTR

SEQ ID NO: 184705 - protein, 9 aa, Homo Sapiens
PIVGFLILE

SEQ ID NO: 184706 - protein, 9 aa, Homo Sapiens
HTNWLKNAF

SEQ ID NO: 184707 - protein, 9 aa, Homo Sapiens
HTTGGESCD

SEQ ID NO: 184708 - protein, 9 aa, Homo Sapiens
QDSLQAIQK

SEQ ID NO: 184709 - protein, 9 aa, Homo Sapiens
LMHICTDQL

SEQ ID NO: 184710 - protein, 9 aa, Homo Sapiens
DHPAEVLEE

SEQ ID NO: 184711 - protein, 9 aa, Homo Sapiens
WAKGEKPSS

SEQ ID NO: 184712 - protein, 9 aa, Homo Sapiens
PSCSRGSQR

SEQ ID NO: 184713 - protein, 9 aa, Homo Sapiens
LPSFVELSP

SEQ ID NO: 184714 - protein, 9 aa, Homo Sapiens
HPGLHRLEI

SEQ ID NO: 184715 - protein, 9 aa, Homo Sapiens
DSLSINAMN

SEQ ID NO: 184716 - protein, 9 aa, Homo Sapiens
RKTVKRLWK

SEQ ID NO: 184717 - protein, 9 aa, Homo Sapiens
SAEDLAGQL

SEQ ID NO: 184718 - protein, 9 aa, Homo Sapiens
KHKITMKEG

SEQ ID NO: 184719 - protein, 9 aa, Homo Sapiens
CPLRGHSPR

SEQ ID NO: 184720 - protein, 9 aa, Homo Sapiens
AVAPRAKSI

SEQ ID NO: 184721 - protein, 9 aa, Homo Sapiens
YDTSTDEHL

SEQ ID NO: 184722 - protein, 9 aa, Homo Sapiens
TSVAVKMDN

SEQ ID NO: 184723 - protein, 9 aa, Homo Sapiens
AAGQRRGVL

SEQ ID NO: 184724 - protein, 9 aa, Homo Sapiens
PYSTCYSTQ

SEQ ID NO: 184725 - protein, 9 aa, Homo Sapiens
DMTKKTFNP

SEQ ID NO: 184726 - protein, 9 aa, Homo Sapiens
PECRVRVLA

SEQ ID NO: 184727 - protein, 9 aa, Homo Sapiens
PAVGKQNGT

SEQ ID NO: 184728 - protein, 9 aa, Homo Sapiens
HCVVNGPQT

SEQ ID NO: 184729 - protein, 9 aa, Homo Sapiens
VSAQRLQAQ

SEQ ID NO: 184730 - protein, 9 aa, Homo Sapiens
LEKENNLCN

SEQ ID NO: 184731 - protein, 9 aa, Homo Sapiens
TVKSLPCNI

SEQ ID NO: 184732 - protein, 9 aa, Homo Sapiens
EEHILVFSR

SEQ ID NO: 184733 - protein, 9 aa, Homo Sapiens
SHLATETRA

SEQ ID NO: 184734 - protein, 9 aa, Homo Sapiens
GRQFPQCLQ

SEQ ID NO: 184735 - protein, 9 aa, Homo Sapiens
ARGTTSSTG

SEQ ID NO: 184736 - protein, 9 aa, Homo Sapiens
EFMMRQPNS

SEQ ID NO: 184737 - protein, 9 aa, Homo Sapiens
TIQILHWSY

SEQ ID NO: 184738 - protein, 9 aa, Homo Sapiens
ACCPLPLPR

SEQ ID NO: 184739 - protein, 9 aa, Homo Sapiens
HPTVPHGAS

SEQ ID NO: 184740 - protein, 9 aa, Homo Sapiens
SDLSKSSDD

SEQ ID NO: 184741 - protein, 9 aa, Homo Sapiens
LIQFWDWKI

SEQ ID NO: 184742 - protein, 9 aa, Homo Sapiens
LNTSSKNGA

SEQ ID NO: 184743 - protein, 9 aa, Homo Sapiens
EPTVAPTTS

SEQ ID NO: 184744 - protein, 9 aa, Homo Sapiens
VPENSHGPF

SEQ ID NO: 184745 - protein, 9 aa, Homo Sapiens
KGDSIRNEK

SEQ ID NO: 184746 - protein, 9 aa, Homo Sapiens
VPLNPPPPL

SEQ ID NO: 184747 - protein, 9 aa, Homo Sapiens
YLFHMRNHT

SEQ ID NO: 184748 - protein, 9 aa, Homo Sapiens
AERVQEKDN

SEQ ID NO: 184749 - protein, 9 aa, Homo Sapiens
KIQKTPWFI

SEQ ID NO: 184750 - protein, 9 aa, Homo Sapiens
RGRRPAGKE

SEQ ID NO: 184751 - protein, 9 aa, Homo Sapiens
TPLDKLTQQ

SEQ ID NO: 184752 - protein, 9 aa, Homo Sapiens
AHTLCMMVQ

SEQ ID NO: 184753 - protein, 9 aa, Homo Sapiens
IMENSKVVG

SEQ ID NO: 184754 - protein, 9 aa, Homo Sapiens
ANVDLLNRT

SEQ ID NO: 184755 - protein, 9 aa, Homo Sapiens
VTEKQYYSN

SEQ ID NO: 184756 - protein, 9 aa, Homo Sapiens
FSSIRCRLS

SEQ ID NO: 184757 - protein, 9 aa, Homo Sapiens
PGPCPPPQR

SEQ ID NO: 184758 - protein, 9 aa, Homo Sapiens
AGNKSIKDQ

SEQ ID NO: 184759 - protein, 9 aa, Homo Sapiens
ATTRPSDFC

SEQ ID NO: 184760 - protein, 9 aa, Homo Sapiens
TPTPASSPV

SEQ ID NO: 184761 - protein, 9 aa, Homo Sapiens
PEREVQIVG

SEQ ID NO: 184762 - protein, 9 aa, Homo Sapiens
VRVSTRAGR

SEQ ID NO: 184763 - protein, 9 aa, Homo Sapiens
ISEKKVTWM

SEQ ID NO: 184764 - protein, 9 aa, Homo Sapiens
IIGPQLTVL

SEQ ID NO: 184765 - protein, 9 aa, Homo Sapiens
SQDGSFSAR

SEQ ID NO: 184766 - protein, 9 aa, Homo Sapiens
ERGFPGYTG

SEQ ID NO: 184767 - protein, 9 aa, Homo Sapiens
LLLLHRVLQ

SEQ ID NO: 184768 - protein, 9 aa, Homo Sapiens
NQIAVSSLS

SEQ ID NO: 184769 - protein, 9 aa, Homo Sapiens
TTVGKVVVT

SEQ ID NO: 184770 - protein, 9 aa, Homo Sapiens
ARCGVLWLK

SEQ ID NO: 184771 - protein, 9 aa, Homo Sapiens
GHAAVGAVG

SEQ ID NO: 184772 - protein, 9 aa, Homo Sapiens
LQILAHLLP

SEQ ID NO: 184773 - protein, 9 aa, Homo Sapiens
PTAIRQTLY

SEQ ID NO: 184774 - protein, 9 aa, Homo Sapiens
QLDGRNELA

SEQ ID NO: 184775 - protein, 9 aa, Homo Sapiens
DHICFVVDL

SEQ ID NO: 184776 - protein, 9 aa, Homo Sapiens
LSVNMLVRF

SEQ ID NO: 184777 - protein, 9 aa, Homo Sapiens
ECYPILDGL

SEQ ID NO: 184778 - protein, 9 aa, Homo Sapiens
VTHGGQFKF

SEQ ID NO: 184779 - protein, 9 aa, Homo Sapiens
SDSNSPGNI

SEQ ID NO: 184780 - protein, 9 aa, Homo Sapiens
FCVRCKCQW

SEQ ID NO: 184781 - protein, 9 aa, Homo Sapiens
RRCPLSFGE

SEQ ID NO: 184782 - protein, 9 aa, Homo Sapiens
HQDSSQGNL

SEQ ID NO: 184783 - protein, 9 aa, Homo Sapiens
RSSGNFSSC

SEQ ID NO: 184784 - protein, 9 aa, Homo Sapiens
RSKMSQTLL

SEQ ID NO: 184785 - protein, 9 aa, Homo Sapiens
RDMPQMRME

SEQ ID NO: 184786 - protein, 9 aa, Homo Sapiens
MSQTLLLWR

SEQ ID NO: 184787 - protein, 9 aa, Homo Sapiens
GLHLLQILA

SEQ ID NO: 184788 - protein, 9 aa, Homo Sapiens
FETDSDLLA

SEQ ID NO: 184789 - protein, 9 aa, Homo Sapiens
TFSPGLELV

SEQ ID NO: 184790 - protein, 9 aa, Homo Sapiens
PIIPSASEH

SEQ ID NO: 184791 - protein, 9 aa, Homo Sapiens
FDRISSVKF

SEQ ID NO: 184792 - protein, 9 aa, Homo Sapiens
TSLGLHGLL

SEQ ID NO: 184793 - protein, 9 aa, Homo Sapiens
NNMGWSVCG

SEQ ID NO: 184794 - protein, 9 aa, Homo Sapiens
QEVEGLEAS

SEQ ID NO: 184795 - protein, 9 aa, Homo Sapiens
HRVQRIPKV

SEQ ID NO: 184796 - protein, 9 aa, Homo Sapiens
PQAAAAAIR

SEQ ID NO: 184797 - protein, 9 aa, Homo Sapiens
SLPTPLTLS

SEQ ID NO: 184798 - protein, 9 aa, Homo Sapiens
SYKITSTIE

SEQ ID NO: 184799 - protein, 9 aa, Homo Sapiens
GLQHLGQDH

SEQ ID NO: 184800 - protein, 9 aa, Homo Sapiens
LKTGRQRLF

SEQ ID NO: 184801 - protein, 9 aa, Homo Sapiens
EVKKEMAHP

SEQ ID NO: 184802 - protein, 9 aa, Homo Sapiens
QQLRSAREA

SEQ ID NO: 184803 - protein, 9 aa, Homo Sapiens
GTFVLEAPV

SEQ ID NO: 184804 - protein, 9 aa, Homo Sapiens
ISLSPRKVP

SEQ ID NO: 184805 - protein, 9 aa, Homo Sapiens
WYTMSACPP

SEQ ID NO: 184806 - protein, 9 aa, Homo Sapiens
ARGPVRLLL

SEQ ID NO: 184807 - protein, 9 aa, Homo Sapiens
AGPTRATGW

SEQ ID NO: 184808 - protein, 9 aa, Homo Sapiens
AVLLESLKA

SEQ ID NO: 184809 - protein, 9 aa, Homo Sapiens
ASEQPPSMC

SEQ ID NO: 184810 - protein, 9 aa, Homo Sapiens
FQMVDELEV

SEQ ID NO: 184811 - protein, 9 aa, Homo Sapiens
RACCPLPLP

SEQ ID NO: 184812 - protein, 9 aa, Homo Sapiens
HSSCLHGNT

SEQ ID NO: 184813 - protein, 9 aa, Homo Sapiens
PKNDVHQKQ

SEQ ID NO: 184814 - protein, 9 aa, Homo Sapiens
RQCDAHSAR

SEQ ID NO: 184815 - protein, 9 aa, Homo Sapiens
WNSNDKEKI

SEQ ID NO: 184816 - protein, 9 aa, Homo Sapiens
VLCTHHTNT

SEQ ID NO: 184817 - protein, 9 aa, Homo Sapiens
TEYIQEKNP

SEQ ID NO: 184818 - protein, 9 aa, Homo Sapiens
SPEPSQPQC

SEQ ID NO: 184819 - protein, 9 aa, Homo Sapiens
ALVTLRHHK

SEQ ID NO: 184820 - protein, 9 aa, Homo Sapiens
PTVAPTTSA

SEQ ID NO: 184821 - protein, 9 aa, Homo Sapiens
IKKRRIHKN

SEQ ID NO: 184822 - protein, 9 aa, Homo Sapiens
TEDIMSSGD

SEQ ID NO: 184823 - protein, 9 aa, Homo Sapiens
TSDSQPSNW

SEQ ID NO: 184824 - protein, 9 aa, Homo Sapiens
VTYAFVIQR

SEQ ID NO: 184825 - protein, 9 aa, Homo Sapiens
CLEEEVLPI

SEQ ID NO: 184826 - protein, 9 aa, Homo Sapiens
WSNCSDLKQ

SEQ ID NO: 184827 - protein, 9 aa, Homo Sapiens
LAAPGAPSL

SEQ ID NO: 184828 - protein, 9 aa, Homo Sapiens
SHKVLKTDR

SEQ ID NO: 184829 - protein, 9 aa, Homo Sapiens
EITHHPPVW

SEQ ID NO: 184830 - protein, 9 aa, Homo Sapiens
DGTVDTPPA

SEQ ID NO: 184831 - protein, 9 aa, Homo Sapiens
IAVALFFGP

SEQ ID NO: 184832 - protein, 9 aa, Homo Sapiens
SISAQNSDT

SEQ ID NO: 184833 - protein, 9 aa, Homo Sapiens
QAIAVDPLR

SEQ ID NO: 184834 - protein, 9 aa, Homo Sapiens
LIDQDAGRE

SEQ ID NO: 184835 - protein, 9 aa, Homo Sapiens
DSLQAIQKQ

SEQ ID NO: 184836 - protein, 9 aa, Homo Sapiens
SAGHGHICG

SEQ ID NO: 184837 - protein, 9 aa, Homo Sapiens
VQIVGTMDS

SEQ ID NO: 184838 - protein, 9 aa, Homo Sapiens
LCHAQLLVY

SEQ ID NO: 184839 - protein, 9 aa, Homo Sapiens
AWRLHARSC

SEQ ID NO: 184840 - protein, 9 aa, Homo Sapiens
WLSAESGLS

SEQ ID NO: 184841 - protein, 9 aa, Homo Sapiens
LGATSAQNI

SEQ ID NO: 184842 - protein, 9 aa, Homo Sapiens
REMLLRQHE

SEQ ID NO: 184843 - protein, 9 aa, Homo Sapiens
DDDDEEDDT

SEQ ID NO: 184844 - protein, 9 aa, Homo Sapiens
TVSQPYSFI

SEQ ID NO: 184845 - protein, 9 aa, Homo Sapiens
IWDQNQAIL

SEQ ID NO: 184846 - protein, 9 aa, Homo Sapiens
IPIDQVGLF

SEQ ID NO: 184847 - protein, 9 aa, Homo Sapiens
TLLLLGGFL

SEQ ID NO: 184848 - protein, 9 aa, Homo Sapiens
QMHLRSFLL

SEQ ID NO: 184849 - protein, 9 aa, Homo Sapiens
EGADTVSGT

SEQ ID NO: 184850 - protein, 9 aa, Homo Sapiens
SFAIRKLTQ

SEQ ID NO: 184851 - protein, 9 aa, Homo Sapiens
SMDNNCSLD

SEQ ID NO: 184852 - protein, 9 aa, Homo Sapiens
VSTGGHTHT

SEQ ID NO: 184853 - protein, 9 aa, Homo Sapiens
NTPCRALFY

SEQ ID NO: 184854 - protein, 9 aa, Homo Sapiens
LLLPTQPSF

SEQ ID NO: 184855 - protein, 9 aa, Homo Sapiens
VNSVGSSSV

SEQ ID NO: 184856 - protein, 9 aa, Homo Sapiens
NGPTRPPRP

SEQ ID NO: 184857 - protein, 9 aa, Homo Sapiens
WKEPRAKNI

SEQ ID NO: 184858 - protein, 9 aa, Homo Sapiens
KSKGLNQRL

SEQ ID NO: 184859 - protein, 9 aa, Homo Sapiens
DNYLYICYE

SEQ ID NO: 184860 - protein, 9 aa, Homo Sapiens
FEPPMPPPA

SEQ ID NO: 184861 - protein, 9 aa, Homo Sapiens
CHEINCGNP

SEQ ID NO: 184862 - protein, 9 aa, Homo Sapiens
NPMGVLSVG

SEQ ID NO: 184863 - protein, 9 aa, Homo Sapiens
LDGRNELAE

SEQ ID NO: 184864 - protein, 9 aa, Homo Sapiens
GLHRLEICS

SEQ ID NO: 184865 - protein, 9 aa, Homo Sapiens
ALLSSAWPW

SEQ ID NO: 184866 - protein, 9 aa, Homo Sapiens
PQKRVDSPM

SEQ ID NO: 184867 - protein, 9 aa, Homo Sapiens
VHVPTSLII

SEQ ID NO: 184868 - protein, 9 aa, Homo Sapiens
LPETIGKRL

SEQ ID NO: 184869 - protein, 9 aa, Homo Sapiens
KSQGGRILL

SEQ ID NO: 184870 - protein, 9 aa, Homo Sapiens
PTMQHSCTH

SEQ ID NO: 184871 - protein, 9 aa, Homo Sapiens
LGRGLPTNK

SEQ ID NO: 184872 - protein, 9 aa, Homo Sapiens
FLSSTHPVN

SEQ ID NO: 184873 - protein, 9 aa, Homo Sapiens
LLAERAQML

SEQ ID NO: 184874 - protein, 9 aa, Homo Sapiens
KKLPETDID

SEQ ID NO: 184875 - protein, 9 aa, Homo Sapiens
VIEEFWQQE

SEQ ID NO: 184876 - protein, 9 aa, Homo Sapiens
GILSASWKQ

SEQ ID NO: 184877 - protein, 9 aa, Homo Sapiens
SRAFYRGYL

SEQ ID NO: 184878 - protein, 9 aa, Homo Sapiens
SSWKSPLHL

SEQ ID NO: 184879 - protein, 9 aa, Homo Sapiens
QETLVLPSL

SEQ ID NO: 184880 - protein, 9 aa, Homo Sapiens
KMTLKALVK

SEQ ID NO: 184881 - protein, 9 aa, Homo Sapiens
QRLENTQHL

SEQ ID NO: 184882 - protein, 9 aa, Homo Sapiens
LHGLLALSS

SEQ ID NO: 184883 - protein, 9 aa, Homo Sapiens
IGEVVALCL

SEQ ID NO: 184884 - protein, 9 aa, Homo Sapiens
DDDDGDDEG

SEQ ID NO: 184885 - protein, 9 aa, Homo Sapiens
KSVSRPEAC

SEQ ID NO: 184886 - protein, 9 aa, Homo Sapiens
WSCLEQAKL

SEQ ID NO: 184887 - protein, 9 aa, Homo Sapiens
TIAGALIAD

SEQ ID NO: 184888 - protein, 9 aa, Homo Sapiens
PACSWKASP

SEQ ID NO: 184889 - protein, 9 aa, Homo Sapiens
RPMWQLASL

SEQ ID NO: 184890 - protein, 9 aa, Homo Sapiens
TNKIDAALF

SEQ ID NO: 184891 - protein, 9 aa, Homo Sapiens
NPQGHQIFG

SEQ ID NO: 184892 - protein, 9 aa, Homo Sapiens
QSPVRVRMC

SEQ ID NO: 184893 - protein, 9 aa, Homo Sapiens
VKHFLLGDA

SEQ ID NO: 184894 - protein, 9 aa, Homo Sapiens
LVCRAIFSL

SEQ ID NO: 184895 - protein, 9 aa, Homo Sapiens
EQGPGGPKG

SEQ ID NO: 184896 - protein, 9 aa, Homo Sapiens
LSLRNLSSL

SEQ ID NO: 184897 - protein, 9 aa, Homo Sapiens
TTGWLERAY

SEQ ID NO: 184898 - protein, 9 aa, Homo Sapiens
EDKERAWRL

SEQ ID NO: 184899 - protein, 9 aa, Homo Sapiens
HKYGCTNGR

SEQ ID NO: 184900 - protein, 9 aa, Homo Sapiens
NPALGKSIL

SEQ ID NO: 184901 - protein, 9 aa, Homo Sapiens
PASGSSKLP

SEQ ID NO: 184902 - protein, 9 aa, Homo Sapiens
RVERTLTSV

SEQ ID NO: 184903 - protein, 9 aa, Homo Sapiens
TLKSARSSV

SEQ ID NO: 184904 - protein, 9 aa, Homo Sapiens
RTSLLVRRM

SEQ ID NO: 184905 - protein, 9 aa, Homo Sapiens
YLLLCHAQL

SEQ ID NO: 184906 - protein, 9 aa, Homo Sapiens
RSCVVDQTG

SEQ ID NO: 184907 - protein, 9 aa, Homo Sapiens
TKTWQWKFW

SEQ ID NO: 184908 - protein, 9 aa, Homo Sapiens
SPKNHGQTS

SEQ ID NO: 184909 - protein, 9 aa, Homo Sapiens
QSQACPHQA

SEQ ID NO: 184910 - protein, 9 aa, Homo Sapiens
LQRLENTQH

SEQ ID NO: 184911 - protein, 9 aa, Homo Sapiens
WDKTTMKEL

SEQ ID NO: 184912 - protein, 9 aa, Homo Sapiens
LKKYYHHRN

SEQ ID NO: 184913 - protein, 9 aa, Homo Sapiens
VPNSAYGAL

SEQ ID NO: 184914 - protein, 9 aa, Homo Sapiens
NQKKAKIKK

SEQ ID NO: 184915 - protein, 9 aa, Homo Sapiens
AAGEQGPGG

SEQ ID NO: 184916 - protein, 9 aa, Homo Sapiens
PGSMPFSLN

SEQ ID NO: 184917 - protein, 9 aa, Homo Sapiens
RDHKSKPFR

SEQ ID NO: 184918 - protein, 9 aa, Homo Sapiens
GALAAPGAP

SEQ ID NO: 184919 - protein, 9 aa, Homo Sapiens
TATEVAQEE

SEQ ID NO: 184920 - protein, 9 aa, Homo Sapiens
KQPQISGSL

SEQ ID NO: 184921 - protein, 9 aa, Homo Sapiens
RWVLIAAHC

SEQ ID NO: 184922 - protein, 9 aa, Homo Sapiens
KNKEKLADL

SEQ ID NO: 184923 - protein, 9 aa, Homo Sapiens
MKMNAKKAA

SEQ ID NO: 184924 - protein, 9 aa, Homo Sapiens
LLLHLISLS

SEQ ID NO: 184925 - protein, 9 aa, Homo Sapiens
SGKNRWLSC

SEQ ID NO: 184926 - protein, 9 aa, Homo Sapiens
ESPSISAQN

SEQ ID NO: 184927 - protein, 9 aa, Homo Sapiens
GDHHKDRHF

SEQ ID NO: 184928 - protein, 9 aa, Homo Sapiens
DAGREDGVA

SEQ ID NO: 184929 - protein, 9 aa, Homo Sapiens
DDECHASFL

SEQ ID NO: 184930 - protein, 9 aa, Homo Sapiens
ILYFFYYGW

SEQ ID NO: 184931 - protein, 9 aa, Homo Sapiens
AAIWKKLVI

SEQ ID NO: 184932 - protein, 9 aa, Homo Sapiens
AFLNMFVCA

SEQ ID NO: 184933 - protein, 9 aa, Homo Sapiens
IDQDAGRED

SEQ ID NO: 184934 - protein, 9 aa, Homo Sapiens
YEINEKIGP

SEQ ID NO: 184935 - protein, 9 aa, Homo Sapiens
HPAEDMEGT

SEQ ID NO: 184936 - protein, 9 aa, Homo Sapiens
EPQRPPRSI

SEQ ID NO: 184937 - protein, 9 aa, Homo Sapiens
PEVDFVPIV

SEQ ID NO: 184938 - protein, 9 aa, Homo Sapiens
DIRLVDAGG

SEQ ID NO: 184939 - protein, 9 aa, Homo Sapiens
AVREMLLRQ

SEQ ID NO: 184940 - protein, 9 aa, Homo Sapiens
SLTWFLSPT

SEQ ID NO: 184941 - protein, 9 aa, Homo Sapiens
PDWLVKVTD

SEQ ID NO: 184942 - protein, 9 aa, Homo Sapiens
QSIDFKIDS

SEQ ID NO: 184943 - protein, 9 aa, Homo Sapiens
GDFIQRAVY

SEQ ID NO: 184944 - protein, 9 aa, Homo Sapiens
KKTHTSLTF

SEQ ID NO: 184945 - protein, 9 aa, Homo Sapiens
QPHGQKMTS

SEQ ID NO: 184946 - protein, 9 aa, Homo Sapiens
VNKSLLSLR

SEQ ID NO: 184947 - protein, 9 aa, Homo Sapiens
TQCQSHCTM

SEQ ID NO: 184948 - protein, 9 aa, Homo Sapiens
VAYKCKPSS

SEQ ID NO: 184949 - protein, 9 aa, Homo Sapiens
LCGMREMRA

SEQ ID NO: 184950 - protein, 9 aa, Homo Sapiens
DESGPPVPS

SEQ ID NO: 184951 - protein, 9 aa, Homo Sapiens
TLCMMVQKE

SEQ ID NO: 184952 - protein, 9 aa, Homo Sapiens
SLRKELGVN

SEQ ID NO: 184953 - protein, 9 aa, Homo Sapiens
CENMCPSVN

SEQ ID NO: 184954 - protein, 9 aa, Homo Sapiens
TGAAASPTT

SEQ ID NO: 184955 - protein, 9 aa, Homo Sapiens
EKLCQETAI

SEQ ID NO: 184956 - protein, 9 aa, Homo Sapiens
VLNIHMAKS

SEQ ID NO: 184957 - protein, 9 aa, Homo Sapiens
YCLSVIFFF

SEQ ID NO: 184958 - protein, 9 aa, Homo Sapiens
VRPSDMTKK

SEQ ID NO: 184959 - protein, 9 aa, Homo Sapiens
THRPASAWT

SEQ ID NO: 184960 - protein, 9 aa, Homo Sapiens
PLAHQPVPC

SEQ ID NO: 184961 - protein, 9 aa, Homo Sapiens
ALEEANILF

SEQ ID NO: 184962 - protein, 9 aa, Homo Sapiens
QIAVSSLSA

SEQ ID NO: 184963 - protein, 9 aa, Homo Sapiens
WGRWCWWGR

SEQ ID NO: 184964 - protein, 9 aa, Homo Sapiens
SFGLSDEHI

SEQ ID NO: 184965 - protein, 9 aa, Homo Sapiens
GGPSDSGKQ

SEQ ID NO: 184966 - protein, 9 aa, Homo Sapiens
QPQISGSLF

SEQ ID NO: 184967 - protein, 9 aa, Homo Sapiens
EKDNGFFLR

SEQ ID NO: 184968 - protein, 9 aa, Homo Sapiens
TSFRILASD

SEQ ID NO: 184969 - protein, 9 aa, Homo Sapiens
ARKRLEEKR

SEQ ID NO: 184970 - protein, 9 aa, Homo Sapiens
DGKVTEKQY

SEQ ID NO: 184971 - protein, 9 aa, Homo Sapiens
CSCLAALDM

SEQ ID NO: 184972 - protein, 9 aa, Homo Sapiens
KGRKGSVRK

SEQ ID NO: 184973 - protein, 9 aa, Homo Sapiens
PRMRQLQSS

SEQ ID NO: 184974 - protein, 9 aa, Homo Sapiens
WPWPKIPLD

SEQ ID NO: 184975 - protein, 9 aa, Homo Sapiens
LTNSDINLK

SEQ ID NO: 184976 - protein, 9 aa, Homo Sapiens
SVCSAPSSS

SEQ ID NO: 184977 - protein, 9 aa, Homo Sapiens
GPGSCPPSR

SEQ ID NO: 184978 - protein, 9 aa, Homo Sapiens
LILRKPEWI

SEQ ID NO: 184979 - protein, 9 aa, Homo Sapiens
EGIRKCQGS

SEQ ID NO: 184980 - protein, 9 aa, Homo Sapiens
IAARTRSTP

SEQ ID NO: 184981 - protein, 9 aa, Homo Sapiens
GSTGCSLGS

SEQ ID NO: 184982 - protein, 9 aa, Homo Sapiens
LVLQLDGRN

SEQ ID NO: 184983 - protein, 9 aa, Homo Sapiens
IPTSHLVTY

SEQ ID NO: 184984 - protein, 9 aa, Homo Sapiens
AAVGAVGAK

SEQ ID NO: 184985 - protein, 9 aa, Homo Sapiens
ADQGQGPHA

SEQ ID NO: 184986 - protein, 9 aa, Homo Sapiens
QLRSAREAI

SEQ ID NO: 184987 - protein, 9 aa, Homo Sapiens
ILWLPVVLW

SEQ ID NO: 184988 - protein, 9 aa, Homo Sapiens
SPNLLYSQN

SEQ ID NO: 184989 - protein, 9 aa, Homo Sapiens
TRCWESCQE

SEQ ID NO: 184990 - protein, 9 aa, Homo Sapiens
RPALLRKTK

SEQ ID NO: 184991 - protein, 9 aa, Homo Sapiens
GEEHILVFS

SEQ ID NO: 184992 - protein, 9 aa, Homo Sapiens
LEEHPQSVV

SEQ ID NO: 184993 - protein, 9 aa, Homo Sapiens
HHVIDGLHD

SEQ ID NO: 184994 - protein, 9 aa, Homo Sapiens
TQTKAIKDQ

SEQ ID NO: 184995 - protein, 9 aa, Homo Sapiens
CQAPIEKNA

SEQ ID NO: 184996 - protein, 9 aa, Homo Sapiens
LLGHRAELF

SEQ ID NO: 184997 - protein, 9 aa, Homo Sapiens
TSPEPSQPQ

SEQ ID NO: 184998 - protein, 9 aa, Homo Sapiens
THQHTPYRE

SEQ ID NO: 184999 - protein, 9 aa, Homo Sapiens
HMAKSYVLK

SEQ ID NO: 185000 - protein, 9 aa, Homo Sapiens
NDVHQKQRR

SEQ ID NO: 185001 - protein, 9 aa, Homo Sapiens
QHKQGNDGR

SEQ ID NO: 185002 - protein, 9 aa, Homo Sapiens
YYGRTEFID

SEQ ID NO: 185003 - protein, 9 aa, Homo Sapiens
WTAQGHVNH

SEQ ID NO: 185004 - protein, 9 aa, Homo Sapiens
FQENVLPDI

SEQ ID NO: 185005 - protein, 9 aa, Homo Sapiens
RTHQHTPYR

SEQ ID NO: 185006 - protein, 9 aa, Homo Sapiens
VRLLHFFSG

SEQ ID NO: 185007 - protein, 9 aa, Homo Sapiens
DVLQGQVAE

SEQ ID NO: 185008 - protein, 9 aa, Homo Sapiens
DWRAVNQQP

SEQ ID NO: 185009 - protein, 9 aa, Homo Sapiens
CKKLIQKSH

SEQ ID NO: 185010 - protein, 9 aa, Homo Sapiens
ELAHQGVWP

SEQ ID NO: 185011 - protein, 9 aa, Homo Sapiens
IQVKALIVV

SEQ ID NO: 185012 - protein, 9 aa, Homo Sapiens
AEAFKTKDC

SEQ ID NO: 185013 - protein, 9 aa, Homo Sapiens
EPRGAGGMR

SEQ ID NO: 185014 - protein, 9 aa, Homo Sapiens
SVTCSHFAQ

SEQ ID NO: 185015 - protein, 9 aa, Homo Sapiens
NVAVMDQES

SEQ ID NO: 185016 - protein, 9 aa, Homo Sapiens
LVSGKPTES

SEQ ID NO: 185017 - protein, 9 aa, Homo Sapiens
EGLTLYITS

SEQ ID NO: 185018 - protein, 9 aa, Homo Sapiens
KKWTAVPLQ

SEQ ID NO: 185019 - protein, 9 aa, Homo Sapiens
SYVAGITWF

SEQ ID NO: 185020 - protein, 9 aa, Homo Sapiens
NVNSVGSSS

SEQ ID NO: 185021 - protein, 9 aa, Homo Sapiens
VVTEYQENK

SEQ ID NO: 185022 - protein, 9 aa, Homo Sapiens
ALHVFPWGL

SEQ ID NO: 185023 - protein, 9 aa, Homo Sapiens
EENQSLNSD

SEQ ID NO: 185024 - protein, 9 aa, Homo Sapiens
DYLRRRASL

SEQ ID NO: 185025 - protein, 9 aa, Homo Sapiens
SDPGPRKQD

SEQ ID NO: 185026 - protein, 9 aa, Homo Sapiens
ENLPCFPSL

SEQ ID NO: 185027 - protein, 9 aa, Homo Sapiens
QACPHQASP

SEQ ID NO: 185028 - protein, 9 aa, Homo Sapiens
TIIKQAPGH

SEQ ID NO: 185029 - protein, 9 aa, Homo Sapiens
TSMYFQCCA

SEQ ID NO: 185030 - protein, 9 aa, Homo Sapiens
GDNVEIAVG

SEQ ID NO: 185031 - protein, 9 aa, Homo Sapiens
GNVATCESK

SEQ ID NO: 185032 - protein, 9 aa, Homo Sapiens
GKGLTLELA

SEQ ID NO: 185033 - protein, 9 aa, Homo Sapiens
LPATPRDRL

SEQ ID NO: 185034 - protein, 9 aa, Homo Sapiens
KTPPKPWQS

SEQ ID NO: 185035 - protein, 9 aa, Homo Sapiens
FEGKTNTEP

SEQ ID NO: 185036 - protein, 9 aa, Homo Sapiens
QGDEDDKLL

SEQ ID NO: 185037 - protein, 9 aa, Homo Sapiens
YSSTMTNNE

SEQ ID NO: 185038 - protein, 9 aa, Homo Sapiens
NGVIEEFWQ

SEQ ID NO: 185039 - protein, 9 aa, Homo Sapiens
DLMPKEQAR

SEQ ID NO: 185040 - protein, 9 aa, Homo Sapiens
TCGPVHLLP

SEQ ID NO: 185041 - protein, 9 aa, Homo Sapiens
EGAVVIDVG

SEQ ID NO: 185042 - protein, 9 aa, Homo Sapiens
EGGGHAVPV

SEQ ID NO: 185043 - protein, 9 aa, Homo Sapiens
EKIGPRTGL

SEQ ID NO: 185044 - protein, 9 aa, Homo Sapiens
RDKPITDQQ

SEQ ID NO: 185045 - protein, 9 aa, Homo Sapiens
LFNILDLLT

SEQ ID NO: 185046 - protein, 9 aa, Homo Sapiens
KETRPQLDY

SEQ ID NO: 185047 - protein, 9 aa, Homo Sapiens
SPPSTNAKS

SEQ ID NO: 185048 - protein, 9 aa, Homo Sapiens
FLLGDAAVL

SEQ ID NO: 185049 - protein, 9 aa, Homo Sapiens
EHTPLDKLT

SEQ ID NO: 185050 - protein, 9 aa, Homo Sapiens
LWMEFVSDG

SEQ ID NO: 185051 - protein, 9 aa, Homo Sapiens
HPDLQKQLW

SEQ ID NO: 185052 - protein, 9 aa, Homo Sapiens
LLRLQSLLS

SEQ ID NO: 185053 - protein, 9 aa, Homo Sapiens
RLSLFPSTH

SEQ ID NO: 185054 - protein, 9 aa, Homo Sapiens
LVSVHLLEE

SEQ ID NO: 185055 - protein, 9 aa, Homo Sapiens
KDPSQCPSM

SEQ ID NO: 185056 - protein, 9 aa, Homo Sapiens
LGRGLDPSS

SEQ ID NO: 185057 - protein, 9 aa, Homo Sapiens
RSRPALLRK

SEQ ID NO: 185058 - protein, 9 aa, Homo Sapiens
SQNHRRLLS

SEQ ID NO: 185059 - protein, 9 aa, Homo Sapiens
VWAKTFLQQ

SEQ ID NO: 185060 - protein, 9 aa, Homo Sapiens
AHPRWESQV

SEQ ID NO: 185061 - protein, 9 aa, Homo Sapiens
PQLDYEVPR

SEQ ID NO: 185062 - protein, 9 aa, Homo Sapiens
KFLSRHLAE

SEQ ID NO: 185063 - protein, 9 aa, Homo Sapiens
MAIALMTTV

SEQ ID NO: 185064 - protein, 9 aa, Homo Sapiens
NSSKIPKKA

SEQ ID NO: 185065 - protein, 9 aa, Homo Sapiens
KETGNVATC

SEQ ID NO: 185066 - protein, 9 aa, Homo Sapiens
IIILTSGKY

SEQ ID NO: 185067 - protein, 9 aa, Homo Sapiens
DSNSPGNIQ

SEQ ID NO: 185068 - protein, 9 aa, Homo Sapiens
SAQQNCVVG

SEQ ID NO: 185069 - protein, 9 aa, Homo Sapiens
PEHLAHGSP

SEQ ID NO: 185070 - protein, 9 aa, Homo Sapiens
QVASVKGKL

SEQ ID NO: 185071 - protein, 9 aa, Homo Sapiens
KTEIQLTMN

SEQ ID NO: 185072 - protein, 9 aa, Homo Sapiens
LLLLIKPKN

SEQ ID NO: 185073 - protein, 9 aa, Homo Sapiens
TTQAPMFTQ

SEQ ID NO: 185074 - protein, 9 aa, Homo Sapiens
CEWINSHFH

SEQ ID NO: 185075 - protein, 9 aa, Homo Sapiens
LNQRLLLLI

SEQ ID NO: 185076 - protein, 9 aa, Homo Sapiens
IQEITRSRK

SEQ ID NO: 185077 - protein, 9 aa, Homo Sapiens
KHLSRRRKN

SEQ ID NO: 185078 - protein, 9 aa, Homo Sapiens
PPPANPQLL

SEQ ID NO: 185079 - protein, 9 aa, Homo Sapiens
DNQFESPKR

SEQ ID NO: 185080 - protein, 9 aa, Homo Sapiens
LTLKLPETI

SEQ ID NO: 185081 - protein, 9 aa, Homo Sapiens
SVGAEGGWG

SEQ ID NO: 185082 - protein, 9 aa, Homo Sapiens
SFIRFDVPE

SEQ ID NO: 185083 - protein, 9 aa, Homo Sapiens
RAEQLKKAS

SEQ ID NO: 185084 - protein, 9 aa, Homo Sapiens
SSASCCYST

SEQ ID NO: 185085 - protein, 9 aa, Homo Sapiens
GRWSCCPAR

SEQ ID NO: 185086 - protein, 9 aa, Homo Sapiens
VSGSGGRGH

SEQ ID NO: 185087 - protein, 9 aa, Homo Sapiens
RKAMTKKRV

SEQ ID NO: 185088 - protein, 9 aa, Homo Sapiens
KKCYGMASH

SEQ ID NO: 185089 - protein, 9 aa, Homo Sapiens
EAFSDDPSP

SEQ ID NO: 185090 - protein, 9 aa, Homo Sapiens
KGKQPAVGK

SEQ ID NO: 185091 - protein, 9 aa, Homo Sapiens
KCRHMRGNQ

SEQ ID NO: 185092 - protein, 9 aa, Homo Sapiens
TGVGRTRAG

SEQ ID NO: 185093 - protein, 9 aa, Homo Sapiens
NTDVPILAG

SEQ ID NO: 185094 - protein, 9 aa, Homo Sapiens
IIQRTTSTL

SEQ ID NO: 185095 - protein, 9 aa, Homo Sapiens
QEKNPMGVL

SEQ ID NO: 185096 - protein, 9 aa, Homo Sapiens
TYRFLDTSN

SEQ ID NO: 185097 - protein, 9 aa, Homo Sapiens
GDGTLCSET

SEQ ID NO: 185098 - protein, 9 aa, Homo Sapiens
LSVIFFFFV

SEQ ID NO: 185099 - protein, 9 aa, Homo Sapiens
HQKQRRKRL

SEQ ID NO: 185100 - protein, 9 aa, Homo Sapiens
VWWIMHDGG

SEQ ID NO: 185101 - protein, 9 aa, Homo Sapiens
QTSFAIRKL

SEQ ID NO: 185102 - protein, 9 aa, Homo Sapiens
PGLVLQLDG

SEQ ID NO: 185103 - protein, 9 aa, Homo Sapiens
KPIYADGYG

SEQ ID NO: 185104 - protein, 9 aa, Homo Sapiens
HDQQRDPIK

SEQ ID NO: 185105 - protein, 9 aa, Homo Sapiens
IIKQAPGHR

SEQ ID NO: 185106 - protein, 9 aa, Homo Sapiens
FCLHQFPRS

SEQ ID NO: 185107 - protein, 9 aa, Homo Sapiens
NPLDHVLAK

SEQ ID NO: 185108 - protein, 9 aa, Homo Sapiens
SGPSTPTGM

SEQ ID NO: 185109 - protein, 9 aa, Homo Sapiens
AREAIAVVM

SEQ ID NO: 185110 - protein, 9 aa, Homo Sapiens
KKGRVMVKA

SEQ ID NO: 185111 - protein, 9 aa, Homo Sapiens
SYHPKRSER

SEQ ID NO: 185112 - protein, 9 aa, Homo Sapiens
KKRRRRRIP

SEQ ID NO: 185113 - protein, 9 aa, Homo Sapiens
AKHQELLGK

SEQ ID NO: 185114 - protein, 9 aa, Homo Sapiens
IQNPQAPEA

SEQ ID NO: 185115 - protein, 9 aa, Homo Sapiens
SQAFRGSLL

SEQ ID NO: 185116 - protein, 9 aa, Homo Sapiens
TSHSLRNLY

SEQ ID NO: 185117 - protein, 9 aa, Homo Sapiens
TILDKSSEM

SEQ ID NO: 185118 - protein, 9 aa, Homo Sapiens
GINHARALV

SEQ ID NO: 185119 - protein, 9 aa, Homo Sapiens
EAAVTAVLR

SEQ ID NO: 185120 - protein, 9 aa, Homo Sapiens
RAAGVRYPE

SEQ ID NO: 185121 - protein, 9 aa, Homo Sapiens
PTTGVRTRG

SEQ ID NO: 185122 - protein, 9 aa, Homo Sapiens
RHRVITILI

SEQ ID NO: 185123 - protein, 9 aa, Homo Sapiens
LHYLFHMRN

SEQ ID NO: 185124 - protein, 9 aa, Homo Sapiens
QVSPASPPT

SEQ ID NO: 185125 - protein, 9 aa, Homo Sapiens
HCFKAYHYL

SEQ ID NO: 185126 - protein, 9 aa, Homo Sapiens
ITEYMSKGS

SEQ ID NO: 185127 - protein, 9 aa, Homo Sapiens
GKSFSTCTD

SEQ ID NO: 185128 - protein, 9 aa, Homo Sapiens
GQCGEADRW

SEQ ID NO: 185129 - protein, 9 aa, Homo Sapiens
NAAKEHHCQ

SEQ ID NO: 185130 - protein, 9 aa, Homo Sapiens
SDEMQKFME

SEQ ID NO: 185131 - protein, 9 aa, Homo Sapiens
MDMKVSLKT

SEQ ID NO: 185132 - protein, 9 aa, Homo Sapiens
LTAEEKISL

SEQ ID NO: 185133 - protein, 9 aa, Homo Sapiens
FCRTKNDCD

SEQ ID NO: 185134 - protein, 9 aa, Homo Sapiens
QGLVPCVLF

SEQ ID NO: 185135 - protein, 9 aa, Homo Sapiens
GYWIAVGGK

SEQ ID NO: 185136 - protein, 9 aa, Homo Sapiens
TSYHPKRSE

SEQ ID NO: 185137 - protein, 9 aa, Homo Sapiens
APACTRWKQ

SEQ ID NO: 185138 - protein, 9 aa, Homo Sapiens
AIRKLTQAR

SEQ ID NO: 185139 - protein, 9 aa, Homo Sapiens
DALDVKKDK

SEQ ID NO: 185140 - protein, 9 aa, Homo Sapiens
ADVGFKFTF

SEQ ID NO: 185141 - protein, 9 aa, Homo Sapiens
GLGASSHTT

SEQ ID NO: 185142 - protein, 9 aa, Homo Sapiens
DMGGEPLLS

SEQ ID NO: 185143 - protein, 9 aa, Homo Sapiens
SYWRASVSV

SEQ ID NO: 185144 - protein, 9 aa, Homo Sapiens
GPSDSGKQF

SEQ ID NO: 185145 - protein, 9 aa, Homo Sapiens
LSRRRKNQK

SEQ ID NO: 185146 - protein, 9 aa, Homo Sapiens
ATVGMPLIY

SEQ ID NO: 185147 - protein, 9 aa, Homo Sapiens
QLEDWVLCL

SEQ ID NO: 185148 - protein, 9 aa, Homo Sapiens
RWLWAPASS

SEQ ID NO: 185149 - protein, 9 aa, Homo Sapiens
QLSSDLSKS

SEQ ID NO: 185150 - protein, 9 aa, Homo Sapiens
VAPTTSARM

SEQ ID NO: 185151 - protein, 9 aa, Homo Sapiens
IKHIRIGEA

SEQ ID NO: 185152 - protein, 9 aa, Homo Sapiens
PWTHLTHYG

SEQ ID NO: 185153 - protein, 9 aa, Homo Sapiens
QSHCTMRGA

SEQ ID NO: 185154 - protein, 9 aa, Homo Sapiens
LSTHSLEPP

SEQ ID NO: 185155 - protein, 9 aa, Homo Sapiens
KRRRRNLIL

SEQ ID NO: 185156 - protein, 9 aa, Homo Sapiens
CSFNSSLFR

SEQ ID NO: 185157 - protein, 9 aa, Homo Sapiens
GATTQTASR

SEQ ID NO: 185158 - protein, 9 aa, Homo Sapiens
TRNRLKIQY

SEQ ID NO: 185159 - protein, 9 aa, Homo Sapiens
RWKQRGRPG

SEQ ID NO: 185160 - protein, 9 aa, Homo Sapiens
CSSMLSLIP

SEQ ID NO: 185161 - protein, 9 aa, Homo Sapiens
SLYRKIIGY

SEQ ID NO: 185162 - protein, 9 aa, Homo Sapiens
PRSCKRVIL

SEQ ID NO: 185163 - protein, 9 aa, Homo Sapiens
TFSSIRCRL

SEQ ID NO: 185164 - protein, 9 aa, Homo Sapiens
ERAYGRLWR

SEQ ID NO: 185165 - protein, 9 aa, Homo Sapiens
NSMKHLFGI

SEQ ID NO: 185166 - protein, 9 aa, Homo Sapiens
TQKSKGLNQ

SEQ ID NO: 185167 - protein, 9 aa, Homo Sapiens
LHSWKKSVW

SEQ ID NO: 185168 - protein, 9 aa, Homo Sapiens
DVGFKFTFP

SEQ ID NO: 185169 - protein, 9 aa, Homo Sapiens
TIRVLGASH

SEQ ID NO: 185170 - protein, 9 aa, Homo Sapiens
LRRGLESRV

SEQ ID NO: 185171 - protein, 9 aa, Homo Sapiens
NIHMAKSYV

SEQ ID NO: 185172 - protein, 9 aa, Homo Sapiens
DLLNPRKLH

SEQ ID NO: 185173 - protein, 9 aa, Homo Sapiens
CVQASDVDS

SEQ ID NO: 185174 - protein, 9 aa, Homo Sapiens
NTHRYSSSQ

SEQ ID NO: 185175 - protein, 9 aa, Homo Sapiens
SGPPVPSKP

SEQ ID NO: 185176 - protein, 9 aa, Homo Sapiens
TSLSADIIQ

SEQ ID NO: 185177 - protein, 9 aa, Homo Sapiens
KQPLLLLQK

SEQ ID NO: 185178 - protein, 9 aa, Homo Sapiens
CHLNKMQNH

SEQ ID NO: 185179 - protein, 9 aa, Homo Sapiens
ADHTPHYSE

SEQ ID NO: 185180 - protein, 9 aa, Homo Sapiens
SRRLKRFRA

SEQ ID NO: 185181 - protein, 9 aa, Homo Sapiens
EKLVQEVEG

SEQ ID NO: 185182 - protein, 9 aa, Homo Sapiens
TQPGSSFTR

SEQ ID NO: 185183 - protein, 9 aa, Homo Sapiens
YDEKLVQEV

SEQ ID NO: 185184 - protein, 9 aa, Homo Sapiens
VQQDLQSSE

SEQ ID NO: 185185 - protein, 9 aa, Homo Sapiens
CLLNIGRQF

SEQ ID NO: 185186 - protein, 9 aa, Homo Sapiens
LAHHVIDGL

SEQ ID NO: 185187 - protein, 9 aa, Homo Sapiens
PNNHERYLE

SEQ ID NO: 185188 - protein, 9 aa, Homo Sapiens
LSSAWPWPK

SEQ ID NO: 185189 - protein, 9 aa, Homo Sapiens
TANRQCASL

SEQ ID NO: 185190 - protein, 9 aa, Homo Sapiens
GCVQVTFSP

SEQ ID NO: 185191 - protein, 9 aa, Homo Sapiens
FRDTFHLLL

SEQ ID NO: 185192 - protein, 9 aa, Homo Sapiens
DLMLFQRLQ

SEQ ID NO: 185193 - protein, 9 aa, Homo Sapiens
SIDFKIDSA

SEQ ID NO: 185194 - protein, 9 aa, Homo Sapiens
GTMDSSFPY

SEQ ID NO: 185195 - protein, 9 aa, Homo Sapiens
GPRLASLPT

SEQ ID NO: 185196 - protein, 9 aa, Homo Sapiens
RAAARWRRR

SEQ ID NO: 185197 - protein, 9 aa, Homo Sapiens
VKKRCSLME

SEQ ID NO: 185198 - protein, 9 aa, Homo Sapiens
CSSCHRPFH

SEQ ID NO: 185199 - protein, 9 aa, Homo Sapiens
NCEDAQAIQ

SEQ ID NO: 185200 - protein, 9 aa, Homo Sapiens
FSRNLSEPQ

SEQ ID NO: 185201 - protein, 9 aa, Homo Sapiens
STPRPTSPS

SEQ ID NO: 185202 - protein, 9 aa, Homo Sapiens
SARPEQVPR

SEQ ID NO: 185203 - protein, 9 aa, Homo Sapiens
WLWAPASSP

SEQ ID NO: 185204 - protein, 9 aa, Homo Sapiens
SLEHRMGGP

SEQ ID NO: 185205 - protein, 9 aa, Homo Sapiens
GITWFLALV

SEQ ID NO: 185206 - protein, 9 aa, Homo Sapiens
LFITEYIQE

SEQ ID NO: 185207 - protein, 9 aa, Homo Sapiens
PRCLLNIGR

SEQ ID NO: 185208 - protein, 9 aa, Homo Sapiens
GAGGMRMSS

SEQ ID NO: 185209 - protein, 9 aa, Homo Sapiens
LSGSWPPLL

SEQ ID NO: 185210 - protein, 9 aa, Homo Sapiens
GIRVIRTDT

SEQ ID NO: 185211 - protein, 9 aa, Homo Sapiens
TWQWKFWNC

SEQ ID NO: 185212 - protein, 9 aa, Homo Sapiens
KSPPPPLQT

SEQ ID NO: 185213 - protein, 9 aa, Homo Sapiens
ALIDQDAGR

SEQ ID NO: 185214 - protein, 9 aa, Homo Sapiens
NGSWAACVN

SEQ ID NO: 185215 - protein, 9 aa, Homo Sapiens
TRALARSHR

SEQ ID NO: 185216 - protein, 9 aa, Homo Sapiens
GPVHLLPSM

SEQ ID NO: 185217 - protein, 9 aa, Homo Sapiens
ISCPRPSAT

SEQ ID NO: 185218 - protein, 9 aa, Homo Sapiens
LRMPMHTII

SEQ ID NO: 185219 - protein, 9 aa, Homo Sapiens
KDTVAENNY

SEQ ID NO: 185220 - protein, 9 aa, Homo Sapiens
QMRAQRVHM

SEQ ID NO: 185221 - protein, 9 aa, Homo Sapiens
MLTPEECHL

SEQ ID NO: 185222 - protein, 9 aa, Homo Sapiens
SGRCVRRSR

SEQ ID NO: 185223 - protein, 9 aa, Homo Sapiens
QLQAWDSED

SEQ ID NO: 185224 - protein, 9 aa, Homo Sapiens
GASPGAWGG

SEQ ID NO: 185225 - protein, 9 aa, Homo Sapiens
EREVQIVGT

SEQ ID NO: 185226 - protein, 9 aa, Homo Sapiens
LEPLGPETA

SEQ ID NO: 185227 - protein, 9 aa, Homo Sapiens
LTMNDSKHK

SEQ ID NO: 185228 - protein, 9 aa, Homo Sapiens
VRATDRLMK

SEQ ID NO: 185229 - protein, 9 aa, Homo Sapiens
VKRLWKHQH

SEQ ID NO: 185230 - protein, 9 aa, Homo Sapiens
PPCLSPTIP

SEQ ID NO: 185231 - protein, 9 aa, Homo Sapiens
SCYTCDCDL

SEQ ID NO: 185232 - protein, 9 aa, Homo Sapiens
QRGGEIILC

SEQ ID NO: 185233 - protein, 9 aa, Homo Sapiens
HHTILVSVH

SEQ ID NO: 185234 - protein, 9 aa, Homo Sapiens
IIPSASEHM

SEQ ID NO: 185235 - protein, 9 aa, Homo Sapiens
RMNCKKLIQ

SEQ ID NO: 185236 - protein, 9 aa, Homo Sapiens
KIDRCILDR

SEQ ID NO: 185237 - protein, 9 aa, Homo Sapiens
HEDKERAWR

SEQ ID NO: 185238 - protein, 9 aa, Homo Sapiens
DRCILDRKK

SEQ ID NO: 185239 - protein, 9 aa, Homo Sapiens
VCSSTRGAC

SEQ ID NO: 185240 - protein, 9 aa, Homo Sapiens
VTYPKSLSQ

SEQ ID NO: 185241 - protein, 9 aa, Homo Sapiens
PASSLRSQH

SEQ ID NO: 185242 - protein, 9 aa, Homo Sapiens
CQKAMDERQ

SEQ ID NO: 185243 - protein, 9 aa, Homo Sapiens
LGPLGSRTL

SEQ ID NO: 185244 - protein, 9 aa, Homo Sapiens
QEVEERQRV

SEQ ID NO: 185245 - protein, 9 aa, Homo Sapiens
CQCDKKRGA

SEQ ID NO: 185246 - protein, 9 aa, Homo Sapiens
MILGNARHR

SEQ ID NO: 185247 - protein, 9 aa, Homo Sapiens
ENEEGPTTD

SEQ ID NO: 185248 - protein, 9 aa, Homo Sapiens
LSCRGASDS

SEQ ID NO: 185249 - protein, 9 aa, Homo Sapiens
MVGMLIDGL

SEQ ID NO: 185250 - protein, 9 aa, Homo Sapiens
PSQGAPQWP

SEQ ID NO: 185251 - protein, 9 aa, Homo Sapiens
VQEVEGLEA

SEQ ID NO: 185252 - protein, 9 aa, Homo Sapiens
EVLEEHPQS

SEQ ID NO: 185253 - protein, 9 aa, Homo Sapiens
NLSSLRPEN

SEQ ID NO: 185254 - protein, 9 aa, Homo Sapiens
AFVIQRLPL

SEQ ID NO: 185255 - protein, 9 aa, Homo Sapiens
DSSDMVPVA

SEQ ID NO: 185256 - protein, 9 aa, Homo Sapiens
KCSEDLKNA

SEQ ID NO: 185257 - protein, 9 aa, Homo Sapiens
RDYKRLWAG

SEQ ID NO: 185258 - protein, 9 aa, Homo Sapiens
VSVIPPTTL

SEQ ID NO: 185259 - protein, 9 aa, Homo Sapiens
GHLKPSGEQ

SEQ ID NO: 185260 - protein, 9 aa, Homo Sapiens
RPSATSQTP

SEQ ID NO: 185261 - protein, 9 aa, Homo Sapiens
KAAANFRRC

SEQ ID NO: 185262 - protein, 9 aa, Homo Sapiens
SGSGGRGHP

SEQ ID NO: 185263 - protein, 9 aa, Homo Sapiens
SPALKQVSP

SEQ ID NO: 185264 - protein, 9 aa, Homo Sapiens
CWWGRGCCL

SEQ ID NO: 185265 - protein, 9 aa, Homo Sapiens
PPRAEVSQR

SEQ ID NO: 185266 - protein, 9 aa, Homo Sapiens
ITFVLLMLK

SEQ ID NO: 185267 - protein, 9 aa, Homo Sapiens
LENTQHLLT

SEQ ID NO: 185268 - protein, 9 aa, Homo Sapiens
ETEKLQLTN

SEQ ID NO: 185269 - protein, 9 aa, Homo Sapiens
YGALTFPVP

SEQ ID NO: 185270 - protein, 9 aa, Homo Sapiens
GGNDDCRIH

SEQ ID NO: 185271 - protein, 9 aa, Homo Sapiens
FGFEDDPYG

SEQ ID NO: 185272 - protein, 9 aa, Homo Sapiens
HVNHGFVVE

SEQ ID NO: 185273 - protein, 9 aa, Homo Sapiens
KNMLKTPHV

SEQ ID NO: 185274 - protein, 9 aa, Homo Sapiens
LALCMQLSS

SEQ ID NO: 185275 - protein, 9 aa, Homo Sapiens
PPSMCVGSS

SEQ ID NO: 185276 - protein, 9 aa, Homo Sapiens
QRTLYRDAM

SEQ ID NO: 185277 - protein, 9 aa, Homo Sapiens
MSKISFFAM

SEQ ID NO: 185278 - protein, 9 aa, Homo Sapiens
NKEVNAMAV

SEQ ID NO: 185279 - protein, 9 aa, Homo Sapiens
LFMILYFFY

SEQ ID NO: 185280 - protein, 9 aa, Homo Sapiens
GISAQQNCV

SEQ ID NO: 185281 - protein, 9 aa, Homo Sapiens
VPRCSGRAP

SEQ ID NO: 185282 - protein, 9 aa, Homo Sapiens
NLIQNRSPT

SEQ ID NO: 185283 - protein, 9 aa, Homo Sapiens
WPPLLRPLS

SEQ ID NO: 185284 - protein, 9 aa, Homo Sapiens
HPSLDDIAH

SEQ ID NO: 185285 - protein, 9 aa, Homo Sapiens
WACTVSLST

SEQ ID NO: 185286 - protein, 9 aa, Homo Sapiens
MGVDRWNAL

SEQ ID NO: 185287 - protein, 9 aa, Homo Sapiens
TRATGWPWQ

SEQ ID NO: 185288 - protein, 9 aa, Homo Sapiens
IRTSLLVRR

SEQ ID NO: 185289 - protein, 9 aa, Homo Sapiens
TSKQMPPVM

SEQ ID NO: 185290 - protein, 9 aa, Homo Sapiens
TKFNVDEFE

SEQ ID NO: 185291 - protein, 9 aa, Homo Sapiens
QMHGELLEA

SEQ ID NO: 185292 - protein, 9 aa, Homo Sapiens
GDQPKAGPG

SEQ ID NO: 185293 - protein, 9 aa, Homo Sapiens
TSSQPWRSG

SEQ ID NO: 185294 - protein, 9 aa, Homo Sapiens
QGVWPCDIS

SEQ ID NO: 185295 - protein, 9 aa, Homo Sapiens
DPGPRKQDD

SEQ ID NO: 185296 - protein, 9 aa, Homo Sapiens
VTCSHFAQD

SEQ ID NO: 185297 - protein, 9 aa, Homo Sapiens
HQPSHHHPL

SEQ ID NO: 185298 - protein, 9 aa, Homo Sapiens
PPELQPQHE

SEQ ID NO: 185299 - protein, 9 aa, Homo Sapiens
RVAFKLCIN

SEQ ID NO: 185300 - protein, 9 aa, Homo Sapiens
SQWDLKYHF

SEQ ID NO: 185301 - protein, 9 aa, Homo Sapiens
DNPPLSRSQ

SEQ ID NO: 185302 - protein, 9 aa, Homo Sapiens
EPRFGSMVR

SEQ ID NO: 185303 - protein, 9 aa, Homo Sapiens
IRSYGEKFY

SEQ ID NO: 185304 - protein, 9 aa, Homo Sapiens
DRDVTSKSN

SEQ ID NO: 185305 - protein, 9 aa, Homo Sapiens
LQAQMDTSP

SEQ ID NO: 185306 - protein, 9 aa, Homo Sapiens
QGPGGPKGS

SEQ ID NO: 185307 - protein, 9 aa, Homo Sapiens
TSMPVRHMP

SEQ ID NO: 185308 - protein, 9 aa, Homo Sapiens
EQDDTTEQE

SEQ ID NO: 185309 - protein, 9 aa, Homo Sapiens
KLENHKDIA

SEQ ID NO: 185310 - protein, 9 aa, Homo Sapiens
SKNKEKLAD

SEQ ID NO: 185311 - protein, 9 aa, Homo Sapiens
IMGVEEDDD

SEQ ID NO: 185312 - protein, 9 aa, Homo Sapiens
SWKKTFTRT

SEQ ID NO: 185313 - protein, 9 aa, Homo Sapiens
EELLKKCSL

SEQ ID NO: 185314 - protein, 9 aa, Homo Sapiens
QRLFAQEKE

SEQ ID NO: 185315 - protein, 9 aa, Homo Sapiens
RTLIEALVA

SEQ ID NO: 185316 - protein, 9 aa, Homo Sapiens
TPELVLYTL

SEQ ID NO: 185317 - protein, 9 aa, Homo Sapiens
CDPPSSMGT

SEQ ID NO: 185318 - protein, 9 aa, Homo Sapiens
RGLPTNKID

SEQ ID NO: 185319 - protein, 9 aa, Homo Sapiens
MKSILRQEM

SEQ ID NO: 185320 - protein, 9 aa, Homo Sapiens
SRRWRSSKE

SEQ ID NO: 185321 - protein, 9 aa, Homo Sapiens
SSFIRFDVP

SEQ ID NO: 185322 - protein, 9 aa, Homo Sapiens
YPESHHDQQ

SEQ ID NO: 185323 - protein, 9 aa, Homo Sapiens
KGCAKEAAD

SEQ ID NO: 185324 - protein, 9 aa, Homo Sapiens
YRNCIYTYR

SEQ ID NO: 185325 - protein, 9 aa, Homo Sapiens
QFEERSAEE

SEQ ID NO: 185326 - protein, 9 aa, Homo Sapiens
ERVQEKDNG

SEQ ID NO: 185327 - protein, 9 aa, Homo Sapiens
HAGSSALGP

SEQ ID NO: 185328 - protein, 9 aa, Homo Sapiens
FSLLCPHSP

SEQ ID NO: 185329 - protein, 9 aa, Homo Sapiens
EPFLENAPF

SEQ ID NO: 185330 - protein, 9 aa, Homo Sapiens
MMFAGFLGC

SEQ ID NO: 185331 - protein, 9 aa, Homo Sapiens
RCARRGRRP

SEQ ID NO: 185332 - protein, 9 aa, Homo Sapiens
RGEFSGDDS

SEQ ID NO: 185333 - protein, 9 aa, Homo Sapiens
NSNDKEKII

SEQ ID NO: 185334 - protein, 9 aa, Homo Sapiens
EVWRGKWQG

SEQ ID NO: 185335 - protein, 9 aa, Homo Sapiens
RPEQVPRAR

SEQ ID NO: 185336 - protein, 9 aa, Homo Sapiens
FLQEVFQAE

SEQ ID NO: 185337 - protein, 9 aa, Homo Sapiens
PGAAVPAPR

SEQ ID NO: 185338 - protein, 9 aa, Homo Sapiens
GARAVAHLL

SEQ ID NO: 185339 - protein, 9 aa, Homo Sapiens
CSPQLGPRG

SEQ ID NO: 185340 - protein, 9 aa, Homo Sapiens
EVLFGPGRK

SEQ ID NO: 185341 - protein, 9 aa, Homo Sapiens
LVQLLARAL

SEQ ID NO: 185342 - protein, 9 aa, Homo Sapiens
RLHLLAVEL

SEQ ID NO: 185343 - protein, 9 aa, Homo Sapiens
VPPAVHITH

SEQ ID NO: 185344 - protein, 9 aa, Homo Sapiens
TVEEQLLCL

SEQ ID NO: 185345 - protein, 9 aa, Homo Sapiens
DSLMIIPWR

SEQ ID NO: 185346 - protein, 9 aa, Homo Sapiens
RRVDADMPP

SEQ ID NO: 185347 - protein, 9 aa, Homo Sapiens
LRVFDSGLM

SEQ ID NO: 185348 - protein, 9 aa, Homo Sapiens
TKQRHWDRI

SEQ ID NO: 185349 - protein, 9 aa, Homo Sapiens
DAAVLVKVI

SEQ ID NO: 185350 - protein, 9 aa, Homo Sapiens
VIQEDGMIM

SEQ ID NO: 185351 - protein, 9 aa, Homo Sapiens
RACRMNCKK

SEQ ID NO: 185352 - protein, 9 aa, Homo Sapiens
CEDGCAEGN

SEQ ID NO: 185353 - protein, 9 aa, Homo Sapiens
SVRPSDMTK

SEQ ID NO: 185354 - protein, 9 aa, Homo Sapiens
TQTASTPAS

SEQ ID NO: 185355 - protein, 9 aa, Homo Sapiens
GVKKIVPKK

SEQ ID NO: 185356 - protein, 9 aa, Homo Sapiens
GPRKQDDSG

SEQ ID NO: 185357 - protein, 9 aa, Homo Sapiens
TGEIELKNN

SEQ ID NO: 185358 - protein, 9 aa, Homo Sapiens
SLSYWRASV

SEQ ID NO: 185359 - protein, 9 aa, Homo Sapiens
RRKRLPSQN

SEQ ID NO: 185360 - protein, 9 aa, Homo Sapiens
IFTIDETTG

SEQ ID NO: 185361 - protein, 9 aa, Homo Sapiens
THCWACTVS

SEQ ID NO: 185362 - protein, 9 aa, Homo Sapiens
LGWWQSPLR

SEQ ID NO: 185363 - protein, 9 aa, Homo Sapiens
VLSVLGDQP

SEQ ID NO: 185364 - protein, 9 aa, Homo Sapiens
KATHKCILK

SEQ ID NO: 185365 - protein, 9 aa, Homo Sapiens
VPGGPSDSG

SEQ ID NO: 185366 - protein, 9 aa, Homo Sapiens
FYNTPCRAL

SEQ ID NO: 185367 - protein, 9 aa, Homo Sapiens
VVTAEMCCC

SEQ ID NO: 185368 - protein, 9 aa, Homo Sapiens
QGQQVHRLW

SEQ ID NO: 185369 - protein, 9 aa, Homo Sapiens
GTPIADVQA

SEQ ID NO: 185370 - protein, 9 aa, Homo Sapiens
SGSLPFLLS

SEQ ID NO: 185371 - protein, 9 aa, Homo Sapiens
AHRQKFLSR

SEQ ID NO: 185372 - protein, 9 aa, Homo Sapiens
KNGALFLLI

SEQ ID NO: 185373 - protein, 9 aa, Homo Sapiens
SEKKVTWMK

SEQ ID NO: 185374 - protein, 9 aa, Homo Sapiens
SLMEQIPHL

SEQ ID NO: 185375 - protein, 9 aa, Homo Sapiens
ASPGRRPLK

SEQ ID NO: 185376 - protein, 9 aa, Homo Sapiens
EASRLRRLN

SEQ ID NO: 185377 - protein, 9 aa, Homo Sapiens
LCTHHTNTL

SEQ ID NO: 185378 - protein, 9 aa, Homo Sapiens
SKVVGVKSE

SEQ ID NO: 185379 - protein, 9 aa, Homo Sapiens
NPPPPLTLG

SEQ ID NO: 185380 - protein, 9 aa, Homo Sapiens
LGGREKKKA

SEQ ID NO: 185381 - protein, 9 aa, Homo Sapiens
FCTRAVLAQ

SEQ ID NO: 185382 - protein, 9 aa, Homo Sapiens
DPEDEGKIT

SEQ ID NO: 185383 - protein, 9 aa, Homo Sapiens
PVVTGTSVT

SEQ ID NO: 185384 - protein, 9 aa, Homo Sapiens
TQPIYLAKP

SEQ ID NO: 185385 - protein, 9 aa, Homo Sapiens
ATIQILHWS

SEQ ID NO: 185386 - protein, 9 aa, Homo Sapiens
FHTFLLTKV

SEQ ID NO: 185387 - protein, 9 aa, Homo Sapiens
TMWDIQKDL

SEQ ID NO: 185388 - protein, 9 aa, Homo Sapiens
PEAAFQRML

SEQ ID NO: 185389 - protein, 9 aa, Homo Sapiens
WTTNLQDSL

SEQ ID NO: 185390 - protein, 9 aa, Homo Sapiens
QDAGREDGV

SEQ ID NO: 185391 - protein, 9 aa, Homo Sapiens
LRALKFREQ

SEQ ID NO: 185392 - protein, 9 aa, Homo Sapiens
CWSCLEQAK

SEQ ID NO: 185393 - protein, 9 aa, Homo Sapiens
GKYRQLSRL

SEQ ID NO: 185394 - protein, 9 aa, Homo Sapiens
FPVPSFLPP

SEQ ID NO: 185395 - protein, 9 aa, Homo Sapiens
NKIDAALFW

SEQ ID NO: 185396 - protein, 9 aa, Homo Sapiens
GHHELYFKN

SEQ ID NO: 185397 - protein, 9 aa, Homo Sapiens
VNRIKKPIY

SEQ ID NO: 185398 - protein, 9 aa, Homo Sapiens
GNVKQTDAW

SEQ ID NO: 185399 - protein, 9 aa, Homo Sapiens
CHAQLLVYE

SEQ ID NO: 185400 - protein, 9 aa, Homo Sapiens
DDLMLFQRL

SEQ ID NO: 185401 - protein, 9 aa, Homo Sapiens
GCWTVRGSC

SEQ ID NO: 185402 - protein, 9 aa, Homo Sapiens
GEHNTEVKE

SEQ ID NO: 185403 - protein, 9 aa, Homo Sapiens
FWNCLSGFR

SEQ ID NO: 185404 - protein, 9 aa, Homo Sapiens
FQALPREKS

SEQ ID NO: 185405 - protein, 9 aa, Homo Sapiens
DPTALLSSA

SEQ ID NO: 185406 - protein, 9 aa, Homo Sapiens
DQRLCKASD

SEQ ID NO: 185407 - protein, 9 aa, Homo Sapiens
RVKSASIIY

SEQ ID NO: 185408 - protein, 9 aa, Homo Sapiens
SLSIRKLTR

SEQ ID NO: 185409 - protein, 9 aa, Homo Sapiens
LRSCRTSSQ

SEQ ID NO: 185410 - protein, 9 aa, Homo Sapiens
CNLSSRDHK

SEQ ID NO: 185411 - protein, 9 aa, Homo Sapiens
KKVPPLLEG

SEQ ID NO: 185412 - protein, 9 aa, Homo Sapiens
KHVVTEYQE

SEQ ID NO: 185413 - protein, 9 aa, Homo Sapiens
FEEFQTTVA

SEQ ID NO: 185414 - protein, 9 aa, Homo Sapiens
YRKEGLSVN

SEQ ID NO: 185415 - protein, 9 aa, Homo Sapiens
RALLELCAQ

SEQ ID NO: 185416 - protein, 9 aa, Homo Sapiens
MVGVKGIEE

SEQ ID NO: 185417 - protein, 9 aa, Homo Sapiens
SLVLCATLI

SEQ ID NO: 185418 - protein, 9 aa, Homo Sapiens
TTSRRRPSS

SEQ ID NO: 185419 - protein, 9 aa, Homo Sapiens
DAQLEEKLM

SEQ ID NO: 185420 - protein, 9 aa, Homo Sapiens
LLLRSGFRQ

SEQ ID NO: 185421 - protein, 9 aa, Homo Sapiens
IDGKVTEKQ

SEQ ID NO: 185422 - protein, 9 aa, Homo Sapiens
RGKSQGGRI

SEQ ID NO: 185423 - protein, 9 aa, Homo Sapiens
QRLQAQMDT

SEQ ID NO: 185424 - protein, 9 aa, Homo Sapiens
RAVNQQPIP

SEQ ID NO: 185425 - protein, 9 aa, Homo Sapiens
GPCVTACPW

SEQ ID NO: 185426 - protein, 9 aa, Homo Sapiens
LLAVLDHPA

SEQ ID NO: 185427 - protein, 9 aa, Homo Sapiens
PVVLWIIFQ

SEQ ID NO: 185428 - protein, 9 aa, Homo Sapiens
QEFGPTSPS

SEQ ID NO: 185429 - protein, 9 aa, Homo Sapiens
ADIQGVSIQ

SEQ ID NO: 185430 - protein, 9 aa, Homo Sapiens
AAGRHRVIT

SEQ ID NO: 185431 - protein, 9 aa, Homo Sapiens
AQFGQELPM

SEQ ID NO: 185432 - protein, 9 aa, Homo Sapiens
LAALPQATE

SEQ ID NO: 185433 - protein, 9 aa, Homo Sapiens
DNSGGGKKP

SEQ ID NO: 185434 - protein, 9 aa, Homo Sapiens
MAVCLTLCL

SEQ ID NO: 185435 - protein, 9 aa, Homo Sapiens
LGEEHILVF

SEQ ID NO: 185436 - protein, 9 aa, Homo Sapiens
AGVRYPESH

SEQ ID NO: 185437 - protein, 9 aa, Homo Sapiens
LNVPQLTDP

SEQ ID NO: 185438 - protein, 9 aa, Homo Sapiens
DDHPSLDDI

SEQ ID NO: 185439 - protein, 9 aa, Homo Sapiens
DKGLKKMTL

SEQ ID NO: 185440 - protein, 9 aa, Homo Sapiens
PRLLWQTLT

SEQ ID NO: 185441 - protein, 9 aa, Homo Sapiens
IGAGVSLRK

SEQ ID NO: 185442 - protein, 9 aa, Homo Sapiens
PKEGADTVS

SEQ ID NO: 185443 - protein, 9 aa, Homo Sapiens
DVNKKRKTA

SEQ ID NO: 185444 - protein, 9 aa, Homo Sapiens
PPHCVPEGP

SEQ ID NO: 185445 - protein, 9 aa, Homo Sapiens
IQKFVLFDE

SEQ ID NO: 185446 - protein, 9 aa, Homo Sapiens
WKFWNCLSG

SEQ ID NO: 185447 - protein, 9 aa, Homo Sapiens
KAEHTNWLK

SEQ ID NO: 185448 - protein, 9 aa, Homo Sapiens
EGASPGAWG

SEQ ID NO: 185449 - protein, 9 aa, Homo Sapiens
WAQDEHPQE

SEQ ID NO: 185450 - protein, 9 aa, Homo Sapiens
IDAVDNKKT

SEQ ID NO: 185451 - protein, 9 aa, Homo Sapiens
RWRSSKERI

SEQ ID NO: 185452 - protein, 9 aa, Homo Sapiens
WTANRQCAS

SEQ ID NO: 185453 - protein, 9 aa, Homo Sapiens
QHRQGRGNL

SEQ ID NO: 185454 - protein, 9 aa, Homo Sapiens
RGLQHRQGR

SEQ ID NO: 185455 - protein, 9 aa, Homo Sapiens
RALHTQPCA

SEQ ID NO: 185456 - protein, 9 aa, Homo Sapiens
QLKTSLSAD

SEQ ID NO: 185457 - protein, 9 aa, Homo Sapiens
EEEHTPLDK

SEQ ID NO: 185458 - protein, 9 aa, Homo Sapiens
KITMKEGWH

SEQ ID NO: 185459 - protein, 9 aa, Homo Sapiens
SHFFQLKTS

SEQ ID NO: 185460 - protein, 9 aa, Homo Sapiens
MSLGALRTA

SEQ ID NO: 185461 - protein, 9 aa, Homo Sapiens
QPMEILTLT

SEQ ID NO: 185462 - protein, 9 aa, Homo Sapiens
WSTPAPQKI

SEQ ID NO: 185463 - protein, 9 aa, Homo Sapiens
SPSRRRTQT

SEQ ID NO: 185464 - protein, 9 aa, Homo Sapiens
NVPFFQSPG

SEQ ID NO: 185465 - protein, 9 aa, Homo Sapiens
KCEWINSHF

SEQ ID NO: 185466 - protein, 9 aa, Homo Sapiens
LTKVGAADA

SEQ ID NO: 185467 - protein, 9 aa, Homo Sapiens
LKKVVQKSH

SEQ ID NO: 185468 - protein, 9 aa, Homo Sapiens
LRPENQVLL

SEQ ID NO: 185469 - protein, 9 aa, Homo Sapiens
APPTATWAA

SEQ ID NO: 185470 - protein, 9 aa, Homo Sapiens
PHPWRSGDE

SEQ ID NO: 185471 - protein, 9 aa, Homo Sapiens
ARGNSSLVE

SEQ ID NO: 185472 - protein, 9 aa, Homo Sapiens
LATKDTRKS

SEQ ID NO: 185473 - protein, 9 aa, Homo Sapiens
PQPLLHNLA

SEQ ID NO: 185474 - protein, 9 aa, Homo Sapiens
MRQPNSTAA

SEQ ID NO: 185475 - protein, 9 aa, Homo Sapiens
DGLSTELLE

SEQ ID NO: 185476 - protein, 9 aa, Homo Sapiens
LATIQILHW

SEQ ID NO: 185477 - protein, 9 aa, Homo Sapiens
YRKIIGYVL

SEQ ID NO: 185478 - protein, 9 aa, Homo Sapiens
NSDYKRLVM

SEQ ID NO: 185479 - protein, 9 aa, Homo Sapiens
KESRSRRAP

SEQ ID NO: 185480 - protein, 9 aa, Homo Sapiens
PASLTGALL

SEQ ID NO: 185481 - protein, 9 aa, Homo Sapiens
SKNGALFLL

SEQ ID NO: 185482 - protein, 9 aa, Homo Sapiens
GPGASMTVT

SEQ ID NO: 185483 - protein, 9 aa, Homo Sapiens
LCVLYRNCI

SEQ ID NO: 185484 - protein, 9 aa, Homo Sapiens
VMVSVSQTS

SEQ ID NO: 185485 - protein, 9 aa, Homo Sapiens
LMFFGNQSI

SEQ ID NO: 185486 - protein, 9 aa, Homo Sapiens
VTSYHPKRS

SEQ ID NO: 185487 - protein, 9 aa, Homo Sapiens
RRIPRRPHR

SEQ ID NO: 185488 - protein, 9 aa, Homo Sapiens
QGQDSAIFN

SEQ ID NO: 185489 - protein, 9 aa, Homo Sapiens
MAEVVRWKL

SEQ ID NO: 185490 - protein, 9 aa, Homo Sapiens
IGPESPSIS

SEQ ID NO: 185491 - protein, 9 aa, Homo Sapiens
CSNKKNVAV

SEQ ID NO: 185492 - protein, 9 aa, Homo Sapiens
YADGYGTQR

SEQ ID NO: 185493 - protein, 9 aa, Homo Sapiens
KHHKHGKHS

SEQ ID NO: 185494 - protein, 9 aa, Homo Sapiens
TIFPNPEEP

SEQ ID NO: 185495 - protein, 9 aa, Homo Sapiens
EITKLESRL

SEQ ID NO: 185496 - protein, 9 aa, Homo Sapiens
CLHGNTAPS

SEQ ID NO: 185497 - protein, 9 aa, Homo Sapiens
KLLLPVAGD

SEQ ID NO: 185498 - protein, 9 aa, Homo Sapiens
IFLEGMDIC

SEQ ID NO: 185499 - protein, 9 aa, Homo Sapiens
LDHPAEVLE

SEQ ID NO: 185500 - protein, 9 aa, Homo Sapiens
RSRWQGPCR

SEQ ID NO: 185501 - protein, 9 aa, Homo Sapiens
HPLTVQSQA

SEQ ID NO: 185502 - protein, 9 aa, Homo Sapiens
PDLSPTLPQ

SEQ ID NO: 185503 - protein, 9 aa, Homo Sapiens
EFGKILGEG

SEQ ID NO: 185504 - protein, 9 aa, Homo Sapiens
GGQFKFIVH

SEQ ID NO: 185505 - protein, 9 aa, Homo Sapiens
AEQKTGTPI

SEQ ID NO: 185506 - protein, 9 aa, Homo Sapiens
PGSSPTMQH

SEQ ID NO: 185507 - protein, 9 aa, Homo Sapiens
VSETGKGLT

SEQ ID NO: 185508 - protein, 9 aa, Homo Sapiens
PTPEEHAHG

SEQ ID NO: 185509 - protein, 9 aa, Homo Sapiens
GRVAFKLCI

SEQ ID NO: 185510 - protein, 9 aa, Homo Sapiens
KFQEAAKCE

SEQ ID NO: 185511 - protein, 9 aa, Homo Sapiens
FVLSVLGDQ

SEQ ID NO: 185512 - protein, 9 aa, Homo Sapiens
MILYFFYYG

SEQ ID NO: 185513 - protein, 9 aa, Homo Sapiens
RKSKNNKSS

SEQ ID NO: 185514 - protein, 9 aa, Homo Sapiens
KCSCLAALD

SEQ ID NO: 185515 - protein, 9 aa, Homo Sapiens
ASAAAPAAT

SEQ ID NO: 185516 - protein, 9 aa, Homo Sapiens
VFQAERLLL

SEQ ID NO: 185517 - protein, 9 aa, Homo Sapiens
QEVTTRLLH

SEQ ID NO: 185518 - protein, 9 aa, Homo Sapiens
YTTAWSPGE

SEQ ID NO: 185519 - protein, 9 aa, Homo Sapiens
SSEDPVLMA

SEQ ID NO: 185520 - protein, 9 aa, Homo Sapiens
DFEFGKILG

SEQ ID NO: 185521 - protein, 9 aa, Homo Sapiens
LKIKTQKSK

SEQ ID NO: 185522 - protein, 9 aa, Homo Sapiens
ASAVEQMAE

SEQ ID NO: 185523 - protein, 9 aa, Homo Sapiens
SCGPSSSPT

SEQ ID NO: 185524 - protein, 9 aa, Homo Sapiens
FHIGNSGKE

SEQ ID NO: 185525 - protein, 9 aa, Homo Sapiens
SKRTFSSIR

SEQ ID NO: 185526 - protein, 9 aa, Homo Sapiens
HSSSSTSSL

SEQ ID NO: 185527 - protein, 9 aa, Homo Sapiens
ELFAQLAEG

SEQ ID NO: 185528 - protein, 9 aa, Homo Sapiens
VSECAVRTA

SEQ ID NO: 185529 - protein, 9 aa, Homo Sapiens
LPRHPTWRP

SEQ ID NO: 185530 - protein, 9 aa, Homo Sapiens
DHTTGGESC

SEQ ID NO: 185531 - protein, 9 aa, Homo Sapiens
ITLTRQRDG

SEQ ID NO: 185532 - protein, 9 aa, Homo Sapiens
PQRPPRSIL

SEQ ID NO: 185533 - protein, 9 aa, Homo Sapiens
NCSLDLDSI

SEQ ID NO: 185534 - protein, 9 aa, Homo Sapiens
KNEPQRPPR

SEQ ID NO: 185535 - protein, 9 aa, Homo Sapiens
LVFCSDKHF

SEQ ID NO: 185536 - protein, 9 aa, Homo Sapiens
DNKKTHPCT

SEQ ID NO: 185537 - protein, 9 aa, Homo Sapiens
SARSSVPWS

SEQ ID NO: 185538 - protein, 9 aa, Homo Sapiens
NLLLRSGFR

SEQ ID NO: 185539 - protein, 9 aa, Homo Sapiens
GYASHFIVI

SEQ ID NO: 185540 - protein, 9 aa, Homo Sapiens
CPLPLPRPP

SEQ ID NO: 185541 - protein, 9 aa, Homo Sapiens
PHGQKMTSS

SEQ ID NO: 185542 - protein, 9 aa, Homo Sapiens
KPSTFGSEV

SEQ ID NO: 185543 - protein, 9 aa, Homo Sapiens
TVRAEPLIQ

SEQ ID NO: 185544 - protein, 9 aa, Homo Sapiens
HPCTMLLPQ

SEQ ID NO: 185545 - protein, 9 aa, Homo Sapiens
TWFLALVFP

SEQ ID NO: 185546 - protein, 9 aa, Homo Sapiens
NDASPPSAC

SEQ ID NO: 185547 - protein, 9 aa, Homo Sapiens
PMDMKVSLK

SEQ ID NO: 185548 - protein, 9 aa, Homo Sapiens
ERGLFRGVE

SEQ ID NO: 185549 - protein, 9 aa, Homo Sapiens
PVLVECPSY

SEQ ID NO: 185550 - protein, 9 aa, Homo Sapiens
QSPWGEHSS

SEQ ID NO: 185551 - protein, 9 aa, Homo Sapiens
EGAKIQSGT

SEQ ID NO: 185552 - protein, 9 aa, Homo Sapiens
SGDGEEIAE

SEQ ID NO: 185553 - protein, 9 aa, Homo Sapiens
ESRALGPVS

SEQ ID NO: 185554 - protein, 9 aa, Homo Sapiens
DEEYGGFTE

SEQ ID NO: 185555 - protein, 9 aa, Homo Sapiens
VGMLIDGLK

SEQ ID NO: 185556 - protein, 9 aa, Homo Sapiens
LHGDSGISV

SEQ ID NO: 185557 - protein, 9 aa, Homo Sapiens
KTNTEPSTA

SEQ ID NO: 185558 - protein, 9 aa, Homo Sapiens
EGEGVSLGE

SEQ ID NO: 185559 - protein, 9 aa, Homo Sapiens
NLLEVLLID

SEQ ID NO: 185560 - protein, 9 aa, Homo Sapiens
LHDVKHFLL

SEQ ID NO: 185561 - protein, 9 aa, Homo Sapiens
PTTRSCGPS

SEQ ID NO: 185562 - protein, 9 aa, Homo Sapiens
DDKEGMISL

SEQ ID NO: 185563 - protein, 9 aa, Homo Sapiens
AARTRSTPP

SEQ ID NO: 185564 - protein, 9 aa, Homo Sapiens
EDMEGTEFE

SEQ ID NO: 185565 - protein, 9 aa, Homo Sapiens
GGGVGRRCL

SEQ ID NO: 185566 - protein, 9 aa, Homo Sapiens
MALELSNEL

SEQ ID NO: 185567 - protein, 9 aa, Homo Sapiens
SHQPDPDHP

SEQ ID NO: 185568 - protein, 9 aa, Homo Sapiens
DDVHRTWPF

SEQ ID NO: 185569 - protein, 9 aa, Homo Sapiens
LDATVGMPL

SEQ ID NO: 185570 - protein, 9 aa, Homo Sapiens
VVRIRAPIM

SEQ ID NO: 185571 - protein, 9 aa, Homo Sapiens
MPMHTIIPL

SEQ ID NO: 185572 - protein, 9 aa, Homo Sapiens
GRWWWSART

SEQ ID NO: 185573 - protein, 9 aa, Homo Sapiens
LLVSAQRLQ

SEQ ID NO: 185574 - protein, 9 aa, Homo Sapiens
RKRLCNLSS

SEQ ID NO: 185575 - protein, 9 aa, Homo Sapiens
HLGRRSMGK

SEQ ID NO: 185576 - protein, 9 aa, Homo Sapiens
TRGGTVKLA

SEQ ID NO: 185577 - protein, 9 aa, Homo Sapiens
EVEYDHHPR

SEQ ID NO: 185578 - protein, 9 aa, Homo Sapiens
SETDPCTGL

SEQ ID NO: 185579 - protein, 9 aa, Homo Sapiens
HLPEEGEGV

SEQ ID NO: 185580 - protein, 9 aa, Homo Sapiens
HLGQDHSDG

SEQ ID NO: 185581 - protein, 9 aa, Homo Sapiens
CQETAIRDE

SEQ ID NO: 185582 - protein, 9 aa, Homo Sapiens
YVVRWCYDK

SEQ ID NO: 185583 - protein, 9 aa, Homo Sapiens
PTTGLPATS

SEQ ID NO: 185584 - protein, 9 aa, Homo Sapiens
LSGFRQESQ

SEQ ID NO: 185585 - protein, 9 aa, Homo Sapiens
CRRLDSIIG

SEQ ID NO: 185586 - protein, 9 aa, Homo Sapiens
QQPIPLPSF

SEQ ID NO: 185587 - protein, 9 aa, Homo Sapiens
GVEMRAALQ

SEQ ID NO: 185588 - protein, 9 aa, Homo Sapiens
DSRSFFTSA

SEQ ID NO: 185589 - protein, 9 aa, Homo Sapiens
DQRHAGNKS

SEQ ID NO: 185590 - protein, 9 aa, Homo Sapiens
SGKLLLLHL

SEQ ID NO: 185591 - protein, 9 aa, Homo Sapiens
NSGGGKKPK

SEQ ID NO: 185592 - protein, 9 aa, Homo Sapiens
KVTWMKRRR

SEQ ID NO: 185593 - protein, 9 aa, Homo Sapiens
KVDSECQAC

SEQ ID NO: 185594 - protein, 9 aa, Homo Sapiens
STLARLERS

SEQ ID NO: 185595 - protein, 9 aa, Homo Sapiens
SLSDPGPRK

SEQ ID NO: 185596 - protein, 9 aa, Homo Sapiens
CIEIMGGAK

SEQ ID NO: 185597 - protein, 9 aa, Homo Sapiens
TFIGDHMKN

SEQ ID NO: 185598 - protein, 9 aa, Homo Sapiens
CSHCQNKGE

SEQ ID NO: 185599 - protein, 9 aa, Homo Sapiens
HLSKDLDCK

SEQ ID NO: 185600 - protein, 9 aa, Homo Sapiens
RRGFNWGLH

SEQ ID NO: 185601 - protein, 9 aa, Homo Sapiens
LRHCVVNGP

SEQ ID NO: 185602 - protein, 9 aa, Homo Sapiens
FLSPTLGLI

SEQ ID NO: 185603 - protein, 9 aa, Homo Sapiens
SLYGKKLVK

SEQ ID NO: 185604 - protein, 9 aa, Homo Sapiens
SKNFSPMKS

SEQ ID NO: 185605 - protein, 9 aa, Homo Sapiens
EGNGRPSCR

SEQ ID NO: 185606 - protein, 9 aa, Homo Sapiens
SPCPLPLQN

SEQ ID NO: 185607 - protein, 9 aa, Homo Sapiens
LGASHIHFS

SEQ ID NO: 185608 - protein, 9 aa, Homo Sapiens
LCWAAGSPC

SEQ ID NO: 185609 - protein, 9 aa, Homo Sapiens
ELKNNSISK

SEQ ID NO: 185610 - protein, 9 aa, Homo Sapiens
ALKEDLLYL

SEQ ID NO: 185611 - protein, 9 aa, Homo Sapiens
PASPPTQQP

SEQ ID NO: 185612 - protein, 9 aa, Homo Sapiens
FPKKNYKVS

SEQ ID NO: 185613 - protein, 9 aa, Homo Sapiens
HVVCPRPRS

SEQ ID NO: 185614 - protein, 9 aa, Homo Sapiens
RSPLLQGEL

SEQ ID NO: 185615 - protein, 9 aa, Homo Sapiens
SNVNRIKKP

SEQ ID NO: 185616 - protein, 9 aa, Homo Sapiens
ACPHQASPH

SEQ ID NO: 185617 - protein, 9 aa, Homo Sapiens
NSPNLLYSQ

SEQ ID NO: 185618 - protein, 9 aa, Homo Sapiens
GPQRGQYGP

SEQ ID NO: 185619 - protein, 9 aa, Homo Sapiens
VGAVMMFAG

SEQ ID NO: 185620 - protein, 9 aa, Homo Sapiens
GNSSLVEKK

SEQ ID NO: 185621 - protein, 9 aa, Homo Sapiens
RNHLNTHRY

SEQ ID NO: 185622 - protein, 9 aa, Homo Sapiens
FIPSQPPTL

SEQ ID NO: 185623 - protein, 9 aa, Homo Sapiens
EGVEMRAAL

SEQ ID NO: 185624 - protein, 9 aa, Homo Sapiens
GDDKEGMIS

SEQ ID NO: 185625 - protein, 9 aa, Homo Sapiens
FGIVQGSLQ

SEQ ID NO: 185626 - protein, 9 aa, Homo Sapiens
GVTTGTQSS

SEQ ID NO: 185627 - protein, 9 aa, Homo Sapiens
DFGDAGPRT

SEQ ID NO: 185628 - protein, 9 aa, Homo Sapiens
GDNVDVLPA

SEQ ID NO: 185629 - protein, 9 aa, Homo Sapiens
GAKIQSGTA

SEQ ID NO: 185630 - protein, 9 aa, Homo Sapiens
GPAHPTVPH

SEQ ID NO: 185631 - protein, 9 aa, Homo Sapiens
GEKQFHCPL

SEQ ID NO: 185632 - protein, 9 aa, Homo Sapiens
TWEPEENLR

SEQ ID NO: 185633 - protein, 9 aa, Homo Sapiens
QTSSSGLQG

SEQ ID NO: 185634 - protein, 9 aa, Homo Sapiens
TLLPTTGVR

SEQ ID NO: 185635 - protein, 9 aa, Homo Sapiens
EKKVPPLLE

SEQ ID NO: 185636 - protein, 9 aa, Homo Sapiens
TKMWHQSRL

SEQ ID NO: 185637 - protein, 9 aa, Homo Sapiens
KRGKSQGGR

SEQ ID NO: 185638 - protein, 9 aa, Homo Sapiens
EEFQTTVAK

SEQ ID NO: 185639 - protein, 9 aa, Homo Sapiens
TIFTIDETT

SEQ ID NO: 185640 - protein, 9 aa, Homo Sapiens
NTCNLRKNL

SEQ ID NO: 185641 - protein, 9 aa, Homo Sapiens
PEPSQPQCA

SEQ ID NO: 185642 - protein, 9 aa, Homo Sapiens
VDEDEPTVA

SEQ ID NO: 185643 - protein, 9 aa, Homo Sapiens
LQFLDCAHQ

SEQ ID NO: 185644 - protein, 9 aa, Homo Sapiens
QQCPFFYNR

SEQ ID NO: 185645 - protein, 9 aa, Homo Sapiens
SDSGKQFPN

SEQ ID NO: 185646 - protein, 9 aa, Homo Sapiens
WSWCGTSQT

SEQ ID NO: 185647 - protein, 9 aa, Homo Sapiens
KYRCYEVIM

SEQ ID NO: 185648 - protein, 9 aa, Homo Sapiens
PEECYPILD

SEQ ID NO: 185649 - protein, 9 aa, Homo Sapiens
CVAYDLVYY

SEQ ID NO: 185650 - protein, 9 aa, Homo Sapiens
QVSECAVRT

SEQ ID NO: 185651 - protein, 9 aa, Homo Sapiens
NDCDNLEQY

SEQ ID NO: 185652 - protein, 9 aa, Homo Sapiens
ASWLTRHRS

SEQ ID NO: 185653 - protein, 9 aa, Homo Sapiens
LQSSENPQG

SEQ ID NO: 185654 - protein, 9 aa, Homo Sapiens
RILARGGIN

SEQ ID NO: 185655 - protein, 9 aa, Homo Sapiens
SNKKNVAVM

SEQ ID NO: 185656 - protein, 9 aa, Homo Sapiens
AKMEPLNNM

SEQ ID NO: 185657 - protein, 9 aa, Homo Sapiens
SRSNGVTTG

SEQ ID NO: 185658 - protein, 9 aa, Homo Sapiens
KLKPENQVL

SEQ ID NO: 185659 - protein, 9 aa, Homo Sapiens
KALRDMPQM

SEQ ID NO: 185660 - protein, 9 aa, Homo Sapiens
EITLTRQRD

SEQ ID NO: 185661 - protein, 9 aa, Homo Sapiens
LEAVHADRM

SEQ ID NO: 185662 - protein, 9 aa, Homo Sapiens
KNLDAVETL

SEQ ID NO: 185663 - protein, 9 aa, Homo Sapiens
CFQGHHELY

SEQ ID NO: 185664 - protein, 9 aa, Homo Sapiens
SPGNIQPNS

SEQ ID NO: 185665 - protein, 9 aa, Homo Sapiens
KTPRSCKRV

SEQ ID NO: 185666 - protein, 9 aa, Homo Sapiens
ILSPSFPGN

SEQ ID NO: 185667 - protein, 9 aa, Homo Sapiens
WLFVSVPST

SEQ ID NO: 185668 - protein, 9 aa, Homo Sapiens
PLLSGARGR

SEQ ID NO: 185669 - protein, 9 aa, Homo Sapiens
VIQRLPLFY

SEQ ID NO: 185670 - protein, 9 aa, Homo Sapiens
AKCSCLAAL

SEQ ID NO: 185671 - protein, 9 aa, Homo Sapiens
MNMSKISFF

SEQ ID NO: 185672 - protein, 9 aa, Homo Sapiens
GNTHLKYVN

SEQ ID NO: 185673 - protein, 9 aa, Homo Sapiens
KTVKRLWKH

SEQ ID NO: 185674 - protein, 9 aa, Homo Sapiens
TESQIISEL

SEQ ID NO: 185675 - protein, 9 aa, Homo Sapiens
TNTMGGTRK

SEQ ID NO: 185676 - protein, 9 aa, Homo Sapiens
YEAFSDDPS

SEQ ID NO: 185677 - protein, 9 aa, Homo Sapiens
TTTKSMAAP

SEQ ID NO: 185678 - protein, 9 aa, Homo Sapiens
LRAKLLLPV

SEQ ID NO: 185679 - protein, 9 aa, Homo Sapiens
TEVKEQTLC

SEQ ID NO: 185680 - protein, 9 aa, Homo Sapiens
KKTKIQTSR

SEQ ID NO: 185681 - protein, 9 aa, Homo Sapiens
KTVRAEPLI

SEQ ID NO: 185682 - protein, 9 aa, Homo Sapiens
TALLSSAWP

SEQ ID NO: 185683 - protein, 9 aa, Homo Sapiens
ALVSGKPTE

SEQ ID NO: 185684 - protein, 9 aa, Homo Sapiens
EGVILSPSF

SEQ ID NO: 185685 - protein, 9 aa, Homo Sapiens
DLSPTLPQG

SEQ ID NO: 185686 - protein, 9 aa, Homo Sapiens
PLGPETALV

SEQ ID NO: 185687 - protein, 9 aa, Homo Sapiens
TSQTPGRGV

SEQ ID NO: 185688 - protein, 9 aa, Homo Sapiens
KLESPALKQ

SEQ ID NO: 185689 - protein, 9 aa, Homo Sapiens
VPWSAGCWT

SEQ ID NO: 185690 - protein, 9 aa, Homo Sapiens
FWDWKIQKT

SEQ ID NO: 185691 - protein, 9 aa, Homo Sapiens
WPLSTFSPA

SEQ ID NO: 185692 - protein, 9 aa, Homo Sapiens
PRLLAFPQP

SEQ ID NO: 185693 - protein, 9 aa, Homo Sapiens
VRWCYDKQV

SEQ ID NO: 185694 - protein, 9 aa, Homo Sapiens
TLYRDAMLE

SEQ ID NO: 185695 - protein, 9 aa, Homo Sapiens
SDFGLREIT

SEQ ID NO: 185696 - protein, 9 aa, Homo Sapiens
KQLWAHGIS

SEQ ID NO: 185697 - protein, 9 aa, Homo Sapiens
AHRCTHAGQ

SEQ ID NO: 185698 - protein, 9 aa, Homo Sapiens
KKRPEDFEF

SEQ ID NO: 185699 - protein, 9 aa, Homo Sapiens
GLSDEHISL

SEQ ID NO: 185700 - protein, 9 aa, Homo Sapiens
YGKHTPWED

SEQ ID NO: 185701 - protein, 9 aa, Homo Sapiens
LGSPLLSGA

SEQ ID NO: 185702 - protein, 9 aa, Homo Sapiens
TCSSCHRPF

SEQ ID NO: 185703 - protein, 9 aa, Homo Sapiens
VVGGVPEES

SEQ ID NO: 185704 - protein, 9 aa, Homo Sapiens
LARASPTFI

SEQ ID NO: 185705 - protein, 9 aa, Homo Sapiens
WKGWFGTRV

SEQ ID NO: 185706 - protein, 9 aa, Homo Sapiens
GVVHFGHRR

SEQ ID NO: 185707 - protein, 9 aa, Homo Sapiens
AEVLERGLG

SEQ ID NO: 185708 - protein, 9 aa, Homo Sapiens
TWLVCRAIF

SEQ ID NO: 185709 - protein, 9 aa, Homo Sapiens
RVTEMRRTP

SEQ ID NO: 185710 - protein, 9 aa, Homo Sapiens
SSPTWRVCI

SEQ ID NO: 185711 - protein, 9 aa, Homo Sapiens
VLLISGSLP

SEQ ID NO: 185712 - protein, 9 aa, Homo Sapiens
CYSYENNTP

SEQ ID NO: 185713 - protein, 9 aa, Homo Sapiens
HVVTEYQEN

SEQ ID NO: 185714 - protein, 9 aa, Homo Sapiens
ILSLENLPC

SEQ ID NO: 185715 - protein, 9 aa, Homo Sapiens
SDAGRKRGL

SEQ ID NO: 185716 - protein, 9 aa, Homo Sapiens
YETDHTTGG

SEQ ID NO: 185717 - protein, 9 aa, Homo Sapiens
LNPRKLHSD

SEQ ID NO: 185718 - protein, 9 aa, Homo Sapiens
SRVERTLTS

SEQ ID NO: 185719 - protein, 9 aa, Homo Sapiens
SAYYYPIYE

SEQ ID NO: 185720 - protein, 9 aa, Homo Sapiens
ETRRPYDSA

SEQ ID NO: 185721 - protein, 9 aa, Homo Sapiens
RTLKSARSS

SEQ ID NO: 185722 - protein, 9 aa, Homo Sapiens
SNTIFPNPE

SEQ ID NO: 185723 - protein, 9 aa, Homo Sapiens
WDCGICLVR

SEQ ID NO: 185724 - protein, 9 aa, Homo Sapiens
AAASPTTAA

SEQ ID NO: 185725 - protein, 9 aa, Homo Sapiens
TRWKQRGRP

SEQ ID NO: 185726 - protein, 9 aa, Homo Sapiens
RPEGGPARG

SEQ ID NO: 185727 - protein, 9 aa, Homo Sapiens
RSMAVCLTL

SEQ ID NO: 185728 - protein, 9 aa, Homo Sapiens
PMHTIIPLL

SEQ ID NO: 185729 - protein, 9 aa, Homo Sapiens
VMMFAGFLG

SEQ ID NO: 185730 - protein, 9 aa, Homo Sapiens
REVDPNGQL

SEQ ID NO: 185731 - protein, 9 aa, Homo Sapiens
LQHRQGRGN

SEQ ID NO: 185732 - protein, 9 aa, Homo Sapiens
RKQDDSGQD

SEQ ID NO: 185733 - protein, 9 aa, Homo Sapiens
VSLKGIPMK

SEQ ID NO: 185734 - protein, 9 aa, Homo Sapiens
NGRPSCRIT

SEQ ID NO: 185735 - protein, 9 aa, Homo Sapiens
KKVTWMKRR

SEQ ID NO: 185736 - protein, 9 aa, Homo Sapiens
LEAFVFPMD

SEQ ID NO: 185737 - protein, 9 aa, Homo Sapiens
VRYPESHHD

SEQ ID NO: 185738 - protein, 9 aa, Homo Sapiens
YLHSCDPPS

SEQ ID NO: 185739 - protein, 9 aa, Homo Sapiens
NKLENHKDI

SEQ ID NO: 185740 - protein, 9 aa, Homo Sapiens
HIMKYKKSV

SEQ ID NO: 185741 - protein, 9 aa, Homo Sapiens
QYQRALDML

SEQ ID NO: 185742 - protein, 9 aa, Homo Sapiens
RGSCGWWAP

SEQ ID NO: 185743 - protein, 9 aa, Homo Sapiens
VAPRAKSIR

SEQ ID NO: 185744 - protein, 9 aa, Homo Sapiens
RRPIRQNPG

SEQ ID NO: 185745 - protein, 9 aa, Homo Sapiens
ESLYRKIIG

SEQ ID NO: 185746 - protein, 9 aa, Homo Sapiens
YQHLSNPLE

SEQ ID NO: 185747 - protein, 9 aa, Homo Sapiens
SPPKQPQIS

SEQ ID NO: 185748 - protein, 9 aa, Homo Sapiens
YPGQRYYGR

SEQ ID NO: 185749 - protein, 9 aa, Homo Sapiens
RVRRPSTDP

SEQ ID NO: 185750 - protein, 9 aa, Homo Sapiens
VHMGARAVA

SEQ ID NO: 185751 - protein, 9 aa, Homo Sapiens
IGEKTEIQL

SEQ ID NO: 185752 - protein, 9 aa, Homo Sapiens
TMARQLSRM

SEQ ID NO: 185753 - protein, 9 aa, Homo Sapiens
EGWHKFIQL

SEQ ID NO: 185754 - protein, 9 aa, Homo Sapiens
VKTVYFHTR

SEQ ID NO: 185755 - protein, 9 aa, Homo Sapiens
DLQEAKYEA

SEQ ID NO: 185756 - protein, 9 aa, Homo Sapiens
LVREVDPNG

SEQ ID NO: 185757 - protein, 9 aa, Homo Sapiens
GRPGRPRWR

SEQ ID NO: 185758 - protein, 9 aa, Homo Sapiens
ALKTILDKS

SEQ ID NO: 185759 - protein, 9 aa, Homo Sapiens
FKNMLKTPH

SEQ ID NO: 185760 - protein, 9 aa, Homo Sapiens
IIAHVPVGH

SEQ ID NO: 185761 - protein, 9 aa, Homo Sapiens
ARRCDQKLQ

SEQ ID NO: 185762 - protein, 9 aa, Homo Sapiens
VPFSSKSAE

SEQ ID NO: 185763 - protein, 9 aa, Homo Sapiens
LEEANILFD

SEQ ID NO: 185764 - protein, 9 aa, Homo Sapiens
RRLHQAAFQ

SEQ ID NO: 185765 - protein, 9 aa, Homo Sapiens
RHMRGNQLW

SEQ ID NO: 185766 - protein, 9 aa, Homo Sapiens
TLAPVLICR

SEQ ID NO: 185767 - protein, 9 aa, Homo Sapiens
ICAHPLGNL

SEQ ID NO: 185768 - protein, 9 aa, Homo Sapiens
MLKKYYHHR

SEQ ID NO: 185769 - protein, 9 aa, Homo Sapiens
TVRLLHFFS

SEQ ID NO: 185770 - protein, 9 aa, Homo Sapiens
VKFWNSNDK

SEQ ID NO: 185771 - protein, 9 aa, Homo Sapiens
SPKLHCHEI

SEQ ID NO: 185772 - protein, 9 aa, Homo Sapiens
AEMCCCCFD

SEQ ID NO: 185773 - protein, 9 aa, Homo Sapiens
PVYEINEKI

SEQ ID NO: 185774 - protein, 9 aa, Homo Sapiens
WPRASACVP

SEQ ID NO: 185775 - protein, 9 aa, Homo Sapiens
PAIMTVGFC

SEQ ID NO: 185776 - protein, 9 aa, Homo Sapiens
AQQEFAGGV

SEQ ID NO: 185777 - protein, 9 aa, Homo Sapiens
AQLHFAAES

SEQ ID NO: 185778 - protein, 9 aa, Homo Sapiens
MDTLKTKGR

SEQ ID NO: 185779 - protein, 9 aa, Homo Sapiens
VCQRGGEII

SEQ ID NO: 185780 - protein, 9 aa, Homo Sapiens
AQLLLQLVQ

SEQ ID NO: 185781 - protein, 9 aa, Homo Sapiens
LRKPEWIFK

SEQ ID NO: 185782 - protein, 9 aa, Homo Sapiens
RAVILLLLC

SEQ ID NO: 185783 - protein, 9 aa, Homo Sapiens
RNHMNVNSV

SEQ ID NO: 185784 - protein, 9 aa, Homo Sapiens
LGEQGPLEA

SEQ ID NO: 185785 - protein, 9 aa, Homo Sapiens
DEEVDPDEV

SEQ ID NO: 185786 - protein, 9 aa, Homo Sapiens
EEKWRRGDP

SEQ ID NO: 185787 - protein, 9 aa, Homo Sapiens
LVSEWKEPR

SEQ ID NO: 185788 - protein, 9 aa, Homo Sapiens
TLGSSPSTP

SEQ ID NO: 185789 - protein, 9 aa, Homo Sapiens
GAGGGSHLY

SEQ ID NO: 185790 - protein, 9 aa, Homo Sapiens
LPCAQPTVS

SEQ ID NO: 185791 - protein, 9 aa, Homo Sapiens
EFAGGVFSN

SEQ ID NO: 185792 - protein, 9 aa, Homo Sapiens
GLAPPHCVP

SEQ ID NO: 185793 - protein, 9 aa, Homo Sapiens
IPRRPHRHC

SEQ ID NO: 185794 - protein, 9 aa, Homo Sapiens
ENSSRSMVA

SEQ ID NO: 185795 - protein, 9 aa, Homo Sapiens
ETGVADHGG

SEQ ID NO: 185796 - protein, 9 aa, Homo Sapiens
RHPSLIQNE

SEQ ID NO: 185797 - protein, 9 aa, Homo Sapiens
RWGRQCDAH

SEQ ID NO: 185798 - protein, 9 aa, Homo Sapiens
WRGKWQGEE

SEQ ID NO: 185799 - protein, 9 aa, Homo Sapiens
VGFLILEEG

SEQ ID NO: 185800 - protein, 9 aa, Homo Sapiens
KENGVKKIV

SEQ ID NO: 185801 - protein, 9 aa, Homo Sapiens
TRAGPRDTA

SEQ ID NO: 185802 - protein, 9 aa, Homo Sapiens
GVKKAAEYL

SEQ ID NO: 185803 - protein, 9 aa, Homo Sapiens
GTLCSETDP

SEQ ID NO: 185804 - protein, 9 aa, Homo Sapiens
MGVLSVGKP

SEQ ID NO: 185805 - protein, 9 aa, Homo Sapiens
AASAYPVLQ

SEQ ID NO: 185806 - protein, 9 aa, Homo Sapiens
GNILQIQGV

SEQ ID NO: 185807 - protein, 9 aa, Homo Sapiens
EQVITSFRI

SEQ ID NO: 185808 - protein, 9 aa, Homo Sapiens
HVPWRTPRF

SEQ ID NO: 185809 - protein, 9 aa, Homo Sapiens
EPPCASLCA

SEQ ID NO: 185810 - protein, 9 aa, Homo Sapiens
GFPGYTGPK

SEQ ID NO: 185811 - protein, 9 aa, Homo Sapiens
GGRILLQRN

SEQ ID NO: 185812 - protein, 9 aa, Homo Sapiens
GGLSASLCR

SEQ ID NO: 185813 - protein, 9 aa, Homo Sapiens
VLLAIRLLT

SEQ ID NO: 185814 - protein, 9 aa, Homo Sapiens
GTFRCYSYE

SEQ ID NO: 185815 - protein, 9 aa, Homo Sapiens
TEPVAGSPF

SEQ ID NO: 185816 - protein, 9 aa, Homo Sapiens
VLLLRVVRI

SEQ ID NO: 185817 - protein, 9 aa, Homo Sapiens
QAGSVGAEG

SEQ ID NO: 185818 - protein, 9 aa, Homo Sapiens
RGDVLEVPW

SEQ ID NO: 185819 - protein, 9 aa, Homo Sapiens
SQDFGDAGP

SEQ ID NO: 185820 - protein, 9 aa, Homo Sapiens
DAHHRRQLR

SEQ ID NO: 185821 - protein, 9 aa, Homo Sapiens
AIQKQLATI

SEQ ID NO: 185822 - protein, 9 aa, Homo Sapiens
IPWREHKHR

SEQ ID NO: 185823 - protein, 9 aa, Homo Sapiens
ILFDGVSRT

SEQ ID NO: 185824 - protein, 9 aa, Homo Sapiens
LQIQGVTTE

SEQ ID NO: 185825 - protein, 9 aa, Homo Sapiens
EPVPGQKGE

SEQ ID NO: 185826 - protein, 9 aa, Homo Sapiens
QTLLLWRWA

SEQ ID NO: 185827 - protein, 9 aa, Homo Sapiens
SFGTGTHAK

SEQ ID NO: 185828 - protein, 9 aa, Homo Sapiens
LEKKPNIDG

SEQ ID NO: 185829 - protein, 9 aa, Homo Sapiens
LSPPEAAFQ

SEQ ID NO: 185830 - protein, 9 aa, Homo Sapiens
CGFCLHQFP

SEQ ID NO: 185831 - protein, 9 aa, Homo Sapiens
DSFSVLNIH

SEQ ID NO: 185832 - protein, 9 aa, Homo Sapiens
WPQMTCRPN

SEQ ID NO: 185833 - protein, 9 aa, Homo Sapiens
CPFPFSLRG

SEQ ID NO: 185834 - protein, 9 aa, Homo Sapiens
AICHHRGIR

SEQ ID NO: 185835 - protein, 9 aa, Homo Sapiens
GHTCMPENQ

SEQ ID NO: 185836 - protein, 9 aa, Homo Sapiens
DCGICLVRN

SEQ ID NO: 185837 - protein, 9 aa, Homo Sapiens
LAALDMTGK

SEQ ID NO: 185838 - protein, 9 aa, Homo Sapiens
STNQCFRNI

SEQ ID NO: 185839 - protein, 9 aa, Homo Sapiens
QEEPRTVQG

SEQ ID NO: 185840 - protein, 9 aa, Homo Sapiens
VSPRGLQHR

SEQ ID NO: 185841 - protein, 9 aa, Homo Sapiens
RQGRGNLGW

SEQ ID NO: 185842 - protein, 9 aa, Homo Sapiens
ITDQQLIEK

SEQ ID NO: 185843 - protein, 9 aa, Homo Sapiens
TALVSMSPR

SEQ ID NO: 185844 - protein, 9 aa, Homo Sapiens
AFETDSDLL

SEQ ID NO: 185845 - protein, 9 aa, Homo Sapiens
AQRKLHESQ

SEQ ID NO: 185846 - protein, 9 aa, Homo Sapiens
AGDLTSLGL

SEQ ID NO: 185847 - protein, 9 aa, Homo Sapiens
MKRRRRNLI

SEQ ID NO: 185848 - protein, 9 aa, Homo Sapiens
SPCSRRWRS

SEQ ID NO: 185849 - protein, 9 aa, Homo Sapiens
DGSFSARYG

SEQ ID NO: 185850 - protein, 9 aa, Homo Sapiens
TCYSTQVSH

SEQ ID NO: 185851 - protein, 9 aa, Homo Sapiens
VELSPENTE

SEQ ID NO: 185852 - protein, 9 aa, Homo Sapiens
FAAICFRNA

SEQ ID NO: 185853 - protein, 9 aa, Homo Sapiens
LLSRKQRRP

SEQ ID NO: 185854 - protein, 9 aa, Homo Sapiens
WNTFNSIWD

SEQ ID NO: 185855 - protein, 9 aa, Homo Sapiens
FGPTSPSSA

SEQ ID NO: 185856 - protein, 9 aa, Homo Sapiens
VYVMPTVAM

SEQ ID NO: 185857 - protein, 9 aa, Homo Sapiens
LLQQLWRGG

SEQ ID NO: 185858 - protein, 9 aa, Homo Sapiens
AWPWPKIPL

SEQ ID NO: 185859 - protein, 9 aa, Homo Sapiens
KSSVCSAPS

SEQ ID NO: 185860 - protein, 9 aa, Homo Sapiens
VEDNPMVVP

SEQ ID NO: 185861 - protein, 9 aa, Homo Sapiens
RVNTAWKTK

SEQ ID NO: 185862 - protein, 9 aa, Homo Sapiens
SPGLELVFA

SEQ ID NO: 185863 - protein, 9 aa, Homo Sapiens
NVLPDIFTE

SEQ ID NO: 185864 - protein, 9 aa, Homo Sapiens
YLPPTARAR

SEQ ID NO: 185865 - protein, 9 aa, Homo Sapiens
TYAFVIQRL

SEQ ID NO: 185866 - protein, 9 aa, Homo Sapiens
ARALQQEFA

SEQ ID NO: 185867 - protein, 9 aa, Homo Sapiens
PKLQNASQD

SEQ ID NO: 185868 - protein, 9 aa, Homo Sapiens
EYVVRWCYD

SEQ ID NO: 185869 - protein, 9 aa, Homo Sapiens
VRVRMCNHP

SEQ ID NO: 185870 - protein, 9 aa, Homo Sapiens
QAEQAEAEQ

SEQ ID NO: 185871 - protein, 9 aa, Homo Sapiens
STPPTTGLP

SEQ ID NO: 185872 - protein, 9 aa, Homo Sapiens
NHGKKPFSQ

SEQ ID NO: 185873 - protein, 9 aa, Homo Sapiens
EARKRLEEK

SEQ ID NO: 185874 - protein, 9 aa, Homo Sapiens
SMVRRAANV

SEQ ID NO: 185875 - protein, 9 aa, Homo Sapiens
RVVALVDID

SEQ ID NO: 185876 - protein, 9 aa, Homo Sapiens
MCCNKSGFA

SEQ ID NO: 185877 - protein, 9 aa, Homo Sapiens
MGKFRGGVN

SEQ ID NO: 185878 - protein, 9 aa, Homo Sapiens
TDSDLLAGW

SEQ ID NO: 185879 - protein, 9 aa, Homo Sapiens
SLFSLSILS

SEQ ID NO: 185880 - protein, 9 aa, Homo Sapiens
LKEDLLYLR

SEQ ID NO: 185881 - protein, 9 aa, Homo Sapiens
STPASTNRA

SEQ ID NO: 185882 - protein, 9 aa, Homo Sapiens
TASRGSSSS

SEQ ID NO: 185883 - protein, 9 aa, Homo Sapiens
PQCLQSFAN

SEQ ID NO: 185884 - protein, 9 aa, Homo Sapiens
VFCSDKHFY

SEQ ID NO: 185885 - protein, 9 aa, Homo Sapiens
ANNLAAAVS

SEQ ID NO: 185886 - protein, 9 aa, Homo Sapiens
GWLERAYGR

SEQ ID NO: 185887 - protein, 9 aa, Homo Sapiens
KYYHHRNIA

SEQ ID NO: 185888 - protein, 9 aa, Homo Sapiens
VSAEDLAGQ

SEQ ID NO: 185889 - protein, 9 aa, Homo Sapiens
SPGSPCSRR

SEQ ID NO: 185890 - protein, 9 aa, Homo Sapiens
EMSTPFTCI

SEQ ID NO: 185891 - protein, 9 aa, Homo Sapiens
MALCNLDHL

SEQ ID NO: 185892 - protein, 9 aa, Homo Sapiens
WESRNKFSN

SEQ ID NO: 185893 - protein, 9 aa, Homo Sapiens
QCTFFFLHK

SEQ ID NO: 185894 - protein, 9 aa, Homo Sapiens
DATTRPSDF

SEQ ID NO: 185895 - protein, 9 aa, Homo Sapiens
RGNSSLVEK

SEQ ID NO: 185896 - protein, 9 aa, Homo Sapiens
FLPPGAPSI

SEQ ID NO: 185897 - protein, 9 aa, Homo Sapiens
LLNIGRQFP

SEQ ID NO: 185898 - protein, 9 aa, Homo Sapiens
DSSSFIRFD

SEQ ID NO: 185899 - protein, 9 aa, Homo Sapiens
TSFAIRKLT

SEQ ID NO: 185900 - protein, 9 aa, Homo Sapiens
RMSSGRWWW

SEQ ID NO: 185901 - protein, 9 aa, Homo Sapiens
PSPLPDDSK

SEQ ID NO: 185902 - protein, 9 aa, Homo Sapiens
DHPGLHRLE

SEQ ID NO: 185903 - protein, 9 aa, Homo Sapiens
NQVLLGHLS

SEQ ID NO: 185904 - protein, 9 aa, Homo Sapiens
VEQLQLEDW

SEQ ID NO: 185905 - protein, 9 aa, Homo Sapiens
LTHLKKYRC

SEQ ID NO: 185906 - protein, 9 aa, Homo Sapiens
HPSLIQNEC

SEQ ID NO: 185907 - protein, 9 aa, Homo Sapiens
GNLGWWQSP

SEQ ID NO: 185908 - protein, 9 aa, Homo Sapiens
SLSILSLEN

SEQ ID NO: 185909 - protein, 9 aa, Homo Sapiens
RRGDPGPPF

SEQ ID NO: 185910 - protein, 9 aa, Homo Sapiens
WKIQKTPWF

SEQ ID NO: 185911 - protein, 9 aa, Homo Sapiens
QDLQLLARE

SEQ ID NO: 185912 - protein, 9 aa, Homo Sapiens
CYERNDSKL

SEQ ID NO: 185913 - protein, 9 aa, Homo Sapiens
FTTGAARWG

SEQ ID NO: 185914 - protein, 9 aa, Homo Sapiens
CTRPQSTCA

SEQ ID NO: 185915 - protein, 9 aa, Homo Sapiens
EDGLSTELL

SEQ ID NO: 185916 - protein, 9 aa, Homo Sapiens
RPCWEATHN

SEQ ID NO: 185917 - protein, 9 aa, Homo Sapiens
YIQEKNPMG

SEQ ID NO: 185918 - protein, 9 aa, Homo Sapiens
VLQCELSKV

SEQ ID NO: 185919 - protein, 9 aa, Homo Sapiens
EVLLLRVVR

SEQ ID NO: 185920 - protein, 9 aa, Homo Sapiens
LVKATGRSM

SEQ ID NO: 185921 - protein, 9 aa, Homo Sapiens
RCVERYSCY

SEQ ID NO: 185922 - protein, 9 aa, Homo Sapiens
DRISSVKFN

SEQ ID NO: 185923 - protein, 9 aa, Homo Sapiens
DDTTEQEQP

SEQ ID NO: 185924 - protein, 9 aa, Homo Sapiens
QMISILARL

SEQ ID NO: 185925 - protein, 9 aa, Homo Sapiens
TNHFWPQMT

SEQ ID NO: 185926 - protein, 9 aa, Homo Sapiens
RVPKRRMVY

SEQ ID NO: 185927 - protein, 9 aa, Homo Sapiens
HGVSLQQWH

SEQ ID NO: 185928 - protein, 9 aa, Homo Sapiens
MMGHRSDYS

SEQ ID NO: 185929 - protein, 9 aa, Homo Sapiens
GKTNTEPST

SEQ ID NO: 185930 - protein, 9 aa, Homo Sapiens
DFGLCVAYD

SEQ ID NO: 185931 - protein, 9 aa, Homo Sapiens
IAHVPVGHL

SEQ ID NO: 185932 - protein, 9 aa, Homo Sapiens
PGTPPPLIL

SEQ ID NO: 185933 - protein, 9 aa, Homo Sapiens
DGMVGMLID

SEQ ID NO: 185934 - protein, 9 aa, Homo Sapiens
TAAFMEVWV

SEQ ID NO: 185935 - protein, 9 aa, Homo Sapiens
RLLAFPQPL

SEQ ID NO: 185936 - protein, 9 aa, Homo Sapiens
GHRAELFAQ

SEQ ID NO: 185937 - protein, 9 aa, Homo Sapiens
YYFARCQGF

SEQ ID NO: 185938 - protein, 9 aa, Homo Sapiens
QIQGVTTER

SEQ ID NO: 185939 - protein, 9 aa, Homo Sapiens
EYIQEKNPM

SEQ ID NO: 185940 - protein, 9 aa, Homo Sapiens
HLLSHGSLA

SEQ ID NO: 185941 - protein, 9 aa, Homo Sapiens
HKDIAQDMV

SEQ ID NO: 185942 - protein, 9 aa, Homo Sapiens
NHVSHYKCP

SEQ ID NO: 185943 - protein, 9 aa, Homo Sapiens
RKTKCRPTT

SEQ ID NO: 185944 - protein, 9 aa, Homo Sapiens
MGVEEDDDD

SEQ ID NO: 185945 - protein, 9 aa, Homo Sapiens
HFFSGFSFF

SEQ ID NO: 185946 - protein, 9 aa, Homo Sapiens
NWPPMDDVH

SEQ ID NO: 185947 - protein, 9 aa, Homo Sapiens
RMMSLGALR

SEQ ID NO: 185948 - protein, 9 aa, Homo Sapiens
PSNWIQKTA

SEQ ID NO: 185949 - protein, 9 aa, Homo Sapiens
GATYTPRHP

SEQ ID NO: 185950 - protein, 9 aa, Homo Sapiens
PHYSEQETE

SEQ ID NO: 185951 - protein, 9 aa, Homo Sapiens
RATTHNAYD

SEQ ID NO: 185952 - protein, 9 aa, Homo Sapiens
RPEDSGRRV

SEQ ID NO: 185953 - protein, 9 aa, Homo Sapiens
TVEAANYQD

SEQ ID NO: 185954 - protein, 9 aa, Homo Sapiens
RGTFRCYSY

SEQ ID NO: 185955 - protein, 9 aa, Homo Sapiens
APSIQQPIP

SEQ ID NO: 185956 - protein, 9 aa, Homo Sapiens
SHLYYSFKN

SEQ ID NO: 185957 - protein, 9 aa, Homo Sapiens
FSIRRWSTI

SEQ ID NO: 185958 - protein, 9 aa, Homo Sapiens
LHFAAESII

SEQ ID NO: 185959 - protein, 9 aa, Homo Sapiens
NILFDGVSR

SEQ ID NO: 185960 - protein, 9 aa, Homo Sapiens
LCRKDLEIV

SEQ ID NO: 185961 - protein, 9 aa, Homo Sapiens
TCYSSDEAA

SEQ ID NO: 185962 - protein, 9 aa, Homo Sapiens
PSPPSPTDH

SEQ ID NO: 185963 - protein, 9 aa, Homo Sapiens
QFGKSATRT

SEQ ID NO: 185964 - protein, 9 aa, Homo Sapiens
CLAAARQLQ

SEQ ID NO: 185965 - protein, 9 aa, Homo Sapiens
EERSAEERH

SEQ ID NO: 185966 - protein, 9 aa, Homo Sapiens
GFRQESQTR

SEQ ID NO: 185967 - protein, 9 aa, Homo Sapiens
CHLIEQSSN

SEQ ID NO: 185968 - protein, 9 aa, Homo Sapiens
EENLKLKPE

SEQ ID NO: 185969 - protein, 9 aa, Homo Sapiens
KPENILVTR

SEQ ID NO: 185970 - protein, 9 aa, Homo Sapiens
LLAFGIVQG

SEQ ID NO: 185971 - protein, 9 aa, Homo Sapiens
CQWEEQHRG

SEQ ID NO: 185972 - protein, 9 aa, Homo Sapiens
GVCGHLKPS

SEQ ID NO: 185973 - protein, 9 aa, Homo Sapiens
WIAVGGKEP

SEQ ID NO: 185974 - protein, 9 aa, Homo Sapiens
PMFTQPLQS

SEQ ID NO: 185975 - protein, 9 aa, Homo Sapiens
RMCNHPPRK

SEQ ID NO: 185976 - protein, 9 aa, Homo Sapiens
RTLSGSWPP

SEQ ID NO: 185977 - protein, 9 aa, Homo Sapiens
EDDLTQTKA

SEQ ID NO: 185978 - protein, 9 aa, Homo Sapiens
IYIITEYMS

SEQ ID NO: 185979 - protein, 9 aa, Homo Sapiens
FNSCLNPVL

SEQ ID NO: 185980 - protein, 9 aa, Homo Sapiens
AIAARTRST

SEQ ID NO: 185981 - protein, 9 aa, Homo Sapiens
PHQASPHPE

SEQ ID NO: 185982 - protein, 9 aa, Homo Sapiens
AGGGSHLYY

SEQ ID NO: 185983 - protein, 9 aa, Homo Sapiens
FLHDPVLLA

SEQ ID NO: 185984 - protein, 9 aa, Homo Sapiens
ALFFGPGTF

SEQ ID NO: 185985 - protein, 9 aa, Homo Sapiens
NMSKISFFA

SEQ ID NO: 185986 - protein, 9 aa, Homo Sapiens
TKNDCDNLE

SEQ ID NO: 185987 - protein, 9 aa, Homo Sapiens
LHRLEICSA

SEQ ID NO: 185988 - protein, 9 aa, Homo Sapiens
DNVDVLPAP

SEQ ID NO: 185989 - protein, 9 aa, Homo Sapiens
TSPTATPTT

SEQ ID NO: 185990 - protein, 9 aa, Homo Sapiens
RWSCCPARA

SEQ ID NO: 185991 - protein, 9 aa, Homo Sapiens
PPSPFPSTP

SEQ ID NO: 185992 - protein, 9 aa, Homo Sapiens
TSGTTRTSL

SEQ ID NO: 185993 - protein, 9 aa, Homo Sapiens
RSLHLEKME

SEQ ID NO: 185994 - protein, 9 aa, Homo Sapiens
LVNMGGTGL

SEQ ID NO: 185995 - protein, 9 aa, Homo Sapiens
QRCFCTRAV

SEQ ID NO: 185996 - protein, 9 aa, Homo Sapiens
GSMPFSLNS

SEQ ID NO: 185997 - protein, 9 aa, Homo Sapiens
PFLLSLRNL

SEQ ID NO: 185998 - protein, 9 aa, Homo Sapiens
SSIRCRLSS

SEQ ID NO: 185999 - protein, 9 aa, Homo Sapiens
NASQDLLGE

SEQ ID NO: 186000 - protein, 9 aa, Homo Sapiens
ELAEVREGE

SEQ ID NO: 186001 - protein, 9 aa, Homo Sapiens
YYNFICAHP

SEQ ID NO: 186002 - protein, 9 aa, Homo Sapiens
QRKLHESQE

SEQ ID NO: 186003 - protein, 9 aa, Homo Sapiens
LTFPVPSFL

SEQ ID NO: 186004 - protein, 9 aa, Homo Sapiens
KWKSIVTAP

SEQ ID NO: 186005 - protein, 9 aa, Homo Sapiens
ERNLRPLSL

SEQ ID NO: 186006 - protein, 9 aa, Homo Sapiens
ATKQRHWDR

SEQ ID NO: 186007 - protein, 9 aa, Homo Sapiens
VMGKFRGGV

SEQ ID NO: 186008 - protein, 9 aa, Homo Sapiens
GRILARGGI

SEQ ID NO: 186009 - protein, 9 aa, Homo Sapiens
LLIKPKNEC

SEQ ID NO: 186010 - protein, 9 aa, Homo Sapiens
PTTAATLPV

SEQ ID NO: 186011 - protein, 9 aa, Homo Sapiens
TYSICVMPL

SEQ ID NO: 186012 - protein, 9 aa, Homo Sapiens
QLGPGASMT

SEQ ID NO: 186013 - protein, 9 aa, Homo Sapiens
YASHFIVIA

SEQ ID NO: 186014 - protein, 9 aa, Homo Sapiens
VLSKILTSK

SEQ ID NO: 186015 - protein, 9 aa, Homo Sapiens
ESLKARGQA

SEQ ID NO: 186016 - protein, 9 aa, Homo Sapiens
CAGPSWKRL

SEQ ID NO: 186017 - protein, 9 aa, Homo Sapiens
ITILIEHTH

SEQ ID NO: 186018 - protein, 9 aa, Homo Sapiens
AYAALMDEE

SEQ ID NO: 186019 - protein, 9 aa, Homo Sapiens
GVPPRAPAS

SEQ ID NO: 186020 - protein, 9 aa, Homo Sapiens
GASSAQEFG

SEQ ID NO: 186021 - protein, 9 aa, Homo Sapiens
EWTHQDSSQ

SEQ ID NO: 186022 - protein, 9 aa, Homo Sapiens
QLHTARTDW

SEQ ID NO: 186023 - protein, 9 aa, Homo Sapiens
WPMHPDGMQ

SEQ ID NO: 186024 - protein, 9 aa, Homo Sapiens
ICWLRKRLC

SEQ ID NO: 186025 - protein, 9 aa, Homo Sapiens
REEEERRLH

SEQ ID NO: 186026 - protein, 9 aa, Homo Sapiens
VLGDQPKAG

SEQ ID NO: 186027 - protein, 9 aa, Homo Sapiens
NVFQGMLRA

SEQ ID NO: 186028 - protein, 9 aa, Homo Sapiens
STYEEALKK

SEQ ID NO: 186029 - protein, 9 aa, Homo Sapiens
EIELKNNSI

SEQ ID NO: 186030 - protein, 9 aa, Homo Sapiens
VYMWSASSG

SEQ ID NO: 186031 - protein, 9 aa, Homo Sapiens
DGGFFEEKG

SEQ ID NO: 186032 - protein, 9 aa, Homo Sapiens
PYFWDNVCL

SEQ ID NO: 186033 - protein, 9 aa, Homo Sapiens
TNSDINLKI

SEQ ID NO: 186034 - protein, 9 aa, Homo Sapiens
GKSQGGRIL

SEQ ID NO: 186035 - protein, 9 aa, Homo Sapiens
TVLVTVSVL

SEQ ID NO: 186036 - protein, 9 aa, Homo Sapiens
FAAESIIII

SEQ ID NO: 186037 - protein, 9 aa, Homo Sapiens
HRPFHLEEW

SEQ ID NO: 186038 - protein, 9 aa, Homo Sapiens
LDQAEQAEA

SEQ ID NO: 186039 - protein, 9 aa, Homo Sapiens
ELDWRAVNQ

SEQ ID NO: 186040 - protein, 9 aa, Homo Sapiens
RKQRRPIRQ

SEQ ID NO: 186041 - protein, 9 aa, Homo Sapiens
PRAVILLLL

SEQ ID NO: 186042 - protein, 9 aa, Homo Sapiens
LISGSLPFL

SEQ ID NO: 186043 - protein, 9 aa, Homo Sapiens
EAVVVDVGA

SEQ ID NO: 186044 - protein, 9 aa, Homo Sapiens
AQEEAKPGG

SEQ ID NO: 186045 - protein, 9 aa, Homo Sapiens
PPGAPSIQQ

SEQ ID NO: 186046 - protein, 9 aa, Homo Sapiens
LTALLQFQV

SEQ ID NO: 186047 - protein, 9 aa, Homo Sapiens
MKKPSPSKA

SEQ ID NO: 186048 - protein, 9 aa, Homo Sapiens
LMVRCANAL

SEQ ID NO: 186049 - protein, 9 aa, Homo Sapiens
QVVEIITEV

SEQ ID NO: 186050 - protein, 9 aa, Homo Sapiens
NEEGPTTDV

SEQ ID NO: 186051 - protein, 9 aa, Homo Sapiens
FAGGVFSNP

SEQ ID NO: 186052 - protein, 9 aa, Homo Sapiens
FQHLAVRRK

SEQ ID NO: 186053 - protein, 9 aa, Homo Sapiens
MTIFLSFAF

SEQ ID NO: 186054 - protein, 9 aa, Homo Sapiens
TGNASGTRK

SEQ ID NO: 186055 - protein, 9 aa, Homo Sapiens
DCCQYVTSY

SEQ ID NO: 186056 - protein, 9 aa, Homo Sapiens
TERLLSWRA

SEQ ID NO: 186057 - protein, 9 aa, Homo Sapiens
PREKSPPPP

SEQ ID NO: 186058 - protein, 9 aa, Homo Sapiens
ADMIKEGAV

SEQ ID NO: 186059 - protein, 9 aa, Homo Sapiens
ECDLTKATK

SEQ ID NO: 186060 - protein, 9 aa, Homo Sapiens
NGPQTEEMM

SEQ ID NO: 186061 - protein, 9 aa, Homo Sapiens
LLFANRRDI

SEQ ID NO: 186062 - protein, 9 aa, Homo Sapiens
MSTPFTCIS

SEQ ID NO: 186063 - protein, 9 aa, Homo Sapiens
SHLGRRSMG

SEQ ID NO: 186064 - protein, 9 aa, Homo Sapiens
QSPVYFFLS

SEQ ID NO: 186065 - protein, 9 aa, Homo Sapiens
RKLHESQEG

SEQ ID NO: 186066 - protein, 9 aa, Homo Sapiens
TVFRHWKKI

SEQ ID NO: 186067 - protein, 9 aa, Homo Sapiens
LQQEFAASR

SEQ ID NO: 186068 - protein, 9 aa, Homo Sapiens
PTSHLVTYF

SEQ ID NO: 186069 - protein, 9 aa, Homo Sapiens
RRTQTASTP

SEQ ID NO: 186070 - protein, 9 aa, Homo Sapiens
MSLLLSHQQ

SEQ ID NO: 186071 - protein, 9 aa, Homo Sapiens
DINDNPPLS

SEQ ID NO: 186072 - protein, 9 aa, Homo Sapiens
EKMEITHHP

SEQ ID NO: 186073 - protein, 9 aa, Homo Sapiens
EKWLSAESG

SEQ ID NO: 186074 - protein, 9 aa, Homo Sapiens
SKMSQTLLL

SEQ ID NO: 186075 - protein, 9 aa, Homo Sapiens
RSVVQQDLQ

SEQ ID NO: 186076 - protein, 9 aa, Homo Sapiens
KGAEAASVT

SEQ ID NO: 186077 - protein, 9 aa, Homo Sapiens
TLLFYRVPF

SEQ ID NO: 186078 - protein, 9 aa, Homo Sapiens
PSDSALHGR

SEQ ID NO: 186079 - protein, 9 aa, Homo Sapiens
LLFQVIPEL

SEQ ID NO: 186080 - protein, 9 aa, Homo Sapiens
DAAVSPRGL

SEQ ID NO: 186081 - protein, 9 aa, Homo Sapiens
LCATLIFFA

SEQ ID NO: 186082 - protein, 9 aa, Homo Sapiens
ACTRPQSTC

SEQ ID NO: 186083 - protein, 9 aa, Homo Sapiens
TAEMCCCCF

SEQ ID NO: 186084 - protein, 9 aa, Homo Sapiens
RDRRPPRLS

SEQ ID NO: 186085 - protein, 9 aa, Homo Sapiens
SGVSCLAAA

SEQ ID NO: 186086 - protein, 9 aa, Homo Sapiens
QYPVPGGPS

SEQ ID NO: 186087 - protein, 9 aa, Homo Sapiens
TPPPHQMKC

SEQ ID NO: 186088 - protein, 9 aa, Homo Sapiens
AGLLALVTL

SEQ ID NO: 186089 - protein, 9 aa, Homo Sapiens
LHQAAFQKL

SEQ ID NO: 186090 - protein, 9 aa, Homo Sapiens
CYDKQVNSC

SEQ ID NO: 186091 - protein, 9 aa, Homo Sapiens
QNYLWTTNL

SEQ ID NO: 186092 - protein, 9 aa, Homo Sapiens
LFNVAHTLC

SEQ ID NO: 186093 - protein, 9 aa, Homo Sapiens
DNNCSLDLD

SEQ ID NO: 186094 - protein, 9 aa, Homo Sapiens
SFLDLMFGE

SEQ ID NO: 186095 - protein, 9 aa, Homo Sapiens
LEPFLENAP

SEQ ID NO: 186096 - protein, 9 aa, Homo Sapiens
HADRMRGGR

SEQ ID NO: 186097 - protein, 9 aa, Homo Sapiens
PTTDVEPFF

SEQ ID NO: 186098 - protein, 9 aa, Homo Sapiens
PTVAMPPRE

SEQ ID NO: 186099 - protein, 9 aa, Homo Sapiens
KKKTHTSLT

SEQ ID NO: 186100 - protein, 9 aa, Homo Sapiens
QQAGSVGAE

SEQ ID NO: 186101 - protein, 9 aa, Homo Sapiens
KMNAKKAAA

SEQ ID NO: 186102 - protein, 9 aa, Homo Sapiens
VVLWIIFQI

SEQ ID NO: 186103 - protein, 9 aa, Homo Sapiens
ASLLFSIRR

SEQ ID NO: 186104 - protein, 9 aa, Homo Sapiens
QSSLFITEY

SEQ ID NO: 186105 - protein, 9 aa, Homo Sapiens
SRSMVASVS

SEQ ID NO: 186106 - protein, 9 aa, Homo Sapiens
RGAALQTGP

SEQ ID NO: 186107 - protein, 9 aa, Homo Sapiens
RNHVSHYKC

SEQ ID NO: 186108 - protein, 9 aa, Homo Sapiens
AWRLEALRK

SEQ ID NO: 186109 - protein, 9 aa, Homo Sapiens
QNYSEDLPQ

SEQ ID NO: 186110 - protein, 9 aa, Homo Sapiens
VLWLKGCAK

SEQ ID NO: 186111 - protein, 9 aa, Homo Sapiens
ANRQCASLD

SEQ ID NO: 186112 - protein, 9 aa, Homo Sapiens
YKCDACGKS

SEQ ID NO: 186113 - protein, 9 aa, Homo Sapiens
PSTHLTPYL

SEQ ID NO: 186114 - protein, 9 aa, Homo Sapiens
GVRYPESHH

SEQ ID NO: 186115 - protein, 9 aa, Homo Sapiens
TLIFFAIWH

SEQ ID NO: 186116 - protein, 9 aa, Homo Sapiens
EVPKRCGEV

SEQ ID NO: 186117 - protein, 9 aa, Homo Sapiens
TFGSEVGFN

SEQ ID NO: 186118 - protein, 9 aa, Homo Sapiens
PWGLLPECR

SEQ ID NO: 186119 - protein, 9 aa, Homo Sapiens
LPQGRARCG

SEQ ID NO: 186120 - protein, 9 aa, Homo Sapiens
WCYDKQVNS

SEQ ID NO: 186121 - protein, 9 aa, Homo Sapiens
ALLGSLNPC

SEQ ID NO: 186122 - protein, 9 aa, Homo Sapiens
RGNLGWWQS

SEQ ID NO: 186123 - protein, 9 aa, Homo Sapiens
PLILWPQAA

SEQ ID NO: 186124 - protein, 9 aa, Homo Sapiens
FTKFNVDEF

SEQ ID NO: 186125 - protein, 9 aa, Homo Sapiens
LLLPAHASC

SEQ ID NO: 186126 - protein, 9 aa, Homo Sapiens
EHMGSGVER

SEQ ID NO: 186127 - protein, 9 aa, Homo Sapiens
QEALYWMMQ

SEQ ID NO: 186128 - protein, 9 aa, Homo Sapiens
LCDQWRIGS

SEQ ID NO: 186129 - protein, 9 aa, Homo Sapiens
GPDTVPHFW

SEQ ID NO: 186130 - protein, 9 aa, Homo Sapiens
MLSLVLCAT

SEQ ID NO: 186131 - protein, 9 aa, Homo Sapiens
AIMVGVKGI

SEQ ID NO: 186132 - protein, 9 aa, Homo Sapiens
GTRKQPWSV

SEQ ID NO: 186133 - protein, 9 aa, Homo Sapiens
QDAHHRRQL

SEQ ID NO: 186134 - protein, 9 aa, Homo Sapiens
KHIRIGEAK

SEQ ID NO: 186135 - protein, 9 aa, Homo Sapiens
FRIRGQKER

SEQ ID NO: 186136 - protein, 9 aa, Homo Sapiens
GFSTRSSPT

SEQ ID NO: 186137 - protein, 9 aa, Homo Sapiens
NLRPLSLQC

SEQ ID NO: 186138 - protein, 9 aa, Homo Sapiens
EELDWRAVN

SEQ ID NO: 186139 - protein, 9 aa, Homo Sapiens
HEINCGNPP

SEQ ID NO: 186140 - protein, 9 aa, Homo Sapiens
TVPHGASRG

SEQ ID NO: 186141 - protein, 9 aa, Homo Sapiens
SGEPWDTER

SEQ ID NO: 186142 - protein, 9 aa, Homo Sapiens
VKTWTQFRN

SEQ ID NO: 186143 - protein, 9 aa, Homo Sapiens
ANWQDAHHR

SEQ ID NO: 186144 - protein, 9 aa, Homo Sapiens
TTLNSIDSD

SEQ ID NO: 186145 - protein, 9 aa, Homo Sapiens
KEAPEAQMH

SEQ ID NO: 186146 - protein, 9 aa, Homo Sapiens
IIMENSKVV

SEQ ID NO: 186147 - protein, 9 aa, Homo Sapiens
TVAMPPREI

SEQ ID NO: 186148 - protein, 9 aa, Homo Sapiens
RTPTPASSP

SEQ ID NO: 186149 - protein, 9 aa, Homo Sapiens
CYYNFICAH

SEQ ID NO: 186150 - protein, 9 aa, Homo Sapiens
AVEGPTAKR

SEQ ID NO: 186151 - protein, 9 aa, Homo Sapiens
AEPGLDATT

SEQ ID NO: 186152 - protein, 9 aa, Homo Sapiens
HQFHPFLCV

SEQ ID NO: 186153 - protein, 9 aa, Homo Sapiens
IEQSSNSQR

SEQ ID NO: 186154 - protein, 9 aa, Homo Sapiens
LPWTLRKQP

SEQ ID NO: 186155 - protein, 9 aa, Homo Sapiens
RAPASPGRR

SEQ ID NO: 186156 - protein, 9 aa, Homo Sapiens
ARGQALAQL

SEQ ID NO: 186157 - protein, 9 aa, Homo Sapiens
AASMKMNAK

SEQ ID NO: 186158 - protein, 9 aa, Homo Sapiens
SGVTTSTHR

SEQ ID NO: 186159 - protein, 9 aa, Homo Sapiens
LNHGKKPFS

SEQ ID NO: 186160 - protein, 9 aa, Homo Sapiens
FTKVKMSLL

SEQ ID NO: 186161 - protein, 9 aa, Homo Sapiens
PPTARARSP

SEQ ID NO: 186162 - protein, 9 aa, Homo Sapiens
DGHTAQEND

SEQ ID NO: 186163 - protein, 9 aa, Homo Sapiens
DSDLLAGWM

SEQ ID NO: 186164 - protein, 9 aa, Homo Sapiens
FTEAPYSTC

SEQ ID NO: 186165 - protein, 9 aa, Homo Sapiens
SAAAPAATV

SEQ ID NO: 186166 - protein, 9 aa, Homo Sapiens
AHQPVPCIM

SEQ ID NO: 186167 - protein, 9 aa, Homo Sapiens
PRPGRLPPG

SEQ ID NO: 186168 - protein, 9 aa, Homo Sapiens
RRVKDALHT

SEQ ID NO: 186169 - protein, 9 aa, Homo Sapiens
RRFLRRAGQ

SEQ ID NO: 186170 - protein, 9 aa, Homo Sapiens
QQEFAGGVF

SEQ ID NO: 186171 - protein, 9 aa, Homo Sapiens
TRKSQERSM

SEQ ID NO: 186172 - protein, 9 aa, Homo Sapiens
SSKLPVPLL

SEQ ID NO: 186173 - protein, 9 aa, Homo Sapiens
DCHLALLFK

SEQ ID NO: 186174 - protein, 9 aa, Homo Sapiens
VSGELGGGW

SEQ ID NO: 186175 - protein, 9 aa, Homo Sapiens
LRELRHAPR

SEQ ID NO: 186176 - protein, 9 aa, Homo Sapiens
EMCCCCFDV

SEQ ID NO: 186177 - protein, 9 aa, Homo Sapiens
TEIQLTMND

SEQ ID NO: 186178 - protein, 9 aa, Homo Sapiens
EEKAGAATM

SEQ ID NO: 186179 - protein, 9 aa, Homo Sapiens
EAQRISGKN

SEQ ID NO: 186180 - protein, 9 aa, Homo Sapiens
LFVLLCRLA

SEQ ID NO: 186181 - protein, 9 aa, Homo Sapiens
LLFCRVRYS

SEQ ID NO: 186182 - protein, 9 aa, Homo Sapiens
VLKTDRAIM

SEQ ID NO: 186183 - protein, 9 aa, Homo Sapiens
PAASAYPVL

SEQ ID NO: 186184 - protein, 9 aa, Homo Sapiens
VVQQDLQSS

SEQ ID NO: 186185 - protein, 9 aa, Homo Sapiens
WPRVRCARR

SEQ ID NO: 186186 - protein, 9 aa, Homo Sapiens
CSMTWGFDR

SEQ ID NO: 186187 - protein, 9 aa, Homo Sapiens
TTCTTGVGR

SEQ ID NO: 186188 - protein, 9 aa, Homo Sapiens
AGTFVLEAP

SEQ ID NO: 186189 - protein, 9 aa, Homo Sapiens
EAKYEAFSD

SEQ ID NO: 186190 - protein, 9 aa, Homo Sapiens
GSLLGCVST

SEQ ID NO: 186191 - protein, 9 aa, Homo Sapiens
PRWESQVRQ

SEQ ID NO: 186192 - protein, 9 aa, Homo Sapiens
KIPTSHLVT

SEQ ID NO: 186193 - protein, 9 aa, Homo Sapiens
ADHGGRSDD

SEQ ID NO: 186194 - protein, 9 aa, Homo Sapiens
LHRVLQGKA

SEQ ID NO: 186195 - protein, 9 aa, Homo Sapiens
PSECGFCLH

SEQ ID NO: 186196 - protein, 9 aa, Homo Sapiens
GKPTESSAV

SEQ ID NO: 186197 - protein, 9 aa, Homo Sapiens
GLGEGSPRQ

SEQ ID NO: 186198 - protein, 9 aa, Homo Sapiens
RPKKCPLLL

SEQ ID NO: 186199 - protein, 9 aa, Homo Sapiens
SRDHKSKPF

SEQ ID NO: 186200 - protein, 9 aa, Homo Sapiens
KKEALFLQE

SEQ ID NO: 186201 - protein, 9 aa, Homo Sapiens
IEHMGSGVE

SEQ ID NO: 186202 - protein, 9 aa, Homo Sapiens
HEGPPRLLL

SEQ ID NO: 186203 - protein, 9 aa, Homo Sapiens
GDPHSQILI

SEQ ID NO: 186204 - protein, 9 aa, Homo Sapiens
LLDKMTMSF

SEQ ID NO: 186205 - protein, 9 aa, Homo Sapiens
QGLAPPHCV

SEQ ID NO: 186206 - protein, 9 aa, Homo Sapiens
WAHGISSYF

SEQ ID NO: 186207 - protein, 9 aa, Homo Sapiens
AILHSSCLH

SEQ ID NO: 186208 - protein, 9 aa, Homo Sapiens
LKDNPLDHV

SEQ ID NO: 186209 - protein, 9 aa, Homo Sapiens
DSECQACLR

SEQ ID NO: 186210 - protein, 9 aa, Homo Sapiens
GPEHLAHGS

SEQ ID NO: 186211 - protein, 9 aa, Homo Sapiens
FYYGWQCMV

SEQ ID NO: 186212 - protein, 9 aa, Homo Sapiens
WVQSIVVEF

SEQ ID NO: 186213 - protein, 9 aa, Homo Sapiens
TAQFGQELP

SEQ ID NO: 186214 - protein, 9 aa, Homo Sapiens
NYSLMVRCA

SEQ ID NO: 186215 - protein, 9 aa, Homo Sapiens
EVVQVGLHL

SEQ ID NO: 186216 - protein, 9 aa, Homo Sapiens
CLSGFRQES

SEQ ID NO: 186217 - protein, 9 aa, Homo Sapiens
VGFNGCSPQ

SEQ ID NO: 186218 - protein, 9 aa, Homo Sapiens
QRRKRLPSQ

SEQ ID NO: 186219 - protein, 9 aa, Homo Sapiens
QGRGNLGWW

SEQ ID NO: 186220 - protein, 9 aa, Homo Sapiens
ARGRTGAVT

SEQ ID NO: 186221 - protein, 9 aa, Homo Sapiens
LPAHASCHV

SEQ ID NO: 186222 - protein, 9 aa, Homo Sapiens
AKAYAALMD

SEQ ID NO: 186223 - protein, 9 aa, Homo Sapiens
LSKTVRAEP

SEQ ID NO: 186224 - protein, 9 aa, Homo Sapiens
VLQGQVAED

SEQ ID NO: 186225 - protein, 9 aa, Homo Sapiens
NKEKLADLW

SEQ ID NO: 186226 - protein, 9 aa, Homo Sapiens
EPPMPPPAN

SEQ ID NO: 186227 - protein, 9 aa, Homo Sapiens
KIFFQTGVL

SEQ ID NO: 186228 - protein, 9 aa, Homo Sapiens
QLQSAGLLG

SEQ ID NO: 186229 - protein, 9 aa, Homo Sapiens
DEQSKDREN

SEQ ID NO: 186230 - protein, 9 aa, Homo Sapiens
RKHRIIHLG

SEQ ID NO: 186231 - protein, 9 aa, Homo Sapiens
EADPIKHIR

SEQ ID NO: 186232 - protein, 9 aa, Homo Sapiens
NLRDISNVF

SEQ ID NO: 186233 - protein, 9 aa, Homo Sapiens
VQQMIGQVD

SEQ ID NO: 186234 - protein, 9 aa, Homo Sapiens
GARNENQDQ

SEQ ID NO: 186235 - protein, 9 aa, Homo Sapiens
LSKSSDDGF

SEQ ID NO: 186236 - protein, 9 aa, Homo Sapiens
SPLLSGARG

SEQ ID NO: 186237 - protein, 9 aa, Homo Sapiens
SQHRYSTDS

SEQ ID NO: 186238 - protein, 9 aa, Homo Sapiens
HSWKKSVWT

SEQ ID NO: 186239 - protein, 9 aa, Homo Sapiens
GMSLTSDAP

SEQ ID NO: 186240 - protein, 9 aa, Homo Sapiens
ISGESGRCV

SEQ ID NO: 186241 - protein, 9 aa, Homo Sapiens
EKDLLRIMP

SEQ ID NO: 186242 - protein, 9 aa, Homo Sapiens
PQGHQIFGS

SEQ ID NO: 186243 - protein, 9 aa, Homo Sapiens
VETGVADHG

SEQ ID NO: 186244 - protein, 9 aa, Homo Sapiens
TLLLWRWAW

SEQ ID NO: 186245 - protein, 9 aa, Homo Sapiens
ALYGGLSAS

SEQ ID NO: 186246 - protein, 9 aa, Homo Sapiens
RSFLDLMFG

SEQ ID NO: 186247 - protein, 9 aa, Homo Sapiens
YVAGITWFL

SEQ ID NO: 186248 - protein, 9 aa, Homo Sapiens
FWTANRQCA

SEQ ID NO: 186249 - protein, 9 aa, Homo Sapiens
WDTERNLRP

SEQ ID NO: 186250 - protein, 9 aa, Homo Sapiens
AYKDTVAEN

SEQ ID NO: 186251 - protein, 9 aa, Homo Sapiens
NVLLMSPQP

SEQ ID NO: 186252 - protein, 9 aa, Homo Sapiens
QVMVSVSQT

SEQ ID NO: 186253 - protein, 9 aa, Homo Sapiens
GTIFTIDET

SEQ ID NO: 186254 - protein, 9 aa, Homo Sapiens
DEKLVQEVE

SEQ ID NO: 186255 - protein, 9 aa, Homo Sapiens
SCGDSDSRR

SEQ ID NO: 186256 - protein, 9 aa, Homo Sapiens
VPILAGGND

SEQ ID NO: 186257 - protein, 9 aa, Homo Sapiens
LSSEDPVLM

SEQ ID NO: 186258 - protein, 9 aa, Homo Sapiens
LIIGQNGVL

SEQ ID NO: 186259 - protein, 9 aa, Homo Sapiens
FNLRDISNV

SEQ ID NO: 186260 - protein, 9 aa, Homo Sapiens
YGARNENQD

SEQ ID NO: 186261 - protein, 9 aa, Homo Sapiens
PYLGCIEIM

SEQ ID NO: 186262 - protein, 9 aa, Homo Sapiens
EEHELQKER

SEQ ID NO: 186263 - protein, 9 aa, Homo Sapiens
KGEKKAVEQ

SEQ ID NO: 186264 - protein, 9 aa, Homo Sapiens
SGSSKLPVP

SEQ ID NO: 186265 - protein, 9 aa, Homo Sapiens
LANWSNCSD

SEQ ID NO: 186266 - protein, 9 aa, Homo Sapiens
PRHPSLIQN

SEQ ID NO: 186267 - protein, 9 aa, Homo Sapiens
NHSHKPPRV

SEQ ID NO: 186268 - protein, 9 aa, Homo Sapiens
AMEPLCNDN

SEQ ID NO: 186269 - protein, 9 aa, Homo Sapiens
GCALRRCPL

SEQ ID NO: 186270 - protein, 9 aa, Homo Sapiens
QRALDMLLS

SEQ ID NO: 186271 - protein, 9 aa, Homo Sapiens
ELLPSDSAL

SEQ ID NO: 186272 - protein, 9 aa, Homo Sapiens
GGTRKASAA

SEQ ID NO: 186273 - protein, 9 aa, Homo Sapiens
WKASPCSRR

SEQ ID NO: 186274 - protein, 9 aa, Homo Sapiens
NSISKNFSP

SEQ ID NO: 186275 - protein, 9 aa, Homo Sapiens
RCFFFNHGE

SEQ ID NO: 186276 - protein, 9 aa, Homo Sapiens
TDHTTGGES

SEQ ID NO: 186277 - protein, 9 aa, Homo Sapiens
PLLQGELLV

SEQ ID NO: 186278 - protein, 9 aa, Homo Sapiens
QVIQEDGMI

SEQ ID NO: 186279 - protein, 9 aa, Homo Sapiens
LRLTLWPPR

SEQ ID NO: 186280 - protein, 9 aa, Homo Sapiens
LMKLLRILL

SEQ ID NO: 186281 - protein, 9 aa, Homo Sapiens
EPVLPRHPS

SEQ ID NO: 186282 - protein, 9 aa, Homo Sapiens
PAGPLREKV

SEQ ID NO: 186283 - protein, 9 aa, Homo Sapiens
TGKNPIFVM

SEQ ID NO: 186284 - protein, 9 aa, Homo Sapiens
CSLDLDSII

SEQ ID NO: 186285 - protein, 9 aa, Homo Sapiens
ANLDGSNRH

SEQ ID NO: 186286 - protein, 9 aa, Homo Sapiens
MTVACLVGC

SEQ ID NO: 186287 - protein, 9 aa, Homo Sapiens
TTVAKSNEL

SEQ ID NO: 186288 - protein, 9 aa, Homo Sapiens
WCGTSQTYF

SEQ ID NO: 186289 - protein, 9 aa, Homo Sapiens
RVLEEERKK

SEQ ID NO: 186290 - protein, 9 aa, Homo Sapiens
GRTRAGPRD

SEQ ID NO: 186291 - protein, 9 aa, Homo Sapiens
ASLTGALLS

SEQ ID NO: 186292 - protein, 9 aa, Homo Sapiens
MHTIIPLLQ

SEQ ID NO: 186293 - protein, 9 aa, Homo Sapiens
SLNPCPFPF

SEQ ID NO: 186294 - protein, 9 aa, Homo Sapiens
FSTVRLLHF

SEQ ID NO: 186295 - protein, 9 aa, Homo Sapiens
RTSLRSCRT

SEQ ID NO: 186296 - protein, 9 aa, Homo Sapiens
PRKVPVVVL

SEQ ID NO: 186297 - protein, 9 aa, Homo Sapiens
HSPVPRLPR

SEQ ID NO: 186298 - protein, 9 aa, Homo Sapiens
ITPPPHQMK

SEQ ID NO: 186299 - protein, 9 aa, Homo Sapiens
SKIPKKALW

SEQ ID NO: 186300 - protein, 9 aa, Homo Sapiens
SVQTCGPVH

SEQ ID NO: 186301 - protein, 9 aa, Homo Sapiens
HRRVKDALH

SEQ ID NO: 186302 - protein, 9 aa, Homo Sapiens
AIVNGKSYK

SEQ ID NO: 186303 - protein, 9 aa, Homo Sapiens
INSAVCSAD

SEQ ID NO: 186304 - protein, 9 aa, Homo Sapiens
GYSDPEDEG

SEQ ID NO: 186305 - protein, 9 aa, Homo Sapiens
SWCGTSQTY

SEQ ID NO: 186306 - protein, 9 aa, Homo Sapiens
IKPKNECDL

SEQ ID NO: 186307 - protein, 9 aa, Homo Sapiens
RDHMRNHVS

SEQ ID NO: 186308 - protein, 9 aa, Homo Sapiens
ATELGAAGR

SEQ ID NO: 186309 - protein, 9 aa, Homo Sapiens
LYICYERND

SEQ ID NO: 186310 - protein, 9 aa, Homo Sapiens
FGIWSEGVD

SEQ ID NO: 186311 - protein, 9 aa, Homo Sapiens
PKGVIYATI

SEQ ID NO: 186312 - protein, 9 aa, Homo Sapiens
SDSQPSNWI

SEQ ID NO: 186313 - protein, 9 aa, Homo Sapiens
HHMVFSSCA

SEQ ID NO: 186314 - protein, 9 aa, Homo Sapiens
STMTNNEGL

SEQ ID NO: 186315 - protein, 9 aa, Homo Sapiens
CCSHCQNKG

SEQ ID NO: 186316 - protein, 9 aa, Homo Sapiens
SARQQPCER

SEQ ID NO: 186317 - protein, 9 aa, Homo Sapiens
ALQQEFAAS

SEQ ID NO: 186318 - protein, 9 aa, Homo Sapiens
RRRTQTAST

SEQ ID NO: 186319 - protein, 9 aa, Homo Sapiens
HRRRLTWEV

SEQ ID NO: 186320 - protein, 9 aa, Homo Sapiens
GPDWLVKVT

SEQ ID NO: 186321 - protein, 9 aa, Homo Sapiens
IEFANLDGS

SEQ ID NO: 186322 - protein, 9 aa, Homo Sapiens
FEFGKILGE

SEQ ID NO: 186323 - protein, 9 aa, Homo Sapiens
AGREDGVAI

SEQ ID NO: 186324 - protein, 9 aa, Homo Sapiens
GREDGVAIP

SEQ ID NO: 186325 - protein, 9 aa, Homo Sapiens
VGTMDSSFP

SEQ ID NO: 186326 - protein, 9 aa, Homo Sapiens
AEKAHENPF

SEQ ID NO: 186327 - protein, 9 aa, Homo Sapiens
PMLTPEECH

SEQ ID NO: 186328 - protein, 9 aa, Homo Sapiens
ISSEKNEAQ

SEQ ID NO: 186329 - protein, 9 aa, Homo Sapiens
RLLLGVCGH

SEQ ID NO: 186330 - protein, 9 aa, Homo Sapiens
QGGRILLQR

SEQ ID NO: 186331 - protein, 9 aa, Homo Sapiens
PCAQPTVST

SEQ ID NO: 186332 - protein, 9 aa, Homo Sapiens
TGTPIGLSS

SEQ ID NO: 186333 - protein, 9 aa, Homo Sapiens
VTTARTPGP

SEQ ID NO: 186334 - protein, 9 aa, Homo Sapiens
VGSSPSSRD

SEQ ID NO: 186335 - protein, 9 aa, Homo Sapiens
AVCSADESL

SEQ ID NO: 186336 - protein, 9 aa, Homo Sapiens
TNLQDSLQA

SEQ ID NO: 186337 - protein, 9 aa, Homo Sapiens
GNAFLNMFV

SEQ ID NO: 186338 - protein, 9 aa, Homo Sapiens
PMPPPANPQ

SEQ ID NO: 186339 - protein, 9 aa, Homo Sapiens
DSAIFNLGH

SEQ ID NO: 186340 - protein, 9 aa, Homo Sapiens
LQPTEKQQY

SEQ ID NO: 186341 - protein, 9 aa, Homo Sapiens
EEFGWKLVR

SEQ ID NO: 186342 - protein, 9 aa, Homo Sapiens
LAFGIVQGS

SEQ ID NO: 186343 - protein, 9 aa, Homo Sapiens
GKVPQHAGK

SEQ ID NO: 186344 - protein, 9 aa, Homo Sapiens
DGHIREHDS

SEQ ID NO: 186345 - protein, 9 aa, Homo Sapiens
NLAYTTAWS

SEQ ID NO: 186346 - protein, 9 aa, Homo Sapiens
VWMPRMRQL

SEQ ID NO: 186347 - protein, 9 aa, Homo Sapiens
LQEAKYEAF

SEQ ID NO: 186348 - protein, 9 aa, Homo Sapiens
PFPSTPLPL

SEQ ID NO: 186349 - protein, 9 aa, Homo Sapiens
ATKHALPRT

SEQ ID NO: 186350 - protein, 9 aa, Homo Sapiens
GGEEPRGAG

SEQ ID NO: 186351 - protein, 9 aa, Homo Sapiens
KWDKTTMKE

SEQ ID NO: 186352 - protein, 9 aa, Homo Sapiens
WSPKGKQPA

SEQ ID NO: 186353 - protein, 9 aa, Homo Sapiens
NKHRDSFEA

SEQ ID NO: 186354 - protein, 9 aa, Homo Sapiens
SRPEACGIR

SEQ ID NO: 186355 - protein, 9 aa, Homo Sapiens
TKIQTSRRL

SEQ ID NO: 186356 - protein, 9 aa, Homo Sapiens
SLPEPASGD

SEQ ID NO: 186357 - protein, 9 aa, Homo Sapiens
QRISGKNRW

SEQ ID NO: 186358 - protein, 9 aa, Homo Sapiens
SGTRKQPWS

SEQ ID NO: 186359 - protein, 9 aa, Homo Sapiens
QQRDPIKCQ

SEQ ID NO: 186360 - protein, 9 aa, Homo Sapiens
RSSKERIEW

SEQ ID NO: 186361 - protein, 9 aa, Homo Sapiens
RGCPLRGHS

SEQ ID NO: 186362 - protein, 9 aa, Homo Sapiens
CEDAQAIQN

SEQ ID NO: 186363 - protein, 9 aa, Homo Sapiens
RPYDSAQLG

SEQ ID NO: 186364 - protein, 9 aa, Homo Sapiens
KRQSYDIGI

SEQ ID NO: 186365 - protein, 9 aa, Homo Sapiens
ESKEERRCD

SEQ ID NO: 186366 - protein, 9 aa, Homo Sapiens
THTPLPFST

SEQ ID NO: 186367 - protein, 9 aa, Homo Sapiens
NGPKPKNDV

SEQ ID NO: 186368 - protein, 9 aa, Homo Sapiens
FPASAVSTA

SEQ ID NO: 186369 - protein, 9 aa, Homo Sapiens
LIGPESPSI

SEQ ID NO: 186370 - protein, 9 aa, Homo Sapiens
PINVPENSH

SEQ ID NO: 186371 - protein, 9 aa, Homo Sapiens
GIVAQVDQT

SEQ ID NO: 186372 - protein, 9 aa, Homo Sapiens
LRIMPSNAC

SEQ ID NO: 186373 - protein, 9 aa, Homo Sapiens
EGSPRQGCL

SEQ ID NO: 186374 - protein, 9 aa, Homo Sapiens
TQLEVARRR

SEQ ID NO: 186375 - protein, 9 aa, Homo Sapiens
ASGVTTSTH

SEQ ID NO: 186376 - protein, 9 aa, Homo Sapiens
KVAPGRVML

SEQ ID NO: 186377 - protein, 9 aa, Homo Sapiens
FCLEQKVYF

SEQ ID NO: 186378 - protein, 9 aa, Homo Sapiens
LKEVEYHTT

SEQ ID NO: 186379 - protein, 9 aa, Homo Sapiens
KWKRFVVVT

SEQ ID NO: 186380 - protein, 9 aa, Homo Sapiens
NIYKNRLLL

SEQ ID NO: 186381 - protein, 9 aa, Homo Sapiens
DMQPSVTSQ

SEQ ID NO: 186382 - protein, 9 aa, Homo Sapiens
IMHDGGMLM

SEQ ID NO: 186383 - protein, 9 aa, Homo Sapiens
LRILLQQLW

SEQ ID NO: 186384 - protein, 9 aa, Homo Sapiens
LTRQRDGED

SEQ ID NO: 186385 - protein, 9 aa, Homo Sapiens
PCFPSLPKQ

SEQ ID NO: 186386 - protein, 9 aa, Homo Sapiens
LQKHANVPF

SEQ ID NO: 186387 - protein, 9 aa, Homo Sapiens
RHGLGPIHS

SEQ ID NO: 186388 - protein, 9 aa, Homo Sapiens
DPSLSRARV

SEQ ID NO: 186389 - protein, 9 aa, Homo Sapiens
TVKFLHDPV

SEQ ID NO: 186390 - protein, 9 aa, Homo Sapiens
GRTTNEQVM

SEQ ID NO: 186391 - protein, 9 aa, Homo Sapiens
SGAAVLLES

SEQ ID NO: 186392 - protein, 9 aa, Homo Sapiens
GPLPGPLPG

SEQ ID NO: 186393 - protein, 9 aa, Homo Sapiens
ILAHLLPQA

SEQ ID NO: 186394 - protein, 9 aa, Homo Sapiens
VAQEEAKPG

SEQ ID NO: 186395 - protein, 9 aa, Homo Sapiens
PNGQLDEDV

SEQ ID NO: 186396 - protein, 9 aa, Homo Sapiens
QGPCRHAGS

SEQ ID NO: 186397 - protein, 9 aa, Homo Sapiens
SVLGDQPKA

SEQ ID NO: 186398 - protein, 9 aa, Homo Sapiens
PPLLATMGP

SEQ ID NO: 186399 - protein, 9 aa, Homo Sapiens
YPVQGQQVH

SEQ ID NO: 186400 - protein, 9 aa, Homo Sapiens
NSHGPFPQQ

SEQ ID NO: 186401 - protein, 9 aa, Homo Sapiens
WKDCHLALL

SEQ ID NO: 186402 - protein, 9 aa, Homo Sapiens
LSPTLGLIF

SEQ ID NO: 186403 - protein, 9 aa, Homo Sapiens
NAGCLHMTC

SEQ ID NO: 186404 - protein, 9 aa, Homo Sapiens
TDGILALYG

SEQ ID NO: 186405 - protein, 9 aa, Homo Sapiens
CLQSFANPA

SEQ ID NO: 186406 - protein, 9 aa, Homo Sapiens
LLQFQVLKQ

SEQ ID NO: 186407 - protein, 9 aa, Homo Sapiens
FQLKTSLSA

SEQ ID NO: 186408 - protein, 9 aa, Homo Sapiens
IGYVLLRSG

SEQ ID NO: 186409 - protein, 9 aa, Homo Sapiens
CTTNMVQEE

SEQ ID NO: 186410 - protein, 9 aa, Homo Sapiens
LNLQENGIR

SEQ ID NO: 186411 - protein, 9 aa, Homo Sapiens
SLGEWMTQR

SEQ ID NO: 186412 - protein, 9 aa, Homo Sapiens
TPPPLILWP

SEQ ID NO: 186413 - protein, 9 aa, Homo Sapiens
EVQIVGTMD

SEQ ID NO: 186414 - protein, 9 aa, Homo Sapiens
HPTWRPFHF

SEQ ID NO: 186415 - protein, 9 aa, Homo Sapiens
LLPAHASCH

SEQ ID NO: 186416 - protein, 9 aa, Homo Sapiens
GETSPTATP

SEQ ID NO: 186417 - protein, 9 aa, Homo Sapiens
SSSQVPRLR

SEQ ID NO: 186418 - protein, 9 aa, Homo Sapiens
KKRGASSST

SEQ ID NO: 186419 - protein, 9 aa, Homo Sapiens
GHWDCGICL

SEQ ID NO: 186420 - protein, 9 aa, Homo Sapiens
IQLTMNDSK

SEQ ID NO: 186421 - protein, 9 aa, Homo Sapiens
PGPLPGGLH

SEQ ID NO: 186422 - protein, 9 aa, Homo Sapiens
SSRSNGVTT

SEQ ID NO: 186423 - protein, 9 aa, Homo Sapiens
ALLRKTKCR

SEQ ID NO: 186424 - protein, 9 aa, Homo Sapiens
SMTWGFDRI

SEQ ID NO: 186425 - protein, 9 aa, Homo Sapiens
VYKNKLIFL

SEQ ID NO: 186426 - protein, 9 aa, Homo Sapiens
ESQALMLPL

SEQ ID NO: 186427 - protein, 9 aa, Homo Sapiens
GWSVCGFST

SEQ ID NO: 186428 - protein, 9 aa, Homo Sapiens
KQVALCKFH

SEQ ID NO: 186429 - protein, 9 aa, Homo Sapiens
LRASWLTRH

SEQ ID NO: 186430 - protein, 9 aa, Homo Sapiens
SQGAPQWPL

SEQ ID NO: 186431 - protein, 9 aa, Homo Sapiens
LPRTGGLVT

SEQ ID NO: 186432 - protein, 9 aa, Homo Sapiens
PFFLNLGRR

SEQ ID NO: 186433 - protein, 9 aa, Homo Sapiens
SPGRRPLKK

SEQ ID NO: 186434 - protein, 9 aa, Homo Sapiens
SQTSLSIRK

SEQ ID NO: 186435 - protein, 9 aa, Homo Sapiens
TRTPESTQI

SEQ ID NO: 186436 - protein, 9 aa, Homo Sapiens
ILQIQGVTT

SEQ ID NO: 186437 - protein, 9 aa, Homo Sapiens
ICRFKEREE

SEQ ID NO: 186438 - protein, 9 aa, Homo Sapiens
FDFAFDRKA

SEQ ID NO: 186439 - protein, 9 aa, Homo Sapiens
LAHLLPQAL

SEQ ID NO: 186440 - protein, 9 aa, Homo Sapiens
VKSQALRDT

SEQ ID NO: 186441 - protein, 9 aa, Homo Sapiens
DEPTVAPTT

SEQ ID NO: 186442 - protein, 9 aa, Homo Sapiens
RCGVLWLKG

SEQ ID NO: 186443 - protein, 9 aa, Homo Sapiens
KTHTSLTFQ

SEQ ID NO: 186444 - protein, 9 aa, Homo Sapiens
LRLQSLLSL

SEQ ID NO: 186445 - protein, 9 aa, Homo Sapiens
LANGSWAAC

SEQ ID NO: 186446 - protein, 9 aa, Homo Sapiens
TTSTHRPAS

SEQ ID NO: 186447 - protein, 9 aa, Homo Sapiens
GIQVIQEDG

SEQ ID NO: 186448 - protein, 9 aa, Homo Sapiens
NIGRQFPQC

SEQ ID NO: 186449 - protein, 9 aa, Homo Sapiens
GAAVLLESL

SEQ ID NO: 186450 - protein, 9 aa, Homo Sapiens
SLSRARVEQ

SEQ ID NO: 186451 - protein, 9 aa, Homo Sapiens
IFLSTRCVV

SEQ ID NO: 186452 - protein, 9 aa, Homo Sapiens
PDTSHSLRN

SEQ ID NO: 186453 - protein, 9 aa, Homo Sapiens
PFSTVRLLH

SEQ ID NO: 186454 - protein, 9 aa, Homo Sapiens
MKYKKSVSR

SEQ ID NO: 186455 - protein, 9 aa, Homo Sapiens
VGGVPEESK

SEQ ID NO: 186456 - protein, 9 aa, Homo Sapiens
CRSQQIKTS

SEQ ID NO: 186457 - protein, 9 aa, Homo Sapiens
RAIAARTRS

SEQ ID NO: 186458 - protein, 9 aa, Homo Sapiens
GSGVSCLAA

SEQ ID NO: 186459 - protein, 9 aa, Homo Sapiens
ETDPCTGLT

SEQ ID NO: 186460 - protein, 9 aa, Homo Sapiens
GFSFFPASA

SEQ ID NO: 186461 - protein, 9 aa, Homo Sapiens
CLPVRPGSV

SEQ ID NO: 186462 - protein, 9 aa, Homo Sapiens
ARRGRWSCC

SEQ ID NO: 186463 - protein, 9 aa, Homo Sapiens
NSGFFLEDE

SEQ ID NO: 186464 - protein, 9 aa, Homo Sapiens
WTHLTHYGI

SEQ ID NO: 186465 - protein, 9 aa, Homo Sapiens
FVPVLGFGT

SEQ ID NO: 186466 - protein, 9 aa, Homo Sapiens
GKAILWLPV

SEQ ID NO: 186467 - protein, 9 aa, Homo Sapiens
SPSTPPTTG

SEQ ID NO: 186468 - protein, 9 aa, Homo Sapiens
ERLLSWRAA

SEQ ID NO: 186469 - protein, 9 aa, Homo Sapiens
MSFWKRRNW

SEQ ID NO: 186470 - protein, 9 aa, Homo Sapiens
PPSPTDHPG

SEQ ID NO: 186471 - protein, 9 aa, Homo Sapiens
SPLRKVRVP

SEQ ID NO: 186472 - protein, 9 aa, Homo Sapiens
IHCVAKDPW

SEQ ID NO: 186473 - protein, 9 aa, Homo Sapiens
PVWARRQAA

SEQ ID NO: 186474 - protein, 9 aa, Homo Sapiens
DSRDMWDSR

SEQ ID NO: 186475 - protein, 9 aa, Homo Sapiens
QLCQQSPGS

SEQ ID NO: 186476 - protein, 9 aa, Homo Sapiens
RKFWTANRQ

SEQ ID NO: 186477 - protein, 9 aa, Homo Sapiens
TFQDVTTEI

SEQ ID NO: 186478 - protein, 9 aa, Homo Sapiens
TAQENDDHP

SEQ ID NO: 186479 - protein, 9 aa, Homo Sapiens
LPRHPSLIQ

SEQ ID NO: 186480 - protein, 9 aa, Homo Sapiens
TPLRASWLT

SEQ ID NO: 186481 - protein, 9 aa, Homo Sapiens
GKNPIFVMN

SEQ ID NO: 186482 - protein, 9 aa, Homo Sapiens
WWQSPLRKV

SEQ ID NO: 186483 - protein, 9 aa, Homo Sapiens
EQLIQEACW

SEQ ID NO: 186484 - protein, 9 aa, Homo Sapiens
GALTFPVPS

SEQ ID NO: 186485 - protein, 9 aa, Homo Sapiens
GKESRSRRA

SEQ ID NO: 186486 - protein, 9 aa, Homo Sapiens
RRAIAARTR

SEQ ID NO: 186487 - protein, 9 aa, Homo Sapiens
RYSSSQVPR

SEQ ID NO: 186488 - protein, 9 aa, Homo Sapiens
TPGPCVTAC

SEQ ID NO: 186489 - protein, 9 aa, Homo Sapiens
FSLNSPNLL

SEQ ID NO: 186490 - protein, 9 aa, Homo Sapiens
PSPWAAPAS

SEQ ID NO: 186491 - protein, 9 aa, Homo Sapiens
DLFGQALGG

SEQ ID NO: 186492 - protein, 9 aa, Homo Sapiens
QLPKEELQG

SEQ ID NO: 186493 - protein, 9 aa, Homo Sapiens
NKKCKKNVF

SEQ ID NO: 186494 - protein, 9 aa, Homo Sapiens
TPTTCTTGV

SEQ ID NO: 186495 - protein, 9 aa, Homo Sapiens
SCRITFVLL

SEQ ID NO: 186496 - protein, 9 aa, Homo Sapiens
KKCSLYGKK

SEQ ID NO: 186497 - protein, 9 aa, Homo Sapiens
DKVAQHEGL

SEQ ID NO: 186498 - protein, 9 aa, Homo Sapiens
SSLSDPGPR

SEQ ID NO: 186499 - protein, 9 aa, Homo Sapiens
PPMPRPGPC

SEQ ID NO: 186500 - protein, 9 aa, Homo Sapiens
QHTPYRENK

SEQ ID NO: 186501 - protein, 9 aa, Homo Sapiens
QPLLLLQKH

SEQ ID NO: 186502 - protein, 9 aa, Homo Sapiens
EAGKLCRKD

SEQ ID NO: 186503 - protein, 9 aa, Homo Sapiens
VLLRQLQSA

SEQ ID NO: 186504 - protein, 9 aa, Homo Sapiens
LDGHIREHD

SEQ ID NO: 186505 - protein, 9 aa, Homo Sapiens
WEKMPESWG

SEQ ID NO: 186506 - protein, 9 aa, Homo Sapiens
EVCQRGGEI

SEQ ID NO: 186507 - protein, 9 aa, Homo Sapiens
SFGLDRIVD

SEQ ID NO: 186508 - protein, 9 aa, Homo Sapiens
PPERRHSSS

SEQ ID NO: 186509 - protein, 9 aa, Homo Sapiens
KVSKKDSQN

SEQ ID NO: 186510 - protein, 9 aa, Homo Sapiens
WVLCLHSRW

SEQ ID NO: 186511 - protein, 9 aa, Homo Sapiens
RPASTAGPP

SEQ ID NO: 186512 - protein, 9 aa, Homo Sapiens
PTGMLEFEG

SEQ ID NO: 186513 - protein, 9 aa, Homo Sapiens
RSAREAIAV

SEQ ID NO: 186514 - protein, 9 aa, Homo Sapiens
SDVDSSDFD

SEQ ID NO: 186515 - protein, 9 aa, Homo Sapiens
SPDLSPTLP

SEQ ID NO: 186516 - protein, 9 aa, Homo Sapiens
LAEGGGHAV

SEQ ID NO: 186517 - protein, 9 aa, Homo Sapiens
GMLIDGLKE

SEQ ID NO: 186518 - protein, 9 aa, Homo Sapiens
PSTAQSHQP

SEQ ID NO: 186519 - protein, 9 aa, Homo Sapiens
LLARALLEL

SEQ ID NO: 186520 - protein, 9 aa, Homo Sapiens
SMYFQCCAV

SEQ ID NO: 186521 - protein, 9 aa, Homo Sapiens
SSLRPENQV

SEQ ID NO: 186522 - protein, 9 aa, Homo Sapiens
ALPQATELG

SEQ ID NO: 186523 - protein, 9 aa, Homo Sapiens
SPSISAQNS

SEQ ID NO: 186524 - protein, 9 aa, Homo Sapiens
TVWESRNKF

SEQ ID NO: 186525 - protein, 9 aa, Homo Sapiens
PPYLHQNSH

SEQ ID NO: 186526 - protein, 9 aa, Homo Sapiens
AGGMRMSSG

SEQ ID NO: 186527 - protein, 9 aa, Homo Sapiens
TTCKSPSNT

SEQ ID NO: 186528 - protein, 9 aa, Homo Sapiens
PTVPHGASR

SEQ ID NO: 186529 - protein, 9 aa, Homo Sapiens
LRSFLLLLL

SEQ ID NO: 186530 - protein, 9 aa, Homo Sapiens
HLLEEALHV

SEQ ID NO: 186531 - protein, 9 aa, Homo Sapiens
NKSLLSLRF

SEQ ID NO: 186532 - protein, 9 aa, Homo Sapiens
VLVTVSVLG

SEQ ID NO: 186533 - protein, 9 aa, Homo Sapiens
AAGVRYPES

SEQ ID NO: 186534 - protein, 9 aa, Homo Sapiens
CNHPPRKIS

SEQ ID NO: 186535 - protein, 9 aa, Homo Sapiens
LGGFLPPVS

SEQ ID NO: 186536 - protein, 9 aa, Homo Sapiens
KNHGQTSHK

SEQ ID NO: 186537 - protein, 9 aa, Homo Sapiens
WNIYVVDGR

SEQ ID NO: 186538 - protein, 9 aa, Homo Sapiens
RQQKEKLLC

SEQ ID NO: 186539 - protein, 9 aa, Homo Sapiens
DSGRRVKSA

SEQ ID NO: 186540 - protein, 9 aa, Homo Sapiens
KLTQARNHM

SEQ ID NO: 186541 - protein, 9 aa, Homo Sapiens
YEKSLNQPN

SEQ ID NO: 186542 - protein, 9 aa, Homo Sapiens
KKAQLHFAA

SEQ ID NO: 186543 - protein, 9 aa, Homo Sapiens
RGSIYHNVE

SEQ ID NO: 186544 - protein, 9 aa, Homo Sapiens
QGKAILWLP

SEQ ID NO: 186545 - protein, 9 aa, Homo Sapiens
GYGLPFPKI

SEQ ID NO: 186546 - protein, 9 aa, Homo Sapiens
GNPALGKSI

SEQ ID NO: 186547 - protein, 9 aa, Homo Sapiens
YLDELMKKD

SEQ ID NO: 186548 - protein, 9 aa, Homo Sapiens
DQKSGGNVK

SEQ ID NO: 186549 - protein, 9 aa, Homo Sapiens
LSRKQRRPI

SEQ ID NO: 186550 - protein, 9 aa, Homo Sapiens
IAVGGKEPT

SEQ ID NO: 186551 - protein, 9 aa, Homo Sapiens
KRGINHARA

SEQ ID NO: 186552 - protein, 9 aa, Homo Sapiens
LYGTIGSPV

SEQ ID NO: 186553 - protein, 9 aa, Homo Sapiens
LEAPVQDLQ

SEQ ID NO: 186554 - protein, 9 aa, Homo Sapiens
HESQEGREV

SEQ ID NO: 186555 - protein, 9 aa, Homo Sapiens
VRCKCQWEE

SEQ ID NO: 186556 - protein, 9 aa, Homo Sapiens
LILEGEHNT

SEQ ID NO: 186557 - protein, 9 aa, Homo Sapiens
HRAAWCGKV

SEQ ID NO: 186558 - protein, 9 aa, Homo Sapiens
CVLKSKTYL

SEQ ID NO: 186559 - protein, 9 aa, Homo Sapiens
KNDCDNLEQ

SEQ ID NO: 186560 - protein, 9 aa, Homo Sapiens
KSFDMGGEP

SEQ ID NO: 186561 - protein, 9 aa, Homo Sapiens
CQPMEILTL

SEQ ID NO: 186562 - protein, 9 aa, Homo Sapiens
LRPNATYSI

SEQ ID NO: 186563 - protein, 9 aa, Homo Sapiens
PSQPQCAVC

SEQ ID NO: 186564 - protein, 9 aa, Homo Sapiens
QPNMDFMDT

SEQ ID NO: 186565 - protein, 9 aa, Homo Sapiens
SATRTPEST

SEQ ID NO: 186566 - protein, 9 aa, Homo Sapiens
VKNLDAVET

SEQ ID NO: 186567 - protein, 9 aa, Homo Sapiens
PFLCVADFR

SEQ ID NO: 186568 - protein, 9 aa, Homo Sapiens
PATPRDRLS

SEQ ID NO: 186569 - protein, 9 aa, Homo Sapiens
SFFPASAVS

SEQ ID NO: 186570 - protein, 9 aa, Homo Sapiens
GSLNPCPFP

SEQ ID NO: 186571 - protein, 9 aa, Homo Sapiens
LMDEESRKN

SEQ ID NO: 186572 - protein, 9 aa, Homo Sapiens
FGNAFLNMF

SEQ ID NO: 186573 - protein, 9 aa, Homo Sapiens
FSLRGNWWR

SEQ ID NO: 186574 - protein, 9 aa, Homo Sapiens
IVPGDNVEI

SEQ ID NO: 186575 - protein, 9 aa, Homo Sapiens
VLLLTLPCT

SEQ ID NO: 186576 - protein, 9 aa, Homo Sapiens
SSLFITEYI

SEQ ID NO: 186577 - protein, 9 aa, Homo Sapiens
VTWMKRRRR

SEQ ID NO: 186578 - protein, 9 aa, Homo Sapiens
IGRQFPQCL

SEQ ID NO: 186579 - protein, 9 aa, Homo Sapiens
FNILDLLTP

SEQ ID NO: 186580 - protein, 9 aa, Homo Sapiens
LPPASPLKR

SEQ ID NO: 186581 - protein, 9 aa, Homo Sapiens
SIKDQLGSS

SEQ ID NO: 186582 - protein, 9 aa, Homo Sapiens
ASPTTAATL

SEQ ID NO: 186583 - protein, 9 aa, Homo Sapiens
NATYSICVM

SEQ ID NO: 186584 - protein, 9 aa, Homo Sapiens
EFLSLRELG

SEQ ID NO: 186585 - protein, 9 aa, Homo Sapiens
QPTEKQQYL

SEQ ID NO: 186586 - protein, 9 aa, Homo Sapiens
AGITWFLAL

SEQ ID NO: 186587 - protein, 9 aa, Homo Sapiens
LAHQGVWPC

SEQ ID NO: 186588 - protein, 9 aa, Homo Sapiens
VKAKKTEER

SEQ ID NO: 186589 - protein, 9 aa, Homo Sapiens
QHAVINYDT

SEQ ID NO: 186590 - protein, 9 aa, Homo Sapiens
KIEEAMDRS

SEQ ID NO: 186591 - protein, 9 aa, Homo Sapiens
NCQKAMDER

SEQ ID NO: 186592 - protein, 9 aa, Homo Sapiens
SSEKNEAQR

SEQ ID NO: 186593 - protein, 9 aa, Homo Sapiens
SSENPQGHQ

SEQ ID NO: 186594 - protein, 9 aa, Homo Sapiens
IQAVLSLNA

SEQ ID NO: 186595 - protein, 9 aa, Homo Sapiens
YLAKPIFQM

SEQ ID NO: 186596 - protein, 9 aa, Homo Sapiens
RDATTRPSD

SEQ ID NO: 186597 - protein, 9 aa, Homo Sapiens
IETDFGLCV

SEQ ID NO: 186598 - protein, 9 aa, Homo Sapiens
EALDSAGHG

SEQ ID NO: 186599 - protein, 9 aa, Homo Sapiens
PRFGSMVRR

SEQ ID NO: 186600 - protein, 9 aa, Homo Sapiens
GPAPPRICP

SEQ ID NO: 186601 - protein, 9 aa, Homo Sapiens
IPPTTLNSI

SEQ ID NO: 186602 - protein, 9 aa, Homo Sapiens
PPPQRTVPR

SEQ ID NO: 186603 - protein, 9 aa, Homo Sapiens
MVRCANALG

SEQ ID NO: 186604 - protein, 9 aa, Homo Sapiens
RDISNVFQG

SEQ ID NO: 186605 - protein, 9 aa, Homo Sapiens
RSFFTSAHP

SEQ ID NO: 186606 - protein, 9 aa, Homo Sapiens
DALERYLDP

SEQ ID NO: 186607 - protein, 9 aa, Homo Sapiens
MTIIKQAPG

SEQ ID NO: 186608 - protein, 9 aa, Homo Sapiens
TSHKVLKTD

SEQ ID NO: 186609 - protein, 9 aa, Homo Sapiens
CFVVDLAVN

SEQ ID NO: 186610 - protein, 9 aa, Homo Sapiens
FLLTKVGAA

SEQ ID NO: 186611 - protein, 9 aa, Homo Sapiens
LKKMTLKAL

SEQ ID NO: 186612 - protein, 9 aa, Homo Sapiens
DGEEIAEAL

SEQ ID NO: 186613 - protein, 9 aa, Homo Sapiens
ASTAGPPTT

SEQ ID NO: 186614 - protein, 9 aa, Homo Sapiens
QSLNSDYKR

SEQ ID NO: 186615 - protein, 9 aa, Homo Sapiens
SAASPCHPV

SEQ ID NO: 186616 - protein, 9 aa, Homo Sapiens
RGVPPRAPA

SEQ ID NO: 186617 - protein, 9 aa, Homo Sapiens
MNERTIAGA

SEQ ID NO: 186618 - protein, 9 aa, Homo Sapiens
RVLLWPRWA

SEQ ID NO: 186619 - protein, 9 aa, Homo Sapiens
FHLLLLCRW

SEQ ID NO: 186620 - protein, 9 aa, Homo Sapiens
PRAEVSQRA

SEQ ID NO: 186621 - protein, 9 aa, Homo Sapiens
RRTQNAELC

SEQ ID NO: 186622 - protein, 9 aa, Homo Sapiens
QTRKVPEVT

SEQ ID NO: 186623 - protein, 9 aa, Homo Sapiens
DKQDALDVK

SEQ ID NO: 186624 - protein, 9 aa, Homo Sapiens
YLFSRVLRR

SEQ ID NO: 186625 - protein, 9 aa, Homo Sapiens
CVNYSECQE

SEQ ID NO: 186626 - protein, 9 aa, Homo Sapiens
YGGFTEAPK

SEQ ID NO: 186627 - protein, 9 aa, Homo Sapiens
AVMSGVVQT

SEQ ID NO: 186628 - protein, 9 aa, Homo Sapiens
FFTSAHPSR

SEQ ID NO: 186629 - protein, 9 aa, Homo Sapiens
VVTNHFWPQ

SEQ ID NO: 186630 - protein, 9 aa, Homo Sapiens
RSQHRYSTD

SEQ ID NO: 186631 - protein, 9 aa, Homo Sapiens
KHFLLGDAA

SEQ ID NO: 186632 - protein, 9 aa, Homo Sapiens
QGQLQAWDS

SEQ ID NO: 186633 - protein, 9 aa, Homo Sapiens
ISESDLLNP

SEQ ID NO: 186634 - protein, 9 aa, Homo Sapiens
TMGGTRKAS

SEQ ID NO: 186635 - protein, 9 aa, Homo Sapiens
QWNWLDFTV

SEQ ID NO: 186636 - protein, 9 aa, Homo Sapiens
YWKGWFGTR

SEQ ID NO: 186637 - protein, 9 aa, Homo Sapiens
QGCLPWRGC

SEQ ID NO: 186638 - protein, 9 aa, Homo Sapiens
AGRQRAHGQ

SEQ ID NO: 186639 - protein, 9 aa, Homo Sapiens
AEAPWGRVL

SEQ ID NO: 186640 - protein, 9 aa, Homo Sapiens
DTERNLRPL

SEQ ID NO: 186641 - protein, 9 aa, Homo Sapiens
QKRVDSPML

SEQ ID NO: 186642 - protein, 9 aa, Homo Sapiens
LQRCFCTRA

SEQ ID NO: 186643 - protein, 9 aa, Homo Sapiens
EWKEPRAKN

SEQ ID NO: 186644 - protein, 9 aa, Homo Sapiens
ELQGSGDNV

SEQ ID NO: 186645 - protein, 9 aa, Homo Sapiens
VHADRMRGG

SEQ ID NO: 186646 - protein, 9 aa, Homo Sapiens
LTGEIELKN

SEQ ID NO: 186647 - protein, 9 aa, Homo Sapiens
WMKRRRRNL

SEQ ID NO: 186648 - protein, 9 aa, Homo Sapiens
RAATPAPRR

SEQ ID NO: 186649 - protein, 9 aa, Homo Sapiens
KTHPCTMLL

SEQ ID NO: 186650 - protein, 9 aa, Homo Sapiens
QRRPIRQNP

SEQ ID NO: 186651 - protein, 9 aa, Homo Sapiens
IDVVLEKAT

SEQ ID NO: 186652 - protein, 9 aa, Homo Sapiens
LSHQQLGDY

SEQ ID NO: 186653 - protein, 9 aa, Homo Sapiens
LLTQCQSHC

SEQ ID NO: 186654 - protein, 9 aa, Homo Sapiens
FVPIVGFLI

SEQ ID NO: 186655 - protein, 9 aa, Homo Sapiens
EKFCLEQKV

SEQ ID NO: 186656 - protein, 9 aa, Homo Sapiens
ITMKEGWHK

SEQ ID NO: 186657 - protein, 9 aa, Homo Sapiens
SLFPSTHLT

SEQ ID NO: 186658 - protein, 9 aa, Homo Sapiens
SLPCNICKD

SEQ ID NO: 186659 - protein, 9 aa, Homo Sapiens
EPVKAKKTE

SEQ ID NO: 186660 - protein, 9 aa, Homo Sapiens
AARTGSRPC

SEQ ID NO: 186661 - protein, 9 aa, Homo Sapiens
TSRRRPSSM

SEQ ID NO: 186662 - protein, 9 aa, Homo Sapiens
TILIEHTHR

SEQ ID NO: 186663 - protein, 9 aa, Homo Sapiens
LLNPRKLHS

SEQ ID NO: 186664 - protein, 9 aa, Homo Sapiens
WRLEALRKQ

SEQ ID NO: 186665 - protein, 9 aa, Homo Sapiens
PFEGKTNTE

SEQ ID NO: 186666 - protein, 9 aa, Homo Sapiens
EEMRRLDLE

SEQ ID NO: 186667 - protein, 9 aa, Homo Sapiens
DTVSGTQGK

SEQ ID NO: 186668 - protein, 9 aa, Homo Sapiens
PPSTNAKSY

SEQ ID NO: 186669 - protein, 9 aa, Homo Sapiens
PWHQPSHHH

SEQ ID NO: 186670 - protein, 9 aa, Homo Sapiens
CNKSGFAEA

SEQ ID NO: 186671 - protein, 9 aa, Homo Sapiens
PTLLLLGGF

SEQ ID NO: 186672 - protein, 9 aa, Homo Sapiens
DCNGHIIVV

SEQ ID NO: 186673 - protein, 9 aa, Homo Sapiens
VTVYYFARC

SEQ ID NO: 186674 - protein, 9 aa, Homo Sapiens
LSSRDHKSK

SEQ ID NO: 186675 - protein, 9 aa, Homo Sapiens
VLWIIFQIL

SEQ ID NO: 186676 - protein, 9 aa, Homo Sapiens
YWAKGEKPS

SEQ ID NO: 186677 - protein, 9 aa, Homo Sapiens
DLFHIGNSG

SEQ ID NO: 186678 - protein, 9 aa, Homo Sapiens
RYSCYTCDC

SEQ ID NO: 186679 - protein, 9 aa, Homo Sapiens
NKSQQDAFL

SEQ ID NO: 186680 - protein, 9 aa, Homo Sapiens
KLHTGGKPF

SEQ ID NO: 186681 - protein, 9 aa, Homo Sapiens
GAVMMFAGF

SEQ ID NO: 186682 - protein, 9 aa, Homo Sapiens
PENILVTRG

SEQ ID NO: 186683 - protein, 9 aa, Homo Sapiens
SGSRGAAGQ

SEQ ID NO: 186684 - protein, 9 aa, Homo Sapiens
MNCKKLIQK

SEQ ID NO: 186685 - protein, 9 aa, Homo Sapiens
NSAYGALTF

SEQ ID NO: 186686 - protein, 9 aa, Homo Sapiens
GAATMKKPS

SEQ ID NO: 186687 - protein, 9 aa, Homo Sapiens
LLWAWRLHA

SEQ ID NO: 186688 - protein, 9 aa, Homo Sapiens
AERLLLQEE

SEQ ID NO: 186689 - protein, 9 aa, Homo Sapiens
RTRAGPRDT

SEQ ID NO: 186690 - protein, 9 aa, Homo Sapiens
MAVGPRPGA

SEQ ID NO: 186691 - protein, 9 aa, Homo Sapiens
HICFVVDLA

SEQ ID NO: 186692 - protein, 9 aa, Homo Sapiens
MMAEVVRWK

SEQ ID NO: 186693 - protein, 9 aa, Homo Sapiens
AGKLCRKDL

SEQ ID NO: 186694 - protein, 9 aa, Homo Sapiens
SLPFLLSLR

SEQ ID NO: 186695 - protein, 9 aa, Homo Sapiens
DYGKMAVME

SEQ ID NO: 186696 - protein, 9 aa, Homo Sapiens
WRSRWQGPC

SEQ ID NO: 186697 - protein, 9 aa, Homo Sapiens
WGLLPECRV

SEQ ID NO: 186698 - protein, 9 aa, Homo Sapiens
DKLHRAAWC

SEQ ID NO: 186699 - protein, 9 aa, Homo Sapiens
AHHYPQRSV

SEQ ID NO: 186700 - protein, 9 aa, Homo Sapiens
DALQKTPRS

SEQ ID NO: 186701 - protein, 9 aa, Homo Sapiens
AMPPREIVA

SEQ ID NO: 186702 - protein, 9 aa, Homo Sapiens
LVPENEAAV

SEQ ID NO: 186703 - protein, 9 aa, Homo Sapiens
EDYIEFANL

SEQ ID NO: 186704 - protein, 9 aa, Homo Sapiens
LPHIDGREN

SEQ ID NO: 186705 - protein, 9 aa, Homo Sapiens
SWKKSVWTL

SEQ ID NO: 186706 - protein, 9 aa, Homo Sapiens
FSSPADDNM

SEQ ID NO: 186707 - protein, 9 aa, Homo Sapiens
LKTRMHQAI

SEQ ID NO: 186708 - protein, 9 aa, Homo Sapiens
CSHFFQLKT

SEQ ID NO: 186709 - protein, 9 aa, Homo Sapiens
EKNAGCLHM

SEQ ID NO: 186710 - protein, 9 aa, Homo Sapiens
TSLSIRKLT

SEQ ID NO: 186711 - protein, 9 aa, Homo Sapiens
TAAAPGLVL

SEQ ID NO: 186712 - protein, 9 aa, Homo Sapiens
FIVHAVWVQ

SEQ ID NO: 186713 - protein, 9 aa, Homo Sapiens
EVYKKAVEL

SEQ ID NO: 186714 - protein, 9 aa, Homo Sapiens
PAMPPGHTC

SEQ ID NO: 186715 - protein, 9 aa, Homo Sapiens
LERAYGRLW

SEQ ID NO: 186716 - protein, 9 aa, Homo Sapiens
QLGPRGPES

SEQ ID NO: 186717 - protein, 9 aa, Homo Sapiens
QPLPCVQGQ

SEQ ID NO: 186718 - protein, 9 aa, Homo Sapiens
ELLNSMKHL

SEQ ID NO: 186719 - protein, 9 aa, Homo Sapiens
KNFSPMKSI

SEQ ID NO: 186720 - protein, 9 aa, Homo Sapiens
PIADVQAVD

SEQ ID NO: 186721 - protein, 9 aa, Homo Sapiens
LSPCHLAHL

SEQ ID NO: 186722 - protein, 9 aa, Homo Sapiens
REMEENFTV

SEQ ID NO: 186723 - protein, 9 aa, Homo Sapiens
ELRDSRDMW

SEQ ID NO: 186724 - protein, 9 aa, Homo Sapiens
HTCMPENQR

SEQ ID NO: 186725 - protein, 9 aa, Homo Sapiens
KGAPARMMS

SEQ ID NO: 186726 - protein, 9 aa, Homo Sapiens
ELFVLLCRL

SEQ ID NO: 186727 - protein, 9 aa, Homo Sapiens
QPQHEGPPR

SEQ ID NO: 186728 - protein, 9 aa, Homo Sapiens
DTMWDIQKD

SEQ ID NO: 186729 - protein, 9 aa, Homo Sapiens
LTVVVLQYG

SEQ ID NO: 186730 - protein, 9 aa, Homo Sapiens
ILHWSYQVM

SEQ ID NO: 186731 - protein, 9 aa, Homo Sapiens
LNSSIRAAL

SEQ ID NO: 186732 - protein, 9 aa, Homo Sapiens
DDIIMENSK

SEQ ID NO: 186733 - protein, 9 aa, Homo Sapiens
WEIRYMHFY

SEQ ID NO: 186734 - protein, 9 aa, Homo Sapiens
STNAKSYEE

SEQ ID NO: 186735 - protein, 9 aa, Homo Sapiens
PVPNSAYGA

SEQ ID NO: 186736 - protein, 9 aa, Homo Sapiens
LLPECRVRV

SEQ ID NO: 186737 - protein, 9 aa, Homo Sapiens
LPSDSALHG

SEQ ID NO: 186738 - protein, 9 aa, Homo Sapiens
HGLLALSSS

SEQ ID NO: 186739 - protein, 9 aa, Homo Sapiens
RRPTPASTL

SEQ ID NO: 186740 - protein, 9 aa, Homo Sapiens
EVVRWKLGT

SEQ ID NO: 186741 - protein, 9 aa, Homo Sapiens
IQFGKSATR

SEQ ID NO: 186742 - protein, 9 aa, Homo Sapiens
IQEKNPMGV

SEQ ID NO: 186743 - protein, 9 aa, Homo Sapiens
REDGVAIPL

SEQ ID NO: 186744 - protein, 9 aa, Homo Sapiens
MAKQTRKVP

SEQ ID NO: 186745 - protein, 9 aa, Homo Sapiens
PASPGRRPL

SEQ ID NO: 186746 - protein, 9 aa, Homo Sapiens
RHAGNKSIK

SEQ ID NO: 186747 - protein, 9 aa, Homo Sapiens
RGKWQGEEV

SEQ ID NO: 186748 - protein, 9 aa, Homo Sapiens
SLTPLCQAM

SEQ ID NO: 186749 - protein, 9 aa, Homo Sapiens
LTAVDCLQA

SEQ ID NO: 186750 - protein, 9 aa, Homo Sapiens
DATIFGDPH

SEQ ID NO: 186751 - protein, 9 aa, Homo Sapiens
SMILGNARH

SEQ ID NO: 186752 - protein, 9 aa, Homo Sapiens
EPYLGCIEI

SEQ ID NO: 186753 - protein, 9 aa, Homo Sapiens
AILEQRNMP

SEQ ID NO: 186754 - protein, 9 aa, Homo Sapiens
KLQRCFCTR

SEQ ID NO: 186755 - protein, 9 aa, Homo Sapiens
HTHTPLPFS

SEQ ID NO: 186756 - protein, 9 aa, Homo Sapiens
ILAGGNDDC

SEQ ID NO: 186757 - protein, 9 aa, Homo Sapiens
TCRPNTCNL

SEQ ID NO: 186758 - protein, 9 aa, Homo Sapiens
TGRQRLFAQ

SEQ ID NO: 186759 - protein, 9 aa, Homo Sapiens
SSMLPRRPA

SEQ ID NO: 186760 - protein, 9 aa, Homo Sapiens
LPQADVGFK

SEQ ID NO: 186761 - protein, 9 aa, Homo Sapiens
QFPQCLQSF

SEQ ID NO: 186762 - protein, 9 aa, Homo Sapiens
RQLPRCLLN

SEQ ID NO: 186763 - protein, 9 aa, Homo Sapiens
PTITCSSML

SEQ ID NO: 186764 - protein, 9 aa, Homo Sapiens
DGVADSGLA

SEQ ID NO: 186765 - protein, 9 aa, Homo Sapiens
DDFLCARQP

SEQ ID NO: 186766 - protein, 9 aa, Homo Sapiens
QQDAFLPHV

SEQ ID NO: 186767 - protein, 9 aa, Homo Sapiens
ISKNFSPMK

SEQ ID NO: 186768 - protein, 9 aa, Homo Sapiens
PGCALRRCP

SEQ ID NO: 186769 - protein, 9 aa, Homo Sapiens
FMMRQPNST

SEQ ID NO: 186770 - protein, 9 aa, Homo Sapiens
YSVHLDGLL

SEQ ID NO: 186771 - protein, 9 aa, Homo Sapiens
EAIAVVMDV

SEQ ID NO: 186772 - protein, 9 aa, Homo Sapiens
RPRWRDYKR

SEQ ID NO: 186773 - protein, 9 aa, Homo Sapiens
TITCSSMLS

SEQ ID NO: 186774 - protein, 9 aa, Homo Sapiens
QAIQKQLAT

SEQ ID NO: 186775 - protein, 9 aa, Homo Sapiens
LQQLWRGGK

SEQ ID NO: 186776 - protein, 9 aa, Homo Sapiens
AAAAIRWLW

SEQ ID NO: 186777 - protein, 9 aa, Homo Sapiens
SEEKLCQET

SEQ ID NO: 186778 - protein, 9 aa, Homo Sapiens
DVHVCSSTR

SEQ ID NO: 186779 - protein, 9 aa, Homo Sapiens
NWWRKSWGR

SEQ ID NO: 186780 - protein, 9 aa, Homo Sapiens
ATVSRAAAR

SEQ ID NO: 186781 - protein, 9 aa, Homo Sapiens
FRRPTPAST

SEQ ID NO: 186782 - protein, 9 aa, Homo Sapiens
EGKYRALEM

SEQ ID NO: 186783 - protein, 9 aa, Homo Sapiens
APGAPSLGR

SEQ ID NO: 186784 - protein, 9 aa, Homo Sapiens
MLEPFLENA

SEQ ID NO: 186785 - protein, 9 aa, Homo Sapiens
LEVPWTHLT

SEQ ID NO: 186786 - protein, 9 aa, Homo Sapiens
IRLPYFWDN

SEQ ID NO: 186787 - protein, 9 aa, Homo Sapiens
ELLKKCSLY

SEQ ID NO: 186788 - protein, 9 aa, Homo Sapiens
RDNQFESPK

SEQ ID NO: 186789 - protein, 9 aa, Homo Sapiens
VIMLKCRHM

SEQ ID NO: 186790 - protein, 9 aa, Homo Sapiens
VQEKDNGFF

SEQ ID NO: 186791 - protein, 9 aa, Homo Sapiens
HFYFLNSTF

SEQ ID NO: 186792 - protein, 9 aa, Homo Sapiens
GYCLLLVLA

SEQ ID NO: 186793 - protein, 9 aa, Homo Sapiens
SMRQHEQQV

SEQ ID NO: 186794 - protein, 9 aa, Homo Sapiens
SEWKEPRAK

SEQ ID NO: 186795 - protein, 9 aa, Homo Sapiens
GESGRCVRR

SEQ ID NO: 186796 - protein, 9 aa, Homo Sapiens
HLKPSGEQI

SEQ ID NO: 186797 - protein, 9 aa, Homo Sapiens
IRRWSTISC

SEQ ID NO: 186798 - protein, 9 aa, Homo Sapiens
NIDGRSQEG

SEQ ID NO: 186799 - protein, 9 aa, Homo Sapiens
VDGMVGMLI

SEQ ID NO: 186800 - protein, 9 aa, Homo Sapiens
GSGDNVDVL

SEQ ID NO: 186801 - protein, 9 aa, Homo Sapiens
RCPLSFGEG

SEQ ID NO: 186802 - protein, 9 aa, Homo Sapiens
REDYIEFAN

SEQ ID NO: 186803 - protein, 9 aa, Homo Sapiens
ENGPKPKND

SEQ ID NO: 186804 - protein, 9 aa, Homo Sapiens
LRKHRIIHL

SEQ ID NO: 186805 - protein, 9 aa, Homo Sapiens
LCVADFRKI

SEQ ID NO: 186806 - protein, 9 aa, Homo Sapiens
AVDNKKTHP

SEQ ID NO: 186807 - protein, 9 aa, Homo Sapiens
GKVLEDGGF

SEQ ID NO: 186808 - protein, 9 aa, Homo Sapiens
RALATKDTR

SEQ ID NO: 186809 - protein, 9 aa, Homo Sapiens
HIGNSGKEA

SEQ ID NO: 186810 - protein, 9 aa, Homo Sapiens
SVVPGFQYH

SEQ ID NO: 186811 - protein, 9 aa, Homo Sapiens
PSFVELSPC

SEQ ID NO: 186812 - protein, 9 aa, Homo Sapiens
LLVLAGMGL

SEQ ID NO: 186813 - protein, 9 aa, Homo Sapiens
GLREITKLE

SEQ ID NO: 186814 - protein, 9 aa, Homo Sapiens
TPFTCISWM

SEQ ID NO: 186815 - protein, 9 aa, Homo Sapiens
SETGKGLTL

SEQ ID NO: 186816 - protein, 9 aa, Homo Sapiens
GSGGGVGRR

SEQ ID NO: 186817 - protein, 9 aa, Homo Sapiens
RHLAEYVHG

SEQ ID NO: 186818 - protein, 9 aa, Homo Sapiens
VSVQFVQLC

SEQ ID NO: 186819 - protein, 9 aa, Homo Sapiens
ASGEVEASR

SEQ ID NO: 186820 - protein, 9 aa, Homo Sapiens
PEWTHQDSS

SEQ ID NO: 186821 - protein, 9 aa, Homo Sapiens
SWKSPLHLL

SEQ ID NO: 186822 - protein, 9 aa, Homo Sapiens
LEPPYLHQN

SEQ ID NO: 186823 - protein, 9 aa, Homo Sapiens
IIGNLLYYQ

SEQ ID NO: 186824 - protein, 9 aa, Homo Sapiens
PAPRRFLRR

SEQ ID NO: 186825 - protein, 9 aa, Homo Sapiens
AKKWTAVPL

SEQ ID NO: 186826 - protein, 9 aa, Homo Sapiens
GVLWLKGCA

SEQ ID NO: 186827 - protein, 9 aa, Homo Sapiens
PAGKESRSR

SEQ ID NO: 186828 - protein, 9 aa, Homo Sapiens
TKVGAADAP

SEQ ID NO: 186829 - protein, 9 aa, Homo Sapiens
EKLHGDSGI

SEQ ID NO: 186830 - protein, 9 aa, Homo Sapiens
LLYLRTSGE

SEQ ID NO: 186831 - protein, 9 aa, Homo Sapiens
RSETPQLFT

SEQ ID NO: 186832 - protein, 9 aa, Homo Sapiens
GGLITVRCF

SEQ ID NO: 186833 - protein, 9 aa, Homo Sapiens
GIRTSLLVR

SEQ ID NO: 186834 - protein, 9 aa, Homo Sapiens
VKETLLFYR

SEQ ID NO: 186835 - protein, 9 aa, Homo Sapiens
GIPMKKEPE

SEQ ID NO: 186836 - protein, 9 aa, Homo Sapiens
PTFRPSSIQ

SEQ ID NO: 186837 - protein, 9 aa, Homo Sapiens
WGFTKFNVD

SEQ ID NO: 186838 - protein, 9 aa, Homo Sapiens
RQKFLSRHL

SEQ ID NO: 186839 - protein, 9 aa, Homo Sapiens
EACGIRTSL

SEQ ID NO: 186840 - protein, 9 aa, Homo Sapiens
QRKFWTANR

SEQ ID NO: 186841 - protein, 9 aa, Homo Sapiens
GVPFSSKSA

SEQ ID NO: 186842 - protein, 9 aa, Homo Sapiens
KQVSPASPP

SEQ ID NO: 186843 - protein, 9 aa, Homo Sapiens
TCTTGVGRT

SEQ ID NO: 186844 - protein, 9 aa, Homo Sapiens
TSLNSSIRA

SEQ ID NO: 186845 - protein, 9 aa, Homo Sapiens
FIQKFVLFD

SEQ ID NO: 186846 - protein, 9 aa, Homo Sapiens
TENGPKPKN

SEQ ID NO: 186847 - protein, 9 aa, Homo Sapiens
AIALMTTVV

SEQ ID NO: 186848 - protein, 9 aa, Homo Sapiens
DDDDDGDDE

SEQ ID NO: 186849 - protein, 9 aa, Homo Sapiens
LPELKHVVT

SEQ ID NO: 186850 - protein, 9 aa, Homo Sapiens
GLVRESVLT

SEQ ID NO: 186851 - protein, 9 aa, Homo Sapiens
AGKLVAYKC

SEQ ID NO: 186852 - protein, 9 aa, Homo Sapiens
IKKPIYADG

SEQ ID NO: 186853 - protein, 9 aa, Homo Sapiens
RLLHFFSGF

SEQ ID NO: 186854 - protein, 9 aa, Homo Sapiens
QRLSLFPST

SEQ ID NO: 186855 - protein, 9 aa, Homo Sapiens
RWVQVPKGV

SEQ ID NO: 186856 - protein, 9 aa, Homo Sapiens
PTLPQGRAR

SEQ ID NO: 186857 - protein, 9 aa, Homo Sapiens
QNAAKEHHC

SEQ ID NO: 186858 - protein, 9 aa, Homo Sapiens
WGRQCDAHS

SEQ ID NO: 186859 - protein, 9 aa, Homo Sapiens
TVWLSLISP

SEQ ID NO: 186860 - protein, 9 aa, Homo Sapiens
LPARALQVM

SEQ ID NO: 186861 - protein, 9 aa, Homo Sapiens
GLCDQWRIG

SEQ ID NO: 186862 - protein, 9 aa, Homo Sapiens
KEALFLQEV

SEQ ID NO: 186863 - protein, 9 aa, Homo Sapiens
VGLFLTAIE

SEQ ID NO: 186864 - protein, 9 aa, Homo Sapiens
ARRGRRPAG

SEQ ID NO: 186865 - protein, 9 aa, Homo Sapiens
QASPHPEVE

SEQ ID NO: 186866 - protein, 9 aa, Homo Sapiens
GHGHICGCC

SEQ ID NO: 186867 - protein, 9 aa, Homo Sapiens
NMPTEELYG

SEQ ID NO: 186868 - protein, 9 aa, Homo Sapiens
SEQPPSMCV

SEQ ID NO: 186869 - protein, 9 aa, Homo Sapiens
KKPNIDGRS

SEQ ID NO: 186870 - protein, 9 aa, Homo Sapiens
GSLPFLLSL

SEQ ID NO: 186871 - protein, 9 aa, Homo Sapiens
ASPCSRRPR

SEQ ID NO: 186872 - protein, 9 aa, Homo Sapiens
QISPPSTNA

SEQ ID NO: 186873 - protein, 9 aa, Homo Sapiens
GVTTERLLS

SEQ ID NO: 186874 - protein, 9 aa, Homo Sapiens
PENQVLLGH

SEQ ID NO: 186875 - protein, 9 aa, Homo Sapiens
VNSVDDVIK

SEQ ID NO: 186876 - protein, 9 aa, Homo Sapiens
DVDSSDFDR

SEQ ID NO: 186877 - protein, 9 aa, Homo Sapiens
DHHPRAERG

SEQ ID NO: 186878 - protein, 9 aa, Homo Sapiens
EENFTVEAA

SEQ ID NO: 186879 - protein, 9 aa, Homo Sapiens
ASDGQPRWG

SEQ ID NO: 186880 - protein, 9 aa, Homo Sapiens
GDSIRSYGE

SEQ ID NO: 186881 - protein, 9 aa, Homo Sapiens
GSVGAEGGW

SEQ ID NO: 186882 - protein, 9 aa, Homo Sapiens
QQNCVVGAM

SEQ ID NO: 186883 - protein, 9 aa, Homo Sapiens
KMCWFRTGM

SEQ ID NO: 186884 - protein, 9 aa, Homo Sapiens
RKCVLKSKT

SEQ ID NO: 186885 - protein, 9 aa, Homo Sapiens
TRPSDFCGK

SEQ ID NO: 186886 - protein, 9 aa, Homo Sapiens
GVCGEDGQF

SEQ ID NO: 186887 - protein, 9 aa, Homo Sapiens
KIDSAIDLQ

SEQ ID NO: 186888 - protein, 9 aa, Homo Sapiens
FSGFSFFPA

SEQ ID NO: 186889 - protein, 9 aa, Homo Sapiens
ENILVTRGG

SEQ ID NO: 186890 - protein, 9 aa, Homo Sapiens
RPQDDTDSN

SEQ ID NO: 186891 - protein, 9 aa, Homo Sapiens
DEDFLEPPG

SEQ ID NO: 186892 - protein, 9 aa, Homo Sapiens
MRQHEQQVA

SEQ ID NO: 186893 - protein, 9 aa, Homo Sapiens
SGRWWWSAR

SEQ ID NO: 186894 - protein, 9 aa, Homo Sapiens
SWTTFGVGE

SEQ ID NO: 186895 - protein, 9 aa, Homo Sapiens
SPCLPVRPG

SEQ ID NO: 186896 - protein, 9 aa, Homo Sapiens
VTTERLLSW

SEQ ID NO: 186897 - protein, 9 aa, Homo Sapiens
VNHGFVVEV

SEQ ID NO: 186898 - protein, 9 aa, Homo Sapiens
PFPKILTNV

SEQ ID NO: 186899 - protein, 9 aa, Homo Sapiens
TILQKVAMD

SEQ ID NO: 186900 - protein, 9 aa, Homo Sapiens
ITWFLALVF

SEQ ID NO: 186901 - protein, 9 aa, Homo Sapiens
VRRKLHSWK

SEQ ID NO: 186902 - protein, 9 aa, Homo Sapiens
RLLSLVMNY

SEQ ID NO: 186903 - protein, 9 aa, Homo Sapiens
YHPKRSERR

SEQ ID NO: 186904 - protein, 9 aa, Homo Sapiens
QWPLSTFSP

SEQ ID NO: 186905 - protein, 9 aa, Homo Sapiens
LLFYRVPFP

SEQ ID NO: 186906 - protein, 9 aa, Homo Sapiens
VYYFARCQG

SEQ ID NO: 186907 - protein, 9 aa, Homo Sapiens
EKQYYSNSF

SEQ ID NO: 186908 - protein, 9 aa, Homo Sapiens
ISLPRHRRL

SEQ ID NO: 186909 - protein, 9 aa, Homo Sapiens
HFFQLKTSL

SEQ ID NO: 186910 - protein, 9 aa, Homo Sapiens
EEKSGIGAG

SEQ ID NO: 186911 - protein, 9 aa, Homo Sapiens
QSVVVGSGQ

SEQ ID NO: 186912 - protein, 9 aa, Homo Sapiens
CWTVRGSCG

SEQ ID NO: 186913 - protein, 9 aa, Homo Sapiens
LRIHCVAKD

SEQ ID NO: 186914 - protein, 9 aa, Homo Sapiens
RDLNKGAPA

SEQ ID NO: 186915 - protein, 9 aa, Homo Sapiens
KNFLSKTVR

SEQ ID NO: 186916 - protein, 9 aa, Homo Sapiens
AEKLMHICT

SEQ ID NO: 186917 - protein, 9 aa, Homo Sapiens
PPGHTCMPE

SEQ ID NO: 186918 - protein, 9 aa, Homo Sapiens
SQQDAFLPH

SEQ ID NO: 186919 - protein, 9 aa, Homo Sapiens
SKSSDDGFP

SEQ ID NO: 186920 - protein, 9 aa, Homo Sapiens
GRKGSVRKQ

SEQ ID NO: 186921 - protein, 9 aa, Homo Sapiens
KIQSGTAYL

SEQ ID NO: 186922 - protein, 9 aa, Homo Sapiens
PTNKIDAAL

SEQ ID NO: 186923 - protein, 9 aa, Homo Sapiens
RYGVQTLDM

SEQ ID NO: 186924 - protein, 8 aa, Homo Sapiens
GKEIQLKP

SEQ ID NO: 186925 - protein, 9 aa, Homo Sapiens
SRNLSEPQA

SEQ ID NO: 186926 - protein, 9 aa, Homo Sapiens
PRGLQHRQG

SEQ ID NO: 186927 - protein, 9 aa, Homo Sapiens
GPCRHAGSS

SEQ ID NO: 186928 - protein, 9 aa, Homo Sapiens
TNRAPSSCW

SEQ ID NO: 186929 - protein, 9 aa, Homo Sapiens
KIIGYVLLR

SEQ ID NO: 186930 - protein, 9 aa, Homo Sapiens
EDLPQAVID

SEQ ID NO: 186931 - protein, 9 aa, Homo Sapiens
QQMIGQVDG

SEQ ID NO: 186932 - protein, 9 aa, Homo Sapiens
TAVDCLQAF

SEQ ID NO: 186933 - protein, 9 aa, Homo Sapiens
PSRRRTQTA

SEQ ID NO: 186934 - protein, 9 aa, Homo Sapiens
RISPRSNTI

SEQ ID NO: 186935 - protein, 9 aa, Homo Sapiens
GKSYKITST

SEQ ID NO: 186936 - protein, 9 aa, Homo Sapiens
LQGSGDNVD

SEQ ID NO: 186937 - protein, 9 aa, Homo Sapiens
KPNIDGRSQ

SEQ ID NO: 186938 - protein, 9 aa, Homo Sapiens
LQSVKKRCS

SEQ ID NO: 186939 - protein, 9 aa, Homo Sapiens
PLPSFVELS

SEQ ID NO: 186940 - protein, 9 aa, Homo Sapiens
SLSQEAVAI

SEQ ID NO: 186941 - protein, 9 aa, Homo Sapiens
GSTRCPAAE

SEQ ID NO: 186942 - protein, 9 aa, Homo Sapiens
KEGADTVSG

SEQ ID NO: 186943 - protein, 9 aa, Homo Sapiens
AGAEAPWGR

SEQ ID NO: 186944 - protein, 9 aa, Homo Sapiens
CGTSQTYFG

SEQ ID NO: 186945 - protein, 9 aa, Homo Sapiens
PAPQKISTW

SEQ ID NO: 186946 - protein, 9 aa, Homo Sapiens
ICFLKMESK

SEQ ID NO: 186947 - protein, 9 aa, Homo Sapiens
PQPPQRPPL

SEQ ID NO: 186948 - protein, 9 aa, Homo Sapiens
LAYTTAWSP

SEQ ID NO: 186949 - protein, 9 aa, Homo Sapiens
KCQWEEQHR

SEQ ID NO: 186950 - protein, 9 aa, Homo Sapiens
EPIKDDLML

SEQ ID NO: 186951 - protein, 9 aa, Homo Sapiens
VMSGVVQTI

SEQ ID NO: 186952 - protein, 9 aa, Homo Sapiens
AHVPDAVWY

SEQ ID NO: 186953 - protein, 9 aa, Homo Sapiens
SRIVWMPRM

SEQ ID NO: 186954 - protein, 9 aa, Homo Sapiens
LQRNLLRLQ

SEQ ID NO: 186955 - protein, 9 aa, Homo Sapiens
PTLPWTLRK

SEQ ID NO: 186956 - protein, 9 aa, Homo Sapiens
MGARAVAHL

SEQ ID NO: 186957 - protein, 9 aa, Homo Sapiens
LLLHRVLQG

SEQ ID NO: 186958 - protein, 9 aa, Homo Sapiens
RKEGLSVNM

SEQ ID NO: 186959 - protein, 9 aa, Homo Sapiens
ALVDIDCFF

SEQ ID NO: 186960 - protein, 9 aa, Homo Sapiens
ASTLARLER

SEQ ID NO: 186961 - protein, 9 aa, Homo Sapiens
KTHCGFLTD

SEQ ID NO: 186962 - protein, 9 aa, Homo Sapiens
FFLEDELDI

SEQ ID NO: 186963 - protein, 9 aa, Homo Sapiens
SHCQNKGER

SEQ ID NO: 186964 - protein, 9 aa, Homo Sapiens
AWLSPTADY

SEQ ID NO: 186965 - protein, 9 aa, Homo Sapiens
EGVKKAAEY

SEQ ID NO: 186966 - protein, 9 aa, Homo Sapiens
HGHICGCCG

SEQ ID NO: 186967 - protein, 9 aa, Homo Sapiens
SMKHLFGIQ

SEQ ID NO: 186968 - protein, 9 aa, Homo Sapiens
EAADQGQGP

SEQ ID NO: 186969 - protein, 9 aa, Homo Sapiens
VRESVLTAL

SEQ ID NO: 186970 - protein, 9 aa, Homo Sapiens
KCKSSENNG

SEQ ID NO: 186971 - protein, 9 aa, Homo Sapiens
IGESQALML

SEQ ID NO: 186972 - protein, 9 aa, Homo Sapiens
KTPHVSPQM

SEQ ID NO: 186973 - protein, 9 aa, Homo Sapiens
PSQNVCLHQ

SEQ ID NO: 186974 - protein, 9 aa, Homo Sapiens
RVADYYFLH

SEQ ID NO: 186975 - protein, 9 aa, Homo Sapiens
PFLTANDNL

SEQ ID NO: 186976 - protein, 9 aa, Homo Sapiens
TTQPGSSFT

SEQ ID NO: 186977 - protein, 9 aa, Homo Sapiens
VEIITEVPP

SEQ ID NO: 186978 - protein, 9 aa, Homo Sapiens
PACTRWKQR

SEQ ID NO: 186979 - protein, 9 aa, Homo Sapiens
LVPCVLFVL

SEQ ID NO: 186980 - protein, 9 aa, Homo Sapiens
HTAAAPGLV

SEQ ID NO: 186981 - protein, 9 aa, Homo Sapiens
PFSSKSAEV

SEQ ID NO: 186982 - protein, 9 aa, Homo Sapiens
GNSHFTYSV

SEQ ID NO: 186983 - protein, 9 aa, Homo Sapiens
RWQGPCRHA

SEQ ID NO: 186984 - protein, 9 aa, Homo Sapiens
SECGFCLHQ

SEQ ID NO: 186985 - protein, 9 aa, Homo Sapiens
HQASPHPEV

SEQ ID NO: 186986 - protein, 9 aa, Homo Sapiens
ARTPGPCVT

SEQ ID NO: 186987 - protein, 9 aa, Homo Sapiens
SGSMRQHEQ

SEQ ID NO: 186988 - protein, 9 aa, Homo Sapiens
CPYCDYAGT

SEQ ID NO: 186989 - protein, 9 aa, Homo Sapiens
AGFLGCYGA

SEQ ID NO: 186990 - protein, 9 aa, Homo Sapiens
GAGTIFTID

SEQ ID NO: 186991 - protein, 9 aa, Homo Sapiens
IIVLSILVC

SEQ ID NO: 186992 - protein, 9 aa, Homo Sapiens
LLHHWLFVS

SEQ ID NO: 186993 - protein, 9 aa, Homo Sapiens
PNHTLFLDS

SEQ ID NO: 186994 - protein, 9 aa, Homo Sapiens
LPEMENQIA

SEQ ID NO: 186995 - protein, 9 aa, Homo Sapiens
EEALHVFPW

SEQ ID NO: 186996 - protein, 9 aa, Homo Sapiens
PRVHVPWRT

SEQ ID NO: 186997 - protein, 9 aa, Homo Sapiens
ERAMQRLQA

SEQ ID NO: 186998 - protein, 9 aa, Homo Sapiens
TRATTHNAY

SEQ ID NO: 186999 - protein, 9 aa, Homo Sapiens
HFPSPLPDD

SEQ ID NO: 187000 - protein, 9 aa, Homo Sapiens
SFDAHPRWE

SEQ ID NO: 187001 - protein, 9 aa, Homo Sapiens
GIEEKSGIG

SEQ ID NO: 187002 - protein, 9 aa, Homo Sapiens
EPTEQVVEI

SEQ ID NO: 187003 - protein, 9 aa, Homo Sapiens
ARTASEQPP

SEQ ID NO: 187004 - protein, 9 aa, Homo Sapiens
SPVVHEGVE

SEQ ID NO: 187005 - protein, 9 aa, Homo Sapiens
HNKKEGNLI

SEQ ID NO: 187006 - protein, 9 aa, Homo Sapiens
SRDMWDSRE

SEQ ID NO: 187007 - protein, 9 aa, Homo Sapiens
NQFESPKRG

SEQ ID NO: 187008 - protein, 9 aa, Homo Sapiens
KPENQVLGQ

SEQ ID NO: 187009 - protein, 9 aa, Homo Sapiens
PPPTKKRGK

SEQ ID NO: 187010 - protein, 9 aa, Homo Sapiens
CLAALDMTG

SEQ ID NO: 187011 - protein, 9 aa, Homo Sapiens
LPQAVIDDA

SEQ ID NO: 187012 - protein, 9 aa, Homo Sapiens
PASPSRRRT

SEQ ID NO: 187013 - protein, 9 aa, Homo Sapiens
KQRRPIRQN

SEQ ID NO: 187014 - protein, 9 aa, Homo Sapiens
LLLLGGFLP

SEQ ID NO: 187015 - protein, 9 aa, Homo Sapiens
RAVAHLLAQ

SEQ ID NO: 187016 - protein, 9 aa, Homo Sapiens
RVMLSPCHL

SEQ ID NO: 187017 - protein, 9 aa, Homo Sapiens
AAVQDGLRT

SEQ ID NO: 187018 - protein, 9 aa, Homo Sapiens
LITVRCFFF

SEQ ID NO: 187019 - protein, 9 aa, Homo Sapiens
HLIEQSSNS

SEQ ID NO: 187020 - protein, 9 aa, Homo Sapiens
GDHMKNGPT

SEQ ID NO: 187021 - protein, 9 aa, Homo Sapiens
PVQGQQVHR

SEQ ID NO: 187022 - protein, 9 aa, Homo Sapiens
KLKQFEERS

SEQ ID NO: 187023 - protein, 9 aa, Homo Sapiens
KAELKKVVQ

SEQ ID NO: 187024 - protein, 9 aa, Homo Sapiens
GYGTQRECC

SEQ ID NO: 187025 - protein, 9 aa, Homo Sapiens
LLLVLAGMG

SEQ ID NO: 187026 - protein, 9 aa, Homo Sapiens
PIEKNAGCL

SEQ ID NO: 187027 - protein, 9 aa, Homo Sapiens
MDFMDTFEP

SEQ ID NO: 187028 - protein, 9 aa, Homo Sapiens
KDTYNKKWK

SEQ ID NO: 187029 - protein, 9 aa, Homo Sapiens
EQSSNSQRN

SEQ ID NO: 187030 - protein, 9 aa, Homo Sapiens
IVGTMDSSF

SEQ ID NO: 187031 - protein, 9 aa, Homo Sapiens
TDSNRASLP

SEQ ID NO: 187032 - protein, 9 aa, Homo Sapiens
KSARSSVPW

SEQ ID NO: 187033 - protein, 9 aa, Homo Sapiens
VAPGRVMLS

SEQ ID NO: 187034 - protein, 9 aa, Homo Sapiens
RCSGRAPPP

SEQ ID NO: 187035 - protein, 9 aa, Homo Sapiens
AAGERAMQR

SEQ ID NO: 187036 - protein, 9 aa, Homo Sapiens
TAVPLQHMC

SEQ ID NO: 187037 - protein, 9 aa, Homo Sapiens
TLNSIDSDG

SEQ ID NO: 187038 - protein, 9 aa, Homo Sapiens
RISSVKFNP

SEQ ID NO: 187039 - protein, 9 aa, Homo Sapiens
HLVNSVDDV

SEQ ID NO: 187040 - protein, 9 aa, Homo Sapiens
RGQKERRNQ

SEQ ID NO: 187041 - protein, 9 aa, Homo Sapiens
RPSDFCGKL

SEQ ID NO: 187042 - protein, 9 aa, Homo Sapiens
KQTRKVPEV

SEQ ID NO: 187043 - protein, 9 aa, Homo Sapiens
SVNLFSHGT

SEQ ID NO: 187044 - protein, 9 aa, Homo Sapiens
THCGFLTDA

SEQ ID NO: 187045 - protein, 9 aa, Homo Sapiens
PRATKHALP

SEQ ID NO: 187046 - protein, 9 aa, Homo Sapiens
EEALKKQRE

SEQ ID NO: 187047 - protein, 9 aa, Homo Sapiens
SPASGSSKL

SEQ ID NO: 187048 - protein, 9 aa, Homo Sapiens
SLLSLYSVA

SEQ ID NO: 187049 - protein, 9 aa, Homo Sapiens
VQDLQLLAR

SEQ ID NO: 187050 - protein, 9 aa, Homo Sapiens
KAKKTEERR

SEQ ID NO: 187051 - protein, 9 aa, Homo Sapiens
ASTKTWQWK

SEQ ID NO: 187052 - protein, 9 aa, Homo Sapiens
VCSAPSSSS

SEQ ID NO: 187053 - protein, 9 aa, Homo Sapiens
WRGSTRTTA

SEQ ID NO: 187054 - protein, 9 aa, Homo Sapiens
VLGASHIHF

SEQ ID NO: 187055 - protein, 9 aa, Homo Sapiens
QAPMFTQPL

SEQ ID NO: 187056 - protein, 9 aa, Homo Sapiens
LWLAALPQA

SEQ ID NO: 187057 - protein, 9 aa, Homo Sapiens
HCGFLTDAT

SEQ ID NO: 187058 - protein, 9 aa, Homo Sapiens
FLLISGKLL

SEQ ID NO: 187059 - protein, 9 aa, Homo Sapiens
RVRCARRGR

SEQ ID NO: 187060 - protein, 9 aa, Homo Sapiens
LGSHLGRRS

SEQ ID NO: 187061 - protein, 9 aa, Homo Sapiens
MHGELLEAP

SEQ ID NO: 187062 - protein, 9 aa, Homo Sapiens
AASLLFSIR

SEQ ID NO: 187063 - protein, 9 aa, Homo Sapiens
YLQLHNKKE

SEQ ID NO: 187064 - protein, 9 aa, Homo Sapiens
LQLLAREFG

SEQ ID NO: 187065 - protein, 9 aa, Homo Sapiens
ALCMQLSSH

SEQ ID NO: 187066 - protein, 9 aa, Homo Sapiens
GMRVQEYGS

SEQ ID NO: 187067 - protein, 9 aa, Homo Sapiens
QGQVAEDHV

SEQ ID NO: 187068 - protein, 9 aa, Homo Sapiens
KQLATIQIL

SEQ ID NO: 187069 - protein, 9 aa, Homo Sapiens
TKRYSTVCW

SEQ ID NO: 187070 - protein, 9 aa, Homo Sapiens
LQGCVQVTF

SEQ ID NO: 187071 - protein, 9 aa, Homo Sapiens
PSVGNQTSF

SEQ ID NO: 187072 - protein, 9 aa, Homo Sapiens
ALRRCPLSF

SEQ ID NO: 187073 - protein, 9 aa, Homo Sapiens
SSSTSRDSR

SEQ ID NO: 187074 - protein, 9 aa, Homo Sapiens
VSVSQTSPN

SEQ ID NO: 187075 - protein, 9 aa, Homo Sapiens
VESNFPKKN

SEQ ID NO: 187076 - protein, 9 aa, Homo Sapiens
QQPQTPQDS

SEQ ID NO: 187077 - protein, 9 aa, Homo Sapiens
PSPFPSTPL

SEQ ID NO: 187078 - protein, 9 aa, Homo Sapiens
SLRGNWWRK

SEQ ID NO: 187079 - protein, 9 aa, Homo Sapiens
KVIQVEGPI

SEQ ID NO: 187080 - protein, 9 aa, Homo Sapiens
HLYYSFKNI

SEQ ID NO: 187081 - protein, 9 aa, Homo Sapiens
ASLCARVQA

SEQ ID NO: 187082 - protein, 9 aa, Homo Sapiens
KSLRMQNAA

SEQ ID NO: 187083 - protein, 9 aa, Homo Sapiens
NYIPSLKEP

SEQ ID NO: 187084 - protein, 9 aa, Homo Sapiens
FRNHLCQAT

SEQ ID NO: 187085 - protein, 9 aa, Homo Sapiens
LLQVFFIHM

SEQ ID NO: 187086 - protein, 9 aa, Homo Sapiens
SMAPEELTE

SEQ ID NO: 187087 - protein, 9 aa, Homo Sapiens
AFVQRLSLS

SEQ ID NO: 187088 - protein, 9 aa, Homo Sapiens
AAMVTVVAY

SEQ ID NO: 187089 - protein, 9 aa, Homo Sapiens
PRDGKRVVL

SEQ ID NO: 187090 - protein, 9 aa, Homo Sapiens
SVNEHTEEV

SEQ ID NO: 187091 - protein, 9 aa, Homo Sapiens
DLDETINIV

SEQ ID NO: 187092 - protein, 9 aa, Homo Sapiens
RAPSKPPPS

SEQ ID NO: 187093 - protein, 9 aa, Homo Sapiens
DAPATQGGV

SEQ ID NO: 187094 - protein, 9 aa, Homo Sapiens
CKEAINVLS

SEQ ID NO: 187095 - protein, 9 aa, Homo Sapiens
IENGSGMCK

SEQ ID NO: 187096 - protein, 9 aa, Homo Sapiens
ASFIIRLAL

SEQ ID NO: 187097 - protein, 9 aa, Homo Sapiens
ATLLNDIRK

SEQ ID NO: 187098 - protein, 9 aa, Homo Sapiens
SKFWSLQQP

SEQ ID NO: 187099 - protein, 9 aa, Homo Sapiens
VYHYYLTIF

SEQ ID NO: 187100 - protein, 9 aa, Homo Sapiens
VELQQPALA

SEQ ID NO: 187101 - protein, 9 aa, Homo Sapiens
ARLCICAIT

SEQ ID NO: 187102 - protein, 9 aa, Homo Sapiens
LCICAITIS

SEQ ID NO: 187103 - protein, 9 aa, Homo Sapiens
PQSASVSAL

SEQ ID NO: 187104 - protein, 9 aa, Homo Sapiens
DETINIVEA

SEQ ID NO: 187105 - protein, 9 aa, Homo Sapiens
LGTSQTSVT

SEQ ID NO: 187106 - protein, 9 aa, Homo Sapiens
REVHTSNNQ

SEQ ID NO: 187107 - protein, 9 aa, Homo Sapiens
RCPRAPSKP

SEQ ID NO: 187108 - protein, 9 aa, Homo Sapiens
WRPSLQAIR

SEQ ID NO: 187109 - protein, 9 aa, Homo Sapiens
YSNIVFLHN

SEQ ID NO: 187110 - protein, 9 aa, Homo Sapiens
TAGYLLKCS

SEQ ID NO: 187111 - protein, 9 aa, Homo Sapiens
KGAAMVTVV

SEQ ID NO: 187112 - protein, 9 aa, Homo Sapiens
LTISPSGAF

SEQ ID NO: 187113 - protein, 9 aa, Homo Sapiens
GSETITAST

SEQ ID NO: 187114 - protein, 9 aa, Homo Sapiens
VAKSTYQHH

SEQ ID NO: 187115 - protein, 9 aa, Homo Sapiens
RWQLRATGR

SEQ ID NO: 187116 - protein, 9 aa, Homo Sapiens
ETINIVEAN

SEQ ID NO: 187117 - protein, 9 aa, Homo Sapiens
QHWWIRLHT

SEQ ID NO: 187118 - protein, 9 aa, Homo Sapiens
SVIGSSKQE

SEQ ID NO: 187119 - protein, 9 aa, Homo Sapiens
HFTQDFWPY

SEQ ID NO: 187120 - protein, 9 aa, Homo Sapiens
LRIVIKKIG

SEQ ID NO: 187121 - protein, 9 aa, Homo Sapiens
QLWSNINLE

SEQ ID NO: 187122 - protein, 9 aa, Homo Sapiens
SDFLIGQYL

SEQ ID NO: 187123 - protein, 9 aa, Homo Sapiens
TELGTGVWE

SEQ ID NO: 187124 - protein, 9 aa, Homo Sapiens
NGKWHYKPQ

SEQ ID NO: 187125 - protein, 9 aa, Homo Sapiens
SRLEERLKA

SEQ ID NO: 187126 - protein, 9 aa, Homo Sapiens
GGRVPQSAS

SEQ ID NO: 187127 - protein, 9 aa, Homo Sapiens
FSRELTCRA

SEQ ID NO: 187128 - protein, 9 aa, Homo Sapiens
NCRVAKSTY

SEQ ID NO: 187129 - protein, 9 aa, Homo Sapiens
HGAEKSDAV

SEQ ID NO: 187130 - protein, 9 aa, Homo Sapiens
LSTALRGDV

SEQ ID NO: 187131 - protein, 9 aa, Homo Sapiens
CPRAPSKPP

SEQ ID NO: 187132 - protein, 9 aa, Homo Sapiens
EELTELGTG

SEQ ID NO: 187133 - protein, 9 aa, Homo Sapiens
GYLLKCSGH

SEQ ID NO: 187134 - protein, 9 aa, Homo Sapiens
AVLVIENGS

SEQ ID NO: 187135 - protein, 9 aa, Homo Sapiens
LCNSSDHFK

SEQ ID NO: 187136 - protein, 9 aa, Homo Sapiens
PPGLLNETE

SEQ ID NO: 187137 - protein, 9 aa, Homo Sapiens
TPRAPGPLV

SEQ ID NO: 187138 - protein, 9 aa, Homo Sapiens
GGAQKPAHA

SEQ ID NO: 187139 - protein, 9 aa, Homo Sapiens
SRNSLSRAP

SEQ ID NO: 187140 - protein, 9 aa, Homo Sapiens
HDPSGMFRT

SEQ ID NO: 187141 - protein, 9 aa, Homo Sapiens
RLCICAITI

SEQ ID NO: 187142 - protein, 9 aa, Homo Sapiens
KILVVKENC

SEQ ID NO: 187143 - protein, 9 aa, Homo Sapiens
LGEGCYATV

SEQ ID NO: 187144 - protein, 9 aa, Homo Sapiens
EILSDDYSN

SEQ ID NO: 187145 - protein, 9 aa, Homo Sapiens
EQRRIQEQL

SEQ ID NO: 187146 - protein, 9 aa, Homo Sapiens
EACVELQQP

SEQ ID NO: 187147 - protein, 9 aa, Homo Sapiens
ACVELQQPA

SEQ ID NO: 187148 - protein, 9 aa, Homo Sapiens
ANTPLGPVE

SEQ ID NO: 187149 - protein, 9 aa, Homo Sapiens
EAINVLSHL

SEQ ID NO: 187150 - protein, 9 aa, Homo Sapiens
RKEQRRIQE

SEQ ID NO: 187151 - protein, 9 aa, Homo Sapiens
TASKDRKLK

SEQ ID NO: 187152 - protein, 9 aa, Homo Sapiens
HSQNVLSTA

SEQ ID NO: 187153 - protein, 9 aa, Homo Sapiens
FLLHKDHLD

SEQ ID NO: 187154 - protein, 9 aa, Homo Sapiens
MSSYRRKAK

SEQ ID NO: 187155 - protein, 9 aa, Homo Sapiens
FGICVAWES

SEQ ID NO: 187156 - protein, 9 aa, Homo Sapiens
ESRSIAMQW

SEQ ID NO: 187157 - protein, 9 aa, Homo Sapiens
VVAYRLAEQ

SEQ ID NO: 187158 - protein, 9 aa, Homo Sapiens
PATTLPVNN

SEQ ID NO: 187159 - protein, 9 aa, Homo Sapiens
VSARLCICA

SEQ ID NO: 187160 - protein, 9 aa, Homo Sapiens
LSNYVLELG

SEQ ID NO: 187161 - protein, 9 aa, Homo Sapiens
YNCKEAINV

SEQ ID NO: 187162 - protein, 9 aa, Homo Sapiens
QTEASASSL

SEQ ID NO: 187163 - protein, 9 aa, Homo Sapiens
WPHPCPGPP

SEQ ID NO: 187164 - protein, 9 aa, Homo Sapiens
LFRGAVYHY

SEQ ID NO: 187165 - protein, 9 aa, Homo Sapiens
LRLCISSAD

SEQ ID NO: 187166 - protein, 9 aa, Homo Sapiens
NQICVNNVK

SEQ ID NO: 187167 - protein, 9 aa, Homo Sapiens
NAFVQRLSL

SEQ ID NO: 187168 - protein, 9 aa, Homo Sapiens
ILKHPFNRK

SEQ ID NO: 187169 - protein, 9 aa, Homo Sapiens
LLCNSSDHF

SEQ ID NO: 187170 - protein, 9 aa, Homo Sapiens
KGKTASKDR

SEQ ID NO: 187171 - protein, 9 aa, Homo Sapiens
HLCQATVFR

SEQ ID NO: 187172 - protein, 9 aa, Homo Sapiens
MPEKCLSEL

SEQ ID NO: 187173 - protein, 9 aa, Homo Sapiens
GKGAAMVTV

SEQ ID NO: 187174 - protein, 9 aa, Homo Sapiens
CCVQYDGRR

SEQ ID NO: 187175 - protein, 9 aa, Homo Sapiens
SLSRAPSLK

SEQ ID NO: 187176 - protein, 9 aa, Homo Sapiens
SNINLEKPT

SEQ ID NO: 187177 - protein, 9 aa, Homo Sapiens
TAVLVIENG

SEQ ID NO: 187178 - protein, 9 aa, Homo Sapiens
VGVFYVVPM

SEQ ID NO: 187179 - protein, 9 aa, Homo Sapiens
RELTCRAAS

SEQ ID NO: 187180 - protein, 9 aa, Homo Sapiens
AAVCCVQYD

SEQ ID NO: 187181 - protein, 9 aa, Homo Sapiens
GPPGIAGFP

SEQ ID NO: 187182 - protein, 9 aa, Homo Sapiens
LEDLDETIN

SEQ ID NO: 187183 - protein, 9 aa, Homo Sapiens
PFLSLGTSQ

SEQ ID NO: 187184 - protein, 9 aa, Homo Sapiens
LNFLEAEAA

SEQ ID NO: 187185 - protein, 9 aa, Homo Sapiens
EDLDETINI

SEQ ID NO: 187186 - protein, 9 aa, Homo Sapiens
ELGQEATLT

SEQ ID NO: 187187 - protein, 9 aa, Homo Sapiens
LMGHVAAVC

SEQ ID NO: 187188 - protein, 9 aa, Homo Sapiens
CVQEITAHC

SEQ ID NO: 187189 - protein, 9 aa, Homo Sapiens
NRSKFWSLQ

SEQ ID NO: 187190 - protein, 9 aa, Homo Sapiens
GGSGGRVPQ

SEQ ID NO: 187191 - protein, 9 aa, Homo Sapiens
FLEAEAACE

SEQ ID NO: 187192 - protein, 9 aa, Homo Sapiens
KHPFNRKST

SEQ ID NO: 187193 - protein, 9 aa, Homo Sapiens
PIYLMDVGV

SEQ ID NO: 187194 - protein, 9 aa, Homo Sapiens
SSRNSLSRA

SEQ ID NO: 187195 - protein, 9 aa, Homo Sapiens
HTSTPVTNS

SEQ ID NO: 187196 - protein, 9 aa, Homo Sapiens
MAPEELTEL

SEQ ID NO: 187197 - protein, 9 aa, Homo Sapiens
GQEATLTIS

SEQ ID NO: 187198 - protein, 9 aa, Homo Sapiens
SRSIAMQWN

SEQ ID NO: 187199 - protein, 9 aa, Homo Sapiens
PMYFLLSNV

SEQ ID NO: 187200 - protein, 9 aa, Homo Sapiens
SDDYSNIVF

SEQ ID NO: 187201 - protein, 9 aa, Homo Sapiens
SRTSPRCPR

SEQ ID NO: 187202 - protein, 9 aa, Homo Sapiens
SYRRKAKGR

SEQ ID NO: 187203 - protein, 9 aa, Homo Sapiens
LEAEAACEA

SEQ ID NO: 187204 - protein, 9 aa, Homo Sapiens
QLIDEFLDR

SEQ ID NO: 187205 - protein, 9 aa, Homo Sapiens
QLNEKLEQV

SEQ ID NO: 187206 - protein, 9 aa, Homo Sapiens
ISSADGAGP

SEQ ID NO: 187207 - protein, 9 aa, Homo Sapiens
AEKSDAVCS

SEQ ID NO: 187208 - protein, 9 aa, Homo Sapiens
QTTHTLQEM

SEQ ID NO: 187209 - protein, 9 aa, Homo Sapiens
SGGRVPQSA

SEQ ID NO: 187210 - protein, 9 aa, Homo Sapiens
ACIAHRIQE

SEQ ID NO: 187211 - protein, 9 aa, Homo Sapiens
SFSMINESI

SEQ ID NO: 187212 - protein, 9 aa, Homo Sapiens
GGCLLQVFF

SEQ ID NO: 187213 - protein, 9 aa, Homo Sapiens
IVIKKIGKR

SEQ ID NO: 187214 - protein, 9 aa, Homo Sapiens
KDHLDVSPT

SEQ ID NO: 187215 - protein, 9 aa, Homo Sapiens
AGQKVLASF

SEQ ID NO: 187216 - protein, 9 aa, Homo Sapiens
PRAPGPLVF

SEQ ID NO: 187217 - protein, 9 aa, Homo Sapiens
SDLLYNDLY

SEQ ID NO: 187218 - protein, 9 aa, Homo Sapiens
NDMEDYDAD

SEQ ID NO: 187219 - protein, 9 aa, Homo Sapiens
HIEECVRWQ

SEQ ID NO: 187220 - protein, 9 aa, Homo Sapiens
ENKLTEMPE

SEQ ID NO: 187221 - protein, 9 aa, Homo Sapiens
VPQSASVSA

SEQ ID NO: 187222 - protein, 9 aa, Homo Sapiens
PDAPATQGG

SEQ ID NO: 187223 - protein, 9 aa, Homo Sapiens
LLLALRAVI

SEQ ID NO: 187224 - protein, 9 aa, Homo Sapiens
VINYHQHVY

SEQ ID NO: 187225 - protein, 9 aa, Homo Sapiens
PNPNQICVN

SEQ ID NO: 187226 - protein, 9 aa, Homo Sapiens
PNQICVNNV

SEQ ID NO: 187227 - protein, 9 aa, Homo Sapiens
KPPPSLSAS

SEQ ID NO: 187228 - protein, 9 aa, Homo Sapiens
SKKILVVKE

SEQ ID NO: 187229 - protein, 9 aa, Homo Sapiens
VGILTLSNY

SEQ ID NO: 187230 - protein, 9 aa, Homo Sapiens
FRGAVYHYY

SEQ ID NO: 187231 - protein, 9 aa, Homo Sapiens
LLHKDHLDV

SEQ ID NO: 187232 - protein, 9 aa, Homo Sapiens
RVEHHGAEK

SEQ ID NO: 187233 - protein, 9 aa, Homo Sapiens
FLVINYHQH

SEQ ID NO: 187234 - protein, 9 aa, Homo Sapiens
NYVLELGHP

SEQ ID NO: 187235 - protein, 9 aa, Homo Sapiens
RVAKSTYQH

SEQ ID NO: 187236 - protein, 9 aa, Homo Sapiens
MRKEQRRIQ

SEQ ID NO: 187237 - protein, 9 aa, Homo Sapiens
CICAITISQ

SEQ ID NO: 187238 - protein, 9 aa, Homo Sapiens
SHLWRFCLQ

SEQ ID NO: 187239 - protein, 9 aa, Homo Sapiens
RLCISSADG

SEQ ID NO: 187240 - protein, 9 aa, Homo Sapiens
VESLLCLAC

SEQ ID NO: 187241 - protein, 9 aa, Homo Sapiens
QAGELVFLP

SEQ ID NO: 187242 - protein, 9 aa, Homo Sapiens
LHSQNVLST

SEQ ID NO: 187243 - protein, 9 aa, Homo Sapiens
ILVVKENCS

SEQ ID NO: 187244 - protein, 9 aa, Homo Sapiens
FWPYQSIKD

SEQ ID NO: 187245 - protein, 9 aa, Homo Sapiens
LSGTWPHPC

SEQ ID NO: 187246 - protein, 9 aa, Homo Sapiens
VLGREVHTS

SEQ ID NO: 187247 - protein, 9 aa, Homo Sapiens
PATQGGVES

SEQ ID NO: 187248 - protein, 8 aa, Homo Sapiens
IAEPAHFY

SEQ ID NO: 187249 - protein, 9 aa, Homo Sapiens
RAASRTSPR

SEQ ID NO: 187250 - protein, 9 aa, Homo Sapiens
LLNETECVS

SEQ ID NO: 187251 - protein, 9 aa, Homo Sapiens
LRVDTAGYL

SEQ ID NO: 187252 - protein, 9 aa, Homo Sapiens
GDIEEWTRI

SEQ ID NO: 187253 - protein, 9 aa, Homo Sapiens
QVFFIHMFT

SEQ ID NO: 187254 - protein, 9 aa, Homo Sapiens
LQAIRGWSG

SEQ ID NO: 187255 - protein, 9 aa, Homo Sapiens
HYTGPEDAD

SEQ ID NO: 187256 - protein, 9 aa, Homo Sapiens
AEVLPHTGL

SEQ ID NO: 187257 - protein, 9 aa, Homo Sapiens
RGAVYHYYL

SEQ ID NO: 187258 - protein, 9 aa, Homo Sapiens
SLQAIRGWS

SEQ ID NO: 187259 - protein, 9 aa, Homo Sapiens
RSTNTCPAS

SEQ ID NO: 187260 - protein, 9 aa, Homo Sapiens
RPQDNRSTN

SEQ ID NO: 187261 - protein, 9 aa, Homo Sapiens
DTAVLVIEN

SEQ ID NO: 187262 - protein, 9 aa, Homo Sapiens
FIQSHLWRF

SEQ ID NO: 187263 - protein, 9 aa, Homo Sapiens
DDTAVLVIE

SEQ ID NO: 187264 - protein, 9 aa, Homo Sapiens
VPFLLHKDH

SEQ ID NO: 187265 - protein, 9 aa, Homo Sapiens
VSFIDICQS

SEQ ID NO: 187266 - protein, 9 aa, Homo Sapiens
NCEEASQTQ

SEQ ID NO: 187267 - protein, 9 aa, Homo Sapiens
PEKKEAEDY

SEQ ID NO: 187268 - protein, 9 aa, Homo Sapiens
LEENKLTEM

SEQ ID NO: 187269 - protein, 9 aa, Homo Sapiens
VTTMGSETI

SEQ ID NO: 187270 - protein, 9 aa, Homo Sapiens
ETLQNLDLS

SEQ ID NO: 187271 - protein, 9 aa, Homo Sapiens
VLDSPKDLE

SEQ ID NO: 187272 - protein, 9 aa, Homo Sapiens
WSKKILVVK

SEQ ID NO: 187273 - protein, 9 aa, Homo Sapiens
YLQLWSNIN

SEQ ID NO: 187274 - protein, 9 aa, Homo Sapiens
SNIVFLHND

SEQ ID NO: 187275 - protein, 9 aa, Homo Sapiens
FWSLQQPEP

SEQ ID NO: 187276 - protein, 9 aa, Homo Sapiens
GQYLEVNVI

SEQ ID NO: 187277 - protein, 9 aa, Homo Sapiens
YNCRVAKST

SEQ ID NO: 187278 - protein, 9 aa, Homo Sapiens
AGPPGIAGF

SEQ ID NO: 187279 - protein, 9 aa, Homo Sapiens
RLLQTTHTL

SEQ ID NO: 187280 - protein, 9 aa, Homo Sapiens
RSQLIDEFL

SEQ ID NO: 187281 - protein, 9 aa, Homo Sapiens
LFGPKNDME

SEQ ID NO: 187282 - protein, 9 aa, Homo Sapiens
VCCVQYDGR

SEQ ID NO: 187283 - protein, 9 aa, Homo Sapiens
NDLYDDDID

SEQ ID NO: 187284 - protein, 9 aa, Homo Sapiens
CKKHEEAIH

SEQ ID NO: 187285 - protein, 9 aa, Homo Sapiens
GGSSGTSRG

SEQ ID NO: 187286 - protein, 9 aa, Homo Sapiens
PSNGEDPLG

SEQ ID NO: 187287 - protein, 9 aa, Homo Sapiens
TNTCPASGR

SEQ ID NO: 187288 - protein, 9 aa, Homo Sapiens
ERSLLLALR

SEQ ID NO: 187289 - protein, 9 aa, Homo Sapiens
LDSPKDLEK

SEQ ID NO: 187290 - protein, 9 aa, Homo Sapiens
QTSVTKLSL

SEQ ID NO: 187291 - protein, 9 aa, Homo Sapiens
MGSETITAS

SEQ ID NO: 187292 - protein, 9 aa, Homo Sapiens
APSKPPPSL

SEQ ID NO: 187293 - protein, 9 aa, Homo Sapiens
LSRAPSLKR

SEQ ID NO: 187294 - protein, 9 aa, Homo Sapiens
ICAITISQT

SEQ ID NO: 187295 - protein, 9 aa, Homo Sapiens
ASKDRKLKN

SEQ ID NO: 187296 - protein, 9 aa, Homo Sapiens
REEMRKEQR

SEQ ID NO: 187297 - protein, 9 aa, Homo Sapiens
SLNVLFTAS

SEQ ID NO: 187298 - protein, 9 aa, Homo Sapiens
DIEEWTRIT

SEQ ID NO: 187299 - protein, 9 aa, Homo Sapiens
GQKVLASFI

SEQ ID NO: 187300 - protein, 9 aa, Homo Sapiens
RTSPRCPRA

SEQ ID NO: 187301 - protein, 9 aa, Homo Sapiens
TSCVYYKAT

SEQ ID NO: 187302 - protein, 9 aa, Homo Sapiens
TINIVEANP

SEQ ID NO: 187303 - protein, 9 aa, Homo Sapiens
DTAGYLLKC

SEQ ID NO: 187304 - protein, 9 aa, Homo Sapiens
LQACIAHRI

SEQ ID NO: 187305 - protein, 9 aa, Homo Sapiens
LQLWSNINL

SEQ ID NO: 187306 - protein, 9 aa, Homo Sapiens
FESRSIAMQ

SEQ ID NO: 187307 - protein, 9 aa, Homo Sapiens
EVESLLCLA

SEQ ID NO: 187308 - protein, 9 aa, Homo Sapiens
YYKATLLND

SEQ ID NO: 187309 - protein, 9 aa, Homo Sapiens
GLNFLEAEA

SEQ ID NO: 187310 - protein, 9 aa, Homo Sapiens
GCISNAFVQ

SEQ ID NO: 187311 - protein, 9 aa, Homo Sapiens
TWPHPCPGP

SEQ ID NO: 187312 - protein, 9 aa, Homo Sapiens
EEQFWEACV

SEQ ID NO: 187313 - protein, 9 aa, Homo Sapiens
AINVLSHLP

SEQ ID NO: 187314 - protein, 9 aa, Homo Sapiens
KSTILTRPG

SEQ ID NO: 187315 - protein, 9 aa, Homo Sapiens
LKHPFNRKS

SEQ ID NO: 187316 - protein, 9 aa, Homo Sapiens
RKVGCDSVI

SEQ ID NO: 187317 - protein, 9 aa, Homo Sapiens
VDTAGYLLK

SEQ ID NO: 187318 - protein, 9 aa, Homo Sapiens
ISLLFGICV

SEQ ID NO: 187319 - protein, 9 aa, Homo Sapiens
DGKRVVLKK

SEQ ID NO: 187320 - protein, 9 aa, Homo Sapiens
RSSRNSLSR

SEQ ID NO: 187321 - protein, 9 aa, Homo Sapiens
TMYHTGDIE

SEQ ID NO: 187322 - protein, 9 aa, Homo Sapiens
RSSSRLEER

SEQ ID NO: 187323 - protein, 9 aa, Homo Sapiens
TGDIEEWTR

SEQ ID NO: 187324 - protein, 9 aa, Homo Sapiens
IGQYLEVNV

SEQ ID NO: 187325 - protein, 9 aa, Homo Sapiens
DLLYNDLYD

SEQ ID NO: 187326 - protein, 9 aa, Homo Sapiens
WRFCLQYGA

SEQ ID NO: 187327 - protein, 9 aa, Homo Sapiens
LLQTTHTLQ

SEQ ID NO: 187328 - protein, 9 aa, Homo Sapiens
FSDFLIGQY

SEQ ID NO: 187329 - protein, 9 aa, Homo Sapiens
LLPCLGVSA

SEQ ID NO: 187330 - protein, 9 aa, Homo Sapiens
CVELQQPAL

SEQ ID NO: 187331 - protein, 9 aa, Homo Sapiens
HPCPGPPPL

SEQ ID NO: 187332 - protein, 9 aa, Homo Sapiens
RKSTILTRP

SEQ ID NO: 187333 - protein, 9 aa, Homo Sapiens
KEQRRIQEQ

SEQ ID NO: 187334 - protein, 9 aa, Homo Sapiens
IQSHLWRFC

SEQ ID NO: 187335 - protein, 9 aa, Homo Sapiens
SHIEECVRW

SEQ ID NO: 187336 - protein, 9 aa, Homo Sapiens
SETITASTA

SEQ ID NO: 187337 - protein, 9 aa, Homo Sapiens
LFGICVAWE

SEQ ID NO: 187338 - protein, 9 aa, Homo Sapiens
CYATVYKGK

SEQ ID NO: 187339 - protein, 9 aa, Homo Sapiens
NTCPASGRE

SEQ ID NO: 187340 - protein, 9 aa, Homo Sapiens
EEASQTQNP

SEQ ID NO: 187341 - protein, 9 aa, Homo Sapiens
EATLTISPS

SEQ ID NO: 187342 - protein, 9 aa, Homo Sapiens
LGQEATLTI

SEQ ID NO: 187343 - protein, 9 aa, Homo Sapiens
ASASSLNVL

SEQ ID NO: 187344 - protein, 9 aa, Homo Sapiens
INYHQHVYH

SEQ ID NO: 187345 - protein, 9 aa, Homo Sapiens
SPRSSSRLE

SEQ ID NO: 187346 - protein, 9 aa, Homo Sapiens
PGLLNETEC

SEQ ID NO: 187347 - protein, 9 aa, Homo Sapiens
STALRGDVC

SEQ ID NO: 187348 - protein, 9 aa, Homo Sapiens
ATTLPVNNS

SEQ ID NO: 187349 - protein, 9 aa, Homo Sapiens
YQSIKDSFQ

SEQ ID NO: 187350 - protein, 9 aa, Homo Sapiens
YLLKCSGHG

SEQ ID NO: 187351 - protein, 9 aa, Homo Sapiens
MYHTGDIEE

SEQ ID NO: 187352 - protein, 9 aa, Homo Sapiens
TSRGPSAME

SEQ ID NO: 187353 - protein, 9 aa, Homo Sapiens
LWSNINLEK

SEQ ID NO: 187354 - protein, 9 aa, Homo Sapiens
YIPSLKEPG

SEQ ID NO: 187355 - protein, 9 aa, Homo Sapiens
GEDPLGEEF

SEQ ID NO: 187356 - protein, 9 aa, Homo Sapiens
PLGEEFGIC

SEQ ID NO: 187357 - protein, 9 aa, Homo Sapiens
RIVIKKIGK

SEQ ID NO: 187358 - protein, 9 aa, Homo Sapiens
AETLQNLDL

SEQ ID NO: 187359 - protein, 9 aa, Homo Sapiens
PYGLNFLEA

SEQ ID NO: 187360 - protein, 9 aa, Homo Sapiens
SPKDLEKKR

SEQ ID NO: 187361 - protein, 9 aa, Homo Sapiens
WPYQSIKDS

SEQ ID NO: 187362 - protein, 9 aa, Homo Sapiens
VLNRSKFWS

SEQ ID NO: 187363 - protein, 9 aa, Homo Sapiens
SAKLHYTGP

SEQ ID NO: 187364 - protein, 9 aa, Homo Sapiens
RLYLNCEEA

SEQ ID NO: 187365 - protein, 9 aa, Homo Sapiens
EITAHCKKH

SEQ ID NO: 187366 - protein, 9 aa, Homo Sapiens
EHTEEVESL

SEQ ID NO: 187367 - protein, 9 aa, Homo Sapiens
EQQLNEKLE

SEQ ID NO: 187368 - protein, 9 aa, Homo Sapiens
GPYGLNFLE

SEQ ID NO: 187369 - protein, 9 aa, Homo Sapiens
PEELTELGT

SEQ ID NO: 187370 - protein, 9 aa, Homo Sapiens
PRSSSRLEE

SEQ ID NO: 187371 - protein, 9 aa, Homo Sapiens
LIDEFLDRF

SEQ ID NO: 187372 - protein, 9 aa, Homo Sapiens
VRWQLRATG

SEQ ID NO: 187373 - protein, 9 aa, Homo Sapiens
RSKFWSLQQ

SEQ ID NO: 187374 - protein, 9 aa, Homo Sapiens
RLEERLKAA

SEQ ID NO: 187375 - protein, 9 aa, Homo Sapiens
GELVFLPRD

SEQ ID NO: 187376 - protein, 9 aa, Homo Sapiens
YRLQACIAH

SEQ ID NO: 187377 - protein, 9 aa, Homo Sapiens
FLLSNVSFI

SEQ ID NO: 187378 - protein, 9 aa, Homo Sapiens
QRRIQEQLR

SEQ ID NO: 187379 - protein, 9 aa, Homo Sapiens
RLHSQNVLS

SEQ ID NO: 187380 - protein, 9 aa, Homo Sapiens
SASSLNVLF

SEQ ID NO: 187381 - protein, 9 aa, Homo Sapiens
HCKKHEEAI

SEQ ID NO: 187382 - protein, 9 aa, Homo Sapiens
SGTWPHPCP

SEQ ID NO: 187383 - protein, 9 aa, Homo Sapiens
IEEWTRITI

SEQ ID NO: 187384 - protein, 9 aa, Homo Sapiens
QADFYRKNY

SEQ ID NO: 187385 - protein, 9 aa, Homo Sapiens
QEQHWWIRL

SEQ ID NO: 187386 - protein, 9 aa, Homo Sapiens
TISQTEASA

SEQ ID NO: 187387 - protein, 9 aa, Homo Sapiens
EKLGEGCYA

SEQ ID NO: 187388 - protein, 9 aa, Homo Sapiens
QSHLWRFCL

SEQ ID NO: 187389 - protein, 9 aa, Homo Sapiens
CLLQVFFIH

SEQ ID NO: 187390 - protein, 9 aa, Homo Sapiens
LTEMPEKCL

SEQ ID NO: 187391 - protein, 9 aa, Homo Sapiens
FLFSSFSMI

SEQ ID NO: 187392 - protein, 9 aa, Homo Sapiens
TLPVNNSNS

SEQ ID NO: 187393 - protein, 9 aa, Homo Sapiens
EENKLTEMP

SEQ ID NO: 187394 - protein, 9 aa, Homo Sapiens
EVLNRSKFW

SEQ ID NO: 187395 - protein, 9 aa, Homo Sapiens
QDNRSTNTC

SEQ ID NO: 187396 - protein, 9 aa, Homo Sapiens
LDRFNHSVE

SEQ ID NO: 187397 - protein, 9 aa, Homo Sapiens
INVLSHLPS

SEQ ID NO: 187398 - protein, 9 aa, Homo Sapiens
PFSAKLHYT

SEQ ID NO: 187399 - protein, 9 aa, Homo Sapiens
DCRKVGCDS

SEQ ID NO: 187400 - protein, 9 aa, Homo Sapiens
SPRCPRAPS

SEQ ID NO: 187401 - protein, 9 aa, Homo Sapiens
LQAGELVFL

SEQ ID NO: 187402 - protein, 9 aa, Homo Sapiens
PSGMFRTQS

SEQ ID NO: 187403 - protein, 9 aa, Homo Sapiens
TEEVESLLC

SEQ ID NO: 187404 - protein, 9 aa, Homo Sapiens
RDGKRVVLK

SEQ ID NO: 187405 - protein, 9 aa, Homo Sapiens
LWRFCLQYG

SEQ ID NO: 187406 - protein, 9 aa, Homo Sapiens
AGYLLKCSG

SEQ ID NO: 187407 - protein, 9 aa, Homo Sapiens
AVCCVQYDG

SEQ ID NO: 187408 - protein, 9 aa, Homo Sapiens
QEITAHCKK

SEQ ID NO: 187409 - protein, 9 aa, Homo Sapiens
VTSCVYYKA

SEQ ID NO: 187410 - protein, 9 aa, Homo Sapiens
NKVLGREVH

SEQ ID NO: 187411 - protein, 9 aa, Homo Sapiens
GKTASKDRK

SEQ ID NO: 187412 - protein, 9 aa, Homo Sapiens
DNSSDLLYN

SEQ ID NO: 187413 - protein, 9 aa, Homo Sapiens
VSQQPRQAE

SEQ ID NO: 187414 - protein, 9 aa, Homo Sapiens
NRKSTILTR

SEQ ID NO: 187415 - protein, 9 aa, Homo Sapiens
TCRAASRTS

SEQ ID NO: 187416 - protein, 9 aa, Homo Sapiens
NVLFTASNC

SEQ ID NO: 187417 - protein, 9 aa, Homo Sapiens
EMRKEQRRI

SEQ ID NO: 187418 - protein, 9 aa, Homo Sapiens
EYRLQACIA

SEQ ID NO: 187419 - protein, 9 aa, Homo Sapiens
LLSNVSFID

SEQ ID NO: 187420 - protein, 9 aa, Homo Sapiens
RTQSFSEAE

SEQ ID NO: 187421 - protein, 9 aa, Homo Sapiens
FSAKLHYTG

SEQ ID NO: 187422 - protein, 9 aa, Homo Sapiens
DSWPATTLP

SEQ ID NO: 187423 - protein, 9 aa, Homo Sapiens
FWEACVELQ

SEQ ID NO: 187424 - protein, 9 aa, Homo Sapiens
FYRKNYIPS

SEQ ID NO: 187425 - protein, 9 aa, Homo Sapiens
YEPEKKEAE

SEQ ID NO: 187426 - protein, 9 aa, Homo Sapiens
PGIAGFPGF

SEQ ID NO: 187427 - protein, 9 aa, Homo Sapiens
CDSVIGSSK

SEQ ID NO: 187428 - protein, 9 aa, Homo Sapiens
SVVANTPLG

SEQ ID NO: 187429 - protein, 9 aa, Homo Sapiens
VSVVANTPL

SEQ ID NO: 187430 - protein, 9 aa, Homo Sapiens
FIIRLALAE

SEQ ID NO: 187431 - protein, 9 aa, Homo Sapiens
HTEEVESLL

SEQ ID NO: 187432 - protein, 9 aa, Homo Sapiens
RSYNCRVAK

SEQ ID NO: 187433 - protein, 9 aa, Homo Sapiens
IEECVRWQL

SEQ ID NO: 187434 - protein, 9 aa, Homo Sapiens
HHGAEKSDA

SEQ ID NO: 187435 - protein, 9 aa, Homo Sapiens
CRAASRTSP

SEQ ID NO: 187436 - protein, 9 aa, Homo Sapiens
EQHWWIRLH

SEQ ID NO: 187437 - protein, 9 aa, Homo Sapiens
ISSFSNSVA

SEQ ID NO: 187438 - protein, 9 aa, Homo Sapiens
SQTSVTKLS

SEQ ID NO: 187439 - protein, 9 aa, Homo Sapiens
LQWRPSLQA

SEQ ID NO: 187440 - protein, 9 aa, Homo Sapiens
LVINYHQHV

SEQ ID NO: 187441 - protein, 9 aa, Homo Sapiens
EERLLQTTH

SEQ ID NO: 187442 - protein, 9 aa, Homo Sapiens
LPCLGVSAR

SEQ ID NO: 187443 - protein, 9 aa, Homo Sapiens
VTVVAYRLA

SEQ ID NO: 187444 - protein, 9 aa, Homo Sapiens
SSGTSRGPS

SEQ ID NO: 187445 - protein, 9 aa, Homo Sapiens
EEVESLLCL

SEQ ID NO: 187446 - protein, 9 aa, Homo Sapiens
SYNCRVAKS

SEQ ID NO: 187447 - protein, 9 aa, Homo Sapiens
EEEYEPEKK

SEQ ID NO: 187448 - protein, 9 aa, Homo Sapiens
RSIAMQWNG

SEQ ID NO: 187449 - protein, 9 aa, Homo Sapiens
VIKKIGKRM

SEQ ID NO: 187450 - protein, 9 aa, Homo Sapiens
VLSTALRGD

SEQ ID NO: 187451 - protein, 9 aa, Homo Sapiens
RRSSRNSLS

SEQ ID NO: 187452 - protein, 9 aa, Homo Sapiens
TPVHTSTPV

SEQ ID NO: 187453 - protein, 9 aa, Homo Sapiens
AVYHYYLTI

SEQ ID NO: 187454 - protein, 9 aa, Homo Sapiens
NCKEAINVL

SEQ ID NO: 187455 - protein, 9 aa, Homo Sapiens
TLSTTPVHT

SEQ ID NO: 187456 - protein, 9 aa, Homo Sapiens
DFIQSHLWR

SEQ ID NO: 187457 - protein, 9 aa, Homo Sapiens
GSGGRVPQS

SEQ ID NO: 187458 - protein, 9 aa, Homo Sapiens
LEERLKAAN

SEQ ID NO: 187459 - protein, 9 aa, Homo Sapiens
LADSWPATT

SEQ ID NO: 187460 - protein, 9 aa, Homo Sapiens
NYHQHVYHN

SEQ ID NO: 187461 - protein, 9 aa, Homo Sapiens
NEHTEEVES

SEQ ID NO: 187462 - protein, 9 aa, Homo Sapiens
KKEAEDYVM

SEQ ID NO: 187463 - protein, 9 aa, Homo Sapiens
IAMQWNGKW

SEQ ID NO: 187464 - protein, 9 aa, Homo Sapiens
AGELVFLPR

SEQ ID NO: 187465 - protein, 9 aa, Homo Sapiens
FSKISLLFG

SEQ ID NO: 187466 - protein, 9 aa, Homo Sapiens
EPFSAKLHY

SEQ ID NO: 187467 - protein, 9 aa, Homo Sapiens
AQEQHWWIR

SEQ ID NO: 187468 - protein, 9 aa, Homo Sapiens
VANTPLGPV

SEQ ID NO: 187469 - protein, 9 aa, Homo Sapiens
QQPRQAEVL

SEQ ID NO: 187470 - protein, 9 aa, Homo Sapiens
WIRLHTSES

SEQ ID NO: 187471 - protein, 9 aa, Homo Sapiens
FSMINESIS

SEQ ID NO: 187472 - protein, 9 aa, Homo Sapiens
FGPKNDMED

SEQ ID NO: 187473 - protein, 9 aa, Homo Sapiens
TFWSKKILV

SEQ ID NO: 187474 - protein, 9 aa, Homo Sapiens
NQKGKTASK

SEQ ID NO: 187475 - protein, 9 aa, Homo Sapiens
ETITASTAG

SEQ ID NO: 187476 - protein, 9 aa, Homo Sapiens
NKPNPNQIC

SEQ ID NO: 187477 - protein, 9 aa, Homo Sapiens
EECVRWQLR

SEQ ID NO: 187478 - protein, 9 aa, Homo Sapiens
EGCYATVYK

SEQ ID NO: 187479 - protein, 9 aa, Homo Sapiens
GRVPQSASV

SEQ ID NO: 187480 - protein, 9 aa, Homo Sapiens
DYSNIVFLH

SEQ ID NO: 187481 - protein, 9 aa, Homo Sapiens
LHKDHLDVS

SEQ ID NO: 187482 - protein, 9 aa, Homo Sapiens
STNTCPASG

SEQ ID NO: 187483 - protein, 9 aa, Homo Sapiens
NVLSHLPSH

SEQ ID NO: 187484 - protein, 9 aa, Homo Sapiens
LVFLPRDGA

SEQ ID NO: 187485 - protein, 9 aa, Homo Sapiens
TTHTLQEME

SEQ ID NO: 187486 - protein, 9 aa, Homo Sapiens
GAVYHYYLT

SEQ ID NO: 187487 - protein, 9 aa, Homo Sapiens
TAHCKKHEE

SEQ ID NO: 187488 - protein, 9 aa, Homo Sapiens
VLSHLPSHH

SEQ ID NO: 187489 - protein, 9 aa, Homo Sapiens
KKERSLLLA

SEQ ID NO: 187490 - protein, 9 aa, Homo Sapiens
EDRLYLNCE

SEQ ID NO: 187491 - protein, 9 aa, Homo Sapiens
SGPYGLNFL

SEQ ID NO: 187492 - protein, 9 aa, Homo Sapiens
ILSDDYSNI

SEQ ID NO: 187493 - protein, 9 aa, Homo Sapiens
AHCKKHEEA

SEQ ID NO: 187494 - protein, 9 aa, Homo Sapiens
YHTGDIEEW

SEQ ID NO: 187495 - protein, 9 aa, Homo Sapiens
PPGIAGFPG

SEQ ID NO: 187496 - protein, 9 aa, Homo Sapiens
VLRVDTAGY

SEQ ID NO: 187497 - protein, 9 aa, Homo Sapiens
DRLYLNCEE

SEQ ID NO: 187498 - protein, 9 aa, Homo Sapiens
KNDMEDYDA

SEQ ID NO: 187499 - protein, 9 aa, Homo Sapiens
WWIRLHTSE

SEQ ID NO: 187500 - protein, 9 aa, Homo Sapiens
HWWIRLHTS

SEQ ID NO: 187501 - protein, 9 aa, Homo Sapiens
GEGCYATVY

SEQ ID NO: 187502 - protein, 9 aa, Homo Sapiens
SYLQLWSNI

SEQ ID NO: 187503 - protein, 9 aa, Homo Sapiens
QAIRGWSGD

SEQ ID NO: 187504 - protein, 9 aa, Homo Sapiens
PSKPPPSLS

SEQ ID NO: 187505 - protein, 9 aa, Homo Sapiens
KGVAETLQN

SEQ ID NO: 187506 - protein, 9 aa, Homo Sapiens
QNLDLSDNR

SEQ ID NO: 187507 - protein, 9 aa, Homo Sapiens
EKKEAEDYV

SEQ ID NO: 187508 - protein, 9 aa, Homo Sapiens
FLPRDGAEG

SEQ ID NO: 187509 - protein, 9 aa, Homo Sapiens
TPLGPVEAF

SEQ ID NO: 187510 - protein, 9 aa, Homo Sapiens
NNPPGLLNE

SEQ ID NO: 187511 - protein, 9 aa, Homo Sapiens
GHVAAVCCV

SEQ ID NO: 187512 - protein, 9 aa, Homo Sapiens
VNEHTEEVE

SEQ ID NO: 187513 - protein, 9 aa, Homo Sapiens
AMQWNGKWH

SEQ ID NO: 187514 - protein, 9 aa, Homo Sapiens
LVIENGSGM

SEQ ID NO: 187515 - protein, 9 aa, Homo Sapiens
ETECVSDNQ

SEQ ID NO: 187516 - protein, 9 aa, Homo Sapiens
CLGVSARLC

SEQ ID NO: 187517 - protein, 9 aa, Homo Sapiens
YHYYLTIFG

SEQ ID NO: 187518 - protein, 9 aa, Homo Sapiens
CLFLLCNSS

SEQ ID NO: 187519 - protein, 9 aa, Homo Sapiens
SCVYYKATL

SEQ ID NO: 187520 - protein, 9 aa, Homo Sapiens
LNETECVSD

SEQ ID NO: 187521 - protein, 9 aa, Homo Sapiens
VHTSTPVTN

SEQ ID NO: 187522 - protein, 9 aa, Homo Sapiens
LLALRAVIS

SEQ ID NO: 187523 - protein, 9 aa, Homo Sapiens
GKEQQLNEK

SEQ ID NO: 187524 - protein, 9 aa, Homo Sapiens
YRRKAKGRN

SEQ ID NO: 187525 - protein, 9 aa, Homo Sapiens
SIAMQWNGK

SEQ ID NO: 187526 - protein, 9 aa, Homo Sapiens
KVLGREVHT

SEQ ID NO: 187527 - protein, 9 aa, Homo Sapiens
DNRSTNTCP

SEQ ID NO: 187528 - protein, 9 aa, Homo Sapiens
PCLGVSARL

SEQ ID NO: 187529 - protein, 9 aa, Homo Sapiens
LGREVHTSN

SEQ ID NO: 187530 - protein, 9 aa, Homo Sapiens
ADFYRKNYI

SEQ ID NO: 187531 - protein, 9 aa, Homo Sapiens
CQATVFRCL

SEQ ID NO: 187532 - protein, 9 aa, Homo Sapiens
ILTLSNYVL

SEQ ID NO: 187533 - protein, 9 aa, Homo Sapiens
VAGPPGIAG

SEQ ID NO: 187534 - protein, 9 aa, Homo Sapiens
ELTELGTGV

SEQ ID NO: 187535 - protein, 9 aa, Homo Sapiens
SSPRSSSRL

SEQ ID NO: 187536 - protein, 9 aa, Homo Sapiens
YFLLSNVSF

SEQ ID NO: 187537 - protein, 9 aa, Homo Sapiens
LHYTGPEDA

SEQ ID NO: 187538 - protein, 9 aa, Homo Sapiens
TLSTPRAPG

SEQ ID NO: 187539 - protein, 9 aa, Homo Sapiens
WPATTLPVN

SEQ ID NO: 187540 - protein, 9 aa, Homo Sapiens
QKGKTASKD

SEQ ID NO: 187541 - protein, 9 aa, Homo Sapiens
SSADGAGPE

SEQ ID NO: 187542 - protein, 9 aa, Homo Sapiens
EHHGAEKSD

SEQ ID NO: 187543 - protein, 9 aa, Homo Sapiens
GAVGAIRPL

SEQ ID NO: 187544 - protein, 9 aa, Homo Sapiens
SNVSFIDIC

SEQ ID NO: 187545 - protein, 9 aa, Homo Sapiens
LLYNDLYDD

SEQ ID NO: 187546 - protein, 9 aa, Homo Sapiens
RSLLLALRA

SEQ ID NO: 187547 - protein, 9 aa, Homo Sapiens
PKNDMEDYD

SEQ ID NO: 187548 - protein, 9 aa, Homo Sapiens
CAITISQTE

SEQ ID NO: 187549 - protein, 9 aa, Homo Sapiens
EFLDRFNHS

SEQ ID NO: 187550 - protein, 9 aa, Homo Sapiens
IISSFSNSV

SEQ ID NO: 187551 - protein, 9 aa, Homo Sapiens
NLDLSDNRI

SEQ ID NO: 187552 - protein, 9 aa, Homo Sapiens
LQVFFIHMF

SEQ ID NO: 187553 - protein, 9 aa, Homo Sapiens
EEYEPEKKE

SEQ ID NO: 187554 - protein, 9 aa, Homo Sapiens
LFSSFSMIN

SEQ ID NO: 187555 - protein, 9 aa, Homo Sapiens
INIVEANPR

SEQ ID NO: 187556 - protein, 9 aa, Homo Sapiens
PYQSIKDSF

SEQ ID NO: 187557 - protein, 9 aa, Homo Sapiens
GCYATVYKG

SEQ ID NO: 187558 - protein, 9 aa, Homo Sapiens
LSNVSFIDI

SEQ ID NO: 187559 - protein, 9 aa, Homo Sapiens
KRVEHHGAE

SEQ ID NO: 187560 - protein, 9 aa, Homo Sapiens
KRVVLKKMP

SEQ ID NO: 187561 - protein, 9 aa, Homo Sapiens
IRLHTSESD

SEQ ID NO: 187562 - protein, 9 aa, Homo Sapiens
KEAEDYVMA

SEQ ID NO: 187563 - protein, 9 aa, Homo Sapiens
VVLKKMPNV

SEQ ID NO: 187564 - protein, 9 aa, Homo Sapiens
NEKLEQVKL

SEQ ID NO: 187565 - protein, 9 aa, Homo Sapiens
ASRTSPRCP

SEQ ID NO: 187566 - protein, 9 aa, Homo Sapiens
SLLFGICVA

SEQ ID NO: 187567 - protein, 9 aa, Homo Sapiens
AVGAIRPLV

SEQ ID NO: 187568 - protein, 9 aa, Homo Sapiens
EPEKKEAED

SEQ ID NO: 187569 - protein, 9 aa, Homo Sapiens
YLNCEEASQ

SEQ ID NO: 187570 - protein, 9 aa, Homo Sapiens
IDEFLDRFN

SEQ ID NO: 187571 - protein, 9 aa, Homo Sapiens
SGTSRGPSA

SEQ ID NO: 187572 - protein, 9 aa, Homo Sapiens
DEFLDRFNH

SEQ ID NO: 187573 - protein, 9 aa, Homo Sapiens
FWSKKILVV

SEQ ID NO: 187574 - protein, 9 aa, Homo Sapiens
MDVGVFYVV

SEQ ID NO: 187575 - protein, 9 aa, Homo Sapiens
AMVTVVAYR

SEQ ID NO: 187576 - protein, 9 aa, Homo Sapiens
TEASASSLN

SEQ ID NO: 187577 - protein, 9 aa, Homo Sapiens
VLVIENGSG

SEQ ID NO: 187578 - protein, 9 aa, Homo Sapiens
LPRDGAEGQ

SEQ ID NO: 187579 - protein, 9 aa, Homo Sapiens
KNYIPSLKE

SEQ ID NO: 187580 - protein, 9 aa, Homo Sapiens
AKSTYQHHP

SEQ ID NO: 187581 - protein, 9 aa, Homo Sapiens
ADSWPATTL

SEQ ID NO: 187582 - protein, 9 aa, Homo Sapiens
DSPKDLEKK

SEQ ID NO: 187583 - protein, 9 aa, Homo Sapiens
NSSDHFKRI

SEQ ID NO: 187584 - protein, 9 aa, Homo Sapiens
VHTSNNQLG

SEQ ID NO: 187585 - protein, 9 aa, Homo Sapiens
HVYHNRQRL

SEQ ID NO: 187586 - protein, 9 aa, Homo Sapiens
CPGPPPLMA

SEQ ID NO: 187587 - protein, 9 aa, Homo Sapiens
EYEPEKKEA

SEQ ID NO: 187588 - protein, 9 aa, Homo Sapiens
FTLSTPRAP

SEQ ID NO: 187589 - protein, 9 aa, Homo Sapiens
YGLNFLEAE

SEQ ID NO: 187590 - protein, 9 aa, Homo Sapiens
TMGSETITA

SEQ ID NO: 187591 - protein, 9 aa, Homo Sapiens
MFRTQSFSE

SEQ ID NO: 187592 - protein, 9 aa, Homo Sapiens
DKKERSLLL

SEQ ID NO: 187593 - protein, 9 aa, Homo Sapiens
QKVLASFII

SEQ ID NO: 187594 - protein, 9 aa, Homo Sapiens
LIISSFSNS

SEQ ID NO: 187595 - protein, 9 aa, Homo Sapiens
FLIGQYLEV

SEQ ID NO: 187596 - protein, 9 aa, Homo Sapiens
AGGAQKPAH

SEQ ID NO: 187597 - protein, 9 aa, Homo Sapiens
QAEVLPHTG

SEQ ID NO: 187598 - protein, 9 aa, Homo Sapiens
LASFIIRLA

SEQ ID NO: 187599 - protein, 9 aa, Homo Sapiens
GKRVVLKKM

SEQ ID NO: 187600 - protein, 9 aa, Homo Sapiens
AFTLSTPRA

SEQ ID NO: 187601 - protein, 9 aa, Homo Sapiens
MGGSSGTSR

SEQ ID NO: 187602 - protein, 9 aa, Homo Sapiens
KLHYTGPED

SEQ ID NO: 187603 - protein, 9 aa, Homo Sapiens
GREVHTSNN

SEQ ID NO: 187604 - protein, 9 aa, Homo Sapiens
LTELGTGVW

SEQ ID NO: 187605 - protein, 9 aa, Homo Sapiens
HTGDIEEWT

SEQ ID NO: 187606 - protein, 9 aa, Homo Sapiens
HLCLFLLCN

SEQ ID NO: 187607 - protein, 9 aa, Homo Sapiens
LFLLCNSSD

SEQ ID NO: 187608 - protein, 9 aa, Homo Sapiens
PAYFRNHLC

SEQ ID NO: 187609 - protein, 9 aa, Homo Sapiens
LNEKLEQVK

SEQ ID NO: 187610 - protein, 9 aa, Homo Sapiens
IAGFPGFIG

SEQ ID NO: 187611 - protein, 9 aa, Homo Sapiens
LNCEEASQT

SEQ ID NO: 187612 - protein, 9 aa, Homo Sapiens
KVGCDSVIG

SEQ ID NO: 187613 - protein, 9 aa, Homo Sapiens
KKILVVKEN

SEQ ID NO: 187614 - protein, 9 aa, Homo Sapiens
GLLNETECV

SEQ ID NO: 187615 - protein, 9 aa, Homo Sapiens
PKDLEKKRI

SEQ ID NO: 187616 - protein, 9 aa, Homo Sapiens
ERLLQTTHT

SEQ ID NO: 187617 - protein, 9 aa, Homo Sapiens
SQQPRQAEV

SEQ ID NO: 187618 - protein, 9 aa, Homo Sapiens
NPPGLLNET

SEQ ID NO: 187619 - protein, 9 aa, Homo Sapiens
RVPQSASVS

SEQ ID NO: 187620 - protein, 9 aa, Homo Sapiens
IKKIGKRMK

SEQ ID NO: 187621 - protein, 9 aa, Homo Sapiens
FRTQSFSEA

SEQ ID NO: 187622 - protein, 9 aa, Homo Sapiens
MDEVLDSPK

SEQ ID NO: 187623 - protein, 9 aa, Homo Sapiens
IYLMDVGVF

SEQ ID NO: 187624 - protein, 9 aa, Homo Sapiens
QHVYHNRQR

SEQ ID NO: 187625 - protein, 9 aa, Homo Sapiens
LQNLDLSDN

SEQ ID NO: 187626 - protein, 9 aa, Homo Sapiens
ERLRLCISS

SEQ ID NO: 187627 - protein, 9 aa, Homo Sapiens
SADGAGPEG

SEQ ID NO: 187628 - protein, 9 aa, Homo Sapiens
SRELTCRAA

SEQ ID NO: 187629 - protein, 9 aa, Homo Sapiens
GCDSVIGSS

SEQ ID NO: 187630 - protein, 9 aa, Homo Sapiens
EPGKEQQLN

SEQ ID NO: 187631 - protein, 9 aa, Homo Sapiens
FLDRFNHSV

SEQ ID NO: 187632 - protein, 9 aa, Homo Sapiens
RNSLSRAPS

SEQ ID NO: 187633 - protein, 9 aa, Homo Sapiens
DPLGEEFGI

SEQ ID NO: 187634 - protein, 9 aa, Homo Sapiens
KPAHAQENW

SEQ ID NO: 187635 - protein, 9 aa, Homo Sapiens
AQKPAHAQE

SEQ ID NO: 187636 - protein, 9 aa, Homo Sapiens
EREYRLQAC

SEQ ID NO: 187637 - protein, 9 aa, Homo Sapiens
QSASVSALS

SEQ ID NO: 187638 - protein, 9 aa, Homo Sapiens
TITASTAGS

SEQ ID NO: 187639 - protein, 9 aa, Homo Sapiens
NGEDPLGEE

SEQ ID NO: 187640 - protein, 9 aa, Homo Sapiens
KPNPNQICV

SEQ ID NO: 187641 - protein, 9 aa, Homo Sapiens
SFGGCLLQV

SEQ ID NO: 187642 - protein, 9 aa, Homo Sapiens
LSTTPVHTS

SEQ ID NO: 187643 - protein, 9 aa, Homo Sapiens
KLTEMPEKC

SEQ ID NO: 187644 - protein, 9 aa, Homo Sapiens
NFEGCISNA

SEQ ID NO: 187645 - protein, 9 aa, Homo Sapiens
VGCDSVIGS

SEQ ID NO: 187646 - protein, 9 aa, Homo Sapiens
YRKNYIPSL

SEQ ID NO: 187647 - protein, 9 aa, Homo Sapiens
GTSQTSVTK

SEQ ID NO: 187648 - protein, 9 aa, Homo Sapiens
PELIISSFS

SEQ ID NO: 187649 - protein, 9 aa, Homo Sapiens
GMFRTQSFS

SEQ ID NO: 187650 - protein, 9 aa, Homo Sapiens
CVRWQLRAT

SEQ ID NO: 187651 - protein, 9 aa, Homo Sapiens
SQNVLSTAL

SEQ ID NO: 187652 - protein, 9 aa, Homo Sapiens
GPKNDMEDY

SEQ ID NO: 187653 - protein, 9 aa, Homo Sapiens
PRAPSKPPP

SEQ ID NO: 187654 - protein, 9 aa, Homo Sapiens
VVANTPLGP

SEQ ID NO: 187655 - protein, 9 aa, Homo Sapiens
KVGILTLSN

SEQ ID NO: 187656 - protein, 9 aa, Homo Sapiens
SGMFRTQSF

SEQ ID NO: 187657 - protein, 9 aa, Homo Sapiens
CIAHRIQEL

SEQ ID NO: 187658 - protein, 9 aa, Homo Sapiens
VMGGSSGTS

SEQ ID NO: 187659 - protein, 9 aa, Homo Sapiens
DFLIGQYLE

SEQ ID NO: 187660 - protein, 9 aa, Homo Sapiens
RLHTSESDG

SEQ ID NO: 187661 - protein, 9 aa, Homo Sapiens
ELVFLPRDG

SEQ ID NO: 187662 - protein, 9 aa, Homo Sapiens
LTLSNYVLE

SEQ ID NO: 187663 - protein, 9 aa, Homo Sapiens
TCPASGRET

SEQ ID NO: 187664 - protein, 9 aa, Homo Sapiens
HTSNNQLGG

SEQ ID NO: 187665 - protein, 9 aa, Homo Sapiens
PHPCPGPPP

SEQ ID NO: 187666 - protein, 9 aa, Homo Sapiens
ISQTEASAS

SEQ ID NO: 187667 - protein, 9 aa, Homo Sapiens
HLWRFCLQY

SEQ ID NO: 187668 - protein, 9 aa, Homo Sapiens
AITISQTEA

SEQ ID NO: 187669 - protein, 9 aa, Homo Sapiens
MYFLLSNVS

SEQ ID NO: 187670 - protein, 9 aa, Homo Sapiens
EHGAVGAIR

SEQ ID NO: 187671 - protein, 9 aa, Homo Sapiens
KVLASFIIR

SEQ ID NO: 187672 - protein, 9 aa, Homo Sapiens
TQSFSEAEP

SEQ ID NO: 187673 - protein, 9 aa, Homo Sapiens
NSLSRAPSL

SEQ ID NO: 187674 - protein, 9 aa, Homo Sapiens
EPPAGGAQK

SEQ ID NO: 187675 - protein, 9 aa, Homo Sapiens
LFLFSSFSM

SEQ ID NO: 187676 - protein, 9 aa, Homo Sapiens
KEAINVLSH

SEQ ID NO: 187677 - protein, 9 aa, Homo Sapiens
PSLQAIRGW

SEQ ID NO: 187678 - protein, 9 aa, Homo Sapiens
ASSLNVLFT

SEQ ID NO: 187679 - protein, 9 aa, Homo Sapiens
TLSNYVLEL

SEQ ID NO: 187680 - protein, 9 aa, Homo Sapiens
KTASKDRKL

SEQ ID NO: 187681 - protein, 9 aa, Homo Sapiens
SNYVLELGH

SEQ ID NO: 187682 - protein, 9 aa, Homo Sapiens
CRVAKSTYQ

SEQ ID NO: 187683 - protein, 9 aa, Homo Sapiens
VFLPRDGAE

SEQ ID NO: 187684 - protein, 9 aa, Homo Sapiens
LFTASNCRS

SEQ ID NO: 187685 - protein, 9 aa, Homo Sapiens
LNVLFTASN

SEQ ID NO: 187686 - protein, 9 aa, Homo Sapiens
TEMPEKCLS

SEQ ID NO: 187687 - protein, 9 aa, Homo Sapiens
HQHVYHNRQ

SEQ ID NO: 187688 - protein, 9 aa, Homo Sapiens
EGCISNAFV

SEQ ID NO: 187689 - protein, 9 aa, Homo Sapiens
QEATLTISP

SEQ ID NO: 187690 - protein, 9 aa, Homo Sapiens
NIVEANPRK

SEQ ID NO: 187691 - protein, 9 aa, Homo Sapiens
QICVNNVKA

SEQ ID NO: 187692 - protein, 9 aa, Homo Sapiens
MQWNGKWHY

SEQ ID NO: 187693 - protein, 9 aa, Homo Sapiens
ATQGGVESL

SEQ ID NO: 187694 - protein, 9 aa, Homo Sapiens
TTMGSETIT

SEQ ID NO: 187695 - protein, 9 aa, Homo Sapiens
GLFGPKNDM

SEQ ID NO: 187696 - protein, 9 aa, Homo Sapiens
QEVLNRSKF

SEQ ID NO: 187697 - protein, 9 aa, Homo Sapiens
WQLRATGRP

SEQ ID NO: 187698 - protein, 9 aa, Homo Sapiens
PLGPVEAFD

SEQ ID NO: 187699 - protein, 9 aa, Homo Sapiens
SWPATTLPV

SEQ ID NO: 187700 - protein, 9 aa, Homo Sapiens
TSPRCPRAP

SEQ ID NO: 187701 - protein, 9 aa, Homo Sapiens
SKISLLFGI

SEQ ID NO: 187702 - protein, 9 aa, Homo Sapiens
EVLPHTGLS

SEQ ID NO: 187703 - protein, 9 aa, Homo Sapiens
FTQDFWPYQ

SEQ ID NO: 187704 - protein, 9 aa, Homo Sapiens
ELTCRAASR

SEQ ID NO: 187705 - protein, 9 aa, Homo Sapiens
EVHTSNNQL

SEQ ID NO: 187706 - protein, 9 aa, Homo Sapiens
NTPLGPVEA

SEQ ID NO: 187707 - protein, 9 aa, Homo Sapiens
YYLTIFGQI

SEQ ID NO: 187708 - protein, 9 aa, Homo Sapiens
REYRLQACI

SEQ ID NO: 187709 - protein, 9 aa, Homo Sapiens
SSSRLEERL

SEQ ID NO: 187710 - protein, 9 aa, Homo Sapiens
FSSFSMINE

SEQ ID NO: 187711 - protein, 9 aa, Homo Sapiens
QFWEACVEL

SEQ ID NO: 187712 - protein, 9 aa, Homo Sapiens
HPFNRKSTI

SEQ ID NO: 187713 - protein, 9 aa, Homo Sapiens
VLKKMPNVF

SEQ ID NO: 187714 - protein, 9 aa, Homo Sapiens
NSSDLLYND

SEQ ID NO: 187715 - protein, 9 aa, Homo Sapiens
LQTTHTLQE

SEQ ID NO: 187716 - protein, 9 aa, Homo Sapiens
CNSSDHFKR

SEQ ID NO: 187717 - protein, 9 aa, Homo Sapiens
CFSDFLIGQ

SEQ ID NO: 187718 - protein, 9 aa, Homo Sapiens
FLLCNSSDH

SEQ ID NO: 187719 - protein, 9 aa, Homo Sapiens
QDFWPYQSI

SEQ ID NO: 187720 - protein, 9 aa, Homo Sapiens
ITISQTEAS

SEQ ID NO: 187721 - protein, 9 aa, Homo Sapiens
QPSNGEDPL

SEQ ID NO: 187722 - protein, 9 aa, Homo Sapiens
TLQNLDLSD

SEQ ID NO: 187723 - protein, 9 aa, Homo Sapiens
TSQTSVTKL

SEQ ID NO: 187724 - protein, 9 aa, Homo Sapiens
SKDRKLKNK

SEQ ID NO: 187725 - protein, 9 aa, Homo Sapiens
KISLLFGIC

SEQ ID NO: 187726 - protein, 9 aa, Homo Sapiens
KLEKLGEGC

SEQ ID NO: 187727 - protein, 9 aa, Homo Sapiens
RLQACIAHR

SEQ ID NO: 187728 - protein, 9 aa, Homo Sapiens
HREEMRKEQ

SEQ ID NO: 187729 - protein, 9 aa, Homo Sapiens
TELGQEATL

SEQ ID NO: 187730 - protein, 9 aa, Homo Sapiens
QACIAHRIQ

SEQ ID NO: 187731 - protein, 9 aa, Homo Sapiens
DEVLDSPKD

SEQ ID NO: 187732 - protein, 9 aa, Homo Sapiens
SRAPSLKRR

SEQ ID NO: 187733 - protein, 9 aa, Homo Sapiens
RPSLQAIRG

SEQ ID NO: 187734 - protein, 9 aa, Homo Sapiens
SSRLEERLK

SEQ ID NO: 187735 - protein, 9 aa, Homo Sapiens
FLSLGTSQT

SEQ ID NO: 187736 - protein, 9 aa, Homo Sapiens
AKEHGAVGA

SEQ ID NO: 187737 - protein, 9 aa, Homo Sapiens
HKDHLDVSP

SEQ ID NO: 187738 - protein, 9 aa, Homo Sapiens
LSTPRAPGP

SEQ ID NO: 187739 - protein, 9 aa, Homo Sapiens
SNQKGKTAS

SEQ ID NO: 187740 - protein, 9 aa, Homo Sapiens
PPAGGAQKP

SEQ ID NO: 187741 - protein, 9 aa, Homo Sapiens
YFRNHLCQA

SEQ ID NO: 187742 - protein, 9 aa, Homo Sapiens
SAFTLSTPR

SEQ ID NO: 187743 - protein, 9 aa, Homo Sapiens
LCISSADGA

SEQ ID NO: 187744 - protein, 9 aa, Homo Sapiens
PGKEQQLNE

SEQ ID NO: 187745 - protein, 9 aa, Homo Sapiens
SPIYLMDVG

SEQ ID NO: 187746 - protein, 9 aa, Homo Sapiens
RQAEVLPHT

SEQ ID NO: 187747 - protein, 9 aa, Homo Sapiens
LLFGICVAW

SEQ ID NO: 187748 - protein, 9 aa, Homo Sapiens
SNAFVQRLS

SEQ ID NO: 187749 - protein, 9 aa, Homo Sapiens
QWNGKWHYK

SEQ ID NO: 187750 - protein, 9 aa, Homo Sapiens
MINESISSR

SEQ ID NO: 187751 - protein, 9 aa, Homo Sapiens
TTLPVNNSN

SEQ ID NO: 187752 - protein, 9 aa, Homo Sapiens
IGKRMKQKL

SEQ ID NO: 187753 - protein, 9 aa, Homo Sapiens
TLTISPSGA

SEQ ID NO: 187754 - protein, 9 aa, Homo Sapiens
AIRGWSGDP

SEQ ID NO: 187755 - protein, 9 aa, Homo Sapiens
FNRKSTILT

SEQ ID NO: 187756 - protein, 9 aa, Homo Sapiens
NVLSTALRG

SEQ ID NO: 187757 - protein, 9 aa, Homo Sapiens
SSFSMINES

SEQ ID NO: 187758 - protein, 9 aa, Homo Sapiens
AGFPGFIGS

SEQ ID NO: 187759 - protein, 9 aa, Homo Sapiens
FEGCISNAF

SEQ ID NO: 187760 - protein, 9 aa, Homo Sapiens
KLGEGCYAT

SEQ ID NO: 187761 - protein, 9 aa, Homo Sapiens
INLEKPTED

SEQ ID NO: 187762 - protein, 9 aa, Homo Sapiens
SFESRSIAM

SEQ ID NO: 187763 - protein, 9 aa, Homo Sapiens
YNDLYDDDI

SEQ ID NO: 187764 - protein, 9 aa, Homo Sapiens
PPPSLSASP

SEQ ID NO: 187765 - protein, 9 aa, Homo Sapiens
KSTYQHHPK

SEQ ID NO: 187766 - protein, 9 aa, Homo Sapiens
GVAGPPGIA

SEQ ID NO: 187767 - protein, 9 aa, Homo Sapiens
MGHVAAVCC

SEQ ID NO: 187768 - protein, 9 aa, Homo Sapiens
ECVRWQLRA

SEQ ID NO: 187769 - protein, 9 aa, Homo Sapiens
QKPAHAQEN

SEQ ID NO: 187770 - protein, 9 aa, Homo Sapiens
YKATLLNDI

SEQ ID NO: 187771 - protein, 9 aa, Homo Sapiens
TQDFWPYQS

SEQ ID NO: 187772 - protein, 9 aa, Homo Sapiens
QWRPSLQAI

SEQ ID NO: 187773 - protein, 9 aa, Homo Sapiens
GAEKSDAVC

SEQ ID NO: 187774 - protein, 9 aa, Homo Sapiens
LGVSARLCI

SEQ ID NO: 187775 - protein, 9 aa, Homo Sapiens
MEDYDADSD

SEQ ID NO: 187776 - protein, 9 aa, Homo Sapiens
LNRSKFWSL

SEQ ID NO: 187777 - protein, 9 aa, Homo Sapiens
FGGCLLQVF

SEQ ID NO: 187778 - protein, 9 aa, Homo Sapiens
LSLGTSQTS

SEQ ID NO: 187779 - protein, 9 aa, Homo Sapiens
CISSADGAG

SEQ ID NO: 187780 - protein, 9 aa, Homo Sapiens
SKPPPSLSA

SEQ ID NO: 187781 - protein, 9 aa, Homo Sapiens
SARLCICAI

SEQ ID NO: 187782 - protein, 9 aa, Homo Sapiens
LEKLGEGCY

SEQ ID NO: 187783 - protein, 9 aa, Homo Sapiens
APEELTELG

SEQ ID NO: 187784 - protein, 9 aa, Homo Sapiens
CVYYKATLL

SEQ ID NO: 187785 - protein, 9 aa, Homo Sapiens
MGVPFLLHK

SEQ ID NO: 187786 - protein, 9 aa, Homo Sapiens
SLGTSQTSV

SEQ ID NO: 187787 - protein, 9 aa, Homo Sapiens
KKIGKRMKQ

SEQ ID NO: 187788 - protein, 9 aa, Homo Sapiens
WSNINLEKP

SEQ ID NO: 187789 - protein, 9 aa, Homo Sapiens
VIENGSGMC

SEQ ID NO: 187790 - protein, 9 aa, Homo Sapiens
DVGVFYVVP

SEQ ID NO: 187791 - protein, 9 aa, Homo Sapiens
WEACVELQQ

SEQ ID NO: 187792 - protein, 9 aa, Homo Sapiens
QPRQAEVLP

SEQ ID NO: 187793 - protein, 9 aa, Homo Sapiens
GVMGGSSGT

SEQ ID NO: 187794 - protein, 9 aa, Homo Sapiens
HVAAVCCVQ

SEQ ID NO: 187795 - protein, 9 aa, Homo Sapiens
EQFWEACVE

SEQ ID NO: 187796 - protein, 9 aa, Homo Sapiens
RLRLCISSA

SEQ ID NO: 187797 - protein, 9 aa, Homo Sapiens
VAETLQNLD

SEQ ID NO: 187798 - protein, 9 aa, Homo Sapiens
AAKEHGAVG

SEQ ID NO: 187799 - protein, 9 aa, Homo Sapiens
QYLEVNVIS

SEQ ID NO: 187800 - protein, 9 aa, Homo Sapiens
QNVLSTALR

SEQ ID NO: 187801 - protein, 9 aa, Homo Sapiens
KEHGAVGAI

SEQ ID NO: 187802 - protein, 9 aa, Homo Sapiens
SMINESISS

SEQ ID NO: 187803 - protein, 9 aa, Homo Sapiens
AEPFSAKLH

SEQ ID NO: 187804 - protein, 9 aa, Homo Sapiens
GSSGTSRGP

SEQ ID NO: 187805 - protein, 9 aa, Homo Sapiens
LDETINIVE

SEQ ID NO: 187806 - protein, 9 aa, Homo Sapiens
LTCRAASRT

SEQ ID NO: 187807 - protein, 9 aa, Homo Sapiens
NKLTEMPEK

SEQ ID NO: 187808 - protein, 9 aa, Homo Sapiens
KATLLNDIR

SEQ ID NO: 187809 - protein, 9 aa, Homo Sapiens
CPASGRETN

SEQ ID NO: 187810 - protein, 9 aa, Homo Sapiens
PFNRKSTIL

SEQ ID NO: 187811 - protein, 9 aa, Homo Sapiens
KERSLLLAL

SEQ ID NO: 187812 - protein, 9 aa, Homo Sapiens
QQLNEKLEQ

SEQ ID NO: 187813 - protein, 9 aa, Homo Sapiens
SQLIDEFLD

SEQ ID NO: 187814 - protein, 9 aa, Homo Sapiens
GAQKPAHAQ

SEQ ID NO: 187815 - protein, 9 aa, Homo Sapiens
KIGKRMKQK

SEQ ID NO: 187816 - protein, 9 aa, Homo Sapiens
EEMRKEQRR

SEQ ID NO: 187817 - protein, 9 aa, Homo Sapiens
VAAVCCVQY

SEQ ID NO: 187818 - protein, 9 aa, Homo Sapiens
GILTLSNYV

SEQ ID NO: 187819 - protein, 9 aa, Homo Sapiens
PQDNRSTNT

SEQ ID NO: 187820 - protein, 9 aa, Homo Sapiens
GAAMVTVVA

SEQ ID NO: 187821 - protein, 9 aa, Homo Sapiens
MVTVVAYRL

SEQ ID NO: 187822 - protein, 9 aa, Homo Sapiens
LALRAVISR

SEQ ID NO: 187823 - protein, 9 aa, Homo Sapiens
EMPEKCLSE

SEQ ID NO: 187824 - protein, 9 aa, Homo Sapiens
RAPGPLVFT

SEQ ID NO: 187825 - protein, 9 aa, Homo Sapiens
SSYRRKAKG

SEQ ID NO: 187826 - protein, 9 aa, Homo Sapiens
GVSARLCIC

SEQ ID NO: 187827 - protein, 9 aa, Homo Sapiens
LSDDYSNIV

SEQ ID NO: 187828 - protein, 9 aa, Homo Sapiens
TTPVHTSTP

SEQ ID NO: 187829 - protein, 9 aa, Homo Sapiens
YLMDVGVFY

SEQ ID NO: 187830 - protein, 9 aa, Homo Sapiens
YSPIYLMDV

SEQ ID NO: 187831 - protein, 9 aa, Homo Sapiens
CRKVGCDSV

SEQ ID NO: 187832 - protein, 9 aa, Homo Sapiens
ELIISSFSN

SEQ ID NO: 187833 - protein, 9 aa, Homo Sapiens
ENGSGMCKA

SEQ ID NO: 187834 - protein, 9 aa, Homo Sapiens
VFFIHMFTG

SEQ ID NO: 187835 - protein, 9 aa, Homo Sapiens
VQEITAHCK

SEQ ID NO: 187836 - protein, 9 aa, Homo Sapiens
LIGQYLEVN

SEQ ID NO: 187837 - protein, 9 aa, Homo Sapiens
GKRVEHHGA

SEQ ID NO: 187838 - protein, 9 aa, Homo Sapiens
SSLNVLFTA

SEQ ID NO: 187839 - protein, 9 aa, Homo Sapiens
AASRTSPRC

SEQ ID NO: 187840 - protein, 9 aa, Homo Sapiens
VEHHGAEKS

SEQ ID NO: 187841 - protein, 9 aa, Homo Sapiens
PCPGPPPLM

SEQ ID NO: 187842 - protein, 9 aa, Homo Sapiens
KEQQLNEKL

SEQ ID NO: 187843 - protein, 9 aa, Homo Sapiens
CEEASQTQN

SEQ ID NO: 187844 - protein, 9 aa, Homo Sapiens
LYLNCEEAS

SEQ ID NO: 187845 - protein, 9 aa, Homo Sapiens
SLLLALRAV

SEQ ID NO: 187846 - protein, 9 aa, Homo Sapiens
NINLEKPTE

SEQ ID NO: 187847 - protein, 9 aa, Homo Sapiens
TTFWSKKIL

SEQ ID NO: 187848 - protein, 9 aa, Homo Sapiens
PPELIISSF

SEQ ID NO: 187849 - protein, 9 aa, Homo Sapiens
TVVAYRLAE

SEQ ID NO: 187850 - protein, 9 aa, Homo Sapiens
PTMYHTGDI

SEQ ID NO: 187851 - protein, 9 aa, Homo Sapiens
PRQAEVLPH

SEQ ID NO: 187852 - protein, 9 aa, Homo Sapiens
LCQATVFRC

SEQ ID NO: 187853 - protein, 9 aa, Homo Sapiens
VYYKATLLN

SEQ ID NO: 187854 - protein, 9 aa, Homo Sapiens
GVAETLQNL

SEQ ID NO: 187855 - protein, 9 aa, Homo Sapiens
EVLDSPKDL

SEQ ID NO: 187856 - protein, 9 aa, Homo Sapiens
GVPFLLHKD

SEQ ID NO: 187857 - protein, 9 aa, Homo Sapiens
CISNAFVQR

SEQ ID NO: 187858 - protein, 9 aa, Homo Sapiens
TPDAPATQG

SEQ ID NO: 187859 - protein, 9 aa, Homo Sapiens
RVDTAGYLL

SEQ ID NO: 187860 - protein, 9 aa, Homo Sapiens
GCLLQVFFI

SEQ ID NO: 187861 - protein, 9 aa, Homo Sapiens
DFYRKNYIP

SEQ ID NO: 187862 - protein, 9 aa, Homo Sapiens
LGEEFGICK

SEQ ID NO: 187863 - protein, 9 aa, Homo Sapiens
NRSTNTCPA

SEQ ID NO: 187864 - protein, 9 aa, Homo Sapiens
PRCPRAPSK

SEQ ID NO: 187865 - protein, 9 aa, Homo Sapiens
ATLTISPSG

SEQ ID NO: 187866 - protein, 9 aa, Homo Sapiens
STTPVHTST

SEQ ID NO: 187867 - protein, 9 aa, Homo Sapiens
CVNNVKAGV

SEQ ID NO: 187868 - protein, 9 aa, Homo Sapiens
TQGGVESLL

SEQ ID NO: 187869 - protein, 9 aa, Homo Sapiens
PFLLHKDHL

SEQ ID NO: 187870 - protein, 9 aa, Homo Sapiens
EASASSLNV

SEQ ID NO: 187871 - protein, 9 aa, Homo Sapiens
NVSFIDICQ

SEQ ID NO: 187872 - protein, 9 aa, Homo Sapiens
LMDVGVFYV

SEQ ID NO: 187873 - protein, 9 aa, Homo Sapiens
NIVFLHNDR

SEQ ID NO: 187874 - protein, 9 aa, Homo Sapiens
APATQGGVE

SEQ ID NO: 187875 - protein, 9 aa, Homo Sapiens
NPNQICVNN

SEQ ID NO: 187876 - protein, 9 aa, Homo Sapiens
LYNDLYDDD

SEQ ID NO: 187877 - protein, 9 aa, Homo Sapiens
GIAGFPGFI

SEQ ID NO: 187878 - protein, 9 aa, Homo Sapiens
DSVIGSSKQ

SEQ ID NO: 187879 - protein, 9 aa, Homo Sapiens
NETECVSDN

SEQ ID NO: 187880 - protein, 9 aa, Homo Sapiens
NHLCQATVF

SEQ ID NO: 187881 - protein, 9 aa, Homo Sapiens
ITAHCKKHE

SEQ ID NO: 187882 - protein, 9 aa, Homo Sapiens
DMEDYDADS

SEQ ID NO: 187883 - protein, 9 aa, Homo Sapiens
DPSGMFRTQ

SEQ ID NO: 187884 - protein, 9 aa, Homo Sapiens
THTLQEMEA

SEQ ID NO: 187885 - protein, 9 aa, Homo Sapiens
RNHLCQATV

SEQ ID NO: 187886 - protein, 9 aa, Homo Sapiens
ISNAFVQRL

SEQ ID NO: 187887 - protein, 9 aa, Homo Sapiens
GTWPHPCPG

SEQ ID NO: 187888 - protein, 9 aa, Homo Sapiens
ITASTAGSE

SEQ ID NO: 187889 - protein, 9 aa, Homo Sapiens
STLSTTPVH

SEQ ID NO: 187890 - protein, 9 aa, Homo Sapiens
ICVNNVKAG

SEQ ID NO: 187891 - protein, 9 aa, Homo Sapiens
HTLQEMEAE

SEQ ID NO: 187892 - protein, 9 aa, Homo Sapiens
EDPLGEEFG

SEQ ID NO: 187893 - protein, 9 aa, Homo Sapiens
RKNYIPSLK

SEQ ID NO: 187894 - protein, 9 aa, Homo Sapiens
PAGGAQKPA

SEQ ID NO: 187895 - protein, 9 aa, Homo Sapiens
NFLEAEAAC

SEQ ID NO: 187896 - protein, 9 aa, Homo Sapiens
DDYSNIVFL

SEQ ID NO: 187897 - protein, 9 aa, Homo Sapiens
AKLHYTGPE

SEQ ID NO: 187898 - protein, 9 aa, Homo Sapiens
TAAKEHGAV

SEQ ID NO: 187899 - protein, 9 aa, Homo Sapiens
RVVLKKMPN

SEQ ID NO: 187900 - protein, 9 aa, Homo Sapiens
VGAIRPLVS

SEQ ID NO: 187901 - protein, 9 aa, Homo Sapiens
SFIIRLALA

SEQ ID NO: 187902 - protein, 9 aa, Homo Sapiens
KFWSLQQPE

SEQ ID NO: 187903 - protein, 9 aa, Homo Sapiens
YHQHVYHNR

SEQ ID NO: 187904 - protein, 9 aa, Homo Sapiens
QLLPCLGVS

SEQ ID NO: 187905 - protein, 9 aa, Homo Sapiens
DFWPYQSIK

SEQ ID NO: 187906 - protein, 9 aa, Homo Sapiens
SNGEDPLGE

SEQ ID NO: 187907 - protein, 9 aa, Homo Sapiens
GTSRGPSAM

SEQ ID NO: 187908 - protein, 9 aa, Homo Sapiens
SSDLLYNDL

SEQ ID NO: 187909 - protein, 9 aa, Homo Sapiens
LCLFLLCNS

SEQ ID NO: 187910 - protein, 9 aa, Homo Sapiens
GKRMKQKLL

SEQ ID NO: 187911 - protein, 9 aa, Homo Sapiens
TTTFWSKKI

SEQ ID NO: 187912 - protein, 9 aa, Homo Sapiens
VLFTASNCR

SEQ ID NO: 187913 - protein, 9 aa, Homo Sapiens
SQTEASASS

SEQ ID NO: 187914 - protein, 9 aa, Homo Sapiens
HGAVGAIRP

SEQ ID NO: 187915 - protein, 9 aa, Homo Sapiens
PVHTSTPVT

SEQ ID NO: 187916 - protein, 9 aa, Homo Sapiens
LGPVEAFDF

SEQ ID NO: 187917 - protein, 9 aa, Homo Sapiens
LDFIQSHLW

SEQ ID NO: 187918 - protein, 9 aa, Homo Sapiens
QGGVESLLQ

SEQ ID NO: 187919 - protein, 9 aa, Homo Sapiens
KDLEKKRIC

SEQ ID NO: 187920 - protein, 9 aa, Homo Sapiens
LFSKISLLF

SEQ ID NO: 187921 - protein, 9 aa, Homo Sapiens
GGVESLLQK

SEQ ID NO: 187922 - protein, 9 aa, Homo Sapiens
VLASFIIRL

SEQ ID NO: 187923 - protein, 9 aa, Homo Sapiens
HYYLTIFGQ

SEQ ID NO: 187924 - protein, 9 aa, Homo Sapiens
DPRDGKRVV

SEQ ID NO: 187925 - protein, 9 aa, Homo Sapiens
WNGKWHYKP

SEQ ID NO: 187926 - protein, 9 aa, Homo Sapiens
AYFRNHLCQ

SEQ ID NO: 187927 - protein, 9 aa, Homo Sapiens
RRQILLPFQ

SEQ ID NO: 187928 - protein, 9 aa, Homo Sapiens
HPPPPGTLM

SEQ ID NO: 187929 - protein, 9 aa, Homo Sapiens
VLQATEAGP

SEQ ID NO: 187930 - protein, 9 aa, Homo Sapiens
LEKRGRGGA

SEQ ID NO: 187931 - protein, 9 aa, Homo Sapiens
SNPCDFSDF

SEQ ID NO: 187932 - protein, 9 aa, Homo Sapiens
VFFRDLSDF

SEQ ID NO: 187933 - protein, 9 aa, Homo Sapiens
AGPCASATD

SEQ ID NO: 187934 - protein, 9 aa, Homo Sapiens
QGDQGIPGA

SEQ ID NO: 187935 - protein, 9 aa, Homo Sapiens
LESAFLELL

SEQ ID NO: 187936 - protein, 9 aa, Homo Sapiens
ITYPTTASE

SEQ ID NO: 187937 - protein, 9 aa, Homo Sapiens
QSSGRLRRP

SEQ ID NO: 187938 - protein, 9 aa, Homo Sapiens
DYELWVLCC

SEQ ID NO: 187939 - protein, 9 aa, Homo Sapiens
ETPPQPPRF

SEQ ID NO: 187940 - protein, 9 aa, Homo Sapiens
QCIYVLVCL

SEQ ID NO: 187941 - protein, 9 aa, Homo Sapiens
YQSSGRLRR

SEQ ID NO: 187942 - protein, 9 aa, Homo Sapiens
NQRNEDLYH

SEQ ID NO: 187943 - protein, 9 aa, Homo Sapiens
CTRRGRVRQ

SEQ ID NO: 187944 - protein, 9 aa, Homo Sapiens
IAWNEAAAV

SEQ ID NO: 187945 - protein, 9 aa, Homo Sapiens
TSAEFEVFR

SEQ ID NO: 187946 - protein, 9 aa, Homo Sapiens
QRLMDQGKS

SEQ ID NO: 187947 - protein, 9 aa, Homo Sapiens
YCTRALEYP

SEQ ID NO: 187948 - protein, 9 aa, Homo Sapiens
KAREGDEDP

SEQ ID NO: 187949 - protein, 9 aa, Homo Sapiens
NVVCYPIIF

SEQ ID NO: 187950 - protein, 9 aa, Homo Sapiens
GNVNVEMNV

SEQ ID NO: 187951 - protein, 9 aa, Homo Sapiens
PPAGPCASA

SEQ ID NO: 187952 - protein, 9 aa, Homo Sapiens
GCGNVALGP

SEQ ID NO: 187953 - protein, 9 aa, Homo Sapiens
SQHMTEVLR

SEQ ID NO: 187954 - protein, 9 aa, Homo Sapiens
GPLCTRRGR

SEQ ID NO: 187955 - protein, 9 aa, Homo Sapiens
QKAAAAGAK

SEQ ID NO: 187956 - protein, 9 aa, Homo Sapiens
AMEESPLLA

SEQ ID NO: 187957 - protein, 9 aa, Homo Sapiens
LCTRRGRVR

SEQ ID NO: 187958 - protein, 9 aa, Homo Sapiens
SKNSSRSNT

SEQ ID NO: 187959 - protein, 9 aa, Homo Sapiens
MAEELIFRY

SEQ ID NO: 187960 - protein, 9 aa, Homo Sapiens
PRLNASPTA

SEQ ID NO: 187961 - protein, 9 aa, Homo Sapiens
PRRQKAAAA

SEQ ID NO: 187962 - protein, 9 aa, Homo Sapiens
LKVRPKESW

SEQ ID NO: 187963 - protein, 9 aa, Homo Sapiens
PITYPTTAS

SEQ ID NO: 187964 - protein, 9 aa, Homo Sapiens
GADGVGKSA

SEQ ID NO: 187965 - protein, 9 aa, Homo Sapiens
HPGVRGSDG

SEQ ID NO: 187966 - protein, 9 aa, Homo Sapiens
SQLIRYTGY

SEQ ID NO: 187967 - protein, 9 aa, Homo Sapiens
MTEVLRRCP

SEQ ID NO: 187968 - protein, 9 aa, Homo Sapiens
NASPTAREE

SEQ ID NO: 187969 - protein, 9 aa, Homo Sapiens
FQIVKSVMI

SEQ ID NO: 187970 - protein, 9 aa, Homo Sapiens
RAKELSFMF

SEQ ID NO: 187971 - protein, 9 aa, Homo Sapiens
ASEIAVPEL

SEQ ID NO: 187972 - protein, 9 aa, Homo Sapiens
RFSQLTTFY

SEQ ID NO: 187973 - protein, 9 aa, Homo Sapiens
PQFIGQNQR

SEQ ID NO: 187974 - protein, 9 aa, Homo Sapiens
SQPLQYVTI

SEQ ID NO: 187975 - protein, 9 aa, Homo Sapiens
PPPGTLMAH

SEQ ID NO: 187976 - protein, 9 aa, Homo Sapiens
QIFVYSGIP

SEQ ID NO: 187977 - protein, 9 aa, Homo Sapiens
ALHLACASD

SEQ ID NO: 187978 - protein, 9 aa, Homo Sapiens
SNTKCLFIQ

SEQ ID NO: 187979 - protein, 9 aa, Homo Sapiens
ECVKVFTQN

SEQ ID NO: 187980 - protein, 9 aa, Homo Sapiens
DKYVKPTES

SEQ ID NO: 187981 - protein, 9 aa, Homo Sapiens
RGPEANLKV

SEQ ID NO: 187982 - protein, 9 aa, Homo Sapiens
MEELQERLD

SEQ ID NO: 187983 - protein, 9 aa, Homo Sapiens
MIPRPTPQM

SEQ ID NO: 187984 - protein, 9 aa, Homo Sapiens
YIAISQPLQ

SEQ ID NO: 187985 - protein, 9 aa, Homo Sapiens
QDTRRLRRE

SEQ ID NO: 187986 - protein, 9 aa, Homo Sapiens
NGNYTCIAW

SEQ ID NO: 187987 - protein, 9 aa, Homo Sapiens
WNEAAAVEH

SEQ ID NO: 187988 - protein, 9 aa, Homo Sapiens
EEKKKILLN

SEQ ID NO: 187989 - protein, 9 aa, Homo Sapiens
LKSRVKTIR

SEQ ID NO: 187990 - protein, 9 aa, Homo Sapiens
HRLSHSGLQ

SEQ ID NO: 187991 - protein, 9 aa, Homo Sapiens
GRQIRRGSL

SEQ ID NO: 187992 - protein, 9 aa, Homo Sapiens
LHLACASDH

SEQ ID NO: 187993 - protein, 9 aa, Homo Sapiens
KILLNLSCQ

SEQ ID NO: 187994 - protein, 9 aa, Homo Sapiens
LAVDYFSEC

SEQ ID NO: 187995 - protein, 9 aa, Homo Sapiens
SSSIQRLMD

SEQ ID NO: 187996 - protein, 9 aa, Homo Sapiens
SDFGVFGCQ

SEQ ID NO: 187997 - protein, 9 aa, Homo Sapiens
CHNKQCIPI

SEQ ID NO: 187998 - protein, 9 aa, Homo Sapiens
QAMMVNQAN

SEQ ID NO: 187999 - protein, 9 aa, Homo Sapiens
PGHPGVRGS

SEQ ID NO: 188000 - protein, 9 aa, Homo Sapiens
EVLRRCPHH

SEQ ID NO: 188001 - protein, 9 aa, Homo Sapiens
TESVTDYRT

SEQ ID NO: 188002 - protein, 9 aa, Homo Sapiens
PLQYVTIMN

SEQ ID NO: 188003 - protein, 9 aa, Homo Sapiens
VKGRTECHN

SEQ ID NO: 188004 - protein, 9 aa, Homo Sapiens
VSTGDTTSL

SEQ ID NO: 188005 - protein, 9 aa, Homo Sapiens
VLLAVVLQA

SEQ ID NO: 188006 - protein, 9 aa, Homo Sapiens
EEAPREEAQ

SEQ ID NO: 188007 - protein, 9 aa, Homo Sapiens
TSSEQEVVE

SEQ ID NO: 188008 - protein, 9 aa, Homo Sapiens
DNALAFSQS

SEQ ID NO: 188009 - protein, 9 aa, Homo Sapiens
FIGQNQRNE

SEQ ID NO: 188010 - protein, 9 aa, Homo Sapiens
QDGDSKARE

SEQ ID NO: 188011 - protein, 9 aa, Homo Sapiens
SEEVFFRDL

SEQ ID NO: 188012 - protein, 9 aa, Homo Sapiens
HRRSREEVD

SEQ ID NO: 188013 - protein, 9 aa, Homo Sapiens
QPHACPLCP

SEQ ID NO: 188014 - protein, 9 aa, Homo Sapiens
ILLPFQKPL

SEQ ID NO: 188015 - protein, 9 aa, Homo Sapiens
PTTASEIAV

SEQ ID NO: 188016 - protein, 9 aa, Homo Sapiens
VAPGVDLTV

SEQ ID NO: 188017 - protein, 9 aa, Homo Sapiens
KCVSDWQVD

SEQ ID NO: 188018 - protein, 9 aa, Homo Sapiens
ATMEELQER

SEQ ID NO: 188019 - protein, 9 aa, Homo Sapiens
NVAPGVDLT

SEQ ID NO: 188020 - protein, 9 aa, Homo Sapiens
VHPPPPGTL

SEQ ID NO: 188021 - protein, 9 aa, Homo Sapiens
EEVKTRKPS

SEQ ID NO: 188022 - protein, 9 aa, Homo Sapiens
GCEIICPEN

SEQ ID NO: 188023 - protein, 9 aa, Homo Sapiens
KMESFEFQV

SEQ ID NO: 188024 - protein, 9 aa, Homo Sapiens
VVVGADGVG

SEQ ID NO: 188025 - protein, 9 aa, Homo Sapiens
AGAKSRGGA

SEQ ID NO: 188026 - protein, 9 aa, Homo Sapiens
VMICSSSDS

SEQ ID NO: 188027 - protein, 9 aa, Homo Sapiens
MEEHGATME

SEQ ID NO: 188028 - protein, 9 aa, Homo Sapiens
PTESVTDYR

SEQ ID NO: 188029 - protein, 9 aa, Homo Sapiens
IRSEYKWMY

SEQ ID NO: 188030 - protein, 9 aa, Homo Sapiens
GPEANLKVR

SEQ ID NO: 188031 - protein, 9 aa, Homo Sapiens
TMEELQERL

SEQ ID NO: 188032 - protein, 9 aa, Homo Sapiens
KVMICSSSD

SEQ ID NO: 188033 - protein, 9 aa, Homo Sapiens
EEHGATMEE

SEQ ID NO: 188034 - protein, 9 aa, Homo Sapiens
KAAAAGAKS

SEQ ID NO: 188035 - protein, 9 aa, Homo Sapiens
QFIGQNQRN

SEQ ID NO: 188036 - protein, 9 aa, Homo Sapiens
NFKCVSDWQ

SEQ ID NO: 188037 - protein, 9 aa, Homo Sapiens
VLRRCPHHE

SEQ ID NO: 188038 - protein, 9 aa, Homo Sapiens
ADVNDNALA

SEQ ID NO: 188039 - protein, 9 aa, Homo Sapiens
GAFIITLNS

SEQ ID NO: 188040 - protein, 9 aa, Homo Sapiens
ISQPLQYVT

SEQ ID NO: 188041 - protein, 9 aa, Homo Sapiens
RPSEEVFFR

SEQ ID NO: 188042 - protein, 9 aa, Homo Sapiens
VNQDGDSKA

SEQ ID NO: 188043 - protein, 9 aa, Homo Sapiens
EGVCRLEKR

SEQ ID NO: 188044 - protein, 9 aa, Homo Sapiens
SNDEKKMES

SEQ ID NO: 188045 - protein, 9 aa, Homo Sapiens
QELRAQATL

SEQ ID NO: 188046 - protein, 9 aa, Homo Sapiens
YPEGELSGS

SEQ ID NO: 188047 - protein, 9 aa, Homo Sapiens
AWNEAAAVE

SEQ ID NO: 188048 - protein, 9 aa, Homo Sapiens
RLSHSGLQP

SEQ ID NO: 188049 - protein, 9 aa, Homo Sapiens
SVTDYRTAV

SEQ ID NO: 188050 - protein, 9 aa, Homo Sapiens
APETPPQPP

SEQ ID NO: 188051 - protein, 9 aa, Homo Sapiens
SAPETPPQP

SEQ ID NO: 188052 - protein, 9 aa, Homo Sapiens
LACASDHVK

SEQ ID NO: 188053 - protein, 9 aa, Homo Sapiens
YYQSSGRLR

SEQ ID NO: 188054 - protein, 9 aa, Homo Sapiens
KVRPKESWN

SEQ ID NO: 188055 - protein, 9 aa, Homo Sapiens
AAEPTEAKE

SEQ ID NO: 188056 - protein, 9 aa, Homo Sapiens
QEVVEALRE

SEQ ID NO: 188057 - protein, 9 aa, Homo Sapiens
SEIAVPELD

SEQ ID NO: 188058 - protein, 9 aa, Homo Sapiens
IICPENSHY

SEQ ID NO: 188059 - protein, 9 aa, Homo Sapiens
KIMAVRVSS

SEQ ID NO: 188060 - protein, 9 aa, Homo Sapiens
AVVLQATEA

SEQ ID NO: 188061 - protein, 9 aa, Homo Sapiens
VDPEEKKKI

SEQ ID NO: 188062 - protein, 9 aa, Homo Sapiens
ILEFEADRG

SEQ ID NO: 188063 - protein, 9 aa, Homo Sapiens
LRRKFFGDP

SEQ ID NO: 188064 - protein, 9 aa, Homo Sapiens
PETPPQPPR

SEQ ID NO: 188065 - protein, 9 aa, Homo Sapiens
EYPEGELSG

SEQ ID NO: 188066 - protein, 9 aa, Homo Sapiens
TRAIAIVSV

SEQ ID NO: 188067 - protein, 9 aa, Homo Sapiens
FESLVEPVN

SEQ ID NO: 188068 - protein, 9 aa, Homo Sapiens
KWGSKWNKE

SEQ ID NO: 188069 - protein, 9 aa, Homo Sapiens
KNVVCYPII

SEQ ID NO: 188070 - protein, 9 aa, Homo Sapiens
NTKCLFIQM

SEQ ID NO: 188071 - protein, 9 aa, Homo Sapiens
GTLMAHPPP

SEQ ID NO: 188072 - protein, 9 aa, Homo Sapiens
GGTESQDTR

SEQ ID NO: 188073 - protein, 9 aa, Homo Sapiens
ESSAPPPTP

SEQ ID NO: 188074 - protein, 9 aa, Homo Sapiens
RLMHRRSRE

SEQ ID NO: 188075 - protein, 9 aa, Homo Sapiens
QLQEQQVQL

SEQ ID NO: 188076 - protein, 9 aa, Homo Sapiens
SPTAREEAT

SEQ ID NO: 188077 - protein, 9 aa, Homo Sapiens
ECHNKQCIP

SEQ ID NO: 188078 - protein, 9 aa, Homo Sapiens
RGSDGLKGQ

SEQ ID NO: 188079 - protein, 9 aa, Homo Sapiens
SVMIPRPTP

SEQ ID NO: 188080 - protein, 9 aa, Homo Sapiens
LLRRKFFGD

SEQ ID NO: 188081 - protein, 9 aa, Homo Sapiens
PFQKPLIIF

SEQ ID NO: 188082 - protein, 9 aa, Homo Sapiens
SGSTRAIAI

SEQ ID NO: 188083 - protein, 9 aa, Homo Sapiens
PQAAAEPTE

SEQ ID NO: 188084 - protein, 9 aa, Homo Sapiens
AGVKIMAVR

SEQ ID NO: 188085 - protein, 9 aa, Homo Sapiens
WMYGKSLYH

SEQ ID NO: 188086 - protein, 9 aa, Homo Sapiens
TLARDMGPP

SEQ ID NO: 188087 - protein, 9 aa, Homo Sapiens
QKVMICSSS

SEQ ID NO: 188088 - protein, 9 aa, Homo Sapiens
AAGVKIMAV

SEQ ID NO: 188089 - protein, 9 aa, Homo Sapiens
YSVLEKGPA

SEQ ID NO: 188090 - protein, 9 aa, Homo Sapiens
SAFLELLIL

SEQ ID NO: 188091 - protein, 9 aa, Homo Sapiens
ESQDTRRLR

SEQ ID NO: 188092 - protein, 9 aa, Homo Sapiens
NSSRSNTKC

SEQ ID NO: 188093 - protein, 9 aa, Homo Sapiens
QLSEDGRQI

SEQ ID NO: 188094 - protein, 9 aa, Homo Sapiens
LQRLMHRRS

SEQ ID NO: 188095 - protein, 9 aa, Homo Sapiens
LNASPTARE

SEQ ID NO: 188096 - protein, 9 aa, Homo Sapiens
VEMNVAPGV

SEQ ID NO: 188097 - protein, 9 aa, Homo Sapiens
SEYKWMYGK

SEQ ID NO: 188098 - protein, 9 aa, Homo Sapiens
MESFEFQVI

SEQ ID NO: 188099 - protein, 9 aa, Homo Sapiens
KNSSRSNTK

SEQ ID NO: 188100 - protein, 9 aa, Homo Sapiens
RLMDQGKSS

SEQ ID NO: 188101 - protein, 9 aa, Homo Sapiens
FEADRGAFI

SEQ ID NO: 188102 - protein, 9 aa, Homo Sapiens
NVEMNVAPG

SEQ ID NO: 188103 - protein, 9 aa, Homo Sapiens
QVEKRTDQQ

SEQ ID NO: 188104 - protein, 9 aa, Homo Sapiens
RECAATEEL

SEQ ID NO: 188105 - protein, 9 aa, Homo Sapiens
TQLKSRVKT

SEQ ID NO: 188106 - protein, 9 aa, Homo Sapiens
VKTRKPSKK

SEQ ID NO: 188107 - protein, 9 aa, Homo Sapiens
DQGDQGIPG

SEQ ID NO: 188108 - protein, 9 aa, Homo Sapiens
ALGPVITPS

SEQ ID NO: 188109 - protein, 9 aa, Homo Sapiens
RIKPLQMEE

SEQ ID NO: 188110 - protein, 9 aa, Homo Sapiens
SPITETEYS

SEQ ID NO: 188111 - protein, 9 aa, Homo Sapiens
SGLQPHACP

SEQ ID NO: 188112 - protein, 9 aa, Homo Sapiens
RRAQKVMIC

SEQ ID NO: 188113 - protein, 9 aa, Homo Sapiens
GIKWGSKWN

SEQ ID NO: 188114 - protein, 9 aa, Homo Sapiens
SDGEDQAFG

SEQ ID NO: 188115 - protein, 9 aa, Homo Sapiens
QPPTPLLRR

SEQ ID NO: 188116 - protein, 9 aa, Homo Sapiens
NTSSEQEVV

SEQ ID NO: 188117 - protein, 9 aa, Homo Sapiens
VKTIRYESA

SEQ ID NO: 188118 - protein, 9 aa, Homo Sapiens
AEGVCRLEK

SEQ ID NO: 188119 - protein, 9 aa, Homo Sapiens
EESPLLAPL

SEQ ID NO: 188120 - protein, 9 aa, Homo Sapiens
CIYVLVCLV

SEQ ID NO: 188121 - protein, 9 aa, Homo Sapiens
AAAGVKIMA

SEQ ID NO: 188122 - protein, 9 aa, Homo Sapiens
SSRSNTKCL

SEQ ID NO: 188123 - protein, 9 aa, Homo Sapiens
LEYPEGELS

SEQ ID NO: 188124 - protein, 9 aa, Homo Sapiens
SVNQDGDSK

SEQ ID NO: 188125 - protein, 9 aa, Homo Sapiens
SRFSQLTTF

SEQ ID NO: 188126 - protein, 9 aa, Homo Sapiens
KSPITETEY

SEQ ID NO: 188127 - protein, 9 aa, Homo Sapiens
ESAFLELLI

SEQ ID NO: 188128 - protein, 9 aa, Homo Sapiens
APPAGPCAS

SEQ ID NO: 188129 - protein, 9 aa, Homo Sapiens
ERECAATEE

SEQ ID NO: 188130 - protein, 9 aa, Homo Sapiens
FLELLILRL

SEQ ID NO: 188131 - protein, 9 aa, Homo Sapiens
KKILLNLSC

SEQ ID NO: 188132 - protein, 9 aa, Homo Sapiens
ICPENSHYE

SEQ ID NO: 188133 - protein, 9 aa, Homo Sapiens
KPYKCNECV

SEQ ID NO: 188134 - protein, 9 aa, Homo Sapiens
SECIYWADF

SEQ ID NO: 188135 - protein, 9 aa, Homo Sapiens
PQPPRFSEL

SEQ ID NO: 188136 - protein, 9 aa, Homo Sapiens
VDYFSECIY

SEQ ID NO: 188137 - protein, 9 aa, Homo Sapiens
TRALEYPEG

SEQ ID NO: 188138 - protein, 9 aa, Homo Sapiens
QIVKSVMIP

SEQ ID NO: 188139 - protein, 9 aa, Homo Sapiens
QATLARDMG

SEQ ID NO: 188140 - protein, 9 aa, Homo Sapiens
EADRGAFII

SEQ ID NO: 188141 - protein, 9 aa, Homo Sapiens
EKKMESFEF

SEQ ID NO: 188142 - protein, 9 aa, Homo Sapiens
ELSFMFIET

SEQ ID NO: 188143 - protein, 9 aa, Homo Sapiens
RTECHNKQC

SEQ ID NO: 188144 - protein, 9 aa, Homo Sapiens
GVKIMAVRV

SEQ ID NO: 188145 - protein, 9 aa, Homo Sapiens
VFRTIKERA

SEQ ID NO: 188146 - protein, 9 aa, Homo Sapiens
GQNQRNEDL

SEQ ID NO: 188147 - protein, 9 aa, Homo Sapiens
RVKTIRYES

SEQ ID NO: 188148 - protein, 9 aa, Homo Sapiens
EQRAKELSF

SEQ ID NO: 188149 - protein, 9 aa, Homo Sapiens
TAREEATSP

SEQ ID NO: 188150 - protein, 9 aa, Homo Sapiens
DVLFTYKVK

SEQ ID NO: 188151 - protein, 9 aa, Homo Sapiens
EVFRTIKER

SEQ ID NO: 188152 - protein, 9 aa, Homo Sapiens
IMAVRVSSE

SEQ ID NO: 188153 - protein, 9 aa, Homo Sapiens
DHSAPETPP

SEQ ID NO: 188154 - protein, 9 aa, Homo Sapiens
ASPTAREEA

SEQ ID NO: 188155 - protein, 9 aa, Homo Sapiens
IAISQPLQY

SEQ ID NO: 188156 - protein, 9 aa, Homo Sapiens
PRGPEANLK

SEQ ID NO: 188157 - protein, 9 aa, Homo Sapiens
QNAFVSRLP

SEQ ID NO: 188158 - protein, 9 aa, Homo Sapiens
EYKWMYGKS

SEQ ID NO: 188159 - protein, 9 aa, Homo Sapiens
VSDWQVDSS

SEQ ID NO: 188160 - protein, 9 aa, Homo Sapiens
LMEEHGATM

SEQ ID NO: 188161 - protein, 9 aa, Homo Sapiens
GTWGPKERK

SEQ ID NO: 188162 - protein, 9 aa, Homo Sapiens
HLACASDHV

SEQ ID NO: 188163 - protein, 9 aa, Homo Sapiens
QKESSAPPP

SEQ ID NO: 188164 - protein, 9 aa, Homo Sapiens
EPQAAAEPT

SEQ ID NO: 188165 - protein, 9 aa, Homo Sapiens
TCNLGAQVE

SEQ ID NO: 188166 - protein, 9 aa, Homo Sapiens
GKNVVCYPI

SEQ ID NO: 188167 - protein, 9 aa, Homo Sapiens
ISPPRPGRL

SEQ ID NO: 188168 - protein, 9 aa, Homo Sapiens
KIYRILGKN

SEQ ID NO: 188169 - protein, 9 aa, Homo Sapiens
VGADGVGKS

SEQ ID NO: 188170 - protein, 9 aa, Homo Sapiens
SEQEVVEAL

SEQ ID NO: 188171 - protein, 9 aa, Homo Sapiens
FVYSGIPDR

SEQ ID NO: 188172 - protein, 9 aa, Homo Sapiens
PEANLKVRP

SEQ ID NO: 188173 - protein, 9 aa, Homo Sapiens
FNITVMAEE

SEQ ID NO: 188174 - protein, 9 aa, Homo Sapiens
QEQQVQLEM

SEQ ID NO: 188175 - protein, 9 aa, Homo Sapiens
FRDLSDFPS

SEQ ID NO: 188176 - protein, 9 aa, Homo Sapiens
ESPLLAPLN

SEQ ID NO: 188177 - protein, 9 aa, Homo Sapiens
YKWMYGKSL

SEQ ID NO: 188178 - protein, 9 aa, Homo Sapiens
TPPQPPRFS

SEQ ID NO: 188179 - protein, 9 aa, Homo Sapiens
PPTPPTCPV

SEQ ID NO: 188180 - protein, 9 aa, Homo Sapiens
AKELSFMFI

SEQ ID NO: 188181 - protein, 9 aa, Homo Sapiens
TETEYSVLE

SEQ ID NO: 188182 - protein, 9 aa, Homo Sapiens
DGVGKSALT

SEQ ID NO: 188183 - protein, 9 aa, Homo Sapiens
GPCASATDK

SEQ ID NO: 188184 - protein, 9 aa, Homo Sapiens
VKVFTQNSH

SEQ ID NO: 188185 - protein, 9 aa, Homo Sapiens
GDQGIPGAK

SEQ ID NO: 188186 - protein, 9 aa, Homo Sapiens
LQYVTIMNT

SEQ ID NO: 188187 - protein, 9 aa, Homo Sapiens
TEVLRRCPH

SEQ ID NO: 188188 - protein, 9 aa, Homo Sapiens
LPFQKPLII

SEQ ID NO: 188189 - protein, 9 aa, Homo Sapiens
PITETEYSV

SEQ ID NO: 188190 - protein, 9 aa, Homo Sapiens
SFMFIETSA

SEQ ID NO: 188191 - protein, 9 aa, Homo Sapiens
NVNVEMNVA

SEQ ID NO: 188192 - protein, 9 aa, Homo Sapiens
DYDRTVTLI

SEQ ID NO: 188193 - protein, 9 aa, Homo Sapiens
SGRLRRPVN

SEQ ID NO: 188194 - protein, 9 aa, Homo Sapiens
FKCVSDWQV

SEQ ID NO: 188195 - protein, 9 aa, Homo Sapiens
SHGNQSDGE

SEQ ID NO: 188196 - protein, 9 aa, Homo Sapiens
EAPREEAQE

SEQ ID NO: 188197 - protein, 9 aa, Homo Sapiens
QAAAEPTEA

SEQ ID NO: 188198 - protein, 9 aa, Homo Sapiens
ACHQAMMVN

SEQ ID NO: 188199 - protein, 9 aa, Homo Sapiens
NYTCIAWNE

SEQ ID NO: 188200 - protein, 9 aa, Homo Sapiens
AILPALSRF

SEQ ID NO: 188201 - protein, 9 aa, Homo Sapiens
KGTWGPKER

SEQ ID NO: 188202 - protein, 9 aa, Homo Sapiens
DIRSEYKWM

SEQ ID NO: 188203 - protein, 9 aa, Homo Sapiens
VRGSDGLKG

SEQ ID NO: 188204 - protein, 9 aa, Homo Sapiens
NLGAQVEKR

SEQ ID NO: 188205 - protein, 9 aa, Homo Sapiens
AAAGAKSRG

SEQ ID NO: 188206 - protein, 9 aa, Homo Sapiens
HSAPETPPQ

SEQ ID NO: 188207 - protein, 9 aa, Homo Sapiens
VADVNDNAL

SEQ ID NO: 188208 - protein, 9 aa, Homo Sapiens
KLQRLMHRR

SEQ ID NO: 188209 - protein, 9 aa, Homo Sapiens
LILRLAYRS

SEQ ID NO: 188210 - protein, 9 aa, Homo Sapiens
SRSNTKCLF

SEQ ID NO: 188211 - protein, 9 aa, Homo Sapiens
LDIRSEYKW

SEQ ID NO: 188212 - protein, 9 aa, Homo Sapiens
RYTGYKQPD

SEQ ID NO: 188213 - protein, 9 aa, Homo Sapiens
KGDQGDQGI

SEQ ID NO: 188214 - protein, 9 aa, Homo Sapiens
IYVLVCLVG

SEQ ID NO: 188215 - protein, 9 aa, Homo Sapiens
ESSGSTRAI

SEQ ID NO: 188216 - protein, 9 aa, Homo Sapiens
PAGPCASAT

SEQ ID NO: 188217 - protein, 9 aa, Homo Sapiens
NPCDFSDFG

SEQ ID NO: 188218 - protein, 9 aa, Homo Sapiens
PQIFVYSGI

SEQ ID NO: 188219 - protein, 9 aa, Homo Sapiens
SHSGLQPHA

SEQ ID NO: 188220 - protein, 9 aa, Homo Sapiens
GIPGAKGLP

SEQ ID NO: 188221 - protein, 9 aa, Homo Sapiens
SQKESSAPP

SEQ ID NO: 188222 - protein, 9 aa, Homo Sapiens
LLNLSCQSC

SEQ ID NO: 188223 - protein, 9 aa, Homo Sapiens
TESQDTRRL

SEQ ID NO: 188224 - protein, 9 aa, Homo Sapiens
NLSCQSCTF

SEQ ID NO: 188225 - protein, 9 aa, Homo Sapiens
GPLDAFFKI

SEQ ID NO: 188226 - protein, 9 aa, Homo Sapiens
TTASEIAVP

SEQ ID NO: 188227 - protein, 9 aa, Homo Sapiens
LRAQATLAR

SEQ ID NO: 188228 - protein, 9 aa, Homo Sapiens
TVTLISPPR

SEQ ID NO: 188229 - protein, 9 aa, Homo Sapiens
CIYWADFEL

SEQ ID NO: 188230 - protein, 9 aa, Homo Sapiens
CSSSDSSYM

SEQ ID NO: 188231 - protein, 9 aa, Homo Sapiens
PTEAKEGKE

SEQ ID NO: 188232 - protein, 9 aa, Homo Sapiens
YELWVLCCE

SEQ ID NO: 188233 - protein, 9 aa, Homo Sapiens
SGAFESLVE

SEQ ID NO: 188234 - protein, 9 aa, Homo Sapiens
MVAIQCIYV

SEQ ID NO: 188235 - protein, 9 aa, Homo Sapiens
GPKERKMHM

SEQ ID NO: 188236 - protein, 9 aa, Homo Sapiens
QKPLIIFTP

SEQ ID NO: 188237 - protein, 9 aa, Homo Sapiens
LCHDYELWV

SEQ ID NO: 188238 - protein, 9 aa, Homo Sapiens
AQATLARDM

SEQ ID NO: 188239 - protein, 9 aa, Homo Sapiens
LQEQQVQLE

SEQ ID NO: 188240 - protein, 9 aa, Homo Sapiens
LSEDGRQIR

SEQ ID NO: 188241 - protein, 9 aa, Homo Sapiens
RSNTKCLFI

SEQ ID NO: 188242 - protein, 9 aa, Homo Sapiens
QRNEDLYHQ

SEQ ID NO: 188243 - protein, 9 aa, Homo Sapiens
VLFTYKVKS

SEQ ID NO: 188244 - protein, 9 aa, Homo Sapiens
CASATDKAE

SEQ ID NO: 188245 - protein, 9 aa, Homo Sapiens
APQFIGQNQ

SEQ ID NO: 188246 - protein, 9 aa, Homo Sapiens
QLKSRVKTI

SEQ ID NO: 188247 - protein, 9 aa, Homo Sapiens
AAAEPTEAK

SEQ ID NO: 188248 - protein, 9 aa, Homo Sapiens
FMFIETSAK

SEQ ID NO: 188249 - protein, 9 aa, Homo Sapiens
VERECAATE

SEQ ID NO: 188250 - protein, 9 aa, Homo Sapiens
RRSREEVDG

SEQ ID NO: 188251 - protein, 9 aa, Homo Sapiens
ELLILRLAY

SEQ ID NO: 188252 - protein, 9 aa, Homo Sapiens
SSAPPPTPP

SEQ ID NO: 188253 - protein, 9 aa, Homo Sapiens
ADGVGKSAL

SEQ ID NO: 188254 - protein, 9 aa, Homo Sapiens
KPTESVTDY

SEQ ID NO: 188255 - protein, 9 aa, Homo Sapiens
PDSDVLFTY

SEQ ID NO: 188256 - protein, 9 aa, Homo Sapiens
RQIRRGSLG

SEQ ID NO: 188257 - protein, 9 aa, Homo Sapiens
MICSSSDSS

SEQ ID NO: 188258 - protein, 9 aa, Homo Sapiens
GNFQGPLDA

SEQ ID NO: 188259 - protein, 9 aa, Homo Sapiens
TASEIAVPE

SEQ ID NO: 188260 - protein, 9 aa, Homo Sapiens
HQAMMVNQA

SEQ ID NO: 188261 - protein, 9 aa, Homo Sapiens
GAQVEKRTD

SEQ ID NO: 188262 - protein, 9 aa, Homo Sapiens
MVNQANGIE

SEQ ID NO: 188263 - protein, 9 aa, Homo Sapiens
AAVERECAA

SEQ ID NO: 188264 - protein, 9 aa, Homo Sapiens
RPTGPQIFV

SEQ ID NO: 188265 - protein, 9 aa, Homo Sapiens
ARKNRIKPL

SEQ ID NO: 188266 - protein, 9 aa, Homo Sapiens
ELRAQATLA

SEQ ID NO: 188267 - protein, 9 aa, Homo Sapiens
NQANGIEAV

SEQ ID NO: 188268 - protein, 9 aa, Homo Sapiens
LGKNVVCYP

SEQ ID NO: 188269 - protein, 9 aa, Homo Sapiens
EHGATMEEL

SEQ ID NO: 188270 - protein, 9 aa, Homo Sapiens
NSKNSSRSN

SEQ ID NO: 188271 - protein, 9 aa, Homo Sapiens
VKIMAVRVS

SEQ ID NO: 188272 - protein, 9 aa, Homo Sapiens
YPDSDVLFT

SEQ ID NO: 188273 - protein, 9 aa, Homo Sapiens
GNYTCIAWN

SEQ ID NO: 188274 - protein, 9 aa, Homo Sapiens
PSSGVQNAF

SEQ ID NO: 188275 - protein, 9 aa, Homo Sapiens
ILYYYQSSG

SEQ ID NO: 188276 - protein, 9 aa, Homo Sapiens
QGPLDAFFK

SEQ ID NO: 188277 - protein, 9 aa, Homo Sapiens
PTAREEATS

SEQ ID NO: 188278 - protein, 9 aa, Homo Sapiens
LSHSGLQPH

SEQ ID NO: 188279 - protein, 9 aa, Homo Sapiens
LELLILRLA

SEQ ID NO: 188280 - protein, 9 aa, Homo Sapiens
PPTPLLRRK

SEQ ID NO: 188281 - protein, 9 aa, Homo Sapiens
DGDSKAREG

SEQ ID NO: 188282 - protein, 9 aa, Homo Sapiens
RLEKRGRGG

SEQ ID NO: 188283 - protein, 9 aa, Homo Sapiens
GVQNAFVSR

SEQ ID NO: 188284 - protein, 9 aa, Homo Sapiens
PPPPGTLMA

SEQ ID NO: 188285 - protein, 9 aa, Homo Sapiens
NRIKPLQME

SEQ ID NO: 188286 - protein, 9 aa, Homo Sapiens
FRTIKERAC

SEQ ID NO: 188287 - protein, 9 aa, Homo Sapiens
RRQKAAAAG

SEQ ID NO: 188288 - protein, 9 aa, Homo Sapiens
PYKCNECVK

SEQ ID NO: 188289 - protein, 9 aa, Homo Sapiens
LISPPRPGR

SEQ ID NO: 188290 - protein, 9 aa, Homo Sapiens
YYYQSSGRL

SEQ ID NO: 188291 - protein, 9 aa, Homo Sapiens
DRTVTLISP

SEQ ID NO: 188292 - protein, 9 aa, Homo Sapiens
LSFMFIETS

SEQ ID NO: 188293 - protein, 9 aa, Homo Sapiens
IQRLMDQGK

SEQ ID NO: 188294 - protein, 9 aa, Homo Sapiens
TVMAEELIF

SEQ ID NO: 188295 - protein, 9 aa, Homo Sapiens
WVLCCEYVP

SEQ ID NO: 188296 - protein, 9 aa, Homo Sapiens
VKSVMIPRP

SEQ ID NO: 188297 - protein, 9 aa, Homo Sapiens
RQAEMLTGR

SEQ ID NO: 188298 - protein, 9 aa, Homo Sapiens
RAQKVMICS

SEQ ID NO: 188299 - protein, 9 aa, Homo Sapiens
ANLKVRPKE

SEQ ID NO: 188300 - protein, 9 aa, Homo Sapiens
TGCGNVALG

SEQ ID NO: 188301 - protein, 9 aa, Homo Sapiens
KPGNFQGPL

SEQ ID NO: 188302 - protein, 9 aa, Homo Sapiens
QIRRGSLGG

SEQ ID NO: 188303 - protein, 9 aa, Homo Sapiens
VCRLEKRGR

SEQ ID NO: 188304 - protein, 9 aa, Homo Sapiens
VLVCLVGLV

SEQ ID NO: 188305 - protein, 9 aa, Homo Sapiens
GNQSDGEDQ

SEQ ID NO: 188306 - protein, 9 aa, Homo Sapiens
QRLMHRRSR

SEQ ID NO: 188307 - protein, 9 aa, Homo Sapiens
LTCNLGAQV

SEQ ID NO: 188308 - protein, 9 aa, Homo Sapiens
RTVTLISPP

SEQ ID NO: 188309 - protein, 9 aa, Homo Sapiens
AFLELLILR

SEQ ID NO: 188310 - protein, 9 aa, Homo Sapiens
ITETEYSVL

SEQ ID NO: 188311 - protein, 9 aa, Homo Sapiens
LVVVGADGV

SEQ ID NO: 188312 - protein, 9 aa, Homo Sapiens
SSGVQNAFV

SEQ ID NO: 188313 - protein, 9 aa, Homo Sapiens
PTPLLRRKF

SEQ ID NO: 188314 - protein, 9 aa, Homo Sapiens
WQVDSSGCV

SEQ ID NO: 188315 - protein, 9 aa, Homo Sapiens
AILYYYQSS

SEQ ID NO: 188316 - protein, 9 aa, Homo Sapiens
LLAVVLQAT

SEQ ID NO: 188317 - protein, 9 aa, Homo Sapiens
IGQNQRNED

SEQ ID NO: 188318 - protein, 9 aa, Homo Sapiens
GVCRLEKRG

SEQ ID NO: 188319 - protein, 9 aa, Homo Sapiens
TCIAWNEAA

SEQ ID NO: 188320 - protein, 9 aa, Homo Sapiens
VALGPVITP

SEQ ID NO: 188321 - protein, 9 aa, Homo Sapiens
AQVGCEIIC

SEQ ID NO: 188322 - protein, 9 aa, Homo Sapiens
ALEYPEGEL

SEQ ID NO: 188323 - protein, 9 aa, Homo Sapiens
LFLWLQLTV

SEQ ID NO: 188324 - protein, 9 aa, Homo Sapiens
NFNITVMAE

SEQ ID NO: 188325 - protein, 9 aa, Homo Sapiens
QVGCEIICP

SEQ ID NO: 188326 - protein, 9 aa, Homo Sapiens
GRPTGPQIF

SEQ ID NO: 188327 - protein, 9 aa, Homo Sapiens
VQNAFVSRL

SEQ ID NO: 188328 - protein, 9 aa, Homo Sapiens
AQKVMICSS

SEQ ID NO: 188329 - protein, 9 aa, Homo Sapiens
MMVNQANGI

SEQ ID NO: 188330 - protein, 9 aa, Homo Sapiens
CVSDWQVDS

SEQ ID NO: 188331 - protein, 9 aa, Homo Sapiens
LVLLAVVLQ

SEQ ID NO: 188332 - protein, 9 aa, Homo Sapiens
WNKELMAGR

SEQ ID NO: 188333 - protein, 9 aa, Homo Sapiens
SIQRLMDQG

SEQ ID NO: 188334 - protein, 9 aa, Homo Sapiens
CGNVALGPV

SEQ ID NO: 188335 - protein, 9 aa, Homo Sapiens
LQPHACPLC

SEQ ID NO: 188336 - protein, 9 aa, Homo Sapiens
CASDHVKVV

SEQ ID NO: 188337 - protein, 9 aa, Homo Sapiens
LGPVITPSN

SEQ ID NO: 188338 - protein, 9 aa, Homo Sapiens
NQSDGEDQA

SEQ ID NO: 188339 - protein, 9 aa, Homo Sapiens
ESFEFQVIG

SEQ ID NO: 188340 - protein, 9 aa, Homo Sapiens
VVGADGVGK

SEQ ID NO: 188341 - protein, 9 aa, Homo Sapiens
TLISPPRPG

SEQ ID NO: 188342 - protein, 9 aa, Homo Sapiens
HSGLQPHAC

SEQ ID NO: 188343 - protein, 9 aa, Homo Sapiens
KLVVVGADG

SEQ ID NO: 188344 - protein, 9 aa, Homo Sapiens
HARKNRIKP

SEQ ID NO: 188345 - protein, 9 aa, Homo Sapiens
TGYKQPDGS

SEQ ID NO: 188346 - protein, 9 aa, Homo Sapiens
RAQATLARD

SEQ ID NO: 188347 - protein, 9 aa, Homo Sapiens
ADRGAFIIT

SEQ ID NO: 188348 - protein, 9 aa, Homo Sapiens
LGSGAFESL

SEQ ID NO: 188349 - protein, 9 aa, Homo Sapiens
CAATEELLA

SEQ ID NO: 188350 - protein, 9 aa, Homo Sapiens
KTIRYESAS

SEQ ID NO: 188351 - protein, 9 aa, Homo Sapiens
PTGPQIFVY

SEQ ID NO: 188352 - protein, 9 aa, Homo Sapiens
RRKFFGDPT

SEQ ID NO: 188353 - protein, 9 aa, Homo Sapiens
SLLVSTHVS

SEQ ID NO: 188354 - protein, 9 aa, Homo Sapiens
QLEMDMSKP

SEQ ID NO: 188355 - protein, 9 aa, Homo Sapiens
QSDGEDQAF

SEQ ID NO: 188356 - protein, 9 aa, Homo Sapiens
EYPESSGST

SEQ ID NO: 188357 - protein, 9 aa, Homo Sapiens
PESSGSTRA

SEQ ID NO: 188358 - protein, 9 aa, Homo Sapiens
PGVRGSDGL

SEQ ID NO: 188359 - protein, 9 aa, Homo Sapiens
AMMVNQANG

SEQ ID NO: 188360 - protein, 9 aa, Homo Sapiens
KESSAPPPT

SEQ ID NO: 188361 - protein, 9 aa, Homo Sapiens
KPLQMEEEE

SEQ ID NO: 188362 - protein, 9 aa, Homo Sapiens
VAIQCIYVL

SEQ ID NO: 188363 - protein, 9 aa, Homo Sapiens
AEPTEAKEG

SEQ ID NO: 188364 - protein, 9 aa, Homo Sapiens
PREEAQELQ

SEQ ID NO: 188365 - protein, 9 aa, Homo Sapiens
GDSKAREGD

SEQ ID NO: 188366 - protein, 9 aa, Homo Sapiens
LAAAVEREC

SEQ ID NO: 188367 - protein, 9 aa, Homo Sapiens
RNFKCVSDW

SEQ ID NO: 188368 - protein, 9 aa, Homo Sapiens
PPRLNASPT

SEQ ID NO: 188369 - protein, 9 aa, Homo Sapiens
RNFNITVMA

SEQ ID NO: 188370 - protein, 9 aa, Homo Sapiens
GDQGDQGIP

SEQ ID NO: 188371 - protein, 9 aa, Homo Sapiens
ITVMAEELI

SEQ ID NO: 188372 - protein, 9 aa, Homo Sapiens
SGVQNAFVS

SEQ ID NO: 188373 - protein, 9 aa, Homo Sapiens
QGIPGAKGL

SEQ ID NO: 188374 - protein, 9 aa, Homo Sapiens
AISQPLQYV

SEQ ID NO: 188375 - protein, 9 aa, Homo Sapiens
ILPALSRFS

SEQ ID NO: 188376 - protein, 9 aa, Homo Sapiens
YKLVVVGAD

SEQ ID NO: 188377 - protein, 9 aa, Homo Sapiens
KEPSSGVQN

SEQ ID NO: 188378 - protein, 9 aa, Homo Sapiens
YVLVCLVGL

SEQ ID NO: 188379 - protein, 9 aa, Homo Sapiens
GAFESLVEP

SEQ ID NO: 188380 - protein, 9 aa, Homo Sapiens
HNKQCIPIS

SEQ ID NO: 188381 - protein, 9 aa, Homo Sapiens
EFEVFRTIK

SEQ ID NO: 188382 - protein, 9 aa, Homo Sapiens
RALEYPEGE

SEQ ID NO: 188383 - protein, 9 aa, Homo Sapiens
LPALSRFSQ

SEQ ID NO: 188384 - protein, 9 aa, Homo Sapiens
DGEDQAFGD

SEQ ID NO: 188385 - protein, 9 aa, Homo Sapiens
EPSSGVQNA

SEQ ID NO: 188386 - protein, 9 aa, Homo Sapiens
ASDHVKVVT

SEQ ID NO: 188387 - protein, 9 aa, Homo Sapiens
GSGAFESLV

SEQ ID NO: 188388 - protein, 9 aa, Homo Sapiens
PFQIVKSVM

SEQ ID NO: 188389 - protein, 9 aa, Homo Sapiens
LGAQVEKRT

SEQ ID NO: 188390 - protein, 9 aa, Homo Sapiens
APPPTPPTC

SEQ ID NO: 188391 - protein, 9 aa, Homo Sapiens
VVLQATEAG

SEQ ID NO: 188392 - protein, 9 aa, Homo Sapiens
IYRILGKNV

SEQ ID NO: 188393 - protein, 9 aa, Homo Sapiens
TSNDEKKME

SEQ ID NO: 188394 - protein, 9 aa, Homo Sapiens
LEFEADRGA

SEQ ID NO: 188395 - protein, 9 aa, Homo Sapiens
APREEAQEL

SEQ ID NO: 188396 - protein, 9 aa, Homo Sapiens
QPLQYVTIM

SEQ ID NO: 188397 - protein, 9 aa, Homo Sapiens
PGTLMAHPP

SEQ ID NO: 188398 - protein, 9 aa, Homo Sapiens
HTSAEFEVF

SEQ ID NO: 188399 - protein, 9 aa, Homo Sapiens
TYPTTASEI

SEQ ID NO: 188400 - protein, 9 aa, Homo Sapiens
QILLPFQKP

SEQ ID NO: 188401 - protein, 9 aa, Homo Sapiens
YRILGKNVV

SEQ ID NO: 188402 - protein, 9 aa, Homo Sapiens
AFESLVEPV

SEQ ID NO: 188403 - protein, 9 aa, Homo Sapiens
PCDFSDFGV

SEQ ID NO: 188404 - protein, 9 aa, Homo Sapiens
PLCTRRGRV

SEQ ID NO: 188405 - protein, 9 aa, Homo Sapiens
IKPLQMEEE

SEQ ID NO: 188406 - protein, 9 aa, Homo Sapiens
LAPLNVVPP

SEQ ID NO: 188407 - protein, 9 aa, Homo Sapiens
LLAPLNVVP

SEQ ID NO: 188408 - protein, 9 aa, Homo Sapiens
SRNFNITVM

SEQ ID NO: 188409 - protein, 9 aa, Homo Sapiens
HMTEVLRRC

SEQ ID NO: 188410 - protein, 9 aa, Homo Sapiens
TWGPKERKM

SEQ ID NO: 188411 - protein, 9 aa, Homo Sapiens
LQELRAQAT

SEQ ID NO: 188412 - protein, 9 aa, Homo Sapiens
AEFEVFRTI

SEQ ID NO: 188413 - protein, 9 aa, Homo Sapiens
LWVLCCEYV

SEQ ID NO: 188414 - protein, 9 aa, Homo Sapiens
MHRRSREEV

SEQ ID NO: 188415 - protein, 9 aa, Homo Sapiens
VNQANGIEA

SEQ ID NO: 188416 - protein, 9 aa, Homo Sapiens
PGNFQGPLD

SEQ ID NO: 188417 - protein, 9 aa, Homo Sapiens
LAFSQSEYT

SEQ ID NO: 188418 - protein, 9 aa, Homo Sapiens
MAVRVSSED

SEQ ID NO: 188419 - protein, 9 aa, Homo Sapiens
AAMEESPLL

SEQ ID NO: 188420 - protein, 9 aa, Homo Sapiens
NDNALAFSQ

SEQ ID NO: 188421 - protein, 9 aa, Homo Sapiens
EDGRQIRRG

SEQ ID NO: 188422 - protein, 9 aa, Homo Sapiens
EKKKILLNL

SEQ ID NO: 188423 - protein, 9 aa, Homo Sapiens
KWMYGKSLY

SEQ ID NO: 188424 - protein, 9 aa, Homo Sapiens
KAAAGVKIM

SEQ ID NO: 188425 - protein, 9 aa, Homo Sapiens
CHQAMMVNQ

SEQ ID NO: 188426 - protein, 9 aa, Homo Sapiens
LNLSCQSCT

SEQ ID NO: 188427 - protein, 9 aa, Homo Sapiens
LMHRRSREE

SEQ ID NO: 188428 - protein, 9 aa, Homo Sapiens
KYVKPTESV

SEQ ID NO: 188429 - protein, 9 aa, Homo Sapiens
AQVEKRTDQ

SEQ ID NO: 188430 - protein, 9 aa, Homo Sapiens
RILGKNVVC

SEQ ID NO: 188431 - protein, 9 aa, Homo Sapiens
SAEFEVFRT

SEQ ID NO: 188432 - protein, 9 aa, Homo Sapiens
LEMDMSKPD

SEQ ID NO: 188433 - protein, 9 aa, Homo Sapiens
PYCTRALEY

SEQ ID NO: 188434 - protein, 9 aa, Homo Sapiens
CVKVFTQNS

SEQ ID NO: 188435 - protein, 9 aa, Homo Sapiens
NSQLIRYTG

SEQ ID NO: 188436 - protein, 9 aa, Homo Sapiens
EAQELQLST

SEQ ID NO: 188437 - protein, 9 aa, Homo Sapiens
SLVEPVNGK

SEQ ID NO: 188438 - protein, 9 aa, Homo Sapiens
NSNPCDFSD

SEQ ID NO: 188439 - protein, 9 aa, Homo Sapiens
EEAQELQLS

SEQ ID NO: 188440 - protein, 9 aa, Homo Sapiens
LLAEGVCRL

SEQ ID NO: 188441 - protein, 9 aa, Homo Sapiens
FQGPLDAFF

SEQ ID NO: 188442 - protein, 9 aa, Homo Sapiens
GKEPSSGVQ

SEQ ID NO: 188443 - protein, 9 aa, Homo Sapiens
AIQCIYVLV

SEQ ID NO: 188444 - protein, 9 aa, Homo Sapiens
SKWNKELMA

SEQ ID NO: 188445 - protein, 9 aa, Homo Sapiens
QLIRYTGYK

SEQ ID NO: 188446 - protein, 9 aa, Homo Sapiens
ASATDKAEE

SEQ ID NO: 188447 - protein, 9 aa, Homo Sapiens
EIICPENSH

SEQ ID NO: 188448 - protein, 9 aa, Homo Sapiens
NALAFSQSE

SEQ ID NO: 188449 - protein, 9 aa, Homo Sapiens
KNRIKPLQM

SEQ ID NO: 188450 - protein, 9 aa, Homo Sapiens
TGPQIFVYS

SEQ ID NO: 188451 - protein, 9 aa, Homo Sapiens
LMDQGKSSL

SEQ ID NO: 188452 - protein, 9 aa, Homo Sapiens
YVKPTESVT

SEQ ID NO: 188453 - protein, 9 aa, Homo Sapiens
SDWQVDSSG

SEQ ID NO: 188454 - protein, 9 aa, Homo Sapiens
LYYYQSSGR

SEQ ID NO: 188455 - protein, 9 aa, Homo Sapiens
SDGLKGQKG

SEQ ID NO: 188456 - protein, 9 aa, Homo Sapiens
KELSFMFIE

SEQ ID NO: 188457 - protein, 9 aa, Homo Sapiens
NVALGPVIT

SEQ ID NO: 188458 - protein, 9 aa, Homo Sapiens
NDEKKMESF

SEQ ID NO: 188459 - protein, 9 aa, Homo Sapiens
SATDKAEEV

SEQ ID NO: 188460 - protein, 9 aa, Homo Sapiens
LIRYTGYKQ

SEQ ID NO: 188461 - protein, 9 aa, Homo Sapiens
DFSDFGVFG

SEQ ID NO: 188462 - protein, 9 aa, Homo Sapiens
IVKSVMIPR

SEQ ID NO: 188463 - protein, 9 aa, Homo Sapiens
DWQVDSSGC

SEQ ID NO: 188464 - protein, 9 aa, Homo Sapiens
AAAAGAKSR

SEQ ID NO: 188465 - protein, 9 aa, Homo Sapiens
STRAIAIVS

SEQ ID NO: 188466 - protein, 9 aa, Homo Sapiens
LLILRLAYR

SEQ ID NO: 188467 - protein, 9 aa, Homo Sapiens
DQGIPGAKG

SEQ ID NO: 188468 - protein, 9 aa, Homo Sapiens
PLLRRKFFG

SEQ ID NO: 188469 - protein, 9 aa, Homo Sapiens
YKCNECVKV

SEQ ID NO: 188470 - protein, 9 aa, Homo Sapiens
TEAKEGKEK

SEQ ID NO: 188471 - protein, 9 aa, Homo Sapiens
CIAWNEAAA

SEQ ID NO: 188472 - protein, 9 aa, Homo Sapiens
DFGVFGCQY

SEQ ID NO: 188473 - protein, 9 aa, Homo Sapiens
NKELMAGRE

SEQ ID NO: 188474 - protein, 9 aa, Homo Sapiens
ECAATEELL

SEQ ID NO: 188475 - protein, 9 aa, Homo Sapiens
MEESPLLAP

SEQ ID NO: 188476 - protein, 9 aa, Homo Sapiens
MNVAPGVDL

SEQ ID NO: 188477 - protein, 9 aa, Homo Sapiens
EQQVQLEMD

SEQ ID NO: 188478 - protein, 9 aa, Homo Sapiens
SEDGRQIRR

SEQ ID NO: 188479 - protein, 9 aa, Homo Sapiens
EANLKVRPK

SEQ ID NO: 188480 - protein, 9 aa, Homo Sapiens
PPGTLMAHP

SEQ ID NO: 188481 - protein, 9 aa, Homo Sapiens
YPTTASEIA

SEQ ID NO: 188482 - protein, 9 aa, Homo Sapiens
FSQLTTFYF

SEQ ID NO: 188483 - protein, 9 aa, Homo Sapiens
ALSRFSQLT

SEQ ID NO: 188484 - protein, 9 aa, Homo Sapiens
ATLARDMGP

SEQ ID NO: 188485 - protein, 9 aa, Homo Sapiens
PEEKKKILL

SEQ ID NO: 188486 - protein, 9 aa, Homo Sapiens
SQDTRRLRR

SEQ ID NO: 188487 - protein, 9 aa, Homo Sapiens
DVNDNALAF

SEQ ID NO: 188488 - protein, 9 aa, Homo Sapiens
GATMEELQE

SEQ ID NO: 188489 - protein, 9 aa, Homo Sapiens
RQILLPFQK

SEQ ID NO: 188490 - protein, 9 aa, Homo Sapiens
HGNQSDGED

SEQ ID NO: 188491 - protein, 9 aa, Homo Sapiens
SPLLAPLNV

SEQ ID NO: 188492 - protein, 9 aa, Homo Sapiens
WGPKERKMH

SEQ ID NO: 188493 - protein, 9 aa, Homo Sapiens
RQKAAAAGA

SEQ ID NO: 188494 - protein, 9 aa, Homo Sapiens
VNDNALAFS

SEQ ID NO: 188495 - protein, 9 aa, Homo Sapiens
GHPGVRGSD

SEQ ID NO: 188496 - protein, 9 aa, Homo Sapiens
FEVFRTIKE

SEQ ID NO: 188497 - protein, 9 aa, Homo Sapiens
REEAQELQL

SEQ ID NO: 188498 - protein, 9 aa, Homo Sapiens
FQKPLIIFT

SEQ ID NO: 188499 - protein, 9 aa, Homo Sapiens
ETEYSVLEK

SEQ ID NO: 188500 - protein, 9 aa, Homo Sapiens
PKERKMHMP

SEQ ID NO: 188501 - protein, 9 aa, Homo Sapiens
DSDVLFTYK

SEQ ID NO: 188502 - protein, 9 aa, Homo Sapiens
VGCEIICPE

SEQ ID NO: 188503 - protein, 9 aa, Homo Sapiens
ILGKNVVCY

SEQ ID NO: 188504 - protein, 9 aa, Homo Sapiens
VEKRTDQQL

SEQ ID NO: 188505 - protein, 9 aa, Homo Sapiens
CDFSDFGVF

SEQ ID NO: 188506 - protein, 9 aa, Homo Sapiens
YPESSGSTR

SEQ ID NO: 188507 - protein, 9 aa, Homo Sapiens
QHMTEVLRR

SEQ ID NO: 188508 - protein, 9 aa, Homo Sapiens
PLDAFFKII

SEQ ID NO: 188509 - protein, 9 aa, Homo Sapiens
CEIICPENS

SEQ ID NO: 188510 - protein, 9 aa, Homo Sapiens
QELQLSTAM

SEQ ID NO: 188511 - protein, 9 aa, Homo Sapiens
EPTEAKEGK

SEQ ID NO: 188512 - protein, 9 aa, Homo Sapiens
ELWVLCCEY

SEQ ID NO: 188513 - protein, 9 aa, Homo Sapiens
PLCHDYELW

SEQ ID NO: 188514 - protein, 9 aa, Homo Sapiens
DYFSECIYW

SEQ ID NO: 188515 - protein, 9 aa, Homo Sapiens
AAAVERECA

SEQ ID NO: 188516 - protein, 9 aa, Homo Sapiens
EEVFFRDLS

SEQ ID NO: 188517 - protein, 9 aa, Homo Sapiens
TECHNKQCI

SEQ ID NO: 188518 - protein, 9 aa, Homo Sapiens
DEKKMESFE

SEQ ID NO: 188519 - protein, 9 aa, Homo Sapiens
HGATMEELQ

SEQ ID NO: 188520 - protein, 9 aa, Homo Sapiens
NQDGDSKAR

SEQ ID NO: 188521 - protein, 9 aa, Homo Sapiens
IFVYSGIPD

SEQ ID NO: 188522 - protein, 9 aa, Homo Sapiens
DTRRLRREG

SEQ ID NO: 188523 - protein, 9 aa, Homo Sapiens
DRPSEEVFF

SEQ ID NO: 188524 - protein, 9 aa, Homo Sapiens
VQLEMDMSK

SEQ ID NO: 188525 - protein, 9 aa, Homo Sapiens
FSDFGVFGC

SEQ ID NO: 188526 - protein, 9 aa, Homo Sapiens
KKMESFEFQ

SEQ ID NO: 188527 - protein, 9 aa, Homo Sapiens
SGPLCTRRG

SEQ ID NO: 188528 - protein, 9 aa, Homo Sapiens
PPQPPRFSE

SEQ ID NO: 188529 - protein, 9 aa, Homo Sapiens
KSVMIPRPT

SEQ ID NO: 188530 - protein, 9 aa, Homo Sapiens
SVSTGDTTS

SEQ ID NO: 188531 - protein, 9 aa, Homo Sapiens
EQEVVEALR

SEQ ID NO: 188532 - protein, 9 aa, Homo Sapiens
QARASGPLC

SEQ ID NO: 188533 - protein, 9 aa, Homo Sapiens
KWNKELMAG

SEQ ID NO: 188534 - protein, 9 aa, Homo Sapiens
ESLVEPVNG

SEQ ID NO: 188535 - protein, 9 aa, Homo Sapiens
RAQVGCEII

SEQ ID NO: 188536 - protein, 9 aa, Homo Sapiens
LMAHPPPPG

SEQ ID NO: 188537 - protein, 9 aa, Homo Sapiens
FLFLWLQLT

SEQ ID NO: 188538 - protein, 9 aa, Homo Sapiens
SRVKTIRYE

SEQ ID NO: 188539 - protein, 9 aa, Homo Sapiens
DGRQIRRGS

SEQ ID NO: 188540 - protein, 9 aa, Homo Sapiens
QRAKELSFM

SEQ ID NO: 188541 - protein, 9 aa, Homo Sapiens
SAPPPTPPT

SEQ ID NO: 188542 - protein, 9 aa, Homo Sapiens
AQELQLSTA

SEQ ID NO: 188543 - protein, 9 aa, Homo Sapiens
GTESQDTRR

SEQ ID NO: 188544 - protein, 9 aa, Homo Sapiens
RLNASPTAR

SEQ ID NO: 188545 - protein, 9 aa, Homo Sapiens
NLKVRPKES

SEQ ID NO: 188546 - protein, 9 aa, Homo Sapiens
CRLEKRGRG

SEQ ID NO: 188547 - protein, 9 aa, Homo Sapiens
LLPFQKPLI

SEQ ID NO: 188548 - protein, 9 aa, Homo Sapiens
DSKAREGDE

SEQ ID NO: 188549 - protein, 9 aa, Homo Sapiens
RASGPLCTR

SEQ ID NO: 188550 - protein, 9 aa, Homo Sapiens
GRTECHNKQ

SEQ ID NO: 188551 - protein, 9 aa, Homo Sapiens
LAEGVCRLE

SEQ ID NO: 188552 - protein, 9 aa, Homo Sapiens
TEYSVLEKG

SEQ ID NO: 188553 - protein, 9 aa, Homo Sapiens
WGSKWNKEL

SEQ ID NO: 188554 - protein, 9 aa, Homo Sapiens
LSRFSQLTT

SEQ ID NO: 188555 - protein, 9 aa, Homo Sapiens
RSREEVDGT

SEQ ID NO: 188556 - protein, 9 aa, Homo Sapiens
VMIPRPTPQ

SEQ ID NO: 188557 - protein, 9 aa, Homo Sapiens
DHARKNRIK

SEQ ID NO: 188558 - protein, 9 aa, Homo Sapiens
PCASATDKA

SEQ ID NO: 188559 - protein, 9 aa, Homo Sapiens
EMNVAPGVD

SEQ ID NO: 188560 - protein, 9 aa, Homo Sapiens
SDVLFTYKV

SEQ ID NO: 188561 - protein, 9 aa, Homo Sapiens
DRGAFIITL

SEQ ID NO: 188562 - protein, 9 aa, Homo Sapiens
PLLAPLNVV

SEQ ID NO: 188563 - protein, 9 aa, Homo Sapiens
SKAREGDED

SEQ ID NO: 188564 - protein, 9 aa, Homo Sapiens
VTLISPPRP

SEQ ID NO: 188565 - protein, 9 aa, Homo Sapiens
KSRVKTIRY

SEQ ID NO: 188566 - protein, 9 aa, Homo Sapiens
CTRALEYPE

SEQ ID NO: 188567 - protein, 9 aa, Homo Sapiens
TPLLRRKFF

SEQ ID NO: 188568 - protein, 9 aa, Homo Sapiens
EYSVLEKGP

SEQ ID NO: 188569 - protein, 9 aa, Homo Sapiens
LAVVLQATE

SEQ ID NO: 188570 - protein, 9 aa, Homo Sapiens
TVLIEGKKN

SEQ ID NO: 188571 - protein, 9 aa, Homo Sapiens
FSECIYWAD

SEQ ID NO: 188572 - protein, 9 aa, Homo Sapiens
KQPPTPLLR

SEQ ID NO: 188573 - protein, 9 aa, Homo Sapiens
VNVEMNVAP

SEQ ID NO: 188574 - protein, 9 aa, Homo Sapiens
NITVMAEEL

SEQ ID NO: 188575 - protein, 9 aa, Homo Sapiens
ACASDHVKV

SEQ ID NO: 188576 - protein, 9 aa, Homo Sapiens
ARASGPLCT

SEQ ID NO: 188577 - protein, 9 aa, Homo Sapiens
KKPGNFQGP

SEQ ID NO: 188578 - protein, 9 aa, Homo Sapiens
ILLNLSCQS

SEQ ID NO: 188579 - protein, 9 aa, Homo Sapiens
AAGAKSRGG

SEQ ID NO: 188580 - protein, 9 aa, Homo Sapiens
PALSRFSQL

SEQ ID NO: 188581 - protein, 9 aa, Homo Sapiens
RRLRREGRW

SEQ ID NO: 188582 - protein, 9 aa, Homo Sapiens
CHDYELWVL

SEQ ID NO: 188583 - protein, 9 aa, Homo Sapiens
KGRTECHNK

SEQ ID NO: 188584 - protein, 9 aa, Homo Sapiens
GLQPHACPL

SEQ ID NO: 188585 - protein, 9 aa, Homo Sapiens
QQVQLEMDM

SEQ ID NO: 188586 - protein, 9 aa, Homo Sapiens
LRRCPHHER

SEQ ID NO: 188587 - protein, 9 aa, Homo Sapiens
QKGTWGPKE

SEQ ID NO: 188588 - protein, 9 aa, Homo Sapiens
IKWGSKWNK

SEQ ID NO: 188589 - protein, 9 aa, Homo Sapiens
QSHGNQSDG

SEQ ID NO: 188590 - protein, 9 aa, Homo Sapiens
GNVALGPVI

SEQ ID NO: 188591 - protein, 9 aa, Homo Sapiens
IQCIYVLVC

SEQ ID NO: 188592 - protein, 9 aa, Homo Sapiens
KERKMHMPF

SEQ ID NO: 188593 - protein, 9 aa, Homo Sapiens
IPGAKGLPG

SEQ ID NO: 188594 - protein, 9 aa, Homo Sapiens
HDYELWVLC

SEQ ID NO: 188595 - protein, 9 aa, Homo Sapiens
ASGPLCTRR

SEQ ID NO: 188596 - protein, 9 aa, Homo Sapiens
SSGRLRRPV

SEQ ID NO: 188597 - protein, 9 aa, Homo Sapiens
ATGCGNVAL

SEQ ID NO: 188598 - protein, 9 aa, Homo Sapiens
SSIQRLMDQ

SEQ ID NO: 188599 - protein, 9 aa, Homo Sapiens
QNQRNEDLY

SEQ ID NO: 188600 - protein, 9 aa, Homo Sapiens
EVFFRDLSD

SEQ ID NO: 188601 - protein, 9 aa, Homo Sapiens
RQKGTWGPK

SEQ ID NO: 188602 - protein, 9 aa, Homo Sapiens
YTGYKQPDG

SEQ ID NO: 188603 - protein, 9 aa, Homo Sapiens
EVKTRKPSK

SEQ ID NO: 188604 - protein, 9 aa, Homo Sapiens
CNLGAQVEK

SEQ ID NO: 188605 - protein, 9 aa, Homo Sapiens
TRRLRREGR

SEQ ID NO: 188606 - protein, 9 aa, Homo Sapiens
NQSHGNQSD

SEQ ID NO: 188607 - protein, 9 aa, Homo Sapiens
DPEEKKKIL

SEQ ID NO: 188608 - protein, 9 aa, Homo Sapiens
QYVTIMNTQ

SEQ ID NO: 188609 - protein, 9 aa, Homo Sapiens
LLVSTHVSR

SEQ ID NO: 188610 - protein, 9 aa, Homo Sapiens
VSSSIQRLM

SEQ ID NO: 188611 - protein, 9 aa, Homo Sapiens
RSEYKWMYG

SEQ ID NO: 188612 - protein, 9 aa, Homo Sapiens
IRRGSLGGA

SEQ ID NO: 188613 - protein, 9 aa, Homo Sapiens
TLMAHPPPP

SEQ ID NO: 188614 - protein, 9 aa, Homo Sapiens
YTCIAWNEA

SEQ ID NO: 188615 - protein, 9 aa, Homo Sapiens
AVDYFSECI

SEQ ID NO: 188616 - protein, 9 aa, Homo Sapiens
WNSQLIRYT

SEQ ID NO: 188617 - protein, 9 aa, Homo Sapiens
AVERECAAT

SEQ ID NO: 188618 - protein, 9 aa, Homo Sapiens
VKPTESVTD

SEQ ID NO: 188619 - protein, 9 aa, Homo Sapiens
PSEEVFFRD

SEQ ID NO: 188620 - protein, 9 aa, Homo Sapiens
YFSECIYWA

SEQ ID NO: 188621 - protein, 9 aa, Homo Sapiens
GSDGLKGQK

SEQ ID NO: 188622 - protein, 9 aa, Homo Sapiens
SSGSTRAIA

SEQ ID NO: 188623 - protein, 9 aa, Homo Sapiens
MDQGKSSLD

SEQ ID NO: 188624 - protein, 9 aa, Homo Sapiens
ALAFSQSEY

SEQ ID NO: 188625 - protein, 9 aa, Homo Sapiens
GPQIFVYSG

SEQ ID NO: 188626 - protein, 9 aa, Homo Sapiens
GVRGSDGLK

SEQ ID NO: 188627 - protein, 9 aa, Homo Sapiens
DHVKVVTLL

SEQ ID NO: 188628 - protein, 9 aa, Homo Sapiens
FFRDLSDFP

SEQ ID NO: 188629 - protein, 9 aa, Homo Sapiens
QVQLEMDMS

SEQ ID NO: 188630 - protein, 9 aa, Homo Sapiens
EFEADRGAF

SEQ ID NO: 188631 - protein, 9 aa, Homo Sapiens
ICSSSDSSY

SEQ ID NO: 188632 - protein, 9 aa, Homo Sapiens
IRYTGYKQP

SEQ ID NO: 188633 - protein, 9 aa, Homo Sapiens
RNTSSEQEV

SEQ ID NO: 188634 - protein, 9 aa, Homo Sapiens
PPPTPPTCP

SEQ ID NO: 188635 - protein, 9 aa, Homo Sapiens
YDRTVTLIS

SEQ ID NO: 188636 - protein, 9 aa, Homo Sapiens
SSEQEVVEA

SEQ ID NO: 188637 - protein, 9 aa, Homo Sapiens
KKKILLNLS

SEQ ID NO: 188638 - protein, 9 aa, Homo Sapiens
ECIYWADFE

SEQ ID NO: 188639 - protein, 9 aa, Homo Sapiens
GSTRAIAIV

SEQ ID NO: 188640 - protein, 9 aa, Homo Sapiens
NFQGPLDAF

SEQ ID NO: 188641 - protein, 9 aa, Homo Sapiens
VMAEELIFR

SEQ ID NO: 188642 - protein, 9 aa, Homo Sapiens
NLGSGAFES

SEQ ID NO: 188643 - protein, 9 aa, Homo Sapiens
TIRYESASM

SEQ ID NO: 188644 - protein, 9 aa, Homo Sapiens
RKNRIKPLQ

SEQ ID NO: 188645 - protein, 9 aa, Homo Sapiens
GSKWNKELM

SEQ ID NO: 188646 - protein, 9 aa, Homo Sapiens
ESVTDYRTA

SEQ ID NO: 188647 - protein, 9 aa, Homo Sapiens
CVKGRTECH

SEQ ID NO: 188648 - protein, 9 aa, Homo Sapiens
RGAFIITLN

SEQ ID NO: 188649 - protein, 9 aa, Homo Sapiens
SDHVKVVTL

SEQ ID NO: 188650 - protein, 9 aa, Homo Sapiens
YGGICSYPV

SEQ ID NO: 188651 - protein, 9 aa, Homo Sapiens
QPLDQEEKD

SEQ ID NO: 188652 - protein, 9 aa, Homo Sapiens
GQFTDSYYS

SEQ ID NO: 188653 - protein, 9 aa, Homo Sapiens
LPPTLANDI

SEQ ID NO: 188654 - protein, 9 aa, Homo Sapiens
LVVVGAVGV

SEQ ID NO: 188655 - protein, 9 aa, Homo Sapiens
IITRDRMIN

SEQ ID NO: 188656 - protein, 9 aa, Homo Sapiens
DRMINVEFS

SEQ ID NO: 188657 - protein, 9 aa, Homo Sapiens
YVTQPLDQE

SEQ ID NO: 188658 - protein, 9 aa, Homo Sapiens
KQQKELWNQ

SEQ ID NO: 188659 - protein, 9 aa, Homo Sapiens
TLANDIFRT

SEQ ID NO: 188660 - protein, 9 aa, Homo Sapiens
RQPHVVSQW

SEQ ID NO: 188661 - protein, 9 aa, Homo Sapiens
LTPKAPVDL

SEQ ID NO: 188662 - protein, 9 aa, Homo Sapiens
YGFLFNNFL

SEQ ID NO: 188663 - protein, 9 aa, Homo Sapiens
AHLERMKNM

SEQ ID NO: 188664 - protein, 9 aa, Homo Sapiens
PWLCAQLSA

SEQ ID NO: 188665 - protein, 9 aa, Homo Sapiens
TIYKCLKVH

SEQ ID NO: 188666 - protein, 9 aa, Homo Sapiens
NGEVQAGVK

SEQ ID NO: 188667 - protein, 9 aa, Homo Sapiens
EERIPQLSE

SEQ ID NO: 188668 - protein, 9 aa, Homo Sapiens
GTEHSGWVA

SEQ ID NO: 188669 - protein, 9 aa, Homo Sapiens
VHVGGFLCV

SEQ ID NO: 188670 - protein, 9 aa, Homo Sapiens
KNEMNYKED

SEQ ID NO: 188671 - protein, 9 aa, Homo Sapiens
AYVEDRSQD

SEQ ID NO: 188672 - protein, 9 aa, Homo Sapiens
RDRMINVEF

SEQ ID NO: 188673 - protein, 9 aa, Homo Sapiens
FLFNNFLLL

SEQ ID NO: 188674 - protein, 9 aa, Homo Sapiens
DHISELSGC

SEQ ID NO: 188675 - protein, 9 aa, Homo Sapiens
RRKQCFTMQ

SEQ ID NO: 188676 - protein, 9 aa, Homo Sapiens
SDHIAFLEQ

SEQ ID NO: 188677 - protein, 9 aa, Homo Sapiens
NNFLLLTQI

SEQ ID NO: 188678 - protein, 9 aa, Homo Sapiens
VVGAVGVGK

SEQ ID NO: 188679 - protein, 9 aa, Homo Sapiens
GNIITRDRM

SEQ ID NO: 188680 - protein, 9 aa, Homo Sapiens
CARIEGWKV

SEQ ID NO: 188681 - protein, 9 aa, Homo Sapiens
MIMTPWLCA

SEQ ID NO: 188682 - protein, 9 aa, Homo Sapiens
DEAEVLSDH

SEQ ID NO: 188683 - protein, 9 aa, Homo Sapiens
SSEKVAQVL

SEQ ID NO: 188684 - protein, 9 aa, Homo Sapiens
HSRRQPHVV

SEQ ID NO: 188685 - protein, 9 aa, Homo Sapiens
GSKCHTIYK

SEQ ID NO: 188686 - protein, 9 aa, Homo Sapiens
AKLEYKIFK

SEQ ID NO: 188687 - protein, 9 aa, Homo Sapiens
RKQCFTMQS

SEQ ID NO: 188688 - protein, 9 aa, Homo Sapiens
ACFFQMFIM

SEQ ID NO: 188689 - protein, 9 aa, Homo Sapiens
TPWLCAQLS

SEQ ID NO: 188690 - protein, 9 aa, Homo Sapiens
SFPACFFQM

SEQ ID NO: 188691 - protein, 9 aa, Homo Sapiens
GLPLQRHHN

SEQ ID NO: 188692 - protein, 9 aa, Homo Sapiens
LSDHIAFLE

SEQ ID NO: 188693 - protein, 9 aa, Homo Sapiens
HIAFLEQGG

SEQ ID NO: 188694 - protein, 9 aa, Homo Sapiens
EHSGWVATF

SEQ ID NO: 188695 - protein, 9 aa, Homo Sapiens
KRFVSSHCY

SEQ ID NO: 188696 - protein, 9 aa, Homo Sapiens
FKQQKELWN

SEQ ID NO: 188697 - protein, 9 aa, Homo Sapiens
CNGEVQAGV

SEQ ID NO: 188698 - protein, 9 aa, Homo Sapiens
WVATFQQLP

SEQ ID NO: 188699 - protein, 9 aa, Homo Sapiens
LWNQGSTQG

SEQ ID NO: 188700 - protein, 9 aa, Homo Sapiens
LQRHHNYLQ

SEQ ID NO: 188701 - protein, 9 aa, Homo Sapiens
SISFPACFF

SEQ ID NO: 188702 - protein, 9 aa, Homo Sapiens
IAGKTVTPR

SEQ ID NO: 188703 - protein, 9 aa, Homo Sapiens
SDHISELSG

SEQ ID NO: 188704 - protein, 9 aa, Homo Sapiens
ETAYVEDRS

SEQ ID NO: 188705 - protein, 9 aa, Homo Sapiens
VSSHCYVET

SEQ ID NO: 188706 - protein, 9 aa, Homo Sapiens
FYIAGKTVT

SEQ ID NO: 188707 - protein, 9 aa, Homo Sapiens
AKCKYDLLD

SEQ ID NO: 188708 - protein, 9 aa, Homo Sapiens
SEKVAQVLR

SEQ ID NO: 188709 - protein, 9 aa, Homo Sapiens
PHVVSQWSR

SEQ ID NO: 188710 - protein, 9 aa, Homo Sapiens
HISELSGCT

SEQ ID NO: 188711 - protein, 9 aa, Homo Sapiens
WNQGSTQGD

SEQ ID NO: 188712 - protein, 9 aa, Homo Sapiens
VLSDHIAFL

SEQ ID NO: 188713 - protein, 9 aa, Homo Sapiens
FASDHDLGT

SEQ ID NO: 188714 - protein, 9 aa, Homo Sapiens
AAIIQLTPK

SEQ ID NO: 188715 - protein, 9 aa, Homo Sapiens
GGICSYPVT

SEQ ID NO: 188716 - protein, 9 aa, Homo Sapiens
AVVHVGGFL

SEQ ID NO: 188717 - protein, 9 aa, Homo Sapiens
EVLSDHIAF

SEQ ID NO: 188718 - protein, 9 aa, Homo Sapiens
KLVVVGAVG

SEQ ID NO: 188719 - protein, 9 aa, Homo Sapiens
NFLLLTQIT

SEQ ID NO: 188720 - protein, 9 aa, Homo Sapiens
TRDRMINVE

SEQ ID NO: 188721 - protein, 9 aa, Homo Sapiens
WLCAQLSAG

SEQ ID NO: 188722 - protein, 9 aa, Homo Sapiens
GFLFNNFLL

SEQ ID NO: 188723 - protein, 9 aa, Homo Sapiens
LANDIFRTL

SEQ ID NO: 188724 - protein, 9 aa, Homo Sapiens
HDLGTDGEV

SEQ ID NO: 188725 - protein, 9 aa, Homo Sapiens
YSDHISELS

SEQ ID NO: 188726 - protein, 9 aa, Homo Sapiens
NIITRDRMI

SEQ ID NO: 188727 - protein, 9 aa, Homo Sapiens
FNNFLLLTQ

SEQ ID NO: 188728 - protein, 9 aa, Homo Sapiens
VGGFLCVEI

SEQ ID NO: 188729 - protein, 9 aa, Homo Sapiens
SRRQPHVVS

SEQ ID NO: 188730 - protein, 9 aa, Homo Sapiens
RFVSSHCYV

SEQ ID NO: 188731 - protein, 9 aa, Homo Sapiens
VQAGVKKMW

SEQ ID NO: 188732 - protein, 9 aa, Homo Sapiens
RDQYGGICS

SEQ ID NO: 188733 - protein, 9 aa, Homo Sapiens
MINVEFSCA

SEQ ID NO: 188734 - protein, 9 aa, Homo Sapiens
EKVAQVLRQ

SEQ ID NO: 188735 - protein, 9 aa, Homo Sapiens
KREGLICAR

SEQ ID NO: 188736 - protein, 9 aa, Homo Sapiens
EAQGLPLQR

SEQ ID NO: 188737 - protein, 9 aa, Homo Sapiens
LYSDHISEL

SEQ ID NO: 188738 - protein, 9 aa, Homo Sapiens
DHIAFLEQG

SEQ ID NO: 188739 - protein, 9 aa, Homo Sapiens
QGLPLQRHH

SEQ ID NO: 188740 - protein, 9 aa, Homo Sapiens
TMQSESGED

SEQ ID NO: 188741 - protein, 9 aa, Homo Sapiens
LFYIAGKTV

SEQ ID NO: 188742 - protein, 9 aa, Homo Sapiens
VVHVGGFLC

SEQ ID NO: 188743 - protein, 9 aa, Homo Sapiens
QLTPKAPVD

SEQ ID NO: 188744 - protein, 9 aa, Homo Sapiens
MKNMEQTVK

SEQ ID NO: 188745 - protein, 9 aa, Homo Sapiens
RKSPENQFL

SEQ ID NO: 188746 - protein, 9 aa, Homo Sapiens
CKYDLLDLP

SEQ ID NO: 188747 - protein, 9 aa, Homo Sapiens
PLQRHHNYL

SEQ ID NO: 188748 - protein, 9 aa, Homo Sapiens
FQMFIMNSF

SEQ ID NO: 188749 - protein, 9 aa, Homo Sapiens
KCHTIYKCL

SEQ ID NO: 188750 - protein, 9 aa, Homo Sapiens
HCYVETMLV

SEQ ID NO: 188751 - protein, 9 aa, Homo Sapiens
YQMIMTPWL

SEQ ID NO: 188752 - protein, 9 aa, Homo Sapiens
ERMKNMEQT

SEQ ID NO: 188753 - protein, 9 aa, Homo Sapiens
EMNYKEDQF

SEQ ID NO: 188754 - protein, 9 aa, Homo Sapiens
IMTPWLCAQ

SEQ ID NO: 188755 - protein, 9 aa, Homo Sapiens
KCKYDLLDL

SEQ ID NO: 188756 - protein, 9 aa, Homo Sapiens
YYSDPVKTL

SEQ ID NO: 188757 - protein, 9 aa, Homo Sapiens
AEVLSDHIA

SEQ ID NO: 188758 - protein, 9 aa, Homo Sapiens
HVGGFLCVE

SEQ ID NO: 188759 - protein, 9 aa, Homo Sapiens
GKTVTPRGT

SEQ ID NO: 188760 - protein, 9 aa, Homo Sapiens
ICSYPVTLN

SEQ ID NO: 188761 - protein, 9 aa, Homo Sapiens
QKREGLICA

SEQ ID NO: 188762 - protein, 9 aa, Homo Sapiens
QAGVKKMWS

SEQ ID NO: 188763 - protein, 9 aa, Homo Sapiens
TAAIIQLTP

SEQ ID NO: 188764 - protein, 9 aa, Homo Sapiens
RMKNMEQTV

SEQ ID NO: 188765 - protein, 9 aa, Homo Sapiens
IYKCLKVHC

SEQ ID NO: 188766 - protein, 9 aa, Homo Sapiens
ISFPACFFQ

SEQ ID NO: 188767 - protein, 9 aa, Homo Sapiens
YAKLEYKIF

SEQ ID NO: 188768 - protein, 9 aa, Homo Sapiens
EVQAGVKKM

SEQ ID NO: 188769 - protein, 9 aa, Homo Sapiens
CYVETMLVA

SEQ ID NO: 188770 - protein, 9 aa, Homo Sapiens
IIQLTPKAP

SEQ ID NO: 188771 - protein, 9 aa, Homo Sapiens
CSYPVTLNV

SEQ ID NO: 188772 - protein, 9 aa, Homo Sapiens
CHTIYKCLK

SEQ ID NO: 188773 - protein, 9 aa, Homo Sapiens
FTDSYYSDP

SEQ ID NO: 188774 - protein, 9 aa, Homo Sapiens
HLERMKNME

SEQ ID NO: 188775 - protein, 9 aa, Homo Sapiens
QPHVVSQWS

SEQ ID NO: 188776 - protein, 9 aa, Homo Sapiens
LYGFLFNNF

SEQ ID NO: 188777 - protein, 9 aa, Homo Sapiens
DQYGGICSY

SEQ ID NO: 188778 - protein, 9 aa, Homo Sapiens
NYKEDQFQL

SEQ ID NO: 188779 - protein, 9 aa, Homo Sapiens
QEEKDAYVF

SEQ ID NO: 188780 - protein, 9 aa, Homo Sapiens
VGEVFASDH

SEQ ID NO: 188781 - protein, 9 aa, Homo Sapiens
SYYSDPVKT

SEQ ID NO: 188782 - protein, 9 aa, Homo Sapiens
CFFQMFIMN

SEQ ID NO: 188783 - protein, 9 aa, Homo Sapiens
TVTPRGTEL

SEQ ID NO: 188784 - protein, 9 aa, Homo Sapiens
VEDRSQDHN

SEQ ID NO: 188785 - protein, 9 aa, Homo Sapiens
PYAKLEYKI

SEQ ID NO: 188786 - protein, 9 aa, Homo Sapiens
IYVTQPLDQ

SEQ ID NO: 188787 - protein, 9 aa, Homo Sapiens
AGVKKMWSR

SEQ ID NO: 188788 - protein, 9 aa, Homo Sapiens
TPQEERIPQ

SEQ ID NO: 188789 - protein, 9 aa, Homo Sapiens
LERMKNMEQ

SEQ ID NO: 188790 - protein, 9 aa, Homo Sapiens
GEVQAGVKK

SEQ ID NO: 188791 - protein, 9 aa, Homo Sapiens
LAGMSSEKV

SEQ ID NO: 188792 - protein, 9 aa, Homo Sapiens
PPTLANDIF

SEQ ID NO: 188793 - protein, 9 aa, Homo Sapiens
YVEDRSQDH

SEQ ID NO: 188794 - protein, 9 aa, Homo Sapiens
YIAGKTVTP

SEQ ID NO: 188795 - protein, 9 aa, Homo Sapiens
GLYSDHISE

SEQ ID NO: 188796 - protein, 9 aa, Homo Sapiens
ICARIEGWK

SEQ ID NO: 188797 - protein, 9 aa, Homo Sapiens
EGLICARIE

SEQ ID NO: 188798 - protein, 9 aa, Homo Sapiens
AQGLPLQRH

SEQ ID NO: 188799 - protein, 9 aa, Homo Sapiens
MQSESGEDL

SEQ ID NO: 188800 - protein, 9 aa, Homo Sapiens
QYGGICSYP

SEQ ID NO: 188801 - protein, 9 aa, Homo Sapiens
TPKAPVDLC

SEQ ID NO: 188802 - protein, 9 aa, Homo Sapiens
KVAQVLRQC

SEQ ID NO: 188803 - protein, 9 aa, Homo Sapiens
KSPENQFLR

SEQ ID NO: 188804 - protein, 9 aa, Homo Sapiens
RYQMIMTPW

SEQ ID NO: 188805 - protein, 9 aa, Homo Sapiens
DHDLGTDGE

SEQ ID NO: 188806 - protein, 9 aa, Homo Sapiens
TAKNEMNYK

SEQ ID NO: 188807 - protein, 9 aa, Homo Sapiens
CFTMQSESG

SEQ ID NO: 188808 - protein, 9 aa, Homo Sapiens
LPLQRHHNY

SEQ ID NO: 188809 - protein, 9 aa, Homo Sapiens
AGLYSDHIS

SEQ ID NO: 188810 - protein, 9 aa, Homo Sapiens
VTQPLDQEE

SEQ ID NO: 188811 - protein, 9 aa, Homo Sapiens
NQKREGLIC

SEQ ID NO: 188812 - protein, 9 aa, Homo Sapiens
PQEERIPQL

SEQ ID NO: 188813 - protein, 9 aa, Homo Sapiens
CAGLYSDHI

SEQ ID NO: 188814 - protein, 9 aa, Homo Sapiens
GICSYPVTL

SEQ ID NO: 188815 - protein, 9 aa, Homo Sapiens
QRHHNYLQN

SEQ ID NO: 188816 - protein, 9 aa, Homo Sapiens
PTLANDIFR

SEQ ID NO: 188817 - protein, 9 aa, Homo Sapiens
NQFLRKLLK

SEQ ID NO: 188818 - protein, 9 aa, Homo Sapiens
GMSSEKVAQ

SEQ ID NO: 188819 - protein, 9 aa, Homo Sapiens
GFLCVEITM

SEQ ID NO: 188820 - protein, 9 aa, Homo Sapiens
KQCFTMQSE

SEQ ID NO: 188821 - protein, 9 aa, Homo Sapiens
AIIQLTPKA

SEQ ID NO: 188822 - protein, 9 aa, Homo Sapiens
QFTDSYYSD

SEQ ID NO: 188823 - protein, 9 aa, Homo Sapiens
DRRKQCFTM

SEQ ID NO: 188824 - protein, 9 aa, Homo Sapiens
VVVGAVGVG

SEQ ID NO: 188825 - protein, 9 aa, Homo Sapiens
ERIPQLSES

SEQ ID NO: 188826 - protein, 9 aa, Homo Sapiens
MSSEKVAQV

SEQ ID NO: 188827 - protein, 9 aa, Homo Sapiens
IQLTPKAPV

SEQ ID NO: 188828 - protein, 9 aa, Homo Sapiens
KRKSPENQF

SEQ ID NO: 188829 - protein, 9 aa, Homo Sapiens
QKELWNQGS

SEQ ID NO: 188830 - protein, 9 aa, Homo Sapiens
ASDHDLGTD

SEQ ID NO: 188831 - protein, 9 aa, Homo Sapiens
SGWVATFQQ

SEQ ID NO: 188832 - protein, 9 aa, Homo Sapiens
AGKTVTPRG

SEQ ID NO: 188833 - protein, 9 aa, Homo Sapiens
QGTEHSGWV

SEQ ID NO: 188834 - protein, 9 aa, Homo Sapiens
EAEVLSDHI

SEQ ID NO: 188835 - protein, 9 aa, Homo Sapiens
FFQMFIMNS

SEQ ID NO: 188836 - protein, 9 aa, Homo Sapiens
MGQFTDSYY

SEQ ID NO: 188837 - protein, 9 aa, Homo Sapiens
PACFFQMFI

SEQ ID NO: 188838 - protein, 9 aa, Homo Sapiens
RSQDHNLFC

SEQ ID NO: 188839 - protein, 9 aa, Homo Sapiens
CAKCKYDLL

SEQ ID NO: 188840 - protein, 9 aa, Homo Sapiens
GEVFASDHD

SEQ ID NO: 188841 - protein, 9 aa, Homo Sapiens
EDRSQDHNL

SEQ ID NO: 188842 - protein, 9 aa, Homo Sapiens
QEERIPQLS

SEQ ID NO: 188843 - protein, 9 aa, Homo Sapiens
QQKELWNQG

SEQ ID NO: 188844 - protein, 9 aa, Homo Sapiens
YKEDQFQLS

SEQ ID NO: 188845 - protein, 9 aa, Homo Sapiens
HVVSQWSRS

SEQ ID NO: 188846 - protein, 9 aa, Homo Sapiens
LDQEEKDAY

SEQ ID NO: 188847 - protein, 9 aa, Homo Sapiens
EEAQGLPLQ

SEQ ID NO: 188848 - protein, 9 aa, Homo Sapiens
IMGQFTDSY

SEQ ID NO: 188849 - protein, 9 aa, Homo Sapiens
VFASDHDLG

SEQ ID NO: 188850 - protein, 9 aa, Homo Sapiens
FVSSHCYVE

SEQ ID NO: 188851 - protein, 9 aa, Homo Sapiens
LTAKNEMNY

SEQ ID NO: 188852 - protein, 9 aa, Homo Sapiens
PLDQEEKDA

SEQ ID NO: 188853 - protein, 9 aa, Homo Sapiens
VATFQQLPK

SEQ ID NO: 188854 - protein, 9 aa, Homo Sapiens
SAHLERMKN

SEQ ID NO: 188855 - protein, 9 aa, Homo Sapiens
NEMNYKEDQ

SEQ ID NO: 188856 - protein, 9 aa, Homo Sapiens
VVSQWSRSA

SEQ ID NO: 188857 - protein, 9 aa, Homo Sapiens
LFNNFLLLT

SEQ ID NO: 188858 - protein, 9 aa, Homo Sapiens
SPENQFLRK

SEQ ID NO: 188859 - protein, 9 aa, Homo Sapiens
DRSQDHNLF

SEQ ID NO: 188860 - protein, 9 aa, Homo Sapiens
FPACFFQMF

SEQ ID NO: 188861 - protein, 9 aa, Homo Sapiens
DLAGMSSEK

SEQ ID NO: 188862 - protein, 9 aa, Homo Sapiens
RMINVEFSC

SEQ ID NO: 188863 - protein, 9 aa, Homo Sapiens
LICARIEGW

SEQ ID NO: 188864 - protein, 9 aa, Homo Sapiens
EVFASDHDL

SEQ ID NO: 188865 - protein, 9 aa, Homo Sapiens
AKNEMNYKE

SEQ ID NO: 188866 - protein, 9 aa, Homo Sapiens
HSGWVATFQ

SEQ ID NO: 188867 - protein, 9 aa, Homo Sapiens
KTVTPRGTE

SEQ ID NO: 188868 - protein, 9 aa, Homo Sapiens
KTAAIIQLT

SEQ ID NO: 188869 - protein, 9 aa, Homo Sapiens
IPQLSESPV

SEQ ID NO: 188870 - protein, 9 aa, Homo Sapiens
REGLICARI

SEQ ID NO: 188871 - protein, 9 aa, Homo Sapiens
QCAKCKYDL

SEQ ID NO: 188872 - protein, 9 aa, Homo Sapiens
QMIMTPWLC

SEQ ID NO: 188873 - protein, 9 aa, Homo Sapiens
KKRFVSSHC

SEQ ID NO: 188874 - protein, 9 aa, Homo Sapiens
TCAGLYSDH

SEQ ID NO: 188875 - protein, 9 aa, Homo Sapiens
TAYVEDRSQ

SEQ ID NO: 188876 - protein, 9 aa, Homo Sapiens
GLICARIEG

SEQ ID NO: 188877 - protein, 9 aa, Homo Sapiens
VGVGKSALT

SEQ ID NO: 188878 - protein, 9 aa, Homo Sapiens
GWVATFQQL

SEQ ID NO: 188879 - protein, 9 aa, Homo Sapiens
YCNGEVQAG

SEQ ID NO: 188880 - protein, 9 aa, Homo Sapiens
SKCHTIYKC

SEQ ID NO: 188881 - protein, 9 aa, Homo Sapiens
HTIYKCLKV

SEQ ID NO: 188882 - protein, 9 aa, Homo Sapiens
DQEEKDAYV

SEQ ID NO: 188883 - protein, 9 aa, Homo Sapiens
ITPQEERIP

SEQ ID NO: 188884 - protein, 9 aa, Homo Sapiens
VGAVGVGKS

SEQ ID NO: 188885 - protein, 9 aa, Homo Sapiens
MTPWLCAQL

SEQ ID NO: 188886 - protein, 9 aa, Homo Sapiens
SHCYVETML

SEQ ID NO: 188887 - protein, 9 aa, Homo Sapiens
SDHDLGTDG

SEQ ID NO: 188888 - protein, 9 aa, Homo Sapiens
QCFTMQSES

SEQ ID NO: 188889 - protein, 9 aa, Homo Sapiens
EKRKSPENQ

SEQ ID NO: 188890 - protein, 9 aa, Homo Sapiens
GAVGVGKSA

SEQ ID NO: 188891 - protein, 9 aa, Homo Sapiens
VSQWSRSAS

SEQ ID NO: 188892 - protein, 9 aa, Homo Sapiens
MNYKEDQFQ

SEQ ID NO: 188893 - protein, 9 aa, Homo Sapiens
NAVVHVGGF

SEQ ID NO: 188894 - protein, 9 aa, Homo Sapiens
TQPLDQEEK

SEQ ID NO: 188895 - protein, 9 aa, Homo Sapiens
QFLRKLLKP

SEQ ID NO: 188896 - protein, 9 aa, Homo Sapiens
FTMQSESGE

SEQ ID NO: 188897 - protein, 9 aa, Homo Sapiens
ELYGFLFNN

SEQ ID NO: 188898 - protein, 9 aa, Homo Sapiens
GVKKMWSRW

SEQ ID NO: 188899 - protein, 9 aa, Homo Sapiens
TDSYYSDPV

SEQ ID NO: 188900 - protein, 9 aa, Homo Sapiens
AVGVGKSAL

SEQ ID NO: 188901 - protein, 9 aa, Homo Sapiens
PENQFLRKL

SEQ ID NO: 188902 - protein, 9 aa, Homo Sapiens
ELWNQGSTQ

SEQ ID NO: 188903 - protein, 9 aa, Homo Sapiens
ENQFLRKLL

SEQ ID NO: 188904 - protein, 9 aa, Homo Sapiens
ITRDRMINV

SEQ ID NO: 188905 - protein, 9 aa, Homo Sapiens
KCLKVHCMD

SEQ ID NO: 188906 - protein, 9 aa, Homo Sapiens
KFKQQKELW

SEQ ID NO: 188907 - protein, 9 aa, Homo Sapiens
PQLSESPVI

SEQ ID NO: 188908 - protein, 9 aa, Homo Sapiens
GGFLCVEIT

SEQ ID NO: 188909 - protein, 9 aa, Homo Sapiens
IRDQYGGIC

SEQ ID NO: 188910 - protein, 9 aa, Homo Sapiens
RIPQLSESP

SEQ ID NO: 188911 - protein, 9 aa, Homo Sapiens
SQDHNLFCN

SEQ ID NO: 188912 - protein, 9 aa, Homo Sapiens
SSHCYVETM

SEQ ID NO: 188913 - protein, 9 aa, Homo Sapiens
DSYYSDPVK

SEQ ID NO: 188914 - protein, 9 aa, Homo Sapiens
FLCVEITMY

SEQ ID NO: 188915 - protein, 9 aa, Homo Sapiens
GLFYIAGKT

SEQ ID NO: 188916 - protein, 9 aa, Homo Sapiens
YKLVVVGAV

SEQ ID NO: 188917 - protein, 9 aa, Homo Sapiens
YKCLKVHCM

SEQ ID NO: 188918 - protein, 9 aa, Homo Sapiens
TEHSGWVAT

SEQ ID NO: 188919 - protein, 9 aa, Homo Sapiens
AGMSSEKVA

SEQ ID NO: 188920 - protein, 9 aa, Homo Sapiens
RRQPHVVSQ

SEQ ID NO: 188921 - protein, 9 aa, Homo Sapiens
KELWNQGST

SEQ ID NO: 188922 - protein, 9 aa, Homo Sapiens
VIGGAVGEL

SEQ ID NO: 188923 - protein, 9 aa, Homo Sapiens
FRTGSVVLQ

SEQ ID NO: 188924 - protein, 9 aa, Homo Sapiens
IAESPAPPA

SEQ ID NO: 188925 - protein, 9 aa, Homo Sapiens
LLIFSRWKP

SEQ ID NO: 188926 - protein, 9 aa, Homo Sapiens
SLRCGEGTQ

SEQ ID NO: 188927 - protein, 9 aa, Homo Sapiens
MGLSWTVPE

SEQ ID NO: 188928 - protein, 9 aa, Homo Sapiens
NTRRSCQSK

SEQ ID NO: 188929 - protein, 9 aa, Homo Sapiens
SAMIIFNPS

SEQ ID NO: 188930 - protein, 9 aa, Homo Sapiens
KLVIGGAVG

SEQ ID NO: 188931 - protein, 9 aa, Homo Sapiens
TDPHAYLKY

SEQ ID NO: 188932 - protein, 9 aa, Homo Sapiens
VPTSQSESH

SEQ ID NO: 188933 - protein, 9 aa, Homo Sapiens
WARVSGTIP

SEQ ID NO: 188934 - protein, 9 aa, Homo Sapiens
STCGFRGPA

SEQ ID NO: 188935 - protein, 9 aa, Homo Sapiens
GLPCWPCLT

SEQ ID NO: 188936 - protein, 9 aa, Homo Sapiens
SGPCQARPF

SEQ ID NO: 188937 - protein, 9 aa, Homo Sapiens
RAKMERTVT

SEQ ID NO: 188938 - protein, 9 aa, Homo Sapiens
IGEKLPTTK

SEQ ID NO: 188939 - protein, 9 aa, Homo Sapiens
DDQLWLVRE

SEQ ID NO: 188940 - protein, 9 aa, Homo Sapiens
CLQEQVQNC

SEQ ID NO: 188941 - protein, 9 aa, Homo Sapiens
EQSHTKWVC

SEQ ID NO: 188942 - protein, 9 aa, Homo Sapiens
LESLVAPPA

SEQ ID NO: 188943 - protein, 9 aa, Homo Sapiens
ELWVYPHKT

SEQ ID NO: 188944 - protein, 9 aa, Homo Sapiens
SDEKDKQDP

SEQ ID NO: 188945 - protein, 9 aa, Homo Sapiens
EKRTDKVFR

SEQ ID NO: 188946 - protein, 9 aa, Homo Sapiens
SSENTRRSC

SEQ ID NO: 188947 - protein, 9 aa, Homo Sapiens
DWICKRELP

SEQ ID NO: 188948 - protein, 9 aa, Homo Sapiens
AESPAPPAG

SEQ ID NO: 188949 - protein, 9 aa, Homo Sapiens
VNLQLQVLG

SEQ ID NO: 188950 - protein, 9 aa, Homo Sapiens
YIGEITKGT

SEQ ID NO: 188951 - protein, 9 aa, Homo Sapiens
CGEGTQSRK

SEQ ID NO: 188952 - protein, 9 aa, Homo Sapiens
MLQLINSNE

SEQ ID NO: 188953 - protein, 9 aa, Homo Sapiens
QVPIAESPA

SEQ ID NO: 188954 - protein, 9 aa, Homo Sapiens
LAWQLNLSE

SEQ ID NO: 188955 - protein, 9 aa, Homo Sapiens
TKDNQQKAN

SEQ ID NO: 188956 - protein, 9 aa, Homo Sapiens
GEKLPTTKG

SEQ ID NO: 188957 - protein, 9 aa, Homo Sapiens
PELWVYPHK

SEQ ID NO: 188958 - protein, 9 aa, Homo Sapiens
KDPAFYMLK

SEQ ID NO: 188959 - protein, 9 aa, Homo Sapiens
AVGELIISA

SEQ ID NO: 188960 - protein, 9 aa, Homo Sapiens
YDPIGKYAP

SEQ ID NO: 188961 - protein, 9 aa, Homo Sapiens
VGTLPSKLP

SEQ ID NO: 188962 - protein, 9 aa, Homo Sapiens
FTYKEAPGS

SEQ ID NO: 188963 - protein, 9 aa, Homo Sapiens
KVFRQMDTN

SEQ ID NO: 188964 - protein, 9 aa, Homo Sapiens
LGPDGSTFF

SEQ ID NO: 188965 - protein, 9 aa, Homo Sapiens
CLWTLRKLS

SEQ ID NO: 188966 - protein, 9 aa, Homo Sapiens
LVTIIKVYM

SEQ ID NO: 188967 - protein, 9 aa, Homo Sapiens
EEGIQEEIN

SEQ ID NO: 188968 - protein, 9 aa, Homo Sapiens
HYSSFLCAS

SEQ ID NO: 188969 - protein, 9 aa, Homo Sapiens
IQQRPWARV

SEQ ID NO: 188970 - protein, 9 aa, Homo Sapiens
YSSPGSYNP

SEQ ID NO: 188971 - protein, 9 aa, Homo Sapiens
PEKRTDKVF

SEQ ID NO: 188972 - protein, 9 aa, Homo Sapiens
KTISSVSVV

SEQ ID NO: 188973 - protein, 9 aa, Homo Sapiens
FSRWKPSVM

SEQ ID NO: 188974 - protein, 9 aa, Homo Sapiens
RTDKVFRQM

SEQ ID NO: 188975 - protein, 9 aa, Homo Sapiens
QLLIFSRWK

SEQ ID NO: 188976 - protein, 9 aa, Homo Sapiens
TQPFVIDKK

SEQ ID NO: 188977 - protein, 9 aa, Homo Sapiens
LASLRPVHC

SEQ ID NO: 188978 - protein, 9 aa, Homo Sapiens
GQPITGRSI

SEQ ID NO: 188979 - protein, 9 aa, Homo Sapiens
LYCINFSHY

SEQ ID NO: 188980 - protein, 9 aa, Homo Sapiens
DESLTIFVD

SEQ ID NO: 188981 - protein, 9 aa, Homo Sapiens
CYNGPVPKP

SEQ ID NO: 188982 - protein, 9 aa, Homo Sapiens
TSVFENVMY

SEQ ID NO: 188983 - protein, 9 aa, Homo Sapiens
HGSNQSVQH

SEQ ID NO: 188984 - protein, 9 aa, Homo Sapiens
LMLPFQGTD

SEQ ID NO: 188985 - protein, 9 aa, Homo Sapiens
LQVGELSNE

SEQ ID NO: 188986 - protein, 9 aa, Homo Sapiens
KWIMDKTKV

SEQ ID NO: 188987 - protein, 9 aa, Homo Sapiens
SPFTFGVRQ

SEQ ID NO: 188988 - protein, 9 aa, Homo Sapiens
VSGKCKWTC

SEQ ID NO: 188989 - protein, 9 aa, Homo Sapiens
IIGHFLFWF

SEQ ID NO: 188990 - protein, 9 aa, Homo Sapiens
PLHYPVTMG

SEQ ID NO: 188991 - protein, 9 aa, Homo Sapiens
VFRQMDTNN

SEQ ID NO: 188992 - protein, 9 aa, Homo Sapiens
QEQVQNCDR

SEQ ID NO: 188993 - protein, 9 aa, Homo Sapiens
RNKIIGHFL

SEQ ID NO: 188994 - protein, 9 aa, Homo Sapiens
WTLRKLSDA

SEQ ID NO: 188995 - protein, 9 aa, Homo Sapiens
PNQLGGGAV

SEQ ID NO: 188996 - protein, 9 aa, Homo Sapiens
LVQHPDLVS

SEQ ID NO: 188997 - protein, 9 aa, Homo Sapiens
LRNKIIGHF

SEQ ID NO: 188998 - protein, 9 aa, Homo Sapiens
AASVGHCLV

SEQ ID NO: 188999 - protein, 9 aa, Homo Sapiens
LDGNFNSIQ

SEQ ID NO: 189000 - protein, 9 aa, Homo Sapiens
GTQRWASEK

SEQ ID NO: 189001 - protein, 9 aa, Homo Sapiens
IKTISSVSV

SEQ ID NO: 189002 - protein, 9 aa, Homo Sapiens
QITLEKMPS

SEQ ID NO: 189003 - protein, 9 aa, Homo Sapiens
TLEKMPSYF

SEQ ID NO: 189004 - protein, 9 aa, Homo Sapiens
WRRAWQASR

SEQ ID NO: 189005 - protein, 9 aa, Homo Sapiens
AIWQSLWPS

SEQ ID NO: 189006 - protein, 9 aa, Homo Sapiens
FNSIQMDMF

SEQ ID NO: 189007 - protein, 9 aa, Homo Sapiens
GAVGELIIS

SEQ ID NO: 189008 - protein, 9 aa, Homo Sapiens
YHFSQPIHL

SEQ ID NO: 189009 - protein, 9 aa, Homo Sapiens
DGNFNSIQM

SEQ ID NO: 189010 - protein, 9 aa, Homo Sapiens
AALFSEISP

SEQ ID NO: 189011 - protein, 9 aa, Homo Sapiens
IWQSLWPSE

SEQ ID NO: 189012 - protein, 9 aa, Homo Sapiens
TELAWQLNL

SEQ ID NO: 189013 - protein, 9 aa, Homo Sapiens
IKVYMKERS

SEQ ID NO: 189014 - protein, 9 aa, Homo Sapiens
PITGRSISA

SEQ ID NO: 189015 - protein, 9 aa, Homo Sapiens
NYVLIDYIG

SEQ ID NO: 189016 - protein, 9 aa, Homo Sapiens
KSCSKPRCF

SEQ ID NO: 189017 - protein, 9 aa, Homo Sapiens
DGKPKSAHT

SEQ ID NO: 189018 - protein, 9 aa, Homo Sapiens
APGSPPELQ

SEQ ID NO: 189019 - protein, 9 aa, Homo Sapiens
CEETSKWIM

SEQ ID NO: 189020 - protein, 9 aa, Homo Sapiens
SWRSDYKDP

SEQ ID NO: 189021 - protein, 9 aa, Homo Sapiens
LPTTKGLEA

SEQ ID NO: 189022 - protein, 9 aa, Homo Sapiens
TEWASSENT

SEQ ID NO: 189023 - protein, 9 aa, Homo Sapiens
GSPPELQLV

SEQ ID NO: 189024 - protein, 9 aa, Homo Sapiens
KAMTAYWTN

SEQ ID NO: 189025 - protein, 9 aa, Homo Sapiens
HCCFALPLR

SEQ ID NO: 189026 - protein, 9 aa, Homo Sapiens
ESPAPPAGA

SEQ ID NO: 189027 - protein, 9 aa, Homo Sapiens
NGLIAALEQ

SEQ ID NO: 189028 - protein, 9 aa, Homo Sapiens
RSISAMGYK

SEQ ID NO: 189029 - protein, 9 aa, Homo Sapiens
LEDDTKDNQ

SEQ ID NO: 189030 - protein, 9 aa, Homo Sapiens
SFRTGSVVL

SEQ ID NO: 189031 - protein, 9 aa, Homo Sapiens
ITRTEGQVY

SEQ ID NO: 189032 - protein, 9 aa, Homo Sapiens
MQQCLQEQV

SEQ ID NO: 189033 - protein, 9 aa, Homo Sapiens
CKIWLGSEY

SEQ ID NO: 189034 - protein, 9 aa, Homo Sapiens
THVDEQVFL

SEQ ID NO: 189035 - protein, 9 aa, Homo Sapiens
PGIRVARVY

SEQ ID NO: 189036 - protein, 9 aa, Homo Sapiens
KEYNKCKML

SEQ ID NO: 189037 - protein, 9 aa, Homo Sapiens
EKVPPITRT

SEQ ID NO: 189038 - protein, 9 aa, Homo Sapiens
PTTKGLEAG

SEQ ID NO: 189039 - protein, 9 aa, Homo Sapiens
ASLRPVHCC

SEQ ID NO: 189040 - protein, 9 aa, Homo Sapiens
RSGHNEVKE

SEQ ID NO: 189041 - protein, 9 aa, Homo Sapiens
TIIKVYMKE

SEQ ID NO: 189042 - protein, 9 aa, Homo Sapiens
ENESYVLQP

SEQ ID NO: 189043 - protein, 9 aa, Homo Sapiens
SNEGRNDYH

SEQ ID NO: 189044 - protein, 9 aa, Homo Sapiens
VVLQKVEEE

SEQ ID NO: 189045 - protein, 9 aa, Homo Sapiens
PDGSTFFDM

SEQ ID NO: 189046 - protein, 9 aa, Homo Sapiens
DTKDNQQKA

SEQ ID NO: 189047 - protein, 9 aa, Homo Sapiens
KLPFRFGQP

SEQ ID NO: 189048 - protein, 9 aa, Homo Sapiens
CDSMLETAK

SEQ ID NO: 189049 - protein, 9 aa, Homo Sapiens
FSEISPVQP

SEQ ID NO: 189050 - protein, 9 aa, Homo Sapiens
QLGGGAVVL

SEQ ID NO: 189051 - protein, 9 aa, Homo Sapiens
LQKLEDDTK

SEQ ID NO: 189052 - protein, 9 aa, Homo Sapiens
AMIIFNPSS

SEQ ID NO: 189053 - protein, 9 aa, Homo Sapiens
IFHIYAPEA

SEQ ID NO: 189054 - protein, 9 aa, Homo Sapiens
GENGLIAAL

SEQ ID NO: 189055 - protein, 9 aa, Homo Sapiens
KPKSAHTSP

SEQ ID NO: 189056 - protein, 9 aa, Homo Sapiens
CSCSWNQEW

SEQ ID NO: 189057 - protein, 9 aa, Homo Sapiens
AAVILSGHQ

SEQ ID NO: 189058 - protein, 9 aa, Homo Sapiens
PIAESPAPP

SEQ ID NO: 189059 - protein, 9 aa, Homo Sapiens
FELLEKDTN

SEQ ID NO: 189060 - protein, 9 aa, Homo Sapiens
AKMERTVTE

SEQ ID NO: 189061 - protein, 9 aa, Homo Sapiens
ALFSEISPV

SEQ ID NO: 189062 - protein, 9 aa, Homo Sapiens
LVPFKQWIK

SEQ ID NO: 189063 - protein, 9 aa, Homo Sapiens
ASAMIIFNP

SEQ ID NO: 189064 - protein, 9 aa, Homo Sapiens
RPMNAFMLW

SEQ ID NO: 189065 - protein, 9 aa, Homo Sapiens
RGPAVSGAG

SEQ ID NO: 189066 - protein, 9 aa, Homo Sapiens
SNTESRLES

SEQ ID NO: 189067 - protein, 9 aa, Homo Sapiens
HNEVKEVWS

SEQ ID NO: 189068 - protein, 9 aa, Homo Sapiens
CYLSGNSQA

SEQ ID NO: 189069 - protein, 9 aa, Homo Sapiens
EQVQNCDRI

SEQ ID NO: 189070 - protein, 9 aa, Homo Sapiens
EWASSENTR

SEQ ID NO: 189071 - protein, 9 aa, Homo Sapiens
VLQPMKSAT

SEQ ID NO: 189072 - protein, 9 aa, Homo Sapiens
MCKLKPLLS

SEQ ID NO: 189073 - protein, 9 aa, Homo Sapiens
LSGHQKSTT

SEQ ID NO: 189074 - protein, 9 aa, Homo Sapiens
LKLAGWQCP

SEQ ID NO: 189075 - protein, 9 aa, Homo Sapiens
VQQMEGRCD

SEQ ID NO: 189076 - protein, 9 aa, Homo Sapiens
KLAGWQCPE

SEQ ID NO: 189077 - protein, 9 aa, Homo Sapiens
LAPSGLEKF

SEQ ID NO: 189078 - protein, 9 aa, Homo Sapiens
VGELIISAV

SEQ ID NO: 189079 - protein, 9 aa, Homo Sapiens
ASYSGPCQA

SEQ ID NO: 189080 - protein, 9 aa, Homo Sapiens
ASRVFVAVK

SEQ ID NO: 189081 - protein, 9 aa, Homo Sapiens
VREFCGAGS

SEQ ID NO: 189082 - protein, 9 aa, Homo Sapiens
TCGFRGPAV

SEQ ID NO: 189083 - protein, 9 aa, Homo Sapiens
PPLAVGALG

SEQ ID NO: 189084 - protein, 9 aa, Homo Sapiens
LFSEISPVQ

SEQ ID NO: 189085 - protein, 9 aa, Homo Sapiens
EAPGSPPEL

SEQ ID NO: 189086 - protein, 9 aa, Homo Sapiens
FTFGVRQPP

SEQ ID NO: 189087 - protein, 9 aa, Homo Sapiens
SGLEKFKEI

SEQ ID NO: 189088 - protein, 9 aa, Homo Sapiens
IMDKTKVVE

SEQ ID NO: 189089 - protein, 9 aa, Homo Sapiens
ESYIPGIRV

SEQ ID NO: 189090 - protein, 9 aa, Homo Sapiens
NFNSIQMDM

SEQ ID NO: 189091 - protein, 9 aa, Homo Sapiens
KQWIKTISS

SEQ ID NO: 189092 - protein, 9 aa, Homo Sapiens
PGITERKKR

SEQ ID NO: 189093 - protein, 9 aa, Homo Sapiens
CRVDNVNLQ

SEQ ID NO: 189094 - protein, 9 aa, Homo Sapiens
VLLMLPFQG

SEQ ID NO: 189095 - protein, 9 aa, Homo Sapiens
CSWNQEWRR

SEQ ID NO: 189096 - protein, 9 aa, Homo Sapiens
PLAVGALGS

SEQ ID NO: 189097 - protein, 9 aa, Homo Sapiens
TPGGTQRWA

SEQ ID NO: 189098 - protein, 9 aa, Homo Sapiens
PCWPCLTAE

SEQ ID NO: 189099 - protein, 9 aa, Homo Sapiens
MIGEKLPTT

SEQ ID NO: 189100 - protein, 9 aa, Homo Sapiens
TDKEYNKCK

SEQ ID NO: 189101 - protein, 9 aa, Homo Sapiens
LSATLGGDE

SEQ ID NO: 189102 - protein, 9 aa, Homo Sapiens
ICKRELPFT

SEQ ID NO: 189103 - protein, 9 aa, Homo Sapiens
EQDRVGAQP

SEQ ID NO: 189104 - protein, 9 aa, Homo Sapiens
WNQEWRRAW

SEQ ID NO: 189105 - protein, 9 aa, Homo Sapiens
MESNTESRL

SEQ ID NO: 189106 - protein, 9 aa, Homo Sapiens
ERTVTEAKR

SEQ ID NO: 189107 - protein, 9 aa, Homo Sapiens
AFSAVFFVP

SEQ ID NO: 189108 - protein, 9 aa, Homo Sapiens
KCKMLDHFD

SEQ ID NO: 189109 - protein, 9 aa, Homo Sapiens
PITRTEGQV

SEQ ID NO: 189110 - protein, 9 aa, Homo Sapiens
PIGKYAPAT

SEQ ID NO: 189111 - protein, 9 aa, Homo Sapiens
PSKLPFRFG

SEQ ID NO: 189112 - protein, 9 aa, Homo Sapiens
KFKEIHYPP

SEQ ID NO: 189113 - protein, 9 aa, Homo Sapiens
PWARVSGTI

SEQ ID NO: 189114 - protein, 9 aa, Homo Sapiens
NEEGLEGPR

SEQ ID NO: 189115 - protein, 9 aa, Homo Sapiens
KPRCFNGGT

SEQ ID NO: 189116 - protein, 9 aa, Homo Sapiens
ELLEKDTNA

SEQ ID NO: 189117 - protein, 9 aa, Homo Sapiens
ACCLADIFH

SEQ ID NO: 189118 - protein, 9 aa, Homo Sapiens
HLQVIILHN

SEQ ID NO: 189119 - protein, 9 aa, Homo Sapiens
NQSVQHLKY

SEQ ID NO: 189120 - protein, 9 aa, Homo Sapiens
DQLWLVREF

SEQ ID NO: 189121 - protein, 9 aa, Homo Sapiens
QQEMLQLIN

SEQ ID NO: 189122 - protein, 9 aa, Homo Sapiens
FENVMYICC

SEQ ID NO: 189123 - protein, 9 aa, Homo Sapiens
AVKLYGAVR

SEQ ID NO: 189124 - protein, 9 aa, Homo Sapiens
QAISYAGCA

SEQ ID NO: 189125 - protein, 9 aa, Homo Sapiens
VPIAESPAP

SEQ ID NO: 189126 - protein, 9 aa, Homo Sapiens
FHIYAPEAP

SEQ ID NO: 189127 - protein, 9 aa, Homo Sapiens
PPITRTEGQ

SEQ ID NO: 189128 - protein, 9 aa, Homo Sapiens
QQRPWARVS

SEQ ID NO: 189129 - protein, 9 aa, Homo Sapiens
LILIFDNDY

SEQ ID NO: 189130 - protein, 9 aa, Homo Sapiens
EGVPTSQSE

SEQ ID NO: 189131 - protein, 9 aa, Homo Sapiens
SCSWNQEWR

SEQ ID NO: 189132 - protein, 9 aa, Homo Sapiens
QPPLAVGAL

SEQ ID NO: 189133 - protein, 9 aa, Homo Sapiens
NQEWRRAWQ

SEQ ID NO: 189134 - protein, 9 aa, Homo Sapiens
KVLVTIIKV

SEQ ID NO: 189135 - protein, 9 aa, Homo Sapiens
LHNNPLQVP

SEQ ID NO: 189136 - protein, 9 aa, Homo Sapiens
LCYLSGNSQ

SEQ ID NO: 189137 - protein, 9 aa, Homo Sapiens
SVGHCLVPE

SEQ ID NO: 189138 - protein, 9 aa, Homo Sapiens
HMQQCLQEQ

SEQ ID NO: 189139 - protein, 9 aa, Homo Sapiens
CRALSMDWA

SEQ ID NO: 189140 - protein, 9 aa, Homo Sapiens
QNSMGLSWT

SEQ ID NO: 189141 - protein, 9 aa, Homo Sapiens
PPQAPAPPP

SEQ ID NO: 189142 - protein, 9 aa, Homo Sapiens
VDNVNLQLQ

SEQ ID NO: 189143 - protein, 9 aa, Homo Sapiens
SESHSGPLN

SEQ ID NO: 189144 - protein, 9 aa, Homo Sapiens
TVTEAKRQA

SEQ ID NO: 189145 - protein, 9 aa, Homo Sapiens
RCGEGTQSR

SEQ ID NO: 189146 - protein, 9 aa, Homo Sapiens
SGSSTCGFR

SEQ ID NO: 189147 - protein, 9 aa, Homo Sapiens
LTKHPRSTE

SEQ ID NO: 189148 - protein, 9 aa, Homo Sapiens
SQSESHSGP

SEQ ID NO: 189149 - protein, 9 aa, Homo Sapiens
VPNRFACWG

SEQ ID NO: 189150 - protein, 9 aa, Homo Sapiens
SKVLVTIIK

SEQ ID NO: 189151 - protein, 9 aa, Homo Sapiens
VKEVWSNAD

SEQ ID NO: 189152 - protein, 9 aa, Homo Sapiens
EYNKCKMLD

SEQ ID NO: 189153 - protein, 9 aa, Homo Sapiens
SPGSYNPRA

SEQ ID NO: 189154 - protein, 9 aa, Homo Sapiens
GITERKKRE

SEQ ID NO: 189155 - protein, 9 aa, Homo Sapiens
SKWIMDKTK

SEQ ID NO: 189156 - protein, 9 aa, Homo Sapiens
TQNSMGLSW

SEQ ID NO: 189157 - protein, 9 aa, Homo Sapiens
TTPELWVYP

SEQ ID NO: 189158 - protein, 9 aa, Homo Sapiens
TQRWASEKK

SEQ ID NO: 189159 - protein, 9 aa, Homo Sapiens
LTTPELWVY

SEQ ID NO: 189160 - protein, 9 aa, Homo Sapiens
PGSYTPPPP

SEQ ID NO: 189161 - protein, 9 aa, Homo Sapiens
EINVKEDGA

SEQ ID NO: 189162 - protein, 9 aa, Homo Sapiens
NDQVPIAES

SEQ ID NO: 189163 - protein, 9 aa, Homo Sapiens
VKSCSKPRC

SEQ ID NO: 189164 - protein, 9 aa, Homo Sapiens
ASYIYYLIR

SEQ ID NO: 189165 - protein, 9 aa, Homo Sapiens
IIKVYMKER

SEQ ID NO: 189166 - protein, 9 aa, Homo Sapiens
EGRCDSMLE

SEQ ID NO: 189167 - protein, 9 aa, Homo Sapiens
EILQVGELS

SEQ ID NO: 189168 - protein, 9 aa, Homo Sapiens
RPWARVSGT

SEQ ID NO: 189169 - protein, 9 aa, Homo Sapiens
RPRIQQRPW

SEQ ID NO: 189170 - protein, 9 aa, Homo Sapiens
YSSFLCASS

SEQ ID NO: 189171 - protein, 9 aa, Homo Sapiens
ALGSMWPPQ

SEQ ID NO: 189172 - protein, 9 aa, Homo Sapiens
HPPSFNEEG

SEQ ID NO: 189173 - protein, 9 aa, Homo Sapiens
LQEQVQNCD

SEQ ID NO: 189174 - protein, 9 aa, Homo Sapiens
HPDLVSQAS

SEQ ID NO: 189175 - protein, 9 aa, Homo Sapiens
GNSQAISYA

SEQ ID NO: 189176 - protein, 9 aa, Homo Sapiens
KYDPPLAQN

SEQ ID NO: 189177 - protein, 9 aa, Homo Sapiens
VPPITRTEG

SEQ ID NO: 189178 - protein, 9 aa, Homo Sapiens
SVMSHKCSS

SEQ ID NO: 189179 - protein, 9 aa, Homo Sapiens
TDKVFRQMD

SEQ ID NO: 189180 - protein, 9 aa, Homo Sapiens
YCPKPASYS

SEQ ID NO: 189181 - protein, 9 aa, Homo Sapiens
VLQKVEEEQ

SEQ ID NO: 189182 - protein, 9 aa, Homo Sapiens
LYGMVFKKN

SEQ ID NO: 189183 - protein, 9 aa, Homo Sapiens
RSDYKDPAF

SEQ ID NO: 189184 - protein, 9 aa, Homo Sapiens
TLVLLMLPF

SEQ ID NO: 189185 - protein, 9 aa, Homo Sapiens
LKRGLRNKI

SEQ ID NO: 189186 - protein, 9 aa, Homo Sapiens
LPFRFGQPS

SEQ ID NO: 189187 - protein, 9 aa, Homo Sapiens
YCINFSHYS

SEQ ID NO: 189188 - protein, 9 aa, Homo Sapiens
LHYPVTMGH

SEQ ID NO: 189189 - protein, 9 aa, Homo Sapiens
ELSALEQDR

SEQ ID NO: 189190 - protein, 9 aa, Homo Sapiens
KFELLEKDT

SEQ ID NO: 189191 - protein, 9 aa, Homo Sapiens
KMERTVTEA

SEQ ID NO: 189192 - protein, 9 aa, Homo Sapiens
YLIRRTMET

SEQ ID NO: 189193 - protein, 9 aa, Homo Sapiens
CINFSHYSS

SEQ ID NO: 189194 - protein, 9 aa, Homo Sapiens
SSPGSYNPR

SEQ ID NO: 189195 - protein, 9 aa, Homo Sapiens
PGTPGGTQR

SEQ ID NO: 189196 - protein, 9 aa, Homo Sapiens
GPGITERKK

SEQ ID NO: 189197 - protein, 9 aa, Homo Sapiens
DRVGAQPPP

SEQ ID NO: 189198 - protein, 9 aa, Homo Sapiens
GELVAIHLF

SEQ ID NO: 189199 - protein, 9 aa, Homo Sapiens
GRSISAMGY

SEQ ID NO: 189200 - protein, 9 aa, Homo Sapiens
SKWLEEADS

SEQ ID NO: 189201 - protein, 9 aa, Homo Sapiens
PSPFTFGVR

SEQ ID NO: 189202 - protein, 9 aa, Homo Sapiens
TTKGLEAGL

SEQ ID NO: 189203 - protein, 9 aa, Homo Sapiens
KFATAAVIL

SEQ ID NO: 189204 - protein, 9 aa, Homo Sapiens
PEGVPTSQS

SEQ ID NO: 189205 - protein, 9 aa, Homo Sapiens
APAPPPELS

SEQ ID NO: 189206 - protein, 9 aa, Homo Sapiens
NFSHYSSFL

SEQ ID NO: 189207 - protein, 9 aa, Homo Sapiens
LLYGMVFKK

SEQ ID NO: 189208 - protein, 9 aa, Homo Sapiens
QEMLQLINS

SEQ ID NO: 189209 - protein, 9 aa, Homo Sapiens
YNKCKMLDH

SEQ ID NO: 189210 - protein, 9 aa, Homo Sapiens
NPRAVAVKE

SEQ ID NO: 189211 - protein, 9 aa, Homo Sapiens
LPGSYTPPP

SEQ ID NO: 189212 - protein, 9 aa, Homo Sapiens
SWNQEWRRA

SEQ ID NO: 189213 - protein, 9 aa, Homo Sapiens
AWQLNLSET

SEQ ID NO: 189214 - protein, 9 aa, Homo Sapiens
CKRELPFTK

SEQ ID NO: 189215 - protein, 9 aa, Homo Sapiens
TPLKLAGWQ

SEQ ID NO: 189216 - protein, 9 aa, Homo Sapiens
PHVRPEDCS

SEQ ID NO: 189217 - protein, 9 aa, Homo Sapiens
NGNACKIWL

SEQ ID NO: 189218 - protein, 9 aa, Homo Sapiens
VSQASPSEP

SEQ ID NO: 189219 - protein, 9 aa, Homo Sapiens
LGSMWPPQA

SEQ ID NO: 189220 - protein, 9 aa, Homo Sapiens
SPPELQLVS

SEQ ID NO: 189221 - protein, 9 aa, Homo Sapiens
GQSLRHQDK

SEQ ID NO: 189222 - protein, 9 aa, Homo Sapiens
KKTAEIRLK

SEQ ID NO: 189223 - protein, 9 aa, Homo Sapiens
YKEAPGSPP

SEQ ID NO: 189224 - protein, 9 aa, Homo Sapiens
KKREIIENA

SEQ ID NO: 189225 - protein, 9 aa, Homo Sapiens
CIHITEAKK

SEQ ID NO: 189226 - protein, 9 aa, Homo Sapiens
KRNRLAPTH

SEQ ID NO: 189227 - protein, 9 aa, Homo Sapiens
DTSVFENVM

SEQ ID NO: 189228 - protein, 9 aa, Homo Sapiens
IFNPSSYNP

SEQ ID NO: 189229 - protein, 9 aa, Homo Sapiens
RERTELAWQ

SEQ ID NO: 189230 - protein, 9 aa, Homo Sapiens
PQAPAPPPE

SEQ ID NO: 189231 - protein, 9 aa, Homo Sapiens
CSKPRCFNG

SEQ ID NO: 189232 - protein, 9 aa, Homo Sapiens
ALPLAPNQL

SEQ ID NO: 189233 - protein, 9 aa, Homo Sapiens
LEQDRVGAQ

SEQ ID NO: 189234 - protein, 9 aa, Homo Sapiens
WQLNLSETQ

SEQ ID NO: 189235 - protein, 9 aa, Homo Sapiens
NCIHITEAK

SEQ ID NO: 189236 - protein, 9 aa, Homo Sapiens
SLTKHPRST

SEQ ID NO: 189237 - protein, 9 aa, Homo Sapiens
WVYPHKTLY

SEQ ID NO: 189238 - protein, 9 aa, Homo Sapiens
SKAMTAYWT

SEQ ID NO: 189239 - protein, 9 aa, Homo Sapiens
LIDYIGEIT

SEQ ID NO: 189240 - protein, 9 aa, Homo Sapiens
TGSVVLQKV

SEQ ID NO: 189241 - protein, 9 aa, Homo Sapiens
NCLWTLRKL

SEQ ID NO: 189242 - protein, 9 aa, Homo Sapiens
RSRAASVGH

SEQ ID NO: 189243 - protein, 9 aa, Homo Sapiens
LVQQMEGRC

SEQ ID NO: 189244 - protein, 9 aa, Homo Sapiens
RTVTEAKRQ

SEQ ID NO: 189245 - protein, 9 aa, Homo Sapiens
PALGPDGST

SEQ ID NO: 189246 - protein, 9 aa, Homo Sapiens
FSKVLVTII

SEQ ID NO: 189247 - protein, 9 aa, Homo Sapiens
RTWSVMSHK

SEQ ID NO: 189248 - protein, 9 aa, Homo Sapiens
EKLPTTKGL

SEQ ID NO: 189249 - protein, 9 aa, Homo Sapiens
SVPVKSCSK

SEQ ID NO: 189250 - protein, 9 aa, Homo Sapiens
GSSTCGFRG

SEQ ID NO: 189251 - protein, 9 aa, Homo Sapiens
SHLHSNHLC

SEQ ID NO: 189252 - protein, 9 aa, Homo Sapiens
NKMSTYLLL

SEQ ID NO: 189253 - protein, 9 aa, Homo Sapiens
VFENVMYIC

SEQ ID NO: 189254 - protein, 9 aa, Homo Sapiens
SATLGGDES

SEQ ID NO: 189255 - protein, 9 aa, Homo Sapiens
LADIFHIYA

SEQ ID NO: 189256 - protein, 9 aa, Homo Sapiens
EISPVQPAR

SEQ ID NO: 189257 - protein, 9 aa, Homo Sapiens
KIWLGSEYP

SEQ ID NO: 189258 - protein, 9 aa, Homo Sapiens
GSMWPPQAP

SEQ ID NO: 189259 - protein, 9 aa, Homo Sapiens
MWPPQAPAP

SEQ ID NO: 189260 - protein, 9 aa, Homo Sapiens
KLKPLLSKW

SEQ ID NO: 189261 - protein, 9 aa, Homo Sapiens
DREGDGKPK

SEQ ID NO: 189262 - protein, 9 aa, Homo Sapiens
GHCLVPEGP

SEQ ID NO: 189263 - protein, 9 aa, Homo Sapiens
SALPLAPNQ

SEQ ID NO: 189264 - protein, 9 aa, Homo Sapiens
ESQITLEKM

SEQ ID NO: 189265 - protein, 9 aa, Homo Sapiens
KLSDAATKQ

SEQ ID NO: 189266 - protein, 9 aa, Homo Sapiens
NRLAPTHVD

SEQ ID NO: 189267 - protein, 9 aa, Homo Sapiens
GLTTPELWV

SEQ ID NO: 189268 - protein, 9 aa, Homo Sapiens
IHLRNIPFN

SEQ ID NO: 189269 - protein, 9 aa, Homo Sapiens
RVDNVNLQL

SEQ ID NO: 189270 - protein, 9 aa, Homo Sapiens
ASVGHCLVP

SEQ ID NO: 189271 - protein, 9 aa, Homo Sapiens
GLRNKIIGH

SEQ ID NO: 189272 - protein, 9 aa, Homo Sapiens
SKLVIGGAV

SEQ ID NO: 189273 - protein, 9 aa, Homo Sapiens
QVREAIWQS

SEQ ID NO: 189274 - protein, 9 aa, Homo Sapiens
KDTNALDVS

SEQ ID NO: 189275 - protein, 9 aa, Homo Sapiens
KAALFSEIS

SEQ ID NO: 189276 - protein, 9 aa, Homo Sapiens
QLWLVREFC

SEQ ID NO: 189277 - protein, 9 aa, Homo Sapiens
ESNTESRLE

SEQ ID NO: 189278 - protein, 9 aa, Homo Sapiens
MVFKKNLME

SEQ ID NO: 189279 - protein, 9 aa, Homo Sapiens
EKFKEIHYP

SEQ ID NO: 189280 - protein, 9 aa, Homo Sapiens
REFCGAGSI

SEQ ID NO: 189281 - protein, 9 aa, Homo Sapiens
HLRNIPFNL

SEQ ID NO: 189282 - protein, 9 aa, Homo Sapiens
PLAQNQPPI

SEQ ID NO: 189283 - protein, 9 aa, Homo Sapiens
NTESRLESL

SEQ ID NO: 189284 - protein, 9 aa, Homo Sapiens
ACWGELVAI

SEQ ID NO: 189285 - protein, 9 aa, Homo Sapiens
LPSKLPFRF

SEQ ID NO: 189286 - protein, 9 aa, Homo Sapiens
IRVARVYHG

SEQ ID NO: 189287 - protein, 9 aa, Homo Sapiens
IGGAVGELI

SEQ ID NO: 189288 - protein, 9 aa, Homo Sapiens
SMWPPQAPA

SEQ ID NO: 189289 - protein, 9 aa, Homo Sapiens
FKQWIKTIS

SEQ ID NO: 189290 - protein, 9 aa, Homo Sapiens
TPHVRPEDC

SEQ ID NO: 189291 - protein, 9 aa, Homo Sapiens
HDDQLWLVR

SEQ ID NO: 189292 - protein, 9 aa, Homo Sapiens
WRSDYKDPA

SEQ ID NO: 189293 - protein, 9 aa, Homo Sapiens
LSKWLEEAD

SEQ ID NO: 189294 - protein, 9 aa, Homo Sapiens
HNNPLQVPP

SEQ ID NO: 189295 - protein, 9 aa, Homo Sapiens
VGHCLVPEG

SEQ ID NO: 189296 - protein, 9 aa, Homo Sapiens
SLRPVHCCF

SEQ ID NO: 189297 - protein, 9 aa, Homo Sapiens
LRCGEGTQS

SEQ ID NO: 189298 - protein, 9 aa, Homo Sapiens
RNRLAPTHV

SEQ ID NO: 189299 - protein, 9 aa, Homo Sapiens
HIYAPEAPY

SEQ ID NO: 189300 - protein, 9 aa, Homo Sapiens
DLVSQASPS

SEQ ID NO: 189301 - protein, 9 aa, Homo Sapiens
TAAVILSGH

SEQ ID NO: 189302 - protein, 9 aa, Homo Sapiens
RCDSMLETA

SEQ ID NO: 189303 - protein, 9 aa, Homo Sapiens
EGDGKPKSA

SEQ ID NO: 189304 - protein, 9 aa, Homo Sapiens
PAQSLPGSY

SEQ ID NO: 189305 - protein, 9 aa, Homo Sapiens
TPSPFTFGV

SEQ ID NO: 189306 - protein, 9 aa, Homo Sapiens
DQVPIAESP

SEQ ID NO: 189307 - protein, 9 aa, Homo Sapiens
MLWAQAARR

SEQ ID NO: 189308 - protein, 9 aa, Homo Sapiens
LPLAPNQLG

SEQ ID NO: 189309 - protein, 9 aa, Homo Sapiens
PATRFSYTS

SEQ ID NO: 189310 - protein, 9 aa, Homo Sapiens
LPCWPCLTA

SEQ ID NO: 189311 - protein, 9 aa, Homo Sapiens
SRVFVAVKL

SEQ ID NO: 189312 - protein, 9 aa, Homo Sapiens
KIIGHFLFW

SEQ ID NO: 189313 - protein, 9 aa, Homo Sapiens
ADTSVFENV

SEQ ID NO: 189314 - protein, 9 aa, Homo Sapiens
YVLIDYIGE

SEQ ID NO: 189315 - protein, 9 aa, Homo Sapiens
QQCLQEQVQ

SEQ ID NO: 189316 - protein, 9 aa, Homo Sapiens
KPLLSKWLE

SEQ ID NO: 189317 - protein, 9 aa, Homo Sapiens
TAYWTNFAK

SEQ ID NO: 189318 - protein, 9 aa, Homo Sapiens
SVQHLKYSL

SEQ ID NO: 189319 - protein, 9 aa, Homo Sapiens
AVILSGHQK

SEQ ID NO: 189320 - protein, 9 aa, Homo Sapiens
LSNEGRNDY

SEQ ID NO: 189321 - protein, 9 aa, Homo Sapiens
PPAQSLPGS

SEQ ID NO: 189322 - protein, 9 aa, Homo Sapiens
EKDTNALDV

SEQ ID NO: 189323 - protein, 9 aa, Homo Sapiens
TERKKREII

SEQ ID NO: 189324 - protein, 9 aa, Homo Sapiens
EEKNESLTK

SEQ ID NO: 189325 - protein, 9 aa, Homo Sapiens
PHAYLKYGK

SEQ ID NO: 189326 - protein, 9 aa, Homo Sapiens
PPPELSALE

SEQ ID NO: 189327 - protein, 9 aa, Homo Sapiens
NIVTPHVRP

SEQ ID NO: 189328 - protein, 9 aa, Homo Sapiens
LADTLVLLM

SEQ ID NO: 189329 - protein, 9 aa, Homo Sapiens
TLGGDESLT

SEQ ID NO: 189330 - protein, 9 aa, Homo Sapiens
FGVRQPPLA

SEQ ID NO: 189331 - protein, 9 aa, Homo Sapiens
VDFECLQII

SEQ ID NO: 189332 - protein, 9 aa, Homo Sapiens
FNEEGLEGP

SEQ ID NO: 189333 - protein, 9 aa, Homo Sapiens
QSLWPSEEL

SEQ ID NO: 189334 - protein, 9 aa, Homo Sapiens
TKGLEAGLD

SEQ ID NO: 189335 - protein, 9 aa, Homo Sapiens
ADIFHIYAP

SEQ ID NO: 189336 - protein, 9 aa, Homo Sapiens
KWTCNTLIP

SEQ ID NO: 189337 - protein, 9 aa, Homo Sapiens
LWTLRKLSD

SEQ ID NO: 189338 - protein, 9 aa, Homo Sapiens
GDGKPKSAH

SEQ ID NO: 189339 - protein, 9 aa, Homo Sapiens
TRTEGQVYA

SEQ ID NO: 189340 - protein, 9 aa, Homo Sapiens
GTPGGTQRW

SEQ ID NO: 189341 - protein, 9 aa, Homo Sapiens
KVPPITRTE

SEQ ID NO: 189342 - protein, 9 aa, Homo Sapiens
GEGTQSRKI

SEQ ID NO: 189343 - protein, 9 aa, Homo Sapiens
HVRPEDCSI

SEQ ID NO: 189344 - protein, 9 aa, Homo Sapiens
LNIVTPHVR

SEQ ID NO: 189345 - protein, 9 aa, Homo Sapiens
WIKTISSVS

SEQ ID NO: 189346 - protein, 9 aa, Homo Sapiens
ESLTKHPRS

SEQ ID NO: 189347 - protein, 9 aa, Homo Sapiens
VTQPFVIDK

SEQ ID NO: 189348 - protein, 9 aa, Homo Sapiens
LCGENGLIA

SEQ ID NO: 189349 - protein, 9 aa, Homo Sapiens
TCDREGDGK

SEQ ID NO: 189350 - protein, 9 aa, Homo Sapiens
TEAKRQAAE

SEQ ID NO: 189351 - protein, 9 aa, Homo Sapiens
VILSGHQKS

SEQ ID NO: 189352 - protein, 9 aa, Homo Sapiens
FACWGELVA

SEQ ID NO: 189353 - protein, 9 aa, Homo Sapiens
VEKDNCIHI

SEQ ID NO: 189354 - protein, 9 aa, Homo Sapiens
LEKDTNALD

SEQ ID NO: 189355 - protein, 9 aa, Homo Sapiens
FENESYVLQ

SEQ ID NO: 189356 - protein, 9 aa, Homo Sapiens
GFRGPAVSG

SEQ ID NO: 189357 - protein, 9 aa, Homo Sapiens
LCIKQQQQQ

SEQ ID NO: 189358 - protein, 9 aa, Homo Sapiens
SLPGSYTPP

SEQ ID NO: 189359 - protein, 9 aa, Homo Sapiens
REAIWQSLW

SEQ ID NO: 189360 - protein, 9 aa, Homo Sapiens
GDESLTIFV

SEQ ID NO: 189361 - protein, 9 aa, Homo Sapiens
LVLLMLPFQ

SEQ ID NO: 189362 - protein, 9 aa, Homo Sapiens
DTNALDVSN

SEQ ID NO: 189363 - protein, 9 aa, Homo Sapiens
GKPKSAHTS

SEQ ID NO: 189364 - protein, 9 aa, Homo Sapiens
DNCIHITEA

SEQ ID NO: 189365 - protein, 9 aa, Homo Sapiens
YNPRAVAVK

SEQ ID NO: 189366 - protein, 9 aa, Homo Sapiens
PLLSKWLEE

SEQ ID NO: 189367 - protein, 9 aa, Homo Sapiens
TKRTWSVMS

SEQ ID NO: 189368 - protein, 9 aa, Homo Sapiens
HLAKTKKPF

SEQ ID NO: 189369 - protein, 9 aa, Homo Sapiens
RFACWGELV

SEQ ID NO: 189370 - protein, 9 aa, Homo Sapiens
ECTIFTDPH

SEQ ID NO: 189371 - protein, 9 aa, Homo Sapiens
RVARVYHGW

SEQ ID NO: 189372 - protein, 9 aa, Homo Sapiens
VFKIDWICK

SEQ ID NO: 189373 - protein, 9 aa, Homo Sapiens
GMVFKKNLM

SEQ ID NO: 189374 - protein, 9 aa, Homo Sapiens
QEWRRAWQA

SEQ ID NO: 189375 - protein, 9 aa, Homo Sapiens
PRNYVLIDY

SEQ ID NO: 189376 - protein, 9 aa, Homo Sapiens
PIHLRNIPF

SEQ ID NO: 189377 - protein, 9 aa, Homo Sapiens
TVTQNSMGL

SEQ ID NO: 189378 - protein, 9 aa, Homo Sapiens
IDYIGEITK

SEQ ID NO: 189379 - protein, 9 aa, Homo Sapiens
SPAPPAGAS

SEQ ID NO: 189380 - protein, 9 aa, Homo Sapiens
WICKRELPF

SEQ ID NO: 189381 - protein, 9 aa, Homo Sapiens
YSGPCQARP

SEQ ID NO: 189382 - protein, 9 aa, Homo Sapiens
LVSQASPSE

SEQ ID NO: 189383 - protein, 9 aa, Homo Sapiens
SCSKPRCFN

SEQ ID NO: 189384 - protein, 9 aa, Homo Sapiens
QHLKYSLFK

SEQ ID NO: 189385 - protein, 9 aa, Homo Sapiens
SKPRCFNGG

SEQ ID NO: 189386 - protein, 9 aa, Homo Sapiens
RPVHCCFAL

SEQ ID NO: 189387 - protein, 9 aa, Homo Sapiens
GLEKFKEIH

SEQ ID NO: 189388 - protein, 9 aa, Homo Sapiens
PRIQQRPWA

SEQ ID NO: 189389 - protein, 9 aa, Homo Sapiens
TWSVMSHKC

SEQ ID NO: 189390 - protein, 9 aa, Homo Sapiens
NLQLQVLGD

SEQ ID NO: 189391 - protein, 9 aa, Homo Sapiens
ACKIWLGSE

SEQ ID NO: 189392 - protein, 9 aa, Homo Sapiens
VLVTIIKVY

SEQ ID NO: 189393 - protein, 9 aa, Homo Sapiens
CTIFTDPHA

SEQ ID NO: 189394 - protein, 9 aa, Homo Sapiens
PLKLAGWQC

SEQ ID NO: 189395 - protein, 9 aa, Homo Sapiens
GLIAALEQV

SEQ ID NO: 189396 - protein, 9 aa, Homo Sapiens
NESYVLQPM

SEQ ID NO: 189397 - protein, 9 aa, Homo Sapiens
LWLVREFCG

SEQ ID NO: 189398 - protein, 9 aa, Homo Sapiens
ENGLIAALE

SEQ ID NO: 189399 - protein, 9 aa, Homo Sapiens
PCLTAEALK

SEQ ID NO: 189400 - protein, 9 aa, Homo Sapiens
ATAAVILSG

SEQ ID NO: 189401 - protein, 9 aa, Homo Sapiens
QDKRLSLNL

SEQ ID NO: 189402 - protein, 9 aa, Homo Sapiens
RIIQQEMLQ

SEQ ID NO: 189403 - protein, 9 aa, Homo Sapiens
TYKEAPGSP

SEQ ID NO: 189404 - protein, 9 aa, Homo Sapiens
MERTVTEAK

SEQ ID NO: 189405 - protein, 9 aa, Homo Sapiens
LSMDWAGPG

SEQ ID NO: 189406 - protein, 9 aa, Homo Sapiens
HTKWVCYNG

SEQ ID NO: 189407 - protein, 9 aa, Homo Sapiens
QCRALSMDW

SEQ ID NO: 189408 - protein, 9 aa, Homo Sapiens
GWSDEKDKQ

SEQ ID NO: 189409 - protein, 9 aa, Homo Sapiens
LGGDESLTI

SEQ ID NO: 189410 - protein, 9 aa, Homo Sapiens
QEEINVKED

SEQ ID NO: 189411 - protein, 9 aa, Homo Sapiens
KMSTYLLLI

SEQ ID NO: 189412 - protein, 9 aa, Homo Sapiens
DPLHYPVTM

SEQ ID NO: 189413 - protein, 9 aa, Homo Sapiens
GNASYIYYL

SEQ ID NO: 189414 - protein, 9 aa, Homo Sapiens
PFKQWIKTI

SEQ ID NO: 189415 - protein, 9 aa, Homo Sapiens
AVSGKCKWT

SEQ ID NO: 189416 - protein, 9 aa, Homo Sapiens
EGTQSRKIR

SEQ ID NO: 189417 - protein, 9 aa, Homo Sapiens
GIQEEINVK

SEQ ID NO: 189418 - protein, 9 aa, Homo Sapiens
GVRQPPLAV

SEQ ID NO: 189419 - protein, 9 aa, Homo Sapiens
VQHLKYSLF

SEQ ID NO: 189420 - protein, 9 aa, Homo Sapiens
QHPDLVSQA

SEQ ID NO: 189421 - protein, 9 aa, Homo Sapiens
DNVNLQLQV

SEQ ID NO: 189422 - protein, 9 aa, Homo Sapiens
SEISPVQPA

SEQ ID NO: 189423 - protein, 9 aa, Homo Sapiens
CGFRGPAVS

SEQ ID NO: 189424 - protein, 9 aa, Homo Sapiens
TSKWIMDKT

SEQ ID NO: 189425 - protein, 9 aa, Homo Sapiens
VTPLKLAGW

SEQ ID NO: 189426 - protein, 9 aa, Homo Sapiens
LIFSRWKPS

SEQ ID NO: 189427 - protein, 9 aa, Homo Sapiens
QAPAPPPEL

SEQ ID NO: 189428 - protein, 9 aa, Homo Sapiens
LAVGALGSM

SEQ ID NO: 189429 - protein, 9 aa, Homo Sapiens
RTGSVVLQK

SEQ ID NO: 189430 - protein, 9 aa, Homo Sapiens
HSNHLCIKQ

SEQ ID NO: 189431 - protein, 9 aa, Homo Sapiens
VVEKDNCIH

SEQ ID NO: 189432 - protein, 9 aa, Homo Sapiens
LLLILIFDN

SEQ ID NO: 189433 - protein, 9 aa, Homo Sapiens
NKIIGHFLF

SEQ ID NO: 189434 - protein, 9 aa, Homo Sapiens
GRCDSMLET

SEQ ID NO: 189435 - protein, 9 aa, Homo Sapiens
YKDPAFYML

SEQ ID NO: 189436 - protein, 9 aa, Homo Sapiens
WSDEKDKQD

SEQ ID NO: 189437 - protein, 9 aa, Homo Sapiens
SHTKWVCYN

SEQ ID NO: 189438 - protein, 9 aa, Homo Sapiens
RAASVGHCL

SEQ ID NO: 189439 - protein, 9 aa, Homo Sapiens
DYIGEITKG

SEQ ID NO: 189440 - protein, 9 aa, Homo Sapiens
KMPSYFVTQ

SEQ ID NO: 189441 - protein, 9 aa, Homo Sapiens
LLCGENGLI

SEQ ID NO: 189442 - protein, 9 aa, Homo Sapiens
DKQDPLRQV

SEQ ID NO: 189443 - protein, 9 aa, Homo Sapiens
PGGTQRWAS

SEQ ID NO: 189444 - protein, 9 aa, Homo Sapiens
KYHFSQPIH

SEQ ID NO: 189445 - protein, 9 aa, Homo Sapiens
YVLQPMKSA

SEQ ID NO: 189446 - protein, 9 aa, Homo Sapiens
LEEGIQEEI

SEQ ID NO: 189447 - protein, 9 aa, Homo Sapiens
QMEGRCDSM

SEQ ID NO: 189448 - protein, 9 aa, Homo Sapiens
TVSKAMTAY

SEQ ID NO: 189449 - protein, 9 aa, Homo Sapiens
NVGTLPSKL

SEQ ID NO: 189450 - protein, 9 aa, Homo Sapiens
AKRNRLAPT

SEQ ID NO: 189451 - protein, 9 aa, Homo Sapiens
GWNGNACKI

SEQ ID NO: 189452 - protein, 9 aa, Homo Sapiens
VTEAKRQAA

SEQ ID NO: 189453 - protein, 9 aa, Homo Sapiens
SIQMDMFSV

SEQ ID NO: 189454 - protein, 9 aa, Homo Sapiens
SGNSQAISY

SEQ ID NO: 189455 - protein, 9 aa, Homo Sapiens
ESRLESLVA

SEQ ID NO: 189456 - protein, 9 aa, Homo Sapiens
KRTDKVFRQ

SEQ ID NO: 189457 - protein, 9 aa, Homo Sapiens
APSGLEKFK

SEQ ID NO: 189458 - protein, 9 aa, Homo Sapiens
VTQNSMGLS

SEQ ID NO: 189459 - protein, 9 aa, Homo Sapiens
DEKDKQDPL

SEQ ID NO: 189460 - protein, 9 aa, Homo Sapiens
TKWVCYNGP

SEQ ID NO: 189461 - protein, 9 aa, Homo Sapiens
QKYDPPLAQ

SEQ ID NO: 189462 - protein, 9 aa, Homo Sapiens
CDREGDGKP

SEQ ID NO: 189463 - protein, 9 aa, Homo Sapiens
SLASLRPVH

SEQ ID NO: 189464 - protein, 9 aa, Homo Sapiens
VLIDYIGEI

SEQ ID NO: 189465 - protein, 9 aa, Homo Sapiens
ENVMYICCV

SEQ ID NO: 189466 - protein, 9 aa, Homo Sapiens
FQVREAIWQ

SEQ ID NO: 189467 - protein, 9 aa, Homo Sapiens
VGELSNEGR

SEQ ID NO: 189468 - protein, 9 aa, Homo Sapiens
LRKLSDAAT

SEQ ID NO: 189469 - protein, 9 aa, Homo Sapiens
PSGLEKFKE

SEQ ID NO: 189470 - protein, 9 aa, Homo Sapiens
TPELWVYPH

SEQ ID NO: 189471 - protein, 9 aa, Homo Sapiens
KRELPFTKS

SEQ ID NO: 189472 - protein, 9 aa, Homo Sapiens
ALEQDRVGA

SEQ ID NO: 189473 - protein, 9 aa, Homo Sapiens
LLSATLGGD

SEQ ID NO: 189474 - protein, 9 aa, Homo Sapiens
GSNQSVQHL

SEQ ID NO: 189475 - protein, 9 aa, Homo Sapiens
KRGLRNKII

SEQ ID NO: 189476 - protein, 9 aa, Homo Sapiens
IAVTPLKLA

SEQ ID NO: 189477 - protein, 9 aa, Homo Sapiens
KIDWICKRE

SEQ ID NO: 189478 - protein, 9 aa, Homo Sapiens
LEKMPSYFV

SEQ ID NO: 189479 - protein, 9 aa, Homo Sapiens
SQITLEKMP

SEQ ID NO: 189480 - protein, 9 aa, Homo Sapiens
NISWRSDYK

SEQ ID NO: 189481 - protein, 9 aa, Homo Sapiens
WIMDKTKVV

SEQ ID NO: 189482 - protein, 9 aa, Homo Sapiens
RKLSDAATK

SEQ ID NO: 189483 - protein, 9 aa, Homo Sapiens
PGSPPELQL

SEQ ID NO: 189484 - protein, 9 aa, Homo Sapiens
RKKREIIEN

SEQ ID NO: 189485 - protein, 9 aa, Homo Sapiens
HCLVPEGPL

SEQ ID NO: 189486 - protein, 9 aa, Homo Sapiens
CCLADIFHI

SEQ ID NO: 189487 - protein, 9 aa, Homo Sapiens
LAGWQCPEC

SEQ ID NO: 189488 - protein, 9 aa, Homo Sapiens
DKEYNKCKM

SEQ ID NO: 189489 - protein, 9 aa, Homo Sapiens
QCLQEQVQN

SEQ ID NO: 189490 - protein, 9 aa, Homo Sapiens
INVKEDGAH

SEQ ID NO: 189491 - protein, 9 aa, Homo Sapiens
KKAALFSEI

SEQ ID NO: 189492 - protein, 9 aa, Homo Sapiens
PVTMGHISC

SEQ ID NO: 189493 - protein, 9 aa, Homo Sapiens
KCKWTCNTL

SEQ ID NO: 189494 - protein, 9 aa, Homo Sapiens
LWVYPHKTL

SEQ ID NO: 189495 - protein, 9 aa, Homo Sapiens
IVCKLQRNH

SEQ ID NO: 189496 - protein, 9 aa, Homo Sapiens
CGQPITGRS

SEQ ID NO: 189497 - protein, 9 aa, Homo Sapiens
NPSSYNPGP

SEQ ID NO: 189498 - protein, 9 aa, Homo Sapiens
QPITGRSIS

SEQ ID NO: 189499 - protein, 9 aa, Homo Sapiens
EEINVKEDG

SEQ ID NO: 189500 - protein, 9 aa, Homo Sapiens
GNFNSIQMD

SEQ ID NO: 189501 - protein, 9 aa, Homo Sapiens
QDRVGAQPP

SEQ ID NO: 189502 - protein, 9 aa, Homo Sapiens
MTAYWTNFA

SEQ ID NO: 189503 - protein, 9 aa, Homo Sapiens
FKIDWICKR

SEQ ID NO: 189504 - protein, 9 aa, Homo Sapiens
EEGLEGPRV

SEQ ID NO: 189505 - protein, 9 aa, Homo Sapiens
CPKPASYSG

SEQ ID NO: 189506 - protein, 9 aa, Homo Sapiens
YAVSGKCKW

SEQ ID NO: 189507 - protein, 9 aa, Homo Sapiens
SLRHQDKRL

SEQ ID NO: 189508 - protein, 9 aa, Homo Sapiens
VTMGHISCA

SEQ ID NO: 189509 - protein, 9 aa, Homo Sapiens
SRAASVGHC

SEQ ID NO: 189510 - protein, 9 aa, Homo Sapiens
LLEKDTNAL

SEQ ID NO: 189511 - protein, 9 aa, Homo Sapiens
SNHLCIKQQ

SEQ ID NO: 189512 - protein, 9 aa, Homo Sapiens
SDYKDPAFY

SEQ ID NO: 189513 - protein, 9 aa, Homo Sapiens
VQHPDLVSQ

SEQ ID NO: 189514 - protein, 9 aa, Homo Sapiens
TFFDMVPRS

SEQ ID NO: 189515 - protein, 9 aa, Homo Sapiens
AFMLWAQAA

SEQ ID NO: 189516 - protein, 9 aa, Homo Sapiens
TSQSESHSG

SEQ ID NO: 189517 - protein, 9 aa, Homo Sapiens
HAYLKYGKE

SEQ ID NO: 189518 - protein, 9 aa, Homo Sapiens
MEGRCDSML

SEQ ID NO: 189519 - protein, 9 aa, Homo Sapiens
ALSMDWAGP

SEQ ID NO: 189520 - protein, 9 aa, Homo Sapiens
GGAVGELII

SEQ ID NO: 189521 - protein, 9 aa, Homo Sapiens
CDPLHYPVT

SEQ ID NO: 189522 - protein, 9 aa, Homo Sapiens
IPGIRVARV

SEQ ID NO: 189523 - protein, 9 aa, Homo Sapiens
VTIIKVYMK

SEQ ID NO: 189524 - protein, 9 aa, Homo Sapiens
IGKYAPATR

SEQ ID NO: 189525 - protein, 9 aa, Homo Sapiens
SGLPCWPCL

SEQ ID NO: 189526 - protein, 9 aa, Homo Sapiens
YAPATRFSY

SEQ ID NO: 189527 - protein, 9 aa, Homo Sapiens
HHLQVIILH

SEQ ID NO: 189528 - protein, 9 aa, Homo Sapiens
GKCKWTCNT

SEQ ID NO: 189529 - protein, 9 aa, Homo Sapiens
LAQCRALSM

SEQ ID NO: 189530 - protein, 9 aa, Homo Sapiens
QPFVIDKKT

SEQ ID NO: 189531 - protein, 9 aa, Homo Sapiens
VPFKQWIKT

SEQ ID NO: 189532 - protein, 9 aa, Homo Sapiens
QRPWARVSG

SEQ ID NO: 189533 - protein, 9 aa, Homo Sapiens
LQRNHLAKT

SEQ ID NO: 189534 - protein, 9 aa, Homo Sapiens
QWIKTISSV

SEQ ID NO: 189535 - protein, 9 aa, Homo Sapiens
QSESHSGPL

SEQ ID NO: 189536 - protein, 9 aa, Homo Sapiens
REGDGKPKS

SEQ ID NO: 189537 - protein, 9 aa, Homo Sapiens
RLVQHPDLV

SEQ ID NO: 189538 - protein, 9 aa, Homo Sapiens
NHLCIKQQQ

SEQ ID NO: 189539 - protein, 9 aa, Homo Sapiens
GPGTPGGTQ

SEQ ID NO: 189540 - protein, 9 aa, Homo Sapiens
IQEEINVKE

SEQ ID NO: 189541 - protein, 9 aa, Homo Sapiens
GKYAPATRF

SEQ ID NO: 189542 - protein, 9 aa, Homo Sapiens
EGIQEEINV

SEQ ID NO: 189543 - protein, 9 aa, Homo Sapiens
FVAVKLYGA

SEQ ID NO: 189544 - protein, 9 aa, Homo Sapiens
QTLNIVTPH

SEQ ID NO: 189545 - protein, 9 aa, Homo Sapiens
PSFNEEGLE

SEQ ID NO: 189546 - protein, 9 aa, Homo Sapiens
ITERKKREI

SEQ ID NO: 189547 - protein, 9 aa, Homo Sapiens
IAALEQVFH

SEQ ID NO: 189548 - protein, 9 aa, Homo Sapiens
WPCLTAEAL

SEQ ID NO: 189549 - protein, 9 aa, Homo Sapiens
AGNASYIYY

SEQ ID NO: 189550 - protein, 9 aa, Homo Sapiens
SVVLQKVEE

SEQ ID NO: 189551 - protein, 9 aa, Homo Sapiens
SSTCGFRGP

SEQ ID NO: 189552 - protein, 9 aa, Homo Sapiens
RIQQRPWAR

SEQ ID NO: 189553 - protein, 9 aa, Homo Sapiens
RNYVLIDYI

SEQ ID NO: 189554 - protein, 9 aa, Homo Sapiens
PNRFACWGE

SEQ ID NO: 189555 - protein, 9 aa, Homo Sapiens
HFSQPIHLR

SEQ ID NO: 189556 - protein, 9 aa, Homo Sapiens
GIRVARVYH

SEQ ID NO: 189557 - protein, 9 aa, Homo Sapiens
VIILHNNPL

SEQ ID NO: 189558 - protein, 9 aa, Homo Sapiens
TIFTDPHAY

SEQ ID NO: 189559 - protein, 9 aa, Homo Sapiens
ITLEKMPSY

SEQ ID NO: 189560 - protein, 9 aa, Homo Sapiens
CGENGLIAA

SEQ ID NO: 189561 - protein, 9 aa, Homo Sapiens
DDTKDNQQK

SEQ ID NO: 189562 - protein, 9 aa, Homo Sapiens
WASSENTRR

SEQ ID NO: 189563 - protein, 9 aa, Homo Sapiens
DYKDPAFYM

SEQ ID NO: 189564 - protein, 9 aa, Homo Sapiens
SRSGHNEVK

SEQ ID NO: 189565 - protein, 9 aa, Homo Sapiens
QRIIQQEML

SEQ ID NO: 189566 - protein, 9 aa, Homo Sapiens
AVTPLKLAG

SEQ ID NO: 189567 - protein, 9 aa, Homo Sapiens
IKVVEKDNC

SEQ ID NO: 189568 - protein, 9 aa, Homo Sapiens
KMLDHFDII

SEQ ID NO: 189569 - protein, 9 aa, Homo Sapiens
LVIGGAVGE

SEQ ID NO: 189570 - protein, 9 aa, Homo Sapiens
CLADIFHIY

SEQ ID NO: 189571 - protein, 9 aa, Homo Sapiens
EDDTKDNQQ

SEQ ID NO: 189572 - protein, 9 aa, Homo Sapiens
TMGHISCAQ

SEQ ID NO: 189573 - protein, 9 aa, Homo Sapiens
PGSYNPRAV

SEQ ID NO: 189574 - protein, 9 aa, Homo Sapiens
NSQAISYAG

SEQ ID NO: 189575 - protein, 9 aa, Homo Sapiens
IVTPHVRPE

SEQ ID NO: 189576 - protein, 9 aa, Homo Sapiens
LQLQVLGDH

SEQ ID NO: 189577 - protein, 9 aa, Homo Sapiens
VFVAVKLYG

SEQ ID NO: 189578 - protein, 9 aa, Homo Sapiens
WSVMSHKCS

SEQ ID NO: 189579 - protein, 9 aa, Homo Sapiens
VFKKNLMEI

SEQ ID NO: 189580 - protein, 9 aa, Homo Sapiens
MSTYLLLIL

SEQ ID NO: 189581 - protein, 9 aa, Homo Sapiens
SENTRRSCQ

SEQ ID NO: 189582 - protein, 9 aa, Homo Sapiens
MNAFMLWAQ

SEQ ID NO: 189583 - protein, 9 aa, Homo Sapiens
ATLGGDESL

SEQ ID NO: 189584 - protein, 9 aa, Homo Sapiens
VTTVTQNSM

SEQ ID NO: 189585 - protein, 9 aa, Homo Sapiens
LKPLLSKWL

SEQ ID NO: 189586 - protein, 9 aa, Homo Sapiens
PPPPPSQGA

SEQ ID NO: 189587 - protein, 9 aa, Homo Sapiens
MIIFNPSSY

SEQ ID NO: 189588 - protein, 9 aa, Homo Sapiens
SYSGPCQAR

SEQ ID NO: 189589 - protein, 9 aa, Homo Sapiens
VSKAMTAYW

SEQ ID NO: 189590 - protein, 9 aa, Homo Sapiens
GNACKIWLG

SEQ ID NO: 189591 - protein, 9 aa, Homo Sapiens
SFNEEGLEG

SEQ ID NO: 189592 - protein, 9 aa, Homo Sapiens
NVMYICCVL

SEQ ID NO: 189593 - protein, 9 aa, Homo Sapiens
DIFHIYAPE

SEQ ID NO: 189594 - protein, 9 aa, Homo Sapiens
PQLLIFSRW

SEQ ID NO: 189595 - protein, 9 aa, Homo Sapiens
LRHQDKRLS

SEQ ID NO: 189596 - protein, 9 aa, Homo Sapiens
FATAAVILS

SEQ ID NO: 189597 - protein, 9 aa, Homo Sapiens
PDLVSQASP

SEQ ID NO: 189598 - protein, 9 aa, Homo Sapiens
KDNCIHITE

SEQ ID NO: 189599 - protein, 9 aa, Homo Sapiens
KCRVDNVNL

SEQ ID NO: 189600 - protein, 9 aa, Homo Sapiens
PFTFGVRQP

SEQ ID NO: 189601 - protein, 9 aa, Homo Sapiens
LSALEQDRV

SEQ ID NO: 189602 - protein, 9 aa, Homo Sapiens
RGLTTPELW

SEQ ID NO: 189603 - protein, 9 aa, Homo Sapiens
ENTRRSCQS

SEQ ID NO: 189604 - protein, 9 aa, Homo Sapiens
DKKTAEIRL

SEQ ID NO: 189605 - protein, 9 aa, Homo Sapiens
LDLLYGMVF

SEQ ID NO: 189606 - protein, 9 aa, Homo Sapiens
RTEGQVYAT

SEQ ID NO: 189607 - protein, 9 aa, Homo Sapiens
CIKQQQQQQ

SEQ ID NO: 189608 - protein, 9 aa, Homo Sapiens
EKNESLTKH

SEQ ID NO: 189609 - protein, 9 aa, Homo Sapiens
RALSMDWAG

SEQ ID NO: 189610 - protein, 9 aa, Homo Sapiens
VGAQPPPPP

SEQ ID NO: 189611 - protein, 9 aa, Homo Sapiens
MDWAGPGSP

SEQ ID NO: 189612 - protein, 9 aa, Homo Sapiens
SRWKPSVMT

SEQ ID NO: 189613 - protein, 9 aa, Homo Sapiens
GSYNPRAVA

SEQ ID NO: 189614 - protein, 9 aa, Homo Sapiens
NVNLQLQVL

SEQ ID NO: 189615 - protein, 9 aa, Homo Sapiens
FSAVFFVPL

SEQ ID NO: 189616 - protein, 9 aa, Homo Sapiens
DKVFRQMDT

SEQ ID NO: 189617 - protein, 9 aa, Homo Sapiens
APNQLGGGA

SEQ ID NO: 189618 - protein, 9 aa, Homo Sapiens
WPPQAPAPP

SEQ ID NO: 189619 - protein, 9 aa, Homo Sapiens
ELQKLEDDT

SEQ ID NO: 189620 - protein, 9 aa, Homo Sapiens
SISAMGYKF

SEQ ID NO: 189621 - protein, 9 aa, Homo Sapiens
NHLAKTKKP

SEQ ID NO: 189622 - protein, 9 aa, Homo Sapiens
WLVREFCGA

SEQ ID NO: 189623 - protein, 9 aa, Homo Sapiens
VMSHKCSST

SEQ ID NO: 189624 - protein, 9 aa, Homo Sapiens
TKHPRSTEL

SEQ ID NO: 189625 - protein, 9 aa, Homo Sapiens
QSHTKWVCY

SEQ ID NO: 189626 - protein, 9 aa, Homo Sapiens
PSHPPSFNE

SEQ ID NO: 189627 - protein, 9 aa, Homo Sapiens
TLNIVTPHV

SEQ ID NO: 189628 - protein, 9 aa, Homo Sapiens
CWPCLTAEA

SEQ ID NO: 189629 - protein, 9 aa, Homo Sapiens
EVKEVWSNA

SEQ ID NO: 189630 - protein, 9 aa, Homo Sapiens
EETSKWIMD

SEQ ID NO: 189631 - protein, 9 aa, Homo Sapiens
QVQNCDRIR

SEQ ID NO: 189632 - protein, 9 aa, Homo Sapiens
FTDPHAYLK

SEQ ID NO: 189633 - protein, 9 aa, Homo Sapiens
CKMLDHFDI

SEQ ID NO: 189634 - protein, 9 aa, Homo Sapiens
QSLPGSYTP

SEQ ID NO: 189635 - protein, 9 aa, Homo Sapiens
RESYIPGIR

SEQ ID NO: 189636 - protein, 9 aa, Homo Sapiens
SMGLSWTVP

SEQ ID NO: 189637 - protein, 9 aa, Homo Sapiens
ESYVLQPMK

SEQ ID NO: 189638 - protein, 9 aa, Homo Sapiens
ITGRSISAM

SEQ ID NO: 189639 - protein, 9 aa, Homo Sapiens
CLTAEALKN

SEQ ID NO: 189640 - protein, 9 aa, Homo Sapiens
NAFMLWAQA

SEQ ID NO: 189641 - protein, 9 aa, Homo Sapiens
LAPNQLGGG

SEQ ID NO: 189642 - protein, 9 aa, Homo Sapiens
SHPPSFNEE

SEQ ID NO: 189643 - protein, 9 aa, Homo Sapiens
KHPRSTELP

SEQ ID NO: 189644 - protein, 9 aa, Homo Sapiens
IDWICKREL

SEQ ID NO: 189645 - protein, 9 aa, Homo Sapiens
SNQSVQHLK

SEQ ID NO: 189646 - protein, 9 aa, Homo Sapiens
ASSENTRRS

SEQ ID NO: 189647 - protein, 9 aa, Homo Sapiens
DPIGKYAPA

SEQ ID NO: 189648 - protein, 9 aa, Homo Sapiens
SRLESLVAP

SEQ ID NO: 189649 - protein, 9 aa, Homo Sapiens
GTLPSKLPF

SEQ ID NO: 189650 - protein, 9 aa, Homo Sapiens
APATRFSYT

SEQ ID NO: 189651 - protein, 9 aa, Homo Sapiens
FSQPIHLRN

SEQ ID NO: 189652 - protein, 9 aa, Homo Sapiens
QQMEGRCDS

SEQ ID NO: 189653 - protein, 9 aa, Homo Sapiens
YYLIRRTME

SEQ ID NO: 189654 - protein, 9 aa, Homo Sapiens
RQPPLAVGA

SEQ ID NO: 189655 - protein, 9 aa, Homo Sapiens
IIFNPSSYN

SEQ ID NO: 189656 - protein, 9 aa, Homo Sapiens
LAQNQPPIA

SEQ ID NO: 189657 - protein, 9 aa, Homo Sapiens
STYLLLILI

SEQ ID NO: 189658 - protein, 9 aa, Homo Sapiens
PLAPNQLGG

SEQ ID NO: 189659 - protein, 9 aa, Homo Sapiens
IFSRWKPSV

SEQ ID NO: 189660 - protein, 9 aa, Homo Sapiens
PKPASYSGP

SEQ ID NO: 189661 - protein, 9 aa, Homo Sapiens
NQLGGGAVV

SEQ ID NO: 189662 - protein, 9 aa, Homo Sapiens
SYVLQPMKS

SEQ ID NO: 189663 - protein, 9 aa, Homo Sapiens
KLQRNHLAK

SEQ ID NO: 189664 - protein, 9 aa, Homo Sapiens
VGALGSMWP

SEQ ID NO: 189665 - protein, 9 aa, Homo Sapiens
KLEDDTKDN

SEQ ID NO: 189666 - protein, 9 aa, Homo Sapiens
TFGVRQPPL

SEQ ID NO: 189667 - protein, 9 aa, Homo Sapiens
ELAWQLNLS

SEQ ID NO: 189668 - protein, 9 aa, Homo Sapiens
GHNEVKEVW

SEQ ID NO: 189669 - protein, 9 aa, Homo Sapiens
KRTWSVMSH

SEQ ID NO: 189670 - protein, 9 aa, Homo Sapiens
ERTELAWQL

SEQ ID NO: 189671 - protein, 9 aa, Homo Sapiens
KVVEKDNCI

SEQ ID NO: 189672 - protein, 9 aa, Homo Sapiens
FVIDKKTAE

SEQ ID NO: 189673 - protein, 9 aa, Homo Sapiens
NRFACWGEL

SEQ ID NO: 189674 - protein, 9 aa, Homo Sapiens
VKLYGAVRL

SEQ ID NO: 189675 - protein, 9 aa, Homo Sapiens
PSSYNPGPF

SEQ ID NO: 189676 - protein, 9 aa, Homo Sapiens
RSLRCGEGT

SEQ ID NO: 189677 - protein, 9 aa, Homo Sapiens
GVPTSQSES

SEQ ID NO: 189678 - protein, 9 aa, Homo Sapiens
CKWTCNTLI

SEQ ID NO: 189679 - protein, 9 aa, Homo Sapiens
SGHNEVKEV

SEQ ID NO: 189680 - protein, 9 aa, Homo Sapiens
VPVKSCSKP

SEQ ID NO: 189681 - protein, 9 aa, Homo Sapiens
VHCCFALPL

SEQ ID NO: 189682 - protein, 9 aa, Homo Sapiens
ELSNEGRND

SEQ ID NO: 189683 - protein, 9 aa, Homo Sapiens
INFSHYSSF

SEQ ID NO: 189684 - protein, 9 aa, Homo Sapiens
DGWNGNACK

SEQ ID NO: 189685 - protein, 9 aa, Homo Sapiens
AMTAYWTNF

SEQ ID NO: 189686 - protein, 9 aa, Homo Sapiens
QSVQHLKYS

SEQ ID NO: 189687 - protein, 9 aa, Homo Sapiens
MSHKCSSTS

SEQ ID NO: 189688 - protein, 9 aa, Homo Sapiens
GPPAQSLPG

SEQ ID NO: 189689 - protein, 9 aa, Homo Sapiens
SHYSSFLCA

SEQ ID NO: 189690 - protein, 9 aa, Homo Sapiens
NEVKEVWSN

SEQ ID NO: 189691 - protein, 9 aa, Homo Sapiens
GGPGTPGGT

SEQ ID NO: 189692 - protein, 9 aa, Homo Sapiens
PPELSALEQ

SEQ ID NO: 189693 - protein, 9 aa, Homo Sapiens
TTVTQNSMG

SEQ ID NO: 189694 - protein, 9 aa, Homo Sapiens
VAVKLYGAV

SEQ ID NO: 189695 - protein, 9 aa, Homo Sapiens
GAQPPPPPS

SEQ ID NO: 189696 - protein, 9 aa, Homo Sapiens
TPEKRTDKV

SEQ ID NO: 189697 - protein, 9 aa, Homo Sapiens
SQPIHLRNI

SEQ ID NO: 189698 - protein, 9 aa, Homo Sapiens
NACKIWLGS

SEQ ID NO: 189699 - protein, 9 aa, Homo Sapiens
QNCLWTLRK

SEQ ID NO: 189700 - protein, 9 aa, Homo Sapiens
QPPPPPSQG

SEQ ID NO: 189701 - protein, 9 aa, Homo Sapiens
SSGLPCWPC

SEQ ID NO: 189702 - protein, 9 aa, Homo Sapiens
WVCYNGPVP

SEQ ID NO: 189703 - protein, 9 aa, Homo Sapiens
ATKRTWSVM

SEQ ID NO: 189704 - protein, 9 aa, Homo Sapiens
PTHVDEQVF

SEQ ID NO: 189705 - protein, 9 aa, Homo Sapiens
FKEIHYPPY

SEQ ID NO: 189706 - protein, 9 aa, Homo Sapiens
FNPSSYNPG

SEQ ID NO: 189707 - protein, 9 aa, Homo Sapiens
LHSNHLCIK

SEQ ID NO: 189708 - protein, 9 aa, Homo Sapiens
PELSALEQD

SEQ ID NO: 189709 - protein, 9 aa, Homo Sapiens
ISPVQPARK

SEQ ID NO: 189710 - protein, 9 aa, Homo Sapiens
RHQDKRLSL

SEQ ID NO: 189711 - protein, 9 aa, Homo Sapiens
PTSQSESHS

SEQ ID NO: 189712 - protein, 9 aa, Homo Sapiens
EWRRAWQAS

SEQ ID NO: 189713 - protein, 9 aa, Homo Sapiens
EKDKQDPLR

SEQ ID NO: 189714 - protein, 9 aa, Homo Sapiens
EKDNCIHIT

SEQ ID NO: 189715 - protein, 9 aa, Homo Sapiens
VRQPPLAVG

SEQ ID NO: 189716 - protein, 9 aa, Homo Sapiens
KNESLTKHP

SEQ ID NO: 189717 - protein, 9 aa, Homo Sapiens
PASYSGPCQ

SEQ ID NO: 189718 - protein, 9 aa, Homo Sapiens
VEGQSLRHQ

SEQ ID NO: 189719 - protein, 9 aa, Homo Sapiens
ILHNNPLQV

SEQ ID NO: 189720 - protein, 9 aa, Homo Sapiens
ATEWASSEN

SEQ ID NO: 189721 - protein, 9 aa, Homo Sapiens
QSLRHQDKR

SEQ ID NO: 189722 - protein, 9 aa, Homo Sapiens
WQSLWPSEE

SEQ ID NO: 189723 - protein, 9 aa, Homo Sapiens
LQPMKSATN

SEQ ID NO: 189724 - protein, 9 aa, Homo Sapiens
YLSGNSQAI

SEQ ID NO: 189725 - protein, 9 aa, Homo Sapiens
GHGSNQSVQ

SEQ ID NO: 189726 - protein, 9 aa, Homo Sapiens
ELRSLRCGE

SEQ ID NO: 189727 - protein, 9 aa, Homo Sapiens
IQQEMLQLI

SEQ ID NO: 189728 - protein, 9 aa, Homo Sapiens
RTELAWQLN

SEQ ID NO: 189729 - protein, 9 aa, Homo Sapiens
FRGPAVSGA

SEQ ID NO: 189730 - protein, 9 aa, Homo Sapiens
WNGNACKIW

SEQ ID NO: 189731 - protein, 9 aa, Homo Sapiens
IFTDPHAYL

SEQ ID NO: 189732 - protein, 9 aa, Homo Sapiens
LQRIIQQEM

SEQ ID NO: 189733 - protein, 9 aa, Homo Sapiens
GPDGSTFFD

SEQ ID NO: 189734 - protein, 9 aa, Homo Sapiens
VIDKKTAEI

SEQ ID NO: 189735 - protein, 9 aa, Homo Sapiens
PVKSCSKPR

SEQ ID NO: 189736 - protein, 9 aa, Homo Sapiens
EEKVPPITR

SEQ ID NO: 189737 - protein, 9 aa, Homo Sapiens
IYYLIRRTM

SEQ ID NO: 189738 - protein, 9 aa, Homo Sapiens
SVDFECLQI

SEQ ID NO: 189739 - protein, 9 aa, Homo Sapiens
NASYIYYLI

SEQ ID NO: 189740 - protein, 9 aa, Homo Sapiens
FKKNLMEIV

SEQ ID NO: 189741 - protein, 9 aa, Homo Sapiens
KYAPATRFS

SEQ ID NO: 189742 - protein, 9 aa, Homo Sapiens
SYIPGIRVA

SEQ ID NO: 189743 - protein, 9 aa, Homo Sapiens
PAPPPELSA

SEQ ID NO: 189744 - protein, 9 aa, Homo Sapiens
FMLWAQAAR

SEQ ID NO: 189745 - protein, 9 aa, Homo Sapiens
YIYYLIRRT

SEQ ID NO: 189746 - protein, 9 aa, Homo Sapiens
SAFSAVFFV

SEQ ID NO: 189747 - protein, 9 aa, Homo Sapiens
AQSLPGSYT

SEQ ID NO: 189748 - protein, 9 aa, Homo Sapiens
DSRSGHNEV

SEQ ID NO: 189749 - protein, 9 aa, Homo Sapiens
DLLYGMVFK

SEQ ID NO: 189750 - protein, 9 aa, Homo Sapiens
GELSNEGRN

SEQ ID NO: 189751 - protein, 9 aa, Homo Sapiens
AQCRALSMD

SEQ ID NO: 189752 - protein, 9 aa, Homo Sapiens
YIPGIRVAR

SEQ ID NO: 189753 - protein, 9 aa, Homo Sapiens
VCYNGPVPK

SEQ ID NO: 189754 - protein, 9 aa, Homo Sapiens
YLLLILIFD

SEQ ID NO: 189755 - protein, 9 aa, Homo Sapiens
TNALDVSNT

SEQ ID NO: 189756 - protein, 9 aa, Homo Sapiens
DIAVTPLKL

SEQ ID NO: 189757 - protein, 9 aa, Homo Sapiens
HLCIKQQQQ

SEQ ID NO: 189758 - protein, 9 aa, Homo Sapiens
SAVFFVPLI

SEQ ID NO: 189759 - protein, 9 aa, Homo Sapiens
RTVSKAMTA

SEQ ID NO: 189760 - protein, 9 aa, Homo Sapiens
KDKQDPLRQ

SEQ ID NO: 189761 - protein, 9 aa, Homo Sapiens
TESRLESLV

SEQ ID NO: 189762 - protein, 9 aa, Homo Sapiens
WGELVAIHL

SEQ ID NO: 189763 - protein, 9 aa, Homo Sapiens
GALGSMWPP

SEQ ID NO: 189764 - protein, 9 aa, Homo Sapiens
RNHLAKTKK

SEQ ID NO: 189765 - protein, 9 aa, Homo Sapiens
KWVCYNGPV

SEQ ID NO: 189766 - protein, 9 aa, Homo Sapiens
ADTLVLLML

SEQ ID NO: 189767 - protein, 9 aa, Homo Sapiens
AVGALGSMW

SEQ ID NO: 189768 - protein, 9 aa, Homo Sapiens
QVIILHNNP

SEQ ID NO: 189769 - protein, 9 aa, Homo Sapiens
PVHCCFALP

SEQ ID NO: 189770 - protein, 9 aa, Homo Sapiens
HQDKRLSLN

SEQ ID NO: 189771 - protein, 9 aa, Homo Sapiens
DPPLAQNQP

SEQ ID NO: 189772 - protein, 9 aa, Homo Sapiens
LIAALEQVF

SEQ ID NO: 189773 - protein, 9 aa, Homo Sapiens
QKLEDDTKD

SEQ ID NO: 189774 - protein, 9 aa, Homo Sapiens
DGSTFFDMV

SEQ ID NO: 189775 - protein, 9 aa, Homo Sapiens
AQNQPPIAG

SEQ ID NO: 189776 - protein, 9 aa, Homo Sapiens
RVGAQPPPP

SEQ ID NO: 189777 - protein, 9 aa, Homo Sapiens
ALGPDGSTF

SEQ ID NO: 189778 - protein, 9 aa, Homo Sapiens
IYSSPGSYN

SEQ ID NO: 189779 - protein, 9 aa, Homo Sapiens
QDPLRQVLS

SEQ ID NO: 189780 - protein, 9 aa, Homo Sapiens
RGLRNKIIG

SEQ ID NO: 189781 - protein, 9 aa, Homo Sapiens
PMNAFMLWA

SEQ ID NO: 189782 - protein, 9 aa, Homo Sapiens
GRERTELAW

SEQ ID NO: 189783 - protein, 9 aa, Homo Sapiens
YPVTMGHIS

SEQ ID NO: 189784 - protein, 9 aa, Homo Sapiens
LSGNSQAIS

SEQ ID NO: 189785 - protein, 9 aa, Homo Sapiens
TLRKLSDAA

SEQ ID NO: 189786 - protein, 9 aa, Homo Sapiens
EMLQLINSN

SEQ ID NO: 189787 - protein, 9 aa, Homo Sapiens
TLPSKLPFR

SEQ ID NO: 189788 - protein, 9 aa, Homo Sapiens
YDPPLAQNQ

SEQ ID NO: 189789 - protein, 9 aa, Homo Sapiens
QNQPPIAGK

SEQ ID NO: 189790 - protein, 9 aa, Homo Sapiens
IIQQEMLQL

SEQ ID NO: 189791 - protein, 9 aa, Homo Sapiens
GGTQRWASE

SEQ ID NO: 189792 - protein, 9 aa, Homo Sapiens
CWGELVAIH

SEQ ID NO: 189793 - protein, 9 aa, Homo Sapiens
LRPVHCCFA

SEQ ID NO: 189794 - protein, 9 aa, Homo Sapiens
SYIYYLIRR

SEQ ID NO: 189795 - protein, 9 aa, Homo Sapiens
TGRSISAMG

SEQ ID NO: 189796 - protein, 9 aa, Homo Sapiens
TYLLLILIF

SEQ ID NO: 189797 - protein, 9 aa, Homo Sapiens
STFFDMVPR

SEQ ID NO: 189798 - protein, 9 aa, Homo Sapiens
KGPGITERK

SEQ ID NO: 189799 - protein, 9 aa, Homo Sapiens
WTCNTLIPF

SEQ ID NO: 189800 - protein, 9 aa, Homo Sapiens
HLHSNHLCI

SEQ ID NO: 189801 - protein, 9 aa, Homo Sapiens
SMDWAGPGS

SEQ ID NO: 189802 - protein, 9 aa, Homo Sapiens
KLPTTKGLE

SEQ ID NO: 189803 - protein, 9 aa, Homo Sapiens
SQAISYAGC

SEQ ID NO: 189804 - protein, 9 aa, Homo Sapiens
LRSLRCGEG

SEQ ID NO: 189805 - protein, 9 aa, Homo Sapiens
AVFFVPLII

SEQ ID NO: 189806 - protein, 9 aa, Homo Sapiens
GSTFFDMVP

SEQ ID NO: 189807 - protein, 9 aa, Homo Sapiens
CKLQRNHLA

SEQ ID NO: 189808 - protein, 9 aa, Homo Sapiens
QPIHLRNIP

SEQ ID NO: 189809 - protein, 9 aa, Homo Sapiens
DRTVSKAMT

SEQ ID NO: 189810 - protein, 9 aa, Homo Sapiens
GSVVLQKVE

SEQ ID NO: 189811 - protein, 9 aa, Homo Sapiens
ISWRSDYKD

SEQ ID NO: 189812 - protein, 9 aa, Homo Sapiens
ETSKWIMDK

SEQ ID NO: 189813 - protein, 9 aa, Homo Sapiens
APTHVDEQV

SEQ ID NO: 189814 - protein, 9 aa, Homo Sapiens
IDKKTAEIR

SEQ ID NO: 189815 - protein, 9 aa, Homo Sapiens
WKPSVMTPT

SEQ ID NO: 189816 - protein, 9 aa, Homo Sapiens
KPASYSGPC

SEQ ID NO: 189817 - protein, 9 aa, Homo Sapiens
ERKKREIIE

SEQ ID NO: 189818 - protein, 9 aa, Homo Sapiens
FSHYSSFLC

SEQ ID NO: 189819 - protein, 9 aa, Homo Sapiens
ILSGHQKST

SEQ ID NO: 189820 - protein, 9 aa, Homo Sapiens
DPHAYLKYG

SEQ ID NO: 189821 - protein, 9 aa, Homo Sapiens
VCKLQRNHL

SEQ ID NO: 189822 - protein, 9 aa, Homo Sapiens
SYNPRAVAV

SEQ ID NO: 189823 - protein, 9 aa, Homo Sapiens
VFFVPLIIS

SEQ ID NO: 189824 - protein, 9 aa, Homo Sapiens
KEAPGSPPE

SEQ ID NO: 189825 - protein, 9 aa, Homo Sapiens
QPMKSATNR

SEQ ID NO: 189826 - protein, 9 aa, Homo Sapiens
GSYTPPPPP

SEQ ID NO: 189827 - protein, 9 aa, Homo Sapiens
LLILIFDND

SEQ ID NO: 189828 - protein, 9 aa, Homo Sapiens
HYPVTMGHI

SEQ ID NO: 189829 - protein, 9 aa, Homo Sapiens
LWAQAARRK

SEQ ID NO: 189830 - protein, 9 aa, Homo Sapiens
SKLPFRFGQ

SEQ ID NO: 189831 - protein, 9 aa, Homo Sapiens
RWKPSVMTP

SEQ ID NO: 189832 - protein, 9 aa, Homo Sapiens
EAIWQSLWP

SEQ ID NO: 189833 - protein, 9 aa, Homo Sapiens
KQDPLRQVL

SEQ ID NO: 189834 - protein, 9 aa, Homo Sapiens
MLPFQGTDI

SEQ ID NO: 189835 - protein, 9 aa, Homo Sapiens
CKLKPLLSK

SEQ ID NO: 189836 - protein, 9 aa, Homo Sapiens
PFVIDKKTA

SEQ ID NO: 189837 - protein, 9 aa, Homo Sapiens
SVFENVMYI

SEQ ID NO: 189838 - protein, 9 aa, Homo Sapiens
NKCKMLDHF

SEQ ID NO: 189839 - protein, 9 aa, Homo Sapiens
RLAPTHVDE

SEQ ID NO: 189840 - protein, 9 aa, Homo Sapiens
ILQVGELSN

SEQ ID NO: 189841 - protein, 9 aa, Homo Sapiens
LLMLPFQGT

SEQ ID NO: 189842 - protein, 9 aa, Homo Sapiens
VREAIWQSL

SEQ ID NO: 189843 - protein, 9 aa, Homo Sapiens
DTLVLLMLP

SEQ ID NO: 189844 - protein, 9 aa, Homo Sapiens
LLSKWLEEA

SEQ ID NO: 189845 - protein, 9 aa, Homo Sapiens
EGQSLRHQD

SEQ ID NO: 189846 - protein, 9 aa, Homo Sapiens
LQKVEEEQM

SEQ ID NO: 189847 - protein, 9 aa, Homo Sapiens
LAPTHVDEQ

SEQ ID NO: 189848 - protein, 9 aa, Homo Sapiens
KLYGAVRLT

SEQ ID NO: 189849 - protein, 9 aa, Homo Sapiens
NESLTKHPR

SEQ ID NO: 189850 - protein, 9 aa, Homo Sapiens
PPSFNEEGL

SEQ ID NO: 189851 - protein, 9 aa, Homo Sapiens
RLESLVAPP

SEQ ID NO: 189852 - protein, 9 aa, Homo Sapiens
LQVIILHNN

SEQ ID NO: 189853 - protein, 9 aa, Homo Sapiens
AQPPPPPSQ

SEQ ID NO: 189854 - protein, 9 aa, Homo Sapiens
PPLAQNQPP

SEQ ID NO: 189855 - protein, 9 aa, Homo Sapiens
NSIQMDMFS

SEQ ID NO: 189856 - protein, 9 aa, Homo Sapiens
LVREFCGAG

SEQ ID NO: 189857 - protein, 9 aa, Homo Sapiens
YGMVFKKNL

SEQ ID NO: 189858 - protein, 9 aa, Homo Sapiens
GGDESLTIF

SEQ ID NO: 189859 - protein, 9 aa, Homo Sapiens
VMYICCVLM

SEQ ID NO: 189860 - protein, 9 aa, Homo Sapiens
NSMGLSWTV

SEQ ID NO: 189861 - protein, 9 aa, Homo Sapiens
MPSYFVTQE

SEQ ID NO: 189862 - protein, 9 aa, Homo Sapiens
SALEQDRVG

SEQ ID NO: 189863 - protein, 9 aa, Homo Sapiens
LEKFKEIHY

SEQ ID NO: 189864 - protein, 9 aa, Homo Sapiens
APPPELSAL

SEQ ID NO: 189865 - protein, 9 aa, Homo Sapiens
EKMPSYFVT

SEQ ID NO: 189866 - protein, 9 aa, Homo Sapiens
MDKTKVVES

SEQ ID NO: 189867 - protein, 9 aa, Homo Sapiens
VTPHVRPED

SEQ ID NO: 189868 - protein, 9 aa, Homo Sapiens
IILHNNPLQ

SEQ ID NO: 189869 - protein, 9 aa, Homo Sapiens
QRNHLAKTK

SEQ ID NO: 189870 - protein, 9 aa, Homo Sapiens
RVFVAVKLY

SEQ ID NO: 189871 - protein, 9 aa, Homo Sapiens
QVGELSNEG

SEQ ID NO: 189872 - protein, 9 aa, Homo Sapiens
SGKCKWTCN

SEQ ID NO: 189873 - protein, 9 aa, Homo Sapiens
KSNFHDGHK

SEQ ID NO: 189874 - protein, 9 aa, Homo Sapiens
SYAWEPRCP

SEQ ID NO: 189875 - protein, 9 aa, Homo Sapiens
PKHAIWVEN

SEQ ID NO: 189876 - protein, 9 aa, Homo Sapiens
GAARLTALH

SEQ ID NO: 189877 - protein, 9 aa, Homo Sapiens
SNLQRLENN

SEQ ID NO: 189878 - protein, 9 aa, Homo Sapiens
DVIDLCTVP

SEQ ID NO: 189879 - protein, 9 aa, Homo Sapiens
PFRAARDAL

SEQ ID NO: 189880 - protein, 9 aa, Homo Sapiens
AAMKASVKE

SEQ ID NO: 189881 - protein, 9 aa, Homo Sapiens
SLARKCLTL

SEQ ID NO: 189882 - protein, 9 aa, Homo Sapiens
QHENYDEAL

SEQ ID NO: 189883 - protein, 9 aa, Homo Sapiens
HVTGMKGKG

SEQ ID NO: 189884 - protein, 9 aa, Homo Sapiens
LFMRHLCEL

SEQ ID NO: 189885 - protein, 9 aa, Homo Sapiens
AMYLMCTVP

SEQ ID NO: 189886 - protein, 9 aa, Homo Sapiens
MEQGGAFSN

SEQ ID NO: 189887 - protein, 9 aa, Homo Sapiens
LCNQYRCSN

SEQ ID NO: 189888 - protein, 9 aa, Homo Sapiens
YLQINNADI

SEQ ID NO: 189889 - protein, 9 aa, Homo Sapiens
QDALPEDHD

SEQ ID NO: 189890 - protein, 9 aa, Homo Sapiens
DSRFPPTLP

SEQ ID NO: 189891 - protein, 9 aa, Homo Sapiens
SAKWSHKAE

SEQ ID NO: 189892 - protein, 9 aa, Homo Sapiens
LDYNPPWVQ

SEQ ID NO: 189893 - protein, 9 aa, Homo Sapiens
DFQDGLKLM

SEQ ID NO: 189894 - protein, 9 aa, Homo Sapiens
TRALRKVLR

SEQ ID NO: 189895 - protein, 9 aa, Homo Sapiens
PRAKEPLCA

SEQ ID NO: 189896 - protein, 9 aa, Homo Sapiens
TIRHRPEAL

SEQ ID NO: 189897 - protein, 9 aa, Homo Sapiens
RTRLLAKGK

SEQ ID NO: 189898 - protein, 9 aa, Homo Sapiens
LIHPYLGDM

SEQ ID NO: 189899 - protein, 9 aa, Homo Sapiens
FQEPASAMA

SEQ ID NO: 189900 - protein, 9 aa, Homo Sapiens
DTELLQIQA

SEQ ID NO: 189901 - protein, 9 aa, Homo Sapiens
ADRAMYLMC

SEQ ID NO: 189902 - protein, 9 aa, Homo Sapiens
ASQLHTGIT

SEQ ID NO: 189903 - protein, 9 aa, Homo Sapiens
TRWPNSGRG

SEQ ID NO: 189904 - protein, 9 aa, Homo Sapiens
LCKFPAGKV

SEQ ID NO: 189905 - protein, 9 aa, Homo Sapiens
QEAQLQAEC

SEQ ID NO: 189906 - protein, 9 aa, Homo Sapiens
RRLLGVDSA

SEQ ID NO: 189907 - protein, 9 aa, Homo Sapiens
PKPSQFLPC

SEQ ID NO: 189908 - protein, 9 aa, Homo Sapiens
SDVVSTTEP

SEQ ID NO: 189909 - protein, 9 aa, Homo Sapiens
ISALQAGTV

SEQ ID NO: 189910 - protein, 9 aa, Homo Sapiens
RRELEKIPT

SEQ ID NO: 189911 - protein, 9 aa, Homo Sapiens
YSGSSALKH

SEQ ID NO: 189912 - protein, 9 aa, Homo Sapiens
TNCSTPGVA

SEQ ID NO: 189913 - protein, 9 aa, Homo Sapiens
QMPVDSPDD

SEQ ID NO: 189914 - protein, 9 aa, Homo Sapiens
QRQDCMDAM

SEQ ID NO: 189915 - protein, 9 aa, Homo Sapiens
VYQCSTAIF

SEQ ID NO: 189916 - protein, 9 aa, Homo Sapiens
LVDTVFNTM

SEQ ID NO: 189917 - protein, 9 aa, Homo Sapiens
PGPSRAHCP

SEQ ID NO: 189918 - protein, 9 aa, Homo Sapiens
YKCNDCNMT

SEQ ID NO: 189919 - protein, 9 aa, Homo Sapiens
GFVSSEVVF

SEQ ID NO: 189920 - protein, 9 aa, Homo Sapiens
TACALAFTQ

SEQ ID NO: 189921 - protein, 9 aa, Homo Sapiens
GTREAHDIF

SEQ ID NO: 189922 - protein, 9 aa, Homo Sapiens
PAVLAPEDV

SEQ ID NO: 189923 - protein, 9 aa, Homo Sapiens
DYIAVWDDP

SEQ ID NO: 189924 - protein, 9 aa, Homo Sapiens
PNTRNQQEF

SEQ ID NO: 189925 - protein, 9 aa, Homo Sapiens
PPPIPVKKP

SEQ ID NO: 189926 - protein, 9 aa, Homo Sapiens
CAHNMSFWS

SEQ ID NO: 189927 - protein, 9 aa, Homo Sapiens
TNLEGCYLS

SEQ ID NO: 189928 - protein, 9 aa, Homo Sapiens
PQQMYSEII

SEQ ID NO: 189929 - protein, 9 aa, Homo Sapiens
ENAEVIYTI

SEQ ID NO: 189930 - protein, 9 aa, Homo Sapiens
ARMITETEG

SEQ ID NO: 189931 - protein, 9 aa, Homo Sapiens
DAKTLKKKI

SEQ ID NO: 189932 - protein, 9 aa, Homo Sapiens
LLRRCYQSS

SEQ ID NO: 189933 - protein, 9 aa, Homo Sapiens
CQDLPAWDY

SEQ ID NO: 189934 - protein, 9 aa, Homo Sapiens
PATSRATGL

SEQ ID NO: 189935 - protein, 9 aa, Homo Sapiens
TIVYKVPRN

SEQ ID NO: 189936 - protein, 9 aa, Homo Sapiens
NLQLAKQEW

SEQ ID NO: 189937 - protein, 9 aa, Homo Sapiens
FFSETRAGK

SEQ ID NO: 189938 - protein, 9 aa, Homo Sapiens
SDGSLLSML

SEQ ID NO: 189939 - protein, 9 aa, Homo Sapiens
DFFNCVNLI

SEQ ID NO: 189940 - protein, 9 aa, Homo Sapiens
QDTGTIERC

SEQ ID NO: 189941 - protein, 9 aa, Homo Sapiens
EALKKRRTY

SEQ ID NO: 189942 - protein, 9 aa, Homo Sapiens
VSPSHRALP

SEQ ID NO: 189943 - protein, 9 aa, Homo Sapiens
PRSLPPSSH

SEQ ID NO: 189944 - protein, 9 aa, Homo Sapiens
LELDALCSK

SEQ ID NO: 189945 - protein, 9 aa, Homo Sapiens
HMTEVVRHC

SEQ ID NO: 189946 - protein, 9 aa, Homo Sapiens
AVPLGPART

SEQ ID NO: 189947 - protein, 9 aa, Homo Sapiens
VIYYYLTKK

SEQ ID NO: 189948 - protein, 9 aa, Homo Sapiens
NVILVCFER

SEQ ID NO: 189949 - protein, 9 aa, Homo Sapiens
LSECHTPPG

SEQ ID NO: 189950 - protein, 9 aa, Homo Sapiens
LSPSPRQPL

SEQ ID NO: 189951 - protein, 9 aa, Homo Sapiens
PSHCIQCAA

SEQ ID NO: 189952 - protein, 9 aa, Homo Sapiens
EKIFEYLDC

SEQ ID NO: 189953 - protein, 9 aa, Homo Sapiens
ELQRVGLAA

SEQ ID NO: 189954 - protein, 9 aa, Homo Sapiens
SVVHDYFEG

SEQ ID NO: 189955 - protein, 9 aa, Homo Sapiens
IYVHLDFPD

SEQ ID NO: 189956 - protein, 9 aa, Homo Sapiens
KPSMTQKEI

SEQ ID NO: 189957 - protein, 9 aa, Homo Sapiens
SLVSADENS

SEQ ID NO: 189958 - protein, 9 aa, Homo Sapiens
CRVLVHCPH

SEQ ID NO: 189959 - protein, 9 aa, Homo Sapiens
VYKVPRNPE

SEQ ID NO: 189960 - protein, 9 aa, Homo Sapiens
EGIYPDPGL

SEQ ID NO: 189961 - protein, 9 aa, Homo Sapiens
YNCGRDGHI

SEQ ID NO: 189962 - protein, 9 aa, Homo Sapiens
NERPARSPP

SEQ ID NO: 189963 - protein, 9 aa, Homo Sapiens
KGWRLDLQG

SEQ ID NO: 189964 - protein, 9 aa, Homo Sapiens
GNPSRLYYI

SEQ ID NO: 189965 - protein, 9 aa, Homo Sapiens
TLRDVLSYH

SEQ ID NO: 189966 - protein, 9 aa, Homo Sapiens
PRPPVQGCS

SEQ ID NO: 189967 - protein, 9 aa, Homo Sapiens
SLYMMDPHE

SEQ ID NO: 189968 - protein, 9 aa, Homo Sapiens
WIQQDNGSV

SEQ ID NO: 189969 - protein, 9 aa, Homo Sapiens
ESWGATRPF

SEQ ID NO: 189970 - protein, 9 aa, Homo Sapiens
WSGEARAPP

SEQ ID NO: 189971 - protein, 9 aa, Homo Sapiens
AKMNLVVLP

SEQ ID NO: 189972 - protein, 9 aa, Homo Sapiens
TCTNYSKDI

SEQ ID NO: 189973 - protein, 9 aa, Homo Sapiens
HGYHRFLPT

SEQ ID NO: 189974 - protein, 9 aa, Homo Sapiens
PPSLSGQTK

SEQ ID NO: 189975 - protein, 9 aa, Homo Sapiens
EHFQARKKQ

SEQ ID NO: 189976 - protein, 9 aa, Homo Sapiens
LQRVGLAAC

SEQ ID NO: 189977 - protein, 9 aa, Homo Sapiens
APAPAPPAA

SEQ ID NO: 189978 - protein, 9 aa, Homo Sapiens
MGSYKCMCP

SEQ ID NO: 189979 - protein, 9 aa, Homo Sapiens
TPPYTENVH

SEQ ID NO: 189980 - protein, 9 aa, Homo Sapiens
LSASQLHTG

SEQ ID NO: 189981 - protein, 9 aa, Homo Sapiens
EVQRLWFEV

SEQ ID NO: 189982 - protein, 9 aa, Homo Sapiens
LRLGQQRAL

SEQ ID NO: 189983 - protein, 9 aa, Homo Sapiens
AQGVCSPLL

SEQ ID NO: 189984 - protein, 9 aa, Homo Sapiens
QPGERGLPG

SEQ ID NO: 189985 - protein, 9 aa, Homo Sapiens
RGNSVIVGN

SEQ ID NO: 189986 - protein, 9 aa, Homo Sapiens
RIAYCTTDH

SEQ ID NO: 189987 - protein, 9 aa, Homo Sapiens
TVDRTAGWN

SEQ ID NO: 189988 - protein, 9 aa, Homo Sapiens
RRSMIFSSS

SEQ ID NO: 189989 - protein, 9 aa, Homo Sapiens
DVSPSDHKI

SEQ ID NO: 189990 - protein, 9 aa, Homo Sapiens
HPTRHRHLM

SEQ ID NO: 189991 - protein, 9 aa, Homo Sapiens
CLVTIVDKL

SEQ ID NO: 189992 - protein, 9 aa, Homo Sapiens
AKCRQASEK

SEQ ID NO: 189993 - protein, 9 aa, Homo Sapiens
RPKNATSES

SEQ ID NO: 189994 - protein, 9 aa, Homo Sapiens
ECESRIRGL

SEQ ID NO: 189995 - protein, 9 aa, Homo Sapiens
DKQNIQKIS

SEQ ID NO: 189996 - protein, 9 aa, Homo Sapiens
LQRLENNRP

SEQ ID NO: 189997 - protein, 9 aa, Homo Sapiens
VYFHTDAAH

SEQ ID NO: 189998 - protein, 9 aa, Homo Sapiens
RQCPGHCSL

SEQ ID NO: 189999 - protein, 9 aa, Homo Sapiens
WQTHSGEKP

SEQ ID NO: 190000 - protein, 9 aa, Homo Sapiens
EWQGDRSSQ

SEQ ID NO: 190001 - protein, 9 aa, Homo Sapiens
FSLLREQKR

SEQ ID NO: 190002 - protein, 9 aa, Homo Sapiens
GGLRIEGPM

SEQ ID NO: 190003 - protein, 9 aa, Homo Sapiens
TMQVLPQCE

SEQ ID NO: 190004 - protein, 9 aa, Homo Sapiens
QAPGPLGEC

SEQ ID NO: 190005 - protein, 9 aa, Homo Sapiens
SALQRCLEL

SEQ ID NO: 190006 - protein, 9 aa, Homo Sapiens
LHQHQLQHS

SEQ ID NO: 190007 - protein, 9 aa, Homo Sapiens
GLGPDPPTG

SEQ ID NO: 190008 - protein, 9 aa, Homo Sapiens
ERCLARRSR

SEQ ID NO: 190009 - protein, 9 aa, Homo Sapiens
AHLSLELQM

SEQ ID NO: 190010 - protein, 9 aa, Homo Sapiens
GEPKGSSSL

SEQ ID NO: 190011 - protein, 9 aa, Homo Sapiens
YSTYRLFPP

SEQ ID NO: 190012 - protein, 9 aa, Homo Sapiens
SYSDQKLPY

SEQ ID NO: 190013 - protein, 9 aa, Homo Sapiens
LKDLAARLP

SEQ ID NO: 190014 - protein, 9 aa, Homo Sapiens
ARKTMTPIA

SEQ ID NO: 190015 - protein, 9 aa, Homo Sapiens
IMECQVCSF

SEQ ID NO: 190016 - protein, 9 aa, Homo Sapiens
KNERPARSP

SEQ ID NO: 190017 - protein, 9 aa, Homo Sapiens
ASWDKAVQA

SEQ ID NO: 190018 - protein, 9 aa, Homo Sapiens
MTTKNVHSK

SEQ ID NO: 190019 - protein, 9 aa, Homo Sapiens
KPHSLEAPG

SEQ ID NO: 190020 - protein, 9 aa, Homo Sapiens
KRRTYAAIE

SEQ ID NO: 190021 - protein, 9 aa, Homo Sapiens
ELQGHHTEK

SEQ ID NO: 190022 - protein, 9 aa, Homo Sapiens
TQGQTMVCQ

SEQ ID NO: 190023 - protein, 9 aa, Homo Sapiens
SGLWTQVHQ

SEQ ID NO: 190024 - protein, 9 aa, Homo Sapiens
LVATKDGDV

SEQ ID NO: 190025 - protein, 9 aa, Homo Sapiens
LLAFVEARA

SEQ ID NO: 190026 - protein, 9 aa, Homo Sapiens
ALEYSQAMT

SEQ ID NO: 190027 - protein, 9 aa, Homo Sapiens
EYSQAMTVR

SEQ ID NO: 190028 - protein, 9 aa, Homo Sapiens
EKVYQPVPE

SEQ ID NO: 190029 - protein, 9 aa, Homo Sapiens
SGFTGSMFG

SEQ ID NO: 190030 - protein, 9 aa, Homo Sapiens
SPLESSVPQ

SEQ ID NO: 190031 - protein, 9 aa, Homo Sapiens
DSLLKDKNF

SEQ ID NO: 190032 - protein, 9 aa, Homo Sapiens
CMTSFHRFF

SEQ ID NO: 190033 - protein, 9 aa, Homo Sapiens
TAATTNSSL

SEQ ID NO: 190034 - protein, 9 aa, Homo Sapiens
PGFLKPGEQ

SEQ ID NO: 190035 - protein, 9 aa, Homo Sapiens
AGGPKVGVG

SEQ ID NO: 190036 - protein, 9 aa, Homo Sapiens
HQMVCTDSR

SEQ ID NO: 190037 - protein, 9 aa, Homo Sapiens
SRATVRCLQ

SEQ ID NO: 190038 - protein, 9 aa, Homo Sapiens
IALYRLRLL

SEQ ID NO: 190039 - protein, 9 aa, Homo Sapiens
HIKPDQSNM

SEQ ID NO: 190040 - protein, 9 aa, Homo Sapiens
VCHRTGMQP

SEQ ID NO: 190041 - protein, 9 aa, Homo Sapiens
LGPGESRKS

SEQ ID NO: 190042 - protein, 9 aa, Homo Sapiens
KHAIWVENS

SEQ ID NO: 190043 - protein, 9 aa, Homo Sapiens
PTLLSHFTL

SEQ ID NO: 190044 - protein, 9 aa, Homo Sapiens
SIQENVREA

SEQ ID NO: 190045 - protein, 9 aa, Homo Sapiens
CNSSFCMCK

SEQ ID NO: 190046 - protein, 9 aa, Homo Sapiens
KEPLCARAK

SEQ ID NO: 190047 - protein, 9 aa, Homo Sapiens
PPIGQRTQL

SEQ ID NO: 190048 - protein, 9 aa, Homo Sapiens
EMQPNVKYP

SEQ ID NO: 190049 - protein, 9 aa, Homo Sapiens
ADEVFHREL

SEQ ID NO: 190050 - protein, 9 aa, Homo Sapiens
GRPGQPGER

SEQ ID NO: 190051 - protein, 9 aa, Homo Sapiens
AAFPMNFIT

SEQ ID NO: 190052 - protein, 9 aa, Homo Sapiens
VMVQSPTPF

SEQ ID NO: 190053 - protein, 9 aa, Homo Sapiens
LFLEFHKDS

SEQ ID NO: 190054 - protein, 9 aa, Homo Sapiens
SLVEESKFL

SEQ ID NO: 190055 - protein, 9 aa, Homo Sapiens
PSSELHYKR

SEQ ID NO: 190056 - protein, 9 aa, Homo Sapiens
QLFVVFLVI

SEQ ID NO: 190057 - protein, 9 aa, Homo Sapiens
EYLNPDSWS

SEQ ID NO: 190058 - protein, 9 aa, Homo Sapiens
CRWLRRFQA

SEQ ID NO: 190059 - protein, 9 aa, Homo Sapiens
VGDALWLEC

SEQ ID NO: 190060 - protein, 9 aa, Homo Sapiens
LLSCICHTL

SEQ ID NO: 190061 - protein, 9 aa, Homo Sapiens
RQDCMDAMA

SEQ ID NO: 190062 - protein, 9 aa, Homo Sapiens
CCQTNAQFA

SEQ ID NO: 190063 - protein, 9 aa, Homo Sapiens
ELPCPPPTP

SEQ ID NO: 190064 - protein, 9 aa, Homo Sapiens
QKPKGSQQS

SEQ ID NO: 190065 - protein, 9 aa, Homo Sapiens
YLNPDSWSN

SEQ ID NO: 190066 - protein, 9 aa, Homo Sapiens
IITLSLAGR

SEQ ID NO: 190067 - protein, 9 aa, Homo Sapiens
QHSSVLGLA

SEQ ID NO: 190068 - protein, 9 aa, Homo Sapiens
QGPESCSLG

SEQ ID NO: 190069 - protein, 9 aa, Homo Sapiens
QTAFRQYHM

SEQ ID NO: 190070 - protein, 9 aa, Homo Sapiens
PYKEFLGQG

SEQ ID NO: 190071 - protein, 9 aa, Homo Sapiens
QREKTRWPN

SEQ ID NO: 190072 - protein, 9 aa, Homo Sapiens
DIVTMQVLP

SEQ ID NO: 190073 - protein, 9 aa, Homo Sapiens
VPGTIWNEI

SEQ ID NO: 190074 - protein, 9 aa, Homo Sapiens
SENKKTVPP

SEQ ID NO: 190075 - protein, 9 aa, Homo Sapiens
SSSAGHSTA

SEQ ID NO: 190076 - protein, 9 aa, Homo Sapiens
SRMHRFVLH

SEQ ID NO: 190077 - protein, 9 aa, Homo Sapiens
VILFAFTAR

SEQ ID NO: 190078 - protein, 9 aa, Homo Sapiens
ILRRSGMHT

SEQ ID NO: 190079 - protein, 9 aa, Homo Sapiens
WREIREKYY

SEQ ID NO: 190080 - protein, 9 aa, Homo Sapiens
GNGGTASLV

SEQ ID NO: 190081 - protein, 9 aa, Homo Sapiens
LNHSHNMTT

SEQ ID NO: 190082 - protein, 9 aa, Homo Sapiens
QILAALRER

SEQ ID NO: 190083 - protein, 9 aa, Homo Sapiens
LPPTAKSWL

SEQ ID NO: 190084 - protein, 9 aa, Homo Sapiens
SPPSCARSQ

SEQ ID NO: 190085 - protein, 9 aa, Homo Sapiens
PRSGAILNS

SEQ ID NO: 190086 - protein, 9 aa, Homo Sapiens
VADYIIPAQ

SEQ ID NO: 190087 - protein, 9 aa, Homo Sapiens
RWPNSGRGD

SEQ ID NO: 190088 - protein, 9 aa, Homo Sapiens
VGRAVLSAS

SEQ ID NO: 190089 - protein, 9 aa, Homo Sapiens
HHMHVPAIP

SEQ ID NO: 190090 - protein, 9 aa, Homo Sapiens
MGEDMSADG

SEQ ID NO: 190091 - protein, 9 aa, Homo Sapiens
VDECKIGAH

SEQ ID NO: 190092 - protein, 9 aa, Homo Sapiens
VDGEWPTLP

SEQ ID NO: 190093 - protein, 9 aa, Homo Sapiens
SQLWLHLRQ

SEQ ID NO: 190094 - protein, 9 aa, Homo Sapiens
SYCAPPTRG

SEQ ID NO: 190095 - protein, 9 aa, Homo Sapiens
KTITKNLAL

SEQ ID NO: 190096 - protein, 9 aa, Homo Sapiens
DNISSGCSS

SEQ ID NO: 190097 - protein, 9 aa, Homo Sapiens
NKKNTGFTP

SEQ ID NO: 190098 - protein, 9 aa, Homo Sapiens
KVLEAVCQE

SEQ ID NO: 190099 - protein, 9 aa, Homo Sapiens
KCREIAQTV

SEQ ID NO: 190100 - protein, 9 aa, Homo Sapiens
PPQVGGRTF

SEQ ID NO: 190101 - protein, 9 aa, Homo Sapiens
SLGHTSSSN

SEQ ID NO: 190102 - protein, 9 aa, Homo Sapiens
LLELLRNSD

SEQ ID NO: 190103 - protein, 9 aa, Homo Sapiens
DGQRCSMDA

SEQ ID NO: 190104 - protein, 9 aa, Homo Sapiens
ISSQGSTVR

SEQ ID NO: 190105 - protein, 9 aa, Homo Sapiens
TDGEERQKR

SEQ ID NO: 190106 - protein, 9 aa, Homo Sapiens
SYWIGPVEV

SEQ ID NO: 190107 - protein, 9 aa, Homo Sapiens
RDLIAHSIH

SEQ ID NO: 190108 - protein, 9 aa, Homo Sapiens
MARRLLGVD

SEQ ID NO: 190109 - protein, 9 aa, Homo Sapiens
RQIERKHLI

SEQ ID NO: 190110 - protein, 9 aa, Homo Sapiens
YDVQGIQKP

SEQ ID NO: 190111 - protein, 9 aa, Homo Sapiens
HSPDPHIPC

SEQ ID NO: 190112 - protein, 9 aa, Homo Sapiens
CQGQEHIGS

SEQ ID NO: 190113 - protein, 9 aa, Homo Sapiens
ASVSPSHRA

SEQ ID NO: 190114 - protein, 9 aa, Homo Sapiens
LPSSSISGE

SEQ ID NO: 190115 - protein, 9 aa, Homo Sapiens
PDYVMTGIV

SEQ ID NO: 190116 - protein, 9 aa, Homo Sapiens
VDPPHRHHR

SEQ ID NO: 190117 - protein, 9 aa, Homo Sapiens
TNGYEIKED

SEQ ID NO: 190118 - protein, 9 aa, Homo Sapiens
QLAKQEWGP

SEQ ID NO: 190119 - protein, 9 aa, Homo Sapiens
NACHVAELA

SEQ ID NO: 190120 - protein, 9 aa, Homo Sapiens
AFPTLNTFM

SEQ ID NO: 190121 - protein, 9 aa, Homo Sapiens
APGNHGFPG

SEQ ID NO: 190122 - protein, 9 aa, Homo Sapiens
PTLNTFMNT

SEQ ID NO: 190123 - protein, 9 aa, Homo Sapiens
QRGLMDWSF

SEQ ID NO: 190124 - protein, 9 aa, Homo Sapiens
RPPLRAPWN

SEQ ID NO: 190125 - protein, 9 aa, Homo Sapiens
KVHAFVRMI

SEQ ID NO: 190126 - protein, 9 aa, Homo Sapiens
AHQLVAAQP

SEQ ID NO: 190127 - protein, 9 aa, Homo Sapiens
EGLGPDPPT

SEQ ID NO: 190128 - protein, 9 aa, Homo Sapiens
IGGNNSCTM

SEQ ID NO: 190129 - protein, 9 aa, Homo Sapiens
PQAIVLYHE

SEQ ID NO: 190130 - protein, 9 aa, Homo Sapiens
LQQKVELLP

SEQ ID NO: 190131 - protein, 9 aa, Homo Sapiens
HYHLLHRYC

SEQ ID NO: 190132 - protein, 9 aa, Homo Sapiens
PVLQAPAAP

SEQ ID NO: 190133 - protein, 9 aa, Homo Sapiens
PLAVQLFAK

SEQ ID NO: 190134 - protein, 9 aa, Homo Sapiens
FISDDGPPS

SEQ ID NO: 190135 - protein, 9 aa, Homo Sapiens
SGAAYVGAY

SEQ ID NO: 190136 - protein, 9 aa, Homo Sapiens
KSWLPLHPL

SEQ ID NO: 190137 - protein, 9 aa, Homo Sapiens
LQLLEDGDP

SEQ ID NO: 190138 - protein, 9 aa, Homo Sapiens
LVARGLVGK

SEQ ID NO: 190139 - protein, 9 aa, Homo Sapiens
GLVKVAQTA

SEQ ID NO: 190140 - protein, 9 aa, Homo Sapiens
QPVYETVQH

SEQ ID NO: 190141 - protein, 9 aa, Homo Sapiens
PPDECFGLL

SEQ ID NO: 190142 - protein, 9 aa, Homo Sapiens
ELLPAEPLP

SEQ ID NO: 190143 - protein, 9 aa, Homo Sapiens
HTRDTESQV

SEQ ID NO: 190144 - protein, 9 aa, Homo Sapiens
RTWSQKRAL

SEQ ID NO: 190145 - protein, 9 aa, Homo Sapiens
PPLPPPQGG

SEQ ID NO: 190146 - protein, 9 aa, Homo Sapiens
TFYQIGDSC

SEQ ID NO: 190147 - protein, 9 aa, Homo Sapiens
CCNTSSGSE

SEQ ID NO: 190148 - protein, 9 aa, Homo Sapiens
PRALASSPP

SEQ ID NO: 190149 - protein, 9 aa, Homo Sapiens
RHWYPEEYE

SEQ ID NO: 190150 - protein, 9 aa, Homo Sapiens
EQDEALLIQ

SEQ ID NO: 190151 - protein, 9 aa, Homo Sapiens
GLGATTIYP

SEQ ID NO: 190152 - protein, 9 aa, Homo Sapiens
SQRPSSSQP

SEQ ID NO: 190153 - protein, 9 aa, Homo Sapiens
IQENVREAL

SEQ ID NO: 190154 - protein, 9 aa, Homo Sapiens
YTVHECCVS

SEQ ID NO: 190155 - protein, 9 aa, Homo Sapiens
VRDSNRQAH

SEQ ID NO: 190156 - protein, 9 aa, Homo Sapiens
ILATQGQLS

SEQ ID NO: 190157 - protein, 9 aa, Homo Sapiens
RKGVQCQCW

SEQ ID NO: 190158 - protein, 9 aa, Homo Sapiens
EDVLAMSLH

SEQ ID NO: 190159 - protein, 9 aa, Homo Sapiens
TVRIINCKV

SEQ ID NO: 190160 - protein, 9 aa, Homo Sapiens
GPVSDTEIE

SEQ ID NO: 190161 - protein, 9 aa, Homo Sapiens
LDSDVYMEP

SEQ ID NO: 190162 - protein, 9 aa, Homo Sapiens
NTAPTRTAL

SEQ ID NO: 190163 - protein, 9 aa, Homo Sapiens
VYLQRSNME

SEQ ID NO: 190164 - protein, 9 aa, Homo Sapiens
EVSLCTPPT

SEQ ID NO: 190165 - protein, 9 aa, Homo Sapiens
RREGERREQ

SEQ ID NO: 190166 - protein, 9 aa, Homo Sapiens
VSVSDADCD

SEQ ID NO: 190167 - protein, 9 aa, Homo Sapiens
GPEGLLIIN

SEQ ID NO: 190168 - protein, 9 aa, Homo Sapiens
DVLKQSLVV

SEQ ID NO: 190169 - protein, 9 aa, Homo Sapiens
QRSNGEQFP

SEQ ID NO: 190170 - protein, 9 aa, Homo Sapiens
SFTMDDMSR

SEQ ID NO: 190171 - protein, 9 aa, Homo Sapiens
TGIVTGVLV

SEQ ID NO: 190172 - protein, 9 aa, Homo Sapiens
REDPPTDPG

SEQ ID NO: 190173 - protein, 9 aa, Homo Sapiens
GFLKPGEQR

SEQ ID NO: 190174 - protein, 9 aa, Homo Sapiens
NVDHFSCTH

SEQ ID NO: 190175 - protein, 9 aa, Homo Sapiens
IKVASEQYI

SEQ ID NO: 190176 - protein, 9 aa, Homo Sapiens
TARRVHELE

SEQ ID NO: 190177 - protein, 9 aa, Homo Sapiens
APPRAREDA

SEQ ID NO: 190178 - protein, 9 aa, Homo Sapiens
ITVYQISPE

SEQ ID NO: 190179 - protein, 9 aa, Homo Sapiens
DYGGGYGGY

SEQ ID NO: 190180 - protein, 9 aa, Homo Sapiens
WQNLDSPQA

SEQ ID NO: 190181 - protein, 9 aa, Homo Sapiens
EACEEMILK

SEQ ID NO: 190182 - protein, 9 aa, Homo Sapiens
QYRISPTVC

SEQ ID NO: 190183 - protein, 9 aa, Homo Sapiens
IFKLPCQRV

SEQ ID NO: 190184 - protein, 9 aa, Homo Sapiens
GGARRSYCA

SEQ ID NO: 190185 - protein, 9 aa, Homo Sapiens
GTPYKGPSF

SEQ ID NO: 190186 - protein, 9 aa, Homo Sapiens
TIVWRPDIV

SEQ ID NO: 190187 - protein, 9 aa, Homo Sapiens
WDRNLERSA

SEQ ID NO: 190188 - protein, 9 aa, Homo Sapiens
AGSGNWAYR

SEQ ID NO: 190189 - protein, 9 aa, Homo Sapiens
HCPANGAGW

SEQ ID NO: 190190 - protein, 9 aa, Homo Sapiens
RSYLAVHWQ

SEQ ID NO: 190191 - protein, 9 aa, Homo Sapiens
FSWHSNLTR

SEQ ID NO: 190192 - protein, 9 aa, Homo Sapiens
HHVCLGFVH

SEQ ID NO: 190193 - protein, 9 aa, Homo Sapiens
RGSGHVLVT

SEQ ID NO: 190194 - protein, 9 aa, Homo Sapiens
LSRNEMQVD

SEQ ID NO: 190195 - protein, 9 aa, Homo Sapiens
VLLVRGLML

SEQ ID NO: 190196 - protein, 9 aa, Homo Sapiens
SNEMLLVAA

SEQ ID NO: 190197 - protein, 9 aa, Homo Sapiens
CRVRFDNVI

SEQ ID NO: 190198 - protein, 9 aa, Homo Sapiens
DEDEAVPDS

SEQ ID NO: 190199 - protein, 9 aa, Homo Sapiens
SPEGSTTSG

SEQ ID NO: 190200 - protein, 9 aa, Homo Sapiens
GEKAGHPRP

SEQ ID NO: 190201 - protein, 9 aa, Homo Sapiens
SGRPGQPGE

SEQ ID NO: 190202 - protein, 9 aa, Homo Sapiens
LVVLPDSLQ

SEQ ID NO: 190203 - protein, 9 aa, Homo Sapiens
IQHPYALTL

SEQ ID NO: 190204 - protein, 9 aa, Homo Sapiens
QTLLFSHHT

SEQ ID NO: 190205 - protein, 9 aa, Homo Sapiens
ACCLVRFLF

SEQ ID NO: 190206 - protein, 9 aa, Homo Sapiens
ENTKNSVDK

SEQ ID NO: 190207 - protein, 9 aa, Homo Sapiens
VIGGNNSCT

SEQ ID NO: 190208 - protein, 9 aa, Homo Sapiens
TEDRDHMTS

SEQ ID NO: 190209 - protein, 9 aa, Homo Sapiens
ARMSNMGHK

SEQ ID NO: 190210 - protein, 9 aa, Homo Sapiens
NDGGELPDP

SEQ ID NO: 190211 - protein, 9 aa, Homo Sapiens
SDYCDISEG

SEQ ID NO: 190212 - protein, 9 aa, Homo Sapiens
QQSALKVLQ

SEQ ID NO: 190213 - protein, 9 aa, Homo Sapiens
KSSPSTENK

SEQ ID NO: 190214 - protein, 9 aa, Homo Sapiens
CIEGHTGTS

SEQ ID NO: 190215 - protein, 9 aa, Homo Sapiens
MTLDQWLEQ

SEQ ID NO: 190216 - protein, 9 aa, Homo Sapiens
YLQRAAEKS

SEQ ID NO: 190217 - protein, 9 aa, Homo Sapiens
LEDRVKQNI

SEQ ID NO: 190218 - protein, 9 aa, Homo Sapiens
LDDQHLLLP

SEQ ID NO: 190219 - protein, 9 aa, Homo Sapiens
GAPTSTAAL

SEQ ID NO: 190220 - protein, 9 aa, Homo Sapiens
YLVVAGLGS

SEQ ID NO: 190221 - protein, 9 aa, Homo Sapiens
EESRGQTSS

SEQ ID NO: 190222 - protein, 9 aa, Homo Sapiens
FREECGVHV

SEQ ID NO: 190223 - protein, 9 aa, Homo Sapiens
REMRETNRL

SEQ ID NO: 190224 - protein, 9 aa, Homo Sapiens
GAAEGKVVY

SEQ ID NO: 190225 - protein, 9 aa, Homo Sapiens
EDPATPQVS

SEQ ID NO: 190226 - protein, 9 aa, Homo Sapiens
LSISGPDFM

SEQ ID NO: 190227 - protein, 9 aa, Homo Sapiens
AHVLGYLVV

SEQ ID NO: 190228 - protein, 9 aa, Homo Sapiens
VTRMTVSFV

SEQ ID NO: 190229 - protein, 9 aa, Homo Sapiens
ARKCLTLAN

SEQ ID NO: 190230 - protein, 9 aa, Homo Sapiens
ARPRAKEPL

SEQ ID NO: 190231 - protein, 9 aa, Homo Sapiens
QNGVGPGHI

SEQ ID NO: 190232 - protein, 9 aa, Homo Sapiens
CIFKNTLVI

SEQ ID NO: 190233 - protein, 9 aa, Homo Sapiens
PGCVHSICN

SEQ ID NO: 190234 - protein, 9 aa, Homo Sapiens
EKQDYVFAC

SEQ ID NO: 190235 - protein, 9 aa, Homo Sapiens
GKHEVSPLQ

SEQ ID NO: 190236 - protein, 9 aa, Homo Sapiens
VYIATVVGN

SEQ ID NO: 190237 - protein, 9 aa, Homo Sapiens
GVQCQCWSA

SEQ ID NO: 190238 - protein, 9 aa, Homo Sapiens
RPGPSDIAT

SEQ ID NO: 190239 - protein, 9 aa, Homo Sapiens
EEEGIYPDP

SEQ ID NO: 190240 - protein, 9 aa, Homo Sapiens
ESGEAVRHP

SEQ ID NO: 190241 - protein, 9 aa, Homo Sapiens
YAKAVLWEP

SEQ ID NO: 190242 - protein, 9 aa, Homo Sapiens
DECKIGAHN

SEQ ID NO: 190243 - protein, 9 aa, Homo Sapiens
LKLSSPAII

SEQ ID NO: 190244 - protein, 9 aa, Homo Sapiens
PAWVTGNVT

SEQ ID NO: 190245 - protein, 9 aa, Homo Sapiens
LICFSTSTP

SEQ ID NO: 190246 - protein, 9 aa, Homo Sapiens
CRGIGRCLH

SEQ ID NO: 190247 - protein, 9 aa, Homo Sapiens
YKNAKVRPP

SEQ ID NO: 190248 - protein, 9 aa, Homo Sapiens
LGPVVEKRV

SEQ ID NO: 190249 - protein, 9 aa, Homo Sapiens
HRALPPTAK

SEQ ID NO: 190250 - protein, 9 aa, Homo Sapiens
LGWTDFLMN

SEQ ID NO: 190251 - protein, 9 aa, Homo Sapiens
CSTGRMERC

SEQ ID NO: 190252 - protein, 9 aa, Homo Sapiens
KQASEKQVV

SEQ ID NO: 190253 - protein, 9 aa, Homo Sapiens
PGPYSHHLQ

SEQ ID NO: 190254 - protein, 9 aa, Homo Sapiens
GKSPVFLFL

SEQ ID NO: 190255 - protein, 9 aa, Homo Sapiens
CVHTASGPH

SEQ ID NO: 190256 - protein, 9 aa, Homo Sapiens
DPDEVACRW

SEQ ID NO: 190257 - protein, 9 aa, Homo Sapiens
DQQAGWRLS

SEQ ID NO: 190258 - protein, 9 aa, Homo Sapiens
RPQIPTNLR

SEQ ID NO: 190259 - protein, 9 aa, Homo Sapiens
HRGLYHFCL

SEQ ID NO: 190260 - protein, 9 aa, Homo Sapiens
PKDVNAAIV

SEQ ID NO: 190261 - protein, 9 aa, Homo Sapiens
SEDSCMPPF

SEQ ID NO: 190262 - protein, 9 aa, Homo Sapiens
DPATPQVSP

SEQ ID NO: 190263 - protein, 9 aa, Homo Sapiens
CQLMHKLLV

SEQ ID NO: 190264 - protein, 9 aa, Homo Sapiens
VLNLSISGP

SEQ ID NO: 190265 - protein, 9 aa, Homo Sapiens
SPTQEGQRM

SEQ ID NO: 190266 - protein, 9 aa, Homo Sapiens
PSKYDVQGI

SEQ ID NO: 190267 - protein, 9 aa, Homo Sapiens
APWNQAAGA

SEQ ID NO: 190268 - protein, 9 aa, Homo Sapiens
YCCPHCPFA

SEQ ID NO: 190269 - protein, 9 aa, Homo Sapiens
DRDHMTSVI

SEQ ID NO: 190270 - protein, 9 aa, Homo Sapiens
VTLVKDFHM

SEQ ID NO: 190271 - protein, 9 aa, Homo Sapiens
AFCVWEQAT

SEQ ID NO: 190272 - protein, 9 aa, Homo Sapiens
QIIAGKAME

SEQ ID NO: 190273 - protein, 9 aa, Homo Sapiens
LARGVLVGM

SEQ ID NO: 190274 - protein, 9 aa, Homo Sapiens
PPYTENVHW

SEQ ID NO: 190275 - protein, 9 aa, Homo Sapiens
FQDTELLQI

SEQ ID NO: 190276 - protein, 9 aa, Homo Sapiens
WLFGGSSDL

SEQ ID NO: 190277 - protein, 9 aa, Homo Sapiens
PQILEALSL

SEQ ID NO: 190278 - protein, 9 aa, Homo Sapiens
PPGGGGREP

SEQ ID NO: 190279 - protein, 9 aa, Homo Sapiens
AYMHVLEGL

SEQ ID NO: 190280 - protein, 9 aa, Homo Sapiens
HCQERLCPE

SEQ ID NO: 190281 - protein, 9 aa, Homo Sapiens
AMGPHCAEK

SEQ ID NO: 190282 - protein, 9 aa, Homo Sapiens
AEARSQQAH

SEQ ID NO: 190283 - protein, 9 aa, Homo Sapiens
CYGPYISDC

SEQ ID NO: 190284 - protein, 9 aa, Homo Sapiens
TINIHHTSS

SEQ ID NO: 190285 - protein, 9 aa, Homo Sapiens
VWLILAVIS

SEQ ID NO: 190286 - protein, 9 aa, Homo Sapiens
SLVLGILVG

SEQ ID NO: 190287 - protein, 9 aa, Homo Sapiens
SIDRTMMYY

SEQ ID NO: 190288 - protein, 9 aa, Homo Sapiens
FCQGGHFRY

SEQ ID NO: 190289 - protein, 9 aa, Homo Sapiens
LRYCENKLN

SEQ ID NO: 190290 - protein, 9 aa, Homo Sapiens
YTGTREAHD

SEQ ID NO: 190291 - protein, 9 aa, Homo Sapiens
PMYFFLANI

SEQ ID NO: 190292 - protein, 9 aa, Homo Sapiens
DCNMTFVTS

SEQ ID NO: 190293 - protein, 9 aa, Homo Sapiens
YYDPNTESC

SEQ ID NO: 190294 - protein, 9 aa, Homo Sapiens
GLQTKTDIK

SEQ ID NO: 190295 - protein, 9 aa, Homo Sapiens
RPRAKEPLC

SEQ ID NO: 190296 - protein, 9 aa, Homo Sapiens
KPENEKQQR

SEQ ID NO: 190297 - protein, 9 aa, Homo Sapiens
YCENKLNDK

SEQ ID NO: 190298 - protein, 9 aa, Homo Sapiens
ARAGLRARF

SEQ ID NO: 190299 - protein, 9 aa, Homo Sapiens
PSGTPPSPV

SEQ ID NO: 190300 - protein, 9 aa, Homo Sapiens
AESTAGSDP

SEQ ID NO: 190301 - protein, 9 aa, Homo Sapiens
SAAEQHEKI

SEQ ID NO: 190302 - protein, 9 aa, Homo Sapiens
KHLAFERQV

SEQ ID NO: 190303 - protein, 9 aa, Homo Sapiens
IRQEILQEF

SEQ ID NO: 190304 - protein, 9 aa, Homo Sapiens
MVFKGGRME

SEQ ID NO: 190305 - protein, 9 aa, Homo Sapiens
NQPPSSELH

SEQ ID NO: 190306 - protein, 9 aa, Homo Sapiens
TDLLSCICH

SEQ ID NO: 190307 - protein, 9 aa, Homo Sapiens
FLRKQESGL

SEQ ID NO: 190308 - protein, 9 aa, Homo Sapiens
AFDFRVGTT

SEQ ID NO: 190309 - protein, 9 aa, Homo Sapiens
MIDTGDALI

SEQ ID NO: 190310 - protein, 9 aa, Homo Sapiens
DLAARLPAG

SEQ ID NO: 190311 - protein, 9 aa, Homo Sapiens
MRTALLTHC

SEQ ID NO: 190312 - protein, 9 aa, Homo Sapiens
WIDGRKLVR

SEQ ID NO: 190313 - protein, 9 aa, Homo Sapiens
SLGACIIEK

SEQ ID NO: 190314 - protein, 9 aa, Homo Sapiens
PTAKANECL

SEQ ID NO: 190315 - protein, 9 aa, Homo Sapiens
LLSSEDLVK

SEQ ID NO: 190316 - protein, 9 aa, Homo Sapiens
TTPDPTMDP

SEQ ID NO: 190317 - protein, 9 aa, Homo Sapiens
ANIFQDTEL

SEQ ID NO: 190318 - protein, 9 aa, Homo Sapiens
TFYIWDGNN

SEQ ID NO: 190319 - protein, 9 aa, Homo Sapiens
FHTDAAHAV

SEQ ID NO: 190320 - protein, 9 aa, Homo Sapiens
TEGNNIHSF

SEQ ID NO: 190321 - protein, 9 aa, Homo Sapiens
LINKEHESS

SEQ ID NO: 190322 - protein, 9 aa, Homo Sapiens
KQESGLGFR

SEQ ID NO: 190323 - protein, 9 aa, Homo Sapiens
PGASLAAAC

SEQ ID NO: 190324 - protein, 9 aa, Homo Sapiens
TNAQFAEIS

SEQ ID NO: 190325 - protein, 9 aa, Homo Sapiens
DMAQYEREQ

SEQ ID NO: 190326 - protein, 9 aa, Homo Sapiens
EDASWGPHC

SEQ ID NO: 190327 - protein, 9 aa, Homo Sapiens
CPPEIGDFA

SEQ ID NO: 190328 - protein, 9 aa, Homo Sapiens
KDKGENAEV

SEQ ID NO: 190329 - protein, 9 aa, Homo Sapiens
KHCHQQFKY

SEQ ID NO: 190330 - protein, 9 aa, Homo Sapiens
EGRPQIPTN

SEQ ID NO: 190331 - protein, 9 aa, Homo Sapiens
GMQTANLRC

SEQ ID NO: 190332 - protein, 9 aa, Homo Sapiens
IMDTKITWP

SEQ ID NO: 190333 - protein, 9 aa, Homo Sapiens
VLEKNAVRI

SEQ ID NO: 190334 - protein, 9 aa, Homo Sapiens
EREWQLREE

SEQ ID NO: 190335 - protein, 9 aa, Homo Sapiens
QRGRYGDAI

SEQ ID NO: 190336 - protein, 9 aa, Homo Sapiens
GECVLYKSV

SEQ ID NO: 190337 - protein, 9 aa, Homo Sapiens
VISELQEKL

SEQ ID NO: 190338 - protein, 9 aa, Homo Sapiens
RSSTPTILG

SEQ ID NO: 190339 - protein, 9 aa, Homo Sapiens
LYAIGGHNA

SEQ ID NO: 190340 - protein, 9 aa, Homo Sapiens
RREYQRQDC

SEQ ID NO: 190341 - protein, 9 aa, Homo Sapiens
AHIGDPSVH

SEQ ID NO: 190342 - protein, 9 aa, Homo Sapiens
SIHSKPSQD

SEQ ID NO: 190343 - protein, 9 aa, Homo Sapiens
YTAVFMPYS

SEQ ID NO: 190344 - protein, 9 aa, Homo Sapiens
TFSVHMTLD

SEQ ID NO: 190345 - protein, 9 aa, Homo Sapiens
YFHTDAAHA

SEQ ID NO: 190346 - protein, 9 aa, Homo Sapiens
VISIPSFFY

SEQ ID NO: 190347 - protein, 9 aa, Homo Sapiens
LSHFTLTSP

SEQ ID NO: 190348 - protein, 9 aa, Homo Sapiens
DFVSRYCEH

SEQ ID NO: 190349 - protein, 9 aa, Homo Sapiens
TRHRHLMKT

SEQ ID NO: 190350 - protein, 9 aa, Homo Sapiens
PHSLEAPGK

SEQ ID NO: 190351 - protein, 9 aa, Homo Sapiens
EREVLFTTD

SEQ ID NO: 190352 - protein, 9 aa, Homo Sapiens
HLRHGEDST

SEQ ID NO: 190353 - protein, 9 aa, Homo Sapiens
KKKIYKKKQ

SEQ ID NO: 190354 - protein, 9 aa, Homo Sapiens
SQELLSVWQ

SEQ ID NO: 190355 - protein, 9 aa, Homo Sapiens
SWSNAATLY

SEQ ID NO: 190356 - protein, 9 aa, Homo Sapiens
CTVPLPPHL

SEQ ID NO: 190357 - protein, 9 aa, Homo Sapiens
YCCKFDIDI

SEQ ID NO: 190358 - protein, 9 aa, Homo Sapiens
AEALANPIT

SEQ ID NO: 190359 - protein, 9 aa, Homo Sapiens
YMVPMETSN

SEQ ID NO: 190360 - protein, 9 aa, Homo Sapiens
YGVCENLQK

SEQ ID NO: 190361 - protein, 9 aa, Homo Sapiens
SLLRSGFYD

SEQ ID NO: 190362 - protein, 9 aa, Homo Sapiens
NLCGVSKPT

SEQ ID NO: 190363 - protein, 9 aa, Homo Sapiens
YSYLSDFEM

SEQ ID NO: 190364 - protein, 9 aa, Homo Sapiens
YGPYISDCC

SEQ ID NO: 190365 - protein, 9 aa, Homo Sapiens
CSWTVIFVD

SEQ ID NO: 190366 - protein, 9 aa, Homo Sapiens
RRIKRLEYA

SEQ ID NO: 190367 - protein, 9 aa, Homo Sapiens
TGELIYQVQ

SEQ ID NO: 190368 - protein, 9 aa, Homo Sapiens
PTLISLFDD

SEQ ID NO: 190369 - protein, 9 aa, Homo Sapiens
SLLSMLAHH

SEQ ID NO: 190370 - protein, 9 aa, Homo Sapiens
VTIKTKRTI

SEQ ID NO: 190371 - protein, 9 aa, Homo Sapiens
KHNQVGETS

SEQ ID NO: 190372 - protein, 9 aa, Homo Sapiens
ISCRLSQYP

SEQ ID NO: 190373 - protein, 9 aa, Homo Sapiens
GDSCTDDAV

SEQ ID NO: 190374 - protein, 9 aa, Homo Sapiens
LVLSSPEDI

SEQ ID NO: 190375 - protein, 9 aa, Homo Sapiens
HDIQHYDLE

SEQ ID NO: 190376 - protein, 9 aa, Homo Sapiens
DIYSTYRLF

SEQ ID NO: 190377 - protein, 9 aa, Homo Sapiens
LYIGIEDSG

SEQ ID NO: 190378 - protein, 9 aa, Homo Sapiens
WRTVPILFA

SEQ ID NO: 190379 - protein, 9 aa, Homo Sapiens
QGSWELLLA

SEQ ID NO: 190380 - protein, 9 aa, Homo Sapiens
GITSRETYN

SEQ ID NO: 190381 - protein, 9 aa, Homo Sapiens
RNDVAKQCA

SEQ ID NO: 190382 - protein, 9 aa, Homo Sapiens
SSGQSNCYR

SEQ ID NO: 190383 - protein, 9 aa, Homo Sapiens
VNIERRWEA

SEQ ID NO: 190384 - protein, 9 aa, Homo Sapiens
QKKKNKEEE

SEQ ID NO: 190385 - protein, 9 aa, Homo Sapiens
TIILACYFY

SEQ ID NO: 190386 - protein, 9 aa, Homo Sapiens
AGTSGLGQN

SEQ ID NO: 190387 - protein, 9 aa, Homo Sapiens
IYQWQRRGS

SEQ ID NO: 190388 - protein, 9 aa, Homo Sapiens
QESGLGFRV

SEQ ID NO: 190389 - protein, 9 aa, Homo Sapiens
PYCRIEPEI

SEQ ID NO: 190390 - protein, 9 aa, Homo Sapiens
VCDVNTGPM

SEQ ID NO: 190391 - protein, 9 aa, Homo Sapiens
SSSLPRGPL

SEQ ID NO: 190392 - protein, 9 aa, Homo Sapiens
PKCLDELPN

SEQ ID NO: 190393 - protein, 9 aa, Homo Sapiens
INECKDPLN

SEQ ID NO: 190394 - protein, 9 aa, Homo Sapiens
EGRYGVQER

SEQ ID NO: 190395 - protein, 9 aa, Homo Sapiens
IPTSLMALS

SEQ ID NO: 190396 - protein, 9 aa, Homo Sapiens
KREHEFHLQ

SEQ ID NO: 190397 - protein, 9 aa, Homo Sapiens
GFVPRNSQK

SEQ ID NO: 190398 - protein, 9 aa, Homo Sapiens
QIGDSCEKY

SEQ ID NO: 190399 - protein, 9 aa, Homo Sapiens
NPSRPGPPS

SEQ ID NO: 190400 - protein, 9 aa, Homo Sapiens
SPENLCLIN

SEQ ID NO: 190401 - protein, 9 aa, Homo Sapiens
LCILANIVD

SEQ ID NO: 190402 - protein, 9 aa, Homo Sapiens
KRLEYALKQ

SEQ ID NO: 190403 - protein, 9 aa, Homo Sapiens
SGSSNSESS

SEQ ID NO: 190404 - protein, 9 aa, Homo Sapiens
LPGKLPTLI

SEQ ID NO: 190405 - protein, 9 aa, Homo Sapiens
CINPFLYCF

SEQ ID NO: 190406 - protein, 9 aa, Homo Sapiens
HKCIFCSES

SEQ ID NO: 190407 - protein, 9 aa, Homo Sapiens
MTGLLLCEP

SEQ ID NO: 190408 - protein, 9 aa, Homo Sapiens
KPDYVMTGI

SEQ ID NO: 190409 - protein, 9 aa, Homo Sapiens
PHPGCVHSI

SEQ ID NO: 190410 - protein, 9 aa, Homo Sapiens
ADEIDFEDF

SEQ ID NO: 190411 - protein, 9 aa, Homo Sapiens
LWTQVHQSM

SEQ ID NO: 190412 - protein, 9 aa, Homo Sapiens
NVTVKRRMR

SEQ ID NO: 190413 - protein, 9 aa, Homo Sapiens
QVSCCQQTA

SEQ ID NO: 190414 - protein, 9 aa, Homo Sapiens
MECQVCSFH

SEQ ID NO: 190415 - protein, 9 aa, Homo Sapiens
INEDTGTAH

SEQ ID NO: 190416 - protein, 9 aa, Homo Sapiens
VQSDHCINI

SEQ ID NO: 190417 - protein, 9 aa, Homo Sapiens
EIVLESDYR

SEQ ID NO: 190418 - protein, 9 aa, Homo Sapiens
VGSRRRFSD

SEQ ID NO: 190419 - protein, 9 aa, Homo Sapiens
PPKKTCTNY

SEQ ID NO: 190420 - protein, 9 aa, Homo Sapiens
NGPCEVMVQ

SEQ ID NO: 190421 - protein, 9 aa, Homo Sapiens
ELQMDSHMK

SEQ ID NO: 190422 - protein, 9 aa, Homo Sapiens
FEEHEEGSV

SEQ ID NO: 190423 - protein, 9 aa, Homo Sapiens
GREPQCWAE

SEQ ID NO: 190424 - protein, 9 aa, Homo Sapiens
TSSGSKSQS

SEQ ID NO: 190425 - protein, 9 aa, Homo Sapiens
SQPRRWSPT

SEQ ID NO: 190426 - protein, 9 aa, Homo Sapiens
NMFQKLVDL

SEQ ID NO: 190427 - protein, 9 aa, Homo Sapiens
KGENAEVIY

SEQ ID NO: 190428 - protein, 9 aa, Homo Sapiens
TDARGGQSR

SEQ ID NO: 190429 - protein, 9 aa, Homo Sapiens
CSKYEALQT

SEQ ID NO: 190430 - protein, 9 aa, Homo Sapiens
QHGSTSVQA

SEQ ID NO: 190431 - protein, 9 aa, Homo Sapiens
RLVQVYYQQ

SEQ ID NO: 190432 - protein, 9 aa, Homo Sapiens
IVLQMLKDL

SEQ ID NO: 190433 - protein, 9 aa, Homo Sapiens
RVVLLCDGK

SEQ ID NO: 190434 - protein, 9 aa, Homo Sapiens
KTPKVHLKY

SEQ ID NO: 190435 - protein, 9 aa, Homo Sapiens
TVVGEELVD

SEQ ID NO: 190436 - protein, 9 aa, Homo Sapiens
KVAQTAGAW

SEQ ID NO: 190437 - protein, 9 aa, Homo Sapiens
GGGSPSRSA

SEQ ID NO: 190438 - protein, 9 aa, Homo Sapiens
NQRDGLGNM

SEQ ID NO: 190439 - protein, 9 aa, Homo Sapiens
FTSILNFYC

SEQ ID NO: 190440 - protein, 9 aa, Homo Sapiens
CQCWSAETP

SEQ ID NO: 190441 - protein, 9 aa, Homo Sapiens
VNTRYLFLG

SEQ ID NO: 190442 - protein, 9 aa, Homo Sapiens
RRHTGEMSY

SEQ ID NO: 190443 - protein, 9 aa, Homo Sapiens
GLQEYHSHA

SEQ ID NO: 190444 - protein, 9 aa, Homo Sapiens
KEESNAMRN

SEQ ID NO: 190445 - protein, 9 aa, Homo Sapiens
HTLTGYQSL

SEQ ID NO: 190446 - protein, 9 aa, Homo Sapiens
IIKGTTLNN

SEQ ID NO: 190447 - protein, 9 aa, Homo Sapiens
QGYTHFCQG

SEQ ID NO: 190448 - protein, 9 aa, Homo Sapiens
TESCARFWY

SEQ ID NO: 190449 - protein, 9 aa, Homo Sapiens
KTQVVQNAA

SEQ ID NO: 190450 - protein, 9 aa, Homo Sapiens
GSRRSRHQG

SEQ ID NO: 190451 - protein, 9 aa, Homo Sapiens
MSQVYSYQD

SEQ ID NO: 190452 - protein, 9 aa, Homo Sapiens
EACRTWSQK

SEQ ID NO: 190453 - protein, 9 aa, Homo Sapiens
SHSSKDANK

SEQ ID NO: 190454 - protein, 9 aa, Homo Sapiens
RERIHTGEK

SEQ ID NO: 190455 - protein, 9 aa, Homo Sapiens
DTLCQGQEH

SEQ ID NO: 190456 - protein, 9 aa, Homo Sapiens
HLQYYTAEK

SEQ ID NO: 190457 - protein, 9 aa, Homo Sapiens
AIQGSLWPA

SEQ ID NO: 190458 - protein, 9 aa, Homo Sapiens
LCYEERITE

SEQ ID NO: 190459 - protein, 9 aa, Homo Sapiens
IGERPYECN

SEQ ID NO: 190460 - protein, 9 aa, Homo Sapiens
NIHHTSSVE

SEQ ID NO: 190461 - protein, 9 aa, Homo Sapiens
AKSCIYREL

SEQ ID NO: 190462 - protein, 9 aa, Homo Sapiens
RVITVYQIS

SEQ ID NO: 190463 - protein, 9 aa, Homo Sapiens
LSKRIMQLS

SEQ ID NO: 190464 - protein, 9 aa, Homo Sapiens
YSVFEEHEE

SEQ ID NO: 190465 - protein, 9 aa, Homo Sapiens
EARAPPFPQ

SEQ ID NO: 190466 - protein, 9 aa, Homo Sapiens
LPELLPTST

SEQ ID NO: 190467 - protein, 9 aa, Homo Sapiens
YQNIFMAMQ

SEQ ID NO: 190468 - protein, 9 aa, Homo Sapiens
TIPSPYKDG

SEQ ID NO: 190469 - protein, 9 aa, Homo Sapiens
LVEPVSAVP

SEQ ID NO: 190470 - protein, 9 aa, Homo Sapiens
SEENSTGEL

SEQ ID NO: 190471 - protein, 9 aa, Homo Sapiens
LQGTTEPDA

SEQ ID NO: 190472 - protein, 9 aa, Homo Sapiens
HRTGMQPHE

SEQ ID NO: 190473 - protein, 9 aa, Homo Sapiens
RKVLRKGKC

SEQ ID NO: 190474 - protein, 9 aa, Homo Sapiens
SCLVDSLTD

SEQ ID NO: 190475 - protein, 9 aa, Homo Sapiens
DIGMKGDRG

SEQ ID NO: 190476 - protein, 9 aa, Homo Sapiens
PRPHTIPAP

SEQ ID NO: 190477 - protein, 9 aa, Homo Sapiens
SSLHKHQQV

SEQ ID NO: 190478 - protein, 9 aa, Homo Sapiens
QSDSDGQRC

SEQ ID NO: 190479 - protein, 9 aa, Homo Sapiens
LLVVEAVRG

SEQ ID NO: 190480 - protein, 9 aa, Homo Sapiens
FIDRDPTAF

SEQ ID NO: 190481 - protein, 9 aa, Homo Sapiens
SGSLRCSSM

SEQ ID NO: 190482 - protein, 9 aa, Homo Sapiens
EYLKIPDEQ

SEQ ID NO: 190483 - protein, 9 aa, Homo Sapiens
DEWPRWPGH

SEQ ID NO: 190484 - protein, 9 aa, Homo Sapiens
PKATLQKDV

SEQ ID NO: 190485 - protein, 9 aa, Homo Sapiens
PPQSPQGGT

SEQ ID NO: 190486 - protein, 9 aa, Homo Sapiens
VNSWWSLGM

SEQ ID NO: 190487 - protein, 9 aa, Homo Sapiens
QIMPGAGKP

SEQ ID NO: 190488 - protein, 9 aa, Homo Sapiens
HMASIISSF

SEQ ID NO: 190489 - protein, 9 aa, Homo Sapiens
SSMSLRDPV

SEQ ID NO: 190490 - protein, 9 aa, Homo Sapiens
QMYLCYYQP

SEQ ID NO: 190491 - protein, 9 aa, Homo Sapiens
LTPTPPPVS

SEQ ID NO: 190492 - protein, 9 aa, Homo Sapiens
LYWKVWPLL

SEQ ID NO: 190493 - protein, 9 aa, Homo Sapiens
SEQAVLNAA

SEQ ID NO: 190494 - protein, 9 aa, Homo Sapiens
EAAREWRRR

SEQ ID NO: 190495 - protein, 9 aa, Homo Sapiens
FLCKFPAGK

SEQ ID NO: 190496 - protein, 9 aa, Homo Sapiens
VNTFCQCCI

SEQ ID NO: 190497 - protein, 9 aa, Homo Sapiens
GVNASMLRV

SEQ ID NO: 190498 - protein, 9 aa, Homo Sapiens
AFPVDTLQE

SEQ ID NO: 190499 - protein, 9 aa, Homo Sapiens
LPEMVCALS

SEQ ID NO: 190500 - protein, 9 aa, Homo Sapiens
DFTKMTPKQ

SEQ ID NO: 190501 - protein, 9 aa, Homo Sapiens
THESRFNFS

SEQ ID NO: 190502 - protein, 9 aa, Homo Sapiens
KSKAESAMT

SEQ ID NO: 190503 - protein, 9 aa, Homo Sapiens
LREMRETNR

SEQ ID NO: 190504 - protein, 9 aa, Homo Sapiens
REDITQNAQ

SEQ ID NO: 190505 - protein, 9 aa, Homo Sapiens
DFSADEVFH

SEQ ID NO: 190506 - protein, 9 aa, Homo Sapiens
QTNAQFAEI

SEQ ID NO: 190507 - protein, 9 aa, Homo Sapiens
VKGMKTKHA

SEQ ID NO: 190508 - protein, 9 aa, Homo Sapiens
ESLLQRTRQ

SEQ ID NO: 190509 - protein, 9 aa, Homo Sapiens
YHHSWPENL

SEQ ID NO: 190510 - protein, 9 aa, Homo Sapiens
CIPCKDSRF

SEQ ID NO: 190511 - protein, 9 aa, Homo Sapiens
YTENVHWFV

SEQ ID NO: 190512 - protein, 9 aa, Homo Sapiens
DLDNRHQGF

SEQ ID NO: 190513 - protein, 9 aa, Homo Sapiens
QGQHGSTSV

SEQ ID NO: 190514 - protein, 9 aa, Homo Sapiens
QNEPLSERL

SEQ ID NO: 190515 - protein, 9 aa, Homo Sapiens
MVSISLNFY

SEQ ID NO: 190516 - protein, 9 aa, Homo Sapiens
DPGLKEDAL

SEQ ID NO: 190517 - protein, 9 aa, Homo Sapiens
MERHHILFR

SEQ ID NO: 190518 - protein, 9 aa, Homo Sapiens
THQRHHSRE

SEQ ID NO: 190519 - protein, 9 aa, Homo Sapiens
EQLLQCFRH

SEQ ID NO: 190520 - protein, 9 aa, Homo Sapiens
NLAMCLAPS

SEQ ID NO: 190521 - protein, 9 aa, Homo Sapiens
RFPGFSYIT

SEQ ID NO: 190522 - protein, 9 aa, Homo Sapiens
QGDGGAGVK

SEQ ID NO: 190523 - protein, 9 aa, Homo Sapiens
LDMIGFLLA

SEQ ID NO: 190524 - protein, 9 aa, Homo Sapiens
HWKEKQDYV

SEQ ID NO: 190525 - protein, 9 aa, Homo Sapiens
YPNIHDLDL

SEQ ID NO: 190526 - protein, 9 aa, Homo Sapiens
VAAADSPAG

SEQ ID NO: 190527 - protein, 9 aa, Homo Sapiens
ILNELHPGL

SEQ ID NO: 190528 - protein, 9 aa, Homo Sapiens
MMVDSQLYV

SEQ ID NO: 190529 - protein, 9 aa, Homo Sapiens
QTSSLRQET

SEQ ID NO: 190530 - protein, 9 aa, Homo Sapiens
FITAYVMLF

SEQ ID NO: 190531 - protein, 9 aa, Homo Sapiens
MIYGEVFVD

SEQ ID NO: 190532 - protein, 9 aa, Homo Sapiens
TSYSLVKKI

SEQ ID NO: 190533 - protein, 9 aa, Homo Sapiens
NEKKERIPV

SEQ ID NO: 190534 - protein, 9 aa, Homo Sapiens
SVDKQEETV

SEQ ID NO: 190535 - protein, 9 aa, Homo Sapiens
DWSKVPSLE

SEQ ID NO: 190536 - protein, 9 aa, Homo Sapiens
YRALTEVCD

SEQ ID NO: 190537 - protein, 9 aa, Homo Sapiens
GEDDEEEEA

SEQ ID NO: 190538 - protein, 9 aa, Homo Sapiens
QKAARWQRE

SEQ ID NO: 190539 - protein, 9 aa, Homo Sapiens
SDVFFFTDC

SEQ ID NO: 190540 - protein, 9 aa, Homo Sapiens
KSNSKEREI

SEQ ID NO: 190541 - protein, 9 aa, Homo Sapiens
DEIDFEDFL

SEQ ID NO: 190542 - protein, 9 aa, Homo Sapiens
DENCILDEQ

SEQ ID NO: 190543 - protein, 9 aa, Homo Sapiens
RHKSQLWLH

SEQ ID NO: 190544 - protein, 9 aa, Homo Sapiens
VGPDGEVIS

SEQ ID NO: 190545 - protein, 9 aa, Homo Sapiens
WVWEHHPES

SEQ ID NO: 190546 - protein, 9 aa, Homo Sapiens
SMATLSSTP

SEQ ID NO: 190547 - protein, 9 aa, Homo Sapiens
WQESVEPQP

SEQ ID NO: 190548 - protein, 9 aa, Homo Sapiens
QVSAHDAGV

SEQ ID NO: 190549 - protein, 9 aa, Homo Sapiens
IQNMSKVVN

SEQ ID NO: 190550 - protein, 9 aa, Homo Sapiens
AKANECLFR

SEQ ID NO: 190551 - protein, 9 aa, Homo Sapiens
KAPLATATP

SEQ ID NO: 190552 - protein, 9 aa, Homo Sapiens
HGGFNMRGG

SEQ ID NO: 190553 - protein, 9 aa, Homo Sapiens
KRESLGWTD

SEQ ID NO: 190554 - protein, 9 aa, Homo Sapiens
AFQNSFGLN

SEQ ID NO: 190555 - protein, 9 aa, Homo Sapiens
NYIQNRKST

SEQ ID NO: 190556 - protein, 9 aa, Homo Sapiens
WSKVPSLEL

SEQ ID NO: 190557 - protein, 9 aa, Homo Sapiens
MKGWRLDLQ

SEQ ID NO: 190558 - protein, 9 aa, Homo Sapiens
RGLLSGLQR

SEQ ID NO: 190559 - protein, 9 aa, Homo Sapiens
NTEKAIECY

SEQ ID NO: 190560 - protein, 9 aa, Homo Sapiens
MGPPQTHAQ

SEQ ID NO: 190561 - protein, 9 aa, Homo Sapiens
CICQQARLL

SEQ ID NO: 190562 - protein, 9 aa, Homo Sapiens
CSTGIGRSG

SEQ ID NO: 190563 - protein, 9 aa, Homo Sapiens
CMRFQPSAK

SEQ ID NO: 190564 - protein, 9 aa, Homo Sapiens
LLETCIVNI

SEQ ID NO: 190565 - protein, 9 aa, Homo Sapiens
NERDKTQFL

SEQ ID NO: 190566 - protein, 9 aa, Homo Sapiens
CYLAIVHAV

SEQ ID NO: 190567 - protein, 9 aa, Homo Sapiens
LLCAAAPPF

SEQ ID NO: 190568 - protein, 9 aa, Homo Sapiens
GPHFPAAPT

SEQ ID NO: 190569 - protein, 9 aa, Homo Sapiens
RQSPWHIYF

SEQ ID NO: 190570 - protein, 9 aa, Homo Sapiens
TQQILPFPA

SEQ ID NO: 190571 - protein, 9 aa, Homo Sapiens
QHPYALTLF

SEQ ID NO: 190572 - protein, 9 aa, Homo Sapiens
RVQRREKNC

SEQ ID NO: 190573 - protein, 9 aa, Homo Sapiens
VQRELLRRC

SEQ ID NO: 190574 - protein, 9 aa, Homo Sapiens
LTAMTLTPR

SEQ ID NO: 190575 - protein, 9 aa, Homo Sapiens
LMAVVPLTT

SEQ ID NO: 190576 - protein, 9 aa, Homo Sapiens
RPPHQALMG

SEQ ID NO: 190577 - protein, 9 aa, Homo Sapiens
WDSMKSECV

SEQ ID NO: 190578 - protein, 9 aa, Homo Sapiens
IPTMSRRVK

SEQ ID NO: 190579 - protein, 9 aa, Homo Sapiens
NTKYWDSLP

SEQ ID NO: 190580 - protein, 9 aa, Homo Sapiens
LVSIYVHLD

SEQ ID NO: 190581 - protein, 9 aa, Homo Sapiens
GGASCHNTM

SEQ ID NO: 190582 - protein, 9 aa, Homo Sapiens
TPEFLCKFP

SEQ ID NO: 190583 - protein, 9 aa, Homo Sapiens
LARASHDVA

SEQ ID NO: 190584 - protein, 9 aa, Homo Sapiens
LGSMSTCIV

SEQ ID NO: 190585 - protein, 9 aa, Homo Sapiens
LISDVPPGV

SEQ ID NO: 190586 - protein, 9 aa, Homo Sapiens
LSQVGDPIT

SEQ ID NO: 190587 - protein, 9 aa, Homo Sapiens
LSFGNKSAL

SEQ ID NO: 190588 - protein, 9 aa, Homo Sapiens
RITWQQNYH

SEQ ID NO: 190589 - protein, 9 aa, Homo Sapiens
INDSTPKFQ

SEQ ID NO: 190590 - protein, 9 aa, Homo Sapiens
GSDLGGPCP

SEQ ID NO: 190591 - protein, 9 aa, Homo Sapiens
AHCMDYQKT

SEQ ID NO: 190592 - protein, 9 aa, Homo Sapiens
FAPLSPGFS

SEQ ID NO: 190593 - protein, 9 aa, Homo Sapiens
DGSLLSMLA

SEQ ID NO: 190594 - protein, 9 aa, Homo Sapiens
GSVLGVTVM

SEQ ID NO: 190595 - protein, 9 aa, Homo Sapiens
AYLLVAACV

SEQ ID NO: 190596 - protein, 9 aa, Homo Sapiens
CACSPGYEP

SEQ ID NO: 190597 - protein, 9 aa, Homo Sapiens
ATATPLWRQ

SEQ ID NO: 190598 - protein, 9 aa, Homo Sapiens
LRTFRVLQA

SEQ ID NO: 190599 - protein, 9 aa, Homo Sapiens
CLNVLRLNF

SEQ ID NO: 190600 - protein, 9 aa, Homo Sapiens
PMRRSRRLN

SEQ ID NO: 190601 - protein, 9 aa, Homo Sapiens
RSIPYKEFL

SEQ ID NO: 190602 - protein, 9 aa, Homo Sapiens
EWRAPQAGN

SEQ ID NO: 190603 - protein, 9 aa, Homo Sapiens
KELCRHWYP

SEQ ID NO: 190604 - protein, 9 aa, Homo Sapiens
SHRMRVEHF

SEQ ID NO: 190605 - protein, 9 aa, Homo Sapiens
GISSQGSTV

SEQ ID NO: 190606 - protein, 9 aa, Homo Sapiens
ILYIMVCSS

SEQ ID NO: 190607 - protein, 9 aa, Homo Sapiens
NVQKMPSNQ

SEQ ID NO: 190608 - protein, 9 aa, Homo Sapiens
LEPLARLAL

SEQ ID NO: 190609 - protein, 9 aa, Homo Sapiens
GGFQCLCTD

SEQ ID NO: 190610 - protein, 9 aa, Homo Sapiens
VYRAVTIVK

SEQ ID NO: 190611 - protein, 9 aa, Homo Sapiens
TTSSVGQIV

SEQ ID NO: 190612 - protein, 9 aa, Homo Sapiens
KPSHSSKDA

SEQ ID NO: 190613 - protein, 9 aa, Homo Sapiens
CRVPRRDIE

SEQ ID NO: 190614 - protein, 9 aa, Homo Sapiens
QFDEGWVDG

SEQ ID NO: 190615 - protein, 9 aa, Homo Sapiens
SECPPGCPE

SEQ ID NO: 190616 - protein, 9 aa, Homo Sapiens
MLEYEPTAR

SEQ ID NO: 190617 - protein, 9 aa, Homo Sapiens
IHMVPTIRS

SEQ ID NO: 190618 - protein, 9 aa, Homo Sapiens
DELQGNARE

SEQ ID NO: 190619 - protein, 9 aa, Homo Sapiens
GCSTSQQGE

SEQ ID NO: 190620 - protein, 9 aa, Homo Sapiens
EVSFPQPYP

SEQ ID NO: 190621 - protein, 9 aa, Homo Sapiens
RLQPGRGWA

SEQ ID NO: 190622 - protein, 9 aa, Homo Sapiens
GRCYGPYIS

SEQ ID NO: 190623 - protein, 9 aa, Homo Sapiens
DELPNLKAF

SEQ ID NO: 190624 - protein, 9 aa, Homo Sapiens
GYDRHSALH

SEQ ID NO: 190625 - protein, 9 aa, Homo Sapiens
MFIRVTTVA

SEQ ID NO: 190626 - protein, 9 aa, Homo Sapiens
GMPSFVQVI

SEQ ID NO: 190627 - protein, 9 aa, Homo Sapiens
YGMLANGSR

SEQ ID NO: 190628 - protein, 9 aa, Homo Sapiens
VFLAECTGP

SEQ ID NO: 190629 - protein, 9 aa, Homo Sapiens
RLPAALHPP

SEQ ID NO: 190630 - protein, 9 aa, Homo Sapiens
ESIRETGVI

SEQ ID NO: 190631 - protein, 9 aa, Homo Sapiens
LSNFTPYSH

SEQ ID NO: 190632 - protein, 9 aa, Homo Sapiens
EASGEHTME

SEQ ID NO: 190633 - protein, 9 aa, Homo Sapiens
EKLQTSVRC

SEQ ID NO: 190634 - protein, 9 aa, Homo Sapiens
LLLQGEQLH

SEQ ID NO: 190635 - protein, 9 aa, Homo Sapiens
EYQRLGIDP

SEQ ID NO: 190636 - protein, 9 aa, Homo Sapiens
CNQVPWARL

SEQ ID NO: 190637 - protein, 9 aa, Homo Sapiens
SPDRTHVLS

SEQ ID NO: 190638 - protein, 9 aa, Homo Sapiens
ILYCWAGQG

SEQ ID NO: 190639 - protein, 9 aa, Homo Sapiens
ESLPATHIW

SEQ ID NO: 190640 - protein, 9 aa, Homo Sapiens
APRDIGYVK

SEQ ID NO: 190641 - protein, 9 aa, Homo Sapiens
CITKTFFWR

SEQ ID NO: 190642 - protein, 9 aa, Homo Sapiens
ELLTGTSLD

SEQ ID NO: 190643 - protein, 9 aa, Homo Sapiens
VQKLFAKPH

SEQ ID NO: 190644 - protein, 9 aa, Homo Sapiens
HKKKLYVIR

SEQ ID NO: 190645 - protein, 9 aa, Homo Sapiens
MCRQCGLSF

SEQ ID NO: 190646 - protein, 9 aa, Homo Sapiens
VRLQRHGMV

SEQ ID NO: 190647 - protein, 9 aa, Homo Sapiens
PPQPALPVH

SEQ ID NO: 190648 - protein, 9 aa, Homo Sapiens
QYHSLDMIG

SEQ ID NO: 190649 - protein, 9 aa, Homo Sapiens
LQCHAVGPY

SEQ ID NO: 190650 - protein, 9 aa, Homo Sapiens
LMEGRPQIP

SEQ ID NO: 190651 - protein, 9 aa, Homo Sapiens
GNKKLKRVG

SEQ ID NO: 190652 - protein, 9 aa, Homo Sapiens
CGHVPFEAE

SEQ ID NO: 190653 - protein, 9 aa, Homo Sapiens
DVTLIGKVS

SEQ ID NO: 190654 - protein, 9 aa, Homo Sapiens
HIRQEILQE

SEQ ID NO: 190655 - protein, 9 aa, Homo Sapiens
ATDQKQKSG

SEQ ID NO: 190656 - protein, 9 aa, Homo Sapiens
GQSLGCQPS

SEQ ID NO: 190657 - protein, 9 aa, Homo Sapiens
KLPNDITGQ

SEQ ID NO: 190658 - protein, 9 aa, Homo Sapiens
STRAGGFGL

SEQ ID NO: 190659 - protein, 9 aa, Homo Sapiens
YTVAIILRM

SEQ ID NO: 190660 - protein, 9 aa, Homo Sapiens
HSELKKELL

SEQ ID NO: 190661 - protein, 9 aa, Homo Sapiens
QVFSQENVC

SEQ ID NO: 190662 - protein, 9 aa, Homo Sapiens
YRDHLDPAS

SEQ ID NO: 190663 - protein, 9 aa, Homo Sapiens
MLAHHLGVE

SEQ ID NO: 190664 - protein, 9 aa, Homo Sapiens
AKDFIQKLL

SEQ ID NO: 190665 - protein, 9 aa, Homo Sapiens
NLKMVLWSL

SEQ ID NO: 190666 - protein, 9 aa, Homo Sapiens
TISGSKKKT

SEQ ID NO: 190667 - protein, 9 aa, Homo Sapiens
RAVTIVKQA

SEQ ID NO: 190668 - protein, 9 aa, Homo Sapiens
VWFEFHYPN

SEQ ID NO: 190669 - protein, 9 aa, Homo Sapiens
FPHWYFDVE

SEQ ID NO: 190670 - protein, 9 aa, Homo Sapiens
LPKRQFVPS

SEQ ID NO: 190671 - protein, 9 aa, Homo Sapiens
TRRGLARSW

SEQ ID NO: 190672 - protein, 9 aa, Homo Sapiens
NLMSQVYSY

SEQ ID NO: 190673 - protein, 9 aa, Homo Sapiens
SGCGGSCCR

SEQ ID NO: 190674 - protein, 9 aa, Homo Sapiens
MKVIAGRFE

SEQ ID NO: 190675 - protein, 9 aa, Homo Sapiens
SIFFVGQLE

SEQ ID NO: 190676 - protein, 9 aa, Homo Sapiens
IWNEIDDMQ

SEQ ID NO: 190677 - protein, 9 aa, Homo Sapiens
NGKADVTLI

SEQ ID NO: 190678 - protein, 9 aa, Homo Sapiens
RKSTFIKQM

SEQ ID NO: 190679 - protein, 9 aa, Homo Sapiens
QVASSACVQ

SEQ ID NO: 190680 - protein, 9 aa, Homo Sapiens
ARTGLLPGE

SEQ ID NO: 190681 - protein, 9 aa, Homo Sapiens
YAHQMVCTD

SEQ ID NO: 190682 - protein, 9 aa, Homo Sapiens
SICNEPWQC

SEQ ID NO: 190683 - protein, 9 aa, Homo Sapiens
SLVASKLPL

SEQ ID NO: 190684 - protein, 9 aa, Homo Sapiens
YFADMERHH

SEQ ID NO: 190685 - protein, 9 aa, Homo Sapiens
VYEAVLQSS

SEQ ID NO: 190686 - protein, 9 aa, Homo Sapiens
FFTGIFYMC

SEQ ID NO: 190687 - protein, 9 aa, Homo Sapiens
HCPHGPELD

SEQ ID NO: 190688 - protein, 9 aa, Homo Sapiens
HQVFAPVCL

SEQ ID NO: 190689 - protein, 9 aa, Homo Sapiens
QPKLPNHLT

SEQ ID NO: 190690 - protein, 9 aa, Homo Sapiens
SGSESEGDN

SEQ ID NO: 190691 - protein, 9 aa, Homo Sapiens
LLDRDVLKQ

SEQ ID NO: 190692 - protein, 9 aa, Homo Sapiens
TSYKMCLKS

SEQ ID NO: 190693 - protein, 9 aa, Homo Sapiens
LTCLLRRER

SEQ ID NO: 190694 - protein, 9 aa, Homo Sapiens
RKECDRQKQ

SEQ ID NO: 190695 - protein, 9 aa, Homo Sapiens
PLQVAVRGP

SEQ ID NO: 190696 - protein, 9 aa, Homo Sapiens
DAKDLEGQM

SEQ ID NO: 190697 - protein, 9 aa, Homo Sapiens
GNLALLVDE

SEQ ID NO: 190698 - protein, 9 aa, Homo Sapiens
SALITVTDK

SEQ ID NO: 190699 - protein, 9 aa, Homo Sapiens
STSVQASSS

SEQ ID NO: 190700 - protein, 9 aa, Homo Sapiens
WWTGDGEFN

SEQ ID NO: 190701 - protein, 9 aa, Homo Sapiens
PVMLKQTHV

SEQ ID NO: 190702 - protein, 9 aa, Homo Sapiens
QVRDTAIEQ

SEQ ID NO: 190703 - protein, 9 aa, Homo Sapiens
KCVENINGT

SEQ ID NO: 190704 - protein, 9 aa, Homo Sapiens
HLSLELQMD

SEQ ID NO: 190705 - protein, 9 aa, Homo Sapiens
AHTYPAQWT

SEQ ID NO: 190706 - protein, 9 aa, Homo Sapiens
DRQGVLRSI

SEQ ID NO: 190707 - protein, 9 aa, Homo Sapiens
DLALLFPLK

SEQ ID NO: 190708 - protein, 9 aa, Homo Sapiens
LPCRPRPRV

SEQ ID NO: 190709 - protein, 9 aa, Homo Sapiens
SSFGCSFHG

SEQ ID NO: 190710 - protein, 9 aa, Homo Sapiens
YEPTARISP

SEQ ID NO: 190711 - protein, 9 aa, Homo Sapiens
SALMYFIVH

SEQ ID NO: 190712 - protein, 9 aa, Homo Sapiens
VHCKPMMVD

SEQ ID NO: 190713 - protein, 9 aa, Homo Sapiens
KEEAKLKKV

SEQ ID NO: 190714 - protein, 9 aa, Homo Sapiens
WRRRARQER

SEQ ID NO: 190715 - protein, 9 aa, Homo Sapiens
VREGCAAVM

SEQ ID NO: 190716 - protein, 9 aa, Homo Sapiens
TGNLALLVD

SEQ ID NO: 190717 - protein, 9 aa, Homo Sapiens
ALGLGTCRG

SEQ ID NO: 190718 - protein, 9 aa, Homo Sapiens
SEQGKCVEN

SEQ ID NO: 190719 - protein, 9 aa, Homo Sapiens
KAGHPRPGS

SEQ ID NO: 190720 - protein, 9 aa, Homo Sapiens
STYELKKKT

SEQ ID NO: 190721 - protein, 9 aa, Homo Sapiens
SGSSALKHN

SEQ ID NO: 190722 - protein, 9 aa, Homo Sapiens
IHVLQFCYA

SEQ ID NO: 190723 - protein, 9 aa, Homo Sapiens
SPTQLSSVP

SEQ ID NO: 190724 - protein, 9 aa, Homo Sapiens
DWDACPLPP

SEQ ID NO: 190725 - protein, 9 aa, Homo Sapiens
GCQSDIISL

SEQ ID NO: 190726 - protein, 9 aa, Homo Sapiens
VYQISPEEM

SEQ ID NO: 190727 - protein, 9 aa, Homo Sapiens
GGCGSTPPP

SEQ ID NO: 190728 - protein, 9 aa, Homo Sapiens
TFISSGQSL

SEQ ID NO: 190729 - protein, 9 aa, Homo Sapiens
RCVMTSHPR

SEQ ID NO: 190730 - protein, 9 aa, Homo Sapiens
LRHKKYEEG

SEQ ID NO: 190731 - protein, 9 aa, Homo Sapiens
SAAMACFTA

SEQ ID NO: 190732 - protein, 9 aa, Homo Sapiens
PASAMASFL

SEQ ID NO: 190733 - protein, 9 aa, Homo Sapiens
KMNLVVLPD

SEQ ID NO: 190734 - protein, 9 aa, Homo Sapiens
EALIYQILP

SEQ ID NO: 190735 - protein, 9 aa, Homo Sapiens
VLVKWQPVD

SEQ ID NO: 190736 - protein, 9 aa, Homo Sapiens
SCCQQTAIH

SEQ ID NO: 190737 - protein, 9 aa, Homo Sapiens
PQVVAKILK

SEQ ID NO: 190738 - protein, 9 aa, Homo Sapiens
SCEKYVHGV

SEQ ID NO: 190739 - protein, 9 aa, Homo Sapiens
RSNDGNSYH

SEQ ID NO: 190740 - protein, 9 aa, Homo Sapiens
ILACYFYEQ

SEQ ID NO: 190741 - protein, 9 aa, Homo Sapiens
ESRGQTSSK

SEQ ID NO: 190742 - protein, 9 aa, Homo Sapiens
RCGFLQLWA

SEQ ID NO: 190743 - protein, 9 aa, Homo Sapiens
WEHGRSRLS

SEQ ID NO: 190744 - protein, 9 aa, Homo Sapiens
RSHINPTGI

SEQ ID NO: 190745 - protein, 9 aa, Homo Sapiens
GIQNMPNVC

SEQ ID NO: 190746 - protein, 9 aa, Homo Sapiens
YSWPIMNSS

SEQ ID NO: 190747 - protein, 9 aa, Homo Sapiens
RTTTFSTDG

SEQ ID NO: 190748 - protein, 9 aa, Homo Sapiens
SEAHQRYFG

SEQ ID NO: 190749 - protein, 9 aa, Homo Sapiens
KIVASNLMT

SEQ ID NO: 190750 - protein, 9 aa, Homo Sapiens
QQFGFKAFV

SEQ ID NO: 190751 - protein, 9 aa, Homo Sapiens
CKFDIDIRL

SEQ ID NO: 190752 - protein, 9 aa, Homo Sapiens
RCEEKTVGH

SEQ ID NO: 190753 - protein, 9 aa, Homo Sapiens
VTLIDYTLE

SEQ ID NO: 190754 - protein, 9 aa, Homo Sapiens
YLRITWQQN

SEQ ID NO: 190755 - protein, 9 aa, Homo Sapiens
RFHADSMCK

SEQ ID NO: 190756 - protein, 9 aa, Homo Sapiens
EQYSDCDGR

SEQ ID NO: 190757 - protein, 9 aa, Homo Sapiens
LAMCLAPSL

SEQ ID NO: 190758 - protein, 9 aa, Homo Sapiens
LFFHWLFDK

SEQ ID NO: 190759 - protein, 9 aa, Homo Sapiens
DDEEEGEDD

SEQ ID NO: 190760 - protein, 9 aa, Homo Sapiens
SCYFFLEEK

SEQ ID NO: 190761 - protein, 9 aa, Homo Sapiens
LAPEDVLAM

SEQ ID NO: 190762 - protein, 9 aa, Homo Sapiens
PGLKEDALQ

SEQ ID NO: 190763 - protein, 9 aa, Homo Sapiens
QISEDCVFS

SEQ ID NO: 190764 - protein, 9 aa, Homo Sapiens
QVVLLTNER

SEQ ID NO: 190765 - protein, 9 aa, Homo Sapiens
SFCVCYMPY

SEQ ID NO: 190766 - protein, 9 aa, Homo Sapiens
VAQCILSYG

SEQ ID NO: 190767 - protein, 9 aa, Homo Sapiens
EDRPFPHTV

SEQ ID NO: 190768 - protein, 9 aa, Homo Sapiens
EMAEKCCQT

SEQ ID NO: 190769 - protein, 9 aa, Homo Sapiens
GLPGDQGAP

SEQ ID NO: 190770 - protein, 9 aa, Homo Sapiens
EGSDEMYKV

SEQ ID NO: 190771 - protein, 9 aa, Homo Sapiens
SGEGARPWG

SEQ ID NO: 190772 - protein, 9 aa, Homo Sapiens
VPISKKVAW

SEQ ID NO: 190773 - protein, 9 aa, Homo Sapiens
LKGHQEGWC

SEQ ID NO: 190774 - protein, 9 aa, Homo Sapiens
QDEALLIQE

SEQ ID NO: 190775 - protein, 9 aa, Homo Sapiens
IVKQANCPL

SEQ ID NO: 190776 - protein, 9 aa, Homo Sapiens
LLSGLQRRK

SEQ ID NO: 190777 - protein, 9 aa, Homo Sapiens
PNNRTHGSL

SEQ ID NO: 190778 - protein, 9 aa, Homo Sapiens
WTFYHHIRQ

SEQ ID NO: 190779 - protein, 9 aa, Homo Sapiens
LANASSLRK

SEQ ID NO: 190780 - protein, 9 aa, Homo Sapiens
PESVKNGFD

SEQ ID NO: 190781 - protein, 9 aa, Homo Sapiens
HILLWTFVQ

SEQ ID NO: 190782 - protein, 9 aa, Homo Sapiens
LIIQHPYAL

SEQ ID NO: 190783 - protein, 9 aa, Homo Sapiens
LQGPESCSL

SEQ ID NO: 190784 - protein, 9 aa, Homo Sapiens
ELQHVVKDP

SEQ ID NO: 190785 - protein, 9 aa, Homo Sapiens
DNGSVHKSI

SEQ ID NO: 190786 - protein, 9 aa, Homo Sapiens
KICGKDLFC

SEQ ID NO: 190787 - protein, 9 aa, Homo Sapiens
IQPQEPLAT

SEQ ID NO: 190788 - protein, 9 aa, Homo Sapiens
RALLDRDVL

SEQ ID NO: 190789 - protein, 9 aa, Homo Sapiens
LFSMESPQE

SEQ ID NO: 190790 - protein, 9 aa, Homo Sapiens
GAPPPGTMG

SEQ ID NO: 190791 - protein, 9 aa, Homo Sapiens
SSGCSSVSS

SEQ ID NO: 190792 - protein, 9 aa, Homo Sapiens
ADWAQIFLK

SEQ ID NO: 190793 - protein, 9 aa, Homo Sapiens
FVLSITTTT

SEQ ID NO: 190794 - protein, 9 aa, Homo Sapiens
FVEARARAW

SEQ ID NO: 190795 - protein, 9 aa, Homo Sapiens
LVDLQELAL

SEQ ID NO: 190796 - protein, 9 aa, Homo Sapiens
PACRVLVHC

SEQ ID NO: 190797 - protein, 9 aa, Homo Sapiens
LWWAANELR

SEQ ID NO: 190798 - protein, 9 aa, Homo Sapiens
SPPHVPLPP

SEQ ID NO: 190799 - protein, 9 aa, Homo Sapiens
AASSGMISI

SEQ ID NO: 190800 - protein, 9 aa, Homo Sapiens
IMVCSSMPY

SEQ ID NO: 190801 - protein, 9 aa, Homo Sapiens
NSMLPLTQT

SEQ ID NO: 190802 - protein, 9 aa, Homo Sapiens
VLTPHMSSV

SEQ ID NO: 190803 - protein, 9 aa, Homo Sapiens
HFTVRYIRI

SEQ ID NO: 190804 - protein, 9 aa, Homo Sapiens
LTSCYFFLE

SEQ ID NO: 190805 - protein, 9 aa, Homo Sapiens
NYVPGGTLT

SEQ ID NO: 190806 - protein, 9 aa, Homo Sapiens
TPKVHLKYA

SEQ ID NO: 190807 - protein, 9 aa, Homo Sapiens
GQHGSTSVQ

SEQ ID NO: 190808 - protein, 9 aa, Homo Sapiens
SVLKKLCGT

SEQ ID NO: 190809 - protein, 9 aa, Homo Sapiens
STPPPPPGW

SEQ ID NO: 190810 - protein, 9 aa, Homo Sapiens
FTPETERQW

SEQ ID NO: 190811 - protein, 9 aa, Homo Sapiens
NGAGWPCPA

SEQ ID NO: 190812 - protein, 9 aa, Homo Sapiens
ALRTFRVLQ

SEQ ID NO: 190813 - protein, 9 aa, Homo Sapiens
EGGNVEKDP

SEQ ID NO: 190814 - protein, 9 aa, Homo Sapiens
NPWADPECC

SEQ ID NO: 190815 - protein, 9 aa, Homo Sapiens
FCMYSKGAS

SEQ ID NO: 190816 - protein, 9 aa, Homo Sapiens
QAFDFRVGT

SEQ ID NO: 190817 - protein, 9 aa, Homo Sapiens
TEKAIECYR

SEQ ID NO: 190818 - protein, 9 aa, Homo Sapiens
IMHRDLKPD

SEQ ID NO: 190819 - protein, 9 aa, Homo Sapiens
FEDAKTDGE

SEQ ID NO: 190820 - protein, 9 aa, Homo Sapiens
ACNHVAHTV

SEQ ID NO: 190821 - protein, 9 aa, Homo Sapiens
AKVEEAERA

SEQ ID NO: 190822 - protein, 9 aa, Homo Sapiens
YHLTQPLPL

SEQ ID NO: 190823 - protein, 9 aa, Homo Sapiens
AQTLVIQPM

SEQ ID NO: 190824 - protein, 9 aa, Homo Sapiens
GIGRCLHTL

SEQ ID NO: 190825 - protein, 9 aa, Homo Sapiens
VILESFQAL

SEQ ID NO: 190826 - protein, 9 aa, Homo Sapiens
KSDSHILAS

SEQ ID NO: 190827 - protein, 9 aa, Homo Sapiens
DRPLQERGE

SEQ ID NO: 190828 - protein, 9 aa, Homo Sapiens
HTYSVHWSE

SEQ ID NO: 190829 - protein, 9 aa, Homo Sapiens
SMGEDMSAD

SEQ ID NO: 190830 - protein, 9 aa, Homo Sapiens
HLTRFLSRV

SEQ ID NO: 190831 - protein, 9 aa, Homo Sapiens
APTLPTRRG

SEQ ID NO: 190832 - protein, 9 aa, Homo Sapiens
ATGAHLEPP

SEQ ID NO: 190833 - protein, 9 aa, Homo Sapiens
HLPIRMAKG

SEQ ID NO: 190834 - protein, 9 aa, Homo Sapiens
YRRVITVYQ

SEQ ID NO: 190835 - protein, 9 aa, Homo Sapiens
TGPQVASSA

SEQ ID NO: 190836 - protein, 9 aa, Homo Sapiens
RPLFLEFHK

SEQ ID NO: 190837 - protein, 9 aa, Homo Sapiens
PHRGRRQAP

SEQ ID NO: 190838 - protein, 9 aa, Homo Sapiens
PRPPETQVS

SEQ ID NO: 190839 - protein, 9 aa, Homo Sapiens
QYVQNVVVK

SEQ ID NO: 190840 - protein, 9 aa, Homo Sapiens
CHQRACRKR

SEQ ID NO: 190841 - protein, 9 aa, Homo Sapiens
QVGGRTFPE

SEQ ID NO: 190842 - protein, 9 aa, Homo Sapiens
QVYWNIIHQ

SEQ ID NO: 190843 - protein, 9 aa, Homo Sapiens
SADEVFHRE

SEQ ID NO: 190844 - protein, 9 aa, Homo Sapiens
SSPAVLREA

SEQ ID NO: 190845 - protein, 9 aa, Homo Sapiens
VRDTAIEQR

SEQ ID NO: 190846 - protein, 9 aa, Homo Sapiens
SAIKPPHEE

SEQ ID NO: 190847 - protein, 9 aa, Homo Sapiens
LGPILQSIL

SEQ ID NO: 190848 - protein, 9 aa, Homo Sapiens
TNYVRNSRT

SEQ ID NO: 190849 - protein, 9 aa, Homo Sapiens
CTPPTAAVG

SEQ ID NO: 190850 - protein, 9 aa, Homo Sapiens
RSAPSLIMD

SEQ ID NO: 190851 - protein, 9 aa, Homo Sapiens
LFQSTNAGT

SEQ ID NO: 190852 - protein, 9 aa, Homo Sapiens
IKYDIKGGA

SEQ ID NO: 190853 - protein, 9 aa, Homo Sapiens
SDKIRTAQD

SEQ ID NO: 190854 - protein, 9 aa, Homo Sapiens
APAWVTGNV

SEQ ID NO: 190855 - protein, 9 aa, Homo Sapiens
YHHIRQEIL

SEQ ID NO: 190856 - protein, 9 aa, Homo Sapiens
TGICYHICS

SEQ ID NO: 190857 - protein, 9 aa, Homo Sapiens
TALHIKKTL

SEQ ID NO: 190858 - protein, 9 aa, Homo Sapiens
EATLQRAKQ

SEQ ID NO: 190859 - protein, 9 aa, Homo Sapiens
CRKTINGHL

SEQ ID NO: 190860 - protein, 9 aa, Homo Sapiens
VCDSVLGKM

SEQ ID NO: 190861 - protein, 9 aa, Homo Sapiens
SPSRSAACG

SEQ ID NO: 190862 - protein, 9 aa, Homo Sapiens
TSILNFYCT

SEQ ID NO: 190863 - protein, 9 aa, Homo Sapiens
CVGILSGHD

SEQ ID NO: 190864 - protein, 9 aa, Homo Sapiens
SLDQPVSQD

SEQ ID NO: 190865 - protein, 9 aa, Homo Sapiens
NLRVGHKPS

SEQ ID NO: 190866 - protein, 9 aa, Homo Sapiens
FFGTLELTK

SEQ ID NO: 190867 - protein, 9 aa, Homo Sapiens
QETTADVIA

SEQ ID NO: 190868 - protein, 9 aa, Homo Sapiens
RAQDEVLTK

SEQ ID NO: 190869 - protein, 9 aa, Homo Sapiens
LTEESVNES

SEQ ID NO: 190870 - protein, 9 aa, Homo Sapiens
WPRWPGHLR

SEQ ID NO: 190871 - protein, 9 aa, Homo Sapiens
QTMFRAQPH

SEQ ID NO: 190872 - protein, 9 aa, Homo Sapiens
DDLAHELVK

SEQ ID NO: 190873 - protein, 9 aa, Homo Sapiens
KKTQQRGLM

SEQ ID NO: 190874 - protein, 9 aa, Homo Sapiens
PPSLEPLAR

SEQ ID NO: 190875 - protein, 9 aa, Homo Sapiens
HKPWETPGR

SEQ ID NO: 190876 - protein, 9 aa, Homo Sapiens
FLCARDFNI

SEQ ID NO: 190877 - protein, 9 aa, Homo Sapiens
EDDDDDEDG

SEQ ID NO: 190878 - protein, 9 aa, Homo Sapiens
AALVFEQSV

SEQ ID NO: 190879 - protein, 9 aa, Homo Sapiens
ENELLMTPC

SEQ ID NO: 190880 - protein, 9 aa, Homo Sapiens
YPSIRDKWS

SEQ ID NO: 190881 - protein, 9 aa, Homo Sapiens
CIKPEALKF

SEQ ID NO: 190882 - protein, 9 aa, Homo Sapiens
HGELLETCI

SEQ ID NO: 190883 - protein, 9 aa, Homo Sapiens
EHEETKKDP

SEQ ID NO: 190884 - protein, 9 aa, Homo Sapiens
LVERNIKYD

SEQ ID NO: 190885 - protein, 9 aa, Homo Sapiens
QHSGEKRSV

SEQ ID NO: 190886 - protein, 9 aa, Homo Sapiens
YPRPASVPL

SEQ ID NO: 190887 - protein, 9 aa, Homo Sapiens
PRAYTCFNR

SEQ ID NO: 190888 - protein, 9 aa, Homo Sapiens
AVALALPLT

SEQ ID NO: 190889 - protein, 9 aa, Homo Sapiens
QRDGLGNMP

SEQ ID NO: 190890 - protein, 9 aa, Homo Sapiens
LRKVLRKGK

SEQ ID NO: 190891 - protein, 9 aa, Homo Sapiens
PDDIMGTIK

SEQ ID NO: 190892 - protein, 9 aa, Homo Sapiens
TNLCEGHIE

SEQ ID NO: 190893 - protein, 9 aa, Homo Sapiens
EHLQDSVKT

SEQ ID NO: 190894 - protein, 9 aa, Homo Sapiens
KLQTSVRCL

SEQ ID NO: 190895 - protein, 9 aa, Homo Sapiens
KPIADWAQI

SEQ ID NO: 190896 - protein, 9 aa, Homo Sapiens
CEVPQPSTA

SEQ ID NO: 190897 - protein, 9 aa, Homo Sapiens
QFEPQVNNR

SEQ ID NO: 190898 - protein, 9 aa, Homo Sapiens
PQHMASIIS

SEQ ID NO: 190899 - protein, 9 aa, Homo Sapiens
EGARPWGII

SEQ ID NO: 190900 - protein, 9 aa, Homo Sapiens
MSYKCIECG

SEQ ID NO: 190901 - protein, 9 aa, Homo Sapiens
TTTAATGSM

SEQ ID NO: 190902 - protein, 9 aa, Homo Sapiens
KRSRMHRFV

SEQ ID NO: 190903 - protein, 9 aa, Homo Sapiens
FSLYMMDPH

SEQ ID NO: 190904 - protein, 9 aa, Homo Sapiens
FWTFRTTTF

SEQ ID NO: 190905 - protein, 9 aa, Homo Sapiens
DSVTSSDTA

SEQ ID NO: 190906 - protein, 9 aa, Homo Sapiens
VISTLKLKP

SEQ ID NO: 190907 - protein, 9 aa, Homo Sapiens
RKATARERV

SEQ ID NO: 190908 - protein, 9 aa, Homo Sapiens
CNRIKQSAS

SEQ ID NO: 190909 - protein, 9 aa, Homo Sapiens
HLRSPSVLE

SEQ ID NO: 190910 - protein, 9 aa, Homo Sapiens
HRFIKYNIW

SEQ ID NO: 190911 - protein, 9 aa, Homo Sapiens
LPQLWIGID

SEQ ID NO: 190912 - protein, 9 aa, Homo Sapiens
EWICHIEEC

SEQ ID NO: 190913 - protein, 9 aa, Homo Sapiens
SGQSNCYRG

SEQ ID NO: 190914 - protein, 9 aa, Homo Sapiens
GSSSRKECD

SEQ ID NO: 190915 - protein, 9 aa, Homo Sapiens
RRSRDLDAL

SEQ ID NO: 190916 - protein, 9 aa, Homo Sapiens
QHRKSIFFV

SEQ ID NO: 190917 - protein, 9 aa, Homo Sapiens
PVDWNNEYC

SEQ ID NO: 190918 - protein, 9 aa, Homo Sapiens
HTQMLLHLL

SEQ ID NO: 190919 - protein, 9 aa, Homo Sapiens
KKENLACIG

SEQ ID NO: 190920 - protein, 9 aa, Homo Sapiens
RCLCQFSTR

SEQ ID NO: 190921 - protein, 9 aa, Homo Sapiens
AHDAGVPPL

SEQ ID NO: 190922 - protein, 9 aa, Homo Sapiens
PMESCLDLL

SEQ ID NO: 190923 - protein, 9 aa, Homo Sapiens
NQYVKVQIP

SEQ ID NO: 190924 - protein, 9 aa, Homo Sapiens
IDRTMMYYG

SEQ ID NO: 190925 - protein, 9 aa, Homo Sapiens
KKPDYVMTG

SEQ ID NO: 190926 - protein, 9 aa, Homo Sapiens
KQLQYLEKL

SEQ ID NO: 190927 - protein, 9 aa, Homo Sapiens
RIHTAFAPV

SEQ ID NO: 190928 - protein, 9 aa, Homo Sapiens
ASLVSADEN

SEQ ID NO: 190929 - protein, 9 aa, Homo Sapiens
VSSPMNPGQ

SEQ ID NO: 190930 - protein, 9 aa, Homo Sapiens
TVELLTGTS

SEQ ID NO: 190931 - protein, 9 aa, Homo Sapiens
QRFIEKGPL

SEQ ID NO: 190932 - protein, 9 aa, Homo Sapiens
QMDTPITHI

SEQ ID NO: 190933 - protein, 9 aa, Homo Sapiens
PEPPSLGTH

SEQ ID NO: 190934 - protein, 9 aa, Homo Sapiens
SEGGFLMLG

SEQ ID NO: 190935 - protein, 9 aa, Homo Sapiens
PVLYWCAHN

SEQ ID NO: 190936 - protein, 9 aa, Homo Sapiens
EIKMLSDQK

SEQ ID NO: 190937 - protein, 9 aa, Homo Sapiens
IKWMAPEAI

SEQ ID NO: 190938 - protein, 9 aa, Homo Sapiens
SIHYSSVPR

SEQ ID NO: 190939 - protein, 9 aa, Homo Sapiens
EDVLNGGEC

SEQ ID NO: 190940 - protein, 9 aa, Homo Sapiens
SQRQTGPSK

SEQ ID NO: 190941 - protein, 9 aa, Homo Sapiens
RGGAKPPWP

SEQ ID NO: 190942 - protein, 9 aa, Homo Sapiens
QMKVCNLSN

SEQ ID NO: 190943 - protein, 9 aa, Homo Sapiens
GGLGLYTCR

SEQ ID NO: 190944 - protein, 9 aa, Homo Sapiens
DYVMTGIVP

SEQ ID NO: 190945 - protein, 9 aa, Homo Sapiens
IKCVKAFST

SEQ ID NO: 190946 - protein, 9 aa, Homo Sapiens
LQNMPSLHS

SEQ ID NO: 190947 - protein, 9 aa, Homo Sapiens
RYCENKLND

SEQ ID NO: 190948 - protein, 9 aa, Homo Sapiens
DVDECKIGA

SEQ ID NO: 190949 - protein, 9 aa, Homo Sapiens
FNDDRRFPG

SEQ ID NO: 190950 - protein, 9 aa, Homo Sapiens
RIQLWRTHQ

SEQ ID NO: 190951 - protein, 9 aa, Homo Sapiens
RESLELMQY

SEQ ID NO: 190952 - protein, 9 aa, Homo Sapiens
QGSSDLVVP

SEQ ID NO: 190953 - protein, 9 aa, Homo Sapiens
KTKGAYPNH

SEQ ID NO: 190954 - protein, 9 aa, Homo Sapiens
PFTHLPIRM

SEQ ID NO: 190955 - protein, 9 aa, Homo Sapiens
SCVLISFMV

SEQ ID NO: 190956 - protein, 9 aa, Homo Sapiens
VPTLLSSSS

SEQ ID NO: 190957 - protein, 9 aa, Homo Sapiens
PGTNGVVPA

SEQ ID NO: 190958 - protein, 9 aa, Homo Sapiens
PAGPWRKEC

SEQ ID NO: 190959 - protein, 9 aa, Homo Sapiens
HYSKTSYSL

SEQ ID NO: 190960 - protein, 9 aa, Homo Sapiens
AEIMESIKC

SEQ ID NO: 190961 - protein, 9 aa, Homo Sapiens
LWEHVPNGA

SEQ ID NO: 190962 - protein, 9 aa, Homo Sapiens
SNQYVKVQI

SEQ ID NO: 190963 - protein, 9 aa, Homo Sapiens
RLARASHDV

SEQ ID NO: 190964 - protein, 9 aa, Homo Sapiens
NSGTAMWFC

SEQ ID NO: 190965 - protein, 9 aa, Homo Sapiens
QKFISGISS

SEQ ID NO: 190966 - protein, 9 aa, Homo Sapiens
LQEYHSHAR

SEQ ID NO: 190967 - protein, 9 aa, Homo Sapiens
AQLWWAANE

SEQ ID NO: 190968 - protein, 9 aa, Homo Sapiens
WLFCRVRFD

SEQ ID NO: 190969 - protein, 9 aa, Homo Sapiens
LQMAIRLLN

SEQ ID NO: 190970 - protein, 9 aa, Homo Sapiens
GLWTQVHQS

SEQ ID NO: 190971 - protein, 9 aa, Homo Sapiens
ALLNIYDCL

SEQ ID NO: 190972 - protein, 9 aa, Homo Sapiens
KVAWDPRFD

SEQ ID NO: 190973 - protein, 9 aa, Homo Sapiens
EYQRQDCMD

SEQ ID NO: 190974 - protein, 9 aa, Homo Sapiens
LPRLTRERA

SEQ ID NO: 190975 - protein, 9 aa, Homo Sapiens
YTYGLGATT

SEQ ID NO: 190976 - protein, 9 aa, Homo Sapiens
SDQKLPYSY

SEQ ID NO: 190977 - protein, 9 aa, Homo Sapiens
ETLITLGAE

SEQ ID NO: 190978 - protein, 9 aa, Homo Sapiens
HALAKACST

SEQ ID NO: 190979 - protein, 9 aa, Homo Sapiens
VRHTPAEEM

SEQ ID NO: 190980 - protein, 9 aa, Homo Sapiens
EIDFEDFLT

SEQ ID NO: 190981 - protein, 9 aa, Homo Sapiens
QKYRRCGFL

SEQ ID NO: 190982 - protein, 9 aa, Homo Sapiens
EQRELIACL

SEQ ID NO: 190983 - protein, 9 aa, Homo Sapiens
IVSDLLELQ

SEQ ID NO: 190984 - protein, 9 aa, Homo Sapiens
FSCTNIFYE

SEQ ID NO: 190985 - protein, 9 aa, Homo Sapiens
GPQVASSAC

SEQ ID NO: 190986 - protein, 9 aa, Homo Sapiens
EDRDHMTSV

SEQ ID NO: 190987 - protein, 9 aa, Homo Sapiens
EVARLWGVH

SEQ ID NO: 190988 - protein, 9 aa, Homo Sapiens
GVALGGPPA

SEQ ID NO: 190989 - protein, 9 aa, Homo Sapiens
GIWSPGILP

SEQ ID NO: 190990 - protein, 9 aa, Homo Sapiens
LMTFFTGIF

SEQ ID NO: 190991 - protein, 9 aa, Homo Sapiens
FLPWIIKAA

SEQ ID NO: 190992 - protein, 9 aa, Homo Sapiens
EVVEKVYQP

SEQ ID NO: 190993 - protein, 9 aa, Homo Sapiens
TTTSMEEHV

SEQ ID NO: 190994 - protein, 9 aa, Homo Sapiens
LAFVEARAR

SEQ ID NO: 190995 - protein, 9 aa, Homo Sapiens
IWSPGILPV

SEQ ID NO: 190996 - protein, 9 aa, Homo Sapiens
QTQQILPFP

SEQ ID NO: 190997 - protein, 9 aa, Homo Sapiens
FQAAINTAI

SEQ ID NO: 190998 - protein, 9 aa, Homo Sapiens
NADYLQRAA

SEQ ID NO: 190999 - protein, 9 aa, Homo Sapiens
DDEEEDLED

SEQ ID NO: 191000 - protein, 9 aa, Homo Sapiens
TATLATSIK

SEQ ID NO: 191001 - protein, 9 aa, Homo Sapiens
DRSSTPTIL

SEQ ID NO: 191002 - protein, 9 aa, Homo Sapiens
TVYQISPEE

SEQ ID NO: 191003 - protein, 9 aa, Homo Sapiens
FFNMSHCQL

SEQ ID NO: 191004 - protein, 9 aa, Homo Sapiens
NVDSRNRKE

SEQ ID NO: 191005 - protein, 9 aa, Homo Sapiens
HSYMRMLMH

SEQ ID NO: 191006 - protein, 9 aa, Homo Sapiens
TKNSVDKQE

SEQ ID NO: 191007 - protein, 9 aa, Homo Sapiens
AYLALNVIL

SEQ ID NO: 191008 - protein, 9 aa, Homo Sapiens
YRCGGPVPQ

SEQ ID NO: 191009 - protein, 9 aa, Homo Sapiens
PYGMLANGS

SEQ ID NO: 191010 - protein, 9 aa, Homo Sapiens
PVLISEGKY

SEQ ID NO: 191011 - protein, 9 aa, Homo Sapiens
SDGELAPLH

SEQ ID NO: 191012 - protein, 9 aa, Homo Sapiens
IATSARTAA

SEQ ID NO: 191013 - protein, 9 aa, Homo Sapiens
HCFCPSPRD

SEQ ID NO: 191014 - protein, 9 aa, Homo Sapiens
LHGLSGNPG

SEQ ID NO: 191015 - protein, 9 aa, Homo Sapiens
DVLNLSISG

SEQ ID NO: 191016 - protein, 9 aa, Homo Sapiens
KSRERSGGS

SEQ ID NO: 191017 - protein, 9 aa, Homo Sapiens
PANGAGWPC

SEQ ID NO: 191018 - protein, 9 aa, Homo Sapiens
ETEGLTYQV

SEQ ID NO: 191019 - protein, 9 aa, Homo Sapiens
IHPYLGDMT

SEQ ID NO: 191020 - protein, 9 aa, Homo Sapiens
VHRKQYHLT

SEQ ID NO: 191021 - protein, 9 aa, Homo Sapiens
QEGKDSTHL

SEQ ID NO: 191022 - protein, 9 aa, Homo Sapiens
QMGGPGAEE

SEQ ID NO: 191023 - protein, 9 aa, Homo Sapiens
KYEWAVREV

SEQ ID NO: 191024 - protein, 9 aa, Homo Sapiens
WKVFEEWKE

SEQ ID NO: 191025 - protein, 9 aa, Homo Sapiens
HPGTPSLHP

SEQ ID NO: 191026 - protein, 9 aa, Homo Sapiens
NWAYRDHLD

SEQ ID NO: 191027 - protein, 9 aa, Homo Sapiens
QKPESLGKR

SEQ ID NO: 191028 - protein, 9 aa, Homo Sapiens
IMTRKLLRR

SEQ ID NO: 191029 - protein, 9 aa, Homo Sapiens
PNSKHFWTT

SEQ ID NO: 191030 - protein, 9 aa, Homo Sapiens
ELDEDPAAD

SEQ ID NO: 191031 - protein, 9 aa, Homo Sapiens
EDQLVQQET

SEQ ID NO: 191032 - protein, 9 aa, Homo Sapiens
TANLLANDM

SEQ ID NO: 191033 - protein, 9 aa, Homo Sapiens
LNGGECVLY

SEQ ID NO: 191034 - protein, 9 aa, Homo Sapiens
PMMVDSQLY

SEQ ID NO: 191035 - protein, 9 aa, Homo Sapiens
EFYQAAHHA

SEQ ID NO: 191036 - protein, 9 aa, Homo Sapiens
GWTGWFPSN

SEQ ID NO: 191037 - protein, 9 aa, Homo Sapiens
PGQPGERGL

SEQ ID NO: 191038 - protein, 9 aa, Homo Sapiens
TYELKKKTY

SEQ ID NO: 191039 - protein, 9 aa, Homo Sapiens
DKIVASNLM

SEQ ID NO: 191040 - protein, 9 aa, Homo Sapiens
CQQTCIKLE

SEQ ID NO: 191041 - protein, 9 aa, Homo Sapiens
TRGRYAGTM

SEQ ID NO: 191042 - protein, 9 aa, Homo Sapiens
NGSVLHDAV

SEQ ID NO: 191043 - protein, 9 aa, Homo Sapiens
QPHRGAQCH

SEQ ID NO: 191044 - protein, 9 aa, Homo Sapiens
SHRNPRTNI

SEQ ID NO: 191045 - protein, 9 aa, Homo Sapiens
SSDVFFFTD

SEQ ID NO: 191046 - protein, 9 aa, Homo Sapiens
LADEIDFED

SEQ ID NO: 191047 - protein, 9 aa, Homo Sapiens
QVVQNAASI

SEQ ID NO: 191048 - protein, 9 aa, Homo Sapiens
FPIKWMAPE

SEQ ID NO: 191049 - protein, 9 aa, Homo Sapiens
DTELENFTP

SEQ ID NO: 191050 - protein, 9 aa, Homo Sapiens
IILHSMHKH

SEQ ID NO: 191051 - protein, 9 aa, Homo Sapiens
DTSTTSPVD

SEQ ID NO: 191052 - protein, 9 aa, Homo Sapiens
GSRRQGKEW

SEQ ID NO: 191053 - protein, 9 aa, Homo Sapiens
KPLQGVEIA

SEQ ID NO: 191054 - protein, 9 aa, Homo Sapiens
SLARRPPEA

SEQ ID NO: 191055 - protein, 9 aa, Homo Sapiens
HSNELAIFS

SEQ ID NO: 191056 - protein, 9 aa, Homo Sapiens
PLPSSSISG

SEQ ID NO: 191057 - protein, 9 aa, Homo Sapiens
KPPWPALDA

SEQ ID NO: 191058 - protein, 9 aa, Homo Sapiens
PPPTPRLNA

SEQ ID NO: 191059 - protein, 9 aa, Homo Sapiens
RRGGDGLYL

SEQ ID NO: 191060 - protein, 9 aa, Homo Sapiens
IAGREQFHG

SEQ ID NO: 191061 - protein, 9 aa, Homo Sapiens
WEDRSSTPT

SEQ ID NO: 191062 - protein, 9 aa, Homo Sapiens
DRDVLKQSL

SEQ ID NO: 191063 - protein, 9 aa, Homo Sapiens
DPPSGTPPS

SEQ ID NO: 191064 - protein, 9 aa, Homo Sapiens
PGNHGFPGQ

SEQ ID NO: 191065 - protein, 9 aa, Homo Sapiens
RATAWESHA

SEQ ID NO: 191066 - protein, 9 aa, Homo Sapiens
TCSVRSFMD

SEQ ID NO: 191067 - protein, 9 aa, Homo Sapiens
LPSQDLHLP

SEQ ID NO: 191068 - protein, 9 aa, Homo Sapiens
MCQLNGFQQ

SEQ ID NO: 191069 - protein, 9 aa, Homo Sapiens
GPPQTHAQC

SEQ ID NO: 191070 - protein, 9 aa, Homo Sapiens
TMMYYGLPF

SEQ ID NO: 191071 - protein, 9 aa, Homo Sapiens
SANIFQDTE

SEQ ID NO: 191072 - protein, 9 aa, Homo Sapiens
WQDVAKQMC

SEQ ID NO: 191073 - protein, 9 aa, Homo Sapiens
RRFPGFSYI

SEQ ID NO: 191074 - protein, 9 aa, Homo Sapiens
LPRGPLVVG

SEQ ID NO: 191075 - protein, 9 aa, Homo Sapiens
IVNINRALQ

SEQ ID NO: 191076 - protein, 9 aa, Homo Sapiens
VQRRCRQPH

SEQ ID NO: 191077 - protein, 9 aa, Homo Sapiens
IADWAQIFL

SEQ ID NO: 191078 - protein, 9 aa, Homo Sapiens
PQKPTRKIS

SEQ ID NO: 191079 - protein, 9 aa, Homo Sapiens
LVDSLTDAS

SEQ ID NO: 191080 - protein, 9 aa, Homo Sapiens
SQLGDLSNW

SEQ ID NO: 191081 - protein, 9 aa, Homo Sapiens
FLDWADVRL

SEQ ID NO: 191082 - protein, 9 aa, Homo Sapiens
RPRPRLTPS

SEQ ID NO: 191083 - protein, 9 aa, Homo Sapiens
SVRSFMDLK

SEQ ID NO: 191084 - protein, 9 aa, Homo Sapiens
DYFSRSNHR

SEQ ID NO: 191085 - protein, 9 aa, Homo Sapiens
DFEMPQSSG

SEQ ID NO: 191086 - protein, 9 aa, Homo Sapiens
HPNSGGFHP

SEQ ID NO: 191087 - protein, 9 aa, Homo Sapiens
ELEHEAILQ

SEQ ID NO: 191088 - protein, 9 aa, Homo Sapiens
KEPRIQLQK

SEQ ID NO: 191089 - protein, 9 aa, Homo Sapiens
PHRHHRHRD

SEQ ID NO: 191090 - protein, 9 aa, Homo Sapiens
KGDIGMKGD

SEQ ID NO: 191091 - protein, 9 aa, Homo Sapiens
VDHSVQINS

SEQ ID NO: 191092 - protein, 9 aa, Homo Sapiens
DRKMGKQAF

SEQ ID NO: 191093 - protein, 9 aa, Homo Sapiens
DDEDGNYLH

SEQ ID NO: 191094 - protein, 9 aa, Homo Sapiens
ASLSSMSLR

SEQ ID NO: 191095 - protein, 9 aa, Homo Sapiens
DMVASMEDQ

SEQ ID NO: 191096 - protein, 9 aa, Homo Sapiens
PLVDIHVLQ

SEQ ID NO: 191097 - protein, 9 aa, Homo Sapiens
GGREPAPGA

SEQ ID NO: 191098 - protein, 9 aa, Homo Sapiens
VKRRMRGLV

SEQ ID NO: 191099 - protein, 9 aa, Homo Sapiens
QINNADIGD

SEQ ID NO: 191100 - protein, 9 aa, Homo Sapiens
RGRYAGTMD

SEQ ID NO: 191101 - protein, 9 aa, Homo Sapiens
KPLSQVTSL

SEQ ID NO: 191102 - protein, 9 aa, Homo Sapiens
AASAGVLIL

SEQ ID NO: 191103 - protein, 9 aa, Homo Sapiens
AFRNQSMLK

SEQ ID NO: 191104 - protein, 9 aa, Homo Sapiens
SKYEEMCPP

SEQ ID NO: 191105 - protein, 9 aa, Homo Sapiens
MWFCTYMWG

SEQ ID NO: 191106 - protein, 9 aa, Homo Sapiens
GNESRECAH

SEQ ID NO: 191107 - protein, 9 aa, Homo Sapiens
ASHQRSSFN

SEQ ID NO: 191108 - protein, 9 aa, Homo Sapiens
EDRVKQNIY

SEQ ID NO: 191109 - protein, 9 aa, Homo Sapiens
AEFDDRQGV

SEQ ID NO: 191110 - protein, 9 aa, Homo Sapiens
PCVLTQACS

SEQ ID NO: 191111 - protein, 9 aa, Homo Sapiens
AIKPPHEEF

SEQ ID NO: 191112 - protein, 9 aa, Homo Sapiens
TGTREAHDI

SEQ ID NO: 191113 - protein, 9 aa, Homo Sapiens
QMTPTNLAM

SEQ ID NO: 191114 - protein, 9 aa, Homo Sapiens
PQQPPPRLP

SEQ ID NO: 191115 - protein, 9 aa, Homo Sapiens
YECSGCGKS

SEQ ID NO: 191116 - protein, 9 aa, Homo Sapiens
NSIPKHAIW

SEQ ID NO: 191117 - protein, 9 aa, Homo Sapiens
LAQLTKPSM

SEQ ID NO: 191118 - protein, 9 aa, Homo Sapiens
LNPKAMTLD

SEQ ID NO: 191119 - protein, 9 aa, Homo Sapiens
CQLQHSGPR

SEQ ID NO: 191120 - protein, 9 aa, Homo Sapiens
YDLGHVERI

SEQ ID NO: 191121 - protein, 9 aa, Homo Sapiens
LQEHTVAYI

SEQ ID NO: 191122 - protein, 9 aa, Homo Sapiens
CKPMMVDSQ

SEQ ID NO: 191123 - protein, 9 aa, Homo Sapiens
FRQKTILVA

SEQ ID NO: 191124 - protein, 9 aa, Homo Sapiens
DFHMDTIVF

SEQ ID NO: 191125 - protein, 9 aa, Homo Sapiens
PQGGTSSSI

SEQ ID NO: 191126 - protein, 9 aa, Homo Sapiens
QNMFQKLVD

SEQ ID NO: 191127 - protein, 9 aa, Homo Sapiens
PTSMATDQK

SEQ ID NO: 191128 - protein, 9 aa, Homo Sapiens
DRSHGKRFS

SEQ ID NO: 191129 - protein, 9 aa, Homo Sapiens
QLWWAANEL

SEQ ID NO: 191130 - protein, 9 aa, Homo Sapiens
PYECIKCVK

SEQ ID NO: 191131 - protein, 9 aa, Homo Sapiens
WHIYFRKEF

SEQ ID NO: 191132 - protein, 9 aa, Homo Sapiens
TPPHHSSGS

SEQ ID NO: 191133 - protein, 9 aa, Homo Sapiens
RQYRISPTV

SEQ ID NO: 191134 - protein, 9 aa, Homo Sapiens
LEFMYQLPA

SEQ ID NO: 191135 - protein, 9 aa, Homo Sapiens
RTEKDNATL

SEQ ID NO: 191136 - protein, 9 aa, Homo Sapiens
FYHDMDPNE

SEQ ID NO: 191137 - protein, 9 aa, Homo Sapiens
PSLSGQTKP

SEQ ID NO: 191138 - protein, 9 aa, Homo Sapiens
DLHFHFTVR

SEQ ID NO: 191139 - protein, 9 aa, Homo Sapiens
SDLLELQGQ

SEQ ID NO: 191140 - protein, 9 aa, Homo Sapiens
KHFWTTVGS

SEQ ID NO: 191141 - protein, 9 aa, Homo Sapiens
VCLQLRCPR

SEQ ID NO: 191142 - protein, 9 aa, Homo Sapiens
ILMGLTLSD

SEQ ID NO: 191143 - protein, 9 aa, Homo Sapiens
VCQEKQKET

SEQ ID NO: 191144 - protein, 9 aa, Homo Sapiens
AWGSLEEQL

SEQ ID NO: 191145 - protein, 9 aa, Homo Sapiens
DKECQLKEL

SEQ ID NO: 191146 - protein, 9 aa, Homo Sapiens
GVDPPHRHH

SEQ ID NO: 191147 - protein, 9 aa, Homo Sapiens
AATRPKSAF

SEQ ID NO: 191148 - protein, 9 aa, Homo Sapiens
RHLCELGAD

SEQ ID NO: 191149 - protein, 9 aa, Homo Sapiens
FIRPRWIYS

SEQ ID NO: 191150 - protein, 9 aa, Homo Sapiens
DYLQRAAEK

SEQ ID NO: 191151 - protein, 9 aa, Homo Sapiens
VPALSGQVL

SEQ ID NO: 191152 - protein, 9 aa, Homo Sapiens
TSTWNSIVS

SEQ ID NO: 191153 - protein, 9 aa, Homo Sapiens
ATSRATGLF

SEQ ID NO: 191154 - protein, 9 aa, Homo Sapiens
IMDKALQKR

SEQ ID NO: 191155 - protein, 9 aa, Homo Sapiens
WSPPLTAIH

SEQ ID NO: 191156 - protein, 9 aa, Homo Sapiens
SMATDQKQK

SEQ ID NO: 191157 - protein, 9 aa, Homo Sapiens
LPLPPGAAS

SEQ ID NO: 191158 - protein, 9 aa, Homo Sapiens
TPGASPHHC

SEQ ID NO: 191159 - protein, 9 aa, Homo Sapiens
AIREIDDSI

SEQ ID NO: 191160 - protein, 9 aa, Homo Sapiens
DALYPNRVH

SEQ ID NO: 191161 - protein, 9 aa, Homo Sapiens
SKNCSSRRC

SEQ ID NO: 191162 - protein, 9 aa, Homo Sapiens
HGDRSHGKR

SEQ ID NO: 191163 - protein, 9 aa, Homo Sapiens
GDAIREIDD

SEQ ID NO: 191164 - protein, 9 aa, Homo Sapiens
CRFLLAHVL

SEQ ID NO: 191165 - protein, 9 aa, Homo Sapiens
SVELHSLQS

SEQ ID NO: 191166 - protein, 9 aa, Homo Sapiens
VLGAKTGLA

SEQ ID NO: 191167 - protein, 9 aa, Homo Sapiens
ILFYRKTIV

SEQ ID NO: 191168 - protein, 9 aa, Homo Sapiens
EMCPPEIGD

SEQ ID NO: 191169 - protein, 9 aa, Homo Sapiens
VKRLMKEVA

SEQ ID NO: 191170 - protein, 9 aa, Homo Sapiens
DQQTFTRSV

SEQ ID NO: 191171 - protein, 9 aa, Homo Sapiens
PLQCHAVGP

SEQ ID NO: 191172 - protein, 9 aa, Homo Sapiens
KYLTHFLKE

SEQ ID NO: 191173 - protein, 9 aa, Homo Sapiens
ERHSCDTLN

SEQ ID NO: 191174 - protein, 9 aa, Homo Sapiens
LGDPGLQGT

SEQ ID NO: 191175 - protein, 9 aa, Homo Sapiens
HPRPGSVGG

SEQ ID NO: 191176 - protein, 9 aa, Homo Sapiens
TSSTAMAQT

SEQ ID NO: 191177 - protein, 9 aa, Homo Sapiens
CSDLHDDMF

SEQ ID NO: 191178 - protein, 9 aa, Homo Sapiens
PAPPILPWR

SEQ ID NO: 191179 - protein, 9 aa, Homo Sapiens
LEYLKIPDE

SEQ ID NO: 191180 - protein, 9 aa, Homo Sapiens
HHGLTQKMI

SEQ ID NO: 191181 - protein, 9 aa, Homo Sapiens
ARKYPHSWM

SEQ ID NO: 191182 - protein, 9 aa, Homo Sapiens
MHVPAIPPN

SEQ ID NO: 191183 - protein, 9 aa, Homo Sapiens
GRAVLSASQ

SEQ ID NO: 191184 - protein, 9 aa, Homo Sapiens
ISFLFHTGQ

SEQ ID NO: 191185 - protein, 9 aa, Homo Sapiens
LSELEATLQ

SEQ ID NO: 191186 - protein, 9 aa, Homo Sapiens
CLQQFGFKA

SEQ ID NO: 191187 - protein, 9 aa, Homo Sapiens
HVGHAGHTS

SEQ ID NO: 191188 - protein, 9 aa, Homo Sapiens
RVDRIIMLF

SEQ ID NO: 191189 - protein, 9 aa, Homo Sapiens
SDGTCALWD

SEQ ID NO: 191190 - protein, 9 aa, Homo Sapiens
HGIWSPGIL

SEQ ID NO: 191191 - protein, 9 aa, Homo Sapiens
ELELLMCSL

SEQ ID NO: 191192 - protein, 9 aa, Homo Sapiens
VDLQELALN

SEQ ID NO: 191193 - protein, 9 aa, Homo Sapiens
RTTSAGGNT

SEQ ID NO: 191194 - protein, 9 aa, Homo Sapiens
TARGVGLAG

SEQ ID NO: 191195 - protein, 9 aa, Homo Sapiens
GCLRLGIRG

SEQ ID NO: 191196 - protein, 9 aa, Homo Sapiens
KEEIKEIHG

SEQ ID NO: 191197 - protein, 9 aa, Homo Sapiens
PDETILHAF

SEQ ID NO: 191198 - protein, 9 aa, Homo Sapiens
SCNSSFCMC

SEQ ID NO: 191199 - protein, 9 aa, Homo Sapiens
PILGHFVAE

SEQ ID NO: 191200 - protein, 9 aa, Homo Sapiens
TLSSSLSQV

SEQ ID NO: 191201 - protein, 9 aa, Homo Sapiens
VSGYRHIIK

SEQ ID NO: 191202 - protein, 9 aa, Homo Sapiens
GHVLVTGSV

SEQ ID NO: 191203 - protein, 9 aa, Homo Sapiens
SQMPFVPAV

SEQ ID NO: 191204 - protein, 9 aa, Homo Sapiens
ADVNAQNWL

SEQ ID NO: 191205 - protein, 9 aa, Homo Sapiens
SGEHTMEVR

SEQ ID NO: 191206 - protein, 9 aa, Homo Sapiens
ERESLLQRT

SEQ ID NO: 191207 - protein, 9 aa, Homo Sapiens
INLMELKLM

SEQ ID NO: 191208 - protein, 9 aa, Homo Sapiens
GPSFPMCPP

SEQ ID NO: 191209 - protein, 9 aa, Homo Sapiens
FCCGQCGRT

SEQ ID NO: 191210 - protein, 9 aa, Homo Sapiens
HSNLTRHQL

SEQ ID NO: 191211 - protein, 9 aa, Homo Sapiens
FHRIVTYHH

SEQ ID NO: 191212 - protein, 9 aa, Homo Sapiens
HTRWVAPVE

SEQ ID NO: 191213 - protein, 9 aa, Homo Sapiens
RPFGCDECT

SEQ ID NO: 191214 - protein, 9 aa, Homo Sapiens
PPETQVSCL

SEQ ID NO: 191215 - protein, 9 aa, Homo Sapiens
ENKKTVPPK

SEQ ID NO: 191216 - protein, 9 aa, Homo Sapiens
EQLQAQIWN

SEQ ID NO: 191217 - protein, 9 aa, Homo Sapiens
PPLLTSTFL

SEQ ID NO: 191218 - protein, 9 aa, Homo Sapiens
KRASQTYEK

SEQ ID NO: 191219 - protein, 9 aa, Homo Sapiens
VVKERLQQS

SEQ ID NO: 191220 - protein, 9 aa, Homo Sapiens
HVCTLEANS

SEQ ID NO: 191221 - protein, 9 aa, Homo Sapiens
GDFSADEVF

SEQ ID NO: 191222 - protein, 9 aa, Homo Sapiens
VEVIIIEST

SEQ ID NO: 191223 - protein, 9 aa, Homo Sapiens
TYLCVLLEQ

SEQ ID NO: 191224 - protein, 9 aa, Homo Sapiens
RTMTTKNVH

SEQ ID NO: 191225 - protein, 9 aa, Homo Sapiens
VVEKVYQPV

SEQ ID NO: 191226 - protein, 9 aa, Homo Sapiens
SFLILLFQR

SEQ ID NO: 191227 - protein, 9 aa, Homo Sapiens
CALYIGIED

SEQ ID NO: 191228 - protein, 9 aa, Homo Sapiens
EELVDDHSR

SEQ ID NO: 191229 - protein, 9 aa, Homo Sapiens
STLSLSSVS

SEQ ID NO: 191230 - protein, 9 aa, Homo Sapiens
CMAAWLMAV

SEQ ID NO: 191231 - protein, 9 aa, Homo Sapiens
NSGCGQTPI

SEQ ID NO: 191232 - protein, 9 aa, Homo Sapiens
GVYFELPDL

SEQ ID NO: 191233 - protein, 9 aa, Homo Sapiens
PERKGSPMP

SEQ ID NO: 191234 - protein, 9 aa, Homo Sapiens
QCKQEQREA

SEQ ID NO: 191235 - protein, 9 aa, Homo Sapiens
PGGAAMKAS

SEQ ID NO: 191236 - protein, 9 aa, Homo Sapiens
QQTAIHQVP

SEQ ID NO: 191237 - protein, 9 aa, Homo Sapiens
LGGPECCLC

SEQ ID NO: 191238 - protein, 9 aa, Homo Sapiens
CLSFVYNHY

SEQ ID NO: 191239 - protein, 9 aa, Homo Sapiens
MNVTHSHMQ

SEQ ID NO: 191240 - protein, 9 aa, Homo Sapiens
YHLLHRYCV

SEQ ID NO: 191241 - protein, 9 aa, Homo Sapiens
HHLQGEADP

SEQ ID NO: 191242 - protein, 9 aa, Homo Sapiens
LSHEIIIWS

SEQ ID NO: 191243 - protein, 9 aa, Homo Sapiens
SGGVMATTG

SEQ ID NO: 191244 - protein, 9 aa, Homo Sapiens
EYLKREEEI

SEQ ID NO: 191245 - protein, 9 aa, Homo Sapiens
AGKAMEQGG

SEQ ID NO: 191246 - protein, 9 aa, Homo Sapiens
GFTDIVTMQ

SEQ ID NO: 191247 - protein, 9 aa, Homo Sapiens
YTRIPQVHW

SEQ ID NO: 191248 - protein, 9 aa, Homo Sapiens
KVGVGASKE

SEQ ID NO: 191249 - protein, 9 aa, Homo Sapiens
AYVGAYAPC

SEQ ID NO: 191250 - protein, 9 aa, Homo Sapiens
TCNHCACRL

SEQ ID NO: 191251 - protein, 9 aa, Homo Sapiens
RYRRVITVY

SEQ ID NO: 191252 - protein, 9 aa, Homo Sapiens
MLALPSLVP

SEQ ID NO: 191253 - protein, 9 aa, Homo Sapiens
ITDYMGIQN

SEQ ID NO: 191254 - protein, 9 aa, Homo Sapiens
NIIHVTGMK

SEQ ID NO: 191255 - protein, 9 aa, Homo Sapiens
WRKECTVAL

SEQ ID NO: 191256 - protein, 9 aa, Homo Sapiens
HGKSFYSSN

SEQ ID NO: 191257 - protein, 9 aa, Homo Sapiens
EGHFNNGNH

SEQ ID NO: 191258 - protein, 9 aa, Homo Sapiens
SKKHSDPSQ

SEQ ID NO: 191259 - protein, 9 aa, Homo Sapiens
SVVKAVFWL

SEQ ID NO: 191260 - protein, 9 aa, Homo Sapiens
SPVSTGLPT

SEQ ID NO: 191261 - protein, 9 aa, Homo Sapiens
GGVPERQGS

SEQ ID NO: 191262 - protein, 9 aa, Homo Sapiens
DAVAAADSP

SEQ ID NO: 191263 - protein, 9 aa, Homo Sapiens
IKTTLQRAL

SEQ ID NO: 191264 - protein, 9 aa, Homo Sapiens
WGKCSVTLL

SEQ ID NO: 191265 - protein, 9 aa, Homo Sapiens
GRDKTRKRC

SEQ ID NO: 191266 - protein, 9 aa, Homo Sapiens
RGGQSRTIR

SEQ ID NO: 191267 - protein, 9 aa, Homo Sapiens
SQGSWELLL

SEQ ID NO: 191268 - protein, 9 aa, Homo Sapiens
YTIHILLWT

SEQ ID NO: 191269 - protein, 9 aa, Homo Sapiens
GARRSYCAP

SEQ ID NO: 191270 - protein, 9 aa, Homo Sapiens
PASSSAPVP

SEQ ID NO: 191271 - protein, 9 aa, Homo Sapiens
LKAHSFERG

SEQ ID NO: 191272 - protein, 9 aa, Homo Sapiens
CCDAAQFRL

SEQ ID NO: 191273 - protein, 9 aa, Homo Sapiens
WGTSSCLLR

SEQ ID NO: 191274 - protein, 9 aa, Homo Sapiens
QQLPKATLQ

SEQ ID NO: 191275 - protein, 9 aa, Homo Sapiens
VVDKGRILS

SEQ ID NO: 191276 - protein, 9 aa, Homo Sapiens
GLTHMNISA

SEQ ID NO: 191277 - protein, 9 aa, Homo Sapiens
LLLHSPGFR

SEQ ID NO: 191278 - protein, 9 aa, Homo Sapiens
GKPFGVFLM

SEQ ID NO: 191279 - protein, 9 aa, Homo Sapiens
GSIHYSSVP

SEQ ID NO: 191280 - protein, 9 aa, Homo Sapiens
AWLPYHVLQ

SEQ ID NO: 191281 - protein, 9 aa, Homo Sapiens
VTTSVQLQT

SEQ ID NO: 191282 - protein, 9 aa, Homo Sapiens
RFHFTLEAP

SEQ ID NO: 191283 - protein, 9 aa, Homo Sapiens
GCGSTPPPP

SEQ ID NO: 191284 - protein, 9 aa, Homo Sapiens
PAPAPAPPA

SEQ ID NO: 191285 - protein, 9 aa, Homo Sapiens
ELLLRMATE

SEQ ID NO: 191286 - protein, 9 aa, Homo Sapiens
MAVVPLTTF

SEQ ID NO: 191287 - protein, 9 aa, Homo Sapiens
VAGDRGLVC

SEQ ID NO: 191288 - protein, 9 aa, Homo Sapiens
QSMLKTHMR

SEQ ID NO: 191289 - protein, 9 aa, Homo Sapiens
EAYMHVLEG

SEQ ID NO: 191290 - protein, 9 aa, Homo Sapiens
NLDVFIKKS

SEQ ID NO: 191291 - protein, 9 aa, Homo Sapiens
ERKRASQTY

SEQ ID NO: 191292 - protein, 9 aa, Homo Sapiens
PLKLAGWQC

SEQ ID NO: 191293 - protein, 9 aa, Homo Sapiens
PPWIDGRKL

SEQ ID NO: 191294 - protein, 9 aa, Homo Sapiens
PENLCLINE

SEQ ID NO: 191295 - protein, 9 aa, Homo Sapiens
ELAIFSEGG

SEQ ID NO: 191296 - protein, 9 aa, Homo Sapiens
QHKLWVGYQ

SEQ ID NO: 191297 - protein, 9 aa, Homo Sapiens
AACGGRERR

SEQ ID NO: 191298 - protein, 9 aa, Homo Sapiens
CYQSSPAKP

SEQ ID NO: 191299 - protein, 9 aa, Homo Sapiens
LPPGAASSP

SEQ ID NO: 191300 - protein, 9 aa, Homo Sapiens
MTSHPRGVK

SEQ ID NO: 191301 - protein, 9 aa, Homo Sapiens
RHHILFRYA

SEQ ID NO: 191302 - protein, 9 aa, Homo Sapiens
PDSDKCREI

SEQ ID NO: 191303 - protein, 9 aa, Homo Sapiens
IPCKDSRFP

SEQ ID NO: 191304 - protein, 9 aa, Homo Sapiens
NPSGSHKVS

SEQ ID NO: 191305 - protein, 9 aa, Homo Sapiens
LEMATIRHR

SEQ ID NO: 191306 - protein, 9 aa, Homo Sapiens
PSRLYYIDA

SEQ ID NO: 191307 - protein, 9 aa, Homo Sapiens
QVEPQAKKP

SEQ ID NO: 191308 - protein, 9 aa, Homo Sapiens
PPVSKNCSS

SEQ ID NO: 191309 - protein, 9 aa, Homo Sapiens
PGNGGTASL

SEQ ID NO: 191310 - protein, 9 aa, Homo Sapiens
DATLLIVNC

SEQ ID NO: 191311 - protein, 9 aa, Homo Sapiens
LDVVMPAVK

SEQ ID NO: 191312 - protein, 9 aa, Homo Sapiens
SQVTSLANL

SEQ ID NO: 191313 - protein, 9 aa, Homo Sapiens
RFIKYNIWC

SEQ ID NO: 191314 - protein, 9 aa, Homo Sapiens
ICVGIPPDE

SEQ ID NO: 191315 - protein, 9 aa, Homo Sapiens
KECDRQKQK

SEQ ID NO: 191316 - protein, 9 aa, Homo Sapiens
SNKVGQDEQ

SEQ ID NO: 191317 - protein, 9 aa, Homo Sapiens
QNAQVHPLV

SEQ ID NO: 191318 - protein, 9 aa, Homo Sapiens
KGKKSCHTT

SEQ ID NO: 191319 - protein, 9 aa, Homo Sapiens
LTCIEPPQH

SEQ ID NO: 191320 - protein, 9 aa, Homo Sapiens
NFNMEAFTE

SEQ ID NO: 191321 - protein, 9 aa, Homo Sapiens
QTHAQCSSW

SEQ ID NO: 191322 - protein, 9 aa, Homo Sapiens
QEVVRDLVH

SEQ ID NO: 191323 - protein, 9 aa, Homo Sapiens
HACNHVAHT

SEQ ID NO: 191324 - protein, 9 aa, Homo Sapiens
AEYIYQRQP

SEQ ID NO: 191325 - protein, 9 aa, Homo Sapiens
PTNLAMCLA

SEQ ID NO: 191326 - protein, 9 aa, Homo Sapiens
TVWDLWAKQ

SEQ ID NO: 191327 - protein, 9 aa, Homo Sapiens
LLSSSLPRG

SEQ ID NO: 191328 - protein, 9 aa, Homo Sapiens
VKAKKRIPP

SEQ ID NO: 191329 - protein, 9 aa, Homo Sapiens
LHTYGMFSV

SEQ ID NO: 191330 - protein, 9 aa, Homo Sapiens
VEKQESIHS

SEQ ID NO: 191331 - protein, 9 aa, Homo Sapiens
TLPTRRGLA

SEQ ID NO: 191332 - protein, 9 aa, Homo Sapiens
RWLWQLQAQ

SEQ ID NO: 191333 - protein, 9 aa, Homo Sapiens
FWTLLPTTG

SEQ ID NO: 191334 - protein, 9 aa, Homo Sapiens
PPDGDWGWV

SEQ ID NO: 191335 - protein, 9 aa, Homo Sapiens
IQTAFRQYH

SEQ ID NO: 191336 - protein, 9 aa, Homo Sapiens
LVSLSLFSC

SEQ ID NO: 191337 - protein, 9 aa, Homo Sapiens
VDFCIHVEN

SEQ ID NO: 191338 - protein, 9 aa, Homo Sapiens
EMKGWRLDL

SEQ ID NO: 191339 - protein, 9 aa, Homo Sapiens
GRLQAILQN

SEQ ID NO: 191340 - protein, 9 aa, Homo Sapiens
LASRHSSLS

SEQ ID NO: 191341 - protein, 9 aa, Homo Sapiens
LNLPPPHRP

SEQ ID NO: 191342 - protein, 9 aa, Homo Sapiens
ILAIEGTCS

SEQ ID NO: 191343 - protein, 9 aa, Homo Sapiens
DSVLGKMDK

SEQ ID NO: 191344 - protein, 9 aa, Homo Sapiens
SLPLLGYSM

SEQ ID NO: 191345 - protein, 9 aa, Homo Sapiens
TYGGWGARG

SEQ ID NO: 191346 - protein, 9 aa, Homo Sapiens
RTTPLADMT

SEQ ID NO: 191347 - protein, 9 aa, Homo Sapiens
ERPYECSGC

SEQ ID NO: 191348 - protein, 9 aa, Homo Sapiens
LATQGQLSA

SEQ ID NO: 191349 - protein, 9 aa, Homo Sapiens
ILSALTILW

SEQ ID NO: 191350 - protein, 9 aa, Homo Sapiens
STRLTHQRH

SEQ ID NO: 191351 - protein, 9 aa, Homo Sapiens
NCMEDESAK

SEQ ID NO: 191352 - protein, 9 aa, Homo Sapiens
GSGGVCIPE

SEQ ID NO: 191353 - protein, 9 aa, Homo Sapiens
EVERRKEQR

SEQ ID NO: 191354 - protein, 9 aa, Homo Sapiens
SDSDGQRCS

SEQ ID NO: 191355 - protein, 9 aa, Homo Sapiens
LGLSAVVWA

SEQ ID NO: 191356 - protein, 9 aa, Homo Sapiens
VEASGEHTM

SEQ ID NO: 191357 - protein, 9 aa, Homo Sapiens
KTAVASVIY

SEQ ID NO: 191358 - protein, 9 aa, Homo Sapiens
EIISPEKQH

SEQ ID NO: 191359 - protein, 9 aa, Homo Sapiens
HTEKLPAGA

SEQ ID NO: 191360 - protein, 9 aa, Homo Sapiens
VDQTLQERE

SEQ ID NO: 191361 - protein, 9 aa, Homo Sapiens
VLLAVTLVG

SEQ ID NO: 191362 - protein, 9 aa, Homo Sapiens
PACSALLPG

SEQ ID NO: 191363 - protein, 9 aa, Homo Sapiens
LSTWFTAVG

SEQ ID NO: 191364 - protein, 9 aa, Homo Sapiens
TLVEPVSAV

SEQ ID NO: 191365 - protein, 9 aa, Homo Sapiens
DGLLFDFVG

SEQ ID NO: 191366 - protein, 9 aa, Homo Sapiens
YKVENYLGN

SEQ ID NO: 191367 - protein, 9 aa, Homo Sapiens
CSDVLQEHF

SEQ ID NO: 191368 - protein, 9 aa, Homo Sapiens
ASQFLVSAS

SEQ ID NO: 191369 - protein, 9 aa, Homo Sapiens
PELLPTSTA

SEQ ID NO: 191370 - protein, 9 aa, Homo Sapiens
DGGDNNAPS

SEQ ID NO: 191371 - protein, 9 aa, Homo Sapiens
HHLWLQMDT

SEQ ID NO: 191372 - protein, 9 aa, Homo Sapiens
CSHCCPPCR

SEQ ID NO: 191373 - protein, 9 aa, Homo Sapiens
EKSSPSTEN

SEQ ID NO: 191374 - protein, 9 aa, Homo Sapiens
VGAVTGIVT

SEQ ID NO: 191375 - protein, 9 aa, Homo Sapiens
TAHAPGTPA

SEQ ID NO: 191376 - protein, 9 aa, Homo Sapiens
LLRISCRLS

SEQ ID NO: 191377 - protein, 9 aa, Homo Sapiens
LALLFPLKE

SEQ ID NO: 191378 - protein, 9 aa, Homo Sapiens
GCRVPRRDI

SEQ ID NO: 191379 - protein, 9 aa, Homo Sapiens
LAMEHEETK

SEQ ID NO: 191380 - protein, 9 aa, Homo Sapiens
EWARMITET

SEQ ID NO: 191381 - protein, 9 aa, Homo Sapiens
TGTAHAIQR

SEQ ID NO: 191382 - protein, 9 aa, Homo Sapiens
PLRCTIHLW

SEQ ID NO: 191383 - protein, 9 aa, Homo Sapiens
LPELAKVEE

SEQ ID NO: 191384 - protein, 9 aa, Homo Sapiens
AVDIEFVKL

SEQ ID NO: 191385 - protein, 9 aa, Homo Sapiens
AVLSASQLH

SEQ ID NO: 191386 - protein, 9 aa, Homo Sapiens
SAQTSRELT

SEQ ID NO: 191387 - protein, 9 aa, Homo Sapiens
VNFFGTLEL

SEQ ID NO: 191388 - protein, 9 aa, Homo Sapiens
MNVEQSFMT

SEQ ID NO: 191389 - protein, 9 aa, Homo Sapiens
ESALVSIYV

SEQ ID NO: 191390 - protein, 9 aa, Homo Sapiens
PFCPESPHY

SEQ ID NO: 191391 - protein, 9 aa, Homo Sapiens
MDEVQNHIK

SEQ ID NO: 191392 - protein, 9 aa, Homo Sapiens
DDLDHFIPL

SEQ ID NO: 191393 - protein, 9 aa, Homo Sapiens
EPKPAMACW

SEQ ID NO: 191394 - protein, 9 aa, Homo Sapiens
QLSGTPYKG

SEQ ID NO: 191395 - protein, 9 aa, Homo Sapiens
TCSLTLACS

SEQ ID NO: 191396 - protein, 9 aa, Homo Sapiens
GIALKMNEL

SEQ ID NO: 191397 - protein, 9 aa, Homo Sapiens
QAQLQLLQK

SEQ ID NO: 191398 - protein, 9 aa, Homo Sapiens
YKMCLKSQL

SEQ ID NO: 191399 - protein, 9 aa, Homo Sapiens
EMLCGHVPF

SEQ ID NO: 191400 - protein, 9 aa, Homo Sapiens
AEQHEKIKQ

SEQ ID NO: 191401 - protein, 9 aa, Homo Sapiens
CMGRQDQDT

SEQ ID NO: 191402 - protein, 9 aa, Homo Sapiens
FYGEGCSHC

SEQ ID NO: 191403 - protein, 9 aa, Homo Sapiens
TTPNQLLLI

SEQ ID NO: 191404 - protein, 9 aa, Homo Sapiens
AWVQKIKVA

SEQ ID NO: 191405 - protein, 9 aa, Homo Sapiens
QVVIEVNSW

SEQ ID NO: 191406 - protein, 9 aa, Homo Sapiens
VVGGARRSY

SEQ ID NO: 191407 - protein, 9 aa, Homo Sapiens
FYFLSYDEL

SEQ ID NO: 191408 - protein, 9 aa, Homo Sapiens
CDGRGMGCR

SEQ ID NO: 191409 - protein, 9 aa, Homo Sapiens
DGFINLMEL

SEQ ID NO: 191410 - protein, 9 aa, Homo Sapiens
HSTHVGHAG

SEQ ID NO: 191411 - protein, 9 aa, Homo Sapiens
RKEQRLPQD

SEQ ID NO: 191412 - protein, 9 aa, Homo Sapiens
FQSTNAGTS

SEQ ID NO: 191413 - protein, 9 aa, Homo Sapiens
FAKSSWAQQ

SEQ ID NO: 191414 - protein, 9 aa, Homo Sapiens
GYRMEQSRN

SEQ ID NO: 191415 - protein, 9 aa, Homo Sapiens
LKGMMRDEK

SEQ ID NO: 191416 - protein, 9 aa, Homo Sapiens
KRASVSFWT

SEQ ID NO: 191417 - protein, 9 aa, Homo Sapiens
HYERPLTQE

SEQ ID NO: 191418 - protein, 9 aa, Homo Sapiens
LCVSLMPLR

SEQ ID NO: 191419 - protein, 9 aa, Homo Sapiens
ISLNGKADV

SEQ ID NO: 191420 - protein, 9 aa, Homo Sapiens
CEEEVLDVD

SEQ ID NO: 191421 - protein, 9 aa, Homo Sapiens
ETTDPSTVS

SEQ ID NO: 191422 - protein, 9 aa, Homo Sapiens
EPTTTPDTM

SEQ ID NO: 191423 - protein, 9 aa, Homo Sapiens
VSSDVFFFT

SEQ ID NO: 191424 - protein, 9 aa, Homo Sapiens
EYLCPPWVL

SEQ ID NO: 191425 - protein, 9 aa, Homo Sapiens
RDWDRNLER

SEQ ID NO: 191426 - protein, 9 aa, Homo Sapiens
TLDFDLTAA

SEQ ID NO: 191427 - protein, 9 aa, Homo Sapiens
VMELLWPSL

SEQ ID NO: 191428 - protein, 9 aa, Homo Sapiens
AERVDRIIM

SEQ ID NO: 191429 - protein, 9 aa, Homo Sapiens
TDPSTVSSL

SEQ ID NO: 191430 - protein, 9 aa, Homo Sapiens
QRLGLAPPR

SEQ ID NO: 191431 - protein, 9 aa, Homo Sapiens
PLRPQRGPR

SEQ ID NO: 191432 - protein, 9 aa, Homo Sapiens
PKSVKSWEQ

SEQ ID NO: 191433 - protein, 9 aa, Homo Sapiens
GAPGNHGFP

SEQ ID NO: 191434 - protein, 9 aa, Homo Sapiens
EALVNNPRI

SEQ ID NO: 191435 - protein, 9 aa, Homo Sapiens
CILPTTAYT

SEQ ID NO: 191436 - protein, 9 aa, Homo Sapiens
SLPPSSHVR

SEQ ID NO: 191437 - protein, 9 aa, Homo Sapiens
LAGTANPMV

SEQ ID NO: 191438 - protein, 9 aa, Homo Sapiens
VRVTSSSVP

SEQ ID NO: 191439 - protein, 9 aa, Homo Sapiens
MAEEAGVEN

SEQ ID NO: 191440 - protein, 9 aa, Homo Sapiens
LEAAAGVLE

SEQ ID NO: 191441 - protein, 9 aa, Homo Sapiens
VLLTNERYL

SEQ ID NO: 191442 - protein, 9 aa, Homo Sapiens
PKRQFVPSY

SEQ ID NO: 191443 - protein, 9 aa, Homo Sapiens
LEAAWRVEK

SEQ ID NO: 191444 - protein, 9 aa, Homo Sapiens
YGEGCSHCC

SEQ ID NO: 191445 - protein, 9 aa, Homo Sapiens
PTSTAALEA

SEQ ID NO: 191446 - protein, 9 aa, Homo Sapiens
RELLRRCYQ

SEQ ID NO: 191447 - protein, 9 aa, Homo Sapiens
VSCVRTVMN

SEQ ID NO: 191448 - protein, 9 aa, Homo Sapiens
HVHLAQIQI

SEQ ID NO: 191449 - protein, 9 aa, Homo Sapiens
PGLQGTTEP

SEQ ID NO: 191450 - protein, 9 aa, Homo Sapiens
RLVVRFTAL

SEQ ID NO: 191451 - protein, 9 aa, Homo Sapiens
VAHVRAQEH

SEQ ID NO: 191452 - protein, 9 aa, Homo Sapiens
KSEDVVLQW

SEQ ID NO: 191453 - protein, 9 aa, Homo Sapiens
HNQVGETSL

SEQ ID NO: 191454 - protein, 9 aa, Homo Sapiens
RKMGKQAFM

SEQ ID NO: 191455 - protein, 9 aa, Homo Sapiens
WYVTCAIHN

SEQ ID NO: 191456 - protein, 9 aa, Homo Sapiens
KAKSRPVQG

SEQ ID NO: 191457 - protein, 9 aa, Homo Sapiens
LENVPGIFI

SEQ ID NO: 191458 - protein, 9 aa, Homo Sapiens
DSEEGSDEM

SEQ ID NO: 191459 - protein, 9 aa, Homo Sapiens
LKERAINGL

SEQ ID NO: 191460 - protein, 9 aa, Homo Sapiens
GGALEMKGW

SEQ ID NO: 191461 - protein, 9 aa, Homo Sapiens
TEIVLESDY

SEQ ID NO: 191462 - protein, 9 aa, Homo Sapiens
TDGKSIAIH

SEQ ID NO: 191463 - protein, 9 aa, Homo Sapiens
DSVTKPENE

SEQ ID NO: 191464 - protein, 9 aa, Homo Sapiens
VYIYNIFKT

SEQ ID NO: 191465 - protein, 9 aa, Homo Sapiens
HRGPVSGLW

SEQ ID NO: 191466 - protein, 9 aa, Homo Sapiens
QLQAECRLQ

SEQ ID NO: 191467 - protein, 9 aa, Homo Sapiens
PSLARRPPE

SEQ ID NO: 191468 - protein, 9 aa, Homo Sapiens
PGMPSFVQV

SEQ ID NO: 191469 - protein, 9 aa, Homo Sapiens
ECLDNFKGK

SEQ ID NO: 191470 - protein, 9 aa, Homo Sapiens
MWTVVTSSG

SEQ ID NO: 191471 - protein, 9 aa, Homo Sapiens
DHQKRLSYP

SEQ ID NO: 191472 - protein, 9 aa, Homo Sapiens
WAYRDHLDP

SEQ ID NO: 191473 - protein, 9 aa, Homo Sapiens
CHKVYQCST

SEQ ID NO: 191474 - protein, 9 aa, Homo Sapiens
KDNGDEVIS

SEQ ID NO: 191475 - protein, 9 aa, Homo Sapiens
QLQGTTSTA

SEQ ID NO: 191476 - protein, 9 aa, Homo Sapiens
KQIIAGKAM

SEQ ID NO: 191477 - protein, 9 aa, Homo Sapiens
SCTMCSLAN

SEQ ID NO: 191478 - protein, 9 aa, Homo Sapiens
MHVLEGLQE

SEQ ID NO: 191479 - protein, 9 aa, Homo Sapiens
YYKSAVEQL

SEQ ID NO: 191480 - protein, 9 aa, Homo Sapiens
RMATEKPGP

SEQ ID NO: 191481 - protein, 9 aa, Homo Sapiens
NFTPYSHGN

SEQ ID NO: 191482 - protein, 9 aa, Homo Sapiens
GPPPPSLEP

SEQ ID NO: 191483 - protein, 9 aa, Homo Sapiens
PPGPRGEGT

SEQ ID NO: 191484 - protein, 9 aa, Homo Sapiens
QGSLWPAKS

SEQ ID NO: 191485 - protein, 9 aa, Homo Sapiens
IVVSPLLVK

SEQ ID NO: 191486 - protein, 9 aa, Homo Sapiens
VSISLNFYK

SEQ ID NO: 191487 - protein, 9 aa, Homo Sapiens
SGAILNSSP

SEQ ID NO: 191488 - protein, 9 aa, Homo Sapiens
VPQNDDPNP

SEQ ID NO: 191489 - protein, 9 aa, Homo Sapiens
WLPLHPLLA

SEQ ID NO: 191490 - protein, 9 aa, Homo Sapiens
CMPPFEFHA

SEQ ID NO: 191491 - protein, 9 aa, Homo Sapiens
PTDPGVEEP

SEQ ID NO: 191492 - protein, 9 aa, Homo Sapiens
GHTASPPSC

SEQ ID NO: 191493 - protein, 9 aa, Homo Sapiens
MPYAAFAMY

SEQ ID NO: 191494 - protein, 9 aa, Homo Sapiens
DLKPIADWA

SEQ ID NO: 191495 - protein, 9 aa, Homo Sapiens
NGAKGTKVV

SEQ ID NO: 191496 - protein, 9 aa, Homo Sapiens
HMSEVQSDS

SEQ ID NO: 191497 - protein, 9 aa, Homo Sapiens
TTEDNVKKR

SEQ ID NO: 191498 - protein, 9 aa, Homo Sapiens
ISELQEKLD

SEQ ID NO: 191499 - protein, 9 aa, Homo Sapiens
DRTMMYYGL

SEQ ID NO: 191500 - protein, 9 aa, Homo Sapiens
LQHSGPRCL

SEQ ID NO: 191501 - protein, 9 aa, Homo Sapiens
NGLANFLVS

SEQ ID NO: 191502 - protein, 9 aa, Homo Sapiens
TTVLRLLLG

SEQ ID NO: 191503 - protein, 9 aa, Homo Sapiens
DPDTLVWWE

SEQ ID NO: 191504 - protein, 9 aa, Homo Sapiens
EKLLEEEVI

SEQ ID NO: 191505 - protein, 9 aa, Homo Sapiens
CTMSLVSSV

SEQ ID NO: 191506 - protein, 9 aa, Homo Sapiens
PLEHLVFFL

SEQ ID NO: 191507 - protein, 9 aa, Homo Sapiens
KIEKMKEKD

SEQ ID NO: 191508 - protein, 9 aa, Homo Sapiens
GDVEHSRHL

SEQ ID NO: 191509 - protein, 9 aa, Homo Sapiens
NDSEEGSDE

SEQ ID NO: 191510 - protein, 9 aa, Homo Sapiens
LRQKQAADV

SEQ ID NO: 191511 - protein, 9 aa, Homo Sapiens
SGTAMWFCT

SEQ ID NO: 191512 - protein, 9 aa, Homo Sapiens
ANHPLLHLQ

SEQ ID NO: 191513 - protein, 9 aa, Homo Sapiens
LEVYGVYFE

SEQ ID NO: 191514 - protein, 9 aa, Homo Sapiens
DQFEPQVNN

SEQ ID NO: 191515 - protein, 9 aa, Homo Sapiens
DPSSERNEK

SEQ ID NO: 191516 - protein, 9 aa, Homo Sapiens
RPPHVLDGP

SEQ ID NO: 191517 - protein, 9 aa, Homo Sapiens
NAMPSQGPA

SEQ ID NO: 191518 - protein, 9 aa, Homo Sapiens
PNSGRGDEA

SEQ ID NO: 191519 - protein, 9 aa, Homo Sapiens
AIELRRLAA

SEQ ID NO: 191520 - protein, 9 aa, Homo Sapiens
LYDGEDYTP

SEQ ID NO: 191521 - protein, 9 aa, Homo Sapiens
VVQEALDQA

SEQ ID NO: 191522 - protein, 9 aa, Homo Sapiens
VMRTALLTH

SEQ ID NO: 191523 - protein, 9 aa, Homo Sapiens
CVLMKNGDV

SEQ ID NO: 191524 - protein, 9 aa, Homo Sapiens
RVKKADPPL

SEQ ID NO: 191525 - protein, 9 aa, Homo Sapiens
SDGQRCSMD

SEQ ID NO: 191526 - protein, 9 aa, Homo Sapiens
AESAMTKQD

SEQ ID NO: 191527 - protein, 9 aa, Homo Sapiens
TTDCVLSLF

SEQ ID NO: 191528 - protein, 9 aa, Homo Sapiens
PRIEVIDGK

SEQ ID NO: 191529 - protein, 9 aa, Homo Sapiens
YQVCQMLLP

SEQ ID NO: 191530 - protein, 9 aa, Homo Sapiens
LSNYEQLRQ

SEQ ID NO: 191531 - protein, 9 aa, Homo Sapiens
AVHWQTHSG

SEQ ID NO: 191532 - protein, 9 aa, Homo Sapiens
AGDISVTPL

SEQ ID NO: 191533 - protein, 9 aa, Homo Sapiens
SCRQRQEVE

SEQ ID NO: 191534 - protein, 9 aa, Homo Sapiens
VSTGLPTAP

SEQ ID NO: 191535 - protein, 9 aa, Homo Sapiens
AAVPHADPG

SEQ ID NO: 191536 - protein, 9 aa, Homo Sapiens
PGCDRIPPV

SEQ ID NO: 191537 - protein, 9 aa, Homo Sapiens
IVTMQVLPQ

SEQ ID NO: 191538 - protein, 9 aa, Homo Sapiens
GDGEFNFSE

SEQ ID NO: 191539 - protein, 9 aa, Homo Sapiens
GKAFRVGSQ

SEQ ID NO: 191540 - protein, 9 aa, Homo Sapiens
NIGYDLERG

SEQ ID NO: 191541 - protein, 9 aa, Homo Sapiens
RGMARVGAL

SEQ ID NO: 191542 - protein, 9 aa, Homo Sapiens
RGPRPLHRW

SEQ ID NO: 191543 - protein, 9 aa, Homo Sapiens
ASSPPAEFI

SEQ ID NO: 191544 - protein, 9 aa, Homo Sapiens
GIKCFAVCS

SEQ ID NO: 191545 - protein, 9 aa, Homo Sapiens
AQMWKVNVQ

SEQ ID NO: 191546 - protein, 9 aa, Homo Sapiens
PGDVEHSRH

SEQ ID NO: 191547 - protein, 9 aa, Homo Sapiens
NFKGKFPEQ

SEQ ID NO: 191548 - protein, 9 aa, Homo Sapiens
SRTMTTKNV

SEQ ID NO: 191549 - protein, 9 aa, Homo Sapiens
QENTCLCNQ

SEQ ID NO: 191550 - protein, 9 aa, Homo Sapiens
LWNEKCHDY

SEQ ID NO: 191551 - protein, 9 aa, Homo Sapiens
EIKEIHGLR

SEQ ID NO: 191552 - protein, 9 aa, Homo Sapiens
SHLLAADAL

SEQ ID NO: 191553 - protein, 9 aa, Homo Sapiens
EDPAADPAE

SEQ ID NO: 191554 - protein, 9 aa, Homo Sapiens
TRFTRQMPV

SEQ ID NO: 191555 - protein, 9 aa, Homo Sapiens
YVSVHTESG

SEQ ID NO: 191556 - protein, 9 aa, Homo Sapiens
DITQDFEEM

SEQ ID NO: 191557 - protein, 9 aa, Homo Sapiens
TTFSTDGIL

SEQ ID NO: 191558 - protein, 9 aa, Homo Sapiens
VSPSDHKIQ

SEQ ID NO: 191559 - protein, 9 aa, Homo Sapiens
NISSGCSSV

SEQ ID NO: 191560 - protein, 9 aa, Homo Sapiens
AERSKATAM

SEQ ID NO: 191561 - protein, 9 aa, Homo Sapiens
LSKEQLEHW

SEQ ID NO: 191562 - protein, 9 aa, Homo Sapiens
QRRRSRSCC

SEQ ID NO: 191563 - protein, 9 aa, Homo Sapiens
VGMRISAKE

SEQ ID NO: 191564 - protein, 9 aa, Homo Sapiens
PGWLPRLTR

SEQ ID NO: 191565 - protein, 9 aa, Homo Sapiens
SVELYTWDN

SEQ ID NO: 191566 - protein, 9 aa, Homo Sapiens
SNFTPYSHG

SEQ ID NO: 191567 - protein, 9 aa, Homo Sapiens
RTVCDSVLG

SEQ ID NO: 191568 - protein, 9 aa, Homo Sapiens
SRHSSLSSH

SEQ ID NO: 191569 - protein, 9 aa, Homo Sapiens
MALGSFPAG

SEQ ID NO: 191570 - protein, 9 aa, Homo Sapiens
GWGLQTKTD

SEQ ID NO: 191571 - protein, 9 aa, Homo Sapiens
CAMGPHCAE

SEQ ID NO: 191572 - protein, 9 aa, Homo Sapiens
AAALFDRKQ

SEQ ID NO: 191573 - protein, 9 aa, Homo Sapiens
HSLDSGIRR

SEQ ID NO: 191574 - protein, 9 aa, Homo Sapiens
ALSNYEQLR

SEQ ID NO: 191575 - protein, 9 aa, Homo Sapiens
APVAKISTF

SEQ ID NO: 191576 - protein, 9 aa, Homo Sapiens
NLQKLEITG

SEQ ID NO: 191577 - protein, 9 aa, Homo Sapiens
AGVYAKAVL

SEQ ID NO: 191578 - protein, 9 aa, Homo Sapiens
IFTILLSSC

SEQ ID NO: 191579 - protein, 9 aa, Homo Sapiens
QWWCRKTHV

SEQ ID NO: 191580 - protein, 9 aa, Homo Sapiens
IHACNHVAH

SEQ ID NO: 191581 - protein, 9 aa, Homo Sapiens
QASAGRTVL

SEQ ID NO: 191582 - protein, 9 aa, Homo Sapiens
KDQHKLWVG

SEQ ID NO: 191583 - protein, 9 aa, Homo Sapiens
NGPYGKCLS

SEQ ID NO: 191584 - protein, 9 aa, Homo Sapiens
LQGNARETE

SEQ ID NO: 191585 - protein, 9 aa, Homo Sapiens
WKDQHKLWV

SEQ ID NO: 191586 - protein, 9 aa, Homo Sapiens
EEEVITYTS

SEQ ID NO: 191587 - protein, 9 aa, Homo Sapiens
NPPWVQLSD

SEQ ID NO: 191588 - protein, 9 aa, Homo Sapiens
TQVSCLPPE

SEQ ID NO: 191589 - protein, 9 aa, Homo Sapiens
ERQGSIQPQ

SEQ ID NO: 191590 - protein, 9 aa, Homo Sapiens
RQVAEARSQ

SEQ ID NO: 191591 - protein, 9 aa, Homo Sapiens
QSRNCDDEV

SEQ ID NO: 191592 - protein, 9 aa, Homo Sapiens
YTFPNTRNQ

SEQ ID NO: 191593 - protein, 9 aa, Homo Sapiens
QYHMNKNFE

SEQ ID NO: 191594 - protein, 9 aa, Homo Sapiens
TVKRRMRGL

SEQ ID NO: 191595 - protein, 9 aa, Homo Sapiens
GGSATGAHL

SEQ ID NO: 191596 - protein, 9 aa, Homo Sapiens
ILYTVAIIL

SEQ ID NO: 191597 - protein, 9 aa, Homo Sapiens
GNVSTPPHH

SEQ ID NO: 191598 - protein, 9 aa, Homo Sapiens
CEQRFIEKG

SEQ ID NO: 191599 - protein, 9 aa, Homo Sapiens
EAVRRAFCV

SEQ ID NO: 191600 - protein, 9 aa, Homo Sapiens
SCMSRPVLK

SEQ ID NO: 191601 - protein, 9 aa, Homo Sapiens
EQTPRGCCK

SEQ ID NO: 191602 - protein, 9 aa, Homo Sapiens
PRGNTEGLQ

SEQ ID NO: 191603 - protein, 9 aa, Homo Sapiens
GPSFVQKEF

SEQ ID NO: 191604 - protein, 9 aa, Homo Sapiens
FPPFRLLII

SEQ ID NO: 191605 - protein, 9 aa, Homo Sapiens
LEDVGRHLG

SEQ ID NO: 191606 - protein, 9 aa, Homo Sapiens
HTVISVRDG

SEQ ID NO: 191607 - protein, 9 aa, Homo Sapiens
GSIGWARAR

SEQ ID NO: 191608 - protein, 9 aa, Homo Sapiens
EGKAKSRPV

SEQ ID NO: 191609 - protein, 9 aa, Homo Sapiens
MPLHHGLTQ

SEQ ID NO: 191610 - protein, 9 aa, Homo Sapiens
GNWQCWLKV

SEQ ID NO: 191611 - protein, 9 aa, Homo Sapiens
VNWEDRSST

SEQ ID NO: 191612 - protein, 9 aa, Homo Sapiens
SYTSLVLGI

SEQ ID NO: 191613 - protein, 9 aa, Homo Sapiens
CLVHGGQVN

SEQ ID NO: 191614 - protein, 9 aa, Homo Sapiens
ARGGQSRTI

SEQ ID NO: 191615 - protein, 9 aa, Homo Sapiens
QIRPAPDKP

SEQ ID NO: 191616 - protein, 9 aa, Homo Sapiens
YHLTRFLSR

SEQ ID NO: 191617 - protein, 9 aa, Homo Sapiens
LYHENIEAR

SEQ ID NO: 191618 - protein, 9 aa, Homo Sapiens
SHCAHIGDP

SEQ ID NO: 191619 - protein, 9 aa, Homo Sapiens
RAPQAGNRT

SEQ ID NO: 191620 - protein, 9 aa, Homo Sapiens
HGRSRLSLS

SEQ ID NO: 191621 - protein, 9 aa, Homo Sapiens
SRRSRHQGS

SEQ ID NO: 191622 - protein, 9 aa, Homo Sapiens
VLLDVKAWL

SEQ ID NO: 191623 - protein, 9 aa, Homo Sapiens
VMILNELHP

SEQ ID NO: 191624 - protein, 9 aa, Homo Sapiens
DSPQAIVLY

SEQ ID NO: 191625 - protein, 9 aa, Homo Sapiens
CVSLMPLRL

SEQ ID NO: 191626 - protein, 9 aa, Homo Sapiens
AAWGTSSCL

SEQ ID NO: 191627 - protein, 9 aa, Homo Sapiens
GEKHWNDLA

SEQ ID NO: 191628 - protein, 9 aa, Homo Sapiens
CRPPSPLES

SEQ ID NO: 191629 - protein, 9 aa, Homo Sapiens
LPLQPYLLP

SEQ ID NO: 191630 - protein, 9 aa, Homo Sapiens
QEHFAVEMK

SEQ ID NO: 191631 - protein, 9 aa, Homo Sapiens
QRGSEQGKC

SEQ ID NO: 191632 - protein, 9 aa, Homo Sapiens
SLTFSEDAR

SEQ ID NO: 191633 - protein, 9 aa, Homo Sapiens
VSADENSVA

SEQ ID NO: 191634 - protein, 9 aa, Homo Sapiens
DEMYKVEAE

SEQ ID NO: 191635 - protein, 9 aa, Homo Sapiens
SDIVGLRFS

SEQ ID NO: 191636 - protein, 9 aa, Homo Sapiens
GVLVGMAQL

SEQ ID NO: 191637 - protein, 9 aa, Homo Sapiens
CLVDSLTDA

SEQ ID NO: 191638 - protein, 9 aa, Homo Sapiens
LCELGADGA

SEQ ID NO: 191639 - protein, 9 aa, Homo Sapiens
EEKLQTSVR

SEQ ID NO: 191640 - protein, 9 aa, Homo Sapiens
CLHTLPGSF

SEQ ID NO: 191641 - protein, 9 aa, Homo Sapiens
VLRNPPLFA

SEQ ID NO: 191642 - protein, 9 aa, Homo Sapiens
WTVIFVDLD

SEQ ID NO: 191643 - protein, 9 aa, Homo Sapiens
KHQQRIIIG

SEQ ID NO: 191644 - protein, 9 aa, Homo Sapiens
ILRSTVMVI

SEQ ID NO: 191645 - protein, 9 aa, Homo Sapiens
HSSVLGLAR

SEQ ID NO: 191646 - protein, 9 aa, Homo Sapiens
PIPVKKPSS

SEQ ID NO: 191647 - protein, 9 aa, Homo Sapiens
KFFSWHSNL

SEQ ID NO: 191648 - protein, 9 aa, Homo Sapiens
YWCAHNMSF

SEQ ID NO: 191649 - protein, 9 aa, Homo Sapiens
IPVKKPSSV

SEQ ID NO: 191650 - protein, 9 aa, Homo Sapiens
HRNSDVRHT

SEQ ID NO: 191651 - protein, 9 aa, Homo Sapiens
AKWSHKAEF

SEQ ID NO: 191652 - protein, 9 aa, Homo Sapiens
YSAPPPGPG

SEQ ID NO: 191653 - protein, 9 aa, Homo Sapiens
GSKKKTQIA

SEQ ID NO: 191654 - protein, 9 aa, Homo Sapiens
NFITAYVML

SEQ ID NO: 191655 - protein, 9 aa, Homo Sapiens
FQALTEFFR

SEQ ID NO: 191656 - protein, 9 aa, Homo Sapiens
TVISVRDGK

SEQ ID NO: 191657 - protein, 9 aa, Homo Sapiens
DLEDSYRQQ

SEQ ID NO: 191658 - protein, 9 aa, Homo Sapiens
IIYVLALTY

SEQ ID NO: 191659 - protein, 9 aa, Homo Sapiens
ECQVCSFHE

SEQ ID NO: 191660 - protein, 9 aa, Homo Sapiens
LMTGIFYTI

SEQ ID NO: 191661 - protein, 9 aa, Homo Sapiens
SSCVSARAA

SEQ ID NO: 191662 - protein, 9 aa, Homo Sapiens
TTTPDTMVQ

SEQ ID NO: 191663 - protein, 9 aa, Homo Sapiens
GLRYLQWWC

SEQ ID NO: 191664 - protein, 9 aa, Homo Sapiens
DCSSPTSPF

SEQ ID NO: 191665 - protein, 9 aa, Homo Sapiens
LNTKSALIT

SEQ ID NO: 191666 - protein, 9 aa, Homo Sapiens
SETCSVRSF

SEQ ID NO: 191667 - protein, 9 aa, Homo Sapiens
PHCLAVLVP

SEQ ID NO: 191668 - protein, 9 aa, Homo Sapiens
TVQTGFYDW

SEQ ID NO: 191669 - protein, 9 aa, Homo Sapiens
SISFPGCFT

SEQ ID NO: 191670 - protein, 9 aa, Homo Sapiens
TLYWKVWPL

SEQ ID NO: 191671 - protein, 9 aa, Homo Sapiens
YPPCICDNR

SEQ ID NO: 191672 - protein, 9 aa, Homo Sapiens
WFEFHYPNS

SEQ ID NO: 191673 - protein, 9 aa, Homo Sapiens
AMNVEQSFM

SEQ ID NO: 191674 - protein, 9 aa, Homo Sapiens
MDPGVPRPS

SEQ ID NO: 191675 - protein, 9 aa, Homo Sapiens
MTRKLLRRP

SEQ ID NO: 191676 - protein, 9 aa, Homo Sapiens
SSMPYDDSN

SEQ ID NO: 191677 - protein, 9 aa, Homo Sapiens
YSEDDIHRF

SEQ ID NO: 191678 - protein, 9 aa, Homo Sapiens
RQFVPSYES

SEQ ID NO: 191679 - protein, 9 aa, Homo Sapiens
PRGEGTREK

SEQ ID NO: 191680 - protein, 9 aa, Homo Sapiens
FSVFPAICF

SEQ ID NO: 191681 - protein, 9 aa, Homo Sapiens
IIAGKAMEQ

SEQ ID NO: 191682 - protein, 9 aa, Homo Sapiens
RHGMPPTMM

SEQ ID NO: 191683 - protein, 9 aa, Homo Sapiens
WLMAVALAL

SEQ ID NO: 191684 - protein, 9 aa, Homo Sapiens
WLQALLNIY

SEQ ID NO: 191685 - protein, 9 aa, Homo Sapiens
PCITKTFFW

SEQ ID NO: 191686 - protein, 9 aa, Homo Sapiens
ALVATKDGD

SEQ ID NO: 191687 - protein, 9 aa, Homo Sapiens
LQINNADIG

SEQ ID NO: 191688 - protein, 9 aa, Homo Sapiens
KQEEFFNMS

SEQ ID NO: 191689 - protein, 9 aa, Homo Sapiens
GPGHISEII

SEQ ID NO: 191690 - protein, 9 aa, Homo Sapiens
VCNLSNQRM

SEQ ID NO: 191691 - protein, 9 aa, Homo Sapiens
PLPLQPYLL

SEQ ID NO: 191692 - protein, 9 aa, Homo Sapiens
SPDPPPGPR

SEQ ID NO: 191693 - protein, 9 aa, Homo Sapiens
IIQLLQKLW

SEQ ID NO: 191694 - protein, 9 aa, Homo Sapiens
PLANVTLID

SEQ ID NO: 191695 - protein, 9 aa, Homo Sapiens
PVPQNDDPN

SEQ ID NO: 191696 - protein, 9 aa, Homo Sapiens
KIPTMSRRV

SEQ ID NO: 191697 - protein, 9 aa, Homo Sapiens
VLGSMSTCI

SEQ ID NO: 191698 - protein, 9 aa, Homo Sapiens
VDKRSGAQH

SEQ ID NO: 191699 - protein, 9 aa, Homo Sapiens
SVLSDPKLK

SEQ ID NO: 191700 - protein, 9 aa, Homo Sapiens
IHNGEKPYS

SEQ ID NO: 191701 - protein, 9 aa, Homo Sapiens
HQRHHSRET

SEQ ID NO: 191702 - protein, 9 aa, Homo Sapiens
PSAPPPPLP

SEQ ID NO: 191703 - protein, 9 aa, Homo Sapiens
DYEEEPVEA

SEQ ID NO: 191704 - protein, 9 aa, Homo Sapiens
KNATSESTS

SEQ ID NO: 191705 - protein, 9 aa, Homo Sapiens
EPLCARAKE

SEQ ID NO: 191706 - protein, 9 aa, Homo Sapiens
CLCQFSTRV

SEQ ID NO: 191707 - protein, 9 aa, Homo Sapiens
GEHTMEVRT

SEQ ID NO: 191708 - protein, 9 aa, Homo Sapiens
CRTWSQKRA

SEQ ID NO: 191709 - protein, 9 aa, Homo Sapiens
HVAELAVNY

SEQ ID NO: 191710 - protein, 9 aa, Homo Sapiens
SRSQWVMSQ

SEQ ID NO: 191711 - protein, 9 aa, Homo Sapiens
KKRIPPPFQ

SEQ ID NO: 191712 - protein, 9 aa, Homo Sapiens
WLPPAVPQS

SEQ ID NO: 191713 - protein, 9 aa, Homo Sapiens
DVQTFQAKC

SEQ ID NO: 191714 - protein, 9 aa, Homo Sapiens
EENFNMEAF

SEQ ID NO: 191715 - protein, 9 aa, Homo Sapiens
ILPWRRHLS

SEQ ID NO: 191716 - protein, 9 aa, Homo Sapiens
DFWYVTCAI

SEQ ID NO: 191717 - protein, 9 aa, Homo Sapiens
FPYVTPAPP

SEQ ID NO: 191718 - protein, 9 aa, Homo Sapiens
ECVIYYYLT

SEQ ID NO: 191719 - protein, 9 aa, Homo Sapiens
CLSHEIIIW

SEQ ID NO: 191720 - protein, 9 aa, Homo Sapiens
PGEKHWNDL

SEQ ID NO: 191721 - protein, 9 aa, Homo Sapiens
GAASPSSVI

SEQ ID NO: 191722 - protein, 9 aa, Homo Sapiens
AKILKQSPQ

SEQ ID NO: 191723 - protein, 9 aa, Homo Sapiens
YFLEEKFES

SEQ ID NO: 191724 - protein, 9 aa, Homo Sapiens
YQPVPEQLQ

SEQ ID NO: 191725 - protein, 9 aa, Homo Sapiens
RCPRGHHHL

SEQ ID NO: 191726 - protein, 9 aa, Homo Sapiens
TLLHHLFLC

SEQ ID NO: 191727 - protein, 9 aa, Homo Sapiens
FIALSIGML

SEQ ID NO: 191728 - protein, 9 aa, Homo Sapiens
FLSYYHLTR

SEQ ID NO: 191729 - protein, 9 aa, Homo Sapiens
LNTVWDLWA

SEQ ID NO: 191730 - protein, 9 aa, Homo Sapiens
SPEKQHPFQ

SEQ ID NO: 191731 - protein, 9 aa, Homo Sapiens
SAHSTHVGH

SEQ ID NO: 191732 - protein, 9 aa, Homo Sapiens
RPANGGQCR

SEQ ID NO: 191733 - protein, 9 aa, Homo Sapiens
LVYQNIFMA

SEQ ID NO: 191734 - protein, 9 aa, Homo Sapiens
QRYFGGTED

SEQ ID NO: 191735 - protein, 9 aa, Homo Sapiens
MRVEHFMNH

SEQ ID NO: 191736 - protein, 9 aa, Homo Sapiens
LVVRFTALD

SEQ ID NO: 191737 - protein, 9 aa, Homo Sapiens
LGRLCERFL

SEQ ID NO: 191738 - protein, 9 aa, Homo Sapiens
GWWTGDGEF

SEQ ID NO: 191739 - protein, 9 aa, Homo Sapiens
NMTLNILPE

SEQ ID NO: 191740 - protein, 9 aa, Homo Sapiens
FDPKCLDEL

SEQ ID NO: 191741 - protein, 9 aa, Homo Sapiens
LNRESVHAR

SEQ ID NO: 191742 - protein, 9 aa, Homo Sapiens
DVIARKLRP

SEQ ID NO: 191743 - protein, 9 aa, Homo Sapiens
RLAAPCLAE

SEQ ID NO: 191744 - protein, 9 aa, Homo Sapiens
TCIVNGAYK

SEQ ID NO: 191745 - protein, 9 aa, Homo Sapiens
IYRELIDVD

SEQ ID NO: 191746 - protein, 9 aa, Homo Sapiens
TVLRNPPLF

SEQ ID NO: 191747 - protein, 9 aa, Homo Sapiens
LNTFMNTEK

SEQ ID NO: 191748 - protein, 9 aa, Homo Sapiens
FGAAAPLRH

SEQ ID NO: 191749 - protein, 9 aa, Homo Sapiens
LNELHPGLK

SEQ ID NO: 191750 - protein, 9 aa, Homo Sapiens
VALGGPPAL

SEQ ID NO: 191751 - protein, 9 aa, Homo Sapiens
GQLDESIQE

SEQ ID NO: 191752 - protein, 9 aa, Homo Sapiens
PSPILGKDN

SEQ ID NO: 191753 - protein, 9 aa, Homo Sapiens
LQHVVKDPS

SEQ ID NO: 191754 - protein, 9 aa, Homo Sapiens
SLGSYSGTT

SEQ ID NO: 191755 - protein, 9 aa, Homo Sapiens
YFVTSYKMC

SEQ ID NO: 191756 - protein, 9 aa, Homo Sapiens
RLRLLKEEA

SEQ ID NO: 191757 - protein, 9 aa, Homo Sapiens
AFTQMPGFQ

SEQ ID NO: 191758 - protein, 9 aa, Homo Sapiens
SISARKTMT

SEQ ID NO: 191759 - protein, 9 aa, Homo Sapiens
SELEATLQR

SEQ ID NO: 191760 - protein, 9 aa, Homo Sapiens
DYAPAGPAC

SEQ ID NO: 191761 - protein, 9 aa, Homo Sapiens
NPITESLAQ

SEQ ID NO: 191762 - protein, 9 aa, Homo Sapiens
SGHRLQAFD

SEQ ID NO: 191763 - protein, 9 aa, Homo Sapiens
SVVACAYDR

SEQ ID NO: 191764 - protein, 9 aa, Homo Sapiens
CTDVDECKI

SEQ ID NO: 191765 - protein, 9 aa, Homo Sapiens
EIQNHWFTY

SEQ ID NO: 191766 - protein, 9 aa, Homo Sapiens
PLSGGSATG

SEQ ID NO: 191767 - protein, 8 aa, Homo Sapiens
DQYVSTAP

SEQ ID NO: 191768 - protein, 9 aa, Homo Sapiens
THLMNGPIS

SEQ ID NO: 191769 - protein, 9 aa, Homo Sapiens
GLHPILGHF

SEQ ID NO: 191770 - protein, 9 aa, Homo Sapiens
NMELCCDAA

SEQ ID NO: 191771 - protein, 9 aa, Homo Sapiens
HRQDVLNWL

SEQ ID NO: 191772 - protein, 9 aa, Homo Sapiens
CDSVLGKMD

SEQ ID NO: 191773 - protein, 9 aa, Homo Sapiens
SDVLQEHFA

SEQ ID NO: 191774 - protein, 9 aa, Homo Sapiens
VKQNIYSLQ

SEQ ID NO: 191775 - protein, 9 aa, Homo Sapiens
IWGKCSVTL

SEQ ID NO: 191776 - protein, 9 aa, Homo Sapiens
GLTHTYSVH

SEQ ID NO: 191777 - protein, 9 aa, Homo Sapiens
VMTSHPRGV

SEQ ID NO: 191778 - protein, 9 aa, Homo Sapiens
PYCCPHCPF

SEQ ID NO: 191779 - protein, 9 aa, Homo Sapiens
SSNSESSSD

SEQ ID NO: 191780 - protein, 9 aa, Homo Sapiens
KTGKSPVFL

SEQ ID NO: 191781 - protein, 9 aa, Homo Sapiens
KQIHTGEKP

SEQ ID NO: 191782 - protein, 9 aa, Homo Sapiens
ESGHPSSDV

SEQ ID NO: 191783 - protein, 9 aa, Homo Sapiens
LAGVYAKAV

SEQ ID NO: 191784 - protein, 9 aa, Homo Sapiens
PPHHSSGSL

SEQ ID NO: 191785 - protein, 9 aa, Homo Sapiens
EIHMVPTIR

SEQ ID NO: 191786 - protein, 9 aa, Homo Sapiens
HMNKNFERL

SEQ ID NO: 191787 - protein, 9 aa, Homo Sapiens
LQTHLKERE

SEQ ID NO: 191788 - protein, 9 aa, Homo Sapiens
QETAQQQQA

SEQ ID NO: 191789 - protein, 9 aa, Homo Sapiens
TMDDMSRTC

SEQ ID NO: 191790 - protein, 9 aa, Homo Sapiens
LPPHLGICL

SEQ ID NO: 191791 - protein, 9 aa, Homo Sapiens
GWKDQHKLW

SEQ ID NO: 191792 - protein, 9 aa, Homo Sapiens
QLAPTLPTR

SEQ ID NO: 191793 - protein, 9 aa, Homo Sapiens
LCPPWVLPS

SEQ ID NO: 191794 - protein, 9 aa, Homo Sapiens
PMLRGTQCP

SEQ ID NO: 191795 - protein, 9 aa, Homo Sapiens
AVLPALLQD

SEQ ID NO: 191796 - protein, 9 aa, Homo Sapiens
WDDPDQNSP

SEQ ID NO: 191797 - protein, 9 aa, Homo Sapiens
TKNLALKEN

SEQ ID NO: 191798 - protein, 9 aa, Homo Sapiens
LARRSRDLD

SEQ ID NO: 191799 - protein, 9 aa, Homo Sapiens
PPALRWYRT

SEQ ID NO: 191800 - protein, 9 aa, Homo Sapiens
GAPGSPGPP

SEQ ID NO: 191801 - protein, 9 aa, Homo Sapiens
SMVVLGAKT

SEQ ID NO: 191802 - protein, 9 aa, Homo Sapiens
VGTLQVVRR

SEQ ID NO: 191803 - protein, 9 aa, Homo Sapiens
HKEVHTGIC

SEQ ID NO: 191804 - protein, 9 aa, Homo Sapiens
NSDYCDISE

SEQ ID NO: 191805 - protein, 9 aa, Homo Sapiens
PGLPVGAVT

SEQ ID NO: 191806 - protein, 9 aa, Homo Sapiens
DIHVLQFCY

SEQ ID NO: 191807 - protein, 9 aa, Homo Sapiens
LNPDSWSNA

SEQ ID NO: 191808 - protein, 9 aa, Homo Sapiens
EMGLGKTMQ

SEQ ID NO: 191809 - protein, 9 aa, Homo Sapiens
AGHAAAPEL

SEQ ID NO: 191810 - protein, 9 aa, Homo Sapiens
LTPHMSSVP

SEQ ID NO: 191811 - protein, 9 aa, Homo Sapiens
QPRRWSPTW

SEQ ID NO: 191812 - protein, 9 aa, Homo Sapiens
VKRYAAEMY

SEQ ID NO: 191813 - protein, 9 aa, Homo Sapiens
PVGAVTGIV

SEQ ID NO: 191814 - protein, 9 aa, Homo Sapiens
AEVIYTIEA

SEQ ID NO: 191815 - protein, 9 aa, Homo Sapiens
RSNGEQFPD

SEQ ID NO: 191816 - protein, 9 aa, Homo Sapiens
AIALQYCST

SEQ ID NO: 191817 - protein, 9 aa, Homo Sapiens
LWHTRDTES

SEQ ID NO: 191818 - protein, 9 aa, Homo Sapiens
LTHHPVGTG

SEQ ID NO: 191819 - protein, 9 aa, Homo Sapiens
SEEIEILMH

SEQ ID NO: 191820 - protein, 9 aa, Homo Sapiens
RTTLCYEER

SEQ ID NO: 191821 - protein, 9 aa, Homo Sapiens
AVLALQLAM

SEQ ID NO: 191822 - protein, 9 aa, Homo Sapiens
STSCPRCPS

SEQ ID NO: 191823 - protein, 9 aa, Homo Sapiens
LRERLDGLV

SEQ ID NO: 191824 - protein, 9 aa, Homo Sapiens
THTRWVAPV

SEQ ID NO: 191825 - protein, 9 aa, Homo Sapiens
DWAQIFLKA

SEQ ID NO: 191826 - protein, 9 aa, Homo Sapiens
SVGQRLSQD

SEQ ID NO: 191827 - protein, 9 aa, Homo Sapiens
VIYTIEAGN

SEQ ID NO: 191828 - protein, 9 aa, Homo Sapiens
DVWKGENWL

SEQ ID NO: 191829 - protein, 9 aa, Homo Sapiens
YCDISEGME

SEQ ID NO: 191830 - protein, 9 aa, Homo Sapiens
RLELDALCS

SEQ ID NO: 191831 - protein, 9 aa, Homo Sapiens
VLIETLITL

SEQ ID NO: 191832 - protein, 9 aa, Homo Sapiens
EDFVEGLHV

SEQ ID NO: 191833 - protein, 9 aa, Homo Sapiens
TCHKVYQCS

SEQ ID NO: 191834 - protein, 9 aa, Homo Sapiens
DFWRPLAQL

SEQ ID NO: 191835 - protein, 9 aa, Homo Sapiens
PPSAPPPPL

SEQ ID NO: 191836 - protein, 9 aa, Homo Sapiens
LLCHQRACR

SEQ ID NO: 191837 - protein, 9 aa, Homo Sapiens
TSLTWVSAP

SEQ ID NO: 191838 - protein, 9 aa, Homo Sapiens
QTFQAKCHI

SEQ ID NO: 191839 - protein, 9 aa, Homo Sapiens
AHVRAQEHE

SEQ ID NO: 191840 - protein, 9 aa, Homo Sapiens
STLTCHHRL

SEQ ID NO: 191841 - protein, 9 aa, Homo Sapiens
DFLANGAKG

SEQ ID NO: 191842 - protein, 9 aa, Homo Sapiens
LQSEAHQRY

SEQ ID NO: 191843 - protein, 9 aa, Homo Sapiens
AVGPPNPWA

SEQ ID NO: 191844 - protein, 9 aa, Homo Sapiens
LIIVNIERR

SEQ ID NO: 191845 - protein, 9 aa, Homo Sapiens
SRNEMQVDG

SEQ ID NO: 191846 - protein, 9 aa, Homo Sapiens
TNSCINPFL

SEQ ID NO: 191847 - protein, 9 aa, Homo Sapiens
SEGERCLTQ

SEQ ID NO: 191848 - protein, 9 aa, Homo Sapiens
RSFGWKDQH

SEQ ID NO: 191849 - protein, 9 aa, Homo Sapiens
AHSIHDHQA

SEQ ID NO: 191850 - protein, 9 aa, Homo Sapiens
VIPLTDVKF

SEQ ID NO: 191851 - protein, 9 aa, Homo Sapiens
CILSYGNKK

SEQ ID NO: 191852 - protein, 9 aa, Homo Sapiens
QLIGRLQTH

SEQ ID NO: 191853 - protein, 9 aa, Homo Sapiens
RIISDKQQS

SEQ ID NO: 191854 - protein, 9 aa, Homo Sapiens
VIFFACMVR

SEQ ID NO: 191855 - protein, 9 aa, Homo Sapiens
LALTGDVVA

SEQ ID NO: 191856 - protein, 9 aa, Homo Sapiens
LVNTFCQCC

SEQ ID NO: 191857 - protein, 9 aa, Homo Sapiens
HPPKPSQFL

SEQ ID NO: 191858 - protein, 9 aa, Homo Sapiens
QALRQCYHG

SEQ ID NO: 191859 - protein, 9 aa, Homo Sapiens
LSDPKLKEA

SEQ ID NO: 191860 - protein, 9 aa, Homo Sapiens
YSSFGCSFH

SEQ ID NO: 191861 - protein, 9 aa, Homo Sapiens
ELDALCSKY

SEQ ID NO: 191862 - protein, 9 aa, Homo Sapiens
RRPQSCSQS

SEQ ID NO: 191863 - protein, 9 aa, Homo Sapiens
AKNAMNVEQ

SEQ ID NO: 191864 - protein, 9 aa, Homo Sapiens
GPSEENFNM

SEQ ID NO: 191865 - protein, 9 aa, Homo Sapiens
VNNPRIEVI

SEQ ID NO: 191866 - protein, 9 aa, Homo Sapiens
DSPDDIMGT

SEQ ID NO: 191867 - protein, 9 aa, Homo Sapiens
PPYYLDFST

SEQ ID NO: 191868 - protein, 9 aa, Homo Sapiens
FVVFLPVYI

SEQ ID NO: 191869 - protein, 9 aa, Homo Sapiens
LGFKVKSKM

SEQ ID NO: 191870 - protein, 9 aa, Homo Sapiens
EVALLRLGQ

SEQ ID NO: 191871 - protein, 9 aa, Homo Sapiens
NSVDRLYEC

SEQ ID NO: 191872 - protein, 9 aa, Homo Sapiens
GSLFSLLRE

SEQ ID NO: 191873 - protein, 9 aa, Homo Sapiens
FQDGLKLML

SEQ ID NO: 191874 - protein, 9 aa, Homo Sapiens
LSQGDGLYK

SEQ ID NO: 191875 - protein, 9 aa, Homo Sapiens
TARISPLGA

SEQ ID NO: 191876 - protein, 9 aa, Homo Sapiens
VVMPAVKKP

SEQ ID NO: 191877 - protein, 9 aa, Homo Sapiens
CPLSECHTP

SEQ ID NO: 191878 - protein, 9 aa, Homo Sapiens
GTLQVVRRV

SEQ ID NO: 191879 - protein, 9 aa, Homo Sapiens
RQPPASPPQ

SEQ ID NO: 191880 - protein, 9 aa, Homo Sapiens
RVGLAACLC

SEQ ID NO: 191881 - protein, 9 aa, Homo Sapiens
TGYQSLTSG

SEQ ID NO: 191882 - protein, 9 aa, Homo Sapiens
SSGAAYVGA

SEQ ID NO: 191883 - protein, 9 aa, Homo Sapiens
GNESECPPG

SEQ ID NO: 191884 - protein, 9 aa, Homo Sapiens
HTEGLFQKS

SEQ ID NO: 191885 - protein, 9 aa, Homo Sapiens
PPEELHLPA

SEQ ID NO: 191886 - protein, 9 aa, Homo Sapiens
YTYTYLCVL

SEQ ID NO: 191887 - protein, 9 aa, Homo Sapiens
PYGKCLSVE

SEQ ID NO: 191888 - protein, 9 aa, Homo Sapiens
FSSPASSCS

SEQ ID NO: 191889 - protein, 9 aa, Homo Sapiens
EEEQPAPPI

SEQ ID NO: 191890 - protein, 9 aa, Homo Sapiens
AIILRMLAD

SEQ ID NO: 191891 - protein, 9 aa, Homo Sapiens
AKTLACILV

SEQ ID NO: 191892 - protein, 9 aa, Homo Sapiens
MVDSQLYVV

SEQ ID NO: 191893 - protein, 9 aa, Homo Sapiens
KAGCSAEEI

SEQ ID NO: 191894 - protein, 9 aa, Homo Sapiens
QQPPPRLPL

SEQ ID NO: 191895 - protein, 9 aa, Homo Sapiens
HPSSDVWKG

SEQ ID NO: 191896 - protein, 9 aa, Homo Sapiens
HKHQQVHTG

SEQ ID NO: 191897 - protein, 9 aa, Homo Sapiens
QHVVKDPSG

SEQ ID NO: 191898 - protein, 9 aa, Homo Sapiens
YGAPAPLLS

SEQ ID NO: 191899 - protein, 9 aa, Homo Sapiens
GSVLSDPKL

SEQ ID NO: 191900 - protein, 9 aa, Homo Sapiens
NATSESTST

SEQ ID NO: 191901 - protein, 9 aa, Homo Sapiens
LMHTLHTWA

SEQ ID NO: 191902 - protein, 9 aa, Homo Sapiens
GQVLGGEVI

SEQ ID NO: 191903 - protein, 9 aa, Homo Sapiens
WDIAGREQF

SEQ ID NO: 191904 - protein, 9 aa, Homo Sapiens
IFKNTLVIP

SEQ ID NO: 191905 - protein, 9 aa, Homo Sapiens
VLYHENIEA

SEQ ID NO: 191906 - protein, 9 aa, Homo Sapiens
HADPGPEAL

SEQ ID NO: 191907 - protein, 9 aa, Homo Sapiens
QLGSIYNIL

SEQ ID NO: 191908 - protein, 9 aa, Homo Sapiens
VAIQVYWNI

SEQ ID NO: 191909 - protein, 9 aa, Homo Sapiens
GSMVLFAWM

SEQ ID NO: 191910 - protein, 9 aa, Homo Sapiens
RTLLECGMR

SEQ ID NO: 191911 - protein, 9 aa, Homo Sapiens
RATGLFSSS

SEQ ID NO: 191912 - protein, 9 aa, Homo Sapiens
WVVQGPGRE

SEQ ID NO: 191913 - protein, 9 aa, Homo Sapiens
QLLLIWNDG

SEQ ID NO: 191914 - protein, 9 aa, Homo Sapiens
RAGAEHVRS

SEQ ID NO: 191915 - protein, 9 aa, Homo Sapiens
GADSNPPAA

SEQ ID NO: 191916 - protein, 9 aa, Homo Sapiens
HQQRIIIGF

SEQ ID NO: 191917 - protein, 9 aa, Homo Sapiens
FGVWSPWMP

SEQ ID NO: 191918 - protein, 9 aa, Homo Sapiens
DKPVQMEVV

SEQ ID NO: 191919 - protein, 9 aa, Homo Sapiens
IRVTTVADT

SEQ ID NO: 191920 - protein, 9 aa, Homo Sapiens
VRGEDAASE

SEQ ID NO: 191921 - protein, 9 aa, Homo Sapiens
AGESVWPKK

SEQ ID NO: 191922 - protein, 9 aa, Homo Sapiens
MLLKIRESL

SEQ ID NO: 191923 - protein, 9 aa, Homo Sapiens
KRKSGSLRC

SEQ ID NO: 191924 - protein, 9 aa, Homo Sapiens
SGPSLTGCQ

SEQ ID NO: 191925 - protein, 9 aa, Homo Sapiens
LNLSISGPD

SEQ ID NO: 191926 - protein, 9 aa, Homo Sapiens
PHVPLPPPP

SEQ ID NO: 191927 - protein, 9 aa, Homo Sapiens
LCERFLVVV

SEQ ID NO: 191928 - protein, 9 aa, Homo Sapiens
VDRLYECKE

SEQ ID NO: 191929 - protein, 9 aa, Homo Sapiens
AYTKEDVDN

SEQ ID NO: 191930 - protein, 9 aa, Homo Sapiens
WMWAVEHSL

SEQ ID NO: 191931 - protein, 9 aa, Homo Sapiens
RACRCDSDG

SEQ ID NO: 191932 - protein, 9 aa, Homo Sapiens
DVMELVARA

SEQ ID NO: 191933 - protein, 9 aa, Homo Sapiens
SMDGILDTI

SEQ ID NO: 191934 - protein, 9 aa, Homo Sapiens
QHNEFSEVA

SEQ ID NO: 191935 - protein, 9 aa, Homo Sapiens
GQTLPALTI

SEQ ID NO: 191936 - protein, 9 aa, Homo Sapiens
TGIPVSLTH

SEQ ID NO: 191937 - protein, 9 aa, Homo Sapiens
HSKPSQDRP

SEQ ID NO: 191938 - protein, 9 aa, Homo Sapiens
HLLGWLVPQ

SEQ ID NO: 191939 - protein, 9 aa, Homo Sapiens
GHNAWLPYH

SEQ ID NO: 191940 - protein, 9 aa, Homo Sapiens
VCAGDDVQM

SEQ ID NO: 191941 - protein, 9 aa, Homo Sapiens
WWCRKTHVE

SEQ ID NO: 191942 - protein, 9 aa, Homo Sapiens
ACVSKPPVL

SEQ ID NO: 191943 - protein, 9 aa, Homo Sapiens
FLLCHQRAC

SEQ ID NO: 191944 - protein, 9 aa, Homo Sapiens
VVSPFLKEA

SEQ ID NO: 191945 - protein, 9 aa, Homo Sapiens
LTAPRPHTI

SEQ ID NO: 191946 - protein, 9 aa, Homo Sapiens
SVQISDRIL

SEQ ID NO: 191947 - protein, 9 aa, Homo Sapiens
NYRRCQRAL

SEQ ID NO: 191948 - protein, 9 aa, Homo Sapiens
IRMGSSQRQ

SEQ ID NO: 191949 - protein, 9 aa, Homo Sapiens
MLPGAGAGI

SEQ ID NO: 191950 - protein, 9 aa, Homo Sapiens
ETVRIINCK

SEQ ID NO: 191951 - protein, 9 aa, Homo Sapiens
AEHVRSPLE

SEQ ID NO: 191952 - protein, 9 aa, Homo Sapiens
VQRLWFEVH

SEQ ID NO: 191953 - protein, 9 aa, Homo Sapiens
HAEHVQSWP

SEQ ID NO: 191954 - protein, 9 aa, Homo Sapiens
AHSLASRHS

SEQ ID NO: 191955 - protein, 9 aa, Homo Sapiens
TEVSLCTPP

SEQ ID NO: 191956 - protein, 9 aa, Homo Sapiens
LLLRPGDLV

SEQ ID NO: 191957 - protein, 9 aa, Homo Sapiens
VPSYESRRQ

SEQ ID NO: 191958 - protein, 9 aa, Homo Sapiens
SDNRIITLS

SEQ ID NO: 191959 - protein, 9 aa, Homo Sapiens
CLCVSLMPL

SEQ ID NO: 191960 - protein, 9 aa, Homo Sapiens
YDFSLYMMD

SEQ ID NO: 191961 - protein, 9 aa, Homo Sapiens
IVIEDYVQY

SEQ ID NO: 191962 - protein, 9 aa, Homo Sapiens
TGVRTRGSP

SEQ ID NO: 191963 - protein, 9 aa, Homo Sapiens
DLGGPCPQT

SEQ ID NO: 191964 - protein, 9 aa, Homo Sapiens
RRSRHQGSS

SEQ ID NO: 191965 - protein, 9 aa, Homo Sapiens
YQEDPVYLR

SEQ ID NO: 191966 - protein, 9 aa, Homo Sapiens
QLWIGIDFD

SEQ ID NO: 191967 - protein, 9 aa, Homo Sapiens
APDKPVQME

SEQ ID NO: 191968 - protein, 9 aa, Homo Sapiens
IGQRTQLSK

SEQ ID NO: 191969 - protein, 9 aa, Homo Sapiens
LACIAVDCY

SEQ ID NO: 191970 - protein, 9 aa, Homo Sapiens
PPWGKEQHL

SEQ ID NO: 191971 - protein, 9 aa, Homo Sapiens
DPWREIREK

SEQ ID NO: 191972 - protein, 9 aa, Homo Sapiens
LAACLCPGL

SEQ ID NO: 191973 - protein, 9 aa, Homo Sapiens
SPRYSTSCP

SEQ ID NO: 191974 - protein, 9 aa, Homo Sapiens
MQLDREYKK

SEQ ID NO: 191975 - protein, 9 aa, Homo Sapiens
DEVQNHIKE

SEQ ID NO: 191976 - protein, 9 aa, Homo Sapiens
EKDNATLAR

SEQ ID NO: 191977 - protein, 9 aa, Homo Sapiens
SEVAAVPHA

SEQ ID NO: 191978 - protein, 9 aa, Homo Sapiens
RVTEFCQQT

SEQ ID NO: 191979 - protein, 9 aa, Homo Sapiens
GHLRERAAA

SEQ ID NO: 191980 - protein, 9 aa, Homo Sapiens
GEVFVDQID

SEQ ID NO: 191981 - protein, 9 aa, Homo Sapiens
KKTKPSHSS

SEQ ID NO: 191982 - protein, 9 aa, Homo Sapiens
RMDEQQVDL

SEQ ID NO: 191983 - protein, 9 aa, Homo Sapiens
PPQTHAQCS

SEQ ID NO: 191984 - protein, 9 aa, Homo Sapiens
LLMLDDQHL

SEQ ID NO: 191985 - protein, 9 aa, Homo Sapiens
LSQNLLLHS

SEQ ID NO: 191986 - protein, 9 aa, Homo Sapiens
MGNKKLKRV

SEQ ID NO: 191987 - protein, 9 aa, Homo Sapiens
SVFEEHEEG

SEQ ID NO: 191988 - protein, 9 aa, Homo Sapiens
RHSCDTLNR

SEQ ID NO: 191989 - protein, 9 aa, Homo Sapiens
WNLPPRRTL

SEQ ID NO: 191990 - protein, 9 aa, Homo Sapiens
AEEAGVENL

SEQ ID NO: 191991 - protein, 9 aa, Homo Sapiens
TLHTWAASI

SEQ ID NO: 191992 - protein, 9 aa, Homo Sapiens
AKVRPPFTY

SEQ ID NO: 191993 - protein, 9 aa, Homo Sapiens
NPAYRANLG

SEQ ID NO: 191994 - protein, 9 aa, Homo Sapiens
RIEGPMGQG

SEQ ID NO: 191995 - protein, 9 aa, Homo Sapiens
RLGQQRALP

SEQ ID NO: 191996 - protein, 9 aa, Homo Sapiens
SQMSPMPKT

SEQ ID NO: 191997 - protein, 9 aa, Homo Sapiens
LRAENELLM

SEQ ID NO: 191998 - protein, 9 aa, Homo Sapiens
ICREDLISF

SEQ ID NO: 191999 - protein, 9 aa, Homo Sapiens
SSDTSTLSY

SEQ ID NO: 192000 - protein, 9 aa, Homo Sapiens
ENLRLRKGS

SEQ ID NO: 192001 - protein, 9 aa, Homo Sapiens
FHKDSSTWT

SEQ ID NO: 192002 - protein, 9 aa, Homo Sapiens
RTRDKFEED

SEQ ID NO: 192003 - protein, 9 aa, Homo Sapiens
ITLRKAGCS

SEQ ID NO: 192004 - protein, 9 aa, Homo Sapiens
LENFTPSGP

SEQ ID NO: 192005 - protein, 9 aa, Homo Sapiens
TGFYDWSAR

SEQ ID NO: 192006 - protein, 9 aa, Homo Sapiens
LAQHHRVHT

SEQ ID NO: 192007 - protein, 9 aa, Homo Sapiens
VDKGRILSR

SEQ ID NO: 192008 - protein, 9 aa, Homo Sapiens
KCRQASEKE

SEQ ID NO: 192009 - protein, 9 aa, Homo Sapiens
LVSGYRHII

SEQ ID NO: 192010 - protein, 9 aa, Homo Sapiens
VCTDSREQK

SEQ ID NO: 192011 - protein, 9 aa, Homo Sapiens
LQLTKFCPS

SEQ ID NO: 192012 - protein, 9 aa, Homo Sapiens
LPVCTMSLV

SEQ ID NO: 192013 - protein, 9 aa, Homo Sapiens
TNLLKRILL

SEQ ID NO: 192014 - protein, 9 aa, Homo Sapiens
VRLVLTVAS

SEQ ID NO: 192015 - protein, 9 aa, Homo Sapiens
AEGDVFRGI

SEQ ID NO: 192016 - protein, 9 aa, Homo Sapiens
VAEARSQQA

SEQ ID NO: 192017 - protein, 9 aa, Homo Sapiens
FLGVALGGP

SEQ ID NO: 192018 - protein, 9 aa, Homo Sapiens
EQRLPQDDV

SEQ ID NO: 192019 - protein, 9 aa, Homo Sapiens
ALGLAVISA

SEQ ID NO: 192020 - protein, 9 aa, Homo Sapiens
VGRLHSLDS

SEQ ID NO: 192021 - protein, 9 aa, Homo Sapiens
YIQNRKSTS

SEQ ID NO: 192022 - protein, 9 aa, Homo Sapiens
GVDSATVFN

SEQ ID NO: 192023 - protein, 9 aa, Homo Sapiens
KYFKMGDHM

SEQ ID NO: 192024 - protein, 9 aa, Homo Sapiens
LPCPPPTPR

SEQ ID NO: 192025 - protein, 9 aa, Homo Sapiens
DRRFPGFSY

SEQ ID NO: 192026 - protein, 9 aa, Homo Sapiens
VGTTDRGSP

SEQ ID NO: 192027 - protein, 9 aa, Homo Sapiens
ITIVSVLVI

SEQ ID NO: 192028 - protein, 9 aa, Homo Sapiens
QRLPAAGEV

SEQ ID NO: 192029 - protein, 9 aa, Homo Sapiens
LAECTGPLL

SEQ ID NO: 192030 - protein, 9 aa, Homo Sapiens
WLHLRQKHG

SEQ ID NO: 192031 - protein, 9 aa, Homo Sapiens
LLIWNDGKI

SEQ ID NO: 192032 - protein, 9 aa, Homo Sapiens
ENHSQALLD

SEQ ID NO: 192033 - protein, 9 aa, Homo Sapiens
YLGDKWSHF

SEQ ID NO: 192034 - protein, 9 aa, Homo Sapiens
KHQPRVHVI

SEQ ID NO: 192035 - protein, 9 aa, Homo Sapiens
VPLAQGEPG

SEQ ID NO: 192036 - protein, 9 aa, Homo Sapiens
CSALLPGPL

SEQ ID NO: 192037 - protein, 9 aa, Homo Sapiens
QLIYFYVTT

SEQ ID NO: 192038 - protein, 9 aa, Homo Sapiens
APAPAPAPP

SEQ ID NO: 192039 - protein, 9 aa, Homo Sapiens
FRSLAQETL

SEQ ID NO: 192040 - protein, 9 aa, Homo Sapiens
WAVREVDFT

SEQ ID NO: 192041 - protein, 9 aa, Homo Sapiens
KPKGSQQSR

SEQ ID NO: 192042 - protein, 9 aa, Homo Sapiens
RNSDVRHTP

SEQ ID NO: 192043 - protein, 9 aa, Homo Sapiens
GSDEMYKVE

SEQ ID NO: 192044 - protein, 9 aa, Homo Sapiens
YRKTIVYKV

SEQ ID NO: 192045 - protein, 9 aa, Homo Sapiens
RVVVVLSFL

SEQ ID NO: 192046 - protein, 9 aa, Homo Sapiens
YASLGAPRM

SEQ ID NO: 192047 - protein, 9 aa, Homo Sapiens
PMSGQTRVI

SEQ ID NO: 192048 - protein, 9 aa, Homo Sapiens
ERWPRLQRQ

SEQ ID NO: 192049 - protein, 9 aa, Homo Sapiens
KDCSSPTSP

SEQ ID NO: 192050 - protein, 9 aa, Homo Sapiens
PITETEISV

SEQ ID NO: 192051 - protein, 9 aa, Homo Sapiens
PVHPEPLQP

SEQ ID NO: 192052 - protein, 9 aa, Homo Sapiens
LKHQIVHME

SEQ ID NO: 192053 - protein, 9 aa, Homo Sapiens
TSSLRQETL

SEQ ID NO: 192054 - protein, 9 aa, Homo Sapiens
CREDLISFL

SEQ ID NO: 192055 - protein, 9 aa, Homo Sapiens
QRVGLAACL

SEQ ID NO: 192056 - protein, 9 aa, Homo Sapiens
RQDGTGHYL

SEQ ID NO: 192057 - protein, 9 aa, Homo Sapiens
VSKNCSSRR

SEQ ID NO: 192058 - protein, 9 aa, Homo Sapiens
GVAYDLGHV

SEQ ID NO: 192059 - protein, 9 aa, Homo Sapiens
KHHWKAENF

SEQ ID NO: 192060 - protein, 9 aa, Homo Sapiens
DGRAQGVCS

SEQ ID NO: 192061 - protein, 9 aa, Homo Sapiens
TGYQLRVLQ

SEQ ID NO: 192062 - protein, 9 aa, Homo Sapiens
CSWTFYHHI

SEQ ID NO: 192063 - protein, 9 aa, Homo Sapiens
EIVCNILID

SEQ ID NO: 192064 - protein, 9 aa, Homo Sapiens
LTTTEDNVK

SEQ ID NO: 192065 - protein, 9 aa, Homo Sapiens
VGKKMVKEG

SEQ ID NO: 192066 - protein, 9 aa, Homo Sapiens
PSVVHDYFE

SEQ ID NO: 192067 - protein, 9 aa, Homo Sapiens
IQGSGGVCI

SEQ ID NO: 192068 - protein, 9 aa, Homo Sapiens
DHLSMGEEP

SEQ ID NO: 192069 - protein, 9 aa, Homo Sapiens
TPDHSYMRM

SEQ ID NO: 192070 - protein, 9 aa, Homo Sapiens
YDEAILYLV

SEQ ID NO: 192071 - protein, 9 aa, Homo Sapiens
PQTPCWGWH

SEQ ID NO: 192072 - protein, 9 aa, Homo Sapiens
VAQPSCCLG

SEQ ID NO: 192073 - protein, 9 aa, Homo Sapiens
WLYLPDFFW

SEQ ID NO: 192074 - protein, 9 aa, Homo Sapiens
LRLGIRGPG

SEQ ID NO: 192075 - protein, 9 aa, Homo Sapiens
YPTAKANEC

SEQ ID NO: 192076 - protein, 9 aa, Homo Sapiens
TTSGGSQAL

SEQ ID NO: 192077 - protein, 9 aa, Homo Sapiens
EEACRTWSQ

SEQ ID NO: 192078 - protein, 9 aa, Homo Sapiens
QLVQQETAQ

SEQ ID NO: 192079 - protein, 9 aa, Homo Sapiens
HIEDDGSYF

SEQ ID NO: 192080 - protein, 9 aa, Homo Sapiens
LLLVARGLV

SEQ ID NO: 192081 - protein, 9 aa, Homo Sapiens
NGYILFGIE

SEQ ID NO: 192082 - protein, 9 aa, Homo Sapiens
LQPKLPNHL

SEQ ID NO: 192083 - protein, 9 aa, Homo Sapiens
ALQRCLELK

SEQ ID NO: 192084 - protein, 9 aa, Homo Sapiens
KCSEHGKAF

SEQ ID NO: 192085 - protein, 9 aa, Homo Sapiens
YLESWGATR

SEQ ID NO: 192086 - protein, 9 aa, Homo Sapiens
GLGTCRGMA

SEQ ID NO: 192087 - protein, 9 aa, Homo Sapiens
FGPVSDTEI

SEQ ID NO: 192088 - protein, 9 aa, Homo Sapiens
WDKAVQALL

SEQ ID NO: 192089 - protein, 9 aa, Homo Sapiens
KWSHKAEFS

SEQ ID NO: 192090 - protein, 9 aa, Homo Sapiens
QGCQGDGGA

SEQ ID NO: 192091 - protein, 9 aa, Homo Sapiens
PWGKEQHLH

SEQ ID NO: 192092 - protein, 9 aa, Homo Sapiens
MDDFKLVIN

SEQ ID NO: 192093 - protein, 9 aa, Homo Sapiens
RLLAKGKKP

SEQ ID NO: 192094 - protein, 9 aa, Homo Sapiens
LQFQVSAHD

SEQ ID NO: 192095 - protein, 9 aa, Homo Sapiens
SDADTATAR

SEQ ID NO: 192096 - protein, 9 aa, Homo Sapiens
PLFLELPIF

SEQ ID NO: 192097 - protein, 9 aa, Homo Sapiens
YNRLRYKRL

SEQ ID NO: 192098 - protein, 9 aa, Homo Sapiens
DYVFACEQM

SEQ ID NO: 192099 - protein, 9 aa, Homo Sapiens
LPIFTILLS

SEQ ID NO: 192100 - protein, 9 aa, Homo Sapiens
LVSCVLISF

SEQ ID NO: 192101 - protein, 9 aa, Homo Sapiens
LDSEEMDPG

SEQ ID NO: 192102 - protein, 9 aa, Homo Sapiens
ELPVMGLTK

SEQ ID NO: 192103 - protein, 9 aa, Homo Sapiens
ALAEMSKGH

SEQ ID NO: 192104 - protein, 9 aa, Homo Sapiens
FVSSEVVFE

SEQ ID NO: 192105 - protein, 9 aa, Homo Sapiens
HEEGSVVGN

SEQ ID NO: 192106 - protein, 9 aa, Homo Sapiens
EHTLLHHLF

SEQ ID NO: 192107 - protein, 9 aa, Homo Sapiens
KDVINRSMV

SEQ ID NO: 192108 - protein, 9 aa, Homo Sapiens
GRERHSCDT

SEQ ID NO: 192109 - protein, 9 aa, Homo Sapiens
SDVPPGVEK

SEQ ID NO: 192110 - protein, 9 aa, Homo Sapiens
HVLRPLRLV

SEQ ID NO: 192111 - protein, 9 aa, Homo Sapiens
MNHGVVTEF

SEQ ID NO: 192112 - protein, 9 aa, Homo Sapiens
VVDCSHLFD

SEQ ID NO: 192113 - protein, 9 aa, Homo Sapiens
MKVVLEKNA

SEQ ID NO: 192114 - protein, 9 aa, Homo Sapiens
MMRDEKKST

SEQ ID NO: 192115 - protein, 9 aa, Homo Sapiens
VVLLCDGKL

SEQ ID NO: 192116 - protein, 9 aa, Homo Sapiens
QDPENQALV

SEQ ID NO: 192117 - protein, 9 aa, Homo Sapiens
HFVHCIIPN

SEQ ID NO: 192118 - protein, 9 aa, Homo Sapiens
INSKWFDDL

SEQ ID NO: 192119 - protein, 9 aa, Homo Sapiens
EHMSEVQSD

SEQ ID NO: 192120 - protein, 9 aa, Homo Sapiens
CINIDECSE

SEQ ID NO: 192121 - protein, 9 aa, Homo Sapiens
YQLPAFANM

SEQ ID NO: 192122 - protein, 9 aa, Homo Sapiens
LRARFTIDL

SEQ ID NO: 192123 - protein, 9 aa, Homo Sapiens
KEELKLNIC

SEQ ID NO: 192124 - protein, 9 aa, Homo Sapiens
LIYQILPHS

SEQ ID NO: 192125 - protein, 9 aa, Homo Sapiens
ARYQWVCCN

SEQ ID NO: 192126 - protein, 9 aa, Homo Sapiens
EETRREGER

SEQ ID NO: 192127 - protein, 9 aa, Homo Sapiens
SPEYQRLGI

SEQ ID NO: 192128 - protein, 9 aa, Homo Sapiens
WGATRPFAH

SEQ ID NO: 192129 - protein, 9 aa, Homo Sapiens
IMLVEEDFS

SEQ ID NO: 192130 - protein, 9 aa, Homo Sapiens
PLMREDPPT

SEQ ID NO: 192131 - protein, 9 aa, Homo Sapiens
NQMLSFSFM

SEQ ID NO: 192132 - protein, 9 aa, Homo Sapiens
MVCQLMHKL

SEQ ID NO: 192133 - protein, 9 aa, Homo Sapiens
AQCHVCTLE

SEQ ID NO: 192134 - protein, 9 aa, Homo Sapiens
VKDPSGCVE

SEQ ID NO: 192135 - protein, 9 aa, Homo Sapiens
MAAWLMAVA

SEQ ID NO: 192136 - protein, 9 aa, Homo Sapiens
PSTARKGPP

SEQ ID NO: 192137 - protein, 9 aa, Homo Sapiens
CTDPYELGD

SEQ ID NO: 192138 - protein, 9 aa, Homo Sapiens
NSKEREIRR

SEQ ID NO: 192139 - protein, 9 aa, Homo Sapiens
PKAVDEDRS

SEQ ID NO: 192140 - protein, 9 aa, Homo Sapiens
STAGSDPGS

SEQ ID NO: 192141 - protein, 9 aa, Homo Sapiens
EKAWVCCIC

SEQ ID NO: 192142 - protein, 9 aa, Homo Sapiens
NAQNWLGAS

SEQ ID NO: 192143 - protein, 9 aa, Homo Sapiens
IKPNSKHFW

SEQ ID NO: 192144 - protein, 9 aa, Homo Sapiens
VLESDYRYS

SEQ ID NO: 192145 - protein, 9 aa, Homo Sapiens
KTQQRGLMD

SEQ ID NO: 192146 - protein, 9 aa, Homo Sapiens
LQHLCRKTI

SEQ ID NO: 192147 - protein, 9 aa, Homo Sapiens
LRLSTLFES

SEQ ID NO: 192148 - protein, 9 aa, Homo Sapiens
GAAAPLRHG

SEQ ID NO: 192149 - protein, 9 aa, Homo Sapiens
PDWLQGEPP

SEQ ID NO: 192150 - protein, 9 aa, Homo Sapiens
QGWWTGDGE

SEQ ID NO: 192151 - protein, 9 aa, Homo Sapiens
DDRRFPGFS

SEQ ID NO: 192152 - protein, 9 aa, Homo Sapiens
LLNADYLQR

SEQ ID NO: 192153 - protein, 9 aa, Homo Sapiens
YLQWWCRKT

SEQ ID NO: 192154 - protein, 9 aa, Homo Sapiens
AAPPFRAAR

SEQ ID NO: 192155 - protein, 9 aa, Homo Sapiens
LSEQDEALL

SEQ ID NO: 192156 - protein, 9 aa, Homo Sapiens
PNPCQKTKG

SEQ ID NO: 192157 - protein, 9 aa, Homo Sapiens
FTQKGNLLC

SEQ ID NO: 192158 - protein, 9 aa, Homo Sapiens
PLHHGLTQK

SEQ ID NO: 192159 - protein, 9 aa, Homo Sapiens
LMCSLGDVD

SEQ ID NO: 192160 - protein, 9 aa, Homo Sapiens
PAVPLGPAR

SEQ ID NO: 192161 - protein, 9 aa, Homo Sapiens
YMCRQCGLS

SEQ ID NO: 192162 - protein, 9 aa, Homo Sapiens
PLEPYCRIE

SEQ ID NO: 192163 - protein, 9 aa, Homo Sapiens
VLKQSLVVA

SEQ ID NO: 192164 - protein, 9 aa, Homo Sapiens
DMGFKGDIR

SEQ ID NO: 192165 - protein, 9 aa, Homo Sapiens
PPPECCRRR

SEQ ID NO: 192166 - protein, 9 aa, Homo Sapiens
QCHAVGPYS

SEQ ID NO: 192167 - protein, 9 aa, Homo Sapiens
LDQASAGRT

SEQ ID NO: 192168 - protein, 9 aa, Homo Sapiens
PAGTIPSPY

SEQ ID NO: 192169 - protein, 9 aa, Homo Sapiens
RATVRCLQA

SEQ ID NO: 192170 - protein, 9 aa, Homo Sapiens
RRARYQWVC

SEQ ID NO: 192171 - protein, 9 aa, Homo Sapiens
TIQKKMIDT

SEQ ID NO: 192172 - protein, 9 aa, Homo Sapiens
QELDSPDDI

SEQ ID NO: 192173 - protein, 9 aa, Homo Sapiens
SETRAGKHV

SEQ ID NO: 192174 - protein, 9 aa, Homo Sapiens
HLRERAAAG

SEQ ID NO: 192175 - protein, 9 aa, Homo Sapiens
ETVSILKHK

SEQ ID NO: 192176 - protein, 9 aa, Homo Sapiens
TNNSYQMTR

SEQ ID NO: 192177 - protein, 9 aa, Homo Sapiens
HPERKRASQ

SEQ ID NO: 192178 - protein, 9 aa, Homo Sapiens
VDWNNEYCS

SEQ ID NO: 192179 - protein, 9 aa, Homo Sapiens
NIPFLDMSF

SEQ ID NO: 192180 - protein, 9 aa, Homo Sapiens
IPVSLTHHP

SEQ ID NO: 192181 - protein, 9 aa, Homo Sapiens
APNNRTHGS

SEQ ID NO: 192182 - protein, 9 aa, Homo Sapiens
SGNYPPCIC

SEQ ID NO: 192183 - protein, 9 aa, Homo Sapiens
QGSGGVCIP

SEQ ID NO: 192184 - protein, 9 aa, Homo Sapiens
ITTMLALAL

SEQ ID NO: 192185 - protein, 9 aa, Homo Sapiens
SSLPSHTPL

SEQ ID NO: 192186 - protein, 9 aa, Homo Sapiens
KNTLVIPLT

SEQ ID NO: 192187 - protein, 9 aa, Homo Sapiens
SDLFSLGMP

SEQ ID NO: 192188 - protein, 9 aa, Homo Sapiens
GQYPWASCN

SEQ ID NO: 192189 - protein, 9 aa, Homo Sapiens
RTRGSPLRL

SEQ ID NO: 192190 - protein, 9 aa, Homo Sapiens
DLKEEMDKM

SEQ ID NO: 192191 - protein, 9 aa, Homo Sapiens
AILCSDEII

SEQ ID NO: 192192 - protein, 9 aa, Homo Sapiens
YVRNSRTIG

SEQ ID NO: 192193 - protein, 9 aa, Homo Sapiens
MNPIIYAFL

SEQ ID NO: 192194 - protein, 9 aa, Homo Sapiens
SYLAVHWQT

SEQ ID NO: 192195 - protein, 9 aa, Homo Sapiens
LEPYCRIEP

SEQ ID NO: 192196 - protein, 9 aa, Homo Sapiens
RGWAQGWGE

SEQ ID NO: 192197 - protein, 9 aa, Homo Sapiens
QPESCLCFT

SEQ ID NO: 192198 - protein, 9 aa, Homo Sapiens
ALELIETEL

SEQ ID NO: 192199 - protein, 9 aa, Homo Sapiens
GENAEVIYT

SEQ ID NO: 192200 - protein, 9 aa, Homo Sapiens
ALANPITES

SEQ ID NO: 192201 - protein, 9 aa, Homo Sapiens
EHENLRLRK

SEQ ID NO: 192202 - protein, 9 aa, Homo Sapiens
ASGFTGSMF

SEQ ID NO: 192203 - protein, 9 aa, Homo Sapiens
TTLCYEERI

SEQ ID NO: 192204 - protein, 9 aa, Homo Sapiens
FHDSLKKNA

SEQ ID NO: 192205 - protein, 9 aa, Homo Sapiens
AARWQREEQ

SEQ ID NO: 192206 - protein, 9 aa, Homo Sapiens
LHDAVAAAD

SEQ ID NO: 192207 - protein, 9 aa, Homo Sapiens
KGDIRTIFS

SEQ ID NO: 192208 - protein, 9 aa, Homo Sapiens
LRKQESGLG

SEQ ID NO: 192209 - protein, 9 aa, Homo Sapiens
EEKKKILLN

SEQ ID NO: 192210 - protein, 9 aa, Homo Sapiens
ASPHHCRVP

SEQ ID NO: 192211 - protein, 9 aa, Homo Sapiens
FMQVWISGE

SEQ ID NO: 192212 - protein, 9 aa, Homo Sapiens
PSAPNGPEL

SEQ ID NO: 192213 - protein, 9 aa, Homo Sapiens
LGELRQRLG

SEQ ID NO: 192214 - protein, 9 aa, Homo Sapiens
ALKELEHEA

SEQ ID NO: 192215 - protein, 9 aa, Homo Sapiens
PTMDPDPIT

SEQ ID NO: 192216 - protein, 9 aa, Homo Sapiens
HILMAVVPL

SEQ ID NO: 192217 - protein, 9 aa, Homo Sapiens
YLKREEEIL

SEQ ID NO: 192218 - protein, 9 aa, Homo Sapiens
PTSPGPSLP

SEQ ID NO: 192219 - protein, 9 aa, Homo Sapiens
NEDDDDDED

SEQ ID NO: 192220 - protein, 9 aa, Homo Sapiens
IWNLTVLTP

SEQ ID NO: 192221 - protein, 9 aa, Homo Sapiens
NTRNQQEFA

SEQ ID NO: 192222 - protein, 9 aa, Homo Sapiens
SAMDIMGED

SEQ ID NO: 192223 - protein, 9 aa, Homo Sapiens
DINGALQMA

SEQ ID NO: 192224 - protein, 9 aa, Homo Sapiens
DHPIKKGPV

SEQ ID NO: 192225 - protein, 9 aa, Homo Sapiens
AAAALRAVG

SEQ ID NO: 192226 - protein, 9 aa, Homo Sapiens
WASCNQVPW

SEQ ID NO: 192227 - protein, 9 aa, Homo Sapiens
KKARKYPHS

SEQ ID NO: 192228 - protein, 9 aa, Homo Sapiens
FQGKRYELS

SEQ ID NO: 192229 - protein, 9 aa, Homo Sapiens
YSKDILNPK

SEQ ID NO: 192230 - protein, 9 aa, Homo Sapiens
VKELVLKSV

SEQ ID NO: 192231 - protein, 9 aa, Homo Sapiens
EEEILRLHL

SEQ ID NO: 192232 - protein, 9 aa, Homo Sapiens
AMHMPGPTE

SEQ ID NO: 192233 - protein, 9 aa, Homo Sapiens
FMERESLLQ

SEQ ID NO: 192234 - protein, 9 aa, Homo Sapiens
FEVGGSPVN

SEQ ID NO: 192235 - protein, 9 aa, Homo Sapiens
ILNFYCTGR

SEQ ID NO: 192236 - protein, 9 aa, Homo Sapiens
VALLRLGQQ

SEQ ID NO: 192237 - protein, 9 aa, Homo Sapiens
RQAHKIQGE

SEQ ID NO: 192238 - protein, 9 aa, Homo Sapiens
LRRPNDPVP

SEQ ID NO: 192239 - protein, 9 aa, Homo Sapiens
MQTIALITY

SEQ ID NO: 192240 - protein, 9 aa, Homo Sapiens
SEEFYQAAH

SEQ ID NO: 192241 - protein, 9 aa, Homo Sapiens
DQKLPYSYI

SEQ ID NO: 192242 - protein, 9 aa, Homo Sapiens
IQKVWQKRK

SEQ ID NO: 192243 - protein, 9 aa, Homo Sapiens
DRTHVLSAG

SEQ ID NO: 192244 - protein, 9 aa, Homo Sapiens
LGTQRIFEL

SEQ ID NO: 192245 - protein, 9 aa, Homo Sapiens
TWDNSMTWE

SEQ ID NO: 192246 - protein, 9 aa, Homo Sapiens
RLLWKVFEE

SEQ ID NO: 192247 - protein, 9 aa, Homo Sapiens
VGGRTFPED

SEQ ID NO: 192248 - protein, 9 aa, Homo Sapiens
MSHCQLVTL

SEQ ID NO: 192249 - protein, 9 aa, Homo Sapiens
VQNVHRPPR

SEQ ID NO: 192250 - protein, 9 aa, Homo Sapiens
GETGPNVCL

SEQ ID NO: 192251 - protein, 9 aa, Homo Sapiens
SFSIYHDSI

SEQ ID NO: 192252 - protein, 9 aa, Homo Sapiens
GTWELMKEG

SEQ ID NO: 192253 - protein, 9 aa, Homo Sapiens
EEEPVEALA

SEQ ID NO: 192254 - protein, 9 aa, Homo Sapiens
TFPEDESQV

SEQ ID NO: 192255 - protein, 9 aa, Homo Sapiens
PPGEKHWND

SEQ ID NO: 192256 - protein, 9 aa, Homo Sapiens
ARECESRIR

SEQ ID NO: 192257 - protein, 9 aa, Homo Sapiens
ESLGKRPFP

SEQ ID NO: 192258 - protein, 9 aa, Homo Sapiens
RLGLVAVAW

SEQ ID NO: 192259 - protein, 9 aa, Homo Sapiens
TRLQERPIK

SEQ ID NO: 192260 - protein, 9 aa, Homo Sapiens
ARGVLVGMA

SEQ ID NO: 192261 - protein, 9 aa, Homo Sapiens
GIHHFARAA

SEQ ID NO: 192262 - protein, 9 aa, Homo Sapiens
WMIMASAFL

SEQ ID NO: 192263 - protein, 9 aa, Homo Sapiens
PVNTRYLFL

SEQ ID NO: 192264 - protein, 9 aa, Homo Sapiens
VEHSRHLIS

SEQ ID NO: 192265 - protein, 9 aa, Homo Sapiens
VTVKRRMRG

SEQ ID NO: 192266 - protein, 9 aa, Homo Sapiens
RAELYGIWL

SEQ ID NO: 192267 - protein, 9 aa, Homo Sapiens
FLELPIFTI

SEQ ID NO: 192268 - protein, 9 aa, Homo Sapiens
AMDIMGEDE

SEQ ID NO: 192269 - protein, 9 aa, Homo Sapiens
APLLIHPYL

SEQ ID NO: 192270 - protein, 9 aa, Homo Sapiens
APPPGPGPG

SEQ ID NO: 192271 - protein, 9 aa, Homo Sapiens
FQYPCLRKG

SEQ ID NO: 192272 - protein, 9 aa, Homo Sapiens
YSQHNEFSE

SEQ ID NO: 192273 - protein, 9 aa, Homo Sapiens
MDEQQVDLA

SEQ ID NO: 192274 - protein, 9 aa, Homo Sapiens
TTTPGPQQV

SEQ ID NO: 192275 - protein, 9 aa, Homo Sapiens
SESEGDNFT

SEQ ID NO: 192276 - protein, 9 aa, Homo Sapiens
VPRPSRQFW

SEQ ID NO: 192277 - protein, 9 aa, Homo Sapiens
NWEDRSSTP

SEQ ID NO: 192278 - protein, 9 aa, Homo Sapiens
ELSTDTDGW

SEQ ID NO: 192279 - protein, 9 aa, Homo Sapiens
RHRPGGGHV

SEQ ID NO: 192280 - protein, 9 aa, Homo Sapiens
QEQPCSLLV

SEQ ID NO: 192281 - protein, 9 aa, Homo Sapiens
AQNTATLAT

SEQ ID NO: 192282 - protein, 9 aa, Homo Sapiens
GFKAFVESH

SEQ ID NO: 192283 - protein, 9 aa, Homo Sapiens
QNIYSLQRT

SEQ ID NO: 192284 - protein, 9 aa, Homo Sapiens
WREHSLELE

SEQ ID NO: 192285 - protein, 9 aa, Homo Sapiens
TDQKQKSGE

SEQ ID NO: 192286 - protein, 9 aa, Homo Sapiens
VMELVARAV

SEQ ID NO: 192287 - protein, 9 aa, Homo Sapiens
LTHTYSVHW

SEQ ID NO: 192288 - protein, 9 aa, Homo Sapiens
DVISMTANW

SEQ ID NO: 192289 - protein, 9 aa, Homo Sapiens
ATLARETDE

SEQ ID NO: 192290 - protein, 9 aa, Homo Sapiens
FIVSDLLEL

SEQ ID NO: 192291 - protein, 9 aa, Homo Sapiens
HCSQLAPRA

SEQ ID NO: 192292 - protein, 9 aa, Homo Sapiens
ILAILALCR

SEQ ID NO: 192293 - protein, 9 aa, Homo Sapiens
RIRGLGVSL

SEQ ID NO: 192294 - protein, 9 aa, Homo Sapiens
PLVVGPLRA

SEQ ID NO: 192295 - protein, 9 aa, Homo Sapiens
TIVSVLVIL

SEQ ID NO: 192296 - protein, 9 aa, Homo Sapiens
CLLNVDSRN

SEQ ID NO: 192297 - protein, 9 aa, Homo Sapiens
AAFQNSFGL

SEQ ID NO: 192298 - protein, 9 aa, Homo Sapiens
AIGGHNAPA

SEQ ID NO: 192299 - protein, 9 aa, Homo Sapiens
HNKGTPNPG

SEQ ID NO: 192300 - protein, 9 aa, Homo Sapiens
ETTAATTNS

SEQ ID NO: 192301 - protein, 9 aa, Homo Sapiens
GGCQGGRFD

SEQ ID NO: 192302 - protein, 9 aa, Homo Sapiens
VGGARRSYC

SEQ ID NO: 192303 - protein, 9 aa, Homo Sapiens
RPVLKLRSW

SEQ ID NO: 192304 - protein, 9 aa, Homo Sapiens
PEDVLAMSL

SEQ ID NO: 192305 - protein, 9 aa, Homo Sapiens
NFAIVLQML

SEQ ID NO: 192306 - protein, 9 aa, Homo Sapiens
EKLCEKIRS

SEQ ID NO: 192307 - protein, 9 aa, Homo Sapiens
PSSERNEKK

SEQ ID NO: 192308 - protein, 9 aa, Homo Sapiens
GQTKPEDSD

SEQ ID NO: 192309 - protein, 9 aa, Homo Sapiens
RASGEKVML

SEQ ID NO: 192310 - protein, 9 aa, Homo Sapiens
SECHTPPGS

SEQ ID NO: 192311 - protein, 9 aa, Homo Sapiens
EDAASEAKS

SEQ ID NO: 192312 - protein, 9 aa, Homo Sapiens
MTHSWSPPL

SEQ ID NO: 192313 - protein, 9 aa, Homo Sapiens
LAFTQMPGF

SEQ ID NO: 192314 - protein, 9 aa, Homo Sapiens
KTVGGLIYW

SEQ ID NO: 192315 - protein, 9 aa, Homo Sapiens
VTDARGGQS

SEQ ID NO: 192316 - protein, 9 aa, Homo Sapiens
QGHHTEKLP

SEQ ID NO: 192317 - protein, 9 aa, Homo Sapiens
LNTKYWDSL

SEQ ID NO: 192318 - protein, 9 aa, Homo Sapiens
LEPIKDEKR

SEQ ID NO: 192319 - protein, 9 aa, Homo Sapiens
QALKTISVI

SEQ ID NO: 192320 - protein, 9 aa, Homo Sapiens
IYSTYRLFP

SEQ ID NO: 192321 - protein, 9 aa, Homo Sapiens
TGLPDTPTA

SEQ ID NO: 192322 - protein, 9 aa, Homo Sapiens
ALPEDHDTY

SEQ ID NO: 192323 - protein, 9 aa, Homo Sapiens
ASELRIQLW

SEQ ID NO: 192324 - protein, 9 aa, Homo Sapiens
EIDNILHNK

SEQ ID NO: 192325 - protein, 9 aa, Homo Sapiens
LAFPPPECC

SEQ ID NO: 192326 - protein, 9 aa, Homo Sapiens
MSRRVKSSS

SEQ ID NO: 192327 - protein, 9 aa, Homo Sapiens
WALLGPILQ

SEQ ID NO: 192328 - protein, 9 aa, Homo Sapiens
DVYMEPYYY

SEQ ID NO: 192329 - protein, 9 aa, Homo Sapiens
EQSCNSSFC

SEQ ID NO: 192330 - protein, 9 aa, Homo Sapiens
FAAMSFVLD

SEQ ID NO: 192331 - protein, 9 aa, Homo Sapiens
RMDIDMVEK

SEQ ID NO: 192332 - protein, 9 aa, Homo Sapiens
LKISYKDVI

SEQ ID NO: 192333 - protein, 9 aa, Homo Sapiens
LWLHLRQKH

SEQ ID NO: 192334 - protein, 9 aa, Homo Sapiens
ANLGMLNTV

SEQ ID NO: 192335 - protein, 9 aa, Homo Sapiens
RPRLTPSLA

SEQ ID NO: 192336 - protein, 9 aa, Homo Sapiens
PYYLDFSTN

SEQ ID NO: 192337 - protein, 9 aa, Homo Sapiens
NICPLLRLV

SEQ ID NO: 192338 - protein, 9 aa, Homo Sapiens
RGQRKALWQ

SEQ ID NO: 192339 - protein, 9 aa, Homo Sapiens
LLRHLGLTH

SEQ ID NO: 192340 - protein, 9 aa, Homo Sapiens
YGKCLSVED

SEQ ID NO: 192341 - protein, 9 aa, Homo Sapiens
GSPLRLTLW

SEQ ID NO: 192342 - protein, 9 aa, Homo Sapiens
ICRWLRRFQ

SEQ ID NO: 192343 - protein, 9 aa, Homo Sapiens
VADTAQRSI

SEQ ID NO: 192344 - protein, 9 aa, Homo Sapiens
SDWSKVPSL

SEQ ID NO: 192345 - protein, 9 aa, Homo Sapiens
HLGLTHMNI

SEQ ID NO: 192346 - protein, 9 aa, Homo Sapiens
RELIDVDSE

SEQ ID NO: 192347 - protein, 9 aa, Homo Sapiens
PATGFLYWV

SEQ ID NO: 192348 - protein, 9 aa, Homo Sapiens
LRKTITKNL

SEQ ID NO: 192349 - protein, 9 aa, Homo Sapiens
TGSMATLSS

SEQ ID NO: 192350 - protein, 9 aa, Homo Sapiens
AASSPAVLR

SEQ ID NO: 192351 - protein, 9 aa, Homo Sapiens
LGKTMQTIA

SEQ ID NO: 192352 - protein, 9 aa, Homo Sapiens
PLLAHGYHR

SEQ ID NO: 192353 - protein, 9 aa, Homo Sapiens
HHTSSVEGL

SEQ ID NO: 192354 - protein, 9 aa, Homo Sapiens
RIIMLFDAH

SEQ ID NO: 192355 - protein, 9 aa, Homo Sapiens
ESCLCFTSP

SEQ ID NO: 192356 - protein, 9 aa, Homo Sapiens
TRREGERRE

SEQ ID NO: 192357 - protein, 9 aa, Homo Sapiens
LSITTTTQA

SEQ ID NO: 192358 - protein, 9 aa, Homo Sapiens
HKTPKVHLK

SEQ ID NO: 192359 - protein, 9 aa, Homo Sapiens
GHPRPGSVG

SEQ ID NO: 192360 - protein, 9 aa, Homo Sapiens
SRHIYLQMT

SEQ ID NO: 192361 - protein, 9 aa, Homo Sapiens
ITSLPRAYT

SEQ ID NO: 192362 - protein, 9 aa, Homo Sapiens
SGIHHFARA

SEQ ID NO: 192363 - protein, 9 aa, Homo Sapiens
SMSLRDPVA

SEQ ID NO: 192364 - protein, 9 aa, Homo Sapiens
IQPMLQSSP

SEQ ID NO: 192365 - protein, 9 aa, Homo Sapiens
VHSLRTAAL

SEQ ID NO: 192366 - protein, 9 aa, Homo Sapiens
SHARESELE

SEQ ID NO: 192367 - protein, 9 aa, Homo Sapiens
NIPKTSQCS

SEQ ID NO: 192368 - protein, 9 aa, Homo Sapiens
ARIAYCTTD

SEQ ID NO: 192369 - protein, 9 aa, Homo Sapiens
PYVRVTSSS

SEQ ID NO: 192370 - protein, 9 aa, Homo Sapiens
RCVRLQRHG

SEQ ID NO: 192371 - protein, 9 aa, Homo Sapiens
PWCDYTSYW

SEQ ID NO: 192372 - protein, 9 aa, Homo Sapiens
EVYTDVKHH

SEQ ID NO: 192373 - protein, 9 aa, Homo Sapiens
DSNPPAAAD

SEQ ID NO: 192374 - protein, 9 aa, Homo Sapiens
KGNLLCHIK

SEQ ID NO: 192375 - protein, 9 aa, Homo Sapiens
SSPPRECMH

SEQ ID NO: 192376 - protein, 9 aa, Homo Sapiens
GLVAVAWSG

SEQ ID NO: 192377 - protein, 9 aa, Homo Sapiens
PWEPPGLIF

SEQ ID NO: 192378 - protein, 9 aa, Homo Sapiens
PIMTRKLLR

SEQ ID NO: 192379 - protein, 9 aa, Homo Sapiens
VVVLSFLLI

SEQ ID NO: 192380 - protein, 9 aa, Homo Sapiens
FFSRVAALV

SEQ ID NO: 192381 - protein, 9 aa, Homo Sapiens
RIEVIDGKY

SEQ ID NO: 192382 - protein, 9 aa, Homo Sapiens
TLNRWLGEQ

SEQ ID NO: 192383 - protein, 9 aa, Homo Sapiens
LNADYLQRA

SEQ ID NO: 192384 - protein, 9 aa, Homo Sapiens
SNSESSSDS

SEQ ID NO: 192385 - protein, 9 aa, Homo Sapiens
PQHRYCMDV

SEQ ID NO: 192386 - protein, 9 aa, Homo Sapiens
QKLPVAGDR

SEQ ID NO: 192387 - protein, 9 aa, Homo Sapiens
SGLGFRVLG

SEQ ID NO: 192388 - protein, 9 aa, Homo Sapiens
CQGGHFRYT

SEQ ID NO: 192389 - protein, 9 aa, Homo Sapiens
AWWGLGELR

SEQ ID NO: 192390 - protein, 9 aa, Homo Sapiens
YMRMLMHWG

SEQ ID NO: 192391 - protein, 9 aa, Homo Sapiens
HRGRRQAPG

SEQ ID NO: 192392 - protein, 9 aa, Homo Sapiens
QVAEARSQQ

SEQ ID NO: 192393 - protein, 9 aa, Homo Sapiens
SMRDGPLEL

SEQ ID NO: 192394 - protein, 9 aa, Homo Sapiens
RQTGPSKQH

SEQ ID NO: 192395 - protein, 9 aa, Homo Sapiens
DGDILTANE

SEQ ID NO: 192396 - protein, 9 aa, Homo Sapiens
VVLEKNAVR

SEQ ID NO: 192397 - protein, 9 aa, Homo Sapiens
TNLEDVGRH

SEQ ID NO: 192398 - protein, 9 aa, Homo Sapiens
HQHQLQHSW

SEQ ID NO: 192399 - protein, 9 aa, Homo Sapiens
VQKMPSNQN

SEQ ID NO: 192400 - protein, 9 aa, Homo Sapiens
RRSTGGGRV

SEQ ID NO: 192401 - protein, 9 aa, Homo Sapiens
KGTPNPGLT

SEQ ID NO: 192402 - protein, 9 aa, Homo Sapiens
GHHTEKLPA

SEQ ID NO: 192403 - protein, 9 aa, Homo Sapiens
ACMRFQPSA

SEQ ID NO: 192404 - protein, 9 aa, Homo Sapiens
GPECCLCVS

SEQ ID NO: 192405 - protein, 9 aa, Homo Sapiens
RQCYHGFLN

SEQ ID NO: 192406 - protein, 9 aa, Homo Sapiens
QAAINTAII

SEQ ID NO: 192407 - protein, 9 aa, Homo Sapiens
FSEDARFLL

SEQ ID NO: 192408 - protein, 9 aa, Homo Sapiens
YTSYWTSSP

SEQ ID NO: 192409 - protein, 9 aa, Homo Sapiens
RSTGGGRVR

SEQ ID NO: 192410 - protein, 9 aa, Homo Sapiens
RALASSPPA

SEQ ID NO: 192411 - protein, 9 aa, Homo Sapiens
QAHASQGHF

SEQ ID NO: 192412 - protein, 9 aa, Homo Sapiens
ARPTGPQVA

SEQ ID NO: 192413 - protein, 9 aa, Homo Sapiens
MHHRDRPTT

SEQ ID NO: 192414 - protein, 9 aa, Homo Sapiens
AVTPDHSYM

SEQ ID NO: 192415 - protein, 9 aa, Homo Sapiens
GSLSSSGKL

SEQ ID NO: 192416 - protein, 9 aa, Homo Sapiens
PMRQVEPQA

SEQ ID NO: 192417 - protein, 9 aa, Homo Sapiens
KMIDTGDAL

SEQ ID NO: 192418 - protein, 9 aa, Homo Sapiens
QKEKNVQGI

SEQ ID NO: 192419 - protein, 9 aa, Homo Sapiens
RFLENVLAV

SEQ ID NO: 192420 - protein, 9 aa, Homo Sapiens
VLWTNDGGE

SEQ ID NO: 192421 - protein, 9 aa, Homo Sapiens
EHELLEAVD

SEQ ID NO: 192422 - protein, 9 aa, Homo Sapiens
IIHTSAKPF

SEQ ID NO: 192423 - protein, 9 aa, Homo Sapiens
RASVSFWTL

SEQ ID NO: 192424 - protein, 9 aa, Homo Sapiens
ELHLPAPPS

SEQ ID NO: 192425 - protein, 9 aa, Homo Sapiens
KHVGPSFVQ

SEQ ID NO: 192426 - protein, 9 aa, Homo Sapiens
AMPSQGPAG

SEQ ID NO: 192427 - protein, 9 aa, Homo Sapiens
VISRSGEPV

SEQ ID NO: 192428 - protein, 9 aa, Homo Sapiens
DYYSPYGML

SEQ ID NO: 192429 - protein, 9 aa, Homo Sapiens
GLLPGEAAP

SEQ ID NO: 192430 - protein, 9 aa, Homo Sapiens
IPQYEVNPQ

SEQ ID NO: 192431 - protein, 9 aa, Homo Sapiens
MEVSSDVFF

SEQ ID NO: 192432 - protein, 9 aa, Homo Sapiens
DKRSGAQHD

SEQ ID NO: 192433 - protein, 9 aa, Homo Sapiens
IQLWRTHQA

SEQ ID NO: 192434 - protein, 9 aa, Homo Sapiens
VELKVAPLG

SEQ ID NO: 192435 - protein, 9 aa, Homo Sapiens
EPYCRIEPE

SEQ ID NO: 192436 - protein, 9 aa, Homo Sapiens
QGSIQPQEP

SEQ ID NO: 192437 - protein, 9 aa, Homo Sapiens
HDMDPNEAK

SEQ ID NO: 192438 - protein, 9 aa, Homo Sapiens
RKRCSASSG

SEQ ID NO: 192439 - protein, 9 aa, Homo Sapiens
SADENLKSH

SEQ ID NO: 192440 - protein, 9 aa, Homo Sapiens
MCPPEIGDF

SEQ ID NO: 192441 - protein, 9 aa, Homo Sapiens
LSLFIPREM

SEQ ID NO: 192442 - protein, 9 aa, Homo Sapiens
LGENHSQAL

SEQ ID NO: 192443 - protein, 9 aa, Homo Sapiens
HVIPTEKPS

SEQ ID NO: 192444 - protein, 9 aa, Homo Sapiens
STTSGGSQA

SEQ ID NO: 192445 - protein, 9 aa, Homo Sapiens
VSTTEPCKP

SEQ ID NO: 192446 - protein, 9 aa, Homo Sapiens
SCRLSQYPN

SEQ ID NO: 192447 - protein, 9 aa, Homo Sapiens
YSGSSNSES

SEQ ID NO: 192448 - protein, 9 aa, Homo Sapiens
HRGAQCHVC

SEQ ID NO: 192449 - protein, 9 aa, Homo Sapiens
MDRKQEQPC

SEQ ID NO: 192450 - protein, 9 aa, Homo Sapiens
ERPLRGGKR

SEQ ID NO: 192451 - protein, 9 aa, Homo Sapiens
HHSRETPLK

SEQ ID NO: 192452 - protein, 9 aa, Homo Sapiens
LQDLALQGT

SEQ ID NO: 192453 - protein, 9 aa, Homo Sapiens
ANLDVFIKK

SEQ ID NO: 192454 - protein, 9 aa, Homo Sapiens
ENLCLINEC

SEQ ID NO: 192455 - protein, 9 aa, Homo Sapiens
VGKLSAGVP

SEQ ID NO: 192456 - protein, 9 aa, Homo Sapiens
GSSNSESSS

SEQ ID NO: 192457 - protein, 9 aa, Homo Sapiens
VIRYFYTEK

SEQ ID NO: 192458 - protein, 9 aa, Homo Sapiens
FPLKEETPK

SEQ ID NO: 192459 - protein, 9 aa, Homo Sapiens
DEAILYLVV

SEQ ID NO: 192460 - protein, 9 aa, Homo Sapiens
CEFCEQRFI

SEQ ID NO: 192461 - protein, 9 aa, Homo Sapiens
FYDWSARYF

SEQ ID NO: 192462 - protein, 9 aa, Homo Sapiens
AGEVQRRCR

SEQ ID NO: 192463 - protein, 9 aa, Homo Sapiens
MSHRNPRTN

SEQ ID NO: 192464 - protein, 9 aa, Homo Sapiens
LKVLEAVCQ

SEQ ID NO: 192465 - protein, 9 aa, Homo Sapiens
FVFHKIDIN

SEQ ID NO: 192466 - protein, 9 aa, Homo Sapiens
LVSHTCYPL

SEQ ID NO: 192467 - protein, 9 aa, Homo Sapiens
TDPTGLSSP

SEQ ID NO: 192468 - protein, 9 aa, Homo Sapiens
GRMETELAL

SEQ ID NO: 192469 - protein, 9 aa, Homo Sapiens
FPPWIDGRK

SEQ ID NO: 192470 - protein, 9 aa, Homo Sapiens
EDTPDNSSL

SEQ ID NO: 192471 - protein, 9 aa, Homo Sapiens
SIQPQEPLA

SEQ ID NO: 192472 - protein, 9 aa, Homo Sapiens
GEELVDDHS

SEQ ID NO: 192473 - protein, 9 aa, Homo Sapiens
LWRQLATLG

SEQ ID NO: 192474 - protein, 9 aa, Homo Sapiens
QRCLELKPD

SEQ ID NO: 192475 - protein, 9 aa, Homo Sapiens
ECVLYKSVS

SEQ ID NO: 192476 - protein, 9 aa, Homo Sapiens
QEMLALPSL

SEQ ID NO: 192477 - protein, 9 aa, Homo Sapiens
IEFTEGKDK

SEQ ID NO: 192478 - protein, 9 aa, Homo Sapiens
ARRSYCAPP

SEQ ID NO: 192479 - protein, 9 aa, Homo Sapiens
TLCYEERIT

SEQ ID NO: 192480 - protein, 9 aa, Homo Sapiens
RLLIIDGQQ

SEQ ID NO: 192481 - protein, 9 aa, Homo Sapiens
TSYWTSSPK

SEQ ID NO: 192482 - protein, 9 aa, Homo Sapiens
EFHKDSSTW

SEQ ID NO: 192483 - protein, 9 aa, Homo Sapiens
FICNYVPGG

SEQ ID NO: 192484 - protein, 9 aa, Homo Sapiens
RPFPHLCNV

SEQ ID NO: 192485 - protein, 9 aa, Homo Sapiens
MASFLNGLA

SEQ ID NO: 192486 - protein, 9 aa, Homo Sapiens
NMRRMHTAV

SEQ ID NO: 192487 - protein, 9 aa, Homo Sapiens
DLMHTLHTW

SEQ ID NO: 192488 - protein, 9 aa, Homo Sapiens
TDSLSHLRS

SEQ ID NO: 192489 - protein, 9 aa, Homo Sapiens
SPVPLAQGE

SEQ ID NO: 192490 - protein, 9 aa, Homo Sapiens
RPVQGLSET

SEQ ID NO: 192491 - protein, 9 aa, Homo Sapiens
DPTFLGKKE

SEQ ID NO: 192492 - protein, 9 aa, Homo Sapiens
EEPFPSVRS

SEQ ID NO: 192493 - protein, 9 aa, Homo Sapiens
EHVRSPLEP

SEQ ID NO: 192494 - protein, 9 aa, Homo Sapiens
RWPGHLRGE

SEQ ID NO: 192495 - protein, 9 aa, Homo Sapiens
ANSERDNGG

SEQ ID NO: 192496 - protein, 9 aa, Homo Sapiens
SGVTILFDE

SEQ ID NO: 192497 - protein, 9 aa, Homo Sapiens
PAVAHEGNY

SEQ ID NO: 192498 - protein, 9 aa, Homo Sapiens
FRVGSQLKQ

SEQ ID NO: 192499 - protein, 9 aa, Homo Sapiens
VDHFSCTHL

SEQ ID NO: 192500 - protein, 9 aa, Homo Sapiens
TAASGGVMA

SEQ ID NO: 192501 - protein, 9 aa, Homo Sapiens
GACTEPWEP

SEQ ID NO: 192502 - protein, 9 aa, Homo Sapiens
AKPHSLEAP

SEQ ID NO: 192503 - protein, 9 aa, Homo Sapiens
PHPRALASS

SEQ ID NO: 192504 - protein, 9 aa, Homo Sapiens
CRVKKADPP

SEQ ID NO: 192505 - protein, 9 aa, Homo Sapiens
SGQSLGCQP

SEQ ID NO: 192506 - protein, 9 aa, Homo Sapiens
RLHCMVILF

SEQ ID NO: 192507 - protein, 9 aa, Homo Sapiens
LKEALSPIK

SEQ ID NO: 192508 - protein, 9 aa, Homo Sapiens
SRSVIMDTK

SEQ ID NO: 192509 - protein, 9 aa, Homo Sapiens
IQNHWFTYN

SEQ ID NO: 192510 - protein, 9 aa, Homo Sapiens
AAHCMDYQK

SEQ ID NO: 192511 - protein, 9 aa, Homo Sapiens
SRPSSDELS

SEQ ID NO: 192512 - protein, 9 aa, Homo Sapiens
DSIMLVEED

SEQ ID NO: 192513 - protein, 9 aa, Homo Sapiens
LRQCYHGFL

SEQ ID NO: 192514 - protein, 9 aa, Homo Sapiens
KFITILCTC

SEQ ID NO: 192515 - protein, 9 aa, Homo Sapiens
LYTVAIILR

SEQ ID NO: 192516 - protein, 9 aa, Homo Sapiens
NVQSRAQML

SEQ ID NO: 192517 - protein, 9 aa, Homo Sapiens
VWALLGPIL

SEQ ID NO: 192518 - protein, 9 aa, Homo Sapiens
DLRQYMDKH

SEQ ID NO: 192519 - protein, 9 aa, Homo Sapiens
PGYDRHSAL

SEQ ID NO: 192520 - protein, 9 aa, Homo Sapiens
VEKVYQPVP

SEQ ID NO: 192521 - protein, 9 aa, Homo Sapiens
TCPLFLELP

SEQ ID NO: 192522 - protein, 9 aa, Homo Sapiens
PEEKKKILL

SEQ ID NO: 192523 - protein, 9 aa, Homo Sapiens
SEQETKDLP

SEQ ID NO: 192524 - protein, 9 aa, Homo Sapiens
AWGTSSCLL

SEQ ID NO: 192525 - protein, 9 aa, Homo Sapiens
FSADEVFHR

SEQ ID NO: 192526 - protein, 9 aa, Homo Sapiens
QNPSRMDRI

SEQ ID NO: 192527 - protein, 9 aa, Homo Sapiens
QLRCIPCKD

SEQ ID NO: 192528 - protein, 9 aa, Homo Sapiens
SVPRPSRQF

SEQ ID NO: 192529 - protein, 9 aa, Homo Sapiens
QPVPEQLQL

SEQ ID NO: 192530 - protein, 9 aa, Homo Sapiens
VPVRGRTTS

SEQ ID NO: 192531 - protein, 9 aa, Homo Sapiens
REPAPGAGG

SEQ ID NO: 192532 - protein, 9 aa, Homo Sapiens
PSWPVHFQQ

SEQ ID NO: 192533 - protein, 9 aa, Homo Sapiens
TLQRGWGLQ

SEQ ID NO: 192534 - protein, 9 aa, Homo Sapiens
QSRKRGHTA

SEQ ID NO: 192535 - protein, 9 aa, Homo Sapiens
RSISKYRCV

SEQ ID NO: 192536 - protein, 9 aa, Homo Sapiens
LHPLLASPS

SEQ ID NO: 192537 - protein, 9 aa, Homo Sapiens
HFHFTVRYI

SEQ ID NO: 192538 - protein, 9 aa, Homo Sapiens
AYDLGHVER

SEQ ID NO: 192539 - protein, 9 aa, Homo Sapiens
HGLIRRDGI

SEQ ID NO: 192540 - protein, 9 aa, Homo Sapiens
SGGSATGAH

SEQ ID NO: 192541 - protein, 9 aa, Homo Sapiens
ANAPLQCIR

SEQ ID NO: 192542 - protein, 9 aa, Homo Sapiens
NILAAILNV

SEQ ID NO: 192543 - protein, 9 aa, Homo Sapiens
MPYSAAFLL

SEQ ID NO: 192544 - protein, 9 aa, Homo Sapiens
SKATAMALG

SEQ ID NO: 192545 - protein, 9 aa, Homo Sapiens
ENFNMEAFT

SEQ ID NO: 192546 - protein, 9 aa, Homo Sapiens
AMTKQDQIS

SEQ ID NO: 192547 - protein, 9 aa, Homo Sapiens
AMEQGGAFS

SEQ ID NO: 192548 - protein, 9 aa, Homo Sapiens
MINSKWFDD

SEQ ID NO: 192549 - protein, 9 aa, Homo Sapiens
TYRLSTETL

SEQ ID NO: 192550 - protein, 9 aa, Homo Sapiens
LLAKGKKPR

SEQ ID NO: 192551 - protein, 9 aa, Homo Sapiens
MPDNASQEE

SEQ ID NO: 192552 - protein, 9 aa, Homo Sapiens
MELCCDAAQ

SEQ ID NO: 192553 - protein, 9 aa, Homo Sapiens
VATKDGDVA

SEQ ID NO: 192554 - protein, 9 aa, Homo Sapiens
LLQGEQLHR

SEQ ID NO: 192555 - protein, 9 aa, Homo Sapiens
FHQELIHTP

SEQ ID NO: 192556 - protein, 9 aa, Homo Sapiens
RMHRFVLHL

SEQ ID NO: 192557 - protein, 9 aa, Homo Sapiens
AMLSIHQLV

SEQ ID NO: 192558 - protein, 9 aa, Homo Sapiens
AVTPLKLAG

SEQ ID NO: 192559 - protein, 9 aa, Homo Sapiens
DRTPRPTSP

SEQ ID NO: 192560 - protein, 9 aa, Homo Sapiens
LQDGLPVLI

SEQ ID NO: 192561 - protein, 9 aa, Homo Sapiens
LLPSQDLHL

SEQ ID NO: 192562 - protein, 9 aa, Homo Sapiens
QQAHSALGI

SEQ ID NO: 192563 - protein, 9 aa, Homo Sapiens
QVLKSKDPR

SEQ ID NO: 192564 - protein, 9 aa, Homo Sapiens
LHAKGDSCT

SEQ ID NO: 192565 - protein, 9 aa, Homo Sapiens
LRITWQQNY

SEQ ID NO: 192566 - protein, 9 aa, Homo Sapiens
HHRDRPTTG

SEQ ID NO: 192567 - protein, 9 aa, Homo Sapiens
WRGRCHDHF

SEQ ID NO: 192568 - protein, 9 aa, Homo Sapiens
GLSQNLLLH

SEQ ID NO: 192569 - protein, 9 aa, Homo Sapiens
LYLVLHTEQ

SEQ ID NO: 192570 - protein, 9 aa, Homo Sapiens
LHTEQPGPY

SEQ ID NO: 192571 - protein, 9 aa, Homo Sapiens
LGILVGSFI

SEQ ID NO: 192572 - protein, 9 aa, Homo Sapiens
PRYSTSCPR

SEQ ID NO: 192573 - protein, 9 aa, Homo Sapiens
LTDASGGWH

SEQ ID NO: 192574 - protein, 9 aa, Homo Sapiens
IEFVKLSYS

SEQ ID NO: 192575 - protein, 9 aa, Homo Sapiens
QLLEFMYQL

SEQ ID NO: 192576 - protein, 9 aa, Homo Sapiens
EAGVENLFI

SEQ ID NO: 192577 - protein, 9 aa, Homo Sapiens
AELAVNYSL

SEQ ID NO: 192578 - protein, 9 aa, Homo Sapiens
LGVAPMGQY

SEQ ID NO: 192579 - protein, 9 aa, Homo Sapiens
ISSGQSLGC

SEQ ID NO: 192580 - protein, 9 aa, Homo Sapiens
SIAIHAKLL

SEQ ID NO: 192581 - protein, 9 aa, Homo Sapiens
GVRTRGSPL

SEQ ID NO: 192582 - protein, 9 aa, Homo Sapiens
CIKCVKAFS

SEQ ID NO: 192583 - protein, 9 aa, Homo Sapiens
RLGIRGPGD

SEQ ID NO: 192584 - protein, 9 aa, Homo Sapiens
TAVGFIHLV

SEQ ID NO: 192585 - protein, 9 aa, Homo Sapiens
LTALHIKKT

SEQ ID NO: 192586 - protein, 9 aa, Homo Sapiens
HIKEILNKH

SEQ ID NO: 192587 - protein, 9 aa, Homo Sapiens
LGLAVISAS

SEQ ID NO: 192588 - protein, 9 aa, Homo Sapiens
DRHSALHVA

SEQ ID NO: 192589 - protein, 9 aa, Homo Sapiens
RLDYGGGYG

SEQ ID NO: 192590 - protein, 9 aa, Homo Sapiens
VIQDFIFFV

SEQ ID NO: 192591 - protein, 9 aa, Homo Sapiens
ADPAEAGVG

SEQ ID NO: 192592 - protein, 9 aa, Homo Sapiens
HTGICYHIC

SEQ ID NO: 192593 - protein, 9 aa, Homo Sapiens
PAALKDRHM

SEQ ID NO: 192594 - protein, 9 aa, Homo Sapiens
NCVNLIYGT

SEQ ID NO: 192595 - protein, 9 aa, Homo Sapiens
TITDTCNRI

SEQ ID NO: 192596 - protein, 9 aa, Homo Sapiens
THIWGKCSV

SEQ ID NO: 192597 - protein, 9 aa, Homo Sapiens
WSPWMPCTH

SEQ ID NO: 192598 - protein, 9 aa, Homo Sapiens
TNAGTSGLG

SEQ ID NO: 192599 - protein, 9 aa, Homo Sapiens
FLYKTVGGL

SEQ ID NO: 192600 - protein, 9 aa, Homo Sapiens
GGEKAGHPR

SEQ ID NO: 192601 - protein, 9 aa, Homo Sapiens
AVVQTMPPH

SEQ ID NO: 192602 - protein, 9 aa, Homo Sapiens
HRPNMELCC

SEQ ID NO: 192603 - protein, 9 aa, Homo Sapiens
ALLIQEAKR

SEQ ID NO: 192604 - protein, 9 aa, Homo Sapiens
KRIKAGNVI

SEQ ID NO: 192605 - protein, 9 aa, Homo Sapiens
LLSSSSAQD

SEQ ID NO: 192606 - protein, 9 aa, Homo Sapiens
NFTPSGPLT

SEQ ID NO: 192607 - protein, 9 aa, Homo Sapiens
LIAHSIHDH

SEQ ID NO: 192608 - protein, 9 aa, Homo Sapiens
ANFNPSRPG

SEQ ID NO: 192609 - protein, 9 aa, Homo Sapiens
YLTHFLKEV

SEQ ID NO: 192610 - protein, 9 aa, Homo Sapiens
NWLGASVLT

SEQ ID NO: 192611 - protein, 9 aa, Homo Sapiens
SRAQMLLDQ

SEQ ID NO: 192612 - protein, 9 aa, Homo Sapiens
SVATTTPGP

SEQ ID NO: 192613 - protein, 9 aa, Homo Sapiens
LLSVFTGYE

SEQ ID NO: 192614 - protein, 9 aa, Homo Sapiens
EWMVKCVVQ

SEQ ID NO: 192615 - protein, 9 aa, Homo Sapiens
VQADRAMYL

SEQ ID NO: 192616 - protein, 9 aa, Homo Sapiens
RQKTILVAH

SEQ ID NO: 192617 - protein, 9 aa, Homo Sapiens
LQLAKQEWG

SEQ ID NO: 192618 - protein, 9 aa, Homo Sapiens
HLDVVMPAV

SEQ ID NO: 192619 - protein, 9 aa, Homo Sapiens
VHHERKYAP

SEQ ID NO: 192620 - protein, 9 aa, Homo Sapiens
SGDQGQTIW

SEQ ID NO: 192621 - protein, 9 aa, Homo Sapiens
MKEVAELKD

SEQ ID NO: 192622 - protein, 9 aa, Homo Sapiens
AQQAQNVQC

SEQ ID NO: 192623 - protein, 9 aa, Homo Sapiens
EAAPRDIGY

SEQ ID NO: 192624 - protein, 9 aa, Homo Sapiens
SNCCQHSSV

SEQ ID NO: 192625 - protein, 9 aa, Homo Sapiens
NFVFHKIDI

SEQ ID NO: 192626 - protein, 9 aa, Homo Sapiens
APPRPAAGH

SEQ ID NO: 192627 - protein, 9 aa, Homo Sapiens
QMEPDQLPR

SEQ ID NO: 192628 - protein, 9 aa, Homo Sapiens
LSTRGEPTE

SEQ ID NO: 192629 - protein, 9 aa, Homo Sapiens
AMAQTVPID

SEQ ID NO: 192630 - protein, 9 aa, Homo Sapiens
SHLSGSLHT

SEQ ID NO: 192631 - protein, 9 aa, Homo Sapiens
SAQGTEDTP

SEQ ID NO: 192632 - protein, 9 aa, Homo Sapiens
ISSGCSSVS

SEQ ID NO: 192633 - protein, 9 aa, Homo Sapiens
LRLLLGLPR

SEQ ID NO: 192634 - protein, 9 aa, Homo Sapiens
SSTEALNDN

SEQ ID NO: 192635 - protein, 9 aa, Homo Sapiens
TWSQKRALE

SEQ ID NO: 192636 - protein, 9 aa, Homo Sapiens
CVKAFSTHS

SEQ ID NO: 192637 - protein, 9 aa, Homo Sapiens
DPKRPPPPR

SEQ ID NO: 192638 - protein, 9 aa, Homo Sapiens
GKRLRVVSP

SEQ ID NO: 192639 - protein, 9 aa, Homo Sapiens
ESIPHLFPQ

SEQ ID NO: 192640 - protein, 9 aa, Homo Sapiens
YLCAECVKG

SEQ ID NO: 192641 - protein, 9 aa, Homo Sapiens
SNAMPSQGP

SEQ ID NO: 192642 - protein, 9 aa, Homo Sapiens
DTTETAHAP

SEQ ID NO: 192643 - protein, 9 aa, Homo Sapiens
YYSPYGMLA

SEQ ID NO: 192644 - protein, 9 aa, Homo Sapiens
TDEPMGIAL

SEQ ID NO: 192645 - protein, 9 aa, Homo Sapiens
ANGAGWPCP

SEQ ID NO: 192646 - protein, 9 aa, Homo Sapiens
PQGYRMEQS

SEQ ID NO: 192647 - protein, 9 aa, Homo Sapiens
MELATICAL

SEQ ID NO: 192648 - protein, 9 aa, Homo Sapiens
DMSRTCGNQ

SEQ ID NO: 192649 - protein, 9 aa, Homo Sapiens
FPGCFTQYF

SEQ ID NO: 192650 - protein, 9 aa, Homo Sapiens
LSGSLHTCK

SEQ ID NO: 192651 - protein, 9 aa, Homo Sapiens
LHYVYECIE

SEQ ID NO: 192652 - protein, 9 aa, Homo Sapiens
MRLELDALC

SEQ ID NO: 192653 - protein, 9 aa, Homo Sapiens
GISCLQGLG

SEQ ID NO: 192654 - protein, 9 aa, Homo Sapiens
GQTSSKTAF

SEQ ID NO: 192655 - protein, 9 aa, Homo Sapiens
IAVDCYLAI

SEQ ID NO: 192656 - protein, 9 aa, Homo Sapiens
VMLKQTHVL

SEQ ID NO: 192657 - protein, 9 aa, Homo Sapiens
WPQPLTFSP

SEQ ID NO: 192658 - protein, 9 aa, Homo Sapiens
DVINRSMVE

SEQ ID NO: 192659 - protein, 9 aa, Homo Sapiens
FNPSRPGPP

SEQ ID NO: 192660 - protein, 9 aa, Homo Sapiens
LLTSAGCVE

SEQ ID NO: 192661 - protein, 9 aa, Homo Sapiens
WREAVKSYK

SEQ ID NO: 192662 - protein, 9 aa, Homo Sapiens
INSSSYWIG

SEQ ID NO: 192663 - protein, 9 aa, Homo Sapiens
ECMHHMGSE

SEQ ID NO: 192664 - protein, 9 aa, Homo Sapiens
QRQSPWHIY

SEQ ID NO: 192665 - protein, 9 aa, Homo Sapiens
CVIYYYLTK

SEQ ID NO: 192666 - protein, 9 aa, Homo Sapiens
PDALYPNRV

SEQ ID NO: 192667 - protein, 9 aa, Homo Sapiens
AAPLRHGMP

SEQ ID NO: 192668 - protein, 9 aa, Homo Sapiens
GTLIPLAFL

SEQ ID NO: 192669 - protein, 9 aa, Homo Sapiens
QGPCANTLC

SEQ ID NO: 192670 - protein, 9 aa, Homo Sapiens
ACGALLLAL

SEQ ID NO: 192671 - protein, 9 aa, Homo Sapiens
KGSPMPGFS

SEQ ID NO: 192672 - protein, 9 aa, Homo Sapiens
LVVVGADGV

SEQ ID NO: 192673 - protein, 9 aa, Homo Sapiens
KTSYSLVKK

SEQ ID NO: 192674 - protein, 9 aa, Homo Sapiens
LKKRRTYAA

SEQ ID NO: 192675 - protein, 9 aa, Homo Sapiens
QRKILATQG

SEQ ID NO: 192676 - protein, 9 aa, Homo Sapiens
QWQRRGSLF

SEQ ID NO: 192677 - protein, 9 aa, Homo Sapiens
TSHPRGVKR

SEQ ID NO: 192678 - protein, 9 aa, Homo Sapiens
KMVKEGPFG

SEQ ID NO: 192679 - protein, 9 aa, Homo Sapiens
SYKDVINRS

SEQ ID NO: 192680 - protein, 9 aa, Homo Sapiens
PKNATSEST

SEQ ID NO: 192681 - protein, 9 aa, Homo Sapiens
PLCARAKEE

SEQ ID NO: 192682 - protein, 9 aa, Homo Sapiens
GAPAPLLSS

SEQ ID NO: 192683 - protein, 9 aa, Homo Sapiens
TQRIFELGL

SEQ ID NO: 192684 - protein, 9 aa, Homo Sapiens
REVMFSMLM

SEQ ID NO: 192685 - protein, 9 aa, Homo Sapiens
EDAKTDGEE

SEQ ID NO: 192686 - protein, 9 aa, Homo Sapiens
SVIRTNFST

SEQ ID NO: 192687 - protein, 9 aa, Homo Sapiens
GGSKPWASS

SEQ ID NO: 192688 - protein, 9 aa, Homo Sapiens
CPLLRLVCK

SEQ ID NO: 192689 - protein, 9 aa, Homo Sapiens
QDPKAVDED

SEQ ID NO: 192690 - protein, 9 aa, Homo Sapiens
LAHELVKSK

SEQ ID NO: 192691 - protein, 9 aa, Homo Sapiens
SLEPLARLA

SEQ ID NO: 192692 - protein, 9 aa, Homo Sapiens
TLDSDVYME

SEQ ID NO: 192693 - protein, 9 aa, Homo Sapiens
CLKVKGIQE

SEQ ID NO: 192694 - protein, 9 aa, Homo Sapiens
DSLTTTEDN

SEQ ID NO: 192695 - protein, 9 aa, Homo Sapiens
TVMNSRQGI

SEQ ID NO: 192696 - protein, 9 aa, Homo Sapiens
TLVIPLTDV

SEQ ID NO: 192697 - protein, 9 aa, Homo Sapiens
EQGCQGDGG

SEQ ID NO: 192698 - protein, 9 aa, Homo Sapiens
VQHPLDRLF

SEQ ID NO: 192699 - protein, 9 aa, Homo Sapiens
GRLALHRAP

SEQ ID NO: 192700 - protein, 9 aa, Homo Sapiens
VSAVPNITW

SEQ ID NO: 192701 - protein, 9 aa, Homo Sapiens
TFRVLQALK

SEQ ID NO: 192702 - protein, 9 aa, Homo Sapiens
SDVYMEPYY

SEQ ID NO: 192703 - protein, 9 aa, Homo Sapiens
WSPGILPVI

SEQ ID NO: 192704 - protein, 9 aa, Homo Sapiens
LRNALWHTR

SEQ ID NO: 192705 - protein, 9 aa, Homo Sapiens
KQDYVFACE

SEQ ID NO: 192706 - protein, 9 aa, Homo Sapiens
KAGGLPGTA

SEQ ID NO: 192707 - protein, 9 aa, Homo Sapiens
ATPLWRQDG

SEQ ID NO: 192708 - protein, 9 aa, Homo Sapiens
AFIVSDLLE

SEQ ID NO: 192709 - protein, 9 aa, Homo Sapiens
VVPVPLLSV

SEQ ID NO: 192710 - protein, 9 aa, Homo Sapiens
VPQPPMESC

SEQ ID NO: 192711 - protein, 9 aa, Homo Sapiens
QKLLVKETR

SEQ ID NO: 192712 - protein, 9 aa, Homo Sapiens
GYCHGEAVY

SEQ ID NO: 192713 - protein, 9 aa, Homo Sapiens
LNTITDTCN

SEQ ID NO: 192714 - protein, 9 aa, Homo Sapiens
IPRDYSPEL

SEQ ID NO: 192715 - protein, 9 aa, Homo Sapiens
TMLALALSQ

SEQ ID NO: 192716 - protein, 9 aa, Homo Sapiens
LKAPLATAT

SEQ ID NO: 192717 - protein, 9 aa, Homo Sapiens
ELGEEVILE

SEQ ID NO: 192718 - protein, 9 aa, Homo Sapiens
TEETEGLTY

SEQ ID NO: 192719 - protein, 9 aa, Homo Sapiens
EVLLSSVDK

SEQ ID NO: 192720 - protein, 9 aa, Homo Sapiens
REVAAYLHG

SEQ ID NO: 192721 - protein, 9 aa, Homo Sapiens
YKDMLKAHS

SEQ ID NO: 192722 - protein, 9 aa, Homo Sapiens
GVYWREAVK

SEQ ID NO: 192723 - protein, 9 aa, Homo Sapiens
MALSLASAS

SEQ ID NO: 192724 - protein, 9 aa, Homo Sapiens
PVALPEMVC

SEQ ID NO: 192725 - protein, 9 aa, Homo Sapiens
EYLCAECVK

SEQ ID NO: 192726 - protein, 9 aa, Homo Sapiens
RLTHQRHHS

SEQ ID NO: 192727 - protein, 9 aa, Homo Sapiens
LGAYSGSSN

SEQ ID NO: 192728 - protein, 9 aa, Homo Sapiens
QEFYKNAKV

SEQ ID NO: 192729 - protein, 9 aa, Homo Sapiens
PPTPASHQR

SEQ ID NO: 192730 - protein, 9 aa, Homo Sapiens
SSHLSGSLH

SEQ ID NO: 192731 - protein, 9 aa, Homo Sapiens
PRRTLFIKH

SEQ ID NO: 192732 - protein, 9 aa, Homo Sapiens
VVLQWSQEF

SEQ ID NO: 192733 - protein, 9 aa, Homo Sapiens
QVINGEKLG

SEQ ID NO: 192734 - protein, 9 aa, Homo Sapiens
RQGKEWQGD

SEQ ID NO: 192735 - protein, 9 aa, Homo Sapiens
TATARTPAW

SEQ ID NO: 192736 - protein, 9 aa, Homo Sapiens
GPVVVHCST

SEQ ID NO: 192737 - protein, 9 aa, Homo Sapiens
KKNDPTFLG

SEQ ID NO: 192738 - protein, 9 aa, Homo Sapiens
LRPGDLVFL

SEQ ID NO: 192739 - protein, 9 aa, Homo Sapiens
ALMGPPLPG

SEQ ID NO: 192740 - protein, 9 aa, Homo Sapiens
RRCFVRIRA

SEQ ID NO: 192741 - protein, 9 aa, Homo Sapiens
HRWLQQTTG

SEQ ID NO: 192742 - protein, 9 aa, Homo Sapiens
VLGGEVIAW

SEQ ID NO: 192743 - protein, 9 aa, Homo Sapiens
EQRCFARYL

SEQ ID NO: 192744 - protein, 9 aa, Homo Sapiens
SVQINSVGS

SEQ ID NO: 192745 - protein, 9 aa, Homo Sapiens
DSDVYMEPY

SEQ ID NO: 192746 - protein, 9 aa, Homo Sapiens
ELKKKTYCY

SEQ ID NO: 192747 - protein, 9 aa, Homo Sapiens
HMQICDQCG

SEQ ID NO: 192748 - protein, 9 aa, Homo Sapiens
SSDGTCALW

SEQ ID NO: 192749 - protein, 9 aa, Homo Sapiens
ENASNSMLP

SEQ ID NO: 192750 - protein, 9 aa, Homo Sapiens
ERHELTNDR

SEQ ID NO: 192751 - protein, 9 aa, Homo Sapiens
ALNDNQEFP

SEQ ID NO: 192752 - protein, 9 aa, Homo Sapiens
KMDEVQNHI

SEQ ID NO: 192753 - protein, 9 aa, Homo Sapiens
TANPMVAKR

SEQ ID NO: 192754 - protein, 9 aa, Homo Sapiens
LGKRPFPHL

SEQ ID NO: 192755 - protein, 9 aa, Homo Sapiens
AAAGAAGRV

SEQ ID NO: 192756 - protein, 9 aa, Homo Sapiens
STAVDDLDE

SEQ ID NO: 192757 - protein, 9 aa, Homo Sapiens
LVWWEKNEM

SEQ ID NO: 192758 - protein, 9 aa, Homo Sapiens
IVNCYWAQL

SEQ ID NO: 192759 - protein, 9 aa, Homo Sapiens
ASEKQVVLL

SEQ ID NO: 192760 - protein, 9 aa, Homo Sapiens
GCGGSCCRS

SEQ ID NO: 192761 - protein, 9 aa, Homo Sapiens
RGLARSWAP

SEQ ID NO: 192762 - protein, 9 aa, Homo Sapiens
LSHSSCRQR

SEQ ID NO: 192763 - protein, 9 aa, Homo Sapiens
RFLWMWAVE

SEQ ID NO: 192764 - protein, 9 aa, Homo Sapiens
DKWSRLIEG

SEQ ID NO: 192765 - protein, 9 aa, Homo Sapiens
EELTLMEAL

SEQ ID NO: 192766 - protein, 9 aa, Homo Sapiens
GSYDCACSP

SEQ ID NO: 192767 - protein, 9 aa, Homo Sapiens
GKPVVTTFS

SEQ ID NO: 192768 - protein, 9 aa, Homo Sapiens
HPQRLPAAG

SEQ ID NO: 192769 - protein, 9 aa, Homo Sapiens
LPAAGEVQR

SEQ ID NO: 192770 - protein, 9 aa, Homo Sapiens
PQQAGWSSQ

SEQ ID NO: 192771 - protein, 9 aa, Homo Sapiens
PPYRLQPGR

SEQ ID NO: 192772 - protein, 9 aa, Homo Sapiens
SQVQADRAM

SEQ ID NO: 192773 - protein, 9 aa, Homo Sapiens
FSDVVSTTE

SEQ ID NO: 192774 - protein, 9 aa, Homo Sapiens
RGDSFPDDR

SEQ ID NO: 192775 - protein, 9 aa, Homo Sapiens
ALRKVLRKG

SEQ ID NO: 192776 - protein, 9 aa, Homo Sapiens
FTHTRWVAP

SEQ ID NO: 192777 - protein, 9 aa, Homo Sapiens
ETCSVRSFM

SEQ ID NO: 192778 - protein, 9 aa, Homo Sapiens
GEMSYKCIE

SEQ ID NO: 192779 - protein, 9 aa, Homo Sapiens
GNLQLAKQE

SEQ ID NO: 192780 - protein, 9 aa, Homo Sapiens
PLESSVPQQ

SEQ ID NO: 192781 - protein, 9 aa, Homo Sapiens
LNNMRVEYE

SEQ ID NO: 192782 - protein, 9 aa, Homo Sapiens
VHSLVLKAL

SEQ ID NO: 192783 - protein, 9 aa, Homo Sapiens
AQAHQLVAA

SEQ ID NO: 192784 - protein, 9 aa, Homo Sapiens
PHLDVVMPA

SEQ ID NO: 192785 - protein, 9 aa, Homo Sapiens
HTVAYINVD

SEQ ID NO: 192786 - protein, 9 aa, Homo Sapiens
FKNTLVIPL

SEQ ID NO: 192787 - protein, 9 aa, Homo Sapiens
KPEPKPAMA

SEQ ID NO: 192788 - protein, 9 aa, Homo Sapiens
KWFKQHLAK

SEQ ID NO: 192789 - protein, 9 aa, Homo Sapiens
PLSAEALAN

SEQ ID NO: 192790 - protein, 9 aa, Homo Sapiens
IFSAMDIMG

SEQ ID NO: 192791 - protein, 9 aa, Homo Sapiens
EHYVQDVME

SEQ ID NO: 192792 - protein, 9 aa, Homo Sapiens
DLQTLLRSV

SEQ ID NO: 192793 - protein, 9 aa, Homo Sapiens
ELAEAQAQL

SEQ ID NO: 192794 - protein, 9 aa, Homo Sapiens
GRFGGGGGG

SEQ ID NO: 192795 - protein, 9 aa, Homo Sapiens
DPTTGHVQL

SEQ ID NO: 192796 - protein, 9 aa, Homo Sapiens
NVVQKTQVV

SEQ ID NO: 192797 - protein, 9 aa, Homo Sapiens
DQGQTIWQL

SEQ ID NO: 192798 - protein, 9 aa, Homo Sapiens
FGWLFCRVR

SEQ ID NO: 192799 - protein, 9 aa, Homo Sapiens
VKDFHMDTI

SEQ ID NO: 192800 - protein, 9 aa, Homo Sapiens
DWLEISLLT

SEQ ID NO: 192801 - protein, 9 aa, Homo Sapiens
PLRAQEQVL

SEQ ID NO: 192802 - protein, 9 aa, Homo Sapiens
RAVLSASQL

SEQ ID NO: 192803 - protein, 9 aa, Homo Sapiens
GSTSVQASS

SEQ ID NO: 192804 - protein, 9 aa, Homo Sapiens
VYGEFMQVW

SEQ ID NO: 192805 - protein, 9 aa, Homo Sapiens
EAILYLVVA

SEQ ID NO: 192806 - protein, 9 aa, Homo Sapiens
NADIGDTAN

SEQ ID NO: 192807 - protein, 9 aa, Homo Sapiens
QDNGSVHKS

SEQ ID NO: 192808 - protein, 9 aa, Homo Sapiens
AVDCYLAIV

SEQ ID NO: 192809 - protein, 9 aa, Homo Sapiens
QMWKVNVQK

SEQ ID NO: 192810 - protein, 9 aa, Homo Sapiens
AYSGSSNSE

SEQ ID NO: 192811 - protein, 9 aa, Homo Sapiens
DKEVVVATT

SEQ ID NO: 192812 - protein, 9 aa, Homo Sapiens
GGVGPMIVA

SEQ ID NO: 192813 - protein, 9 aa, Homo Sapiens
NRPAGTIPS

SEQ ID NO: 192814 - protein, 9 aa, Homo Sapiens
SPASMRDGP

SEQ ID NO: 192815 - protein, 9 aa, Homo Sapiens
GPLVVGPLR

SEQ ID NO: 192816 - protein, 9 aa, Homo Sapiens
IVPATLHRS

SEQ ID NO: 192817 - protein, 9 aa, Homo Sapiens
CPHGPELDA

SEQ ID NO: 192818 - protein, 9 aa, Homo Sapiens
GIGYDFWRP

SEQ ID NO: 192819 - protein, 9 aa, Homo Sapiens
GWWRGRCHD

SEQ ID NO: 192820 - protein, 9 aa, Homo Sapiens
TTDLKEEMD

SEQ ID NO: 192821 - protein, 9 aa, Homo Sapiens
EEDVTHESR

SEQ ID NO: 192822 - protein, 9 aa, Homo Sapiens
EEPTGIFLK

SEQ ID NO: 192823 - protein, 9 aa, Homo Sapiens
LSEPNSTTI

SEQ ID NO: 192824 - protein, 9 aa, Homo Sapiens
EFCEQRFIE

SEQ ID NO: 192825 - protein, 9 aa, Homo Sapiens
ARWMWTVVT

SEQ ID NO: 192826 - protein, 9 aa, Homo Sapiens
CPLLCTMEK

SEQ ID NO: 192827 - protein, 9 aa, Homo Sapiens
RAYTCFNRL

SEQ ID NO: 192828 - protein, 9 aa, Homo Sapiens
SDCDGRGMG

SEQ ID NO: 192829 - protein, 9 aa, Homo Sapiens
SPGPVVAIT

SEQ ID NO: 192830 - protein, 9 aa, Homo Sapiens
GCSWTVIFV

SEQ ID NO: 192831 - protein, 9 aa, Homo Sapiens
VLNAAKEKA

SEQ ID NO: 192832 - protein, 9 aa, Homo Sapiens
GMEANTQKE

SEQ ID NO: 192833 - protein, 9 aa, Homo Sapiens
PRQRLPAAL

SEQ ID NO: 192834 - protein, 9 aa, Homo Sapiens
WPTLPVCIV

SEQ ID NO: 192835 - protein, 9 aa, Homo Sapiens
ISGPDFMDH

SEQ ID NO: 192836 - protein, 9 aa, Homo Sapiens
GKKERCDYL

SEQ ID NO: 192837 - protein, 9 aa, Homo Sapiens
PESPHYLYI

SEQ ID NO: 192838 - protein, 9 aa, Homo Sapiens
LGFRVLGGD

SEQ ID NO: 192839 - protein, 9 aa, Homo Sapiens
TTDRGSPAL

SEQ ID NO: 192840 - protein, 9 aa, Homo Sapiens
GRGAATGGC

SEQ ID NO: 192841 - protein, 9 aa, Homo Sapiens
IDLELKLVV

SEQ ID NO: 192842 - protein, 9 aa, Homo Sapiens
RSQTSMGMH

SEQ ID NO: 192843 - protein, 9 aa, Homo Sapiens
FTNSCINPF

SEQ ID NO: 192844 - protein, 9 aa, Homo Sapiens
DTSTLSYDS

SEQ ID NO: 192845 - protein, 9 aa, Homo Sapiens
RLTALHIKK

SEQ ID NO: 192846 - protein, 9 aa, Homo Sapiens
PHLFPQRVI

SEQ ID NO: 192847 - protein, 9 aa, Homo Sapiens
PPSGTPPSP

SEQ ID NO: 192848 - protein, 9 aa, Homo Sapiens
AEVVSYSNA

SEQ ID NO: 192849 - protein, 9 aa, Homo Sapiens
SSCMLCAGF

SEQ ID NO: 192850 - protein, 9 aa, Homo Sapiens
LDHLSMGEE

SEQ ID NO: 192851 - protein, 9 aa, Homo Sapiens
VQGSDSDKE

SEQ ID NO: 192852 - protein, 9 aa, Homo Sapiens
SMKSECVGI

SEQ ID NO: 192853 - protein, 9 aa, Homo Sapiens
VANFAVGMR

SEQ ID NO: 192854 - protein, 9 aa, Homo Sapiens
PLFLEFHKD

SEQ ID NO: 192855 - protein, 9 aa, Homo Sapiens
LSYAWEPRC

SEQ ID NO: 192856 - protein, 9 aa, Homo Sapiens
GTPNPGLTK

SEQ ID NO: 192857 - protein, 9 aa, Homo Sapiens
TPNQLLLIW

SEQ ID NO: 192858 - protein, 9 aa, Homo Sapiens
PNNFLSYYH

SEQ ID NO: 192859 - protein, 9 aa, Homo Sapiens
HSEKSSPST

SEQ ID NO: 192860 - protein, 9 aa, Homo Sapiens
LTDQKLIPE

SEQ ID NO: 192861 - protein, 9 aa, Homo Sapiens
DVSVFDVVV

SEQ ID NO: 192862 - protein, 9 aa, Homo Sapiens
FVGRLHSLD

SEQ ID NO: 192863 - protein, 9 aa, Homo Sapiens
MTVSFVVIM

SEQ ID NO: 192864 - protein, 9 aa, Homo Sapiens
QTFVVPRPP

SEQ ID NO: 192865 - protein, 9 aa, Homo Sapiens
VLKSNQYVK

SEQ ID NO: 192866 - protein, 9 aa, Homo Sapiens
VKLVRLSDS

SEQ ID NO: 192867 - protein, 9 aa, Homo Sapiens
YSTSCPRCP

SEQ ID NO: 192868 - protein, 9 aa, Homo Sapiens
SLRCSSMSL

SEQ ID NO: 192869 - protein, 9 aa, Homo Sapiens
GDNNAPSLG

SEQ ID NO: 192870 - protein, 9 aa, Homo Sapiens
MITETEGSY

SEQ ID NO: 192871 - protein, 9 aa, Homo Sapiens
KRVKPLSQV

SEQ ID NO: 192872 - protein, 9 aa, Homo Sapiens
QLMRPLGPS

SEQ ID NO: 192873 - protein, 9 aa, Homo Sapiens
LRCSSMSLY

SEQ ID NO: 192874 - protein, 9 aa, Homo Sapiens
AMTLTPRGN

SEQ ID NO: 192875 - protein, 9 aa, Homo Sapiens
ATGSMATLS

SEQ ID NO: 192876 - protein, 9 aa, Homo Sapiens
NPRGNTEGL

SEQ ID NO: 192877 - protein, 9 aa, Homo Sapiens
LLPGLELHR

SEQ ID NO: 192878 - protein, 9 aa, Homo Sapiens
RAQGVCSPL

SEQ ID NO: 192879 - protein, 9 aa, Homo Sapiens
QHEQLLLDT

SEQ ID NO: 192880 - protein, 9 aa, Homo Sapiens
SGEARAPPF

SEQ ID NO: 192881 - protein, 9 aa, Homo Sapiens
DGEFNFSEV

SEQ ID NO: 192882 - protein, 9 aa, Homo Sapiens
MELMGPEDG

SEQ ID NO: 192883 - protein, 9 aa, Homo Sapiens
GEIVCNILI

SEQ ID NO: 192884 - protein, 9 aa, Homo Sapiens
DRTRLLAKG

SEQ ID NO: 192885 - protein, 9 aa, Homo Sapiens
AWVCCICQQ

SEQ ID NO: 192886 - protein, 9 aa, Homo Sapiens
ARGLVGKLS

SEQ ID NO: 192887 - protein, 9 aa, Homo Sapiens
VASMEDQGL

SEQ ID NO: 192888 - protein, 9 aa, Homo Sapiens
FLMVFLQHY

SEQ ID NO: 192889 - protein, 9 aa, Homo Sapiens
TYTSNAMPS

SEQ ID NO: 192890 - protein, 9 aa, Homo Sapiens
LQAYTQLVS

SEQ ID NO: 192891 - protein, 9 aa, Homo Sapiens
RQTIRLKLV

SEQ ID NO: 192892 - protein, 9 aa, Homo Sapiens
VLKSVVEAE

SEQ ID NO: 192893 - protein, 9 aa, Homo Sapiens
LRNGTEIVL

SEQ ID NO: 192894 - protein, 9 aa, Homo Sapiens
LYDMAQYER

SEQ ID NO: 192895 - protein, 9 aa, Homo Sapiens
SLLLTSAGC

SEQ ID NO: 192896 - protein, 9 aa, Homo Sapiens
THSAHSTHV

SEQ ID NO: 192897 - protein, 9 aa, Homo Sapiens
FPDHRGLYH

SEQ ID NO: 192898 - protein, 9 aa, Homo Sapiens
KEVHTGICY

SEQ ID NO: 192899 - protein, 9 aa, Homo Sapiens
PHVLSEPYQ

SEQ ID NO: 192900 - protein, 9 aa, Homo Sapiens
SEPNSTTIQ

SEQ ID NO: 192901 - protein, 9 aa, Homo Sapiens
ENVPGIFIS

SEQ ID NO: 192902 - protein, 9 aa, Homo Sapiens
PPPPSLEPL

SEQ ID NO: 192903 - protein, 9 aa, Homo Sapiens
GSIQPQEPL

SEQ ID NO: 192904 - protein, 9 aa, Homo Sapiens
LTPAPNNRT

SEQ ID NO: 192905 - protein, 9 aa, Homo Sapiens
WHSNLTRHQ

SEQ ID NO: 192906 - protein, 9 aa, Homo Sapiens
HVALRRTLD

SEQ ID NO: 192907 - protein, 9 aa, Homo Sapiens
SFEDAGEYM

SEQ ID NO: 192908 - protein, 9 aa, Homo Sapiens
VLLPLANVT

SEQ ID NO: 192909 - protein, 9 aa, Homo Sapiens
SERDNGGRR

SEQ ID NO: 192910 - protein, 9 aa, Homo Sapiens
YLQRSNMEF

SEQ ID NO: 192911 - protein, 9 aa, Homo Sapiens
HFTLEAPVS

SEQ ID NO: 192912 - protein, 9 aa, Homo Sapiens
LTISGSKKK

SEQ ID NO: 192913 - protein, 9 aa, Homo Sapiens
RHLPLFYTI

SEQ ID NO: 192914 - protein, 9 aa, Homo Sapiens
ACSTGRMER

SEQ ID NO: 192915 - protein, 9 aa, Homo Sapiens
NFLSYYHLT

SEQ ID NO: 192916 - protein, 9 aa, Homo Sapiens
VLGGLVNTV

SEQ ID NO: 192917 - protein, 9 aa, Homo Sapiens
PLHPLLASP

SEQ ID NO: 192918 - protein, 9 aa, Homo Sapiens
TKPENEKQQ

SEQ ID NO: 192919 - protein, 9 aa, Homo Sapiens
EDYVQYLSG

SEQ ID NO: 192920 - protein, 9 aa, Homo Sapiens
THSLANLDV

SEQ ID NO: 192921 - protein, 9 aa, Homo Sapiens
ENMTLNILP

SEQ ID NO: 192922 - protein, 9 aa, Homo Sapiens
GKEGRFEMQ

SEQ ID NO: 192923 - protein, 9 aa, Homo Sapiens
LPVYIATVV

SEQ ID NO: 192924 - protein, 9 aa, Homo Sapiens
HNHHHHQPQ

SEQ ID NO: 192925 - protein, 9 aa, Homo Sapiens
VSPMELMGP

SEQ ID NO: 192926 - protein, 9 aa, Homo Sapiens
GFYDWSARY

SEQ ID NO: 192927 - protein, 9 aa, Homo Sapiens
QQKQIDRVL

SEQ ID NO: 192928 - protein, 9 aa, Homo Sapiens
GSTPPPPPG

SEQ ID NO: 192929 - protein, 9 aa, Homo Sapiens
SMLRVSYIK

SEQ ID NO: 192930 - protein, 9 aa, Homo Sapiens
AELNPYVRV

SEQ ID NO: 192931 - protein, 9 aa, Homo Sapiens
LLRLGQQRA

SEQ ID NO: 192932 - protein, 9 aa, Homo Sapiens
ISPKEAKAP

SEQ ID NO: 192933 - protein, 9 aa, Homo Sapiens
FEKILRGHR

SEQ ID NO: 192934 - protein, 9 aa, Homo Sapiens
ADQRITESC

SEQ ID NO: 192935 - protein, 9 aa, Homo Sapiens
VESHYSKTS

SEQ ID NO: 192936 - protein, 9 aa, Homo Sapiens
SFRSLAQET

SEQ ID NO: 192937 - protein, 9 aa, Homo Sapiens
HSLASRHSS

SEQ ID NO: 192938 - protein, 9 aa, Homo Sapiens
TLLCAAAPP

SEQ ID NO: 192939 - protein, 9 aa, Homo Sapiens
PPVGGQVPL

SEQ ID NO: 192940 - protein, 9 aa, Homo Sapiens
NLDSPQAIV

SEQ ID NO: 192941 - protein, 9 aa, Homo Sapiens
HFGVWSPWM

SEQ ID NO: 192942 - protein, 9 aa, Homo Sapiens
TTLVEPVSA

SEQ ID NO: 192943 - protein, 9 aa, Homo Sapiens
VAVCLQLRC

SEQ ID NO: 192944 - protein, 9 aa, Homo Sapiens
YCMDVNECE

SEQ ID NO: 192945 - protein, 9 aa, Homo Sapiens
VQKTQVVQN

SEQ ID NO: 192946 - protein, 9 aa, Homo Sapiens
LLSVWQESV

SEQ ID NO: 192947 - protein, 9 aa, Homo Sapiens
PPWVQLSDE

SEQ ID NO: 192948 - protein, 9 aa, Homo Sapiens
GALGLAVIS

SEQ ID NO: 192949 - protein, 9 aa, Homo Sapiens
EILMHYGQH

SEQ ID NO: 192950 - protein, 9 aa, Homo Sapiens
VEMEKHKKF

SEQ ID NO: 192951 - protein, 9 aa, Homo Sapiens
QGQTIWQLI

SEQ ID NO: 192952 - protein, 9 aa, Homo Sapiens
VFTCPLFLE

SEQ ID NO: 192953 - protein, 9 aa, Homo Sapiens
RCRQPHRGR

SEQ ID NO: 192954 - protein, 9 aa, Homo Sapiens
DVQMGGPGA

SEQ ID NO: 192955 - protein, 9 aa, Homo Sapiens
RLSASLPDI

SEQ ID NO: 192956 - protein, 9 aa, Homo Sapiens
LELQHENYD

SEQ ID NO: 192957 - protein, 9 aa, Homo Sapiens
PLLSECSLR

SEQ ID NO: 192958 - protein, 9 aa, Homo Sapiens
ERCLTQSWP

SEQ ID NO: 192959 - protein, 9 aa, Homo Sapiens
LKVKGIQEK

SEQ ID NO: 192960 - protein, 9 aa, Homo Sapiens
PCPSLTFSE

SEQ ID NO: 192961 - protein, 9 aa, Homo Sapiens
AEDIVSDSR

SEQ ID NO: 192962 - protein, 9 aa, Homo Sapiens
LIDRWGSHY

SEQ ID NO: 192963 - protein, 9 aa, Homo Sapiens
VITVYQISP

SEQ ID NO: 192964 - protein, 9 aa, Homo Sapiens
QKVELLPAE

SEQ ID NO: 192965 - protein, 9 aa, Homo Sapiens
YLCVLLEQP

SEQ ID NO: 192966 - protein, 9 aa, Homo Sapiens
EVVSYSNAT

SEQ ID NO: 192967 - protein, 9 aa, Homo Sapiens
CPLFLELPI

SEQ ID NO: 192968 - protein, 9 aa, Homo Sapiens
ISLFDDEDE

SEQ ID NO: 192969 - protein, 9 aa, Homo Sapiens
CLARRSRDL

SEQ ID NO: 192970 - protein, 9 aa, Homo Sapiens
EPSVGTTLM

SEQ ID NO: 192971 - protein, 9 aa, Homo Sapiens
THILMAVVP

SEQ ID NO: 192972 - protein, 9 aa, Homo Sapiens
RKRSWSTCG

SEQ ID NO: 192973 - protein, 9 aa, Homo Sapiens
NVKKRIVVA

SEQ ID NO: 192974 - protein, 9 aa, Homo Sapiens
EQGKEHCNM

SEQ ID NO: 192975 - protein, 9 aa, Homo Sapiens
GFKVKSKMV

SEQ ID NO: 192976 - protein, 9 aa, Homo Sapiens
VQRREKNCI

SEQ ID NO: 192977 - protein, 9 aa, Homo Sapiens
FIRVTTVAD

SEQ ID NO: 192978 - protein, 9 aa, Homo Sapiens
LHRTTRSVV

SEQ ID NO: 192979 - protein, 9 aa, Homo Sapiens
PAIITDKVI

SEQ ID NO: 192980 - protein, 9 aa, Homo Sapiens
LEDSYRQQW

SEQ ID NO: 192981 - protein, 9 aa, Homo Sapiens
FNLTAPRPH

SEQ ID NO: 192982 - protein, 9 aa, Homo Sapiens
NKLQQLEAA

SEQ ID NO: 192983 - protein, 9 aa, Homo Sapiens
ELEATLQRA

SEQ ID NO: 192984 - protein, 9 aa, Homo Sapiens
TILCTCSAT

SEQ ID NO: 192985 - protein, 9 aa, Homo Sapiens
SGEKRSVLQ

SEQ ID NO: 192986 - protein, 9 aa, Homo Sapiens
EQLGSIYNI

SEQ ID NO: 192987 - protein, 9 aa, Homo Sapiens
LWLQMDTPI

SEQ ID NO: 192988 - protein, 9 aa, Homo Sapiens
LQMLKDLAI

SEQ ID NO: 192989 - protein, 9 aa, Homo Sapiens
VYTDVKHHW

SEQ ID NO: 192990 - protein, 9 aa, Homo Sapiens
GDQGQTIWQ

SEQ ID NO: 192991 - protein, 9 aa, Homo Sapiens
DLPSKKGIV

SEQ ID NO: 192992 - protein, 9 aa, Homo Sapiens
QVSCLPPEP

SEQ ID NO: 192993 - protein, 9 aa, Homo Sapiens
HQRYFGGTE

SEQ ID NO: 192994 - protein, 9 aa, Homo Sapiens
ESLEDAGPL

SEQ ID NO: 192995 - protein, 9 aa, Homo Sapiens
NRGGGHRGH

SEQ ID NO: 192996 - protein, 9 aa, Homo Sapiens
QVDLAGGPE

SEQ ID NO: 192997 - protein, 9 aa, Homo Sapiens
GTCRGMARV

SEQ ID NO: 192998 - protein, 9 aa, Homo Sapiens
RGNWQCWLK

SEQ ID NO: 192999 - protein, 9 aa, Homo Sapiens
RASQCEYEE

SEQ ID NO: 193000 - protein, 9 aa, Homo Sapiens
RHLGQHVVG

SEQ ID NO: 193001 - protein, 9 aa, Homo Sapiens
KANECLFRM

SEQ ID NO: 193002 - protein, 9 aa, Homo Sapiens
FTWSHLSKH

SEQ ID NO: 193003 - protein, 9 aa, Homo Sapiens
IFSLFGMQL

SEQ ID NO: 193004 - protein, 9 aa, Homo Sapiens
RPQRGPRPL

SEQ ID NO: 193005 - protein, 9 aa, Homo Sapiens
AQEQVLGVA

SEQ ID NO: 193006 - protein, 9 aa, Homo Sapiens
FSETRAGKH

SEQ ID NO: 193007 - protein, 9 aa, Homo Sapiens
LFIESIPHL

SEQ ID NO: 193008 - protein, 9 aa, Homo Sapiens
IAHSIHDHQ

SEQ ID NO: 193009 - protein, 9 aa, Homo Sapiens
ALYPQRWSY

SEQ ID NO: 193010 - protein, 9 aa, Homo Sapiens
RRPLVVHTG

SEQ ID NO: 193011 - protein, 9 aa, Homo Sapiens
EAVLQSSRA

SEQ ID NO: 193012 - protein, 9 aa, Homo Sapiens
IRHRPEALE

SEQ ID NO: 193013 - protein, 9 aa, Homo Sapiens
VERRKEQRL

SEQ ID NO: 193014 - protein, 9 aa, Homo Sapiens
VEGLHVFDK

SEQ ID NO: 193015 - protein, 9 aa, Homo Sapiens
GFPKSVKSW

SEQ ID NO: 193016 - protein, 9 aa, Homo Sapiens
MLLSNALFQ

SEQ ID NO: 193017 - protein, 9 aa, Homo Sapiens
RKMLLQNYI

SEQ ID NO: 193018 - protein, 9 aa, Homo Sapiens
VILICFSTS

SEQ ID NO: 193019 - protein, 9 aa, Homo Sapiens
SPLMREDPP

SEQ ID NO: 193020 - protein, 9 aa, Homo Sapiens
ERKHLIQLR

SEQ ID NO: 193021 - protein, 9 aa, Homo Sapiens
TRHGSLPLP

SEQ ID NO: 193022 - protein, 9 aa, Homo Sapiens
YQISPEEMH

SEQ ID NO: 193023 - protein, 9 aa, Homo Sapiens
SRKSTFIKQ

SEQ ID NO: 193024 - protein, 9 aa, Homo Sapiens
RGAPPPGTM

SEQ ID NO: 193025 - protein, 9 aa, Homo Sapiens
EMDKMRKMI

SEQ ID NO: 193026 - protein, 9 aa, Homo Sapiens
GAGGGDGDI

SEQ ID NO: 193027 - protein, 9 aa, Homo Sapiens
EFLNIKGCA

SEQ ID NO: 193028 - protein, 9 aa, Homo Sapiens
DLSHCAHIG

SEQ ID NO: 193029 - protein, 9 aa, Homo Sapiens
LDEPREFPP

SEQ ID NO: 193030 - protein, 9 aa, Homo Sapiens
YTDVKHHWK

SEQ ID NO: 193031 - protein, 9 aa, Homo Sapiens
KDPRHRALA

SEQ ID NO: 193032 - protein, 9 aa, Homo Sapiens
RKRSRMHRF

SEQ ID NO: 193033 - protein, 9 aa, Homo Sapiens
ADRELSGLW

SEQ ID NO: 193034 - protein, 9 aa, Homo Sapiens
SRRRKGPHY

SEQ ID NO: 193035 - protein, 9 aa, Homo Sapiens
KNSVDKQEE

SEQ ID NO: 193036 - protein, 9 aa, Homo Sapiens
HENLRLRKG

SEQ ID NO: 193037 - protein, 9 aa, Homo Sapiens
PLSECHTPP

SEQ ID NO: 193038 - protein, 9 aa, Homo Sapiens
KIRMDIDMV

SEQ ID NO: 193039 - protein, 9 aa, Homo Sapiens
ILLKGDVDE

SEQ ID NO: 193040 - protein, 9 aa, Homo Sapiens
SNAMRNFLQ

SEQ ID NO: 193041 - protein, 9 aa, Homo Sapiens
RRCYQSSPA

SEQ ID NO: 193042 - protein, 9 aa, Homo Sapiens
ATRPVQVFS

SEQ ID NO: 193043 - protein, 9 aa, Homo Sapiens
TAFAPILNF

SEQ ID NO: 193044 - protein, 9 aa, Homo Sapiens
EGACTEPWE

SEQ ID NO: 193045 - protein, 9 aa, Homo Sapiens
AALRAVGTQ

SEQ ID NO: 193046 - protein, 9 aa, Homo Sapiens
TGEKPYCCP

SEQ ID NO: 193047 - protein, 9 aa, Homo Sapiens
HHHLLPGIG

SEQ ID NO: 193048 - protein, 9 aa, Homo Sapiens
QVQADRAMY

SEQ ID NO: 193049 - protein, 9 aa, Homo Sapiens
QAVLNAAKE

SEQ ID NO: 193050 - protein, 9 aa, Homo Sapiens
GYGAPAPLL

SEQ ID NO: 193051 - protein, 9 aa, Homo Sapiens
HIWGKCSVT

SEQ ID NO: 193052 - protein, 9 aa, Homo Sapiens
EEREWQLRE

SEQ ID NO: 193053 - protein, 9 aa, Homo Sapiens
TLLFSHHTV

SEQ ID NO: 193054 - protein, 9 aa, Homo Sapiens
KLPCQRVDS

SEQ ID NO: 193055 - protein, 9 aa, Homo Sapiens
AITNSSHLK

SEQ ID NO: 193056 - protein, 9 aa, Homo Sapiens
EIIWLEPEV

SEQ ID NO: 193057 - protein, 9 aa, Homo Sapiens
IPPVLISEG

SEQ ID NO: 193058 - protein, 9 aa, Homo Sapiens
NTVELLTGT

SEQ ID NO: 193059 - protein, 9 aa, Homo Sapiens
KTDPTGLSS

SEQ ID NO: 193060 - protein, 9 aa, Homo Sapiens
VVGPLRAQE

SEQ ID NO: 193061 - protein, 9 aa, Homo Sapiens
NHSQALLDQ

SEQ ID NO: 193062 - protein, 9 aa, Homo Sapiens
NDIYSTYRL

SEQ ID NO: 193063 - protein, 9 aa, Homo Sapiens
DDYYSPYGM

SEQ ID NO: 193064 - protein, 9 aa, Homo Sapiens
TSLDRWSKE

SEQ ID NO: 193065 - protein, 9 aa, Homo Sapiens
PHHSSGSLT

SEQ ID NO: 193066 - protein, 9 aa, Homo Sapiens
AWVWEHHPE

SEQ ID NO: 193067 - protein, 9 aa, Homo Sapiens
LYPQRWSYT

SEQ ID NO: 193068 - protein, 9 aa, Homo Sapiens
MRDEKKSTA

SEQ ID NO: 193069 - protein, 9 aa, Homo Sapiens
TGIVLLQLE

SEQ ID NO: 193070 - protein, 9 aa, Homo Sapiens
WKHGGEKGV

SEQ ID NO: 193071 - protein, 9 aa, Homo Sapiens
YDPNTESCA

SEQ ID NO: 193072 - protein, 9 aa, Homo Sapiens
YTCFNRLDL

SEQ ID NO: 193073 - protein, 9 aa, Homo Sapiens
CFAVCSLGW

SEQ ID NO: 193074 - protein, 9 aa, Homo Sapiens
NGVGPGHIS

SEQ ID NO: 193075 - protein, 9 aa, Homo Sapiens
SLQSEAHQR

SEQ ID NO: 193076 - protein, 9 aa, Homo Sapiens
STGRMERCT

SEQ ID NO: 193077 - protein, 9 aa, Homo Sapiens
GWGARGGGA

SEQ ID NO: 193078 - protein, 9 aa, Homo Sapiens
SNLMTGLPK

SEQ ID NO: 193079 - protein, 9 aa, Homo Sapiens
WLWQLQAQL

SEQ ID NO: 193080 - protein, 9 aa, Homo Sapiens
LPVAGDRGL

SEQ ID NO: 193081 - protein, 9 aa, Homo Sapiens
KKTVPPKKM

SEQ ID NO: 193082 - protein, 9 aa, Homo Sapiens
EEVSFPQPY

SEQ ID NO: 193083 - protein, 9 aa, Homo Sapiens
NYGIMHRDL

SEQ ID NO: 193084 - protein, 9 aa, Homo Sapiens
EQSRNCDDE

SEQ ID NO: 193085 - protein, 9 aa, Homo Sapiens
WLEGEINTY

SEQ ID NO: 193086 - protein, 9 aa, Homo Sapiens
QTKKQAHCM

SEQ ID NO: 193087 - protein, 9 aa, Homo Sapiens
DEISGQGVS

SEQ ID NO: 193088 - protein, 9 aa, Homo Sapiens
LANPITESL

SEQ ID NO: 193089 - protein, 9 aa, Homo Sapiens
YKSAVEQLQ

SEQ ID NO: 193090 - protein, 9 aa, Homo Sapiens
NGCELVVGR

SEQ ID NO: 193091 - protein, 9 aa, Homo Sapiens
FLWMWAVEH

SEQ ID NO: 193092 - protein, 9 aa, Homo Sapiens
PQPLSSSAG

SEQ ID NO: 193093 - protein, 9 aa, Homo Sapiens
FINFVFHKI

SEQ ID NO: 193094 - protein, 9 aa, Homo Sapiens
TLLSSSSAQ

SEQ ID NO: 193095 - protein, 9 aa, Homo Sapiens
ATTNSSLSD

SEQ ID NO: 193096 - protein, 9 aa, Homo Sapiens
CAIHKEDLQ

SEQ ID NO: 193097 - protein, 9 aa, Homo Sapiens
GDDVQMGGP

SEQ ID NO: 193098 - protein, 9 aa, Homo Sapiens
KVVKVYLEW

SEQ ID NO: 193099 - protein, 9 aa, Homo Sapiens
QSSRAVMGA

SEQ ID NO: 193100 - protein, 9 aa, Homo Sapiens
WYLYDGEDY

SEQ ID NO: 193101 - protein, 9 aa, Homo Sapiens
NSKHFWTTV

SEQ ID NO: 193102 - protein, 9 aa, Homo Sapiens
KNAKVRPPF

SEQ ID NO: 193103 - protein, 9 aa, Homo Sapiens
YFFLANIPF

SEQ ID NO: 193104 - protein, 9 aa, Homo Sapiens
VTSYKMCLK

SEQ ID NO: 193105 - protein, 9 aa, Homo Sapiens
EASHLLAAD

SEQ ID NO: 193106 - protein, 9 aa, Homo Sapiens
ATATFKAYS

SEQ ID NO: 193107 - protein, 9 aa, Homo Sapiens
EVVRDLVHQ

SEQ ID NO: 193108 - protein, 9 aa, Homo Sapiens
DEPREFPPH

SEQ ID NO: 193109 - protein, 9 aa, Homo Sapiens
NQSMLKTHM

SEQ ID NO: 193110 - protein, 9 aa, Homo Sapiens
VRQCLQEWR

SEQ ID NO: 193111 - protein, 9 aa, Homo Sapiens
SSLEDRVKQ

SEQ ID NO: 193112 - protein, 9 aa, Homo Sapiens
TDPDETILH

SEQ ID NO: 193113 - protein, 9 aa, Homo Sapiens
SLLVVSPIS

SEQ ID NO: 193114 - protein, 9 aa, Homo Sapiens
IDRDPTAFA

SEQ ID NO: 193115 - protein, 9 aa, Homo Sapiens
NLGMLNTVS

SEQ ID NO: 193116 - protein, 9 aa, Homo Sapiens
QAADVEMEK

SEQ ID NO: 193117 - protein, 9 aa, Homo Sapiens
KVSYLFSFS

SEQ ID NO: 193118 - protein, 9 aa, Homo Sapiens
PLATVRDRP

SEQ ID NO: 193119 - protein, 9 aa, Homo Sapiens
RVRPPHVLD

SEQ ID NO: 193120 - protein, 9 aa, Homo Sapiens
TGNVTTPPM

SEQ ID NO: 193121 - protein, 9 aa, Homo Sapiens
PLLVKCYKI

SEQ ID NO: 193122 - protein, 9 aa, Homo Sapiens
GMRPGHGDF

SEQ ID NO: 193123 - protein, 9 aa, Homo Sapiens
EKDPVEAKP

SEQ ID NO: 193124 - protein, 9 aa, Homo Sapiens
MPSFVQVIG

SEQ ID NO: 193125 - protein, 9 aa, Homo Sapiens
EKQRALVAT

SEQ ID NO: 193126 - protein, 9 aa, Homo Sapiens
EVSSDVFFF

SEQ ID NO: 193127 - protein, 9 aa, Homo Sapiens
VIAQAQKKG

SEQ ID NO: 193128 - protein, 9 aa, Homo Sapiens
QHQLQHSWG

SEQ ID NO: 193129 - protein, 9 aa, Homo Sapiens
VLVHCPHGP

SEQ ID NO: 193130 - protein, 9 aa, Homo Sapiens
PHTVVAVEV

SEQ ID NO: 193131 - protein, 9 aa, Homo Sapiens
LPTAPVLEA

SEQ ID NO: 193132 - protein, 9 aa, Homo Sapiens
LVVVKERLQ

SEQ ID NO: 193133 - protein, 9 aa, Homo Sapiens
VCDHDASVY

SEQ ID NO: 193134 - protein, 9 aa, Homo Sapiens
WVCTERQCP

SEQ ID NO: 193135 - protein, 9 aa, Homo Sapiens
NEIDNILHN

SEQ ID NO: 193136 - protein, 9 aa, Homo Sapiens
GGSLFSLLR

SEQ ID NO: 193137 - protein, 9 aa, Homo Sapiens
VAKIHIEDD

SEQ ID NO: 193138 - protein, 9 aa, Homo Sapiens
VDWIQQDNG

SEQ ID NO: 193139 - protein, 9 aa, Homo Sapiens
SGENPYRCE

SEQ ID NO: 193140 - protein, 9 aa, Homo Sapiens
VIQPMLQSS

SEQ ID NO: 193141 - protein, 9 aa, Homo Sapiens
KKDKECQLK

SEQ ID NO: 193142 - protein, 9 aa, Homo Sapiens
ERSGGSVTR

SEQ ID NO: 193143 - protein, 9 aa, Homo Sapiens
NFNPSRPGP

SEQ ID NO: 193144 - protein, 9 aa, Homo Sapiens
APLHTYGMF

SEQ ID NO: 193145 - protein, 9 aa, Homo Sapiens
VSRLVQVYY

SEQ ID NO: 193146 - protein, 9 aa, Homo Sapiens
RPHTIPAPE

SEQ ID NO: 193147 - protein, 9 aa, Homo Sapiens
NIEAELHIS

SEQ ID NO: 193148 - protein, 9 aa, Homo Sapiens
VYMEPYYYK

SEQ ID NO: 193149 - protein, 9 aa, Homo Sapiens
LWEQYSDCD

SEQ ID NO: 193150 - protein, 9 aa, Homo Sapiens
DSQEMLALP

SEQ ID NO: 193151 - protein, 9 aa, Homo Sapiens
LFFVLVNLE

SEQ ID NO: 193152 - protein, 9 aa, Homo Sapiens
ALEVLSTRG

SEQ ID NO: 193153 - protein, 9 aa, Homo Sapiens
EDTDLLSCI

SEQ ID NO: 193154 - protein, 9 aa, Homo Sapiens
ITETEGSYT

SEQ ID NO: 193155 - protein, 9 aa, Homo Sapiens
RPPGTNGVV

SEQ ID NO: 193156 - protein, 9 aa, Homo Sapiens
KSDSGSTSS

SEQ ID NO: 193157 - protein, 9 aa, Homo Sapiens
GPRQRLPAA

SEQ ID NO: 193158 - protein, 9 aa, Homo Sapiens
ASSSAPVPP

SEQ ID NO: 193159 - protein, 9 aa, Homo Sapiens
IVWRPDIVL

SEQ ID NO: 193160 - protein, 9 aa, Homo Sapiens
VHKCIFCSE

SEQ ID NO: 193161 - protein, 9 aa, Homo Sapiens
CCQHSSVLG

SEQ ID NO: 193162 - protein, 9 aa, Homo Sapiens
WSYTSEDEA

SEQ ID NO: 193163 - protein, 9 aa, Homo Sapiens
GITIVSVLV

SEQ ID NO: 193164 - protein, 9 aa, Homo Sapiens
SSEVVFETG

SEQ ID NO: 193165 - protein, 9 aa, Homo Sapiens
LKTAVVQTM

SEQ ID NO: 193166 - protein, 9 aa, Homo Sapiens
LRMLADLLS

SEQ ID NO: 193167 - protein, 9 aa, Homo Sapiens
RCMDLLTQR

SEQ ID NO: 193168 - protein, 9 aa, Homo Sapiens
KANMWALEL

SEQ ID NO: 193169 - protein, 9 aa, Homo Sapiens
SRHSSYSYC

SEQ ID NO: 193170 - protein, 9 aa, Homo Sapiens
GGILVGVIS

SEQ ID NO: 193171 - protein, 9 aa, Homo Sapiens
VQGCSTSQQ

SEQ ID NO: 193172 - protein, 9 aa, Homo Sapiens
HGSSYSMHT

SEQ ID NO: 193173 - protein, 9 aa, Homo Sapiens
CENKLNDKH

SEQ ID NO: 193174 - protein, 9 aa, Homo Sapiens
HGNVTFSIL

SEQ ID NO: 193175 - protein, 9 aa, Homo Sapiens
AKGDMGLHG

SEQ ID NO: 193176 - protein, 9 aa, Homo Sapiens
RQASEKEDG

SEQ ID NO: 193177 - protein, 9 aa, Homo Sapiens
QPPMESCLD

SEQ ID NO: 193178 - protein, 9 aa, Homo Sapiens
LHCMVILFA

SEQ ID NO: 193179 - protein, 9 aa, Homo Sapiens
LTPSLARRP

SEQ ID NO: 193180 - protein, 9 aa, Homo Sapiens
QEALDQASA

SEQ ID NO: 193181 - protein, 9 aa, Homo Sapiens
GGGSAAEQH

SEQ ID NO: 193182 - protein, 9 aa, Homo Sapiens
NVCLISIQL

SEQ ID NO: 193183 - protein, 9 aa, Homo Sapiens
GHVKIESVK

SEQ ID NO: 193184 - protein, 9 aa, Homo Sapiens
RKTINGHLD

SEQ ID NO: 193185 - protein, 9 aa, Homo Sapiens
GEDTTETAH

SEQ ID NO: 193186 - protein, 9 aa, Homo Sapiens
TKETVSILK

SEQ ID NO: 193187 - protein, 9 aa, Homo Sapiens
STGIGRSGT

SEQ ID NO: 193188 - protein, 9 aa, Homo Sapiens
TPPEELHLP

SEQ ID NO: 193189 - protein, 9 aa, Homo Sapiens
DIVGQLKRQ

SEQ ID NO: 193190 - protein, 9 aa, Homo Sapiens
RAGLRARFT

SEQ ID NO: 193191 - protein, 9 aa, Homo Sapiens
HMKVIAGRF

SEQ ID NO: 193192 - protein, 9 aa, Homo Sapiens
KRRRTICRE

SEQ ID NO: 193193 - protein, 9 aa, Homo Sapiens
HVPNGLKTM

SEQ ID NO: 193194 - protein, 9 aa, Homo Sapiens
LLFPLKEET

SEQ ID NO: 193195 - protein, 9 aa, Homo Sapiens
PASVPLSPS

SEQ ID NO: 193196 - protein, 9 aa, Homo Sapiens
PYRCEDSDK

SEQ ID NO: 193197 - protein, 9 aa, Homo Sapiens
CAVLRTTPL

SEQ ID NO: 193198 - protein, 9 aa, Homo Sapiens
LLRQGYTIH

SEQ ID NO: 193199 - protein, 9 aa, Homo Sapiens
IQKKMIDTG

SEQ ID NO: 193200 - protein, 9 aa, Homo Sapiens
NKLQEHTVA

SEQ ID NO: 193201 - protein, 9 aa, Homo Sapiens
RPFPHTVVA

SEQ ID NO: 193202 - protein, 9 aa, Homo Sapiens
RSQQAHSAL

SEQ ID NO: 193203 - protein, 9 aa, Homo Sapiens
VVAKILKQS

SEQ ID NO: 193204 - protein, 9 aa, Homo Sapiens
AQELSDNRI

SEQ ID NO: 193205 - protein, 9 aa, Homo Sapiens
DVKHHWKAE

SEQ ID NO: 193206 - protein, 9 aa, Homo Sapiens
LALQLAMQI

SEQ ID NO: 193207 - protein, 9 aa, Homo Sapiens
ACALAFTQM

SEQ ID NO: 193208 - protein, 9 aa, Homo Sapiens
ILPTTAYTK

SEQ ID NO: 193209 - protein, 9 aa, Homo Sapiens
FPADLDNRH

SEQ ID NO: 193210 - protein, 9 aa, Homo Sapiens
FLLLDKWDV

SEQ ID NO: 193211 - protein, 9 aa, Homo Sapiens
ECIKCVKAF

SEQ ID NO: 193212 - protein, 9 aa, Homo Sapiens
AGGFGLNLQ

SEQ ID NO: 193213 - protein, 9 aa, Homo Sapiens
ACSCLLLGG

SEQ ID NO: 193214 - protein, 9 aa, Homo Sapiens
LSVTLPMSG

SEQ ID NO: 193215 - protein, 9 aa, Homo Sapiens
CFRHGQSLA

SEQ ID NO: 193216 - protein, 9 aa, Homo Sapiens
CGMRPGHGD

SEQ ID NO: 193217 - protein, 9 aa, Homo Sapiens
QRELIACLE

SEQ ID NO: 193218 - protein, 9 aa, Homo Sapiens
MAKSYNRLR

SEQ ID NO: 193219 - protein, 9 aa, Homo Sapiens
VRCLQAIME

SEQ ID NO: 193220 - protein, 9 aa, Homo Sapiens
TYSQHNEFS

SEQ ID NO: 193221 - protein, 9 aa, Homo Sapiens
RQRSHTQML

SEQ ID NO: 193222 - protein, 9 aa, Homo Sapiens
FVSRYCEHF

SEQ ID NO: 193223 - protein, 9 aa, Homo Sapiens
IREIDDSIG

SEQ ID NO: 193224 - protein, 9 aa, Homo Sapiens
MRKVVKVYL

SEQ ID NO: 193225 - protein, 9 aa, Homo Sapiens
KMCQLNGFQ

SEQ ID NO: 193226 - protein, 9 aa, Homo Sapiens
HSSLSSHSH

SEQ ID NO: 193227 - protein, 9 aa, Homo Sapiens
TTNSSLSDP

SEQ ID NO: 193228 - protein, 9 aa, Homo Sapiens
LQMDTPITH

SEQ ID NO: 193229 - protein, 9 aa, Homo Sapiens
AQKKGTVVY

SEQ ID NO: 193230 - protein, 9 aa, Homo Sapiens
RLVEGNPDW

SEQ ID NO: 193231 - protein, 9 aa, Homo Sapiens
EDPVYLRQC

SEQ ID NO: 193232 - protein, 9 aa, Homo Sapiens
RRGLARSWA

SEQ ID NO: 193233 - protein, 9 aa, Homo Sapiens
NYLGNRDHF

SEQ ID NO: 193234 - protein, 9 aa, Homo Sapiens
FSVQISDRI

SEQ ID NO: 193235 - protein, 9 aa, Homo Sapiens
SSFRWHLPQ

SEQ ID NO: 193236 - protein, 9 aa, Homo Sapiens
WSGSAVPPP

SEQ ID NO: 193237 - protein, 9 aa, Homo Sapiens
DDQHLLLPH

SEQ ID NO: 193238 - protein, 9 aa, Homo Sapiens
MYKLFSHVP

SEQ ID NO: 193239 - protein, 9 aa, Homo Sapiens
LLVGRQKEK

SEQ ID NO: 193240 - protein, 9 aa, Homo Sapiens
NDENCILDE

SEQ ID NO: 193241 - protein, 9 aa, Homo Sapiens
ECTGPLLIY

SEQ ID NO: 193242 - protein, 9 aa, Homo Sapiens
NNRTHGSLN

SEQ ID NO: 193243 - protein, 9 aa, Homo Sapiens
DSPPHVPLP

SEQ ID NO: 193244 - protein, 9 aa, Homo Sapiens
LLGFTNSCI

SEQ ID NO: 193245 - protein, 9 aa, Homo Sapiens
SATVQTGFY

SEQ ID NO: 193246 - protein, 9 aa, Homo Sapiens
QISSCMLCA

SEQ ID NO: 193247 - protein, 9 aa, Homo Sapiens
ERLYCIKPE

SEQ ID NO: 193248 - protein, 9 aa, Homo Sapiens
YFEAYMHVL

SEQ ID NO: 193249 - protein, 9 aa, Homo Sapiens
CQTNAQFAE

SEQ ID NO: 193250 - protein, 9 aa, Homo Sapiens
GQPHRGAQC

SEQ ID NO: 193251 - protein, 9 aa, Homo Sapiens
WLVLAVKQG

SEQ ID NO: 193252 - protein, 9 aa, Homo Sapiens
PSAWLLLVD

SEQ ID NO: 193253 - protein, 9 aa, Homo Sapiens
AVTGIVTGV

SEQ ID NO: 193254 - protein, 9 aa, Homo Sapiens
DGEAKTDPT

SEQ ID NO: 193255 - protein, 9 aa, Homo Sapiens
QGHVRSLSK

SEQ ID NO: 193256 - protein, 9 aa, Homo Sapiens
EGGSKPWAS

SEQ ID NO: 193257 - protein, 9 aa, Homo Sapiens
HQQVHTGKK

SEQ ID NO: 193258 - protein, 9 aa, Homo Sapiens
RDIGYVKQA

SEQ ID NO: 193259 - protein, 9 aa, Homo Sapiens
KILRGHRQS

SEQ ID NO: 193260 - protein, 9 aa, Homo Sapiens
PDSWSNAAT

SEQ ID NO: 193261 - protein, 9 aa, Homo Sapiens
GPYSHHLQG

SEQ ID NO: 193262 - protein, 9 aa, Homo Sapiens
ILHSMHKHQ

SEQ ID NO: 193263 - protein, 9 aa, Homo Sapiens
PRIISDKQQ

SEQ ID NO: 193264 - protein, 9 aa, Homo Sapiens
FGGGGRFGG

SEQ ID NO: 193265 - protein, 9 aa, Homo Sapiens
YKGPHCQER

SEQ ID NO: 193266 - protein, 9 aa, Homo Sapiens
GSWELLLAL

SEQ ID NO: 193267 - protein, 9 aa, Homo Sapiens
RLKYEWAVR

SEQ ID NO: 193268 - protein, 9 aa, Homo Sapiens
CANGPYGKC

SEQ ID NO: 193269 - protein, 9 aa, Homo Sapiens
DPPHRHHRH

SEQ ID NO: 193270 - protein, 9 aa, Homo Sapiens
MYQLPAFAN

SEQ ID NO: 193271 - protein, 9 aa, Homo Sapiens
SEHGKAFHQ

SEQ ID NO: 193272 - protein, 9 aa, Homo Sapiens
YDRHSALHV

SEQ ID NO: 193273 - protein, 9 aa, Homo Sapiens
PSPDPPPGP

SEQ ID NO: 193274 - protein, 9 aa, Homo Sapiens
LEDAGPLAI

SEQ ID NO: 193275 - protein, 9 aa, Homo Sapiens
WLPWNIYIV

SEQ ID NO: 193276 - protein, 9 aa, Homo Sapiens
EKCLKVKGI

SEQ ID NO: 193277 - protein, 9 aa, Homo Sapiens
ASHHIKGED

SEQ ID NO: 193278 - protein, 9 aa, Homo Sapiens
HFWTTVGSK

SEQ ID NO: 193279 - protein, 9 aa, Homo Sapiens
ERQCPGHCS

SEQ ID NO: 193280 - protein, 9 aa, Homo Sapiens
TQKMISETC

SEQ ID NO: 193281 - protein, 9 aa, Homo Sapiens
LMREDPPTD

SEQ ID NO: 193282 - protein, 9 aa, Homo Sapiens
RRGQNRSAQ

SEQ ID NO: 193283 - protein, 9 aa, Homo Sapiens
FTPWKHGGE

SEQ ID NO: 193284 - protein, 9 aa, Homo Sapiens
PWRKECTVA

SEQ ID NO: 193285 - protein, 9 aa, Homo Sapiens
HVTVSGSRS

SEQ ID NO: 193286 - protein, 9 aa, Homo Sapiens
VQERVTISG

SEQ ID NO: 193287 - protein, 9 aa, Homo Sapiens
DNHSVNDEN

SEQ ID NO: 193288 - protein, 9 aa, Homo Sapiens
ITNSSHLKQ

SEQ ID NO: 193289 - protein, 9 aa, Homo Sapiens
PTPPPVSKN

SEQ ID NO: 193290 - protein, 9 aa, Homo Sapiens
LAGWQCPEC

SEQ ID NO: 193291 - protein, 9 aa, Homo Sapiens
SSDELSGDP

SEQ ID NO: 193292 - protein, 9 aa, Homo Sapiens
SNATNKYEV

SEQ ID NO: 193293 - protein, 9 aa, Homo Sapiens
AAVMTSHSM

SEQ ID NO: 193294 - protein, 9 aa, Homo Sapiens
LNINGGCSQ

SEQ ID NO: 193295 - protein, 9 aa, Homo Sapiens
HLSKHLAFE

SEQ ID NO: 193296 - protein, 9 aa, Homo Sapiens
VISGISSQG

SEQ ID NO: 193297 - protein, 9 aa, Homo Sapiens
SMESPQELA

SEQ ID NO: 193298 - protein, 9 aa, Homo Sapiens
FKVTDARGG

SEQ ID NO: 193299 - protein, 9 aa, Homo Sapiens
DNQEFPFPE

SEQ ID NO: 193300 - protein, 9 aa, Homo Sapiens
DDFKLVINK

SEQ ID NO: 193301 - protein, 9 aa, Homo Sapiens
REWTNIEAE

SEQ ID NO: 193302 - protein, 9 aa, Homo Sapiens
VQDYILFAE

SEQ ID NO: 193303 - protein, 9 aa, Homo Sapiens
QGCSTSQQG

SEQ ID NO: 193304 - protein, 9 aa, Homo Sapiens
YIAVWDDPD

SEQ ID NO: 193305 - protein, 9 aa, Homo Sapiens
LPALTILDV

SEQ ID NO: 193306 - protein, 9 aa, Homo Sapiens
SYYHLTRFL

SEQ ID NO: 193307 - protein, 9 aa, Homo Sapiens
IPNLCGVSK

SEQ ID NO: 193308 - protein, 9 aa, Homo Sapiens
SKNERPARS

SEQ ID NO: 193309 - protein, 9 aa, Homo Sapiens
PVSKNCSSR

SEQ ID NO: 193310 - protein, 9 aa, Homo Sapiens
GPTEMFPER

SEQ ID NO: 193311 - protein, 9 aa, Homo Sapiens
GLLSGLQRR

SEQ ID NO: 193312 - protein, 9 aa, Homo Sapiens
AIEGTCSDL

SEQ ID NO: 193313 - protein, 9 aa, Homo Sapiens
EFELSTDTD

SEQ ID NO: 193314 - protein, 9 aa, Homo Sapiens
RSRDLDALD

SEQ ID NO: 193315 - protein, 9 aa, Homo Sapiens
IQNRKSTSR

SEQ ID NO: 193316 - protein, 9 aa, Homo Sapiens
RRRLCLPGR

SEQ ID NO: 193317 - protein, 9 aa, Homo Sapiens
QGTTEPDAT

SEQ ID NO: 193318 - protein, 9 aa, Homo Sapiens
HCKPMMVDS

SEQ ID NO: 193319 - protein, 9 aa, Homo Sapiens
AVGAASAGV

SEQ ID NO: 193320 - protein, 9 aa, Homo Sapiens
SCSQSFFAA

SEQ ID NO: 193321 - protein, 9 aa, Homo Sapiens
DELEMATIR

SEQ ID NO: 193322 - protein, 9 aa, Homo Sapiens
EFHLQADNM

SEQ ID NO: 193323 - protein, 9 aa, Homo Sapiens
ESVKNGFDS

SEQ ID NO: 193324 - protein, 9 aa, Homo Sapiens
YFKMGDHMK

SEQ ID NO: 193325 - protein, 9 aa, Homo Sapiens
FQKSGSVIR

SEQ ID NO: 193326 - protein, 9 aa, Homo Sapiens
LVEEDFSVT

SEQ ID NO: 193327 - protein, 9 aa, Homo Sapiens
QGVYSWPIM

SEQ ID NO: 193328 - protein, 9 aa, Homo Sapiens
LLGDPGLQG

SEQ ID NO: 193329 - protein, 9 aa, Homo Sapiens
RVQEGKDST

SEQ ID NO: 193330 - protein, 9 aa, Homo Sapiens
VSDWSKVPS

SEQ ID NO: 193331 - protein, 9 aa, Homo Sapiens
SPHYLYIIQ

SEQ ID NO: 193332 - protein, 9 aa, Homo Sapiens
PHNQRKALN

SEQ ID NO: 193333 - protein, 9 aa, Homo Sapiens
SPRPPETQV

SEQ ID NO: 193334 - protein, 9 aa, Homo Sapiens
GWRLSSGSV

SEQ ID NO: 193335 - protein, 9 aa, Homo Sapiens
SSPPAEFIY

SEQ ID NO: 193336 - protein, 9 aa, Homo Sapiens
REASPVPLA

SEQ ID NO: 193337 - protein, 9 aa, Homo Sapiens
RELSGLWTQ

SEQ ID NO: 193338 - protein, 9 aa, Homo Sapiens
CAECVKGMK

SEQ ID NO: 193339 - protein, 9 aa, Homo Sapiens
HFVSQMPFV

SEQ ID NO: 193340 - protein, 9 aa, Homo Sapiens
TATPPCSPL

SEQ ID NO: 193341 - protein, 9 aa, Homo Sapiens
HLQSWLYSS

SEQ ID NO: 193342 - protein, 9 aa, Homo Sapiens
YSVHWSETS

SEQ ID NO: 193343 - protein, 9 aa, Homo Sapiens
ETDGKSIAI

SEQ ID NO: 193344 - protein, 9 aa, Homo Sapiens
ACEEMILKI

SEQ ID NO: 193345 - protein, 9 aa, Homo Sapiens
QRVANFAVG

SEQ ID NO: 193346 - protein, 9 aa, Homo Sapiens
EKLSVPVMC

SEQ ID NO: 193347 - protein, 9 aa, Homo Sapiens
PENTCKDKT

SEQ ID NO: 193348 - protein, 9 aa, Homo Sapiens
SLIMDKALQ

SEQ ID NO: 193349 - protein, 9 aa, Homo Sapiens
NAANICCHS

SEQ ID NO: 193350 - protein, 9 aa, Homo Sapiens
DIATSARTA

SEQ ID NO: 193351 - protein, 9 aa, Homo Sapiens
WKVWPLLLV

SEQ ID NO: 193352 - protein, 9 aa, Homo Sapiens
NQVPWARLG

SEQ ID NO: 193353 - protein, 9 aa, Homo Sapiens
IDKAITISA

SEQ ID NO: 193354 - protein, 9 aa, Homo Sapiens
SPTLLSHFT

SEQ ID NO: 193355 - protein, 9 aa, Homo Sapiens
GKYDSMIQD

SEQ ID NO: 193356 - protein, 9 aa, Homo Sapiens
WYAAICNPL

SEQ ID NO: 193357 - protein, 9 aa, Homo Sapiens
YVRVTSSSV

SEQ ID NO: 193358 - protein, 9 aa, Homo Sapiens
CHIKLHSGE

SEQ ID NO: 193359 - protein, 9 aa, Homo Sapiens
LAKVEEAER

SEQ ID NO: 193360 - protein, 9 aa, Homo Sapiens
AELQGHHTE

SEQ ID NO: 193361 - protein, 9 aa, Homo Sapiens
CLDELPNLK

SEQ ID NO: 193362 - protein, 9 aa, Homo Sapiens
QTHVLPPTI

SEQ ID NO: 193363 - protein, 9 aa, Homo Sapiens
QYHLTQPLP

SEQ ID NO: 193364 - protein, 9 aa, Homo Sapiens
TINATDNPS

SEQ ID NO: 193365 - protein, 9 aa, Homo Sapiens
VESADENLK

SEQ ID NO: 193366 - protein, 9 aa, Homo Sapiens
LWIGIDFDR

SEQ ID NO: 193367 - protein, 9 aa, Homo Sapiens
LNIKGCAMG

SEQ ID NO: 193368 - protein, 9 aa, Homo Sapiens
GYILFGIEF

SEQ ID NO: 193369 - protein, 9 aa, Homo Sapiens
KELNIQLSG

SEQ ID NO: 193370 - protein, 9 aa, Homo Sapiens
KCLYPGSVY

SEQ ID NO: 193371 - protein, 9 aa, Homo Sapiens
LKIPDEQHL

SEQ ID NO: 193372 - protein, 9 aa, Homo Sapiens
VCQLMHKLL

SEQ ID NO: 193373 - protein, 9 aa, Homo Sapiens
QLEAAAGVL

SEQ ID NO: 193374 - protein, 9 aa, Homo Sapiens
PLPPPQGGS

SEQ ID NO: 193375 - protein, 9 aa, Homo Sapiens
CAYDRLDHG

SEQ ID NO: 193376 - protein, 9 aa, Homo Sapiens
SPMRQVEPQ

SEQ ID NO: 193377 - protein, 9 aa, Homo Sapiens
GSSRSVIMD

SEQ ID NO: 193378 - protein, 9 aa, Homo Sapiens
AVFAATPKP

SEQ ID NO: 193379 - protein, 9 aa, Homo Sapiens
VIMDTKITW

SEQ ID NO: 193380 - protein, 9 aa, Homo Sapiens
EPKESPHPT

SEQ ID NO: 193381 - protein, 9 aa, Homo Sapiens
EKIPTMSRR

SEQ ID NO: 193382 - protein, 9 aa, Homo Sapiens
QRIIIGFLQ

SEQ ID NO: 193383 - protein, 9 aa, Homo Sapiens
LLLTSAGCV

SEQ ID NO: 193384 - protein, 9 aa, Homo Sapiens
VDVAGHFPI

SEQ ID NO: 193385 - protein, 9 aa, Homo Sapiens
CSMVVLGAK

SEQ ID NO: 193386 - protein, 9 aa, Homo Sapiens
ASLQIFITE

SEQ ID NO: 193387 - protein, 9 aa, Homo Sapiens
QLSKGDIAQ

SEQ ID NO: 193388 - protein, 9 aa, Homo Sapiens
CHITDLYKD

SEQ ID NO: 193389 - protein, 9 aa, Homo Sapiens
NYQTMFRAQ

SEQ ID NO: 193390 - protein, 9 aa, Homo Sapiens
LARVSCHIT

SEQ ID NO: 193391 - protein, 9 aa, Homo Sapiens
LCHQRACRK

SEQ ID NO: 193392 - protein, 9 aa, Homo Sapiens
TSGERSQAH

SEQ ID NO: 193393 - protein, 9 aa, Homo Sapiens
LWGVHKCKP

SEQ ID NO: 193394 - protein, 9 aa, Homo Sapiens
IPMDVARQR

SEQ ID NO: 193395 - protein, 9 aa, Homo Sapiens
NLTPAPNNR

SEQ ID NO: 193396 - protein, 9 aa, Homo Sapiens
DHDTYTCLA

SEQ ID NO: 193397 - protein, 9 aa, Homo Sapiens
GPRAPSSPM

SEQ ID NO: 193398 - protein, 9 aa, Homo Sapiens
QYLKDRQLT

SEQ ID NO: 193399 - protein, 9 aa, Homo Sapiens
AAEPGEHPQ

SEQ ID NO: 193400 - protein, 9 aa, Homo Sapiens
HIEFTEGKD

SEQ ID NO: 193401 - protein, 9 aa, Homo Sapiens
VFTGYELET

SEQ ID NO: 193402 - protein, 9 aa, Homo Sapiens
NLMMSKYLT

SEQ ID NO: 193403 - protein, 9 aa, Homo Sapiens
HRGSMVLFA

SEQ ID NO: 193404 - protein, 9 aa, Homo Sapiens
DEVACRWGK

SEQ ID NO: 193405 - protein, 9 aa, Homo Sapiens
SWTVIFVDL

SEQ ID NO: 193406 - protein, 9 aa, Homo Sapiens
LEALEVLST

SEQ ID NO: 193407 - protein, 9 aa, Homo Sapiens
FGMQLFGGK

SEQ ID NO: 193408 - protein, 9 aa, Homo Sapiens
FTGMMHCSQ

SEQ ID NO: 193409 - protein, 9 aa, Homo Sapiens
SVTKPENEK

SEQ ID NO: 193410 - protein, 9 aa, Homo Sapiens
MISAAMACF

SEQ ID NO: 193411 - protein, 9 aa, Homo Sapiens
VQKEFQNNF

SEQ ID NO: 193412 - protein, 9 aa, Homo Sapiens
NIHDLDLTL

SEQ ID NO: 193413 - protein, 9 aa, Homo Sapiens
QAECRLQEA

SEQ ID NO: 193414 - protein, 9 aa, Homo Sapiens
DTAIEQRTS

SEQ ID NO: 193415 - protein, 9 aa, Homo Sapiens
KNKASITPG

SEQ ID NO: 193416 - protein, 9 aa, Homo Sapiens
TFSEDARFL

SEQ ID NO: 193417 - protein, 9 aa, Homo Sapiens
SSPQAWGSL

SEQ ID NO: 193418 - protein, 9 aa, Homo Sapiens
MSEVQSDSP

SEQ ID NO: 193419 - protein, 9 aa, Homo Sapiens
RWVAPVETL

SEQ ID NO: 193420 - protein, 9 aa, Homo Sapiens
NDSTPKFQA

SEQ ID NO: 193421 - protein, 9 aa, Homo Sapiens
DGGLGLYTC

SEQ ID NO: 193422 - protein, 9 aa, Homo Sapiens
GVPLRKTIT

SEQ ID NO: 193423 - protein, 9 aa, Homo Sapiens
AQIAKQLEN

SEQ ID NO: 193424 - protein, 9 aa, Homo Sapiens
TRKFGLLLL

SEQ ID NO: 193425 - protein, 9 aa, Homo Sapiens
IDFEDFLTI

SEQ ID NO: 193426 - protein, 9 aa, Homo Sapiens
PHDGRRLVV

SEQ ID NO: 193427 - protein, 9 aa, Homo Sapiens
PPPGPRGEG

SEQ ID NO: 193428 - protein, 9 aa, Homo Sapiens
HHCLGFVPR

SEQ ID NO: 193429 - protein, 9 aa, Homo Sapiens
SVTRSLQLA

SEQ ID NO: 193430 - protein, 9 aa, Homo Sapiens
HCIQCAAGY

SEQ ID NO: 193431 - protein, 9 aa, Homo Sapiens
QVEPGLGSV

SEQ ID NO: 193432 - protein, 9 aa, Homo Sapiens
RKYAPRLAP

SEQ ID NO: 193433 - protein, 9 aa, Homo Sapiens
PGIGGVPER

SEQ ID NO: 193434 - protein, 9 aa, Homo Sapiens
AKEREWVEN

SEQ ID NO: 193435 - protein, 9 aa, Homo Sapiens
GPPNANEDH

SEQ ID NO: 193436 - protein, 9 aa, Homo Sapiens
TGDALIYME

SEQ ID NO: 193437 - protein, 9 aa, Homo Sapiens
ETHFLSNPG

SEQ ID NO: 193438 - protein, 9 aa, Homo Sapiens
MSMTTNLCE

SEQ ID NO: 193439 - protein, 9 aa, Homo Sapiens
YEAVLQSSR

SEQ ID NO: 193440 - protein, 9 aa, Homo Sapiens
WFANYRRCQ

SEQ ID NO: 193441 - protein, 9 aa, Homo Sapiens
RYLQWWCRK

SEQ ID NO: 193442 - protein, 9 aa, Homo Sapiens
DPTAFAPIL

SEQ ID NO: 193443 - protein, 9 aa, Homo Sapiens
DCDWEKEDE

SEQ ID NO: 193444 - protein, 9 aa, Homo Sapiens
PLSPGFSRE

SEQ ID NO: 193445 - protein, 9 aa, Homo Sapiens
IVFPTQDSR

SEQ ID NO: 193446 - protein, 9 aa, Homo Sapiens
WSHQATVSS

SEQ ID NO: 193447 - protein, 9 aa, Homo Sapiens
ASSCSQTPE

SEQ ID NO: 193448 - protein, 9 aa, Homo Sapiens
KGGRMETEL

SEQ ID NO: 193449 - protein, 9 aa, Homo Sapiens
QGEADPVHG

SEQ ID NO: 193450 - protein, 9 aa, Homo Sapiens
AASLALTGD

SEQ ID NO: 193451 - protein, 9 aa, Homo Sapiens
TAKTLACIL

SEQ ID NO: 193452 - protein, 9 aa, Homo Sapiens
QPVDLAQVK

SEQ ID NO: 193453 - protein, 9 aa, Homo Sapiens
NKNARLLTF

SEQ ID NO: 193454 - protein, 9 aa, Homo Sapiens
AGVKRYAAE

SEQ ID NO: 193455 - protein, 9 aa, Homo Sapiens
WCDYTSYWT

SEQ ID NO: 193456 - protein, 9 aa, Homo Sapiens
PQCDDLDHF

SEQ ID NO: 193457 - protein, 9 aa, Homo Sapiens
KAARWQREE

SEQ ID NO: 193458 - protein, 9 aa, Homo Sapiens
TVYECWWYE

SEQ ID NO: 193459 - protein, 9 aa, Homo Sapiens
EAGSAMSCL

SEQ ID NO: 193460 - protein, 9 aa, Homo Sapiens
AEHTLLHHL

SEQ ID NO: 193461 - protein, 9 aa, Homo Sapiens
TGMKGKGST

SEQ ID NO: 193462 - protein, 9 aa, Homo Sapiens
PTPASHQRS

SEQ ID NO: 193463 - protein, 9 aa, Homo Sapiens
KQQSTMPNR

SEQ ID NO: 193464 - protein, 9 aa, Homo Sapiens
QSDHCINID

SEQ ID NO: 193465 - protein, 9 aa, Homo Sapiens
VPALQANVF

SEQ ID NO: 193466 - protein, 9 aa, Homo Sapiens
RTHVLSAGK

SEQ ID NO: 193467 - protein, 9 aa, Homo Sapiens
ISAIHRNSA

SEQ ID NO: 193468 - protein, 9 aa, Homo Sapiens
TTYEGGVQE

SEQ ID NO: 193469 - protein, 9 aa, Homo Sapiens
HRQSFLVGN

SEQ ID NO: 193470 - protein, 9 aa, Homo Sapiens
GSQQSRKRG

SEQ ID NO: 193471 - protein, 9 aa, Homo Sapiens
DLSNWCNGL

SEQ ID NO: 193472 - protein, 9 aa, Homo Sapiens
NSTTIQTSE

SEQ ID NO: 193473 - protein, 9 aa, Homo Sapiens
SEQDEALLI

SEQ ID NO: 193474 - protein, 9 aa, Homo Sapiens
FVCTECGQD

SEQ ID NO: 193475 - protein, 9 aa, Homo Sapiens
VSRYCEHFN

SEQ ID NO: 193476 - protein, 9 aa, Homo Sapiens
SSAVLVKWQ

SEQ ID NO: 193477 - protein, 9 aa, Homo Sapiens
RFYFLSYDE

SEQ ID NO: 193478 - protein, 9 aa, Homo Sapiens
RLLQEELEG

SEQ ID NO: 193479 - protein, 9 aa, Homo Sapiens
LEFKCLASS

SEQ ID NO: 193480 - protein, 9 aa, Homo Sapiens
MGLTLSDEI

SEQ ID NO: 193481 - protein, 9 aa, Homo Sapiens
SWSDEWPRW

SEQ ID NO: 193482 - protein, 9 aa, Homo Sapiens
LKSNQYVKV

SEQ ID NO: 193483 - protein, 9 aa, Homo Sapiens
PWNIYIVAG

SEQ ID NO: 193484 - protein, 9 aa, Homo Sapiens
SKEQLEHWE

SEQ ID NO: 193485 - protein, 9 aa, Homo Sapiens
AKKRIPPPF

SEQ ID NO: 193486 - protein, 9 aa, Homo Sapiens
INFVFHKID

SEQ ID NO: 193487 - protein, 9 aa, Homo Sapiens
ISETCSVRS

SEQ ID NO: 193488 - protein, 9 aa, Homo Sapiens
TKDGDVATL

SEQ ID NO: 193489 - protein, 9 aa, Homo Sapiens
GAYSGSSNS

SEQ ID NO: 193490 - protein, 9 aa, Homo Sapiens
TFFTSPCTK

SEQ ID NO: 193491 - protein, 9 aa, Homo Sapiens
PDKTLISDV

SEQ ID NO: 193492 - protein, 9 aa, Homo Sapiens
VYVSLDNTV

SEQ ID NO: 193493 - protein, 9 aa, Homo Sapiens
QELSDNRII

SEQ ID NO: 193494 - protein, 9 aa, Homo Sapiens
YISDCCHRE

SEQ ID NO: 193495 - protein, 9 aa, Homo Sapiens
PAICFGFQC

SEQ ID NO: 193496 - protein, 9 aa, Homo Sapiens
STYSQHNEF

SEQ ID NO: 193497 - protein, 9 aa, Homo Sapiens
KELVLKSVV

SEQ ID NO: 193498 - protein, 9 aa, Homo Sapiens
HNYGIMHRD

SEQ ID NO: 193499 - protein, 9 aa, Homo Sapiens
VVDHSVQIN

SEQ ID NO: 193500 - protein, 9 aa, Homo Sapiens
FEHYVQDVM

SEQ ID NO: 193501 - protein, 9 aa, Homo Sapiens
FHWLFDKKF

SEQ ID NO: 193502 - protein, 9 aa, Homo Sapiens
PSSDVWKGE

SEQ ID NO: 193503 - protein, 9 aa, Homo Sapiens
NSDVRHTPA

SEQ ID NO: 193504 - protein, 9 aa, Homo Sapiens
NSLYDMAQY

SEQ ID NO: 193505 - protein, 9 aa, Homo Sapiens
GVAKIHIED

SEQ ID NO: 193506 - protein, 9 aa, Homo Sapiens
NWQCWLKVR

SEQ ID NO: 193507 - protein, 9 aa, Homo Sapiens
IIKLFQYPC

SEQ ID NO: 193508 - protein, 9 aa, Homo Sapiens
ITESCQVVE

SEQ ID NO: 193509 - protein, 9 aa, Homo Sapiens
SGGVCIPEA

SEQ ID NO: 193510 - protein, 9 aa, Homo Sapiens
RCGKTFSKM

SEQ ID NO: 193511 - protein, 9 aa, Homo Sapiens
TREDRPFCC

SEQ ID NO: 193512 - protein, 9 aa, Homo Sapiens
SSVTTDCVL

SEQ ID NO: 193513 - protein, 9 aa, Homo Sapiens
QNIFMAMQA

SEQ ID NO: 193514 - protein, 9 aa, Homo Sapiens
KHRRTQMHL

SEQ ID NO: 193515 - protein, 9 aa, Homo Sapiens
SLMALSLAS

SEQ ID NO: 193516 - protein, 9 aa, Homo Sapiens
AHHCLGFVP

SEQ ID NO: 193517 - protein, 9 aa, Homo Sapiens
TSSCLLRSS

SEQ ID NO: 193518 - protein, 9 aa, Homo Sapiens
GQMFEHLSA

SEQ ID NO: 193519 - protein, 9 aa, Homo Sapiens
RGRASGFTG

SEQ ID NO: 193520 - protein, 9 aa, Homo Sapiens
PPSSELHYK

SEQ ID NO: 193521 - protein, 9 aa, Homo Sapiens
VCSLGWVEM

SEQ ID NO: 193522 - protein, 9 aa, Homo Sapiens
VQGPGRETK

SEQ ID NO: 193523 - protein, 9 aa, Homo Sapiens
LTLANASSL

SEQ ID NO: 193524 - protein, 9 aa, Homo Sapiens
HFPAAPTRH

SEQ ID NO: 193525 - protein, 9 aa, Homo Sapiens
PQRWSYTSE

SEQ ID NO: 193526 - protein, 9 aa, Homo Sapiens
IKTKTEHFQ

SEQ ID NO: 193527 - protein, 9 aa, Homo Sapiens
ELLRNSDEK

SEQ ID NO: 193528 - protein, 9 aa, Homo Sapiens
GPDGEVISD

SEQ ID NO: 193529 - protein, 9 aa, Homo Sapiens
YYEQRLLWK

SEQ ID NO: 193530 - protein, 9 aa, Homo Sapiens
WWGLGELRQ

SEQ ID NO: 193531 - protein, 9 aa, Homo Sapiens
LLRREWREH

SEQ ID NO: 193532 - protein, 9 aa, Homo Sapiens
MSQTQQILP

SEQ ID NO: 193533 - protein, 9 aa, Homo Sapiens
LQAWVWEHH

SEQ ID NO: 193534 - protein, 9 aa, Homo Sapiens
ASHISRMLN

SEQ ID NO: 193535 - protein, 9 aa, Homo Sapiens
HIYLQMTTL

SEQ ID NO: 193536 - protein, 9 aa, Homo Sapiens
ILLSSCVSA

SEQ ID NO: 193537 - protein, 9 aa, Homo Sapiens
RIITLSLAG

SEQ ID NO: 193538 - protein, 9 aa, Homo Sapiens
MYLGEIVCN

SEQ ID NO: 193539 - protein, 9 aa, Homo Sapiens
FLGFFHYLK

SEQ ID NO: 193540 - protein, 9 aa, Homo Sapiens
LLSHFTLTS

SEQ ID NO: 193541 - protein, 9 aa, Homo Sapiens
AGGTSVSLL

SEQ ID NO: 193542 - protein, 9 aa, Homo Sapiens
EIPAEFADC

SEQ ID NO: 193543 - protein, 9 aa, Homo Sapiens
KCVVQNVHR

SEQ ID NO: 193544 - protein, 9 aa, Homo Sapiens
KGMEANTQK

SEQ ID NO: 193545 - protein, 9 aa, Homo Sapiens
VPGPGAPGA

SEQ ID NO: 193546 - protein, 9 aa, Homo Sapiens
SGEAVRHPI

SEQ ID NO: 193547 - protein, 9 aa, Homo Sapiens
SAGSRRSRH

SEQ ID NO: 193548 - protein, 9 aa, Homo Sapiens
SLDNTVLGD

SEQ ID NO: 193549 - protein, 9 aa, Homo Sapiens
PYVTPAPPR

SEQ ID NO: 193550 - protein, 9 aa, Homo Sapiens
KDFHMDTIV

SEQ ID NO: 193551 - protein, 9 aa, Homo Sapiens
LHLPAPPSP

SEQ ID NO: 193552 - protein, 9 aa, Homo Sapiens
GHKPSLNLS

SEQ ID NO: 193553 - protein, 9 aa, Homo Sapiens
ARPWGIIHV

SEQ ID NO: 193554 - protein, 9 aa, Homo Sapiens
DGLGETEDL

SEQ ID NO: 193555 - protein, 9 aa, Homo Sapiens
LLHTMLPQT

SEQ ID NO: 193556 - protein, 9 aa, Homo Sapiens
YTSLVLGIL

SEQ ID NO: 193557 - protein, 9 aa, Homo Sapiens
DGKSTFLYI

SEQ ID NO: 193558 - protein, 9 aa, Homo Sapiens
LICRCLCQF

SEQ ID NO: 193559 - protein, 9 aa, Homo Sapiens
KMGKQAFMG

SEQ ID NO: 193560 - protein, 9 aa, Homo Sapiens
IEDMVASME

SEQ ID NO: 193561 - protein, 9 aa, Homo Sapiens
NGEQFPDLS

SEQ ID NO: 193562 - protein, 9 aa, Homo Sapiens
ALVGSEKPS

SEQ ID NO: 193563 - protein, 9 aa, Homo Sapiens
RNPNGGFCM

SEQ ID NO: 193564 - protein, 9 aa, Homo Sapiens
ASHDVAQLS

SEQ ID NO: 193565 - protein, 9 aa, Homo Sapiens
TSSSISVYY

SEQ ID NO: 193566 - protein, 9 aa, Homo Sapiens
KERLSYHHP

SEQ ID NO: 193567 - protein, 9 aa, Homo Sapiens
IIIFSLFGM

SEQ ID NO: 193568 - protein, 9 aa, Homo Sapiens
VRHQKIHNG

SEQ ID NO: 193569 - protein, 9 aa, Homo Sapiens
EQSLLATHV

SEQ ID NO: 193570 - protein, 9 aa, Homo Sapiens
APEDVLAMS

SEQ ID NO: 193571 - protein, 9 aa, Homo Sapiens
ELQEKLDLQ

SEQ ID NO: 193572 - protein, 9 aa, Homo Sapiens
SYDEAILYL

SEQ ID NO: 193573 - protein, 9 aa, Homo Sapiens
AWDPRFDDL

SEQ ID NO: 193574 - protein, 9 aa, Homo Sapiens
GRRLLAFVE

SEQ ID NO: 193575 - protein, 9 aa, Homo Sapiens
RSKATAMAL

SEQ ID NO: 193576 - protein, 9 aa, Homo Sapiens
KLNSVDRLY

SEQ ID NO: 193577 - protein, 9 aa, Homo Sapiens
LVGDVIDLC

SEQ ID NO: 193578 - protein, 9 aa, Homo Sapiens
RHQGFKEKW

SEQ ID NO: 193579 - protein, 9 aa, Homo Sapiens
NEMQVDGAR

SEQ ID NO: 193580 - protein, 9 aa, Homo Sapiens
LLPREVSPL

SEQ ID NO: 193581 - protein, 9 aa, Homo Sapiens
PKVFVKMDG

SEQ ID NO: 193582 - protein, 9 aa, Homo Sapiens
TTETAHAPG

SEQ ID NO: 193583 - protein, 9 aa, Homo Sapiens
NVIRYFYTE

SEQ ID NO: 193584 - protein, 9 aa, Homo Sapiens
SAAATRPKS

SEQ ID NO: 193585 - protein, 9 aa, Homo Sapiens
DEIIWLEPE

SEQ ID NO: 193586 - protein, 9 aa, Homo Sapiens
VGPLRAQEQ

SEQ ID NO: 193587 - protein, 9 aa, Homo Sapiens
RWGSHYVDE

SEQ ID NO: 193588 - protein, 9 aa, Homo Sapiens
CALVGSEKP

SEQ ID NO: 193589 - protein, 9 aa, Homo Sapiens
ILPFPASLA

SEQ ID NO: 193590 - protein, 9 aa, Homo Sapiens
TIVSPAIVF

SEQ ID NO: 193591 - protein, 9 aa, Homo Sapiens
DLRHKPWET

SEQ ID NO: 193592 - protein, 9 aa, Homo Sapiens
EAERLRLLK

SEQ ID NO: 193593 - protein, 9 aa, Homo Sapiens
LLQPRKRSW

SEQ ID NO: 193594 - protein, 9 aa, Homo Sapiens
APAPLLSSS

SEQ ID NO: 193595 - protein, 9 aa, Homo Sapiens
QLETLKAVF

SEQ ID NO: 193596 - protein, 9 aa, Homo Sapiens
GRQDQDTGT

SEQ ID NO: 193597 - protein, 9 aa, Homo Sapiens
YEVNPQTTE

SEQ ID NO: 193598 - protein, 9 aa, Homo Sapiens
HSGEKRSVL

SEQ ID NO: 193599 - protein, 9 aa, Homo Sapiens
WEHVPNGAA

SEQ ID NO: 193600 - protein, 9 aa, Homo Sapiens
SEVVFETGP

SEQ ID NO: 193601 - protein, 9 aa, Homo Sapiens
LGLDHLSMG

SEQ ID NO: 193602 - protein, 9 aa, Homo Sapiens
TFVCTECGQ

SEQ ID NO: 193603 - protein, 9 aa, Homo Sapiens
HHLFLCYQQ

SEQ ID NO: 193604 - protein, 9 aa, Homo Sapiens
ELLAISALQ

SEQ ID NO: 193605 - protein, 9 aa, Homo Sapiens
FADCPKLKE

SEQ ID NO: 193606 - protein, 9 aa, Homo Sapiens
VVGKKMVKE

SEQ ID NO: 193607 - protein, 9 aa, Homo Sapiens
PFSSPTLLS

SEQ ID NO: 193608 - protein, 9 aa, Homo Sapiens
LKEDALQFL

SEQ ID NO: 193609 - protein, 9 aa, Homo Sapiens
ECVLLKGHQ

SEQ ID NO: 193610 - protein, 9 aa, Homo Sapiens
DTCNRIKQS

SEQ ID NO: 193611 - protein, 9 aa, Homo Sapiens
SDLGGPCPQ

SEQ ID NO: 193612 - protein, 9 aa, Homo Sapiens
TSTLSYDSV

SEQ ID NO: 193613 - protein, 9 aa, Homo Sapiens
LEDGDPTVI

SEQ ID NO: 193614 - protein, 9 aa, Homo Sapiens
KKKILLNLS

SEQ ID NO: 193615 - protein, 9 aa, Homo Sapiens
AQNWLGASV

SEQ ID NO: 193616 - protein, 9 aa, Homo Sapiens
AEALIYQIL

SEQ ID NO: 193617 - protein, 9 aa, Homo Sapiens
DPRLAHAKL

SEQ ID NO: 193618 - protein, 9 aa, Homo Sapiens
GQDATRPVQ

SEQ ID NO: 193619 - protein, 9 aa, Homo Sapiens
KNCIAAQKS

SEQ ID NO: 193620 - protein, 9 aa, Homo Sapiens
CVSCVRTVM

SEQ ID NO: 193621 - protein, 9 aa, Homo Sapiens
YMCLAGNSI

SEQ ID NO: 193622 - protein, 9 aa, Homo Sapiens
SASLPDIVG

SEQ ID NO: 193623 - protein, 9 aa, Homo Sapiens
EDSVVKAVF

SEQ ID NO: 193624 - protein, 9 aa, Homo Sapiens
TKEPRIQLQ

SEQ ID NO: 193625 - protein, 9 aa, Homo Sapiens
VWDDPDQNS

SEQ ID NO: 193626 - protein, 9 aa, Homo Sapiens
SCPESVKNG

SEQ ID NO: 193627 - protein, 9 aa, Homo Sapiens
FIEKGPLLR

SEQ ID NO: 193628 - protein, 9 aa, Homo Sapiens
TRDTESQVR

SEQ ID NO: 193629 - protein, 9 aa, Homo Sapiens
HRHHRHRDK

SEQ ID NO: 193630 - protein, 9 aa, Homo Sapiens
PRPSRQFWM

SEQ ID NO: 193631 - protein, 9 aa, Homo Sapiens
EHHVCLGFV

SEQ ID NO: 193632 - protein, 9 aa, Homo Sapiens
QHQPLGPRQ

SEQ ID NO: 193633 - protein, 9 aa, Homo Sapiens
PLIPQQAQE

SEQ ID NO: 193634 - protein, 9 aa, Homo Sapiens
RRLAAPCLA

SEQ ID NO: 193635 - protein, 9 aa, Homo Sapiens
HAAAPELSY

SEQ ID NO: 193636 - protein, 9 aa, Homo Sapiens
LPKATLQKD

SEQ ID NO: 193637 - protein, 9 aa, Homo Sapiens
KYEEMCPPE

SEQ ID NO: 193638 - protein, 9 aa, Homo Sapiens
QRSHTQMLL

SEQ ID NO: 193639 - protein, 9 aa, Homo Sapiens
IGCILSILR

SEQ ID NO: 193640 - protein, 9 aa, Homo Sapiens
GLGLYTCRL

SEQ ID NO: 193641 - protein, 9 aa, Homo Sapiens
FMAMQAMIR

SEQ ID NO: 193642 - protein, 9 aa, Homo Sapiens
GRHLGQHVV

SEQ ID NO: 193643 - protein, 9 aa, Homo Sapiens
GCGQTPIKQ

SEQ ID NO: 193644 - protein, 9 aa, Homo Sapiens
GSLTTPPYT

SEQ ID NO: 193645 - protein, 9 aa, Homo Sapiens
LRMLEYEPT

SEQ ID NO: 193646 - protein, 9 aa, Homo Sapiens
CSSPTSPFQ

SEQ ID NO: 193647 - protein, 9 aa, Homo Sapiens
DASGGWHDA

SEQ ID NO: 193648 - protein, 9 aa, Homo Sapiens
TAQGPPNLP

SEQ ID NO: 193649 - protein, 9 aa, Homo Sapiens
VPVRTTPVT

SEQ ID NO: 193650 - protein, 9 aa, Homo Sapiens
HQATVSSVK

SEQ ID NO: 193651 - protein, 9 aa, Homo Sapiens
CVMTSHPRG

SEQ ID NO: 193652 - protein, 9 aa, Homo Sapiens
PRLPLRPQR

SEQ ID NO: 193653 - protein, 9 aa, Homo Sapiens
ICGKDLFCE

SEQ ID NO: 193654 - protein, 9 aa, Homo Sapiens
DFCIHVENQ

SEQ ID NO: 193655 - protein, 9 aa, Homo Sapiens
TGAMVWALD

SEQ ID NO: 193656 - protein, 9 aa, Homo Sapiens
QEWRTVPIL

SEQ ID NO: 193657 - protein, 9 aa, Homo Sapiens
DSEDEASHL

SEQ ID NO: 193658 - protein, 9 aa, Homo Sapiens
TRNESVAHS

SEQ ID NO: 193659 - protein, 9 aa, Homo Sapiens
AVTIVKQAN

SEQ ID NO: 193660 - protein, 9 aa, Homo Sapiens
QGTEDTPDN

SEQ ID NO: 193661 - protein, 9 aa, Homo Sapiens
KSVLKKLCG

SEQ ID NO: 193662 - protein, 9 aa, Homo Sapiens
GKLDVPCSL

SEQ ID NO: 193663 - protein, 9 aa, Homo Sapiens
YANERDKTQ

SEQ ID NO: 193664 - protein, 9 aa, Homo Sapiens
QRLLWKVFE

SEQ ID NO: 193665 - protein, 9 aa, Homo Sapiens
DYPRYPNIH

SEQ ID NO: 193666 - protein, 9 aa, Homo Sapiens
NKGHKSSRQ

SEQ ID NO: 193667 - protein, 9 aa, Homo Sapiens
NEDTGTAHA

SEQ ID NO: 193668 - protein, 9 aa, Homo Sapiens
CQCCIPDTV

SEQ ID NO: 193669 - protein, 9 aa, Homo Sapiens
KDLRHKPWE

SEQ ID NO: 193670 - protein, 9 aa, Homo Sapiens
GDPAMVFLD

SEQ ID NO: 193671 - protein, 9 aa, Homo Sapiens
YSLEHHVCL

SEQ ID NO: 193672 - protein, 9 aa, Homo Sapiens
SYSLEHHVC

SEQ ID NO: 193673 - protein, 9 aa, Homo Sapiens
GGCGRLLQG

SEQ ID NO: 193674 - protein, 9 aa, Homo Sapiens
AVGMRISAK

SEQ ID NO: 193675 - protein, 9 aa, Homo Sapiens
YEMLLKIRE

SEQ ID NO: 193676 - protein, 9 aa, Homo Sapiens
WLGASVLTV

SEQ ID NO: 193677 - protein, 9 aa, Homo Sapiens
RPQSCSQSF

SEQ ID NO: 193678 - protein, 9 aa, Homo Sapiens
ARGITIVSV

SEQ ID NO: 193679 - protein, 9 aa, Homo Sapiens
KSEQAVLNA

SEQ ID NO: 193680 - protein, 9 aa, Homo Sapiens
LRVASALNR

SEQ ID NO: 193681 - protein, 9 aa, Homo Sapiens
FRAHSPDPH

SEQ ID NO: 193682 - protein, 9 aa, Homo Sapiens
EDFSVTSVD

SEQ ID NO: 193683 - protein, 9 aa, Homo Sapiens
VVRDLVHQG

SEQ ID NO: 193684 - protein, 9 aa, Homo Sapiens
PARTGLLPG

SEQ ID NO: 193685 - protein, 9 aa, Homo Sapiens
KLPPIPRDY

SEQ ID NO: 193686 - protein, 9 aa, Homo Sapiens
PTAFAPILN

SEQ ID NO: 193687 - protein, 9 aa, Homo Sapiens
DRHMENLVA

SEQ ID NO: 193688 - protein, 9 aa, Homo Sapiens
MTLDFDLTA

SEQ ID NO: 193689 - protein, 9 aa, Homo Sapiens
EGSSMYSTP

SEQ ID NO: 193690 - protein, 9 aa, Homo Sapiens
LMSRGLLEK

SEQ ID NO: 193691 - protein, 9 aa, Homo Sapiens
WAPNSTNLI

SEQ ID NO: 193692 - protein, 9 aa, Homo Sapiens
MRMLMHWGW

SEQ ID NO: 193693 - protein, 9 aa, Homo Sapiens
SFVVIMFEL

SEQ ID NO: 193694 - protein, 9 aa, Homo Sapiens
CYTGTREAH

SEQ ID NO: 193695 - protein, 9 aa, Homo Sapiens
SPCTSTNCS

SEQ ID NO: 193696 - protein, 9 aa, Homo Sapiens
AHELVKSKI

SEQ ID NO: 193697 - protein, 9 aa, Homo Sapiens
KDPAQPLDP

SEQ ID NO: 193698 - protein, 9 aa, Homo Sapiens
CEPENTCKD

SEQ ID NO: 193699 - protein, 9 aa, Homo Sapiens
DSTIRLYHA

SEQ ID NO: 193700 - protein, 9 aa, Homo Sapiens
AEGSVKTPA

SEQ ID NO: 193701 - protein, 9 aa, Homo Sapiens
ALAFTQMPG

SEQ ID NO: 193702 - protein, 9 aa, Homo Sapiens
SLSSDTSTL

SEQ ID NO: 193703 - protein, 9 aa, Homo Sapiens
EKNCIAAQK

SEQ ID NO: 193704 - protein, 9 aa, Homo Sapiens
VYECWWYEK

SEQ ID NO: 193705 - protein, 9 aa, Homo Sapiens
VKHHWKAEN

SEQ ID NO: 193706 - protein, 9 aa, Homo Sapiens
RFEMQPNVK

SEQ ID NO: 193707 - protein, 9 aa, Homo Sapiens
FSFSVQISD

SEQ ID NO: 193708 - protein, 9 aa, Homo Sapiens
AGEYMCLAG

SEQ ID NO: 193709 - protein, 9 aa, Homo Sapiens
FSSPTLLSH

SEQ ID NO: 193710 - protein, 9 aa, Homo Sapiens
RLLQGPESC

SEQ ID NO: 193711 - protein, 9 aa, Homo Sapiens
SALVSIYVH

SEQ ID NO: 193712 - protein, 9 aa, Homo Sapiens
ETLKAVFAA

SEQ ID NO: 193713 - protein, 9 aa, Homo Sapiens
NLGTCQLQH

SEQ ID NO: 193714 - protein, 9 aa, Homo Sapiens
FRVLQALKT

SEQ ID NO: 193715 - protein, 9 aa, Homo Sapiens
LWGRTWRLL

SEQ ID NO: 193716 - protein, 9 aa, Homo Sapiens
ECIFPLFCT

SEQ ID NO: 193717 - protein, 9 aa, Homo Sapiens
DTAQRSISK

SEQ ID NO: 193718 - protein, 9 aa, Homo Sapiens
CVEHYHLLH

SEQ ID NO: 193719 - protein, 9 aa, Homo Sapiens
LENKEFMKC

SEQ ID NO: 193720 - protein, 9 aa, Homo Sapiens
ELAKVEEAE

SEQ ID NO: 193721 - protein, 9 aa, Homo Sapiens
LLASLSSMS

SEQ ID NO: 193722 - protein, 9 aa, Homo Sapiens
QALVRFYCY

SEQ ID NO: 193723 - protein, 9 aa, Homo Sapiens
IRHRPGGGH

SEQ ID NO: 193724 - protein, 9 aa, Homo Sapiens
GGVSLTSFL

SEQ ID NO: 193725 - protein, 9 aa, Homo Sapiens
NFPLEPIKD

SEQ ID NO: 193726 - protein, 9 aa, Homo Sapiens
DEHILRFLC

SEQ ID NO: 193727 - protein, 9 aa, Homo Sapiens
FTAVGFIHL

SEQ ID NO: 193728 - protein, 9 aa, Homo Sapiens
REPQCWAEG

SEQ ID NO: 193729 - protein, 9 aa, Homo Sapiens
SVRSFPSVE

SEQ ID NO: 193730 - protein, 9 aa, Homo Sapiens
QRRCRQPHR

SEQ ID NO: 193731 - protein, 9 aa, Homo Sapiens
KRHYLALWN

SEQ ID NO: 193732 - protein, 9 aa, Homo Sapiens
FQHGFKSPQ

SEQ ID NO: 193733 - protein, 9 aa, Homo Sapiens
PLGECIFPL

SEQ ID NO: 193734 - protein, 9 aa, Homo Sapiens
TLSERLWGP

SEQ ID NO: 193735 - protein, 9 aa, Homo Sapiens
VGVGAQGAA

SEQ ID NO: 193736 - protein, 9 aa, Homo Sapiens
VKTPAPIPE

SEQ ID NO: 193737 - protein, 9 aa, Homo Sapiens
KVEEAERAS

SEQ ID NO: 193738 - protein, 9 aa, Homo Sapiens
MKGDRGEVG

SEQ ID NO: 193739 - protein, 9 aa, Homo Sapiens
AYAHAEHVQ

SEQ ID NO: 193740 - protein, 9 aa, Homo Sapiens
VCATNNSYQ

SEQ ID NO: 193741 - protein, 9 aa, Homo Sapiens
HKEDLQDGL

SEQ ID NO: 193742 - protein, 9 aa, Homo Sapiens
EVRDSNRQA

SEQ ID NO: 193743 - protein, 9 aa, Homo Sapiens
TCCSTKIDL

SEQ ID NO: 193744 - protein, 9 aa, Homo Sapiens
VAIQRFLWM

SEQ ID NO: 193745 - protein, 9 aa, Homo Sapiens
PPHPPKPSQ

SEQ ID NO: 193746 - protein, 9 aa, Homo Sapiens
LIETLITLG

SEQ ID NO: 193747 - protein, 9 aa, Homo Sapiens
GGGGRFGGG

SEQ ID NO: 193748 - protein, 9 aa, Homo Sapiens
YVHTDLRQY

SEQ ID NO: 193749 - protein, 9 aa, Homo Sapiens
VAKILKQSP

SEQ ID NO: 193750 - protein, 9 aa, Homo Sapiens
DEAGSAMSC

SEQ ID NO: 193751 - protein, 9 aa, Homo Sapiens
EEELDSTRG

SEQ ID NO: 193752 - protein, 9 aa, Homo Sapiens
LLYAIGGHN

SEQ ID NO: 193753 - protein, 9 aa, Homo Sapiens
EVQRRCRQP

SEQ ID NO: 193754 - protein, 9 aa, Homo Sapiens
KMTKFLYHR

SEQ ID NO: 193755 - protein, 9 aa, Homo Sapiens
IIQHPYALT

SEQ ID NO: 193756 - protein, 9 aa, Homo Sapiens
IQNESFMKL

SEQ ID NO: 193757 - protein, 9 aa, Homo Sapiens
RNEKKERIP

SEQ ID NO: 193758 - protein, 9 aa, Homo Sapiens
WRLSSGSVH

SEQ ID NO: 193759 - protein, 9 aa, Homo Sapiens
KTQIANAQD

SEQ ID NO: 193760 - protein, 9 aa, Homo Sapiens
KSYNRLRYK

SEQ ID NO: 193761 - protein, 9 aa, Homo Sapiens
LEGHTASPP

SEQ ID NO: 193762 - protein, 9 aa, Homo Sapiens
HYSAKWSHK

SEQ ID NO: 193763 - protein, 9 aa, Homo Sapiens
ASSPAVLRE

SEQ ID NO: 193764 - protein, 9 aa, Homo Sapiens
LPGDQGAPG

SEQ ID NO: 193765 - protein, 9 aa, Homo Sapiens
ITGVNASML

SEQ ID NO: 193766 - protein, 9 aa, Homo Sapiens
GQHAPPIST

SEQ ID NO: 193767 - protein, 9 aa, Homo Sapiens
VTIVKQANC

SEQ ID NO: 193768 - protein, 9 aa, Homo Sapiens
SDELPVMGL

SEQ ID NO: 193769 - protein, 9 aa, Homo Sapiens
YGIMHRDLK

SEQ ID NO: 193770 - protein, 9 aa, Homo Sapiens
TYTRIPQVH

SEQ ID NO: 193771 - protein, 9 aa, Homo Sapiens
SWLPWNIYI

SEQ ID NO: 193772 - protein, 9 aa, Homo Sapiens
TVPLPPHLG

SEQ ID NO: 193773 - protein, 9 aa, Homo Sapiens
VSFWTLLPT

SEQ ID NO: 193774 - protein, 9 aa, Homo Sapiens
SAVHCKPMM

SEQ ID NO: 193775 - protein, 9 aa, Homo Sapiens
LKRLKGMMR

SEQ ID NO: 193776 - protein, 9 aa, Homo Sapiens
FFNCVNLIY

SEQ ID NO: 193777 - protein, 9 aa, Homo Sapiens
NLWEKLCEK

SEQ ID NO: 193778 - protein, 9 aa, Homo Sapiens
IHTRYPHST

SEQ ID NO: 193779 - protein, 9 aa, Homo Sapiens
SFLFHTGQH

SEQ ID NO: 193780 - protein, 9 aa, Homo Sapiens
LQYYTAEKL

SEQ ID NO: 193781 - protein, 9 aa, Homo Sapiens
SCIYRELID

SEQ ID NO: 193782 - protein, 9 aa, Homo Sapiens
PGCFTQYFF

SEQ ID NO: 193783 - protein, 9 aa, Homo Sapiens
SSYVSVHTE

SEQ ID NO: 193784 - protein, 9 aa, Homo Sapiens
SLAAACQDL

SEQ ID NO: 193785 - protein, 9 aa, Homo Sapiens
NGLDVESAD

SEQ ID NO: 193786 - protein, 9 aa, Homo Sapiens
CEPILIKYH

SEQ ID NO: 193787 - protein, 9 aa, Homo Sapiens
VPVPLLSVF

SEQ ID NO: 193788 - protein, 9 aa, Homo Sapiens
ASEAKSPGP

SEQ ID NO: 193789 - protein, 9 aa, Homo Sapiens
QAHQLVAAQ

SEQ ID NO: 193790 - protein, 9 aa, Homo Sapiens
LLPAEPLPT

SEQ ID NO: 193791 - protein, 9 aa, Homo Sapiens
VPLSPSLSR

SEQ ID NO: 193792 - protein, 9 aa, Homo Sapiens
LPPLLMPPC

SEQ ID NO: 193793 - protein, 9 aa, Homo Sapiens
NPKAMTLDQ

SEQ ID NO: 193794 - protein, 9 aa, Homo Sapiens
VVDFFNCVN

SEQ ID NO: 193795 - protein, 9 aa, Homo Sapiens
EAVRHPIFR

SEQ ID NO: 193796 - protein, 9 aa, Homo Sapiens
KENIEVEER

SEQ ID NO: 193797 - protein, 9 aa, Homo Sapiens
MATEKPGPA

SEQ ID NO: 193798 - protein, 9 aa, Homo Sapiens
EDPPTDPGV

SEQ ID NO: 193799 - protein, 9 aa, Homo Sapiens
PWIDGRKLV

SEQ ID NO: 193800 - protein, 9 aa, Homo Sapiens
EQKAARWQR

SEQ ID NO: 193801 - protein, 9 aa, Homo Sapiens
DLLVVEAVR

SEQ ID NO: 193802 - protein, 9 aa, Homo Sapiens
LFLESVQSH

SEQ ID NO: 193803 - protein, 9 aa, Homo Sapiens
CLAVLVPFR

SEQ ID NO: 193804 - protein, 9 aa, Homo Sapiens
LLQFQVSAH

SEQ ID NO: 193805 - protein, 9 aa, Homo Sapiens
TSARTAAEG

SEQ ID NO: 193806 - protein, 9 aa, Homo Sapiens
IFITEGNNI

SEQ ID NO: 193807 - protein, 9 aa, Homo Sapiens
QCRPPSPLE

SEQ ID NO: 193808 - protein, 9 aa, Homo Sapiens
TMEVRTQVQ

SEQ ID NO: 193809 - protein, 9 aa, Homo Sapiens
LDSTIRLYH

SEQ ID NO: 193810 - protein, 9 aa, Homo Sapiens
DWIQQDNGS

SEQ ID NO: 193811 - protein, 9 aa, Homo Sapiens
SREYLCPPW

SEQ ID NO: 193812 - protein, 9 aa, Homo Sapiens
EARSQQAHS

SEQ ID NO: 193813 - protein, 9 aa, Homo Sapiens
RLAHAKLWE

SEQ ID NO: 193814 - protein, 9 aa, Homo Sapiens
AYSYSLEHH

SEQ ID NO: 193815 - protein, 9 aa, Homo Sapiens
SVLGLARCT

SEQ ID NO: 193816 - protein, 9 aa, Homo Sapiens
DHFIPLQCH

SEQ ID NO: 193817 - protein, 9 aa, Homo Sapiens
SVDRLYECK

SEQ ID NO: 193818 - protein, 9 aa, Homo Sapiens
PIKWMAPEA

SEQ ID NO: 193819 - protein, 9 aa, Homo Sapiens
LVSKQHWDR

SEQ ID NO: 193820 - protein, 9 aa, Homo Sapiens
APMGQYPWA

SEQ ID NO: 193821 - protein, 9 aa, Homo Sapiens
GWPVTKNER

SEQ ID NO: 193822 - protein, 9 aa, Homo Sapiens
LKSVVEAER

SEQ ID NO: 193823 - protein, 9 aa, Homo Sapiens
HCACRLVFF

SEQ ID NO: 193824 - protein, 9 aa, Homo Sapiens
WWRGRCHDH

SEQ ID NO: 193825 - protein, 9 aa, Homo Sapiens
RERHSCDTL

SEQ ID NO: 193826 - protein, 9 aa, Homo Sapiens
IMGPSPILG

SEQ ID NO: 193827 - protein, 9 aa, Homo Sapiens
AMEYLQSVS

SEQ ID NO: 193828 - protein, 9 aa, Homo Sapiens
IGMLLSNAL

SEQ ID NO: 193829 - protein, 9 aa, Homo Sapiens
HAYCPFQGF

SEQ ID NO: 193830 - protein, 9 aa, Homo Sapiens
NGSNEMLLV

SEQ ID NO: 193831 - protein, 9 aa, Homo Sapiens
CCIPDTVWS

SEQ ID NO: 193832 - protein, 9 aa, Homo Sapiens
RLGTPALMS

SEQ ID NO: 193833 - protein, 9 aa, Homo Sapiens
EKDKQNIQK

SEQ ID NO: 193834 - protein, 9 aa, Homo Sapiens
RNIKYDIKG

SEQ ID NO: 193835 - protein, 9 aa, Homo Sapiens
KAVVSHNKG

SEQ ID NO: 193836 - protein, 9 aa, Homo Sapiens
SRTCGNQDY

SEQ ID NO: 193837 - protein, 9 aa, Homo Sapiens
PRVAQPSCC

SEQ ID NO: 193838 - protein, 9 aa, Homo Sapiens
LLDPWREIR

SEQ ID NO: 193839 - protein, 9 aa, Homo Sapiens
ERPQILEAL

SEQ ID NO: 193840 - protein, 9 aa, Homo Sapiens
HTLYGSRDS

SEQ ID NO: 193841 - protein, 9 aa, Homo Sapiens
TNCMEDESA

SEQ ID NO: 193842 - protein, 9 aa, Homo Sapiens
RQTGGRVLI

SEQ ID NO: 193843 - protein, 9 aa, Homo Sapiens
DRVQDDDDR

SEQ ID NO: 193844 - protein, 9 aa, Homo Sapiens
CMYSKGASE

SEQ ID NO: 193845 - protein, 9 aa, Homo Sapiens
VDPEEKKKI

SEQ ID NO: 193846 - protein, 9 aa, Homo Sapiens
LTELLLRMA

SEQ ID NO: 193847 - protein, 9 aa, Homo Sapiens
GSTTSGGSQ

SEQ ID NO: 193848 - protein, 9 aa, Homo Sapiens
DISEGMEMK

SEQ ID NO: 193849 - protein, 9 aa, Homo Sapiens
VSAAATRPK

SEQ ID NO: 193850 - protein, 9 aa, Homo Sapiens
HTSSSNTTL

SEQ ID NO: 193851 - protein, 9 aa, Homo Sapiens
VWPLLLVVA

SEQ ID NO: 193852 - protein, 9 aa, Homo Sapiens
ALMSRGLLE

SEQ ID NO: 193853 - protein, 9 aa, Homo Sapiens
LGADGAETF

SEQ ID NO: 193854 - protein, 9 aa, Homo Sapiens
RHELTNDRY

SEQ ID NO: 193855 - protein, 9 aa, Homo Sapiens
DQRITESCQ

SEQ ID NO: 193856 - protein, 9 aa, Homo Sapiens
GHFQAQLLS

SEQ ID NO: 193857 - protein, 9 aa, Homo Sapiens
VVVGILLVV

SEQ ID NO: 193858 - protein, 9 aa, Homo Sapiens
PCWGWHWEG

SEQ ID NO: 193859 - protein, 9 aa, Homo Sapiens
SKVHAFVRM

SEQ ID NO: 193860 - protein, 9 aa, Homo Sapiens
LRRLAAPCL

SEQ ID NO: 193861 - protein, 9 aa, Homo Sapiens
ISAAMACFT

SEQ ID NO: 193862 - protein, 9 aa, Homo Sapiens
CPESVKNGF

SEQ ID NO: 193863 - protein, 9 aa, Homo Sapiens
PHFVHCIIP

SEQ ID NO: 193864 - protein, 9 aa, Homo Sapiens
LVGDPAMVF

SEQ ID NO: 193865 - protein, 9 aa, Homo Sapiens
GNQGCSWTV

SEQ ID NO: 193866 - protein, 9 aa, Homo Sapiens
FFACMVRVR

SEQ ID NO: 193867 - protein, 9 aa, Homo Sapiens
RSYDEAILY

SEQ ID NO: 193868 - protein, 9 aa, Homo Sapiens
PPDSQEMLA

SEQ ID NO: 193869 - protein, 9 aa, Homo Sapiens
HVGPSFVQK

SEQ ID NO: 193870 - protein, 9 aa, Homo Sapiens
KHSEKSSPS

SEQ ID NO: 193871 - protein, 9 aa, Homo Sapiens
IFICNYVPG

SEQ ID NO: 193872 - protein, 9 aa, Homo Sapiens
IKWAQGGDY

SEQ ID NO: 193873 - protein, 9 aa, Homo Sapiens
AALRERLDG

SEQ ID NO: 193874 - protein, 9 aa, Homo Sapiens
VGPGHISEI

SEQ ID NO: 193875 - protein, 9 aa, Homo Sapiens
NQDPKAVDE

SEQ ID NO: 193876 - protein, 9 aa, Homo Sapiens
VCSNTCCST

SEQ ID NO: 193877 - protein, 9 aa, Homo Sapiens
RHQKLNSVD

SEQ ID NO: 193878 - protein, 9 aa, Homo Sapiens
SETVRIINC

SEQ ID NO: 193879 - protein, 9 aa, Homo Sapiens
LEDDYYSPY

SEQ ID NO: 193880 - protein, 9 aa, Homo Sapiens
FHFTVRYIR

SEQ ID NO: 193881 - protein, 9 aa, Homo Sapiens
GAKGDMGLH

SEQ ID NO: 193882 - protein, 9 aa, Homo Sapiens
GRYAGTMDI

SEQ ID NO: 193883 - protein, 9 aa, Homo Sapiens
VMGLTKSGG

SEQ ID NO: 193884 - protein, 9 aa, Homo Sapiens
SLSQVGDPI

SEQ ID NO: 193885 - protein, 9 aa, Homo Sapiens
VWSGEARAP

SEQ ID NO: 193886 - protein, 9 aa, Homo Sapiens
MLSFSFMVL

SEQ ID NO: 193887 - protein, 9 aa, Homo Sapiens
KGDKTKETV

SEQ ID NO: 193888 - protein, 9 aa, Homo Sapiens
PKKSRTMTT

SEQ ID NO: 193889 - protein, 9 aa, Homo Sapiens
EFYKNAKVR

SEQ ID NO: 193890 - protein, 9 aa, Homo Sapiens
NKYLPSLLR

SEQ ID NO: 193891 - protein, 9 aa, Homo Sapiens
ADIGDTANY

SEQ ID NO: 193892 - protein, 9 aa, Homo Sapiens
ESRECAHCL

SEQ ID NO: 193893 - protein, 9 aa, Homo Sapiens
ALASVIMGP

SEQ ID NO: 193894 - protein, 9 aa, Homo Sapiens
TDAAHAVGK

SEQ ID NO: 193895 - protein, 9 aa, Homo Sapiens
ETYTSNAMP

SEQ ID NO: 193896 - protein, 9 aa, Homo Sapiens
EFRGGCRVP

SEQ ID NO: 193897 - protein, 9 aa, Homo Sapiens
TDVDECKIG

SEQ ID NO: 193898 - protein, 9 aa, Homo Sapiens
ALWLECVVA

SEQ ID NO: 193899 - protein, 9 aa, Homo Sapiens
LKRILLPGL

SEQ ID NO: 193900 - protein, 9 aa, Homo Sapiens
MDPNEAKQW

SEQ ID NO: 193901 - protein, 9 aa, Homo Sapiens
LPMAKSYNR

SEQ ID NO: 193902 - protein, 9 aa, Homo Sapiens
KDPHIAQKI

SEQ ID NO: 193903 - protein, 9 aa, Homo Sapiens
YGGWGARGG

SEQ ID NO: 193904 - protein, 9 aa, Homo Sapiens
ISAFPVDTL

SEQ ID NO: 193905 - protein, 9 aa, Homo Sapiens
VEPGLGSVT

SEQ ID NO: 193906 - protein, 9 aa, Homo Sapiens
GGCVGSRRR

SEQ ID NO: 193907 - protein, 9 aa, Homo Sapiens
MSRATVRCL

SEQ ID NO: 193908 - protein, 9 aa, Homo Sapiens
DLLQAATRL

SEQ ID NO: 193909 - protein, 9 aa, Homo Sapiens
ADFTKMTPK

SEQ ID NO: 193910 - protein, 9 aa, Homo Sapiens
NTATLATSI

SEQ ID NO: 193911 - protein, 9 aa, Homo Sapiens
VEIQNHWFT

SEQ ID NO: 193912 - protein, 9 aa, Homo Sapiens
SCKSDSHIL

SEQ ID NO: 193913 - protein, 9 aa, Homo Sapiens
GSTSSGSKS

SEQ ID NO: 193914 - protein, 9 aa, Homo Sapiens
FYIINILVS

SEQ ID NO: 193915 - protein, 9 aa, Homo Sapiens
VPPKKMHKS

SEQ ID NO: 193916 - protein, 9 aa, Homo Sapiens
KENYISNHA

SEQ ID NO: 193917 - protein, 9 aa, Homo Sapiens
YLFSFSVQI

SEQ ID NO: 193918 - protein, 9 aa, Homo Sapiens
PYEFNDHGK

SEQ ID NO: 193919 - protein, 9 aa, Homo Sapiens
LALSQGDGL

SEQ ID NO: 193920 - protein, 9 aa, Homo Sapiens
DECTLGATV

SEQ ID NO: 193921 - protein, 9 aa, Homo Sapiens
HEVSPLQCH

SEQ ID NO: 193922 - protein, 9 aa, Homo Sapiens
TPKFQAESL

SEQ ID NO: 193923 - protein, 9 aa, Homo Sapiens
ITTPNQLLL

SEQ ID NO: 193924 - protein, 9 aa, Homo Sapiens
DPKLKEALS

SEQ ID NO: 193925 - protein, 9 aa, Homo Sapiens
QVVDCSHLF

SEQ ID NO: 193926 - protein, 9 aa, Homo Sapiens
RHYLALWNN

SEQ ID NO: 193927 - protein, 9 aa, Homo Sapiens
LRSPQKPTR

SEQ ID NO: 193928 - protein, 9 aa, Homo Sapiens
PSQGPAGLG

SEQ ID NO: 193929 - protein, 9 aa, Homo Sapiens
SYVSVHTES

SEQ ID NO: 193930 - protein, 9 aa, Homo Sapiens
VRKRQFQLR

SEQ ID NO: 193931 - protein, 9 aa, Homo Sapiens
EWRTVPILF

SEQ ID NO: 193932 - protein, 9 aa, Homo Sapiens
AKMQLDREY

SEQ ID NO: 193933 - protein, 9 aa, Homo Sapiens
APAGPACSA

SEQ ID NO: 193934 - protein, 9 aa, Homo Sapiens
IANAQDRRE

SEQ ID NO: 193935 - protein, 9 aa, Homo Sapiens
LQRRKRPLS

SEQ ID NO: 193936 - protein, 9 aa, Homo Sapiens
PQAWGSLEE

SEQ ID NO: 193937 - protein, 9 aa, Homo Sapiens
FPRFYFLSY

SEQ ID NO: 193938 - protein, 9 aa, Homo Sapiens
ADPPLLTST

SEQ ID NO: 193939 - protein, 9 aa, Homo Sapiens
PSFVQKEFQ

SEQ ID NO: 193940 - protein, 9 aa, Homo Sapiens
VMTSHSMEE

SEQ ID NO: 193941 - protein, 9 aa, Homo Sapiens
AVREASPVP

SEQ ID NO: 193942 - protein, 9 aa, Homo Sapiens
RFTGYQLRV

SEQ ID NO: 193943 - protein, 9 aa, Homo Sapiens
ARLRRDPAR

SEQ ID NO: 193944 - protein, 9 aa, Homo Sapiens
GESGRPGQP

SEQ ID NO: 193945 - protein, 9 aa, Homo Sapiens
DLLELQGQA

SEQ ID NO: 193946 - protein, 9 aa, Homo Sapiens
TMWRIRQLL

SEQ ID NO: 193947 - protein, 9 aa, Homo Sapiens
CDVNTGPMR

SEQ ID NO: 193948 - protein, 9 aa, Homo Sapiens
VGREPQCWA

SEQ ID NO: 193949 - protein, 9 aa, Homo Sapiens
HRDLKANMW

SEQ ID NO: 193950 - protein, 9 aa, Homo Sapiens
DLFCEFISK

SEQ ID NO: 193951 - protein, 9 aa, Homo Sapiens
LDRAGAEHV

SEQ ID NO: 193952 - protein, 9 aa, Homo Sapiens
CIVNGAYKH

SEQ ID NO: 193953 - protein, 9 aa, Homo Sapiens
IYHLKSKVH

SEQ ID NO: 193954 - protein, 9 aa, Homo Sapiens
VDTVFNTMW

SEQ ID NO: 193955 - protein, 9 aa, Homo Sapiens
TVRDRPLQE

SEQ ID NO: 193956 - protein, 9 aa, Homo Sapiens
YHLQSWLYS

SEQ ID NO: 193957 - protein, 9 aa, Homo Sapiens
QLAMQIHFQ

SEQ ID NO: 193958 - protein, 9 aa, Homo Sapiens
RETGVIDPQ

SEQ ID NO: 193959 - protein, 9 aa, Homo Sapiens
RKRASQTYE

SEQ ID NO: 193960 - protein, 9 aa, Homo Sapiens
NVISRSGEP

SEQ ID NO: 193961 - protein, 9 aa, Homo Sapiens
APGPAGARD

SEQ ID NO: 193962 - protein, 9 aa, Homo Sapiens
AQARDQLRE

SEQ ID NO: 193963 - protein, 9 aa, Homo Sapiens
VLGLSAVVW

SEQ ID NO: 193964 - protein, 9 aa, Homo Sapiens
RCGGPVPQE

SEQ ID NO: 193965 - protein, 9 aa, Homo Sapiens
KSSPQAWGS

SEQ ID NO: 193966 - protein, 9 aa, Homo Sapiens
TGMQPHEPK

SEQ ID NO: 193967 - protein, 9 aa, Homo Sapiens
DDPNPVVQI

SEQ ID NO: 193968 - protein, 9 aa, Homo Sapiens
ILDVSFNRL

SEQ ID NO: 193969 - protein, 9 aa, Homo Sapiens
WFCLSFVYN

SEQ ID NO: 193970 - protein, 9 aa, Homo Sapiens
DLFSLGMPL

SEQ ID NO: 193971 - protein, 9 aa, Homo Sapiens
REWVENRRA

SEQ ID NO: 193972 - protein, 9 aa, Homo Sapiens
LTWVSAPNR

SEQ ID NO: 193973 - protein, 9 aa, Homo Sapiens
RGRTTSAGG

SEQ ID NO: 193974 - protein, 9 aa, Homo Sapiens
SCHTTVDRT

SEQ ID NO: 193975 - protein, 9 aa, Homo Sapiens
SCLCFTSPQ

SEQ ID NO: 193976 - protein, 9 aa, Homo Sapiens
TQFLSKELE

SEQ ID NO: 193977 - protein, 9 aa, Homo Sapiens
NEEEGDRKM

SEQ ID NO: 193978 - protein, 9 aa, Homo Sapiens
KTDIVLWYR

SEQ ID NO: 193979 - protein, 9 aa, Homo Sapiens
IRDKWSRLI

SEQ ID NO: 193980 - protein, 9 aa, Homo Sapiens
GTCQLQHSG

SEQ ID NO: 193981 - protein, 9 aa, Homo Sapiens
SDHCINIDE

SEQ ID NO: 193982 - protein, 9 aa, Homo Sapiens
NVIYWAAYT

SEQ ID NO: 193983 - protein, 9 aa, Homo Sapiens
NASLASKSG

SEQ ID NO: 193984 - protein, 9 aa, Homo Sapiens
PSEVAAVPH

SEQ ID NO: 193985 - protein, 9 aa, Homo Sapiens
KLIAKVCCL

SEQ ID NO: 193986 - protein, 9 aa, Homo Sapiens
TKHKQIHTG

SEQ ID NO: 193987 - protein, 9 aa, Homo Sapiens
LEGQMFEHL

SEQ ID NO: 193988 - protein, 9 aa, Homo Sapiens
LVVPDLPVP

SEQ ID NO: 193989 - protein, 9 aa, Homo Sapiens
PSRMDRIVE

SEQ ID NO: 193990 - protein, 9 aa, Homo Sapiens
ERDNGGRRG

SEQ ID NO: 193991 - protein, 9 aa, Homo Sapiens
FKSPQLFKN

SEQ ID NO: 193992 - protein, 9 aa, Homo Sapiens
QENVREALL

SEQ ID NO: 193993 - protein, 9 aa, Homo Sapiens
AQIRPAPDK

SEQ ID NO: 193994 - protein, 9 aa, Homo Sapiens
QVCEPENTC

SEQ ID NO: 193995 - protein, 9 aa, Homo Sapiens
GRLCERFLV

SEQ ID NO: 193996 - protein, 9 aa, Homo Sapiens
MNSTINIHH

SEQ ID NO: 193997 - protein, 9 aa, Homo Sapiens
VTCNHCACR

SEQ ID NO: 193998 - protein, 9 aa, Homo Sapiens
SPSSVIRTN

SEQ ID NO: 193999 - protein, 9 aa, Homo Sapiens
PALTILDVS

SEQ ID NO: 194000 - protein, 9 aa, Homo Sapiens
GKTMQTIAL

SEQ ID NO: 194001 - protein, 9 aa, Homo Sapiens
SLFIPREMT

SEQ ID NO: 194002 - protein, 9 aa, Homo Sapiens
AQVHPLVLQ

SEQ ID NO: 194003 - protein, 9 aa, Homo Sapiens
CSNQMPSLG

SEQ ID NO: 194004 - protein, 9 aa, Homo Sapiens
TKSALITVT

SEQ ID NO: 194005 - protein, 9 aa, Homo Sapiens
CYHGFLNTS

SEQ ID NO: 194006 - protein, 9 aa, Homo Sapiens
QPAPPILPW

SEQ ID NO: 194007 - protein, 9 aa, Homo Sapiens
LLKLSSPAI

SEQ ID NO: 194008 - protein, 9 aa, Homo Sapiens
IQVYWNIIH

SEQ ID NO: 194009 - protein, 9 aa, Homo Sapiens
LCVDVAGHF

SEQ ID NO: 194010 - protein, 9 aa, Homo Sapiens
RMITETEGS

SEQ ID NO: 194011 - protein, 9 aa, Homo Sapiens
WEQYSDCDG

SEQ ID NO: 194012 - protein, 9 aa, Homo Sapiens
LESVQSHLR

SEQ ID NO: 194013 - protein, 9 aa, Homo Sapiens
VLMDRKQEQ

SEQ ID NO: 194014 - protein, 9 aa, Homo Sapiens
FNMEAFTEM

SEQ ID NO: 194015 - protein, 9 aa, Homo Sapiens
GRYGVQERV

SEQ ID NO: 194016 - protein, 9 aa, Homo Sapiens
WKEKQDYVF

SEQ ID NO: 194017 - protein, 9 aa, Homo Sapiens
SSRPANGGQ

SEQ ID NO: 194018 - protein, 9 aa, Homo Sapiens
LSVATTTPG

SEQ ID NO: 194019 - protein, 9 aa, Homo Sapiens
SDLVRCVRL

SEQ ID NO: 194020 - protein, 9 aa, Homo Sapiens
YFVFMFMDM

SEQ ID NO: 194021 - protein, 9 aa, Homo Sapiens
YHENIEARD

SEQ ID NO: 194022 - protein, 9 aa, Homo Sapiens
ARSQQAHSA

SEQ ID NO: 194023 - protein, 9 aa, Homo Sapiens
GEQTPRGCC

SEQ ID NO: 194024 - protein, 9 aa, Homo Sapiens
MTEEACRTW

SEQ ID NO: 194025 - protein, 9 aa, Homo Sapiens
DHRGLYHFC

SEQ ID NO: 194026 - protein, 9 aa, Homo Sapiens
YECWWYEKL

SEQ ID NO: 194027 - protein, 9 aa, Homo Sapiens
VAKMQLDRE

SEQ ID NO: 194028 - protein, 9 aa, Homo Sapiens
ACMVRVRDG

SEQ ID NO: 194029 - protein, 9 aa, Homo Sapiens
ILQNEPLSE

SEQ ID NO: 194030 - protein, 9 aa, Homo Sapiens
DLSSEEHFH

SEQ ID NO: 194031 - protein, 9 aa, Homo Sapiens
ILENKEFMK

SEQ ID NO: 194032 - protein, 9 aa, Homo Sapiens
QEGQRMCAF

SEQ ID NO: 194033 - protein, 9 aa, Homo Sapiens
GRTFPEDES

SEQ ID NO: 194034 - protein, 9 aa, Homo Sapiens
EQEFLYKTV

SEQ ID NO: 194035 - protein, 9 aa, Homo Sapiens
ENTCLCNQY

SEQ ID NO: 194036 - protein, 9 aa, Homo Sapiens
PWASSLLPE

SEQ ID NO: 194037 - protein, 9 aa, Homo Sapiens
VCCLPQVQL

SEQ ID NO: 194038 - protein, 9 aa, Homo Sapiens
APSSPMLRG

SEQ ID NO: 194039 - protein, 9 aa, Homo Sapiens
SRNRKEEKP

SEQ ID NO: 194040 - protein, 9 aa, Homo Sapiens
LFLELPIFT

SEQ ID NO: 194041 - protein, 9 aa, Homo Sapiens
VTDINDSTP

SEQ ID NO: 194042 - protein, 9 aa, Homo Sapiens
RGAATGGCQ

SEQ ID NO: 194043 - protein, 9 aa, Homo Sapiens
QCPGHCSLE

SEQ ID NO: 194044 - protein, 9 aa, Homo Sapiens
LHKALNQLE

SEQ ID NO: 194045 - protein, 9 aa, Homo Sapiens
WYTYTYLCV

SEQ ID NO: 194046 - protein, 9 aa, Homo Sapiens
DSDKCREIA

SEQ ID NO: 194047 - protein, 9 aa, Homo Sapiens
TYEGGVQEP

SEQ ID NO: 194048 - protein, 9 aa, Homo Sapiens
HHSWPENLA

SEQ ID NO: 194049 - protein, 9 aa, Homo Sapiens
TIRAGESVW

SEQ ID NO: 194050 - protein, 9 aa, Homo Sapiens
LSTLFESHI

SEQ ID NO: 194051 - protein, 9 aa, Homo Sapiens
RVANFAVGM

SEQ ID NO: 194052 - protein, 9 aa, Homo Sapiens
CSTPGVAST

SEQ ID NO: 194053 - protein, 9 aa, Homo Sapiens
FNCVNLIYG

SEQ ID NO: 194054 - protein, 9 aa, Homo Sapiens
LTASSDGTC

SEQ ID NO: 194055 - protein, 9 aa, Homo Sapiens
FLFLRTLKE

SEQ ID NO: 194056 - protein, 9 aa, Homo Sapiens
RGNVSTPPH

SEQ ID NO: 194057 - protein, 9 aa, Homo Sapiens
LQEREAGTA

SEQ ID NO: 194058 - protein, 9 aa, Homo Sapiens
CRKINFSLR

SEQ ID NO: 194059 - protein, 9 aa, Homo Sapiens
SSDELPVMG

SEQ ID NO: 194060 - protein, 9 aa, Homo Sapiens
EKELANFNP

SEQ ID NO: 194061 - protein, 9 aa, Homo Sapiens
IYNIFKTDI

SEQ ID NO: 194062 - protein, 9 aa, Homo Sapiens
RLYCIKPEA

SEQ ID NO: 194063 - protein, 9 aa, Homo Sapiens
LFSHHTVIS

SEQ ID NO: 194064 - protein, 9 aa, Homo Sapiens
GGLVYLQRS

SEQ ID NO: 194065 - protein, 9 aa, Homo Sapiens
SPEDITQDF

SEQ ID NO: 194066 - protein, 9 aa, Homo Sapiens
PWNQAAGAP

SEQ ID NO: 194067 - protein, 9 aa, Homo Sapiens
VPRNSQKVT

SEQ ID NO: 194068 - protein, 9 aa, Homo Sapiens
LHHGLTQKM

SEQ ID NO: 194069 - protein, 9 aa, Homo Sapiens
EIAEDIVSD

SEQ ID NO: 194070 - protein, 9 aa, Homo Sapiens
KEDNISFSI

SEQ ID NO: 194071 - protein, 9 aa, Homo Sapiens
HKSQLWLHL

SEQ ID NO: 194072 - protein, 9 aa, Homo Sapiens
QPQEPLATV

SEQ ID NO: 194073 - protein, 9 aa, Homo Sapiens
RRWSPTWGR

SEQ ID NO: 194074 - protein, 9 aa, Homo Sapiens
CCLPQVQLD

SEQ ID NO: 194075 - protein, 9 aa, Homo Sapiens
PSLAFIRPR

SEQ ID NO: 194076 - protein, 9 aa, Homo Sapiens
LMKEGFMTS

SEQ ID NO: 194077 - protein, 9 aa, Homo Sapiens
LPEDHDTYT

SEQ ID NO: 194078 - protein, 9 aa, Homo Sapiens
EDCLQQFGF

SEQ ID NO: 194079 - protein, 9 aa, Homo Sapiens
YAPRLAPLL

SEQ ID NO: 194080 - protein, 9 aa, Homo Sapiens
RAGESVWPK

SEQ ID NO: 194081 - protein, 9 aa, Homo Sapiens
SRFHADSMC

SEQ ID NO: 194082 - protein, 9 aa, Homo Sapiens
PTLTEESVN

SEQ ID NO: 194083 - protein, 9 aa, Homo Sapiens
SSPTLLSHF

SEQ ID NO: 194084 - protein, 9 aa, Homo Sapiens
RGNPSRLYY

SEQ ID NO: 194085 - protein, 9 aa, Homo Sapiens
YSNLQRLEN

SEQ ID NO: 194086 - protein, 9 aa, Homo Sapiens
KGSTYSQHN

SEQ ID NO: 194087 - protein, 9 aa, Homo Sapiens
NANEDHREA

SEQ ID NO: 194088 - protein, 9 aa, Homo Sapiens
KDNATLARE

SEQ ID NO: 194089 - protein, 9 aa, Homo Sapiens
IDKARVEIQ

SEQ ID NO: 194090 - protein, 9 aa, Homo Sapiens
LEQLEETRR

SEQ ID NO: 194091 - protein, 9 aa, Homo Sapiens
FKAFVESHY

SEQ ID NO: 194092 - protein, 9 aa, Homo Sapiens
NLVELEAAW

SEQ ID NO: 194093 - protein, 9 aa, Homo Sapiens
YKKSDGIQK

SEQ ID NO: 194094 - protein, 9 aa, Homo Sapiens
PRPLHRWLQ

SEQ ID NO: 194095 - protein, 9 aa, Homo Sapiens
VQDFISAIH

SEQ ID NO: 194096 - protein, 9 aa, Homo Sapiens
TELLQIQAL

SEQ ID NO: 194097 - protein, 9 aa, Homo Sapiens
SNDGNSYHL

SEQ ID NO: 194098 - protein, 9 aa, Homo Sapiens
EKAGHPRPG

SEQ ID NO: 194099 - protein, 9 aa, Homo Sapiens
RGEPAVLPA

SEQ ID NO: 194100 - protein, 9 aa, Homo Sapiens
SCPRCPSSF

SEQ ID NO: 194101 - protein, 9 aa, Homo Sapiens
QGHIAKMPV

SEQ ID NO: 194102 - protein, 9 aa, Homo Sapiens
ARAAWGTSS

SEQ ID NO: 194103 - protein, 9 aa, Homo Sapiens
FFWAPNSTN

SEQ ID NO: 194104 - protein, 9 aa, Homo Sapiens
PPHQALMGP

SEQ ID NO: 194105 - protein, 9 aa, Homo Sapiens
LYEMLCGHV

SEQ ID NO: 194106 - protein, 9 aa, Homo Sapiens
SRLGLVAVA

SEQ ID NO: 194107 - protein, 9 aa, Homo Sapiens
HIGDPSVHL

SEQ ID NO: 194108 - protein, 9 aa, Homo Sapiens
DEALLIQEA

SEQ ID NO: 194109 - protein, 9 aa, Homo Sapiens
EVANNPSSH

SEQ ID NO: 194110 - protein, 9 aa, Homo Sapiens
KLVYQNIFM

SEQ ID NO: 194111 - protein, 9 aa, Homo Sapiens
EYEPTARIS

SEQ ID NO: 194112 - protein, 9 aa, Homo Sapiens
GESVWPKKI

SEQ ID NO: 194113 - protein, 9 aa, Homo Sapiens
NVQCKQEQR

SEQ ID NO: 194114 - protein, 9 aa, Homo Sapiens
TNIEAELHI

SEQ ID NO: 194115 - protein, 9 aa, Homo Sapiens
FTCPLFLEL

SEQ ID NO: 194116 - protein, 9 aa, Homo Sapiens
VKAWLEGEI

SEQ ID NO: 194117 - protein, 9 aa, Homo Sapiens
SLGMPLKLG

SEQ ID NO: 194118 - protein, 9 aa, Homo Sapiens
LADPDEVAC

SEQ ID NO: 194119 - protein, 9 aa, Homo Sapiens
CGGLIKNIK

SEQ ID NO: 194120 - protein, 9 aa, Homo Sapiens
KTDGEERQK

SEQ ID NO: 194121 - protein, 9 aa, Homo Sapiens
DRAMYLMCT

SEQ ID NO: 194122 - protein, 9 aa, Homo Sapiens
KSTFLYILA

SEQ ID NO: 194123 - protein, 9 aa, Homo Sapiens
QNDLYYNTI

SEQ ID NO: 194124 - protein, 9 aa, Homo Sapiens
GGDFWYVTC

SEQ ID NO: 194125 - protein, 9 aa, Homo Sapiens
NYQGLCFSG

SEQ ID NO: 194126 - protein, 9 aa, Homo Sapiens
ADVEFELST

SEQ ID NO: 194127 - protein, 9 aa, Homo Sapiens
DHFGLFPAN

SEQ ID NO: 194128 - protein, 9 aa, Homo Sapiens
WDLKPIADW

SEQ ID NO: 194129 - protein, 9 aa, Homo Sapiens
IKRLEYALK

SEQ ID NO: 194130 - protein, 9 aa, Homo Sapiens
TLQNMPSLH

SEQ ID NO: 194131 - protein, 9 aa, Homo Sapiens
VYGVYFELP

SEQ ID NO: 194132 - protein, 9 aa, Homo Sapiens
VRHPIFRPA

SEQ ID NO: 194133 - protein, 9 aa, Homo Sapiens
LASVIMGPS

SEQ ID NO: 194134 - protein, 9 aa, Homo Sapiens
ISQETTADV

SEQ ID NO: 194135 - protein, 9 aa, Homo Sapiens
RIPQVHWTT

SEQ ID NO: 194136 - protein, 9 aa, Homo Sapiens
DHSDHTLSI

SEQ ID NO: 194137 - protein, 9 aa, Homo Sapiens
KEVERRKEQ

SEQ ID NO: 194138 - protein, 9 aa, Homo Sapiens
RRCPRGHHH

SEQ ID NO: 194139 - protein, 9 aa, Homo Sapiens
LTVILDADF

SEQ ID NO: 194140 - protein, 9 aa, Homo Sapiens
AFRVEIHMV

SEQ ID NO: 194141 - protein, 9 aa, Homo Sapiens
PPECCRRRR

SEQ ID NO: 194142 - protein, 9 aa, Homo Sapiens
LKREEEILR

SEQ ID NO: 194143 - protein, 9 aa, Homo Sapiens
KPWASSLLP

SEQ ID NO: 194144 - protein, 9 aa, Homo Sapiens
NRSAQIAKQ

SEQ ID NO: 194145 - protein, 9 aa, Homo Sapiens
FSRFHADSM

SEQ ID NO: 194146 - protein, 9 aa, Homo Sapiens
QIALEYSQA

SEQ ID NO: 194147 - protein, 9 aa, Homo Sapiens
ILSRYVRTW

SEQ ID NO: 194148 - protein, 9 aa, Homo Sapiens
KWSRLIEGY

SEQ ID NO: 194149 - protein, 9 aa, Homo Sapiens
SPPQQAGWS

SEQ ID NO: 194150 - protein, 9 aa, Homo Sapiens
GAGWPCPAV

SEQ ID NO: 194151 - protein, 9 aa, Homo Sapiens
LVILICFST

SEQ ID NO: 194152 - protein, 9 aa, Homo Sapiens
GDILTANEK

SEQ ID NO: 194153 - protein, 9 aa, Homo Sapiens
LDVESADEN

SEQ ID NO: 194154 - protein, 9 aa, Homo Sapiens
GGLPGTAQG

SEQ ID NO: 194155 - protein, 9 aa, Homo Sapiens
RMETELALK

SEQ ID NO: 194156 - protein, 9 aa, Homo Sapiens
QCSTAIFFY

SEQ ID NO: 194157 - protein, 9 aa, Homo Sapiens
GQALRQCYH

SEQ ID NO: 194158 - protein, 9 aa, Homo Sapiens
MDSHMKQLL

SEQ ID NO: 194159 - protein, 9 aa, Homo Sapiens
NCKVKPREP

SEQ ID NO: 194160 - protein, 9 aa, Homo Sapiens
QQRGLMDWS

SEQ ID NO: 194161 - protein, 9 aa, Homo Sapiens
ENLMSQVYS

SEQ ID NO: 194162 - protein, 9 aa, Homo Sapiens
LQPYLLPCL

SEQ ID NO: 194163 - protein, 9 aa, Homo Sapiens
AADLDAGRD

SEQ ID NO: 194164 - protein, 9 aa, Homo Sapiens
VKSKIALRN

SEQ ID NO: 194165 - protein, 9 aa, Homo Sapiens
NSRLICRCL

SEQ ID NO: 194166 - protein, 9 aa, Homo Sapiens
GWRLDLQGI

SEQ ID NO: 194167 - protein, 9 aa, Homo Sapiens
QPSCCLGRS

SEQ ID NO: 194168 - protein, 9 aa, Homo Sapiens
LGLAPPRPA

SEQ ID NO: 194169 - protein, 9 aa, Homo Sapiens
DVWTFGVNN

SEQ ID NO: 194170 - protein, 9 aa, Homo Sapiens
FRWHLPQHQ

SEQ ID NO: 194171 - protein, 9 aa, Homo Sapiens
QKMPSNQNV

SEQ ID NO: 194172 - protein, 9 aa, Homo Sapiens
MGIALKMNE

SEQ ID NO: 194173 - protein, 9 aa, Homo Sapiens
WPKKINNIT

SEQ ID NO: 194174 - protein, 9 aa, Homo Sapiens
RECESRIRG

SEQ ID NO: 194175 - protein, 9 aa, Homo Sapiens
ASGLPAISK

SEQ ID NO: 194176 - protein, 9 aa, Homo Sapiens
ALLSSEDLV

SEQ ID NO: 194177 - protein, 9 aa, Homo Sapiens
NAVLHKALN

SEQ ID NO: 194178 - protein, 9 aa, Homo Sapiens
AIVLQMLKD

SEQ ID NO: 194179 - protein, 9 aa, Homo Sapiens
SKPLNLPPP

SEQ ID NO: 194180 - protein, 9 aa, Homo Sapiens
TGVPVRTTP

SEQ ID NO: 194181 - protein, 9 aa, Homo Sapiens
RGGGSPSRS

SEQ ID NO: 194182 - protein, 9 aa, Homo Sapiens
TGGCQGGRF

SEQ ID NO: 194183 - protein, 9 aa, Homo Sapiens
ASKSGWEDC

SEQ ID NO: 194184 - protein, 9 aa, Homo Sapiens
VYAKAVLWE

SEQ ID NO: 194185 - protein, 9 aa, Homo Sapiens
SSDLFSLGM

SEQ ID NO: 194186 - protein, 9 aa, Homo Sapiens
VPIAVGAAS

SEQ ID NO: 194187 - protein, 9 aa, Homo Sapiens
AYRDHLDPA

SEQ ID NO: 194188 - protein, 9 aa, Homo Sapiens
NSEQRDSID

SEQ ID NO: 194189 - protein, 9 aa, Homo Sapiens
SIGWARARG

SEQ ID NO: 194190 - protein, 9 aa, Homo Sapiens
LPVLFPPWI

SEQ ID NO: 194191 - protein, 9 aa, Homo Sapiens
VSEFCLPET

SEQ ID NO: 194192 - protein, 9 aa, Homo Sapiens
VHLRRRCPR

SEQ ID NO: 194193 - protein, 9 aa, Homo Sapiens
SAGVLILVL

SEQ ID NO: 194194 - protein, 9 aa, Homo Sapiens
MASIISSFL

SEQ ID NO: 194195 - protein, 9 aa, Homo Sapiens
TTMLALALS

SEQ ID NO: 194196 - protein, 9 aa, Homo Sapiens
TATPLWRQD

SEQ ID NO: 194197 - protein, 9 aa, Homo Sapiens
SELRIQLWR

SEQ ID NO: 194198 - protein, 9 aa, Homo Sapiens
LIKYHHSWP

SEQ ID NO: 194199 - protein, 9 aa, Homo Sapiens
CLCNQYRCS

SEQ ID NO: 194200 - protein, 9 aa, Homo Sapiens
EALEGHTAS

SEQ ID NO: 194201 - protein, 9 aa, Homo Sapiens
IVHSLRTAA

SEQ ID NO: 194202 - protein, 9 aa, Homo Sapiens
GKADVTLIG

SEQ ID NO: 194203 - protein, 9 aa, Homo Sapiens
QTLQEREAG

SEQ ID NO: 194204 - protein, 9 aa, Homo Sapiens
ATNNSYQMT

SEQ ID NO: 194205 - protein, 9 aa, Homo Sapiens
VVGADGVGK

SEQ ID NO: 194206 - protein, 9 aa, Homo Sapiens
AIQRFLWMW

SEQ ID NO: 194207 - protein, 9 aa, Homo Sapiens
ANTLCNFTR

SEQ ID NO: 194208 - protein, 9 aa, Homo Sapiens
PENQALVRF

SEQ ID NO: 194209 - protein, 9 aa, Homo Sapiens
YAPCPTAGV

SEQ ID NO: 194210 - protein, 9 aa, Homo Sapiens
IMGTIKRAP

SEQ ID NO: 194211 - protein, 9 aa, Homo Sapiens
DQKGSTYSQ

SEQ ID NO: 194212 - protein, 9 aa, Homo Sapiens
DNGGRRGGD

SEQ ID NO: 194213 - protein, 9 aa, Homo Sapiens
KTMTPIAQN

SEQ ID NO: 194214 - protein, 9 aa, Homo Sapiens
KMKAVYHIR

SEQ ID NO: 194215 - protein, 9 aa, Homo Sapiens
YLAVHWQTH

SEQ ID NO: 194216 - protein, 9 aa, Homo Sapiens
PDTLVWWEK

SEQ ID NO: 194217 - protein, 9 aa, Homo Sapiens
GMISIVKYL

SEQ ID NO: 194218 - protein, 9 aa, Homo Sapiens
KLAMEHEET

SEQ ID NO: 194219 - protein, 9 aa, Homo Sapiens
LGESPRYST

SEQ ID NO: 194220 - protein, 9 aa, Homo Sapiens
VIGGLVYLQ

SEQ ID NO: 194221 - protein, 9 aa, Homo Sapiens
ERVDRIIML

SEQ ID NO: 194222 - protein, 9 aa, Homo Sapiens
STVADIKRV

SEQ ID NO: 194223 - protein, 9 aa, Homo Sapiens
ACYNCGRDG

SEQ ID NO: 194224 - protein, 9 aa, Homo Sapiens
SDQISEDCV

SEQ ID NO: 194225 - protein, 9 aa, Homo Sapiens
PSDIATSAR

SEQ ID NO: 194226 - protein, 9 aa, Homo Sapiens
FLSLQMEVL

SEQ ID NO: 194227 - protein, 9 aa, Homo Sapiens
VKDETYTSN

SEQ ID NO: 194228 - protein, 9 aa, Homo Sapiens
NSSHLKQCV

SEQ ID NO: 194229 - protein, 9 aa, Homo Sapiens
GYTHFCQGG

SEQ ID NO: 194230 - protein, 9 aa, Homo Sapiens
VINFLLTTN

SEQ ID NO: 194231 - protein, 9 aa, Homo Sapiens
RALYYKSAV

SEQ ID NO: 194232 - protein, 9 aa, Homo Sapiens
NASNSMLPL

SEQ ID NO: 194233 - protein, 9 aa, Homo Sapiens
KERAINGLA

SEQ ID NO: 194234 - protein, 9 aa, Homo Sapiens
RKTVAECVI

SEQ ID NO: 194235 - protein, 9 aa, Homo Sapiens
VNASMLRVS

SEQ ID NO: 194236 - protein, 9 aa, Homo Sapiens
NIPLNTKSA

SEQ ID NO: 194237 - protein, 9 aa, Homo Sapiens
SERLEVNGR

SEQ ID NO: 194238 - protein, 9 aa, Homo Sapiens
EWRRRARQE

SEQ ID NO: 194239 - protein, 9 aa, Homo Sapiens
MKEKDKQNI

SEQ ID NO: 194240 - protein, 9 aa, Homo Sapiens
PPFSSPTLL

SEQ ID NO: 194241 - protein, 9 aa, Homo Sapiens
ESRIRGLGV

SEQ ID NO: 194242 - protein, 9 aa, Homo Sapiens
RPSLQVSTL

SEQ ID NO: 194243 - protein, 9 aa, Homo Sapiens
RMGSSQRQT

SEQ ID NO: 194244 - protein, 9 aa, Homo Sapiens
TLNNSLYIQ

SEQ ID NO: 194245 - protein, 9 aa, Homo Sapiens
EMNDELQGN

SEQ ID NO: 194246 - protein, 9 aa, Homo Sapiens
EYLQSVSRI

SEQ ID NO: 194247 - protein, 9 aa, Homo Sapiens
LPWNIYIVA

SEQ ID NO: 194248 - protein, 9 aa, Homo Sapiens
KWDVVSCFR

SEQ ID NO: 194249 - protein, 9 aa, Homo Sapiens
KENLACIGD

SEQ ID NO: 194250 - protein, 9 aa, Homo Sapiens
PLLCTMEKF

SEQ ID NO: 194251 - protein, 9 aa, Homo Sapiens
PEFLCKFPA

SEQ ID NO: 194252 - protein, 9 aa, Homo Sapiens
EDDIHRFIK

SEQ ID NO: 194253 - protein, 9 aa, Homo Sapiens
SPLLVKCYK

SEQ ID NO: 194254 - protein, 9 aa, Homo Sapiens
QVSPAHSPP

SEQ ID NO: 194255 - protein, 9 aa, Homo Sapiens
LLPMAKSYN

SEQ ID NO: 194256 - protein, 9 aa, Homo Sapiens
YNILAAILN

SEQ ID NO: 194257 - protein, 9 aa, Homo Sapiens
QSNMRRMHT

SEQ ID NO: 194258 - protein, 9 aa, Homo Sapiens
YLKVQVIIF

SEQ ID NO: 194259 - protein, 9 aa, Homo Sapiens
NILHNKPYS

SEQ ID NO: 194260 - protein, 9 aa, Homo Sapiens
EDYTPSYRG

SEQ ID NO: 194261 - protein, 9 aa, Homo Sapiens
LAMKIGGVS

SEQ ID NO: 194262 - protein, 9 aa, Homo Sapiens
EYIYQRQPE

SEQ ID NO: 194263 - protein, 9 aa, Homo Sapiens
YIENRPKYA

SEQ ID NO: 194264 - protein, 9 aa, Homo Sapiens
NCGRDGHIA

SEQ ID NO: 194265 - protein, 9 aa, Homo Sapiens
TLSLWKTPV

SEQ ID NO: 194266 - protein, 9 aa, Homo Sapiens
SCTDDAVGK

SEQ ID NO: 194267 - protein, 9 aa, Homo Sapiens
KYKFEDAKT

SEQ ID NO: 194268 - protein, 9 aa, Homo Sapiens
TAKANECLF

SEQ ID NO: 194269 - protein, 9 aa, Homo Sapiens
GHAAAPELS

SEQ ID NO: 194270 - protein, 9 aa, Homo Sapiens
YQTMFRAQP

SEQ ID NO: 194271 - protein, 9 aa, Homo Sapiens
HQRIHIGER

SEQ ID NO: 194272 - protein, 9 aa, Homo Sapiens
PTAPETSTN

SEQ ID NO: 194273 - protein, 9 aa, Homo Sapiens
YGVQERVTI

SEQ ID NO: 194274 - protein, 9 aa, Homo Sapiens
YATLGQSQM

SEQ ID NO: 194275 - protein, 9 aa, Homo Sapiens
IDPVPQNDD

SEQ ID NO: 194276 - protein, 9 aa, Homo Sapiens
MLRLSTLFE

SEQ ID NO: 194277 - protein, 9 aa, Homo Sapiens
LRLNPKAMT

SEQ ID NO: 194278 - protein, 9 aa, Homo Sapiens
WSHWTDVQV

SEQ ID NO: 194279 - protein, 9 aa, Homo Sapiens
EKLKGTDPD

SEQ ID NO: 194280 - protein, 9 aa, Homo Sapiens
ALSHSSCRQ

SEQ ID NO: 194281 - protein, 9 aa, Homo Sapiens
PPWPALDAR

SEQ ID NO: 194282 - protein, 9 aa, Homo Sapiens
TGLLPGEAA

SEQ ID NO: 194283 - protein, 9 aa, Homo Sapiens
PRLTPSLAR

SEQ ID NO: 194284 - protein, 9 aa, Homo Sapiens
DRIPPVLIS

SEQ ID NO: 194285 - protein, 9 aa, Homo Sapiens
VLRYCENKL

SEQ ID NO: 194286 - protein, 9 aa, Homo Sapiens
STINIHHTS

SEQ ID NO: 194287 - protein, 9 aa, Homo Sapiens
HEGNYFLSL

SEQ ID NO: 194288 - protein, 9 aa, Homo Sapiens
PEGACTEPW

SEQ ID NO: 194289 - protein, 9 aa, Homo Sapiens
AVRTVCDSV

SEQ ID NO: 194290 - protein, 9 aa, Homo Sapiens
LVYGITSRE

SEQ ID NO: 194291 - protein, 9 aa, Homo Sapiens
FFHYLKVQV

SEQ ID NO: 194292 - protein, 9 aa, Homo Sapiens
VLTKRQLLE

SEQ ID NO: 194293 - protein, 9 aa, Homo Sapiens
LEMKGWRLD

SEQ ID NO: 194294 - protein, 9 aa, Homo Sapiens
DTYTCLAEN

SEQ ID NO: 194295 - protein, 9 aa, Homo Sapiens
GGECVLYKS

SEQ ID NO: 194296 - protein, 9 aa, Homo Sapiens
TPHGLENVP

SEQ ID NO: 194297 - protein, 9 aa, Homo Sapiens
GIVLLQLEN

SEQ ID NO: 194298 - protein, 9 aa, Homo Sapiens
DMDPNEAKQ

SEQ ID NO: 194299 - protein, 9 aa, Homo Sapiens
VTGTQLCGP

SEQ ID NO: 194300 - protein, 9 aa, Homo Sapiens
RSHGDRSHG

SEQ ID NO: 194301 - protein, 9 aa, Homo Sapiens
QGGHFRYTL

SEQ ID NO: 194302 - protein, 9 aa, Homo Sapiens
LTTSSVGQI

SEQ ID NO: 194303 - protein, 9 aa, Homo Sapiens
RRATAHTLV

SEQ ID NO: 194304 - protein, 9 aa, Homo Sapiens
WRKRECNQQ

SEQ ID NO: 194305 - protein, 9 aa, Homo Sapiens
VTAASGGVM

SEQ ID NO: 194306 - protein, 9 aa, Homo Sapiens
EKKKILLNL

SEQ ID NO: 194307 - protein, 9 aa, Homo Sapiens
MRGQHCQHC

SEQ ID NO: 194308 - protein, 9 aa, Homo Sapiens
LRQPQQVIN

SEQ ID NO: 194309 - protein, 9 aa, Homo Sapiens
CIHTLTGYQ

SEQ ID NO: 194310 - protein, 9 aa, Homo Sapiens
LYVIRGGPN

SEQ ID NO: 194311 - protein, 9 aa, Homo Sapiens
NFKEESNAM

SEQ ID NO: 194312 - protein, 9 aa, Homo Sapiens
VSIRLDSTI

SEQ ID NO: 194313 - protein, 9 aa, Homo Sapiens
SDPKLKEAL

SEQ ID NO: 194314 - protein, 9 aa, Homo Sapiens
LKKNAFRLK

SEQ ID NO: 194315 - protein, 9 aa, Homo Sapiens
DDDDDEDGN

SEQ ID NO: 194316 - protein, 9 aa, Homo Sapiens
SPPLTAIHT

SEQ ID NO: 194317 - protein, 9 aa, Homo Sapiens
TGIFLKKPD

SEQ ID NO: 194318 - protein, 9 aa, Homo Sapiens
LEAAPRDIG

SEQ ID NO: 194319 - protein, 9 aa, Homo Sapiens
VKKADPPLL

SEQ ID NO: 194320 - protein, 9 aa, Homo Sapiens
CFTAITATN

SEQ ID NO: 194321 - protein, 9 aa, Homo Sapiens
PTSLMALSL

SEQ ID NO: 194322 - protein, 9 aa, Homo Sapiens
VTPLPLQPY

SEQ ID NO: 194323 - protein, 9 aa, Homo Sapiens
LSSRPSGHR

SEQ ID NO: 194324 - protein, 9 aa, Homo Sapiens
VEIAQARDQ

SEQ ID NO: 194325 - protein, 9 aa, Homo Sapiens
YFIKRESLG

SEQ ID NO: 194326 - protein, 9 aa, Homo Sapiens
VSARAAWGT

SEQ ID NO: 194327 - protein, 9 aa, Homo Sapiens
GHGGFNMRG

SEQ ID NO: 194328 - protein, 9 aa, Homo Sapiens
SAIHRNSAA

SEQ ID NO: 194329 - protein, 9 aa, Homo Sapiens
GTSLDRWSK

SEQ ID NO: 194330 - protein, 9 aa, Homo Sapiens
LTILDVSFN

SEQ ID NO: 194331 - protein, 9 aa, Homo Sapiens
DLKIKLAMK

SEQ ID NO: 194332 - protein, 9 aa, Homo Sapiens
TSFLILLFQ

SEQ ID NO: 194333 - protein, 9 aa, Homo Sapiens
TLQKDVGPM

SEQ ID NO: 194334 - protein, 9 aa, Homo Sapiens
ASSSCIRQY

SEQ ID NO: 194335 - protein, 9 aa, Homo Sapiens
YDRLDHGDW

SEQ ID NO: 194336 - protein, 9 aa, Homo Sapiens
PPHVLDGPG

SEQ ID NO: 194337 - protein, 9 aa, Homo Sapiens
EQLEETRRE

SEQ ID NO: 194338 - protein, 9 aa, Homo Sapiens
FKTDIVLWY

SEQ ID NO: 194339 - protein, 9 aa, Homo Sapiens
ALLRLGQQR

SEQ ID NO: 194340 - protein, 9 aa, Homo Sapiens
QRACRKRIR

SEQ ID NO: 194341 - protein, 9 aa, Homo Sapiens
DQGAPGSPG

SEQ ID NO: 194342 - protein, 9 aa, Homo Sapiens
RRRRRLCLP

SEQ ID NO: 194343 - protein, 9 aa, Homo Sapiens
SYSLVKKIE

SEQ ID NO: 194344 - protein, 9 aa, Homo Sapiens
QAWVWEHHP

SEQ ID NO: 194345 - protein, 9 aa, Homo Sapiens
MHRFVLHLA

SEQ ID NO: 194346 - protein, 9 aa, Homo Sapiens
LAEEKLQTS

SEQ ID NO: 194347 - protein, 9 aa, Homo Sapiens
QERGEPAVL

SEQ ID NO: 194348 - protein, 9 aa, Homo Sapiens
ACAPSVVHD

SEQ ID NO: 194349 - protein, 9 aa, Homo Sapiens
HAFFREECG

SEQ ID NO: 194350 - protein, 9 aa, Homo Sapiens
PDDLDAFVW

SEQ ID NO: 194351 - protein, 9 aa, Homo Sapiens
EGLTYQVCQ

SEQ ID NO: 194352 - protein, 9 aa, Homo Sapiens
LRQYMDKHP

SEQ ID NO: 194353 - protein, 9 aa, Homo Sapiens
RRVINSAAA

SEQ ID NO: 194354 - protein, 9 aa, Homo Sapiens
EAMPDYLDD

SEQ ID NO: 194355 - protein, 9 aa, Homo Sapiens
KMQLDREYK

SEQ ID NO: 194356 - protein, 9 aa, Homo Sapiens
FLRLPLEHL

SEQ ID NO: 194357 - protein, 9 aa, Homo Sapiens
ALEVALLRL

SEQ ID NO: 194358 - protein, 9 aa, Homo Sapiens
CEYEELRNS

SEQ ID NO: 194359 - protein, 9 aa, Homo Sapiens
LQCLVHGGQ

SEQ ID NO: 194360 - protein, 9 aa, Homo Sapiens
GASLAAACQ

SEQ ID NO: 194361 - protein, 9 aa, Homo Sapiens
EEMILKIFV

SEQ ID NO: 194362 - protein, 9 aa, Homo Sapiens
RFLVVVHSV

SEQ ID NO: 194363 - protein, 9 aa, Homo Sapiens
NPYRCEDSD

SEQ ID NO: 194364 - protein, 9 aa, Homo Sapiens
YSPYGMLES

SEQ ID NO: 194365 - protein, 9 aa, Homo Sapiens
PFSSPASSC

SEQ ID NO: 194366 - protein, 9 aa, Homo Sapiens
AQCILSYGN

SEQ ID NO: 194367 - protein, 9 aa, Homo Sapiens
ERRHQAEKP

SEQ ID NO: 194368 - protein, 9 aa, Homo Sapiens
LEKNAVRIL

SEQ ID NO: 194369 - protein, 9 aa, Homo Sapiens
KLLEEEVIT

SEQ ID NO: 194370 - protein, 9 aa, Homo Sapiens
CHGEAVYSR

SEQ ID NO: 194371 - protein, 9 aa, Homo Sapiens
AYAPCPTAG

SEQ ID NO: 194372 - protein, 9 aa, Homo Sapiens
DIKKTQQRG

SEQ ID NO: 194373 - protein, 9 aa, Homo Sapiens
QTMVCQLMH

SEQ ID NO: 194374 - protein, 9 aa, Homo Sapiens
TLMEALVGL

SEQ ID NO: 194375 - protein, 9 aa, Homo Sapiens
GPRPLHRWL

SEQ ID NO: 194376 - protein, 9 aa, Homo Sapiens
RPLEPYCRI

SEQ ID NO: 194377 - protein, 9 aa, Homo Sapiens
GGKRHYLAL

SEQ ID NO: 194378 - protein, 9 aa, Homo Sapiens
LRIEGPMGQ

SEQ ID NO: 194379 - protein, 9 aa, Homo Sapiens
YQRLGIDPI

SEQ ID NO: 194380 - protein, 9 aa, Homo Sapiens
RWLQQTTGC

SEQ ID NO: 194381 - protein, 9 aa, Homo Sapiens
LGAKTGLAE

SEQ ID NO: 194382 - protein, 9 aa, Homo Sapiens
IYQILPHSV

SEQ ID NO: 194383 - protein, 9 aa, Homo Sapiens
RIVEMFMNI

SEQ ID NO: 194384 - protein, 9 aa, Homo Sapiens
AGGGDGDIL

SEQ ID NO: 194385 - protein, 9 aa, Homo Sapiens
DSVILSIWC

SEQ ID NO: 194386 - protein, 9 aa, Homo Sapiens
SVHMTLDFD

SEQ ID NO: 194387 - protein, 9 aa, Homo Sapiens
IKCFAVCSL

SEQ ID NO: 194388 - protein, 9 aa, Homo Sapiens
LTGTSLDRW

SEQ ID NO: 194389 - protein, 9 aa, Homo Sapiens
ALGVQDYIL

SEQ ID NO: 194390 - protein, 9 aa, Homo Sapiens
SFRWHLPQH

SEQ ID NO: 194391 - protein, 9 aa, Homo Sapiens
ENFQGKRYE

SEQ ID NO: 194392 - protein, 9 aa, Homo Sapiens
FSRARKATA

SEQ ID NO: 194393 - protein, 9 aa, Homo Sapiens
FSGPSFPMC

SEQ ID NO: 194394 - protein, 9 aa, Homo Sapiens
QTANLRCLF

SEQ ID NO: 194395 - protein, 9 aa, Homo Sapiens
SGEKVMLTG

SEQ ID NO: 194396 - protein, 9 aa, Homo Sapiens
HITDLYKDL

SEQ ID NO: 194397 - protein, 9 aa, Homo Sapiens
AINGLANFL

SEQ ID NO: 194398 - protein, 9 aa, Homo Sapiens
AINSLGACI

SEQ ID NO: 194399 - protein, 9 aa, Homo Sapiens
AAPCLAERG

SEQ ID NO: 194400 - protein, 9 aa, Homo Sapiens
YHCAMNNKN

SEQ ID NO: 194401 - protein, 9 aa, Homo Sapiens
DGDWGWVVV

SEQ ID NO: 194402 - protein, 9 aa, Homo Sapiens
ALLPAVAHE

SEQ ID NO: 194403 - protein, 9 aa, Homo Sapiens
NTLVIPLTD

SEQ ID NO: 194404 - protein, 9 aa, Homo Sapiens
HLFDNDLPD

SEQ ID NO: 194405 - protein, 9 aa, Homo Sapiens
PPNANEDHR

SEQ ID NO: 194406 - protein, 9 aa, Homo Sapiens
PSEENFNME

SEQ ID NO: 194407 - protein, 9 aa, Homo Sapiens
SDSPQGIYD

SEQ ID NO: 194408 - protein, 9 aa, Homo Sapiens
PLKEETPKL

SEQ ID NO: 194409 - protein, 9 aa, Homo Sapiens
RQWIQQLAF

SEQ ID NO: 194410 - protein, 9 aa, Homo Sapiens
VELEAAWRV

SEQ ID NO: 194411 - protein, 9 aa, Homo Sapiens
GKSTFLYIL

SEQ ID NO: 194412 - protein, 9 aa, Homo Sapiens
VYMVPMETS

SEQ ID NO: 194413 - protein, 9 aa, Homo Sapiens
CRMLTPAFH

SEQ ID NO: 194414 - protein, 9 aa, Homo Sapiens
GAAYVGAYA

SEQ ID NO: 194415 - protein, 9 aa, Homo Sapiens
ACTEPWEPP

SEQ ID NO: 194416 - protein, 9 aa, Homo Sapiens
PVSPMELMG

SEQ ID NO: 194417 - protein, 9 aa, Homo Sapiens
RLEKDHVAL

SEQ ID NO: 194418 - protein, 9 aa, Homo Sapiens
QHLLLPHWA

SEQ ID NO: 194419 - protein, 9 aa, Homo Sapiens
CDVKDETYT

SEQ ID NO: 194420 - protein, 9 aa, Homo Sapiens
KDKITLEGP

SEQ ID NO: 194421 - protein, 9 aa, Homo Sapiens
LVLKALFLR

SEQ ID NO: 194422 - protein, 9 aa, Homo Sapiens
HPPQHNHHH

SEQ ID NO: 194423 - protein, 9 aa, Homo Sapiens
KPVFLAFQI

SEQ ID NO: 194424 - protein, 9 aa, Homo Sapiens
DDLPNLEIL

SEQ ID NO: 194425 - protein, 9 aa, Homo Sapiens
SDLDETHAF

SEQ ID NO: 194426 - protein, 9 aa, Homo Sapiens
IPHQVFAPV

SEQ ID NO: 194427 - protein, 9 aa, Homo Sapiens
GDNLLDPWR

SEQ ID NO: 194428 - protein, 9 aa, Homo Sapiens
QSGEGFPQG

SEQ ID NO: 194429 - protein, 9 aa, Homo Sapiens
QTTGCSQRR

SEQ ID NO: 194430 - protein, 9 aa, Homo Sapiens
NVSTPPHHS

SEQ ID NO: 194431 - protein, 9 aa, Homo Sapiens
PMVAKRNMT

SEQ ID NO: 194432 - protein, 9 aa, Homo Sapiens
ELIHTPQLC

SEQ ID NO: 194433 - protein, 9 aa, Homo Sapiens
RTWRLLWAS

SEQ ID NO: 194434 - protein, 9 aa, Homo Sapiens
RTTPVTSSA

SEQ ID NO: 194435 - protein, 9 aa, Homo Sapiens
GLRARFTID

SEQ ID NO: 194436 - protein, 9 aa, Homo Sapiens
AGNRTPVPS

SEQ ID NO: 194437 - protein, 9 aa, Homo Sapiens
QHYGFSSVG

SEQ ID NO: 194438 - protein, 9 aa, Homo Sapiens
VQVYYQQIG

SEQ ID NO: 194439 - protein, 9 aa, Homo Sapiens
CVLTQACSC

SEQ ID NO: 194440 - protein, 9 aa, Homo Sapiens
PTLLSSSSA

SEQ ID NO: 194441 - protein, 9 aa, Homo Sapiens
SGKRLRVVS

SEQ ID NO: 194442 - protein, 9 aa, Homo Sapiens
HSDHTLSIS

SEQ ID NO: 194443 - protein, 9 aa, Homo Sapiens
KNARLLTFQ

SEQ ID NO: 194444 - protein, 9 aa, Homo Sapiens
PTRHRHLMK

SEQ ID NO: 194445 - protein, 9 aa, Homo Sapiens
DVESADENL

SEQ ID NO: 194446 - protein, 9 aa, Homo Sapiens
KVTDARGGQ

SEQ ID NO: 194447 - protein, 9 aa, Homo Sapiens
SGGWHDALY

SEQ ID NO: 194448 - protein, 9 aa, Homo Sapiens
ICASHISRM

SEQ ID NO: 194449 - protein, 9 aa, Homo Sapiens
EQQVDLAGG

SEQ ID NO: 194450 - protein, 9 aa, Homo Sapiens
SHGDRSHGK

SEQ ID NO: 194451 - protein, 9 aa, Homo Sapiens
LGLVAVAWS

SEQ ID NO: 194452 - protein, 9 aa, Homo Sapiens
YMSHRNPRT

SEQ ID NO: 194453 - protein, 9 aa, Homo Sapiens
PSLGTHAEG

SEQ ID NO: 194454 - protein, 9 aa, Homo Sapiens
GCSHCCPPC

SEQ ID NO: 194455 - protein, 9 aa, Homo Sapiens
HPYLGDMTL

SEQ ID NO: 194456 - protein, 9 aa, Homo Sapiens
LPTTAYTKE

SEQ ID NO: 194457 - protein, 9 aa, Homo Sapiens
GAGVKASPR

SEQ ID NO: 194458 - protein, 9 aa, Homo Sapiens
VGSQLKQHQ

SEQ ID NO: 194459 - protein, 9 aa, Homo Sapiens
QMLLDQYRK

SEQ ID NO: 194460 - protein, 9 aa, Homo Sapiens
ENKLNDKHI

SEQ ID NO: 194461 - protein, 9 aa, Homo Sapiens
ALTILDVSF

SEQ ID NO: 194462 - protein, 9 aa, Homo Sapiens
TWAASIYSS

SEQ ID NO: 194463 - protein, 9 aa, Homo Sapiens
GTQRIIGHV

SEQ ID NO: 194464 - protein, 9 aa, Homo Sapiens
KAWVCCICQ

SEQ ID NO: 194465 - protein, 9 aa, Homo Sapiens
IKNIKRKAP

SEQ ID NO: 194466 - protein, 9 aa, Homo Sapiens
ESIDRTMMY

SEQ ID NO: 194467 - protein, 9 aa, Homo Sapiens
YFYTEKDRQ

SEQ ID NO: 194468 - protein, 9 aa, Homo Sapiens
GDRGLVCPY

SEQ ID NO: 194469 - protein, 9 aa, Homo Sapiens
ALIFSAMDI

SEQ ID NO: 194470 - protein, 9 aa, Homo Sapiens
KLQQLEAAA

SEQ ID NO: 194471 - protein, 9 aa, Homo Sapiens
RANLGMLNT

SEQ ID NO: 194472 - protein, 9 aa, Homo Sapiens
AMKASVKEG

SEQ ID NO: 194473 - protein, 9 aa, Homo Sapiens
ILANIVDGT

SEQ ID NO: 194474 - protein, 9 aa, Homo Sapiens
HSAHSTHVG

SEQ ID NO: 194475 - protein, 9 aa, Homo Sapiens
SVIYSVFPQ

SEQ ID NO: 194476 - protein, 9 aa, Homo Sapiens
VHECCVSRN

SEQ ID NO: 194477 - protein, 9 aa, Homo Sapiens
KAGNVISRS

SEQ ID NO: 194478 - protein, 9 aa, Homo Sapiens
PQEPLATVR

SEQ ID NO: 194479 - protein, 9 aa, Homo Sapiens
RLTRERAAA

SEQ ID NO: 194480 - protein, 9 aa, Homo Sapiens
SVTLPMSGQ

SEQ ID NO: 194481 - protein, 9 aa, Homo Sapiens
AGRVQPGFC

SEQ ID NO: 194482 - protein, 9 aa, Homo Sapiens
SSHVRPMAR

SEQ ID NO: 194483 - protein, 9 aa, Homo Sapiens
NHMTDIPLA

SEQ ID NO: 194484 - protein, 9 aa, Homo Sapiens
KAKKRIPPP

SEQ ID NO: 194485 - protein, 9 aa, Homo Sapiens
AVYRAVTIV

SEQ ID NO: 194486 - protein, 9 aa, Homo Sapiens
DWLSAQVPE

SEQ ID NO: 194487 - protein, 9 aa, Homo Sapiens
AVIPSPSRK

SEQ ID NO: 194488 - protein, 9 aa, Homo Sapiens
VMVSISLNF

SEQ ID NO: 194489 - protein, 9 aa, Homo Sapiens
LFLRTLKER

SEQ ID NO: 194490 - protein, 9 aa, Homo Sapiens
LMSQVYSYQ

SEQ ID NO: 194491 - protein, 9 aa, Homo Sapiens
NLLKRILLP

SEQ ID NO: 194492 - protein, 9 aa, Homo Sapiens
GFLQLWAAS

SEQ ID NO: 194493 - protein, 9 aa, Homo Sapiens
VRCVRLQRH

SEQ ID NO: 194494 - protein, 9 aa, Homo Sapiens
WGKEQHLHL

SEQ ID NO: 194495 - protein, 9 aa, Homo Sapiens
VAYDLGHVE

SEQ ID NO: 194496 - protein, 9 aa, Homo Sapiens
SGHPSSDVW

SEQ ID NO: 194497 - protein, 9 aa, Homo Sapiens
EKRVVLLCD

SEQ ID NO: 194498 - protein, 9 aa, Homo Sapiens
RALGLGTCR

SEQ ID NO: 194499 - protein, 9 aa, Homo Sapiens
KMGDHMKVI

SEQ ID NO: 194500 - protein, 9 aa, Homo Sapiens
PGNASTTVL

SEQ ID NO: 194501 - protein, 9 aa, Homo Sapiens
PRVLSNSGC

SEQ ID NO: 194502 - protein, 9 aa, Homo Sapiens
VRRVINSAA

SEQ ID NO: 194503 - protein, 9 aa, Homo Sapiens
NTLCNFTRA

SEQ ID NO: 194504 - protein, 9 aa, Homo Sapiens
RTTHPHFVH

SEQ ID NO: 194505 - protein, 9 aa, Homo Sapiens
WAQIFLKAA

SEQ ID NO: 194506 - protein, 9 aa, Homo Sapiens
GLSLPVCTM

SEQ ID NO: 194507 - protein, 9 aa, Homo Sapiens
CRGMARVGA

SEQ ID NO: 194508 - protein, 9 aa, Homo Sapiens
QTTEILHHL

SEQ ID NO: 194509 - protein, 9 aa, Homo Sapiens
SPLSGGSAT

SEQ ID NO: 194510 - protein, 9 aa, Homo Sapiens
PEACEEMIL

SEQ ID NO: 194511 - protein, 9 aa, Homo Sapiens
DALTMVVDD

SEQ ID NO: 194512 - protein, 9 aa, Homo Sapiens
QNWLGASVL

SEQ ID NO: 194513 - protein, 9 aa, Homo Sapiens
VHVCEIAED

SEQ ID NO: 194514 - protein, 9 aa, Homo Sapiens
AADPAEAGV

SEQ ID NO: 194515 - protein, 9 aa, Homo Sapiens
KATLQKDVG

SEQ ID NO: 194516 - protein, 9 aa, Homo Sapiens
RCIPCKDSR

SEQ ID NO: 194517 - protein, 9 aa, Homo Sapiens
CPAVPLGPA

SEQ ID NO: 194518 - protein, 9 aa, Homo Sapiens
FIGDVHSLV

SEQ ID NO: 194519 - protein, 9 aa, Homo Sapiens
HKAEFSKIL

SEQ ID NO: 194520 - protein, 9 aa, Homo Sapiens
CFSTSTPGY

SEQ ID NO: 194521 - protein, 9 aa, Homo Sapiens
IGPELSRHI

SEQ ID NO: 194522 - protein, 9 aa, Homo Sapiens
EVLDVDNVK

SEQ ID NO: 194523 - protein, 9 aa, Homo Sapiens
HKPSLNLSC

SEQ ID NO: 194524 - protein, 9 aa, Homo Sapiens
HVVKDPSGC

SEQ ID NO: 194525 - protein, 9 aa, Homo Sapiens
WEEHRGSMV

SEQ ID NO: 194526 - protein, 9 aa, Homo Sapiens
IDVLNLSIS

SEQ ID NO: 194527 - protein, 9 aa, Homo Sapiens
YEEMCPPEI

SEQ ID NO: 194528 - protein, 9 aa, Homo Sapiens
EDNISFSIY

SEQ ID NO: 194529 - protein, 9 aa, Homo Sapiens
DLIRPVALV

SEQ ID NO: 194530 - protein, 9 aa, Homo Sapiens
EHILRFLCA

SEQ ID NO: 194531 - protein, 9 aa, Homo Sapiens
KDPEACEEM

SEQ ID NO: 194532 - protein, 9 aa, Homo Sapiens
WVTGNVTTP

SEQ ID NO: 194533 - protein, 9 aa, Homo Sapiens
HQLVAAQPE

SEQ ID NO: 194534 - protein, 9 aa, Homo Sapiens
RQVEPQAKK

SEQ ID NO: 194535 - protein, 9 aa, Homo Sapiens
HSHARESEL

SEQ ID NO: 194536 - protein, 9 aa, Homo Sapiens
ALFDRKQLQ

SEQ ID NO: 194537 - protein, 9 aa, Homo Sapiens
GIFYTISLC

SEQ ID NO: 194538 - protein, 9 aa, Homo Sapiens
VLLLRPGDL

SEQ ID NO: 194539 - protein, 9 aa, Homo Sapiens
GESALVSIY

SEQ ID NO: 194540 - protein, 9 aa, Homo Sapiens
STLFESHIK

SEQ ID NO: 194541 - protein, 9 aa, Homo Sapiens
VKCYKIPQL

SEQ ID NO: 194542 - protein, 9 aa, Homo Sapiens
AQEGDPVDC

SEQ ID NO: 194543 - protein, 9 aa, Homo Sapiens
GLMELATIC

SEQ ID NO: 194544 - protein, 9 aa, Homo Sapiens
GYRHIIKNP

SEQ ID NO: 194545 - protein, 9 aa, Homo Sapiens
EDELEMATI

SEQ ID NO: 194546 - protein, 9 aa, Homo Sapiens
SLLQSAKKR

SEQ ID NO: 194547 - protein, 9 aa, Homo Sapiens
GGDGLYLVL

SEQ ID NO: 194548 - protein, 9 aa, Homo Sapiens
DRKHQQRII

SEQ ID NO: 194549 - protein, 9 aa, Homo Sapiens
LWGPTEMFP

SEQ ID NO: 194550 - protein, 9 aa, Homo Sapiens
PILPWRRHL

SEQ ID NO: 194551 - protein, 9 aa, Homo Sapiens
ESFQALTEF

SEQ ID NO: 194552 - protein, 9 aa, Homo Sapiens
SVSEFCLPE

SEQ ID NO: 194553 - protein, 9 aa, Homo Sapiens
RVQPGFCFH

SEQ ID NO: 194554 - protein, 9 aa, Homo Sapiens
VNDLEDSYR

SEQ ID NO: 194555 - protein, 9 aa, Homo Sapiens
SIMHLCATS

SEQ ID NO: 194556 - protein, 9 aa, Homo Sapiens
VLDVDNVKY

SEQ ID NO: 194557 - protein, 9 aa, Homo Sapiens
LPPFWEQQN

SEQ ID NO: 194558 - protein, 9 aa, Homo Sapiens
SSERNEKKE

SEQ ID NO: 194559 - protein, 9 aa, Homo Sapiens
PSLLSCDPA

SEQ ID NO: 194560 - protein, 9 aa, Homo Sapiens
RGWGLQTKT

SEQ ID NO: 194561 - protein, 9 aa, Homo Sapiens
TNRTPEFLC

SEQ ID NO: 194562 - protein, 9 aa, Homo Sapiens
ICRNPVCVN

SEQ ID NO: 194563 - protein, 9 aa, Homo Sapiens
AGTANPMVA

SEQ ID NO: 194564 - protein, 9 aa, Homo Sapiens
IQVSAAATR

SEQ ID NO: 194565 - protein, 9 aa, Homo Sapiens
QIALVSFYE

SEQ ID NO: 194566 - protein, 9 aa, Homo Sapiens
RPLHRWLQQ

SEQ ID NO: 194567 - protein, 9 aa, Homo Sapiens
LQHYGFSSV

SEQ ID NO: 194568 - protein, 9 aa, Homo Sapiens
TMGPPPGMR

SEQ ID NO: 194569 - protein, 9 aa, Homo Sapiens
NDDRRFPGF

SEQ ID NO: 194570 - protein, 9 aa, Homo Sapiens
VQNLIRSTK

SEQ ID NO: 194571 - protein, 9 aa, Homo Sapiens
CCPHCPFAC

SEQ ID NO: 194572 - protein, 9 aa, Homo Sapiens
GRVTEGPHQ

SEQ ID NO: 194573 - protein, 9 aa, Homo Sapiens
EDVGRHLGQ

SEQ ID NO: 194574 - protein, 9 aa, Homo Sapiens
IASKYEEMC

SEQ ID NO: 194575 - protein, 9 aa, Homo Sapiens
DRELSGLWT

SEQ ID NO: 194576 - protein, 9 aa, Homo Sapiens
SSLSDPSKE

SEQ ID NO: 194577 - protein, 9 aa, Homo Sapiens
PNANEDHRE

SEQ ID NO: 194578 - protein, 9 aa, Homo Sapiens
LQGVEIAAV

SEQ ID NO: 194579 - protein, 9 aa, Homo Sapiens
QTIRLKLVY

SEQ ID NO: 194580 - protein, 9 aa, Homo Sapiens
LTRSVCTMP

SEQ ID NO: 194581 - protein, 9 aa, Homo Sapiens
GHRLQAFDC

SEQ ID NO: 194582 - protein, 9 aa, Homo Sapiens
LALEVALLR

SEQ ID NO: 194583 - protein, 9 aa, Homo Sapiens
HHLYDIHVT

SEQ ID NO: 194584 - protein, 9 aa, Homo Sapiens
ELRRLAAPC

SEQ ID NO: 194585 - protein, 9 aa, Homo Sapiens
SMHTLYGSR

SEQ ID NO: 194586 - protein, 9 aa, Homo Sapiens
LAHVLGYLV

SEQ ID NO: 194587 - protein, 9 aa, Homo Sapiens
GRDGHIAKD

SEQ ID NO: 194588 - protein, 9 aa, Homo Sapiens
LKQTHVLPP

SEQ ID NO: 194589 - protein, 9 aa, Homo Sapiens
EVGGSPVNT

SEQ ID NO: 194590 - protein, 9 aa, Homo Sapiens
LKNKASITP

SEQ ID NO: 194591 - protein, 9 aa, Homo Sapiens
YQAAHHAEQ

SEQ ID NO: 194592 - protein, 9 aa, Homo Sapiens
SHINPTGIV

SEQ ID NO: 194593 - protein, 9 aa, Homo Sapiens
PVMCKIRVF

SEQ ID NO: 194594 - protein, 9 aa, Homo Sapiens
NLLFVGSSL

SEQ ID NO: 194595 - protein, 9 aa, Homo Sapiens
WAASIYSSW

SEQ ID NO: 194596 - protein, 9 aa, Homo Sapiens
SLLREQKRI

SEQ ID NO: 194597 - protein, 9 aa, Homo Sapiens
ECKICGKDL

SEQ ID NO: 194598 - protein, 9 aa, Homo Sapiens
TRIPQVHWT

SEQ ID NO: 194599 - protein, 9 aa, Homo Sapiens
LLVVSPISQ

SEQ ID NO: 194600 - protein, 9 aa, Homo Sapiens
TMDPDPITT

SEQ ID NO: 194601 - protein, 9 aa, Homo Sapiens
NTKNSVDKQ

SEQ ID NO: 194602 - protein, 9 aa, Homo Sapiens
SCLLRSSSP

SEQ ID NO: 194603 - protein, 9 aa, Homo Sapiens
HLLLPHWAK

SEQ ID NO: 194604 - protein, 9 aa, Homo Sapiens
PMIVYVGDL

SEQ ID NO: 194605 - protein, 9 aa, Homo Sapiens
MLFDAHKLD

SEQ ID NO: 194606 - protein, 9 aa, Homo Sapiens
GRLHSLDSG

SEQ ID NO: 194607 - protein, 9 aa, Homo Sapiens
FSHVPNGLK

SEQ ID NO: 194608 - protein, 9 aa, Homo Sapiens
PAEPRPLEP

SEQ ID NO: 194609 - protein, 9 aa, Homo Sapiens
CRCRVGFEV

SEQ ID NO: 194610 - protein, 9 aa, Homo Sapiens
AALFDRKQL

SEQ ID NO: 194611 - protein, 9 aa, Homo Sapiens
QAAYLALNV

SEQ ID NO: 194612 - protein, 9 aa, Homo Sapiens
SSEEFYQAA

SEQ ID NO: 194613 - protein, 9 aa, Homo Sapiens
ELLLLRREW

SEQ ID NO: 194614 - protein, 9 aa, Homo Sapiens
TAFAPVTPA

SEQ ID NO: 194615 - protein, 9 aa, Homo Sapiens
PLPPGAASS

SEQ ID NO: 194616 - protein, 9 aa, Homo Sapiens
AALARGVLV

SEQ ID NO: 194617 - protein, 9 aa, Homo Sapiens
FPFNSEQRD

SEQ ID NO: 194618 - protein, 9 aa, Homo Sapiens
REKNCIAAQ

SEQ ID NO: 194619 - protein, 9 aa, Homo Sapiens
KVENYLGNR

SEQ ID NO: 194620 - protein, 9 aa, Homo Sapiens
SHGNVTFSI

SEQ ID NO: 194621 - protein, 9 aa, Homo Sapiens
APGSPGPPG

SEQ ID NO: 194622 - protein, 9 aa, Homo Sapiens
RHKPWETPG

SEQ ID NO: 194623 - protein, 9 aa, Homo Sapiens
KVWPLLLVV

SEQ ID NO: 194624 - protein, 9 aa, Homo Sapiens
GHIAKMPVK

SEQ ID NO: 194625 - protein, 9 aa, Homo Sapiens
GPCPQTPCW

SEQ ID NO: 194626 - protein, 9 aa, Homo Sapiens
VFAATPKPT

SEQ ID NO: 194627 - protein, 9 aa, Homo Sapiens
TGDGEFNFS

SEQ ID NO: 194628 - protein, 9 aa, Homo Sapiens
DIQHYDLES

SEQ ID NO: 194629 - protein, 9 aa, Homo Sapiens
KYHHSWPEN

SEQ ID NO: 194630 - protein, 9 aa, Homo Sapiens
HEFHLQADN

SEQ ID NO: 194631 - protein, 9 aa, Homo Sapiens
DRVTEFCQQ

SEQ ID NO: 194632 - protein, 9 aa, Homo Sapiens
VRSFPSVEL

SEQ ID NO: 194633 - protein, 9 aa, Homo Sapiens
VEKRVVLLC

SEQ ID NO: 194634 - protein, 9 aa, Homo Sapiens
RPSKYDVQG

SEQ ID NO: 194635 - protein, 9 aa, Homo Sapiens
FKYRDGQII

SEQ ID NO: 194636 - protein, 9 aa, Homo Sapiens
HIIKNPMDF

SEQ ID NO: 194637 - protein, 9 aa, Homo Sapiens
PEELHLPAP

SEQ ID NO: 194638 - protein, 9 aa, Homo Sapiens
SPCTKEPRI

SEQ ID NO: 194639 - protein, 9 aa, Homo Sapiens
PPHVPLPPP

SEQ ID NO: 194640 - protein, 9 aa, Homo Sapiens
CSQTPERPA

SEQ ID NO: 194641 - protein, 9 aa, Homo Sapiens
NNLTFLWPY

SEQ ID NO: 194642 - protein, 9 aa, Homo Sapiens
EHYHLLHRY

SEQ ID NO: 194643 - protein, 9 aa, Homo Sapiens
LIFSAMDIM

SEQ ID NO: 194644 - protein, 9 aa, Homo Sapiens
VLSAGKAEE

SEQ ID NO: 194645 - protein, 9 aa, Homo Sapiens
DMESDINYL

SEQ ID NO: 194646 - protein, 9 aa, Homo Sapiens
SARMSNMGH

SEQ ID NO: 194647 - protein, 9 aa, Homo Sapiens
KHKQIHTGE

SEQ ID NO: 194648 - protein, 9 aa, Homo Sapiens
CQAETEERS

SEQ ID NO: 194649 - protein, 9 aa, Homo Sapiens
RVHCANGPY

SEQ ID NO: 194650 - protein, 9 aa, Homo Sapiens
AQIWNLTVL

SEQ ID NO: 194651 - protein, 9 aa, Homo Sapiens
GKCTNCMED

SEQ ID NO: 194652 - protein, 9 aa, Homo Sapiens
ISSDLFSLG

SEQ ID NO: 194653 - protein, 9 aa, Homo Sapiens
LLQAATRLQ

SEQ ID NO: 194654 - protein, 9 aa, Homo Sapiens
PHYLYIIQN

SEQ ID NO: 194655 - protein, 9 aa, Homo Sapiens
CIRQYRISP

SEQ ID NO: 194656 - protein, 9 aa, Homo Sapiens
WVENRRAFL

SEQ ID NO: 194657 - protein, 9 aa, Homo Sapiens
WMGMTGPGF

SEQ ID NO: 194658 - protein, 9 aa, Homo Sapiens
LRSTVMVIH

SEQ ID NO: 194659 - protein, 9 aa, Homo Sapiens
SFGCSFHGA

SEQ ID NO: 194660 - protein, 9 aa, Homo Sapiens
MDKDGKPLL

SEQ ID NO: 194661 - protein, 9 aa, Homo Sapiens
EHRGSMVLF

SEQ ID NO: 194662 - protein, 9 aa, Homo Sapiens
YLLVAACVL

SEQ ID NO: 194663 - protein, 9 aa, Homo Sapiens
GPRGEGTRE

SEQ ID NO: 194664 - protein, 9 aa, Homo Sapiens
VAHTVGCSA

SEQ ID NO: 194665 - protein, 9 aa, Homo Sapiens
KPPPIPVKK

SEQ ID NO: 194666 - protein, 9 aa, Homo Sapiens
QLSSVPTLL

SEQ ID NO: 194667 - protein, 9 aa, Homo Sapiens
ECSLRSFFV

SEQ ID NO: 194668 - protein, 9 aa, Homo Sapiens
NGYEIKEDI

SEQ ID NO: 194669 - protein, 9 aa, Homo Sapiens
QRRKRPLSW

SEQ ID NO: 194670 - protein, 9 aa, Homo Sapiens
KYRDGQIIS

SEQ ID NO: 194671 - protein, 9 aa, Homo Sapiens
PNHLTGRPG

SEQ ID NO: 194672 - protein, 9 aa, Homo Sapiens
SGGSVTRSL

SEQ ID NO: 194673 - protein, 9 aa, Homo Sapiens
RNLERSANR

SEQ ID NO: 194674 - protein, 9 aa, Homo Sapiens
GSHRMRVEH

SEQ ID NO: 194675 - protein, 9 aa, Homo Sapiens
WQRATAWES

SEQ ID NO: 194676 - protein, 9 aa, Homo Sapiens
YIWDGNNRS

SEQ ID NO: 194677 - protein, 9 aa, Homo Sapiens
SFGWKDQHK

SEQ ID NO: 194678 - protein, 9 aa, Homo Sapiens
AQCSSWWGG

SEQ ID NO: 194679 - protein, 9 aa, Homo Sapiens
SHLRHGEDS

SEQ ID NO: 194680 - protein, 9 aa, Homo Sapiens
GIQNESFMK

SEQ ID NO: 194681 - protein, 9 aa, Homo Sapiens
VTVMRTALL

SEQ ID NO: 194682 - protein, 9 aa, Homo Sapiens
TGLSDGDGD

SEQ ID NO: 194683 - protein, 9 aa, Homo Sapiens
LLVDEFALE

SEQ ID NO: 194684 - protein, 9 aa, Homo Sapiens
SWGATRPFA

SEQ ID NO: 194685 - protein, 9 aa, Homo Sapiens
SVFVLDTVC

SEQ ID NO: 194686 - protein, 9 aa, Homo Sapiens
TYHHHLYDI

SEQ ID NO: 194687 - protein, 9 aa, Homo Sapiens
EQDVVNQTS

SEQ ID NO: 194688 - protein, 9 aa, Homo Sapiens
MVMELLWPS

SEQ ID NO: 194689 - protein, 9 aa, Homo Sapiens
TAWESHACL

SEQ ID NO: 194690 - protein, 9 aa, Homo Sapiens
GYSMSIPRE

SEQ ID NO: 194691 - protein, 9 aa, Homo Sapiens
GYDFWRPLA

SEQ ID NO: 194692 - protein, 9 aa, Homo Sapiens
DEELTLMEA

SEQ ID NO: 194693 - protein, 9 aa, Homo Sapiens
KSPVFLFLR

SEQ ID NO: 194694 - protein, 9 aa, Homo Sapiens
IVEMFMNIE

SEQ ID NO: 194695 - protein, 9 aa, Homo Sapiens
CILSILRST

SEQ ID NO: 194696 - protein, 9 aa, Homo Sapiens
QFQVSAHDA

SEQ ID NO: 194697 - protein, 9 aa, Homo Sapiens
QFLPCRPRP

SEQ ID NO: 194698 - protein, 9 aa, Homo Sapiens
SLPPLLMPP

SEQ ID NO: 194699 - protein, 9 aa, Homo Sapiens
CKDALELIE

SEQ ID NO: 194700 - protein, 9 aa, Homo Sapiens
CPQTPCWGW

SEQ ID NO: 194701 - protein, 9 aa, Homo Sapiens
FHVLRPLRL

SEQ ID NO: 194702 - protein, 9 aa, Homo Sapiens
ELSRHIYLQ

SEQ ID NO: 194703 - protein, 9 aa, Homo Sapiens
APSVVHDYF

SEQ ID NO: 194704 - protein, 9 aa, Homo Sapiens
KALRAFHVL

SEQ ID NO: 194705 - protein, 9 aa, Homo Sapiens
LGHERIHTA

SEQ ID NO: 194706 - protein, 9 aa, Homo Sapiens
FSCTHLMWA

SEQ ID NO: 194707 - protein, 9 aa, Homo Sapiens
NIDECSEEP

SEQ ID NO: 194708 - protein, 9 aa, Homo Sapiens
AGPACSALL

SEQ ID NO: 194709 - protein, 9 aa, Homo Sapiens
CRCLCQFST

SEQ ID NO: 194710 - protein, 9 aa, Homo Sapiens
VPQPSTAPQ

SEQ ID NO: 194711 - protein, 9 aa, Homo Sapiens
SCMLCAGFP

SEQ ID NO: 194712 - protein, 9 aa, Homo Sapiens
SRTRFTGYQ

SEQ ID NO: 194713 - protein, 9 aa, Homo Sapiens
LIACLEQDL

SEQ ID NO: 194714 - protein, 9 aa, Homo Sapiens
DADTATART

SEQ ID NO: 194715 - protein, 9 aa, Homo Sapiens
STFLYILAK

SEQ ID NO: 194716 - protein, 9 aa, Homo Sapiens
GSLRCSSMS

SEQ ID NO: 194717 - protein, 9 aa, Homo Sapiens
YYPTAKANE

SEQ ID NO: 194718 - protein, 9 aa, Homo Sapiens
QGCSWTVIF

SEQ ID NO: 194719 - protein, 9 aa, Homo Sapiens
AYDWYAAIC

SEQ ID NO: 194720 - protein, 9 aa, Homo Sapiens
TDSFDTMWR

SEQ ID NO: 194721 - protein, 9 aa, Homo Sapiens
VDCYLAIVH

SEQ ID NO: 194722 - protein, 9 aa, Homo Sapiens
QPGRGWAQG

SEQ ID NO: 194723 - protein, 9 aa, Homo Sapiens
AGLGKVRPC

SEQ ID NO: 194724 - protein, 9 aa, Homo Sapiens
RHQAEKPKK

SEQ ID NO: 194725 - protein, 9 aa, Homo Sapiens
SQQSRKRGH

SEQ ID NO: 194726 - protein, 9 aa, Homo Sapiens
LGFTNSCIN

SEQ ID NO: 194727 - protein, 9 aa, Homo Sapiens
MRWSHQATV

SEQ ID NO: 194728 - protein, 9 aa, Homo Sapiens
EGHTASPPS

SEQ ID NO: 194729 - protein, 9 aa, Homo Sapiens
SDSHILASF

SEQ ID NO: 194730 - protein, 9 aa, Homo Sapiens
NDPTFLGKK

SEQ ID NO: 194731 - protein, 9 aa, Homo Sapiens
ALQLAMQIH

SEQ ID NO: 194732 - protein, 9 aa, Homo Sapiens
ARPLFLEFH

SEQ ID NO: 194733 - protein, 9 aa, Homo Sapiens
TSLVEESKF

SEQ ID NO: 194734 - protein, 9 aa, Homo Sapiens
SLHKHQQVH

SEQ ID NO: 194735 - protein, 9 aa, Homo Sapiens
MDIDMVEKT

SEQ ID NO: 194736 - protein, 9 aa, Homo Sapiens
SVRAYYKKC

SEQ ID NO: 194737 - protein, 9 aa, Homo Sapiens
CLQEWRTVP

SEQ ID NO: 194738 - protein, 9 aa, Homo Sapiens
YEEEPVEAL

SEQ ID NO: 194739 - protein, 9 aa, Homo Sapiens
KSTLTSRGH

SEQ ID NO: 194740 - protein, 9 aa, Homo Sapiens
FLMTGIFYT

SEQ ID NO: 194741 - protein, 9 aa, Homo Sapiens
PHGLENVPG

SEQ ID NO: 194742 - protein, 9 aa, Homo Sapiens
WEHHPESGE

SEQ ID NO: 194743 - protein, 9 aa, Homo Sapiens
QLQHSGPRC

SEQ ID NO: 194744 - protein, 9 aa, Homo Sapiens
PASPPQQAG

SEQ ID NO: 194745 - protein, 9 aa, Homo Sapiens
PWSMGEDMS

SEQ ID NO: 194746 - protein, 9 aa, Homo Sapiens
TKYTYGLGA

SEQ ID NO: 194747 - protein, 9 aa, Homo Sapiens
PRFYFLSYD

SEQ ID NO: 194748 - protein, 9 aa, Homo Sapiens
GGVCIPEAR

SEQ ID NO: 194749 - protein, 9 aa, Homo Sapiens
DVLWIKWAQ

SEQ ID NO: 194750 - protein, 9 aa, Homo Sapiens
EEVITYTSE

SEQ ID NO: 194751 - protein, 9 aa, Homo Sapiens
AQAQKKGTV

SEQ ID NO: 194752 - protein, 9 aa, Homo Sapiens
CQDNITTAR

SEQ ID NO: 194753 - protein, 9 aa, Homo Sapiens
TQEGQRMCA

SEQ ID NO: 194754 - protein, 9 aa, Homo Sapiens
TWFTAVGFI

SEQ ID NO: 194755 - protein, 9 aa, Homo Sapiens
GLLIINTLP

SEQ ID NO: 194756 - protein, 9 aa, Homo Sapiens
HCPHHERCS

SEQ ID NO: 194757 - protein, 9 aa, Homo Sapiens
VVTTFSESR

SEQ ID NO: 194758 - protein, 9 aa, Homo Sapiens
REMTYQFHS

SEQ ID NO: 194759 - protein, 9 aa, Homo Sapiens
RSFPDHRGL

SEQ ID NO: 194760 - protein, 9 aa, Homo Sapiens
FAKPHSLEA

SEQ ID NO: 194761 - protein, 9 aa, Homo Sapiens
MAMQAMIRA

SEQ ID NO: 194762 - protein, 9 aa, Homo Sapiens
DSVLFYATT

SEQ ID NO: 194763 - protein, 9 aa, Homo Sapiens
VAAVPHADP

SEQ ID NO: 194764 - protein, 9 aa, Homo Sapiens
CQHSSVLGL

SEQ ID NO: 194765 - protein, 9 aa, Homo Sapiens
ESRKSTFIK

SEQ ID NO: 194766 - protein, 9 aa, Homo Sapiens
CRSSCCGSG

SEQ ID NO: 194767 - protein, 9 aa, Homo Sapiens
PSLEPLARL

SEQ ID NO: 194768 - protein, 9 aa, Homo Sapiens
KLSYSVREG

SEQ ID NO: 194769 - protein, 9 aa, Homo Sapiens
DRLHCMVIL

SEQ ID NO: 194770 - protein, 9 aa, Homo Sapiens
LTSFLILLF

SEQ ID NO: 194771 - protein, 9 aa, Homo Sapiens
QDNITTARG

SEQ ID NO: 194772 - protein, 9 aa, Homo Sapiens
DPSSGVQKF

SEQ ID NO: 194773 - protein, 9 aa, Homo Sapiens
RIHFIEARD

SEQ ID NO: 194774 - protein, 9 aa, Homo Sapiens
MEEQTEVIT

SEQ ID NO: 194775 - protein, 9 aa, Homo Sapiens
CDISEGMEM

SEQ ID NO: 194776 - protein, 9 aa, Homo Sapiens
PVSGLWRQL

SEQ ID NO: 194777 - protein, 9 aa, Homo Sapiens
ATVRCLQAI

SEQ ID NO: 194778 - protein, 9 aa, Homo Sapiens
QHRYCMDVN

SEQ ID NO: 194779 - protein, 9 aa, Homo Sapiens
WVCCICQQA

SEQ ID NO: 194780 - protein, 9 aa, Homo Sapiens
VRALNESKR

SEQ ID NO: 194781 - protein, 9 aa, Homo Sapiens
IKGCAMGPH

SEQ ID NO: 194782 - protein, 9 aa, Homo Sapiens
KLGLDHLSM

SEQ ID NO: 194783 - protein, 9 aa, Homo Sapiens
EMPQSSGRS

SEQ ID NO: 194784 - protein, 9 aa, Homo Sapiens
SGQTKPEDS

SEQ ID NO: 194785 - protein, 9 aa, Homo Sapiens
FLESVQSHL

SEQ ID NO: 194786 - protein, 9 aa, Homo Sapiens
VFEQSVLQD

SEQ ID NO: 194787 - protein, 9 aa, Homo Sapiens
KPSQFLPCR

SEQ ID NO: 194788 - protein, 9 aa, Homo Sapiens
KTQFLSKEL

SEQ ID NO: 194789 - protein, 9 aa, Homo Sapiens
GFLMEVSSD

SEQ ID NO: 194790 - protein, 9 aa, Homo Sapiens
RLSTETLQQ

SEQ ID NO: 194791 - protein, 9 aa, Homo Sapiens
DVAGHFPIG

SEQ ID NO: 194792 - protein, 9 aa, Homo Sapiens
LSAGKAEET

SEQ ID NO: 194793 - protein, 9 aa, Homo Sapiens
QDEVLTKRQ

SEQ ID NO: 194794 - protein, 9 aa, Homo Sapiens
DVHSLVLKA

SEQ ID NO: 194795 - protein, 9 aa, Homo Sapiens
ALKACMTSF

SEQ ID NO: 194796 - protein, 9 aa, Homo Sapiens
SCLQGLGEG

SEQ ID NO: 194797 - protein, 9 aa, Homo Sapiens
TDRTRLLAK

SEQ ID NO: 194798 - protein, 9 aa, Homo Sapiens
CPSLTFSED

SEQ ID NO: 194799 - protein, 9 aa, Homo Sapiens
LIGNLQLAK

SEQ ID NO: 194800 - protein, 9 aa, Homo Sapiens
LWICTRYTP

SEQ ID NO: 194801 - protein, 9 aa, Homo Sapiens
QMVCTDSRE

SEQ ID NO: 194802 - protein, 9 aa, Homo Sapiens
TVPPKKMHK

SEQ ID NO: 194803 - protein, 9 aa, Homo Sapiens
RKCLTLANA

SEQ ID NO: 194804 - protein, 9 aa, Homo Sapiens
HIAKMPVKW

SEQ ID NO: 194805 - protein, 9 aa, Homo Sapiens
NGSVHKSIN

SEQ ID NO: 194806 - protein, 9 aa, Homo Sapiens
CGADSNPPA

SEQ ID NO: 194807 - protein, 9 aa, Homo Sapiens
SLYDMAQYE

SEQ ID NO: 194808 - protein, 9 aa, Homo Sapiens
VSPPSSQMS

SEQ ID NO: 194809 - protein, 9 aa, Homo Sapiens
RCTRKFGLL

SEQ ID NO: 194810 - protein, 9 aa, Homo Sapiens
DFSLYMMDP

SEQ ID NO: 194811 - protein, 9 aa, Homo Sapiens
LSLFKTLKA

SEQ ID NO: 194812 - protein, 9 aa, Homo Sapiens
GGKCTNCME

SEQ ID NO: 194813 - protein, 9 aa, Homo Sapiens
DNRHQGFKE

SEQ ID NO: 194814 - protein, 9 aa, Homo Sapiens
RITESCQVV

SEQ ID NO: 194815 - protein, 9 aa, Homo Sapiens
MKEGFMTSF

SEQ ID NO: 194816 - protein, 9 aa, Homo Sapiens
NIKRKAPFF

SEQ ID NO: 194817 - protein, 9 aa, Homo Sapiens
GACIIEKIA

SEQ ID NO: 194818 - protein, 9 aa, Homo Sapiens
DNVKKRIVV

SEQ ID NO: 194819 - protein, 9 aa, Homo Sapiens
CLTQSWPGP

SEQ ID NO: 194820 - protein, 9 aa, Homo Sapiens
KDALELIET

SEQ ID NO: 194821 - protein, 9 aa, Homo Sapiens
THQRIHIGE

SEQ ID NO: 194822 - protein, 9 aa, Homo Sapiens
WARARGQAR

SEQ ID NO: 194823 - protein, 9 aa, Homo Sapiens
VASVIYSVF

SEQ ID NO: 194824 - protein, 9 aa, Homo Sapiens
EVATCDRCA

SEQ ID NO: 194825 - protein, 9 aa, Homo Sapiens
EEQPAPPIL

SEQ ID NO: 194826 - protein, 9 aa, Homo Sapiens
MSNMGHKEP

SEQ ID NO: 194827 - protein, 9 aa, Homo Sapiens
CIFCSESFG

SEQ ID NO: 194828 - protein, 9 aa, Homo Sapiens
DFDRLTLLA

SEQ ID NO: 194829 - protein, 9 aa, Homo Sapiens
FIAKPCALY

SEQ ID NO: 194830 - protein, 9 aa, Homo Sapiens
AAPTRHGSL

SEQ ID NO: 194831 - protein, 9 aa, Homo Sapiens
GGLVNTVLK

SEQ ID NO: 194832 - protein, 9 aa, Homo Sapiens
AICFGFQCH

SEQ ID NO: 194833 - protein, 9 aa, Homo Sapiens
PEYLNPDSW

SEQ ID NO: 194834 - protein, 9 aa, Homo Sapiens
KADPPLLTS

SEQ ID NO: 194835 - protein, 9 aa, Homo Sapiens
PDAVRNPVK

SEQ ID NO: 194836 - protein, 9 aa, Homo Sapiens
SDLLVPYNL

SEQ ID NO: 194837 - protein, 9 aa, Homo Sapiens
LASKSGWED

SEQ ID NO: 194838 - protein, 9 aa, Homo Sapiens
SPYKVYMVP

SEQ ID NO: 194839 - protein, 9 aa, Homo Sapiens
IALKMNELN

SEQ ID NO: 194840 - protein, 9 aa, Homo Sapiens
LGTPALMSR

SEQ ID NO: 194841 - protein, 9 aa, Homo Sapiens
TLKAVFAAT

SEQ ID NO: 194842 - protein, 9 aa, Homo Sapiens
GRTTSAGGN

SEQ ID NO: 194843 - protein, 9 aa, Homo Sapiens
AGGGDPRRR

SEQ ID NO: 194844 - protein, 9 aa, Homo Sapiens
TEGSYDCAC

SEQ ID NO: 194845 - protein, 9 aa, Homo Sapiens
VNVQKMPSN

SEQ ID NO: 194846 - protein, 9 aa, Homo Sapiens
PEETFVSGH

SEQ ID NO: 194847 - protein, 9 aa, Homo Sapiens
VKQENTCLC

SEQ ID NO: 194848 - protein, 9 aa, Homo Sapiens
DLAHELVKS

SEQ ID NO: 194849 - protein, 9 aa, Homo Sapiens
HVLTPHMSS

SEQ ID NO: 194850 - protein, 9 aa, Homo Sapiens
DGHIAKDCK

SEQ ID NO: 194851 - protein, 9 aa, Homo Sapiens
LKHNQVGET

SEQ ID NO: 194852 - protein, 9 aa, Homo Sapiens
HVVDFFNCV

SEQ ID NO: 194853 - protein, 9 aa, Homo Sapiens
LKSKVHAFV

SEQ ID NO: 194854 - protein, 9 aa, Homo Sapiens
ENIPKTSQC

SEQ ID NO: 194855 - protein, 9 aa, Homo Sapiens
KKILLNLSC

SEQ ID NO: 194856 - protein, 9 aa, Homo Sapiens
WTQVHQSMV

SEQ ID NO: 194857 - protein, 9 aa, Homo Sapiens
QRCFARYLA

SEQ ID NO: 194858 - protein, 9 aa, Homo Sapiens
RGRDLLVVE

SEQ ID NO: 194859 - protein, 9 aa, Homo Sapiens
AQETLRDVL

SEQ ID NO: 194860 - protein, 9 aa, Homo Sapiens
NASTTVLRL

SEQ ID NO: 194861 - protein, 9 aa, Homo Sapiens
QKLPYSYIS

SEQ ID NO: 194862 - protein, 9 aa, Homo Sapiens
SAPNGPELG

SEQ ID NO: 194863 - protein, 9 aa, Homo Sapiens
ACIIEKIAL

SEQ ID NO: 194864 - protein, 9 aa, Homo Sapiens
CGGSSYSYG

SEQ ID NO: 194865 - protein, 9 aa, Homo Sapiens
GKEQHLHLE

SEQ ID NO: 194866 - protein, 9 aa, Homo Sapiens
LRPQRGPRP

SEQ ID NO: 194867 - protein, 9 aa, Homo Sapiens
TSCYFFLEE

SEQ ID NO: 194868 - protein, 9 aa, Homo Sapiens
TEGSYTLSS

SEQ ID NO: 194869 - protein, 9 aa, Homo Sapiens
RLEYALKQE

SEQ ID NO: 194870 - protein, 9 aa, Homo Sapiens
TPDNSSLEL

SEQ ID NO: 194871 - protein, 9 aa, Homo Sapiens
TTPDTMVQP

SEQ ID NO: 194872 - protein, 9 aa, Homo Sapiens
ERRRPQSCS

SEQ ID NO: 194873 - protein, 9 aa, Homo Sapiens
FQDCIIQDL

SEQ ID NO: 194874 - protein, 9 aa, Homo Sapiens
LQQFGFKAF

SEQ ID NO: 194875 - protein, 9 aa, Homo Sapiens
GSMSTCIVN

SEQ ID NO: 194876 - protein, 9 aa, Homo Sapiens
WHWEGWWSA

SEQ ID NO: 194877 - protein, 9 aa, Homo Sapiens
TAYFEAYMH

SEQ ID NO: 194878 - protein, 9 aa, Homo Sapiens
AHAFFREEC

SEQ ID NO: 194879 - protein, 9 aa, Homo Sapiens
RVINSAAAQ

SEQ ID NO: 194880 - protein, 9 aa, Homo Sapiens
VDIHVLQFC

SEQ ID NO: 194881 - protein, 9 aa, Homo Sapiens
KPRPQSPAE

SEQ ID NO: 194882 - protein, 9 aa, Homo Sapiens
VGIPPDECF

SEQ ID NO: 194883 - protein, 9 aa, Homo Sapiens
ELLWPSLED

SEQ ID NO: 194884 - protein, 9 aa, Homo Sapiens
LESFQALTE

SEQ ID NO: 194885 - protein, 9 aa, Homo Sapiens
LIASDLDET

SEQ ID NO: 194886 - protein, 9 aa, Homo Sapiens
TPRPTSPGP

SEQ ID NO: 194887 - protein, 9 aa, Homo Sapiens
CSHCRARQD

SEQ ID NO: 194888 - protein, 9 aa, Homo Sapiens
IGDPSVHLL

SEQ ID NO: 194889 - protein, 9 aa, Homo Sapiens
LEHLVFFLQ

SEQ ID NO: 194890 - protein, 9 aa, Homo Sapiens
SSCLLRSSS

SEQ ID NO: 194891 - protein, 9 aa, Homo Sapiens
AGGIPVLGG

SEQ ID NO: 194892 - protein, 9 aa, Homo Sapiens
SGLADEIDF

SEQ ID NO: 194893 - protein, 9 aa, Homo Sapiens
PLELQCLVH

SEQ ID NO: 194894 - protein, 9 aa, Homo Sapiens
CNQYRCSNG

SEQ ID NO: 194895 - protein, 9 aa, Homo Sapiens
YHHHLYDIH

SEQ ID NO: 194896 - protein, 9 aa, Homo Sapiens
GDGDILTAN

SEQ ID NO: 194897 - protein, 9 aa, Homo Sapiens
YCTTDHNVS

SEQ ID NO: 194898 - protein, 9 aa, Homo Sapiens
FCVLYHENI

SEQ ID NO: 194899 - protein, 9 aa, Homo Sapiens
TGPPPIDHQ

SEQ ID NO: 194900 - protein, 9 aa, Homo Sapiens
DTHLFSMES

SEQ ID NO: 194901 - protein, 9 aa, Homo Sapiens
RKREHEFHL

SEQ ID NO: 194902 - protein, 9 aa, Homo Sapiens
QWVCCNPDS

SEQ ID NO: 194903 - protein, 9 aa, Homo Sapiens
IYYYLTKKN

SEQ ID NO: 194904 - protein, 9 aa, Homo Sapiens
MRPGHGDFL

SEQ ID NO: 194905 - protein, 9 aa, Homo Sapiens
IASDLIIQH

SEQ ID NO: 194906 - protein, 9 aa, Homo Sapiens
MPPHDLAAT

SEQ ID NO: 194907 - protein, 9 aa, Homo Sapiens
VSLCTPPTA

SEQ ID NO: 194908 - protein, 9 aa, Homo Sapiens
RATAHTLVP

SEQ ID NO: 194909 - protein, 9 aa, Homo Sapiens
TQNAQHALR

SEQ ID NO: 194910 - protein, 9 aa, Homo Sapiens
FADMERHHI

SEQ ID NO: 194911 - protein, 9 aa, Homo Sapiens
RTPRPTSPG

SEQ ID NO: 194912 - protein, 9 aa, Homo Sapiens
STRGRYAGT

SEQ ID NO: 194913 - protein, 9 aa, Homo Sapiens
LTRERAAAA

SEQ ID NO: 194914 - protein, 9 aa, Homo Sapiens
ENDSEEGSD

SEQ ID NO: 194915 - protein, 9 aa, Homo Sapiens
VIIIESTKS

SEQ ID NO: 194916 - protein, 9 aa, Homo Sapiens
EGKDGERHE

SEQ ID NO: 194917 - protein, 9 aa, Homo Sapiens
NQGCSWTVI

SEQ ID NO: 194918 - protein, 9 aa, Homo Sapiens
QDSVKTPKI

SEQ ID NO: 194919 - protein, 9 aa, Homo Sapiens
RKHQQRIII

SEQ ID NO: 194920 - protein, 9 aa, Homo Sapiens
LTEPEKDPV

SEQ ID NO: 194921 - protein, 9 aa, Homo Sapiens
PVYIATVVG

SEQ ID NO: 194922 - protein, 9 aa, Homo Sapiens
IYHDSIPNA

SEQ ID NO: 194923 - protein, 9 aa, Homo Sapiens
SRECAHCLL

SEQ ID NO: 194924 - protein, 9 aa, Homo Sapiens
NLGFATLWE

SEQ ID NO: 194925 - protein, 9 aa, Homo Sapiens
MEVRTQVQQ

SEQ ID NO: 194926 - protein, 9 aa, Homo Sapiens
LDVFIKKSE

SEQ ID NO: 194927 - protein, 9 aa, Homo Sapiens
MKIGGVSLT

SEQ ID NO: 194928 - protein, 9 aa, Homo Sapiens
FTMDDMSRT

SEQ ID NO: 194929 - protein, 9 aa, Homo Sapiens
ELEEAKCRQ

SEQ ID NO: 194930 - protein, 9 aa, Homo Sapiens
LGISCLQGL

SEQ ID NO: 194931 - protein, 9 aa, Homo Sapiens
AICHPLLYS

SEQ ID NO: 194932 - protein, 9 aa, Homo Sapiens
QRSPLLSEC

SEQ ID NO: 194933 - protein, 9 aa, Homo Sapiens
LNIIHVTGM

SEQ ID NO: 194934 - protein, 9 aa, Homo Sapiens
NNPRIEVID

SEQ ID NO: 194935 - protein, 9 aa, Homo Sapiens
KWAQGGDYF

SEQ ID NO: 194936 - protein, 9 aa, Homo Sapiens
YESKKHSDP

SEQ ID NO: 194937 - protein, 9 aa, Homo Sapiens
RDISGHLLR

SEQ ID NO: 194938 - protein, 9 aa, Homo Sapiens
LSVPVMCKI

SEQ ID NO: 194939 - protein, 9 aa, Homo Sapiens
VREASPVPL

SEQ ID NO: 194940 - protein, 9 aa, Homo Sapiens
LPLANVTLI

SEQ ID NO: 194941 - protein, 9 aa, Homo Sapiens
LESWGATRP

SEQ ID NO: 194942 - protein, 9 aa, Homo Sapiens
LSGGSATGA

SEQ ID NO: 194943 - protein, 9 aa, Homo Sapiens
SSAPVPPMR

SEQ ID NO: 194944 - protein, 9 aa, Homo Sapiens
GHVQLMRPL

SEQ ID NO: 194945 - protein, 9 aa, Homo Sapiens
LKEEAKLKK

SEQ ID NO: 194946 - protein, 9 aa, Homo Sapiens
PSVRGEDAA

SEQ ID NO: 194947 - protein, 9 aa, Homo Sapiens
GTTLMPASE

SEQ ID NO: 194948 - protein, 9 aa, Homo Sapiens
VLLASLSSM

SEQ ID NO: 194949 - protein, 9 aa, Homo Sapiens
YDMAQYERE

SEQ ID NO: 194950 - protein, 9 aa, Homo Sapiens
HGTKYTYGL

SEQ ID NO: 194951 - protein, 9 aa, Homo Sapiens
HNQRKALNI

SEQ ID NO: 194952 - protein, 9 aa, Homo Sapiens
DPHIAQKIK

SEQ ID NO: 194953 - protein, 9 aa, Homo Sapiens
FSRVAALVF

SEQ ID NO: 194954 - protein, 9 aa, Homo Sapiens
RTLKERLSY

SEQ ID NO: 194955 - protein, 9 aa, Homo Sapiens
ISLSGIHHF

SEQ ID NO: 194956 - protein, 9 aa, Homo Sapiens
DRIIMLFDA

SEQ ID NO: 194957 - protein, 9 aa, Homo Sapiens
WYPIPFTHL

SEQ ID NO: 194958 - protein, 9 aa, Homo Sapiens
QVCSFHEQR

SEQ ID NO: 194959 - protein, 9 aa, Homo Sapiens
LALQGTKER

SEQ ID NO: 194960 - protein, 9 aa, Homo Sapiens
NNEYCSSGG

SEQ ID NO: 194961 - protein, 9 aa, Homo Sapiens
KAWLEGEIN

SEQ ID NO: 194962 - protein, 9 aa, Homo Sapiens
QYEVNPQTT

SEQ ID NO: 194963 - protein, 9 aa, Homo Sapiens
DYVQYLSGY

SEQ ID NO: 194964 - protein, 9 aa, Homo Sapiens
NSCTMCSLA

SEQ ID NO: 194965 - protein, 9 aa, Homo Sapiens
LLCHIKLHS

SEQ ID NO: 194966 - protein, 9 aa, Homo Sapiens
VDQIDPPCG

SEQ ID NO: 194967 - protein, 9 aa, Homo Sapiens
LVKCYKIPQ

SEQ ID NO: 194968 - protein, 9 aa, Homo Sapiens
GGHVKIESV

SEQ ID NO: 194969 - protein, 9 aa, Homo Sapiens
MERESLLQR

SEQ ID NO: 194970 - protein, 9 aa, Homo Sapiens
VFWLCVGKC

SEQ ID NO: 194971 - protein, 9 aa, Homo Sapiens
LKDRQLTGA

SEQ ID NO: 194972 - protein, 9 aa, Homo Sapiens
CQLNGFQQE

SEQ ID NO: 194973 - protein, 9 aa, Homo Sapiens
LMHYGQHPN

SEQ ID NO: 194974 - protein, 9 aa, Homo Sapiens
SNLKMVLWS

SEQ ID NO: 194975 - protein, 9 aa, Homo Sapiens
WPVHFQQPQ

SEQ ID NO: 194976 - protein, 9 aa, Homo Sapiens
VALIFSAMD

SEQ ID NO: 194977 - protein, 9 aa, Homo Sapiens
RCTIHLWDT

SEQ ID NO: 194978 - protein, 9 aa, Homo Sapiens
MVFLQHYGF

SEQ ID NO: 194979 - protein, 9 aa, Homo Sapiens
VAGHFPIGP

SEQ ID NO: 194980 - protein, 9 aa, Homo Sapiens
GHMKPNTLV

SEQ ID NO: 194981 - protein, 9 aa, Homo Sapiens
ENCILDEQE

SEQ ID NO: 194982 - protein, 9 aa, Homo Sapiens
KASHHIKGE

SEQ ID NO: 194983 - protein, 9 aa, Homo Sapiens
LQPGVHLRR

SEQ ID NO: 194984 - protein, 9 aa, Homo Sapiens
LAPLHTYGM

SEQ ID NO: 194985 - protein, 9 aa, Homo Sapiens
YHMNKNFER

SEQ ID NO: 194986 - protein, 9 aa, Homo Sapiens
GLSDGDGDK

SEQ ID NO: 194987 - protein, 9 aa, Homo Sapiens
LSLFSCTNI

SEQ ID NO: 194988 - protein, 9 aa, Homo Sapiens
KAITISALQ

SEQ ID NO: 194989 - protein, 9 aa, Homo Sapiens
RDSDGSVGP

SEQ ID NO: 194990 - protein, 9 aa, Homo Sapiens
SLPATHIWG

SEQ ID NO: 194991 - protein, 9 aa, Homo Sapiens
SPSPRQPLL

SEQ ID NO: 194992 - protein, 9 aa, Homo Sapiens
IVNIALPNR

SEQ ID NO: 194993 - protein, 9 aa, Homo Sapiens
NILVSCVLI

SEQ ID NO: 194994 - protein, 9 aa, Homo Sapiens
EEVQRLWFE

SEQ ID NO: 194995 - protein, 9 aa, Homo Sapiens
TATFKAYSN

SEQ ID NO: 194996 - protein, 9 aa, Homo Sapiens
KPVQMEVVQ

SEQ ID NO: 194997 - protein, 9 aa, Homo Sapiens
NGEKPYSCN

SEQ ID NO: 194998 - protein, 9 aa, Homo Sapiens
SLWKTPVAF

SEQ ID NO: 194999 - protein, 9 aa, Homo Sapiens
TPLTGVPVR

SEQ ID NO: 195000 - protein, 9 aa, Homo Sapiens
TMSLVSSVS

SEQ ID NO: 195001 - protein, 9 aa, Homo Sapiens
MMLRLSTLF

SEQ ID NO: 195002 - protein, 9 aa, Homo Sapiens
GPCANTLCN

SEQ ID NO: 195003 - protein, 9 aa, Homo Sapiens
PAVPQSQHG

SEQ ID NO: 195004 - protein, 9 aa, Homo Sapiens
ARGGGAFSG

SEQ ID NO: 195005 - protein, 9 aa, Homo Sapiens
RQGHIAKMP

SEQ ID NO: 195006 - protein, 9 aa, Homo Sapiens
TRWVAPVET

SEQ ID NO: 195007 - protein, 9 aa, Homo Sapiens
MQVWISGEE

SEQ ID NO: 195008 - protein, 9 aa, Homo Sapiens
VENLFIFGL

SEQ ID NO: 195009 - protein, 9 aa, Homo Sapiens
PRECMHHMG

SEQ ID NO: 195010 - protein, 9 aa, Homo Sapiens
EVAELKDPT

SEQ ID NO: 195011 - protein, 9 aa, Homo Sapiens
ESGLGFRVL

SEQ ID NO: 195012 - protein, 9 aa, Homo Sapiens
ATSESTSTL

SEQ ID NO: 195013 - protein, 9 aa, Homo Sapiens
RTLFIKHFI

SEQ ID NO: 195014 - protein, 9 aa, Homo Sapiens
KTFSKMTKF

SEQ ID NO: 195015 - protein, 9 aa, Homo Sapiens
QEPSTARKG

SEQ ID NO: 195016 - protein, 9 aa, Homo Sapiens
KDKQNIQKI

SEQ ID NO: 195017 - protein, 9 aa, Homo Sapiens
LHSMHKHQP

SEQ ID NO: 195018 - protein, 9 aa, Homo Sapiens
TPLTEPEKD

SEQ ID NO: 195019 - protein, 9 aa, Homo Sapiens
AHQRYFGGT

SEQ ID NO: 195020 - protein, 9 aa, Homo Sapiens
GPVPQEPTA

SEQ ID NO: 195021 - protein, 9 aa, Homo Sapiens
LGELARLRR

SEQ ID NO: 195022 - protein, 9 aa, Homo Sapiens
QLNTKYWDS

SEQ ID NO: 195023 - protein, 9 aa, Homo Sapiens
SEETCFISD

SEQ ID NO: 195024 - protein, 9 aa, Homo Sapiens
LDSEDEASH

SEQ ID NO: 195025 - protein, 9 aa, Homo Sapiens
LCFPPSLLS

SEQ ID NO: 195026 - protein, 9 aa, Homo Sapiens
SIYHDSIPN

SEQ ID NO: 195027 - protein, 9 aa, Homo Sapiens
LLFQRITRL

SEQ ID NO: 195028 - protein, 9 aa, Homo Sapiens
EPASAMASF

SEQ ID NO: 195029 - protein, 9 aa, Homo Sapiens
SLGTHAEGP

SEQ ID NO: 195030 - protein, 9 aa, Homo Sapiens
WSRLIEGYT

SEQ ID NO: 195031 - protein, 9 aa, Homo Sapiens
TQMLLHLLL

SEQ ID NO: 195032 - protein, 9 aa, Homo Sapiens
SIPMDVARQ

SEQ ID NO: 195033 - protein, 9 aa, Homo Sapiens
VTTDCVLSL

SEQ ID NO: 195034 - protein, 9 aa, Homo Sapiens
RPLVVHTGA

SEQ ID NO: 195035 - protein, 9 aa, Homo Sapiens
PAPQPLSSS

SEQ ID NO: 195036 - protein, 9 aa, Homo Sapiens
ISYKDVINR

SEQ ID NO: 195037 - protein, 9 aa, Homo Sapiens
VEALALEAA

SEQ ID NO: 195038 - protein, 9 aa, Homo Sapiens
KAVQALLRA

SEQ ID NO: 195039 - protein, 9 aa, Homo Sapiens
AECVIYYYL

SEQ ID NO: 195040 - protein, 9 aa, Homo Sapiens
LMSMTTNLC

SEQ ID NO: 195041 - protein, 9 aa, Homo Sapiens
WMWTVVTSS

SEQ ID NO: 195042 - protein, 9 aa, Homo Sapiens
SSVCPMRRS

SEQ ID NO: 195043 - protein, 9 aa, Homo Sapiens
MDPDPITTL

SEQ ID NO: 195044 - protein, 9 aa, Homo Sapiens
SPASSCSQT

SEQ ID NO: 195045 - protein, 9 aa, Homo Sapiens
VTMWSFTEG

SEQ ID NO: 195046 - protein, 9 aa, Homo Sapiens
PRPQSPAEE

SEQ ID NO: 195047 - protein, 9 aa, Homo Sapiens
HNMTTVTPF

SEQ ID NO: 195048 - protein, 9 aa, Homo Sapiens
LLHSPGFRQ

SEQ ID NO: 195049 - protein, 9 aa, Homo Sapiens
RIIIGFLQA

SEQ ID NO: 195050 - protein, 9 aa, Homo Sapiens
LQPGRGWAQ

SEQ ID NO: 195051 - protein, 9 aa, Homo Sapiens
FGWKDQHKL

SEQ ID NO: 195052 - protein, 9 aa, Homo Sapiens
AMAYDWYAA

SEQ ID NO: 195053 - protein, 9 aa, Homo Sapiens
VVLLTNERY

SEQ ID NO: 195054 - protein, 9 aa, Homo Sapiens
RSVCTMPLA

SEQ ID NO: 195055 - protein, 9 aa, Homo Sapiens
LFAKPHSLE

SEQ ID NO: 195056 - protein, 9 aa, Homo Sapiens
VQLMRPLGP

SEQ ID NO: 195057 - protein, 9 aa, Homo Sapiens
FYTISLCTY

SEQ ID NO: 195058 - protein, 9 aa, Homo Sapiens
VTMQVLPQC

SEQ ID NO: 195059 - protein, 9 aa, Homo Sapiens
AEYLKREEE

SEQ ID NO: 195060 - protein, 9 aa, Homo Sapiens
GTIWNEIDD

SEQ ID NO: 195061 - protein, 9 aa, Homo Sapiens
GMHTVAMAY

SEQ ID NO: 195062 - protein, 9 aa, Homo Sapiens
RVASALNRL

SEQ ID NO: 195063 - protein, 9 aa, Homo Sapiens
VSAHDAGVP

SEQ ID NO: 195064 - protein, 9 aa, Homo Sapiens
VKVAQTAGA

SEQ ID NO: 195065 - protein, 9 aa, Homo Sapiens
LQCFRHGQS

SEQ ID NO: 195066 - protein, 9 aa, Homo Sapiens
ATHVGSIAE

SEQ ID NO: 195067 - protein, 9 aa, Homo Sapiens
PEELQAWVW

SEQ ID NO: 195068 - protein, 9 aa, Homo Sapiens
KESPHPTRH

SEQ ID NO: 195069 - protein, 9 aa, Homo Sapiens
GAKGTKVVG

SEQ ID NO: 195070 - protein, 9 aa, Homo Sapiens
QFPDLSCEI

SEQ ID NO: 195071 - protein, 9 aa, Homo Sapiens
KDRQLTGAM

SEQ ID NO: 195072 - protein, 9 aa, Homo Sapiens
YTKEDVDNS

SEQ ID NO: 195073 - protein, 9 aa, Homo Sapiens
SCSLYPPPH

SEQ ID NO: 195074 - protein, 9 aa, Homo Sapiens
LSQLGDLSN

SEQ ID NO: 195075 - protein, 9 aa, Homo Sapiens
FWLNRESVH

SEQ ID NO: 195076 - protein, 9 aa, Homo Sapiens
KDPLNINGG

SEQ ID NO: 195077 - protein, 9 aa, Homo Sapiens
HLLHRYCVF

SEQ ID NO: 195078 - protein, 9 aa, Homo Sapiens
GLPDTPTAP

SEQ ID NO: 195079 - protein, 9 aa, Homo Sapiens
WKTPVAFAS

SEQ ID NO: 195080 - protein, 9 aa, Homo Sapiens
CCLCVSLMP

SEQ ID NO: 195081 - protein, 9 aa, Homo Sapiens
KAPVAKIST

SEQ ID NO: 195082 - protein, 9 aa, Homo Sapiens
SRSCCNTSS

SEQ ID NO: 195083 - protein, 9 aa, Homo Sapiens
ILKQSPQSG

SEQ ID NO: 195084 - protein, 9 aa, Homo Sapiens
AALGVQDYI

SEQ ID NO: 195085 - protein, 9 aa, Homo Sapiens
TRERAAAAL

SEQ ID NO: 195086 - protein, 9 aa, Homo Sapiens
IPKHAIWVE

SEQ ID NO: 195087 - protein, 9 aa, Homo Sapiens
ARFTIDLGS

SEQ ID NO: 195088 - protein, 9 aa, Homo Sapiens
SFPQPYPAR

SEQ ID NO: 195089 - protein, 9 aa, Homo Sapiens
CIIEKIALQ

SEQ ID NO: 195090 - protein, 9 aa, Homo Sapiens
VVQKTQVVQ

SEQ ID NO: 195091 - protein, 9 aa, Homo Sapiens
IRACRCDSD

SEQ ID NO: 195092 - protein, 9 aa, Homo Sapiens
SPSTLSLSS

SEQ ID NO: 195093 - protein, 9 aa, Homo Sapiens
RKVVKVYLE

SEQ ID NO: 195094 - protein, 9 aa, Homo Sapiens
LHSLQSLPR

SEQ ID NO: 195095 - protein, 9 aa, Homo Sapiens
AQDPDAVRN

SEQ ID NO: 195096 - protein, 9 aa, Homo Sapiens
LIKTTLQRA

SEQ ID NO: 195097 - protein, 9 aa, Homo Sapiens
PSVGQRLSQ

SEQ ID NO: 195098 - protein, 9 aa, Homo Sapiens
SCIRQYRIS

SEQ ID NO: 195099 - protein, 9 aa, Homo Sapiens
RVRALNESK

SEQ ID NO: 195100 - protein, 9 aa, Homo Sapiens
RELLFNGYI

SEQ ID NO: 195101 - protein, 9 aa, Homo Sapiens
DGRRLVVRF

SEQ ID NO: 195102 - protein, 9 aa, Homo Sapiens
RQSVELHSL

SEQ ID NO: 195103 - protein, 9 aa, Homo Sapiens
EVILESFQA

SEQ ID NO: 195104 - protein, 9 aa, Homo Sapiens
WAQQESLQE

SEQ ID NO: 195105 - protein, 9 aa, Homo Sapiens
ALEAGEDEG

SEQ ID NO: 195106 - protein, 9 aa, Homo Sapiens
KAMTLDQWL

SEQ ID NO: 195107 - protein, 9 aa, Homo Sapiens
RDNGGRRGG

SEQ ID NO: 195108 - protein, 9 aa, Homo Sapiens
QAQIWNLTV

SEQ ID NO: 195109 - protein, 9 aa, Homo Sapiens
IHDHQASLD

SEQ ID NO: 195110 - protein, 9 aa, Homo Sapiens
TLWPNLTVR

SEQ ID NO: 195111 - protein, 9 aa, Homo Sapiens
GPSRLPPVD

SEQ ID NO: 195112 - protein, 9 aa, Homo Sapiens
VGFIHLVEN

SEQ ID NO: 195113 - protein, 9 aa, Homo Sapiens
RGHGGFNMR

SEQ ID NO: 195114 - protein, 9 aa, Homo Sapiens
RSVIMDTKI

SEQ ID NO: 195115 - protein, 9 aa, Homo Sapiens
LLLLRREWR

SEQ ID NO: 195116 - protein, 9 aa, Homo Sapiens
AAHAVGKIP

SEQ ID NO: 195117 - protein, 9 aa, Homo Sapiens
ATQGQLSAQ

SEQ ID NO: 195118 - protein, 9 aa, Homo Sapiens
STEFTPWKH

SEQ ID NO: 195119 - protein, 9 aa, Homo Sapiens
TDINDSTPK

SEQ ID NO: 195120 - protein, 9 aa, Homo Sapiens
QLDREYKKG

SEQ ID NO: 195121 - protein, 9 aa, Homo Sapiens
NAKSCIYRE

SEQ ID NO: 195122 - protein, 9 aa, Homo Sapiens
DIEFVKLSY

SEQ ID NO: 195123 - protein, 9 aa, Homo Sapiens
DLPDIIYVL

SEQ ID NO: 195124 - protein, 9 aa, Homo Sapiens
KELQRVGLA

SEQ ID NO: 195125 - protein, 9 aa, Homo Sapiens
DYGIIKLFQ

SEQ ID NO: 195126 - protein, 9 aa, Homo Sapiens
EGLFQKSGS

SEQ ID NO: 195127 - protein, 9 aa, Homo Sapiens
QSQMAAKRH

SEQ ID NO: 195128 - protein, 9 aa, Homo Sapiens
GWHWEGWWS

SEQ ID NO: 195129 - protein, 9 aa, Homo Sapiens
NTITDTCNR

SEQ ID NO: 195130 - protein, 9 aa, Homo Sapiens
RPTGPQVAS

SEQ ID NO: 195131 - protein, 9 aa, Homo Sapiens
IVYKVPRNP

SEQ ID NO: 195132 - protein, 9 aa, Homo Sapiens
PGRGWAQGW

SEQ ID NO: 195133 - protein, 9 aa, Homo Sapiens
TCVSCKHNM

SEQ ID NO: 195134 - protein, 9 aa, Homo Sapiens
LWPYYQTEE

SEQ ID NO: 195135 - protein, 9 aa, Homo Sapiens
VNAAIVTIK

SEQ ID NO: 195136 - protein, 9 aa, Homo Sapiens
EFINFVFHK

SEQ ID NO: 195137 - protein, 9 aa, Homo Sapiens
RDPARALRA

SEQ ID NO: 195138 - protein, 9 aa, Homo Sapiens
GEVRGPVTI

SEQ ID NO: 195139 - protein, 9 aa, Homo Sapiens
SGFVSSEVV

SEQ ID NO: 195140 - protein, 9 aa, Homo Sapiens
LELHRAQMS

SEQ ID NO: 195141 - protein, 9 aa, Homo Sapiens
RHSSLSSHS

SEQ ID NO: 195142 - protein, 9 aa, Homo Sapiens
LQRSNMEFL

SEQ ID NO: 195143 - protein, 9 aa, Homo Sapiens
LNAKSCIYR

SEQ ID NO: 195144 - protein, 9 aa, Homo Sapiens
RCRVGFEVA

SEQ ID NO: 195145 - protein, 9 aa, Homo Sapiens
FRNPQRRIC

SEQ ID NO: 195146 - protein, 9 aa, Homo Sapiens
LMGLTLSDE

SEQ ID NO: 195147 - protein, 9 aa, Homo Sapiens
DPAMVFLDE

SEQ ID NO: 195148 - protein, 9 aa, Homo Sapiens
TEGKDKITL

SEQ ID NO: 195149 - protein, 9 aa, Homo Sapiens
WPNSGRGDE

SEQ ID NO: 195150 - protein, 9 aa, Homo Sapiens
VIARKLRPY

SEQ ID NO: 195151 - protein, 9 aa, Homo Sapiens
GDDIVNINR

SEQ ID NO: 195152 - protein, 9 aa, Homo Sapiens
EGGVQEPAL

SEQ ID NO: 195153 - protein, 9 aa, Homo Sapiens
LTYQVCQML

SEQ ID NO: 195154 - protein, 9 aa, Homo Sapiens
GPGAFSYAD

SEQ ID NO: 195155 - protein, 9 aa, Homo Sapiens
SCSQTPERP

SEQ ID NO: 195156 - protein, 9 aa, Homo Sapiens
KVPTPITET

SEQ ID NO: 195157 - protein, 9 aa, Homo Sapiens
ESNCEVPQP

SEQ ID NO: 195158 - protein, 9 aa, Homo Sapiens
LIMDKALQK

SEQ ID NO: 195159 - protein, 9 aa, Homo Sapiens
KPESLGKRP

SEQ ID NO: 195160 - protein, 9 aa, Homo Sapiens
QSTAVDDLD

SEQ ID NO: 195161 - protein, 9 aa, Homo Sapiens
REEEILRLH

SEQ ID NO: 195162 - protein, 9 aa, Homo Sapiens
LSAQVPEPD

SEQ ID NO: 195163 - protein, 9 aa, Homo Sapiens
WQQNYHSME

SEQ ID NO: 195164 - protein, 9 aa, Homo Sapiens
SVLHDAVAA

SEQ ID NO: 195165 - protein, 9 aa, Homo Sapiens
YELKKKTYC

SEQ ID NO: 195166 - protein, 9 aa, Homo Sapiens
LPHVLSEPY

SEQ ID NO: 195167 - protein, 9 aa, Homo Sapiens
LITLGAEVQ

SEQ ID NO: 195168 - protein, 9 aa, Homo Sapiens
RAKVVGKKM

SEQ ID NO: 195169 - protein, 9 aa, Homo Sapiens
FNTFFSETR

SEQ ID NO: 195170 - protein, 9 aa, Homo Sapiens
SHVRPMARS

SEQ ID NO: 195171 - protein, 9 aa, Homo Sapiens
CKICGKDLF

SEQ ID NO: 195172 - protein, 9 aa, Homo Sapiens
SHTPLLNGL

SEQ ID NO: 195173 - protein, 9 aa, Homo Sapiens
LPAPQPLSS

SEQ ID NO: 195174 - protein, 9 aa, Homo Sapiens
INGLANFLV

SEQ ID NO: 195175 - protein, 9 aa, Homo Sapiens
RDGFINLME

SEQ ID NO: 195176 - protein, 9 aa, Homo Sapiens
HVKIESVKL

SEQ ID NO: 195177 - protein, 9 aa, Homo Sapiens
SIWCPSSDL

SEQ ID NO: 195178 - protein, 9 aa, Homo Sapiens
LAHGYHRFL

SEQ ID NO: 195179 - protein, 9 aa, Homo Sapiens
PDPTMDPDP

SEQ ID NO: 195180 - protein, 9 aa, Homo Sapiens
VFKGGRMET

SEQ ID NO: 195181 - protein, 9 aa, Homo Sapiens
ANFAVGMRI

SEQ ID NO: 195182 - protein, 9 aa, Homo Sapiens
YCAPPTRGP

SEQ ID NO: 195183 - protein, 9 aa, Homo Sapiens
GLPTAPVLE

SEQ ID NO: 195184 - protein, 9 aa, Homo Sapiens
GLGNMPLHL

SEQ ID NO: 195185 - protein, 9 aa, Homo Sapiens
TLPMSGQTR

SEQ ID NO: 195186 - protein, 9 aa, Homo Sapiens
PVCVNRRRF

SEQ ID NO: 195187 - protein, 9 aa, Homo Sapiens
GAVPGPGAP

SEQ ID NO: 195188 - protein, 9 aa, Homo Sapiens
VHTASGPHC

SEQ ID NO: 195189 - protein, 9 aa, Homo Sapiens
GCGSFRRLD

SEQ ID NO: 195190 - protein, 9 aa, Homo Sapiens
RGHWAPVIR

SEQ ID NO: 195191 - protein, 9 aa, Homo Sapiens
EQLGTQRIF

SEQ ID NO: 195192 - protein, 9 aa, Homo Sapiens
PGLTRSVCT

SEQ ID NO: 195193 - protein, 9 aa, Homo Sapiens
VQCQCWSAE

SEQ ID NO: 195194 - protein, 9 aa, Homo Sapiens
GLDAPQQMY

SEQ ID NO: 195195 - protein, 9 aa, Homo Sapiens
SQGPAGLGS

SEQ ID NO: 195196 - protein, 9 aa, Homo Sapiens
NECKDPLNI

SEQ ID NO: 195197 - protein, 9 aa, Homo Sapiens
SVLGKMDKD

SEQ ID NO: 195198 - protein, 9 aa, Homo Sapiens
MTFVTSGEL

SEQ ID NO: 195199 - protein, 9 aa, Homo Sapiens
QPRKRSWST

SEQ ID NO: 195200 - protein, 9 aa, Homo Sapiens
RKFGLLLLF

SEQ ID NO: 195201 - protein, 9 aa, Homo Sapiens
WWEGTLNGW

SEQ ID NO: 195202 - protein, 9 aa, Homo Sapiens
RAMYLMCTV

SEQ ID NO: 195203 - protein, 9 aa, Homo Sapiens
MHLNNSRLS

SEQ ID NO: 195204 - protein, 9 aa, Homo Sapiens
AMLYSQGSK

SEQ ID NO: 195205 - protein, 9 aa, Homo Sapiens
LRIHFIEAR

SEQ ID NO: 195206 - protein, 9 aa, Homo Sapiens
GILYCWAGQ

SEQ ID NO: 195207 - protein, 9 aa, Homo Sapiens
MSGQTRVIH

SEQ ID NO: 195208 - protein, 9 aa, Homo Sapiens
PMFIRVTTV

SEQ ID NO: 195209 - protein, 9 aa, Homo Sapiens
TAGSDPGSL

SEQ ID NO: 195210 - protein, 9 aa, Homo Sapiens
SLVKKIENI

SEQ ID NO: 195211 - protein, 9 aa, Homo Sapiens
VDFFNCVNL

SEQ ID NO: 195212 - protein, 9 aa, Homo Sapiens
TPPPPPGWL

SEQ ID NO: 195213 - protein, 9 aa, Homo Sapiens
QHGFKSPQL

SEQ ID NO: 195214 - protein, 9 aa, Homo Sapiens
KIFEYLDCT

SEQ ID NO: 195215 - protein, 9 aa, Homo Sapiens
PRAPSSPML

SEQ ID NO: 195216 - protein, 9 aa, Homo Sapiens
MFQKLVDLQ

SEQ ID NO: 195217 - protein, 9 aa, Homo Sapiens
KEREIRRNS

SEQ ID NO: 195218 - protein, 9 aa, Homo Sapiens
DDFVSRYCE

SEQ ID NO: 195219 - protein, 9 aa, Homo Sapiens
LRPSLQVST

SEQ ID NO: 195220 - protein, 9 aa, Homo Sapiens
VLISEGKYS

SEQ ID NO: 195221 - protein, 9 aa, Homo Sapiens
KIRESLELM

SEQ ID NO: 195222 - protein, 9 aa, Homo Sapiens
VTILFDENG

SEQ ID NO: 195223 - protein, 9 aa, Homo Sapiens
NESRECAHC

SEQ ID NO: 195224 - protein, 9 aa, Homo Sapiens
RVPALSGQV

SEQ ID NO: 195225 - protein, 9 aa, Homo Sapiens
LGGDFWYVT

SEQ ID NO: 195226 - protein, 9 aa, Homo Sapiens
TEALNDNQE

SEQ ID NO: 195227 - protein, 9 aa, Homo Sapiens
FTGIPVSLT

SEQ ID NO: 195228 - protein, 9 aa, Homo Sapiens
VAQTAGAWI

SEQ ID NO: 195229 - protein, 9 aa, Homo Sapiens
NTGFTPQER

SEQ ID NO: 195230 - protein, 9 aa, Homo Sapiens
TPLWRQDGT

SEQ ID NO: 195231 - protein, 9 aa, Homo Sapiens
TDTCNRIKQ

SEQ ID NO: 195232 - protein, 9 aa, Homo Sapiens
GLAVISASS

SEQ ID NO: 195233 - protein, 9 aa, Homo Sapiens
LRLGTPALM

SEQ ID NO: 195234 - protein, 9 aa, Homo Sapiens
ESVQSHLRH

SEQ ID NO: 195235 - protein, 9 aa, Homo Sapiens
LITRLVSDW

SEQ ID NO: 195236 - protein, 9 aa, Homo Sapiens
CRAPSDQVS

SEQ ID NO: 195237 - protein, 9 aa, Homo Sapiens
PAGARDSDG

SEQ ID NO: 195238 - protein, 9 aa, Homo Sapiens
VDCSHLFDN

SEQ ID NO: 195239 - protein, 9 aa, Homo Sapiens
FDEFNCIDL

SEQ ID NO: 195240 - protein, 9 aa, Homo Sapiens
WAEGSVKTP

SEQ ID NO: 195241 - protein, 9 aa, Homo Sapiens
SGSKKKTQI

SEQ ID NO: 195242 - protein, 9 aa, Homo Sapiens
PGPRGEGTR

SEQ ID NO: 195243 - protein, 9 aa, Homo Sapiens
QIFITEGNN

SEQ ID NO: 195244 - protein, 9 aa, Homo Sapiens
SLQMEVLTE

SEQ ID NO: 195245 - protein, 9 aa, Homo Sapiens
QLLLDTSTT

SEQ ID NO: 195246 - protein, 9 aa, Homo Sapiens
DNTVLGDDK

SEQ ID NO: 195247 - protein, 9 aa, Homo Sapiens
EVNFFGTLE

SEQ ID NO: 195248 - protein, 9 aa, Homo Sapiens
FPQPYPARR

SEQ ID NO: 195249 - protein, 9 aa, Homo Sapiens
QGLTFTAAR

SEQ ID NO: 195250 - protein, 9 aa, Homo Sapiens
HSLQSLPRG

SEQ ID NO: 195251 - protein, 9 aa, Homo Sapiens
KDLAIELRR

SEQ ID NO: 195252 - protein, 9 aa, Homo Sapiens
YMGIQNESF

SEQ ID NO: 195253 - protein, 9 aa, Homo Sapiens
PPRLPLRPQ

SEQ ID NO: 195254 - protein, 9 aa, Homo Sapiens
RYELSAECP

SEQ ID NO: 195255 - protein, 9 aa, Homo Sapiens
SHHLQGEAD

SEQ ID NO: 195256 - protein, 9 aa, Homo Sapiens
EDRLHCMVI

SEQ ID NO: 195257 - protein, 9 aa, Homo Sapiens
IKYLPEWTV

SEQ ID NO: 195258 - protein, 9 aa, Homo Sapiens
MIDMGFKGD

SEQ ID NO: 195259 - protein, 9 aa, Homo Sapiens
AGGCGRLLQ

SEQ ID NO: 195260 - protein, 9 aa, Homo Sapiens
WVMSQTQQI

SEQ ID NO: 195261 - protein, 9 aa, Homo Sapiens
HWQTHSGEK

SEQ ID NO: 195262 - protein, 9 aa, Homo Sapiens
SQKLLRSPQ

SEQ ID NO: 195263 - protein, 9 aa, Homo Sapiens
KGDVDEDEA

SEQ ID NO: 195264 - protein, 9 aa, Homo Sapiens
LPPRRTLFI

SEQ ID NO: 195265 - protein, 9 aa, Homo Sapiens
APPYYLDFS

SEQ ID NO: 195266 - protein, 9 aa, Homo Sapiens
RRGSGHVLV

SEQ ID NO: 195267 - protein, 9 aa, Homo Sapiens
IQYCCKFDI

SEQ ID NO: 195268 - protein, 9 aa, Homo Sapiens
QLRAENELL

SEQ ID NO: 195269 - protein, 9 aa, Homo Sapiens
STVKELCRH

SEQ ID NO: 195270 - protein, 9 aa, Homo Sapiens
SFQALTEFF

SEQ ID NO: 195271 - protein, 9 aa, Homo Sapiens
LVRCVRLQR

SEQ ID NO: 195272 - protein, 9 aa, Homo Sapiens
RNALWHTRD

SEQ ID NO: 195273 - protein, 9 aa, Homo Sapiens
RNQQEFAVP

SEQ ID NO: 195274 - protein, 9 aa, Homo Sapiens
KGIQIPNLC

SEQ ID NO: 195275 - protein, 9 aa, Homo Sapiens
QAPGPGNGG

SEQ ID NO: 195276 - protein, 9 aa, Homo Sapiens
DTLVWWEKN

SEQ ID NO: 195277 - protein, 9 aa, Homo Sapiens
FDFRVGTTD

SEQ ID NO: 195278 - protein, 9 aa, Homo Sapiens
SWSTCGDSE

SEQ ID NO: 195279 - protein, 9 aa, Homo Sapiens
GNVISRSGE

SEQ ID NO: 195280 - protein, 9 aa, Homo Sapiens
KQEQPCSLL

SEQ ID NO: 195281 - protein, 9 aa, Homo Sapiens
PAMDSSRLH

SEQ ID NO: 195282 - protein, 9 aa, Homo Sapiens
AHEGNYFLS

SEQ ID NO: 195283 - protein, 9 aa, Homo Sapiens
RCYQSSPAK

SEQ ID NO: 195284 - protein, 9 aa, Homo Sapiens
DHFSCTHLM

SEQ ID NO: 195285 - protein, 9 aa, Homo Sapiens
PPMESCLDL

SEQ ID NO: 195286 - protein, 9 aa, Homo Sapiens
NLYDEEGKQ

SEQ ID NO: 195287 - protein, 9 aa, Homo Sapiens
TGFTPQERQ

SEQ ID NO: 195288 - protein, 9 aa, Homo Sapiens
HTDLRQYMD

SEQ ID NO: 195289 - protein, 9 aa, Homo Sapiens
RLDSTIRLY

SEQ ID NO: 195290 - protein, 9 aa, Homo Sapiens
GLAPPRPAA

SEQ ID NO: 195291 - protein, 9 aa, Homo Sapiens
VDTHLFSME

SEQ ID NO: 195292 - protein, 9 aa, Homo Sapiens
LELQMDSHM

SEQ ID NO: 195293 - protein, 9 aa, Homo Sapiens
WRQDGTGHY

SEQ ID NO: 195294 - protein, 9 aa, Homo Sapiens
DIMGTIKRA

SEQ ID NO: 195295 - protein, 9 aa, Homo Sapiens
LVLGILVGS

SEQ ID NO: 195296 - protein, 9 aa, Homo Sapiens
GTAHAIQRK

SEQ ID NO: 195297 - protein, 9 aa, Homo Sapiens
IKPDQSNMR

SEQ ID NO: 195298 - protein, 9 aa, Homo Sapiens
YIIPAQGEN

SEQ ID NO: 195299 - protein, 9 aa, Homo Sapiens
PKFFTFRTR

SEQ ID NO: 195300 - protein, 9 aa, Homo Sapiens
PTMSRRVKS

SEQ ID NO: 195301 - protein, 9 aa, Homo Sapiens
YLVLHTEQP

SEQ ID NO: 195302 - protein, 9 aa, Homo Sapiens
IQRGLVLWN

SEQ ID NO: 195303 - protein, 9 aa, Homo Sapiens
HLTDQKLIP

SEQ ID NO: 195304 - protein, 9 aa, Homo Sapiens
YEDFVEGLH

SEQ ID NO: 195305 - protein, 9 aa, Homo Sapiens
TELENFTPS

SEQ ID NO: 195306 - protein, 9 aa, Homo Sapiens
GAALWGRTW

SEQ ID NO: 195307 - protein, 9 aa, Homo Sapiens
TPCWGWHWE

SEQ ID NO: 195308 - protein, 9 aa, Homo Sapiens
RFCGGLIKN

SEQ ID NO: 195309 - protein, 9 aa, Homo Sapiens
SPVNTRYLF

SEQ ID NO: 195310 - protein, 9 aa, Homo Sapiens
VSLLVVSPI

SEQ ID NO: 195311 - protein, 9 aa, Homo Sapiens
KRYELSAEC

SEQ ID NO: 195312 - protein, 9 aa, Homo Sapiens
WTLLPTTGV

SEQ ID NO: 195313 - protein, 9 aa, Homo Sapiens
ILYSVFEEH

SEQ ID NO: 195314 - protein, 9 aa, Homo Sapiens
MILNELHPG

SEQ ID NO: 195315 - protein, 9 aa, Homo Sapiens
RVVSPFLKE

SEQ ID NO: 195316 - protein, 9 aa, Homo Sapiens
LVRGLMLPG

SEQ ID NO: 195317 - protein, 9 aa, Homo Sapiens
CNHVAHTVG

SEQ ID NO: 195318 - protein, 9 aa, Homo Sapiens
TMTPIAQNT

SEQ ID NO: 195319 - protein, 9 aa, Homo Sapiens
RVTNDMESD

SEQ ID NO: 195320 - protein, 9 aa, Homo Sapiens
DPENQALVR

SEQ ID NO: 195321 - protein, 9 aa, Homo Sapiens
QGPAGLGSM

SEQ ID NO: 195322 - protein, 9 aa, Homo Sapiens
MDMDNFLLA

SEQ ID NO: 195323 - protein, 9 aa, Homo Sapiens
GLAACLCPG

SEQ ID NO: 195324 - protein, 9 aa, Homo Sapiens
QNESFMKLA

SEQ ID NO: 195325 - protein, 9 aa, Homo Sapiens
SWPGKYDSM

SEQ ID NO: 195326 - protein, 9 aa, Homo Sapiens
KTTLQRALE

SEQ ID NO: 195327 - protein, 9 aa, Homo Sapiens
PDSQEMLAL

SEQ ID NO: 195328 - protein, 9 aa, Homo Sapiens
TKDLPSKKG

SEQ ID NO: 195329 - protein, 9 aa, Homo Sapiens
CMDYQKTFR

SEQ ID NO: 195330 - protein, 9 aa, Homo Sapiens
PIDHQKRLS

SEQ ID NO: 195331 - protein, 9 aa, Homo Sapiens
ENPYRCEDS

SEQ ID NO: 195332 - protein, 9 aa, Homo Sapiens
PDHRGLYHF

SEQ ID NO: 195333 - protein, 9 aa, Homo Sapiens
ENIEEDFQD

SEQ ID NO: 195334 - protein, 9 aa, Homo Sapiens
DWLQGEPPR

SEQ ID NO: 195335 - protein, 9 aa, Homo Sapiens
EASPVPLAQ

SEQ ID NO: 195336 - protein, 9 aa, Homo Sapiens
QSKSENMTL

SEQ ID NO: 195337 - protein, 9 aa, Homo Sapiens
MREDPPTDP

SEQ ID NO: 195338 - protein, 9 aa, Homo Sapiens
KKASHHIKG

SEQ ID NO: 195339 - protein, 9 aa, Homo Sapiens
YRGGGRYEE

SEQ ID NO: 195340 - protein, 9 aa, Homo Sapiens
LLQSAKKRA

SEQ ID NO: 195341 - protein, 9 aa, Homo Sapiens
SLYIRHLPL

SEQ ID NO: 195342 - protein, 9 aa, Homo Sapiens
PASMRDGPL

SEQ ID NO: 195343 - protein, 9 aa, Homo Sapiens
ESADENLKS

SEQ ID NO: 195344 - protein, 9 aa, Homo Sapiens
CRVPLSPLS

SEQ ID NO: 195345 - protein, 9 aa, Homo Sapiens
WVPVPQPPM

SEQ ID NO: 195346 - protein, 9 aa, Homo Sapiens
ILFAEMLMQ

SEQ ID NO: 195347 - protein, 9 aa, Homo Sapiens
NPQTTEILH

SEQ ID NO: 195348 - protein, 9 aa, Homo Sapiens
RQAPGALQP

SEQ ID NO: 195349 - protein, 9 aa, Homo Sapiens
TVHECCVSR

SEQ ID NO: 195350 - protein, 9 aa, Homo Sapiens
GEPAVLPAL

SEQ ID NO: 195351 - protein, 9 aa, Homo Sapiens
YRANLGMLN

SEQ ID NO: 195352 - protein, 9 aa, Homo Sapiens
SILAIEGTC

SEQ ID NO: 195353 - protein, 9 aa, Homo Sapiens
ASLSSDTST

SEQ ID NO: 195354 - protein, 9 aa, Homo Sapiens
VVTSSGDSS

SEQ ID NO: 195355 - protein, 9 aa, Homo Sapiens
RTFISSGQS

SEQ ID NO: 195356 - protein, 9 aa, Homo Sapiens
YKFEDAKTD

SEQ ID NO: 195357 - protein, 9 aa, Homo Sapiens
PSSGVQKFI

SEQ ID NO: 195358 - protein, 9 aa, Homo Sapiens
FLEEKFESL

SEQ ID NO: 195359 - protein, 9 aa, Homo Sapiens
PGDLVFLQM

SEQ ID NO: 195360 - protein, 9 aa, Homo Sapiens
TSSNYQTMF

SEQ ID NO: 195361 - protein, 9 aa, Homo Sapiens
PLNINGGCS

SEQ ID NO: 195362 - protein, 9 aa, Homo Sapiens
HHHLYDIHV

SEQ ID NO: 195363 - protein, 9 aa, Homo Sapiens
SMTTNLCEG

SEQ ID NO: 195364 - protein, 9 aa, Homo Sapiens
PHLLGWLVP

SEQ ID NO: 195365 - protein, 9 aa, Homo Sapiens
VPQSQHGVC

SEQ ID NO: 195366 - protein, 9 aa, Homo Sapiens
KYDVQGIQK

SEQ ID NO: 195367 - protein, 9 aa, Homo Sapiens
IVSPAIVFP

SEQ ID NO: 195368 - protein, 9 aa, Homo Sapiens
LWPQPLTFS

SEQ ID NO: 195369 - protein, 9 aa, Homo Sapiens
QGTKERAHQ

SEQ ID NO: 195370 - protein, 9 aa, Homo Sapiens
KTQFDEGWV

SEQ ID NO: 195371 - protein, 9 aa, Homo Sapiens
DISGHLLRE

SEQ ID NO: 195372 - protein, 9 aa, Homo Sapiens
DPVEAKPEC

SEQ ID NO: 195373 - protein, 9 aa, Homo Sapiens
HEDRPFPHT

SEQ ID NO: 195374 - protein, 9 aa, Homo Sapiens
ELQAYTQLV

SEQ ID NO: 195375 - protein, 9 aa, Homo Sapiens
RKLKNKASI

SEQ ID NO: 195376 - protein, 9 aa, Homo Sapiens
QCDDLDHFI

SEQ ID NO: 195377 - protein, 9 aa, Homo Sapiens
IILLKGDVD

SEQ ID NO: 195378 - protein, 9 aa, Homo Sapiens
IIEGKLPPI

SEQ ID NO: 195379 - protein, 9 aa, Homo Sapiens
EKQVVLLTN

SEQ ID NO: 195380 - protein, 9 aa, Homo Sapiens
LCAAAPPFR

SEQ ID NO: 195381 - protein, 9 aa, Homo Sapiens
DVGRHLGQH

SEQ ID NO: 195382 - protein, 9 aa, Homo Sapiens
PSSQMSPMP

SEQ ID NO: 195383 - protein, 9 aa, Homo Sapiens
PKAMTLDQW

SEQ ID NO: 195384 - protein, 9 aa, Homo Sapiens
LTFLWPYYQ

SEQ ID NO: 195385 - protein, 9 aa, Homo Sapiens
DHTLSISSD

SEQ ID NO: 195386 - protein, 9 aa, Homo Sapiens
LWIKWAQGG

SEQ ID NO: 195387 - protein, 9 aa, Homo Sapiens
SSSAPVPPM

SEQ ID NO: 195388 - protein, 9 aa, Homo Sapiens
HYGQHPNII

SEQ ID NO: 195389 - protein, 9 aa, Homo Sapiens
SSMYSTPSS

SEQ ID NO: 195390 - protein, 9 aa, Homo Sapiens
SAYSYSLEH

SEQ ID NO: 195391 - protein, 9 aa, Homo Sapiens
RPSVGQRLS

SEQ ID NO: 195392 - protein, 9 aa, Homo Sapiens
PKKTKPSHS

SEQ ID NO: 195393 - protein, 9 aa, Homo Sapiens
LEGCYLSHT

SEQ ID NO: 195394 - protein, 9 aa, Homo Sapiens
YQAPGPGNG

SEQ ID NO: 195395 - protein, 9 aa, Homo Sapiens
AWVTGNVTT

SEQ ID NO: 195396 - protein, 9 aa, Homo Sapiens
HAQCSSWWG

SEQ ID NO: 195397 - protein, 9 aa, Homo Sapiens
ECGMRPGHG

SEQ ID NO: 195398 - protein, 9 aa, Homo Sapiens
ETVNWEDRS

SEQ ID NO: 195399 - protein, 9 aa, Homo Sapiens
ISNHALAEM

SEQ ID NO: 195400 - protein, 9 aa, Homo Sapiens
TTSMEEHVI

SEQ ID NO: 195401 - protein, 9 aa, Homo Sapiens
AISTLYWKV

SEQ ID NO: 195402 - protein, 9 aa, Homo Sapiens
SRLSLSWAL

SEQ ID NO: 195403 - protein, 9 aa, Homo Sapiens
LRVPSTIVW

SEQ ID NO: 195404 - protein, 9 aa, Homo Sapiens
WSDEWPRWP

SEQ ID NO: 195405 - protein, 9 aa, Homo Sapiens
NRNAGQGER

SEQ ID NO: 195406 - protein, 9 aa, Homo Sapiens
TRPKSAFKV

SEQ ID NO: 195407 - protein, 9 aa, Homo Sapiens
FQAELAEAQ

SEQ ID NO: 195408 - protein, 9 aa, Homo Sapiens
FWEQQNDLY

SEQ ID NO: 195409 - protein, 9 aa, Homo Sapiens
YSHHLQGEA

SEQ ID NO: 195410 - protein, 9 aa, Homo Sapiens
NAPLQCIRS

SEQ ID NO: 195411 - protein, 9 aa, Homo Sapiens
NLLLHSPGF

SEQ ID NO: 195412 - protein, 9 aa, Homo Sapiens
FLLAHVLGY

SEQ ID NO: 195413 - protein, 9 aa, Homo Sapiens
QIQQQSALK

SEQ ID NO: 195414 - protein, 9 aa, Homo Sapiens
AVRGPTGVA

SEQ ID NO: 195415 - protein, 9 aa, Homo Sapiens
PPVQGCSTS

SEQ ID NO: 195416 - protein, 9 aa, Homo Sapiens
CAPGPLGEC

SEQ ID NO: 195417 - protein, 9 aa, Homo Sapiens
SAGKAEETL

SEQ ID NO: 195418 - protein, 9 aa, Homo Sapiens
LTSLVEESK

SEQ ID NO: 195419 - protein, 9 aa, Homo Sapiens
VFSVFPAIC

SEQ ID NO: 195420 - protein, 9 aa, Homo Sapiens
EGCYLSHTL

SEQ ID NO: 195421 - protein, 9 aa, Homo Sapiens
RVTPHGLEN

SEQ ID NO: 195422 - protein, 9 aa, Homo Sapiens
GDLNLVAVN

SEQ ID NO: 195423 - protein, 9 aa, Homo Sapiens
VLQEHFAVE

SEQ ID NO: 195424 - protein, 9 aa, Homo Sapiens
NVMVMELLW

SEQ ID NO: 195425 - protein, 9 aa, Homo Sapiens
KFFTFRTRD

SEQ ID NO: 195426 - protein, 9 aa, Homo Sapiens
CGTADVTHD

SEQ ID NO: 195427 - protein, 9 aa, Homo Sapiens
PEEPLRDWL

SEQ ID NO: 195428 - protein, 9 aa, Homo Sapiens
IDNLEAAPR

SEQ ID NO: 195429 - protein, 9 aa, Homo Sapiens
PFNSEQRDS

SEQ ID NO: 195430 - protein, 9 aa, Homo Sapiens
WPAKSVPSV

SEQ ID NO: 195431 - protein, 9 aa, Homo Sapiens
AEPLPSSSI

SEQ ID NO: 195432 - protein, 9 aa, Homo Sapiens
LYEALKKRR

SEQ ID NO: 195433 - protein, 9 aa, Homo Sapiens
YSPYGMLAN

SEQ ID NO: 195434 - protein, 9 aa, Homo Sapiens
EIIPHQVFA

SEQ ID NO: 195435 - protein, 9 aa, Homo Sapiens
QCEYEELRN

SEQ ID NO: 195436 - protein, 9 aa, Homo Sapiens
LMDRKQEQP

SEQ ID NO: 195437 - protein, 9 aa, Homo Sapiens
IENRPKYAG

SEQ ID NO: 195438 - protein, 9 aa, Homo Sapiens
LTHFLKEVT

SEQ ID NO: 195439 - protein, 9 aa, Homo Sapiens
NEERLRGLL

SEQ ID NO: 195440 - protein, 9 aa, Homo Sapiens
TMWSFTEGR

SEQ ID NO: 195441 - protein, 9 aa, Homo Sapiens
LYVADGLGE

SEQ ID NO: 195442 - protein, 9 aa, Homo Sapiens
LESGVWALL

SEQ ID NO: 195443 - protein, 9 aa, Homo Sapiens
SAKMNLVVL

SEQ ID NO: 195444 - protein, 9 aa, Homo Sapiens
HKLWVGYQY

SEQ ID NO: 195445 - protein, 9 aa, Homo Sapiens
LGYCPQENT

SEQ ID NO: 195446 - protein, 9 aa, Homo Sapiens
QRWSYTSED

SEQ ID NO: 195447 - protein, 9 aa, Homo Sapiens
TVSSLQAKM

SEQ ID NO: 195448 - protein, 9 aa, Homo Sapiens
PEMVCALSA

SEQ ID NO: 195449 - protein, 9 aa, Homo Sapiens
LLACIAVDC

SEQ ID NO: 195450 - protein, 9 aa, Homo Sapiens
VPFLLLDKW

SEQ ID NO: 195451 - protein, 9 aa, Homo Sapiens
AMFCVLYHE

SEQ ID NO: 195452 - protein, 9 aa, Homo Sapiens
GRQCVEHYH

SEQ ID NO: 195453 - protein, 9 aa, Homo Sapiens
SILNFYCTG

SEQ ID NO: 195454 - protein, 9 aa, Homo Sapiens
LLTSLVEES

SEQ ID NO: 195455 - protein, 9 aa, Homo Sapiens
FTHLPIRMA

SEQ ID NO: 195456 - protein, 9 aa, Homo Sapiens
RGPVSGLWR

SEQ ID NO: 195457 - protein, 9 aa, Homo Sapiens
VHQGRLEFA

SEQ ID NO: 195458 - protein, 9 aa, Homo Sapiens
GVSLGHTSS

SEQ ID NO: 195459 - protein, 9 aa, Homo Sapiens
VRLTLKKYI

SEQ ID NO: 195460 - protein, 9 aa, Homo Sapiens
IKAGNVISR

SEQ ID NO: 195461 - protein, 9 aa, Homo Sapiens
PAGHAAAPE

SEQ ID NO: 195462 - protein, 9 aa, Homo Sapiens
LCGVSKPTT

SEQ ID NO: 195463 - protein, 9 aa, Homo Sapiens
GGFGGGGRF

SEQ ID NO: 195464 - protein, 9 aa, Homo Sapiens
QDCMDAMAE

SEQ ID NO: 195465 - protein, 9 aa, Homo Sapiens
QCIRSTSTP

SEQ ID NO: 195466 - protein, 9 aa, Homo Sapiens
SVISGISSQ

SEQ ID NO: 195467 - protein, 9 aa, Homo Sapiens
PGAASSPAV

SEQ ID NO: 195468 - protein, 9 aa, Homo Sapiens
SIMLVEEDF

SEQ ID NO: 195469 - protein, 9 aa, Homo Sapiens
NMEEQTEVI

SEQ ID NO: 195470 - protein, 9 aa, Homo Sapiens
QGPGRETKR

SEQ ID NO: 195471 - protein, 9 aa, Homo Sapiens
DVTHESRFN

SEQ ID NO: 195472 - protein, 9 aa, Homo Sapiens
PPLLMPPCS

SEQ ID NO: 195473 - protein, 9 aa, Homo Sapiens
QTKPEDSDC

SEQ ID NO: 195474 - protein, 9 aa, Homo Sapiens
GSESEGDNF

SEQ ID NO: 195475 - protein, 9 aa, Homo Sapiens
KLNDKHITT

SEQ ID NO: 195476 - protein, 9 aa, Homo Sapiens
RYGVQERVT

SEQ ID NO: 195477 - protein, 9 aa, Homo Sapiens
ISDCCHREC

SEQ ID NO: 195478 - protein, 9 aa, Homo Sapiens
YNIFKTDIV

SEQ ID NO: 195479 - protein, 9 aa, Homo Sapiens
YTSKETHFL

SEQ ID NO: 195480 - protein, 9 aa, Homo Sapiens
KSEATKSCR

SEQ ID NO: 195481 - protein, 9 aa, Homo Sapiens
EPNSTTIQT

SEQ ID NO: 195482 - protein, 9 aa, Homo Sapiens
IETLITLGA

SEQ ID NO: 195483 - protein, 9 aa, Homo Sapiens
AQYEREQYA

SEQ ID NO: 195484 - protein, 9 aa, Homo Sapiens
QWSQEFSTL

SEQ ID NO: 195485 - protein, 9 aa, Homo Sapiens
HQIIHTSAK

SEQ ID NO: 195486 - protein, 9 aa, Homo Sapiens
MDSQMLASD

SEQ ID NO: 195487 - protein, 9 aa, Homo Sapiens
DLQIALVSF

SEQ ID NO: 195488 - protein, 9 aa, Homo Sapiens
RIHIGERPY

SEQ ID NO: 195489 - protein, 9 aa, Homo Sapiens
VRTVCDSVL

SEQ ID NO: 195490 - protein, 9 aa, Homo Sapiens
LNLRVGHKP

SEQ ID NO: 195491 - protein, 9 aa, Homo Sapiens
GVTILFDEN

SEQ ID NO: 195492 - protein, 9 aa, Homo Sapiens
RKSNFHDGH

SEQ ID NO: 195493 - protein, 9 aa, Homo Sapiens
LHSGENPYR

SEQ ID NO: 195494 - protein, 9 aa, Homo Sapiens
GAGHISEFK

SEQ ID NO: 195495 - protein, 9 aa, Homo Sapiens
SEYRLKPAM

SEQ ID NO: 195496 - protein, 9 aa, Homo Sapiens
PADSKPLNL

SEQ ID NO: 195497 - protein, 9 aa, Homo Sapiens
SSCSQTPER

SEQ ID NO: 195498 - protein, 9 aa, Homo Sapiens
RTTSSTAMA

SEQ ID NO: 195499 - protein, 9 aa, Homo Sapiens
CIDLPVLSV

SEQ ID NO: 195500 - protein, 9 aa, Homo Sapiens
EKIRKALLS

SEQ ID NO: 195501 - protein, 9 aa, Homo Sapiens
LKDHRPWMV

SEQ ID NO: 195502 - protein, 9 aa, Homo Sapiens
RELEKIPTM

SEQ ID NO: 195503 - protein, 9 aa, Homo Sapiens
EQGKCVENI

SEQ ID NO: 195504 - protein, 9 aa, Homo Sapiens
FRWLWQLQA

SEQ ID NO: 195505 - protein, 9 aa, Homo Sapiens
ECNQQLDLC

SEQ ID NO: 195506 - protein, 9 aa, Homo Sapiens
TPQVSPAHS

SEQ ID NO: 195507 - protein, 9 aa, Homo Sapiens
HGLSGNPGP

SEQ ID NO: 195508 - protein, 9 aa, Homo Sapiens
DLDAGRDSP

SEQ ID NO: 195509 - protein, 9 aa, Homo Sapiens
NTCLCNQYR

SEQ ID NO: 195510 - protein, 9 aa, Homo Sapiens
PCPAVPLGP

SEQ ID NO: 195511 - protein, 9 aa, Homo Sapiens
VAQKPYRCP

SEQ ID NO: 195512 - protein, 9 aa, Homo Sapiens
HRGNPSRLY

SEQ ID NO: 195513 - protein, 9 aa, Homo Sapiens
LTDSFDTMW

SEQ ID NO: 195514 - protein, 9 aa, Homo Sapiens
FCPLLCTME

SEQ ID NO: 195515 - protein, 9 aa, Homo Sapiens
IILACYFYE

SEQ ID NO: 195516 - protein, 9 aa, Homo Sapiens
IFRSIPYKE

SEQ ID NO: 195517 - protein, 9 aa, Homo Sapiens
ELHPGLKYD

SEQ ID NO: 195518 - protein, 9 aa, Homo Sapiens
LANLRASQC

SEQ ID NO: 195519 - protein, 9 aa, Homo Sapiens
TLQVVRRVI

SEQ ID NO: 195520 - protein, 9 aa, Homo Sapiens
DVAKQMCTK

SEQ ID NO: 195521 - protein, 9 aa, Homo Sapiens
VLSNSGCGQ

SEQ ID NO: 195522 - protein, 9 aa, Homo Sapiens
YSHGNVTFS

SEQ ID NO: 195523 - protein, 9 aa, Homo Sapiens
NKASITPGL

SEQ ID NO: 195524 - protein, 9 aa, Homo Sapiens
QAHKIQGEL

SEQ ID NO: 195525 - protein, 9 aa, Homo Sapiens
AINTAIIEV

SEQ ID NO: 195526 - protein, 9 aa, Homo Sapiens
CPRGHHHLL

SEQ ID NO: 195527 - protein, 9 aa, Homo Sapiens
EERHGSLDQ

SEQ ID NO: 195528 - protein, 9 aa, Homo Sapiens
VRAQEHELL

SEQ ID NO: 195529 - protein, 9 aa, Homo Sapiens
MPDYLDDGK

SEQ ID NO: 195530 - protein, 9 aa, Homo Sapiens
QQTTGCSQR

SEQ ID NO: 195531 - protein, 9 aa, Homo Sapiens
VSCCQQTAI

SEQ ID NO: 195532 - protein, 9 aa, Homo Sapiens
LMKEVAELK

SEQ ID NO: 195533 - protein, 9 aa, Homo Sapiens
FAILDNFKE

SEQ ID NO: 195534 - protein, 9 aa, Homo Sapiens
EHPQRLPAA

SEQ ID NO: 195535 - protein, 9 aa, Homo Sapiens
PQAGNRTPV

SEQ ID NO: 195536 - protein, 9 aa, Homo Sapiens
AGRLLVQWL

SEQ ID NO: 195537 - protein, 9 aa, Homo Sapiens
AILNSSPES

SEQ ID NO: 195538 - protein, 9 aa, Homo Sapiens
GGAGVKASP

SEQ ID NO: 195539 - protein, 9 aa, Homo Sapiens
AKVVGKKMV

SEQ ID NO: 195540 - protein, 9 aa, Homo Sapiens
AFHDSLKKN

SEQ ID NO: 195541 - protein, 9 aa, Homo Sapiens
LLNNMRVEY

SEQ ID NO: 195542 - protein, 9 aa, Homo Sapiens
GFEVATCDR

SEQ ID NO: 195543 - protein, 9 aa, Homo Sapiens
RPAPDKPVQ

SEQ ID NO: 195544 - protein, 9 aa, Homo Sapiens
NLGVYWREA

SEQ ID NO: 195545 - protein, 9 aa, Homo Sapiens
PMIVAMLMK

SEQ ID NO: 195546 - protein, 9 aa, Homo Sapiens
PQLFKNVFI

SEQ ID NO: 195547 - protein, 9 aa, Homo Sapiens
NCYWAQLDE

SEQ ID NO: 195548 - protein, 9 aa, Homo Sapiens
ENQIQQQSA

SEQ ID NO: 195549 - protein, 9 aa, Homo Sapiens
TMTTKNVHS

SEQ ID NO: 195550 - protein, 9 aa, Homo Sapiens
ISSLPSHTP

SEQ ID NO: 195551 - protein, 9 aa, Homo Sapiens
WGLQTKTDI

SEQ ID NO: 195552 - protein, 9 aa, Homo Sapiens
MDTIVFPTA

SEQ ID NO: 195553 - protein, 9 aa, Homo Sapiens
LARKCLTLA

SEQ ID NO: 195554 - protein, 9 aa, Homo Sapiens
GELARLRRD

SEQ ID NO: 195555 - protein, 9 aa, Homo Sapiens
RFLLAHVLG

SEQ ID NO: 195556 - protein, 9 aa, Homo Sapiens
MASADLQTL

SEQ ID NO: 195557 - protein, 9 aa, Homo Sapiens
RYAAEMYGS

SEQ ID NO: 195558 - protein, 9 aa, Homo Sapiens
STGLPDTPT

SEQ ID NO: 195559 - protein, 9 aa, Homo Sapiens
FTFRTRDKF

SEQ ID NO: 195560 - protein, 9 aa, Homo Sapiens
RQFWMMAIV

SEQ ID NO: 195561 - protein, 9 aa, Homo Sapiens
IFLKKPDSV

SEQ ID NO: 195562 - protein, 9 aa, Homo Sapiens
DNSDYCDIS

SEQ ID NO: 195563 - protein, 9 aa, Homo Sapiens
LTLMEALVG

SEQ ID NO: 195564 - protein, 9 aa, Homo Sapiens
QQQTFVVPR

SEQ ID NO: 195565 - protein, 9 aa, Homo Sapiens
QKKMIDTGD

SEQ ID NO: 195566 - protein, 9 aa, Homo Sapiens
QRSISKYRC

SEQ ID NO: 195567 - protein, 9 aa, Homo Sapiens
NAKHSEKSS

SEQ ID NO: 195568 - protein, 9 aa, Homo Sapiens
PLTSFLILL

SEQ ID NO: 195569 - protein, 9 aa, Homo Sapiens
HCLGFVPRN

SEQ ID NO: 195570 - protein, 9 aa, Homo Sapiens
TAVDDLDED

SEQ ID NO: 195571 - protein, 9 aa, Homo Sapiens
VYGITSRET

SEQ ID NO: 195572 - protein, 9 aa, Homo Sapiens
MLRGTQCPP

SEQ ID NO: 195573 - protein, 9 aa, Homo Sapiens
SGRLQAILQ

SEQ ID NO: 195574 - protein, 9 aa, Homo Sapiens
VLAPEDVLA

SEQ ID NO: 195575 - protein, 9 aa, Homo Sapiens
VRTRGSPLR

SEQ ID NO: 195576 - protein, 9 aa, Homo Sapiens
GKDGERHEL

SEQ ID NO: 195577 - protein, 9 aa, Homo Sapiens
PVRVRPPHV

SEQ ID NO: 195578 - protein, 9 aa, Homo Sapiens
TAAVLNTVW

SEQ ID NO: 195579 - protein, 9 aa, Homo Sapiens
RRSYCAPPT

SEQ ID NO: 195580 - protein, 9 aa, Homo Sapiens
STDTDGWVA

SEQ ID NO: 195581 - protein, 9 aa, Homo Sapiens
TRAGGFGLN

SEQ ID NO: 195582 - protein, 9 aa, Homo Sapiens
CMVILFAFT

SEQ ID NO: 195583 - protein, 9 aa, Homo Sapiens
SAWLLLVDL

SEQ ID NO: 195584 - protein, 9 aa, Homo Sapiens
SEKQVVLLT

SEQ ID NO: 195585 - protein, 9 aa, Homo Sapiens
AALKDRHME

SEQ ID NO: 195586 - protein, 9 aa, Homo Sapiens
SRPANGGQC

SEQ ID NO: 195587 - protein, 9 aa, Homo Sapiens
ILHNKPYSK

SEQ ID NO: 195588 - protein, 9 aa, Homo Sapiens
DNKYLPSLL

SEQ ID NO: 195589 - protein, 9 aa, Homo Sapiens
CRCGKTFSK

SEQ ID NO: 195590 - protein, 9 aa, Homo Sapiens
IQSDKIRTA

SEQ ID NO: 195591 - protein, 9 aa, Homo Sapiens
QYSDCDGRG

SEQ ID NO: 195592 - protein, 9 aa, Homo Sapiens
WRPLAQLRE

SEQ ID NO: 195593 - protein, 9 aa, Homo Sapiens
MWLPPAVPQ

SEQ ID NO: 195594 - protein, 9 aa, Homo Sapiens
AGAWIITGG

SEQ ID NO: 195595 - protein, 9 aa, Homo Sapiens
RIRSRSSSY

SEQ ID NO: 195596 - protein, 9 aa, Homo Sapiens
LQGEQLHRT

SEQ ID NO: 195597 - protein, 9 aa, Homo Sapiens
EENTEKAIE

SEQ ID NO: 195598 - protein, 9 aa, Homo Sapiens
VLHDAVAAA

SEQ ID NO: 195599 - protein, 9 aa, Homo Sapiens
VSFPQPYPA

SEQ ID NO: 195600 - protein, 9 aa, Homo Sapiens
TPPTAAVGR

SEQ ID NO: 195601 - protein, 9 aa, Homo Sapiens
MYFVFMFMD

SEQ ID NO: 195602 - protein, 9 aa, Homo Sapiens
ATPQVSPAH

SEQ ID NO: 195603 - protein, 9 aa, Homo Sapiens
CHRTGMQPH

SEQ ID NO: 195604 - protein, 9 aa, Homo Sapiens
NRLRYKRLL

SEQ ID NO: 195605 - protein, 9 aa, Homo Sapiens
KKADPPLLT

SEQ ID NO: 195606 - protein, 9 aa, Homo Sapiens
TSRGHTLNL

SEQ ID NO: 195607 - protein, 9 aa, Homo Sapiens
CQAHFAPLS

SEQ ID NO: 195608 - protein, 9 aa, Homo Sapiens
NLIRSTKEL

SEQ ID NO: 195609 - protein, 9 aa, Homo Sapiens
YLKDRQLTG

SEQ ID NO: 195610 - protein, 9 aa, Homo Sapiens
SRVQAQQKQ

SEQ ID NO: 195611 - protein, 9 aa, Homo Sapiens
SNYEQLRQV

SEQ ID NO: 195612 - protein, 9 aa, Homo Sapiens
EPTGIFLKK

SEQ ID NO: 195613 - protein, 9 aa, Homo Sapiens
QNHIKEILN

SEQ ID NO: 195614 - protein, 9 aa, Homo Sapiens
CDPVIERWP

SEQ ID NO: 195615 - protein, 9 aa, Homo Sapiens
EENVDFCIH

SEQ ID NO: 195616 - protein, 9 aa, Homo Sapiens
LLSSCVSAR

SEQ ID NO: 195617 - protein, 9 aa, Homo Sapiens
SSGSKSQSR

SEQ ID NO: 195618 - protein, 9 aa, Homo Sapiens
PSTVSSLQA

SEQ ID NO: 195619 - protein, 9 aa, Homo Sapiens
SAFLLCHQR

SEQ ID NO: 195620 - protein, 9 aa, Homo Sapiens
GEEEEEGGN

SEQ ID NO: 195621 - protein, 9 aa, Homo Sapiens
TCKDKTHNC

SEQ ID NO: 195622 - protein, 9 aa, Homo Sapiens
RALRKVLRK

SEQ ID NO: 195623 - protein, 9 aa, Homo Sapiens
GFWTFRTTT

SEQ ID NO: 195624 - protein, 9 aa, Homo Sapiens
VGDPAMVFL

SEQ ID NO: 195625 - protein, 9 aa, Homo Sapiens
NSWRQHREV

SEQ ID NO: 195626 - protein, 9 aa, Homo Sapiens
PDLPDIIYV

SEQ ID NO: 195627 - protein, 9 aa, Homo Sapiens
RASFPHWYF

SEQ ID NO: 195628 - protein, 9 aa, Homo Sapiens
AKPCALYIG

SEQ ID NO: 195629 - protein, 9 aa, Homo Sapiens
PHCFCPSPR

SEQ ID NO: 195630 - protein, 9 aa, Homo Sapiens
HLPAPPSPE

SEQ ID NO: 195631 - protein, 9 aa, Homo Sapiens
RLYYIDADG

SEQ ID NO: 195632 - protein, 9 aa, Homo Sapiens
KPPVLQAPA

SEQ ID NO: 195633 - protein, 9 aa, Homo Sapiens
LLGPILQSI

SEQ ID NO: 195634 - protein, 9 aa, Homo Sapiens
SHISRMLNY

SEQ ID NO: 195635 - protein, 9 aa, Homo Sapiens
IALVSVRAY

SEQ ID NO: 195636 - protein, 9 aa, Homo Sapiens
LWRQDGTGH

SEQ ID NO: 195637 - protein, 9 aa, Homo Sapiens
NIEEDFQDG

SEQ ID NO: 195638 - protein, 9 aa, Homo Sapiens
KDLVRRIKR

SEQ ID NO: 195639 - protein, 9 aa, Homo Sapiens
CHPLLYSLI

SEQ ID NO: 195640 - protein, 9 aa, Homo Sapiens
VSTNLEGCY

SEQ ID NO: 195641 - protein, 9 aa, Homo Sapiens
TVFNTMWTL

SEQ ID NO: 195642 - protein, 9 aa, Homo Sapiens
ERPSVGQRL

SEQ ID NO: 195643 - protein, 9 aa, Homo Sapiens
VCSSMPYDD

SEQ ID NO: 195644 - protein, 9 aa, Homo Sapiens
EWTNIEAEL

SEQ ID NO: 195645 - protein, 9 aa, Homo Sapiens
VNAQNWLGA

SEQ ID NO: 195646 - protein, 8 aa, Homo Sapiens
ETPAWPRV

SEQ ID NO: 195647 - protein, 9 aa, Homo Sapiens
TMVPGKDPM

SEQ ID NO: 195648 - protein, 9 aa, Homo Sapiens
ELAPLHTYG

SEQ ID NO: 195649 - protein, 9 aa, Homo Sapiens
FQTASQPSW

SEQ ID NO: 195650 - protein, 9 aa, Homo Sapiens
NSLYNKAKK

SEQ ID NO: 195651 - protein, 9 aa, Homo Sapiens
AITISALQA

SEQ ID NO: 195652 - protein, 9 aa, Homo Sapiens
VLTQLAPTL

SEQ ID NO: 195653 - protein, 9 aa, Homo Sapiens
SAGCVESGE

SEQ ID NO: 195654 - protein, 9 aa, Homo Sapiens
SDPGSLTPD

SEQ ID NO: 195655 - protein, 9 aa, Homo Sapiens
KIYKKKQFI

SEQ ID NO: 195656 - protein, 9 aa, Homo Sapiens
SHQATVSSV

SEQ ID NO: 195657 - protein, 9 aa, Homo Sapiens
ITDTCNRIK

SEQ ID NO: 195658 - protein, 9 aa, Homo Sapiens
KIHIEDDGS

SEQ ID NO: 195659 - protein, 9 aa, Homo Sapiens
RFVLHLALT

SEQ ID NO: 195660 - protein, 9 aa, Homo Sapiens
NAPSLGSYS

SEQ ID NO: 195661 - protein, 9 aa, Homo Sapiens
VVIEVNSWW

SEQ ID NO: 195662 - protein, 9 aa, Homo Sapiens
VTLPMSGQT

SEQ ID NO: 195663 - protein, 9 aa, Homo Sapiens
PGYKGPHCQ

SEQ ID NO: 195664 - protein, 9 aa, Homo Sapiens
REQKAARWQ

SEQ ID NO: 195665 - protein, 9 aa, Homo Sapiens
RPQQPPPRL

SEQ ID NO: 195666 - protein, 9 aa, Homo Sapiens
ERNEKKERI

SEQ ID NO: 195667 - protein, 9 aa, Homo Sapiens
GPACSALLP

SEQ ID NO: 195668 - protein, 9 aa, Homo Sapiens
ECWWYEKLI

SEQ ID NO: 195669 - protein, 9 aa, Homo Sapiens
EISGQGVSS

SEQ ID NO: 195670 - protein, 9 aa, Homo Sapiens
DPDQNSPQL

SEQ ID NO: 195671 - protein, 9 aa, Homo Sapiens
VSSQDTKTF

SEQ ID NO: 195672 - protein, 9 aa, Homo Sapiens
PEDHDTYTC

SEQ ID NO: 195673 - protein, 9 aa, Homo Sapiens
DPTGLSSPH

SEQ ID NO: 195674 - protein, 9 aa, Homo Sapiens
VVVNPGQTF

SEQ ID NO: 195675 - protein, 9 aa, Homo Sapiens
NIENVHVCS

SEQ ID NO: 195676 - protein, 9 aa, Homo Sapiens
EVPLRCTIH

SEQ ID NO: 195677 - protein, 9 aa, Homo Sapiens
VGSFCVCYM

SEQ ID NO: 195678 - protein, 9 aa, Homo Sapiens
IIPAQGENV

SEQ ID NO: 195679 - protein, 9 aa, Homo Sapiens
VACMRFQPS

SEQ ID NO: 195680 - protein, 9 aa, Homo Sapiens
DWYAAICNP

SEQ ID NO: 195681 - protein, 9 aa, Homo Sapiens
KRQFVPSYE

SEQ ID NO: 195682 - protein, 9 aa, Homo Sapiens
ILVGVISDR

SEQ ID NO: 195683 - protein, 9 aa, Homo Sapiens
KCVKAFSTH

SEQ ID NO: 195684 - protein, 9 aa, Homo Sapiens
SSDTAPSTT

SEQ ID NO: 195685 - protein, 9 aa, Homo Sapiens
SQHNEFSEV

SEQ ID NO: 195686 - protein, 9 aa, Homo Sapiens
CACRLVFFN

SEQ ID NO: 195687 - protein, 9 aa, Homo Sapiens
AAILGYCHG

SEQ ID NO: 195688 - protein, 9 aa, Homo Sapiens
ALAKACSTG

SEQ ID NO: 195689 - protein, 9 aa, Homo Sapiens
RGLVGKLSA

SEQ ID NO: 195690 - protein, 9 aa, Homo Sapiens
VLWSLVEYS

SEQ ID NO: 195691 - protein, 9 aa, Homo Sapiens
NELLMTPCY

SEQ ID NO: 195692 - protein, 9 aa, Homo Sapiens
VLFTTDLIR

SEQ ID NO: 195693 - protein, 9 aa, Homo Sapiens
TEGPHQEYS

SEQ ID NO: 195694 - protein, 9 aa, Homo Sapiens
LSAEALANP

SEQ ID NO: 195695 - protein, 9 aa, Homo Sapiens
HMENLVAYA

SEQ ID NO: 195696 - protein, 9 aa, Homo Sapiens
LVVDKGRIL

SEQ ID NO: 195697 - protein, 9 aa, Homo Sapiens
RWSYTSEDE

SEQ ID NO: 195698 - protein, 9 aa, Homo Sapiens
STHLMNGPI

SEQ ID NO: 195699 - protein, 9 aa, Homo Sapiens
HFHVELHFS

SEQ ID NO: 195700 - protein, 9 aa, Homo Sapiens
LSGLQRRKR

SEQ ID NO: 195701 - protein, 9 aa, Homo Sapiens
KRVVLLCDG

SEQ ID NO: 195702 - protein, 9 aa, Homo Sapiens
PPTPRLNAS

SEQ ID NO: 195703 - protein, 9 aa, Homo Sapiens
AYRDSIFRW

SEQ ID NO: 195704 - protein, 9 aa, Homo Sapiens
TGCIEGHTG

SEQ ID NO: 195705 - protein, 9 aa, Homo Sapiens
LCATSLDRY

SEQ ID NO: 195706 - protein, 9 aa, Homo Sapiens
PGGVGPMIV

SEQ ID NO: 195707 - protein, 9 aa, Homo Sapiens
PPAAADLDA

SEQ ID NO: 195708 - protein, 9 aa, Homo Sapiens
ALVFEQSVL

SEQ ID NO: 195709 - protein, 9 aa, Homo Sapiens
HWERSLQTL

SEQ ID NO: 195710 - protein, 9 aa, Homo Sapiens
GVEIAAVTH

SEQ ID NO: 195711 - protein, 9 aa, Homo Sapiens
PNRVHPYPA

SEQ ID NO: 195712 - protein, 9 aa, Homo Sapiens
STAMAQTVP

SEQ ID NO: 195713 - protein, 9 aa, Homo Sapiens
EHPERKRAS

SEQ ID NO: 195714 - protein, 9 aa, Homo Sapiens
AICMYRQSK

SEQ ID NO: 195715 - protein, 9 aa, Homo Sapiens
VRRAFCVWE

SEQ ID NO: 195716 - protein, 9 aa, Homo Sapiens
LSSVPTLLS

SEQ ID NO: 195717 - protein, 9 aa, Homo Sapiens
THANVGALG

SEQ ID NO: 195718 - protein, 9 aa, Homo Sapiens
TTMVPGKDP

SEQ ID NO: 195719 - protein, 9 aa, Homo Sapiens
GCGKSFSQT

SEQ ID NO: 195720 - protein, 9 aa, Homo Sapiens
SDTMDSQML

SEQ ID NO: 195721 - protein, 9 aa, Homo Sapiens
LPDSLQTTA

SEQ ID NO: 195722 - protein, 9 aa, Homo Sapiens
LAALRERLD

SEQ ID NO: 195723 - protein, 9 aa, Homo Sapiens
HMISAAMAC

SEQ ID NO: 195724 - protein, 9 aa, Homo Sapiens
VGFEVATCD

SEQ ID NO: 195725 - protein, 9 aa, Homo Sapiens
LCTDPYELG

SEQ ID NO: 195726 - protein, 9 aa, Homo Sapiens
GHVRSLSKR

SEQ ID NO: 195727 - protein, 9 aa, Homo Sapiens
HINPTGIVL

SEQ ID NO: 195728 - protein, 9 aa, Homo Sapiens
DQKRELEHR

SEQ ID NO: 195729 - protein, 9 aa, Homo Sapiens
HNSIPKHAI

SEQ ID NO: 195730 - protein, 9 aa, Homo Sapiens
VRRIKRLEY

SEQ ID NO: 195731 - protein, 9 aa, Homo Sapiens
DRWGSHYVD

SEQ ID NO: 195732 - protein, 9 aa, Homo Sapiens
WETPGRLEI

SEQ ID NO: 195733 - protein, 9 aa, Homo Sapiens
VGYTSKETH

SEQ ID NO: 195734 - protein, 9 aa, Homo Sapiens
SIPKHAIWV

SEQ ID NO: 195735 - protein, 9 aa, Homo Sapiens
LLGWLVPQQ

SEQ ID NO: 195736 - protein, 9 aa, Homo Sapiens
MKNGDVWTF

SEQ ID NO: 195737 - protein, 9 aa, Homo Sapiens
RFTIDLGSG

SEQ ID NO: 195738 - protein, 9 aa, Homo Sapiens
GILVGSFII

SEQ ID NO: 195739 - protein, 9 aa, Homo Sapiens
PGPAGARDS

SEQ ID NO: 195740 - protein, 9 aa, Homo Sapiens
EEDDEEEDL

SEQ ID NO: 195741 - protein, 9 aa, Homo Sapiens
KTRKRCSAS

SEQ ID NO: 195742 - protein, 9 aa, Homo Sapiens
IELQHVVKD

SEQ ID NO: 195743 - protein, 9 aa, Homo Sapiens
FCVWEQATP

SEQ ID NO: 195744 - protein, 9 aa, Homo Sapiens
EIDSVTSSD

SEQ ID NO: 195745 - protein, 9 aa, Homo Sapiens
CRARQDSLK

SEQ ID NO: 195746 - protein, 9 aa, Homo Sapiens
QNLKDLAAR

SEQ ID NO: 195747 - protein, 9 aa, Homo Sapiens
TADVIARKL

SEQ ID NO: 195748 - protein, 9 aa, Homo Sapiens
ASCHNTMGS

SEQ ID NO: 195749 - protein, 9 aa, Homo Sapiens
HDVAQLSRT

SEQ ID NO: 195750 - protein, 9 aa, Homo Sapiens
RPGGGHVKI

SEQ ID NO: 195751 - protein, 9 aa, Homo Sapiens
VHWQTHSGE

SEQ ID NO: 195752 - protein, 9 aa, Homo Sapiens
SISSDSGHS

SEQ ID NO: 195753 - protein, 9 aa, Homo Sapiens
ECCRRRRLG

SEQ ID NO: 195754 - protein, 9 aa, Homo Sapiens
LSDFEMPQS

SEQ ID NO: 195755 - protein, 9 aa, Homo Sapiens
VHKCKPQMN

SEQ ID NO: 195756 - protein, 9 aa, Homo Sapiens
KPYCCPHCP

SEQ ID NO: 195757 - protein, 9 aa, Homo Sapiens
ISDCSVQME

SEQ ID NO: 195758 - protein, 9 aa, Homo Sapiens
PQQQTFVVP

SEQ ID NO: 195759 - protein, 9 aa, Homo Sapiens
LPAMDSSRL

SEQ ID NO: 195760 - protein, 9 aa, Homo Sapiens
RGIQVVEHA

SEQ ID NO: 195761 - protein, 9 aa, Homo Sapiens
KHSDPSQPG

SEQ ID NO: 195762 - protein, 9 aa, Homo Sapiens
LELNGEDKL

SEQ ID NO: 195763 - protein, 9 aa, Homo Sapiens
TIQTSEGAS

SEQ ID NO: 195764 - protein, 9 aa, Homo Sapiens
KVRPPFTYA

SEQ ID NO: 195765 - protein, 9 aa, Homo Sapiens
EALYPQRWS

SEQ ID NO: 195766 - protein, 9 aa, Homo Sapiens
FCQCCIPDT

SEQ ID NO: 195767 - protein, 9 aa, Homo Sapiens
KGYSSFGCS

SEQ ID NO: 195768 - protein, 9 aa, Homo Sapiens
VFVDSVSEF

SEQ ID NO: 195769 - protein, 9 aa, Homo Sapiens
QYPWASCNQ

SEQ ID NO: 195770 - protein, 9 aa, Homo Sapiens
YKNRMYLTP

SEQ ID NO: 195771 - protein, 9 aa, Homo Sapiens
PPQHNHHHH

SEQ ID NO: 195772 - protein, 9 aa, Homo Sapiens
TFCQCCIPD

SEQ ID NO: 195773 - protein, 9 aa, Homo Sapiens
EWPTLPVCI

SEQ ID NO: 195774 - protein, 9 aa, Homo Sapiens
HPGLKYDFL

SEQ ID NO: 195775 - protein, 9 aa, Homo Sapiens
KIGAHNCDM

SEQ ID NO: 195776 - protein, 9 aa, Homo Sapiens
GPYGKCLSV

SEQ ID NO: 195777 - protein, 9 aa, Homo Sapiens
PQRLPAAGE

SEQ ID NO: 195778 - protein, 9 aa, Homo Sapiens
GLGKTMQTI

SEQ ID NO: 195779 - protein, 9 aa, Homo Sapiens
KYLRITWQQ

SEQ ID NO: 195780 - protein, 9 aa, Homo Sapiens
DRKQLQYLE

SEQ ID NO: 195781 - protein, 9 aa, Homo Sapiens
LGATTIYPA

SEQ ID NO: 195782 - protein, 9 aa, Homo Sapiens
SALSVTLPM

SEQ ID NO: 195783 - protein, 9 aa, Homo Sapiens
RARYQWVCC

SEQ ID NO: 195784 - protein, 9 aa, Homo Sapiens
AITLRKAGC

SEQ ID NO: 195785 - protein, 9 aa, Homo Sapiens
TNRLLQEEL

SEQ ID NO: 195786 - protein, 9 aa, Homo Sapiens
QRITESCQV

SEQ ID NO: 195787 - protein, 9 aa, Homo Sapiens
DILRIQDKP

SEQ ID NO: 195788 - protein, 9 aa, Homo Sapiens
LLGYSMSIP

SEQ ID NO: 195789 - protein, 9 aa, Homo Sapiens
KSVVEAERL

SEQ ID NO: 195790 - protein, 9 aa, Homo Sapiens
NQALVRFYC

SEQ ID NO: 195791 - protein, 9 aa, Homo Sapiens
YQRQDCMDA

SEQ ID NO: 195792 - protein, 9 aa, Homo Sapiens
PQVSPAHSP

SEQ ID NO: 195793 - protein, 9 aa, Homo Sapiens
PDQSNMRRM

SEQ ID NO: 195794 - protein, 9 aa, Homo Sapiens
ESCAPPYYL

SEQ ID NO: 195795 - protein, 9 aa, Homo Sapiens
ASPPQQAGW

SEQ ID NO: 195796 - protein, 9 aa, Homo Sapiens
QTHLKERED

SEQ ID NO: 195797 - protein, 9 aa, Homo Sapiens
NYPFMFANY

SEQ ID NO: 195798 - protein, 9 aa, Homo Sapiens
EQFCREGFL

SEQ ID NO: 195799 - protein, 9 aa, Homo Sapiens
FAVKIISKG

SEQ ID NO: 195800 - protein, 9 aa, Homo Sapiens
FVEGLHVFD

SEQ ID NO: 195801 - protein, 9 aa, Homo Sapiens
TYTYLCVLL

SEQ ID NO: 195802 - protein, 9 aa, Homo Sapiens
FIFFVMPLH

SEQ ID NO: 195803 - protein, 9 aa, Homo Sapiens
ATLGQSQMA

SEQ ID NO: 195804 - protein, 9 aa, Homo Sapiens
CVKGMKTKH

SEQ ID NO: 195805 - protein, 9 aa, Homo Sapiens
YPRYPNIHD

SEQ ID NO: 195806 - protein, 9 aa, Homo Sapiens
TIHILLWTF

SEQ ID NO: 195807 - protein, 9 aa, Homo Sapiens
RKHLIQLRR

SEQ ID NO: 195808 - protein, 9 aa, Homo Sapiens
DLAIELRRL

SEQ ID NO: 195809 - protein, 9 aa, Homo Sapiens
LYILAKSLS

SEQ ID NO: 195810 - protein, 9 aa, Homo Sapiens
KLPVAGDRG

SEQ ID NO: 195811 - protein, 9 aa, Homo Sapiens
FEYVHTDLR

SEQ ID NO: 195812 - protein, 9 aa, Homo Sapiens
APTSTAALE

SEQ ID NO: 195813 - protein, 9 aa, Homo Sapiens
NESAEVEEI

SEQ ID NO: 195814 - protein, 9 aa, Homo Sapiens
TFVGPDGEV

SEQ ID NO: 195815 - protein, 9 aa, Homo Sapiens
CVGIPPDEC

SEQ ID NO: 195816 - protein, 9 aa, Homo Sapiens
GGDPRRRRR

SEQ ID NO: 195817 - protein, 9 aa, Homo Sapiens
GIRGPGDCL

SEQ ID NO: 195818 - protein, 9 aa, Homo Sapiens
ALVSFYEDG

SEQ ID NO: 195819 - protein, 9 aa, Homo Sapiens
LNIYDCLQE

SEQ ID NO: 195820 - protein, 9 aa, Homo Sapiens
LSSSLPRGP

SEQ ID NO: 195821 - protein, 9 aa, Homo Sapiens
LEWIQQEEK

SEQ ID NO: 195822 - protein, 9 aa, Homo Sapiens
MYLCYYQPG

SEQ ID NO: 195823 - protein, 9 aa, Homo Sapiens
IEDYVQYLS

SEQ ID NO: 195824 - protein, 9 aa, Homo Sapiens
GKSIAIHAK

SEQ ID NO: 195825 - protein, 9 aa, Homo Sapiens
SSVIRTNFS

SEQ ID NO: 195826 - protein, 9 aa, Homo Sapiens
QDGRAQGVC

SEQ ID NO: 195827 - protein, 9 aa, Homo Sapiens
KFISGISSP

SEQ ID NO: 195828 - protein, 9 aa, Homo Sapiens
TEVVRHCPH

SEQ ID NO: 195829 - protein, 9 aa, Homo Sapiens
TLKKKIYKK

SEQ ID NO: 195830 - protein, 9 aa, Homo Sapiens
VVRLVLTVA

SEQ ID NO: 195831 - protein, 9 aa, Homo Sapiens
ELCVDVAGH

SEQ ID NO: 195832 - protein, 9 aa, Homo Sapiens
CIEDTSGKP

SEQ ID NO: 195833 - protein, 9 aa, Homo Sapiens
TGTQLCGPA

SEQ ID NO: 195834 - protein, 9 aa, Homo Sapiens
LVSDWSKVP

SEQ ID NO: 195835 - protein, 9 aa, Homo Sapiens
RLLGVDSAT

SEQ ID NO: 195836 - protein, 9 aa, Homo Sapiens
FIKRESLGW

SEQ ID NO: 195837 - protein, 9 aa, Homo Sapiens
IIVNIERRW

SEQ ID NO: 195838 - protein, 9 aa, Homo Sapiens
STNTMTIRA

SEQ ID NO: 195839 - protein, 9 aa, Homo Sapiens
GDLVFLQMP

SEQ ID NO: 195840 - protein, 9 aa, Homo Sapiens
VRTLLECGM

SEQ ID NO: 195841 - protein, 9 aa, Homo Sapiens
LLMDDFKLV

SEQ ID NO: 195842 - protein, 9 aa, Homo Sapiens
SRATGLFSS

SEQ ID NO: 195843 - protein, 9 aa, Homo Sapiens
IDIHACNHV

SEQ ID NO: 195844 - protein, 9 aa, Homo Sapiens
RLRVVSPFL

SEQ ID NO: 195845 - protein, 9 aa, Homo Sapiens
QKKGTVVYG

SEQ ID NO: 195846 - protein, 9 aa, Homo Sapiens
KTYCYHKYK

SEQ ID NO: 195847 - protein, 9 aa, Homo Sapiens
QPLHQHQLQ

SEQ ID NO: 195848 - protein, 9 aa, Homo Sapiens
LSGQTKPED

SEQ ID NO: 195849 - protein, 9 aa, Homo Sapiens
EHTMEVRTQ

SEQ ID NO: 195850 - protein, 9 aa, Homo Sapiens
GRPSKYDVQ

SEQ ID NO: 195851 - protein, 9 aa, Homo Sapiens
PYISDCCHR

SEQ ID NO: 195852 - protein, 9 aa, Homo Sapiens
LGKVRPCSV

SEQ ID NO: 195853 - protein, 9 aa, Homo Sapiens
VLYWCAHNM

SEQ ID NO: 195854 - protein, 9 aa, Homo Sapiens
PANAPLQCI

SEQ ID NO: 195855 - protein, 9 aa, Homo Sapiens
LALKHKTPK

SEQ ID NO: 195856 - protein, 9 aa, Homo Sapiens
SNTCCSTKI

SEQ ID NO: 195857 - protein, 9 aa, Homo Sapiens
TGLHHSLSH

SEQ ID NO: 195858 - protein, 9 aa, Homo Sapiens
ARASGEKVM

SEQ ID NO: 195859 - protein, 9 aa, Homo Sapiens
TVCSNQMPS

SEQ ID NO: 195860 - protein, 9 aa, Homo Sapiens
PTTTPDTMV

SEQ ID NO: 195861 - protein, 9 aa, Homo Sapiens
LECGMRPGH

SEQ ID NO: 195862 - protein, 9 aa, Homo Sapiens
NDMDFHSFP

SEQ ID NO: 195863 - protein, 9 aa, Homo Sapiens
QQMYSEIIA

SEQ ID NO: 195864 - protein, 9 aa, Homo Sapiens
LRAFHVLRP

SEQ ID NO: 195865 - protein, 9 aa, Homo Sapiens
LDSTRGRYA

SEQ ID NO: 195866 - protein, 9 aa, Homo Sapiens
DPMIVYVGD

SEQ ID NO: 195867 - protein, 9 aa, Homo Sapiens
VYETVQHPL

SEQ ID NO: 195868 - protein, 9 aa, Homo Sapiens
PTVVGEELV

SEQ ID NO: 195869 - protein, 9 aa, Homo Sapiens
CSEHGKAFH

SEQ ID NO: 195870 - protein, 9 aa, Homo Sapiens
LILTPSRSQ

SEQ ID NO: 195871 - protein, 9 aa, Homo Sapiens
YCKYTVHEC

SEQ ID NO: 195872 - protein, 9 aa, Homo Sapiens
TTLDSDVYM

SEQ ID NO: 195873 - protein, 9 aa, Homo Sapiens
LCTVPKVEV

SEQ ID NO: 195874 - protein, 9 aa, Homo Sapiens
SLKDQQTFT

SEQ ID NO: 195875 - protein, 9 aa, Homo Sapiens
EDVVLQWSQ

SEQ ID NO: 195876 - protein, 9 aa, Homo Sapiens
CSASSGSSS

SEQ ID NO: 195877 - protein, 9 aa, Homo Sapiens
EVRGNWQCW

SEQ ID NO: 195878 - protein, 9 aa, Homo Sapiens
GRIRSRSSS

SEQ ID NO: 195879 - protein, 9 aa, Homo Sapiens
FDDRQGVLR

SEQ ID NO: 195880 - protein, 9 aa, Homo Sapiens
CDECTLGAT

SEQ ID NO: 195881 - protein, 9 aa, Homo Sapiens
RRTEPPDGD

SEQ ID NO: 195882 - protein, 9 aa, Homo Sapiens
LRHFGCPVS

SEQ ID NO: 195883 - protein, 9 aa, Homo Sapiens
ASLALTGDV

SEQ ID NO: 195884 - protein, 9 aa, Homo Sapiens
DELPVMGLT

SEQ ID NO: 195885 - protein, 9 aa, Homo Sapiens
KWSRHCRML

SEQ ID NO: 195886 - protein, 9 aa, Homo Sapiens
LPDIVGQLK

SEQ ID NO: 195887 - protein, 9 aa, Homo Sapiens
GRCLHTLPG

SEQ ID NO: 195888 - protein, 9 aa, Homo Sapiens
KQFEESRGQ

SEQ ID NO: 195889 - protein, 9 aa, Homo Sapiens
LNICPLLRL

SEQ ID NO: 195890 - protein, 9 aa, Homo Sapiens
GAASAGVLI

SEQ ID NO: 195891 - protein, 9 aa, Homo Sapiens
IAQAQKKGT

SEQ ID NO: 195892 - protein, 9 aa, Homo Sapiens
TGIFYMCAY

SEQ ID NO: 195893 - protein, 9 aa, Homo Sapiens
ELNLIASDL

SEQ ID NO: 195894 - protein, 9 aa, Homo Sapiens
SQIALEYSQ

SEQ ID NO: 195895 - protein, 9 aa, Homo Sapiens
DPKEYDPFI

SEQ ID NO: 195896 - protein, 9 aa, Homo Sapiens
HRLQAFDCP

SEQ ID NO: 195897 - protein, 9 aa, Homo Sapiens
LGLPSMGYT

SEQ ID NO: 195898 - protein, 9 aa, Homo Sapiens
HVLGYLVVM

SEQ ID NO: 195899 - protein, 9 aa, Homo Sapiens
SSGPARGIT

SEQ ID NO: 195900 - protein, 9 aa, Homo Sapiens
PIPFTHLPI

SEQ ID NO: 195901 - protein, 9 aa, Homo Sapiens
DLDAFVWFE

SEQ ID NO: 195902 - protein, 9 aa, Homo Sapiens
SGVAKIHIE

SEQ ID NO: 195903 - protein, 9 aa, Homo Sapiens
EDDEEEDLE

SEQ ID NO: 195904 - protein, 9 aa, Homo Sapiens
GGQSRTIRQ

SEQ ID NO: 195905 - protein, 9 aa, Homo Sapiens
QYCSTVADI

SEQ ID NO: 195906 - protein, 9 aa, Homo Sapiens
VTSSDTAPS

SEQ ID NO: 195907 - protein, 9 aa, Homo Sapiens
RVQDDDDRL

SEQ ID NO: 195908 - protein, 9 aa, Homo Sapiens
HIYFRKEFF

SEQ ID NO: 195909 - protein, 9 aa, Homo Sapiens
KGVQCQCWS

SEQ ID NO: 195910 - protein, 9 aa, Homo Sapiens
VVQTMPPHD

SEQ ID NO: 195911 - protein, 9 aa, Homo Sapiens
LTLPHVLSE

SEQ ID NO: 195912 - protein, 9 aa, Homo Sapiens
TAQQQQALA

SEQ ID NO: 195913 - protein, 9 aa, Homo Sapiens
SPSCSLYPP

SEQ ID NO: 195914 - protein, 9 aa, Homo Sapiens
HMDRPLSVR

SEQ ID NO: 195915 - protein, 9 aa, Homo Sapiens
CEVMVQSPT

SEQ ID NO: 195916 - protein, 9 aa, Homo Sapiens
MTLTPRGNS

SEQ ID NO: 195917 - protein, 9 aa, Homo Sapiens
EHFHVELHF

SEQ ID NO: 195918 - protein, 9 aa, Homo Sapiens
EGELDRRSM

SEQ ID NO: 195919 - protein, 9 aa, Homo Sapiens
ILWMIMASA

SEQ ID NO: 195920 - protein, 9 aa, Homo Sapiens
TSPFQVLVK

SEQ ID NO: 195921 - protein, 9 aa, Homo Sapiens
SHILASFET

SEQ ID NO: 195922 - protein, 9 aa, Homo Sapiens
LQSAKKRAS

SEQ ID NO: 195923 - protein, 9 aa, Homo Sapiens
TLLECGMRP

SEQ ID NO: 195924 - protein, 9 aa, Homo Sapiens
PSPSRKPSK

SEQ ID NO: 195925 - protein, 9 aa, Homo Sapiens
HDHFGLFPA

SEQ ID NO: 195926 - protein, 9 aa, Homo Sapiens
YEQRLLWKV

SEQ ID NO: 195927 - protein, 9 aa, Homo Sapiens
CSNTCCSTK

SEQ ID NO: 195928 - protein, 9 aa, Homo Sapiens
RSRLSLSWA

SEQ ID NO: 195929 - protein, 9 aa, Homo Sapiens
ATTTPGPQQ

SEQ ID NO: 195930 - protein, 9 aa, Homo Sapiens
FAKEREWVE

SEQ ID NO: 195931 - protein, 9 aa, Homo Sapiens
ATSLDRYVA

SEQ ID NO: 195932 - protein, 9 aa, Homo Sapiens
AQNLKDLAA

SEQ ID NO: 195933 - protein, 9 aa, Homo Sapiens
NLRLRKGSA

SEQ ID NO: 195934 - protein, 9 aa, Homo Sapiens
KIRKALLSS

SEQ ID NO: 195935 - protein, 9 aa, Homo Sapiens
TGDKLYKPK

SEQ ID NO: 195936 - protein, 9 aa, Homo Sapiens
LECLDNFKG

SEQ ID NO: 195937 - protein, 9 aa, Homo Sapiens
KHLRGGGSP

SEQ ID NO: 195938 - protein, 9 aa, Homo Sapiens
ANLRASQCE

SEQ ID NO: 195939 - protein, 9 aa, Homo Sapiens
GSPSRSAAC

SEQ ID NO: 195940 - protein, 9 aa, Homo Sapiens
CLMASADLQ

SEQ ID NO: 195941 - protein, 9 aa, Homo Sapiens
LACILVGVS

SEQ ID NO: 195942 - protein, 9 aa, Homo Sapiens
PSPCTSTNC

SEQ ID NO: 195943 - protein, 9 aa, Homo Sapiens
CEIAEDIVS

SEQ ID NO: 195944 - protein, 9 aa, Homo Sapiens
GGAKPPWPA

SEQ ID NO: 195945 - protein, 9 aa, Homo Sapiens
RRLLAFVEA

SEQ ID NO: 195946 - protein, 9 aa, Homo Sapiens
LIWNDGKIL

SEQ ID NO: 195947 - protein, 9 aa, Homo Sapiens
YTQLVSLGN

SEQ ID NO: 195948 - protein, 9 aa, Homo Sapiens
PCLAERGLM

SEQ ID NO: 195949 - protein, 9 aa, Homo Sapiens
AKWRKRECN

SEQ ID NO: 195950 - protein, 9 aa, Homo Sapiens
VPATLHRSR

SEQ ID NO: 195951 - protein, 9 aa, Homo Sapiens
WWPSALGSW

SEQ ID NO: 195952 - protein, 9 aa, Homo Sapiens
YMPYAAFAM

SEQ ID NO: 195953 - protein, 9 aa, Homo Sapiens
TVLGDDKFH

SEQ ID NO: 195954 - protein, 9 aa, Homo Sapiens
LANLDVFIK

SEQ ID NO: 195955 - protein, 9 aa, Homo Sapiens
YVEQVTNQM

SEQ ID NO: 195956 - protein, 9 aa, Homo Sapiens
TEHYKCSEH

SEQ ID NO: 195957 - protein, 9 aa, Homo Sapiens
SSMNPIIYA

SEQ ID NO: 195958 - protein, 9 aa, Homo Sapiens
DGSQGSWEL

SEQ ID NO: 195959 - protein, 9 aa, Homo Sapiens
LQPHLDVVM

SEQ ID NO: 195960 - protein, 9 aa, Homo Sapiens
TPDTMVQPF

SEQ ID NO: 195961 - protein, 9 aa, Homo Sapiens
SPDDIMGTI

SEQ ID NO: 195962 - protein, 9 aa, Homo Sapiens
LYSVFEEHE

SEQ ID NO: 195963 - protein, 9 aa, Homo Sapiens
WIKWAQGGD

SEQ ID NO: 195964 - protein, 9 aa, Homo Sapiens
EGSVKTPAP

SEQ ID NO: 195965 - protein, 9 aa, Homo Sapiens
IDHQKRLSY

SEQ ID NO: 195966 - protein, 9 aa, Homo Sapiens
TPSLARRPP

SEQ ID NO: 195967 - protein, 9 aa, Homo Sapiens
TGVIDPQDL

SEQ ID NO: 195968 - protein, 9 aa, Homo Sapiens
SYSMHTLYG

SEQ ID NO: 195969 - protein, 9 aa, Homo Sapiens
KMVLWSLVE

SEQ ID NO: 195970 - protein, 9 aa, Homo Sapiens
ELADTELEN

SEQ ID NO: 195971 - protein, 9 aa, Homo Sapiens
NPNPCQKTK

SEQ ID NO: 195972 - protein, 9 aa, Homo Sapiens
HKHQPRVHV

SEQ ID NO: 195973 - protein, 9 aa, Homo Sapiens
KWRKRECNQ

SEQ ID NO: 195974 - protein, 9 aa, Homo Sapiens
YEEGEQARW

SEQ ID NO: 195975 - protein, 9 aa, Homo Sapiens
RRLDYGGGY

SEQ ID NO: 195976 - protein, 9 aa, Homo Sapiens
LPPTPASHQ

SEQ ID NO: 195977 - protein, 9 aa, Homo Sapiens
EVFVDQIDP

SEQ ID NO: 195978 - protein, 9 aa, Homo Sapiens
NAQHALRLA

SEQ ID NO: 195979 - protein, 9 aa, Homo Sapiens
PGESRKSTF

SEQ ID NO: 195980 - protein, 9 aa, Homo Sapiens
PRKRSWSTC

SEQ ID NO: 195981 - protein, 9 aa, Homo Sapiens
PAFTDAICM

SEQ ID NO: 195982 - protein, 9 aa, Homo Sapiens
KPANMEEQT

SEQ ID NO: 195983 - protein, 9 aa, Homo Sapiens
LPLSDLPLA

SEQ ID NO: 195984 - protein, 9 aa, Homo Sapiens
AVASVIYSV

SEQ ID NO: 195985 - protein, 9 aa, Homo Sapiens
PVLGLSAVV

SEQ ID NO: 195986 - protein, 9 aa, Homo Sapiens
MGFKGDIRT

SEQ ID NO: 195987 - protein, 9 aa, Homo Sapiens
ETDDCNAAN

SEQ ID NO: 195988 - protein, 9 aa, Homo Sapiens
QWLFGGSSD

SEQ ID NO: 195989 - protein, 9 aa, Homo Sapiens
ALALSQGDG

SEQ ID NO: 195990 - protein, 9 aa, Homo Sapiens
SQAMTVRVC

SEQ ID NO: 195991 - protein, 9 aa, Homo Sapiens
RECMHHMGS

SEQ ID NO: 195992 - protein, 9 aa, Homo Sapiens
NQAAGAPPR

SEQ ID NO: 195993 - protein, 9 aa, Homo Sapiens
ERDKTQFLS

SEQ ID NO: 195994 - protein, 9 aa, Homo Sapiens
RYPHSTLSL

SEQ ID NO: 195995 - protein, 9 aa, Homo Sapiens
WSQKRALER

SEQ ID NO: 195996 - protein, 9 aa, Homo Sapiens
MVLFAWMQF

SEQ ID NO: 195997 - protein, 9 aa, Homo Sapiens
LLAVTLVGV

SEQ ID NO: 195998 - protein, 9 aa, Homo Sapiens
FAGFLPWII

SEQ ID NO: 195999 - protein, 9 aa, Homo Sapiens
DHSYMRMLM

SEQ ID NO: 196000 - protein, 9 aa, Homo Sapiens
KAIQGSLWP

SEQ ID NO: 196001 - protein, 9 aa, Homo Sapiens
PAGPACSAL

SEQ ID NO: 196002 - protein, 9 aa, Homo Sapiens
GGFHPGTPS

SEQ ID NO: 196003 - protein, 9 aa, Homo Sapiens
VPVPQPPME

SEQ ID NO: 196004 - protein, 9 aa, Homo Sapiens
WIQQLAFVY

SEQ ID NO: 196005 - protein, 9 aa, Homo Sapiens
IQDFIFFVM

SEQ ID NO: 196006 - protein, 9 aa, Homo Sapiens
DVVLQWSQE

SEQ ID NO: 196007 - protein, 9 aa, Homo Sapiens
CAHIGDPSV

SEQ ID NO: 196008 - protein, 9 aa, Homo Sapiens
EVLSTRGEP

SEQ ID NO: 196009 - protein, 9 aa, Homo Sapiens
ALQMAIRLL

SEQ ID NO: 196010 - protein, 9 aa, Homo Sapiens
TGQGPQILM

SEQ ID NO: 196011 - protein, 9 aa, Homo Sapiens
GGRLYVADG

SEQ ID NO: 196012 - protein, 9 aa, Homo Sapiens
EERQCLVTI

SEQ ID NO: 196013 - protein, 9 aa, Homo Sapiens
GGQVVDCSH

SEQ ID NO: 196014 - protein, 9 aa, Homo Sapiens
WASSLLPES

SEQ ID NO: 196015 - protein, 9 aa, Homo Sapiens
TDAICMYRQ

SEQ ID NO: 196016 - protein, 9 aa, Homo Sapiens
VCCNPDSNS

SEQ ID NO: 196017 - protein, 9 aa, Homo Sapiens
AYFEAYMHV

SEQ ID NO: 196018 - protein, 9 aa, Homo Sapiens
SLDHLTDQK

SEQ ID NO: 196019 - protein, 9 aa, Homo Sapiens
GEAKTDPTG

SEQ ID NO: 196020 - protein, 9 aa, Homo Sapiens
VVPLTTFAV

SEQ ID NO: 196021 - protein, 9 aa, Homo Sapiens
HQIVHMEGK

SEQ ID NO: 196022 - protein, 9 aa, Homo Sapiens
CRLGRQRNQ

SEQ ID NO: 196023 - protein, 9 aa, Homo Sapiens
PGFKGDIGM

SEQ ID NO: 196024 - protein, 9 aa, Homo Sapiens
SQFLVSASS

SEQ ID NO: 196025 - protein, 9 aa, Homo Sapiens
HLARVSCHI

SEQ ID NO: 196026 - protein, 9 aa, Homo Sapiens
SQMLASDTM

SEQ ID NO: 196027 - protein, 9 aa, Homo Sapiens
FFRQTIRLK

SEQ ID NO: 196028 - protein, 9 aa, Homo Sapiens
IVTIKTKRT

SEQ ID NO: 196029 - protein, 9 aa, Homo Sapiens
GCFDEFNCI

SEQ ID NO: 196030 - protein, 9 aa, Homo Sapiens
IAGKAMEQG

SEQ ID NO: 196031 - protein, 9 aa, Homo Sapiens
FRHGQSLAL

SEQ ID NO: 196032 - protein, 9 aa, Homo Sapiens
KDSRFPPTL

SEQ ID NO: 196033 - protein, 9 aa, Homo Sapiens
RAPPGTFVC

SEQ ID NO: 196034 - protein, 9 aa, Homo Sapiens
RVVRTLQNM

SEQ ID NO: 196035 - protein, 9 aa, Homo Sapiens
RAFHVLRPL

SEQ ID NO: 196036 - protein, 9 aa, Homo Sapiens
PELGGSDQE

SEQ ID NO: 196037 - protein, 9 aa, Homo Sapiens
PYTCSDCKS

SEQ ID NO: 196038 - protein, 9 aa, Homo Sapiens
FLLTTNYPF

SEQ ID NO: 196039 - protein, 9 aa, Homo Sapiens
SGQLDESIQ

SEQ ID NO: 196040 - protein, 9 aa, Homo Sapiens
NYSKDILNP

SEQ ID NO: 196041 - protein, 9 aa, Homo Sapiens
VRTLQNMPS

SEQ ID NO: 196042 - protein, 9 aa, Homo Sapiens
LLSCDPAAP

SEQ ID NO: 196043 - protein, 9 aa, Homo Sapiens
ANAQDRREL

SEQ ID NO: 196044 - protein, 9 aa, Homo Sapiens
KGMMRDEKK

SEQ ID NO: 196045 - protein, 9 aa, Homo Sapiens
HSMHKHQPR

SEQ ID NO: 196046 - protein, 9 aa, Homo Sapiens
MPASEPPFI

SEQ ID NO: 196047 - protein, 9 aa, Homo Sapiens
LHPILGHFV

SEQ ID NO: 196048 - protein, 9 aa, Homo Sapiens
AAPRDIGYV

SEQ ID NO: 196049 - protein, 9 aa, Homo Sapiens
TKPSMTQKE

SEQ ID NO: 196050 - protein, 9 aa, Homo Sapiens
GSAAEQHEK

SEQ ID NO: 196051 - protein, 9 aa, Homo Sapiens
RETKRAPAA

SEQ ID NO: 196052 - protein, 9 aa, Homo Sapiens
LTILWMIMA

SEQ ID NO: 196053 - protein, 9 aa, Homo Sapiens
FVTSYKMCL

SEQ ID NO: 196054 - protein, 9 aa, Homo Sapiens
TLIDYTLEF

SEQ ID NO: 196055 - protein, 9 aa, Homo Sapiens
PLATATPPC

SEQ ID NO: 196056 - protein, 9 aa, Homo Sapiens
VRAPPGTFV

SEQ ID NO: 196057 - protein, 9 aa, Homo Sapiens
ERRKEQRLP

SEQ ID NO: 196058 - protein, 9 aa, Homo Sapiens
QPSTAPQRV

SEQ ID NO: 196059 - protein, 9 aa, Homo Sapiens
WDSLPQLPK

SEQ ID NO: 196060 - protein, 9 aa, Homo Sapiens
LGLGLHPIL

SEQ ID NO: 196061 - protein, 9 aa, Homo Sapiens
FMDMDNFLL

SEQ ID NO: 196062 - protein, 9 aa, Homo Sapiens
LMLDDQHLL

SEQ ID NO: 196063 - protein, 9 aa, Homo Sapiens
VSCKHNMRG

SEQ ID NO: 196064 - protein, 9 aa, Homo Sapiens
VLQMLKDLA

SEQ ID NO: 196065 - protein, 9 aa, Homo Sapiens
RKRQFQLRR

SEQ ID NO: 196066 - protein, 9 aa, Homo Sapiens
PCTSTNCST

SEQ ID NO: 196067 - protein, 9 aa, Homo Sapiens
TSNAMPSQG

SEQ ID NO: 196068 - protein, 9 aa, Homo Sapiens
EETEGLTYQ

SEQ ID NO: 196069 - protein, 9 aa, Homo Sapiens
GLIRRDGIQ

SEQ ID NO: 196070 - protein, 9 aa, Homo Sapiens
LETLKAVFA

SEQ ID NO: 196071 - protein, 9 aa, Homo Sapiens
ELAALARGV

SEQ ID NO: 196072 - protein, 9 aa, Homo Sapiens
WRGQRKALW

SEQ ID NO: 196073 - protein, 9 aa, Homo Sapiens
LTAALSNYE

SEQ ID NO: 196074 - protein, 9 aa, Homo Sapiens
KVTWVNAHT

SEQ ID NO: 196075 - protein, 9 aa, Homo Sapiens
SGSLHTCKL

SEQ ID NO: 196076 - protein, 9 aa, Homo Sapiens
HIHTEGLFQ

SEQ ID NO: 196077 - protein, 9 aa, Homo Sapiens
LSKKDKECQ

SEQ ID NO: 196078 - protein, 9 aa, Homo Sapiens
SVDKRSGAQ

SEQ ID NO: 196079 - protein, 9 aa, Homo Sapiens
EGSTTSGGS

SEQ ID NO: 196080 - protein, 9 aa, Homo Sapiens
MTGPGFTSP

SEQ ID NO: 196081 - protein, 9 aa, Homo Sapiens
HEKAWVCCI

SEQ ID NO: 196082 - protein, 9 aa, Homo Sapiens
GAASSPAVL

SEQ ID NO: 196083 - protein, 9 aa, Homo Sapiens
EFCQKMAFP

SEQ ID NO: 196084 - protein, 9 aa, Homo Sapiens
LLIHPYLGD

SEQ ID NO: 196085 - protein, 9 aa, Homo Sapiens
SWPVHFQQP

SEQ ID NO: 196086 - protein, 9 aa, Homo Sapiens
PLSERLEVN

SEQ ID NO: 196087 - protein, 9 aa, Homo Sapiens
RVAFVSGPG

SEQ ID NO: 196088 - protein, 9 aa, Homo Sapiens
CALAFTQMP

SEQ ID NO: 196089 - protein, 9 aa, Homo Sapiens
YAHAEHVQS

SEQ ID NO: 196090 - protein, 9 aa, Homo Sapiens
CTSTNCSTP

SEQ ID NO: 196091 - protein, 9 aa, Homo Sapiens
VWWEKNEMN

SEQ ID NO: 196092 - protein, 9 aa, Homo Sapiens
NNIHFTNGY

SEQ ID NO: 196093 - protein, 9 aa, Homo Sapiens
SLVLKALFL

SEQ ID NO: 196094 - protein, 9 aa, Homo Sapiens
HESSSEDCL

SEQ ID NO: 196095 - protein, 9 aa, Homo Sapiens
MANHPLLHL

SEQ ID NO: 196096 - protein, 9 aa, Homo Sapiens
GSGVAKIHI

SEQ ID NO: 196097 - protein, 9 aa, Homo Sapiens
ALYEALKKR

SEQ ID NO: 196098 - protein, 9 aa, Homo Sapiens
TQEIIPHQV

SEQ ID NO: 196099 - protein, 9 aa, Homo Sapiens
WSLQSEAHQ

SEQ ID NO: 196100 - protein, 9 aa, Homo Sapiens
FRTRDKFEE

SEQ ID NO: 196101 - protein, 9 aa, Homo Sapiens
KAVYEAVLQ

SEQ ID NO: 196102 - protein, 9 aa, Homo Sapiens
HGEAVYSRD

SEQ ID NO: 196103 - protein, 9 aa, Homo Sapiens
IGYDFWRPL

SEQ ID NO: 196104 - protein, 9 aa, Homo Sapiens
FFVLVNLEV

SEQ ID NO: 196105 - protein, 9 aa, Homo Sapiens
QVYYQQIGR

SEQ ID NO: 196106 - protein, 9 aa, Homo Sapiens
IQTLDHPIK

SEQ ID NO: 196107 - protein, 9 aa, Homo Sapiens
SGSIHYSSV

SEQ ID NO: 196108 - protein, 9 aa, Homo Sapiens
LLKDKNFAK

SEQ ID NO: 196109 - protein, 9 aa, Homo Sapiens
SKKKTQIAN

SEQ ID NO: 196110 - protein, 9 aa, Homo Sapiens
VQEPALAFW

SEQ ID NO: 196111 - protein, 9 aa, Homo Sapiens
QLIIVNIER

SEQ ID NO: 196112 - protein, 9 aa, Homo Sapiens
MVLWSLVEY

SEQ ID NO: 196113 - protein, 9 aa, Homo Sapiens
MAADSAHSF

SEQ ID NO: 196114 - protein, 9 aa, Homo Sapiens
GEVQRRCRQ

SEQ ID NO: 196115 - protein, 9 aa, Homo Sapiens
GVWSPWMPC

SEQ ID NO: 196116 - protein, 9 aa, Homo Sapiens
AGSDPGSLT

SEQ ID NO: 196117 - protein, 9 aa, Homo Sapiens
SPVLGLSAV

SEQ ID NO: 196118 - protein, 9 aa, Homo Sapiens
PAAPTRHGS

SEQ ID NO: 196119 - protein, 9 aa, Homo Sapiens
CRLQEAEKQ

SEQ ID NO: 196120 - protein, 9 aa, Homo Sapiens
QHLAKWRRS

SEQ ID NO: 196121 - protein, 9 aa, Homo Sapiens
QLQAQIWNL

SEQ ID NO: 196122 - protein, 9 aa, Homo Sapiens
EYHSHARES

SEQ ID NO: 196123 - protein, 9 aa, Homo Sapiens
GKCEHENLR

SEQ ID NO: 196124 - protein, 9 aa, Homo Sapiens
MTKQDQISA

SEQ ID NO: 196125 - protein, 9 aa, Homo Sapiens
HALAEMSKG

SEQ ID NO: 196126 - protein, 9 aa, Homo Sapiens
HVSSVPHAY

SEQ ID NO: 196127 - protein, 9 aa, Homo Sapiens
IDMVEKTNK

SEQ ID NO: 196128 - protein, 9 aa, Homo Sapiens
QRHHSRETP

SEQ ID NO: 196129 - protein, 9 aa, Homo Sapiens
VTNQMLSFS

SEQ ID NO: 196130 - protein, 9 aa, Homo Sapiens
PIFTILLSS

SEQ ID NO: 196131 - protein, 9 aa, Homo Sapiens
LLPLANVTL

SEQ ID NO: 196132 - protein, 9 aa, Homo Sapiens
NREVRQTGG

SEQ ID NO: 196133 - protein, 9 aa, Homo Sapiens
LQRGWGLQT

SEQ ID NO: 196134 - protein, 9 aa, Homo Sapiens
CDDLDHFIP

SEQ ID NO: 196135 - protein, 9 aa, Homo Sapiens
VGRQKEKNV

SEQ ID NO: 196136 - protein, 9 aa, Homo Sapiens
SPPPIMTDG

SEQ ID NO: 196137 - protein, 9 aa, Homo Sapiens
IGHVHLAQI

SEQ ID NO: 196138 - protein, 9 aa, Homo Sapiens
GGSPVNTRY

SEQ ID NO: 196139 - protein, 9 aa, Homo Sapiens
IHTPQLCTR

SEQ ID NO: 196140 - protein, 9 aa, Homo Sapiens
FQVSAHDAG

SEQ ID NO: 196141 - protein, 9 aa, Homo Sapiens
RQHREVAAY

SEQ ID NO: 196142 - protein, 9 aa, Homo Sapiens
KRECNQQLD

SEQ ID NO: 196143 - protein, 9 aa, Homo Sapiens
PHIPCTPQL

SEQ ID NO: 196144 - protein, 9 aa, Homo Sapiens
PGRECLWPG

SEQ ID NO: 196145 - protein, 9 aa, Homo Sapiens
PHPTRHRHL

SEQ ID NO: 196146 - protein, 9 aa, Homo Sapiens
PHLGICLDY

SEQ ID NO: 196147 - protein, 9 aa, Homo Sapiens
ATAMALGSF

SEQ ID NO: 196148 - protein, 9 aa, Homo Sapiens
AGWRLSSGS

SEQ ID NO: 196149 - protein, 9 aa, Homo Sapiens
FCPESPHYL

SEQ ID NO: 196150 - protein, 9 aa, Homo Sapiens
RRDGIQIRL

SEQ ID NO: 196151 - protein, 9 aa, Homo Sapiens
GIPPDECFG

SEQ ID NO: 196152 - protein, 9 aa, Homo Sapiens
TTAYTKEDV

SEQ ID NO: 196153 - protein, 9 aa, Homo Sapiens
EMRETNRLL

SEQ ID NO: 196154 - protein, 9 aa, Homo Sapiens
GLMLPGAGA

SEQ ID NO: 196155 - protein, 9 aa, Homo Sapiens
VLSDPKLKE

SEQ ID NO: 196156 - protein, 9 aa, Homo Sapiens
GRNIGSHRM

SEQ ID NO: 196157 - protein, 9 aa, Homo Sapiens
DVQERTTLC

SEQ ID NO: 196158 - protein, 9 aa, Homo Sapiens
LIRSTKELN

SEQ ID NO: 196159 - protein, 9 aa, Homo Sapiens
LNREVRQTG

SEQ ID NO: 196160 - protein, 9 aa, Homo Sapiens
NYVRNSRTI

SEQ ID NO: 196161 - protein, 9 aa, Homo Sapiens
PMCPPGGIQ

SEQ ID NO: 196162 - protein, 9 aa, Homo Sapiens
IPREMTYQF

SEQ ID NO: 196163 - protein, 9 aa, Homo Sapiens
AQRSISKYR

SEQ ID NO: 196164 - protein, 9 aa, Homo Sapiens
RGCTLRSTD

SEQ ID NO: 196165 - protein, 9 aa, Homo Sapiens
PKESPHPTR

SEQ ID NO: 196166 - protein, 9 aa, Homo Sapiens
EPQVNNRNA

SEQ ID NO: 196167 - protein, 9 aa, Homo Sapiens
ALQFLIKVV

SEQ ID NO: 196168 - protein, 9 aa, Homo Sapiens
ERRDRRPGP

SEQ ID NO: 196169 - protein, 9 aa, Homo Sapiens
DINDSTPKF

SEQ ID NO: 196170 - protein, 9 aa, Homo Sapiens
EMQVDGARA

SEQ ID NO: 196171 - protein, 9 aa, Homo Sapiens
YRLRLLVYT

SEQ ID NO: 196172 - protein, 9 aa, Homo Sapiens
GCPVSSPMN

SEQ ID NO: 196173 - protein, 9 aa, Homo Sapiens
LAERGLMIP

SEQ ID NO: 196174 - protein, 9 aa, Homo Sapiens
GFDPHHHMH

SEQ ID NO: 196175 - protein, 9 aa, Homo Sapiens
HTAILVTGT

SEQ ID NO: 196176 - protein, 9 aa, Homo Sapiens
FVGSSLASQ

SEQ ID NO: 196177 - protein, 9 aa, Homo Sapiens
YYKNRMYLT

SEQ ID NO: 196178 - protein, 9 aa, Homo Sapiens
YSTPSSLVY

SEQ ID NO: 196179 - protein, 9 aa, Homo Sapiens
GNSYHLQSW

SEQ ID NO: 196180 - protein, 9 aa, Homo Sapiens
SSEDCLQQF

SEQ ID NO: 196181 - protein, 9 aa, Homo Sapiens
LCVDYYKNR

SEQ ID NO: 196182 - protein, 9 aa, Homo Sapiens
RWMWTVVTS

SEQ ID NO: 196183 - protein, 9 aa, Homo Sapiens
TVIFVDLDA

SEQ ID NO: 196184 - protein, 9 aa, Homo Sapiens
DYLDDGKVN

SEQ ID NO: 196185 - protein, 9 aa, Homo Sapiens
QHEKIKQFS

SEQ ID NO: 196186 - protein, 9 aa, Homo Sapiens
DCMDAMAEK

SEQ ID NO: 196187 - protein, 9 aa, Homo Sapiens
EPMGIALKM

SEQ ID NO: 196188 - protein, 9 aa, Homo Sapiens
GFKGDIGMK

SEQ ID NO: 196189 - protein, 9 aa, Homo Sapiens
NEYCSSGGM

SEQ ID NO: 196190 - protein, 9 aa, Homo Sapiens
TVMSEENST

SEQ ID NO: 196191 - protein, 9 aa, Homo Sapiens
DTGTIERCL

SEQ ID NO: 196192 - protein, 9 aa, Homo Sapiens
STPSSLVYT

SEQ ID NO: 196193 - protein, 9 aa, Homo Sapiens
LLRQVLKSK

SEQ ID NO: 196194 - protein, 9 aa, Homo Sapiens
ARDSDGSVG

SEQ ID NO: 196195 - protein, 9 aa, Homo Sapiens
IGHNYLGDK

SEQ ID NO: 196196 - protein, 9 aa, Homo Sapiens
NHRGSVVSE

SEQ ID NO: 196197 - protein, 9 aa, Homo Sapiens
LPVHPEPLQ

SEQ ID NO: 196198 - protein, 9 aa, Homo Sapiens
ELSYAWEPR

SEQ ID NO: 196199 - protein, 9 aa, Homo Sapiens
YGAASPSSV

SEQ ID NO: 196200 - protein, 9 aa, Homo Sapiens
VITYTSEAS

SEQ ID NO: 196201 - protein, 9 aa, Homo Sapiens
PANMEEQTE

SEQ ID NO: 196202 - protein, 9 aa, Homo Sapiens
PHYERPLTQ

SEQ ID NO: 196203 - protein, 9 aa, Homo Sapiens
REWQLREEQ

SEQ ID NO: 196204 - protein, 9 aa, Homo Sapiens
PLQPYLLPC

SEQ ID NO: 196205 - protein, 9 aa, Homo Sapiens
GVQEPALAF

SEQ ID NO: 196206 - protein, 9 aa, Homo Sapiens
LSGDPSSQE

SEQ ID NO: 196207 - protein, 9 aa, Homo Sapiens
SSPAIITDK

SEQ ID NO: 196208 - protein, 9 aa, Homo Sapiens
MSKYLTHFL

SEQ ID NO: 196209 - protein, 9 aa, Homo Sapiens
CGELELQHE

SEQ ID NO: 196210 - protein, 9 aa, Homo Sapiens
TTKNVHSKP

SEQ ID NO: 196211 - protein, 9 aa, Homo Sapiens
SLAGVYAKA

SEQ ID NO: 196212 - protein, 9 aa, Homo Sapiens
RQKEKNVQG

SEQ ID NO: 196213 - protein, 9 aa, Homo Sapiens
DCVFSVIYG

SEQ ID NO: 196214 - protein, 9 aa, Homo Sapiens
MRRMHTAVK

SEQ ID NO: 196215 - protein, 9 aa, Homo Sapiens
QIGHNYLGD

SEQ ID NO: 196216 - protein, 9 aa, Homo Sapiens
DRELITNKN

SEQ ID NO: 196217 - protein, 9 aa, Homo Sapiens
EEGKQLPPC

SEQ ID NO: 196218 - protein, 9 aa, Homo Sapiens
KAAEYLKRE

SEQ ID NO: 196219 - protein, 9 aa, Homo Sapiens
DFYHDMDPN

SEQ ID NO: 196220 - protein, 9 aa, Homo Sapiens
KNYESKKHS

SEQ ID NO: 196221 - protein, 9 aa, Homo Sapiens
MWKVNVQKM

SEQ ID NO: 196222 - protein, 9 aa, Homo Sapiens
PAPNNRTHG

SEQ ID NO: 196223 - protein, 9 aa, Homo Sapiens
EKLHNTAPT

SEQ ID NO: 196224 - protein, 9 aa, Homo Sapiens
LPWIIKAAP

SEQ ID NO: 196225 - protein, 9 aa, Homo Sapiens
GTLELTKGL

SEQ ID NO: 196226 - protein, 9 aa, Homo Sapiens
FDEGWVDGR

SEQ ID NO: 196227 - protein, 9 aa, Homo Sapiens
IDNKYLPSL

SEQ ID NO: 196228 - protein, 9 aa, Homo Sapiens
YEWAVREVD

SEQ ID NO: 196229 - protein, 9 aa, Homo Sapiens
PNPGLTKPP

SEQ ID NO: 196230 - protein, 9 aa, Homo Sapiens
LSECSLRSF

SEQ ID NO: 196231 - protein, 9 aa, Homo Sapiens
GRVVRLVLT

SEQ ID NO: 196232 - protein, 9 aa, Homo Sapiens
IHFIEARDL

SEQ ID NO: 196233 - protein, 9 aa, Homo Sapiens
HDYFEGSGF

SEQ ID NO: 196234 - protein, 9 aa, Homo Sapiens
GCVGSRRRF

SEQ ID NO: 196235 - protein, 9 aa, Homo Sapiens
FSLKERAIN

SEQ ID NO: 196236 - protein, 9 aa, Homo Sapiens
HTAFAPVTP

SEQ ID NO: 196237 - protein, 9 aa, Homo Sapiens
LCEEEVLDV

SEQ ID NO: 196238 - protein, 9 aa, Homo Sapiens
MVCTDSREQ

SEQ ID NO: 196239 - protein, 9 aa, Homo Sapiens
EEAKVEIAQ

SEQ ID NO: 196240 - protein, 9 aa, Homo Sapiens
LAVISASSC

SEQ ID NO: 196241 - protein, 9 aa, Homo Sapiens
GPVSGLWRQ

SEQ ID NO: 196242 - protein, 9 aa, Homo Sapiens
TWGRRWPWP

SEQ ID NO: 196243 - protein, 9 aa, Homo Sapiens
MVQSPTPFN

SEQ ID NO: 196244 - protein, 9 aa, Homo Sapiens
YKCSEHGKA

SEQ ID NO: 196245 - protein, 9 aa, Homo Sapiens
QIPTNLRRR

SEQ ID NO: 196246 - protein, 9 aa, Homo Sapiens
GTVGQIPHL

SEQ ID NO: 196247 - protein, 9 aa, Homo Sapiens
IKKTQQRGL

SEQ ID NO: 196248 - protein, 9 aa, Homo Sapiens
IKRESLGWT

SEQ ID NO: 196249 - protein, 9 aa, Homo Sapiens
RQPLLGPSL

SEQ ID NO: 196250 - protein, 9 aa, Homo Sapiens
RARAGLRAR

SEQ ID NO: 196251 - protein, 9 aa, Homo Sapiens
AEALECLDN

SEQ ID NO: 196252 - protein, 9 aa, Homo Sapiens
YFLGSDLLV

SEQ ID NO: 196253 - protein, 9 aa, Homo Sapiens
ARLTALHIK

SEQ ID NO: 196254 - protein, 9 aa, Homo Sapiens
PSRKPSKTK

SEQ ID NO: 196255 - protein, 9 aa, Homo Sapiens
PHSWMKIDV

SEQ ID NO: 196256 - protein, 9 aa, Homo Sapiens
LWDHILENK

SEQ ID NO: 196257 - protein, 9 aa, Homo Sapiens
KLDVPCSLY

SEQ ID NO: 196258 - protein, 9 aa, Homo Sapiens
GLTQKMISE

SEQ ID NO: 196259 - protein, 9 aa, Homo Sapiens
SFVQKEFQN

SEQ ID NO: 196260 - protein, 9 aa, Homo Sapiens
MPPRTLWSC

SEQ ID NO: 196261 - protein, 9 aa, Homo Sapiens
QCLCTDPYE

SEQ ID NO: 196262 - protein, 9 aa, Homo Sapiens
GTHILMAVV

SEQ ID NO: 196263 - protein, 9 aa, Homo Sapiens
RALVATKDG

SEQ ID NO: 196264 - protein, 9 aa, Homo Sapiens
LIDKARVEI

SEQ ID NO: 196265 - protein, 9 aa, Homo Sapiens
MCKIRVFPE

SEQ ID NO: 196266 - protein, 9 aa, Homo Sapiens
TEHFQARKK

SEQ ID NO: 196267 - protein, 9 aa, Homo Sapiens
AEIKMLSDQ

SEQ ID NO: 196268 - protein, 9 aa, Homo Sapiens
PLLHLQYYT

SEQ ID NO: 196269 - protein, 9 aa, Homo Sapiens
HRFLPTKDH

SEQ ID NO: 196270 - protein, 9 aa, Homo Sapiens
DVKAWLEGE

SEQ ID NO: 196271 - protein, 9 aa, Homo Sapiens
DTAPSTTLV

SEQ ID NO: 196272 - protein, 9 aa, Homo Sapiens
NYYFLEEKF

SEQ ID NO: 196273 - protein, 9 aa, Homo Sapiens
SPQGGTSSS

SEQ ID NO: 196274 - protein, 9 aa, Homo Sapiens
IMLFDAHKL

SEQ ID NO: 196275 - protein, 9 aa, Homo Sapiens
KPVVDHSVQ

SEQ ID NO: 196276 - protein, 9 aa, Homo Sapiens
YVQDVMELV

SEQ ID NO: 196277 - protein, 9 aa, Homo Sapiens
NELHPGLKY

SEQ ID NO: 196278 - protein, 9 aa, Homo Sapiens
TCLEQGKEH

SEQ ID NO: 196279 - protein, 9 aa, Homo Sapiens
IRYFYTEKD

SEQ ID NO: 196280 - protein, 9 aa, Homo Sapiens
ACGGRERRD

SEQ ID NO: 196281 - protein, 9 aa, Homo Sapiens
LDADFTKMT

SEQ ID NO: 196282 - protein, 9 aa, Homo Sapiens
ACQDLPAWD

SEQ ID NO: 196283 - protein, 9 aa, Homo Sapiens
RGGKRHYLA

SEQ ID NO: 196284 - protein, 9 aa, Homo Sapiens
RRMRGLVVN

SEQ ID NO: 196285 - protein, 9 aa, Homo Sapiens
LVQVYYQQI

SEQ ID NO: 196286 - protein, 9 aa, Homo Sapiens
PLQGVEIAA

SEQ ID NO: 196287 - protein, 9 aa, Homo Sapiens
PVGGQVPLR

SEQ ID NO: 196288 - protein, 9 aa, Homo Sapiens
GHISEFKPM

SEQ ID NO: 196289 - protein, 9 aa, Homo Sapiens
DSLKKNAFR

SEQ ID NO: 196290 - protein, 9 aa, Homo Sapiens
LEEEREWQL

SEQ ID NO: 196291 - protein, 9 aa, Homo Sapiens
SHHIKGEDK

SEQ ID NO: 196292 - protein, 9 aa, Homo Sapiens
TESNCEVPQ

SEQ ID NO: 196293 - protein, 9 aa, Homo Sapiens
VTEFCQQTC

SEQ ID NO: 196294 - protein, 9 aa, Homo Sapiens
TPGPQQVLP

SEQ ID NO: 196295 - protein, 9 aa, Homo Sapiens
LSPEEFINF

SEQ ID NO: 196296 - protein, 9 aa, Homo Sapiens
VSAIKPPHE

SEQ ID NO: 196297 - protein, 9 aa, Homo Sapiens
ECDRQKQKS

SEQ ID NO: 196298 - protein, 9 aa, Homo Sapiens
LLPGIGGVP

SEQ ID NO: 196299 - protein, 9 aa, Homo Sapiens
RSAQIAKQL

SEQ ID NO: 196300 - protein, 9 aa, Homo Sapiens
HLQGEADPV

SEQ ID NO: 196301 - protein, 9 aa, Homo Sapiens
VCGKAFRVG

SEQ ID NO: 196302 - protein, 9 aa, Homo Sapiens
LEYEPTARI

SEQ ID NO: 196303 - protein, 9 aa, Homo Sapiens
GQDEQLIYF

SEQ ID NO: 196304 - protein, 9 aa, Homo Sapiens
LALQQKVEL

SEQ ID NO: 196305 - protein, 9 aa, Homo Sapiens
VSDLLELQG

SEQ ID NO: 196306 - protein, 9 aa, Homo Sapiens
WERSLQTLR

SEQ ID NO: 196307 - protein, 9 aa, Homo Sapiens
THFLSNPGT

SEQ ID NO: 196308 - protein, 9 aa, Homo Sapiens
LDSPQAIVL

SEQ ID NO: 196309 - protein, 9 aa, Homo Sapiens
VYYQQIGRI

SEQ ID NO: 196310 - protein, 9 aa, Homo Sapiens
CCGCLRLGI

SEQ ID NO: 196311 - protein, 9 aa, Homo Sapiens
YTCSDCKSR

SEQ ID NO: 196312 - protein, 9 aa, Homo Sapiens
SSPADSKPL

SEQ ID NO: 196313 - protein, 9 aa, Homo Sapiens
SHTCYPLFK

SEQ ID NO: 196314 - protein, 9 aa, Homo Sapiens
PWIIKAAPS

SEQ ID NO: 196315 - protein, 9 aa, Homo Sapiens
GVPERQGSI

SEQ ID NO: 196316 - protein, 9 aa, Homo Sapiens
REYLCAECV

SEQ ID NO: 196317 - protein, 9 aa, Homo Sapiens
AQLTKPSMT

SEQ ID NO: 196318 - protein, 9 aa, Homo Sapiens
NTGPPPIDH

SEQ ID NO: 196319 - protein, 9 aa, Homo Sapiens
LIFKLPCQR

SEQ ID NO: 196320 - protein, 9 aa, Homo Sapiens
DLVTMWSFT

SEQ ID NO: 196321 - protein, 9 aa, Homo Sapiens
SPQGLILNV

SEQ ID NO: 196322 - protein, 9 aa, Homo Sapiens
RKALLSSED

SEQ ID NO: 196323 - protein, 9 aa, Homo Sapiens
KMCLKSQLV

SEQ ID NO: 196324 - protein, 9 aa, Homo Sapiens
SVLFYATTT

SEQ ID NO: 196325 - protein, 9 aa, Homo Sapiens
FHADSMCKA

SEQ ID NO: 196326 - protein, 9 aa, Homo Sapiens
ARGLLSGLQ

SEQ ID NO: 196327 - protein, 9 aa, Homo Sapiens
SDVRHTPAE

SEQ ID NO: 196328 - protein, 9 aa, Homo Sapiens
GAEHVRSPL

SEQ ID NO: 196329 - protein, 9 aa, Homo Sapiens
FVWFEFHYP

SEQ ID NO: 196330 - protein, 9 aa, Homo Sapiens
KKIENIPKT

SEQ ID NO: 196331 - protein, 9 aa, Homo Sapiens
CPESPHYLY

SEQ ID NO: 196332 - protein, 9 aa, Homo Sapiens
ADLDNRHQG

SEQ ID NO: 196333 - protein, 9 aa, Homo Sapiens
RAELQGHHT

SEQ ID NO: 196334 - protein, 9 aa, Homo Sapiens
GARPWGIIH

SEQ ID NO: 196335 - protein, 9 aa, Homo Sapiens
VFMFMDMDN

SEQ ID NO: 196336 - protein, 9 aa, Homo Sapiens
NVDFCIHVE

SEQ ID NO: 196337 - protein, 9 aa, Homo Sapiens
RSRHQGSSV

SEQ ID NO: 196338 - protein, 9 aa, Homo Sapiens
ADDKMCQLN

SEQ ID NO: 196339 - protein, 9 aa, Homo Sapiens
EEAAREWRR

SEQ ID NO: 196340 - protein, 9 aa, Homo Sapiens
PTQEGQRMC

SEQ ID NO: 196341 - protein, 9 aa, Homo Sapiens
GQRTQLSKG

SEQ ID NO: 196342 - protein, 9 aa, Homo Sapiens
TRQMPVDSP

SEQ ID NO: 196343 - protein, 9 aa, Homo Sapiens
MTPIAQNTP

SEQ ID NO: 196344 - protein, 9 aa, Homo Sapiens
MPVDSPDDT

SEQ ID NO: 196345 - protein, 9 aa, Homo Sapiens
GTLLAYLLV

SEQ ID NO: 196346 - protein, 9 aa, Homo Sapiens
APCLAERGL

SEQ ID NO: 196347 - protein, 9 aa, Homo Sapiens
HSGPRCLCP

SEQ ID NO: 196348 - protein, 9 aa, Homo Sapiens
FNGYILFGI

SEQ ID NO: 196349 - protein, 9 aa, Homo Sapiens
QGQPESCLC

SEQ ID NO: 196350 - protein, 9 aa, Homo Sapiens
YGRCMDLLT

SEQ ID NO: 196351 - protein, 9 aa, Homo Sapiens
ATLLIVNCY

SEQ ID NO: 196352 - protein, 9 aa, Homo Sapiens
LAHAKLWEE

SEQ ID NO: 196353 - protein, 9 aa, Homo Sapiens
HLCRKTING

SEQ ID NO: 196354 - protein, 9 aa, Homo Sapiens
YNPPWVQLS

SEQ ID NO: 196355 - protein, 9 aa, Homo Sapiens
LAISALQRC

SEQ ID NO: 196356 - protein, 9 aa, Homo Sapiens
PGTFVCTEC

SEQ ID NO: 196357 - protein, 9 aa, Homo Sapiens
RSLPPSSHV

SEQ ID NO: 196358 - protein, 9 aa, Homo Sapiens
RDTESQVRL

SEQ ID NO: 196359 - protein, 9 aa, Homo Sapiens
AGVENLFIF

SEQ ID NO: 196360 - protein, 9 aa, Homo Sapiens
NFFGTLELT

SEQ ID NO: 196361 - protein, 9 aa, Homo Sapiens
SPQVVAKIL

SEQ ID NO: 196362 - protein, 9 aa, Homo Sapiens
FKENIEVEE

SEQ ID NO: 196363 - protein, 9 aa, Homo Sapiens
HQEGWCRDS

SEQ ID NO: 196364 - protein, 9 aa, Homo Sapiens
CHWNGKKML

SEQ ID NO: 196365 - protein, 9 aa, Homo Sapiens
IISVVVGIL

SEQ ID NO: 196366 - protein, 9 aa, Homo Sapiens
RCSSMSLYT

SEQ ID NO: 196367 - protein, 9 aa, Homo Sapiens
CGCLRLGIR

SEQ ID NO: 196368 - protein, 9 aa, Homo Sapiens
SGNESECPP

SEQ ID NO: 196369 - protein, 9 aa, Homo Sapiens
DTYSAPPPG

SEQ ID NO: 196370 - protein, 9 aa, Homo Sapiens
VCALSAQQQ

SEQ ID NO: 196371 - protein, 9 aa, Homo Sapiens
NIERRWEAI

SEQ ID NO: 196372 - protein, 9 aa, Homo Sapiens
SRDLDALDK

SEQ ID NO: 196373 - protein, 9 aa, Homo Sapiens
GPKVGVGAS

SEQ ID NO: 196374 - protein, 9 aa, Homo Sapiens
PPHRHHRHR

SEQ ID NO: 196375 - protein, 9 aa, Homo Sapiens
YLPEWTVWL

SEQ ID NO: 196376 - protein, 9 aa, Homo Sapiens
LQGEPKGSS

SEQ ID NO: 196377 - protein, 9 aa, Homo Sapiens
LVSPPSSQM

SEQ ID NO: 196378 - protein, 9 aa, Homo Sapiens
LRGGGSPSR

SEQ ID NO: 196379 - protein, 9 aa, Homo Sapiens
SRYCEHFNI

SEQ ID NO: 196380 - protein, 9 aa, Homo Sapiens
STGELIYQV

SEQ ID NO: 196381 - protein, 9 aa, Homo Sapiens
LEKDPHIAQ

SEQ ID NO: 196382 - protein, 9 aa, Homo Sapiens
VNNRNAGQG

SEQ ID NO: 196383 - protein, 9 aa, Homo Sapiens
SLTDASSAF

SEQ ID NO: 196384 - protein, 9 aa, Homo Sapiens
MAGRLLVQW

SEQ ID NO: 196385 - protein, 9 aa, Homo Sapiens
WNIYIVAGV

SEQ ID NO: 196386 - protein, 9 aa, Homo Sapiens
ACRCDSDGT

SEQ ID NO: 196387 - protein, 9 aa, Homo Sapiens
KAESAMTKQ

SEQ ID NO: 196388 - protein, 9 aa, Homo Sapiens
MSRPVLKLR

SEQ ID NO: 196389 - protein, 9 aa, Homo Sapiens
SDESEGERC

SEQ ID NO: 196390 - protein, 9 aa, Homo Sapiens
TETAHAPGT

SEQ ID NO: 196391 - protein, 9 aa, Homo Sapiens
DIHACNHVA

SEQ ID NO: 196392 - protein, 9 aa, Homo Sapiens
KPFGVFLMN

SEQ ID NO: 196393 - protein, 9 aa, Homo Sapiens
HMPGPTELF

SEQ ID NO: 196394 - protein, 9 aa, Homo Sapiens
WGVTCSLTL

SEQ ID NO: 196395 - protein, 9 aa, Homo Sapiens
IPAEFADCP

SEQ ID NO: 196396 - protein, 9 aa, Homo Sapiens
KVGQDEQLI

SEQ ID NO: 196397 - protein, 9 aa, Homo Sapiens
QGKEHCNMK

SEQ ID NO: 196398 - protein, 9 aa, Homo Sapiens
SMHKHQPRV

SEQ ID NO: 196399 - protein, 9 aa, Homo Sapiens
ASLAAACQD

SEQ ID NO: 196400 - protein, 9 aa, Homo Sapiens
FENVAVCLQ

SEQ ID NO: 196401 - protein, 9 aa, Homo Sapiens
SVFPAICFG

SEQ ID NO: 196402 - protein, 9 aa, Homo Sapiens
SMVLFAWMQ

SEQ ID NO: 196403 - protein, 9 aa, Homo Sapiens
RGSIPTSLM

SEQ ID NO: 196404 - protein, 9 aa, Homo Sapiens
EAHQRYFGG

SEQ ID NO: 196405 - protein, 9 aa, Homo Sapiens
MGSSQRQTG

SEQ ID NO: 196406 - protein, 9 aa, Homo Sapiens
CDYTSYWTS

SEQ ID NO: 196407 - protein, 9 aa, Homo Sapiens
SEDCVFSVI

SEQ ID NO: 196408 - protein, 9 aa, Homo Sapiens
QHLCRKTIN

SEQ ID NO: 196409 - protein, 9 aa, Homo Sapiens
IYKKKQFIA

SEQ ID NO: 196410 - protein, 9 aa, Homo Sapiens
PQPPMESCL

SEQ ID NO: 196411 - protein, 9 aa, Homo Sapiens
FMDLKIKLA

SEQ ID NO: 196412 - protein, 9 aa, Homo Sapiens
VNESAEVEE

SEQ ID NO: 196413 - protein, 9 aa, Homo Sapiens
CGRLLQGPE

SEQ ID NO: 196414 - protein, 9 aa, Homo Sapiens
MELEFKCLA

SEQ ID NO: 196415 - protein, 9 aa, Homo Sapiens
DPLSPSPRQ

SEQ ID NO: 196416 - protein, 9 aa, Homo Sapiens
CHTTVDRTA

SEQ ID NO: 196417 - protein, 9 aa, Homo Sapiens
NGEKLGLPG

SEQ ID NO: 196418 - protein, 9 aa, Homo Sapiens
TQGEPGYLA

SEQ ID NO: 196419 - protein, 9 aa, Homo Sapiens
TLVGVGAQG

SEQ ID NO: 196420 - protein, 9 aa, Homo Sapiens
VGGLIYWIG

SEQ ID NO: 196421 - protein, 9 aa, Homo Sapiens
SQLDTLCQG

SEQ ID NO: 196422 - protein, 9 aa, Homo Sapiens
WGRTWRLLW

SEQ ID NO: 196423 - protein, 9 aa, Homo Sapiens
IWALQLTKF

SEQ ID NO: 196424 - protein, 9 aa, Homo Sapiens
KHLIQLRRW

SEQ ID NO: 196425 - protein, 9 aa, Homo Sapiens
ILALCRLGR

SEQ ID NO: 196426 - protein, 9 aa, Homo Sapiens
WVDGRMLHY

SEQ ID NO: 196427 - protein, 9 aa, Homo Sapiens
PKEILHYVY

SEQ ID NO: 196428 - protein, 9 aa, Homo Sapiens
LRLPLEHLV

SEQ ID NO: 196429 - protein, 9 aa, Homo Sapiens
LNFYKELQA

SEQ ID NO: 196430 - protein, 9 aa, Homo Sapiens
RLKGMMRDE

SEQ ID NO: 196431 - protein, 9 aa, Homo Sapiens
RLGISCLQG

SEQ ID NO: 196432 - protein, 9 aa, Homo Sapiens
QGSDSDKEV

SEQ ID NO: 196433 - protein, 9 aa, Homo Sapiens
INKEHESSS

SEQ ID NO: 196434 - protein, 9 aa, Homo Sapiens
SRSNHRGSV

SEQ ID NO: 196435 - protein, 9 aa, Homo Sapiens
KGHQEGWCR

SEQ ID NO: 196436 - protein, 9 aa, Homo Sapiens
QQVDLAGGP

SEQ ID NO: 196437 - protein, 9 aa, Homo Sapiens
TLQRALERE

SEQ ID NO: 196438 - protein, 9 aa, Homo Sapiens
CELGADGAE

SEQ ID NO: 196439 - protein, 9 aa, Homo Sapiens
RTRFTGYQL

SEQ ID NO: 196440 - protein, 9 aa, Homo Sapiens
HTDAAHAVG

SEQ ID NO: 196441 - protein, 9 aa, Homo Sapiens
MPNVCDHDA

SEQ ID NO: 196442 - protein, 9 aa, Homo Sapiens
PQVASSACV

SEQ ID NO: 196443 - protein, 9 aa, Homo Sapiens
VLNGGECVL

SEQ ID NO: 196444 - protein, 9 aa, Homo Sapiens
RLICRCLCQ

SEQ ID NO: 196445 - protein, 9 aa, Homo Sapiens
QCFRHGQSL

SEQ ID NO: 196446 - protein, 9 aa, Homo Sapiens
RILQNEPLS

SEQ ID NO: 196447 - protein, 9 aa, Homo Sapiens
ELQAWVWEH

SEQ ID NO: 196448 - protein, 9 aa, Homo Sapiens
VRGNWQCWL

SEQ ID NO: 196449 - protein, 9 aa, Homo Sapiens
VLRLLLGLP

SEQ ID NO: 196450 - protein, 9 aa, Homo Sapiens
SSLLTSLVE

SEQ ID NO: 196451 - protein, 9 aa, Homo Sapiens
FPVDTLQEW

SEQ ID NO: 196452 - protein, 9 aa, Homo Sapiens
DPPTDPGVE

SEQ ID NO: 196453 - protein, 9 aa, Homo Sapiens
NPRIEVIDG

SEQ ID NO: 196454 - protein, 9 aa, Homo Sapiens
HKCKPQMNY

SEQ ID NO: 196455 - protein, 9 aa, Homo Sapiens
DQHLLLPHW

SEQ ID NO: 196456 - protein, 9 aa, Homo Sapiens
LENFQGKRY

SEQ ID NO: 196457 - protein, 9 aa, Homo Sapiens
IACLEQDLS

SEQ ID NO: 196458 - protein, 9 aa, Homo Sapiens
HIKKTLSQL

SEQ ID NO: 196459 - protein, 9 aa, Homo Sapiens
EVIIIESTK

SEQ ID NO: 196460 - protein, 9 aa, Homo Sapiens
AREWRRRAR

SEQ ID NO: 196461 - protein, 9 aa, Homo Sapiens
DWNNEYCSS

SEQ ID NO: 196462 - protein, 9 aa, Homo Sapiens
RARFTIDLG

SEQ ID NO: 196463 - protein, 9 aa, Homo Sapiens
PGKLPTLIS

SEQ ID NO: 196464 - protein, 9 aa, Homo Sapiens
TLARETDEL

SEQ ID NO: 196465 - protein, 9 aa, Homo Sapiens
GEGARPWGI

SEQ ID NO: 196466 - protein, 9 aa, Homo Sapiens
RPSSDELSG

SEQ ID NO: 196467 - protein, 9 aa, Homo Sapiens
LANFNPSRP

SEQ ID NO: 196468 - protein, 9 aa, Homo Sapiens
VRNSRTIGV

SEQ ID NO: 196469 - protein, 9 aa, Homo Sapiens
QGSTVRSKK

SEQ ID NO: 196470 - protein, 9 aa, Homo Sapiens
KRMDEQQVD

SEQ ID NO: 196471 - protein, 9 aa, Homo Sapiens
VAAQPENHA

SEQ ID NO: 196472 - protein, 9 aa, Homo Sapiens
SAVEQLQSH

SEQ ID NO: 196473 - protein, 9 aa, Homo Sapiens
HWSETSVER

SEQ ID NO: 196474 - protein, 9 aa, Homo Sapiens
GVSSQDTKT

SEQ ID NO: 196475 - protein, 9 aa, Homo Sapiens
GCCKSVSKS

SEQ ID NO: 196476 - protein, 9 aa, Homo Sapiens
LVAASTDGK

SEQ ID NO: 196477 - protein, 9 aa, Homo Sapiens
RGSPLRLTL

SEQ ID NO: 196478 - protein, 9 aa, Homo Sapiens
EQLIYFYVT

SEQ ID NO: 196479 - protein, 9 aa, Homo Sapiens
GLFQKSGSV

SEQ ID NO: 196480 - protein, 9 aa, Homo Sapiens
FLRTLKERL

SEQ ID NO: 196481 - protein, 9 aa, Homo Sapiens
EKTRWPNSG

SEQ ID NO: 196482 - protein, 9 aa, Homo Sapiens
VCPLGFKVK

SEQ ID NO: 196483 - protein, 9 aa, Homo Sapiens
VLMTFFTGI

SEQ ID NO: 196484 - protein, 9 aa, Homo Sapiens
AKTDGEERQ

SEQ ID NO: 196485 - protein, 9 aa, Homo Sapiens
KCEHENLRL

SEQ ID NO: 196486 - protein, 9 aa, Homo Sapiens
PDRTPRPTS

SEQ ID NO: 196487 - protein, 9 aa, Homo Sapiens
HRGHGGFNM

SEQ ID NO: 196488 - protein, 9 aa, Homo Sapiens
HGMPPTMMD

SEQ ID NO: 196489 - protein, 9 aa, Homo Sapiens
GWARARGQA

SEQ ID NO: 196490 - protein, 9 aa, Homo Sapiens
GKDKITLEG

SEQ ID NO: 196491 - protein, 9 aa, Homo Sapiens
VIEVNSWWS

SEQ ID NO: 196492 - protein, 9 aa, Homo Sapiens
THMNISARR

SEQ ID NO: 196493 - protein, 9 aa, Homo Sapiens
EHWERSLQT

SEQ ID NO: 196494 - protein, 9 aa, Homo Sapiens
ANEDHREAS

SEQ ID NO: 196495 - protein, 9 aa, Homo Sapiens
TVCDSVLGK

SEQ ID NO: 196496 - protein, 9 aa, Homo Sapiens
FCGGLIKNI

SEQ ID NO: 196497 - protein, 9 aa, Homo Sapiens
LQAILQNQG

SEQ ID NO: 196498 - protein, 9 aa, Homo Sapiens
KTVGHLFTI

SEQ ID NO: 196499 - protein, 9 aa, Homo Sapiens
GFATLWEHV

SEQ ID NO: 196500 - protein, 9 aa, Homo Sapiens
ERVTISGAA

SEQ ID NO: 196501 - protein, 9 aa, Homo Sapiens
RYFYTEKDR

SEQ ID NO: 196502 - protein, 9 aa, Homo Sapiens
QLTKPSMTQ

SEQ ID NO: 196503 - protein, 9 aa, Homo Sapiens
LLQKLWSGS

SEQ ID NO: 196504 - protein, 9 aa, Homo Sapiens
FACCLVRFL

SEQ ID NO: 196505 - protein, 9 aa, Homo Sapiens
AAAFPMNFI

SEQ ID NO: 196506 - protein, 9 aa, Homo Sapiens
SNELAIFSE

SEQ ID NO: 196507 - protein, 9 aa, Homo Sapiens
FVDQIDPPC

SEQ ID NO: 196508 - protein, 9 aa, Homo Sapiens
GNNIHFTNG

SEQ ID NO: 196509 - protein, 9 aa, Homo Sapiens
QLTGAMVWA

SEQ ID NO: 196510 - protein, 9 aa, Homo Sapiens
RALLQEQFC

SEQ ID NO: 196511 - protein, 9 aa, Homo Sapiens
AAIFICNYV

SEQ ID NO: 196512 - protein, 9 aa, Homo Sapiens
SFPMCPPGG

SEQ ID NO: 196513 - protein, 9 aa, Homo Sapiens
GCCQDNITT

SEQ ID NO: 196514 - protein, 9 aa, Homo Sapiens
MGPPLPGPP

SEQ ID NO: 196515 - protein, 9 aa, Homo Sapiens
TETAFPTLN

SEQ ID NO: 196516 - protein, 9 aa, Homo Sapiens
HFNFAIVLQ

SEQ ID NO: 196517 - protein, 9 aa, Homo Sapiens
CLYPGSVYG

SEQ ID NO: 196518 - protein, 9 aa, Homo Sapiens
KGSSSLPPL

SEQ ID NO: 196519 - protein, 9 aa, Homo Sapiens
GKVRPCSVY

SEQ ID NO: 196520 - protein, 9 aa, Homo Sapiens
GGEVIAWWG

SEQ ID NO: 196521 - protein, 9 aa, Homo Sapiens
SMLAHHLGV

SEQ ID NO: 196522 - protein, 9 aa, Homo Sapiens
NKGTPNPGL

SEQ ID NO: 196523 - protein, 9 aa, Homo Sapiens
RERSGGSVT

SEQ ID NO: 196524 - protein, 9 aa, Homo Sapiens
LSALTILWM

SEQ ID NO: 196525 - protein, 9 aa, Homo Sapiens
YYHLTRFLS

SEQ ID NO: 196526 - protein, 9 aa, Homo Sapiens
QHMASIISS

SEQ ID NO: 196527 - protein, 9 aa, Homo Sapiens
VLSEPYQYT

SEQ ID NO: 196528 - protein, 9 aa, Homo Sapiens
IWQLISAHV

SEQ ID NO: 196529 - protein, 9 aa, Homo Sapiens
ISYGQVRDT

SEQ ID NO: 196530 - protein, 9 aa, Homo Sapiens
YRHIIKNPM

SEQ ID NO: 196531 - protein, 9 aa, Homo Sapiens
VVQGPGRET

SEQ ID NO: 196532 - protein, 9 aa, Homo Sapiens
YFLSYDELL

SEQ ID NO: 196533 - protein, 9 aa, Homo Sapiens
CEEMILKIF

SEQ ID NO: 196534 - protein, 9 aa, Homo Sapiens
ETYRLSTET

SEQ ID NO: 196535 - protein, 9 aa, Homo Sapiens
EQVTNQMLS

SEQ ID NO: 196536 - protein, 9 aa, Homo Sapiens
QEEKCLKVK

SEQ ID NO: 196537 - protein, 9 aa, Homo Sapiens
LAIFSEGGF

SEQ ID NO: 196538 - protein, 9 aa, Homo Sapiens
FNNGNHMTD

SEQ ID NO: 196539 - protein, 9 aa, Homo Sapiens
HCANGPYGK

SEQ ID NO: 196540 - protein, 9 aa, Homo Sapiens
VAESIRETG

SEQ ID NO: 196541 - protein, 9 aa, Homo Sapiens
PVFTEDRDH

SEQ ID NO: 196542 - protein, 9 aa, Homo Sapiens
QTGFYDWSA

SEQ ID NO: 196543 - protein, 9 aa, Homo Sapiens
LMKNGDVWT

SEQ ID NO: 196544 - protein, 9 aa, Homo Sapiens
CIGDALLLA

SEQ ID NO: 196545 - protein, 9 aa, Homo Sapiens
PKEAKAPVA

SEQ ID NO: 196546 - protein, 9 aa, Homo Sapiens
SHKAEFSKI

SEQ ID NO: 196547 - protein, 9 aa, Homo Sapiens
PYSHGNVTF

SEQ ID NO: 196548 - protein, 9 aa, Homo Sapiens
LDKWDVVSC

SEQ ID NO: 196549 - protein, 9 aa, Homo Sapiens
LDVKAWLEG

SEQ ID NO: 196550 - protein, 9 aa, Homo Sapiens
PLGPRQRLP

SEQ ID NO: 196551 - protein, 9 aa, Homo Sapiens
DSKPLNLPP

SEQ ID NO: 196552 - protein, 9 aa, Homo Sapiens
ATVQTGFYD

SEQ ID NO: 196553 - protein, 9 aa, Homo Sapiens
NNNLTFLWP

SEQ ID NO: 196554 - protein, 9 aa, Homo Sapiens
VLCFPPSLL

SEQ ID NO: 196555 - protein, 9 aa, Homo Sapiens
PQAESGEAV

SEQ ID NO: 196556 - protein, 9 aa, Homo Sapiens
QNLDSPQAI

SEQ ID NO: 196557 - protein, 9 aa, Homo Sapiens
GIQIPNLCG

SEQ ID NO: 196558 - protein, 9 aa, Homo Sapiens
PESLEDAGP

SEQ ID NO: 196559 - protein, 9 aa, Homo Sapiens
LQMEHDIQH

SEQ ID NO: 196560 - protein, 9 aa, Homo Sapiens
ATLWEHVPN

SEQ ID NO: 196561 - protein, 9 aa, Homo Sapiens
CPARVVVVL

SEQ ID NO: 196562 - protein, 9 aa, Homo Sapiens
VCTMSLVSS

SEQ ID NO: 196563 - protein, 9 aa, Homo Sapiens
LFSLGMPLK

SEQ ID NO: 196564 - protein, 9 aa, Homo Sapiens
VTYHHHLYD

SEQ ID NO: 196565 - protein, 9 aa, Homo Sapiens
GTTDRGSPA

SEQ ID NO: 196566 - protein, 9 aa, Homo Sapiens
KAGAHLQGE

SEQ ID NO: 196567 - protein, 9 aa, Homo Sapiens
PCKDSRFPP

SEQ ID NO: 196568 - protein, 9 aa, Homo Sapiens
KSENMTLNI

SEQ ID NO: 196569 - protein, 9 aa, Homo Sapiens
MGGCVGSRR

SEQ ID NO: 196570 - protein, 9 aa, Homo Sapiens
KNLSGWMGM

SEQ ID NO: 196571 - protein, 9 aa, Homo Sapiens
DYNPPWVQL

SEQ ID NO: 196572 - protein, 9 aa, Homo Sapiens
HAIWVENSI

SEQ ID NO: 196573 - protein, 9 aa, Homo Sapiens
LVCKDVAQC

SEQ ID NO: 196574 - protein, 9 aa, Homo Sapiens
LDHPIKKGP

SEQ ID NO: 196575 - protein, 9 aa, Homo Sapiens
REDRPFCCG

SEQ ID NO: 196576 - protein, 9 aa, Homo Sapiens
LSEIPAEFA

SEQ ID NO: 196577 - protein, 9 aa, Homo Sapiens
FKCSKRFCS

SEQ ID NO: 196578 - protein, 9 aa, Homo Sapiens
DCKDALELI

SEQ ID NO: 196579 - protein, 9 aa, Homo Sapiens
SDYEEEPVE

SEQ ID NO: 196580 - protein, 9 aa, Homo Sapiens
PQYEVNPQT

SEQ ID NO: 196581 - protein, 9 aa, Homo Sapiens
QRTHNIENV

SEQ ID NO: 196582 - protein, 9 aa, Homo Sapiens
EEPGKPVVT

SEQ ID NO: 196583 - protein, 9 aa, Homo Sapiens
LVEGNPDWL

SEQ ID NO: 196584 - protein, 9 aa, Homo Sapiens
WEKLCEKIR

SEQ ID NO: 196585 - protein, 9 aa, Homo Sapiens
VVEAERLVA

SEQ ID NO: 196586 - protein, 9 aa, Homo Sapiens
TREAHDIFY

SEQ ID NO: 196587 - protein, 9 aa, Homo Sapiens
AKSRPVQGL

SEQ ID NO: 196588 - protein, 9 aa, Homo Sapiens
NAIALQYCS

SEQ ID NO: 196589 - protein, 9 aa, Homo Sapiens
GRTWRLLWA

SEQ ID NO: 196590 - protein, 9 aa, Homo Sapiens
TTEPCKPCT

SEQ ID NO: 196591 - protein, 9 aa, Homo Sapiens
ELENFTPSG

SEQ ID NO: 196592 - protein, 9 aa, Homo Sapiens
WCRKTHVEK

SEQ ID NO: 196593 - protein, 9 aa, Homo Sapiens
NLERSANRD

SEQ ID NO: 196594 - protein, 9 aa, Homo Sapiens
EEVPVRGRT

SEQ ID NO: 196595 - protein, 9 aa, Homo Sapiens
TLLSHFTLT

SEQ ID NO: 196596 - protein, 9 aa, Homo Sapiens
SPLPTTSKC

SEQ ID NO: 196597 - protein, 9 aa, Homo Sapiens
GADVNAQNW

SEQ ID NO: 196598 - protein, 9 aa, Homo Sapiens
HTLVPGAHP

SEQ ID NO: 196599 - protein, 9 aa, Homo Sapiens
SGDYYRQGH

SEQ ID NO: 196600 - protein, 9 aa, Homo Sapiens
QRAQMKVCN

SEQ ID NO: 196601 - protein, 9 aa, Homo Sapiens
GGDKWSRHC

SEQ ID NO: 196602 - protein, 9 aa, Homo Sapiens
CILVGVSFL

SEQ ID NO: 196603 - protein, 9 aa, Homo Sapiens
EETCFISDD

SEQ ID NO: 196604 - protein, 9 aa, Homo Sapiens
SPWCDYTSY

SEQ ID NO: 196605 - protein, 9 aa, Homo Sapiens
LPGTAQGPP

SEQ ID NO: 196606 - protein, 9 aa, Homo Sapiens
AQEHELLEA

SEQ ID NO: 196607 - protein, 9 aa, Homo Sapiens
LQMEVLTEL

SEQ ID NO: 196608 - protein, 9 aa, Homo Sapiens
DKVCSNTCC

SEQ ID NO: 196609 - protein, 9 aa, Homo Sapiens
NEESRLTTS

SEQ ID NO: 196610 - protein, 9 aa, Homo Sapiens
PRQPLLGPS

SEQ ID NO: 196611 - protein, 9 aa, Homo Sapiens
TEGGSKPWA

SEQ ID NO: 196612 - protein, 9 aa, Homo Sapiens
NATDNPSGS

SEQ ID NO: 196613 - protein, 9 aa, Homo Sapiens
DTLNRWLGE

SEQ ID NO: 196614 - protein, 9 aa, Homo Sapiens
SDADCDWEK

SEQ ID NO: 196615 - protein, 9 aa, Homo Sapiens
NLLNERLYC

SEQ ID NO: 196616 - protein, 9 aa, Homo Sapiens
RCVEEVYRT

SEQ ID NO: 196617 - protein, 9 aa, Homo Sapiens
DRIVEMFMN

SEQ ID NO: 196618 - protein, 9 aa, Homo Sapiens
FMQVAKMQL

SEQ ID NO: 196619 - protein, 9 aa, Homo Sapiens
VAVLMTFFT

SEQ ID NO: 196620 - protein, 9 aa, Homo Sapiens
SIRETGVID

SEQ ID NO: 196621 - protein, 9 aa, Homo Sapiens
SELQEKLDL

SEQ ID NO: 196622 - protein, 9 aa, Homo Sapiens
APLQVAVRG

SEQ ID NO: 196623 - protein, 9 aa, Homo Sapiens
YSLLPSQDL

SEQ ID NO: 196624 - protein, 9 aa, Homo Sapiens
HSTLSLWKT

SEQ ID NO: 196625 - protein, 9 aa, Homo Sapiens
LSSVDKRSG

SEQ ID NO: 196626 - protein, 9 aa, Homo Sapiens
GAAQPGAVP

SEQ ID NO: 196627 - protein, 9 aa, Homo Sapiens
CVSARAAWG

SEQ ID NO: 196628 - protein, 9 aa, Homo Sapiens
EWREHSLEL

SEQ ID NO: 196629 - protein, 9 aa, Homo Sapiens
GYTSKETHF

SEQ ID NO: 196630 - protein, 9 aa, Homo Sapiens
IENLMSQVY

SEQ ID NO: 196631 - protein, 9 aa, Homo Sapiens
LYLPDFFWA

SEQ ID NO: 196632 - protein, 9 aa, Homo Sapiens
TNTMTIRAC

SEQ ID NO: 196633 - protein, 9 aa, Homo Sapiens
ETERQWIQQ

SEQ ID NO: 196634 - protein, 9 aa, Homo Sapiens
PRPAAGHCA

SEQ ID NO: 196635 - protein, 9 aa, Homo Sapiens
EEFCQKMAF

SEQ ID NO: 196636 - protein, 9 aa, Homo Sapiens
FIIIFSLFG

SEQ ID NO: 196637 - protein, 9 aa, Homo Sapiens
FEPQVNNRN

SEQ ID NO: 196638 - protein, 9 aa, Homo Sapiens
NISIWDIAG

SEQ ID NO: 196639 - protein, 9 aa, Homo Sapiens
QLDESIQEN

SEQ ID NO: 196640 - protein, 9 aa, Homo Sapiens
ARSPPPIMT

SEQ ID NO: 196641 - protein, 9 aa, Homo Sapiens
EVHKKPLQG

SEQ ID NO: 196642 - protein, 9 aa, Homo Sapiens
EPLRDWLEI

SEQ ID NO: 196643 - protein, 9 aa, Homo Sapiens
SKAESAMTK

SEQ ID NO: 196644 - protein, 9 aa, Homo Sapiens
SLTTPPYTE

SEQ ID NO: 196645 - protein, 9 aa, Homo Sapiens
ILAALRERL

SEQ ID NO: 196646 - protein, 9 aa, Homo Sapiens
GPPNPWADP

SEQ ID NO: 196647 - protein, 9 aa, Homo Sapiens
DINECKDPL

SEQ ID NO: 196648 - protein, 9 aa, Homo Sapiens
LWSGSAVPP

SEQ ID NO: 196649 - protein, 9 aa, Homo Sapiens
EGIGYDFWR

SEQ ID NO: 196650 - protein, 9 aa, Homo Sapiens
SNSEETCFI

SEQ ID NO: 196651 - protein, 9 aa, Homo Sapiens
FHFTLEAPV

SEQ ID NO: 196652 - protein, 9 aa, Homo Sapiens
LYMMDPHEN

SEQ ID NO: 196653 - protein, 9 aa, Homo Sapiens
CLASSKAHT

SEQ ID NO: 196654 - protein, 9 aa, Homo Sapiens
VCSFHEQRS

SEQ ID NO: 196655 - protein, 9 aa, Homo Sapiens
SMSTCIVNG

SEQ ID NO: 196656 - protein, 9 aa, Homo Sapiens
GRDSPPGGG

SEQ ID NO: 196657 - protein, 9 aa, Homo Sapiens
RTHGSLNHL

SEQ ID NO: 196658 - protein, 9 aa, Homo Sapiens
RTYIENRPK

SEQ ID NO: 196659 - protein, 9 aa, Homo Sapiens
ETTADVIAR

SEQ ID NO: 196660 - protein, 9 aa, Homo Sapiens
LLECGMRPG

SEQ ID NO: 196661 - protein, 9 aa, Homo Sapiens
LAVTLVGVG

SEQ ID NO: 196662 - protein, 9 aa, Homo Sapiens
AIVFPTQDS

SEQ ID NO: 196663 - protein, 9 aa, Homo Sapiens
STEGGSKPW

SEQ ID NO: 196664 - protein, 9 aa, Homo Sapiens
NRHQGFKEK

SEQ ID NO: 196665 - protein, 9 aa, Homo Sapiens
LPLRPQRGP

SEQ ID NO: 196666 - protein, 9 aa, Homo Sapiens
QSNCYRGGG

SEQ ID NO: 196667 - protein, 9 aa, Homo Sapiens
DAKTDGEER

SEQ ID NO: 196668 - protein, 9 aa, Homo Sapiens
KVYLEWIQQ

SEQ ID NO: 196669 - protein, 9 aa, Homo Sapiens
AKIHIEDDG

SEQ ID NO: 196670 - protein, 9 aa, Homo Sapiens
LCNEKLHNT

SEQ ID NO: 196671 - protein, 9 aa, Homo Sapiens
MTGIFYTIS

SEQ ID NO: 196672 - protein, 9 aa, Homo Sapiens
KLWTTMVPG

SEQ ID NO: 196673 - protein, 9 aa, Homo Sapiens
MHFIMSPPT

SEQ ID NO: 196674 - protein, 9 aa, Homo Sapiens
TDCVLSLFY

SEQ ID NO: 196675 - protein, 9 aa, Homo Sapiens
KKQAHCMHI

SEQ ID NO: 196676 - protein, 9 aa, Homo Sapiens
LGGPCPQTP

SEQ ID NO: 196677 - protein, 9 aa, Homo Sapiens
KQYHLTQPL

SEQ ID NO: 196678 - protein, 9 aa, Homo Sapiens
VINGEKLGL

SEQ ID NO: 196679 - protein, 9 aa, Homo Sapiens
VYQNIFMAM

SEQ ID NO: 196680 - protein, 9 aa, Homo Sapiens
SSLDLFFHW

SEQ ID NO: 196681 - protein, 9 aa, Homo Sapiens
SKYDVQGIQ

SEQ ID NO: 196682 - protein, 9 aa, Homo Sapiens
EKRSVLQDY

SEQ ID NO: 196683 - protein, 9 aa, Homo Sapiens
TCIVNIALP

SEQ ID NO: 196684 - protein, 9 aa, Homo Sapiens
RNRKEEKPA

SEQ ID NO: 196685 - protein, 9 aa, Homo Sapiens
PFGCDECTL

SEQ ID NO: 196686 - protein, 9 aa, Homo Sapiens
DALQFLIKV

SEQ ID NO: 196687 - protein, 9 aa, Homo Sapiens
KYTVHECCV

SEQ ID NO: 196688 - protein, 9 aa, Homo Sapiens
LNGEDKLVF

SEQ ID NO: 196689 - protein, 9 aa, Homo Sapiens
ATAWESHAC

SEQ ID NO: 196690 - protein, 9 aa, Homo Sapiens
RNPVCVNRR

SEQ ID NO: 196691 - protein, 9 aa, Homo Sapiens
KNQCISLLN

SEQ ID NO: 196692 - protein, 9 aa, Homo Sapiens
EWPRWPGHL

SEQ ID NO: 196693 - protein, 9 aa, Homo Sapiens
PAAGEVQRR

SEQ ID NO: 196694 - protein, 9 aa, Homo Sapiens
EVLYFLGSD

SEQ ID NO: 196695 - protein, 9 aa, Homo Sapiens
LNDNQEFPF

SEQ ID NO: 196696 - protein, 9 aa, Homo Sapiens
VVGEELVDD

SEQ ID NO: 196697 - protein, 9 aa, Homo Sapiens
HTLSISSDS

SEQ ID NO: 196698 - protein, 9 aa, Homo Sapiens
RGAPGNHGF

SEQ ID NO: 196699 - protein, 9 aa, Homo Sapiens
GILDTIAKE

SEQ ID NO: 196700 - protein, 9 aa, Homo Sapiens
FNFAIVLQM

SEQ ID NO: 196701 - protein, 9 aa, Homo Sapiens
FHHLWLQMD

SEQ ID NO: 196702 - protein, 9 aa, Homo Sapiens
GDWGWVVVL

SEQ ID NO: 196703 - protein, 9 aa, Homo Sapiens
GHVERIMSE

SEQ ID NO: 196704 - protein, 9 aa, Homo Sapiens
GFLMVFLQH

SEQ ID NO: 196705 - protein, 9 aa, Homo Sapiens
GNARETELE

SEQ ID NO: 196706 - protein, 9 aa, Homo Sapiens
KYEEGEQAR

SEQ ID NO: 196707 - protein, 9 aa, Homo Sapiens
HYGFSSVGF

SEQ ID NO: 196708 - protein, 9 aa, Homo Sapiens
DRQLTGAMV

SEQ ID NO: 196709 - protein, 9 aa, Homo Sapiens
SKLPLLIED

SEQ ID NO: 196710 - protein, 9 aa, Homo Sapiens
DDMSRTCGN

SEQ ID NO: 196711 - protein, 9 aa, Homo Sapiens
SPQAIVLYH

SEQ ID NO: 196712 - protein, 9 aa, Homo Sapiens
RYLESWGAT

SEQ ID NO: 196713 - protein, 9 aa, Homo Sapiens
LLEFMYQLP

SEQ ID NO: 196714 - protein, 9 aa, Homo Sapiens
HCCPPCRDG

SEQ ID NO: 196715 - protein, 9 aa, Homo Sapiens
CLEQGKEHC

SEQ ID NO: 196716 - protein, 9 aa, Homo Sapiens
LSKLWPQPL

SEQ ID NO: 196717 - protein, 9 aa, Homo Sapiens
KTVAECVIY

SEQ ID NO: 196718 - protein, 9 aa, Homo Sapiens
RGGGAFSGK

SEQ ID NO: 196719 - protein, 9 aa, Homo Sapiens
LEFHKDSST

SEQ ID NO: 196720 - protein, 9 aa, Homo Sapiens
KTIVYKVPR

SEQ ID NO: 196721 - protein, 9 aa, Homo Sapiens
PGFSYITQN

SEQ ID NO: 196722 - protein, 9 aa, Homo Sapiens
VAMEYLQSV

SEQ ID NO: 196723 - protein, 9 aa, Homo Sapiens
MEHDIQHYD

SEQ ID NO: 196724 - protein, 9 aa, Homo Sapiens
LEALSLFKT

SEQ ID NO: 196725 - protein, 9 aa, Homo Sapiens
VCSNQMPSL

SEQ ID NO: 196726 - protein, 9 aa, Homo Sapiens
LCGGSSYSY

SEQ ID NO: 196727 - protein, 9 aa, Homo Sapiens
ERNIKYDIK

SEQ ID NO: 196728 - protein, 9 aa, Homo Sapiens
LIPLAFLAS

SEQ ID NO: 196729 - protein, 9 aa, Homo Sapiens
NAWLPYHVL

SEQ ID NO: 196730 - protein, 9 aa, Homo Sapiens
VQNHIKEIL

SEQ ID NO: 196731 - protein, 9 aa, Homo Sapiens
IEDTSGKPF

SEQ ID NO: 196732 - protein, 9 aa, Homo Sapiens
RMIDMGFKG

SEQ ID NO: 196733 - protein, 9 aa, Homo Sapiens
NICRNPVCV

SEQ ID NO: 196734 - protein, 9 aa, Homo Sapiens
QEREAGTAM

SEQ ID NO: 196735 - protein, 9 aa, Homo Sapiens
DYRHFVSQM

SEQ ID NO: 196736 - protein, 9 aa, Homo Sapiens
MGKQAFMGE

SEQ ID NO: 196737 - protein, 9 aa, Homo Sapiens
DPAEAGVGT

SEQ ID NO: 196738 - protein, 9 aa, Homo Sapiens
GRKRSRMHR

SEQ ID NO: 196739 - protein, 9 aa, Homo Sapiens
QPPPRLPLR

SEQ ID NO: 196740 - protein, 9 aa, Homo Sapiens
QFEESRGQT

SEQ ID NO: 196741 - protein, 9 aa, Homo Sapiens
DMIGFLLAV

SEQ ID NO: 196742 - protein, 9 aa, Homo Sapiens
TFCACAMVL

SEQ ID NO: 196743 - protein, 9 aa, Homo Sapiens
EIAQARDQL

SEQ ID NO: 196744 - protein, 9 aa, Homo Sapiens
FRLLIIDGQ

SEQ ID NO: 196745 - protein, 9 aa, Homo Sapiens
NDDPNPVVQ

SEQ ID NO: 196746 - protein, 9 aa, Homo Sapiens
PGPLGECIF

SEQ ID NO: 196747 - protein, 9 aa, Homo Sapiens
TAPTRTALA

SEQ ID NO: 196748 - protein, 9 aa, Homo Sapiens
MHTLHTWAA

SEQ ID NO: 196749 - protein, 9 aa, Homo Sapiens
GNASLASKS

SEQ ID NO: 196750 - protein, 9 aa, Homo Sapiens
RWSPTWGRR

SEQ ID NO: 196751 - protein, 9 aa, Homo Sapiens
GKFFSWHSN

SEQ ID NO: 196752 - protein, 9 aa, Homo Sapiens
TLTPRGNSV

SEQ ID NO: 196753 - protein, 9 aa, Homo Sapiens
LVEESKFLA

SEQ ID NO: 196754 - protein, 9 aa, Homo Sapiens
GLKEDALQF

SEQ ID NO: 196755 - protein, 9 aa, Homo Sapiens
YKTVGGLIY

SEQ ID NO: 196756 - protein, 9 aa, Homo Sapiens
APTTPAMPD

SEQ ID NO: 196757 - protein, 9 aa, Homo Sapiens
PMNFITAYV

SEQ ID NO: 196758 - protein, 9 aa, Homo Sapiens
TASPPSCAR

SEQ ID NO: 196759 - protein, 9 aa, Homo Sapiens
LLDTSTTSP

SEQ ID NO: 196760 - protein, 9 aa, Homo Sapiens
WRVEKEALA

SEQ ID NO: 196761 - protein, 9 aa, Homo Sapiens
CQVCSFHEQ

SEQ ID NO: 196762 - protein, 9 aa, Homo Sapiens
TRLLAKGKK

SEQ ID NO: 196763 - protein, 9 aa, Homo Sapiens
PSSSQPRRW

SEQ ID NO: 196764 - protein, 9 aa, Homo Sapiens
YVQNVVVKT

SEQ ID NO: 196765 - protein, 9 aa, Homo Sapiens
DITLLDLIN

SEQ ID NO: 196766 - protein, 9 aa, Homo Sapiens
YLNANSFLA

SEQ ID NO: 196767 - protein, 9 aa, Homo Sapiens
LAMFCVLYH

SEQ ID NO: 196768 - protein, 9 aa, Homo Sapiens
LANGAKGTK

SEQ ID NO: 196769 - protein, 9 aa, Homo Sapiens
DHVALRRTL

SEQ ID NO: 196770 - protein, 9 aa, Homo Sapiens
SYKMCLKSQ

SEQ ID NO: 196771 - protein, 9 aa, Homo Sapiens
PTTGHVQLM

SEQ ID NO: 196772 - protein, 9 aa, Homo Sapiens
INSLGACII

SEQ ID NO: 196773 - protein, 9 aa, Homo Sapiens
IDRWGSHYV

SEQ ID NO: 196774 - protein, 9 aa, Homo Sapiens
DCSVQMEPD

SEQ ID NO: 196775 - protein, 9 aa, Homo Sapiens
AGLGHMKPN

SEQ ID NO: 196776 - protein, 9 aa, Homo Sapiens
NLQRLENNR

SEQ ID NO: 196777 - protein, 9 aa, Homo Sapiens
DLIIQHPYA

SEQ ID NO: 196778 - protein, 9 aa, Homo Sapiens
EPAVLPALL

SEQ ID NO: 196779 - protein, 9 aa, Homo Sapiens
QAAGLGHMK

SEQ ID NO: 196780 - protein, 9 aa, Homo Sapiens
RLCERFLVV

SEQ ID NO: 196781 - protein, 9 aa, Homo Sapiens
RNNNLTFLW

SEQ ID NO: 196782 - protein, 9 aa, Homo Sapiens
NRPQQPPPR

SEQ ID NO: 196783 - protein, 9 aa, Homo Sapiens
EPQAKKPAT

SEQ ID NO: 196784 - protein, 9 aa, Homo Sapiens
LWPAKSVPS

SEQ ID NO: 196785 - protein, 9 aa, Homo Sapiens
AKSYNRLRY

SEQ ID NO: 196786 - protein, 9 aa, Homo Sapiens
SSSRKECDR

SEQ ID NO: 196787 - protein, 9 aa, Homo Sapiens
FAVCSLGWV

SEQ ID NO: 196788 - protein, 9 aa, Homo Sapiens
VLYAWGVTC

SEQ ID NO: 196789 - protein, 9 aa, Homo Sapiens
GRVPALSGQ

SEQ ID NO: 196790 - protein, 9 aa, Homo Sapiens
SFCMCKNGR

SEQ ID NO: 196791 - protein, 9 aa, Homo Sapiens
DDLVTMWSF

SEQ ID NO: 196792 - protein, 9 aa, Homo Sapiens
TERPSVGQR

SEQ ID NO: 196793 - protein, 9 aa, Homo Sapiens
ECTLGATVD

SEQ ID NO: 196794 - protein, 9 aa, Homo Sapiens
QMPGFQTPS

SEQ ID NO: 196795 - protein, 9 aa, Homo Sapiens
RPAGTIPSP

SEQ ID NO: 196796 - protein, 9 aa, Homo Sapiens
AHASQGHFQ

SEQ ID NO: 196797 - protein, 9 aa, Homo Sapiens
VQVEVIIIE

SEQ ID NO: 196798 - protein, 9 aa, Homo Sapiens
QEEEGIYPD

SEQ ID NO: 196799 - protein, 9 aa, Homo Sapiens
EGCKGFFRQ

SEQ ID NO: 196800 - protein, 9 aa, Homo Sapiens
AFVSGPGAF

SEQ ID NO: 196801 - protein, 9 aa, Homo Sapiens
WFKQHLAKW

SEQ ID NO: 196802 - protein, 9 aa, Homo Sapiens
HPLDRLFSS

SEQ ID NO: 196803 - protein, 9 aa, Homo Sapiens
VQINSVGST

SEQ ID NO: 196804 - protein, 9 aa, Homo Sapiens
TPTPPPVSK

SEQ ID NO: 196805 - protein, 9 aa, Homo Sapiens
VPHADPGPE

SEQ ID NO: 196806 - protein, 9 aa, Homo Sapiens
RREWREHSL

SEQ ID NO: 196807 - protein, 9 aa, Homo Sapiens
APNGPELGG

SEQ ID NO: 196808 - protein, 9 aa, Homo Sapiens
RLRRDPARA

SEQ ID NO: 196809 - protein, 9 aa, Homo Sapiens
PWHIYFRKE

SEQ ID NO: 196810 - protein, 9 aa, Homo Sapiens
PESLGKRPF

SEQ ID NO: 196811 - protein, 9 aa, Homo Sapiens
YIGIEDSGP

SEQ ID NO: 196812 - protein, 9 aa, Homo Sapiens
IGSLSKLWP

SEQ ID NO: 196813 - protein, 9 aa, Homo Sapiens
ALKMNELNH

SEQ ID NO: 196814 - protein, 9 aa, Homo Sapiens
MPQSSGRSS

SEQ ID NO: 196815 - protein, 9 aa, Homo Sapiens
FVRIRAELY

SEQ ID NO: 196816 - protein, 9 aa, Homo Sapiens
LPRSGAILN

SEQ ID NO: 196817 - protein, 9 aa, Homo Sapiens
NLSNQRMGR

SEQ ID NO: 196818 - protein, 9 aa, Homo Sapiens
VSSEVVFET

SEQ ID NO: 196819 - protein, 9 aa, Homo Sapiens
CWGWHWEGW

SEQ ID NO: 196820 - protein, 9 aa, Homo Sapiens
NRTHGSLNH

SEQ ID NO: 196821 - protein, 9 aa, Homo Sapiens
LFPLKEETP

SEQ ID NO: 196822 - protein, 9 aa, Homo Sapiens
KIPDEQHLV

SEQ ID NO: 196823 - protein, 9 aa, Homo Sapiens
PIDVLWIKW

SEQ ID NO: 196824 - protein, 9 aa, Homo Sapiens
ARDLQGKDT

SEQ ID NO: 196825 - protein, 9 aa, Homo Sapiens
GNPDWLQGE

SEQ ID NO: 196826 - protein, 9 aa, Homo Sapiens
FEAYMHVLE

SEQ ID NO: 196827 - protein, 9 aa, Homo Sapiens
NKYYVLLPL

SEQ ID NO: 196828 - protein, 9 aa, Homo Sapiens
LAYSNSSMN

SEQ ID NO: 196829 - protein, 9 aa, Homo Sapiens
VHMTLDFDL

SEQ ID NO: 196830 - protein, 9 aa, Homo Sapiens
DSVSEFCLP

SEQ ID NO: 196831 - protein, 9 aa, Homo Sapiens
TIMECQVCS

SEQ ID NO: 196832 - protein, 9 aa, Homo Sapiens
ELKLNICPL

SEQ ID NO: 196833 - protein, 9 aa, Homo Sapiens
LKKLCGTAD

SEQ ID NO: 196834 - protein, 9 aa, Homo Sapiens
VGADGVGKS

SEQ ID NO: 196835 - protein, 9 aa, Homo Sapiens
HDIFYKPFH

SEQ ID NO: 196836 - protein, 9 aa, Homo Sapiens
LCLINECVR

SEQ ID NO: 196837 - protein, 9 aa, Homo Sapiens
MAQTVPIDS

SEQ ID NO: 196838 - protein, 9 aa, Homo Sapiens
HVLQFCYAF

SEQ ID NO: 196839 - protein, 9 aa, Homo Sapiens
IGKTAAFQN

SEQ ID NO: 196840 - protein, 9 aa, Homo Sapiens
QCWSAETPH

SEQ ID NO: 196841 - protein, 9 aa, Homo Sapiens
YYKDMLKAH

SEQ ID NO: 196842 - protein, 9 aa, Homo Sapiens
VVAITSTWN

SEQ ID NO: 196843 - protein, 9 aa, Homo Sapiens
MEALVGLSG

SEQ ID NO: 196844 - protein, 9 aa, Homo Sapiens
ELQSTAVDD

SEQ ID NO: 196845 - protein, 9 aa, Homo Sapiens
INIHHTSSV

SEQ ID NO: 196846 - protein, 9 aa, Homo Sapiens
KNFAKMEKL

SEQ ID NO: 196847 - protein, 9 aa, Homo Sapiens
VDCTCVRDS

SEQ ID NO: 196848 - protein, 9 aa, Homo Sapiens
IHFTNGYEI

SEQ ID NO: 196849 - protein, 9 aa, Homo Sapiens
EHCNMKRHE

SEQ ID NO: 196850 - protein, 9 aa, Homo Sapiens
LDILILWIC

SEQ ID NO: 196851 - protein, 9 aa, Homo Sapiens
PVQVFSQEN

SEQ ID NO: 196852 - protein, 9 aa, Homo Sapiens
DIVNINRAL

SEQ ID NO: 196853 - protein, 9 aa, Homo Sapiens
CFDEFNCID

SEQ ID NO: 196854 - protein, 9 aa, Homo Sapiens
DGVGKSALT

SEQ ID NO: 196855 - protein, 9 aa, Homo Sapiens
QKQAADVEM

SEQ ID NO: 196856 - protein, 9 aa, Homo Sapiens
RASQTYEKE

SEQ ID NO: 196857 - protein, 9 aa, Homo Sapiens
VVLTQLAPT

SEQ ID NO: 196858 - protein, 9 aa, Homo Sapiens
LVGRQKEKN

SEQ ID NO: 196859 - protein, 9 aa, Homo Sapiens
CFISDDGPP

SEQ ID NO: 196860 - protein, 9 aa, Homo Sapiens
KDHVALRRT

SEQ ID NO: 196861 - protein, 9 aa, Homo Sapiens
ACLEQDLSI

SEQ ID NO: 196862 - protein, 9 aa, Homo Sapiens
QGSVEVKAK

SEQ ID NO: 196863 - protein, 9 aa, Homo Sapiens
SLTWVSAPN

SEQ ID NO: 196864 - protein, 9 aa, Homo Sapiens
DEASHLLAA

SEQ ID NO: 196865 - protein, 9 aa, Homo Sapiens
AVGFIHLVE

SEQ ID NO: 196866 - protein, 9 aa, Homo Sapiens
SSCRQRQEV

SEQ ID NO: 196867 - protein, 9 aa, Homo Sapiens
QSAKKRASV

SEQ ID NO: 196868 - protein, 9 aa, Homo Sapiens
KILKQSPQS

SEQ ID NO: 196869 - protein, 9 aa, Homo Sapiens
LGFRCVEEV

SEQ ID NO: 196870 - protein, 9 aa, Homo Sapiens
PGPQQQTFV

SEQ ID NO: 196871 - protein, 9 aa, Homo Sapiens
QPPASPPQQ

SEQ ID NO: 196872 - protein, 9 aa, Homo Sapiens
IRLYHAHTY

SEQ ID NO: 196873 - protein, 9 aa, Homo Sapiens
NRDHFALDR

SEQ ID NO: 196874 - protein, 9 aa, Homo Sapiens
CIVNIALPN

SEQ ID NO: 196875 - protein, 9 aa, Homo Sapiens
MGQYPWASC

SEQ ID NO: 196876 - protein, 9 aa, Homo Sapiens
RREKNCIAA

SEQ ID NO: 196877 - protein, 9 aa, Homo Sapiens
ELEKDPHIA

SEQ ID NO: 196878 - protein, 9 aa, Homo Sapiens
QLQHSWGSL

SEQ ID NO: 196879 - protein, 9 aa, Homo Sapiens
THTYSVHWS

SEQ ID NO: 196880 - protein, 9 aa, Homo Sapiens
QFDGLMELA

SEQ ID NO: 196881 - protein, 9 aa, Homo Sapiens
CGFLQLWAA

SEQ ID NO: 196882 - protein, 9 aa, Homo Sapiens
AGHPRPGSV

SEQ ID NO: 196883 - protein, 9 aa, Homo Sapiens
LTSRGHTLN

SEQ ID NO: 196884 - protein, 9 aa, Homo Sapiens
IDMGFKGDI

SEQ ID NO: 196885 - protein, 9 aa, Homo Sapiens
ACIGDALLL

SEQ ID NO: 196886 - protein, 9 aa, Homo Sapiens
FHLQADNMS

SEQ ID NO: 196887 - protein, 9 aa, Homo Sapiens
KQRALVATK

SEQ ID NO: 196888 - protein, 9 aa, Homo Sapiens
ELSCPLSEC

SEQ ID NO: 196889 - protein, 9 aa, Homo Sapiens
YWREAVKSY

SEQ ID NO: 196890 - protein, 9 aa, Homo Sapiens
DNILHNKPY

SEQ ID NO: 196891 - protein, 9 aa, Homo Sapiens
ILVGVSFLA

SEQ ID NO: 196892 - protein, 9 aa, Homo Sapiens
TPITETEIS

SEQ ID NO: 196893 - protein, 9 aa, Homo Sapiens
LAIEGTCSD

SEQ ID NO: 196894 - protein, 9 aa, Homo Sapiens
ITTARGVGL

SEQ ID NO: 196895 - protein, 9 aa, Homo Sapiens
NPMFIRVTT

SEQ ID NO: 196896 - protein, 9 aa, Homo Sapiens
TCHQRIHVA

SEQ ID NO: 196897 - protein, 9 aa, Homo Sapiens
ASVIYSVFP

SEQ ID NO: 196898 - protein, 9 aa, Homo Sapiens
WTGDGEFNF

SEQ ID NO: 196899 - protein, 9 aa, Homo Sapiens
GTIPSPYKD

SEQ ID NO: 196900 - protein, 9 aa, Homo Sapiens
YGITSRETY

SEQ ID NO: 196901 - protein, 9 aa, Homo Sapiens
VAWDPRFDD

SEQ ID NO: 196902 - protein, 9 aa, Homo Sapiens
SWRDDDFVS

SEQ ID NO: 196903 - protein, 9 aa, Homo Sapiens
YGMLESIRK

SEQ ID NO: 196904 - protein, 9 aa, Homo Sapiens
CHTPPGSCC

SEQ ID NO: 196905 - protein, 9 aa, Homo Sapiens
VQTMPPHDL

SEQ ID NO: 196906 - protein, 9 aa, Homo Sapiens
RGAQCHVCT

SEQ ID NO: 196907 - protein, 9 aa, Homo Sapiens
LTGAMVWAL

SEQ ID NO: 196908 - protein, 9 aa, Homo Sapiens
SGFPVPALQ

SEQ ID NO: 196909 - protein, 9 aa, Homo Sapiens
IERWPRLQR

SEQ ID NO: 196910 - protein, 9 aa, Homo Sapiens
SNFKEESNA

SEQ ID NO: 196911 - protein, 9 aa, Homo Sapiens
RCLARRSRD

SEQ ID NO: 196912 - protein, 9 aa, Homo Sapiens
ESVNESAEV

SEQ ID NO: 196913 - protein, 9 aa, Homo Sapiens
LANIVDGTT

SEQ ID NO: 196914 - protein, 9 aa, Homo Sapiens
ENQALVRFY

SEQ ID NO: 196915 - protein, 9 aa, Homo Sapiens
YLDCTPRCP

SEQ ID NO: 196916 - protein, 9 aa, Homo Sapiens
SYSPYGMLE

SEQ ID NO: 196917 - protein, 9 aa, Homo Sapiens
VVKDPSGCV

SEQ ID NO: 196918 - protein, 9 aa, Homo Sapiens
KKYEEGEQA

SEQ ID NO: 196919 - protein, 9 aa, Homo Sapiens
FLGSDLLVP

SEQ ID NO: 196920 - protein, 9 aa, Homo Sapiens
EDSCMPPFE

SEQ ID NO: 196921 - protein, 9 aa, Homo Sapiens
PTAPTTPAM

SEQ ID NO: 196922 - protein, 9 aa, Homo Sapiens
RGLMDWSFT

SEQ ID NO: 196923 - protein, 9 aa, Homo Sapiens
VALPEMVCA

SEQ ID NO: 196924 - protein, 9 aa, Homo Sapiens
RVHPYPAQS

SEQ ID NO: 196925 - protein, 9 aa, Homo Sapiens
KKRRTYAAI

SEQ ID NO: 196926 - protein, 9 aa, Homo Sapiens
IKEIHGLRI

SEQ ID NO: 196927 - protein, 9 aa, Homo Sapiens
LCAECVKGM

SEQ ID NO: 196928 - protein, 9 aa, Homo Sapiens
VLRKGKCGE

SEQ ID NO: 196929 - protein, 9 aa, Homo Sapiens
VAWSGLSGQ

SEQ ID NO: 196930 - protein, 9 aa, Homo Sapiens
SWGPHCLAV

SEQ ID NO: 196931 - protein, 9 aa, Homo Sapiens
TLRKAGCSA

SEQ ID NO: 196932 - protein, 9 aa, Homo Sapiens
SSLSQVGDP

SEQ ID NO: 196933 - protein, 9 aa, Homo Sapiens
QKSGSVIRL

SEQ ID NO: 196934 - protein, 9 aa, Homo Sapiens
AHAPGTPAR

SEQ ID NO: 196935 - protein, 9 aa, Homo Sapiens
VRGPVTIFP

SEQ ID NO: 196936 - protein, 9 aa, Homo Sapiens
LDFDLTAAQ

SEQ ID NO: 196937 - protein, 9 aa, Homo Sapiens
CSVQMEPDQ

SEQ ID NO: 196938 - protein, 9 aa, Homo Sapiens
VYQPVPEQL

SEQ ID NO: 196939 - protein, 9 aa, Homo Sapiens
KLVFTLVEE

SEQ ID NO: 196940 - protein, 9 aa, Homo Sapiens
VTHESRFNF

SEQ ID NO: 196941 - protein, 9 aa, Homo Sapiens
LSSYVSVHT

SEQ ID NO: 196942 - protein, 9 aa, Homo Sapiens
QSLLATHVG

SEQ ID NO: 196943 - protein, 9 aa, Homo Sapiens
KLAMDTYSA

SEQ ID NO: 196944 - protein, 9 aa, Homo Sapiens
TFRTRDKFE

SEQ ID NO: 196945 - protein, 9 aa, Homo Sapiens
QVTSLANLI

SEQ ID NO: 196946 - protein, 9 aa, Homo Sapiens
PRPLEPYCR

SEQ ID NO: 196947 - protein, 9 aa, Homo Sapiens
NQCISLLNQ

SEQ ID NO: 196948 - protein, 9 aa, Homo Sapiens
TKTEHFQAR

SEQ ID NO: 196949 - protein, 9 aa, Homo Sapiens
VTGMKGKGS

SEQ ID NO: 196950 - protein, 9 aa, Homo Sapiens
LYKTVGGLI

SEQ ID NO: 196951 - protein, 9 aa, Homo Sapiens
LEAGEDEGP

SEQ ID NO: 196952 - protein, 9 aa, Homo Sapiens
TETEISVKR

SEQ ID NO: 196953 - protein, 9 aa, Homo Sapiens
AHTLVPGAH

SEQ ID NO: 196954 - protein, 9 aa, Homo Sapiens
KPYTCSDCK

SEQ ID NO: 196955 - protein, 9 aa, Homo Sapiens
CQEKQKETA

SEQ ID NO: 196956 - protein, 9 aa, Homo Sapiens
GLILNVTAL

SEQ ID NO: 196957 - protein, 9 aa, Homo Sapiens
PQSQHGVCL

SEQ ID NO: 196958 - protein, 9 aa, Homo Sapiens
QNDDPNPVV

SEQ ID NO: 196959 - protein, 9 aa, Homo Sapiens
NLPPRRTLF

SEQ ID NO: 196960 - protein, 9 aa, Homo Sapiens
GGRTFPEDE

SEQ ID NO: 196961 - protein, 9 aa, Homo Sapiens
PHPPKPSQF

SEQ ID NO: 196962 - protein, 9 aa, Homo Sapiens
RGPLVVGPL

SEQ ID NO: 196963 - protein, 9 aa, Homo Sapiens
VCENLQKLE

SEQ ID NO: 196964 - protein, 9 aa, Homo Sapiens
ADVTLIGKV

SEQ ID NO: 196965 - protein, 9 aa, Homo Sapiens
HQLSGTPYK

SEQ ID NO: 196966 - protein, 9 aa, Homo Sapiens
CRNPVCVNR

SEQ ID NO: 196967 - protein, 9 aa, Homo Sapiens
MCKASNRRP

SEQ ID NO: 196968 - protein, 9 aa, Homo Sapiens
GEFMQVWIS

SEQ ID NO: 196969 - protein, 9 aa, Homo Sapiens
FLKPGEQRC

SEQ ID NO: 196970 - protein, 9 aa, Homo Sapiens
SLLATHVGS

SEQ ID NO: 196971 - protein, 9 aa, Homo Sapiens
DPKAVDEDR

SEQ ID NO: 196972 - protein, 9 aa, Homo Sapiens
SRRQGKEWQ

SEQ ID NO: 196973 - protein, 9 aa, Homo Sapiens
PSLLRSGFY

SEQ ID NO: 196974 - protein, 9 aa, Homo Sapiens
PAAADLDAG

SEQ ID NO: 196975 - protein, 9 aa, Homo Sapiens
CLLRRERIH

SEQ ID NO: 196976 - protein, 9 aa, Homo Sapiens
YRHFVSQMP

SEQ ID NO: 196977 - protein, 9 aa, Homo Sapiens
QPNPAYRAN

SEQ ID NO: 196978 - protein, 9 aa, Homo Sapiens
SSPMLRGTQ

SEQ ID NO: 196979 - protein, 9 aa, Homo Sapiens
VTTFSESRI

SEQ ID NO: 196980 - protein, 9 aa, Homo Sapiens
LPYNKYYVL

SEQ ID NO: 196981 - protein, 9 aa, Homo Sapiens
NFAKMEKLM

SEQ ID NO: 196982 - protein, 9 aa, Homo Sapiens
PADLDNRHQ

SEQ ID NO: 196983 - protein, 9 aa, Homo Sapiens
QVHTGKKPY

SEQ ID NO: 196984 - protein, 9 aa, Homo Sapiens
LLEEEVITY

SEQ ID NO: 196985 - protein, 9 aa, Homo Sapiens
SPWLQALLN

SEQ ID NO: 196986 - protein, 9 aa, Homo Sapiens
GFFRQTIRL

SEQ ID NO: 196987 - protein, 9 aa, Homo Sapiens
RCICSIGYE

SEQ ID NO: 196988 - protein, 9 aa, Homo Sapiens
EESRLTTSS

SEQ ID NO: 196989 - protein, 9 aa, Homo Sapiens
ALRQCYHGF

SEQ ID NO: 196990 - protein, 9 aa, Homo Sapiens
VPFEAENED

SEQ ID NO: 196991 - protein, 9 aa, Homo Sapiens
APQQMYSEI

SEQ ID NO: 196992 - protein, 9 aa, Homo Sapiens
EDITQDFEE

SEQ ID NO: 196993 - protein, 9 aa, Homo Sapiens
IPDEQHLVI

SEQ ID NO: 196994 - protein, 9 aa, Homo Sapiens
PDDRVQDDD

SEQ ID NO: 196995 - protein, 9 aa, Homo Sapiens
YLCYYQPGI

SEQ ID NO: 196996 - protein, 9 aa, Homo Sapiens
RLLKEEAKL

SEQ ID NO: 196997 - protein, 9 aa, Homo Sapiens
WLQMDTPIT

SEQ ID NO: 196998 - protein, 9 aa, Homo Sapiens
TLVSLSLFS

SEQ ID NO: 196999 - protein, 9 aa, Homo Sapiens
SGDSRHSSY

SEQ ID NO: 197000 - protein, 9 aa, Homo Sapiens
GAATGGCQG

SEQ ID NO: 197001 - protein, 9 aa, Homo Sapiens
PHQEYSENN

SEQ ID NO: 197002 - protein, 9 aa, Homo Sapiens
RHQIIHTSA

SEQ ID NO: 197003 - protein, 9 aa, Homo Sapiens
RGGGRYEEY

SEQ ID NO: 197004 - protein, 9 aa, Homo Sapiens
SEDRLHCMV

SEQ ID NO: 197005 - protein, 9 aa, Homo Sapiens
DLQELALNQ

SEQ ID NO: 197006 - protein, 9 aa, Homo Sapiens
LPLAVQLFA

SEQ ID NO: 197007 - protein, 9 aa, Homo Sapiens
AHVLTPHMS

SEQ ID NO: 197008 - protein, 9 aa, Homo Sapiens
PSSDELSGD

SEQ ID NO: 197009 - protein, 9 aa, Homo Sapiens
NAQDRRELE

SEQ ID NO: 197010 - protein, 9 aa, Homo Sapiens
DSDKEVVVA

SEQ ID NO: 197011 - protein, 9 aa, Homo Sapiens
QLVAAQPEN

SEQ ID NO: 197012 - protein, 9 aa, Homo Sapiens
SQQMASWDK

SEQ ID NO: 197013 - protein, 9 aa, Homo Sapiens
QDCIIQDLT

SEQ ID NO: 197014 - protein, 9 aa, Homo Sapiens
RFLCARDFN

SEQ ID NO: 197015 - protein, 9 aa, Homo Sapiens
EEEAAREWR

SEQ ID NO: 197016 - protein, 9 aa, Homo Sapiens
GEKVMLTGS

SEQ ID NO: 197017 - protein, 9 aa, Homo Sapiens
GVTVMRTAL

SEQ ID NO: 197018 - protein, 9 aa, Homo Sapiens
GAESTAGSD

SEQ ID NO: 197019 - protein, 9 aa, Homo Sapiens
SSSCIRQYR

SEQ ID NO: 197020 - protein, 9 aa, Homo Sapiens
LGGRLYVAD

SEQ ID NO: 197021 - protein, 9 aa, Homo Sapiens
GLRIEGPMG

SEQ ID NO: 197022 - protein, 9 aa, Homo Sapiens
PQPYPARRR

SEQ ID NO: 197023 - protein, 9 aa, Homo Sapiens
RSPQKPTRK

SEQ ID NO: 197024 - protein, 9 aa, Homo Sapiens
YILEVYGVY

SEQ ID NO: 197025 - protein, 9 aa, Homo Sapiens
FCRVRFDNV

SEQ ID NO: 197026 - protein, 9 aa, Homo Sapiens
TPTSMATDQ

SEQ ID NO: 197027 - protein, 9 aa, Homo Sapiens
GVQERVTIS

SEQ ID NO: 197028 - protein, 9 aa, Homo Sapiens
VVDWIQQDN

SEQ ID NO: 197029 - protein, 9 aa, Homo Sapiens
EFLDWADVR

SEQ ID NO: 197030 - protein, 9 aa, Homo Sapiens
DESEGERCL

SEQ ID NO: 197031 - protein, 9 aa, Homo Sapiens
HLKEREDII

SEQ ID NO: 197032 - protein, 9 aa, Homo Sapiens
PTTAYTKED

SEQ ID NO: 197033 - protein, 9 aa, Homo Sapiens
HLRGGGSPS

SEQ ID NO: 197034 - protein, 9 aa, Homo Sapiens
PECCLCVSL

SEQ ID NO: 197035 - protein, 9 aa, Homo Sapiens
AVAHEGNYF

SEQ ID NO: 197036 - protein, 9 aa, Homo Sapiens
YEMLCGHVP

SEQ ID NO: 197037 - protein, 9 aa, Homo Sapiens
NPQILAALR

SEQ ID NO: 197038 - protein, 9 aa, Homo Sapiens
LSSVSGVKT

SEQ ID NO: 197039 - protein, 9 aa, Homo Sapiens
LALHRAPGP

SEQ ID NO: 197040 - protein, 9 aa, Homo Sapiens
LSSSSAQDT

SEQ ID NO: 197041 - protein, 9 aa, Homo Sapiens
RLRKGSASV

SEQ ID NO: 197042 - protein, 9 aa, Homo Sapiens
EMLLVAAST

SEQ ID NO: 197043 - protein, 9 aa, Homo Sapiens
NDVAKQCAA

SEQ ID NO: 197044 - protein, 9 aa, Homo Sapiens
QERTTLCYE

SEQ ID NO: 197045 - protein, 9 aa, Homo Sapiens
TCHWNGKKM

SEQ ID NO: 197046 - protein, 9 aa, Homo Sapiens
ATVRDRPLQ

SEQ ID NO: 197047 - protein, 9 aa, Homo Sapiens
LRNPPLFAL

SEQ ID NO: 197048 - protein, 9 aa, Homo Sapiens
KNGDVWTFG

SEQ ID NO: 197049 - protein, 9 aa, Homo Sapiens
LGLYTCRLN

SEQ ID NO: 197050 - protein, 9 aa, Homo Sapiens
FKLPCQRVD

SEQ ID NO: 197051 - protein, 9 aa, Homo Sapiens
VACRWGKRK

SEQ ID NO: 197052 - protein, 9 aa, Homo Sapiens
TPDPTMDPD

SEQ ID NO: 197053 - protein, 9 aa, Homo Sapiens
TLSKKDKEC

SEQ ID NO: 197054 - protein, 9 aa, Homo Sapiens
QKLEEEREW

SEQ ID NO: 197055 - protein, 9 aa, Homo Sapiens
DEGWVDGRM

SEQ ID NO: 197056 - protein, 9 aa, Homo Sapiens
TISALQAGT

SEQ ID NO: 197057 - protein, 9 aa, Homo Sapiens
TTGHVQLMR

SEQ ID NO: 197058 - protein, 9 aa, Homo Sapiens
TFHQELIHT

SEQ ID NO: 197059 - protein, 9 aa, Homo Sapiens
MEDQGLSVH

SEQ ID NO: 197060 - protein, 9 aa, Homo Sapiens
LGQPGYDRH

SEQ ID NO: 197061 - protein, 9 aa, Homo Sapiens
VVDWDACPL

SEQ ID NO: 197062 - protein, 9 aa, Homo Sapiens
STNAGTSGL

SEQ ID NO: 197063 - protein, 9 aa, Homo Sapiens
LYTCRLNRL

SEQ ID NO: 197064 - protein, 9 aa, Homo Sapiens
ASWGPHCLA

SEQ ID NO: 197065 - protein, 9 aa, Homo Sapiens
THEDRPFPH

SEQ ID NO: 197066 - protein, 9 aa, Homo Sapiens
EDHDTYTCL

SEQ ID NO: 197067 - protein, 9 aa, Homo Sapiens
LTKDCSSPT

SEQ ID NO: 197068 - protein, 9 aa, Homo Sapiens
SCPLSECHT

SEQ ID NO: 197069 - protein, 9 aa, Homo Sapiens
LERSANRDR

SEQ ID NO: 197070 - protein, 9 aa, Homo Sapiens
EVIAWWGLG

SEQ ID NO: 197071 - protein, 9 aa, Homo Sapiens
NMRGQHCQH

SEQ ID NO: 197072 - protein, 9 aa, Homo Sapiens
YLHNYGIMH

SEQ ID NO: 197073 - protein, 9 aa, Homo Sapiens
CWLKVRDLT

SEQ ID NO: 197074 - protein, 9 aa, Homo Sapiens
GQQEPSTAR

SEQ ID NO: 197075 - protein, 9 aa, Homo Sapiens
EYGGTWELM

SEQ ID NO: 197076 - protein, 9 aa, Homo Sapiens
SDLIIQHPY

SEQ ID NO: 197077 - protein, 9 aa, Homo Sapiens
LCTPPTAAV

SEQ ID NO: 197078 - protein, 9 aa, Homo Sapiens
PVMILNELH

SEQ ID NO: 197079 - protein, 9 aa, Homo Sapiens
KIKVASEQY

SEQ ID NO: 197080 - protein, 9 aa, Homo Sapiens
GTQFDWLSA

SEQ ID NO: 197081 - protein, 9 aa, Homo Sapiens
FYRCGGPVP

SEQ ID NO: 197082 - protein, 9 aa, Homo Sapiens
GKDLFCEFI

SEQ ID NO: 197083 - protein, 9 aa, Homo Sapiens
DVQGIQKPG

SEQ ID NO: 197084 - protein, 9 aa, Homo Sapiens
CSVYLFSFS

SEQ ID NO: 197085 - protein, 9 aa, Homo Sapiens
EAQLQAECR

SEQ ID NO: 197086 - protein, 9 aa, Homo Sapiens
LTQKMISET

SEQ ID NO: 197087 - protein, 9 aa, Homo Sapiens
TNFTGVSGV

SEQ ID NO: 197088 - protein, 9 aa, Homo Sapiens
KGPHYERPL

SEQ ID NO: 197089 - protein, 9 aa, Homo Sapiens
EDGDPTVIG

SEQ ID NO: 197090 - protein, 9 aa, Homo Sapiens
QNLLLHSPG

SEQ ID NO: 197091 - protein, 9 aa, Homo Sapiens
AVAVAARQE

SEQ ID NO: 197092 - protein, 9 aa, Homo Sapiens
SYDCACSPG

SEQ ID NO: 197093 - protein, 9 aa, Homo Sapiens
CLDNFKGKF

SEQ ID NO: 197094 - protein, 9 aa, Homo Sapiens
ASAGVLILV

SEQ ID NO: 197095 - protein, 9 aa, Homo Sapiens
TAMHMPGPT

SEQ ID NO: 197096 - protein, 9 aa, Homo Sapiens
EPCPSLTFS

SEQ ID NO: 197097 - protein, 9 aa, Homo Sapiens
ENKEFMKCL

SEQ ID NO: 197098 - protein, 9 aa, Homo Sapiens
VFPAICFGF

SEQ ID NO: 197099 - protein, 9 aa, Homo Sapiens
LQKDVGPMY

SEQ ID NO: 197100 - protein, 9 aa, Homo Sapiens
SGTPPSPVS

SEQ ID NO: 197101 - protein, 9 aa, Homo Sapiens
IFIDRDPTA

SEQ ID NO: 197102 - protein, 9 aa, Homo Sapiens
KKDLRHKPW

SEQ ID NO: 197103 - protein, 9 aa, Homo Sapiens
LMSARMSNM

SEQ ID NO: 197104 - protein, 9 aa, Homo Sapiens
QGKEWQGDR

SEQ ID NO: 197105 - protein, 9 aa, Homo Sapiens
VQMVAIQVY

SEQ ID NO: 197106 - protein, 9 aa, Homo Sapiens
ISPDLPDII

SEQ ID NO: 197107 - protein, 9 aa, Homo Sapiens
CAPPYYLDF

SEQ ID NO: 197108 - protein, 9 aa, Homo Sapiens
GRPQIPTNL

SEQ ID NO: 197109 - protein, 9 aa, Homo Sapiens
PWKHGGEKG

SEQ ID NO: 197110 - protein, 9 aa, Homo Sapiens
LTLVGEAIV

SEQ ID NO: 197111 - protein, 9 aa, Homo Sapiens
DRMIDMGFK

SEQ ID NO: 197112 - protein, 9 aa, Homo Sapiens
IWSHWTDVQ

SEQ ID NO: 197113 - protein, 9 aa, Homo Sapiens
NYEQLRQVH

SEQ ID NO: 197114 - protein, 9 aa, Homo Sapiens
IQGSLWPAK

SEQ ID NO: 197115 - protein, 9 aa, Homo Sapiens
NTMGSYKCM

SEQ ID NO: 197116 - protein, 9 aa, Homo Sapiens
FVFMFMDMD

SEQ ID NO: 197117 - protein, 9 aa, Homo Sapiens
PELSRHIYL

SEQ ID NO: 197118 - protein, 9 aa, Homo Sapiens
FTVRYIRIV

SEQ ID NO: 197119 - protein, 9 aa, Homo Sapiens
AGAHLQGEP

SEQ ID NO: 197120 - protein, 9 aa, Homo Sapiens
WFEVHDISS

SEQ ID NO: 197121 - protein, 9 aa, Homo Sapiens
LARLRRDPA

SEQ ID NO: 197122 - protein, 9 aa, Homo Sapiens
LVIYTAVFM

SEQ ID NO: 197123 - protein, 9 aa, Homo Sapiens
MGGPGAEEM

SEQ ID NO: 197124 - protein, 9 aa, Homo Sapiens
IDLCTVPKV

SEQ ID NO: 197125 - protein, 9 aa, Homo Sapiens
TARRCTRKF

SEQ ID NO: 197126 - protein, 9 aa, Homo Sapiens
PTSPEGSTT

SEQ ID NO: 197127 - protein, 9 aa, Homo Sapiens
KTSQCSVFW

SEQ ID NO: 197128 - protein, 9 aa, Homo Sapiens
FKMGDHMKV

SEQ ID NO: 197129 - protein, 9 aa, Homo Sapiens
PILIKYHHS

SEQ ID NO: 197130 - protein, 9 aa, Homo Sapiens
VVEAVRGCE

SEQ ID NO: 197131 - protein, 9 aa, Homo Sapiens
NSCINPFLY

SEQ ID NO: 197132 - protein, 9 aa, Homo Sapiens
KQENTCLCN

SEQ ID NO: 197133 - protein, 9 aa, Homo Sapiens
ELEKIPTMS

SEQ ID NO: 197134 - protein, 9 aa, Homo Sapiens
MNFITAYVM

SEQ ID NO: 197135 - protein, 9 aa, Homo Sapiens
QRRPLVVHT

SEQ ID NO: 197136 - protein, 9 aa, Homo Sapiens
AVLNTVWDL

SEQ ID NO: 197137 - protein, 9 aa, Homo Sapiens
HNKGHKSSR

SEQ ID NO: 197138 - protein, 9 aa, Homo Sapiens
SEGDNFTSP

SEQ ID NO: 197139 - protein, 9 aa, Homo Sapiens
DTSGKPFGV

SEQ ID NO: 197140 - protein, 9 aa, Homo Sapiens
ALYYKSAVE

SEQ ID NO: 197141 - protein, 9 aa, Homo Sapiens
SSSCRPGMP

SEQ ID NO: 197142 - protein, 9 aa, Homo Sapiens
STIRLYHAH

SEQ ID NO: 197143 - protein, 9 aa, Homo Sapiens
RHKFCPLLC

SEQ ID NO: 197144 - protein, 9 aa, Homo Sapiens
GPVTIFPWC

SEQ ID NO: 197145 - protein, 9 aa, Homo Sapiens
SDEMYKVEA

SEQ ID NO: 197146 - protein, 9 aa, Homo Sapiens
IMESIKCLY

SEQ ID NO: 197147 - protein, 9 aa, Homo Sapiens
IRRDGIQIR

SEQ ID NO: 197148 - protein, 9 aa, Homo Sapiens
AYYKKCPSV

SEQ ID NO: 197149 - protein, 9 aa, Homo Sapiens
PLLGYSMSI

SEQ ID NO: 197150 - protein, 9 aa, Homo Sapiens
RYCMDVNEC

SEQ ID NO: 197151 - protein, 9 aa, Homo Sapiens
EARGRDLLV

SEQ ID NO: 197152 - protein, 9 aa, Homo Sapiens
LTGNLALLV

SEQ ID NO: 197153 - protein, 9 aa, Homo Sapiens
LQSQLDTLC

SEQ ID NO: 197154 - protein, 9 aa, Homo Sapiens
QLQTQQEQQ

SEQ ID NO: 197155 - protein, 9 aa, Homo Sapiens
AAACQDLPA

SEQ ID NO: 197156 - protein, 9 aa, Homo Sapiens
QGVLRSISC

SEQ ID NO: 197157 - protein, 9 aa, Homo Sapiens
HSIHDHQAS

SEQ ID NO: 197158 - protein, 9 aa, Homo Sapiens
LQSSRAVMG

SEQ ID NO: 197159 - protein, 9 aa, Homo Sapiens
ETQKWFKQH

SEQ ID NO: 197160 - protein, 9 aa, Homo Sapiens
WPSALGSWS

SEQ ID NO: 197161 - protein, 9 aa, Homo Sapiens
EDVRGNPRG

SEQ ID NO: 197162 - protein, 9 aa, Homo Sapiens
AVKIISKGM

SEQ ID NO: 197163 - protein, 9 aa, Homo Sapiens
QQESLQERK

SEQ ID NO: 197164 - protein, 9 aa, Homo Sapiens
GPDFPWSMG

SEQ ID NO: 197165 - protein, 9 aa, Homo Sapiens
TSGGSQALD

SEQ ID NO: 197166 - protein, 9 aa, Homo Sapiens
GSPMPGFST

SEQ ID NO: 197167 - protein, 9 aa, Homo Sapiens
KASITPGLH

SEQ ID NO: 197168 - protein, 9 aa, Homo Sapiens
HCSTGIGRS

SEQ ID NO: 197169 - protein, 9 aa, Homo Sapiens
VMEGDDIVN

SEQ ID NO: 197170 - protein, 9 aa, Homo Sapiens
SCMPPFEFH

SEQ ID NO: 197171 - protein, 9 aa, Homo Sapiens
LQERPIKKL

SEQ ID NO: 197172 - protein, 9 aa, Homo Sapiens
MQPNVKYPW

SEQ ID NO: 197173 - protein, 9 aa, Homo Sapiens
FEVATCDRC

SEQ ID NO: 197174 - protein, 9 aa, Homo Sapiens
KQLRAENEL

SEQ ID NO: 197175 - protein, 9 aa, Homo Sapiens
VKPLSQVTS

SEQ ID NO: 197176 - protein, 9 aa, Homo Sapiens
ERVPGTIWN

SEQ ID NO: 197177 - protein, 9 aa, Homo Sapiens
LSIGMLLSN

SEQ ID NO: 197178 - protein, 9 aa, Homo Sapiens
CMDAMAEKQ

SEQ ID NO: 197179 - protein, 9 aa, Homo Sapiens
EHEEGSVVG

SEQ ID NO: 197180 - protein, 9 aa, Homo Sapiens
EEMDPGVPR

SEQ ID NO: 197181 - protein, 9 aa, Homo Sapiens
DAGEYMCLA

SEQ ID NO: 197182 - protein, 9 aa, Homo Sapiens
KCCQTNAQF

SEQ ID NO: 197183 - protein, 9 aa, Homo Sapiens
SQAHVTVSG

SEQ ID NO: 197184 - protein, 9 aa, Homo Sapiens
VAIILRMLA

SEQ ID NO: 197185 - protein, 9 aa, Homo Sapiens
AMASFLNGL

SEQ ID NO: 197186 - protein, 9 aa, Homo Sapiens
AADVEMEKH

SEQ ID NO: 197187 - protein, 9 aa, Homo Sapiens
DPVYLRQCL

SEQ ID NO: 197188 - protein, 9 aa, Homo Sapiens
SVKSWEQLS

SEQ ID NO: 197189 - protein, 9 aa, Homo Sapiens
EFKVTDARG

SEQ ID NO: 197190 - protein, 9 aa, Homo Sapiens
VIRGGPNGK

SEQ ID NO: 197191 - protein, 9 aa, Homo Sapiens
SLASRHSSL

SEQ ID NO: 197192 - protein, 9 aa, Homo Sapiens
SLPRGPLVV

SEQ ID NO: 197193 - protein, 9 aa, Homo Sapiens
CVSCKHNMR

SEQ ID NO: 197194 - protein, 9 aa, Homo Sapiens
WCLNVLRLN

SEQ ID NO: 197195 - protein, 9 aa, Homo Sapiens
DGVACMRFQ

SEQ ID NO: 197196 - protein, 9 aa, Homo Sapiens
LGGSDQEHS

SEQ ID NO: 197197 - protein, 9 aa, Homo Sapiens
RRDPARALR

SEQ ID NO: 197198 - protein, 9 aa, Homo Sapiens
CVNRRRFLL

SEQ ID NO: 197199 - protein, 9 aa, Homo Sapiens
FPQGAAPEG

SEQ ID NO: 197200 - protein, 9 aa, Homo Sapiens
SSYWIGPVE

SEQ ID NO: 197201 - protein, 9 aa, Homo Sapiens
DPDPITTLN

SEQ ID NO: 197202 - protein, 9 aa, Homo Sapiens
RLLVYTPEL

SEQ ID NO: 197203 - protein, 9 aa, Homo Sapiens
IRKALLSSE

SEQ ID NO: 197204 - protein, 9 aa, Homo Sapiens
GDPTVIGDR

SEQ ID NO: 197205 - protein, 9 aa, Homo Sapiens
QRLGIDPIN

SEQ ID NO: 197206 - protein, 9 aa, Homo Sapiens
PWQRATAWE

SEQ ID NO: 197207 - protein, 9 aa, Homo Sapiens
TPPCSPLLK

SEQ ID NO: 197208 - protein, 9 aa, Homo Sapiens
KAGVKRYAA

SEQ ID NO: 197209 - protein, 9 aa, Homo Sapiens
YFSRSNHRG

SEQ ID NO: 197210 - protein, 9 aa, Homo Sapiens
LVQWLFGGS

SEQ ID NO: 197211 - protein, 9 aa, Homo Sapiens
AVISASSCI

SEQ ID NO: 197212 - protein, 9 aa, Homo Sapiens
ETSAKNAMN

SEQ ID NO: 197213 - protein, 9 aa, Homo Sapiens
DEQLIYFYV

SEQ ID NO: 197214 - protein, 9 aa, Homo Sapiens
HLPLSDLPL

SEQ ID NO: 197215 - protein, 9 aa, Homo Sapiens
LRLEKDHVA

SEQ ID NO: 197216 - protein, 9 aa, Homo Sapiens
LVRKRQFQL

SEQ ID NO: 197217 - protein, 9 aa, Homo Sapiens
MATLSSTPG

SEQ ID NO: 197218 - protein, 9 aa, Homo Sapiens
FPTQDSRPN

SEQ ID NO: 197219 - protein, 9 aa, Homo Sapiens
RGRIRSRSS

SEQ ID NO: 197220 - protein, 9 aa, Homo Sapiens
MKVCNLSNQ

SEQ ID NO: 197221 - protein, 9 aa, Homo Sapiens
LRSGNESEC

SEQ ID NO: 197222 - protein, 9 aa, Homo Sapiens
MSRGLLEKD

SEQ ID NO: 197223 - protein, 9 aa, Homo Sapiens
QPNVKYPWG

SEQ ID NO: 197224 - protein, 9 aa, Homo Sapiens
KGKKPRQRY

SEQ ID NO: 197225 - protein, 9 aa, Homo Sapiens
PPKPSQFLP

SEQ ID NO: 197226 - protein, 9 aa, Homo Sapiens
SPYGMLESI

SEQ ID NO: 197227 - protein, 9 aa, Homo Sapiens
ELGQALRQC

SEQ ID NO: 197228 - protein, 9 aa, Homo Sapiens
IVNIERRWE

SEQ ID NO: 197229 - protein, 9 aa, Homo Sapiens
LDVPCSLYM

SEQ ID NO: 197230 - protein, 9 aa, Homo Sapiens
ANVTLIDYT

SEQ ID NO: 197231 - protein, 9 aa, Homo Sapiens
RGGPNGKLA

SEQ ID NO: 197232 - protein, 9 aa, Homo Sapiens
DHSVQINSV

SEQ ID NO: 197233 - protein, 9 aa, Homo Sapiens
AFFREECGV

SEQ ID NO: 197234 - protein, 9 aa, Homo Sapiens
MTFFTGIFY

SEQ ID NO: 197235 - protein, 9 aa, Homo Sapiens
DAFVWFEFH

SEQ ID NO: 197236 - protein, 9 aa, Homo Sapiens
HGNNIHFTN

SEQ ID NO: 197237 - protein, 9 aa, Homo Sapiens
GTEDTPDNS

SEQ ID NO: 197238 - protein, 9 aa, Homo Sapiens
TNGVVPATV

SEQ ID NO: 197239 - protein, 9 aa, Homo Sapiens
SLELQMDSH

SEQ ID NO: 197240 - protein, 9 aa, Homo Sapiens
RPSSSQPRR

SEQ ID NO: 197241 - protein, 9 aa, Homo Sapiens
YNISIWDIA

SEQ ID NO: 197242 - protein, 9 aa, Homo Sapiens
TTSVQLQTQ

SEQ ID NO: 197243 - protein, 9 aa, Homo Sapiens
NMRVEYEAL

SEQ ID NO: 197244 - protein, 9 aa, Homo Sapiens
PVYETVQHP

SEQ ID NO: 197245 - protein, 9 aa, Homo Sapiens
IPLNTKSAL

SEQ ID NO: 197246 - protein, 9 aa, Homo Sapiens
DFAYKFKCS

SEQ ID NO: 197247 - protein, 9 aa, Homo Sapiens
SKSGWEDCK

SEQ ID NO: 197248 - protein, 9 aa, Homo Sapiens
AMWFCTYMW

SEQ ID NO: 197249 - protein, 9 aa, Homo Sapiens
TRHQKLNSV

SEQ ID NO: 197250 - protein, 9 aa, Homo Sapiens
DFRVGTTDR

SEQ ID NO: 197251 - protein, 9 aa, Homo Sapiens
AARHVVFAE

SEQ ID NO: 197252 - protein, 9 aa, Homo Sapiens
SSGVQKFIS

SEQ ID NO: 197253 - protein, 9 aa, Homo Sapiens
KPNSKHFWT

SEQ ID NO: 197254 - protein, 9 aa, Homo Sapiens
AKSWLPLHP

SEQ ID NO: 197255 - protein, 9 aa, Homo Sapiens
PTRRGLARS

SEQ ID NO: 197256 - protein, 9 aa, Homo Sapiens
QRGPRPLHR

SEQ ID NO: 197257 - protein, 9 aa, Homo Sapiens
SDIATSART

SEQ ID NO: 197258 - protein, 9 aa, Homo Sapiens
RRAITNSSH

SEQ ID NO: 197259 - protein, 9 aa, Homo Sapiens
TAAPCSLKM

SEQ ID NO: 197260 - protein, 9 aa, Homo Sapiens
QCSSWWGGL

SEQ ID NO: 197261 - protein, 9 aa, Homo Sapiens
RKTNQLQYV

SEQ ID NO: 197262 - protein, 9 aa, Homo Sapiens
VDEFALEDF

SEQ ID NO: 197263 - protein, 9 aa, Homo Sapiens
QIIHTSAKP

SEQ ID NO: 197264 - protein, 9 aa, Homo Sapiens
HILFRYAGP

SEQ ID NO: 197265 - protein, 9 aa, Homo Sapiens
DLLSCICHT

SEQ ID NO: 197266 - protein, 9 aa, Homo Sapiens
RGRYGDAIR

SEQ ID NO: 197267 - protein, 9 aa, Homo Sapiens
ADTATARTP

SEQ ID NO: 197268 - protein, 9 aa, Homo Sapiens
VFIKKSESG

SEQ ID NO: 197269 - protein, 9 aa, Homo Sapiens
GFQCLCTDP

SEQ ID NO: 197270 - protein, 9 aa, Homo Sapiens
STGLPTAPV

SEQ ID NO: 197271 - protein, 9 aa, Homo Sapiens
TTAYFEAYM

SEQ ID NO: 197272 - protein, 9 aa, Homo Sapiens
TSAKPFQCT

SEQ ID NO: 197273 - protein, 9 aa, Homo Sapiens
SLSSVSGVK

SEQ ID NO: 197274 - protein, 9 aa, Homo Sapiens
YSLVKKIEN

SEQ ID NO: 197275 - protein, 9 aa, Homo Sapiens
RTQLSKGDI

SEQ ID NO: 197276 - protein, 9 aa, Homo Sapiens
NLSISGPDF

SEQ ID NO: 197277 - protein, 9 aa, Homo Sapiens
HKSNSKERE

SEQ ID NO: 197278 - protein, 9 aa, Homo Sapiens
HYVYECIEK

SEQ ID NO: 197279 - protein, 9 aa, Homo Sapiens
SDTSTLSYD

SEQ ID NO: 197280 - protein, 9 aa, Homo Sapiens
RAQEHELLE

SEQ ID NO: 197281 - protein, 9 aa, Homo Sapiens
WGPTEMFPE

SEQ ID NO: 197282 - protein, 9 aa, Homo Sapiens
LYQSKGYSS

SEQ ID NO: 197283 - protein, 9 aa, Homo Sapiens
VQNVVVKTL

SEQ ID NO: 197284 - protein, 9 aa, Homo Sapiens
CLISIQLDQ

SEQ ID NO: 197285 - protein, 9 aa, Homo Sapiens
GMLLSNALF

SEQ ID NO: 197286 - protein, 9 aa, Homo Sapiens
LDNFKGKFP

SEQ ID NO: 197287 - protein, 9 aa, Homo Sapiens
RYSTSCPRC

SEQ ID NO: 197288 - protein, 9 aa, Homo Sapiens
ASLPDIVGQ

SEQ ID NO: 197289 - protein, 9 aa, Homo Sapiens
MLKRLKGMM

SEQ ID NO: 197290 - protein, 9 aa, Homo Sapiens
VIERWPRLQ

SEQ ID NO: 197291 - protein, 9 aa, Homo Sapiens
TSTNCSTPG

SEQ ID NO: 197292 - protein, 9 aa, Homo Sapiens
SCICHTLAE

SEQ ID NO: 197293 - protein, 9 aa, Homo Sapiens
PPHLGICLD

SEQ ID NO: 197294 - protein, 9 aa, Homo Sapiens
GEDDLVTMW

SEQ ID NO: 197295 - protein, 9 aa, Homo Sapiens
FYQIGDSCE

SEQ ID NO: 197296 - protein, 9 aa, Homo Sapiens
CMYKLFSHV

SEQ ID NO: 197297 - protein, 9 aa, Homo Sapiens
AVWDDPDQN

SEQ ID NO: 197298 - protein, 9 aa, Homo Sapiens
INNADIGDT

SEQ ID NO: 197299 - protein, 9 aa, Homo Sapiens
LALALSQGD

SEQ ID NO: 197300 - protein, 9 aa, Homo Sapiens
DGNSYHLQS

SEQ ID NO: 197301 - protein, 9 aa, Homo Sapiens
HQAEKPKKG

SEQ ID NO: 197302 - protein, 9 aa, Homo Sapiens
AQPLHQHQL

SEQ ID NO: 197303 - protein, 9 aa, Homo Sapiens
TCFISDDGP

SEQ ID NO: 197304 - protein, 9 aa, Homo Sapiens
YSLYIRHLP

SEQ ID NO: 197305 - protein, 9 aa, Homo Sapiens
SGLGLCGGS

SEQ ID NO: 197306 - protein, 9 aa, Homo Sapiens
PLGFKVKSK

SEQ ID NO: 197307 - protein, 9 aa, Homo Sapiens
INTAIIEVT

SEQ ID NO: 197308 - protein, 9 aa, Homo Sapiens
AVTLVGVGA

SEQ ID NO: 197309 - protein, 9 aa, Homo Sapiens
MACFTAITA

SEQ ID NO: 197310 - protein, 9 aa, Homo Sapiens
LLDVLKSNQ

SEQ ID NO: 197311 - protein, 9 aa, Homo Sapiens
YLEWIQQEE

SEQ ID NO: 197312 - protein, 9 aa, Homo Sapiens
GPARGITIV

SEQ ID NO: 197313 - protein, 9 aa, Homo Sapiens
CLAYSNSSM

SEQ ID NO: 197314 - protein, 9 aa, Homo Sapiens
ERGEPAVLP

SEQ ID NO: 197315 - protein, 9 aa, Homo Sapiens
EEDNISSGC

SEQ ID NO: 197316 - protein, 9 aa, Homo Sapiens
GEALEGHTA

SEQ ID NO: 197317 - protein, 9 aa, Homo Sapiens
ERSKATAMA

SEQ ID NO: 197318 - protein, 9 aa, Homo Sapiens
DECFGLLGV

SEQ ID NO: 197319 - protein, 9 aa, Homo Sapiens
SLFGMQLFG

SEQ ID NO: 197320 - protein, 9 aa, Homo Sapiens
VQSDSPQGI

SEQ ID NO: 197321 - protein, 9 aa, Homo Sapiens
VLSASQLHT

SEQ ID NO: 197322 - protein, 9 aa, Homo Sapiens
AKEPLCARA

SEQ ID NO: 197323 - protein, 9 aa, Homo Sapiens
CRPRPRVAQ

SEQ ID NO: 197324 - protein, 9 aa, Homo Sapiens
WFTAVGFIH

SEQ ID NO: 197325 - protein, 9 aa, Homo Sapiens
YFPPFRLLI

SEQ ID NO: 197326 - protein, 9 aa, Homo Sapiens
DHRPWMVWD

SEQ ID NO: 197327 - protein, 9 aa, Homo Sapiens
QAHCMHILL

SEQ ID NO: 197328 - protein, 9 aa, Homo Sapiens
LWMWAVEHS

SEQ ID NO: 197329 - protein, 9 aa, Homo Sapiens
RILLPGLLA

SEQ ID NO: 197330 - protein, 9 aa, Homo Sapiens
TNDMESDIN

SEQ ID NO: 197331 - protein, 9 aa, Homo Sapiens
GDFWYVTCA

SEQ ID NO: 197332 - protein, 9 aa, Homo Sapiens
VANNPSSHP

SEQ ID NO: 197333 - protein, 9 aa, Homo Sapiens
WGSHYVDEA

SEQ ID NO: 197334 - protein, 9 aa, Homo Sapiens
KLAGWQCPE

SEQ ID NO: 197335 - protein, 9 aa, Homo Sapiens
ELVLKSVVE

SEQ ID NO: 197336 - protein, 9 aa, Homo Sapiens
NCCQHSSVL

SEQ ID NO: 197337 - protein, 9 aa, Homo Sapiens
KTILVAHQR

SEQ ID NO: 197338 - protein, 9 aa, Homo Sapiens
DGLGNMPLH

SEQ ID NO: 197339 - protein, 9 aa, Homo Sapiens
VSGLIYEET

SEQ ID NO: 197340 - protein, 9 aa, Homo Sapiens
IIIWSHWTD

SEQ ID NO: 197341 - protein, 9 aa, Homo Sapiens
PVMRWSHQA

SEQ ID NO: 197342 - protein, 9 aa, Homo Sapiens
SHPRGVKRR

SEQ ID NO: 197343 - protein, 9 aa, Homo Sapiens
PERQGSIQP

SEQ ID NO: 197344 - protein, 9 aa, Homo Sapiens
ASPENLCLI

SEQ ID NO: 197345 - protein, 9 aa, Homo Sapiens
ISKAPSMDA

SEQ ID NO: 197346 - protein, 9 aa, Homo Sapiens
GGTWELMKE

SEQ ID NO: 197347 - protein, 9 aa, Homo Sapiens
ANEESRLTT

SEQ ID NO: 197348 - protein, 9 aa, Homo Sapiens
PETERQWIQ

SEQ ID NO: 197349 - protein, 9 aa, Homo Sapiens
SEDEASHLL

SEQ ID NO: 197350 - protein, 9 aa, Homo Sapiens
DKLVFTLVE

SEQ ID NO: 197351 - protein, 9 aa, Homo Sapiens
YLALNVILV

SEQ ID NO: 197352 - protein, 9 aa, Homo Sapiens
LKERLSYHH

SEQ ID NO: 197353 - protein, 9 aa, Homo Sapiens
LESSVPQQQ

SEQ ID NO: 197354 - protein, 9 aa, Homo Sapiens
GACGALLLA

SEQ ID NO: 197355 - protein, 9 aa, Homo Sapiens
ILVAHQRTH

SEQ ID NO: 197356 - protein, 9 aa, Homo Sapiens
LMGPEDGAA

SEQ ID NO: 197357 - protein, 9 aa, Homo Sapiens
RGWYSRGRI

SEQ ID NO: 197358 - protein, 9 aa, Homo Sapiens
AGCSAEEIC

SEQ ID NO: 197359 - protein, 9 aa, Homo Sapiens
SIKTKTEHF

SEQ ID NO: 197360 - protein, 9 aa, Homo Sapiens
SCTHLMWAC

SEQ ID NO: 197361 - protein, 9 aa, Homo Sapiens
LVHCPHGPE

SEQ ID NO: 197362 - protein, 9 aa, Homo Sapiens
SQTQQILPF

SEQ ID NO: 197363 - protein, 9 aa, Homo Sapiens
ERTTLCYEE

SEQ ID NO: 197364 - protein, 9 aa, Homo Sapiens
CRLVFFNKC

SEQ ID NO: 197365 - protein, 9 aa, Homo Sapiens
KEQLEHWER

SEQ ID NO: 197366 - protein, 9 aa, Homo Sapiens
DIAVTPLKL

SEQ ID NO: 197367 - protein, 9 aa, Homo Sapiens
LVRHQKIHN

SEQ ID NO: 197368 - protein, 9 aa, Homo Sapiens
MDSSRLHRA

SEQ ID NO: 197369 - protein, 9 aa, Homo Sapiens
GSVTRSLQL

SEQ ID NO: 197370 - protein, 9 aa, Homo Sapiens
EEGTRGWWP

SEQ ID NO: 197371 - protein, 9 aa, Homo Sapiens
RRSRSCCNT

SEQ ID NO: 197372 - protein, 9 aa, Homo Sapiens
LPVMGLTKS

SEQ ID NO: 197373 - protein, 9 aa, Homo Sapiens
EFDDRQGVL

SEQ ID NO: 197374 - protein, 9 aa, Homo Sapiens
AARLTALHI

SEQ ID NO: 197375 - protein, 9 aa, Homo Sapiens
FMPYSAAFL

SEQ ID NO: 197376 - protein, 9 aa, Homo Sapiens
KFPIKWMAP

SEQ ID NO: 197377 - protein, 9 aa, Homo Sapiens
PVSTNLEGC

SEQ ID NO: 197378 - protein, 9 aa, Homo Sapiens
LLLRREWRE

SEQ ID NO: 197379 - protein, 9 aa, Homo Sapiens
MYSTPSSLV

SEQ ID NO: 197380 - protein, 9 aa, Homo Sapiens
SVHARTVFG

SEQ ID NO: 197381 - protein, 9 aa, Homo Sapiens
ITLLDLINF

SEQ ID NO: 197382 - protein, 9 aa, Homo Sapiens
LQVVRRVIN

SEQ ID NO: 197383 - protein, 9 aa, Homo Sapiens
VLGLCALVG

SEQ ID NO: 197384 - protein, 9 aa, Homo Sapiens
IWDVADYII

SEQ ID NO: 197385 - protein, 9 aa, Homo Sapiens
HISEFKPMT

SEQ ID NO: 197386 - protein, 9 aa, Homo Sapiens
RSTVMVIHA

SEQ ID NO: 197387 - protein, 9 aa, Homo Sapiens
LSLTHLFLV

SEQ ID NO: 197388 - protein, 9 aa, Homo Sapiens
LFYATTTLH

SEQ ID NO: 197389 - protein, 9 aa, Homo Sapiens
EDDYYSPYG

SEQ ID NO: 197390 - protein, 9 aa, Homo Sapiens
WPGKYDSMI

SEQ ID NO: 197391 - protein, 9 aa, Homo Sapiens
GRVRIHDLH

SEQ ID NO: 197392 - protein, 9 aa, Homo Sapiens
QIVHMEGKS

SEQ ID NO: 197393 - protein, 9 aa, Homo Sapiens
HSDPSQPGN

SEQ ID NO: 197394 - protein, 9 aa, Homo Sapiens
REAHDIFYK

SEQ ID NO: 197395 - protein, 9 aa, Homo Sapiens
LTGCQSDII

SEQ ID NO: 197396 - protein, 9 aa, Homo Sapiens
LSLPVCTMS

SEQ ID NO: 197397 - protein, 9 aa, Homo Sapiens
GALLVYGIT

SEQ ID NO: 197398 - protein, 9 aa, Homo Sapiens
GQPESCLCF

SEQ ID NO: 197399 - protein, 9 aa, Homo Sapiens
YDEEGKQLP

SEQ ID NO: 197400 - protein, 9 aa, Homo Sapiens
QVWISGEET

SEQ ID NO: 197401 - protein, 9 aa, Homo Sapiens
DTVCSNQMP

SEQ ID NO: 197402 - protein, 9 aa, Homo Sapiens
QKLEITGVS

SEQ ID NO: 197403 - protein, 9 aa, Homo Sapiens
TIWNEIDDM

SEQ ID NO: 197404 - protein, 9 aa, Homo Sapiens
QARDQLRER

SEQ ID NO: 197405 - protein, 9 aa, Homo Sapiens
KKLWTTMVP

SEQ ID NO: 197406 - protein, 9 aa, Homo Sapiens
GDSCEKYVH

SEQ ID NO: 197407 - protein, 9 aa, Homo Sapiens
IHHTSSVEG

SEQ ID NO: 197408 - protein, 9 aa, Homo Sapiens
LLQRTRQAD

SEQ ID NO: 197409 - protein, 9 aa, Homo Sapiens
RSFPSVELF

SEQ ID NO: 197410 - protein, 9 aa, Homo Sapiens
LDTLCQGQE

SEQ ID NO: 197411 - protein, 9 aa, Homo Sapiens
SKPWASSLL

SEQ ID NO: 197412 - protein, 9 aa, Homo Sapiens
HAPGTPARG

SEQ ID NO: 197413 - protein, 9 aa, Homo Sapiens
VLQALKTIS

SEQ ID NO: 197414 - protein, 9 aa, Homo Sapiens
QRGRLALHR

SEQ ID NO: 197415 - protein, 9 aa, Homo Sapiens
TSMATDQKQ

SEQ ID NO: 197416 - protein, 9 aa, Homo Sapiens
KLVVVKERL

SEQ ID NO: 197417 - protein, 9 aa, Homo Sapiens
THNIENVHV

SEQ ID NO: 197418 - protein, 9 aa, Homo Sapiens
TVPATIILA

SEQ ID NO: 197419 - protein, 9 aa, Homo Sapiens
GERSQAHVT

SEQ ID NO: 197420 - protein, 9 aa, Homo Sapiens
LRRDPARAL

SEQ ID NO: 197421 - protein, 9 aa, Homo Sapiens
LAVHWQTHS

SEQ ID NO: 197422 - protein, 9 aa, Homo Sapiens
CSSLDHLTD

SEQ ID NO: 197423 - protein, 9 aa, Homo Sapiens
GPELGGSDQ

SEQ ID NO: 197424 - protein, 9 aa, Homo Sapiens
NKPRPQSPA

SEQ ID NO: 197425 - protein, 9 aa, Homo Sapiens
QFWMMAIVY

SEQ ID NO: 197426 - protein, 9 aa, Homo Sapiens
TRNQQEFAV

SEQ ID NO: 197427 - protein, 9 aa, Homo Sapiens
HTLNLKAAT

SEQ ID NO: 197428 - protein, 9 aa, Homo Sapiens
AAGLGHMKP

SEQ ID NO: 197429 - protein, 9 aa, Homo Sapiens
DPEEKKKIL

SEQ ID NO: 197430 - protein, 9 aa, Homo Sapiens
PSFPMCPPG

SEQ ID NO: 197431 - protein, 9 aa, Homo Sapiens
VSDADCDWE

SEQ ID NO: 197432 - protein, 9 aa, Homo Sapiens
NIVDGTTAK

SEQ ID NO: 197433 - protein, 9 aa, Homo Sapiens
REGCAAVMT

SEQ ID NO: 197434 - protein, 9 aa, Homo Sapiens
AGAEHVRSP

SEQ ID NO: 197435 - protein, 9 aa, Homo Sapiens
VKQGRREAV

SEQ ID NO: 197436 - protein, 9 aa, Homo Sapiens
ERGAPGNHG

SEQ ID NO: 197437 - protein, 9 aa, Homo Sapiens
QLSCMSRPV

SEQ ID NO: 197438 - protein, 9 aa, Homo Sapiens
VTERQIERK

SEQ ID NO: 197439 - protein, 9 aa, Homo Sapiens
KDALTMVVD

SEQ ID NO: 197440 - protein, 9 aa, Homo Sapiens
NFTSPKRIS

SEQ ID NO: 197441 - protein, 9 aa, Homo Sapiens
ERHHILFRY

SEQ ID NO: 197442 - protein, 9 aa, Homo Sapiens
TLEAPVSFF

SEQ ID NO: 197443 - protein, 9 aa, Homo Sapiens
GASCHNTMG

SEQ ID NO: 197444 - protein, 9 aa, Homo Sapiens
VISMTANWL

SEQ ID NO: 197445 - protein, 9 aa, Homo Sapiens
EVVFETGPA

SEQ ID NO: 197446 - protein, 9 aa, Homo Sapiens
VFPTQDSRP

SEQ ID NO: 197447 - protein, 9 aa, Homo Sapiens
YYFLEEKFE

SEQ ID NO: 197448 - protein, 9 aa, Homo Sapiens
LYLVVAGLG

SEQ ID NO: 197449 - protein, 9 aa, Homo Sapiens
TEQRELIAC

SEQ ID NO: 197450 - protein, 9 aa, Homo Sapiens
RKTMTPIAQ

SEQ ID NO: 197451 - protein, 9 aa, Homo Sapiens
ETNRLLQEE

SEQ ID NO: 197452 - protein, 9 aa, Homo Sapiens
CLQLRCPRC

SEQ ID NO: 197453 - protein, 9 aa, Homo Sapiens
KKKTYCYHK

SEQ ID NO: 197454 - protein, 9 aa, Homo Sapiens
SLSKRIMQL

SEQ ID NO: 197455 - protein, 9 aa, Homo Sapiens
QCCIPDTVW

SEQ ID NO: 197456 - protein, 9 aa, Homo Sapiens
NQEFYKNAK

SEQ ID NO: 197457 - protein, 9 aa, Homo Sapiens
PLLMPPCSS

SEQ ID NO: 197458 - protein, 9 aa, Homo Sapiens
PVAFASFTF

SEQ ID NO: 197459 - protein, 9 aa, Homo Sapiens
DMDFHSFPF

SEQ ID NO: 197460 - protein, 9 aa, Homo Sapiens
GESRKSTFI

SEQ ID NO: 197461 - protein, 9 aa, Homo Sapiens
MSFVLDEPR

SEQ ID NO: 197462 - protein, 9 aa, Homo Sapiens
MFSMLMHSS

SEQ ID NO: 197463 - protein, 9 aa, Homo Sapiens
LSGFPVPAL

SEQ ID NO: 197464 - protein, 9 aa, Homo Sapiens
DTGDALIYM

SEQ ID NO: 197465 - protein, 9 aa, Homo Sapiens
ECRLQEAEK

SEQ ID NO: 197466 - protein, 9 aa, Homo Sapiens
LGVTVMRTA

SEQ ID NO: 197467 - protein, 9 aa, Homo Sapiens
NEERVPGTI

SEQ ID NO: 197468 - protein, 9 aa, Homo Sapiens
EVMFSMLMH

SEQ ID NO: 197469 - protein, 9 aa, Homo Sapiens
SVFDVVVNP

SEQ ID NO: 197470 - protein, 9 aa, Homo Sapiens
LVQQETAQQ

SEQ ID NO: 197471 - protein, 9 aa, Homo Sapiens
VVRTLQNMP

SEQ ID NO: 197472 - protein, 9 aa, Homo Sapiens
AKLSELEAT

SEQ ID NO: 197473 - protein, 9 aa, Homo Sapiens
EGSYDCACS

SEQ ID NO: 197474 - protein, 9 aa, Homo Sapiens
KTLKKKIYK

SEQ ID NO: 197475 - protein, 9 aa, Homo Sapiens
IAKPCALYI

SEQ ID NO: 197476 - protein, 9 aa, Homo Sapiens
EGRVVRLVL

SEQ ID NO: 197477 - protein, 9 aa, Homo Sapiens
KCTNCMEDE

SEQ ID NO: 197478 - protein, 9 aa, Homo Sapiens
LDSPDDIMG

SEQ ID NO: 197479 - protein, 9 aa, Homo Sapiens
TIVKQANCP

SEQ ID NO: 197480 - protein, 9 aa, Homo Sapiens
QMLSFSFMV

SEQ ID NO: 197481 - protein, 9 aa, Homo Sapiens
ARDFYHDMD

SEQ ID NO: 197482 - protein, 9 aa, Homo Sapiens
WGPHCLAVL

SEQ ID NO: 197483 - protein, 9 aa, Homo Sapiens
MEPSPHNQR

SEQ ID NO: 197484 - protein, 9 aa, Homo Sapiens
LSDQKRELE

SEQ ID NO: 197485 - protein, 9 aa, Homo Sapiens
NGDEVISTL

SEQ ID NO: 197486 - protein, 9 aa, Homo Sapiens
GKEHCNMKR

SEQ ID NO: 197487 - protein, 9 aa, Homo Sapiens
VLYFLGSDL

SEQ ID NO: 197488 - protein, 9 aa, Homo Sapiens
PPASVSPSH

SEQ ID NO: 197489 - protein, 9 aa, Homo Sapiens
GLGKVRPCS

SEQ ID NO: 197490 - protein, 9 aa, Homo Sapiens
TLSDEIQMA

SEQ ID NO: 197491 - protein, 9 aa, Homo Sapiens
SGPSFPMCP

SEQ ID NO: 197492 - protein, 9 aa, Homo Sapiens
MKGKGSTCA

SEQ ID NO: 197493 - protein, 9 aa, Homo Sapiens
PWARLGESP

SEQ ID NO: 197494 - protein, 9 aa, Homo Sapiens
TDDCNAANI

SEQ ID NO: 197495 - protein, 9 aa, Homo Sapiens
SSTGDAGEA

SEQ ID NO: 197496 - protein, 9 aa, Homo Sapiens
RAPPFPQST

SEQ ID NO: 197497 - protein, 9 aa, Homo Sapiens
LKDLAIELR

SEQ ID NO: 197498 - protein, 9 aa, Homo Sapiens
QQAGWRLSS

SEQ ID NO: 197499 - protein, 9 aa, Homo Sapiens
RRRSRSCCN

SEQ ID NO: 197500 - protein, 9 aa, Homo Sapiens
GNNSCTMCS

SEQ ID NO: 197501 - protein, 9 aa, Homo Sapiens
FPDDRVQDD

SEQ ID NO: 197502 - protein, 9 aa, Homo Sapiens
EDHYFRSPL

SEQ ID NO: 197503 - protein, 9 aa, Homo Sapiens
LRHQIIHTS

SEQ ID NO: 197504 - protein, 9 aa, Homo Sapiens
QRFLWMWAV

SEQ ID NO: 197505 - protein, 9 aa, Homo Sapiens
GGWHDALYV

SEQ ID NO: 197506 - protein, 9 aa, Homo Sapiens
PKKMHKSVS

SEQ ID NO: 197507 - protein, 9 aa, Homo Sapiens
PPAGHAAAP

SEQ ID NO: 197508 - protein, 9 aa, Homo Sapiens
VWQESVEPQ

SEQ ID NO: 197509 - protein, 9 aa, Homo Sapiens
LNANSFLAL

SEQ ID NO: 197510 - protein, 9 aa, Homo Sapiens
GGPPALRWY

SEQ ID NO: 197511 - protein, 9 aa, Homo Sapiens
DVVMPAVKK

SEQ ID NO: 197512 - protein, 9 aa, Homo Sapiens
SKSENMTLN

SEQ ID NO: 197513 - protein, 9 aa, Homo Sapiens
DNEDDDDDE

SEQ ID NO: 197514 - protein, 9 aa, Homo Sapiens
WEQLSEYLT

SEQ ID NO: 197515 - protein, 9 aa, Homo Sapiens
FAEYIYQRQ

SEQ ID NO: 197516 - protein, 9 aa, Homo Sapiens
SAHDAGVPP

SEQ ID NO: 197517 - protein, 9 aa, Homo Sapiens
IALSIGMLL

SEQ ID NO: 197518 - protein, 9 aa, Homo Sapiens
PKGSSSLPP

SEQ ID NO: 197519 - protein, 9 aa, Homo Sapiens
SCSDVLQEH

SEQ ID NO: 197520 - protein, 9 aa, Homo Sapiens
NVGALGLPS

SEQ ID NO: 197521 - protein, 9 aa, Homo Sapiens
RVTISGAAG

SEQ ID NO: 197522 - protein, 9 aa, Homo Sapiens
MNKHLRGGG

SEQ ID NO: 197523 - protein, 9 aa, Homo Sapiens
ASGEHTMEV

SEQ ID NO: 197524 - protein, 9 aa, Homo Sapiens
IHRNSAASG

SEQ ID NO: 197525 - protein, 9 aa, Homo Sapiens
LKDQQTFTR

SEQ ID NO: 197526 - protein, 9 aa, Homo Sapiens
YKPPAGHAA

SEQ ID NO: 197527 - protein, 9 aa, Homo Sapiens
GLLFDFVGA

SEQ ID NO: 197528 - protein, 9 aa, Homo Sapiens
VKKRRRTIC

SEQ ID NO: 197529 - protein, 9 aa, Homo Sapiens
HWYPEEYEF

SEQ ID NO: 197530 - protein, 9 aa, Homo Sapiens
SPMLRGTQC

SEQ ID NO: 197531 - protein, 9 aa, Homo Sapiens
PSVCPLGFK

SEQ ID NO: 197532 - protein, 9 aa, Homo Sapiens
VQSRAQMLL

SEQ ID NO: 197533 - protein, 9 aa, Homo Sapiens
QLEGRVVRL

SEQ ID NO: 197534 - protein, 9 aa, Homo Sapiens
PQSGEGFPQ

SEQ ID NO: 197535 - protein, 9 aa, Homo Sapiens
VLNREVRQT

SEQ ID NO: 197536 - protein, 9 aa, Homo Sapiens
TKDNGDEVI

SEQ ID NO: 197537 - protein, 9 aa, Homo Sapiens
EKMKEKDKQ

SEQ ID NO: 197538 - protein, 9 aa, Homo Sapiens
ALTMVVDDL

SEQ ID NO: 197539 - protein, 9 aa, Homo Sapiens
AERRHQAEK

SEQ ID NO: 197540 - protein, 9 aa, Homo Sapiens
MGLGKTMQT

SEQ ID NO: 197541 - protein, 9 aa, Homo Sapiens
GRRQAPGAL

SEQ ID NO: 197542 - protein, 9 aa, Homo Sapiens
STLTSRGHT

SEQ ID NO: 197543 - protein, 9 aa, Homo Sapiens
TTGVRTRGS

SEQ ID NO: 197544 - protein, 9 aa, Homo Sapiens
HDSLLKDKN

SEQ ID NO: 197545 - protein, 9 aa, Homo Sapiens
QSPWHIYFR

SEQ ID NO: 197546 - protein, 9 aa, Homo Sapiens
KWFDDLPNL

SEQ ID NO: 197547 - protein, 9 aa, Homo Sapiens
GEKRSVLQD

SEQ ID NO: 197548 - protein, 9 aa, Homo Sapiens
EELKLNICP

SEQ ID NO: 197549 - protein, 9 aa, Homo Sapiens
LLPAVAHEG

SEQ ID NO: 197550 - protein, 9 aa, Homo Sapiens
ASVIMGPSP

SEQ ID NO: 197551 - protein, 9 aa, Homo Sapiens
QFDWLSAQV

SEQ ID NO: 197552 - protein, 9 aa, Homo Sapiens
SQEMLALPS

SEQ ID NO: 197553 - protein, 9 aa, Homo Sapiens
QSDKIRTAQ

SEQ ID NO: 197554 - protein, 9 aa, Homo Sapiens
GRVQPGFCF

SEQ ID NO: 197555 - protein, 9 aa, Homo Sapiens
LRPPHQALM

SEQ ID NO: 197556 - protein, 9 aa, Homo Sapiens
RGPTGVAEP

SEQ ID NO: 197557 - protein, 9 aa, Homo Sapiens
VPDERRKLI

SEQ ID NO: 197558 - protein, 9 aa, Homo Sapiens
DSAHSFSPL

SEQ ID NO: 197559 - protein, 9 aa, Homo Sapiens
KMLSLTHLF

SEQ ID NO: 197560 - protein, 9 aa, Homo Sapiens
RRGGVKRVS

SEQ ID NO: 197561 - protein, 9 aa, Homo Sapiens
NLRCLFTVL

SEQ ID NO: 197562 - protein, 9 aa, Homo Sapiens
TTVDRTAGW

SEQ ID NO: 197563 - protein, 9 aa, Homo Sapiens
RCLHTLPGS

SEQ ID NO: 197564 - protein, 9 aa, Homo Sapiens
CQRSNGEQF

SEQ ID NO: 197565 - protein, 9 aa, Homo Sapiens
QFVPSYESR

SEQ ID NO: 197566 - protein, 9 aa, Homo Sapiens
NTVWDLWAK

SEQ ID NO: 197567 - protein, 9 aa, Homo Sapiens
KAVDEDRST

SEQ ID NO: 197568 - protein, 9 aa, Homo Sapiens
EVYGVYFEL

SEQ ID NO: 197569 - protein, 9 aa, Homo Sapiens
NQEVANNPS

SEQ ID NO: 197570 - protein, 9 aa, Homo Sapiens
SVSRILTRS

SEQ ID NO: 197571 - protein, 9 aa, Homo Sapiens
SIVKYLLDL

SEQ ID NO: 197572 - protein, 9 aa, Homo Sapiens
VVLGAKTGL

SEQ ID NO: 197573 - protein, 9 aa, Homo Sapiens
LASLQIFIT

SEQ ID NO: 197574 - protein, 9 aa, Homo Sapiens
VALSHSSCR

SEQ ID NO: 197575 - protein, 9 aa, Homo Sapiens
PSSPMLRGT

SEQ ID NO: 197576 - protein, 9 aa, Homo Sapiens
RFIEKGPLL

SEQ ID NO: 197577 - protein, 9 aa, Homo Sapiens
LRREWREHS

SEQ ID NO: 197578 - protein, 9 aa, Homo Sapiens
SLSLFSCTN

SEQ ID NO: 197579 - protein, 9 aa, Homo Sapiens
VAPVETLEN

SEQ ID NO: 197580 - protein, 9 aa, Homo Sapiens
HKFCPLLCT

SEQ ID NO: 197581 - protein, 9 aa, Homo Sapiens
KVCNLSNQR

SEQ ID NO: 197582 - protein, 9 aa, Homo Sapiens
KSFRQKTIL

SEQ ID NO: 197583 - protein, 9 aa, Homo Sapiens
EPRPLEPYC

SEQ ID NO: 197584 - protein, 9 aa, Homo Sapiens
GVMATTGTV

SEQ ID NO: 197585 - protein, 9 aa, Homo Sapiens
KSKVHAFVR

SEQ ID NO: 197586 - protein, 9 aa, Homo Sapiens
KRYAAEMYG

SEQ ID NO: 197587 - protein, 9 aa, Homo Sapiens
HSGENPYRC

SEQ ID NO: 197588 - protein, 9 aa, Homo Sapiens
NECLFRMAD

SEQ ID NO: 197589 - protein, 9 aa, Homo Sapiens
LLKEEAKLK

SEQ ID NO: 197590 - protein, 9 aa, Homo Sapiens
RSITHAYYR

SEQ ID NO: 197591 - protein, 9 aa, Homo Sapiens
RAVLDALLV

SEQ ID NO: 197592 - protein, 9 aa, Homo Sapiens
AQVVIEVNS

SEQ ID NO: 197593 - protein, 9 aa, Homo Sapiens
RKTITKNLA

SEQ ID NO: 197594 - protein, 9 aa, Homo Sapiens
PSSVIRTNF

SEQ ID NO: 197595 - protein, 9 aa, Homo Sapiens
VAVAWSGLS

SEQ ID NO: 197596 - protein, 9 aa, Homo Sapiens
YIYNIFKTD

SEQ ID NO: 197597 - protein, 9 aa, Homo Sapiens
GYCPQENTL

SEQ ID NO: 197598 - protein, 9 aa, Homo Sapiens
VLMKNGDVW

SEQ ID NO: 197599 - protein, 9 aa, Homo Sapiens
LQLAMQIHF

SEQ ID NO: 197600 - protein, 9 aa, Homo Sapiens
QVEVIIIES

SEQ ID NO: 197601 - protein, 9 aa, Homo Sapiens
NRTPVPSTV

SEQ ID NO: 197602 - protein, 9 aa, Homo Sapiens
LPDFFWAPN

SEQ ID NO: 197603 - protein, 9 aa, Homo Sapiens
VTNDMESDI

SEQ ID NO: 197604 - protein, 9 aa, Homo Sapiens
CYYQPGIPT

SEQ ID NO: 197605 - protein, 9 aa, Homo Sapiens
MHCSQLAPR

SEQ ID NO: 197606 - protein, 9 aa, Homo Sapiens
PVDCTCVRD

SEQ ID NO: 197607 - protein, 9 aa, Homo Sapiens
LGHVERIMS

SEQ ID NO: 197608 - protein, 9 aa, Homo Sapiens
VPWARLGES

SEQ ID NO: 197609 - protein, 9 aa, Homo Sapiens
CTGPLLIYL

SEQ ID NO: 197610 - protein, 9 aa, Homo Sapiens
YSQAMTVRV

SEQ ID NO: 197611 - protein, 9 aa, Homo Sapiens
SCCRSSCCG

SEQ ID NO: 197612 - protein, 9 aa, Homo Sapiens
GGWGARGGG

SEQ ID NO: 197613 - protein, 9 aa, Homo Sapiens
TPIAQNTPV

SEQ ID NO: 197614 - protein, 9 aa, Homo Sapiens
AELAEAQAQ

SEQ ID NO: 197615 - protein, 9 aa, Homo Sapiens
MPLHLAACT

SEQ ID NO: 197616 - protein, 9 aa, Homo Sapiens
EECGVHVEL

SEQ ID NO: 197617 - protein, 9 aa, Homo Sapiens
IINILVSCV

SEQ ID NO: 197618 - protein, 9 aa, Homo Sapiens
VAKQMCTKT

SEQ ID NO: 197619 - protein, 9 aa, Homo Sapiens
QDLALQGTK

SEQ ID NO: 197620 - protein, 9 aa, Homo Sapiens
GWLPRLTRE

SEQ ID NO: 197621 - protein, 9 aa, Homo Sapiens
SSLPRGPLV

SEQ ID NO: 197622 - protein, 9 aa, Homo Sapiens
NHKETDDCN

SEQ ID NO: 197623 - protein, 9 aa, Homo Sapiens
HSHNMTTVT

SEQ ID NO: 197624 - protein, 9 aa, Homo Sapiens
QRATAWESH

SEQ ID NO: 197625 - protein, 9 aa, Homo Sapiens
GERGAPGNH

SEQ ID NO: 197626 - protein, 9 aa, Homo Sapiens
RVSCHITDL

SEQ ID NO: 197627 - protein, 9 aa, Homo Sapiens
RHLGLTHMN

SEQ ID NO: 197628 - protein, 9 aa, Homo Sapiens
SLNFYKELQ

SEQ ID NO: 197629 - protein, 9 aa, Homo Sapiens
HGKRFSQSF

SEQ ID NO: 197630 - protein, 9 aa, Homo Sapiens
PTTPAMPDN

SEQ ID NO: 197631 - protein, 9 aa, Homo Sapiens
SAQAHQLVA

SEQ ID NO: 197632 - protein, 9 aa, Homo Sapiens
SVCPMRRSR

SEQ ID NO: 197633 - protein, 9 aa, Homo Sapiens
FLVVVHSVT

SEQ ID NO: 197634 - protein, 9 aa, Homo Sapiens
SDTEIEYTI

SEQ ID NO: 197635 - protein, 9 aa, Homo Sapiens
DLDHFIPLQ

SEQ ID NO: 197636 - protein, 9 aa, Homo Sapiens
MLYSQGSKG

SEQ ID NO: 197637 - protein, 9 aa, Homo Sapiens
LPFPASLAR

SEQ ID NO: 197638 - protein, 9 aa, Homo Sapiens
MLCGHVPFE

SEQ ID NO: 197639 - protein, 9 aa, Homo Sapiens
LEGRVVRLV

SEQ ID NO: 197640 - protein, 9 aa, Homo Sapiens
IFKTDIVLW

SEQ ID NO: 197641 - protein, 9 aa, Homo Sapiens
ITWQQNYHS

SEQ ID NO: 197642 - protein, 9 aa, Homo Sapiens
GGTSVSLLV

SEQ ID NO: 197643 - protein, 9 aa, Homo Sapiens
FIALYRLRL

SEQ ID NO: 197644 - protein, 9 aa, Homo Sapiens
WPSSRPANG

SEQ ID NO: 197645 - protein, 9 aa, Homo Sapiens
KLNLRVGHK

SEQ ID NO: 197646 - protein, 9 aa, Homo Sapiens
DKGRILSRY

SEQ ID NO: 197647 - protein, 9 aa, Homo Sapiens
SFDTMWRIR

SEQ ID NO: 197648 - protein, 9 aa, Homo Sapiens
KLFSHVPNG

SEQ ID NO: 197649 - protein, 9 aa, Homo Sapiens
SDCSVQMEP

SEQ ID NO: 197650 - protein, 9 aa, Homo Sapiens
CHQRIHVAQ

SEQ ID NO: 197651 - protein, 9 aa, Homo Sapiens
PQVNNRNAG

SEQ ID NO: 197652 - protein, 9 aa, Homo Sapiens
NSESSSDSE

SEQ ID NO: 197653 - protein, 9 aa, Homo Sapiens
WRLARASHD

SEQ ID NO: 197654 - protein, 9 aa, Homo Sapiens
VQQETAQQQ

SEQ ID NO: 197655 - protein, 9 aa, Homo Sapiens
AACQDLPAW

SEQ ID NO: 197656 - protein, 9 aa, Homo Sapiens
PSTLSLSSV

SEQ ID NO: 197657 - protein, 9 aa, Homo Sapiens
NNKNARLLT

SEQ ID NO: 197658 - protein, 9 aa, Homo Sapiens
QSCSQSFFA

SEQ ID NO: 197659 - protein, 9 aa, Homo Sapiens
ITRLVSDWS

SEQ ID NO: 197660 - protein, 9 aa, Homo Sapiens
SRTFISSGQ

SEQ ID NO: 197661 - protein, 9 aa, Homo Sapiens
RGLVCPYME

SEQ ID NO: 197662 - protein, 9 aa, Homo Sapiens
ELEMATIRH

SEQ ID NO: 197663 - protein, 9 aa, Homo Sapiens
LQEHFAVEM

SEQ ID NO: 197664 - protein, 9 aa, Homo Sapiens
SFWTLLPTT

SEQ ID NO: 197665 - protein, 9 aa, Homo Sapiens
FLYILAKSL

SEQ ID NO: 197666 - protein, 9 aa, Homo Sapiens
LGKKERCDY

SEQ ID NO: 197667 - protein, 9 aa, Homo Sapiens
YDWYAAICN

SEQ ID NO: 197668 - protein, 9 aa, Homo Sapiens
QIAKQLEND

SEQ ID NO: 197669 - protein, 9 aa, Homo Sapiens
IVCNILIDF

SEQ ID NO: 197670 - protein, 9 aa, Homo Sapiens
KCLDELPNL

SEQ ID NO: 197671 - protein, 9 aa, Homo Sapiens
KVYAHQMVC

SEQ ID NO: 197672 - protein, 9 aa, Homo Sapiens
FPNTRNQQE

SEQ ID NO: 197673 - protein, 9 aa, Homo Sapiens
GCSAEEICR

SEQ ID NO: 197674 - protein, 9 aa, Homo Sapiens
ECHTPPGSC

SEQ ID NO: 197675 - protein, 9 aa, Homo Sapiens
ISSCMLCAG

SEQ ID NO: 197676 - protein, 9 aa, Homo Sapiens
SHYSKTSYS

SEQ ID NO: 197677 - protein, 9 aa, Homo Sapiens
GERHELTND

SEQ ID NO: 197678 - protein, 9 aa, Homo Sapiens
KWMAPEAIN

SEQ ID NO: 197679 - protein, 9 aa, Homo Sapiens
LDVDNVKYC

SEQ ID NO: 197680 - protein, 9 aa, Homo Sapiens
SSIPMDVAR

SEQ ID NO: 197681 - protein, 9 aa, Homo Sapiens
DDLDAFVWF

SEQ ID NO: 197682 - protein, 9 aa, Homo Sapiens
QEQVLGVAP

SEQ ID NO: 197683 - protein, 9 aa, Homo Sapiens
GALEMKGWR

SEQ ID NO: 197684 - protein, 9 aa, Homo Sapiens
GEIPLELQC

SEQ ID NO: 197685 - protein, 9 aa, Homo Sapiens
EQKPKGSQQ

SEQ ID NO: 197686 - protein, 9 aa, Homo Sapiens
LQTLLRSVL

SEQ ID NO: 197687 - protein, 9 aa, Homo Sapiens
ACAMVLEMI

SEQ ID NO: 197688 - protein, 9 aa, Homo Sapiens
LLAISALQR

SEQ ID NO: 197689 - protein, 9 aa, Homo Sapiens
LLRMATEKP

SEQ ID NO: 197690 - protein, 9 aa, Homo Sapiens
FCLSFVYNH

SEQ ID NO: 197691 - protein, 9 aa, Homo Sapiens
ESAMTKQDQ

SEQ ID NO: 197692 - protein, 9 aa, Homo Sapiens
PVAGDRGLV

SEQ ID NO: 197693 - protein, 9 aa, Homo Sapiens
SRTIGVLWA

SEQ ID NO: 197694 - protein, 9 aa, Homo Sapiens
IALQYCSTV

SEQ ID NO: 197695 - protein, 9 aa, Homo Sapiens
LSHLRSPSV

SEQ ID NO: 197696 - protein, 9 aa, Homo Sapiens
YSMSIPREA

SEQ ID NO: 197697 - protein, 9 aa, Homo Sapiens
THSWSPPLT

SEQ ID NO: 197698 - protein, 9 aa, Homo Sapiens
ANDMDFHSF

SEQ ID NO: 197699 - protein, 9 aa, Homo Sapiens
QGPQILMIA

SEQ ID NO: 197700 - protein, 9 aa, Homo Sapiens
VVSHNKGHK

SEQ ID NO: 197701 - protein, 9 aa, Homo Sapiens
KHKTPKVHL

SEQ ID NO: 197702 - protein, 9 aa, Homo Sapiens
IALEYSQAM

SEQ ID NO: 197703 - protein, 9 aa, Homo Sapiens
EQGCAVLRT

SEQ ID NO: 197704 - protein, 9 aa, Homo Sapiens
GKRYELSAE

SEQ ID NO: 197705 - protein, 9 aa, Homo Sapiens
EGDPVDCTC

SEQ ID NO: 197706 - protein, 9 aa, Homo Sapiens
RRQQCQAET

SEQ ID NO: 197707 - protein, 9 aa, Homo Sapiens
VTPPEELHL

SEQ ID NO: 197708 - protein, 9 aa, Homo Sapiens
ELNPYVRVT

SEQ ID NO: 197709 - protein, 9 aa, Homo Sapiens
IQHYDLESV

SEQ ID NO: 197710 - protein, 9 aa, Homo Sapiens
CRASFPHWY

SEQ ID NO: 197711 - protein, 9 aa, Homo Sapiens
RVPGTIWNE

SEQ ID NO: 197712 - protein, 9 aa, Homo Sapiens
YLPSLLRSG

SEQ ID NO: 197713 - protein, 9 aa, Homo Sapiens
KQVVLLTNE

SEQ ID NO: 197714 - protein, 9 aa, Homo Sapiens
LVLKSVVEA

SEQ ID NO: 197715 - protein, 9 aa, Homo Sapiens
MRQVEPQAK

SEQ ID NO: 197716 - protein, 9 aa, Homo Sapiens
KRGLVSHTC

SEQ ID NO: 197717 - protein, 9 aa, Homo Sapiens
DPSGCVESL

SEQ ID NO: 197718 - protein, 9 aa, Homo Sapiens
ELAKDFIQK

SEQ ID NO: 197719 - protein, 9 aa, Homo Sapiens
DITQNAQHA

SEQ ID NO: 197720 - protein, 9 aa, Homo Sapiens
KFEDAKTDG

SEQ ID NO: 197721 - protein, 9 aa, Homo Sapiens
VTTVADTDD

SEQ ID NO: 197722 - protein, 9 aa, Homo Sapiens
IHYSSVPRF

SEQ ID NO: 197723 - protein, 9 aa, Homo Sapiens
EDGSQGSWE

SEQ ID NO: 197724 - protein, 9 aa, Homo Sapiens
LHIKKTLSQ

SEQ ID NO: 197725 - protein, 9 aa, Homo Sapiens
SVPLSPSLS

SEQ ID NO: 197726 - protein, 9 aa, Homo Sapiens
WLPRLTRER

SEQ ID NO: 197727 - protein, 9 aa, Homo Sapiens
IFMAMQAMI

SEQ ID NO: 197728 - protein, 9 aa, Homo Sapiens
PLHRWLQQT

SEQ ID NO: 197729 - protein, 9 aa, Homo Sapiens
HCRVPLSPL

SEQ ID NO: 197730 - protein, 9 aa, Homo Sapiens
GVSLVLTAR

SEQ ID NO: 197731 - protein, 9 aa, Homo Sapiens
FCDPVIERW

SEQ ID NO: 197732 - protein, 9 aa, Homo Sapiens
QSVELHSLQ

SEQ ID NO: 197733 - protein, 9 aa, Homo Sapiens
PNVCDHDAS

SEQ ID NO: 197734 - protein, 9 aa, Homo Sapiens
VFTEDRDHM

SEQ ID NO: 197735 - protein, 9 aa, Homo Sapiens
VFLAFQIMP

SEQ ID NO: 197736 - protein, 9 aa, Homo Sapiens
NRLLQEELE

SEQ ID NO: 197737 - protein, 9 aa, Homo Sapiens
QGTQFDWLS

SEQ ID NO: 197738 - protein, 9 aa, Homo Sapiens
TEAPLLIHP

SEQ ID NO: 197739 - protein, 9 aa, Homo Sapiens
SHNMTTVTP

SEQ ID NO: 197740 - protein, 9 aa, Homo Sapiens
YELSAECPS

SEQ ID NO: 197741 - protein, 9 aa, Homo Sapiens
TLTSRGHTL

SEQ ID NO: 197742 - protein, 9 aa, Homo Sapiens
KKMIDTGDA

SEQ ID NO: 197743 - protein, 9 aa, Homo Sapiens
PYKPPAGHA

SEQ ID NO: 197744 - protein, 9 aa, Homo Sapiens
GVTRMTVSF

SEQ ID NO: 197745 - protein, 9 aa, Homo Sapiens
RAKWRKREC

SEQ ID NO: 197746 - protein, 9 aa, Homo Sapiens
VILSIWCPS

SEQ ID NO: 197747 - protein, 9 aa, Homo Sapiens
DPVIERWPR

SEQ ID NO: 197748 - protein, 9 aa, Homo Sapiens
HLMWACALG

SEQ ID NO: 197749 - protein, 9 aa, Homo Sapiens
LQGQLFVVF

SEQ ID NO: 197750 - protein, 9 aa, Homo Sapiens
RGASQFLVS

SEQ ID NO: 197751 - protein, 9 aa, Homo Sapiens
HHIRQEILQ

SEQ ID NO: 197752 - protein, 9 aa, Homo Sapiens
GERPYECSG

SEQ ID NO: 197753 - protein, 9 aa, Homo Sapiens
GYTIHILLW

SEQ ID NO: 197754 - protein, 9 aa, Homo Sapiens
HYRTFDGLL

SEQ ID NO: 197755 - protein, 9 aa, Homo Sapiens
KVVNSLYNK

SEQ ID NO: 197756 - protein, 9 aa, Homo Sapiens
EKRKAEALI

SEQ ID NO: 197757 - protein, 9 aa, Homo Sapiens
VLKLRSWPL

SEQ ID NO: 197758 - protein, 9 aa, Homo Sapiens
RKTIVYKVP

SEQ ID NO: 197759 - protein, 9 aa, Homo Sapiens
GSGNWAYRD

SEQ ID NO: 197760 - protein, 9 aa, Homo Sapiens
LQHSWGSLH

SEQ ID NO: 197761 - protein, 9 aa, Homo Sapiens
WQLREEQRR

SEQ ID NO: 197762 - protein, 9 aa, Homo Sapiens
GVYSWPIMN

SEQ ID NO: 197763 - protein, 9 aa, Homo Sapiens
YWNIIHQEV

SEQ ID NO: 197764 - protein, 9 aa, Homo Sapiens
AAYLALNVI

SEQ ID NO: 197765 - protein, 9 aa, Homo Sapiens
KATARERVT

SEQ ID NO: 197766 - protein, 9 aa, Homo Sapiens
VPLRKTITK

SEQ ID NO: 197767 - protein, 9 aa, Homo Sapiens
TSGSLPELL

SEQ ID NO: 197768 - protein, 9 aa, Homo Sapiens
ATARTPAWM

SEQ ID NO: 197769 - protein, 9 aa, Homo Sapiens
VAELAVNYS

SEQ ID NO: 197770 - protein, 9 aa, Homo Sapiens
LAKACSTGR

SEQ ID NO: 197771 - protein, 9 aa, Homo Sapiens
VRTYIENRP

SEQ ID NO: 197772 - protein, 9 aa, Homo Sapiens
VLPDSLQTT

SEQ ID NO: 197773 - protein, 9 aa, Homo Sapiens
SLLPSQDLH

SEQ ID NO: 197774 - protein, 9 aa, Homo Sapiens
SGSKSQSRS

SEQ ID NO: 197775 - protein, 9 aa, Homo Sapiens
LAAACQDLP

SEQ ID NO: 197776 - protein, 9 aa, Homo Sapiens
CANTLCNFT

SEQ ID NO: 197777 - protein, 9 aa, Homo Sapiens
KKTCTNYSK

SEQ ID NO: 197778 - protein, 9 aa, Homo Sapiens
DFEDFLTIM

SEQ ID NO: 197779 - protein, 9 aa, Homo Sapiens
ANGPYGKCL

SEQ ID NO: 197780 - protein, 9 aa, Homo Sapiens
MEYLQSVSR

SEQ ID NO: 197781 - protein, 9 aa, Homo Sapiens
EMTHSWSPP

SEQ ID NO: 197782 - protein, 9 aa, Homo Sapiens
PTQLSSVPT

SEQ ID NO: 197783 - protein, 9 aa, Homo Sapiens
SPSDHKIQE

SEQ ID NO: 197784 - protein, 9 aa, Homo Sapiens
CSQSFFAAA

SEQ ID NO: 197785 - protein, 9 aa, Homo Sapiens
DRNLERSAN

SEQ ID NO: 197786 - protein, 9 aa, Homo Sapiens
LNVTVKRRM

SEQ ID NO: 197787 - protein, 9 aa, Homo Sapiens
LCSKYEALQ

SEQ ID NO: 197788 - protein, 9 aa, Homo Sapiens
VSQMPFVPA

SEQ ID NO: 197789 - protein, 9 aa, Homo Sapiens
KTKETVSIL

SEQ ID NO: 197790 - protein, 9 aa, Homo Sapiens
CGGRERRDR

SEQ ID NO: 197791 - protein, 9 aa, Homo Sapiens
GIQIRLPPR

SEQ ID NO: 197792 - protein, 9 aa, Homo Sapiens
LSLWKTPVA

SEQ ID NO: 197793 - protein, 9 aa, Homo Sapiens
TLLIVNCYW

SEQ ID NO: 197794 - protein, 9 aa, Homo Sapiens
IERKHLIQL

SEQ ID NO: 197795 - protein, 9 aa, Homo Sapiens
MSLRDPVAT

SEQ ID NO: 197796 - protein, 9 aa, Homo Sapiens
MLKTHMRSH

SEQ ID NO: 197797 - protein, 9 aa, Homo Sapiens
VKALRAFHV

SEQ ID NO: 197798 - protein, 9 aa, Homo Sapiens
RPGDLVFLQ

SEQ ID NO: 197799 - protein, 9 aa, Homo Sapiens
IGYDLERGT

SEQ ID NO: 197800 - protein, 9 aa, Homo Sapiens
CSIGYEEIE

SEQ ID NO: 197801 - protein, 9 aa, Homo Sapiens
SLAFIRPRW

SEQ ID NO: 197802 - protein, 9 aa, Homo Sapiens
LKQSPQSGA

SEQ ID NO: 197803 - protein, 9 aa, Homo Sapiens
RSYCAPPTR

SEQ ID NO: 197804 - protein, 9 aa, Homo Sapiens
GCQGGRFDT

SEQ ID NO: 197805 - protein, 9 aa, Homo Sapiens
YAWGVTCSL

SEQ ID NO: 197806 - protein, 9 aa, Homo Sapiens
KDLFCEFIS

SEQ ID NO: 197807 - protein, 9 aa, Homo Sapiens
ELIACLEQD

SEQ ID NO: 197808 - protein, 9 aa, Homo Sapiens
VKKPSSVSL

SEQ ID NO: 197809 - protein, 9 aa, Homo Sapiens
VVHCSTGIG

SEQ ID NO: 197810 - protein, 9 aa, Homo Sapiens
NRIKQSASG

SEQ ID NO: 197811 - protein, 9 aa, Homo Sapiens
PEYQRLGID

SEQ ID NO: 197812 - protein, 9 aa, Homo Sapiens
QQTCIKLEC

SEQ ID NO: 197813 - protein, 9 aa, Homo Sapiens
PLGRCICSI

SEQ ID NO: 197814 - protein, 9 aa, Homo Sapiens
QKLWSGSAV

SEQ ID NO: 197815 - protein, 9 aa, Homo Sapiens
AHLQGEPKG

SEQ ID NO: 197816 - protein, 9 aa, Homo Sapiens
SCPARVVVV

SEQ ID NO: 197817 - protein, 9 aa, Homo Sapiens
AMVFLDEPT

SEQ ID NO: 197818 - protein, 9 aa, Homo Sapiens
EDPSSERNE

SEQ ID NO: 197819 - protein, 9 aa, Homo Sapiens
EMLALPSLV

SEQ ID NO: 197820 - protein, 9 aa, Homo Sapiens
QNYIQNRKS

SEQ ID NO: 197821 - protein, 9 aa, Homo Sapiens
PETQVSCLP

SEQ ID NO: 197822 - protein, 9 aa, Homo Sapiens
QDKPEEQWW

SEQ ID NO: 197823 - protein, 9 aa, Homo Sapiens
VGILYCWAG

SEQ ID NO: 197824 - protein, 9 aa, Homo Sapiens
PGGEKAGHP

SEQ ID NO: 197825 - protein, 9 aa, Homo Sapiens
ILSIWCPSS

SEQ ID NO: 197826 - protein, 9 aa, Homo Sapiens
SYYQGVYSW

SEQ ID NO: 197827 - protein, 9 aa, Homo Sapiens
SRLICRCLC

SEQ ID NO: 197828 - protein, 9 aa, Homo Sapiens
RCSMDAPSR

SEQ ID NO: 197829 - protein, 9 aa, Homo Sapiens
MCPPGGIQE

SEQ ID NO: 197830 - protein, 9 aa, Homo Sapiens
SLTHHPVGT

SEQ ID NO: 197831 - protein, 9 aa, Homo Sapiens
IRMDIDMVE

SEQ ID NO: 197832 - protein, 9 aa, Homo Sapiens
YQCSTAIFF

SEQ ID NO: 197833 - protein, 9 aa, Homo Sapiens
NLKDLAARL

SEQ ID NO: 197834 - protein, 9 aa, Homo Sapiens
EDTTETAHA

SEQ ID NO: 197835 - protein, 9 aa, Homo Sapiens
KGVAYDLGH

SEQ ID NO: 197836 - protein, 9 aa, Homo Sapiens
QQRIIIGFL

SEQ ID NO: 197837 - protein, 9 aa, Homo Sapiens
LIGAGHISE

SEQ ID NO: 197838 - protein, 9 aa, Homo Sapiens
RGGDGLYLV

SEQ ID NO: 197839 - protein, 9 aa, Homo Sapiens
NTLPAMDSS

SEQ ID NO: 197840 - protein, 9 aa, Homo Sapiens
PTEMFPERV

SEQ ID NO: 197841 - protein, 9 aa, Homo Sapiens
SPLVDIHVL

SEQ ID NO: 197842 - protein, 9 aa, Homo Sapiens
ASGEKVMLT

SEQ ID NO: 197843 - protein, 9 aa, Homo Sapiens
IIQDLTETG

SEQ ID NO: 197844 - protein, 9 aa, Homo Sapiens
SPHHCRVPL

SEQ ID NO: 197845 - protein, 9 aa, Homo Sapiens
SGPHCFCPS

SEQ ID NO: 197846 - protein, 9 aa, Homo Sapiens
SSSLSQVGD

SEQ ID NO: 197847 - protein, 9 aa, Homo Sapiens
STEVSLCTP

SEQ ID NO: 197848 - protein, 9 aa, Homo Sapiens
VQPGFCFHL

SEQ ID NO: 197849 - protein, 9 aa, Homo Sapiens
RRRTICRED

SEQ ID NO: 197850 - protein, 9 aa, Homo Sapiens
MIGFLLAVV

SEQ ID NO: 197851 - protein, 9 aa, Homo Sapiens
HGKAFHQGL

SEQ ID NO: 197852 - protein, 9 aa, Homo Sapiens
KVQGSDSDK

SEQ ID NO: 197853 - protein, 9 aa, Homo Sapiens
KKRASVSFW

SEQ ID NO: 197854 - protein, 9 aa, Homo Sapiens
NNMRVEYEA

SEQ ID NO: 197855 - protein, 9 aa, Homo Sapiens
RLPLEHLVF

SEQ ID NO: 197856 - protein, 9 aa, Homo Sapiens
VVYVSLDNT

SEQ ID NO: 197857 - protein, 9 aa, Homo Sapiens
SLESSIPMD

SEQ ID NO: 197858 - protein, 9 aa, Homo Sapiens
HPFQNLLKE

SEQ ID NO: 197859 - protein, 9 aa, Homo Sapiens
AILGYCHGE

SEQ ID NO: 197860 - protein, 9 aa, Homo Sapiens
RLLMLDDQH

SEQ ID NO: 197861 - protein, 9 aa, Homo Sapiens
WNNEYCSSG

SEQ ID NO: 197862 - protein, 9 aa, Homo Sapiens
IHILLWTFV

SEQ ID NO: 197863 - protein, 9 aa, Homo Sapiens
FWPSSRPAN

SEQ ID NO: 197864 - protein, 9 aa, Homo Sapiens
DRDITLLDL

SEQ ID NO: 197865 - protein, 9 aa, Homo Sapiens
FEYLDCTPR

SEQ ID NO: 197866 - protein, 9 aa, Homo Sapiens
RCFVRIRAE

SEQ ID NO: 197867 - protein, 9 aa, Homo Sapiens
LSLSSVSGV

SEQ ID NO: 197868 - protein, 9 aa, Homo Sapiens
EFNCIDLPV

SEQ ID NO: 197869 - protein, 9 aa, Homo Sapiens
GCQGDGGAG

SEQ ID NO: 197870 - protein, 9 aa, Homo Sapiens
EKPYCCPHC

SEQ ID NO: 197871 - protein, 9 aa, Homo Sapiens
KEFLGQGWM

SEQ ID NO: 197872 - protein, 9 aa, Homo Sapiens
PSQFLPCRP

SEQ ID NO: 197873 - protein, 9 aa, Homo Sapiens
LQGTQFDWL

SEQ ID NO: 197874 - protein, 9 aa, Homo Sapiens
EDLLQAATR

SEQ ID NO: 197875 - protein, 9 aa, Homo Sapiens
FHMDTIVFP

SEQ ID NO: 197876 - protein, 9 aa, Homo Sapiens
ILASFETGT

SEQ ID NO: 197877 - protein, 9 aa, Homo Sapiens
FTAARHVVF

SEQ ID NO: 197878 - protein, 9 aa, Homo Sapiens
KDLPSKKGI

SEQ ID NO: 197879 - protein, 9 aa, Homo Sapiens
EYLDCTPRC

SEQ ID NO: 197880 - protein, 9 aa, Homo Sapiens
KSIKTKTEH

SEQ ID NO: 197881 - protein, 9 aa, Homo Sapiens
LTSASLVSA

SEQ ID NO: 197882 - protein, 9 aa, Homo Sapiens
RQCLVTIVD

SEQ ID NO: 197883 - protein, 9 aa, Homo Sapiens
RRRQQCQAE

SEQ ID NO: 197884 - protein, 9 aa, Homo Sapiens
LAIELRRLA

SEQ ID NO: 197885 - protein, 9 aa, Homo Sapiens
GAKPPWPAL

SEQ ID NO: 197886 - protein, 9 aa, Homo Sapiens
PTWGRRWPW

SEQ ID NO: 197887 - protein, 9 aa, Homo Sapiens
VRTVMNSRQ

SEQ ID NO: 197888 - protein, 9 aa, Homo Sapiens
AEHVQSWPS

SEQ ID NO: 197889 - protein, 9 aa, Homo Sapiens
HFLSNPGTN

SEQ ID NO: 197890 - protein, 9 aa, Homo Sapiens
FYYEQRLLW

SEQ ID NO: 197891 - protein, 9 aa, Homo Sapiens
NPKGNKKNT

SEQ ID NO: 197892 - protein, 9 aa, Homo Sapiens
RDHMTSVIA

SEQ ID NO: 197893 - protein, 9 aa, Homo Sapiens
GHQEGWCRD

SEQ ID NO: 197894 - protein, 9 aa, Homo Sapiens
QDVISLQQE

SEQ ID NO: 197895 - protein, 9 aa, Homo Sapiens
DLIAHSIHD

SEQ ID NO: 197896 - protein, 9 aa, Homo Sapiens
YHSHARESE

SEQ ID NO: 197897 - protein, 9 aa, Homo Sapiens
LLNLSCQSC

SEQ ID NO: 197898 - protein, 9 aa, Homo Sapiens
EELEKDPHI

SEQ ID NO: 197899 - protein, 9 aa, Homo Sapiens
VQKFISGIS

SEQ ID NO: 197900 - protein, 9 aa, Homo Sapiens
SGSTSSGSK

SEQ ID NO: 197901 - protein, 9 aa, Homo Sapiens
KPCALYIGI

SEQ ID NO: 197902 - protein, 9 aa, Homo Sapiens
LVALIFSAM

SEQ ID NO: 197903 - protein, 9 aa, Homo Sapiens
NCEVPQPST

SEQ ID NO: 197904 - protein, 9 aa, Homo Sapiens
APGPGNGGT

SEQ ID NO: 197905 - protein, 9 aa, Homo Sapiens
RLTTSSVGQ

SEQ ID NO: 197906 - protein, 9 aa, Homo Sapiens
LVNNPRIEV

SEQ ID NO: 197907 - protein, 9 aa, Homo Sapiens
VSTLRLQHM

SEQ ID NO: 197908 - protein, 9 aa, Homo Sapiens
KEVVVATTR

SEQ ID NO: 197909 - protein, 9 aa, Homo Sapiens
LQGTKERAH

SEQ ID NO: 197910 - protein, 9 aa, Homo Sapiens
NAMRNFLQK

SEQ ID NO: 197911 - protein, 9 aa, Homo Sapiens
DARGGQSRT

SEQ ID NO: 197912 - protein, 9 aa, Homo Sapiens
RSTDAVVGI

SEQ ID NO: 197913 - protein, 9 aa, Homo Sapiens
NMTTVTPFT

SEQ ID NO: 197914 - protein, 9 aa, Homo Sapiens
VSVFDVVVN

SEQ ID NO: 197915 - protein, 9 aa, Homo Sapiens
PYKVYMVPM

SEQ ID NO: 197916 - protein, 9 aa, Homo Sapiens
HKHCHQQFK

SEQ ID NO: 197917 - protein, 9 aa, Homo Sapiens
VACAYDRLD

SEQ ID NO: 197918 - protein, 9 aa, Homo Sapiens
TSIISVVVG

SEQ ID NO: 197919 - protein, 9 aa, Homo Sapiens
YGVYFELPD

SEQ ID NO: 197920 - protein, 9 aa, Homo Sapiens
HYLKVQVII

SEQ ID NO: 197921 - protein, 9 aa, Homo Sapiens
LVVEAVRGC

SEQ ID NO: 197922 - protein, 9 aa, Homo Sapiens
PCANTLCNF

SEQ ID NO: 197923 - protein, 9 aa, Homo Sapiens
YHDMDPNEA

SEQ ID NO: 197924 - protein, 9 aa, Homo Sapiens
MFCVLYHEN

SEQ ID NO: 197925 - protein, 9 aa, Homo Sapiens
CQLKELTMI

SEQ ID NO: 197926 - protein, 9 aa, Homo Sapiens
YQPGIPTLP

SEQ ID NO: 197927 - protein, 9 aa, Homo Sapiens
KEKDKQNIQ

SEQ ID NO: 197928 - protein, 9 aa, Homo Sapiens
LFSHVPNGL

SEQ ID NO: 197929 - protein, 9 aa, Homo Sapiens
YILFGIEFS

SEQ ID NO: 197930 - protein, 9 aa, Homo Sapiens
AVKEEAVAV

SEQ ID NO: 197931 - protein, 9 aa, Homo Sapiens
HYFRSPLPT

SEQ ID NO: 197932 - protein, 9 aa, Homo Sapiens
PPPLPPPQG

SEQ ID NO: 197933 - protein, 9 aa, Homo Sapiens
ANLLANDMD

SEQ ID NO: 197934 - protein, 9 aa, Homo Sapiens
ENIPLNTKS

SEQ ID NO: 197935 - protein, 9 aa, Homo Sapiens
LLGVDSATV

SEQ ID NO: 197936 - protein, 9 aa, Homo Sapiens
LTMVVDDLR

SEQ ID NO: 197937 - protein, 9 aa, Homo Sapiens
LWRLARASH

SEQ ID NO: 197938 - protein, 9 aa, Homo Sapiens
IISDKQQST

SEQ ID NO: 197939 - protein, 9 aa, Homo Sapiens
SPAIITDKV

SEQ ID NO: 197940 - protein, 9 aa, Homo Sapiens
ADGVGKSAL

SEQ ID NO: 197941 - protein, 9 aa, Homo Sapiens
PQVGGRTFP

SEQ ID NO: 197942 - protein, 9 aa, Homo Sapiens
NLCLINECV

SEQ ID NO: 197943 - protein, 9 aa, Homo Sapiens
LVSASSSTT

SEQ ID NO: 197944 - protein, 9 aa, Homo Sapiens
LFIIIFSLF

SEQ ID NO: 197945 - protein, 9 aa, Homo Sapiens
HLWLQMDTP

SEQ ID NO: 197946 - protein, 9 aa, Homo Sapiens
SVLCFPPSL

SEQ ID NO: 197947 - protein, 9 aa, Homo Sapiens
HLISSPKFP

SEQ ID NO: 197948 - protein, 9 aa, Homo Sapiens
ISDDGPPSH

SEQ ID NO: 197949 - protein, 9 aa, Homo Sapiens
NDMESDINY

SEQ ID NO: 197950 - protein, 9 aa, Homo Sapiens
VGDPITEGN

SEQ ID NO: 197951 - protein, 9 aa, Homo Sapiens
ANPMVAKRN

SEQ ID NO: 197952 - protein, 9 aa, Homo Sapiens
TAVVQTMPP

SEQ ID NO: 197953 - protein, 9 aa, Homo Sapiens
QLWLHLRQK

SEQ ID NO: 197954 - protein, 9 aa, Homo Sapiens
KQMCTKTKE

SEQ ID NO: 197955 - protein, 9 aa, Homo Sapiens
TDNPSGSHK

SEQ ID NO: 197956 - protein, 9 aa, Homo Sapiens
NLGRKRGHW

SEQ ID NO: 197957 - protein, 9 aa, Homo Sapiens
EETFVSGHQ

SEQ ID NO: 197958 - protein, 9 aa, Homo Sapiens
QMLASDTMD

SEQ ID NO: 197959 - protein, 9 aa, Homo Sapiens
IIHVTGMKG

SEQ ID NO: 197960 - protein, 9 aa, Homo Sapiens
NSQIALEYS

SEQ ID NO: 197961 - protein, 9 aa, Homo Sapiens
APLSPGFSR

SEQ ID NO: 197962 - protein, 9 aa, Homo Sapiens
HEYIQYCCK

SEQ ID NO: 197963 - protein, 9 aa, Homo Sapiens
DTPDNSSLE

SEQ ID NO: 197964 - protein, 9 aa, Homo Sapiens
GRGWAQGWG

SEQ ID NO: 197965 - protein, 9 aa, Homo Sapiens
CDTLNRWLG

SEQ ID NO: 197966 - protein, 9 aa, Homo Sapiens
PSSSISGEE

SEQ ID NO: 197967 - protein, 9 aa, Homo Sapiens
ELRIQLWRT

SEQ ID NO: 197968 - protein, 9 aa, Homo Sapiens
CQSDIISLD

SEQ ID NO: 197969 - protein, 9 aa, Homo Sapiens
HFGCPVSSP

SEQ ID NO: 197970 - protein, 9 aa, Homo Sapiens
DLDETHAFK

SEQ ID NO: 197971 - protein, 9 aa, Homo Sapiens
ICDNRDLLV

SEQ ID NO: 197972 - protein, 9 aa, Homo Sapiens
GDILRIQDK

SEQ ID NO: 197973 - protein, 9 aa, Homo Sapiens
RPCSVYLFS

SEQ ID NO: 197974 - protein, 9 aa, Homo Sapiens
PNPWADPEC

SEQ ID NO: 197975 - protein, 9 aa, Homo Sapiens
LHSLDSGIR

SEQ ID NO: 197976 - protein, 9 aa, Homo Sapiens
DCCSSLDHL

SEQ ID NO: 197977 - protein, 9 aa, Homo Sapiens
TGDAGEALE

SEQ ID NO: 197978 - protein, 9 aa, Homo Sapiens
VRYIRIVPL

SEQ ID NO: 197979 - protein, 9 aa, Homo Sapiens
VQMGGPGAE

SEQ ID NO: 197980 - protein, 9 aa, Homo Sapiens
QYLSGYHFK

SEQ ID NO: 197981 - protein, 9 aa, Homo Sapiens
LELQSTAVD

SEQ ID NO: 197982 - protein, 9 aa, Homo Sapiens
LMYFIVHSL

SEQ ID NO: 197983 - protein, 9 aa, Homo Sapiens
HERKYAPRL

SEQ ID NO: 197984 - protein, 9 aa, Homo Sapiens
TTPGPQQVL

SEQ ID NO: 197985 - protein, 9 aa, Homo Sapiens
ESQRQSPWH

SEQ ID NO: 197986 - protein, 9 aa, Homo Sapiens
EMATIRHRP

SEQ ID NO: 197987 - protein, 9 aa, Homo Sapiens
DEEEGEDDE

SEQ ID NO: 197988 - protein, 9 aa, Homo Sapiens
MVEKTNKIK

SEQ ID NO: 197989 - protein, 9 aa, Homo Sapiens
GVTCSLTLA

SEQ ID NO: 197990 - protein, 9 aa, Homo Sapiens
CICSIGYEE

SEQ ID NO: 197991 - protein, 9 aa, Homo Sapiens
ASHLLAADA

SEQ ID NO: 197992 - protein, 9 aa, Homo Sapiens
RYQWVCCNP

SEQ ID NO: 197993 - protein, 9 aa, Homo Sapiens
LVMEGDDIV

SEQ ID NO: 197994 - protein, 9 aa, Homo Sapiens
QDGLPVLIP

SEQ ID NO: 197995 - protein, 9 aa, Homo Sapiens
LEVISELQE

SEQ ID NO: 197996 - protein, 9 aa, Homo Sapiens
EGKVVYSSL

SEQ ID NO: 197997 - protein, 9 aa, Homo Sapiens
SSQPRRWSP

SEQ ID NO: 197998 - protein, 9 aa, Homo Sapiens
ANPITESLA

SEQ ID NO: 197999 - protein, 9 aa, Homo Sapiens
TSAGCVESG

SEQ ID NO: 198000 - protein, 9 aa, Homo Sapiens
PVLTLVGEA

SEQ ID NO: 198001 - protein, 9 aa, Homo Sapiens
VVEPYNAML

SEQ ID NO: 198002 - protein, 9 aa, Homo Sapiens
IHVTGMKGK

SEQ ID NO: 198003 - protein, 9 aa, Homo Sapiens
QKGSTYSQH

SEQ ID NO: 198004 - protein, 9 aa, Homo Sapiens
HFCQGGHFR

SEQ ID NO: 198005 - protein, 9 aa, Homo Sapiens
LRAVGTQIS

SEQ ID NO: 198006 - protein, 9 aa, Homo Sapiens
FDRKQLQYL

SEQ ID NO: 198007 - protein, 9 aa, Homo Sapiens
RCHDHFGLF

SEQ ID NO: 198008 - protein, 9 aa, Homo Sapiens
SQALLDQVE

SEQ ID NO: 198009 - protein, 9 aa, Homo Sapiens
KKKLYVIRG

SEQ ID NO: 198010 - protein, 9 aa, Homo Sapiens
APPAAPALA

SEQ ID NO: 198011 - protein, 9 aa, Homo Sapiens
LVPGAHPQP

SEQ ID NO: 198012 - protein, 9 aa, Homo Sapiens
DSTHLMNGP

SEQ ID NO: 198013 - protein, 9 aa, Homo Sapiens
DPDAVRNPV

SEQ ID NO: 198014 - protein, 9 aa, Homo Sapiens
VILEGCVGP

SEQ ID NO: 198015 - protein, 9 aa, Homo Sapiens
FWLCVGKCS

SEQ ID NO: 198016 - protein, 9 aa, Homo Sapiens
EVISTLKLK

SEQ ID NO: 198017 - protein, 9 aa, Homo Sapiens
RPDRTPRPT

SEQ ID NO: 198018 - protein, 9 aa, Homo Sapiens
LRHLGLTHM

SEQ ID NO: 198019 - protein, 9 aa, Homo Sapiens
RSCSMVVLG

SEQ ID NO: 198020 - protein, 9 aa, Homo Sapiens
FGNWQDVAK

SEQ ID NO: 198021 - protein, 9 aa, Homo Sapiens
GTGCIEGHT

SEQ ID NO: 198022 - protein, 9 aa, Homo Sapiens
LQCRPPSPL

SEQ ID NO: 198023 - protein, 9 aa, Homo Sapiens
DEIQMALFM

SEQ ID NO: 198024 - protein, 9 aa, Homo Sapiens
AMTLDQWLE

SEQ ID NO: 198025 - protein, 9 aa, Homo Sapiens
FCTYMWGVI

SEQ ID NO: 198026 - protein, 9 aa, Homo Sapiens
TSVFSVFPA

SEQ ID NO: 198027 - protein, 9 aa, Homo Sapiens
ACAYDRLDH

SEQ ID NO: 198028 - protein, 9 aa, Homo Sapiens
YCWAGQGSE

SEQ ID NO: 198029 - protein, 9 aa, Homo Sapiens
EQTEVITAA

SEQ ID NO: 198030 - protein, 9 aa, Homo Sapiens
SCTNIFYEE

SEQ ID NO: 198031 - protein, 9 aa, Homo Sapiens
LRTTPLADM

SEQ ID NO: 198032 - protein, 9 aa, Homo Sapiens
LKEETPKLF

SEQ ID NO: 198033 - protein, 9 aa, Homo Sapiens
LTQLAPTLP

SEQ ID NO: 198034 - protein, 9 aa, Homo Sapiens
KVKSKMVPG

SEQ ID NO: 198035 - protein, 9 aa, Homo Sapiens
DVDEDEAVP

SEQ ID NO: 198036 - protein, 9 aa, Homo Sapiens
CYRGGGRYE

SEQ ID NO: 198037 - protein, 9 aa, Homo Sapiens
FMFANYGIW

SEQ ID NO: 198038 - protein, 9 aa, Homo Sapiens
RSPLPTTSK

SEQ ID NO: 198039 - protein, 9 aa, Homo Sapiens
FDGLLFDFV

SEQ ID NO: 198040 - protein, 9 aa, Homo Sapiens
PVLNREVRQ

SEQ ID NO: 198041 - protein, 9 aa, Homo Sapiens
SCAPPYYLD

SEQ ID NO: 198042 - protein, 9 aa, Homo Sapiens
SHEYIQYCC

SEQ ID NO: 198043 - protein, 9 aa, Homo Sapiens
TPAEEMPEK

SEQ ID NO: 198044 - protein, 9 aa, Homo Sapiens
AECRLQEAE

SEQ ID NO: 198045 - protein, 9 aa, Homo Sapiens
VRPPHVLDG

SEQ ID NO: 198046 - protein, 9 aa, Homo Sapiens
IEGKLPPIP

SEQ ID NO: 198047 - protein, 9 aa, Homo Sapiens
GEGFPQGAA

SEQ ID NO: 198048 - protein, 9 aa, Homo Sapiens
WSMGEDMSA

SEQ ID NO: 198049 - protein, 9 aa, Homo Sapiens
GHTSSSNTT

SEQ ID NO: 198050 - protein, 9 aa, Homo Sapiens
AALSNYEQL

SEQ ID NO: 198051 - protein, 9 aa, Homo Sapiens
LSPSLSRHS

SEQ ID NO: 198052 - protein, 9 aa, Homo Sapiens
DYDQYAMLY

SEQ ID NO: 198053 - protein, 9 aa, Homo Sapiens
ILILWICTR

SEQ ID NO: 198054 - protein, 9 aa, Homo Sapiens
GGRMETELA

SEQ ID NO: 198055 - protein, 9 aa, Homo Sapiens
LALVGDPAM

SEQ ID NO: 198056 - protein, 9 aa, Homo Sapiens
HTLHTWAAS

SEQ ID NO: 198057 - protein, 9 aa, Homo Sapiens
QTPDKKASH

SEQ ID NO: 198058 - protein, 9 aa, Homo Sapiens
MTPTNLAMC

SEQ ID NO: 198059 - protein, 9 aa, Homo Sapiens
SRLTTSSVG

SEQ ID NO: 198060 - protein, 9 aa, Homo Sapiens
LSNSGCGQT

SEQ ID NO: 198061 - protein, 9 aa, Homo Sapiens
LYYESIHGW

SEQ ID NO: 198062 - protein, 9 aa, Homo Sapiens
PDKPVQMEV

SEQ ID NO: 198063 - protein, 9 aa, Homo Sapiens
QREDITQNA

SEQ ID NO: 198064 - protein, 9 aa, Homo Sapiens
DNFKENIEV

SEQ ID NO: 198065 - protein, 9 aa, Homo Sapiens
CMVRVRDGL

SEQ ID NO: 198066 - protein, 9 aa, Homo Sapiens
HENIEARDM

SEQ ID NO: 198067 - protein, 9 aa, Homo Sapiens
GHISEIIEA

SEQ ID NO: 198068 - protein, 9 aa, Homo Sapiens
AFHVLRPLR

SEQ ID NO: 198069 - protein, 9 aa, Homo Sapiens
SSPTQLSSV

SEQ ID NO: 198070 - protein, 9 aa, Homo Sapiens
ALRAFHVLR

SEQ ID NO: 198071 - protein, 9 aa, Homo Sapiens
RNQSMLKTH

SEQ ID NO: 198072 - protein, 9 aa, Homo Sapiens
QAENIGYDL

SEQ ID NO: 198073 - protein, 9 aa, Homo Sapiens
SMGMHHRDR

SEQ ID NO: 198074 - protein, 9 aa, Homo Sapiens
ACSPGYEPV

SEQ ID NO: 198075 - protein, 9 aa, Homo Sapiens
AMCLAPSLF

SEQ ID NO: 198076 - protein, 9 aa, Homo Sapiens
VSLDNTVLG

SEQ ID NO: 198077 - protein, 9 aa, Homo Sapiens
SHVPNGLKT

SEQ ID NO: 198078 - protein, 9 aa, Homo Sapiens
THAEGPGTT

SEQ ID NO: 198079 - protein, 9 aa, Homo Sapiens
KSAVEQLQS

SEQ ID NO: 198080 - protein, 9 aa, Homo Sapiens
TCLLRRERI

SEQ ID NO: 198081 - protein, 9 aa, Homo Sapiens
LSAVVWAKI

SEQ ID NO: 198082 - protein, 9 aa, Homo Sapiens
AKRMDEQQV

SEQ ID NO: 198083 - protein, 9 aa, Homo Sapiens
PEKDPVEAK

SEQ ID NO: 198084 - protein, 9 aa, Homo Sapiens
SGISSQGST

SEQ ID NO: 198085 - protein, 9 aa, Homo Sapiens
CTHLMWACA

SEQ ID NO: 198086 - protein, 9 aa, Homo Sapiens
FVPSYESRR

SEQ ID NO: 198087 - protein, 9 aa, Homo Sapiens
RVPRRDIED

SEQ ID NO: 198088 - protein, 9 aa, Homo Sapiens
VMRWSHQAT

SEQ ID NO: 198089 - protein, 9 aa, Homo Sapiens
DALCSKYEA

SEQ ID NO: 198090 - protein, 9 aa, Homo Sapiens
GTRGWWPSA

SEQ ID NO: 198091 - protein, 9 aa, Homo Sapiens
ESSIPMDVA

SEQ ID NO: 198092 - protein, 9 aa, Homo Sapiens
RVLQALKTI

SEQ ID NO: 198093 - protein, 9 aa, Homo Sapiens
PNIHDLDLT

SEQ ID NO: 198094 - protein, 9 aa, Homo Sapiens
PDRTHVLSA

SEQ ID NO: 198095 - protein, 9 aa, Homo Sapiens
VYAHQMVCT

SEQ ID NO: 198096 - protein, 9 aa, Homo Sapiens
LWYPIPFTH

SEQ ID NO: 198097 - protein, 9 aa, Homo Sapiens
HGSTSVQAS

SEQ ID NO: 198098 - protein, 9 aa, Homo Sapiens
AYTCFNRLD

SEQ ID NO: 198099 - protein, 9 aa, Homo Sapiens
GVQKFISGI

SEQ ID NO: 198100 - protein, 9 aa, Homo Sapiens
LQLRCPRCG

SEQ ID NO: 198101 - protein, 9 aa, Homo Sapiens
TSLTSASLV

SEQ ID NO: 198102 - protein, 9 aa, Homo Sapiens
KRKAEALIY

SEQ ID NO: 198103 - protein, 9 aa, Homo Sapiens
ASGGVMATT

SEQ ID NO: 198104 - protein, 9 aa, Homo Sapiens
TKDCSSPTS

SEQ ID NO: 198105 - protein, 9 aa, Homo Sapiens
STSTPGYSS

SEQ ID NO: 198106 - protein, 9 aa, Homo Sapiens
ATKDGDVAT

SEQ ID NO: 198107 - protein, 9 aa, Homo Sapiens
LCQGQEHIG

SEQ ID NO: 198108 - protein, 9 aa, Homo Sapiens
REQKRILDL

SEQ ID NO: 198109 - protein, 9 aa, Homo Sapiens
RAINGLANF

SEQ ID NO: 198110 - protein, 9 aa, Homo Sapiens
CIQCAAGYE

SEQ ID NO: 198111 - protein, 9 aa, Homo Sapiens
ESDADDKMC

SEQ ID NO: 198112 - protein, 9 aa, Homo Sapiens
ETLEVELKV

SEQ ID NO: 198113 - protein, 9 aa, Homo Sapiens
VTPDHSYMR

SEQ ID NO: 198114 - protein, 9 aa, Homo Sapiens
YILFAEMLM

SEQ ID NO: 198115 - protein, 9 aa, Homo Sapiens
MYFIVHSLR

SEQ ID NO: 198116 - protein, 9 aa, Homo Sapiens
PEPCPSLTF

SEQ ID NO: 198117 - protein, 9 aa, Homo Sapiens
IHGLRIFTS

SEQ ID NO: 198118 - protein, 9 aa, Homo Sapiens
RDFYHDMDP

SEQ ID NO: 198119 - protein, 9 aa, Homo Sapiens
CQKTKGAYP

SEQ ID NO: 198120 - protein, 9 aa, Homo Sapiens
DLGQPGYDR

SEQ ID NO: 198121 - protein, 9 aa, Homo Sapiens
QADRAMYLM

SEQ ID NO: 198122 - protein, 9 aa, Homo Sapiens
TLAKVLPQL

SEQ ID NO: 198123 - protein, 9 aa, Homo Sapiens
MMYYGLPFI

SEQ ID NO: 198124 - protein, 9 aa, Homo Sapiens
ALQPGVHLR

SEQ ID NO: 198125 - protein, 9 aa, Homo Sapiens
DDRVQDDDD

SEQ ID NO: 198126 - protein, 9 aa, Homo Sapiens
DFSVTSVDA

SEQ ID NO: 198127 - protein, 9 aa, Homo Sapiens
SAVDIEFVK

SEQ ID NO: 198128 - protein, 9 aa, Homo Sapiens
HYSSVPRFY

SEQ ID NO: 198129 - protein, 9 aa, Homo Sapiens
QTMPPHDLA

SEQ ID NO: 198130 - protein, 9 aa, Homo Sapiens
QCHVCTLEA

SEQ ID NO: 198131 - protein, 9 aa, Homo Sapiens
ALVSIYVHL

SEQ ID NO: 198132 - protein, 9 aa, Homo Sapiens
NPNGGFCMY

SEQ ID NO: 198133 - protein, 9 aa, Homo Sapiens
EPGYKGPHC

SEQ ID NO: 198134 - protein, 9 aa, Homo Sapiens
GVSRLVQVY

SEQ ID NO: 198135 - protein, 9 aa, Homo Sapiens
NTKSALITV

SEQ ID NO: 198136 - protein, 9 aa, Homo Sapiens
EEGGNVEKD

SEQ ID NO: 198137 - protein, 9 aa, Homo Sapiens
NPVCVNRRR

SEQ ID NO: 198138 - protein, 9 aa, Homo Sapiens
TMVCQLMHK

SEQ ID NO: 198139 - protein, 9 aa, Homo Sapiens
VELPCPPPT

SEQ ID NO: 198140 - protein, 9 aa, Homo Sapiens
GPARTGLLP

SEQ ID NO: 198141 - protein, 9 aa, Homo Sapiens
RPAAGHCAG

SEQ ID NO: 198142 - protein, 9 aa, Homo Sapiens
IIWLEPEVL

SEQ ID NO: 198143 - protein, 9 aa, Homo Sapiens
PTARISPLG

SEQ ID NO: 198144 - protein, 9 aa, Homo Sapiens
IHDLHSGNI

SEQ ID NO: 198145 - protein, 9 aa, Homo Sapiens
LLSECSLRS

SEQ ID NO: 198146 - protein, 9 aa, Homo Sapiens
SDGIQKVWQ

SEQ ID NO: 198147 - protein, 9 aa, Homo Sapiens
HLQDSVKTP

SEQ ID NO: 198148 - protein, 9 aa, Homo Sapiens
SRSAACGGR

SEQ ID NO: 198149 - protein, 9 aa, Homo Sapiens
MGACGALLL

SEQ ID NO: 198150 - protein, 9 aa, Homo Sapiens
GAVREASPV

SEQ ID NO: 198151 - protein, 9 aa, Homo Sapiens
SIPTSLMAL

SEQ ID NO: 198152 - protein, 9 aa, Homo Sapiens
ISAYQEDPV

SEQ ID NO: 198153 - protein, 9 aa, Homo Sapiens
SAHSFSPLE

SEQ ID NO: 198154 - protein, 9 aa, Homo Sapiens
DTMVQPFTT

SEQ ID NO: 198155 - protein, 9 aa, Homo Sapiens
PAALHPPPA

SEQ ID NO: 198156 - protein, 9 aa, Homo Sapiens
PTAKSWLPL

SEQ ID NO: 198157 - protein, 9 aa, Homo Sapiens
QRQTGPSKQ

SEQ ID NO: 198158 - protein, 9 aa, Homo Sapiens
ENTEKAIEC

SEQ ID NO: 198159 - protein, 9 aa, Homo Sapiens
GQVRDTAIE

SEQ ID NO: 198160 - protein, 9 aa, Homo Sapiens
QRRICRWLR

SEQ ID NO: 198161 - protein, 9 aa, Homo Sapiens
GLLHTMLPQ

SEQ ID NO: 198162 - protein, 9 aa, Homo Sapiens
GLPVGAVTG

SEQ ID NO: 198163 - protein, 9 aa, Homo Sapiens
HGSLTTPPY

SEQ ID NO: 198164 - protein, 9 aa, Homo Sapiens
PYTENVHWF

SEQ ID NO: 198165 - protein, 9 aa, Homo Sapiens
LLNHSHNMT

SEQ ID NO: 198166 - protein, 9 aa, Homo Sapiens
EDRPFCCGQ

SEQ ID NO: 198167 - protein, 9 aa, Homo Sapiens
LGRCICSIG

SEQ ID NO: 198168 - protein, 9 aa, Homo Sapiens
TDTDGWVAV

SEQ ID NO: 198169 - protein, 9 aa, Homo Sapiens
GDPVDCTCV

SEQ ID NO: 198170 - protein, 9 aa, Homo Sapiens
TSSTGDAGE

SEQ ID NO: 198171 - protein, 9 aa, Homo Sapiens
QRMCAFLGM

SEQ ID NO: 198172 - protein, 9 aa, Homo Sapiens
CNDCNMTFV

SEQ ID NO: 198173 - protein, 9 aa, Homo Sapiens
EFAKEREWV

SEQ ID NO: 198174 - protein, 9 aa, Homo Sapiens
CKHNMRGQH

SEQ ID NO: 198175 - protein, 9 aa, Homo Sapiens
NVTLIDYTL

SEQ ID NO: 198176 - protein, 9 aa, Homo Sapiens
INTLPWKRI

SEQ ID NO: 198177 - protein, 9 aa, Homo Sapiens
VLPVLFPPW

SEQ ID NO: 198178 - protein, 9 aa, Homo Sapiens
TPLPLQPYL

SEQ ID NO: 198179 - protein, 9 aa, Homo Sapiens
EDDEEEEAA

SEQ ID NO: 198180 - protein, 9 aa, Homo Sapiens
LRRCYQSSP

SEQ ID NO: 198181 - protein, 9 aa, Homo Sapiens
LPAALHPPP

SEQ ID NO: 198182 - protein, 9 aa, Homo Sapiens
KRGHWAPVI

SEQ ID NO: 198183 - protein, 9 aa, Homo Sapiens
STSSGSKSQ

SEQ ID NO: 198184 - protein, 9 aa, Homo Sapiens
LVIQPMLQS

SEQ ID NO: 198185 - protein, 9 aa, Homo Sapiens
GTSVSLLVV

SEQ ID NO: 198186 - protein, 9 aa, Homo Sapiens
CHQQFKYRD

SEQ ID NO: 198187 - protein, 9 aa, Homo Sapiens
APLRHGMPP

SEQ ID NO: 198188 - protein, 9 aa, Homo Sapiens
GWHDALYVV

SEQ ID NO: 198189 - protein, 9 aa, Homo Sapiens
PNDITGQGP

SEQ ID NO: 198190 - protein, 9 aa, Homo Sapiens
DAVRNPVKY

SEQ ID NO: 198191 - protein, 9 aa, Homo Sapiens
ALEMKGWRL

SEQ ID NO: 198192 - protein, 9 aa, Homo Sapiens
RGLLHTMLP

SEQ ID NO: 198193 - protein, 9 aa, Homo Sapiens
WTVWLILAV

SEQ ID NO: 198194 - protein, 9 aa, Homo Sapiens
KLWSGSAVP

SEQ ID NO: 198195 - protein, 9 aa, Homo Sapiens
CRLNRLPDG

SEQ ID NO: 198196 - protein, 9 aa, Homo Sapiens
WIYQWQRRG

SEQ ID NO: 198197 - protein, 9 aa, Homo Sapiens
QLDTLCQGQ

SEQ ID NO: 198198 - protein, 9 aa, Homo Sapiens
VSKQHWDRD

SEQ ID NO: 198199 - protein, 9 aa, Homo Sapiens
GVWALLGPI

SEQ ID NO: 198200 - protein, 9 aa, Homo Sapiens
QPGFCFHLC

SEQ ID NO: 198201 - protein, 9 aa, Homo Sapiens
LGDNLLDPW

SEQ ID NO: 198202 - protein, 9 aa, Homo Sapiens
EGTLNGWTG

SEQ ID NO: 198203 - protein, 9 aa, Homo Sapiens
IGGHNAPAS

SEQ ID NO: 198204 - protein, 9 aa, Homo Sapiens
LQHENYDEA

SEQ ID NO: 198205 - protein, 9 aa, Homo Sapiens
LAPTLPTRR

SEQ ID NO: 198206 - protein, 9 aa, Homo Sapiens
NTMWTLGCR

SEQ ID NO: 198207 - protein, 9 aa, Homo Sapiens
PQQVINGEK

SEQ ID NO: 198208 - protein, 9 aa, Homo Sapiens
NIYDCLQEF

SEQ ID NO: 198209 - protein, 9 aa, Homo Sapiens
LLHLQYYTA

SEQ ID NO: 198210 - protein, 9 aa, Homo Sapiens
RSCLVDSLT

SEQ ID NO: 198211 - protein, 9 aa, Homo Sapiens
LCHIKLHSG

SEQ ID NO: 198212 - protein, 9 aa, Homo Sapiens
MQVDGARAL

SEQ ID NO: 198213 - protein, 9 aa, Homo Sapiens
WLNRESVHA

SEQ ID NO: 198214 - protein, 9 aa, Homo Sapiens
TPTAPETST

SEQ ID NO: 198215 - protein, 9 aa, Homo Sapiens
TQTKKQAHC

SEQ ID NO: 198216 - protein, 9 aa, Homo Sapiens
FKGGRMETE

SEQ ID NO: 198217 - protein, 9 aa, Homo Sapiens
RPVQVFSQE

SEQ ID NO: 198218 - protein, 9 aa, Homo Sapiens
HTMEVRTQV

SEQ ID NO: 198219 - protein, 9 aa, Homo Sapiens
EEEREWQLR

SEQ ID NO: 198220 - protein, 9 aa, Homo Sapiens
DEPMGIALK

SEQ ID NO: 198221 - protein, 9 aa, Homo Sapiens
CVHSICNEP

SEQ ID NO: 198222 - protein, 9 aa, Homo Sapiens
VMSRATVRC

SEQ ID NO: 198223 - protein, 9 aa, Homo Sapiens
PGPPPPSLE

SEQ ID NO: 198224 - protein, 9 aa, Homo Sapiens
LCARAKEEA

SEQ ID NO: 198225 - protein, 9 aa, Homo Sapiens
RASHDVAQL

SEQ ID NO: 198226 - protein, 9 aa, Homo Sapiens
LYTWDNSMT

SEQ ID NO: 198227 - protein, 9 aa, Homo Sapiens
TRPFAHLNH

SEQ ID NO: 198228 - protein, 9 aa, Homo Sapiens
ALHPPPASV

SEQ ID NO: 198229 - protein, 9 aa, Homo Sapiens
ERPIKKLGE

SEQ ID NO: 198230 - protein, 9 aa, Homo Sapiens
KLQEHTVAY

SEQ ID NO: 198231 - protein, 9 aa, Homo Sapiens
CCLVRFLFY

SEQ ID NO: 198232 - protein, 9 aa, Homo Sapiens
TGPNVCLIS

SEQ ID NO: 198233 - protein, 9 aa, Homo Sapiens
LDCTPRCPP

SEQ ID NO: 198234 - protein, 9 aa, Homo Sapiens
IRGPGDCLA

SEQ ID NO: 198235 - protein, 9 aa, Homo Sapiens
NKKTVPPKK

SEQ ID NO: 198236 - protein, 9 aa, Homo Sapiens
KLNICPLLR

SEQ ID NO: 198237 - protein, 9 aa, Homo Sapiens
DRKQEQPCS

SEQ ID NO: 198238 - protein, 9 aa, Homo Sapiens
LAWRPPGTN

SEQ ID NO: 198239 - protein, 9 aa, Homo Sapiens
RAPSDQVSC

SEQ ID NO: 198240 - protein, 9 aa, Homo Sapiens
EVQSDSPQG

SEQ ID NO: 198241 - protein, 9 aa, Homo Sapiens
IYELSYAWE

SEQ ID NO: 198242 - protein, 9 aa, Homo Sapiens
DPEACEEMI

SEQ ID NO: 198243 - protein, 9 aa, Homo Sapiens
STWFTAVGF

SEQ ID NO: 198244 - protein, 9 aa, Homo Sapiens
DLQDGLPVL

SEQ ID NO: 198245 - protein, 9 aa, Homo Sapiens
LLKIRESLE

SEQ ID NO: 198246 - protein, 9 aa, Homo Sapiens
RIPSNPSHC

SEQ ID NO: 198247 - protein, 9 aa, Homo Sapiens
VLWIKWAQG

SEQ ID NO: 198248 - protein, 9 aa, Homo Sapiens
YRLFPPRQL

SEQ ID NO: 198249 - protein, 9 aa, Homo Sapiens
VQYLSGYHF

SEQ ID NO: 198250 - protein, 9 aa, Homo Sapiens
VVFLVIYLV

SEQ ID NO: 198251 - protein, 9 aa, Homo Sapiens
MSIPREADG

SEQ ID NO: 198252 - protein, 9 aa, Homo Sapiens
DHYFRSPLP

SEQ ID NO: 198253 - protein, 9 aa, Homo Sapiens
LDHFIPLQC

SEQ ID NO: 198254 - protein, 9 aa, Homo Sapiens
GVCSPLLRQ

SEQ ID NO: 198255 - protein, 9 aa, Homo Sapiens
GLWRQLATL

SEQ ID NO: 198256 - protein, 9 aa, Homo Sapiens
VEHYHLLHR

SEQ ID NO: 198257 - protein, 9 aa, Homo Sapiens
MDYQKTFRV

SEQ ID NO: 198258 - protein, 9 aa, Homo Sapiens
TARTPAWME

SEQ ID NO: 198259 - protein, 9 aa, Homo Sapiens
LTRNESVAH

SEQ ID NO: 198260 - protein, 9 aa, Homo Sapiens
TRGSPLRLT

SEQ ID NO: 198261 - protein, 9 aa, Homo Sapiens
EFLSLQMEV

SEQ ID NO: 198262 - protein, 9 aa, Homo Sapiens
GFGLNLQSA

SEQ ID NO: 198263 - protein, 9 aa, Homo Sapiens
ERHGSLDQP

SEQ ID NO: 198264 - protein, 9 aa, Homo Sapiens
EVSPLQCHA

SEQ ID NO: 198265 - protein, 9 aa, Homo Sapiens
PWMVWDSQA

SEQ ID NO: 198266 - protein, 9 aa, Homo Sapiens
PAADPAEAG

SEQ ID NO: 198267 - protein, 9 aa, Homo Sapiens
YTCRLNRLP

SEQ ID NO: 198268 - protein, 9 aa, Homo Sapiens
NELRVASAL

SEQ ID NO: 198269 - protein, 9 aa, Homo Sapiens
VERNIKYDI

SEQ ID NO: 198270 - protein, 9 aa, Homo Sapiens
RDKTRKRCS

SEQ ID NO: 198271 - protein, 9 aa, Homo Sapiens
SSEEHFHVE

SEQ ID NO: 198272 - protein, 9 aa, Homo Sapiens
DTYGGWGAR

SEQ ID NO: 198273 - protein, 9 aa, Homo Sapiens
LVAVAWSGL

SEQ ID NO: 198274 - protein, 9 aa, Homo Sapiens
PLPPHLGIC

SEQ ID NO: 198275 - protein, 9 aa, Homo Sapiens
NLLCHIKLH

SEQ ID NO: 198276 - protein, 9 aa, Homo Sapiens
GPPVGGQVP

SEQ ID NO: 198277 - protein, 9 aa, Homo Sapiens
QKGTGCIEG

SEQ ID NO: 198278 - protein, 9 aa, Homo Sapiens
YWDSLPQLP

SEQ ID NO: 198279 - protein, 9 aa, Homo Sapiens
PLTGVPVRT

SEQ ID NO: 198280 - protein, 9 aa, Homo Sapiens
NESECPPGC

SEQ ID NO: 198281 - protein, 9 aa, Homo Sapiens
LKDKNFAKM

SEQ ID NO: 198282 - protein, 9 aa, Homo Sapiens
KLPYSYISL

SEQ ID NO: 198283 - protein, 9 aa, Homo Sapiens
NSSMNPIIY

SEQ ID NO: 198284 - protein, 9 aa, Homo Sapiens
GCAMGPHCA

SEQ ID NO: 198285 - protein, 9 aa, Homo Sapiens
KVKGIQEKQ

SEQ ID NO: 198286 - protein, 9 aa, Homo Sapiens
PGTAQGPPN

SEQ ID NO: 198287 - protein, 9 aa, Homo Sapiens
GFHPGTPSL

SEQ ID NO: 198288 - protein, 9 aa, Homo Sapiens
PPFWEQQND

SEQ ID NO: 198289 - protein, 9 aa, Homo Sapiens
RGHRQSFLV

SEQ ID NO: 198290 - protein, 9 aa, Homo Sapiens
QSKDGNESR

SEQ ID NO: 198291 - protein, 9 aa, Homo Sapiens
TQLSSVPTL

SEQ ID NO: 198292 - protein, 9 aa, Homo Sapiens
SFMDLKIKL

SEQ ID NO: 198293 - protein, 9 aa, Homo Sapiens
VQCKQEQRE

SEQ ID NO: 198294 - protein, 9 aa, Homo Sapiens
TLEVELKVA

SEQ ID NO: 198295 - protein, 9 aa, Homo Sapiens
PCPPPTPRL

SEQ ID NO: 198296 - protein, 9 aa, Homo Sapiens
AKKRASVSF

SEQ ID NO: 198297 - protein, 9 aa, Homo Sapiens
SYHLQSWLY

SEQ ID NO: 198298 - protein, 9 aa, Homo Sapiens
KETDDCNAA

SEQ ID NO: 198299 - protein, 9 aa, Homo Sapiens
SIGSLSKLW

SEQ ID NO: 198300 - protein, 9 aa, Homo Sapiens
SHEIIIWSH

SEQ ID NO: 198301 - protein, 9 aa, Homo Sapiens
VLSSPEDIT

SEQ ID NO: 198302 - protein, 9 aa, Homo Sapiens
PAHREVMFS

SEQ ID NO: 198303 - protein, 9 aa, Homo Sapiens
NGGECVLYK

SEQ ID NO: 198304 - protein, 9 aa, Homo Sapiens
FSAMDIMGE

SEQ ID NO: 198305 - protein, 9 aa, Homo Sapiens
VFEEHEEGS

SEQ ID NO: 198306 - protein, 9 aa, Homo Sapiens
VILDADFTK

SEQ ID NO: 198307 - protein, 9 aa, Homo Sapiens
KTRWPNSGR

SEQ ID NO: 198308 - protein, 9 aa, Homo Sapiens
AYKTQQKKK

SEQ ID NO: 198309 - protein, 9 aa, Homo Sapiens
IELRRLAAP

SEQ ID NO: 198310 - protein, 9 aa, Homo Sapiens
ASKYEEMCP

SEQ ID NO: 198311 - protein, 9 aa, Homo Sapiens
GELDRRSMI

SEQ ID NO: 198312 - protein, 9 aa, Homo Sapiens
VDDLDEDEE

SEQ ID NO: 198313 - protein, 9 aa, Homo Sapiens
CMHILLGLM

SEQ ID NO: 198314 - protein, 9 aa, Homo Sapiens
LEAPVSFFH

SEQ ID NO: 198315 - protein, 9 aa, Homo Sapiens
ESSSEDCLQ

SEQ ID NO: 198316 - protein, 9 aa, Homo Sapiens
RSVLQDYII

SEQ ID NO: 198317 - protein, 9 aa, Homo Sapiens
PLNLPPPHR

SEQ ID NO: 198318 - protein, 9 aa, Homo Sapiens
MRDGPLELE

SEQ ID NO: 198319 - protein, 9 aa, Homo Sapiens
GELELQHEN

SEQ ID NO: 198320 - protein, 9 aa, Homo Sapiens
MAHVYPICF

SEQ ID NO: 198321 - protein, 9 aa, Homo Sapiens
MPGPTELFI

SEQ ID NO: 198322 - protein, 9 aa, Homo Sapiens
WADPECCSI

SEQ ID NO: 198323 - protein, 9 aa, Homo Sapiens
DGFWTFRTT

SEQ ID NO: 198324 - protein, 9 aa, Homo Sapiens
ESSLVASKL

SEQ ID NO: 198325 - protein, 9 aa, Homo Sapiens
HQGFKEKWY

SEQ ID NO: 198326 - protein, 9 aa, Homo Sapiens
GQQQEEEGI

SEQ ID NO: 198327 - protein, 9 aa, Homo Sapiens
GECIFPLFC

SEQ ID NO: 198328 - protein, 9 aa, Homo Sapiens
RQDQDTGTI

SEQ ID NO: 198329 - protein, 9 aa, Homo Sapiens
PPESLEDAG

SEQ ID NO: 198330 - protein, 9 aa, Homo Sapiens
VNLCVDYYK

SEQ ID NO: 198331 - protein, 9 aa, Homo Sapiens
KECVLLKGH

SEQ ID NO: 198332 - protein, 9 aa, Homo Sapiens
PDHSYMRML

SEQ ID NO: 198333 - protein, 9 aa, Homo Sapiens
GTMGPPPGM

SEQ ID NO: 198334 - protein, 9 aa, Homo Sapiens
VLTQACSCL

SEQ ID NO: 198335 - protein, 9 aa, Homo Sapiens
CARSQRPSS

SEQ ID NO: 198336 - protein, 9 aa, Homo Sapiens
PTLPVCIVE

SEQ ID NO: 198337 - protein, 9 aa, Homo Sapiens
LREQKRILD

SEQ ID NO: 198338 - protein, 9 aa, Homo Sapiens
SPHPTRHRH

SEQ ID NO: 198339 - protein, 9 aa, Homo Sapiens
TFTAARHVV

SEQ ID NO: 198340 - protein, 9 aa, Homo Sapiens
ISGISSQGS

SEQ ID NO: 198341 - protein, 9 aa, Homo Sapiens
LFSFSVQIS

SEQ ID NO: 198342 - protein, 9 aa, Homo Sapiens
RQDSLKKIE

SEQ ID NO: 198343 - protein, 9 aa, Homo Sapiens
SVCTMPLAN

SEQ ID NO: 198344 - protein, 9 aa, Homo Sapiens
NLALLVDEF

SEQ ID NO: 198345 - protein, 9 aa, Homo Sapiens
NPPAAADLD

SEQ ID NO: 198346 - protein, 9 aa, Homo Sapiens
INPFLYCFV

SEQ ID NO: 198347 - protein, 9 aa, Homo Sapiens
DNGDEVIST

SEQ ID NO: 198348 - protein, 9 aa, Homo Sapiens
CPSSDLYSL

SEQ ID NO: 198349 - protein, 9 aa, Homo Sapiens
NNADIGDTA

SEQ ID NO: 198350 - protein, 9 aa, Homo Sapiens
LKEEIKEIH

SEQ ID NO: 198351 - protein, 9 aa, Homo Sapiens
VPPGEKHWN

SEQ ID NO: 198352 - protein, 9 aa, Homo Sapiens
PNGGFCMYS

SEQ ID NO: 198353 - protein, 9 aa, Homo Sapiens
LLLRMATEK

SEQ ID NO: 198354 - protein, 9 aa, Homo Sapiens
EDNVKKRIV

SEQ ID NO: 198355 - protein, 9 aa, Homo Sapiens
DNISFSIYH

SEQ ID NO: 198356 - protein, 9 aa, Homo Sapiens
HALHIEDLP

SEQ ID NO: 198357 - protein, 9 aa, Homo Sapiens
VNSLYNKAK

SEQ ID NO: 198358 - protein, 9 aa, Homo Sapiens
TTHPHFVHC

SEQ ID NO: 198359 - protein, 9 aa, Homo Sapiens
YSDQKLPYS

SEQ ID NO: 198360 - protein, 9 aa, Homo Sapiens
VSSVPHAYC

SEQ ID NO: 198361 - protein, 9 aa, Homo Sapiens
QQFKYRDGQ

SEQ ID NO: 198362 - protein, 9 aa, Homo Sapiens
SRHLISSPK

SEQ ID NO: 198363 - protein, 9 aa, Homo Sapiens
LNGWTGWFP

SEQ ID NO: 198364 - protein, 9 aa, Homo Sapiens
STTIQTSEG

SEQ ID NO: 198365 - protein, 9 aa, Homo Sapiens
PRTNIKRKT

SEQ ID NO: 198366 - protein, 9 aa, Homo Sapiens
QDQDTGTIE

SEQ ID NO: 198367 - protein, 9 aa, Homo Sapiens
GMKGDRGEV

SEQ ID NO: 198368 - protein, 9 aa, Homo Sapiens
PMGQYPWAS

SEQ ID NO: 198369 - protein, 9 aa, Homo Sapiens
VVRHCPHHE

SEQ ID NO: 198370 - protein, 9 aa, Homo Sapiens
KGTTLNNSL

SEQ ID NO: 198371 - protein, 9 aa, Homo Sapiens
LGACIIEKI

SEQ ID NO: 198372 - protein, 9 aa, Homo Sapiens
VFNLGVYWR

SEQ ID NO: 198373 - protein, 9 aa, Homo Sapiens
LVGVISDRL

SEQ ID NO: 198374 - protein, 9 aa, Homo Sapiens
KPLNLPPPH

SEQ ID NO: 198375 - protein, 9 aa, Homo Sapiens
KDHRPWMVW

SEQ ID NO: 198376 - protein, 9 aa, Homo Sapiens
QRSHGDRSH

SEQ ID NO: 198377 - protein, 9 aa, Homo Sapiens
ALLGPILQS

SEQ ID NO: 198378 - protein, 9 aa, Homo Sapiens
AGVSRLVQV

SEQ ID NO: 198379 - protein, 9 aa, Homo Sapiens
KTQQKKKEN

SEQ ID NO: 198380 - protein, 9 aa, Homo Sapiens
FTDIVTMQV

SEQ ID NO: 198381 - protein, 9 aa, Homo Sapiens
RGLVLWNEK

SEQ ID NO: 198382 - protein, 9 aa, Homo Sapiens
KLVRLSDSV

SEQ ID NO: 198383 - protein, 9 aa, Homo Sapiens
AHLAQHHRV

SEQ ID NO: 198384 - protein, 9 aa, Homo Sapiens
FDTRFTRQM

SEQ ID NO: 198385 - protein, 9 aa, Homo Sapiens
TAEEPTGIF

SEQ ID NO: 198386 - protein, 9 aa, Homo Sapiens
AYSNLQRLE

SEQ ID NO: 198387 - protein, 9 aa, Homo Sapiens
HHWKAENFI

SEQ ID NO: 198388 - protein, 9 aa, Homo Sapiens
TSSVGQIVG

SEQ ID NO: 198389 - protein, 9 aa, Homo Sapiens
SILRSTVMV

SEQ ID NO: 198390 - protein, 9 aa, Homo Sapiens
SGYRHIIKN

SEQ ID NO: 198391 - protein, 9 aa, Homo Sapiens
RCGQFDGLM

SEQ ID NO: 198392 - protein, 9 aa, Homo Sapiens
LDAGRDSPP

SEQ ID NO: 198393 - protein, 9 aa, Homo Sapiens
GNVTTPPMP

SEQ ID NO: 198394 - protein, 9 aa, Homo Sapiens
KQHLAKWRR

SEQ ID NO: 198395 - protein, 9 aa, Homo Sapiens
EQDVISLQQ

SEQ ID NO: 198396 - protein, 9 aa, Homo Sapiens
HDTYTCLAE

SEQ ID NO: 198397 - protein, 9 aa, Homo Sapiens
PAIVFPTQD

SEQ ID NO: 198398 - protein, 9 aa, Homo Sapiens
KLSRNEMQV

SEQ ID NO: 198399 - protein, 9 aa, Homo Sapiens
QTASQPSWP

SEQ ID NO: 198400 - protein, 9 aa, Homo Sapiens
PKVHLKYAM

SEQ ID NO: 198401 - protein, 9 aa, Homo Sapiens
LPGLLAYLE

SEQ ID NO: 198402 - protein, 9 aa, Homo Sapiens
KITVCATNN

SEQ ID NO: 198403 - protein, 9 aa, Homo Sapiens
LHRWLQQTT

SEQ ID NO: 198404 - protein, 9 aa, Homo Sapiens
DVEMEKHKK

SEQ ID NO: 198405 - protein, 9 aa, Homo Sapiens
RAHCPANGA

SEQ ID NO: 198406 - protein, 9 aa, Homo Sapiens
GQIPHLLGW

SEQ ID NO: 198407 - protein, 9 aa, Homo Sapiens
SQPSWPVHF

SEQ ID NO: 198408 - protein, 9 aa, Homo Sapiens
QDVAKQMCT

SEQ ID NO: 198409 - protein, 9 aa, Homo Sapiens
PHTIPAPEP

SEQ ID NO: 198410 - protein, 9 aa, Homo Sapiens
GCTDVDECK

SEQ ID NO: 198411 - protein, 9 aa, Homo Sapiens
SSWAQQESL

SEQ ID NO: 198412 - protein, 9 aa, Homo Sapiens
SHQRSSFNF

SEQ ID NO: 198413 - protein, 9 aa, Homo Sapiens
ALSRHGIWS

SEQ ID NO: 198414 - protein, 9 aa, Homo Sapiens
YRTFDGLLF

SEQ ID NO: 198415 - protein, 9 aa, Homo Sapiens
ASVPLSPSL

SEQ ID NO: 198416 - protein, 9 aa, Homo Sapiens
TSQCSVFWV

SEQ ID NO: 198417 - protein, 9 aa, Homo Sapiens
KYDIKGGAF

SEQ ID NO: 198418 - protein, 9 aa, Homo Sapiens
DKKASHHIK

SEQ ID NO: 198419 - protein, 9 aa, Homo Sapiens
MSSLLTSLV

SEQ ID NO: 198420 - protein, 9 aa, Homo Sapiens
THFNFAIVL

SEQ ID NO: 198421 - protein, 9 aa, Homo Sapiens
LDALCSKYE

SEQ ID NO: 198422 - protein, 9 aa, Homo Sapiens
REHEFHLQA

SEQ ID NO: 198423 - protein, 9 aa, Homo Sapiens
HSICNEPWQ

SEQ ID NO: 198424 - protein, 9 aa, Homo Sapiens
LCALVGSEK

SEQ ID NO: 198425 - protein, 9 aa, Homo Sapiens
EQRHKFCPL

SEQ ID NO: 198426 - protein, 9 aa, Homo Sapiens
VVPRPPHQP

SEQ ID NO: 198427 - protein, 9 aa, Homo Sapiens
LRHKPWETP

SEQ ID NO: 198428 - protein, 9 aa, Homo Sapiens
YSRGRIRSR

SEQ ID NO: 198429 - protein, 9 aa, Homo Sapiens
TVAECVIYY

SEQ ID NO: 198430 - protein, 9 aa, Homo Sapiens
EVTPPEELH

SEQ ID NO: 198431 - protein, 9 aa, Homo Sapiens
SGVWALLGP

SEQ ID NO: 198432 - protein, 9 aa, Homo Sapiens
PLPPESLED

SEQ ID NO: 198433 - protein, 9 aa, Homo Sapiens
EPKISLSGI

SEQ ID NO: 198434 - protein, 9 aa, Homo Sapiens
EVILEGCVG

SEQ ID NO: 198435 - protein, 9 aa, Homo Sapiens
PQDQQAGWR

SEQ ID NO: 198436 - protein, 9 aa, Homo Sapiens
ALLVYGITS

SEQ ID NO: 198437 - protein, 9 aa, Homo Sapiens
KGSSHLSGS

SEQ ID NO: 198438 - protein, 9 aa, Homo Sapiens
CPSSFRWHL

SEQ ID NO: 198439 - protein, 9 aa, Homo Sapiens
SPTWGRRWP

SEQ ID NO: 198440 - protein, 9 aa, Homo Sapiens
ELVDDHSRE

SEQ ID NO: 198441 - protein, 9 aa, Homo Sapiens
RKQYHLTQP

SEQ ID NO: 198442 - protein, 9 aa, Homo Sapiens
DGDGDKLKA

SEQ ID NO: 198443 - protein, 9 aa, Homo Sapiens
LFNGYILFG

SEQ ID NO: 198444 - protein, 9 aa, Homo Sapiens
GRWVCTERQ

SEQ ID NO: 198445 - protein, 9 aa, Homo Sapiens
TFVVPRPPH

SEQ ID NO: 198446 - protein, 9 aa, Homo Sapiens
NQEFPFPET

SEQ ID NO: 198447 - protein, 9 aa, Homo Sapiens
VHPLVLQNW

SEQ ID NO: 198448 - protein, 9 aa, Homo Sapiens
SGGRVPALS

SEQ ID NO: 198449 - protein, 9 aa, Homo Sapiens
RRCGFLQLW

SEQ ID NO: 198450 - protein, 9 aa, Homo Sapiens
SVQLQTQQE

SEQ ID NO: 198451 - protein, 9 aa, Homo Sapiens
NTVLRNPPL

SEQ ID NO: 198452 - protein, 9 aa, Homo Sapiens
YIRHLPLFY

SEQ ID NO: 198453 - protein, 9 aa, Homo Sapiens
RQYHMNKNF

SEQ ID NO: 198454 - protein, 9 aa, Homo Sapiens
CMLCAGFPQ

SEQ ID NO: 198455 - protein, 9 aa, Homo Sapiens
EPYNAMLSI

SEQ ID NO: 198456 - protein, 9 aa, Homo Sapiens
RGPVTIFPW

SEQ ID NO: 198457 - protein, 9 aa, Homo Sapiens
LTINATDNP

SEQ ID NO: 198458 - protein, 9 aa, Homo Sapiens
RVSVSDADC

SEQ ID NO: 198459 - protein, 9 aa, Homo Sapiens
DARREKKKN

SEQ ID NO: 198460 - protein, 9 aa, Homo Sapiens
QPLDPKRPP

SEQ ID NO: 198461 - protein, 9 aa, Homo Sapiens
DTRFTRQMP

SEQ ID NO: 198462 - protein, 9 aa, Homo Sapiens
VTFTGMMHC

SEQ ID NO: 198463 - protein, 9 aa, Homo Sapiens
TKSCRKINF

SEQ ID NO: 198464 - protein, 9 aa, Homo Sapiens
KDLSSEEHF

SEQ ID NO: 198465 - protein, 9 aa, Homo Sapiens
QLRCPRCGD

SEQ ID NO: 198466 - protein, 9 aa, Homo Sapiens
LSSPEDITQ

SEQ ID NO: 198467 - protein, 9 aa, Homo Sapiens
GELAPLHTY

SEQ ID NO: 198468 - protein, 9 aa, Homo Sapiens
YTYLCVLLE

SEQ ID NO: 198469 - protein, 9 aa, Homo Sapiens
LGTCQLQHS

SEQ ID NO: 198470 - protein, 9 aa, Homo Sapiens
TGGGRVRAL

SEQ ID NO: 198471 - protein, 9 aa, Homo Sapiens
EQVLGVAPM

SEQ ID NO: 198472 - protein, 9 aa, Homo Sapiens
ETGPNVCLI

SEQ ID NO: 198473 - protein, 9 aa, Homo Sapiens
VVWAKILSS

SEQ ID NO: 198474 - protein, 9 aa, Homo Sapiens
NMWALELAH

SEQ ID NO: 198475 - protein, 9 aa, Homo Sapiens
QAQQKQIDR

SEQ ID NO: 198476 - protein, 9 aa, Homo Sapiens
SFGNKSALI

SEQ ID NO: 198477 - protein, 9 aa, Homo Sapiens
IRHLPLFYT

SEQ ID NO: 198478 - protein, 9 aa, Homo Sapiens
GFTGSMFGS

SEQ ID NO: 198479 - protein, 9 aa, Homo Sapiens
QCQAETEER

SEQ ID NO: 198480 - protein, 9 aa, Homo Sapiens
LIVNCYWAQ

SEQ ID NO: 198481 - protein, 9 aa, Homo Sapiens
VRIRAELYG

SEQ ID NO: 198482 - protein, 9 aa, Homo Sapiens
LIINTLPWK

SEQ ID NO: 198483 - protein, 9 aa, Homo Sapiens
WQLISAHVL

SEQ ID NO: 198484 - protein, 9 aa, Homo Sapiens
DGNESRECA

SEQ ID NO: 198485 - protein, 9 aa, Homo Sapiens
VQEGKDSTH

SEQ ID NO: 198486 - protein, 9 aa, Homo Sapiens
ESVAGNQEV

SEQ ID NO: 198487 - protein, 9 aa, Homo Sapiens
QAATRLQPS

SEQ ID NO: 198488 - protein, 9 aa, Homo Sapiens
IQRFLWMWA

SEQ ID NO: 198489 - protein, 9 aa, Homo Sapiens
THSHMQICD

SEQ ID NO: 198490 - protein, 9 aa, Homo Sapiens
NAQVHPLVL

SEQ ID NO: 198491 - protein, 9 aa, Homo Sapiens
VNRRRFLLD

SEQ ID NO: 198492 - protein, 9 aa, Homo Sapiens
NEPLSERLE

SEQ ID NO: 198493 - protein, 9 aa, Homo Sapiens
VQSWPSINL

SEQ ID NO: 198494 - protein, 9 aa, Homo Sapiens
SRGQTSSKT

SEQ ID NO: 198495 - protein, 9 aa, Homo Sapiens
GQIGHNYLG

SEQ ID NO: 198496 - protein, 9 aa, Homo Sapiens
DRRPGPSRA

SEQ ID NO: 198497 - protein, 9 aa, Homo Sapiens
YKQDRDITL

SEQ ID NO: 198498 - protein, 9 aa, Homo Sapiens
AAGALLVYG

SEQ ID NO: 198499 - protein, 9 aa, Homo Sapiens
LLSMLAHHL

SEQ ID NO: 198500 - protein, 9 aa, Homo Sapiens
KCYKIPQLE

SEQ ID NO: 198501 - protein, 9 aa, Homo Sapiens
LGFFHYLKV

SEQ ID NO: 198502 - protein, 9 aa, Homo Sapiens
KRRGSGHVL

SEQ ID NO: 198503 - protein, 9 aa, Homo Sapiens
LSTDSLSHL

SEQ ID NO: 198504 - protein, 9 aa, Homo Sapiens
GDVFRGIQV

SEQ ID NO: 198505 - protein, 9 aa, Homo Sapiens
DQLVQQETA

SEQ ID NO: 198506 - protein, 9 aa, Homo Sapiens
KRCSASSGS

SEQ ID NO: 198507 - protein, 9 aa, Homo Sapiens
YLYDGEDYT

SEQ ID NO: 198508 - protein, 9 aa, Homo Sapiens
HKALNQLEE

SEQ ID NO: 198509 - protein, 9 aa, Homo Sapiens
IHTLTGYQS

SEQ ID NO: 198510 - protein, 9 aa, Homo Sapiens
RKSGSLRCS

SEQ ID NO: 198511 - protein, 9 aa, Homo Sapiens
CLEQDLSII

SEQ ID NO: 198512 - protein, 9 aa, Homo Sapiens
YCPQENTLW

SEQ ID NO: 198513 - protein, 9 aa, Homo Sapiens
AKGKKPRQR

SEQ ID NO: 198514 - protein, 9 aa, Homo Sapiens
SDQKRELEH

SEQ ID NO: 198515 - protein, 9 aa, Homo Sapiens
WVMTAAHCM

SEQ ID NO: 198516 - protein, 9 aa, Homo Sapiens
VGPMIVAML

SEQ ID NO: 198517 - protein, 9 aa, Homo Sapiens
ELQMEHDIQ

SEQ ID NO: 198518 - protein, 9 aa, Homo Sapiens
VPVMCKIRV

SEQ ID NO: 198519 - protein, 9 aa, Homo Sapiens
WLRNGTEIV

SEQ ID NO: 198520 - protein, 9 aa, Homo Sapiens
LVAIQRFLW

SEQ ID NO: 198521 - protein, 9 aa, Homo Sapiens
GNRTPVPST

SEQ ID NO: 198522 - protein, 9 aa, Homo Sapiens
VLHKALNQL

SEQ ID NO: 198523 - protein, 9 aa, Homo Sapiens
QTAMHMPGP

SEQ ID NO: 198524 - protein, 9 aa, Homo Sapiens
CNLSNQRMG

SEQ ID NO: 198525 - protein, 9 aa, Homo Sapiens
CAWDGVACM

SEQ ID NO: 198526 - protein, 9 aa, Homo Sapiens
MPPFEFHAC

SEQ ID NO: 198527 - protein, 9 aa, Homo Sapiens
DEQQVDLAG

SEQ ID NO: 198528 - protein, 9 aa, Homo Sapiens
HRAPGPDGP

SEQ ID NO: 198529 - protein, 9 aa, Homo Sapiens
SYDELLEIL

SEQ ID NO: 198530 - protein, 9 aa, Homo Sapiens
QNLIRSTKE

SEQ ID NO: 198531 - protein, 9 aa, Homo Sapiens
QMFEHLSAE

SEQ ID NO: 198532 - protein, 9 aa, Homo Sapiens
GTNGVVPAT

SEQ ID NO: 198533 - protein, 9 aa, Homo Sapiens
KKTYCYHKY

SEQ ID NO: 198534 - protein, 9 aa, Homo Sapiens
RKNRPAGTI

SEQ ID NO: 198535 - protein, 9 aa, Homo Sapiens
PGAVPGPGA

SEQ ID NO: 198536 - protein, 9 aa, Homo Sapiens
NDYIAVWDD

SEQ ID NO: 198537 - protein, 9 aa, Homo Sapiens
ARAYSNLQR

SEQ ID NO: 198538 - protein, 9 aa, Homo Sapiens
MHTLYGSRD

SEQ ID NO: 198539 - protein, 9 aa, Homo Sapiens
PEPVLWTND

SEQ ID NO: 198540 - protein, 9 aa, Homo Sapiens
FFEQGSSDL

SEQ ID NO: 198541 - protein, 9 aa, Homo Sapiens
LSSCVSARA

SEQ ID NO: 198542 - protein, 9 aa, Homo Sapiens
WRAPQAGNR

SEQ ID NO: 198543 - protein, 9 aa, Homo Sapiens
AADSAHSFS

SEQ ID NO: 198544 - protein, 9 aa, Homo Sapiens
CTLRSTDAV

SEQ ID NO: 198545 - protein, 9 aa, Homo Sapiens
MESCLDLLV

SEQ ID NO: 198546 - protein, 9 aa, Homo Sapiens
MATIRHRPE

SEQ ID NO: 198547 - protein, 9 aa, Homo Sapiens
ILKVLEAVC

SEQ ID NO: 198548 - protein, 9 aa, Homo Sapiens
GEICASHIS

SEQ ID NO: 198549 - protein, 9 aa, Homo Sapiens
IQIPNLCGV

SEQ ID NO: 198550 - protein, 9 aa, Homo Sapiens
QFQDCIIQD

SEQ ID NO: 198551 - protein, 9 aa, Homo Sapiens
GRGRASGFT

SEQ ID NO: 198552 - protein, 9 aa, Homo Sapiens
TFLYILAKS

SEQ ID NO: 198553 - protein, 9 aa, Homo Sapiens
PREWTNIEA

SEQ ID NO: 198554 - protein, 9 aa, Homo Sapiens
QAHGSWFCL

SEQ ID NO: 198555 - protein, 9 aa, Homo Sapiens
GEEVILEGC

SEQ ID NO: 198556 - protein, 9 aa, Homo Sapiens
FFTSPCTKE

SEQ ID NO: 198557 - protein, 9 aa, Homo Sapiens
VLGLARCTS

SEQ ID NO: 198558 - protein, 9 aa, Homo Sapiens
LAVRTVCDS

SEQ ID NO: 198559 - protein, 9 aa, Homo Sapiens
EQRDSIDEK

SEQ ID NO: 198560 - protein, 9 aa, Homo Sapiens
RAGRVQPGF

SEQ ID NO: 198561 - protein, 9 aa, Homo Sapiens
GDISVTPLP

SEQ ID NO: 198562 - protein, 9 aa, Homo Sapiens
GLVYLQRSN

SEQ ID NO: 198563 - protein, 9 aa, Homo Sapiens
VSGHQYQHT

SEQ ID NO: 198564 - protein, 9 aa, Homo Sapiens
HTEQPGPYS

SEQ ID NO: 198565 - protein, 9 aa, Homo Sapiens
EIMAHVYPI

SEQ ID NO: 198566 - protein, 9 aa, Homo Sapiens
SHSSCRQRQ

SEQ ID NO: 198567 - protein, 9 aa, Homo Sapiens
AWLEGEINT

SEQ ID NO: 198568 - protein, 9 aa, Homo Sapiens
CQGDGGAGV

SEQ ID NO: 198569 - protein, 9 aa, Homo Sapiens
ISGQGVSSQ

SEQ ID NO: 198570 - protein, 9 aa, Homo Sapiens
CSLGWVEMT

SEQ ID NO: 198571 - protein, 9 aa, Homo Sapiens
LKLVVVKER

SEQ ID NO: 198572 - protein, 9 aa, Homo Sapiens
DVLNGGECV

SEQ ID NO: 198573 - protein, 9 aa, Homo Sapiens
IVLESDYRY

SEQ ID NO: 198574 - protein, 9 aa, Homo Sapiens
LSTETLQQV

SEQ ID NO: 198575 - protein, 9 aa, Homo Sapiens
RKTAVASVI

SEQ ID NO: 198576 - protein, 9 aa, Homo Sapiens
TVAIILRML

SEQ ID NO: 198577 - protein, 9 aa, Homo Sapiens
QLPAPQPLS

SEQ ID NO: 198578 - protein, 9 aa, Homo Sapiens
GHFNNGNHM

SEQ ID NO: 198579 - protein, 9 aa, Homo Sapiens
RRVITVYQI

SEQ ID NO: 198580 - protein, 9 aa, Homo Sapiens
AKTLKKKIY

SEQ ID NO: 198581 - protein, 9 aa, Homo Sapiens
PATPQVSPA

SEQ ID NO: 198582 - protein, 9 aa, Homo Sapiens
MCLAGNSIG

SEQ ID NO: 198583 - protein, 9 aa, Homo Sapiens
HASQGHFQA

SEQ ID NO: 198584 - protein, 9 aa, Homo Sapiens
SVSFWTLLP

SEQ ID NO: 198585 - protein, 9 aa, Homo Sapiens
EREWVENRR

SEQ ID NO: 198586 - protein, 9 aa, Homo Sapiens
VVKLVRLSD

SEQ ID NO: 198587 - protein, 9 aa, Homo Sapiens
MSARMSNMG

SEQ ID NO: 198588 - protein, 9 aa, Homo Sapiens
KVGILYCWA

SEQ ID NO: 198589 - protein, 9 aa, Homo Sapiens
RTQMHLNNS

SEQ ID NO: 198590 - protein, 9 aa, Homo Sapiens
QTAIHQVPL

SEQ ID NO: 198591 - protein, 9 aa, Homo Sapiens
LLIVNCYWA

SEQ ID NO: 198592 - protein, 9 aa, Homo Sapiens
LDEDPAADP

SEQ ID NO: 198593 - protein, 9 aa, Homo Sapiens
NRCVMTSHP

SEQ ID NO: 198594 - protein, 9 aa, Homo Sapiens
RNGTEIVLE

SEQ ID NO: 198595 - protein, 9 aa, Homo Sapiens
ICQAHFAPL

SEQ ID NO: 198596 - protein, 9 aa, Homo Sapiens
IEPPQHRQD

SEQ ID NO: 198597 - protein, 9 aa, Homo Sapiens
RECNQQLDL

SEQ ID NO: 198598 - protein, 9 aa, Homo Sapiens
LLKRILLPG

SEQ ID NO: 198599 - protein, 9 aa, Homo Sapiens
TGDVVAHAY

SEQ ID NO: 198600 - protein, 9 aa, Homo Sapiens
ICNYVPGGT

SEQ ID NO: 198601 - protein, 9 aa, Homo Sapiens
RHSALHVAE

SEQ ID NO: 198602 - protein, 9 aa, Homo Sapiens
QTFTRSVGL

SEQ ID NO: 198603 - protein, 9 aa, Homo Sapiens
YKLFSHVPN

SEQ ID NO: 198604 - protein, 9 aa, Homo Sapiens
PGEHPQRLP

SEQ ID NO: 198605 - protein, 9 aa, Homo Sapiens
GEGKDGERH

SEQ ID NO: 198606 - protein, 9 aa, Homo Sapiens
QSPAEEENS

SEQ ID NO: 198607 - protein, 9 aa, Homo Sapiens
MGDHMKVIA

SEQ ID NO: 198608 - protein, 9 aa, Homo Sapiens
DLVRCVRLQ

SEQ ID NO: 198609 - protein, 9 aa, Homo Sapiens
VSHTCYPLF

SEQ ID NO: 198610 - protein, 9 aa, Homo Sapiens
KCFAVCSLG

SEQ ID NO: 198611 - protein, 9 aa, Homo Sapiens
EYMCLAGNS

SEQ ID NO: 198612 - protein, 9 aa, Homo Sapiens
HAFVRMIAP

SEQ ID NO: 198613 - protein, 9 aa, Homo Sapiens
LIHTPQLCT

SEQ ID NO: 198614 - protein, 9 aa, Homo Sapiens
APLLSSSLP

SEQ ID NO: 198615 - protein, 9 aa, Homo Sapiens
LVVVHSVTP

SEQ ID NO: 198616 - protein, 9 aa, Homo Sapiens
TTLQRALER

SEQ ID NO: 198617 - protein, 9 aa, Homo Sapiens
APSLIMDKA

SEQ ID NO: 198618 - protein, 9 aa, Homo Sapiens
PPGWLPRLT

SEQ ID NO: 198619 - protein, 9 aa, Homo Sapiens
TGTIERCLE

SEQ ID NO: 198620 - protein, 9 aa, Homo Sapiens
LQEWRTVPI

SEQ ID NO: 198621 - protein, 9 aa, Homo Sapiens
NIKYDIKGG

SEQ ID NO: 198622 - protein, 9 aa, Homo Sapiens
RSCKSDSHI

SEQ ID NO: 198623 - protein, 9 aa, Homo Sapiens
SYSNATNKY

SEQ ID NO: 198624 - protein, 9 aa, Homo Sapiens
TAPTTPAMP

SEQ ID NO: 198625 - protein, 9 aa, Homo Sapiens
RTEPPDGDW

SEQ ID NO: 198626 - protein, 9 aa, Homo Sapiens
GKRHYLALW

SEQ ID NO: 198627 - protein, 9 aa, Homo Sapiens
HEVILESFQ

SEQ ID NO: 198628 - protein, 9 aa, Homo Sapiens
GGHRGHGGF

SEQ ID NO: 198629 - protein, 9 aa, Homo Sapiens
NSSLSDPSK

SEQ ID NO: 198630 - protein, 9 aa, Homo Sapiens
PPPHPPKPS

SEQ ID NO: 198631 - protein, 9 aa, Homo Sapiens
DQHKLWVGY

SEQ ID NO: 198632 - protein, 9 aa, Homo Sapiens
QRPSAWLLL

SEQ ID NO: 198633 - protein, 9 aa, Homo Sapiens
SISSLPSHT

SEQ ID NO: 198634 - protein, 9 aa, Homo Sapiens
GSLWPAKSV

SEQ ID NO: 198635 - protein, 9 aa, Homo Sapiens
SSALKHNQV

SEQ ID NO: 198636 - protein, 9 aa, Homo Sapiens
DVDNVKYCG

SEQ ID NO: 198637 - protein, 9 aa, Homo Sapiens
TQQKKKENL

SEQ ID NO: 198638 - protein, 9 aa, Homo Sapiens
CQGGRFDTK

SEQ ID NO: 198639 - protein, 9 aa, Homo Sapiens
IRNDVAKQC

SEQ ID NO: 198640 - protein, 9 aa, Homo Sapiens
VGDLNLVAV

SEQ ID NO: 198641 - protein, 9 aa, Homo Sapiens
GEQFPDLSC

SEQ ID NO: 198642 - protein, 9 aa, Homo Sapiens
ESCQVVELA

SEQ ID NO: 198643 - protein, 9 aa, Homo Sapiens
QLLEDGDPT

SEQ ID NO: 198644 - protein, 9 aa, Homo Sapiens
PNSGGFHPG

SEQ ID NO: 198645 - protein, 9 aa, Homo Sapiens
KVCCLPQVQ

SEQ ID NO: 198646 - protein, 9 aa, Homo Sapiens
PPLRAPWNQ

SEQ ID NO: 198647 - protein, 9 aa, Homo Sapiens
NEDHREASS

SEQ ID NO: 198648 - protein, 9 aa, Homo Sapiens
RGMQTANLR

SEQ ID NO: 198649 - protein, 9 aa, Homo Sapiens
RGGVKRVSG

SEQ ID NO: 198650 - protein, 9 aa, Homo Sapiens
GPSDIATSA

SEQ ID NO: 198651 - protein, 9 aa, Homo Sapiens
CVDYYKNRM

SEQ ID NO: 198652 - protein, 9 aa, Homo Sapiens
ISGHLLREV

SEQ ID NO: 198653 - protein, 9 aa, Homo Sapiens
KVYMVPMET

SEQ ID NO: 198654 - protein, 9 aa, Homo Sapiens
DVFIKKSES

SEQ ID NO: 198655 - protein, 9 aa, Homo Sapiens
SFHEQRSHC

SEQ ID NO: 198656 - protein, 9 aa, Homo Sapiens
WKVNVQKMP

SEQ ID NO: 198657 - protein, 9 aa, Homo Sapiens
KNTGFTPQE

SEQ ID NO: 198658 - protein, 9 aa, Homo Sapiens
VQEALDQAS

SEQ ID NO: 198659 - protein, 9 aa, Homo Sapiens
RLYVADGLG

SEQ ID NO: 198660 - protein, 9 aa, Homo Sapiens
TGSMFGSVA

SEQ ID NO: 198661 - protein, 9 aa, Homo Sapiens
YRLSTETLQ

SEQ ID NO: 198662 - protein, 9 aa, Homo Sapiens
LLSTRAGGF

SEQ ID NO: 198663 - protein, 9 aa, Homo Sapiens
SVTTDCVLS

SEQ ID NO: 198664 - protein, 9 aa, Homo Sapiens
GPPALRWYR

SEQ ID NO: 198665 - protein, 9 aa, Homo Sapiens
AVFTCPLFL

SEQ ID NO: 198666 - protein, 9 aa, Homo Sapiens
GGSPSRSAA

SEQ ID NO: 198667 - protein, 9 aa, Homo Sapiens
LSRHGIWSP

SEQ ID NO: 198668 - protein, 9 aa, Homo Sapiens
DAPQQMYSE

SEQ ID NO: 198669 - protein, 9 aa, Homo Sapiens
CVFSVIYGE

SEQ ID NO: 198670 - protein, 9 aa, Homo Sapiens
KTEHFQARK

SEQ ID NO: 198671 - protein, 9 aa, Homo Sapiens
ERQWIQQLA

SEQ ID NO: 198672 - protein, 9 aa, Homo Sapiens
ECGVHVELA

SEQ ID NO: 198673 - protein, 9 aa, Homo Sapiens
RHRDLLEVN

SEQ ID NO: 198674 - protein, 9 aa, Homo Sapiens
VVNPGQTFR

SEQ ID NO: 198675 - protein, 9 aa, Homo Sapiens
LTCVSCVRT

SEQ ID NO: 198676 - protein, 9 aa, Homo Sapiens
ATAHTLVPG

SEQ ID NO: 198677 - protein, 9 aa, Homo Sapiens
YQWVCCNPD

SEQ ID NO: 198678 - protein, 9 aa, Homo Sapiens
YLGEIVCNI

SEQ ID NO: 198679 - protein, 9 aa, Homo Sapiens
GRQKEKNVQ

SEQ ID NO: 198680 - protein, 9 aa, Homo Sapiens
GSATGAHLE

SEQ ID NO: 198681 - protein, 9 aa, Homo Sapiens
HQYQHTKCM

SEQ ID NO: 198682 - protein, 9 aa, Homo Sapiens
GGGDPRRRR

SEQ ID NO: 198683 - protein, 9 aa, Homo Sapiens
SQFLPCRPR

SEQ ID NO: 198684 - protein, 9 aa, Homo Sapiens
GVVTEFIIL

SEQ ID NO: 198685 - protein, 9 aa, Homo Sapiens
SERLWGPTE

SEQ ID NO: 198686 - protein, 9 aa, Homo Sapiens
CLLRSSSPT

SEQ ID NO: 198687 - protein, 9 aa, Homo Sapiens
GGVMATTGT

SEQ ID NO: 198688 - protein, 9 aa, Homo Sapiens
SYKCIECGQ

SEQ ID NO: 198689 - protein, 9 aa, Homo Sapiens
TYRLFPPRQ

SEQ ID NO: 198690 - protein, 9 aa, Homo Sapiens
PSPLESSVP

SEQ ID NO: 198691 - protein, 9 aa, Homo Sapiens
TPAPIPESP

SEQ ID NO: 198692 - protein, 9 aa, Homo Sapiens
IPHLFPQRV

SEQ ID NO: 198693 - protein, 9 aa, Homo Sapiens
SENLLFVGS

SEQ ID NO: 198694 - protein, 9 aa, Homo Sapiens
TSEQETKDL

SEQ ID NO: 198695 - protein, 9 aa, Homo Sapiens
AKVCCLPQV

SEQ ID NO: 198696 - protein, 9 aa, Homo Sapiens
YASDIVGLR

SEQ ID NO: 198697 - protein, 9 aa, Homo Sapiens
ENVDFCIHV

SEQ ID NO: 198698 - protein, 9 aa, Homo Sapiens
TLTEESVNE

SEQ ID NO: 198699 - protein, 9 aa, Homo Sapiens
ETFVSGHQY

SEQ ID NO: 198700 - protein, 9 aa, Homo Sapiens
LTSAGCVES

SEQ ID NO: 198701 - protein, 9 aa, Homo Sapiens
QLTKFCPSL

SEQ ID NO: 198702 - protein, 9 aa, Homo Sapiens
HAEGPGTTS

SEQ ID NO: 198703 - protein, 9 aa, Homo Sapiens
RSWSTCGDS

SEQ ID NO: 198704 - protein, 9 aa, Homo Sapiens
HPLLASPSC

SEQ ID NO: 198705 - protein, 9 aa, Homo Sapiens
VPGGTLTRR

SEQ ID NO: 198706 - protein, 9 aa, Homo Sapiens
LKQAQNTAT

SEQ ID NO: 198707 - protein, 9 aa, Homo Sapiens
VRSLSKRIM

SEQ ID NO: 198708 - protein, 9 aa, Homo Sapiens
RGLMLPGAG

SEQ ID NO: 198709 - protein, 9 aa, Homo Sapiens
NCIAAQKSR

SEQ ID NO: 198710 - protein, 9 aa, Homo Sapiens
VRPCSVYLF

SEQ ID NO: 198711 - protein, 9 aa, Homo Sapiens
CSLGDVDVN

SEQ ID NO: 198712 - protein, 9 aa, Homo Sapiens
THFLKEVTS

SEQ ID NO: 198713 - protein, 9 aa, Homo Sapiens
NLEDVGRHL

SEQ ID NO: 198714 - protein, 9 aa, Homo Sapiens
AAYVGAYAP

SEQ ID NO: 198715 - protein, 9 aa, Homo Sapiens
LFTTDLIRP

SEQ ID NO: 198716 - protein, 9 aa, Homo Sapiens
RLKPAMDKD

SEQ ID NO: 198717 - protein, 9 aa, Homo Sapiens
ALQQKVELL

SEQ ID NO: 198718 - protein, 9 aa, Homo Sapiens
AHHAEQTFR

SEQ ID NO: 198719 - protein, 9 aa, Homo Sapiens
TYPAQWTLG

SEQ ID NO: 198720 - protein, 9 aa, Homo Sapiens
LAARLPAGP

SEQ ID NO: 198721 - protein, 9 aa, Homo Sapiens
AAGHCAGGR

SEQ ID NO: 198722 - protein, 9 aa, Homo Sapiens
RLEQLGTQR

SEQ ID NO: 198723 - protein, 9 aa, Homo Sapiens
TCSDLHDDM

SEQ ID NO: 198724 - protein, 9 aa, Homo Sapiens
LPDTPTAPE

SEQ ID NO: 198725 - protein, 9 aa, Homo Sapiens
GSSMYSTPS

SEQ ID NO: 198726 - protein, 9 aa, Homo Sapiens
ITYSLYIRH

SEQ ID NO: 198727 - protein, 9 aa, Homo Sapiens
LASPSCSLY

SEQ ID NO: 198728 - protein, 9 aa, Homo Sapiens
ARREKKKNS

SEQ ID NO: 198729 - protein, 9 aa, Homo Sapiens
RPPSPLESS

SEQ ID NO: 198730 - protein, 9 aa, Homo Sapiens
QTVLKGPSR

SEQ ID NO: 198731 - protein, 9 aa, Homo Sapiens
ERKGSPMPG

SEQ ID NO: 198732 - protein, 9 aa, Homo Sapiens
LVKSKIALR

SEQ ID NO: 198733 - protein, 9 aa, Homo Sapiens
MQILTASSD

SEQ ID NO: 198734 - protein, 9 aa, Homo Sapiens
KSRPVQGLS

SEQ ID NO: 198735 - protein, 9 aa, Homo Sapiens
EDALQFLIK

SEQ ID NO: 198736 - protein, 9 aa, Homo Sapiens
CGVHVELAE

SEQ ID NO: 198737 - protein, 9 aa, Homo Sapiens
MQPHEPKGH

SEQ ID NO: 198738 - protein, 9 aa, Homo Sapiens
VQWLFGGSS

SEQ ID NO: 198739 - protein, 9 aa, Homo Sapiens
RAAWGTSSC

SEQ ID NO: 198740 - protein, 9 aa, Homo Sapiens
RSQRPSSSQ

SEQ ID NO: 198741 - protein, 9 aa, Homo Sapiens
FINLMELKL

SEQ ID NO: 198742 - protein, 9 aa, Homo Sapiens
QRSNMEFLF

SEQ ID NO: 198743 - protein, 9 aa, Homo Sapiens
HPVMLKQTH

SEQ ID NO: 198744 - protein, 9 aa, Homo Sapiens
HISEIIEAK

SEQ ID NO: 198745 - protein, 9 aa, Homo Sapiens
TRLQPSVSE

SEQ ID NO: 198746 - protein, 9 aa, Homo Sapiens
LLRNSDEKV

SEQ ID NO: 198747 - protein, 9 aa, Homo Sapiens
LCDLMSARM

SEQ ID NO: 198748 - protein, 9 aa, Homo Sapiens
GPMGQGGPR

SEQ ID NO: 198749 - protein, 9 aa, Homo Sapiens
RAKPPPIPV

SEQ ID NO: 198750 - protein, 9 aa, Homo Sapiens
TPSRSQWVM

SEQ ID NO: 198751 - protein, 9 aa, Homo Sapiens
HSLRTAALG

SEQ ID NO: 198752 - protein, 9 aa, Homo Sapiens
APSLGSYSG

SEQ ID NO: 198753 - protein, 9 aa, Homo Sapiens
QMEPSPHNQ

SEQ ID NO: 198754 - protein, 9 aa, Homo Sapiens
LHNTAPTRT

SEQ ID NO: 198755 - protein, 9 aa, Homo Sapiens
AVKRLMKEV

SEQ ID NO: 198756 - protein, 9 aa, Homo Sapiens
QEEFFNMSH

SEQ ID NO: 198757 - protein, 9 aa, Homo Sapiens
KSIAIHAKL

SEQ ID NO: 198758 - protein, 9 aa, Homo Sapiens
GNHGFPGQD

SEQ ID NO: 198759 - protein, 9 aa, Homo Sapiens
ASKLPLLIE

SEQ ID NO: 198760 - protein, 9 aa, Homo Sapiens
RPASVPLSP

SEQ ID NO: 198761 - protein, 9 aa, Homo Sapiens
ISLNFYKEL

SEQ ID NO: 198762 - protein, 9 aa, Homo Sapiens
EVPQPSTAP

SEQ ID NO: 198763 - protein, 9 aa, Homo Sapiens
RGVLVGMAQ

SEQ ID NO: 198764 - protein, 9 aa, Homo Sapiens
SLQVSTLRQ

SEQ ID NO: 198765 - protein, 9 aa, Homo Sapiens
CDWEKEDEA

SEQ ID NO: 198766 - protein, 9 aa, Homo Sapiens
VVLYAWGVT

SEQ ID NO: 198767 - protein, 9 aa, Homo Sapiens
LAYKTQQKK

SEQ ID NO: 198768 - protein, 9 aa, Homo Sapiens
PESCLCFTS

SEQ ID NO: 198769 - protein, 9 aa, Homo Sapiens
QMHLNNSRL

SEQ ID NO: 198770 - protein, 9 aa, Homo Sapiens
ADENLKSHM

SEQ ID NO: 198771 - protein, 9 aa, Homo Sapiens
KCIFCSESF

SEQ ID NO: 198772 - protein, 9 aa, Homo Sapiens
DSWSNAATL

SEQ ID NO: 198773 - protein, 9 aa, Homo Sapiens
SYNRLRYKR

SEQ ID NO: 198774 - protein, 9 aa, Homo Sapiens
VDAKTLKKK

SEQ ID NO: 198775 - protein, 9 aa, Homo Sapiens
PTPITETEI

SEQ ID NO: 198776 - protein, 9 aa, Homo Sapiens
ECVKGMKTK

SEQ ID NO: 198777 - protein, 9 aa, Homo Sapiens
EEIKEIHGL

SEQ ID NO: 198778 - protein, 9 aa, Homo Sapiens
PGDQGAPGS

SEQ ID NO: 198779 - protein, 9 aa, Homo Sapiens
SGHQYQHTK

SEQ ID NO: 198780 - protein, 9 aa, Homo Sapiens
LLCTMEKFA

SEQ ID NO: 198781 - protein, 9 aa, Homo Sapiens
SHDVAQLSR

SEQ ID NO: 198782 - protein, 9 aa, Homo Sapiens
HRTTRSVVH

SEQ ID NO: 198783 - protein, 9 aa, Homo Sapiens
QFGFKAFVE

SEQ ID NO: 198784 - protein, 9 aa, Homo Sapiens
CAMVLEMIR

SEQ ID NO: 198785 - protein, 9 aa, Homo Sapiens
LVDIHVLQF

SEQ ID NO: 198786 - protein, 9 aa, Homo Sapiens
VHVCSECGK

SEQ ID NO: 198787 - protein, 9 aa, Homo Sapiens
PQILAALRE

SEQ ID NO: 198788 - protein, 9 aa, Homo Sapiens
PFVQALKAC

SEQ ID NO: 198789 - protein, 9 aa, Homo Sapiens
RLVLTVASR

SEQ ID NO: 198790 - protein, 9 aa, Homo Sapiens
VEAVKEEAV

SEQ ID NO: 198791 - protein, 9 aa, Homo Sapiens
TMVVDDLRL

SEQ ID NO: 198792 - protein, 9 aa, Homo Sapiens
WEQQNDLYY

SEQ ID NO: 198793 - protein, 9 aa, Homo Sapiens
QLPPCIPGA

SEQ ID NO: 198794 - protein, 9 aa, Homo Sapiens
MLKDLAIEL

SEQ ID NO: 198795 - protein, 9 aa, Homo Sapiens
EHYKCSEHG

SEQ ID NO: 198796 - protein, 9 aa, Homo Sapiens
LAALARGVL

SEQ ID NO: 198797 - protein, 9 aa, Homo Sapiens
CCSSLDHLT

SEQ ID NO: 198798 - protein, 9 aa, Homo Sapiens
EIIIWSHWT

SEQ ID NO: 198799 - protein, 9 aa, Homo Sapiens
LSERLEVNG

SEQ ID NO: 198800 - protein, 9 aa, Homo Sapiens
RKRGLVSHT

SEQ ID NO: 198801 - protein, 9 aa, Homo Sapiens
FNLGVYWRE

SEQ ID NO: 198802 - protein, 9 aa, Homo Sapiens
MLSDQKREL

SEQ ID NO: 198803 - protein, 9 aa, Homo Sapiens
VAFASFTFY

SEQ ID NO: 198804 - protein, 9 aa, Homo Sapiens
PAQPLDPKR

SEQ ID NO: 198805 - protein, 9 aa, Homo Sapiens
MQAAGLGHM

SEQ ID NO: 198806 - protein, 9 aa, Homo Sapiens
EMTYQFHSV

SEQ ID NO: 198807 - protein, 9 aa, Homo Sapiens
AHAFAGLKI

SEQ ID NO: 198808 - protein, 9 aa, Homo Sapiens
PSMTQKEIA

SEQ ID NO: 198809 - protein, 9 aa, Homo Sapiens
TQGQLSAQG

SEQ ID NO: 198810 - protein, 9 aa, Homo Sapiens
DSMCKASNR

SEQ ID NO: 198811 - protein, 9 aa, Homo Sapiens
GQLFVVFLV

SEQ ID NO: 198812 - protein, 9 aa, Homo Sapiens
LGRKRGHWA

SEQ ID NO: 198813 - protein, 9 aa, Homo Sapiens
FTGVSGVTI

SEQ ID NO: 198814 - protein, 9 aa, Homo Sapiens
VPSTIVWRP

SEQ ID NO: 198815 - protein, 9 aa, Homo Sapiens
RHHSRETPL

SEQ ID NO: 198816 - protein, 9 aa, Homo Sapiens
HSCDTLNRW

SEQ ID NO: 198817 - protein, 9 aa, Homo Sapiens
DETYRLSTE

SEQ ID NO: 198818 - protein, 9 aa, Homo Sapiens
LKDALTMVV

SEQ ID NO: 198819 - protein, 9 aa, Homo Sapiens
DTSLTWVSA

SEQ ID NO: 198820 - protein, 9 aa, Homo Sapiens
QCWLKVRDL

SEQ ID NO: 198821 - protein, 9 aa, Homo Sapiens
HNGQQEPST

SEQ ID NO: 198822 - protein, 9 aa, Homo Sapiens
AKQLRAENE

SEQ ID NO: 198823 - protein, 9 aa, Homo Sapiens
SQTYEKEED

SEQ ID NO: 198824 - protein, 9 aa, Homo Sapiens
DLELKLVVV

SEQ ID NO: 198825 - protein, 9 aa, Homo Sapiens
QHLHLEPSP

SEQ ID NO: 198826 - protein, 9 aa, Homo Sapiens
QELLSVWQE

SEQ ID NO: 198827 - protein, 9 aa, Homo Sapiens
CVENINGTS

SEQ ID NO: 198828 - protein, 9 aa, Homo Sapiens
SAVPNITWT

SEQ ID NO: 198829 - protein, 9 aa, Homo Sapiens
HQPRVHVIR

SEQ ID NO: 198830 - protein, 9 aa, Homo Sapiens
LERGTHLPE

SEQ ID NO: 198831 - protein, 9 aa, Homo Sapiens
KPIMTRKLL

SEQ ID NO: 198832 - protein, 9 aa, Homo Sapiens
WAGQGSEEE

SEQ ID NO: 198833 - protein, 9 aa, Homo Sapiens
QQILPFPAS

SEQ ID NO: 198834 - protein, 9 aa, Homo Sapiens
DRRSMIFSS

SEQ ID NO: 198835 - protein, 9 aa, Homo Sapiens
SPMPGFSTR

SEQ ID NO: 198836 - protein, 9 aa, Homo Sapiens
AQQKQIDRV

SEQ ID NO: 198837 - protein, 9 aa, Homo Sapiens
LKSVVPPGE

SEQ ID NO: 198838 - protein, 9 aa, Homo Sapiens
QFQLRRCMN

SEQ ID NO: 198839 - protein, 9 aa, Homo Sapiens
VVSPLLVKC

SEQ ID NO: 198840 - protein, 9 aa, Homo Sapiens
QAKKPATPA

SEQ ID NO: 198841 - protein, 9 aa, Homo Sapiens
SRSFPDHRG

SEQ ID NO: 198842 - protein, 9 aa, Homo Sapiens
DLEEFCQKM

SEQ ID NO: 198843 - protein, 9 aa, Homo Sapiens
HRYCMDVNE

SEQ ID NO: 198844 - protein, 9 aa, Homo Sapiens
GKKMLSLTH

SEQ ID NO: 198845 - protein, 9 aa, Homo Sapiens
PLSSSAGHS

SEQ ID NO: 198846 - protein, 9 aa, Homo Sapiens
SEKSEQAVL

SEQ ID NO: 198847 - protein, 9 aa, Homo Sapiens
QALSGRLQA

SEQ ID NO: 198848 - protein, 9 aa, Homo Sapiens
PTQGQTMVC

SEQ ID NO: 198849 - protein, 9 aa, Homo Sapiens
QDVMELVAR

SEQ ID NO: 198850 - protein, 9 aa, Homo Sapiens
PWASCNQVP

SEQ ID NO: 198851 - protein, 9 aa, Homo Sapiens
VQVFSQENV

SEQ ID NO: 198852 - protein, 9 aa, Homo Sapiens
LFSLLREQK

SEQ ID NO: 198853 - protein, 9 aa, Homo Sapiens
PTGIFLKKP

SEQ ID NO: 198854 - protein, 9 aa, Homo Sapiens
KSGSLRCSS

SEQ ID NO: 198855 - protein, 9 aa, Homo Sapiens
CIAVDCYLA

SEQ ID NO: 198856 - protein, 9 aa, Homo Sapiens
RPLQERGEP

SEQ ID NO: 198857 - protein, 9 aa, Homo Sapiens
PSDHKIQEV

SEQ ID NO: 198858 - protein, 9 aa, Homo Sapiens
LVGVGAQGA

SEQ ID NO: 198859 - protein, 9 aa, Homo Sapiens
TVRYIRIVP

SEQ ID NO: 198860 - protein, 9 aa, Homo Sapiens
FWRPLAQLR

SEQ ID NO: 198861 - protein, 9 aa, Homo Sapiens
PCEVMVQSP

SEQ ID NO: 198862 - protein, 9 aa, Homo Sapiens
FNDHGKSFY

SEQ ID NO: 198863 - protein, 9 aa, Homo Sapiens
KSCHTTVDR

SEQ ID NO: 198864 - protein, 9 aa, Homo Sapiens
HVRSLSKRI

SEQ ID NO: 198865 - protein, 9 aa, Homo Sapiens
SVAHSSKLL

SEQ ID NO: 198866 - protein, 9 aa, Homo Sapiens
SSRTRFTGY

SEQ ID NO: 198867 - protein, 9 aa, Homo Sapiens
SCNQVPWAR

SEQ ID NO: 198868 - protein, 9 aa, Homo Sapiens
AIWVENSIV

SEQ ID NO: 198869 - protein, 9 aa, Homo Sapiens
EEEEEGGNV

SEQ ID NO: 198870 - protein, 9 aa, Homo Sapiens
GESPRYSTS

SEQ ID NO: 198871 - protein, 9 aa, Homo Sapiens
VSNLKMVLW

SEQ ID NO: 198872 - protein, 9 aa, Homo Sapiens
KKLCGTADV

SEQ ID NO: 198873 - protein, 9 aa, Homo Sapiens
INFLLTTNY

SEQ ID NO: 198874 - protein, 9 aa, Homo Sapiens
LTARRCTRK

SEQ ID NO: 198875 - protein, 9 aa, Homo Sapiens
GSLLELLRN

SEQ ID NO: 198876 - protein, 9 aa, Homo Sapiens
ADVRLTLKK

SEQ ID NO: 198877 - protein, 9 aa, Homo Sapiens
DHYPDSDKC

SEQ ID NO: 198878 - protein, 9 aa, Homo Sapiens
YPPPHPPKP

SEQ ID NO: 198879 - protein, 9 aa, Homo Sapiens
RWHLPQHQP

SEQ ID NO: 198880 - protein, 9 aa, Homo Sapiens
DPAADPAEA

SEQ ID NO: 198881 - protein, 9 aa, Homo Sapiens
PPTDPGVEE

SEQ ID NO: 198882 - protein, 9 aa, Homo Sapiens
TSRELTGLH

SEQ ID NO: 198883 - protein, 9 aa, Homo Sapiens
KLKNKASIT

SEQ ID NO: 198884 - protein, 9 aa, Homo Sapiens
TRYPHSTLS

SEQ ID NO: 198885 - protein, 9 aa, Homo Sapiens
KTKPSHSSK

SEQ ID NO: 198886 - protein, 9 aa, Homo Sapiens
GPHCQERLC

SEQ ID NO: 198887 - protein, 9 aa, Homo Sapiens
GNLLCHIKL

SEQ ID NO: 198888 - protein, 9 aa, Homo Sapiens
CVPDERRKL

SEQ ID NO: 198889 - protein, 9 aa, Homo Sapiens
PGPVVAITS

SEQ ID NO: 198890 - protein, 9 aa, Homo Sapiens
DSVVKAVFW

SEQ ID NO: 198891 - protein, 9 aa, Homo Sapiens
TLIQDCKDA

SEQ ID NO: 198892 - protein, 9 aa, Homo Sapiens
MRFQPSAKR

SEQ ID NO: 198893 - protein, 9 aa, Homo Sapiens
TPALMSRGL

SEQ ID NO: 198894 - protein, 9 aa, Homo Sapiens
EEFYQAAHH

SEQ ID NO: 198895 - protein, 9 aa, Homo Sapiens
AVPQSQHGV

SEQ ID NO: 198896 - protein, 9 aa, Homo Sapiens
PLVLQNWML

SEQ ID NO: 198897 - protein, 9 aa, Homo Sapiens
ESIHSKPSQ

SEQ ID NO: 198898 - protein, 9 aa, Homo Sapiens
NLEAAPRDI

SEQ ID NO: 198899 - protein, 9 aa, Homo Sapiens
VHIEFTEGK

SEQ ID NO: 198900 - protein, 9 aa, Homo Sapiens
SRVAALVFE

SEQ ID NO: 198901 - protein, 9 aa, Homo Sapiens
KVLRKGKCG

SEQ ID NO: 198902 - protein, 9 aa, Homo Sapiens
EGVDPPHRH

SEQ ID NO: 198903 - protein, 9 aa, Homo Sapiens
MVKEGPFGT

SEQ ID NO: 198904 - protein, 9 aa, Homo Sapiens
KARVEIQNH

SEQ ID NO: 198905 - protein, 9 aa, Homo Sapiens
RKGSSHLSG

SEQ ID NO: 198906 - protein, 9 aa, Homo Sapiens
LKSKDPRHR

SEQ ID NO: 198907 - protein, 9 aa, Homo Sapiens
VGQIPHLLG

SEQ ID NO: 198908 - protein, 9 aa, Homo Sapiens
AAQPGAVPG

SEQ ID NO: 198909 - protein, 9 aa, Homo Sapiens
FPAAPTRHG

SEQ ID NO: 198910 - protein, 9 aa, Homo Sapiens
PTSPFQVLV

SEQ ID NO: 198911 - protein, 9 aa, Homo Sapiens
CACAMVLEM

SEQ ID NO: 198912 - protein, 9 aa, Homo Sapiens
DTCHKVYQC

SEQ ID NO: 198913 - protein, 9 aa, Homo Sapiens
QVLLDVKAW

SEQ ID NO: 198914 - protein, 9 aa, Homo Sapiens
SARAAWGTS

SEQ ID NO: 198915 - protein, 9 aa, Homo Sapiens
KGTDPDETI

SEQ ID NO: 198916 - protein, 9 aa, Homo Sapiens
DFVEGLHVF

SEQ ID NO: 198917 - protein, 9 aa, Homo Sapiens
LRERAAAGA

SEQ ID NO: 198918 - protein, 9 aa, Homo Sapiens
IVSTLQRWC

SEQ ID NO: 198919 - protein, 9 aa, Homo Sapiens
PWREIREKY

SEQ ID NO: 198920 - protein, 9 aa, Homo Sapiens
EKQESIHSK

SEQ ID NO: 198921 - protein, 9 aa, Homo Sapiens
DTDLLSCIC

SEQ ID NO: 198922 - protein, 9 aa, Homo Sapiens
RTGLSDGDG

SEQ ID NO: 198923 - protein, 9 aa, Homo Sapiens
RIKRLEYAL

SEQ ID NO: 198924 - protein, 9 aa, Homo Sapiens
KPCVLTQAC

SEQ ID NO: 198925 - protein, 9 aa, Homo Sapiens
LWKTPVAFA

SEQ ID NO: 198926 - protein, 9 aa, Homo Sapiens
QLLQKLWSG

SEQ ID NO: 198927 - protein, 9 aa, Homo Sapiens
KVEIAQARD

SEQ ID NO: 198928 - protein, 9 aa, Homo Sapiens
PISPKEAKA

SEQ ID NO: 198929 - protein, 9 aa, Homo Sapiens
KISYKDVIN

SEQ ID NO: 198930 - protein, 9 aa, Homo Sapiens
LLASPSCSL

SEQ ID NO: 198931 - protein, 9 aa, Homo Sapiens
FCIHVENQT

SEQ ID NO: 198932 - protein, 9 aa, Homo Sapiens
LRQVLKSKD

SEQ ID NO: 198933 - protein, 9 aa, Homo Sapiens
GGGFGGGGR

SEQ ID NO: 198934 - protein, 9 aa, Homo Sapiens
ADVEMEKHK

SEQ ID NO: 198935 - protein, 9 aa, Homo Sapiens
TPAPPRARE

SEQ ID NO: 198936 - protein, 9 aa, Homo Sapiens
ALKHKTPKV

SEQ ID NO: 198937 - protein, 9 aa, Homo Sapiens
GKSEDVVLQ

SEQ ID NO: 198938 - protein, 9 aa, Homo Sapiens
PLTRLQERP

SEQ ID NO: 198939 - protein, 9 aa, Homo Sapiens
GAYPNHRSA

SEQ ID NO: 198940 - protein, 9 aa, Homo Sapiens
NEGHFNNGN

SEQ ID NO: 198941 - protein, 9 aa, Homo Sapiens
HPLLYSLIM

SEQ ID NO: 198942 - protein, 9 aa, Homo Sapiens
GSNEMLLVA

SEQ ID NO: 198943 - protein, 9 aa, Homo Sapiens
AAAPLRHGM

SEQ ID NO: 198944 - protein, 9 aa, Homo Sapiens
RDWLEISLL

SEQ ID NO: 198945 - protein, 9 aa, Homo Sapiens
ATRRTGLSD

SEQ ID NO: 198946 - protein, 9 aa, Homo Sapiens
DILTANEKS

SEQ ID NO: 198947 - protein, 9 aa, Homo Sapiens
DPLNINGGC

SEQ ID NO: 198948 - protein, 9 aa, Homo Sapiens
DSLTDASSA

SEQ ID NO: 198949 - protein, 9 aa, Homo Sapiens
NNAPSLGSY

SEQ ID NO: 198950 - protein, 9 aa, Homo Sapiens
ATRLQPSVS

SEQ ID NO: 198951 - protein, 9 aa, Homo Sapiens
SSELHYKRR

SEQ ID NO: 198952 - protein, 9 aa, Homo Sapiens
IYTAVFMPY

SEQ ID NO: 198953 - protein, 9 aa, Homo Sapiens
WDACPLPPP

SEQ ID NO: 198954 - protein, 9 aa, Homo Sapiens
LGVALGGPP

SEQ ID NO: 198955 - protein, 9 aa, Homo Sapiens
RAQEQVLGV

SEQ ID NO: 198956 - protein, 9 aa, Homo Sapiens
HFIEARDLQ

SEQ ID NO: 198957 - protein, 9 aa, Homo Sapiens
QRTRQADGI

SEQ ID NO: 198958 - protein, 9 aa, Homo Sapiens
CGSFRRLDY

SEQ ID NO: 198959 - protein, 9 aa, Homo Sapiens
LLQEQFCRE

SEQ ID NO: 198960 - protein, 9 aa, Homo Sapiens
PQTHAQCSS

SEQ ID NO: 198961 - protein, 9 aa, Homo Sapiens
ITHAYYRDA

SEQ ID NO: 198962 - protein, 9 aa, Homo Sapiens
LQAECRLQE

SEQ ID NO: 198963 - protein, 9 aa, Homo Sapiens
KSSYSDQKL

SEQ ID NO: 198964 - protein, 9 aa, Homo Sapiens
RTIGVLWAI

SEQ ID NO: 198965 - protein, 9 aa, Homo Sapiens
ISVTPLPLQ

SEQ ID NO: 198966 - protein, 9 aa, Homo Sapiens
FLSYDELLE

SEQ ID NO: 198967 - protein, 9 aa, Homo Sapiens
VAVRGPTGV

SEQ ID NO: 198968 - protein, 9 aa, Homo Sapiens
NVLAVSTKY

SEQ ID NO: 198969 - protein, 9 aa, Homo Sapiens
GVGPMIVAM

SEQ ID NO: 198970 - protein, 9 aa, Homo Sapiens
MLGFRCVEE

SEQ ID NO: 198971 - protein, 9 aa, Homo Sapiens
SVPVMCKIR

SEQ ID NO: 198972 - protein, 9 aa, Homo Sapiens
DFSNEERLR

SEQ ID NO: 198973 - protein, 9 aa, Homo Sapiens
GLQRRKRPL

SEQ ID NO: 198974 - protein, 9 aa, Homo Sapiens
WIGPVEVES

SEQ ID NO: 198975 - protein, 9 aa, Homo Sapiens
DCTPRCPPS

SEQ ID NO: 198976 - protein, 9 aa, Homo Sapiens
ISALQRCLE

SEQ ID NO: 198977 - protein, 9 aa, Homo Sapiens
DSGFVSSEV

SEQ ID NO: 198978 - protein, 9 aa, Homo Sapiens
LYLNANSFL

SEQ ID NO: 198979 - protein, 9 aa, Homo Sapiens
LMASADLQT

SEQ ID NO: 198980 - protein, 9 aa, Homo Sapiens
MNNKNARLL

SEQ ID NO: 198981 - protein, 9 aa, Homo Sapiens
PTFLGKKER

SEQ ID NO: 198982 - protein, 9 aa, Homo Sapiens
AQDRRELEK

SEQ ID NO: 198983 - protein, 9 aa, Homo Sapiens
CHIEECVRR

SEQ ID NO: 198984 - protein, 9 aa, Homo Sapiens
HTRYPHSTL

SEQ ID NO: 198985 - protein, 9 aa, Homo Sapiens
VPPQVGGRT

SEQ ID NO: 198986 - protein, 9 aa, Homo Sapiens
PDYLDDGKV

SEQ ID NO: 198987 - protein, 9 aa, Homo Sapiens
LPPPQGGSQ

SEQ ID NO: 198988 - protein, 9 aa, Homo Sapiens
HNGEKPYSC

SEQ ID NO: 198989 - protein, 9 aa, Homo Sapiens
VLAVKQGRR

SEQ ID NO: 198990 - protein, 9 aa, Homo Sapiens
HTYGMFSVD

SEQ ID NO: 198991 - protein, 9 aa, Homo Sapiens
KVMLTGSVM

SEQ ID NO: 198992 - protein, 9 aa, Homo Sapiens
TLIPLAFLA

SEQ ID NO: 198993 - protein, 9 aa, Homo Sapiens
KPMMVDSQL

SEQ ID NO: 198994 - protein, 9 aa, Homo Sapiens
YRTEKDNAT

SEQ ID NO: 198995 - protein, 9 aa, Homo Sapiens
LRGHRQSFL

SEQ ID NO: 198996 - protein, 9 aa, Homo Sapiens
GLSTDSLSH

SEQ ID NO: 198997 - protein, 9 aa, Homo Sapiens
RPGQPGERG

SEQ ID NO: 198998 - protein, 9 aa, Homo Sapiens
LHKHQQVHT

SEQ ID NO: 198999 - protein, 9 aa, Homo Sapiens
DTLQEWADT

SEQ ID NO: 199000 - protein, 9 aa, Homo Sapiens
LTGLHHSLS

SEQ ID NO: 199001 - protein, 9 aa, Homo Sapiens
RTFPEDESQ

SEQ ID NO: 199002 - protein, 9 aa, Homo Sapiens
TLSLSSVSG

SEQ ID NO: 199003 - protein, 9 aa, Homo Sapiens
TNSSHLKQC

SEQ ID NO: 199004 - protein, 9 aa, Homo Sapiens
IFCSESFGT

SEQ ID NO: 199005 - protein, 9 aa, Homo Sapiens
WDLTAALSN

SEQ ID NO: 199006 - protein, 9 aa, Homo Sapiens
KGPHCQERL

SEQ ID NO: 199007 - protein, 9 aa, Homo Sapiens
HAFAGLKIY

SEQ ID NO: 199008 - protein, 9 aa, Homo Sapiens
FGSSPATSR

SEQ ID NO: 199009 - protein, 9 aa, Homo Sapiens
ECCLCVSLM

SEQ ID NO: 199010 - protein, 9 aa, Homo Sapiens
DKCREIAQT

SEQ ID NO: 199011 - protein, 9 aa, Homo Sapiens
GHQYQHTKC

SEQ ID NO: 199012 - protein, 9 aa, Homo Sapiens
AEDVRGNPR

SEQ ID NO: 199013 - protein, 9 aa, Homo Sapiens
WRLDLQGIR

SEQ ID NO: 199014 - protein, 9 aa, Homo Sapiens
CPGPPPPSL

SEQ ID NO: 199015 - protein, 9 aa, Homo Sapiens
QEIIPHQVF

SEQ ID NO: 199016 - protein, 9 aa, Homo Sapiens
TPQLCTRAS

SEQ ID NO: 199017 - protein, 9 aa, Homo Sapiens
LDWADVRLT

SEQ ID NO: 199018 - protein, 9 aa, Homo Sapiens
FVVPRPPHQ

SEQ ID NO: 199019 - protein, 9 aa, Homo Sapiens
MRKREHEFH

SEQ ID NO: 199020 - protein, 9 aa, Homo Sapiens
WPLLVGRQK

SEQ ID NO: 199021 - protein, 9 aa, Homo Sapiens
TPPPVSKNC

SEQ ID NO: 199022 - protein, 9 aa, Homo Sapiens
LRVVSPFLK

SEQ ID NO: 199023 - protein, 9 aa, Homo Sapiens
YGLGATTIY

SEQ ID NO: 199024 - protein, 9 aa, Homo Sapiens
KGDMGLHGL

SEQ ID NO: 199025 - protein, 9 aa, Homo Sapiens
CWAGQGSEE

SEQ ID NO: 199026 - protein, 9 aa, Homo Sapiens
QRKALWQLL

SEQ ID NO: 199027 - protein, 9 aa, Homo Sapiens
AGPWRKECT

SEQ ID NO: 199028 - protein, 9 aa, Homo Sapiens
QENTLWPNL

SEQ ID NO: 199029 - protein, 9 aa, Homo Sapiens
HSFERGVYE

SEQ ID NO: 199030 - protein, 9 aa, Homo Sapiens
VKVYLEWIQ

SEQ ID NO: 199031 - protein, 9 aa, Homo Sapiens
HCRMLTPAF

SEQ ID NO: 199032 - protein, 9 aa, Homo Sapiens
DILLMDDFK

SEQ ID NO: 199033 - protein, 9 aa, Homo Sapiens
KGRILSRYV

SEQ ID NO: 199034 - protein, 9 aa, Homo Sapiens
LEVLSTRGE

SEQ ID NO: 199035 - protein, 9 aa, Homo Sapiens
TLQRAKQDM

SEQ ID NO: 199036 - protein, 9 aa, Homo Sapiens
CCPPCRDGH

SEQ ID NO: 199037 - protein, 9 aa, Homo Sapiens
TFSDVVSTT

SEQ ID NO: 199038 - protein, 9 aa, Homo Sapiens
NVTALPLPD

SEQ ID NO: 199039 - protein, 9 aa, Homo Sapiens
LLHHLFLCY

SEQ ID NO: 199040 - protein, 9 aa, Homo Sapiens
DYDVSPSDH

SEQ ID NO: 199041 - protein, 9 aa, Homo Sapiens
QDPDAVRNP

SEQ ID NO: 199042 - protein, 9 aa, Homo Sapiens
DGEICASHI

SEQ ID NO: 199043 - protein, 9 aa, Homo Sapiens
ILVSCVLIS

SEQ ID NO: 199044 - protein, 9 aa, Homo Sapiens
TSPGPSLPA

SEQ ID NO: 199045 - protein, 9 aa, Homo Sapiens
RHKKYEEGE

SEQ ID NO: 199046 - protein, 9 aa, Homo Sapiens
QEYHSHARE

SEQ ID NO: 199047 - protein, 9 aa, Homo Sapiens
KCHIHQHRQ

SEQ ID NO: 199048 - protein, 9 aa, Homo Sapiens
ALDSPAGPW

SEQ ID NO: 199049 - protein, 9 aa, Homo Sapiens
FSVHMTLDF

SEQ ID NO: 199050 - protein, 9 aa, Homo Sapiens
LRLLKEEAK

SEQ ID NO: 199051 - protein, 9 aa, Homo Sapiens
TLITLGAEV

SEQ ID NO: 199052 - protein, 9 aa, Homo Sapiens
ILVTGTQLC

SEQ ID NO: 199053 - protein, 9 aa, Homo Sapiens
KKTQIANAQ

SEQ ID NO: 199054 - protein, 9 aa, Homo Sapiens
SHCIQCAAG

SEQ ID NO: 199055 - protein, 9 aa, Homo Sapiens
FDPHHHMHV

SEQ ID NO: 199056 - protein, 9 aa, Homo Sapiens
YFEEVQRLW

SEQ ID NO: 199057 - protein, 9 aa, Homo Sapiens
SASSCIVPA

SEQ ID NO: 199058 - protein, 9 aa, Homo Sapiens
RGKAGVKRY

SEQ ID NO: 199059 - protein, 9 aa, Homo Sapiens
PFRLLIIDG

SEQ ID NO: 199060 - protein, 9 aa, Homo Sapiens
FIESIPHLF

SEQ ID NO: 199061 - protein, 9 aa, Homo Sapiens
HMEGKSYDY

SEQ ID NO: 199062 - protein, 9 aa, Homo Sapiens
FCVCYMPYA

SEQ ID NO: 199063 - protein, 9 aa, Homo Sapiens
LHTLPGSFR

SEQ ID NO: 199064 - protein, 9 aa, Homo Sapiens
QRLPAALHP

SEQ ID NO: 199065 - protein, 9 aa, Homo Sapiens
FLWPYYQTE

SEQ ID NO: 199066 - protein, 9 aa, Homo Sapiens
IKMLSDQKR

SEQ ID NO: 199067 - protein, 9 aa, Homo Sapiens
RSSCCGSGC

SEQ ID NO: 199068 - protein, 9 aa, Homo Sapiens
VISASSCIV

SEQ ID NO: 199069 - protein, 9 aa, Homo Sapiens
LLNVDSRNR

SEQ ID NO: 199070 - protein, 9 aa, Homo Sapiens
DLLNADYLQ

SEQ ID NO: 199071 - protein, 9 aa, Homo Sapiens
IEGPMGQGG

SEQ ID NO: 199072 - protein, 9 aa, Homo Sapiens
IRTAQDALE

SEQ ID NO: 199073 - protein, 9 aa, Homo Sapiens
HSLANLDVF

SEQ ID NO: 199074 - protein, 9 aa, Homo Sapiens
TEDTPDNSS

SEQ ID NO: 199075 - protein, 9 aa, Homo Sapiens
MHTVAMAYC

SEQ ID NO: 199076 - protein, 9 aa, Homo Sapiens
QDATRPVQV

SEQ ID NO: 199077 - protein, 9 aa, Homo Sapiens
SMSIPREAD

SEQ ID NO: 199078 - protein, 9 aa, Homo Sapiens
PGYGAPAPL

SEQ ID NO: 199079 - protein, 9 aa, Homo Sapiens
YCRFNQDPK

SEQ ID NO: 199080 - protein, 9 aa, Homo Sapiens
LNSVDRLYE

SEQ ID NO: 199081 - protein, 9 aa, Homo Sapiens
DKQEETVIS

SEQ ID NO: 199082 - protein, 9 aa, Homo Sapiens
VQTGFYDWS

SEQ ID NO: 199083 - protein, 9 aa, Homo Sapiens
EGKLPPIPR

SEQ ID NO: 199084 - protein, 9 aa, Homo Sapiens
VTGIVTGVL

SEQ ID NO: 199085 - protein, 9 aa, Homo Sapiens
AKQMCTKTK

SEQ ID NO: 199086 - protein, 9 aa, Homo Sapiens
RGEDAASEA

SEQ ID NO: 199087 - protein, 9 aa, Homo Sapiens
TSASLVSAD

SEQ ID NO: 199088 - protein, 9 aa, Homo Sapiens
GSSDLVVPD

SEQ ID NO: 199089 - protein, 9 aa, Homo Sapiens
GFLPWIIKA

SEQ ID NO: 199090 - protein, 9 aa, Homo Sapiens
CDLMSARMS

SEQ ID NO: 199091 - protein, 9 aa, Homo Sapiens
CSTSQQGEE

SEQ ID NO: 199092 - protein, 9 aa, Homo Sapiens
CRWGKRKNK

SEQ ID NO: 199093 - protein, 9 aa, Homo Sapiens
DIQGSGGVC

SEQ ID NO: 199094 - protein, 9 aa, Homo Sapiens
PHRGAQCHV

SEQ ID NO: 199095 - protein, 9 aa, Homo Sapiens
NERLYCIKP

SEQ ID NO: 199096 - protein, 9 aa, Homo Sapiens
ELLFNGYIL

SEQ ID NO: 199097 - protein, 9 aa, Homo Sapiens
DKWSRHCRM

SEQ ID NO: 199098 - protein, 9 aa, Homo Sapiens
DSRNRKEEK

SEQ ID NO: 199099 - protein, 9 aa, Homo Sapiens
GFRCVEEVY

SEQ ID NO: 199100 - protein, 9 aa, Homo Sapiens
FDDLPNLEI

SEQ ID NO: 199101 - protein, 9 aa, Homo Sapiens
IHSKPSQDR

SEQ ID NO: 199102 - protein, 9 aa, Homo Sapiens
MVILFAFTA

SEQ ID NO: 199103 - protein, 9 aa, Homo Sapiens
ISKGMEANT

SEQ ID NO: 199104 - protein, 9 aa, Homo Sapiens
VLTDSFDTM

SEQ ID NO: 199105 - protein, 9 aa, Homo Sapiens
HSLDMIGFL

SEQ ID NO: 199106 - protein, 9 aa, Homo Sapiens
CYEERITEL

SEQ ID NO: 199107 - protein, 9 aa, Homo Sapiens
EVISELQEK

SEQ ID NO: 199108 - protein, 9 aa, Homo Sapiens
HNTAPTRTA

SEQ ID NO: 199109 - protein, 9 aa, Homo Sapiens
FEKIRKALL

SEQ ID NO: 199110 - protein, 9 aa, Homo Sapiens
HTLLHHLFL

SEQ ID NO: 199111 - protein, 9 aa, Homo Sapiens
CTLEANSER

SEQ ID NO: 199112 - protein, 9 aa, Homo Sapiens
EFLSVATTT

SEQ ID NO: 199113 - protein, 9 aa, Homo Sapiens
PDGEVISDP

SEQ ID NO: 199114 - protein, 9 aa, Homo Sapiens
FKGDIGMKG

SEQ ID NO: 199115 - protein, 9 aa, Homo Sapiens
ALQYCSTVA

SEQ ID NO: 199116 - protein, 9 aa, Homo Sapiens
IIIESTKSG

SEQ ID NO: 199117 - protein, 9 aa, Homo Sapiens
FEMQPNVKY

SEQ ID NO: 199118 - protein, 9 aa, Homo Sapiens
DCSHLFDND

SEQ ID NO: 199119 - protein, 9 aa, Homo Sapiens
SPPSSQMSP

SEQ ID NO: 199120 - protein, 9 aa, Homo Sapiens
PVQGCSTSQ

SEQ ID NO: 199121 - protein, 9 aa, Homo Sapiens
TETLQQVNR

SEQ ID NO: 199122 - protein, 9 aa, Homo Sapiens
VEQVTNQML

SEQ ID NO: 199123 - protein, 9 aa, Homo Sapiens
AEVIAQAQK

SEQ ID NO: 199124 - protein, 9 aa, Homo Sapiens
TIAKEGCSG

SEQ ID NO: 199125 - protein, 9 aa, Homo Sapiens
IPQVHWTTV

SEQ ID NO: 199126 - protein, 9 aa, Homo Sapiens
RLFIESIPH

SEQ ID NO: 199127 - protein, 9 aa, Homo Sapiens
EPILIKYHH

SEQ ID NO: 199128 - protein, 9 aa, Homo Sapiens
KDGERHELT

SEQ ID NO: 199129 - protein, 9 aa, Homo Sapiens
SGDPSSQEE

SEQ ID NO: 199130 - protein, 9 aa, Homo Sapiens
LEKIPTMSR

SEQ ID NO: 199131 - protein, 9 aa, Homo Sapiens
ENDNTVLRN

SEQ ID NO: 199132 - protein, 9 aa, Homo Sapiens
IAIHAKLLA

SEQ ID NO: 199133 - protein, 9 aa, Homo Sapiens
LESWLPWNI

SEQ ID NO: 199134 - protein, 9 aa, Homo Sapiens
STEALNDNQ

SEQ ID NO: 199135 - protein, 9 aa, Homo Sapiens
LPVGAVTGI

SEQ ID NO: 199136 - protein, 9 aa, Homo Sapiens
DQISEDCVF

SEQ ID NO: 199137 - protein, 9 aa, Homo Sapiens
FRNQSMLKT

SEQ ID NO: 199138 - protein, 9 aa, Homo Sapiens
TVFLAECTG

SEQ ID NO: 199139 - protein, 9 aa, Homo Sapiens
AQVKKNQCI

SEQ ID NO: 199140 - protein, 9 aa, Homo Sapiens
RQKQAADVE

SEQ ID NO: 199141 - protein, 9 aa, Homo Sapiens
NMPNVCDHD

SEQ ID NO: 199142 - protein, 9 aa, Homo Sapiens
LRHGMPPTM

SEQ ID NO: 199143 - protein, 9 aa, Homo Sapiens
LDVLKSNQY

SEQ ID NO: 199144 - protein, 9 aa, Homo Sapiens
GPSRAHCPA

SEQ ID NO: 199145 - protein, 9 aa, Homo Sapiens
FPLEPIKDE

SEQ ID NO: 199146 - protein, 9 aa, Homo Sapiens
HSFSPLEKF

SEQ ID NO: 199147 - protein, 9 aa, Homo Sapiens
YTPSYRGFL

SEQ ID NO: 199148 - protein, 9 aa, Homo Sapiens
HSSCRQRQE

SEQ ID NO: 199149 - protein, 9 aa, Homo Sapiens
RQPQQVING

SEQ ID NO: 199150 - protein, 9 aa, Homo Sapiens
SVCPLGFKV

SEQ ID NO: 199151 - protein, 9 aa, Homo Sapiens
SCHNTMGSY

SEQ ID NO: 199152 - protein, 9 aa, Homo Sapiens
LEETRREGE

SEQ ID NO: 199153 - protein, 9 aa, Homo Sapiens
SGCSSVSSS

SEQ ID NO: 199154 - protein, 9 aa, Homo Sapiens
NRVYGEFMQ

SEQ ID NO: 199155 - protein, 9 aa, Homo Sapiens
KGNKKNTGF

SEQ ID NO: 199156 - protein, 9 aa, Homo Sapiens
HIKKPDYVM

SEQ ID NO: 199157 - protein, 9 aa, Homo Sapiens
HPIKKGPVQ

SEQ ID NO: 199158 - protein, 9 aa, Homo Sapiens
HLKSKVHAF

SEQ ID NO: 199159 - protein, 9 aa, Homo Sapiens
KSCRKINFS

SEQ ID NO: 199160 - protein, 9 aa, Homo Sapiens
RMSNMGHKE

SEQ ID NO: 199161 - protein, 9 aa, Homo Sapiens
TLCNFTRAS

SEQ ID NO: 199162 - protein, 9 aa, Homo Sapiens
LYTVPATII

SEQ ID NO: 199163 - protein, 9 aa, Homo Sapiens
QMVAIQVYW

SEQ ID NO: 199164 - protein, 9 aa, Homo Sapiens
PWADPECCS

SEQ ID NO: 199165 - protein, 9 aa, Homo Sapiens
GHVHLAQIQ

SEQ ID NO: 199166 - protein, 9 aa, Homo Sapiens
RKINFSLRY

SEQ ID NO: 199167 - protein, 9 aa, Homo Sapiens
TLFESHIKN

SEQ ID NO: 199168 - protein, 9 aa, Homo Sapiens
EVPVRGRTT

SEQ ID NO: 199169 - protein, 9 aa, Homo Sapiens
YRAVTIVKQ

SEQ ID NO: 199170 - protein, 9 aa, Homo Sapiens
GAYAPCPTA

SEQ ID NO: 199171 - protein, 9 aa, Homo Sapiens
HMNISARRF

SEQ ID NO: 199172 - protein, 9 aa, Homo Sapiens
DSSRLHRAS

SEQ ID NO: 199173 - protein, 9 aa, Homo Sapiens
QQREDITQN

SEQ ID NO: 199174 - protein, 9 aa, Homo Sapiens
LEQLGTQRI

SEQ ID NO: 199175 - protein, 9 aa, Homo Sapiens
TAPETSTNY

SEQ ID NO: 199176 - protein, 9 aa, Homo Sapiens
QGLCFSGVN

SEQ ID NO: 199177 - protein, 9 aa, Homo Sapiens
LSGTPYKGP

SEQ ID NO: 199178 - protein, 9 aa, Homo Sapiens
MFLEIMAHV

SEQ ID NO: 199179 - protein, 9 aa, Homo Sapiens
EPSPHNQRK

SEQ ID NO: 199180 - protein, 9 aa, Homo Sapiens
HQGRLEFAN

SEQ ID NO: 199181 - protein, 9 aa, Homo Sapiens
INILVSCVL

SEQ ID NO: 199182 - protein, 9 aa, Homo Sapiens
GWPCPAVPL

SEQ ID NO: 199183 - protein, 9 aa, Homo Sapiens
RSSRTRFTG

SEQ ID NO: 199184 - protein, 9 aa, Homo Sapiens
FVLVNLEVT

SEQ ID NO: 199185 - protein, 9 aa, Homo Sapiens
IVMAADSAH

SEQ ID NO: 199186 - protein, 9 aa, Homo Sapiens
KALNQLEEL

SEQ ID NO: 199187 - protein, 9 aa, Homo Sapiens
REVLFTTDL

SEQ ID NO: 199188 - protein, 9 aa, Homo Sapiens
KRILLPGLL

SEQ ID NO: 199189 - protein, 9 aa, Homo Sapiens
RDKTQFLSK

SEQ ID NO: 199190 - protein, 9 aa, Homo Sapiens
RHCPHHERC

SEQ ID NO: 199191 - protein, 9 aa, Homo Sapiens
GEARAPPFP

SEQ ID NO: 199192 - protein, 9 aa, Homo Sapiens
LQSTAVDDL

SEQ ID NO: 199193 - protein, 9 aa, Homo Sapiens
NDNQEFPFP

SEQ ID NO: 199194 - protein, 9 aa, Homo Sapiens
CQELEQDVI

SEQ ID NO: 199195 - protein, 9 aa, Homo Sapiens
PPTAKSWLP

SEQ ID NO: 199196 - protein, 9 aa, Homo Sapiens
HFPFNSEQR

SEQ ID NO: 199197 - protein, 9 aa, Homo Sapiens
KVFNLGVYW

SEQ ID NO: 199198 - protein, 9 aa, Homo Sapiens
DKMCQLNGF

SEQ ID NO: 199199 - protein, 9 aa, Homo Sapiens
NVTHSHMQI

SEQ ID NO: 199200 - protein, 9 aa, Homo Sapiens
LFDFVGACK

SEQ ID NO: 199201 - protein, 9 aa, Homo Sapiens
VASNLMTGL

SEQ ID NO: 199202 - protein, 9 aa, Homo Sapiens
SQTFNYYFL

SEQ ID NO: 199203 - protein, 9 aa, Homo Sapiens
PHCQERLCP

SEQ ID NO: 199204 - protein, 9 aa, Homo Sapiens
LKIRESLEL

SEQ ID NO: 199205 - protein, 9 aa, Homo Sapiens
ARRSRDLDA

SEQ ID NO: 199206 - protein, 9 aa, Homo Sapiens
TRKGVQCQC

SEQ ID NO: 199207 - protein, 9 aa, Homo Sapiens
AIDNKYLPS

SEQ ID NO: 199208 - protein, 9 aa, Homo Sapiens
GGRRGGDGL

SEQ ID NO: 199209 - protein, 9 aa, Homo Sapiens
RVVRLVLTV

SEQ ID NO: 199210 - protein, 9 aa, Homo Sapiens
LPTLISLFD

SEQ ID NO: 199211 - protein, 9 aa, Homo Sapiens
HNAPASNLT

SEQ ID NO: 199212 - protein, 9 aa, Homo Sapiens
TTPKYASLG

SEQ ID NO: 199213 - protein, 9 aa, Homo Sapiens
TIIIKGTTL

SEQ ID NO: 199214 - protein, 9 aa, Homo Sapiens
RNEMQVDGA

SEQ ID NO: 199215 - protein, 9 aa, Homo Sapiens
RQRLGLAPP

SEQ ID NO: 199216 - protein, 9 aa, Homo Sapiens
LNVDSRNRK

SEQ ID NO: 199217 - protein, 9 aa, Homo Sapiens
CEVRDSNRQ

SEQ ID NO: 199218 - protein, 9 aa, Homo Sapiens
DHILENKEF

SEQ ID NO: 199219 - protein, 9 aa, Homo Sapiens
RSLAQETLR

SEQ ID NO: 199220 - protein, 9 aa, Homo Sapiens
LIAKVCCLP

SEQ ID NO: 199221 - protein, 9 aa, Homo Sapiens
HLIGAGHIS

SEQ ID NO: 199222 - protein, 9 aa, Homo Sapiens
LSPGFSREL

SEQ ID NO: 199223 - protein, 9 aa, Homo Sapiens
AWEPRCPKS

SEQ ID NO: 199224 - protein, 9 aa, Homo Sapiens
ASTTVLRLL

SEQ ID NO: 199225 - protein, 9 aa, Homo Sapiens
ARWQREEQQ

SEQ ID NO: 199226 - protein, 9 aa, Homo Sapiens
VALGENHSQ

SEQ ID NO: 199227 - protein, 9 aa, Homo Sapiens
ATAAVLNTV

SEQ ID NO: 199228 - protein, 9 aa, Homo Sapiens
ALKSVVPPG

SEQ ID NO: 199229 - protein, 9 aa, Homo Sapiens
IGMKGDRGE

SEQ ID NO: 199230 - protein, 9 aa, Homo Sapiens
AMQIHFQAS

SEQ ID NO: 199231 - protein, 9 aa, Homo Sapiens
SLQEEKCLK

SEQ ID NO: 199232 - protein, 9 aa, Homo Sapiens
PGKYDSMIQ

SEQ ID NO: 199233 - protein, 9 aa, Homo Sapiens
CIEPPQHRQ

SEQ ID NO: 199234 - protein, 9 aa, Homo Sapiens
VLFYATTTL

SEQ ID NO: 199235 - protein, 9 aa, Homo Sapiens
AKQCAAPKV

SEQ ID NO: 199236 - protein, 9 aa, Homo Sapiens
LEKDHVALR

SEQ ID NO: 199237 - protein, 9 aa, Homo Sapiens
HKPVFLAFQ

SEQ ID NO: 199238 - protein, 9 aa, Homo Sapiens
EDITQNAQH

SEQ ID NO: 199239 - protein, 9 aa, Homo Sapiens
ESWLPWNIY

SEQ ID NO: 199240 - protein, 9 aa, Homo Sapiens
IIIGFLQAG

SEQ ID NO: 199241 - protein, 9 aa, Homo Sapiens
CLTLANASS

SEQ ID NO: 199242 - protein, 9 aa, Homo Sapiens
DPAQPLDPK

SEQ ID NO: 199243 - protein, 9 aa, Homo Sapiens
MMDPHENIL

SEQ ID NO: 199244 - protein, 9 aa, Homo Sapiens
SGEGFPQGA

SEQ ID NO: 199245 - protein, 9 aa, Homo Sapiens
FVPRNSQKV

SEQ ID NO: 199246 - protein, 9 aa, Homo Sapiens
KLFQYPCLR

SEQ ID NO: 199247 - protein, 9 aa, Homo Sapiens
PGHISEIIE

SEQ ID NO: 199248 - protein, 9 aa, Homo Sapiens
ISIVKYLLD

SEQ ID NO: 199249 - protein, 9 aa, Homo Sapiens
CGKDLFCEF

SEQ ID NO: 199250 - protein, 9 aa, Homo Sapiens
PEDITQDFE

SEQ ID NO: 199251 - protein, 9 aa, Homo Sapiens
INGALQMAI

SEQ ID NO: 199252 - protein, 9 aa, Homo Sapiens
LLTGTSLDR

SEQ ID NO: 199253 - protein, 9 aa, Homo Sapiens
LQERGEPAV

SEQ ID NO: 199254 - protein, 9 aa, Homo Sapiens
ELRDISGHL

SEQ ID NO: 199255 - protein, 9 aa, Homo Sapiens
DRRELEKIP

SEQ ID NO: 199256 - protein, 9 aa, Homo Sapiens
TGLPTAPVL

SEQ ID NO: 199257 - protein, 9 aa, Homo Sapiens
LGIRGPGDC

SEQ ID NO: 199258 - protein, 9 aa, Homo Sapiens
LSSSLSQVG

SEQ ID NO: 199259 - protein, 9 aa, Homo Sapiens
MTTVTPFTA

SEQ ID NO: 199260 - protein, 9 aa, Homo Sapiens
LNSSPESAS

SEQ ID NO: 199261 - protein, 9 aa, Homo Sapiens
SCSMVVLGA

SEQ ID NO: 199262 - protein, 9 aa, Homo Sapiens
VSGLWRQLA

SEQ ID NO: 199263 - protein, 9 aa, Homo Sapiens
RCYGPYISD

SEQ ID NO: 199264 - protein, 9 aa, Homo Sapiens
LEEAKCRQA

SEQ ID NO: 199265 - protein, 9 aa, Homo Sapiens
LEAVCQEKQ

SEQ ID NO: 199266 - protein, 9 aa, Homo Sapiens
WQRGRLALH

SEQ ID NO: 199267 - protein, 9 aa, Homo Sapiens
CPPGCPEAQ

SEQ ID NO: 199268 - protein, 9 aa, Homo Sapiens
STHVGHAGH

SEQ ID NO: 199269 - protein, 9 aa, Homo Sapiens
ARLGESPRY

SEQ ID NO: 199270 - protein, 9 aa, Homo Sapiens
RLRGLLHTM

SEQ ID NO: 199271 - protein, 9 aa, Homo Sapiens
PVSAVPNIT

SEQ ID NO: 199272 - protein, 9 aa, Homo Sapiens
ELSGDPSSQ

SEQ ID NO: 199273 - protein, 9 aa, Homo Sapiens
AHREVMFSM

SEQ ID NO: 199274 - protein, 9 aa, Homo Sapiens
MDTYSAPPP

SEQ ID NO: 199275 - protein, 9 aa, Homo Sapiens
LQPTVRTYI

SEQ ID NO: 199276 - protein, 9 aa, Homo Sapiens
NMSKVVNSL

SEQ ID NO: 199277 - protein, 9 aa, Homo Sapiens
HLLVERNIK

SEQ ID NO: 199278 - protein, 9 aa, Homo Sapiens
GVSGVTILF

SEQ ID NO: 199279 - protein, 9 aa, Homo Sapiens
DLQKGTGCI

SEQ ID NO: 199280 - protein, 9 aa, Homo Sapiens
KPVVTTFSE

SEQ ID NO: 199281 - protein, 9 aa, Homo Sapiens
IRPRWIYSC

SEQ ID NO: 199282 - protein, 9 aa, Homo Sapiens
SYFIKRESL

SEQ ID NO: 199283 - protein, 9 aa, Homo Sapiens
HQKRLSYPP

SEQ ID NO: 199284 - protein, 9 aa, Homo Sapiens
IRAGESVWP

SEQ ID NO: 199285 - protein, 9 aa, Homo Sapiens
ENSTGELIY

SEQ ID NO: 199286 - protein, 9 aa, Homo Sapiens
NFAVGMRIS

SEQ ID NO: 199287 - protein, 9 aa, Homo Sapiens
MTTNLCEGH

SEQ ID NO: 199288 - protein, 9 aa, Homo Sapiens
WCPSSDLYS

SEQ ID NO: 199289 - protein, 9 aa, Homo Sapiens
TANWLSAVI

SEQ ID NO: 199290 - protein, 9 aa, Homo Sapiens
PVCTMSLVS

SEQ ID NO: 199291 - protein, 9 aa, Homo Sapiens
DRVTNDMES

SEQ ID NO: 199292 - protein, 9 aa, Homo Sapiens
RKRGHWAPV

SEQ ID NO: 199293 - protein, 9 aa, Homo Sapiens
LDRRSMIFS

SEQ ID NO: 199294 - protein, 9 aa, Homo Sapiens
HILAILALC

SEQ ID NO: 199295 - protein, 9 aa, Homo Sapiens
YESIHGWPV

SEQ ID NO: 199296 - protein, 9 aa, Homo Sapiens
CRQPHRGRR

SEQ ID NO: 199297 - protein, 9 aa, Homo Sapiens
KDPVEAKPE

SEQ ID NO: 199298 - protein, 9 aa, Homo Sapiens
EPIKDEKRD

SEQ ID NO: 199299 - protein, 9 aa, Homo Sapiens
SCARSQRPS

SEQ ID NO: 199300 - protein, 9 aa, Homo Sapiens
GRAQGVCSP

SEQ ID NO: 199301 - protein, 9 aa, Homo Sapiens
STKELNIQL

SEQ ID NO: 199302 - protein, 9 aa, Homo Sapiens
FQMEPSPHN

SEQ ID NO: 199303 - protein, 9 aa, Homo Sapiens
QALKACMTS

SEQ ID NO: 199304 - protein, 9 aa, Homo Sapiens
PQHRQDVLN

SEQ ID NO: 199305 - protein, 9 aa, Homo Sapiens
QTLLRSVLS

SEQ ID NO: 199306 - protein, 9 aa, Homo Sapiens
LNERLYCIK

SEQ ID NO: 199307 - protein, 9 aa, Homo Sapiens
GGIPVLGGL

SEQ ID NO: 199308 - protein, 9 aa, Homo Sapiens
AHSPDPHIP

SEQ ID NO: 199309 - protein, 9 aa, Homo Sapiens
FNSEQRDSI

SEQ ID NO: 199310 - protein, 9 aa, Homo Sapiens
SHTQMLLHL

SEQ ID NO: 199311 - protein, 9 aa, Homo Sapiens
RGLVKLSSM

SEQ ID NO: 199312 - protein, 9 aa, Homo Sapiens
CRQCGLSFG

SEQ ID NO: 199313 - protein, 9 aa, Homo Sapiens
KPPHEEFLN

SEQ ID NO: 199314 - protein, 9 aa, Homo Sapiens
ERFLVVVHS

SEQ ID NO: 199315 - protein, 9 aa, Homo Sapiens
SVKTPAPIP

SEQ ID NO: 199316 - protein, 9 aa, Homo Sapiens
SLVLTARRV

SEQ ID NO: 199317 - protein, 9 aa, Homo Sapiens
SFSVQISDR

SEQ ID NO: 199318 - protein, 9 aa, Homo Sapiens
SRQFWMMAI

SEQ ID NO: 199319 - protein, 9 aa, Homo Sapiens
QQVINGEKL

SEQ ID NO: 199320 - protein, 9 aa, Homo Sapiens
RHIIKNPMD

SEQ ID NO: 199321 - protein, 9 aa, Homo Sapiens
FRVEIHMVP

SEQ ID NO: 199322 - protein, 9 aa, Homo Sapiens
GVGSGLGLC

SEQ ID NO: 199323 - protein, 9 aa, Homo Sapiens
AHGSWFCLS

SEQ ID NO: 199324 - protein, 9 aa, Homo Sapiens
RAENELLMT

SEQ ID NO: 199325 - protein, 9 aa, Homo Sapiens
YVPQCDDLD

SEQ ID NO: 199326 - protein, 9 aa, Homo Sapiens
GKRPFPHLC

SEQ ID NO: 199327 - protein, 9 aa, Homo Sapiens
QDSLKKIEI

SEQ ID NO: 199328 - protein, 9 aa, Homo Sapiens
NPDWLQGEP

SEQ ID NO: 199329 - protein, 9 aa, Homo Sapiens
AFVEARARA

SEQ ID NO: 199330 - protein, 9 aa, Homo Sapiens
ICSIGYEEI

SEQ ID NO: 199331 - protein, 9 aa, Homo Sapiens
DSRHSSYSY

SEQ ID NO: 199332 - protein, 9 aa, Homo Sapiens
ESSVCPMRR

SEQ ID NO: 199333 - protein, 9 aa, Homo Sapiens
EPLATVRDR

SEQ ID NO: 199334 - protein, 9 aa, Homo Sapiens
CSSVSSSDG

SEQ ID NO: 199335 - protein, 9 aa, Homo Sapiens
CQDLLNADY

SEQ ID NO: 199336 - protein, 9 aa, Homo Sapiens
GDGGAGVKA

SEQ ID NO: 199337 - protein, 9 aa, Homo Sapiens
GLTFTAARH

SEQ ID NO: 199338 - protein, 9 aa, Homo Sapiens
AESIRETGV

SEQ ID NO: 199339 - protein, 9 aa, Homo Sapiens
CYYASDIVG

SEQ ID NO: 199340 - protein, 9 aa, Homo Sapiens
MQTANLRCL

SEQ ID NO: 199341 - protein, 9 aa, Homo Sapiens
VKKNQCISL

SEQ ID NO: 199342 - protein, 9 aa, Homo Sapiens
YGIIKLFQY

SEQ ID NO: 199343 - protein, 9 aa, Homo Sapiens
QTIWQLISA

SEQ ID NO: 199344 - protein, 9 aa, Homo Sapiens
PFWEQQNDL

SEQ ID NO: 199345 - protein, 9 aa, Homo Sapiens
CSKRFCSMA

SEQ ID NO: 199346 - protein, 9 aa, Homo Sapiens
ASFPHWYFD

SEQ ID NO: 199347 - protein, 9 aa, Homo Sapiens
HFTNGYEIK

SEQ ID NO: 199348 - protein, 9 aa, Homo Sapiens
EIGKTAAFQ

SEQ ID NO: 199349 - protein, 9 aa, Homo Sapiens
TLLAYLLVA

SEQ ID NO: 199350 - protein, 9 aa, Homo Sapiens
DVVVNPGQT

SEQ ID NO: 199351 - protein, 9 aa, Homo Sapiens
EYVHTDLRQ

SEQ ID NO: 199352 - protein, 9 aa, Homo Sapiens
WPRLQRQER

SEQ ID NO: 199353 - protein, 9 aa, Homo Sapiens
RSMIFSSSA

SEQ ID NO: 199354 - protein, 9 aa, Homo Sapiens
QKPTRKISK

SEQ ID NO: 199355 - protein, 9 aa, Homo Sapiens
QMASWDKAV

SEQ ID NO: 199356 - protein, 9 aa, Homo Sapiens
EGQRMCAFL

SEQ ID NO: 199357 - protein, 9 aa, Homo Sapiens
SQQHNKGTP

SEQ ID NO: 199358 - protein, 9 aa, Homo Sapiens
VEPVSAVPN

SEQ ID NO: 199359 - protein, 9 aa, Homo Sapiens
GGSAAEQHE

SEQ ID NO: 199360 - protein, 9 aa, Homo Sapiens
TVRCLQAIM

SEQ ID NO: 199361 - protein, 9 aa, Homo Sapiens
VGQRLSQDP

SEQ ID NO: 199362 - protein, 9 aa, Homo Sapiens
KELLPREVS

SEQ ID NO: 199363 - protein, 9 aa, Homo Sapiens
RICRWLRRF

SEQ ID NO: 199364 - protein, 9 aa, Homo Sapiens
LKPAMDKDG

SEQ ID NO: 199365 - protein, 9 aa, Homo Sapiens
DESIQENVR

SEQ ID NO: 199366 - protein, 9 aa, Homo Sapiens
AVHCKPMMV

SEQ ID NO: 199367 - protein, 9 aa, Homo Sapiens
CYHICSHCG

SEQ ID NO: 199368 - protein, 9 aa, Homo Sapiens
SHYVDEAGL

SEQ ID NO: 199369 - protein, 9 aa, Homo Sapiens
YPHSTLSLW

SEQ ID NO: 199370 - protein, 9 aa, Homo Sapiens
ALVSVRAYY

SEQ ID NO: 199371 - protein, 9 aa, Homo Sapiens
TSTPGYSSL

SEQ ID NO: 199372 - protein, 9 aa, Homo Sapiens
PRWPGHLRG

SEQ ID NO: 199373 - protein, 9 aa, Homo Sapiens
TSVQASSSG

SEQ ID NO: 199374 - protein, 9 aa, Homo Sapiens
ELAVNYSLG

SEQ ID NO: 199375 - protein, 9 aa, Homo Sapiens
ITKNLALKE

SEQ ID NO: 199376 - protein, 9 aa, Homo Sapiens
QETKDLPSK

SEQ ID NO: 199377 - protein, 9 aa, Homo Sapiens
MLKQTHVLP

SEQ ID NO: 199378 - protein, 9 aa, Homo Sapiens
QWASPENLC

SEQ ID NO: 199379 - protein, 9 aa, Homo Sapiens
TQLVSLGNP

SEQ ID NO: 199380 - protein, 9 aa, Homo Sapiens
LQCIRSTST

SEQ ID NO: 199381 - protein, 9 aa, Homo Sapiens
LGYSMSIPR

SEQ ID NO: 199382 - protein, 9 aa, Homo Sapiens
ISSDSGHST

SEQ ID NO: 199383 - protein, 9 aa, Homo Sapiens
GKAVVSHNK

SEQ ID NO: 199384 - protein, 9 aa, Homo Sapiens
GFPVPALQA

SEQ ID NO: 199385 - protein, 9 aa, Homo Sapiens
HDPSSGVQK

SEQ ID NO: 199386 - protein, 9 aa, Homo Sapiens
PNMELCCDA

SEQ ID NO: 199387 - protein, 9 aa, Homo Sapiens
FVLDEPREF

SEQ ID NO: 199388 - protein, 9 aa, Homo Sapiens
LQYVQNVVV

SEQ ID NO: 199389 - protein, 9 aa, Homo Sapiens
PRGHHHLLP

SEQ ID NO: 199390 - protein, 9 aa, Homo Sapiens
HQLQHSWGS

SEQ ID NO: 199391 - protein, 9 aa, Homo Sapiens
ELLRRCYQS

SEQ ID NO: 199392 - protein, 9 aa, Homo Sapiens
FVQKEFQNN

SEQ ID NO: 199393 - protein, 9 aa, Homo Sapiens
MTEAPLLIH

SEQ ID NO: 199394 - protein, 9 aa, Homo Sapiens
NGDVWTFGV

SEQ ID NO: 199395 - protein, 9 aa, Homo Sapiens
QTPCWGWHW

SEQ ID NO: 199396 - protein, 9 aa, Homo Sapiens
SRLVQVYYQ

SEQ ID NO: 199397 - protein, 9 aa, Homo Sapiens
YYVLLPLVA

SEQ ID NO: 199398 - protein, 9 aa, Homo Sapiens
LGHTSSSNT

SEQ ID NO: 199399 - protein, 9 aa, Homo Sapiens
YVQYLSGYH

SEQ ID NO: 199400 - protein, 9 aa, Homo Sapiens
PLEPIKDEK

SEQ ID NO: 199401 - protein, 9 aa, Homo Sapiens
KYWDSLPQL

SEQ ID NO: 199402 - protein, 9 aa, Homo Sapiens
PCALYIGIE

SEQ ID NO: 199403 - protein, 9 aa, Homo Sapiens
CHVCTLEAN

SEQ ID NO: 199404 - protein, 9 aa, Homo Sapiens
AQLDSEEMD

SEQ ID NO: 199405 - protein, 9 aa, Homo Sapiens
RLRLLVYTP

SEQ ID NO: 199406 - protein, 9 aa, Homo Sapiens
ILCTWIYQW

SEQ ID NO: 199407 - protein, 9 aa, Homo Sapiens
WCAHNMSFW

SEQ ID NO: 199408 - protein, 9 aa, Homo Sapiens
GENHSQALL

SEQ ID NO: 199409 - protein, 9 aa, Homo Sapiens
DGEVISDPK

SEQ ID NO: 199410 - protein, 9 aa, Homo Sapiens
LGSDLGGPC

SEQ ID NO: 199411 - protein, 9 aa, Homo Sapiens
TVVEPYNAM

SEQ ID NO: 199412 - protein, 9 aa, Homo Sapiens
RNSLYDMAQ

SEQ ID NO: 199413 - protein, 9 aa, Homo Sapiens
VPEGKAKSR

SEQ ID NO: 199414 - protein, 9 aa, Homo Sapiens
AALHPPPAS

SEQ ID NO: 199415 - protein, 9 aa, Homo Sapiens
RAREDAAEP

SEQ ID NO: 199416 - protein, 9 aa, Homo Sapiens
CERFLVVVH

SEQ ID NO: 199417 - protein, 9 aa, Homo Sapiens
LGEEVILEG

SEQ ID NO: 199418 - protein, 9 aa, Homo Sapiens
GLDHLSMGE

SEQ ID NO: 199419 - protein, 9 aa, Homo Sapiens
IESIPHLFP

SEQ ID NO: 199420 - protein, 9 aa, Homo Sapiens
CGGPVPQEP

SEQ ID NO: 199421 - protein, 9 aa, Homo Sapiens
FLSVATTTP

SEQ ID NO: 199422 - protein, 9 aa, Homo Sapiens
GTANPMVAK

SEQ ID NO: 199423 - protein, 9 aa, Homo Sapiens
RLPLRPQRG

SEQ ID NO: 199424 - protein, 9 aa, Homo Sapiens
QPFVGRLHS

SEQ ID NO: 199425 - protein, 9 aa, Homo Sapiens
EGTRGWWPS

SEQ ID NO: 199426 - protein, 9 aa, Homo Sapiens
EREIRRNSE

SEQ ID NO: 199427 - protein, 9 aa, Homo Sapiens
KHQIVHMEG

SEQ ID NO: 199428 - protein, 9 aa, Homo Sapiens
RPRPRVAQP

SEQ ID NO: 199429 - protein, 9 aa, Homo Sapiens
LQVAVRGPT

SEQ ID NO: 199430 - protein, 9 aa, Homo Sapiens
DTATARTPA

SEQ ID NO: 199431 - protein, 9 aa, Homo Sapiens
LRRRCPRGH

SEQ ID NO: 199432 - protein, 9 aa, Homo Sapiens
CMYRQSKEL

SEQ ID NO: 199433 - protein, 9 aa, Homo Sapiens
CLRLGIRGP

SEQ ID NO: 199434 - protein, 9 aa, Homo Sapiens
TNQMLSFSF

SEQ ID NO: 199435 - protein, 9 aa, Homo Sapiens
FDTMWRIRQ

SEQ ID NO: 199436 - protein, 9 aa, Homo Sapiens
LGPDPPTGI

SEQ ID NO: 199437 - protein, 9 aa, Homo Sapiens
SCVSARAAW

SEQ ID NO: 199438 - protein, 9 aa, Homo Sapiens
LHRSRPETG

SEQ ID NO: 199439 - protein, 9 aa, Homo Sapiens
SSPMNPGQL

SEQ ID NO: 199440 - protein, 9 aa, Homo Sapiens
PPPVSKNCS

SEQ ID NO: 199441 - protein, 9 aa, Homo Sapiens
SNDIYSTYR

SEQ ID NO: 199442 - protein, 9 aa, Homo Sapiens
FNKLQEHTV

SEQ ID NO: 199443 - protein, 9 aa, Homo Sapiens
TPNPGLTKP

SEQ ID NO: 199444 - protein, 9 aa, Homo Sapiens
YDQYAMLYS

SEQ ID NO: 199445 - protein, 9 aa, Homo Sapiens
TCRGMARVG

SEQ ID NO: 199446 - protein, 9 aa, Homo Sapiens
NSDEKVLPV

SEQ ID NO: 199447 - protein, 9 aa, Homo Sapiens
FLQLWAASA

SEQ ID NO: 199448 - protein, 9 aa, Homo Sapiens
SLANLDVFI

SEQ ID NO: 199449 - protein, 9 aa, Homo Sapiens
TMSRRVKSS

SEQ ID NO: 199450 - protein, 9 aa, Homo Sapiens
VSTLRQLFF

SEQ ID NO: 199451 - protein, 9 aa, Homo Sapiens
VCPMRRSRR

SEQ ID NO: 199452 - protein, 9 aa, Homo Sapiens
WNLTVLTPE

SEQ ID NO: 199453 - protein, 9 aa, Homo Sapiens
QEPALAFWP

SEQ ID NO: 199454 - protein, 9 aa, Homo Sapiens
ALPATGFLY

SEQ ID NO: 199455 - protein, 9 aa, Homo Sapiens
HEEFLNSRM

SEQ ID NO: 199456 - protein, 9 aa, Homo Sapiens
MDTKITWPN

SEQ ID NO: 199457 - protein, 9 aa, Homo Sapiens
ISFSIYHDS

SEQ ID NO: 199458 - protein, 9 aa, Homo Sapiens
FTTDLIRPV

SEQ ID NO: 199459 - protein, 9 aa, Homo Sapiens
GELLETCIV

SEQ ID NO: 199460 - protein, 9 aa, Homo Sapiens
ATQGEPGYL

SEQ ID NO: 199461 - protein, 9 aa, Homo Sapiens
VDSLTDASS

SEQ ID NO: 199462 - protein, 9 aa, Homo Sapiens
GTCSDLHDD

SEQ ID NO: 199463 - protein, 9 aa, Homo Sapiens
PATERPSVG

SEQ ID NO: 199464 - protein, 9 aa, Homo Sapiens
LLTTNYPFM

SEQ ID NO: 199465 - protein, 9 aa, Homo Sapiens
APLLAHGYH

SEQ ID NO: 199466 - protein, 9 aa, Homo Sapiens
LSQVTSLAN

SEQ ID NO: 199467 - protein, 9 aa, Homo Sapiens
QNKEEDVTH

SEQ ID NO: 199468 - protein, 9 aa, Homo Sapiens
QPTVRTYIE

SEQ ID NO: 199469 - protein, 9 aa, Homo Sapiens
IRGGPNGKL

SEQ ID NO: 199470 - protein, 9 aa, Homo Sapiens
FEESRGQTS

SEQ ID NO: 199471 - protein, 9 aa, Homo Sapiens
LGGPPALRW

SEQ ID NO: 199472 - protein, 9 aa, Homo Sapiens
RNPMFIRVT

SEQ ID NO: 199473 - protein, 9 aa, Homo Sapiens
APLATATPP

SEQ ID NO: 199474 - protein, 9 aa, Homo Sapiens
LVKWQPVDL

SEQ ID NO: 199475 - protein, 9 aa, Homo Sapiens
PSVGTTLMP

SEQ ID NO: 199476 - protein, 9 aa, Homo Sapiens
NWLSAVIQA

SEQ ID NO: 199477 - protein, 9 aa, Homo Sapiens
LPCQRVDSD

SEQ ID NO: 199478 - protein, 9 aa, Homo Sapiens
REDAAEPGE

SEQ ID NO: 199479 - protein, 9 aa, Homo Sapiens
QQAGWSSQA

SEQ ID NO: 199480 - protein, 9 aa, Homo Sapiens
KNRPAGTIP

SEQ ID NO: 199481 - protein, 9 aa, Homo Sapiens
WICTRYTPE

SEQ ID NO: 199482 - protein, 9 aa, Homo Sapiens
FTNGYEIKE

SEQ ID NO: 199483 - protein, 9 aa, Homo Sapiens
RCPSSFRWH

SEQ ID NO: 199484 - protein, 9 aa, Homo Sapiens
MTGLPKQTP

SEQ ID NO: 199485 - protein, 9 aa, Homo Sapiens
LSHCAHIGD

SEQ ID NO: 199486 - protein, 9 aa, Homo Sapiens
SELAKDFIQ

SEQ ID NO: 199487 - protein, 9 aa, Homo Sapiens
SRPSGHRLQ

SEQ ID NO: 199488 - protein, 9 aa, Homo Sapiens
CPPWVLPSS

SEQ ID NO: 199489 - protein, 9 aa, Homo Sapiens
PTFVLSITT

SEQ ID NO: 199490 - protein, 9 aa, Homo Sapiens
NPCQKTKGA

SEQ ID NO: 199491 - protein, 9 aa, Homo Sapiens
ERFRSITHA

SEQ ID NO: 199492 - protein, 9 aa, Homo Sapiens
VVLPDSLQT

SEQ ID NO: 199493 - protein, 9 aa, Homo Sapiens
SHLSKHLAF

SEQ ID NO: 199494 - protein, 9 aa, Homo Sapiens
EQLHRTTRS

SEQ ID NO: 199495 - protein, 9 aa, Homo Sapiens
LQLWAASAF

SEQ ID NO: 199496 - protein, 9 aa, Homo Sapiens
LEEFCQKMA

SEQ ID NO: 199497 - protein, 9 aa, Homo Sapiens
GNRDHFALD

SEQ ID NO: 199498 - protein, 9 aa, Homo Sapiens
PDEVACRWG

SEQ ID NO: 199499 - protein, 9 aa, Homo Sapiens
IPYKEFLGQ

SEQ ID NO: 199500 - protein, 9 aa, Homo Sapiens
LAAPCLAER

SEQ ID NO: 199501 - protein, 9 aa, Homo Sapiens
RNMCNIDVT

SEQ ID NO: 199502 - protein, 9 aa, Homo Sapiens
EQGSSDLVV

SEQ ID NO: 199503 - protein, 9 aa, Homo Sapiens
EPAPGAGGG

SEQ ID NO: 199504 - protein, 9 aa, Homo Sapiens
AFTDAICMY

SEQ ID NO: 199505 - protein, 9 aa, Homo Sapiens
MELLWPSLE

SEQ ID NO: 199506 - protein, 9 aa, Homo Sapiens
QDETYRLST

SEQ ID NO: 199507 - protein, 9 aa, Homo Sapiens
LADTELENF

SEQ ID NO: 199508 - protein, 9 aa, Homo Sapiens
ITILCTCSA

SEQ ID NO: 199509 - protein, 9 aa, Homo Sapiens
PHMSSVPAV

SEQ ID NO: 199510 - protein, 9 aa, Homo Sapiens
KDPSGCVES

SEQ ID NO: 199511 - protein, 9 aa, Homo Sapiens
ELTLMEALV

SEQ ID NO: 199512 - protein, 9 aa, Homo Sapiens
EKEERHGSL

SEQ ID NO: 199513 - protein, 9 aa, Homo Sapiens
RHLISSPKF

SEQ ID NO: 199514 - protein, 9 aa, Homo Sapiens
TNVQVEVII

SEQ ID NO: 199515 - protein, 9 aa, Homo Sapiens
HESRFNFSG

SEQ ID NO: 199516 - protein, 9 aa, Homo Sapiens
DEVFHRELR

SEQ ID NO: 199517 - protein, 9 aa, Homo Sapiens
GIDFDRLTL

SEQ ID NO: 199518 - protein, 9 aa, Homo Sapiens
RHTPAEEMP

SEQ ID NO: 199519 - protein, 9 aa, Homo Sapiens
HMTSVIAYV

SEQ ID NO: 199520 - protein, 9 aa, Homo Sapiens
EVVRHCPHH

SEQ ID NO: 199521 - protein, 9 aa, Homo Sapiens
MSPMPKTNF

SEQ ID NO: 199522 - protein, 9 aa, Homo Sapiens
LQPRKRSWS

SEQ ID NO: 199523 - protein, 9 aa, Homo Sapiens
VARLWGVHK

SEQ ID NO: 199524 - protein, 9 aa, Homo Sapiens
YSNATNKYE

SEQ ID NO: 199525 - protein, 9 aa, Homo Sapiens
DATRPVQVF

SEQ ID NO: 199526 - protein, 9 aa, Homo Sapiens
KVYQCSTAI

SEQ ID NO: 199527 - protein, 9 aa, Homo Sapiens
LCYYQPGIP

SEQ ID NO: 199528 - protein, 9 aa, Homo Sapiens
ECVGILSGH

SEQ ID NO: 199529 - protein, 9 aa, Homo Sapiens
DLLVPYNLA

SEQ ID NO: 199530 - protein, 9 aa, Homo Sapiens
HQELIHTPQ

SEQ ID NO: 199531 - protein, 9 aa, Homo Sapiens
FFTFRTRDK

SEQ ID NO: 199532 - protein, 9 aa, Homo Sapiens
ANVGALGLP

SEQ ID NO: 199533 - protein, 9 aa, Homo Sapiens
LFIPREMTY

SEQ ID NO: 199534 - protein, 9 aa, Homo Sapiens
TLACILVGV

SEQ ID NO: 199535 - protein, 9 aa, Homo Sapiens
FFSWHSNLT

SEQ ID NO: 199536 - protein, 9 aa, Homo Sapiens
GMYLGEIVC

SEQ ID NO: 199537 - protein, 9 aa, Homo Sapiens
GEWPTLPVC

SEQ ID NO: 199538 - protein, 9 aa, Homo Sapiens
AAEHTLLHH

SEQ ID NO: 199539 - protein, 9 aa, Homo Sapiens
KRFTHTRWV

SEQ ID NO: 199540 - protein, 9 aa, Homo Sapiens
KILLNLSCQ

SEQ ID NO: 199541 - protein, 9 aa, Homo Sapiens
EERLRGLLH

SEQ ID NO: 199542 - protein, 9 aa, Homo Sapiens
QRLWFEVHD

SEQ ID NO: 199543 - protein, 9 aa, Homo Sapiens
DPHIPCTPQ

SEQ ID NO: 199544 - protein, 9 aa, Homo Sapiens
IDPGLKEDA

SEQ ID NO: 199545 - protein, 9 aa, Homo Sapiens
KILATQGQL

SEQ ID NO: 199546 - protein, 9 aa, Homo Sapiens
VHVVDFFNC

SEQ ID NO: 199547 - protein, 9 aa, Homo Sapiens
AILDNFKEN

SEQ ID NO: 199548 - protein, 9 aa, Homo Sapiens
NHGVVTEFI

SEQ ID NO: 199549 - protein, 9 aa, Homo Sapiens
RPRVAQPSC

SEQ ID NO: 199550 - protein, 9 aa, Homo Sapiens
KGDSCTDDA

SEQ ID NO: 199551 - protein, 9 aa, Homo Sapiens
TLNGWTGWF

SEQ ID NO: 199552 - protein, 9 aa, Homo Sapiens
KLAMKIGGV

SEQ ID NO: 199553 - protein, 9 aa, Homo Sapiens
PRPASVPLS

SEQ ID NO: 199554 - protein, 9 aa, Homo Sapiens
SGSLPELLP

SEQ ID NO: 199555 - protein, 9 aa, Homo Sapiens
EHVIPTEKP

SEQ ID NO: 199556 - protein, 9 aa, Homo Sapiens
KREEEILRL

SEQ ID NO: 199557 - protein, 9 aa, Homo Sapiens
NWQDVAKQM

SEQ ID NO: 199558 - protein, 9 aa, Homo Sapiens
YQRQPEYRH

SEQ ID NO: 199559 - protein, 9 aa, Homo Sapiens
KKKNKEEER

SEQ ID NO: 199560 - protein, 9 aa, Homo Sapiens
NQLLLIWND

SEQ ID NO: 199561 - protein, 9 aa, Homo Sapiens
LRDLIAHSI

SEQ ID NO: 199562 - protein, 9 aa, Homo Sapiens
CKQEQREAH

SEQ ID NO: 199563 - protein, 9 aa, Homo Sapiens
DRPFPHTVV

SEQ ID NO: 199564 - protein, 9 aa, Homo Sapiens
NSVDKQEET

SEQ ID NO: 199565 - protein, 9 aa, Homo Sapiens
PSHRALPPT

SEQ ID NO: 199566 - protein, 9 aa, Homo Sapiens
PHQVFAPVC

SEQ ID NO: 199567 - protein, 9 aa, Homo Sapiens
STPKFQAES

SEQ ID NO: 199568 - protein, 9 aa, Homo Sapiens
TGIFYTISL

SEQ ID NO: 199569 - protein, 9 aa, Homo Sapiens
AMDKDGKPL

SEQ ID NO: 199570 - protein, 9 aa, Homo Sapiens
CSSMPYDDS

SEQ ID NO: 199571 - protein, 9 aa, Homo Sapiens
NVCDHDASV

SEQ ID NO: 199572 - protein, 9 aa, Homo Sapiens
TFSKMTKFL

SEQ ID NO: 199573 - protein, 9 aa, Homo Sapiens
SYKQDRDIT

SEQ ID NO: 199574 - protein, 9 aa, Homo Sapiens
NVDELQAYT

SEQ ID NO: 199575 - protein, 9 aa, Homo Sapiens
SPAGPWRKE

SEQ ID NO: 199576 - protein, 9 aa, Homo Sapiens
QEGSSMYST

SEQ ID NO: 199577 - protein, 9 aa, Homo Sapiens
FHFPFNSEQ

SEQ ID NO: 199578 - protein, 9 aa, Homo Sapiens
HHSSGSLTP

SEQ ID NO: 199579 - protein, 9 aa, Homo Sapiens
LQEKLDLQH

SEQ ID NO: 199580 - protein, 9 aa, Homo Sapiens
NSFLALING

SEQ ID NO: 199581 - protein, 9 aa, Homo Sapiens
ACLDILILW

SEQ ID NO: 199582 - protein, 9 aa, Homo Sapiens
VDELQAYTQ

SEQ ID NO: 199583 - protein, 9 aa, Homo Sapiens
MEPDQLPRV

SEQ ID NO: 199584 - protein, 9 aa, Homo Sapiens
QQETAQQQQ

SEQ ID NO: 199585 - protein, 9 aa, Homo Sapiens
FHDGHKAQQ

SEQ ID NO: 199586 - protein, 9 aa, Homo Sapiens
DSTRGRYAG

SEQ ID NO: 199587 - protein, 9 aa, Homo Sapiens
IERRWEAIV

SEQ ID NO: 199588 - protein, 9 aa, Homo Sapiens
EEEVLDVDN

SEQ ID NO: 199589 - protein, 9 aa, Homo Sapiens
NVWSGEARA

SEQ ID NO: 199590 - protein, 9 aa, Homo Sapiens
CGGSCCRSS

SEQ ID NO: 199591 - protein, 9 aa, Homo Sapiens
RRPGPSRAH

SEQ ID NO: 199592 - protein, 9 aa, Homo Sapiens
QPQQVINGE

SEQ ID NO: 199593 - protein, 9 aa, Homo Sapiens
TASQPSWPV

SEQ ID NO: 199594 - protein, 9 aa, Homo Sapiens
IFEYLDCTP

SEQ ID NO: 199595 - protein, 9 aa, Homo Sapiens
GVQDYILFA

SEQ ID NO: 199596 - protein, 9 aa, Homo Sapiens
KKRRRTICR

SEQ ID NO: 199597 - protein, 9 aa, Homo Sapiens
IIGHVHLAQ

SEQ ID NO: 199598 - protein, 9 aa, Homo Sapiens
KLESSVCPM

SEQ ID NO: 199599 - protein, 9 aa, Homo Sapiens
ISKKVAWDP

SEQ ID NO: 199600 - protein, 9 aa, Homo Sapiens
SGPARGITI

SEQ ID NO: 199601 - protein, 9 aa, Homo Sapiens
IVLLQLENT

SEQ ID NO: 199602 - protein, 9 aa, Homo Sapiens
AAREWRRRA

SEQ ID NO: 199603 - protein, 9 aa, Homo Sapiens
AATGSMATL

SEQ ID NO: 199604 - protein, 9 aa, Homo Sapiens
DPVDCTCVR

SEQ ID NO: 199605 - protein, 9 aa, Homo Sapiens
TLPKRQFVP

SEQ ID NO: 199606 - protein, 9 aa, Homo Sapiens
MRETNRLLQ

SEQ ID NO: 199607 - protein, 9 aa, Homo Sapiens
WDHILENKE

SEQ ID NO: 199608 - protein, 9 aa, Homo Sapiens
EPHPRALAS

SEQ ID NO: 199609 - protein, 9 aa, Homo Sapiens
AQMLLDQYR

SEQ ID NO: 199610 - protein, 9 aa, Homo Sapiens
PDEQHLVIE

SEQ ID NO: 199611 - protein, 9 aa, Homo Sapiens
DDCNAANIC

SEQ ID NO: 199612 - protein, 9 aa, Homo Sapiens
AGHISEFKP

SEQ ID NO: 199613 - protein, 9 aa, Homo Sapiens
EHDIQHYDL

SEQ ID NO: 199614 - protein, 9 aa, Homo Sapiens
VAHEGNYFL

SEQ ID NO: 199615 - protein, 9 aa, Homo Sapiens
TSLPRAYTC

SEQ ID NO: 199616 - protein, 9 aa, Homo Sapiens
VFSVIYGEN

SEQ ID NO: 199617 - protein, 9 aa, Homo Sapiens
SLKERAING

SEQ ID NO: 199618 - protein, 9 aa, Homo Sapiens
RLPPVDRLL

SEQ ID NO: 199619 - protein, 9 aa, Homo Sapiens
SSVSGVKTT

SEQ ID NO: 199620 - protein, 9 aa, Homo Sapiens
PLLVGRQKE

SEQ ID NO: 199621 - protein, 9 aa, Homo Sapiens
MATDQKQKS

SEQ ID NO: 199622 - protein, 9 aa, Homo Sapiens
QLFGWLFCR

SEQ ID NO: 199623 - protein, 9 aa, Homo Sapiens
LRGGKRHYL

SEQ ID NO: 199624 - protein, 9 aa, Homo Sapiens
VAPMGQYPW

SEQ ID NO: 199625 - protein, 9 aa, Homo Sapiens
PSSFRWHLP

SEQ ID NO: 199626 - protein, 9 aa, Homo Sapiens
HTVAMAYCG

SEQ ID NO: 199627 - protein, 9 aa, Homo Sapiens
PPRRTLFIK

SEQ ID NO: 199628 - protein, 9 aa, Homo Sapiens
HRSRPETGR

SEQ ID NO: 199629 - protein, 9 aa, Homo Sapiens
YYRQGHIAK

SEQ ID NO: 199630 - protein, 9 aa, Homo Sapiens
AITSTWNSI

SEQ ID NO: 199631 - protein, 9 aa, Homo Sapiens
AHAIQRKPN

SEQ ID NO: 199632 - protein, 9 aa, Homo Sapiens
LVTGTQLCG

SEQ ID NO: 199633 - protein, 9 aa, Homo Sapiens
RKAEALIYQ

SEQ ID NO: 199634 - protein, 9 aa, Homo Sapiens
WPVTKNERQ

SEQ ID NO: 199635 - protein, 9 aa, Homo Sapiens
TEKLPAGAG

SEQ ID NO: 199636 - protein, 9 aa, Homo Sapiens
KYLPEWTVW

SEQ ID NO: 199637 - protein, 9 aa, Homo Sapiens
ETVQHPLDR

SEQ ID NO: 199638 - protein, 9 aa, Homo Sapiens
HYLYIIQNL

SEQ ID NO: 199639 - protein, 9 aa, Homo Sapiens
AFRQYHMNK

SEQ ID NO: 199640 - protein, 9 aa, Homo Sapiens
VLAVSTKYH

SEQ ID NO: 199641 - protein, 9 aa, Homo Sapiens
QQSRKRGHT

SEQ ID NO: 199642 - protein, 9 aa, Homo Sapiens
HPQHRYCMD

SEQ ID NO: 199643 - protein, 9 aa, Homo Sapiens
LVCCYYASD

SEQ ID NO: 199644 - protein, 9 aa, Homo Sapiens
CVNLIYGTI

SEQ ID NO: 199645 - protein, 9 aa, Homo Sapiens
QVYSYQDIQ

SEQ ID NO: 199646 - protein, 9 aa, Homo Sapiens
CMHHMGSEQ

SEQ ID NO: 199647 - protein, 9 aa, Homo Sapiens
YYASDIVGL

SEQ ID NO: 199648 - protein, 9 aa, Homo Sapiens
FYATTTLHN

SEQ ID NO: 199649 - protein, 9 aa, Homo Sapiens
WHDALYVVG

SEQ ID NO: 199650 - protein, 9 aa, Homo Sapiens
DELSGDPSS

SEQ ID NO: 199651 - protein, 9 aa, Homo Sapiens
LQALLNIYD

SEQ ID NO: 199652 - protein, 9 aa, Homo Sapiens
EPEKDPVEA

SEQ ID NO: 199653 - protein, 9 aa, Homo Sapiens
AASGGVMAT

SEQ ID NO: 199654 - protein, 9 aa, Homo Sapiens
IHGWPVTKN

SEQ ID NO: 199655 - protein, 9 aa, Homo Sapiens
VVLSGFPVP

SEQ ID NO: 199656 - protein, 9 aa, Homo Sapiens
LKHKTPKVH

SEQ ID NO: 199657 - protein, 9 aa, Homo Sapiens
PASSCSQTP

SEQ ID NO: 199658 - protein, 9 aa, Homo Sapiens
LDLSHCAHI

SEQ ID NO: 199659 - protein, 9 aa, Homo Sapiens
GLELHRAQM

SEQ ID NO: 199660 - protein, 9 aa, Homo Sapiens
RERAAAALR

SEQ ID NO: 199661 - protein, 9 aa, Homo Sapiens
FCACAMVLE

SEQ ID NO: 199662 - protein, 9 aa, Homo Sapiens
LQIALVSFY

SEQ ID NO: 199663 - protein, 9 aa, Homo Sapiens
SKDGNESRE

SEQ ID NO: 199664 - protein, 9 aa, Homo Sapiens
IPVLGGLVN

SEQ ID NO: 199665 - protein, 9 aa, Homo Sapiens
KAINSLGAC

SEQ ID NO: 199666 - protein, 9 aa, Homo Sapiens
EHVQSWPSI

SEQ ID NO: 199667 - protein, 9 aa, Homo Sapiens
NLACIGDAL

SEQ ID NO: 199668 - protein, 9 aa, Homo Sapiens
PSLTGCQSD

SEQ ID NO: 199669 - protein, 9 aa, Homo Sapiens
YTWDNSMTW

SEQ ID NO: 199670 - protein, 9 aa, Homo Sapiens
YQIGDSCEK

SEQ ID NO: 199671 - protein, 9 aa, Homo Sapiens
EAAWRVEKE

SEQ ID NO: 199672 - protein, 9 aa, Homo Sapiens
VIPSPSRKP

SEQ ID NO: 199673 - protein, 9 aa, Homo Sapiens
LEEVSFPQP

SEQ ID NO: 199674 - protein, 9 aa, Homo Sapiens
DNNAPSLGS

SEQ ID NO: 199675 - protein, 9 aa, Homo Sapiens
PRLAHAKLW

SEQ ID NO: 199676 - protein, 9 aa, Homo Sapiens
PLQERGEPA

SEQ ID NO: 199677 - protein, 9 aa, Homo Sapiens
IDNILHNKP

SEQ ID NO: 199678 - protein, 9 aa, Homo Sapiens
HQRIHVAQK

SEQ ID NO: 199679 - protein, 9 aa, Homo Sapiens
VDEDEAVPD

SEQ ID NO: 199680 - protein, 9 aa, Homo Sapiens
QVSTLRQLF

SEQ ID NO: 199681 - protein, 9 aa, Homo Sapiens
HDAVAAADS

SEQ ID NO: 199682 - protein, 9 aa, Homo Sapiens
VFVDQIDPP

SEQ ID NO: 199683 - protein, 9 aa, Homo Sapiens
TERQIERKH

SEQ ID NO: 199684 - protein, 9 aa, Homo Sapiens
HTASGPHCF

SEQ ID NO: 199685 - protein, 9 aa, Homo Sapiens
GKDSTHLMN

SEQ ID NO: 199686 - protein, 9 aa, Homo Sapiens
DDLYLNANS

SEQ ID NO: 199687 - protein, 9 aa, Homo Sapiens
PKLKEALSP

SEQ ID NO: 199688 - protein, 9 aa, Homo Sapiens
SDSDKEVVV

SEQ ID NO: 199689 - protein, 9 aa, Homo Sapiens
SELKKELLP

SEQ ID NO: 199690 - protein, 9 aa, Homo Sapiens
LNLSCQSCT

SEQ ID NO: 199691 - protein, 9 aa, Homo Sapiens
QCLQEWRTV

SEQ ID NO: 199692 - protein, 9 aa, Homo Sapiens
GVCIPEARG

SEQ ID NO: 199693 - protein, 9 aa, Homo Sapiens
EWRLKYEWA

SEQ ID NO: 199694 - protein, 9 aa, Homo Sapiens
SAHSLASRH

SEQ ID NO: 199695 - protein, 9 aa, Homo Sapiens
IEGTCSDLH

SEQ ID NO: 199696 - protein, 9 aa, Homo Sapiens
HLQADNMSN

SEQ ID NO: 199697 - protein, 9 aa, Homo Sapiens
KSALITVTD

SEQ ID NO: 199698 - protein, 9 aa, Homo Sapiens
QVAKMQLDR

SEQ ID NO: 199699 - protein, 9 aa, Homo Sapiens
INVWSGEAR

SEQ ID NO: 199700 - protein, 9 aa, Homo Sapiens
MHRDLKPDN

SEQ ID NO: 199701 - protein, 9 aa, Homo Sapiens
DPGGEKAGH

SEQ ID NO: 199702 - protein, 9 aa, Homo Sapiens
ISARKTMTP

SEQ ID NO: 199703 - protein, 9 aa, Homo Sapiens
RQGSIQPQE

SEQ ID NO: 199704 - protein, 9 aa, Homo Sapiens
WVLRVPSTI

SEQ ID NO: 199705 - protein, 9 aa, Homo Sapiens
AFILTLPHV

SEQ ID NO: 199706 - protein, 9 aa, Homo Sapiens
GPQSGEGFP

SEQ ID NO: 199707 - protein, 9 aa, Homo Sapiens
IQIRLPPRR

SEQ ID NO: 199708 - protein, 9 aa, Homo Sapiens
SQETTADVI

SEQ ID NO: 199709 - protein, 9 aa, Homo Sapiens
SWHSNLTRH

SEQ ID NO: 199710 - protein, 9 aa, Homo Sapiens
GCILSILRS

SEQ ID NO: 199711 - protein, 9 aa, Homo Sapiens
LQRRPLVVH

SEQ ID NO: 199712 - protein, 9 aa, Homo Sapiens
KVMVSISLN

SEQ ID NO: 199713 - protein, 9 aa, Homo Sapiens
NALWHTRDT

SEQ ID NO: 199714 - protein, 9 aa, Homo Sapiens
LPNKPRPQS

SEQ ID NO: 199715 - protein, 9 aa, Homo Sapiens
AFPMNFITA

SEQ ID NO: 199716 - protein, 9 aa, Homo Sapiens
KGGFQCLCT

SEQ ID NO: 199717 - protein, 9 aa, Homo Sapiens
PGGGHVKIE

SEQ ID NO: 199718 - protein, 9 aa, Homo Sapiens
QTLDHPIKK

SEQ ID NO: 199719 - protein, 9 aa, Homo Sapiens
AISALQRCL

SEQ ID NO: 199720 - protein, 9 aa, Homo Sapiens
APRPHTIPA

SEQ ID NO: 199721 - protein, 9 aa, Homo Sapiens
CKGDKTKET

SEQ ID NO: 199722 - protein, 9 aa, Homo Sapiens
MPSLHSRHW

SEQ ID NO: 199723 - protein, 9 aa, Homo Sapiens
VRDLVHQGR

SEQ ID NO: 199724 - protein, 9 aa, Homo Sapiens
DCLQQFGFK

SEQ ID NO: 199725 - protein, 9 aa, Homo Sapiens
KLLRSPQKP

SEQ ID NO: 199726 - protein, 9 aa, Homo Sapiens
KPPAGHAAA

SEQ ID NO: 199727 - protein, 9 aa, Homo Sapiens
SATGAHLEP

SEQ ID NO: 199728 - protein, 9 aa, Homo Sapiens
CGEQTPRGC

SEQ ID NO: 199729 - protein, 9 aa, Homo Sapiens
TLRLQHMDR

SEQ ID NO: 199730 - protein, 9 aa, Homo Sapiens
LLNERLYCI

SEQ ID NO: 199731 - protein, 9 aa, Homo Sapiens
LLLNHSHNM

SEQ ID NO: 199732 - protein, 9 aa, Homo Sapiens
QGKRYELSA

SEQ ID NO: 199733 - protein, 9 aa, Homo Sapiens
YAAEMYGSV

SEQ ID NO: 199734 - protein, 9 aa, Homo Sapiens
FSTSTPGYS

SEQ ID NO: 199735 - protein, 9 aa, Homo Sapiens
GRYGDAIRE

SEQ ID NO: 199736 - protein, 9 aa, Homo Sapiens
CLQAIMEDA

SEQ ID NO: 199737 - protein, 9 aa, Homo Sapiens
CKSDSHILA

SEQ ID NO: 199738 - protein, 9 aa, Homo Sapiens
RRTLFIKHF

SEQ ID NO: 199739 - protein, 9 aa, Homo Sapiens
PCPQTPCWG

SEQ ID NO: 199740 - protein, 9 aa, Homo Sapiens
QDYVFACEQ

SEQ ID NO: 199741 - protein, 9 aa, Homo Sapiens
QVLGVAPMG

SEQ ID NO: 199742 - protein, 9 aa, Homo Sapiens
MEVNFFGTL

SEQ ID NO: 199743 - protein, 9 aa, Homo Sapiens
GTVCHRTGM

SEQ ID NO: 199744 - protein, 9 aa, Homo Sapiens
LHSGNIALS

SEQ ID NO: 199745 - protein, 9 aa, Homo Sapiens
AAATRPKSA

SEQ ID NO: 199746 - protein, 9 aa, Homo Sapiens
VSVRAYYKK

SEQ ID NO: 199747 - protein, 9 aa, Homo Sapiens
ESEGERCLT

SEQ ID NO: 199748 - protein, 9 aa, Homo Sapiens
STLSLWKTP

SEQ ID NO: 199749 - protein, 9 aa, Homo Sapiens
LVHQGRLEF

SEQ ID NO: 199750 - protein, 9 aa, Homo Sapiens
TERQEWICH

SEQ ID NO: 199751 - protein, 9 aa, Homo Sapiens
GKAGVKRYA

SEQ ID NO: 199752 - protein, 9 aa, Homo Sapiens
NVTTPPMPE

SEQ ID NO: 199753 - protein, 9 aa, Homo Sapiens
VGGKCTNCM

SEQ ID NO: 199754 - protein, 9 aa, Homo Sapiens
SCCNTSSGS

SEQ ID NO: 199755 - protein, 9 aa, Homo Sapiens
LQKLEITGV

SEQ ID NO: 199756 - protein, 9 aa, Homo Sapiens
TRMTVSFVV

SEQ ID NO: 199757 - protein, 9 aa, Homo Sapiens
LFHTGQHAP

SEQ ID NO: 199758 - protein, 9 aa, Homo Sapiens
HDGHKAQQH

SEQ ID NO: 199759 - protein, 9 aa, Homo Sapiens
MWALELAHR

SEQ ID NO: 199760 - protein, 9 aa, Homo Sapiens
LLEDGDPTV

SEQ ID NO: 199761 - protein, 9 aa, Homo Sapiens
KLFAKPHSL

SEQ ID NO: 199762 - protein, 9 aa, Homo Sapiens
PMAKSYNRL

SEQ ID NO: 199763 - protein, 9 aa, Homo Sapiens
VAAYLHGRL

SEQ ID NO: 199764 - protein, 9 aa, Homo Sapiens
FRRLDYGGG

SEQ ID NO: 199765 - protein, 9 aa, Homo Sapiens
HVQSWPSIN

SEQ ID NO: 199766 - protein, 9 aa, Homo Sapiens
SYSYCGRGF

SEQ ID NO: 199767 - protein, 9 aa, Homo Sapiens
QNTATLATS

SEQ ID NO: 199768 - protein, 9 aa, Homo Sapiens
LGNRDHFAL

SEQ ID NO: 199769 - protein, 9 aa, Homo Sapiens
VMPLHHGLT

SEQ ID NO: 199770 - protein, 9 aa, Homo Sapiens
LGSVTLGRD

SEQ ID NO: 199771 - protein, 9 aa, Homo Sapiens
PHSTLSLWK

SEQ ID NO: 199772 - protein, 9 aa, Homo Sapiens
ANLRCLFTV

SEQ ID NO: 199773 - protein, 9 aa, Homo Sapiens
GFSYITQNG

SEQ ID NO: 199774 - protein, 9 aa, Homo Sapiens
TGVNASMLR

SEQ ID NO: 199775 - protein, 9 aa, Homo Sapiens
SGSLAGVYA

SEQ ID NO: 199776 - protein, 9 aa, Homo Sapiens
EGDNFTSPK

SEQ ID NO: 199777 - protein, 9 aa, Homo Sapiens
IQDCKDALE

SEQ ID NO: 199778 - protein, 9 aa, Homo Sapiens
HCAHIGDPS

SEQ ID NO: 199779 - protein, 9 aa, Homo Sapiens
QQEEEGIYP

SEQ ID NO: 199780 - protein, 9 aa, Homo Sapiens
YEFNDHGKS

SEQ ID NO: 199781 - protein, 9 aa, Homo Sapiens
RRRRLCLPG

SEQ ID NO: 199782 - protein, 9 aa, Homo Sapiens
VPLILTPSR

SEQ ID NO: 199783 - protein, 9 aa, Homo Sapiens
HVCEIAEDI

SEQ ID NO: 199784 - protein, 9 aa, Homo Sapiens
MKRRGSGHV

SEQ ID NO: 199785 - protein, 9 aa, Homo Sapiens
ISMTANWLS

SEQ ID NO: 199786 - protein, 9 aa, Homo Sapiens
TCVSCVRTV

SEQ ID NO: 199787 - protein, 9 aa, Homo Sapiens
FLQHYGFSS

SEQ ID NO: 199788 - protein, 9 aa, Homo Sapiens
ALLQEQFCR

SEQ ID NO: 199789 - protein, 9 aa, Homo Sapiens
ILTPSRSQW

SEQ ID NO: 199790 - protein, 9 aa, Homo Sapiens
LSSPAIITD

SEQ ID NO: 199791 - protein, 9 aa, Homo Sapiens
LTGDVVAHA

SEQ ID NO: 199792 - protein, 9 aa, Homo Sapiens
RHMENLVAY

SEQ ID NO: 199793 - protein, 9 aa, Homo Sapiens
GVLGSMSTC

SEQ ID NO: 199794 - protein, 9 aa, Homo Sapiens
ENLLFVGSS

SEQ ID NO: 199795 - protein, 9 aa, Homo Sapiens
ALSGRLQAI

SEQ ID NO: 199796 - protein, 9 aa, Homo Sapiens
YTQHRKSIF

SEQ ID NO: 199797 - protein, 9 aa, Homo Sapiens
NKDLSSEEH

SEQ ID NO: 199798 - protein, 9 aa, Homo Sapiens
DYQRAQDEV

SEQ ID NO: 199799 - protein, 9 aa, Homo Sapiens
IRPAPDKPV

SEQ ID NO: 199800 - protein, 9 aa, Homo Sapiens
TAQDPDAVR

SEQ ID NO: 199801 - protein, 9 aa, Homo Sapiens
IWDGNNRSP

SEQ ID NO: 199802 - protein, 9 aa, Homo Sapiens
PAEFADCPK

SEQ ID NO: 199803 - protein, 9 aa, Homo Sapiens
DAGRDSPPG

SEQ ID NO: 199804 - protein, 9 aa, Homo Sapiens
AKFPIKWMA

SEQ ID NO: 199805 - protein, 9 aa, Homo Sapiens
GHVFVDSVS

SEQ ID NO: 199806 - protein, 9 aa, Homo Sapiens
GGRVPALSG

SEQ ID NO: 199807 - protein, 9 aa, Homo Sapiens
HLFPQRVIR

SEQ ID NO: 199808 - protein, 9 aa, Homo Sapiens
DKSKAESAM

SEQ ID NO: 199809 - protein, 9 aa, Homo Sapiens
GPHYERPLT

SEQ ID NO: 199810 - protein, 9 aa, Homo Sapiens
QMLLHLLLD

SEQ ID NO: 199811 - protein, 9 aa, Homo Sapiens
PPIDHQKRL

SEQ ID NO: 199812 - protein, 9 aa, Homo Sapiens
ASNSMLPLT

SEQ ID NO: 199813 - protein, 9 aa, Homo Sapiens
AKSVLKKLC

SEQ ID NO: 199814 - protein, 9 aa, Homo Sapiens
AAMACFTAI

SEQ ID NO: 199815 - protein, 9 aa, Homo Sapiens
DPGSLTPDK

SEQ ID NO: 199816 - protein, 9 aa, Homo Sapiens
IWDIAGREQ

SEQ ID NO: 199817 - protein, 9 aa, Homo Sapiens
ITSTWNSIV

SEQ ID NO: 199818 - protein, 9 aa, Homo Sapiens
HSKLIAKVC

SEQ ID NO: 199819 - protein, 9 aa, Homo Sapiens
DDKMCQLNG

SEQ ID NO: 199820 - protein, 9 aa, Homo Sapiens
CARDFNIDK

SEQ ID NO: 199821 - protein, 9 aa, Homo Sapiens
FTLEAPVSF

SEQ ID NO: 199822 - protein, 9 aa, Homo Sapiens
KRLMKEVAE

SEQ ID NO: 199823 - protein, 9 aa, Homo Sapiens
PVVVHCSTG

SEQ ID NO: 199824 - protein, 9 aa, Homo Sapiens
DKTRKRCSA

SEQ ID NO: 199825 - protein, 9 aa, Homo Sapiens
AVFMPYSAA

SEQ ID NO: 199826 - protein, 9 aa, Homo Sapiens
AQMKVCNLS

SEQ ID NO: 199827 - protein, 9 aa, Homo Sapiens
KGSQQSRKR

SEQ ID NO: 199828 - protein, 9 aa, Homo Sapiens
QLLRISCRL

SEQ ID NO: 199829 - protein, 9 aa, Homo Sapiens
DKIRTAQDA

SEQ ID NO: 199830 - protein, 9 aa, Homo Sapiens
GDPRLAHAK

SEQ ID NO: 199831 - protein, 9 aa, Homo Sapiens
QKLFAKPHS

SEQ ID NO: 199832 - protein, 9 aa, Homo Sapiens
DVNAAIVTI

SEQ ID NO: 199833 - protein, 9 aa, Homo Sapiens
VTCSLTLAC

SEQ ID NO: 199834 - protein, 9 aa, Homo Sapiens
CIFPLFCTC

SEQ ID NO: 199835 - protein, 9 aa, Homo Sapiens
LVKDFHMDT

SEQ ID NO: 199836 - protein, 9 aa, Homo Sapiens
RWQREEQQQ

SEQ ID NO: 199837 - protein, 9 aa, Homo Sapiens
DVINSSSYW

SEQ ID NO: 199838 - protein, 9 aa, Homo Sapiens
DSPPGGGGR

SEQ ID NO: 199839 - protein, 9 aa, Homo Sapiens
RIQDKPEEQ

SEQ ID NO: 199840 - protein, 9 aa, Homo Sapiens
SYQAPGPGN

SEQ ID NO: 199841 - protein, 9 aa, Homo Sapiens
MIQDQAREL

SEQ ID NO: 199842 - protein, 9 aa, Homo Sapiens
SAAEFDDRQ

SEQ ID NO: 199843 - protein, 9 aa, Homo Sapiens
RARKATARE

SEQ ID NO: 199844 - protein, 9 aa, Homo Sapiens
VRHCPHHER

SEQ ID NO: 199845 - protein, 9 aa, Homo Sapiens
ALTEVCDVN

SEQ ID NO: 199846 - protein, 9 aa, Homo Sapiens
PISAFPVDT

SEQ ID NO: 199847 - protein, 9 aa, Homo Sapiens
ALRAVGTQI

SEQ ID NO: 199848 - protein, 9 aa, Homo Sapiens
CGLSFGNKS

SEQ ID NO: 199849 - protein, 9 aa, Homo Sapiens
ICPLLRLVC

SEQ ID NO: 199850 - protein, 9 aa, Homo Sapiens
DENLKSHME

SEQ ID NO: 199851 - protein, 9 aa, Homo Sapiens
EAKTDPTGL

SEQ ID NO: 199852 - protein, 9 aa, Homo Sapiens
NLCEGHIEK

SEQ ID NO: 199853 - protein, 9 aa, Homo Sapiens
YRDSIFRWL

SEQ ID NO: 199854 - protein, 9 aa, Homo Sapiens
SLSSSGKLD

SEQ ID NO: 199855 - protein, 9 aa, Homo Sapiens
LVSFYEDGG

SEQ ID NO: 199856 - protein, 9 aa, Homo Sapiens
TISDCSVQM

SEQ ID NO: 199857 - protein, 9 aa, Homo Sapiens
EAHDIFYKP

SEQ ID NO: 199858 - protein, 9 aa, Homo Sapiens
KVELLPAEP

SEQ ID NO: 199859 - protein, 9 aa, Homo Sapiens
QTKTDIKKG

SEQ ID NO: 199860 - protein, 9 aa, Homo Sapiens
FGGILVGVI

SEQ ID NO: 199861 - protein, 9 aa, Homo Sapiens
SDFEMPQSS

SEQ ID NO: 199862 - protein, 9 aa, Homo Sapiens
LSDNRIITL

SEQ ID NO: 199863 - protein, 9 aa, Homo Sapiens
QDLGGDFWY

SEQ ID NO: 199864 - protein, 9 aa, Homo Sapiens
PSHTPLLNG

SEQ ID NO: 199865 - protein, 9 aa, Homo Sapiens
WVNAHTYPA

SEQ ID NO: 199866 - protein, 9 aa, Homo Sapiens
LSLQMEVLT

SEQ ID NO: 199867 - protein, 9 aa, Homo Sapiens
LASDTMDSQ

SEQ ID NO: 199868 - protein, 9 aa, Homo Sapiens
ETAHAPGTP

SEQ ID NO: 199869 - protein, 9 aa, Homo Sapiens
PMELMGPED

SEQ ID NO: 199870 - protein, 9 aa, Homo Sapiens
QERRRPQSC

SEQ ID NO: 199871 - protein, 9 aa, Homo Sapiens
QELIHTPQL

SEQ ID NO: 199872 - protein, 9 aa, Homo Sapiens
TFTRSVGLK

SEQ ID NO: 199873 - protein, 9 aa, Homo Sapiens
FPHTVVAVE

SEQ ID NO: 199874 - protein, 9 aa, Homo Sapiens
SADLQTLLR

SEQ ID NO: 199875 - protein, 9 aa, Homo Sapiens
GSQGSWELL

SEQ ID NO: 199876 - protein, 9 aa, Homo Sapiens
GGPKVGVGA

SEQ ID NO: 199877 - protein, 9 aa, Homo Sapiens
MRHLCELGA

SEQ ID NO: 199878 - protein, 9 aa, Homo Sapiens
PYGMLESIR

SEQ ID NO: 199879 - protein, 9 aa, Homo Sapiens
TLKDHRPWM

SEQ ID NO: 199880 - protein, 9 aa, Homo Sapiens
ALVNNPRIE

SEQ ID NO: 199881 - protein, 9 aa, Homo Sapiens
RELTGLHHS

SEQ ID NO: 199882 - protein, 9 aa, Homo Sapiens
ARGRDLLVV

SEQ ID NO: 199883 - protein, 9 aa, Homo Sapiens
SAEALANPI

SEQ ID NO: 199884 - protein, 9 aa, Homo Sapiens
DFIFFVMPL

SEQ ID NO: 199885 - protein, 9 aa, Homo Sapiens
GQVPLRDLS

SEQ ID NO: 199886 - protein, 9 aa, Homo Sapiens
VDGKSTFLY

SEQ ID NO: 199887 - protein, 9 aa, Homo Sapiens
APEGVDPPH

SEQ ID NO: 199888 - protein, 9 aa, Homo Sapiens
QAILQNQGN

SEQ ID NO: 199889 - protein, 9 aa, Homo Sapiens
TPVAFASFT

SEQ ID NO: 199890 - protein, 9 aa, Homo Sapiens
ALQLTKFCP

SEQ ID NO: 199891 - protein, 9 aa, Homo Sapiens
YKGPSFGAD

SEQ ID NO: 199892 - protein, 9 aa, Homo Sapiens
KAHSFERGV

SEQ ID NO: 199893 - protein, 9 aa, Homo Sapiens
TAWVQKIKV

SEQ ID NO: 199894 - protein, 9 aa, Homo Sapiens
NVHVCSECG

SEQ ID NO: 199895 - protein, 9 aa, Homo Sapiens
DERRKLIVA

SEQ ID NO: 199896 - protein, 9 aa, Homo Sapiens
GCYLSHTLS

SEQ ID NO: 199897 - protein, 9 aa, Homo Sapiens
FMYQLPAFA

SEQ ID NO: 199898 - protein, 9 aa, Homo Sapiens
FMFMDMDNF

SEQ ID NO: 199899 - protein, 9 aa, Homo Sapiens
GDKWSHFDR

SEQ ID NO: 199900 - protein, 9 aa, Homo Sapiens
GQPGYDRHS

SEQ ID NO: 199901 - protein, 9 aa, Homo Sapiens
LHPNSGGFH

SEQ ID NO: 199902 - protein, 9 aa, Homo Sapiens
PVFLFLRTL

SEQ ID NO: 199903 - protein, 9 aa, Homo Sapiens
KQLPPCIPG

SEQ ID NO: 199904 - protein, 9 aa, Homo Sapiens
TSMGMHHRD

SEQ ID NO: 199905 - protein, 9 aa, Homo Sapiens
VVKKARKYP

SEQ ID NO: 199906 - protein, 9 aa, Homo Sapiens
LCFTSPQWG

SEQ ID NO: 199907 - protein, 9 aa, Homo Sapiens
EYLHNYGIM

SEQ ID NO: 199908 - protein, 9 aa, Homo Sapiens
QPLGPRQRL

SEQ ID NO: 199909 - protein, 9 aa, Homo Sapiens
CEHENLRLR

SEQ ID NO: 199910 - protein, 9 aa, Homo Sapiens
NRQAHKIQG

SEQ ID NO: 199911 - protein, 9 aa, Homo Sapiens
SISGPDFMD

SEQ ID NO: 199912 - protein, 9 aa, Homo Sapiens
EPGEHPQRL

SEQ ID NO: 199913 - protein, 9 aa, Homo Sapiens
VTHSHMQIC

SEQ ID NO: 199914 - protein, 9 aa, Homo Sapiens
KLKISYKDV

SEQ ID NO: 199915 - protein, 9 aa, Homo Sapiens
LQRWCLNVL

SEQ ID NO: 199916 - protein, 9 aa, Homo Sapiens
GLTRSVCTM

SEQ ID NO: 199917 - protein, 9 aa, Homo Sapiens
NAAIVTIKT

SEQ ID NO: 199918 - protein, 9 aa, Homo Sapiens
RQCVEHYHL

SEQ ID NO: 199919 - protein, 9 aa, Homo Sapiens
DADDKMCQL

SEQ ID NO: 199920 - protein, 9 aa, Homo Sapiens
KSRLGLVAV

SEQ ID NO: 199921 - protein, 9 aa, Homo Sapiens
GYSSFGCSF

SEQ ID NO: 199922 - protein, 9 aa, Homo Sapiens
SFRQKTILV

SEQ ID NO: 199923 - protein, 9 aa, Homo Sapiens
GHWAPVIRP

SEQ ID NO: 199924 - protein, 9 aa, Homo Sapiens
EEDFSVTSV

SEQ ID NO: 199925 - protein, 9 aa, Homo Sapiens
SYLSDFEMP

SEQ ID NO: 199926 - protein, 9 aa, Homo Sapiens
QKGNLLCHI

SEQ ID NO: 199927 - protein, 9 aa, Homo Sapiens
RNTLPAMDS

SEQ ID NO: 199928 - protein, 9 aa, Homo Sapiens
RRCRQPHRG

SEQ ID NO: 199929 - protein, 9 aa, Homo Sapiens
ATKSCRKIN

SEQ ID NO: 199930 - protein, 9 aa, Homo Sapiens
STSSNYQTM

SEQ ID NO: 199931 - protein, 9 aa, Homo Sapiens
SQCEYEELR

SEQ ID NO: 199932 - protein, 9 aa, Homo Sapiens
WRLKYEWAV

SEQ ID NO: 199933 - protein, 9 aa, Homo Sapiens
PMDVARQRE

SEQ ID NO: 199934 - protein, 9 aa, Homo Sapiens
GTVYECWWY

SEQ ID NO: 199935 - protein, 9 aa, Homo Sapiens
VIYWAAYTM

SEQ ID NO: 199936 - protein, 9 aa, Homo Sapiens
ISASSCIVP

SEQ ID NO: 199937 - protein, 9 aa, Homo Sapiens
LPFCPESPH

SEQ ID NO: 199938 - protein, 9 aa, Homo Sapiens
SKETHFLSN

SEQ ID NO: 199939 - protein, 9 aa, Homo Sapiens
RLVSDWSKV

SEQ ID NO: 199940 - protein, 9 aa, Homo Sapiens
EHLVFFLQS

SEQ ID NO: 199941 - protein, 9 aa, Homo Sapiens
PVVDHSVQI

SEQ ID NO: 199942 - protein, 9 aa, Homo Sapiens
SQTSMGMHH

SEQ ID NO: 199943 - protein, 9 aa, Homo Sapiens
PFPHTVVAV

SEQ ID NO: 199944 - protein, 9 aa, Homo Sapiens
TSVRCLATH

SEQ ID NO: 199945 - protein, 9 aa, Homo Sapiens
DVAQCILSY

SEQ ID NO: 199946 - protein, 9 aa, Homo Sapiens
IINTLPWKR

SEQ ID NO: 199947 - protein, 9 aa, Homo Sapiens
ETQVSCLPP

SEQ ID NO: 199948 - protein, 9 aa, Homo Sapiens
AAIVTIKTK

SEQ ID NO: 199949 - protein, 9 aa, Homo Sapiens
CSMDAPSRR

SEQ ID NO: 199950 - protein, 9 aa, Homo Sapiens
IPQQAQELG

SEQ ID NO: 199951 - protein, 9 aa, Homo Sapiens
VVQNVHRPP

SEQ ID NO: 199952 - protein, 9 aa, Homo Sapiens
CGALLLALL

SEQ ID NO: 199953 - protein, 9 aa, Homo Sapiens
EEQTEVITA

SEQ ID NO: 199954 - protein, 9 aa, Homo Sapiens
DTMDSQMLA

SEQ ID NO: 199955 - protein, 9 aa, Homo Sapiens
PPPIDHQKR

SEQ ID NO: 199956 - protein, 9 aa, Homo Sapiens
LTRLQERPI

SEQ ID NO: 199957 - protein, 9 aa, Homo Sapiens
SMTQKEIAK

SEQ ID NO: 199958 - protein, 9 aa, Homo Sapiens
GSLDQPVSQ

SEQ ID NO: 199959 - protein, 9 aa, Homo Sapiens
VKIISKGME

SEQ ID NO: 199960 - protein, 9 aa, Homo Sapiens
KGCAMGPHC

SEQ ID NO: 199961 - protein, 9 aa, Homo Sapiens
GVHLRRRCP

SEQ ID NO: 199962 - protein, 9 aa, Homo Sapiens
KCLKVKGIQ

SEQ ID NO: 199963 - protein, 9 aa, Homo Sapiens
PGRETKRAP

SEQ ID NO: 199964 - protein, 9 aa, Homo Sapiens
IRSTKELNI

SEQ ID NO: 199965 - protein, 9 aa, Homo Sapiens
YATTTLHNL

SEQ ID NO: 199966 - protein, 9 aa, Homo Sapiens
MLLVAASTD

SEQ ID NO: 199967 - protein, 9 aa, Homo Sapiens
DASWGPHCL

SEQ ID NO: 199968 - protein, 9 aa, Homo Sapiens
NIGTVYECW

SEQ ID NO: 199969 - protein, 9 aa, Homo Sapiens
NANSFLALI

SEQ ID NO: 199970 - protein, 9 aa, Homo Sapiens
PDGDWGWVV

SEQ ID NO: 199971 - protein, 9 aa, Homo Sapiens
SGHNAWLPY

SEQ ID NO: 199972 - protein, 9 aa, Homo Sapiens
VLDTVCSNQ

SEQ ID NO: 199973 - protein, 9 aa, Homo Sapiens
ILMHYGQHP

SEQ ID NO: 199974 - protein, 9 aa, Homo Sapiens
SMGEEPVPH

SEQ ID NO: 199975 - protein, 9 aa, Homo Sapiens
QRWCLNVLR

SEQ ID NO: 199976 - protein, 9 aa, Homo Sapiens
IMAHVYPIC

SEQ ID NO: 199977 - protein, 9 aa, Homo Sapiens
MAPEAINFG

SEQ ID NO: 199978 - protein, 9 aa, Homo Sapiens
LKGPSRLPP

SEQ ID NO: 199979 - protein, 9 aa, Homo Sapiens
VWGLDAPQQ

SEQ ID NO: 199980 - protein, 9 aa, Homo Sapiens
QKVWQKRKC

SEQ ID NO: 199981 - protein, 9 aa, Homo Sapiens
LCEGHIEKD

SEQ ID NO: 199982 - protein, 9 aa, Homo Sapiens
VKEEAVAVA

SEQ ID NO: 199983 - protein, 9 aa, Homo Sapiens
RLLGDPGLQ

SEQ ID NO: 199984 - protein, 9 aa, Homo Sapiens
SRGRIRSRS

SEQ ID NO: 199985 - protein, 9 aa, Homo Sapiens
ELGGSDQEH

SEQ ID NO: 199986 - protein, 9 aa, Homo Sapiens
DYTSYWTSS

SEQ ID NO: 199987 - protein, 9 aa, Homo Sapiens
TLISLFDDE

SEQ ID NO: 199988 - protein, 9 aa, Homo Sapiens
KKPLQGVEI

SEQ ID NO: 199989 - protein, 9 aa, Homo Sapiens
HVLSEPYQY

SEQ ID NO: 199990 - protein, 9 aa, Homo Sapiens
QCAAPKVSP

SEQ ID NO: 199991 - protein, 9 aa, Homo Sapiens
AYKFKCSKR

SEQ ID NO: 199992 - protein, 9 aa, Homo Sapiens
SCINPFLYC

SEQ ID NO: 199993 - protein, 9 aa, Homo Sapiens
SDFSNEERL

SEQ ID NO: 199994 - protein, 9 aa, Homo Sapiens
MMHCSQLAP

SEQ ID NO: 199995 - protein, 9 aa, Homo Sapiens
QTLKDHRPW

SEQ ID NO: 199996 - protein, 9 aa, Homo Sapiens
MLASDTMDS

SEQ ID NO: 199997 - protein, 9 aa, Homo Sapiens
EEAGVENLF

SEQ ID NO: 199998 - protein, 9 aa, Homo Sapiens
VNEIDNILH

SEQ ID NO: 199999 - protein, 9 aa, Homo Sapiens
RTGLLPGEA

SEQ ID NO: 200000 - protein, 9 aa, Homo Sapiens
HVLSAGKAE

SEQ ID NO: 200001 - protein, 9 aa, Homo Sapiens
LVFEQSVLQ

SEQ ID NO: 200002 - protein, 9 aa, Homo Sapiens
KQAADVEME

SEQ ID NO: 200003 - protein, 9 aa, Homo Sapiens
HCAMNNKNA

SEQ ID NO: 200004 - protein, 9 aa, Homo Sapiens
QRALVATKD

SEQ ID NO: 200005 - protein, 9 aa, Homo Sapiens
LPTSTATSR

SEQ ID NO: 200006 - protein, 9 aa, Homo Sapiens
PHHHMHVPA

SEQ ID NO: 200007 - protein, 9 aa, Homo Sapiens
LTLSDEIQM

SEQ ID NO: 200008 - protein, 9 aa, Homo Sapiens
RRCQRALPQ

SEQ ID NO: 200009 - protein, 9 aa, Homo Sapiens
QCILSYGNK

SEQ ID NO: 200010 - protein, 9 aa, Homo Sapiens
TSLMALSLA

SEQ ID NO: 200011 - protein, 9 aa, Homo Sapiens
LDCVPDERR

SEQ ID NO: 200012 - protein, 9 aa, Homo Sapiens
ATLQRAKQD

SEQ ID NO: 200013 - protein, 9 aa, Homo Sapiens
EGWVDGRML

SEQ ID NO: 200014 - protein, 9 aa, Homo Sapiens
CVDGEWPTL

SEQ ID NO: 200015 - protein, 9 aa, Homo Sapiens
LKGTDPDET

SEQ ID NO: 200016 - protein, 9 aa, Homo Sapiens
QSDSPQGIY

SEQ ID NO: 200017 - protein, 9 aa, Homo Sapiens
WRDDDFVSR

SEQ ID NO: 200018 - protein, 9 aa, Homo Sapiens
VSYLFSFSV

SEQ ID NO: 200019 - protein, 9 aa, Homo Sapiens
EESVNESAE

SEQ ID NO: 200020 - protein, 9 aa, Homo Sapiens
SLAEEKLQT

SEQ ID NO: 200021 - protein, 9 aa, Homo Sapiens
LLAHGYHRF

SEQ ID NO: 200022 - protein, 9 aa, Homo Sapiens
HYKCSEHGK

SEQ ID NO: 200023 - protein, 9 aa, Homo Sapiens
ASVSFWTLL

SEQ ID NO: 200024 - protein, 9 aa, Homo Sapiens
RLQTHLKER

SEQ ID NO: 200025 - protein, 9 aa, Homo Sapiens
DALLVSKQH

SEQ ID NO: 200026 - protein, 9 aa, Homo Sapiens
ARASHDVAQ

SEQ ID NO: 200027 - protein, 9 aa, Homo Sapiens
ALWQLLSGV

SEQ ID NO: 200028 - protein, 9 aa, Homo Sapiens
SVTSSDTAP

SEQ ID NO: 200029 - protein, 9 aa, Homo Sapiens
PQSCSQSFF

SEQ ID NO: 200030 - protein, 9 aa, Homo Sapiens
ARRATAHTL

SEQ ID NO: 200031 - protein, 9 aa, Homo Sapiens
YSSVPRFYW

SEQ ID NO: 200032 - protein, 9 aa, Homo Sapiens
ASMEDQGLS

SEQ ID NO: 200033 - protein, 9 aa, Homo Sapiens
TFFTGIFYM

SEQ ID NO: 200034 - protein, 9 aa, Homo Sapiens
EGNYFLSLS

SEQ ID NO: 200035 - protein, 9 aa, Homo Sapiens
LQEEKCLKV

SEQ ID NO: 200036 - protein, 9 aa, Homo Sapiens
TGMELEFKC

SEQ ID NO: 200037 - protein, 9 aa, Homo Sapiens
CTKEPRIQL

SEQ ID NO: 200038 - protein, 9 aa, Homo Sapiens
AFVWFEFHY

SEQ ID NO: 200039 - protein, 9 aa, Homo Sapiens
SLFWPSSRP

SEQ ID NO: 200040 - protein, 9 aa, Homo Sapiens
DKLYKPKRC

SEQ ID NO: 200041 - protein, 9 aa, Homo Sapiens
LLKQAQNTA

SEQ ID NO: 200042 - protein, 9 aa, Homo Sapiens
VVLSFLLIL

SEQ ID NO: 200043 - protein, 9 aa, Homo Sapiens
VLLNNMRVE

SEQ ID NO: 200044 - protein, 9 aa, Homo Sapiens
AEPGEHPQR

SEQ ID NO: 200045 - protein, 9 aa, Homo Sapiens
LALNVILVC

SEQ ID NO: 200046 - protein, 9 aa, Homo Sapiens
RNRCVMTSH

SEQ ID NO: 200047 - protein, 9 aa, Homo Sapiens
LDREYKKGY

SEQ ID NO: 200048 - protein, 9 aa, Homo Sapiens
KKLYVIRGG

SEQ ID NO: 200049 - protein, 9 aa, Homo Sapiens
QPHLDVVMP

SEQ ID NO: 200050 - protein, 9 aa, Homo Sapiens
EDDLVTMWS

SEQ ID NO: 200051 - protein, 9 aa, Homo Sapiens
LEIMAHVYP

SEQ ID NO: 200052 - protein, 9 aa, Homo Sapiens
GRGAPPPGT

SEQ ID NO: 200053 - protein, 9 aa, Homo Sapiens
HILASFETG

SEQ ID NO: 200054 - protein, 9 aa, Homo Sapiens
EFFNKLQEH

SEQ ID NO: 200055 - protein, 9 aa, Homo Sapiens
SPWHIYFRK

SEQ ID NO: 200056 - protein, 9 aa, Homo Sapiens
SPTSPFQVL

SEQ ID NO: 200057 - protein, 9 aa, Homo Sapiens
ELVKSKIAL

SEQ ID NO: 200058 - protein, 9 aa, Homo Sapiens
FTFYIWDGN

SEQ ID NO: 200059 - protein, 9 aa, Homo Sapiens
TKPSHSSKD

SEQ ID NO: 200060 - protein, 9 aa, Homo Sapiens
RKAGCSAEE

SEQ ID NO: 200061 - protein, 9 aa, Homo Sapiens
EVKAKKRIP

SEQ ID NO: 200062 - protein, 9 aa, Homo Sapiens
RSCCNTSSG

SEQ ID NO: 200063 - protein, 9 aa, Homo Sapiens
DRPFCCGQC

SEQ ID NO: 200064 - protein, 9 aa, Homo Sapiens
LHYKRRRAM

SEQ ID NO: 200065 - protein, 9 aa, Homo Sapiens
IRESLELMQ

SEQ ID NO: 200066 - protein, 9 aa, Homo Sapiens
TTDHNVSPN

SEQ ID NO: 200067 - protein, 9 aa, Homo Sapiens
CSTKIDLSG

SEQ ID NO: 200068 - protein, 9 aa, Homo Sapiens
TSTAALEAG

SEQ ID NO: 200069 - protein, 9 aa, Homo Sapiens
LELRDISGH

SEQ ID NO: 200070 - protein, 9 aa, Homo Sapiens
KDVAQCILS

SEQ ID NO: 200071 - protein, 9 aa, Homo Sapiens
RAQMLLDQY

SEQ ID NO: 200072 - protein, 9 aa, Homo Sapiens
TEPPDGDWG

SEQ ID NO: 200073 - protein, 9 aa, Homo Sapiens
EDPLSPSPR

SEQ ID NO: 200074 - protein, 9 aa, Homo Sapiens
SKYLTHFLK

SEQ ID NO: 200075 - protein, 9 aa, Homo Sapiens
LANIPFLDM

SEQ ID NO: 200076 - protein, 9 aa, Homo Sapiens
PLSPSLSRH

SEQ ID NO: 200077 - protein, 9 aa, Homo Sapiens
LRTTSSTAM

SEQ ID NO: 200078 - protein, 9 aa, Homo Sapiens
FLSEQDEAL

SEQ ID NO: 200079 - protein, 9 aa, Homo Sapiens
KNAMNVEQS

SEQ ID NO: 200080 - protein, 9 aa, Homo Sapiens
HHLIGAGHI

SEQ ID NO: 200081 - protein, 9 aa, Homo Sapiens
CGKTFSKMT

SEQ ID NO: 200082 - protein, 9 aa, Homo Sapiens
CNPNPCQKT

SEQ ID NO: 200083 - protein, 9 aa, Homo Sapiens
CIHVENQTR

SEQ ID NO: 200084 - protein, 9 aa, Homo Sapiens
EPENTCKDK

SEQ ID NO: 200085 - protein, 9 aa, Homo Sapiens
ATGFLYWVG

SEQ ID NO: 200086 - protein, 9 aa, Homo Sapiens
NLEGCYLSH

SEQ ID NO: 200087 - protein, 9 aa, Homo Sapiens
VHAFVRMIA

SEQ ID NO: 200088 - protein, 9 aa, Homo Sapiens
FPGFSYITQ

SEQ ID NO: 200089 - protein, 9 aa, Homo Sapiens
FEDAGEYMC

SEQ ID NO: 200090 - protein, 9 aa, Homo Sapiens
ITGQGPQIL

SEQ ID NO: 200091 - protein, 9 aa, Homo Sapiens
PKPAMACWC

SEQ ID NO: 200092 - protein, 9 aa, Homo Sapiens
LRNSDEKVL

SEQ ID NO: 200093 - protein, 9 aa, Homo Sapiens
PVPALQANV

SEQ ID NO: 200094 - protein, 9 aa, Homo Sapiens
HSVNDENCI

SEQ ID NO: 200095 - protein, 9 aa, Homo Sapiens
TFNYYFLEE

SEQ ID NO: 200096 - protein, 9 aa, Homo Sapiens
ASQPSWPVH

SEQ ID NO: 200097 - protein, 9 aa, Homo Sapiens
MGMTGPGFT

SEQ ID NO: 200098 - protein, 9 aa, Homo Sapiens
FEMPQSSGR

SEQ ID NO: 200099 - protein, 9 aa, Homo Sapiens
SIFRWLWQL

SEQ ID NO: 200100 - protein, 9 aa, Homo Sapiens
MDLEEFCQK

SEQ ID NO: 200101 - protein, 9 aa, Homo Sapiens
KLPTLISLF

SEQ ID NO: 200102 - protein, 9 aa, Homo Sapiens
QHAPPISTP

SEQ ID NO: 200103 - protein, 9 aa, Homo Sapiens
RERAAAGAA

SEQ ID NO: 200104 - protein, 9 aa, Homo Sapiens
DIAGREQFH

SEQ ID NO: 200105 - protein, 9 aa, Homo Sapiens
CTDSREQKL

SEQ ID NO: 200106 - protein, 9 aa, Homo Sapiens
RFNQDPKAV

SEQ ID NO: 200107 - protein, 9 aa, Homo Sapiens
TVLRLLLGL

SEQ ID NO: 200108 - protein, 9 aa, Homo Sapiens
SNSMLPLTQ

SEQ ID NO: 200109 - protein, 9 aa, Homo Sapiens
VFLFLRTLK

SEQ ID NO: 200110 - protein, 9 aa, Homo Sapiens
SLCTPPTAA

SEQ ID NO: 200111 - protein, 9 aa, Homo Sapiens
ETGVIDPQD

SEQ ID NO: 200112 - protein, 9 aa, Homo Sapiens
LGTHAEGPG

SEQ ID NO: 200113 - protein, 9 aa, Homo Sapiens
KVLPQLPLW

SEQ ID NO: 200114 - protein, 9 aa, Homo Sapiens
SMIFSSSAC

SEQ ID NO: 200115 - protein, 9 aa, Homo Sapiens
THVLPPTIT

SEQ ID NO: 200116 - protein, 9 aa, Homo Sapiens
YVDQTLQER

SEQ ID NO: 200117 - protein, 9 aa, Homo Sapiens
TEQPGPYSH

SEQ ID NO: 200118 - protein, 9 aa, Homo Sapiens
EPQHMASII

SEQ ID NO: 200119 - protein, 9 aa, Homo Sapiens
KIKLAMKIG

SEQ ID NO: 200120 - protein, 9 aa, Homo Sapiens
FAYKFKCSK

SEQ ID NO: 200121 - protein, 9 aa, Homo Sapiens
WYQYHSLDM

SEQ ID NO: 200122 - protein, 9 aa, Homo Sapiens
LPQHQPLGP

SEQ ID NO: 200123 - protein, 9 aa, Homo Sapiens
LGQALRQCY

SEQ ID NO: 200124 - protein, 9 aa, Homo Sapiens
NHHHHQPQQ

SEQ ID NO: 200125 - protein, 9 aa, Homo Sapiens
PALMSRGLL

SEQ ID NO: 200126 - protein, 9 aa, Homo Sapiens
AQNGVGPGH

SEQ ID NO: 200127 - protein, 9 aa, Homo Sapiens
AAEYLKREE

SEQ ID NO: 200128 - protein, 9 aa, Homo Sapiens
TTTFSTDGI

SEQ ID NO: 200129 - protein, 9 aa, Homo Sapiens
GGSVTRSLQ

SEQ ID NO: 200130 - protein, 9 aa, Homo Sapiens
PYKGPSFGA

SEQ ID NO: 200131 - protein, 9 aa, Homo Sapiens
LTASIFRPT

SEQ ID NO: 200132 - protein, 9 aa, Homo Sapiens
QILPFPASL

SEQ ID NO: 200133 - protein, 9 aa, Homo Sapiens
HELVKSKIA

SEQ ID NO: 200134 - protein, 9 aa, Homo Sapiens
TPAMPDNAS

SEQ ID NO: 200135 - protein, 9 aa, Homo Sapiens
KAFRVGSQL

SEQ ID NO: 200136 - protein, 9 aa, Homo Sapiens
TQQRGLMDW

SEQ ID NO: 200137 - protein, 9 aa, Homo Sapiens
LDNFKENIE

SEQ ID NO: 200138 - protein, 9 aa, Homo Sapiens
GKQLPPCIP

SEQ ID NO: 200139 - protein, 9 aa, Homo Sapiens
GDAGEALEG

SEQ ID NO: 200140 - protein, 9 aa, Homo Sapiens
VCCYYASDI

SEQ ID NO: 200141 - protein, 9 aa, Homo Sapiens
RTVMNSRQG

SEQ ID NO: 200142 - protein, 9 aa, Homo Sapiens
VDYYKNRMY

SEQ ID NO: 200143 - protein, 9 aa, Homo Sapiens
GASQFLVSA

SEQ ID NO: 200144 - protein, 9 aa, Homo Sapiens
LRAPWNQAA

SEQ ID NO: 200145 - protein, 9 aa, Homo Sapiens
HVAQKPYRC

SEQ ID NO: 200146 - protein, 9 aa, Homo Sapiens
TQMPGFQTP

SEQ ID NO: 200147 - protein, 9 aa, Homo Sapiens
LRCTIHLWD

SEQ ID NO: 200148 - protein, 9 aa, Homo Sapiens
AGSSVTTDC

SEQ ID NO: 200149 - protein, 9 aa, Homo Sapiens
ELLMTPCYT

SEQ ID NO: 200150 - protein, 9 aa, Homo Sapiens
MLDDQHLLL

SEQ ID NO: 200151 - protein, 9 aa, Homo Sapiens
VELHSLQSL

SEQ ID NO: 200152 - protein, 9 aa, Homo Sapiens
QEHELLEAV

SEQ ID NO: 200153 - protein, 9 aa, Homo Sapiens
YIYQRQPEY

SEQ ID NO: 200154 - protein, 9 aa, Homo Sapiens
QVNNRNAGQ

SEQ ID NO: 200155 - protein, 9 aa, Homo Sapiens
DEDGNYLHP

SEQ ID NO: 200156 - protein, 9 aa, Homo Sapiens
PCILPTTAY

SEQ ID NO: 200157 - protein, 9 aa, Homo Sapiens
YPDSDKCRE

SEQ ID NO: 200158 - protein, 9 aa, Homo Sapiens
RSGAILNSS

SEQ ID NO: 200159 - protein, 9 aa, Homo Sapiens
TIRACRCDS

SEQ ID NO: 200160 - protein, 9 aa, Homo Sapiens
YAPAGPACS

SEQ ID NO: 200161 - protein, 9 aa, Homo Sapiens
TSGSLAGVY

SEQ ID NO: 200162 - protein, 9 aa, Homo Sapiens
AHDIFYKPF

SEQ ID NO: 200163 - protein, 9 aa, Homo Sapiens
PEGKAKSRP

SEQ ID NO: 200164 - protein, 9 aa, Homo Sapiens
KEILHYVYE

SEQ ID NO: 200165 - protein, 9 aa, Homo Sapiens
HTGDKLYKP

SEQ ID NO: 200166 - protein, 9 aa, Homo Sapiens
LSSSAGHST

SEQ ID NO: 200167 - protein, 9 aa, Homo Sapiens
GDEELTLME

SEQ ID NO: 200168 - protein, 9 aa, Homo Sapiens
VCIPEARGD

SEQ ID NO: 200169 - protein, 9 aa, Homo Sapiens
TVGHLFTIG

SEQ ID NO: 200170 - protein, 9 aa, Homo Sapiens
LQQLEAAAG

SEQ ID NO: 200171 - protein, 9 aa, Homo Sapiens
YGEFMQVWI

SEQ ID NO: 200172 - protein, 9 aa, Homo Sapiens
NRESVHART

SEQ ID NO: 200173 - protein, 9 aa, Homo Sapiens
RDRRPGPSR

SEQ ID NO: 200174 - protein, 9 aa, Homo Sapiens
PVIERWPRL

SEQ ID NO: 200175 - protein, 9 aa, Homo Sapiens
LPMSGQTRV

SEQ ID NO: 200176 - protein, 9 aa, Homo Sapiens
AKVEIAQAR

SEQ ID NO: 200177 - protein, 9 aa, Homo Sapiens
YRISPTVCF

SEQ ID NO: 200178 - protein, 9 aa, Homo Sapiens
DGEDYTPSY

SEQ ID NO: 200179 - protein, 9 aa, Homo Sapiens
LQEQFCREG

SEQ ID NO: 200180 - protein, 9 aa, Homo Sapiens
VCNILIDFT

SEQ ID NO: 200181 - protein, 9 aa, Homo Sapiens
KVVLEKNAV

SEQ ID NO: 200182 - protein, 9 aa, Homo Sapiens
HPLLHLQYY

SEQ ID NO: 200183 - protein, 9 aa, Homo Sapiens
VGASKEGGA

SEQ ID NO: 200184 - protein, 9 aa, Homo Sapiens
SLFSLLREQ

SEQ ID NO: 200185 - protein, 9 aa, Homo Sapiens
VTIFPWCVQ

SEQ ID NO: 200186 - protein, 9 aa, Homo Sapiens
LKKELLPRE

SEQ ID NO: 200187 - protein, 9 aa, Homo Sapiens
TFAKSSWAQ

SEQ ID NO: 200188 - protein, 9 aa, Homo Sapiens
ESPHPTRHR

SEQ ID NO: 200189 - protein, 9 aa, Homo Sapiens
RGHTLNLKA

SEQ ID NO: 200190 - protein, 9 aa, Homo Sapiens
YSSPWCDYT

SEQ ID NO: 200191 - protein, 9 aa, Homo Sapiens
AWESHACLA

SEQ ID NO: 200192 - protein, 9 aa, Homo Sapiens
VGSIGWARA

SEQ ID NO: 200193 - protein, 9 aa, Homo Sapiens
EICASHISR

SEQ ID NO: 200194 - protein, 9 aa, Homo Sapiens
ALSLFKTLK

SEQ ID NO: 200195 - protein, 9 aa, Homo Sapiens
IEILMHYGQ

SEQ ID NO: 200196 - protein, 9 aa, Homo Sapiens
ALKHNQVGE

SEQ ID NO: 200197 - protein, 9 aa, Homo Sapiens
SAAQRPSAW

SEQ ID NO: 200198 - protein, 9 aa, Homo Sapiens
SLASKSGWE

SEQ ID NO: 200199 - protein, 9 aa, Homo Sapiens
LKKKTYCYH

SEQ ID NO: 200200 - protein, 9 aa, Homo Sapiens
CVLLKGHQE

SEQ ID NO: 200201 - protein, 9 aa, Homo Sapiens
VEPYNAMLS

SEQ ID NO: 200202 - protein, 9 aa, Homo Sapiens
NKEFMKCLD

SEQ ID NO: 200203 - protein, 9 aa, Homo Sapiens
MHLCATSLD

SEQ ID NO: 200204 - protein, 9 aa, Homo Sapiens
GFKSPQLFK

SEQ ID NO: 200205 - protein, 9 aa, Homo Sapiens
LRIQLWRTH

SEQ ID NO: 200206 - protein, 9 aa, Homo Sapiens
AMALGSFPA

SEQ ID NO: 200207 - protein, 9 aa, Homo Sapiens
SPLLSECSL

SEQ ID NO: 200208 - protein, 9 aa, Homo Sapiens
SYLTKHKQI

SEQ ID NO: 200209 - protein, 9 aa, Homo Sapiens
DLLDVLKSN

SEQ ID NO: 200210 - protein, 9 aa, Homo Sapiens
TANLRCLFT

SEQ ID NO: 200211 - protein, 9 aa, Homo Sapiens
KEVAELKDP

SEQ ID NO: 200212 - protein, 9 aa, Homo Sapiens
ENVHVCSEC

SEQ ID NO: 200213 - protein, 9 aa, Homo Sapiens
EALDQASAG

SEQ ID NO: 200214 - protein, 9 aa, Homo Sapiens
HSQALLDQV

SEQ ID NO: 200215 - protein, 9 aa, Homo Sapiens
PARGITIVS

SEQ ID NO: 200216 - protein, 9 aa, Homo Sapiens
YQGLCFSGV

SEQ ID NO: 200217 - protein, 9 aa, Homo Sapiens
DPAALKDRH

SEQ ID NO: 200218 - protein, 9 aa, Homo Sapiens
WHLPQHQPL

SEQ ID NO: 200219 - protein, 9 aa, Homo Sapiens
TDYMGIQNE

SEQ ID NO: 200220 - protein, 9 aa, Homo Sapiens
HLVFFLQSN

SEQ ID NO: 200221 - protein, 9 aa, Homo Sapiens
GSSYSMHTL

SEQ ID NO: 200222 - protein, 9 aa, Homo Sapiens
LVKVAQTAG

SEQ ID NO: 200223 - protein, 9 aa, Homo Sapiens
PVSDTEIEY

SEQ ID NO: 200224 - protein, 9 aa, Homo Sapiens
VHCANGPYG

SEQ ID NO: 200225 - protein, 9 aa, Homo Sapiens
PKISLSGIH

SEQ ID NO: 200226 - protein, 9 aa, Homo Sapiens
ILGHFVAEH

SEQ ID NO: 200227 - protein, 9 aa, Homo Sapiens
RSPLLSECS

SEQ ID NO: 200228 - protein, 9 aa, Homo Sapiens
HWYFDVERN

SEQ ID NO: 200229 - protein, 9 aa, Homo Sapiens
VYWNIIHQE

SEQ ID NO: 200230 - protein, 9 aa, Homo Sapiens
PVPLLSVFT

SEQ ID NO: 200231 - protein, 9 aa, Homo Sapiens
YVTPAPPRA

SEQ ID NO: 200232 - protein, 9 aa, Homo Sapiens
CEPGYKGPH

SEQ ID NO: 200233 - protein, 9 aa, Homo Sapiens
RDGLGNMPL

SEQ ID NO: 200234 - protein, 9 aa, Homo Sapiens
STDSLSHLR

SEQ ID NO: 200235 - protein, 9 aa, Homo Sapiens
TLMDILLMD

SEQ ID NO: 200236 - protein, 9 aa, Homo Sapiens
QDRDITLLD

SEQ ID NO: 200237 - protein, 9 aa, Homo Sapiens
HDLHFHFTV

SEQ ID NO: 200238 - protein, 9 aa, Homo Sapiens
YERPLTQEE

SEQ ID NO: 200239 - protein, 9 aa, Homo Sapiens
AVPGPGAPG

SEQ ID NO: 200240 - protein, 9 aa, Homo Sapiens
GLTPTPPPV

SEQ ID NO: 200241 - protein, 9 aa, Homo Sapiens
PVFLAFQIM

SEQ ID NO: 200242 - protein, 9 aa, Homo Sapiens
YQSLTSGME

SEQ ID NO: 200243 - protein, 9 aa, Homo Sapiens
HLFTIGRHT

SEQ ID NO: 200244 - protein, 9 aa, Homo Sapiens
EGKDKITLE

SEQ ID NO: 200245 - protein, 9 aa, Homo Sapiens
ISEDCVFSV

SEQ ID NO: 200246 - protein, 9 aa, Homo Sapiens
GELRQRLGL

SEQ ID NO: 200247 - protein, 9 aa, Homo Sapiens
HPLVLQNWM

SEQ ID NO: 200248 - protein, 9 aa, Homo Sapiens
YECIKCVKA

SEQ ID NO: 200249 - protein, 9 aa, Homo Sapiens
SHCCPPCRD

SEQ ID NO: 200250 - protein, 9 aa, Homo Sapiens
KLHNTAPTR

SEQ ID NO: 200251 - protein, 9 aa, Homo Sapiens
PVLKLRSWP

SEQ ID NO: 200252 - protein, 9 aa, Homo Sapiens
HMSEPQHMA

SEQ ID NO: 200253 - protein, 9 aa, Homo Sapiens
SHHTVISVR

SEQ ID NO: 200254 - protein, 9 aa, Homo Sapiens
LEVALLRLG

SEQ ID NO: 200255 - protein, 9 aa, Homo Sapiens
TPRGCCKSV

SEQ ID NO: 200256 - protein, 9 aa, Homo Sapiens
QKDVGPMYS

SEQ ID NO: 200257 - protein, 9 aa, Homo Sapiens
MVCALSAQQ

SEQ ID NO: 200258 - protein, 9 aa, Homo Sapiens
HLLAADALY

SEQ ID NO: 200259 - protein, 9 aa, Homo Sapiens
CALSAQQQT

SEQ ID NO: 200260 - protein, 9 aa, Homo Sapiens
GDKWSRHCR

SEQ ID NO: 200261 - protein, 9 aa, Homo Sapiens
SVIMDTKIT

SEQ ID NO: 200262 - protein, 9 aa, Homo Sapiens
PLLSVFTGY

SEQ ID NO: 200263 - protein, 9 aa, Homo Sapiens
CICHTLAEY

SEQ ID NO: 200264 - protein, 9 aa, Homo Sapiens
QKLVDLQEL

SEQ ID NO: 200265 - protein, 9 aa, Homo Sapiens
HREVAAYLH

SEQ ID NO: 200266 - protein, 9 aa, Homo Sapiens
VTPHGLENV

SEQ ID NO: 200267 - protein, 9 aa, Homo Sapiens
SALRLEKDH

SEQ ID NO: 200268 - protein, 9 aa, Homo Sapiens
KLEEEREWQ

SEQ ID NO: 200269 - protein, 9 aa, Homo Sapiens
TYIENRPKY

SEQ ID NO: 200270 - protein, 9 aa, Homo Sapiens
PIGQRTQLS

SEQ ID NO: 200271 - protein, 9 aa, Homo Sapiens
IHIEDDGSY

SEQ ID NO: 200272 - protein, 9 aa, Homo Sapiens
GIFLKKPDS

SEQ ID NO: 200273 - protein, 9 aa, Homo Sapiens
ATHQRIHIG

SEQ ID NO: 200274 - protein, 9 aa, Homo Sapiens
RDSIFRWLW

SEQ ID NO: 200275 - protein, 9 aa, Homo Sapiens
LQPFVGRLH

SEQ ID NO: 200276 - protein, 9 aa, Homo Sapiens
YVFACEQMK

SEQ ID NO: 200277 - protein, 9 aa, Homo Sapiens
EDMVASMED

SEQ ID NO: 200278 - protein, 9 aa, Homo Sapiens
LKYEWAVRE

SEQ ID NO: 200279 - protein, 9 aa, Homo Sapiens
RAAAGAAGR

SEQ ID NO: 200280 - protein, 9 aa, Homo Sapiens
HVFVDSVSE

SEQ ID NO: 200281 - protein, 9 aa, Homo Sapiens
NVQVEVIII

SEQ ID NO: 200282 - protein, 9 aa, Homo Sapiens
HKDSSTWTV

SEQ ID NO: 200283 - protein, 9 aa, Homo Sapiens
ATERQEWIC

SEQ ID NO: 200284 - protein, 9 aa, Homo Sapiens
RKSIFFVGQ

SEQ ID NO: 200285 - protein, 9 aa, Homo Sapiens
WICHIEECV

SEQ ID NO: 200286 - protein, 9 aa, Homo Sapiens
GSLPELLPT

SEQ ID NO: 200287 - protein, 9 aa, Homo Sapiens
EDSPPHVPL

SEQ ID NO: 200288 - protein, 9 aa, Homo Sapiens
PVTTSVQLQ

SEQ ID NO: 200289 - protein, 9 aa, Homo Sapiens
EKTVGHLFT

SEQ ID NO: 200290 - protein, 9 aa, Homo Sapiens
PDTPTAPET

SEQ ID NO: 200291 - protein, 9 aa, Homo Sapiens
RTHNIENVH

SEQ ID NO: 200292 - protein, 9 aa, Homo Sapiens
EQRFIEKGP

SEQ ID NO: 200293 - protein, 9 aa, Homo Sapiens
NITTARGVG

SEQ ID NO: 200294 - protein, 9 aa, Homo Sapiens
ERQCLVTIV

SEQ ID NO: 200295 - protein, 9 aa, Homo Sapiens
TVRTYIENR

SEQ ID NO: 200296 - protein, 9 aa, Homo Sapiens
NTFCQCCIP

SEQ ID NO: 200297 - protein, 9 aa, Homo Sapiens
QPYLLPCLL

SEQ ID NO: 200298 - protein, 9 aa, Homo Sapiens
GAILNSSPE

SEQ ID NO: 200299 - protein, 9 aa, Homo Sapiens
SLLELLRNS

SEQ ID NO: 200300 - protein, 9 aa, Homo Sapiens
ASWLTSCYF

SEQ ID NO: 200301 - protein, 9 aa, Homo Sapiens
LIQDCKDAL

SEQ ID NO: 200302 - protein, 9 aa, Homo Sapiens
GDIGMKGDR

SEQ ID NO: 200303 - protein, 9 aa, Homo Sapiens
NGNHMTDIP

SEQ ID NO: 200304 - protein, 9 aa, Homo Sapiens
LRSSSPTQL

SEQ ID NO: 200305 - protein, 9 aa, Homo Sapiens
KWQPVDLAQ

SEQ ID NO: 200306 - protein, 9 aa, Homo Sapiens
FQIMPGAGK

SEQ ID NO: 200307 - protein, 9 aa, Homo Sapiens
TSESTSTLK

SEQ ID NO: 200308 - protein, 9 aa, Homo Sapiens
SELHYKRRR

SEQ ID NO: 200309 - protein, 9 aa, Homo Sapiens
SPLTSIISV

SEQ ID NO: 200310 - protein, 9 aa, Homo Sapiens
EIEILMHYG

SEQ ID NO: 200311 - protein, 9 aa, Homo Sapiens
CSESFGTEV

SEQ ID NO: 200312 - protein, 9 aa, Homo Sapiens
GDFACCLVR

SEQ ID NO: 200313 - protein, 9 aa, Homo Sapiens
YPHSWMKID

SEQ ID NO: 200314 - protein, 9 aa, Homo Sapiens
GTKYTYGLG

SEQ ID NO: 200315 - protein, 9 aa, Homo Sapiens
KVVGKKMVK

SEQ ID NO: 200316 - protein, 9 aa, Homo Sapiens
MLKAHSFER

SEQ ID NO: 200317 - protein, 9 aa, Homo Sapiens
RGRLALHRA

SEQ ID NO: 200318 - protein, 9 aa, Homo Sapiens
LHGSSYSMH

SEQ ID NO: 200319 - protein, 9 aa, Homo Sapiens
CAMNNKNAR

SEQ ID NO: 200320 - protein, 9 aa, Homo Sapiens
NNSYQMTRE

SEQ ID NO: 200321 - protein, 9 aa, Homo Sapiens
LPLHPLLAS

SEQ ID NO: 200322 - protein, 9 aa, Homo Sapiens
RQCGLSFGN

SEQ ID NO: 200323 - protein, 9 aa, Homo Sapiens
PLRKTITKN

SEQ ID NO: 200324 - protein, 9 aa, Homo Sapiens
TAFRQYHMN

SEQ ID NO: 200325 - protein, 9 aa, Homo Sapiens
TFRTTTFST

SEQ ID NO: 200326 - protein, 9 aa, Homo Sapiens
DTVFNTMWT

SEQ ID NO: 200327 - protein, 9 aa, Homo Sapiens
ADSMCKASN

SEQ ID NO: 200328 - protein, 9 aa, Homo Sapiens
DLCTVPKVE

SEQ ID NO: 200329 - protein, 9 aa, Homo Sapiens
LEEEVITYT

SEQ ID NO: 200330 - protein, 9 aa, Homo Sapiens
SVSDADCDW

SEQ ID NO: 200331 - protein, 9 aa, Homo Sapiens
VEVRGNWQC

SEQ ID NO: 200332 - protein, 9 aa, Homo Sapiens
QKTKGAYPN

SEQ ID NO: 200333 - protein, 9 aa, Homo Sapiens
SGWEDCKRS

SEQ ID NO: 200334 - protein, 9 aa, Homo Sapiens
AEENVDFCI

SEQ ID NO: 200335 - protein, 9 aa, Homo Sapiens
TLHAKGDSC

SEQ ID NO: 200336 - protein, 9 aa, Homo Sapiens
FSLGMPLKL

SEQ ID NO: 200337 - protein, 9 aa, Homo Sapiens
EILHYVYEC

SEQ ID NO: 200338 - protein, 9 aa, Homo Sapiens
VHMSEPQHM

SEQ ID NO: 200339 - protein, 9 aa, Homo Sapiens
PGASPHHCR

SEQ ID NO: 200340 - protein, 9 aa, Homo Sapiens
NMPSLHSRH

SEQ ID NO: 200341 - protein, 9 aa, Homo Sapiens
FPAHREVMF

SEQ ID NO: 200342 - protein, 9 aa, Homo Sapiens
LNDKHITTL

SEQ ID NO: 200343 - protein, 9 aa, Homo Sapiens
TFDGLLFDF

SEQ ID NO: 200344 - protein, 9 aa, Homo Sapiens
IAGSGNWAY

SEQ ID NO: 200345 - protein, 9 aa, Homo Sapiens
TGMMHCSQL

SEQ ID NO: 200346 - protein, 9 aa, Homo Sapiens
VSFYEDGGD

SEQ ID NO: 200347 - protein, 9 aa, Homo Sapiens
QAWGSLEEQ

SEQ ID NO: 200348 - protein, 9 aa, Homo Sapiens
IMHLCATSL

SEQ ID NO: 200349 - protein, 9 aa, Homo Sapiens
IQNMPNVCD

SEQ ID NO: 200350 - protein, 9 aa, Homo Sapiens
GIGGVPERQ

SEQ ID NO: 200351 - protein, 9 aa, Homo Sapiens
AASEAKSPG

SEQ ID NO: 200352 - protein, 9 aa, Homo Sapiens
SCHITDLYK

SEQ ID NO: 200353 - protein, 9 aa, Homo Sapiens
SLGWTDFLM

SEQ ID NO: 200354 - protein, 9 aa, Homo Sapiens
TVVTSSGDS

SEQ ID NO: 200355 - protein, 9 aa, Homo Sapiens
EEFINFVFH

SEQ ID NO: 200356 - protein, 9 aa, Homo Sapiens
EDEAGSAMS

SEQ ID NO: 200357 - protein, 9 aa, Homo Sapiens
MEQLGSIYN

SEQ ID NO: 200358 - protein, 9 aa, Homo Sapiens
TMWTLGCRP

SEQ ID NO: 200359 - protein, 9 aa, Homo Sapiens
GGLIKNIKR

SEQ ID NO: 200360 - protein, 9 aa, Homo Sapiens
ISVVVGILL

SEQ ID NO: 200361 - protein, 9 aa, Homo Sapiens
TSEERQCLV

SEQ ID NO: 200362 - protein, 9 aa, Homo Sapiens
GSHYVDEAG

SEQ ID NO: 200363 - protein, 9 aa, Homo Sapiens
PSGLADEID

SEQ ID NO: 200364 - protein, 9 aa, Homo Sapiens
DSSSCRPGM

SEQ ID NO: 200365 - protein, 9 aa, Homo Sapiens
GVYAKAVLW

SEQ ID NO: 200366 - protein, 9 aa, Homo Sapiens
EDNISSGCS

SEQ ID NO: 200367 - protein, 9 aa, Homo Sapiens
HDSLKKNAF

SEQ ID NO: 200368 - protein, 9 aa, Homo Sapiens
VGLAACLCP

SEQ ID NO: 200369 - protein, 9 aa, Homo Sapiens
LYIRHLPLF

SEQ ID NO: 200370 - protein, 9 aa, Homo Sapiens
KVCSNTCCS

SEQ ID NO: 200371 - protein, 9 aa, Homo Sapiens
DPTVIGDRG

SEQ ID NO: 200372 - protein, 9 aa, Homo Sapiens
NSSFCMCKN

SEQ ID NO: 200373 - protein, 9 aa, Homo Sapiens
AFVESHYSK

SEQ ID NO: 200374 - protein, 9 aa, Homo Sapiens
PTAPVLEAG

SEQ ID NO: 200375 - protein, 9 aa, Homo Sapiens
CMCKNGRCI

SEQ ID NO: 200376 - protein, 9 aa, Homo Sapiens
RQQCQAETE

SEQ ID NO: 200377 - protein, 9 aa, Homo Sapiens
YRQQWTYEQ

SEQ ID NO: 200378 - protein, 9 aa, Homo Sapiens
PVSFFHAEG

SEQ ID NO: 200379 - protein, 9 aa, Homo Sapiens
FLENVLAVS

SEQ ID NO: 200380 - protein, 9 aa, Homo Sapiens
RIRAELYGI

SEQ ID NO: 200381 - protein, 9 aa, Homo Sapiens
MEAVRRAFC

SEQ ID NO: 200382 - protein, 9 aa, Homo Sapiens
KEAKAPVAK

SEQ ID NO: 200383 - protein, 9 aa, Homo Sapiens
TRQLLRISC

SEQ ID NO: 200384 - protein, 9 aa, Homo Sapiens
IVASNLMTG

SEQ ID NO: 200385 - protein, 9 aa, Homo Sapiens
KSKDPRHRA

SEQ ID NO: 200386 - protein, 9 aa, Homo Sapiens
KKNQCISLL

SEQ ID NO: 200387 - protein, 9 aa, Homo Sapiens
ITQNAQHAL

SEQ ID NO: 200388 - protein, 9 aa, Homo Sapiens
ASANIFQDT

SEQ ID NO: 200389 - protein, 9 aa, Homo Sapiens
VCVNRRRFL

SEQ ID NO: 200390 - protein, 9 aa, Homo Sapiens
RPQSPAEEE

SEQ ID NO: 200391 - protein, 9 aa, Homo Sapiens
SSDLVVPDL

SEQ ID NO: 200392 - protein, 9 aa, Homo Sapiens
WALQLTKFC

SEQ ID NO: 200393 - protein, 9 aa, Homo Sapiens
QAAHHAEQT

SEQ ID NO: 200394 - protein, 9 aa, Homo Sapiens
PPKKMHKSV

SEQ ID NO: 200395 - protein, 9 aa, Homo Sapiens
ARVSCHITD

SEQ ID NO: 200396 - protein, 9 aa, Homo Sapiens
KACSTGRME

SEQ ID NO: 200397 - protein, 9 aa, Homo Sapiens
PPPPPGWLP

SEQ ID NO: 200398 - protein, 9 aa, Homo Sapiens
SQDLHLPLA

SEQ ID NO: 200399 - protein, 9 aa, Homo Sapiens
RERRDRRPG

SEQ ID NO: 200400 - protein, 9 aa, Homo Sapiens
ISRSGEPVR

SEQ ID NO: 200401 - protein, 9 aa, Homo Sapiens
VGRRLLAFV

SEQ ID NO: 200402 - protein, 9 aa, Homo Sapiens
TFVSGHQYQ

SEQ ID NO: 200403 - protein, 9 aa, Homo Sapiens
EALSLFKTL

SEQ ID NO: 200404 - protein, 9 aa, Homo Sapiens
QQTFVVPRP

SEQ ID NO: 200405 - protein, 9 aa, Homo Sapiens
IFQDTELLQ

SEQ ID NO: 200406 - protein, 9 aa, Homo Sapiens
HCINIDECS

SEQ ID NO: 200407 - protein, 9 aa, Homo Sapiens
TTPAMPDNA

SEQ ID NO: 200408 - protein, 9 aa, Homo Sapiens
YSNSSMNPI

SEQ ID NO: 200409 - protein, 9 aa, Homo Sapiens
ADSNPPAAA

SEQ ID NO: 200410 - protein, 9 aa, Homo Sapiens
CSCLLLGGE

SEQ ID NO: 200411 - protein, 9 aa, Homo Sapiens
MGMHHRDRP

SEQ ID NO: 200412 - protein, 9 aa, Homo Sapiens
FAQVVIEVN

SEQ ID NO: 200413 - protein, 9 aa, Homo Sapiens
RKLLRRPND

SEQ ID NO: 200414 - protein, 9 aa, Homo Sapiens
WLSAQVPEP

SEQ ID NO: 200415 - protein, 9 aa, Homo Sapiens
CMDLLTQRG

SEQ ID NO: 200416 - protein, 9 aa, Homo Sapiens
HIAQKIKRF

SEQ ID NO: 200417 - protein, 9 aa, Homo Sapiens
VAECVIYYY

SEQ ID NO: 200418 - protein, 9 aa, Homo Sapiens
RLWGPTEMF

SEQ ID NO: 200419 - protein, 9 aa, Homo Sapiens
VFACEQMKS

SEQ ID NO: 200420 - protein, 9 aa, Homo Sapiens
TEEACRTWS

SEQ ID NO: 200421 - protein, 9 aa, Homo Sapiens
GSVTLGRDR

SEQ ID NO: 200422 - protein, 9 aa, Homo Sapiens
RHTGEMSYK

SEQ ID NO: 200423 - protein, 9 aa, Homo Sapiens
SRALYYKSA

SEQ ID NO: 200424 - protein, 9 aa, Homo Sapiens
IDSVTSSDT

SEQ ID NO: 200425 - protein, 9 aa, Homo Sapiens
EGDVFRGIQ

SEQ ID NO: 200426 - protein, 9 aa, Homo Sapiens
CTMCSLANI

SEQ ID NO: 200427 - protein, 9 aa, Homo Sapiens
LKACMTSFH

SEQ ID NO: 200428 - protein, 9 aa, Homo Sapiens
TAATGSMAT

SEQ ID NO: 200429 - protein, 9 aa, Homo Sapiens
KLSVPVMCK

SEQ ID NO: 200430 - protein, 9 aa, Homo Sapiens
QPLSSSAGH

SEQ ID NO: 200431 - protein, 9 aa, Homo Sapiens
EKCCQTNAQ

SEQ ID NO: 200432 - protein, 9 aa, Homo Sapiens
EGPHQEYSE

SEQ ID NO: 200433 - protein, 9 aa, Homo Sapiens
HHMGSEQLP

SEQ ID NO: 200434 - protein, 9 aa, Homo Sapiens
DHREASSCA

SEQ ID NO: 200435 - protein, 9 aa, Homo Sapiens
LLRPGDLVF

SEQ ID NO: 200436 - protein, 9 aa, Homo Sapiens
VCTLEANSE

SEQ ID NO: 200437 - protein, 9 aa, Homo Sapiens
GNPRGNTEG

SEQ ID NO: 200438 - protein, 9 aa, Homo Sapiens
RAHSPDPHI

SEQ ID NO: 200439 - protein, 9 aa, Homo Sapiens
IVAMLMKNT

SEQ ID NO: 200440 - protein, 9 aa, Homo Sapiens
QHYDLESVP

SEQ ID NO: 200441 - protein, 9 aa, Homo Sapiens
QGHFQAQLL

SEQ ID NO: 200442 - protein, 9 aa, Homo Sapiens
GPGRETKRA

SEQ ID NO: 200443 - protein, 9 aa, Homo Sapiens
WQGDRSSQS

SEQ ID NO: 200444 - protein, 9 aa, Homo Sapiens
YKMDEVQNH

SEQ ID NO: 200445 - protein, 9 aa, Homo Sapiens
VDDFLANGA

SEQ ID NO: 200446 - protein, 9 aa, Homo Sapiens
HVLPPTITD

SEQ ID NO: 200447 - protein, 9 aa, Homo Sapiens
AALWGRTWR

SEQ ID NO: 200448 - protein, 9 aa, Homo Sapiens
NHALAEMSK

SEQ ID NO: 200449 - protein, 9 aa, Homo Sapiens
IGAGHISEF

SEQ ID NO: 200450 - protein, 9 aa, Homo Sapiens
RCLTQSWPG

SEQ ID NO: 200451 - protein, 9 aa, Homo Sapiens
SFPGCFTQY

SEQ ID NO: 200452 - protein, 9 aa, Homo Sapiens
PPPDSQEML

SEQ ID NO: 200453 - protein, 9 aa, Homo Sapiens
LDTVCSNQM

SEQ ID NO: 200454 - protein, 9 aa, Homo Sapiens
PVMGLTKSG

SEQ ID NO: 200455 - protein, 9 aa, Homo Sapiens
HMKPNTLVL

SEQ ID NO: 200456 - protein, 9 aa, Homo Sapiens
RDKWSRLIE

SEQ ID NO: 200457 - protein, 9 aa, Homo Sapiens
NRKEEKPAE

SEQ ID NO: 200458 - protein, 9 aa, Homo Sapiens
QKMISETCS

SEQ ID NO: 200459 - protein, 9 aa, Homo Sapiens
RNSDEKVLP

SEQ ID NO: 200460 - protein, 9 aa, Homo Sapiens
EALNDNQEF

SEQ ID NO: 200461 - protein, 9 aa, Homo Sapiens
EQLLLDTST

SEQ ID NO: 200462 - protein, 9 aa, Homo Sapiens
MVVLGAKTG

SEQ ID NO: 200463 - protein, 9 aa, Homo Sapiens
ECSGCGKSF

SEQ ID NO: 200464 - protein, 9 aa, Homo Sapiens
QHREVAAYL

SEQ ID NO: 200465 - protein, 9 aa, Homo Sapiens
GHHHLLPGI

SEQ ID NO: 200466 - protein, 9 aa, Homo Sapiens
LHPGLKYDF

SEQ ID NO: 200467 - protein, 9 aa, Homo Sapiens
QEPLATVRD

SEQ ID NO: 200468 - protein, 9 aa, Homo Sapiens
TFFSETRAG

SEQ ID NO: 200469 - protein, 9 aa, Homo Sapiens
GHRGHGGFN

SEQ ID NO: 200470 - protein, 9 aa, Homo Sapiens
NQGYTHFCQ

SEQ ID NO: 200471 - protein, 9 aa, Homo Sapiens
LGLGTCRGM

SEQ ID NO: 200472 - protein, 9 aa, Homo Sapiens
VDWDACPLP

SEQ ID NO: 200473 - protein, 9 aa, Homo Sapiens
ACRVLVHCP

SEQ ID NO: 200474 - protein, 9 aa, Homo Sapiens
SNCSEDSCM

SEQ ID NO: 200475 - protein, 9 aa, Homo Sapiens
AVCLQLRCP

SEQ ID NO: 200476 - protein, 9 aa, Homo Sapiens
SSRPSGHRL

SEQ ID NO: 200477 - protein, 9 aa, Homo Sapiens
AGNLWEKLC

SEQ ID NO: 200478 - protein, 9 aa, Homo Sapiens
AHAVGKIPL

SEQ ID NO: 200479 - protein, 9 aa, Homo Sapiens
LMAVALALP

SEQ ID NO: 200480 - protein, 9 aa, Homo Sapiens
IGDSCEKYV

SEQ ID NO: 200481 - protein, 9 aa, Homo Sapiens
ITQDFEEMK

SEQ ID NO: 200482 - protein, 9 aa, Homo Sapiens
PVPLAQGEP

SEQ ID NO: 200483 - protein, 9 aa, Homo Sapiens
VLSTRGEPT

SEQ ID NO: 200484 - protein, 9 aa, Homo Sapiens
MPSQGPAGL

SEQ ID NO: 200485 - protein, 9 aa, Homo Sapiens
LAKGKKPRQ

SEQ ID NO: 200486 - protein, 9 aa, Homo Sapiens
TSKETHFLS

SEQ ID NO: 200487 - protein, 9 aa, Homo Sapiens
EGTCSDLHD

SEQ ID NO: 200488 - protein, 9 aa, Homo Sapiens
TAALSNYEQ

SEQ ID NO: 200489 - protein, 9 aa, Homo Sapiens
WLVYFPPFR

SEQ ID NO: 200490 - protein, 9 aa, Homo Sapiens
SEERQCLVT

SEQ ID NO: 200491 - protein, 9 aa, Homo Sapiens
SFTFYIWDG

SEQ ID NO: 200492 - protein, 9 aa, Homo Sapiens
MQVLPQCEC

SEQ ID NO: 200493 - protein, 9 aa, Homo Sapiens
TLGQSQMAA

SEQ ID NO: 200494 - protein, 9 aa, Homo Sapiens
HGHLRERAA

SEQ ID NO: 200495 - protein, 9 aa, Homo Sapiens
LISLFDDED

SEQ ID NO: 200496 - protein, 9 aa, Homo Sapiens
RLPAAGEVQ

SEQ ID NO: 200497 - protein, 9 aa, Homo Sapiens
LASSPPAEF

SEQ ID NO: 200498 - protein, 9 aa, Homo Sapiens
TCSATHLLR

SEQ ID NO: 200499 - protein, 9 aa, Homo Sapiens
DAGRDGFIN

SEQ ID NO: 200500 - protein, 9 aa, Homo Sapiens
EVHTGICYH

SEQ ID NO: 200501 - protein, 9 aa, Homo Sapiens
VSCVLISFM

SEQ ID NO: 200502 - protein, 9 aa, Homo Sapiens
QALLNIYDC

SEQ ID NO: 200503 - protein, 9 aa, Homo Sapiens
SSQRQTGPS

SEQ ID NO: 200504 - protein, 9 aa, Homo Sapiens
EELHLPAPP

SEQ ID NO: 200505 - protein, 9 aa, Homo Sapiens
MHMPGPTEL

SEQ ID NO: 200506 - protein, 9 aa, Homo Sapiens
KQESIHSKP

SEQ ID NO: 200507 - protein, 9 aa, Homo Sapiens
DLIKTTLQR

SEQ ID NO: 200508 - protein, 9 aa, Homo Sapiens
SLPVCTMSL

SEQ ID NO: 200509 - protein, 9 aa, Homo Sapiens
RLQERPIKK

SEQ ID NO: 200510 - protein, 9 aa, Homo Sapiens
GISYGQVRD

SEQ ID NO: 200511 - protein, 9 aa, Homo Sapiens
GEFAKEREW

SEQ ID NO: 200512 - protein, 9 aa, Homo Sapiens
HDLHSGNIA

SEQ ID NO: 200513 - protein, 9 aa, Homo Sapiens
QGVSLGHTS

SEQ ID NO: 200514 - protein, 9 aa, Homo Sapiens
ITPGLHPGS

SEQ ID NO: 200515 - protein, 9 aa, Homo Sapiens
VINSSSYWI

SEQ ID NO: 200516 - protein, 9 aa, Homo Sapiens
QRAQDEVLT

SEQ ID NO: 200517 - protein, 9 aa, Homo Sapiens
EIEYTIDVF

SEQ ID NO: 200518 - protein, 9 aa, Homo Sapiens
GAVTGIVTG

SEQ ID NO: 200519 - protein, 9 aa, Homo Sapiens
YPVQISSCM

SEQ ID NO: 200520 - protein, 9 aa, Homo Sapiens
SLEHHVCLG

SEQ ID NO: 200521 - protein, 9 aa, Homo Sapiens
SIPYKEFLG

SEQ ID NO: 200522 - protein, 9 aa, Homo Sapiens
CNQQLDLCK

SEQ ID NO: 200523 - protein, 9 aa, Homo Sapiens
PNLCGVSKP

SEQ ID NO: 200524 - protein, 9 aa, Homo Sapiens
DDVQMGGPG

SEQ ID NO: 200525 - protein, 9 aa, Homo Sapiens
ELSDNRIIT

SEQ ID NO: 200526 - protein, 9 aa, Homo Sapiens
TLVWWEKNE

SEQ ID NO: 200527 - protein, 9 aa, Homo Sapiens
YGDAIREID

SEQ ID NO: 200528 - protein, 9 aa, Homo Sapiens
CSTAIFFYC

SEQ ID NO: 200529 - protein, 9 aa, Homo Sapiens
CYMPYAAFA

SEQ ID NO: 200530 - protein, 9 aa, Homo Sapiens
ITTTTQALA

SEQ ID NO: 200531 - protein, 9 aa, Homo Sapiens
CSLYPPPHP

SEQ ID NO: 200532 - protein, 9 aa, Homo Sapiens
ALRLEKDHV

SEQ ID NO: 200533 - protein, 9 aa, Homo Sapiens
LLVERNIKY

SEQ ID NO: 200534 - protein, 9 aa, Homo Sapiens
DFFWAPNST

SEQ ID NO: 200535 - protein, 9 aa, Homo Sapiens
SLTHLFLVF

SEQ ID NO: 200536 - protein, 9 aa, Homo Sapiens
AILALCRLG

SEQ ID NO: 200537 - protein, 9 aa, Homo Sapiens
TVGQIPHLL

SEQ ID NO: 200538 - protein, 9 aa, Homo Sapiens
AHNMSFWSS

SEQ ID NO: 200539 - protein, 9 aa, Homo Sapiens
GATRPFAHL

SEQ ID NO: 200540 - protein, 9 aa, Homo Sapiens
IGSHRMRVE

SEQ ID NO: 200541 - protein, 9 aa, Homo Sapiens
GGVQEPALA

SEQ ID NO: 200542 - protein, 9 aa, Homo Sapiens
TPYKGPSFG

SEQ ID NO: 200543 - protein, 9 aa, Homo Sapiens
PLRLTLWPP

SEQ ID NO: 200544 - protein, 9 aa, Homo Sapiens
GSPVNTRYL

SEQ ID NO: 200545 - protein, 9 aa, Homo Sapiens
ASLASKSGW

SEQ ID NO: 200546 - protein, 9 aa, Homo Sapiens
QNMPNVCDH

SEQ ID NO: 200547 - protein, 9 aa, Homo Sapiens
ILHYVYECI

SEQ ID NO: 200548 - protein, 9 aa, Homo Sapiens
ALIYQILPH

SEQ ID NO: 200549 - protein, 9 aa, Homo Sapiens
QNVQCKQEQ

SEQ ID NO: 200550 - protein, 9 aa, Homo Sapiens
WASPENLCL

SEQ ID NO: 200551 - protein, 9 aa, Homo Sapiens
LAVKQGRRE

SEQ ID NO: 200552 - protein, 9 aa, Homo Sapiens
LSSMSLRDP

SEQ ID NO: 200553 - protein, 9 aa, Homo Sapiens
SFVLDEPRE

SEQ ID NO: 200554 - protein, 9 aa, Homo Sapiens
PAPAPPAAP

SEQ ID NO: 200555 - protein, 9 aa, Homo Sapiens
SWTFYHHIR

SEQ ID NO: 200556 - protein, 9 aa, Homo Sapiens
KSKIALRND

SEQ ID NO: 200557 - protein, 9 aa, Homo Sapiens
MCLAPSLFH

SEQ ID NO: 200558 - protein, 9 aa, Homo Sapiens
EADPVHGHL

SEQ ID NO: 200559 - protein, 9 aa, Homo Sapiens
MAQYEREQY

SEQ ID NO: 200560 - protein, 9 aa, Homo Sapiens
ASIMHLCAT

SEQ ID NO: 200561 - protein, 9 aa, Homo Sapiens
LWEEHRGSM

SEQ ID NO: 200562 - protein, 9 aa, Homo Sapiens
YVMTGIVPD

SEQ ID NO: 200563 - protein, 9 aa, Homo Sapiens
GVGPGHISE

SEQ ID NO: 200564 - protein, 9 aa, Homo Sapiens
WMVKCVVQN

SEQ ID NO: 200565 - protein, 9 aa, Homo Sapiens
MKSECVGIL

SEQ ID NO: 200566 - protein, 9 aa, Homo Sapiens
RQCLQEWRT

SEQ ID NO: 200567 - protein, 9 aa, Homo Sapiens
PGRPKNATS

SEQ ID NO: 200568 - protein, 9 aa, Homo Sapiens
VGEAIVKQI

SEQ ID NO: 200569 - protein, 9 aa, Homo Sapiens
LNVILVCFE

SEQ ID NO: 200570 - protein, 9 aa, Homo Sapiens
GHNAPASNL

SEQ ID NO: 200571 - protein, 9 aa, Homo Sapiens
LLQNYIQNR

SEQ ID NO: 200572 - protein, 9 aa, Homo Sapiens
HLSMGEEPV

SEQ ID NO: 200573 - protein, 9 aa, Homo Sapiens
TILLSSCVS

SEQ ID NO: 200574 - protein, 9 aa, Homo Sapiens
ASSACVQRD

SEQ ID NO: 200575 - protein, 9 aa, Homo Sapiens
RGSVELYTW

SEQ ID NO: 200576 - protein, 9 aa, Homo Sapiens
LDSPAGPWR

SEQ ID NO: 200577 - protein, 9 aa, Homo Sapiens
CHDHFGLFP

SEQ ID NO: 200578 - protein, 9 aa, Homo Sapiens
IYSVFPQMV

SEQ ID NO: 200579 - protein, 9 aa, Homo Sapiens
QEPASAMAS

SEQ ID NO: 200580 - protein, 9 aa, Homo Sapiens
SVTLGRDRH

SEQ ID NO: 200581 - protein, 9 aa, Homo Sapiens
RIHDLHSGN

SEQ ID NO: 200582 - protein, 9 aa, Homo Sapiens
VHKKPLQGV

SEQ ID NO: 200583 - protein, 9 aa, Homo Sapiens
HFYRCGGPV

SEQ ID NO: 200584 - protein, 9 aa, Homo Sapiens
LPDIIYVLA

SEQ ID NO: 200585 - protein, 9 aa, Homo Sapiens
SINNKLQQL

SEQ ID NO: 200586 - protein, 9 aa, Homo Sapiens
VVVGADGVG

SEQ ID NO: 200587 - protein, 9 aa, Homo Sapiens
QAYTQLVSL

SEQ ID NO: 200588 - protein, 9 aa, Homo Sapiens
RWCLNVLRL

SEQ ID NO: 200589 - protein, 9 aa, Homo Sapiens
MFEHLSAEE

SEQ ID NO: 200590 - protein, 9 aa, Homo Sapiens
QPRPPVQGC

SEQ ID NO: 200591 - protein, 9 aa, Homo Sapiens
AQGTEDTPD

SEQ ID NO: 200592 - protein, 9 aa, Homo Sapiens
LQAATRLQP

SEQ ID NO: 200593 - protein, 9 aa, Homo Sapiens
QQDPDTLVW

SEQ ID NO: 200594 - protein, 9 aa, Homo Sapiens
DCVLSLFYT

SEQ ID NO: 200595 - protein, 9 aa, Homo Sapiens
PRDIGYVKQ

SEQ ID NO: 200596 - protein, 9 aa, Homo Sapiens
ASCNQVPWA

SEQ ID NO: 200597 - protein, 9 aa, Homo Sapiens
VQKIKVASE

SEQ ID NO: 200598 - protein, 9 aa, Homo Sapiens
RPTSPGPSL

SEQ ID NO: 200599 - protein, 9 aa, Homo Sapiens
LYCIKPEAL

SEQ ID NO: 200600 - protein, 9 aa, Homo Sapiens
HFAPLSPGF

SEQ ID NO: 200601 - protein, 9 aa, Homo Sapiens
VMTAAHCMD

SEQ ID NO: 200602 - protein, 9 aa, Homo Sapiens
RMARRLLGV

SEQ ID NO: 200603 - protein, 9 aa, Homo Sapiens
SLTGCQSDI

SEQ ID NO: 200604 - protein, 9 aa, Homo Sapiens
YDSMIQDQA

SEQ ID NO: 200605 - protein, 9 aa, Homo Sapiens
RGQNRSAQI

SEQ ID NO: 200606 - protein, 9 aa, Homo Sapiens
FKCLASSKA

SEQ ID NO: 200607 - protein, 9 aa, Homo Sapiens
SPWMPCTHT

SEQ ID NO: 200608 - protein, 9 aa, Homo Sapiens
RICVGIPPD

SEQ ID NO: 200609 - protein, 9 aa, Homo Sapiens
RAVGTQISI

SEQ ID NO: 200610 - protein, 9 aa, Homo Sapiens
MTANWLSAV

SEQ ID NO: 200611 - protein, 9 aa, Homo Sapiens
LMTGLPKQT

SEQ ID NO: 200612 - protein, 9 aa, Homo Sapiens
TVSFVVIMF

SEQ ID NO: 200613 - protein, 9 aa, Homo Sapiens
SEDVVLQWS

SEQ ID NO: 200614 - protein, 9 aa, Homo Sapiens
LVLLVRGLM

SEQ ID NO: 200615 - protein, 9 aa, Homo Sapiens
NSERDNGGR

SEQ ID NO: 200616 - protein, 9 aa, Homo Sapiens
YQGVYSWPI

SEQ ID NO: 200617 - protein, 9 aa, Homo Sapiens
GNMPLHLAA

SEQ ID NO: 200618 - protein, 9 aa, Homo Sapiens
GSGLGLCGG

SEQ ID NO: 200619 - protein, 9 aa, Homo Sapiens
ALLDRDVLK

SEQ ID NO: 200620 - protein, 9 aa, Homo Sapiens
FRCVEEVYR

SEQ ID NO: 200621 - protein, 9 aa, Homo Sapiens
SLFSCTNIF

SEQ ID NO: 200622 - protein, 9 aa, Homo Sapiens
GICYHICSH

SEQ ID NO: 200623 - protein, 9 aa, Homo Sapiens
TAMTLTPRG

SEQ ID NO: 200624 - protein, 9 aa, Homo Sapiens
QYPCLRKGA

SEQ ID NO: 200625 - protein, 9 aa, Homo Sapiens
SDGDGDKLK

SEQ ID NO: 200626 - protein, 9 aa, Homo Sapiens
EVELKVAPL

SEQ ID NO: 200627 - protein, 9 aa, Homo Sapiens
VSLVLTARR

SEQ ID NO: 200628 - protein, 9 aa, Homo Sapiens
ISCLQGLGE

SEQ ID NO: 200629 - protein, 9 aa, Homo Sapiens
FYTEKDRQF

SEQ ID NO: 200630 - protein, 9 aa, Homo Sapiens
SRKPSKTKT

SEQ ID NO: 200631 - protein, 9 aa, Homo Sapiens
FYPVQISSC

SEQ ID NO: 200632 - protein, 9 aa, Homo Sapiens
YDGEDYTPS

SEQ ID NO: 200633 - protein, 9 aa, Homo Sapiens
WRPPGTNGV

SEQ ID NO: 200634 - protein, 9 aa, Homo Sapiens
KLWPQPLTF

SEQ ID NO: 200635 - protein, 9 aa, Homo Sapiens
AILYLVVAG

SEQ ID NO: 200636 - protein, 9 aa, Homo Sapiens
TVCHRTGMQ

SEQ ID NO: 200637 - protein, 9 aa, Homo Sapiens
IHTSAKPFQ

SEQ ID NO: 200638 - protein, 9 aa, Homo Sapiens
EVLTKRQLL

SEQ ID NO: 200639 - protein, 9 aa, Homo Sapiens
PARVVVVLS

SEQ ID NO: 200640 - protein, 9 aa, Homo Sapiens
SWLPLHPLL

SEQ ID NO: 200641 - protein, 9 aa, Homo Sapiens
IVHMEGKSY

SEQ ID NO: 200642 - protein, 9 aa, Homo Sapiens
NAPASNLTS

SEQ ID NO: 200643 - protein, 9 aa, Homo Sapiens
NKRSCLVDS

SEQ ID NO: 200644 - protein, 9 aa, Homo Sapiens
PLDPKRPPP

SEQ ID NO: 200645 - protein, 9 aa, Homo Sapiens
LKAVFAATP

SEQ ID NO: 200646 - protein, 9 aa, Homo Sapiens
QALTEFFRT

SEQ ID NO: 200647 - protein, 9 aa, Homo Sapiens
RQSFLVGNQ

SEQ ID NO: 200648 - protein, 9 aa, Homo Sapiens
QVVRRVINS

SEQ ID NO: 200649 - protein, 9 aa, Homo Sapiens
WEGTLNGWT

SEQ ID NO: 200650 - protein, 9 aa, Homo Sapiens
GLGHMKPNT

SEQ ID NO: 200651 - protein, 9 aa, Homo Sapiens
RSGMHTVAM

SEQ ID NO: 200652 - protein, 9 aa, Homo Sapiens
PQHQPLGPR

SEQ ID NO: 200653 - protein, 9 aa, Homo Sapiens
VAFVSGPGA

SEQ ID NO: 200654 - protein, 9 aa, Homo Sapiens
PPPASVSPS

SEQ ID NO: 200655 - protein, 9 aa, Homo Sapiens
DAAEPGEHP

SEQ ID NO: 200656 - protein, 9 aa, Homo Sapiens
GSSALKHNQ

SEQ ID NO: 200657 - protein, 9 aa, Homo Sapiens
PDERRKLIV

SEQ ID NO: 200658 - protein, 9 aa, Homo Sapiens
EQHLHLEPS

SEQ ID NO: 200659 - protein, 9 aa, Homo Sapiens
SNPSHCIQC

SEQ ID NO: 200660 - protein, 9 aa, Homo Sapiens
AAVLNTVWD

SEQ ID NO: 200661 - protein, 9 aa, Homo Sapiens
VHCPHGPEL

SEQ ID NO: 200662 - protein, 9 aa, Homo Sapiens
LKPIADWAQ

SEQ ID NO: 200663 - protein, 9 aa, Homo Sapiens
MLSLTHLFL

SEQ ID NO: 200664 - protein, 9 aa, Homo Sapiens
AHSFERGVY

SEQ ID NO: 200665 - protein, 9 aa, Homo Sapiens
MGQGGPRFE

SEQ ID NO: 200666 - protein, 9 aa, Homo Sapiens
QHSGPRCLC

SEQ ID NO: 200667 - protein, 9 aa, Homo Sapiens
HLPQHQPLG

SEQ ID NO: 200668 - protein, 9 aa, Homo Sapiens
TQLSKGDIA

SEQ ID NO: 200669 - protein, 9 aa, Homo Sapiens
RRRRQQCQA

SEQ ID NO: 200670 - protein, 9 aa, Homo Sapiens
KARKYPHSW

SEQ ID NO: 200671 - protein, 9 aa, Homo Sapiens
EEDFQDGLK

SEQ ID NO: 200672 - protein, 9 aa, Homo Sapiens
RRRPQSCSQ

SEQ ID NO: 200673 - protein, 9 aa, Homo Sapiens
PDFFWAPNS

SEQ ID NO: 200674 - protein, 9 aa, Homo Sapiens
HIPLVRKRQ

SEQ ID NO: 200675 - protein, 9 aa, Homo Sapiens
RLEEVSFPQ

SEQ ID NO: 200676 - protein, 9 aa, Homo Sapiens
LPTRRGLAR

SEQ ID NO: 200677 - protein, 9 aa, Homo Sapiens
RPYECSGCG

SEQ ID NO: 200678 - protein, 9 aa, Homo Sapiens
STVSSLQAK

SEQ ID NO: 200679 - protein, 9 aa, Homo Sapiens
VCEIAEDIV

SEQ ID NO: 200680 - protein, 9 aa, Homo Sapiens
CVEEVYRTA

SEQ ID NO: 200681 - protein, 9 aa, Homo Sapiens
EACYNCGRD

SEQ ID NO: 200682 - protein, 9 aa, Homo Sapiens
GKLPPIPRD

SEQ ID NO: 200683 - protein, 9 aa, Homo Sapiens
NVPGIFISR

SEQ ID NO: 200684 - protein, 9 aa, Homo Sapiens
TTQEIIPHQ

SEQ ID NO: 200685 - protein, 9 aa, Homo Sapiens
DHCINIDEC

SEQ ID NO: 200686 - protein, 9 aa, Homo Sapiens
QSLGCQPSG

SEQ ID NO: 200687 - protein, 9 aa, Homo Sapiens
FEVVEKVYQ

SEQ ID NO: 200688 - protein, 9 aa, Homo Sapiens
GRSRLSLSW

SEQ ID NO: 200689 - protein, 9 aa, Homo Sapiens
VASSACVQR

SEQ ID NO: 200690 - protein, 9 aa, Homo Sapiens
DVFFFTDCL

SEQ ID NO: 200691 - protein, 9 aa, Homo Sapiens
GDQGAPGSP

SEQ ID NO: 200692 - protein, 9 aa, Homo Sapiens
DCIIQDLTE

SEQ ID NO: 200693 - protein, 9 aa, Homo Sapiens
ESPSTLSLS

SEQ ID NO: 200694 - protein, 9 aa, Homo Sapiens
QKWFKQHLA

SEQ ID NO: 200695 - protein, 9 aa, Homo Sapiens
RNDNSDYCD

SEQ ID NO: 200696 - protein, 9 aa, Homo Sapiens
EPLPSSSIS

SEQ ID NO: 200697 - protein, 9 aa, Homo Sapiens
VGPSFVQKE

SEQ ID NO: 200698 - protein, 9 aa, Homo Sapiens
CFLIFKLPC

SEQ ID NO: 200699 - protein, 9 aa, Homo Sapiens
EEGEDDEEE

SEQ ID NO: 200700 - protein, 9 aa, Homo Sapiens
LMEALVGLS

SEQ ID NO: 200701 - protein, 9 aa, Homo Sapiens
TGNKSISFP

SEQ ID NO: 200702 - protein, 9 aa, Homo Sapiens
PAVIPSPSR

SEQ ID NO: 200703 - protein, 9 aa, Homo Sapiens
PPIPVKKPS

SEQ ID NO: 200704 - protein, 9 aa, Homo Sapiens
DQSNMRRMH

SEQ ID NO: 200705 - protein, 9 aa, Homo Sapiens
EERVPGTIW

SEQ ID NO: 200706 - protein, 9 aa, Homo Sapiens
TAMALGSFP

SEQ ID NO: 200707 - protein, 9 aa, Homo Sapiens
TIHLWDTYQ

SEQ ID NO: 200708 - protein, 9 aa, Homo Sapiens
GIPLIPQQA

SEQ ID NO: 200709 - protein, 9 aa, Homo Sapiens
ATSARTAAE

SEQ ID NO: 200710 - protein, 9 aa, Homo Sapiens
RSTKELNIQ

SEQ ID NO: 200711 - protein, 9 aa, Homo Sapiens
HFSCTHLMW

SEQ ID NO: 200712 - protein, 9 aa, Homo Sapiens
DEEGKQLPP

SEQ ID NO: 200713 - protein, 9 aa, Homo Sapiens
SLEDRVKQN

SEQ ID NO: 200714 - protein, 9 aa, Homo Sapiens
IGRLQTHLK

SEQ ID NO: 200715 - protein, 9 aa, Homo Sapiens
LELQGQAGQ

SEQ ID NO: 200716 - protein, 9 aa, Homo Sapiens
LAMQIHFQA

SEQ ID NO: 200717 - protein, 9 aa, Homo Sapiens
VVVHCSTGI

SEQ ID NO: 200718 - protein, 9 aa, Homo Sapiens
SHCRARQDS

SEQ ID NO: 200719 - protein, 9 aa, Homo Sapiens
VAEENVDFC

SEQ ID NO: 200720 - protein, 9 aa, Homo Sapiens
PLTSIISVV

SEQ ID NO: 200721 - protein, 9 aa, Homo Sapiens
SLSKLWPQP

SEQ ID NO: 200722 - protein, 9 aa, Homo Sapiens
HLSGSLHTC

SEQ ID NO: 200723 - protein, 9 aa, Homo Sapiens
VATTTPGPQ

SEQ ID NO: 200724 - protein, 9 aa, Homo Sapiens
RQVLKSKDP

SEQ ID NO: 200725 - protein, 9 aa, Homo Sapiens
AKCHIHQHR

SEQ ID NO: 200726 - protein, 9 aa, Homo Sapiens
TAPVLEAGV

SEQ ID NO: 200727 - protein, 9 aa, Homo Sapiens
WRGWYTYTY

SEQ ID NO: 200728 - protein, 9 aa, Homo Sapiens
LTEVCDVNT

SEQ ID NO: 200729 - protein, 9 aa, Homo Sapiens
TETLEVELK

SEQ ID NO: 200730 - protein, 9 aa, Homo Sapiens
CIWALQLTK

SEQ ID NO: 200731 - protein, 9 aa, Homo Sapiens
TRKLLRRPN

SEQ ID NO: 200732 - protein, 9 aa, Homo Sapiens
LDALLVSKQ

SEQ ID NO: 200733 - protein, 9 aa, Homo Sapiens
RPARSPPPI

SEQ ID NO: 200734 - protein, 9 aa, Homo Sapiens
LTTPPYTEN

SEQ ID NO: 200735 - protein, 9 aa, Homo Sapiens
GPHCLAVLV

SEQ ID NO: 200736 - protein, 9 aa, Homo Sapiens
TESCQVVEL

SEQ ID NO: 200737 - protein, 9 aa, Homo Sapiens
LRCIPCKDS

SEQ ID NO: 200738 - protein, 9 aa, Homo Sapiens
GPQQQTFVV

SEQ ID NO: 200739 - protein, 9 aa, Homo Sapiens
DTMWRIRQL

SEQ ID NO: 200740 - protein, 9 aa, Homo Sapiens
DGDPTVIGD

SEQ ID NO: 200741 - protein, 9 aa, Homo Sapiens
LCRHWYPEE

SEQ ID NO: 200742 - protein, 9 aa, Homo Sapiens
IGYEEIEGS

SEQ ID NO: 200743 - protein, 9 aa, Homo Sapiens
RSHTQMLLH

SEQ ID NO: 200744 - protein, 9 aa, Homo Sapiens
PCRASFPHW

SEQ ID NO: 200745 - protein, 9 aa, Homo Sapiens
DVLQEHFAV

SEQ ID NO: 200746 - protein, 9 aa, Homo Sapiens
SLRFLENVL

SEQ ID NO: 200747 - protein, 9 aa, Homo Sapiens
HSHMQICDQ

SEQ ID NO: 200748 - protein, 9 aa, Homo Sapiens
SLLKDKNFA

SEQ ID NO: 200749 - protein, 9 aa, Homo Sapiens
GRCICSIGY

SEQ ID NO: 200750 - protein, 9 aa, Homo Sapiens
PVRTTPVTS

SEQ ID NO: 200751 - protein, 9 aa, Homo Sapiens
FVSGHQYQH

SEQ ID NO: 200752 - protein, 9 aa, Homo Sapiens
VCYMPYAAF

SEQ ID NO: 200753 - protein, 9 aa, Homo Sapiens
CVLYHENIE

SEQ ID NO: 200754 - protein, 9 aa, Homo Sapiens
FFLGFFHYL

SEQ ID NO: 200755 - protein, 9 aa, Homo Sapiens
LAEVVSYSN

SEQ ID NO: 200756 - protein, 9 aa, Homo Sapiens
FPKKSRTMT

SEQ ID NO: 200757 - protein, 9 aa, Homo Sapiens
CLWPGQPHR

SEQ ID NO: 200758 - protein, 9 aa, Homo Sapiens
LLVYTPELP

SEQ ID NO: 200759 - protein, 9 aa, Homo Sapiens
EDAAEPGEH

SEQ ID NO: 200760 - protein, 9 aa, Homo Sapiens
KNDPTFLGK

SEQ ID NO: 200761 - protein, 9 aa, Homo Sapiens
NSLFWPSSR

SEQ ID NO: 200762 - protein, 9 aa, Homo Sapiens
YHLKSKVHA

SEQ ID NO: 200763 - protein, 9 aa, Homo Sapiens
IENIPKTSQ

SEQ ID NO: 200764 - protein, 9 aa, Homo Sapiens
HGSLDQPVS

SEQ ID NO: 200765 - protein, 9 aa, Homo Sapiens
AMPDYLDDG

SEQ ID NO: 200766 - protein, 9 aa, Homo Sapiens
KTINGHLDS

SEQ ID NO: 200767 - protein, 9 aa, Homo Sapiens
AHVYPICFT

SEQ ID NO: 200768 - protein, 9 aa, Homo Sapiens
ICHPLLYSL

SEQ ID NO: 200769 - protein, 9 aa, Homo Sapiens
VDIEFVKLS

SEQ ID NO: 200770 - protein, 9 aa, Homo Sapiens
SSPEDITQD

SEQ ID NO: 200771 - protein, 9 aa, Homo Sapiens
VMLTGSVMG

SEQ ID NO: 200772 - protein, 9 aa, Homo Sapiens
AIHQVPLIL

SEQ ID NO: 200773 - protein, 9 aa, Homo Sapiens
EPTARISPL

SEQ ID NO: 200774 - protein, 9 aa, Homo Sapiens
STPPHHSSG

SEQ ID NO: 200775 - protein, 9 aa, Homo Sapiens
EAKAPVAKI

SEQ ID NO: 200776 - protein, 9 aa, Homo Sapiens
HNYLGDKWS

SEQ ID NO: 200777 - protein, 9 aa, Homo Sapiens
ALKDRHMEN

SEQ ID NO: 200778 - protein, 9 aa, Homo Sapiens
VDRIIMLFD

SEQ ID NO: 200779 - protein, 9 aa, Homo Sapiens
LANDMDFHS

SEQ ID NO: 200780 - protein, 9 aa, Homo Sapiens
LGGLVNTVL

SEQ ID NO: 200781 - protein, 9 aa, Homo Sapiens
IRSRSSSYR

SEQ ID NO: 200782 - protein, 9 aa, Homo Sapiens
DWDRNLERS

SEQ ID NO: 200783 - protein, 9 aa, Homo Sapiens
RFRSITHAY

SEQ ID NO: 200784 - protein, 9 aa, Homo Sapiens
GPSPILGKD

SEQ ID NO: 200785 - protein, 9 aa, Homo Sapiens
FVGPDGEVI

SEQ ID NO: 200786 - protein, 9 aa, Homo Sapiens
PMQGVSLGH

SEQ ID NO: 200787 - protein, 9 aa, Homo Sapiens
PGQPHRGAQ

SEQ ID NO: 200788 - protein, 9 aa, Homo Sapiens
HPEPLQPHL

SEQ ID NO: 200789 - protein, 9 aa, Homo Sapiens
QTPRGCCKS

SEQ ID NO: 200790 - protein, 9 aa, Homo Sapiens
TASGPHCFC

SEQ ID NO: 200791 - protein, 9 aa, Homo Sapiens
PQENTLWPN

SEQ ID NO: 200792 - protein, 9 aa, Homo Sapiens
RPFCCGQCG

SEQ ID NO: 200793 - protein, 9 aa, Homo Sapiens
GGGDGDILT

SEQ ID NO: 200794 - protein, 9 aa, Homo Sapiens
KELANFNPS

SEQ ID NO: 200795 - protein, 9 aa, Homo Sapiens
LSGWMGMTG

SEQ ID NO: 200796 - protein, 9 aa, Homo Sapiens
PPRTLWSCY

SEQ ID NO: 200797 - protein, 9 aa, Homo Sapiens
KRRMRGLVV

SEQ ID NO: 200798 - protein, 9 aa, Homo Sapiens
GIFGGILVG

SEQ ID NO: 200799 - protein, 9 aa, Homo Sapiens
GCVHSICNE

SEQ ID NO: 200800 - protein, 9 aa, Homo Sapiens
NESVAHSSK

SEQ ID NO: 200801 - protein, 9 aa, Homo Sapiens
CTGRLHMME

SEQ ID NO: 200802 - protein, 9 aa, Homo Sapiens
SLEDAGPLA

SEQ ID NO: 200803 - protein, 9 aa, Homo Sapiens
LFCEFISKT

SEQ ID NO: 200804 - protein, 9 aa, Homo Sapiens
QQSTMPNRH

SEQ ID NO: 200805 - protein, 9 aa, Homo Sapiens
KKKTQIANA

SEQ ID NO: 200806 - protein, 9 aa, Homo Sapiens
RGHHHLLPG

SEQ ID NO: 200807 - protein, 9 aa, Homo Sapiens
ARQDSLKKI

SEQ ID NO: 200808 - protein, 9 aa, Homo Sapiens
IKLFQYPCL

SEQ ID NO: 200809 - protein, 9 aa, Homo Sapiens
TAVASVIYS

SEQ ID NO: 200810 - protein, 9 aa, Homo Sapiens
ESPRYSTSC

SEQ ID NO: 200811 - protein, 9 aa, Homo Sapiens
CTLPKRQFV

SEQ ID NO: 200812 - protein, 9 aa, Homo Sapiens
TVILDADFT

SEQ ID NO: 200813 - protein, 9 aa, Homo Sapiens
NNRNAGQGE

SEQ ID NO: 200814 - protein, 9 aa, Homo Sapiens
VVVVLSFLL

SEQ ID NO: 200815 - protein, 9 aa, Homo Sapiens
EKSEQAVLN

SEQ ID NO: 200816 - protein, 9 aa, Homo Sapiens
MEPYYYKAE

SEQ ID NO: 200817 - protein, 9 aa, Homo Sapiens
WDVVSCFRD

SEQ ID NO: 200818 - protein, 9 aa, Homo Sapiens
PAPPRARED

SEQ ID NO: 200819 - protein, 9 aa, Homo Sapiens
LATHQRIHI

SEQ ID NO: 200820 - protein, 9 aa, Homo Sapiens
LMLPGAGAG

SEQ ID NO: 200821 - protein, 9 aa, Homo Sapiens
GWLFCRVRF

SEQ ID NO: 200822 - protein, 9 aa, Homo Sapiens
SITTTTQAL

SEQ ID NO: 200823 - protein, 9 aa, Homo Sapiens
RKQEQPCSL

SEQ ID NO: 200824 - protein, 9 aa, Homo Sapiens
LMALSLASA

SEQ ID NO: 200825 - protein, 9 aa, Homo Sapiens
KCLTLANAS

SEQ ID NO: 200826 - protein, 9 aa, Homo Sapiens
RIIGHVHLA

SEQ ID NO: 200827 - protein, 9 aa, Homo Sapiens
TIRLYHAHT

SEQ ID NO: 200828 - protein, 9 aa, Homo Sapiens
SLSHLRSPS

SEQ ID NO: 200829 - protein, 9 aa, Homo Sapiens
VLLKGHQEG

SEQ ID NO: 200830 - protein, 9 aa, Homo Sapiens
SSAFLLCHQ

SEQ ID NO: 200831 - protein, 9 aa, Homo Sapiens
LKANMWALE

SEQ ID NO: 200832 - protein, 9 aa, Homo Sapiens
GDHMKVIAG

SEQ ID NO: 200833 - protein, 9 aa, Homo Sapiens
YMEPYYYKA

SEQ ID NO: 200834 - protein, 9 aa, Homo Sapiens
FIEARDLQG

SEQ ID NO: 200835 - protein, 9 aa, Homo Sapiens
EGFPQGAAP

SEQ ID NO: 200836 - protein, 9 aa, Homo Sapiens
SGGFHPGTP

SEQ ID NO: 200837 - protein, 9 aa, Homo Sapiens
RGSMVLFAW

SEQ ID NO: 200838 - protein, 9 aa, Homo Sapiens
WELLLALSW

SEQ ID NO: 200839 - protein, 9 aa, Homo Sapiens
PAMDKDGKP

SEQ ID NO: 200840 - protein, 9 aa, Homo Sapiens
HVPLPPPPP

SEQ ID NO: 200841 - protein, 9 aa, Homo Sapiens
VHARTVFGV

SEQ ID NO: 200842 - protein, 9 aa, Homo Sapiens
LACIGDALL

SEQ ID NO: 200843 - protein, 9 aa, Homo Sapiens
SPLRLTLWP

SEQ ID NO: 200844 - protein, 9 aa, Homo Sapiens
DVRGNPRGN

SEQ ID NO: 200845 - protein, 9 aa, Homo Sapiens
WVAPVETLE

SEQ ID NO: 200846 - protein, 9 aa, Homo Sapiens
LPPESLEDA

SEQ ID NO: 200847 - protein, 9 aa, Homo Sapiens
KEQHLHLEP

SEQ ID NO: 200848 - protein, 9 aa, Homo Sapiens
PVQDFISAI

SEQ ID NO: 200849 - protein, 9 aa, Homo Sapiens
KTAVVQTMP

SEQ ID NO: 200850 - protein, 9 aa, Homo Sapiens
VHWTTVGLC

SEQ ID NO: 200851 - protein, 9 aa, Homo Sapiens
FCSESFGTE

SEQ ID NO: 200852 - protein, 9 aa, Homo Sapiens
MVPTIRSGP

SEQ ID NO: 200853 - protein, 9 aa, Homo Sapiens
LLPTTGVRT

SEQ ID NO: 200854 - protein, 9 aa, Homo Sapiens
REVRQTGGR

SEQ ID NO: 200855 - protein, 9 aa, Homo Sapiens
REWRRRARQ

SEQ ID NO: 200856 - protein, 9 aa, Homo Sapiens
CTEPWEPPG

SEQ ID NO: 200857 - protein, 9 aa, Homo Sapiens
KAFVESHYS

SEQ ID NO: 200858 - protein, 9 aa, Homo Sapiens
NSLGACIIE

SEQ ID NO: 200859 - protein, 9 aa, Homo Sapiens
HYVDEAGLE

SEQ ID NO: 200860 - protein, 9 aa, Homo Sapiens
QSQLDTLCQ

SEQ ID NO: 200861 - protein, 9 aa, Homo Sapiens
QQTFTRSVG

SEQ ID NO: 200862 - protein, 9 aa, Homo Sapiens
GFCMYSKGA

SEQ ID NO: 200863 - protein, 9 aa, Homo Sapiens
SVQSHLRHG

SEQ ID NO: 200864 - protein, 9 aa, Homo Sapiens
LHSPGFRQL

SEQ ID NO: 200865 - protein, 9 aa, Homo Sapiens
DNFTSPKRI

SEQ ID NO: 200866 - protein, 9 aa, Homo Sapiens
HSPGFRQLC

SEQ ID NO: 200867 - protein, 9 aa, Homo Sapiens
TAFPTLNTF

SEQ ID NO: 200868 - protein, 9 aa, Homo Sapiens
YEELDSTRG

SEQ ID NO: 200869 - protein, 9 aa, Homo Sapiens
DVRLTLKKY

SEQ ID NO: 200870 - protein, 9 aa, Homo Sapiens
SCVRTVMNS

SEQ ID NO: 200871 - protein, 9 aa, Homo Sapiens
RVYGEFMQV

SEQ ID NO: 200872 - protein, 9 aa, Homo Sapiens
IEYTIDVFF

SEQ ID NO: 200873 - protein, 9 aa, Homo Sapiens
EEGIYPDPG

SEQ ID NO: 200874 - protein, 9 aa, Homo Sapiens
HFRHKSQLW

SEQ ID NO: 200875 - protein, 9 aa, Homo Sapiens
SPQAWGSLE

SEQ ID NO: 200876 - protein, 9 aa, Homo Sapiens
VEVKAKKRI

SEQ ID NO: 200877 - protein, 9 aa, Homo Sapiens
TGQHAPPIS

SEQ ID NO: 200878 - protein, 9 aa, Homo Sapiens
NGVVPATVN

SEQ ID NO: 200879 - protein, 9 aa, Homo Sapiens
TTTPDPTMD

SEQ ID NO: 200880 - protein, 9 aa, Homo Sapiens
GILVGVISD

SEQ ID NO: 200881 - protein, 9 aa, Homo Sapiens
QDEQLIYFY

SEQ ID NO: 200882 - protein, 9 aa, Homo Sapiens
LQVEPGLGS

SEQ ID NO: 200883 - protein, 9 aa, Homo Sapiens
ILWICTRYT

SEQ ID NO: 200884 - protein, 9 aa, Homo Sapiens
LHFHFTVRY

SEQ ID NO: 200885 - protein, 9 aa, Homo Sapiens
AQDEVLTKR

SEQ ID NO: 200886 - protein, 9 aa, Homo Sapiens
SAKPFQCTE

SEQ ID NO: 200887 - protein, 9 aa, Homo Sapiens
TLGATVDAP

SEQ ID NO: 200888 - protein, 9 aa, Homo Sapiens
RKPSKTKTS

SEQ ID NO: 200889 - protein, 9 aa, Homo Sapiens
IKLAMKIGG

SEQ ID NO: 200890 - protein, 9 aa, Homo Sapiens
VDKQEETVI

SEQ ID NO: 200891 - protein, 9 aa, Homo Sapiens
PGPGNGGTA

SEQ ID NO: 200892 - protein, 9 aa, Homo Sapiens
LMDILLMDD

SEQ ID NO: 200893 - protein, 9 aa, Homo Sapiens
KAEFSKILI

SEQ ID NO: 200894 - protein, 9 aa, Homo Sapiens
ALECLDNFK

SEQ ID NO: 200895 - protein, 9 aa, Homo Sapiens
QGKAVVSHN

SEQ ID NO: 200896 - protein, 9 aa, Homo Sapiens
HANVGALGL

SEQ ID NO: 200897 - protein, 9 aa, Homo Sapiens
DEEEDLEDD

SEQ ID NO: 200898 - protein, 9 aa, Homo Sapiens
DLMEGRPQI

SEQ ID NO: 200899 - protein, 9 aa, Homo Sapiens
LFDRKQLQY

SEQ ID NO: 200900 - protein, 9 aa, Homo Sapiens
SEEGSDEMY

SEQ ID NO: 200901 - protein, 9 aa, Homo Sapiens
PPCICDNRD

SEQ ID NO: 200902 - protein, 9 aa, Homo Sapiens
QGVCSPLLR

SEQ ID NO: 200903 - protein, 9 aa, Homo Sapiens
RSNHRGSVV

SEQ ID NO: 200904 - protein, 9 aa, Homo Sapiens
EFMQVWISG

SEQ ID NO: 200905 - protein, 9 aa, Homo Sapiens
EVTCNHCAC

SEQ ID NO: 200906 - protein, 9 aa, Homo Sapiens
LFYRKTIVY

SEQ ID NO: 200907 - protein, 9 aa, Homo Sapiens
HKKPLQGVE

SEQ ID NO: 200908 - protein, 9 aa, Homo Sapiens
REYQRQDCM

SEQ ID NO: 200909 - protein, 9 aa, Homo Sapiens
HTWAASIYS

SEQ ID NO: 200910 - protein, 9 aa, Homo Sapiens
ELVVGREPQ

SEQ ID NO: 200911 - protein, 9 aa, Homo Sapiens
SRLPPVDRL

SEQ ID NO: 200912 - protein, 9 aa, Homo Sapiens
ACHVAELAV

SEQ ID NO: 200913 - protein, 9 aa, Homo Sapiens
AMKIGGVSL

SEQ ID NO: 200914 - protein, 9 aa, Homo Sapiens
LVGSEKPSP

SEQ ID NO: 200915 - protein, 9 aa, Homo Sapiens
ETAFPTLNT

SEQ ID NO: 200916 - protein, 9 aa, Homo Sapiens
AEEKLQTSV

SEQ ID NO: 200917 - protein, 9 aa, Homo Sapiens
LFCRVRFDN

SEQ ID NO: 200918 - protein, 9 aa, Homo Sapiens
MSEENSTGE

SEQ ID NO: 200919 - protein, 9 aa, Homo Sapiens
RHIYLQMTT

SEQ ID NO: 200920 - protein, 9 aa, Homo Sapiens
ILEVYGVYF

SEQ ID NO: 200921 - protein, 9 aa, Homo Sapiens
HVPAIPPNL

SEQ ID NO: 200922 - protein, 9 aa, Homo Sapiens
CENLQKLEI

SEQ ID NO: 200923 - protein, 9 aa, Homo Sapiens
REKTRWPNS

SEQ ID NO: 200924 - protein, 9 aa, Homo Sapiens
VASRVQAQQ

SEQ ID NO: 200925 - protein, 9 aa, Homo Sapiens
LPTTGVRTR

SEQ ID NO: 200926 - protein, 9 aa, Homo Sapiens
LGLCGGSSY

SEQ ID NO: 200927 - protein, 9 aa, Homo Sapiens
QMAIRLLNK

SEQ ID NO: 200928 - protein, 9 aa, Homo Sapiens
EALECLDNF

SEQ ID NO: 200929 - protein, 9 aa, Homo Sapiens
YRLKPAMDK

SEQ ID NO: 200930 - protein, 9 aa, Homo Sapiens
GLCFSGVND

SEQ ID NO: 200931 - protein, 9 aa, Homo Sapiens
WSPTWGRRW

SEQ ID NO: 200932 - protein, 9 aa, Homo Sapiens
MATTGTVTM

SEQ ID NO: 200933 - protein, 9 aa, Homo Sapiens
AYCTTDHNV

SEQ ID NO: 200934 - protein, 9 aa, Homo Sapiens
ASLGAPRMY

SEQ ID NO: 200935 - protein, 9 aa, Homo Sapiens
MHKHQPRVH

SEQ ID NO: 200936 - protein, 9 aa, Homo Sapiens
GCAVLRTTP

SEQ ID NO: 200937 - protein, 9 aa, Homo Sapiens
GFINLMELK

SEQ ID NO: 200938 - protein, 9 aa, Homo Sapiens
MVAKRNMTL

SEQ ID NO: 200939 - protein, 9 aa, Homo Sapiens
IPFLDMSFT

SEQ ID NO: 200940 - protein, 9 aa, Homo Sapiens
AKHSEKSSP

SEQ ID NO: 200941 - protein, 9 aa, Homo Sapiens
CATSLDRYV

SEQ ID NO: 200942 - protein, 9 aa, Homo Sapiens
LYRLRLLVY

SEQ ID NO: 200943 - protein, 9 aa, Homo Sapiens
EPDSPYKVY

SEQ ID NO: 200944 - protein, 9 aa, Homo Sapiens
GKEWQGDRS

SEQ ID NO: 200945 - protein, 9 aa, Homo Sapiens
LTARRVHEL

SEQ ID NO: 200946 - protein, 9 aa, Homo Sapiens
KLSELEATL

SEQ ID NO: 200947 - protein, 9 aa, Homo Sapiens
EFNDHGKSF

SEQ ID NO: 200948 - protein, 9 aa, Homo Sapiens
CEGHIEKDA

SEQ ID NO: 200949 - protein, 9 aa, Homo Sapiens
LELCVDVAG

SEQ ID NO: 200950 - protein, 9 aa, Homo Sapiens
VTGNVTTPP

SEQ ID NO: 200951 - protein, 9 aa, Homo Sapiens
PTGPQVASS

SEQ ID NO: 200952 - protein, 9 aa, Homo Sapiens
NQLNTKYWD

SEQ ID NO: 200953 - protein, 9 aa, Homo Sapiens
AEEPTGIFL

SEQ ID NO: 200954 - protein, 9 aa, Homo Sapiens
GAHLQGEPK

SEQ ID NO: 200955 - protein, 9 aa, Homo Sapiens
CCGQCGRTY

SEQ ID NO: 200956 - protein, 9 aa, Homo Sapiens
DNPSLAFIR

SEQ ID NO: 200957 - protein, 9 aa, Homo Sapiens
SPSHRALPP

SEQ ID NO: 200958 - protein, 9 aa, Homo Sapiens
CEKIRSFVA

SEQ ID NO: 200959 - protein, 9 aa, Homo Sapiens
RMLEYEPTA

SEQ ID NO: 200960 - protein, 9 aa, Homo Sapiens
LTKPSMTQK

SEQ ID NO: 200961 - protein, 9 aa, Homo Sapiens
GPAGARDSD

SEQ ID NO: 200962 - protein, 9 aa, Homo Sapiens
AWSLIGNLQ

SEQ ID NO: 200963 - protein, 9 aa, Homo Sapiens
YILAKSLSQ

SEQ ID NO: 200964 - protein, 9 aa, Homo Sapiens
SKHFWTTVG

SEQ ID NO: 200965 - protein, 9 aa, Homo Sapiens
AAWRVEKEA

SEQ ID NO: 200966 - protein, 9 aa, Homo Sapiens
CFPPSLLSC

SEQ ID NO: 200967 - protein, 9 aa, Homo Sapiens
HDAGVPPLG

SEQ ID NO: 200968 - protein, 9 aa, Homo Sapiens
PRLTRERAA

SEQ ID NO: 200969 - protein, 9 aa, Homo Sapiens
SGTPYKGPS

SEQ ID NO: 200970 - protein, 9 aa, Homo Sapiens
NPTGIVLLQ

SEQ ID NO: 200971 - protein, 9 aa, Homo Sapiens
IAWWGLGEL

SEQ ID NO: 200972 - protein, 9 aa, Homo Sapiens
ETLRDVLSY

SEQ ID NO: 200973 - protein, 9 aa, Homo Sapiens
TQACSCLLL

SEQ ID NO: 200974 - protein, 9 aa, Homo Sapiens
PMPGFSTRR

SEQ ID NO: 200975 - protein, 9 aa, Homo Sapiens
GQRCSMDAP

SEQ ID NO: 200976 - protein, 9 aa, Homo Sapiens
YCHGEAVYS

SEQ ID NO: 200977 - protein, 9 aa, Homo Sapiens
LALLVDEFA

SEQ ID NO: 200978 - protein, 9 aa, Homo Sapiens
VFVLDTVCS

SEQ ID NO: 200979 - protein, 9 aa, Homo Sapiens
YVGAYAPCP

SEQ ID NO: 200980 - protein, 9 aa, Homo Sapiens
GDEVISTLK

SEQ ID NO: 200981 - protein, 9 aa, Homo Sapiens
NSSSYWIGP

SEQ ID NO: 200982 - protein, 9 aa, Homo Sapiens
LGVSLVLTA

SEQ ID NO: 200983 - protein, 9 aa, Homo Sapiens
QLHRTTRSV

SEQ ID NO: 200984 - protein, 9 aa, Homo Sapiens
RRQGKEWQG

SEQ ID NO: 200985 - protein, 9 aa, Homo Sapiens
TLANASSLR

SEQ ID NO: 200986 - protein, 9 aa, Homo Sapiens
QLSEIPAEF

SEQ ID NO: 200987 - protein, 9 aa, Homo Sapiens
SAGGTSVSL

SEQ ID NO: 200988 - protein, 9 aa, Homo Sapiens
FPASLARKC

SEQ ID NO: 200989 - protein, 9 aa, Homo Sapiens
WGWHWEGWW

SEQ ID NO: 200990 - protein, 9 aa, Homo Sapiens
DDIVNINRA

SEQ ID NO: 200991 - protein, 9 aa, Homo Sapiens
LAFIRPRWI

SEQ ID NO: 200992 - protein, 9 aa, Homo Sapiens
DGSSRSVIM

SEQ ID NO: 200993 - protein, 9 aa, Homo Sapiens
CTYMWGVIY

SEQ ID NO: 200994 - protein, 9 aa, Homo Sapiens
HLTGRPGEC

SEQ ID NO: 200995 - protein, 9 aa, Homo Sapiens
GGTSSSISV

SEQ ID NO: 200996 - protein, 9 aa, Homo Sapiens
VNLGFATLW

SEQ ID NO: 200997 - protein, 9 aa, Homo Sapiens
ADPVHGHLR

SEQ ID NO: 200998 - protein, 9 aa, Homo Sapiens
TAIIEVTTN

SEQ ID NO: 200999 - protein, 9 aa, Homo Sapiens
LMPASEPPF

SEQ ID NO: 201000 - protein, 9 aa, Homo Sapiens
KLKGTDPDE

SEQ ID NO: 201001 - protein, 9 aa, Homo Sapiens
KELEHEAIL

SEQ ID NO: 201002 - protein, 9 aa, Homo Sapiens
NGGFCMYSK

SEQ ID NO: 201003 - protein, 9 aa, Homo Sapiens
GGGHRGHGG

SEQ ID NO: 201004 - protein, 9 aa, Homo Sapiens
HLGQHVVGM

SEQ ID NO: 201005 - protein, 9 aa, Homo Sapiens
PSAQAHQLV

SEQ ID NO: 201006 - protein, 9 aa, Homo Sapiens
LNGKADVTL

SEQ ID NO: 201007 - protein, 9 aa, Homo Sapiens
NIKGCAMGP

SEQ ID NO: 201008 - protein, 9 aa, Homo Sapiens
PTGLSSPHL

SEQ ID NO: 201009 - protein, 9 aa, Homo Sapiens
RVGHKPSLN

SEQ ID NO: 201010 - protein, 9 aa, Homo Sapiens
SGLWRQLAT

SEQ ID NO: 201011 - protein, 9 aa, Homo Sapiens
DPKEILHYV

SEQ ID NO: 201012 - protein, 9 aa, Homo Sapiens
QKQIDRVLA

SEQ ID NO: 201013 - protein, 9 aa, Homo Sapiens
VDGTTAKDL

SEQ ID NO: 201014 - protein, 9 aa, Homo Sapiens
EPVLTLVGE

SEQ ID NO: 201015 - protein, 9 aa, Homo Sapiens
TQRIIGHVH

SEQ ID NO: 201016 - protein, 9 aa, Homo Sapiens
PPQQAGWSS

SEQ ID NO: 201017 - protein, 9 aa, Homo Sapiens
WNQAAGAPP

SEQ ID NO: 201018 - protein, 9 aa, Homo Sapiens
EAKVEIAQA

SEQ ID NO: 201019 - protein, 9 aa, Homo Sapiens
HMTLDFDLT

SEQ ID NO: 201020 - protein, 9 aa, Homo Sapiens
AHSFSPLEK

SEQ ID NO: 201021 - protein, 9 aa, Homo Sapiens
AHSGKRLRV

SEQ ID NO: 201022 - protein, 9 aa, Homo Sapiens
RHQKIHNGE

SEQ ID NO: 201023 - protein, 9 aa, Homo Sapiens
IPLIPQQAQ

SEQ ID NO: 201024 - protein, 9 aa, Homo Sapiens
SIRLDSTIR

SEQ ID NO: 201025 - protein, 9 aa, Homo Sapiens
CYLSHTLSA

SEQ ID NO: 201026 - protein, 9 aa, Homo Sapiens
ITEGNNIHS

SEQ ID NO: 201027 - protein, 9 aa, Homo Sapiens
HGLENVPGI

SEQ ID NO: 201028 - protein, 9 aa, Homo Sapiens
GEDYTPSYR

SEQ ID NO: 201029 - protein, 9 aa, Homo Sapiens
VVSTTEPCK

SEQ ID NO: 201030 - protein, 9 aa, Homo Sapiens
GLYLVLHTE

SEQ ID NO: 201031 - protein, 9 aa, Homo Sapiens
QGYRMEQSR

SEQ ID NO: 201032 - protein, 9 aa, Homo Sapiens
AWDGVACMR

SEQ ID NO: 201033 - protein, 9 aa, Homo Sapiens
WTVVTSSGD

SEQ ID NO: 201034 - protein, 9 aa, Homo Sapiens
QAQNVQCKQ

SEQ ID NO: 201035 - protein, 9 aa, Homo Sapiens
VWDSMKSEC

SEQ ID NO: 201036 - protein, 9 aa, Homo Sapiens
LQNEPLSER

SEQ ID NO: 201037 - protein, 9 aa, Homo Sapiens
FTRQMPVDS

SEQ ID NO: 201038 - protein, 9 aa, Homo Sapiens
VGTQRIIGH

SEQ ID NO: 201039 - protein, 9 aa, Homo Sapiens
CAAAPPFRA

SEQ ID NO: 201040 - protein, 9 aa, Homo Sapiens
LKEMTHSWS

SEQ ID NO: 201041 - protein, 9 aa, Homo Sapiens
FYGMHFIMS

SEQ ID NO: 201042 - protein, 9 aa, Homo Sapiens
KQLETLKAV

SEQ ID NO: 201043 - protein, 9 aa, Homo Sapiens
DGGAGVKAS

SEQ ID NO: 201044 - protein, 9 aa, Homo Sapiens
RQAHGSWFC

SEQ ID NO: 201045 - protein, 9 aa, Homo Sapiens
DADFTKMTP

SEQ ID NO: 201046 - protein, 9 aa, Homo Sapiens
VYFELPDLG

SEQ ID NO: 201047 - protein, 9 aa, Homo Sapiens
NLIASDLDE

SEQ ID NO: 201048 - protein, 9 aa, Homo Sapiens
SPREWTNIE

SEQ ID NO: 201049 - protein, 9 aa, Homo Sapiens
RNSRLICRC

SEQ ID NO: 201050 - protein, 9 aa, Homo Sapiens
RPPETQVSC

SEQ ID NO: 201051 - protein, 9 aa, Homo Sapiens
NSYQMTRER

SEQ ID NO: 201052 - protein, 9 aa, Homo Sapiens
NIGSHRMRV

SEQ ID NO: 201053 - protein, 9 aa, Homo Sapiens
EKDPHIAQK

SEQ ID NO: 201054 - protein, 9 aa, Homo Sapiens
GNGPCEVMV

SEQ ID NO: 201055 - protein, 9 aa, Homo Sapiens
PLNTKSALI

SEQ ID NO: 201056 - protein, 9 aa, Homo Sapiens
RKGPHYERP

SEQ ID NO: 201057 - protein, 9 aa, Homo Sapiens
GLADEIDFE

SEQ ID NO: 201058 - protein, 9 aa, Homo Sapiens
CKYTVHECC

SEQ ID NO: 201059 - protein, 9 aa, Homo Sapiens
RQLTGAMVW

SEQ ID NO: 201060 - protein, 9 aa, Homo Sapiens
PATLHRSRP

SEQ ID NO: 201061 - protein, 9 aa, Homo Sapiens
FRHKSQLWL

SEQ ID NO: 201062 - protein, 9 aa, Homo Sapiens
GSWSDEWPR

SEQ ID NO: 201063 - protein, 9 aa, Homo Sapiens
TRGEPTEPE

SEQ ID NO: 201064 - protein, 9 aa, Homo Sapiens
GVHKCKPQM

SEQ ID NO: 201065 - protein, 9 aa, Homo Sapiens
PSLQVSTLR

SEQ ID NO: 201066 - protein, 9 aa, Homo Sapiens
LEYSQAMTV

SEQ ID NO: 201067 - protein, 9 aa, Homo Sapiens
LIRRDGIQI

SEQ ID NO: 201068 - protein, 9 aa, Homo Sapiens
KVVYSSLEL

SEQ ID NO: 201069 - protein, 9 aa, Homo Sapiens
MEDLLQAAT

SEQ ID NO: 201070 - protein, 9 aa, Homo Sapiens
GASPHHCRV

SEQ ID NO: 201071 - protein, 9 aa, Homo Sapiens
TTTQALALI

SEQ ID NO: 201072 - protein, 9 aa, Homo Sapiens
EESNAMRNF

SEQ ID NO: 201073 - protein, 9 aa, Homo Sapiens
ELLSVWQES

SEQ ID NO: 201074 - protein, 9 aa, Homo Sapiens
SSPATSRAT

SEQ ID NO: 201075 - protein, 9 aa, Homo Sapiens
VSLSLFSCT

SEQ ID NO: 201076 - protein, 9 aa, Homo Sapiens
SLSGIHHFA

SEQ ID NO: 201077 - protein, 9 aa, Homo Sapiens
SSQMSPMPK

SEQ ID NO: 201078 - protein, 9 aa, Homo Sapiens
DADCDWEKE

SEQ ID NO: 201079 - protein, 9 aa, Homo Sapiens
VWKGENWLY

SEQ ID NO: 201080 - protein, 9 aa, Homo Sapiens
MLTASIFRP

SEQ ID NO: 201081 - protein, 9 aa, Homo Sapiens
DWADVRLTL

SEQ ID NO: 201082 - protein, 9 aa, Homo Sapiens
SIKVVKLVR

SEQ ID NO: 201083 - protein, 9 aa, Homo Sapiens
KYFVTSYKM

SEQ ID NO: 201084 - protein, 9 aa, Homo Sapiens
ETDYDQYAM

SEQ ID NO: 201085 - protein, 9 aa, Homo Sapiens
EVRGPVTIF

SEQ ID NO: 201086 - protein, 9 aa, Homo Sapiens
FGTLELTKG

SEQ ID NO: 201087 - protein, 9 aa, Homo Sapiens
WELMKEGFM

SEQ ID NO: 201088 - protein, 9 aa, Homo Sapiens
FVLDTVCSN

SEQ ID NO: 201089 - protein, 9 aa, Homo Sapiens
ELLPREVSP

SEQ ID NO: 201090 - protein, 9 aa, Homo Sapiens
DLVHQGRLE

SEQ ID NO: 201091 - protein, 9 aa, Homo Sapiens
DRLELCVDV

SEQ ID NO: 201092 - protein, 9 aa, Homo Sapiens
TNSSLSDPS

SEQ ID NO: 201093 - protein, 9 aa, Homo Sapiens
VAFRVEIHM

SEQ ID NO: 201094 - protein, 9 aa, Homo Sapiens
LLLGPGESR

SEQ ID NO: 201095 - protein, 9 aa, Homo Sapiens
AQQESLQER

SEQ ID NO: 201096 - protein, 9 aa, Homo Sapiens
FPMCPPGGI

SEQ ID NO: 201097 - protein, 9 aa, Homo Sapiens
SDKEVVVAT

SEQ ID NO: 201098 - protein, 9 aa, Homo Sapiens
AQTSRELTG

SEQ ID NO: 201099 - protein, 9 aa, Homo Sapiens
RLGLAPPRP

SEQ ID NO: 201100 - protein, 9 aa, Homo Sapiens
ADLDAGRDS

SEQ ID NO: 201101 - protein, 9 aa, Homo Sapiens
DHMKVIAGR

SEQ ID NO: 201102 - protein, 9 aa, Homo Sapiens
VKWQPVDLA

SEQ ID NO: 201103 - protein, 9 aa, Homo Sapiens
RGGCRVPRR

SEQ ID NO: 201104 - protein, 9 aa, Homo Sapiens
VMCKIRVFP

SEQ ID NO: 201105 - protein, 9 aa, Homo Sapiens
SSLVASKLP

SEQ ID NO: 201106 - protein, 9 aa, Homo Sapiens
MHHMGSEQL

SEQ ID NO: 201107 - protein, 9 aa, Homo Sapiens
LNLIASDLD

SEQ ID NO: 201108 - protein, 9 aa, Homo Sapiens
ASADLQTLL

SEQ ID NO: 201109 - protein, 9 aa, Homo Sapiens
KGPSRLPPV

SEQ ID NO: 201110 - protein, 9 aa, Homo Sapiens
ARALLDRDV

SEQ ID NO: 201111 - protein, 9 aa, Homo Sapiens
KYPHSWMKI

SEQ ID NO: 201112 - protein, 9 aa, Homo Sapiens
SSGQSLGCQ

SEQ ID NO: 201113 - protein, 9 aa, Homo Sapiens
CHNTMGSYK

SEQ ID NO: 201114 - protein, 9 aa, Homo Sapiens
RDDDFVSRY

SEQ ID NO: 201115 - protein, 9 aa, Homo Sapiens
TLRLNPKAM

SEQ ID NO: 201116 - protein, 9 aa, Homo Sapiens
ALTGDVVAH

SEQ ID NO: 201117 - protein, 9 aa, Homo Sapiens
IEQLLEFMY

SEQ ID NO: 201118 - protein, 9 aa, Homo Sapiens
RTAQDALES

SEQ ID NO: 201119 - protein, 9 aa, Homo Sapiens
THVGHAGHT

SEQ ID NO: 201120 - protein, 9 aa, Homo Sapiens
NHVAHTVGC

SEQ ID NO: 201121 - protein, 9 aa, Homo Sapiens
KTVPPKKMH

SEQ ID NO: 201122 - protein, 9 aa, Homo Sapiens
GPNVCLISI

SEQ ID NO: 201123 - protein, 9 aa, Homo Sapiens
IVKYLLDLG

SEQ ID NO: 201124 - protein, 9 aa, Homo Sapiens
RQGVLRSIS

SEQ ID NO: 201125 - protein, 9 aa, Homo Sapiens
KFGLLLLFL

SEQ ID NO: 201126 - protein, 9 aa, Homo Sapiens
NETDGKSIA

SEQ ID NO: 201127 - protein, 9 aa, Homo Sapiens
RDLQGKDTY

SEQ ID NO: 201128 - protein, 9 aa, Homo Sapiens
VGGSPVNTR

SEQ ID NO: 201129 - protein, 9 aa, Homo Sapiens
AHVTVSGSR

SEQ ID NO: 201130 - protein, 9 aa, Homo Sapiens
STIVWRPDI

SEQ ID NO: 201131 - protein, 9 aa, Homo Sapiens
PRPRVAQPS

SEQ ID NO: 201132 - protein, 9 aa, Homo Sapiens
PGVHLRRRC

SEQ ID NO: 201133 - protein, 9 aa, Homo Sapiens
WMIYGEVFV

SEQ ID NO: 201134 - protein, 9 aa, Homo Sapiens
SAEVIAQAQ

SEQ ID NO: 201135 - protein, 9 aa, Homo Sapiens
QQNDLYYNT

SEQ ID NO: 201136 - protein, 9 aa, Homo Sapiens
LTKHKQIHT

SEQ ID NO: 201137 - protein, 9 aa, Homo Sapiens
MDLLTQRGL

SEQ ID NO: 201138 - protein, 9 aa, Homo Sapiens
RAPSSPMLR

SEQ ID NO: 201139 - protein, 9 aa, Homo Sapiens
MYFFLANIP

SEQ ID NO: 201140 - protein, 9 aa, Homo Sapiens
TSSDTAPST

SEQ ID NO: 201141 - protein, 9 aa, Homo Sapiens
ILNVTALPL

SEQ ID NO: 201142 - protein, 9 aa, Homo Sapiens
KTPVAFASF

SEQ ID NO: 201143 - protein, 9 aa, Homo Sapiens
DLVVPDLPV

SEQ ID NO: 201144 - protein, 9 aa, Homo Sapiens
FLEFHKDSS

SEQ ID NO: 201145 - protein, 9 aa, Homo Sapiens
CDRQKQKSM

SEQ ID NO: 201146 - protein, 9 aa, Homo Sapiens
HREASSCAV

SEQ ID NO: 201147 - protein, 9 aa, Homo Sapiens
FMKKLWTTM

SEQ ID NO: 201148 - protein, 9 aa, Homo Sapiens
STLQRWCLN

SEQ ID NO: 201149 - protein, 9 aa, Homo Sapiens
CEEKTVGHL

SEQ ID NO: 201150 - protein, 9 aa, Homo Sapiens
PTVRTYIEN

SEQ ID NO: 201151 - protein, 9 aa, Homo Sapiens
ERPARSPPP

SEQ ID NO: 201152 - protein, 9 aa, Homo Sapiens
LLSSVDKRS

SEQ ID NO: 201153 - protein, 9 aa, Homo Sapiens
EKDHVALRR

SEQ ID NO: 201154 - protein, 9 aa, Homo Sapiens
MVLEMIRCH

SEQ ID NO: 201155 - protein, 9 aa, Homo Sapiens
THFCQGGHF

SEQ ID NO: 201156 - protein, 9 aa, Homo Sapiens
VRSFMDLKI

SEQ ID NO: 201157 - protein, 9 aa, Homo Sapiens
PQLWIGIDF

SEQ ID NO: 201158 - protein, 9 aa, Homo Sapiens
FVMPLHHGL

SEQ ID NO: 201159 - protein, 9 aa, Homo Sapiens
NAMLSIHQL

SEQ ID NO: 201160 - protein, 9 aa, Homo Sapiens
TRSVCTMPL

SEQ ID NO: 201161 - protein, 9 aa, Homo Sapiens
GSFCVCYMP

SEQ ID NO: 201162 - protein, 9 aa, Homo Sapiens
THLPIRMAK

SEQ ID NO: 201163 - protein, 9 aa, Homo Sapiens
VTLIGKVSS

SEQ ID NO: 201164 - protein, 9 aa, Homo Sapiens
MLVEEDFSV

SEQ ID NO: 201165 - protein, 9 aa, Homo Sapiens
SAKNAMNVE

SEQ ID NO: 201166 - protein, 9 aa, Homo Sapiens
LLVARGLVG

SEQ ID NO: 201167 - protein, 9 aa, Homo Sapiens
AAMSFVLDE

SEQ ID NO: 201168 - protein, 9 aa, Homo Sapiens
RWGEVRGPV

SEQ ID NO: 201169 - protein, 9 aa, Homo Sapiens
VMTGIVPDW

SEQ ID NO: 201170 - protein, 9 aa, Homo Sapiens
QSVSRILTR

SEQ ID NO: 201171 - protein, 9 aa, Homo Sapiens
LRGCTLRST

SEQ ID NO: 201172 - protein, 9 aa, Homo Sapiens
QTLVIQPML

SEQ ID NO: 201173 - protein, 9 aa, Homo Sapiens
VGQDEQLIY

SEQ ID NO: 201174 - protein, 9 aa, Homo Sapiens
VIMGPSPIL

SEQ ID NO: 201175 - protein, 9 aa, Homo Sapiens
CFVRIRAEL

SEQ ID NO: 201176 - protein, 9 aa, Homo Sapiens
RLALHRAPG

SEQ ID NO: 201177 - protein, 9 aa, Homo Sapiens
PWPALDARP

SEQ ID NO: 201178 - protein, 9 aa, Homo Sapiens
VQASSSGQH

SEQ ID NO: 201179 - protein, 9 aa, Homo Sapiens
HIRNMCNID

SEQ ID NO: 201180 - protein, 9 aa, Homo Sapiens
SGNWAYRDH

SEQ ID NO: 201181 - protein, 9 aa, Homo Sapiens
HFNNGNHMT

SEQ ID NO: 201182 - protein, 9 aa, Homo Sapiens
CVVQNVHRP

SEQ ID NO: 201183 - protein, 9 aa, Homo Sapiens
SEKSSPSTE

SEQ ID NO: 201184 - protein, 9 aa, Homo Sapiens
TPKYASLGA

SEQ ID NO: 201185 - protein, 9 aa, Homo Sapiens
QFKYRDGQI

SEQ ID NO: 201186 - protein, 9 aa, Homo Sapiens
TQKGNLLCH

SEQ ID NO: 201187 - protein, 9 aa, Homo Sapiens
ELHRAQMSI

SEQ ID NO: 201188 - protein, 9 aa, Homo Sapiens
PMGIALKMN

SEQ ID NO: 201189 - protein, 9 aa, Homo Sapiens
LRMATEKPG

SEQ ID NO: 201190 - protein, 9 aa, Homo Sapiens
VLQWSQEFS

SEQ ID NO: 201191 - protein, 9 aa, Homo Sapiens
VVKAVFWLC

SEQ ID NO: 201192 - protein, 9 aa, Homo Sapiens
WLSAVIQAF

SEQ ID NO: 201193 - protein, 9 aa, Homo Sapiens
LQTSVRCLA

SEQ ID NO: 201194 - protein, 9 aa, Homo Sapiens
YTISLCTYA

SEQ ID NO: 201195 - protein, 9 aa, Homo Sapiens
VFNTMWTLG

SEQ ID NO: 201196 - protein, 9 aa, Homo Sapiens
AVYHIRNMC

SEQ ID NO: 201197 - protein, 9 aa, Homo Sapiens
CLGFVPRNS

SEQ ID NO: 201198 - protein, 9 aa, Homo Sapiens
ELGADGAET

SEQ ID NO: 201199 - protein, 9 aa, Homo Sapiens
WGARGGGAF

SEQ ID NO: 201200 - protein, 9 aa, Homo Sapiens
MSTCIVNGA

SEQ ID NO: 201201 - protein, 9 aa, Homo Sapiens
CCQQTAIHQ

SEQ ID NO: 201202 - protein, 9 aa, Homo Sapiens
GRLLVQWLF

SEQ ID NO: 201203 - protein, 9 aa, Homo Sapiens
YFRSPLPTT

SEQ ID NO: 201204 - protein, 9 aa, Homo Sapiens
GVCENLQKL

SEQ ID NO: 201205 - protein, 9 aa, Homo Sapiens
ATRPKSAFK

SEQ ID NO: 201206 - protein, 9 aa, Homo Sapiens
EEHFHVELH

SEQ ID NO: 201207 - protein, 9 aa, Homo Sapiens
KSGWEDCKR

SEQ ID NO: 201208 - protein, 9 aa, Homo Sapiens
GHKAQQHIE

SEQ ID NO: 201209 - protein, 9 aa, Homo Sapiens
GQRKALWQL

SEQ ID NO: 201210 - protein, 9 aa, Homo Sapiens
SNWCNGLLQ

SEQ ID NO: 201211 - protein, 9 aa, Homo Sapiens
VLTLVGEAI

SEQ ID NO: 201212 - protein, 9 aa, Homo Sapiens
RLQHMDRPL

SEQ ID NO: 201213 - protein, 9 aa, Homo Sapiens
LHNYGIMHR

SEQ ID NO: 201214 - protein, 9 aa, Homo Sapiens
EPFPSVRSF

SEQ ID NO: 201215 - protein, 9 aa, Homo Sapiens
PRGNSVIVG

SEQ ID NO: 201216 - protein, 9 aa, Homo Sapiens
KVDDFLANG

SEQ ID NO: 201217 - protein, 9 aa, Homo Sapiens
YYQGVYSWP

SEQ ID NO: 201218 - protein, 9 aa, Homo Sapiens
VIYSVFPQM

SEQ ID NO: 201219 - protein, 9 aa, Homo Sapiens
IDYRHFVSQ

SEQ ID NO: 201220 - protein, 9 aa, Homo Sapiens
KADVTLIGK

SEQ ID NO: 201221 - protein, 9 aa, Homo Sapiens
SHMQICDQC

SEQ ID NO: 201222 - protein, 9 aa, Homo Sapiens
MGPEDGAAS

SEQ ID NO: 201223 - protein, 9 aa, Homo Sapiens
TYQVCQMLL

SEQ ID NO: 201224 - protein, 9 aa, Homo Sapiens
RCSASSGSS

SEQ ID NO: 201225 - protein, 9 aa, Homo Sapiens
GGRVRALNE

SEQ ID NO: 201226 - protein, 9 aa, Homo Sapiens
NFHDGHKAQ

SEQ ID NO: 201227 - protein, 9 aa, Homo Sapiens
SSCRPGMPS

SEQ ID NO: 201228 - protein, 9 aa, Homo Sapiens
KETHFLSNP

SEQ ID NO: 201229 - protein, 9 aa, Homo Sapiens
ISTEFTPWK

SEQ ID NO: 201230 - protein, 9 aa, Homo Sapiens
SLLQRTRQA

SEQ ID NO: 201231 - protein, 9 aa, Homo Sapiens
VPERQGSIQ

SEQ ID NO: 201232 - protein, 9 aa, Homo Sapiens
KEEDVTHES

SEQ ID NO: 201233 - protein, 9 aa, Homo Sapiens
ACILVGVSF

SEQ ID NO: 201234 - protein, 9 aa, Homo Sapiens
TVVGSIGWA

SEQ ID NO: 201235 - protein, 9 aa, Homo Sapiens
QVPWARLGE

SEQ ID NO: 201236 - protein, 9 aa, Homo Sapiens
GSKPWASSL

SEQ ID NO: 201237 - protein, 9 aa, Homo Sapiens
ALLVDEFAL

SEQ ID NO: 201238 - protein, 9 aa, Homo Sapiens
PVDTLQEWA

SEQ ID NO: 201239 - protein, 9 aa, Homo Sapiens
TLNTFMNTE

SEQ ID NO: 201240 - protein, 9 aa, Homo Sapiens
LTPRGNSVI

SEQ ID NO: 201241 - protein, 9 aa, Homo Sapiens
VMSQTQQIL

SEQ ID NO: 201242 - protein, 9 aa, Homo Sapiens
LWLECVVAS

SEQ ID NO: 201243 - protein, 9 aa, Homo Sapiens
RGNPRGNTE

SEQ ID NO: 201244 - protein, 9 aa, Homo Sapiens
QLGTQRIFE

SEQ ID NO: 201245 - protein, 9 aa, Homo Sapiens
LSVFTGYEL

SEQ ID NO: 201246 - protein, 9 aa, Homo Sapiens
YQRAQDEVL

SEQ ID NO: 201247 - protein, 9 aa, Homo Sapiens
NSRTIGVLW

SEQ ID NO: 201248 - protein, 9 aa, Homo Sapiens
EYGVCENLQ

SEQ ID NO: 201249 - protein, 9 aa, Homo Sapiens
AWRVEKEAL

SEQ ID NO: 201250 - protein, 9 aa, Homo Sapiens
AKGDSCTDD

SEQ ID NO: 201251 - protein, 9 aa, Homo Sapiens
AKTDPTGLS

SEQ ID NO: 201252 - protein, 9 aa, Homo Sapiens
RTFRVLQAL

SEQ ID NO: 201253 - protein, 9 aa, Homo Sapiens
ASDIVGLRF

SEQ ID NO: 201254 - protein, 9 aa, Homo Sapiens
MRGLVVNAS

SEQ ID NO: 201255 - protein, 9 aa, Homo Sapiens
ILSILRSTV

SEQ ID NO: 201256 - protein, 9 aa, Homo Sapiens
GCGRLLQGP

SEQ ID NO: 201257 - protein, 9 aa, Homo Sapiens
QYTFPNTRN

SEQ ID NO: 201258 - protein, 9 aa, Homo Sapiens
LAMDTYSAP

SEQ ID NO: 201259 - protein, 9 aa, Homo Sapiens
ACPLPPPPA

SEQ ID NO: 201260 - protein, 9 aa, Homo Sapiens
LVLLAVTLV

SEQ ID NO: 201261 - protein, 9 aa, Homo Sapiens
WTTMVPGKD

SEQ ID NO: 201262 - protein, 9 aa, Homo Sapiens
PASHQRSSF

SEQ ID NO: 201263 - protein, 9 aa, Homo Sapiens
SSPTSPFQV

SEQ ID NO: 201264 - protein, 9 aa, Homo Sapiens
TDIVTMQVL

SEQ ID NO: 201265 - protein, 9 aa, Homo Sapiens
LGMPLKLGG

SEQ ID NO: 201266 - protein, 9 aa, Homo Sapiens
SKLWPQPLT

SEQ ID NO: 201267 - protein, 9 aa, Homo Sapiens
SMNPIIYAF

SEQ ID NO: 201268 - protein, 9 aa, Homo Sapiens
NEMLLVAAS

SEQ ID NO: 201269 - protein, 9 aa, Homo Sapiens
DIIYVLALT

SEQ ID NO: 201270 - protein, 9 aa, Homo Sapiens
PQPVDWNNE

SEQ ID NO: 201271 - protein, 9 aa, Homo Sapiens
PSMDGILDT

SEQ ID NO: 201272 - protein, 9 aa, Homo Sapiens
PPVLQAPAA

SEQ ID NO: 201273 - protein, 9 aa, Homo Sapiens
HPILGHFVA

SEQ ID NO: 201274 - protein, 9 aa, Homo Sapiens
SRHCRMLTP

SEQ ID NO: 201275 - protein, 9 aa, Homo Sapiens
HERIHTAFA

SEQ ID NO: 201276 - protein, 9 aa, Homo Sapiens
TQHRKSIFF

SEQ ID NO: 201277 - protein, 9 aa, Homo Sapiens
KSVVPPGEK

SEQ ID NO: 201278 - protein, 9 aa, Homo Sapiens
DGKSIAIHA

SEQ ID NO: 201279 - protein, 9 aa, Homo Sapiens
CRFNQDPKA

SEQ ID NO: 201280 - protein, 9 aa, Homo Sapiens
DVVAHAYYL

SEQ ID NO: 201281 - protein, 9 aa, Homo Sapiens
AMPDNASQE

SEQ ID NO: 201282 - protein, 9 aa, Homo Sapiens
DPHDGRRLV

SEQ ID NO: 201283 - protein, 9 aa, Homo Sapiens
FNATATFKA

SEQ ID NO: 201284 - protein, 9 aa, Homo Sapiens
CTERQCPGH

SEQ ID NO: 201285 - protein, 9 aa, Homo Sapiens
FAVGMRISA

SEQ ID NO: 201286 - protein, 9 aa, Homo Sapiens
EAPVSFFHA

SEQ ID NO: 201287 - protein, 9 aa, Homo Sapiens
EEEGGNVEK

SEQ ID NO: 201288 - protein, 9 aa, Homo Sapiens
DEVISTLKL

SEQ ID NO: 201289 - protein, 9 aa, Homo Sapiens
MAVALALPL

SEQ ID NO: 201290 - protein, 9 aa, Homo Sapiens
TVNWEDRSS

SEQ ID NO: 201291 - protein, 9 aa, Homo Sapiens
DSTPKFQAE

SEQ ID NO: 201292 - protein, 9 aa, Homo Sapiens
WFDDLPNLE

SEQ ID NO: 201293 - protein, 9 aa, Homo Sapiens
PPHEEFLNS

SEQ ID NO: 201294 - protein, 9 aa, Homo Sapiens
HHILFRYAG

SEQ ID NO: 201295 - protein, 9 aa, Homo Sapiens
PGPEGLLII

SEQ ID NO: 201296 - protein, 9 aa, Homo Sapiens
GQSQMAAKR

SEQ ID NO: 201297 - protein, 9 aa, Homo Sapiens
GLGFRVLGG

SEQ ID NO: 201298 - protein, 9 aa, Homo Sapiens
GPVVAITST

SEQ ID NO: 201299 - protein, 9 aa, Homo Sapiens
NQDSFTFYI

SEQ ID NO: 201300 - protein, 9 aa, Homo Sapiens
GCDRIPPVL

SEQ ID NO: 201301 - protein, 9 aa, Homo Sapiens
ICHIEECVR

SEQ ID NO: 201302 - protein, 9 aa, Homo Sapiens
VVHDYFEGS

SEQ ID NO: 201303 - protein, 9 aa, Homo Sapiens
PERKRASQT

SEQ ID NO: 201304 - protein, 9 aa, Homo Sapiens
LEHMSEVQS

SEQ ID NO: 201305 - protein, 9 aa, Homo Sapiens
NGALQMAIR

SEQ ID NO: 201306 - protein, 9 aa, Homo Sapiens
WGRRWPWPA

SEQ ID NO: 201307 - protein, 9 aa, Homo Sapiens
EPGKPVVTT

SEQ ID NO: 201308 - protein, 9 aa, Homo Sapiens
AESGEAVRH

SEQ ID NO: 201309 - protein, 9 aa, Homo Sapiens
TSTAAPCSL

SEQ ID NO: 201310 - protein, 9 aa, Homo Sapiens
EQSKDGNES

SEQ ID NO: 201311 - protein, 9 aa, Homo Sapiens
LSASLPDIV

SEQ ID NO: 201312 - protein, 9 aa, Homo Sapiens
GHPSSDVWK

SEQ ID NO: 201313 - protein, 9 aa, Homo Sapiens
LPEWTVWLI

SEQ ID NO: 201314 - protein, 9 aa, Homo Sapiens
EFTPWKHGG

SEQ ID NO: 201315 - protein, 9 aa, Homo Sapiens
LRCLFTVLP

SEQ ID NO: 201316 - protein, 9 aa, Homo Sapiens
LFSCTNIFY

SEQ ID NO: 201317 - protein, 9 aa, Homo Sapiens
LYAWGVTCS

SEQ ID NO: 201318 - protein, 9 aa, Homo Sapiens
KSSWAQQES

SEQ ID NO: 201319 - protein, 9 aa, Homo Sapiens
NPSRLYYID

SEQ ID NO: 201320 - protein, 9 aa, Homo Sapiens
INCKVKPRE

SEQ ID NO: 201321 - protein, 9 aa, Homo Sapiens
GGIFGGILV

SEQ ID NO: 201322 - protein, 9 aa, Homo Sapiens
LVVHTGAPY

SEQ ID NO: 201323 - protein, 9 aa, Homo Sapiens
ESVHARTVF

SEQ ID NO: 201324 - protein, 9 aa, Homo Sapiens
AGNQEVANN

SEQ ID NO: 201325 - protein, 9 aa, Homo Sapiens
GHVPFEAEN

SEQ ID NO: 201326 - protein, 9 aa, Homo Sapiens
CEKYVHGVR

SEQ ID NO: 201327 - protein, 9 aa, Homo Sapiens
HHHMHVPAI

SEQ ID NO: 201328 - protein, 9 aa, Homo Sapiens
NTEGSYDCA

SEQ ID NO: 201329 - protein, 9 aa, Homo Sapiens
MDNPSLAFI

SEQ ID NO: 201330 - protein, 9 aa, Homo Sapiens
DALWLECVV

SEQ ID NO: 201331 - protein, 9 aa, Homo Sapiens
SGPSEENFN

SEQ ID NO: 201332 - protein, 9 aa, Homo Sapiens
ALWGRTWRL

SEQ ID NO: 201333 - protein, 9 aa, Homo Sapiens
LVLTVASRA

SEQ ID NO: 201334 - protein, 9 aa, Homo Sapiens
RRRCPRGHH

SEQ ID NO: 201335 - protein, 9 aa, Homo Sapiens
HTPAEEMPE

SEQ ID NO: 201336 - protein, 9 aa, Homo Sapiens
APRLAPLLV

SEQ ID NO: 201337 - protein, 9 aa, Homo Sapiens
AAHHAEQTF

SEQ ID NO: 201338 - protein, 9 aa, Homo Sapiens
FYCTGRLHM

SEQ ID NO: 201339 - protein, 9 aa, Homo Sapiens
RQMPVDSPD

SEQ ID NO: 201340 - protein, 9 aa, Homo Sapiens
TFYHHIRQE

SEQ ID NO: 201341 - protein, 9 aa, Homo Sapiens
HYVQDVMEL

SEQ ID NO: 201342 - protein, 9 aa, Homo Sapiens
QGCAVLRTT

SEQ ID NO: 201343 - protein, 9 aa, Homo Sapiens
AYTQLVSLG

SEQ ID NO: 201344 - protein, 9 aa, Homo Sapiens
CVLYKSVSQ

SEQ ID NO: 201345 - protein, 9 aa, Homo Sapiens
ADSAHSFSP

SEQ ID NO: 201346 - protein, 9 aa, Homo Sapiens
QTSMGMHHR

SEQ ID NO: 201347 - protein, 9 aa, Homo Sapiens
DLGHVERIM

SEQ ID NO: 201348 - protein, 9 aa, Homo Sapiens
FYHHIRQEI

SEQ ID NO: 201349 - protein, 9 aa, Homo Sapiens
EVAAYLHGR

SEQ ID NO: 201350 - protein, 9 aa, Homo Sapiens
NGKKMLSLT

SEQ ID NO: 201351 - protein, 9 aa, Homo Sapiens
MWRIRQLLR

SEQ ID NO: 201352 - protein, 9 aa, Homo Sapiens
RCQRALPQH

SEQ ID NO: 201353 - protein, 9 aa, Homo Sapiens
NTLWPNLTV

SEQ ID NO: 201354 - protein, 9 aa, Homo Sapiens
LCLPGRECL

SEQ ID NO: 201355 - protein, 9 aa, Homo Sapiens
SNHRGSVVS

SEQ ID NO: 201356 - protein, 9 aa, Homo Sapiens
RIGPELSRH

SEQ ID NO: 201357 - protein, 9 aa, Homo Sapiens
KQDRDITLL

SEQ ID NO: 201358 - protein, 9 aa, Homo Sapiens
QVKKNQCIS

SEQ ID NO: 201359 - protein, 9 aa, Homo Sapiens
GPGESRKST

SEQ ID NO: 201360 - protein, 9 aa, Homo Sapiens
NRTPEFLCK

SEQ ID NO: 201361 - protein, 9 aa, Homo Sapiens
KAVFAATPK

SEQ ID NO: 201362 - protein, 9 aa, Homo Sapiens
DNTVLRNPP

SEQ ID NO: 201363 - protein, 9 aa, Homo Sapiens
FIQKLLVKE

SEQ ID NO: 201364 - protein, 9 aa, Homo Sapiens
WPSLEDLFN

SEQ ID NO: 201365 - protein, 9 aa, Homo Sapiens
PVVEKRVVL

SEQ ID NO: 201366 - protein, 9 aa, Homo Sapiens
CTMPLANHR

SEQ ID NO: 201367 - protein, 9 aa, Homo Sapiens
DKRLEQLGT

SEQ ID NO: 201368 - protein, 9 aa, Homo Sapiens
SNSGCGQTP

SEQ ID NO: 201369 - protein, 9 aa, Homo Sapiens
SGTFCACAM

SEQ ID NO: 201370 - protein, 9 aa, Homo Sapiens
WFCTYMWGV

SEQ ID NO: 201371 - protein, 9 aa, Homo Sapiens
PPQHRQDVL

SEQ ID NO: 201372 - protein, 9 aa, Homo Sapiens
PFLLLDKWD

SEQ ID NO: 201373 - protein, 9 aa, Homo Sapiens
LGSDLLVPY

SEQ ID NO: 201374 - protein, 9 aa, Homo Sapiens
AGDPRLAHA

SEQ ID NO: 201375 - protein, 9 aa, Homo Sapiens
ACSALLPGP

SEQ ID NO: 201376 - protein, 9 aa, Homo Sapiens
IWVENSIVQ

SEQ ID NO: 201377 - protein, 9 aa, Homo Sapiens
STYRLFPPR

SEQ ID NO: 201378 - protein, 9 aa, Homo Sapiens
NELELLMCS

SEQ ID NO: 201379 - protein, 9 aa, Homo Sapiens
IVDGTTAKD

SEQ ID NO: 201380 - protein, 9 aa, Homo Sapiens
ALWHTRDTE

SEQ ID NO: 201381 - protein, 9 aa, Homo Sapiens
LLDRVTNDM

SEQ ID NO: 201382 - protein, 9 aa, Homo Sapiens
DKGENAEVI

SEQ ID NO: 201383 - protein, 9 aa, Homo Sapiens
HQHSGEKRS

SEQ ID NO: 201384 - protein, 9 aa, Homo Sapiens
YIQYCCKFD

SEQ ID NO: 201385 - protein, 9 aa, Homo Sapiens
PPAVPQSQH

SEQ ID NO: 201386 - protein, 9 aa, Homo Sapiens
LCFSGVNDT

SEQ ID NO: 201387 - protein, 9 aa, Homo Sapiens
NSPEYQRLG

SEQ ID NO: 201388 - protein, 9 aa, Homo Sapiens
TCRLNRLPD

SEQ ID NO: 201389 - protein, 9 aa, Homo Sapiens
TLTGYQSLT

SEQ ID NO: 201390 - protein, 9 aa, Homo Sapiens
TGHVQLMRP

SEQ ID NO: 201391 - protein, 9 aa, Homo Sapiens
LLTQRGLSR

SEQ ID NO: 201392 - protein, 9 aa, Homo Sapiens
QNVHRPPRQ

SEQ ID NO: 201393 - protein, 9 aa, Homo Sapiens
EGKDSTHLM

SEQ ID NO: 201394 - protein, 9 aa, Homo Sapiens
FVESHYSKT

SEQ ID NO: 201395 - protein, 9 aa, Homo Sapiens
PPRECMHHM

SEQ ID NO: 201396 - protein, 9 aa, Homo Sapiens
RVGFEVATC

SEQ ID NO: 201397 - protein, 9 aa, Homo Sapiens
GLGLHPILG

SEQ ID NO: 201398 - protein, 9 aa, Homo Sapiens
HGVVTEFII

SEQ ID NO: 201399 - protein, 9 aa, Homo Sapiens
GHTLNLKAA

SEQ ID NO: 201400 - protein, 9 aa, Homo Sapiens
DHKIQEVYI

SEQ ID NO: 201401 - protein, 9 aa, Homo Sapiens
MVPGKDPMA

SEQ ID NO: 201402 - protein, 9 aa, Homo Sapiens
GRLEEVSFP

SEQ ID NO: 201403 - protein, 9 aa, Homo Sapiens
VLEAVCQEK

SEQ ID NO: 201404 - protein, 9 aa, Homo Sapiens
VADGLGETE

SEQ ID NO: 201405 - protein, 9 aa, Homo Sapiens
QAKCHIHQH

SEQ ID NO: 201406 - protein, 9 aa, Homo Sapiens
PPASPPQQA

SEQ ID NO: 201407 - protein, 9 aa, Homo Sapiens
QDFIFFVMP

SEQ ID NO: 201408 - protein, 9 aa, Homo Sapiens
LLKGDVDED

SEQ ID NO: 201409 - protein, 9 aa, Homo Sapiens
SVVPPGEKH

SEQ ID NO: 201410 - protein, 9 aa, Homo Sapiens
LGFATLWEH

SEQ ID NO: 201411 - protein, 9 aa, Homo Sapiens
MLLQNYIQN

SEQ ID NO: 201412 - protein, 9 aa, Homo Sapiens
QVPLILTPS

SEQ ID NO: 201413 - protein, 9 aa, Homo Sapiens
PLELQSTAV

SEQ ID NO: 201414 - protein, 9 aa, Homo Sapiens
LGFTDIVTM

SEQ ID NO: 201415 - protein, 9 aa, Homo Sapiens
RGLVSHTCY

SEQ ID NO: 201416 - protein, 9 aa, Homo Sapiens
QCLVTIVDK

SEQ ID NO: 201417 - protein, 9 aa, Homo Sapiens
LLRRPNDPV

SEQ ID NO: 201418 - protein, 9 aa, Homo Sapiens
DDEEEEAAA

SEQ ID NO: 201419 - protein, 9 aa, Homo Sapiens
DDDDEDGNY

SEQ ID NO: 201420 - protein, 9 aa, Homo Sapiens
AKAPVAKIS

SEQ ID NO: 201421 - protein, 9 aa, Homo Sapiens
NNSCTMCSL

SEQ ID NO: 201422 - protein, 9 aa, Homo Sapiens
YTVPATIIL

SEQ ID NO: 201423 - protein, 9 aa, Homo Sapiens
QDFISAIHR

SEQ ID NO: 201424 - protein, 9 aa, Homo Sapiens
MQIHFQASL

SEQ ID NO: 201425 - protein, 9 aa, Homo Sapiens
LQGHHTEKL

SEQ ID NO: 201426 - protein, 9 aa, Homo Sapiens
GRILSRYVR

SEQ ID NO: 201427 - protein, 9 aa, Homo Sapiens
ACIAVDCYL

SEQ ID NO: 201428 - protein, 9 aa, Homo Sapiens
GFKGDIRTI

SEQ ID NO: 201429 - protein, 9 aa, Homo Sapiens
GSGHVLVTG

SEQ ID NO: 201430 - protein, 9 aa, Homo Sapiens
RLWFEVHDI

SEQ ID NO: 201431 - protein, 9 aa, Homo Sapiens
EVQNHIKEI

SEQ ID NO: 201432 - protein, 9 aa, Homo Sapiens
EFCQQTCIK

SEQ ID NO: 201433 - protein, 9 aa, Homo Sapiens
SSTAMAQTV

SEQ ID NO: 201434 - protein, 9 aa, Homo Sapiens
IPLELQCLV

SEQ ID NO: 201435 - protein, 9 aa, Homo Sapiens
AEKCCQTNA

SEQ ID NO: 201436 - protein, 9 aa, Homo Sapiens
KLKDALTMV

SEQ ID NO: 201437 - protein, 9 aa, Homo Sapiens
ATERPSVGQ

SEQ ID NO: 201438 - protein, 9 aa, Homo Sapiens
SNEDPATPQ

SEQ ID NO: 201439 - protein, 9 aa, Homo Sapiens
ASQCEYEEL

SEQ ID NO: 201440 - protein, 9 aa, Homo Sapiens
STTVLRLLL

SEQ ID NO: 201441 - protein, 9 aa, Homo Sapiens
FWYVTCAIH

SEQ ID NO: 201442 - protein, 9 aa, Homo Sapiens
LRDWLEISL

SEQ ID NO: 201443 - protein, 9 aa, Homo Sapiens
CGKAFRVGS

SEQ ID NO: 201444 - protein, 9 aa, Homo Sapiens
AAEGKVVYS

SEQ ID NO: 201445 - protein, 9 aa, Homo Sapiens
SSIKVVKLV

SEQ ID NO: 201446 - protein, 9 aa, Homo Sapiens
KKLQKKKNK

SEQ ID NO: 201447 - protein, 9 aa, Homo Sapiens
IPPDECFGL

SEQ ID NO: 201448 - protein, 9 aa, Homo Sapiens
AFPPPECCR

SEQ ID NO: 201449 - protein, 9 aa, Homo Sapiens
QNAQHALRL

SEQ ID NO: 201450 - protein, 9 aa, Homo Sapiens
VGALGLPSM

SEQ ID NO: 201451 - protein, 9 aa, Homo Sapiens
WVQLSDEMF

SEQ ID NO: 201452 - protein, 9 aa, Homo Sapiens
VPQCDDLDH

SEQ ID NO: 201453 - protein, 9 aa, Homo Sapiens
SLPSHTPLL

SEQ ID NO: 201454 - protein, 9 aa, Homo Sapiens
KCSKRFCSM

SEQ ID NO: 201455 - protein, 9 aa, Homo Sapiens
FPVPALQAN

SEQ ID NO: 201456 - protein, 9 aa, Homo Sapiens
QERPIKKLG

SEQ ID NO: 201457 - protein, 9 aa, Homo Sapiens
TTARGVGLA

SEQ ID NO: 201458 - protein, 9 aa, Homo Sapiens
WGSLEEQLL

SEQ ID NO: 201459 - protein, 9 aa, Homo Sapiens
PSTIVWRPD

SEQ ID NO: 201460 - protein, 9 aa, Homo Sapiens
WLTSCYFFL

SEQ ID NO: 201461 - protein, 9 aa, Homo Sapiens
TWELMKEGF

SEQ ID NO: 201462 - protein, 9 aa, Homo Sapiens
FNYYFLEEK

SEQ ID NO: 201463 - protein, 9 aa, Homo Sapiens
AERLRLLKE

SEQ ID NO: 201464 - protein, 9 aa, Homo Sapiens
TLISDVPPG

SEQ ID NO: 201465 - protein, 9 aa, Homo Sapiens
SPLQCHAVG

SEQ ID NO: 201466 - protein, 9 aa, Homo Sapiens
EQLEHWERS

SEQ ID NO: 201467 - protein, 9 aa, Homo Sapiens
LSALKELEH

SEQ ID NO: 201468 - protein, 9 aa, Homo Sapiens
TWVNAHTYP

SEQ ID NO: 201469 - protein, 9 aa, Homo Sapiens
LAVNYSLGD

SEQ ID NO: 201470 - protein, 9 aa, Homo Sapiens
YGGTWELMK

SEQ ID NO: 201471 - protein, 9 aa, Homo Sapiens
KSCIYRELI

SEQ ID NO: 201472 - protein, 9 aa, Homo Sapiens
RPQILEALS

SEQ ID NO: 201473 - protein, 9 aa, Homo Sapiens
GDVHSLVLK

SEQ ID NO: 201474 - protein, 9 aa, Homo Sapiens
TEALVNNPR

SEQ ID NO: 201475 - protein, 9 aa, Homo Sapiens
LLIINTLPW

SEQ ID NO: 201476 - protein, 9 aa, Homo Sapiens
NDCNMTFVT

SEQ ID NO: 201477 - protein, 9 aa, Homo Sapiens
DSCMPPFEF

SEQ ID NO: 201478 - protein, 9 aa, Homo Sapiens
HLLPGIGGV

SEQ ID NO: 201479 - protein, 9 aa, Homo Sapiens
VGGQVPLRD

SEQ ID NO: 201480 - protein, 9 aa, Homo Sapiens
YIHTRYPHS

SEQ ID NO: 201481 - protein, 9 aa, Homo Sapiens
LSYYHLTRF

SEQ ID NO: 201482 - protein, 9 aa, Homo Sapiens
NAEVIYTIE

SEQ ID NO: 201483 - protein, 9 aa, Homo Sapiens
EAVCQEKQK

SEQ ID NO: 201484 - protein, 9 aa, Homo Sapiens
GLGLCGGSS

SEQ ID NO: 201485 - protein, 9 aa, Homo Sapiens
MEAERRHQA

SEQ ID NO: 201486 - protein, 9 aa, Homo Sapiens
VLKGPSRLP

SEQ ID NO: 201487 - protein, 9 aa, Homo Sapiens
VVHTGAPYR

SEQ ID NO: 201488 - protein, 9 aa, Homo Sapiens
AIFICNYVP

SEQ ID NO: 201489 - protein, 9 aa, Homo Sapiens
VSLTSFLFP

SEQ ID NO: 201490 - protein, 9 aa, Homo Sapiens
SSSYWIGPV

SEQ ID NO: 201491 - protein, 9 aa, Homo Sapiens
WSLIGNLQL

SEQ ID NO: 201492 - protein, 9 aa, Homo Sapiens
PGLGSVTLG

SEQ ID NO: 201493 - protein, 9 aa, Homo Sapiens
GDVVAHAYY

SEQ ID NO: 201494 - protein, 9 aa, Homo Sapiens
GRRLVVRFT

SEQ ID NO: 201495 - protein, 9 aa, Homo Sapiens
SDKCREIAQ

SEQ ID NO: 201496 - protein, 9 aa, Homo Sapiens
YKVYMVPME

SEQ ID NO: 201497 - protein, 9 aa, Homo Sapiens
WPGQPHRGA

SEQ ID NO: 201498 - protein, 9 aa, Homo Sapiens
GYAHVLTPH

SEQ ID NO: 201499 - protein, 9 aa, Homo Sapiens
GRRGGDGLY

SEQ ID NO: 201500 - protein, 9 aa, Homo Sapiens
TGPQSGEGF

SEQ ID NO: 201501 - protein, 9 aa, Homo Sapiens
CLQGLGEGG

SEQ ID NO: 201502 - protein, 9 aa, Homo Sapiens
MIFSSSACD

SEQ ID NO: 201503 - protein, 9 aa, Homo Sapiens
VLLSSVDKR

SEQ ID NO: 201504 - protein, 9 aa, Homo Sapiens
VLWNEKCHD

SEQ ID NO: 201505 - protein, 9 aa, Homo Sapiens
FWPLLVGRQ

SEQ ID NO: 201506 - protein, 9 aa, Homo Sapiens
LPAVAHEGN

SEQ ID NO: 201507 - protein, 9 aa, Homo Sapiens
LRYLQWWCR

SEQ ID NO: 201508 - protein, 9 aa, Homo Sapiens
SEPQHMASI

SEQ ID NO: 201509 - protein, 9 aa, Homo Sapiens
WDPRFDDLS

SEQ ID NO: 201510 - protein, 9 aa, Homo Sapiens
MHYGQHPNI

SEQ ID NO: 201511 - protein, 9 aa, Homo Sapiens
LLWPSLEDL

SEQ ID NO: 201512 - protein, 9 aa, Homo Sapiens
KVHKCIFCS

SEQ ID NO: 201513 - protein, 9 aa, Homo Sapiens
NLTAPRPHT

SEQ ID NO: 201514 - protein, 9 aa, Homo Sapiens
WVLPSSRDS

SEQ ID NO: 201515 - protein, 9 aa, Homo Sapiens
DSAQGTEDT

SEQ ID NO: 201516 - protein, 9 aa, Homo Sapiens
ASQGHFQAQ

SEQ ID NO: 201517 - protein, 9 aa, Homo Sapiens
PHAYCPFQG

SEQ ID NO: 201518 - protein, 9 aa, Homo Sapiens
RWPRLQRQE

SEQ ID NO: 201519 - protein, 9 aa, Homo Sapiens
IGIDFDRLT

SEQ ID NO: 201520 - protein, 9 aa, Homo Sapiens
YMDLEEFCQ

SEQ ID NO: 201521 - protein, 9 aa, Homo Sapiens
PVPQPPMES

SEQ ID NO: 201522 - protein, 9 aa, Homo Sapiens
VFDVVVNPG

SEQ ID NO: 201523 - protein, 9 aa, Homo Sapiens
VCSPLLRQS

SEQ ID NO: 201524 - protein, 9 aa, Homo Sapiens
VAITSTWNS

SEQ ID NO: 201525 - protein, 9 aa, Homo Sapiens
QSRAQMLLD

SEQ ID NO: 201526 - protein, 9 aa, Homo Sapiens
LQSLPRGTK

SEQ ID NO: 201527 - protein, 9 aa, Homo Sapiens
CKELQRVGL

SEQ ID NO: 201528 - protein, 9 aa, Homo Sapiens
VEEAERASA

SEQ ID NO: 201529 - protein, 9 aa, Homo Sapiens
WTTVGSKFR

SEQ ID NO: 201530 - protein, 9 aa, Homo Sapiens
METELALKY

SEQ ID NO: 201531 - protein, 9 aa, Homo Sapiens
FPTLNTFMN

SEQ ID NO: 201532 - protein, 9 aa, Homo Sapiens
EMLLKIRES

SEQ ID NO: 201533 - protein, 9 aa, Homo Sapiens
QTSSKTAFY

SEQ ID NO: 201534 - protein, 9 aa, Homo Sapiens
VAALVFEQS

SEQ ID NO: 201535 - protein, 9 aa, Homo Sapiens
YSMHTLYGS

SEQ ID NO: 201536 - protein, 9 aa, Homo Sapiens
SMTANWLSA

SEQ ID NO: 201537 - protein, 9 aa, Homo Sapiens
DLGGDFWYV

SEQ ID NO: 201538 - protein, 9 aa, Homo Sapiens
KLLRRPNDP

SEQ ID NO: 201539 - protein, 9 aa, Homo Sapiens
ASNLMTGLP

SEQ ID NO: 201540 - protein, 9 aa, Homo Sapiens
KAFRNQSML

SEQ ID NO: 201541 - protein, 9 aa, Homo Sapiens
TSTEVSLCT

SEQ ID NO: 201542 - protein, 9 aa, Homo Sapiens
EDVTHESRF

SEQ ID NO: 201543 - protein, 9 aa, Homo Sapiens
DLHSGNIAL

SEQ ID NO: 201544 - protein, 9 aa, Homo Sapiens
AREDAAEPG

SEQ ID NO: 201545 - protein, 9 aa, Homo Sapiens
GRSCSMVVL

SEQ ID NO: 201546 - protein, 9 aa, Homo Sapiens
VIEDYVQYL

SEQ ID NO: 201547 - protein, 9 aa, Homo Sapiens
KLPLLIEDL

SEQ ID NO: 201548 - protein, 9 aa, Homo Sapiens
KTCTNYSKD

SEQ ID NO: 201549 - protein, 9 aa, Homo Sapiens
EEPVLTLVG

SEQ ID NO: 201550 - protein, 9 aa, Homo Sapiens
AQAQLQLLQ

SEQ ID NO: 201551 - protein, 9 aa, Homo Sapiens
ESVWPKKIN

SEQ ID NO: 201552 - protein, 9 aa, Homo Sapiens
HVPFEAENE

SEQ ID NO: 201553 - protein, 9 aa, Homo Sapiens
ETEGSYTLS

SEQ ID NO: 201554 - protein, 9 aa, Homo Sapiens
FLFHTGQHA

SEQ ID NO: 201555 - protein, 9 aa, Homo Sapiens
TYSVHWSET

SEQ ID NO: 201556 - protein, 9 aa, Homo Sapiens
RAQMSIISA

SEQ ID NO: 201557 - protein, 9 aa, Homo Sapiens
VKAVFWLCV

SEQ ID NO: 201558 - protein, 9 aa, Homo Sapiens
LAFLASWLT

SEQ ID NO: 201559 - protein, 9 aa, Homo Sapiens
GTSEQETKD

SEQ ID NO: 201560 - protein, 9 aa, Homo Sapiens
ATRPFAHLN

SEQ ID NO: 201561 - protein, 9 aa, Homo Sapiens
GHKKIHTGD

SEQ ID NO: 201562 - protein, 9 aa, Homo Sapiens
VRFYCYTER

SEQ ID NO: 201563 - protein, 9 aa, Homo Sapiens
SGPDFMDHP

SEQ ID NO: 201564 - protein, 9 aa, Homo Sapiens
VRGLMLPGA

SEQ ID NO: 201565 - protein, 9 aa, Homo Sapiens
KETVSILKH

SEQ ID NO: 201566 - protein, 9 aa, Homo Sapiens
KEDALQFLI

SEQ ID NO: 201567 - protein, 9 aa, Homo Sapiens
EHGKAFHQG

SEQ ID NO: 201568 - protein, 9 aa, Homo Sapiens
EPPSLGTHA

SEQ ID NO: 201569 - protein, 9 aa, Homo Sapiens
EHFAVEMKC

SEQ ID NO: 201570 - protein, 9 aa, Homo Sapiens
TAHTLVPGA

SEQ ID NO: 201571 - protein, 9 aa, Homo Sapiens
TILDVSFNR

SEQ ID NO: 201572 - protein, 9 aa, Homo Sapiens
DLTAALSNY

SEQ ID NO: 201573 - protein, 9 aa, Homo Sapiens
HSLVLKALF

SEQ ID NO: 201574 - protein, 9 aa, Homo Sapiens
CTTDHNVSP

SEQ ID NO: 201575 - protein, 9 aa, Homo Sapiens
ARVEIQNHW

SEQ ID NO: 201576 - protein, 9 aa, Homo Sapiens
SGWMGMTGP

SEQ ID NO: 201577 - protein, 9 aa, Homo Sapiens
LFQMEPSPH

SEQ ID NO: 201578 - protein, 9 aa, Homo Sapiens
SIWDIAGRE

SEQ ID NO: 201579 - protein, 9 aa, Homo Sapiens
QQQSALKVL

SEQ ID NO: 201580 - protein, 9 aa, Homo Sapiens
ISGSIHYSS

SEQ ID NO: 201581 - protein, 9 aa, Homo Sapiens
GEYMCLAGN

SEQ ID NO: 201582 - protein, 9 aa, Homo Sapiens
PHHCRVPLS

SEQ ID NO: 201583 - protein, 9 aa, Homo Sapiens
DAASEAKSP

SEQ ID NO: 201584 - protein, 9 aa, Homo Sapiens
AGLRARFTI

SEQ ID NO: 201585 - protein, 9 aa, Homo Sapiens
CLSSRPSGH

SEQ ID NO: 201586 - protein, 9 aa, Homo Sapiens
FVKLSYSVR

SEQ ID NO: 201587 - protein, 9 aa, Homo Sapiens
GIQVVEHAC

SEQ ID NO: 201588 - protein, 9 aa, Homo Sapiens
EDEASHLLA

SEQ ID NO: 201589 - protein, 9 aa, Homo Sapiens
ADLQTLLRS

SEQ ID NO: 201590 - protein, 9 aa, Homo Sapiens
ARVVVVLSF

SEQ ID NO: 201591 - protein, 9 aa, Homo Sapiens
QTFNYYFLE

SEQ ID NO: 201592 - protein, 9 aa, Homo Sapiens
FLANGAKGT

SEQ ID NO: 201593 - protein, 9 aa, Homo Sapiens
SWDKAVQAL

SEQ ID NO: 201594 - protein, 9 aa, Homo Sapiens
NEKLHNTAP

SEQ ID NO: 201595 - protein, 9 aa, Homo Sapiens
GPCRASFPH

SEQ ID NO: 201596 - protein, 9 aa, Homo Sapiens
IFSEGGFLM

SEQ ID NO: 201597 - protein, 9 aa, Homo Sapiens
RTICREDLI

SEQ ID NO: 201598 - protein, 9 aa, Homo Sapiens
AMNNKNARL

SEQ ID NO: 201599 - protein, 9 aa, Homo Sapiens
QQDNGSVHK

SEQ ID NO: 201600 - protein, 9 aa, Homo Sapiens
DCDGRGMGC

SEQ ID NO: 201601 - protein, 9 aa, Homo Sapiens
RRGGAKPPW

SEQ ID NO: 201602 - protein, 9 aa, Homo Sapiens
GCTVPLPPH

SEQ ID NO: 201603 - protein, 9 aa, Homo Sapiens
DVADYIIPA

SEQ ID NO: 201604 - protein, 9 aa, Homo Sapiens
PHIAQKIKR

SEQ ID NO: 201605 - protein, 9 aa, Homo Sapiens
IGRCLHTLP

SEQ ID NO: 201606 - protein, 9 aa, Homo Sapiens
TERQCPGHC

SEQ ID NO: 201607 - protein, 9 aa, Homo Sapiens
REYLCPPWV

SEQ ID NO: 201608 - protein, 9 aa, Homo Sapiens
DEFNCIDLP

SEQ ID NO: 201609 - protein, 9 aa, Homo Sapiens
FTTPKYASL

SEQ ID NO: 201610 - protein, 9 aa, Homo Sapiens
VHTGAPYRL

SEQ ID NO: 201611 - protein, 9 aa, Homo Sapiens
QGKCVENIN

SEQ ID NO: 201612 - protein, 9 aa, Homo Sapiens
GQSNCYRGG

SEQ ID NO: 201613 - protein, 9 aa, Homo Sapiens
SASLVSADE

SEQ ID NO: 201614 - protein, 9 aa, Homo Sapiens
ASQTYEKEE

SEQ ID NO: 201615 - protein, 9 aa, Homo Sapiens
TQLAPTLPT

SEQ ID NO: 201616 - protein, 9 aa, Homo Sapiens
TSGEGARPW

SEQ ID NO: 201617 - protein, 9 aa, Homo Sapiens
DQTLQEREA

SEQ ID NO: 201618 - protein, 9 aa, Homo Sapiens
ASVKEGDRI

SEQ ID NO: 201619 - protein, 9 aa, Homo Sapiens
VYTQHRKSI

SEQ ID NO: 201620 - protein, 9 aa, Homo Sapiens
KIGGVSLTS

SEQ ID NO: 201621 - protein, 9 aa, Homo Sapiens
DLMSARMSN

SEQ ID NO: 201622 - protein, 9 aa, Homo Sapiens
RMDRIVEMF

SEQ ID NO: 201623 - protein, 9 aa, Homo Sapiens
LWSLVEYSQ

SEQ ID NO: 201624 - protein, 9 aa, Homo Sapiens
SLKKNAFRL

SEQ ID NO: 201625 - protein, 9 aa, Homo Sapiens
STSPASMRD

SEQ ID NO: 201626 - protein, 9 aa, Homo Sapiens
YAESIDRTM

SEQ ID NO: 201627 - protein, 9 aa, Homo Sapiens
KHMNVTHSH

SEQ ID NO: 201628 - protein, 9 aa, Homo Sapiens
VASKLPLLI

SEQ ID NO: 201629 - protein, 9 aa, Homo Sapiens
CQVVELAVK

SEQ ID NO: 201630 - protein, 9 aa, Homo Sapiens
LKLAGWQCP

SEQ ID NO: 201631 - protein, 9 aa, Homo Sapiens
PQGLILNVT

SEQ ID NO: 201632 - protein, 9 aa, Homo Sapiens
QPVLYWCAH

SEQ ID NO: 201633 - protein, 9 aa, Homo Sapiens
LGFVPRNSQ

SEQ ID NO: 201634 - protein, 9 aa, Homo Sapiens
TNIQTLDHP

SEQ ID NO: 201635 - protein, 9 aa, Homo Sapiens
MDIMGEDED

SEQ ID NO: 201636 - protein, 9 aa, Homo Sapiens
KHNMRGQHC

SEQ ID NO: 201637 - protein, 9 aa, Homo Sapiens
GRASGFTGS

SEQ ID NO: 201638 - protein, 9 aa, Homo Sapiens
LRLRKGSAS

SEQ ID NO: 201639 - protein, 9 aa, Homo Sapiens
NLVVLPDSL

SEQ ID NO: 201640 - protein, 9 aa, Homo Sapiens
CRQASEKED

SEQ ID NO: 201641 - protein, 9 aa, Homo Sapiens
ALLFPLKEE

SEQ ID NO: 201642 - protein, 9 aa, Homo Sapiens
CRLSQYPNE

SEQ ID NO: 201643 - protein, 9 aa, Homo Sapiens
CSFHEQRSH

SEQ ID NO: 201644 - protein, 9 aa, Homo Sapiens
GRKRGHWAP

SEQ ID NO: 201645 - protein, 9 aa, Homo Sapiens
CIAAQKSRQ

SEQ ID NO: 201646 - protein, 9 aa, Homo Sapiens
EEVILEGCV

SEQ ID NO: 201647 - protein, 9 aa, Homo Sapiens
QHPFQNLLK

SEQ ID NO: 201648 - protein, 9 aa, Homo Sapiens
GENPYRCED

SEQ ID NO: 201649 - protein, 9 aa, Homo Sapiens
ILRFLCARD

SEQ ID NO: 201650 - protein, 9 aa, Homo Sapiens
EEPLRDWLE

SEQ ID NO: 201651 - protein, 9 aa, Homo Sapiens
KSQLWLHLR

SEQ ID NO: 201652 - protein, 9 aa, Homo Sapiens
LPNDITGQG

SEQ ID NO: 201653 - protein, 9 aa, Homo Sapiens
FTEGKDKIT

SEQ ID NO: 201654 - protein, 9 aa, Homo Sapiens
GSTYSQHNE

SEQ ID NO: 201655 - protein, 9 aa, Homo Sapiens
CPVSSPMNP

SEQ ID NO: 201656 - protein, 9 aa, Homo Sapiens
LGRRLGISC

SEQ ID NO: 201657 - protein, 9 aa, Homo Sapiens
RNPRTNIKR

SEQ ID NO: 201658 - protein, 9 aa, Homo Sapiens
SSRSVIMDT

SEQ ID NO: 201659 - protein, 9 aa, Homo Sapiens
KRQFQLRRC

SEQ ID NO: 201660 - protein, 9 aa, Homo Sapiens
EPPDGDWGW

SEQ ID NO: 201661 - protein, 9 aa, Homo Sapiens
DIQVSAAAT

SEQ ID NO: 201662 - protein, 9 aa, Homo Sapiens
SARKTMTPI

SEQ ID NO: 201663 - protein, 9 aa, Homo Sapiens
TRFTGYQLR

SEQ ID NO: 201664 - protein, 9 aa, Homo Sapiens
SPATSRATG

SEQ ID NO: 201665 - protein, 9 aa, Homo Sapiens
VEARARAWA

SEQ ID NO: 201666 - protein, 9 aa, Homo Sapiens
WEPRCPKSL

SEQ ID NO: 201667 - protein, 9 aa, Homo Sapiens
MISIVKYLL

SEQ ID NO: 201668 - protein, 9 aa, Homo Sapiens
IEEDFQDGL

SEQ ID NO: 201669 - protein, 9 aa, Homo Sapiens
AQRVANFAV

SEQ ID NO: 201670 - protein, 9 aa, Homo Sapiens
TAYTKEDVD

SEQ ID NO: 201671 - protein, 9 aa, Homo Sapiens
TTSSTAMAQ

SEQ ID NO: 201672 - protein, 9 aa, Homo Sapiens
TYEMLLKIR

SEQ ID NO: 201673 - protein, 9 aa, Homo Sapiens
ISTLYWKVW

SEQ ID NO: 201674 - protein, 9 aa, Homo Sapiens
HQRSSFNFE

SEQ ID NO: 201675 - protein, 9 aa, Homo Sapiens
MSTLTCHHR

SEQ ID NO: 201676 - protein, 9 aa, Homo Sapiens
AMDSSRLHR

SEQ ID NO: 201677 - protein, 9 aa, Homo Sapiens
SSRDWDRNL

SEQ ID NO: 201678 - protein, 9 aa, Homo Sapiens
LEISLLTEN

SEQ ID NO: 201679 - protein, 9 aa, Homo Sapiens
THAQCSSWW

SEQ ID NO: 201680 - protein, 9 aa, Homo Sapiens
CCICQQARL

SEQ ID NO: 201681 - protein, 9 aa, Homo Sapiens
TICREDLIS

SEQ ID NO: 201682 - protein, 9 aa, Homo Sapiens
EPGLGSVTL

SEQ ID NO: 201683 - protein, 9 aa, Homo Sapiens
DTGTAHAIQ

SEQ ID NO: 201684 - protein, 9 aa, Homo Sapiens
TTSTAAPCS

SEQ ID NO: 201685 - protein, 9 aa, Homo Sapiens
TTSAGGNTA

SEQ ID NO: 201686 - protein, 9 aa, Homo Sapiens
LLMCSLGDV

SEQ ID NO: 201687 - protein, 9 aa, Homo Sapiens
NYISNHALA

SEQ ID NO: 201688 - protein, 9 aa, Homo Sapiens
RDITLLDLI

SEQ ID NO: 201689 - protein, 9 aa, Homo Sapiens
CLPGRECLW

SEQ ID NO: 201690 - protein, 9 aa, Homo Sapiens
RVSGLIYEE

SEQ ID NO: 201691 - protein, 9 aa, Homo Sapiens
AMRNFLQKS

SEQ ID NO: 201692 - protein, 9 aa, Homo Sapiens
QAKRMDEQQ

SEQ ID NO: 201693 - protein, 9 aa, Homo Sapiens
DLTETGTDL

SEQ ID NO: 201694 - protein, 9 aa, Homo Sapiens
SLWPAKSVP

SEQ ID NO: 201695 - protein, 9 aa, Homo Sapiens
VLGVAPMGQ

SEQ ID NO: 201696 - protein, 9 aa, Homo Sapiens
SVQASSSGQ

SEQ ID NO: 201697 - protein, 9 aa, Homo Sapiens
AEEGTRGWW

SEQ ID NO: 201698 - protein, 9 aa, Homo Sapiens
ECGKFFSWH

SEQ ID NO: 201699 - protein, 9 aa, Homo Sapiens
PWMPCTHTD

SEQ ID NO: 201700 - protein, 9 aa, Homo Sapiens
LGYCHGEAV

SEQ ID NO: 201701 - protein, 9 aa, Homo Sapiens
WAQLKNLFL

SEQ ID NO: 201702 - protein, 9 aa, Homo Sapiens
YYQPGIPTL

SEQ ID NO: 201703 - protein, 9 aa, Homo Sapiens
SSNYQTMFR

SEQ ID NO: 201704 - protein, 9 aa, Homo Sapiens
HADSMCKAS

SEQ ID NO: 201705 - protein, 9 aa, Homo Sapiens
SPKEAKAPV

SEQ ID NO: 201706 - protein, 9 aa, Homo Sapiens
MVFLDEPTT

SEQ ID NO: 201707 - protein, 9 aa, Homo Sapiens
DSIFRWLWQ

SEQ ID NO: 201708 - protein, 9 aa, Homo Sapiens
DSLSHLRSP

SEQ ID NO: 201709 - protein, 9 aa, Homo Sapiens
DNPSGSHKV

SEQ ID NO: 201710 - protein, 9 aa, Homo Sapiens
HCMHILLGL

SEQ ID NO: 201711 - protein, 9 aa, Homo Sapiens
TCLCNQYRC

SEQ ID NO: 201712 - protein, 9 aa, Homo Sapiens
SDEWPRWPG

SEQ ID NO: 201713 - protein, 9 aa, Homo Sapiens
ACMTSFHRF

SEQ ID NO: 201714 - protein, 9 aa, Homo Sapiens
QDLTETGTD

SEQ ID NO: 201715 - protein, 9 aa, Homo Sapiens
HILRFLCAR

SEQ ID NO: 201716 - protein, 9 aa, Homo Sapiens
RSLSKRIMQ

SEQ ID NO: 201717 - protein, 9 aa, Homo Sapiens
VFRGIQVVE

SEQ ID NO: 201718 - protein, 9 aa, Homo Sapiens
VMSEENSTG

SEQ ID NO: 201719 - protein, 9 aa, Homo Sapiens
EEGIGYDFW

SEQ ID NO: 201720 - protein, 9 aa, Homo Sapiens
PMGQGGPRF

SEQ ID NO: 201721 - protein, 9 aa, Homo Sapiens
QVTNQMLSF

SEQ ID NO: 201722 - protein, 9 aa, Homo Sapiens
SNPPAAADL

SEQ ID NO: 201723 - protein, 9 aa, Homo Sapiens
VEESKFLAV

SEQ ID NO: 201724 - protein, 9 aa, Homo Sapiens
FTPYSHGNV

SEQ ID NO: 201725 - protein, 9 aa, Homo Sapiens
TNLAMCLAP

SEQ ID NO: 201726 - protein, 9 aa, Homo Sapiens
VVKVYLEWI

SEQ ID NO: 201727 - protein, 9 aa, Homo Sapiens
MSRTCGNQD

SEQ ID NO: 201728 - protein, 9 aa, Homo Sapiens
DEMGLGKTM

SEQ ID NO: 201729 - protein, 9 aa, Homo Sapiens
EPWEPPGLI

SEQ ID NO: 201730 - protein, 9 aa, Homo Sapiens
TDLRQYMDK

SEQ ID NO: 201731 - protein, 9 aa, Homo Sapiens
ELYTWDNSM

SEQ ID NO: 201732 - protein, 9 aa, Homo Sapiens
EYIQYCCKF

SEQ ID NO: 201733 - protein, 9 aa, Homo Sapiens
SSLPPLLMP

SEQ ID NO: 201734 - protein, 9 aa, Homo Sapiens
SDEIQMALF

SEQ ID NO: 201735 - protein, 9 aa, Homo Sapiens
QAQNTATLA

SEQ ID NO: 201736 - protein, 9 aa, Homo Sapiens
ENIEVEERE

SEQ ID NO: 201737 - protein, 9 aa, Homo Sapiens
ESLGWTDFL

SEQ ID NO: 201738 - protein, 9 aa, Homo Sapiens
SLDRAGAEH

SEQ ID NO: 201739 - protein, 9 aa, Homo Sapiens
LHHLFLCYQ

SEQ ID NO: 201740 - protein, 9 aa, Homo Sapiens
HHTVISVRD

SEQ ID NO: 201741 - protein, 9 aa, Homo Sapiens
LRLLVYTPE

SEQ ID NO: 201742 - protein, 9 aa, Homo Sapiens
SPEEFINFV

SEQ ID NO: 201743 - protein, 9 aa, Homo Sapiens
TQRGLSRSV

SEQ ID NO: 201744 - protein, 9 aa, Homo Sapiens
SNSKEREIR

SEQ ID NO: 201745 - protein, 9 aa, Homo Sapiens
APQAGNRTP

SEQ ID NO: 201746 - protein, 9 aa, Homo Sapiens
QERVTISGA

SEQ ID NO: 201747 - protein, 9 aa, Homo Sapiens
PEGSTTSGG

SEQ ID NO: 201748 - protein, 9 aa, Homo Sapiens
KKSRTMTTK

SEQ ID NO: 201749 - protein, 9 aa, Homo Sapiens
SSSEDCLQQ

SEQ ID NO: 201750 - protein, 9 aa, Homo Sapiens
HTGEMSYKC

SEQ ID NO: 201751 - protein, 9 aa, Homo Sapiens
ARLPAGPRG

SEQ ID NO: 201752 - protein, 9 aa, Homo Sapiens
TVWLILAVI

SEQ ID NO: 201753 - protein, 9 aa, Homo Sapiens
CARECESRI

SEQ ID NO: 201754 - protein, 9 aa, Homo Sapiens
SAQLDSEEM

SEQ ID NO: 201755 - protein, 9 aa, Homo Sapiens
KISPDLPDI

SEQ ID NO: 201756 - protein, 9 aa, Homo Sapiens
RPWGIIHVY

SEQ ID NO: 201757 - protein, 9 aa, Homo Sapiens
FEEVQRLWF

SEQ ID NO: 201758 - protein, 9 aa, Homo Sapiens
HMSTLTCHH

SEQ ID NO: 201759 - protein, 9 aa, Homo Sapiens
LQQTTGCSQ

SEQ ID NO: 201760 - protein, 9 aa, Homo Sapiens
SQGSTVRSK

SEQ ID NO: 201761 - protein, 9 aa, Homo Sapiens
TGVSGVTIL

SEQ ID NO: 201762 - protein, 9 aa, Homo Sapiens
PDPHIPCTP

SEQ ID NO: 201763 - protein, 9 aa, Homo Sapiens
ALESWLPWN

SEQ ID NO: 201764 - protein, 9 aa, Homo Sapiens
FHPGTPSLH

SEQ ID NO: 201765 - protein, 9 aa, Homo Sapiens
SGQVLGGEV

SEQ ID NO: 201766 - protein, 9 aa, Homo Sapiens
AGFLPWIIK

SEQ ID NO: 201767 - protein, 9 aa, Homo Sapiens
CAPSVVHDY

SEQ ID NO: 201768 - protein, 9 aa, Homo Sapiens
VLKALFLRD

SEQ ID NO: 201769 - protein, 9 aa, Homo Sapiens
ELSGLWTQV

SEQ ID NO: 201770 - protein, 9 aa, Homo Sapiens
YYESIHGWP

SEQ ID NO: 201771 - protein, 9 aa, Homo Sapiens
SRGHTLNLK

SEQ ID NO: 201772 - protein, 9 aa, Homo Sapiens
HYPDSDKCR

SEQ ID NO: 201773 - protein, 9 aa, Homo Sapiens
APVSFFHAE

SEQ ID NO: 201774 - protein, 9 aa, Homo Sapiens
FPPSLLSCD

SEQ ID NO: 201775 - protein, 9 aa, Homo Sapiens
GMHFIMSPP

SEQ ID NO: 201776 - protein, 9 aa, Homo Sapiens
PQSPAEEEN

SEQ ID NO: 201777 - protein, 9 aa, Homo Sapiens
SFPSVELFP

SEQ ID NO: 201778 - protein, 9 aa, Homo Sapiens
STTEPCKPC

SEQ ID NO: 201779 - protein, 9 aa, Homo Sapiens
SSVLGLARC

SEQ ID NO: 201780 - protein, 9 aa, Homo Sapiens
EQLLEFMYQ

SEQ ID NO: 201781 - protein, 9 aa, Homo Sapiens
ICFSTSTPG

SEQ ID NO: 201782 - protein, 9 aa, Homo Sapiens
TTTEDNVKK

SEQ ID NO: 201783 - protein, 9 aa, Homo Sapiens
KENVVQKTQ

SEQ ID NO: 201784 - protein, 9 aa, Homo Sapiens
QRHKFCPLL

SEQ ID NO: 201785 - protein, 9 aa, Homo Sapiens
LLFVGSSLA

SEQ ID NO: 201786 - protein, 9 aa, Homo Sapiens
PSPHNQRKA

SEQ ID NO: 201787 - protein, 9 aa, Homo Sapiens
LLLIWNDGK

SEQ ID NO: 201788 - protein, 9 aa, Homo Sapiens
QMYFVFMFM

SEQ ID NO: 201789 - protein, 9 aa, Homo Sapiens
AEPRPLEPY

SEQ ID NO: 201790 - protein, 9 aa, Homo Sapiens
LSMGEEPVP

SEQ ID NO: 201791 - protein, 9 aa, Homo Sapiens
ARRCTRKFG

SEQ ID NO: 201792 - protein, 9 aa, Homo Sapiens
LQALKTISV

SEQ ID NO: 201793 - protein, 9 aa, Homo Sapiens
RASGFTGSM

SEQ ID NO: 201794 - protein, 9 aa, Homo Sapiens
ECPPGCPEA

SEQ ID NO: 201795 - protein, 9 aa, Homo Sapiens
QPCSLLVYQ

SEQ ID NO: 201796 - protein, 9 aa, Homo Sapiens
HLHLEPSPP

SEQ ID NO: 201797 - protein, 9 aa, Homo Sapiens
EIMESIKCL

SEQ ID NO: 201798 - protein, 9 aa, Homo Sapiens
CNEKLHNTA

SEQ ID NO: 201799 - protein, 9 aa, Homo Sapiens
ICYHICSHC

SEQ ID NO: 201800 - protein, 9 aa, Homo Sapiens
YVIRGGPNG

SEQ ID NO: 201801 - protein, 9 aa, Homo Sapiens
RFTRQMPVD

SEQ ID NO: 201802 - protein, 9 aa, Homo Sapiens
EGKSYDYNE

SEQ ID NO: 201803 - protein, 9 aa, Homo Sapiens
RQQWTYEQR

SEQ ID NO: 201804 - protein, 9 aa, Homo Sapiens
VDSATVFNI

SEQ ID NO: 201805 - protein, 9 aa, Homo Sapiens
RMRVEHFMN

SEQ ID NO: 201806 - protein, 9 aa, Homo Sapiens
SSRKECDRQ

SEQ ID NO: 201807 - protein, 9 aa, Homo Sapiens
YQWQRRGSL

SEQ ID NO: 201808 - protein, 9 aa, Homo Sapiens
ILMAVVPLT

SEQ ID NO: 201809 - protein, 9 aa, Homo Sapiens
TSMEEHVIP

SEQ ID NO: 201810 - protein, 9 aa, Homo Sapiens
ENLQKLEIT

SEQ ID NO: 201811 - protein, 9 aa, Homo Sapiens
LRGLLHTML

SEQ ID NO: 201812 - protein, 9 aa, Homo Sapiens
TTVADTDDH

SEQ ID NO: 201813 - protein, 9 aa, Homo Sapiens
KEHESSSED

SEQ ID NO: 201814 - protein, 9 aa, Homo Sapiens
QVFAPVCLT

SEQ ID NO: 201815 - protein, 9 aa, Homo Sapiens
HEKLSVPVM

SEQ ID NO: 201816 - protein, 9 aa, Homo Sapiens
SGVQKFISG

SEQ ID NO: 201817 - protein, 9 aa, Homo Sapiens
LRAQEQVLG

SEQ ID NO: 201818 - protein, 9 aa, Homo Sapiens
FYKNAKVRP

SEQ ID NO: 201819 - protein, 9 aa, Homo Sapiens
VRDRPLQER

SEQ ID NO: 201820 - protein, 9 aa, Homo Sapiens
DQKQKSGEL

SEQ ID NO: 201821 - protein, 9 aa, Homo Sapiens
LWKVFEEWK

SEQ ID NO: 201822 - protein, 9 aa, Homo Sapiens
GKVVYSSLE

SEQ ID NO: 201823 - protein, 9 aa, Homo Sapiens
RPWQRATAW

SEQ ID NO: 201824 - protein, 9 aa, Homo Sapiens
LLQGPESCS

SEQ ID NO: 201825 - protein, 9 aa, Homo Sapiens
ESKKHSDPS

SEQ ID NO: 201826 - protein, 9 aa, Homo Sapiens
RTPEFLCKF

SEQ ID NO: 201827 - protein, 9 aa, Homo Sapiens
NHSHNMTTV

SEQ ID NO: 201828 - protein, 9 aa, Homo Sapiens
PGKPVVTTF

SEQ ID NO: 201829 - protein, 9 aa, Homo Sapiens
SLAQETLRD

SEQ ID NO: 201830 - protein, 9 aa, Homo Sapiens
GARDSDGSV

SEQ ID NO: 201831 - protein, 9 aa, Homo Sapiens
GEDSPPHVP

SEQ ID NO: 201832 - protein, 9 aa, Homo Sapiens
QGEPKGSSS

SEQ ID NO: 201833 - protein, 9 aa, Homo Sapiens
LATVRDRPL

SEQ ID NO: 201834 - protein, 9 aa, Homo Sapiens
PSRSQWVMS

SEQ ID NO: 201835 - protein, 9 aa, Homo Sapiens
TLHRSRPET

SEQ ID NO: 201836 - protein, 9 aa, Homo Sapiens
PRRWSPTWG

SEQ ID NO: 201837 - protein, 9 aa, Homo Sapiens
NGEDSPPHV

SEQ ID NO: 201838 - protein, 9 aa, Homo Sapiens
AVGRAVLSA

SEQ ID NO: 201839 - protein, 9 aa, Homo Sapiens
TEPEKDPVE

SEQ ID NO: 201840 - protein, 9 aa, Homo Sapiens
GSVELYTWD

SEQ ID NO: 201841 - protein, 9 aa, Homo Sapiens
MGPSPILGK

SEQ ID NO: 201842 - protein, 9 aa, Homo Sapiens
RVTSSSVPF

SEQ ID NO: 201843 - protein, 9 aa, Homo Sapiens
LLPGEAAPS

SEQ ID NO: 201844 - protein, 9 aa, Homo Sapiens
EVRQTGGRV

SEQ ID NO: 201845 - protein, 9 aa, Homo Sapiens
YMHVLEGLQ

SEQ ID NO: 201846 - protein, 9 aa, Homo Sapiens
SPPRECMHH

SEQ ID NO: 201847 - protein, 9 aa, Homo Sapiens
VELLPAEPL

SEQ ID NO: 201848 - protein, 9 aa, Homo Sapiens
VFLPVYIAT

SEQ ID NO: 201849 - protein, 9 aa, Homo Sapiens
ISFPGCFTQ

SEQ ID NO: 201850 - protein, 9 aa, Homo Sapiens
FFHWLFDKK

SEQ ID NO: 201851 - protein, 9 aa, Homo Sapiens
HAKLWEEAF

SEQ ID NO: 201852 - protein, 9 aa, Homo Sapiens
QSEAHQRYF

SEQ ID NO: 201853 - protein, 9 aa, Homo Sapiens
TWSHLSKHL

SEQ ID NO: 201854 - protein, 9 aa, Homo Sapiens
KPVNELRVA

SEQ ID NO: 201855 - protein, 9 aa, Homo Sapiens
SSQGSTVRS

SEQ ID NO: 201856 - protein, 9 aa, Homo Sapiens
EVACRWGKR

SEQ ID NO: 201857 - protein, 9 aa, Homo Sapiens
SCQVVELAV

SEQ ID NO: 201858 - protein, 9 aa, Homo Sapiens
PKGSQQSRK

SEQ ID NO: 201859 - protein, 9 aa, Homo Sapiens
TDIVLWYRS

SEQ ID NO: 201860 - protein, 9 aa, Homo Sapiens
CTCSATHLL

SEQ ID NO: 201861 - protein, 9 aa, Homo Sapiens
ACFTAITAT

SEQ ID NO: 201862 - protein, 9 aa, Homo Sapiens
SVRGEDAAS

SEQ ID NO: 201863 - protein, 9 aa, Homo Sapiens
VGSSLASQV

SEQ ID NO: 201864 - protein, 9 aa, Homo Sapiens
STAAPCSLK

SEQ ID NO: 201865 - protein, 9 aa, Homo Sapiens
NRIITLSLA

SEQ ID NO: 201866 - protein, 9 aa, Homo Sapiens
EPKGSSSLP

SEQ ID NO: 201867 - protein, 9 aa, Homo Sapiens
ALASSPPAE

SEQ ID NO: 201868 - protein, 9 aa, Homo Sapiens
GGPECCLCV

SEQ ID NO: 201869 - protein, 9 aa, Homo Sapiens
TKKQAHCMH

SEQ ID NO: 201870 - protein, 9 aa, Homo Sapiens
TFKAYSNIK

SEQ ID NO: 201871 - protein, 9 aa, Homo Sapiens
KEEMDKMRK

SEQ ID NO: 201872 - protein, 9 aa, Homo Sapiens
RECLWPGQP

SEQ ID NO: 201873 - protein, 9 aa, Homo Sapiens
DVKDETYTS

SEQ ID NO: 201874 - protein, 9 aa, Homo Sapiens
PVKKPSSVS

SEQ ID NO: 201875 - protein, 9 aa, Homo Sapiens
GARGGGAFS

SEQ ID NO: 201876 - protein, 9 aa, Homo Sapiens
HLQGEPKGS

SEQ ID NO: 201877 - protein, 9 aa, Homo Sapiens
AGARDSDGS

SEQ ID NO: 201878 - protein, 9 aa, Homo Sapiens
TFQAKCHIH

SEQ ID NO: 201879 - protein, 9 aa, Homo Sapiens
CKIGAHNCD

SEQ ID NO: 201880 - protein, 9 aa, Homo Sapiens
GEDKLVFTL

SEQ ID NO: 201881 - protein, 9 aa, Homo Sapiens
VALALPLTL

SEQ ID NO: 201882 - protein, 9 aa, Homo Sapiens
RQYMDKHPG

SEQ ID NO: 201883 - protein, 9 aa, Homo Sapiens
PQHNHHHHQ

SEQ ID NO: 201884 - protein, 9 aa, Homo Sapiens
VNDENCILD

SEQ ID NO: 201885 - protein, 9 aa, Homo Sapiens
VSPAIVFPT

SEQ ID NO: 201886 - protein, 9 aa, Homo Sapiens
CHVAELAVN

SEQ ID NO: 201887 - protein, 9 aa, Homo Sapiens
TRLTHQRHH

SEQ ID NO: 201888 - protein, 9 aa, Homo Sapiens
VMAADSAHS

SEQ ID NO: 201889 - protein, 9 aa, Homo Sapiens
YVYECIEKT

SEQ ID NO: 201890 - protein, 9 aa, Homo Sapiens
HSRALYYKS

SEQ ID NO: 201891 - protein, 9 aa, Homo Sapiens
RMCAFLGME

SEQ ID NO: 201892 - protein, 9 aa, Homo Sapiens
LSSEEHFHV

SEQ ID NO: 201893 - protein, 9 aa, Homo Sapiens
DSQMLASDT

SEQ ID NO: 201894 - protein, 9 aa, Homo Sapiens
LAYLLVAAC

SEQ ID NO: 201895 - protein, 9 aa, Homo Sapiens
PDTMVQPFT

SEQ ID NO: 201896 - protein, 9 aa, Homo Sapiens
YESCAPPYY

SEQ ID NO: 201897 - protein, 9 aa, Homo Sapiens
LLVSKQHWD

SEQ ID NO: 201898 - protein, 9 aa, Homo Sapiens
ELPPFWEQQ

SEQ ID NO: 201899 - protein, 9 aa, Homo Sapiens
DSGHNAWLP

SEQ ID NO: 201900 - protein, 9 aa, Homo Sapiens
AGRDGFINL

SEQ ID NO: 201901 - protein, 9 aa, Homo Sapiens
LLDVKAWLE

SEQ ID NO: 201902 - protein, 9 aa, Homo Sapiens
TTLNNSLYI

SEQ ID NO: 201903 - protein, 9 aa, Homo Sapiens
ENVAVCLQL

SEQ ID NO: 201904 - protein, 9 aa, Homo Sapiens
THVLSAGKA

SEQ ID NO: 201905 - protein, 9 aa, Homo Sapiens
SSGMISIVK

SEQ ID NO: 201906 - protein, 9 aa, Homo Sapiens
KQAQNTATL

SEQ ID NO: 201907 - protein, 9 aa, Homo Sapiens
CELVVGREP

SEQ ID NO: 201908 - protein, 9 aa, Homo Sapiens
HLRRRCPRG

SEQ ID NO: 201909 - protein, 9 aa, Homo Sapiens
VDPTTGHVQ

SEQ ID NO: 201910 - protein, 9 aa, Homo Sapiens
PLSDLPLAV

SEQ ID NO: 201911 - protein, 9 aa, Homo Sapiens
SRPVLKLRS

SEQ ID NO: 201912 - protein, 9 aa, Homo Sapiens
LGPRQRLPA

SEQ ID NO: 201913 - protein, 9 aa, Homo Sapiens
GLVLWNEKC

SEQ ID NO: 201914 - protein, 9 aa, Homo Sapiens
FRQTIRLKL

SEQ ID NO: 201915 - protein, 9 aa, Homo Sapiens
DWGWVVVLS

SEQ ID NO: 201916 - protein, 9 aa, Homo Sapiens
PCICDNRDL

SEQ ID NO: 201917 - protein, 9 aa, Homo Sapiens
GRETKRAPA

SEQ ID NO: 201918 - protein, 9 aa, Homo Sapiens
VTFSDVVST

SEQ ID NO: 201919 - protein, 9 aa, Homo Sapiens
IPKTSQCSV

SEQ ID NO: 201920 - protein, 9 aa, Homo Sapiens
CPQENTLWP

SEQ ID NO: 201921 - protein, 9 aa, Homo Sapiens
ELMKEGFMT

SEQ ID NO: 201922 - protein, 9 aa, Homo Sapiens
DSPYKVYMV

SEQ ID NO: 201923 - protein, 9 aa, Homo Sapiens
CIRSTSTPN

SEQ ID NO: 201924 - protein, 9 aa, Homo Sapiens
PGPSDIATS

SEQ ID NO: 201925 - protein, 9 aa, Homo Sapiens
AAVGPPNPW

SEQ ID NO: 201926 - protein, 9 aa, Homo Sapiens
DYYRQGHIA

SEQ ID NO: 201927 - protein, 9 aa, Homo Sapiens
RRWPWPAGH

SEQ ID NO: 201928 - protein, 9 aa, Homo Sapiens
REIRRNSEK

SEQ ID NO: 201929 - protein, 9 aa, Homo Sapiens
TFVTSGELV

SEQ ID NO: 201930 - protein, 9 aa, Homo Sapiens
RDTAIEQRT

SEQ ID NO: 201931 - protein, 9 aa, Homo Sapiens
ISFNATATF

SEQ ID NO: 201932 - protein, 9 aa, Homo Sapiens
RRLVEGNPD

SEQ ID NO: 201933 - protein, 9 aa, Homo Sapiens
LGSSSRKEC

SEQ ID NO: 201934 - protein, 9 aa, Homo Sapiens
SLLTSLVEE

SEQ ID NO: 201935 - protein, 9 aa, Homo Sapiens
PALPVHPEP

SEQ ID NO: 201936 - protein, 9 aa, Homo Sapiens
QPGVHLRRR

SEQ ID NO: 201937 - protein, 9 aa, Homo Sapiens
SPPGGGGRE

SEQ ID NO: 201938 - protein, 9 aa, Homo Sapiens
SKTSYSLVK

SEQ ID NO: 201939 - protein, 9 aa, Homo Sapiens
QPEYRHLST

SEQ ID NO: 201940 - protein, 9 aa, Homo Sapiens
TWIYQWQRR

SEQ ID NO: 201941 - protein, 9 aa, Homo Sapiens
LSCMSRPVL

SEQ ID NO: 201942 - protein, 9 aa, Homo Sapiens
GMQPHEPKG

SEQ ID NO: 201943 - protein, 9 aa, Homo Sapiens
SCRPGMPSF

SEQ ID NO: 201944 - protein, 9 aa, Homo Sapiens
AGTIPSPYK

SEQ ID NO: 201945 - protein, 9 aa, Homo Sapiens
HELTNDRYI

SEQ ID NO: 201946 - protein, 9 aa, Homo Sapiens
EDSYRQQWT

SEQ ID NO: 201947 - protein, 9 aa, Homo Sapiens
WGCFDEFNC

SEQ ID NO: 201948 - protein, 9 aa, Homo Sapiens
DKWDVVSCF

SEQ ID NO: 201949 - protein, 9 aa, Homo Sapiens
GRRWPWPAG

SEQ ID NO: 201950 - protein, 9 aa, Homo Sapiens
QQLEAAAGV

SEQ ID NO: 201951 - protein, 9 aa, Homo Sapiens
YAWEPRCPK

SEQ ID NO: 201952 - protein, 9 aa, Homo Sapiens
MDKALQKRP

SEQ ID NO: 201953 - protein, 9 aa, Homo Sapiens
TLFIKHFII

SEQ ID NO: 201954 - protein, 9 aa, Homo Sapiens
NLMTGLPKQ

SEQ ID NO: 201955 - protein, 9 aa, Homo Sapiens
SIISVVVGI

SEQ ID NO: 201956 - protein, 9 aa, Homo Sapiens
QHHRVHTGE

SEQ ID NO: 201957 - protein, 9 aa, Homo Sapiens
DLPLAVQLF

SEQ ID NO: 201958 - protein, 9 aa, Homo Sapiens
TVGGLIYWI

SEQ ID NO: 201959 - protein, 9 aa, Homo Sapiens
WQCWLKVRD

SEQ ID NO: 201960 - protein, 9 aa, Homo Sapiens
PRYPNIHDL

SEQ ID NO: 201961 - protein, 9 aa, Homo Sapiens
GDRKMGKQA

SEQ ID NO: 201962 - protein, 9 aa, Homo Sapiens
LSERLWGPT

SEQ ID NO: 201963 - protein, 9 aa, Homo Sapiens
LVRFYCYTE

SEQ ID NO: 201964 - protein, 9 aa, Homo Sapiens
SNHALAEMS

SEQ ID NO: 201965 - protein, 9 aa, Homo Sapiens
WSNAATLYR

SEQ ID NO: 201966 - protein, 9 aa, Homo Sapiens
CDHDASVYL

SEQ ID NO: 201967 - protein, 9 aa, Homo Sapiens
CATNNSYQM

SEQ ID NO: 201968 - protein, 9 aa, Homo Sapiens
DYMGIQNES

SEQ ID NO: 201969 - protein, 9 aa, Homo Sapiens
TWRLLWASP

SEQ ID NO: 201970 - protein, 9 aa, Homo Sapiens
LQMDSHMKQ

SEQ ID NO: 201971 - protein, 9 aa, Homo Sapiens
ALPVHPEPL

SEQ ID NO: 201972 - protein, 9 aa, Homo Sapiens
CPVTTSVQL

SEQ ID NO: 201973 - protein, 9 aa, Homo Sapiens
WGLDAPQQM

SEQ ID NO: 201974 - protein, 9 aa, Homo Sapiens
DLVFLQMPS

SEQ ID NO: 201975 - protein, 9 aa, Homo Sapiens
SKRIMQLSL

SEQ ID NO: 201976 - protein, 9 aa, Homo Sapiens
VHTGICYHI

SEQ ID NO: 201977 - protein, 9 aa, Homo Sapiens
AWGVTCSLT

SEQ ID NO: 201978 - protein, 9 aa, Homo Sapiens
GDYYRQGHI

SEQ ID NO: 201979 - protein, 9 aa, Homo Sapiens
TMWLPPAVP

SEQ ID NO: 201980 - protein, 9 aa, Homo Sapiens
RVRIHDLHS

SEQ ID NO: 201981 - protein, 9 aa, Homo Sapiens
HGSWFCLSF

SEQ ID NO: 201982 - protein, 9 aa, Homo Sapiens
HLFSMESPQ

SEQ ID NO: 201983 - protein, 9 aa, Homo Sapiens
TWQQNYHSM

SEQ ID NO: 201984 - protein, 9 aa, Homo Sapiens
SPSRKPSKT

SEQ ID NO: 201985 - protein, 9 aa, Homo Sapiens
PVLFPPWID

SEQ ID NO: 201986 - protein, 9 aa, Homo Sapiens
IEGHTGTSA

SEQ ID NO: 201987 - protein, 9 aa, Homo Sapiens
NGQQEPSTA

SEQ ID NO: 201988 - protein, 9 aa, Homo Sapiens
GPCEVMVQS

SEQ ID NO: 201989 - protein, 9 aa, Homo Sapiens
DGERHELTN

SEQ ID NO: 201990 - protein, 9 aa, Homo Sapiens
QRREKNCIA

SEQ ID NO: 201991 - protein, 9 aa, Homo Sapiens
TLMPASEPP

SEQ ID NO: 201992 - protein, 9 aa, Homo Sapiens
QESIHSKPS

SEQ ID NO: 201993 - protein, 9 aa, Homo Sapiens
LLVRGLMLP

SEQ ID NO: 201994 - protein, 9 aa, Homo Sapiens
TAQRSISKY

SEQ ID NO: 201995 - protein, 9 aa, Homo Sapiens
RIINCKVKP

SEQ ID NO: 201996 - protein, 9 aa, Homo Sapiens
SLGDVDVND

SEQ ID NO: 201997 - protein, 9 aa, Homo Sapiens
RVTEGPHQE

SEQ ID NO: 201998 - protein, 9 aa, Homo Sapiens
PLSQVTSLA

SEQ ID NO: 201999 - protein, 9 aa, Homo Sapiens
AAMAYDWYA

SEQ ID NO: 202000 - protein, 9 aa, Homo Sapiens
QDSFTFYIW

SEQ ID NO: 202001 - protein, 9 aa, Homo Sapiens
AAWLMAVAL

SEQ ID NO: 202002 - protein, 9 aa, Homo Sapiens
PRKGSSHLS

SEQ ID NO: 202003 - protein, 9 aa, Homo Sapiens
IKYHHSWPE

SEQ ID NO: 202004 - protein, 9 aa, Homo Sapiens
LMDDFKLVI

SEQ ID NO: 202005 - protein, 9 aa, Homo Sapiens
TDVKHHWKA

SEQ ID NO: 202006 - protein, 9 aa, Homo Sapiens
AVLHKALNQ

SEQ ID NO: 202007 - protein, 9 aa, Homo Sapiens
QIPNLCGVS

SEQ ID NO: 202008 - protein, 9 aa, Homo Sapiens
HFQAQLLSH

SEQ ID NO: 202009 - protein, 9 aa, Homo Sapiens
AVAWSGLSG

SEQ ID NO: 202010 - protein, 9 aa, Homo Sapiens
SSPSTENKH

SEQ ID NO: 202011 - protein, 9 aa, Homo Sapiens
DALELIETE

SEQ ID NO: 202012 - protein, 9 aa, Homo Sapiens
LPREVSPLE

SEQ ID NO: 202013 - protein, 9 aa, Homo Sapiens
EQETKDLPS

SEQ ID NO: 202014 - protein, 9 aa, Homo Sapiens
NWCNGLLQE

SEQ ID NO: 202015 - protein, 9 aa, Homo Sapiens
GQVVDCSHL

SEQ ID NO: 202016 - protein, 9 aa, Homo Sapiens
AHAEHVQSW

SEQ ID NO: 202017 - protein, 9 aa, Homo Sapiens
RPNMELCCD

SEQ ID NO: 202018 - protein, 9 aa, Homo Sapiens
PVQISSCML

SEQ ID NO: 202019 - protein, 9 aa, Homo Sapiens
NALPELAKV

SEQ ID NO: 202020 - protein, 9 aa, Homo Sapiens
MYLMCTVPA

SEQ ID NO: 202021 - protein, 9 aa, Homo Sapiens
GKSFRQKTI

SEQ ID NO: 202022 - protein, 9 aa, Homo Sapiens
VRGRTTSAG

SEQ ID NO: 202023 - protein, 9 aa, Homo Sapiens
SAACGGRER

SEQ ID NO: 202024 - protein, 9 aa, Homo Sapiens
RKGSPMPGF

SEQ ID NO: 202025 - protein, 9 aa, Homo Sapiens
FATLWEHVP

SEQ ID NO: 202026 - protein, 9 aa, Homo Sapiens
LYVDQTLQE

SEQ ID NO: 202027 - protein, 9 aa, Homo Sapiens
LDDGKVNVH

SEQ ID NO: 202028 - protein, 9 aa, Homo Sapiens
WTGWFPSNY

SEQ ID NO: 202029 - protein, 9 aa, Homo Sapiens
LDTIAKEGC

SEQ ID NO: 202030 - protein, 9 aa, Homo Sapiens
SALTILWMI

SEQ ID NO: 202031 - protein, 9 aa, Homo Sapiens
PNTESCARF

SEQ ID NO: 202032 - protein, 9 aa, Homo Sapiens
AAEQHEKIK

SEQ ID NO: 202033 - protein, 9 aa, Homo Sapiens
NGWTGWFPS

SEQ ID NO: 202034 - protein, 9 aa, Homo Sapiens
FCMCKNGRC

SEQ ID NO: 202035 - protein, 9 aa, Homo Sapiens
QAHVTVSGS

SEQ ID NO: 202036 - protein, 9 aa, Homo Sapiens
YPIPFTHLP

SEQ ID NO: 202037 - protein, 9 aa, Homo Sapiens
RTMMYYGLP

SEQ ID NO: 202038 - protein, 9 aa, Homo Sapiens
PDECFGLLG

SEQ ID NO: 202039 - protein, 9 aa, Homo Sapiens
MWTLGCRPF

SEQ ID NO: 202040 - protein, 9 aa, Homo Sapiens
LGEIVCNIL

SEQ ID NO: 202041 - protein, 9 aa, Homo Sapiens
PLTEPEKDP

SEQ ID NO: 202042 - protein, 9 aa, Homo Sapiens
GALGLPSMG

SEQ ID NO: 202043 - protein, 9 aa, Homo Sapiens
KKPVNELRV

SEQ ID NO: 202044 - protein, 9 aa, Homo Sapiens
GWYSRGRIR

SEQ ID NO: 202045 - protein, 9 aa, Homo Sapiens
MTYQFHSVS

SEQ ID NO: 202046 - protein, 9 aa, Homo Sapiens
SGERSQAHV

SEQ ID NO: 202047 - protein, 9 aa, Homo Sapiens
ARLWGVHKC

SEQ ID NO: 202048 - protein, 9 aa, Homo Sapiens
EFLQPHLDV

SEQ ID NO: 202049 - protein, 9 aa, Homo Sapiens
SEDCLQQFG

SEQ ID NO: 202050 - protein, 9 aa, Homo Sapiens
DVAKQCAAP

SEQ ID NO: 202051 - protein, 9 aa, Homo Sapiens
IAEDIVSDS

SEQ ID NO: 202052 - protein, 9 aa, Homo Sapiens
KPPIGQRTQ

SEQ ID NO: 202053 - protein, 9 aa, Homo Sapiens
TLEANSERD

SEQ ID NO: 202054 - protein, 9 aa, Homo Sapiens
KATAMALGS

SEQ ID NO: 202055 - protein, 9 aa, Homo Sapiens
EWTVWLILA

SEQ ID NO: 202056 - protein, 9 aa, Homo Sapiens
STRGEPTEP

SEQ ID NO: 202057 - protein, 9 aa, Homo Sapiens
TAGAWIITG

SEQ ID NO: 202058 - protein, 9 aa, Homo Sapiens
IQDLTETGT

SEQ ID NO: 202059 - protein, 9 aa, Homo Sapiens
QHRQDVLNW

SEQ ID NO: 202060 - protein, 9 aa, Homo Sapiens
LSGQVLGGE

SEQ ID NO: 202061 - protein, 9 aa, Homo Sapiens
GVPVRTTPV

SEQ ID NO: 202062 - protein, 9 aa, Homo Sapiens
SHNKGHKSS

SEQ ID NO: 202063 - protein, 9 aa, Homo Sapiens
PLRGGKRHY

SEQ ID NO: 202064 - protein, 9 aa, Homo Sapiens
TYMSHRNPR

SEQ ID NO: 202065 - protein, 9 aa, Homo Sapiens
WGEVRGPVT

SEQ ID NO: 202066 - protein, 9 aa, Homo Sapiens
VPHAYCPFQ

SEQ ID NO: 202067 - protein, 9 aa, Homo Sapiens
ALPEMVCAL

SEQ ID NO: 202068 - protein, 9 aa, Homo Sapiens
ENVVQKTQV

SEQ ID NO: 202069 - protein, 9 aa, Homo Sapiens
TLQRWCLNV

SEQ ID NO: 202070 - protein, 9 aa, Homo Sapiens
KDKNFAKME

SEQ ID NO: 202071 - protein, 9 aa, Homo Sapiens
NGEDKLVFT

SEQ ID NO: 202072 - protein, 9 aa, Homo Sapiens
VVGSIGWAR

SEQ ID NO: 202073 - protein, 9 aa, Homo Sapiens
CTNYSKDIL

SEQ ID NO: 202074 - protein, 9 aa, Homo Sapiens
DHLTDQKLI

SEQ ID NO: 202075 - protein, 9 aa, Homo Sapiens
SPDLPDIIY

SEQ ID NO: 202076 - protein, 9 aa, Homo Sapiens
WMPCTHTDG

SEQ ID NO: 202077 - protein, 9 aa, Homo Sapiens
DPNTESCAR

SEQ ID NO: 202078 - protein, 9 aa, Homo Sapiens
LELPIFTIL

SEQ ID NO: 202079 - protein, 9 aa, Homo Sapiens
KYTYGLGAT

SEQ ID NO: 202080 - protein, 9 aa, Homo Sapiens
HRFVLHLAL

SEQ ID NO: 202081 - protein, 9 aa, Homo Sapiens
LRFLCARDF

SEQ ID NO: 202082 - protein, 9 aa, Homo Sapiens
DDDFVSRYC

SEQ ID NO: 202083 - protein, 9 aa, Homo Sapiens
HLAQHHRVH

SEQ ID NO: 202084 - protein, 9 aa, Homo Sapiens
MCSLGDVDV

SEQ ID NO: 202085 - protein, 9 aa, Homo Sapiens
TTDPSTVSS

SEQ ID NO: 202086 - protein, 9 aa, Homo Sapiens
ESRLTTSSV

SEQ ID NO: 202087 - protein, 9 aa, Homo Sapiens
DGIQIRLPP

SEQ ID NO: 202088 - protein, 9 aa, Homo Sapiens
IRETGVIDP

SEQ ID NO: 202089 - protein, 9 aa, Homo Sapiens
TVTFTGMMH

SEQ ID NO: 202090 - protein, 9 aa, Homo Sapiens
LRISCRLSQ

SEQ ID NO: 202091 - protein, 9 aa, Homo Sapiens
GDRSHGKRF

SEQ ID NO: 202092 - protein, 9 aa, Homo Sapiens
VDSRNRKEE

SEQ ID NO: 202093 - protein, 9 aa, Homo Sapiens
CRKTHVEKK

SEQ ID NO: 202094 - protein, 9 aa, Homo Sapiens
VARGLVGKL

SEQ ID NO: 202095 - protein, 9 aa, Homo Sapiens
DPDETILHA

SEQ ID NO: 202096 - protein, 9 aa, Homo Sapiens
AHSSKLLGW

SEQ ID NO: 202097 - protein, 9 aa, Homo Sapiens
VYFPPFRLL

SEQ ID NO: 202098 - protein, 9 aa, Homo Sapiens
LQNAQVHPL

SEQ ID NO: 202099 - protein, 9 aa, Homo Sapiens
TPDKKASHH

SEQ ID NO: 202100 - protein, 9 aa, Homo Sapiens
TSSLHKHQQ

SEQ ID NO: 202101 - protein, 9 aa, Homo Sapiens
LHRAPGPDG

SEQ ID NO: 202102 - protein, 9 aa, Homo Sapiens
VNINRALQK

SEQ ID NO: 202103 - protein, 9 aa, Homo Sapiens
SFRRLDYGG

SEQ ID NO: 202104 - protein, 9 aa, Homo Sapiens
PYRLQPGRG

SEQ ID NO: 202105 - protein, 9 aa, Homo Sapiens
AYRANLGML

SEQ ID NO: 202106 - protein, 9 aa, Homo Sapiens
RGITIVSVL

SEQ ID NO: 202107 - protein, 9 aa, Homo Sapiens
CIALVSVRA

SEQ ID NO: 202108 - protein, 9 aa, Homo Sapiens
FDWLSAQVP

SEQ ID NO: 202109 - protein, 9 aa, Homo Sapiens
EGRFEMQPN

SEQ ID NO: 202110 - protein, 9 aa, Homo Sapiens
MEGDDIVNI

SEQ ID NO: 202111 - protein, 9 aa, Homo Sapiens
LQNYIQNRK

SEQ ID NO: 202112 - protein, 9 aa, Homo Sapiens
ELEQDVISL

SEQ ID NO: 202113 - protein, 9 aa, Homo Sapiens
NELAIFSEG

SEQ ID NO: 202114 - protein, 9 aa, Homo Sapiens
PAMVFLDEP

SEQ ID NO: 202115 - protein, 9 aa, Homo Sapiens
LTCHQRIHV

SEQ ID NO: 202116 - protein, 9 aa, Homo Sapiens
PHQALMGPP

SEQ ID NO: 202117 - protein, 9 aa, Homo Sapiens
LIGRLQTHL

SEQ ID NO: 202118 - protein, 9 aa, Homo Sapiens
GQRMCAFLG

SEQ ID NO: 202119 - protein, 9 aa, Homo Sapiens
HPRGVKRRW

SEQ ID NO: 202120 - protein, 9 aa, Homo Sapiens
IPFTHLPIR

SEQ ID NO: 202121 - protein, 9 aa, Homo Sapiens
EQQNDLYYN

SEQ ID NO: 202122 - protein, 9 aa, Homo Sapiens
QEDPVYLRQ

SEQ ID NO: 202123 - protein, 9 aa, Homo Sapiens
WALELAHRE

SEQ ID NO: 202124 - protein, 9 aa, Homo Sapiens
ECCVSRNIP

SEQ ID NO: 202125 - protein, 9 aa, Homo Sapiens
STAALEAGE

SEQ ID NO: 202126 - protein, 9 aa, Homo Sapiens
GMKGKGSTC

SEQ ID NO: 202127 - protein, 9 aa, Homo Sapiens
KSENLLFVG

SEQ ID NO: 202128 - protein, 9 aa, Homo Sapiens
PPISAFPVD

SEQ ID NO: 202129 - protein, 9 aa, Homo Sapiens
PAVLPALLQ

SEQ ID NO: 202130 - protein, 9 aa, Homo Sapiens
VAFQAAINT

SEQ ID NO: 202131 - protein, 9 aa, Homo Sapiens
PFPASLARK

SEQ ID NO: 202132 - protein, 9 aa, Homo Sapiens
FSIYHDSIP

SEQ ID NO: 202133 - protein, 9 aa, Homo Sapiens
NVAVCLQLR

SEQ ID NO: 202134 - protein, 9 aa, Homo Sapiens
RCLQAIMED

SEQ ID NO: 202135 - protein, 9 aa, Homo Sapiens
PPAAPALAA

SEQ ID NO: 202136 - protein, 9 aa, Homo Sapiens
ILSTWFTAV

SEQ ID NO: 202137 - protein, 9 aa, Homo Sapiens
YDLERGTHL

SEQ ID NO: 202138 - protein, 9 aa, Homo Sapiens
VLKKLCGTA

SEQ ID NO: 202139 - protein, 9 aa, Homo Sapiens
QKIKVASEQ

SEQ ID NO: 202140 - protein, 9 aa, Homo Sapiens
HTYPAQWTL

SEQ ID NO: 202141 - protein, 9 aa, Homo Sapiens
SLSGQTKPE

SEQ ID NO: 202142 - protein, 9 aa, Homo Sapiens
KVNVQKMPS

SEQ ID NO: 202143 - protein, 9 aa, Homo Sapiens
APDALYPNR

SEQ ID NO: 202144 - protein, 9 aa, Homo Sapiens
VGHAGHTSL

SEQ ID NO: 202145 - protein, 9 aa, Homo Sapiens
ILVGSFIIA

SEQ ID NO: 202146 - protein, 9 aa, Homo Sapiens
HKVYQCSTA

SEQ ID NO: 202147 - protein, 9 aa, Homo Sapiens
PVTIFPWCV

SEQ ID NO: 202148 - protein, 9 aa, Homo Sapiens
ILNSSPESA

SEQ ID NO: 202149 - protein, 9 aa, Homo Sapiens
NIQTLDHPI

SEQ ID NO: 202150 - protein, 9 aa, Homo Sapiens
ASITPGLHP

SEQ ID NO: 202151 - protein, 9 aa, Homo Sapiens
QQHNKGTPN

SEQ ID NO: 202152 - protein, 9 aa, Homo Sapiens
GKTFSKMTK

SEQ ID NO: 202153 - protein, 9 aa, Homo Sapiens
HNKPYSKKD

SEQ ID NO: 202154 - protein, 9 aa, Homo Sapiens
SVPHAYCPF

SEQ ID NO: 202155 - protein, 9 aa, Homo Sapiens
IEARDLQGK

SEQ ID NO: 202156 - protein, 9 aa, Homo Sapiens
WAQGGDYFY

SEQ ID NO: 202157 - protein, 9 aa, Homo Sapiens
RPPVQGCST

SEQ ID NO: 202158 - protein, 9 aa, Homo Sapiens
DNRIITLSL

SEQ ID NO: 202159 - protein, 9 aa, Homo Sapiens
SSPASSCSQ

SEQ ID NO: 202160 - protein, 9 aa, Homo Sapiens
SGHLLREVN

SEQ ID NO: 202161 - protein, 9 aa, Homo Sapiens
MDRPLSVRC

SEQ ID NO: 202162 - protein, 9 aa, Homo Sapiens
HVLDGPGPA

SEQ ID NO: 202163 - protein, 9 aa, Homo Sapiens
GPVVEKRVV

SEQ ID NO: 202164 - protein, 9 aa, Homo Sapiens
VTKPENEKQ

SEQ ID NO: 202165 - protein, 9 aa, Homo Sapiens
MLLHLLLDD

SEQ ID NO: 202166 - protein, 9 aa, Homo Sapiens
ILRMLADLL

SEQ ID NO: 202167 - protein, 9 aa, Homo Sapiens
GLHGLSGNP

SEQ ID NO: 202168 - protein, 9 aa, Homo Sapiens
KTGVHRKQY

SEQ ID NO: 202169 - protein, 9 aa, Homo Sapiens
YKTQQKKKE

SEQ ID NO: 202170 - protein, 9 aa, Homo Sapiens
LLVAASTDG

SEQ ID NO: 202171 - protein, 9 aa, Homo Sapiens
VNACHVAEL

SEQ ID NO: 202172 - protein, 9 aa, Homo Sapiens
APPWGKEQH

SEQ ID NO: 202173 - protein, 9 aa, Homo Sapiens
VNELRVASA

SEQ ID NO: 202174 - protein, 9 aa, Homo Sapiens
LQAQIWNLT

SEQ ID NO: 202175 - protein, 9 aa, Homo Sapiens
GYQLRVLQD

SEQ ID NO: 202176 - protein, 9 aa, Homo Sapiens
VQDVMELVA

SEQ ID NO: 202177 - protein, 9 aa, Homo Sapiens
FLWEQYSDC

SEQ ID NO: 202178 - protein, 9 aa, Homo Sapiens
RVLSNSGCG

SEQ ID NO: 202179 - protein, 9 aa, Homo Sapiens
YRRCQRALP

SEQ ID NO: 202180 - protein, 9 aa, Homo Sapiens
AMEHEETKK

SEQ ID NO: 202181 - protein, 9 aa, Homo Sapiens
SRNCDDEVY

SEQ ID NO: 202182 - protein, 9 aa, Homo Sapiens
MSVIFFACM

SEQ ID NO: 202183 - protein, 9 aa, Homo Sapiens
WQRRGSLFC

SEQ ID NO: 202184 - protein, 9 aa, Homo Sapiens
LLPTSTATS

SEQ ID NO: 202185 - protein, 9 aa, Homo Sapiens
HGDFSADEV

SEQ ID NO: 202186 - protein, 9 aa, Homo Sapiens
SKWFDDLPN

SEQ ID NO: 202187 - protein, 9 aa, Homo Sapiens
IPVMRWSHQ

SEQ ID NO: 202188 - protein, 9 aa, Homo Sapiens
LILLFQRIT

SEQ ID NO: 202189 - protein, 9 aa, Homo Sapiens
GRCHDHFGL

SEQ ID NO: 202190 - protein, 9 aa, Homo Sapiens
LYPPPHPPK

SEQ ID NO: 202191 - protein, 9 aa, Homo Sapiens
DIQRGLVLW

SEQ ID NO: 202192 - protein, 9 aa, Homo Sapiens
RQLLRISCR

SEQ ID NO: 202193 - protein, 9 aa, Homo Sapiens
ECRRAITNS

SEQ ID NO: 202194 - protein, 9 aa, Homo Sapiens
SVKEGDRII

SEQ ID NO: 202195 - protein, 9 aa, Homo Sapiens
SRELTGLHH

SEQ ID NO: 202196 - protein, 9 aa, Homo Sapiens
STARKGPPT

SEQ ID NO: 202197 - protein, 9 aa, Homo Sapiens
CIYRELIDV

SEQ ID NO: 202198 - protein, 9 aa, Homo Sapiens
NYLGDKWSH

SEQ ID NO: 202199 - protein, 9 aa, Homo Sapiens
SGMISIVKY

SEQ ID NO: 202200 - protein, 9 aa, Homo Sapiens
SAYQEDPVY

SEQ ID NO: 202201 - protein, 9 aa, Homo Sapiens
IAKVCCLPQ

SEQ ID NO: 202202 - protein, 9 aa, Homo Sapiens
PELAKVEEA

SEQ ID NO: 202203 - protein, 9 aa, Homo Sapiens
GSVEVKAKK

SEQ ID NO: 202204 - protein, 9 aa, Homo Sapiens
AGDDVQMGG

SEQ ID NO: 202205 - protein, 9 aa, Homo Sapiens
IKGTTLNNS

SEQ ID NO: 202206 - protein, 9 aa, Homo Sapiens
CTIHLWDTY

SEQ ID NO: 202207 - protein, 9 aa, Homo Sapiens
DETYTSNAM

SEQ ID NO: 202208 - protein, 9 aa, Homo Sapiens
VGRHLGQHV

SEQ ID NO: 202209 - protein, 9 aa, Homo Sapiens
SCIWALQLT

SEQ ID NO: 202210 - protein, 9 aa, Homo Sapiens
GSVKTPAPI

SEQ ID NO: 202211 - protein, 9 aa, Homo Sapiens
LSILRSTVM

SEQ ID NO: 202212 - protein, 9 aa, Homo Sapiens
VLVNTFCQC

SEQ ID NO: 202213 - protein, 9 aa, Homo Sapiens
LTSIISVVV

SEQ ID NO: 202214 - protein, 9 aa, Homo Sapiens
EWARWMWTV

SEQ ID NO: 202215 - protein, 9 aa, Homo Sapiens
FRGGCRVPR

SEQ ID NO: 202216 - protein, 9 aa, Homo Sapiens
HTSSVEGLC

SEQ ID NO: 202217 - protein, 9 aa, Homo Sapiens
KGFFRQTIR

SEQ ID NO: 202218 - protein, 9 aa, Homo Sapiens
WPYYQTEEG

SEQ ID NO: 202219 - protein, 9 aa, Homo Sapiens
RNESVAHSS

SEQ ID NO: 202220 - protein, 9 aa, Homo Sapiens
LGAPRMYMF

SEQ ID NO: 202221 - protein, 9 aa, Homo Sapiens
PPWVLPSSR

SEQ ID NO: 202222 - protein, 9 aa, Homo Sapiens
KDRHMENLV

SEQ ID NO: 202223 - protein, 9 aa, Homo Sapiens
VAGNQEVAN

SEQ ID NO: 202224 - protein, 9 aa, Homo Sapiens
AGWPCPAVP

SEQ ID NO: 202225 - protein, 9 aa, Homo Sapiens
AKPPWPALD

SEQ ID NO: 202226 - protein, 9 aa, Homo Sapiens
VNQTSSLRQ

SEQ ID NO: 202227 - protein, 9 aa, Homo Sapiens
QPSWPVHFQ

SEQ ID NO: 202228 - protein, 9 aa, Homo Sapiens
KVASEQYID

SEQ ID NO: 202229 - protein, 9 aa, Homo Sapiens
YQSKGYSSF

SEQ ID NO: 202230 - protein, 9 aa, Homo Sapiens
RAFCVWEQA

SEQ ID NO: 202231 - protein, 9 aa, Homo Sapiens
NIFMAMQAM

SEQ ID NO: 202232 - protein, 9 aa, Homo Sapiens
GYHRFLPTK

SEQ ID NO: 202233 - protein, 9 aa, Homo Sapiens
LPPSLSGQT

SEQ ID NO: 202234 - protein, 9 aa, Homo Sapiens
LQGTTSTAA

SEQ ID NO: 202235 - protein, 9 aa, Homo Sapiens
HTTDLKEEM

SEQ ID NO: 202236 - protein, 9 aa, Homo Sapiens
VEFELSTDT

SEQ ID NO: 202237 - protein, 9 aa, Homo Sapiens
ERLRLLKEE

SEQ ID NO: 202238 - protein, 9 aa, Homo Sapiens
GSLLLTSAG

SEQ ID NO: 202239 - protein, 9 aa, Homo Sapiens
IQVVEHACS

SEQ ID NO: 202240 - protein, 9 aa, Homo Sapiens
WSHLSKHLA

SEQ ID NO: 202241 - protein, 9 aa, Homo Sapiens
SKHLAFERQ

SEQ ID NO: 202242 - protein, 9 aa, Homo Sapiens
VSGPGAFSY

SEQ ID NO: 202243 - protein, 9 aa, Homo Sapiens
EVNSWWSLG

SEQ ID NO: 202244 - protein, 9 aa, Homo Sapiens
ASSDGTCAL

SEQ ID NO: 202245 - protein, 9 aa, Homo Sapiens
HKLEYLKIP

SEQ ID NO: 202246 - protein, 9 aa, Homo Sapiens
DSGSTSSGS

SEQ ID NO: 202247 - protein, 9 aa, Homo Sapiens
PIADWAQIF

SEQ ID NO: 202248 - protein, 9 aa, Homo Sapiens
AGNVISRSG

SEQ ID NO: 202249 - protein, 9 aa, Homo Sapiens
TEPWEPPGL

SEQ ID NO: 202250 - protein, 9 aa, Homo Sapiens
LNFYCTGRL

SEQ ID NO: 202251 - protein, 9 aa, Homo Sapiens
DTPTAPETS

SEQ ID NO: 202252 - protein, 9 aa, Homo Sapiens
VWQNLDSPQ

SEQ ID NO: 202253 - protein, 9 aa, Homo Sapiens
ASPREWTNI

SEQ ID NO: 202254 - protein, 9 aa, Homo Sapiens
KIRTAQDAL

SEQ ID NO: 202255 - protein, 9 aa, Homo Sapiens
SAPSLIMDK

SEQ ID NO: 202256 - protein, 9 aa, Homo Sapiens
EIRRNSEKD

SEQ ID NO: 202257 - protein, 9 aa, Homo Sapiens
VLSGFPVPA

SEQ ID NO: 202258 - protein, 9 aa, Homo Sapiens
VVACAYDRL

SEQ ID NO: 202259 - protein, 9 aa, Homo Sapiens
EMSYKCIEC

SEQ ID NO: 202260 - protein, 9 aa, Homo Sapiens
CWWYEKLIN

SEQ ID NO: 202261 - protein, 9 aa, Homo Sapiens
TLPAMDSSR

SEQ ID NO: 202262 - protein, 9 aa, Homo Sapiens
NDELQGNAR

SEQ ID NO: 202263 - protein, 9 aa, Homo Sapiens
SFPHWYFDV

SEQ ID NO: 202264 - protein, 9 aa, Homo Sapiens
SGHVLVTGS

SEQ ID NO: 202265 - protein, 9 aa, Homo Sapiens
DSNRQAHKI

SEQ ID NO: 202266 - protein, 9 aa, Homo Sapiens
ELCRHWYPE

SEQ ID NO: 202267 - protein, 9 aa, Homo Sapiens
PQIPTNLRR

SEQ ID NO: 202268 - protein, 9 aa, Homo Sapiens
NLRASQCEY

SEQ ID NO: 202269 - protein, 9 aa, Homo Sapiens
REFRGGCRV

SEQ ID NO: 202270 - protein, 9 aa, Homo Sapiens
TAVLIETLI

SEQ ID NO: 202271 - protein, 9 aa, Homo Sapiens
YIINILVSC

SEQ ID NO: 202272 - protein, 9 aa, Homo Sapiens
KRLKGMMRD

SEQ ID NO: 202273 - protein, 9 aa, Homo Sapiens
NHSVNDENC

SEQ ID NO: 202274 - protein, 9 aa, Homo Sapiens
AVVPLTTFA

SEQ ID NO: 202275 - protein, 9 aa, Homo Sapiens
MPCTHTDGS

SEQ ID NO: 202276 - protein, 9 aa, Homo Sapiens
MASWDKAVQ

SEQ ID NO: 202277 - protein, 9 aa, Homo Sapiens
NEKQQRAEE

SEQ ID NO: 202278 - protein, 9 aa, Homo Sapiens
GPGNGGTAS

SEQ ID NO: 202279 - protein, 9 aa, Homo Sapiens
ILLFQRITR

SEQ ID NO: 202280 - protein, 9 aa, Homo Sapiens
MENDNTVLR

SEQ ID NO: 202281 - protein, 9 aa, Homo Sapiens
QGQLFVVFL

SEQ ID NO: 202282 - protein, 9 aa, Homo Sapiens
CSVRSFMDL

SEQ ID NO: 202283 - protein, 9 aa, Homo Sapiens
TFTGMMHCS

SEQ ID NO: 202284 - protein, 9 aa, Homo Sapiens
PREMTYQFH

SEQ ID NO: 202285 - protein, 9 aa, Homo Sapiens
VCEPENTCK

SEQ ID NO: 202286 - protein, 9 aa, Homo Sapiens
EQAVLNAAK

SEQ ID NO: 202287 - protein, 9 aa, Homo Sapiens
SYGQVRDTA

SEQ ID NO: 202288 - protein, 9 aa, Homo Sapiens
LTTNYPFMF

SEQ ID NO: 202289 - protein, 9 aa, Homo Sapiens
PAPLLSSSL

SEQ ID NO: 202290 - protein, 9 aa, Homo Sapiens
EEEGDRKMG

SEQ ID NO: 202291 - protein, 9 aa, Homo Sapiens
HEIIIWSHW

SEQ ID NO: 202292 - protein, 9 aa, Homo Sapiens
IEQSLLATH

SEQ ID NO: 202293 - protein, 9 aa, Homo Sapiens
DVRHTPAEE

SEQ ID NO: 202294 - protein, 9 aa, Homo Sapiens
TGFLYWVGA

SEQ ID NO: 202295 - protein, 9 aa, Homo Sapiens
TPAPNNRTH

SEQ ID NO: 202296 - protein, 9 aa, Homo Sapiens
PEIVPATLH

SEQ ID NO: 202297 - protein, 9 aa, Homo Sapiens
AYSNSSMNP

SEQ ID NO: 202298 - protein, 9 aa, Homo Sapiens
PWGIIHVYG

SEQ ID NO: 202299 - protein, 9 aa, Homo Sapiens
QEKLDLQHC

SEQ ID NO: 202300 - protein, 9 aa, Homo Sapiens
YDWSARYFA

SEQ ID NO: 202301 - protein, 9 aa, Homo Sapiens
NSTGELIYQ

SEQ ID NO: 202302 - protein, 9 aa, Homo Sapiens
MVCSSMPYD

SEQ ID NO: 202303 - protein, 9 aa, Homo Sapiens
LWTTMVPGK

SEQ ID NO: 202304 - protein, 9 aa, Homo Sapiens
GLYTCRLNR

SEQ ID NO: 202305 - protein, 9 aa, Homo Sapiens
LDPWREIRE

SEQ ID NO: 202306 - protein, 9 aa, Homo Sapiens
CFTSPQWGL

SEQ ID NO: 202307 - protein, 9 aa, Homo Sapiens
HLCATSLDR

SEQ ID NO: 202308 - protein, 9 aa, Homo Sapiens
YKHRRTQMH

SEQ ID NO: 202309 - protein, 9 aa, Homo Sapiens
QDPKEILHY

SEQ ID NO: 202310 - protein, 9 aa, Homo Sapiens
HLPLFYTIN

SEQ ID NO: 202311 - protein, 9 aa, Homo Sapiens
AAADLDAGR

SEQ ID NO: 202312 - protein, 9 aa, Homo Sapiens
LFAGFLPWI

SEQ ID NO: 202313 - protein, 9 aa, Homo Sapiens
PRPTSPGPS

SEQ ID NO: 202314 - protein, 9 aa, Homo Sapiens
HCIIPNETK

SEQ ID NO: 202315 - protein, 9 aa, Homo Sapiens
GWYTYTYLC

SEQ ID NO: 202316 - protein, 9 aa, Homo Sapiens
FRELLFNGY

SEQ ID NO: 202317 - protein, 9 aa, Homo Sapiens
HAIQRKPNP

SEQ ID NO: 202318 - protein, 9 aa, Homo Sapiens
ENYISNHAL

SEQ ID NO: 202319 - protein, 9 aa, Homo Sapiens
CQQTAIHQV

SEQ ID NO: 202320 - protein, 9 aa, Homo Sapiens
GSSPATSRA

SEQ ID NO: 202321 - protein, 9 aa, Homo Sapiens
TLSYDSVKY

SEQ ID NO: 202322 - protein, 9 aa, Homo Sapiens
VWPKKINNI

SEQ ID NO: 202323 - protein, 9 aa, Homo Sapiens
HWNGKKMLS

SEQ ID NO: 202324 - protein, 9 aa, Homo Sapiens
GMMHCSQLA

SEQ ID NO: 202325 - protein, 9 aa, Homo Sapiens
NCSTPGVAS

SEQ ID NO: 202326 - protein, 9 aa, Homo Sapiens
DNFKGKFPE

SEQ ID NO: 202327 - protein, 9 aa, Homo Sapiens
AIVTIKTKR

SEQ ID NO: 202328 - protein, 9 aa, Homo Sapiens
LRSTDAVVG

SEQ ID NO: 202329 - protein, 9 aa, Homo Sapiens
EQFPDLSCE

SEQ ID NO: 202330 - protein, 9 aa, Homo Sapiens
KLYVIRGGP

SEQ ID NO: 202331 - protein, 9 aa, Homo Sapiens
HKQIHTGEK

SEQ ID NO: 202332 - protein, 9 aa, Homo Sapiens
DGIQKVWQK

SEQ ID NO: 202333 - protein, 9 aa, Homo Sapiens
LGGEVIAWW

SEQ ID NO: 202334 - protein, 9 aa, Homo Sapiens
SWAEGSVKT

SEQ ID NO: 202335 - protein, 9 aa, Homo Sapiens
RAKEPLCAR

SEQ ID NO: 202336 - protein, 9 aa, Homo Sapiens
VASEQYIDT

SEQ ID NO: 202337 - protein, 9 aa, Homo Sapiens
TNDGGELPD

SEQ ID NO: 202338 - protein, 9 aa, Homo Sapiens
VRGNPRGNT

SEQ ID NO: 202339 - protein, 9 aa, Homo Sapiens
FTDAICMYR

SEQ ID NO: 202340 - protein, 9 aa, Homo Sapiens
RVLVHCPHG

SEQ ID NO: 202341 - protein, 9 aa, Homo Sapiens
EEMCPPEIG

SEQ ID NO: 202342 - protein, 9 aa, Homo Sapiens
LFLMTGIFY

SEQ ID NO: 202343 - protein, 9 aa, Homo Sapiens
SESTSTLKA

SEQ ID NO: 202344 - protein, 9 aa, Homo Sapiens
LQKYLRITW

SEQ ID NO: 202345 - protein, 9 aa, Homo Sapiens
PKLPNHLTG

SEQ ID NO: 202346 - protein, 9 aa, Homo Sapiens
TAVFMPYSA

SEQ ID NO: 202347 - protein, 9 aa, Homo Sapiens
MEGKSYDYN

SEQ ID NO: 202348 - protein, 9 aa, Homo Sapiens
AHFAPLSPG

SEQ ID NO: 202349 - protein, 9 aa, Homo Sapiens
LSGIHHFAR

SEQ ID NO: 202350 - protein, 9 aa, Homo Sapiens
QDGLKLMLL

SEQ ID NO: 202351 - protein, 9 aa, Homo Sapiens
EIPLELQCL

SEQ ID NO: 202352 - protein, 9 aa, Homo Sapiens
NKEEDVTHE

SEQ ID NO: 202353 - protein, 9 aa, Homo Sapiens
RRLVVRFTA

SEQ ID NO: 202354 - protein, 9 aa, Homo Sapiens
AWLMAVALA

SEQ ID NO: 202355 - protein, 9 aa, Homo Sapiens
PPPSLEPLA

SEQ ID NO: 202356 - protein, 9 aa, Homo Sapiens
APGALQPGV

SEQ ID NO: 202357 - protein, 9 aa, Homo Sapiens
EEKTVGHLF

SEQ ID NO: 202358 - protein, 9 aa, Homo Sapiens
GPYISDCCH

SEQ ID NO: 202359 - protein, 9 aa, Homo Sapiens
QSCNSSFCM

SEQ ID NO: 202360 - protein, 9 aa, Homo Sapiens
GYQSLTSGM

SEQ ID NO: 202361 - protein, 9 aa, Homo Sapiens
DIDMVEKTN

SEQ ID NO: 202362 - protein, 9 aa, Homo Sapiens
SDTAPSTTL

SEQ ID NO: 202363 - protein, 9 aa, Homo Sapiens
INYQGLCFS

SEQ ID NO: 202364 - protein, 9 aa, Homo Sapiens
NELRRTKKL

SEQ ID NO: 202365 - protein, 9 aa, Homo Sapiens
LIKNIKRKA

SEQ ID NO: 202366 - protein, 9 aa, Homo Sapiens
SYIHTRYPH

SEQ ID NO: 202367 - protein, 9 aa, Homo Sapiens
SEENFNMEA

SEQ ID NO: 202368 - protein, 9 aa, Homo Sapiens
VKRVSGLIY

SEQ ID NO: 202369 - protein, 9 aa, Homo Sapiens
IGNLQLAKQ

SEQ ID NO: 202370 - protein, 9 aa, Homo Sapiens
GDMGLHGLS

SEQ ID NO: 202371 - protein, 9 aa, Homo Sapiens
CTRKFGLLL

SEQ ID NO: 202372 - protein, 9 aa, Homo Sapiens
VEKEERHGS

SEQ ID NO: 202373 - protein, 9 aa, Homo Sapiens
DAICMYRQS

SEQ ID NO: 202374 - protein, 9 aa, Homo Sapiens
SRAHCPANG

SEQ ID NO: 202375 - protein, 9 aa, Homo Sapiens
LSDEIQMAL

SEQ ID NO: 202376 - protein, 9 aa, Homo Sapiens
CVRLQRHGM

SEQ ID NO: 202377 - protein, 9 aa, Homo Sapiens
AFLASWLTS

SEQ ID NO: 202378 - protein, 9 aa, Homo Sapiens
YLKIPDEQH

SEQ ID NO: 202379 - protein, 9 aa, Homo Sapiens
RLLAFVEAR

SEQ ID NO: 202380 - protein, 9 aa, Homo Sapiens
QLFKNVFIW

SEQ ID NO: 202381 - protein, 9 aa, Homo Sapiens
VSPLLVKCY

SEQ ID NO: 202382 - protein, 9 aa, Homo Sapiens
ADYFSRSNH

SEQ ID NO: 202383 - protein, 9 aa, Homo Sapiens
ATLHRSRPE

SEQ ID NO: 202384 - protein, 9 aa, Homo Sapiens
GSQLKQHQR

SEQ ID NO: 202385 - protein, 9 aa, Homo Sapiens
LVLGLCALV

SEQ ID NO: 202386 - protein, 9 aa, Homo Sapiens
IAVWDDPDQ

SEQ ID NO: 202387 - protein, 9 aa, Homo Sapiens
LPSHTPLLN

SEQ ID NO: 202388 - protein, 9 aa, Homo Sapiens
RESLGWTDF

SEQ ID NO: 202389 - protein, 9 aa, Homo Sapiens
CESRIRGLG

SEQ ID NO: 202390 - protein, 9 aa, Homo Sapiens
LNVTALPLP

SEQ ID NO: 202391 - protein, 9 aa, Homo Sapiens
LDNRHQGFK

SEQ ID NO: 202392 - protein, 9 aa, Homo Sapiens
ANAVLHKAL

SEQ ID NO: 202393 - protein, 9 aa, Homo Sapiens
GLTLSDEIQ

SEQ ID NO: 202394 - protein, 9 aa, Homo Sapiens
APPGTFVCT

SEQ ID NO: 202395 - protein, 9 aa, Homo Sapiens
DLFFHWLFD

SEQ ID NO: 202396 - protein, 9 aa, Homo Sapiens
ASLARKCLT

SEQ ID NO: 202397 - protein, 9 aa, Homo Sapiens
GYDLERGTH

SEQ ID NO: 202398 - protein, 9 aa, Homo Sapiens
STLYWKVWP

SEQ ID NO: 202399 - protein, 9 aa, Homo Sapiens
PHWYFDVER

SEQ ID NO: 202400 - protein, 9 aa, Homo Sapiens
RCLFTVLPD

SEQ ID NO: 202401 - protein, 9 aa, Homo Sapiens
AWLLLVDLT

SEQ ID NO: 202402 - protein, 9 aa, Homo Sapiens
LQYCSTVAD

SEQ ID NO: 202403 - protein, 9 aa, Homo Sapiens
RSQAHVTVS

SEQ ID NO: 202404 - protein, 9 aa, Homo Sapiens
VEFLDWADV

SEQ ID NO: 202405 - protein, 9 aa, Homo Sapiens
GVSLTSFLF

SEQ ID NO: 202406 - protein, 9 aa, Homo Sapiens
PQNDDPNPV

SEQ ID NO: 202407 - protein, 9 aa, Homo Sapiens
GGAGGGDGD

SEQ ID NO: 202408 - protein, 9 aa, Homo Sapiens
WRTHQADHV

SEQ ID NO: 202409 - protein, 9 aa, Homo Sapiens
QAQTLVIQP

SEQ ID NO: 202410 - protein, 9 aa, Homo Sapiens
AALSRHGIW

SEQ ID NO: 202411 - protein, 9 aa, Homo Sapiens
SMLKTHMRS

SEQ ID NO: 202412 - protein, 9 aa, Homo Sapiens
SIHDHQASL

SEQ ID NO: 202413 - protein, 9 aa, Homo Sapiens
QGQTMVCQL

SEQ ID NO: 202414 - protein, 9 aa, Homo Sapiens
ALYIGIEDS

SEQ ID NO: 202415 - protein, 9 aa, Homo Sapiens
QCQCWSAET

SEQ ID NO: 202416 - protein, 9 aa, Homo Sapiens
DYIIPAQGE

SEQ ID NO: 202417 - protein, 9 aa, Homo Sapiens
CYNCGRDGH

SEQ ID NO: 202418 - protein, 9 aa, Homo Sapiens
SVVVGILLV

SEQ ID NO: 202419 - protein, 9 aa, Homo Sapiens
ISDVPPGVE

SEQ ID NO: 202420 - protein, 9 aa, Homo Sapiens
RKQESGLGF

SEQ ID NO: 202421 - protein, 9 aa, Homo Sapiens
LVLELGEEV

SEQ ID NO: 202422 - protein, 9 aa, Homo Sapiens
GHLLREVNA

SEQ ID NO: 202423 - protein, 9 aa, Homo Sapiens
ASSGMISIV

SEQ ID NO: 202424 - protein, 9 aa, Homo Sapiens
SVWQESVEP

SEQ ID NO: 202425 - protein, 9 aa, Homo Sapiens
VLNTVWDLW

SEQ ID NO: 202426 - protein, 9 aa, Homo Sapiens
FTEDRDHMT

SEQ ID NO: 202427 - protein, 9 aa, Homo Sapiens
SAMTKQDQI

SEQ ID NO: 202428 - protein, 9 aa, Homo Sapiens
EFMYQLPAF

SEQ ID NO: 202429 - protein, 9 aa, Homo Sapiens
DCNAANICC

SEQ ID NO: 202430 - protein, 9 aa, Homo Sapiens
SSCIRQYRI

SEQ ID NO: 202431 - protein, 9 aa, Homo Sapiens
LANVTLIDY

SEQ ID NO: 202432 - protein, 9 aa, Homo Sapiens
RRKEQRLPQ

SEQ ID NO: 202433 - protein, 9 aa, Homo Sapiens
FACVSKPPV

SEQ ID NO: 202434 - protein, 9 aa, Homo Sapiens
QKYLRITWQ

SEQ ID NO: 202435 - protein, 9 aa, Homo Sapiens
YAAICHPLL

SEQ ID NO: 202436 - protein, 9 aa, Homo Sapiens
TLCILANIV

SEQ ID NO: 202437 - protein, 9 aa, Homo Sapiens
LCGHVPFEA

SEQ ID NO: 202438 - protein, 9 aa, Homo Sapiens
AEGKVVYSS

SEQ ID NO: 202439 - protein, 9 aa, Homo Sapiens
QGLILNVTA

SEQ ID NO: 202440 - protein, 9 aa, Homo Sapiens
CLVRFLFYA

SEQ ID NO: 202441 - protein, 9 aa, Homo Sapiens
EPPQHRQDV

SEQ ID NO: 202442 - protein, 9 aa, Homo Sapiens
HEKIKQFSQ

SEQ ID NO: 202443 - protein, 9 aa, Homo Sapiens
IITDKVIPA

SEQ ID NO: 202444 - protein, 9 aa, Homo Sapiens
MGRQDQDTG

SEQ ID NO: 202445 - protein, 9 aa, Homo Sapiens
RDSNRQAHK

SEQ ID NO: 202446 - protein, 9 aa, Homo Sapiens
KPYEFNDHG

SEQ ID NO: 202447 - protein, 9 aa, Homo Sapiens
DVFRGIQVV

SEQ ID NO: 202448 - protein, 9 aa, Homo Sapiens
NSYHLQSWL

SEQ ID NO: 202449 - protein, 9 aa, Homo Sapiens
FRSIPYKEF

SEQ ID NO: 202450 - protein, 9 aa, Homo Sapiens
DESKLAMEH

SEQ ID NO: 202451 - protein, 9 aa, Homo Sapiens
FKGDIRTIF

SEQ ID NO: 202452 - protein, 9 aa, Homo Sapiens
DSFPDDRVQ

SEQ ID NO: 202453 - protein, 9 aa, Homo Sapiens
YSMMLRLST

SEQ ID NO: 202454 - protein, 9 aa, Homo Sapiens
INGEKLGLP

SEQ ID NO: 202455 - protein, 9 aa, Homo Sapiens
SAFPVDTLQ

SEQ ID NO: 202456 - protein, 9 aa, Homo Sapiens
LPRAYTCFN

SEQ ID NO: 202457 - protein, 9 aa, Homo Sapiens
SSPWCDYTS

SEQ ID NO: 202458 - protein, 9 aa, Homo Sapiens
LMPPCSSWV

SEQ ID NO: 202459 - protein, 9 aa, Homo Sapiens
GDALWLECV

SEQ ID NO: 202460 - protein, 9 aa, Homo Sapiens
NSKWFDDLP

SEQ ID NO: 202461 - protein, 9 aa, Homo Sapiens
RIVTYHHHL

SEQ ID NO: 202462 - protein, 9 aa, Homo Sapiens
ECLWPGQPH

SEQ ID NO: 202463 - protein, 9 aa, Homo Sapiens
SSVDKRSGA

SEQ ID NO: 202464 - protein, 9 aa, Homo Sapiens
NIFKTDIVL

SEQ ID NO: 202465 - protein, 9 aa, Homo Sapiens
DSFDTMWRI

SEQ ID NO: 202466 - protein, 9 aa, Homo Sapiens
EEAVAVAAR

SEQ ID NO: 202467 - protein, 9 aa, Homo Sapiens
KDGNESREC

SEQ ID NO: 202468 - protein, 9 aa, Homo Sapiens
RQRLPAALH

SEQ ID NO: 202469 - protein, 9 aa, Homo Sapiens
DDFLANGAK

SEQ ID NO: 202470 - protein, 9 aa, Homo Sapiens
IDVLWIKWA

SEQ ID NO: 202471 - protein, 9 aa, Homo Sapiens
WADVRLTLK

SEQ ID NO: 202472 - protein, 9 aa, Homo Sapiens
HTPLLNGLD

SEQ ID NO: 202473 - protein, 9 aa, Homo Sapiens
LELLRNSDE

SEQ ID NO: 202474 - protein, 9 aa, Homo Sapiens
WNEKCHDYY

SEQ ID NO: 202475 - protein, 9 aa, Homo Sapiens
RSRMHRFVL

SEQ ID NO: 202476 - protein, 9 aa, Homo Sapiens
GRVAFVSGP

SEQ ID NO: 202477 - protein, 9 aa, Homo Sapiens
PCTKEPRIQ

SEQ ID NO: 202478 - protein, 9 aa, Homo Sapiens
FITILCTCS

SEQ ID NO: 202479 - protein, 9 aa, Homo Sapiens
EEVLDVDNV

SEQ ID NO: 202480 - protein, 9 aa, Homo Sapiens
YSKTSYSLV

SEQ ID NO: 202481 - protein, 9 aa, Homo Sapiens
KPPPDSQEM

SEQ ID NO: 202482 - protein, 9 aa, Homo Sapiens
TEGLFQKSG

SEQ ID NO: 202483 - protein, 9 aa, Homo Sapiens
HLGICLDYE

SEQ ID NO: 202484 - protein, 9 aa, Homo Sapiens
VQMEPDQLP

SEQ ID NO: 202485 - protein, 9 aa, Homo Sapiens
CKDVAQCIL

SEQ ID NO: 202486 - protein, 9 aa, Homo Sapiens
CVSKPPVLQ

SEQ ID NO: 202487 - protein, 9 aa, Homo Sapiens
LHHGDFSAD

SEQ ID NO: 202488 - protein, 9 aa, Homo Sapiens
RALPPTAKS

SEQ ID NO: 202489 - protein, 9 aa, Homo Sapiens
TLCQGQEHI

SEQ ID NO: 202490 - protein, 9 aa, Homo Sapiens
LVELEAAWR

SEQ ID NO: 202491 - protein, 9 aa, Homo Sapiens
HRKSIFFVG

SEQ ID NO: 202492 - protein, 9 aa, Homo Sapiens
LSKHLAFER

SEQ ID NO: 202493 - protein, 9 aa, Homo Sapiens
NIHFTNGYE

SEQ ID NO: 202494 - protein, 9 aa, Homo Sapiens
LRRERIHTG

SEQ ID NO: 202495 - protein, 9 aa, Homo Sapiens
IFFVMPLHH

SEQ ID NO: 202496 - protein, 9 aa, Homo Sapiens
MVEKQESIH

SEQ ID NO: 202497 - protein, 9 aa, Homo Sapiens
DWLVLAVKQ

SEQ ID NO: 202498 - protein, 9 aa, Homo Sapiens
EGCSHCCPP

SEQ ID NO: 202499 - protein, 9 aa, Homo Sapiens
IHLWDTYQS

SEQ ID NO: 202500 - protein, 9 aa, Homo Sapiens
PQPALPVHP

SEQ ID NO: 202501 - protein, 9 aa, Homo Sapiens
NYESKKHSD

SEQ ID NO: 202502 - protein, 9 aa, Homo Sapiens
MFMDMDNFL

SEQ ID NO: 202503 - protein, 9 aa, Homo Sapiens
ALSVTLPMS

SEQ ID NO: 202504 - protein, 9 aa, Homo Sapiens
DMKRRGSGH

SEQ ID NO: 202505 - protein, 9 aa, Homo Sapiens
PSLGSYSGT

SEQ ID NO: 202506 - protein, 9 aa, Homo Sapiens
PEGVDPPHR

SEQ ID NO: 202507 - protein, 9 aa, Homo Sapiens
ASRSFPDHR

SEQ ID NO: 202508 - protein, 9 aa, Homo Sapiens
CKFPAGKVP

SEQ ID NO: 202509 - protein, 9 aa, Homo Sapiens
ENTCKDKTH

SEQ ID NO: 202510 - protein, 9 aa, Homo Sapiens
PSIRDKWSR

SEQ ID NO: 202511 - protein, 9 aa, Homo Sapiens
QLDSEEMDP

SEQ ID NO: 202512 - protein, 9 aa, Homo Sapiens
VLTELGLHF

SEQ ID NO: 202513 - protein, 9 aa, Homo Sapiens
VCLISIQLD

SEQ ID NO: 202514 - protein, 9 aa, Homo Sapiens
TKELNIQLS

SEQ ID NO: 202515 - protein, 9 aa, Homo Sapiens
KSRTMTTKN

SEQ ID NO: 202516 - protein, 9 aa, Homo Sapiens
NFYKELQAH

SEQ ID NO: 202517 - protein, 9 aa, Homo Sapiens
EKQHPFQNL

SEQ ID NO: 202518 - protein, 9 aa, Homo Sapiens
AASPSSVIR

SEQ ID NO: 202519 - protein, 9 aa, Homo Sapiens
SAMASFLNG

SEQ ID NO: 202520 - protein, 9 aa, Homo Sapiens
KLEYLKIPD

SEQ ID NO: 202521 - protein, 9 aa, Homo Sapiens
VPATIILAC

SEQ ID NO: 202522 - protein, 9 aa, Homo Sapiens
TEDNVKKRI

SEQ ID NO: 202523 - protein, 9 aa, Homo Sapiens
AHAKLWEEA

SEQ ID NO: 202524 - protein, 9 aa, Homo Sapiens
QFLVSASSS

SEQ ID NO: 202525 - protein, 9 aa, Homo Sapiens
PLLSSSLPR

SEQ ID NO: 202526 - protein, 9 aa, Homo Sapiens
VGVISDRLE

SEQ ID NO: 202527 - protein, 9 aa, Homo Sapiens
VHSICNEPW

SEQ ID NO: 202528 - protein, 9 aa, Homo Sapiens
KDLAARLPA

SEQ ID NO: 202529 - protein, 9 aa, Homo Sapiens
QKLNSVDRL

SEQ ID NO: 202530 - protein, 9 aa, Homo Sapiens
GGEDDLVTM

SEQ ID NO: 202531 - protein, 9 aa, Homo Sapiens
SRPVQGLSE

SEQ ID NO: 202532 - protein, 9 aa, Homo Sapiens
QCYHGFLNT

SEQ ID NO: 202533 - protein, 9 aa, Homo Sapiens
ELCCDAAQF

SEQ ID NO: 202534 - protein, 9 aa, Homo Sapiens
PMQLIIVNI

SEQ ID NO: 202535 - protein, 9 aa, Homo Sapiens
DRVKQNIYS

SEQ ID NO: 202536 - protein, 9 aa, Homo Sapiens
SYMRMLMHW

SEQ ID NO: 202537 - protein, 9 aa, Homo Sapiens
HSSKLLGWC

SEQ ID NO: 202538 - protein, 9 aa, Homo Sapiens
EAQLWWAAN

SEQ ID NO: 202539 - protein, 9 aa, Homo Sapiens
TFVLSITTT

SEQ ID NO: 202540 - protein, 9 aa, Homo Sapiens
SKKVAWDPR

SEQ ID NO: 202541 - protein, 9 aa, Homo Sapiens
GNLWEKLCE

SEQ ID NO: 202542 - protein, 9 aa, Homo Sapiens
VQLQTQQEQ

SEQ ID NO: 202543 - protein, 9 aa, Homo Sapiens
VFEHYVQDV

SEQ ID NO: 202544 - protein, 9 aa, Homo Sapiens
DPTMDPDPI

SEQ ID NO: 202545 - protein, 9 aa, Homo Sapiens
ETCIVNIAL

SEQ ID NO: 202546 - protein, 9 aa, Homo Sapiens
ERIHTAFAP

SEQ ID NO: 202547 - protein, 9 aa, Homo Sapiens
RTPAWMENP

SEQ ID NO: 202548 - protein, 9 aa, Homo Sapiens
TTPPYTENV

SEQ ID NO: 202549 - protein, 9 aa, Homo Sapiens
KDLEGQMFE

SEQ ID NO: 202550 - protein, 9 aa, Homo Sapiens
SDKQQSTMP

SEQ ID NO: 202551 - protein, 9 aa, Homo Sapiens
EKAIECYRR

SEQ ID NO: 202552 - protein, 9 aa, Homo Sapiens
VGEELVDDH

SEQ ID NO: 202553 - protein, 9 aa, Homo Sapiens
AVVSHNKGH

SEQ ID NO: 202554 - protein, 9 aa, Homo Sapiens
PASLARKCL

SEQ ID NO: 202555 - protein, 9 aa, Homo Sapiens
HTVVAVEVQ

SEQ ID NO: 202556 - protein, 9 aa, Homo Sapiens
GNKSISFPG

SEQ ID NO: 202557 - protein, 9 aa, Homo Sapiens
SVFTGYELE

SEQ ID NO: 202558 - protein, 9 aa, Homo Sapiens
SHRALPPTA

SEQ ID NO: 202559 - protein, 9 aa, Homo Sapiens
LGNMPLHLA

SEQ ID NO: 202560 - protein, 9 aa, Homo Sapiens
EEGEQARWS

SEQ ID NO: 202561 - protein, 9 aa, Homo Sapiens
SAQIAKQLE

SEQ ID NO: 202562 - protein, 9 aa, Homo Sapiens
IILRMLADL

SEQ ID NO: 202563 - protein, 9 aa, Homo Sapiens
SGMHTVAMA

SEQ ID NO: 202564 - protein, 9 aa, Homo Sapiens
KYYVLLPLV

SEQ ID NO: 202565 - protein, 9 aa, Homo Sapiens
PALSGQVLG

SEQ ID NO: 202566 - protein, 9 aa, Homo Sapiens
NLMELKLMM

SEQ ID NO: 202567 - protein, 9 aa, Homo Sapiens
HNMSFWSSI

SEQ ID NO: 202568 - protein, 9 aa, Homo Sapiens
CSSDELPVM

SEQ ID NO: 202569 - protein, 9 aa, Homo Sapiens
KMLLQNYIQ

SEQ ID NO: 202570 - protein, 9 aa, Homo Sapiens
IRNMCNIDV

SEQ ID NO: 202571 - protein, 9 aa, Homo Sapiens
DSMKSECVG

SEQ ID NO: 202572 - protein, 9 aa, Homo Sapiens
SLDLFFHWL

SEQ ID NO: 202573 - protein, 9 aa, Homo Sapiens
GTQLCGPAV

SEQ ID NO: 202574 - protein, 9 aa, Homo Sapiens
SSVPRFYWK

SEQ ID NO: 202575 - protein, 9 aa, Homo Sapiens
SQAAYLALN

SEQ ID NO: 202576 - protein, 9 aa, Homo Sapiens
VCTERQCPG

SEQ ID NO: 202577 - protein, 9 aa, Homo Sapiens
RERLDGLVE

SEQ ID NO: 202578 - protein, 9 aa, Homo Sapiens
AYQEDPVYL

SEQ ID NO: 202579 - protein, 9 aa, Homo Sapiens
VPTPITETE

SEQ ID NO: 202580 - protein, 9 aa, Homo Sapiens
YKTQFDEGW

SEQ ID NO: 202581 - protein, 9 aa, Homo Sapiens
TRSVGLKWR

SEQ ID NO: 202582 - protein, 9 aa, Homo Sapiens
CNILIDFTK

SEQ ID NO: 202583 - protein, 9 aa, Homo Sapiens
MDDMSRTCG

SEQ ID NO: 202584 - protein, 9 aa, Homo Sapiens
VCTMPLANH

SEQ ID NO: 202585 - protein, 9 aa, Homo Sapiens
EQRLLWKVF

SEQ ID NO: 202586 - protein, 9 aa, Homo Sapiens
EEEGEDDEE

SEQ ID NO: 202587 - protein, 9 aa, Homo Sapiens
LGLTHMNIS

SEQ ID NO: 202588 - protein, 9 aa, Homo Sapiens
VVRFTALDL

SEQ ID NO: 202589 - protein, 9 aa, Homo Sapiens
SSYSYCGRG

SEQ ID NO: 202590 - protein, 9 aa, Homo Sapiens
VLDEPREFP

SEQ ID NO: 202591 - protein, 9 aa, Homo Sapiens
VSLTHHPVG

SEQ ID NO: 202592 - protein, 9 aa, Homo Sapiens
QAQKKGTVV

SEQ ID NO: 202593 - protein, 9 aa, Homo Sapiens
LLVQWLFGG

SEQ ID NO: 202594 - protein, 9 aa, Homo Sapiens
CCYYASDIV

SEQ ID NO: 202595 - protein, 9 aa, Homo Sapiens
LASWLTSCY

SEQ ID NO: 202596 - protein, 9 aa, Homo Sapiens
IGGVSLTSF

SEQ ID NO: 202597 - protein, 9 aa, Homo Sapiens
PENEKQQRA

SEQ ID NO: 202598 - protein, 9 aa, Homo Sapiens
VENYLGNRD

SEQ ID NO: 202599 - protein, 9 aa, Homo Sapiens
SEVQSDSPQ

SEQ ID NO: 202600 - protein, 9 aa, Homo Sapiens
KNRMYLTPS

SEQ ID NO: 202601 - protein, 9 aa, Homo Sapiens
SASQLHTGI

SEQ ID NO: 202602 - protein, 9 aa, Homo Sapiens
RVKPLSQVT

SEQ ID NO: 202603 - protein, 9 aa, Homo Sapiens
NTFFSETRA

SEQ ID NO: 202604 - protein, 9 aa, Homo Sapiens
NNKLQQLEA

SEQ ID NO: 202605 - protein, 9 aa, Homo Sapiens
EMAEEAGVE

SEQ ID NO: 202606 - protein, 9 aa, Homo Sapiens
RDLDALDKQ

SEQ ID NO: 202607 - protein, 9 aa, Homo Sapiens
TMFRAQPHS

SEQ ID NO: 202608 - protein, 9 aa, Homo Sapiens
QGVEIAAVT

SEQ ID NO: 202609 - protein, 9 aa, Homo Sapiens
VSTPPHHSS

SEQ ID NO: 202610 - protein, 9 aa, Homo Sapiens
GEQRCFARY

SEQ ID NO: 202611 - protein, 9 aa, Homo Sapiens
SQVGDPITE

SEQ ID NO: 202612 - protein, 9 aa, Homo Sapiens
WAANELRRT

SEQ ID NO: 202613 - protein, 9 aa, Homo Sapiens
VQTFQAKCH

SEQ ID NO: 202614 - protein, 9 aa, Homo Sapiens
RFTWSHLSK

SEQ ID NO: 202615 - protein, 9 aa, Homo Sapiens
FISSGQSLG

SEQ ID NO: 202616 - protein, 9 aa, Homo Sapiens
EMILKIFVQ

SEQ ID NO: 202617 - protein, 9 aa, Homo Sapiens
HTPQLCTRA

SEQ ID NO: 202618 - protein, 9 aa, Homo Sapiens
TGTSLDRWS

SEQ ID NO: 202619 - protein, 9 aa, Homo Sapiens
IVGQLKRQL

SEQ ID NO: 202620 - protein, 9 aa, Homo Sapiens
HKKYEEGEQ

SEQ ID NO: 202621 - protein, 9 aa, Homo Sapiens
GTQRIFELG

SEQ ID NO: 202622 - protein, 9 aa, Homo Sapiens
AHQMVCTDS

SEQ ID NO: 202623 - protein, 9 aa, Homo Sapiens
EEPVEALAL

SEQ ID NO: 202624 - protein, 9 aa, Homo Sapiens
VKQANCPLY

SEQ ID NO: 202625 - protein, 9 aa, Homo Sapiens
ENTLWPNLT

SEQ ID NO: 202626 - protein, 9 aa, Homo Sapiens
TEVCDVNTG

SEQ ID NO: 202627 - protein, 9 aa, Homo Sapiens
GRRLGISCL

SEQ ID NO: 202628 - protein, 9 aa, Homo Sapiens
PIKKLGEHA

SEQ ID NO: 202629 - protein, 9 aa, Homo Sapiens
RLLVQWLFG

SEQ ID NO: 202630 - protein, 9 aa, Homo Sapiens
CPLGFKVKS

SEQ ID NO: 202631 - protein, 9 aa, Homo Sapiens
NVLAYKTQQ

SEQ ID NO: 202632 - protein, 9 aa, Homo Sapiens
CVRTVMNSR

SEQ ID NO: 202633 - protein, 9 aa, Homo Sapiens
AVLLNNMRV

SEQ ID NO: 202634 - protein, 9 aa, Homo Sapiens
VCQRSNGEQ

SEQ ID NO: 202635 - protein, 9 aa, Homo Sapiens
ICQQARLLR

SEQ ID NO: 202636 - protein, 9 aa, Homo Sapiens
YKDVINRSM

SEQ ID NO: 202637 - protein, 9 aa, Homo Sapiens
SDVWKGENW

SEQ ID NO: 202638 - protein, 9 aa, Homo Sapiens
KHQQVHTGK

SEQ ID NO: 202639 - protein, 9 aa, Homo Sapiens
RGWYTYTYL

SEQ ID NO: 202640 - protein, 9 aa, Homo Sapiens
TPASHQRSS

SEQ ID NO: 202641 - protein, 9 aa, Homo Sapiens
PPPRLPLRP

SEQ ID NO: 202642 - protein, 9 aa, Homo Sapiens
PLSPSPRQP

SEQ ID NO: 202643 - protein, 9 aa, Homo Sapiens
PPPGWLPRL

SEQ ID NO: 202644 - protein, 9 aa, Homo Sapiens
MCAFLGMEC

SEQ ID NO: 202645 - protein, 9 aa, Homo Sapiens
PAPGAGGGD

SEQ ID NO: 202646 - protein, 9 aa, Homo Sapiens
NGGRRGGDG

SEQ ID NO: 202647 - protein, 9 aa, Homo Sapiens
ELLETCIVN

SEQ ID NO: 202648 - protein, 9 aa, Homo Sapiens
EEMDKMRKM

SEQ ID NO: 202649 - protein, 9 aa, Homo Sapiens
HECCVSRNI

SEQ ID NO: 202650 - protein, 9 aa, Homo Sapiens
ARHVVFAEL

SEQ ID NO: 202651 - protein, 9 aa, Homo Sapiens
TLVIQPMLQ

SEQ ID NO: 202652 - protein, 9 aa, Homo Sapiens
HHCRVPLSP

SEQ ID NO: 202653 - protein, 9 aa, Homo Sapiens
FLPCRPRPR

SEQ ID NO: 202654 - protein, 9 aa, Homo Sapiens
FGCPVSSPM

SEQ ID NO: 202655 - protein, 9 aa, Homo Sapiens
LRFLENVLA

SEQ ID NO: 202656 - protein, 9 aa, Homo Sapiens
MTSEERQCL

SEQ ID NO: 202657 - protein, 9 aa, Homo Sapiens
DRDPTAFAP

SEQ ID NO: 202658 - protein, 9 aa, Homo Sapiens
AAAPPFRAA

SEQ ID NO: 202659 - protein, 9 aa, Homo Sapiens
GNWAYRDHL

SEQ ID NO: 202660 - protein, 9 aa, Homo Sapiens
EDHREASSC

SEQ ID NO: 202661 - protein, 9 aa, Homo Sapiens
PDIVGQLKR

SEQ ID NO: 202662 - protein, 9 aa, Homo Sapiens
DKAVQALLR

SEQ ID NO: 202663 - protein, 9 aa, Homo Sapiens
DGLYLVLHT

SEQ ID NO: 202664 - protein, 9 aa, Homo Sapiens
PLPNKPRPQ

SEQ ID NO: 202665 - protein, 9 aa, Homo Sapiens
MTEVVRHCP

SEQ ID NO: 202666 - protein, 9 aa, Homo Sapiens
GPELSRHIY

SEQ ID NO: 202667 - protein, 9 aa, Homo Sapiens
QYCCKFDID

SEQ ID NO: 202668 - protein, 9 aa, Homo Sapiens
VINRSMVED

SEQ ID NO: 202669 - protein, 9 aa, Homo Sapiens
HMDTIVFPT

SEQ ID NO: 202670 - protein, 9 aa, Homo Sapiens
QPALPVHPE

SEQ ID NO: 202671 - protein, 9 aa, Homo Sapiens
SFPDDRVQD

SEQ ID NO: 202672 - protein, 9 aa, Homo Sapiens
EAPLLIHPY

SEQ ID NO: 202673 - protein, 9 aa, Homo Sapiens
SFNATATFK

SEQ ID NO: 202674 - protein, 9 aa, Homo Sapiens
VIYTAVFMP

SEQ ID NO: 202675 - protein, 9 aa, Homo Sapiens
PLLIHPYLG

SEQ ID NO: 202676 - protein, 9 aa, Homo Sapiens
VHDYFEGSG

SEQ ID NO: 202677 - protein, 9 aa, Homo Sapiens
MRVEYEALA

SEQ ID NO: 202678 - protein, 9 aa, Homo Sapiens
RKVGILYCW

SEQ ID NO: 202679 - protein, 9 aa, Homo Sapiens
PSQDLHLPL

SEQ ID NO: 202680 - protein, 9 aa, Homo Sapiens
NASMLRVSY

SEQ ID NO: 202681 - protein, 9 aa, Homo Sapiens
ATPPCSPLL

SEQ ID NO: 202682 - protein, 9 aa, Homo Sapiens
CCSTKIDLS

SEQ ID NO: 202683 - protein, 9 aa, Homo Sapiens
AAGAAGRVT

SEQ ID NO: 202684 - protein, 9 aa, Homo Sapiens
DLYLNANSF

SEQ ID NO: 202685 - protein, 9 aa, Homo Sapiens
DPPPGPRGE

SEQ ID NO: 202686 - protein, 9 aa, Homo Sapiens
EQPGPYSHH

SEQ ID NO: 202687 - protein, 9 aa, Homo Sapiens
EEFFNMSHC

SEQ ID NO: 202688 - protein, 9 aa, Homo Sapiens
VYSSLELAQ

SEQ ID NO: 202689 - protein, 9 aa, Homo Sapiens
SQWASPENL

SEQ ID NO: 202690 - protein, 9 aa, Homo Sapiens
PRRRRRLCL

SEQ ID NO: 202691 - protein, 9 aa, Homo Sapiens
RPSAWLLLV

SEQ ID NO: 202692 - protein, 9 aa, Homo Sapiens
KKYFVTSYK

SEQ ID NO: 202693 - protein, 9 aa, Homo Sapiens
GCMYKLFSH

SEQ ID NO: 202694 - protein, 9 aa, Homo Sapiens
RPSGHRLQA

SEQ ID NO: 202695 - protein, 9 aa, Homo Sapiens
GAAMKASVK

SEQ ID NO: 202696 - protein, 9 aa, Homo Sapiens
QRALERELK

SEQ ID NO: 202697 - protein, 9 aa, Homo Sapiens
TLKERLSYH

SEQ ID NO: 202698 - protein, 9 aa, Homo Sapiens
SLGKRPFPH

SEQ ID NO: 202699 - protein, 9 aa, Homo Sapiens
TEESVNESA

SEQ ID NO: 202700 - protein, 9 aa, Homo Sapiens
VYWREAVKS

SEQ ID NO: 202701 - protein, 9 aa, Homo Sapiens
LEGPPVGGQ

SEQ ID NO: 202702 - protein, 9 aa, Homo Sapiens
SMCKASNRR

SEQ ID NO: 202703 - protein, 9 aa, Homo Sapiens
PKKTCTNYS

SEQ ID NO: 202704 - protein, 9 aa, Homo Sapiens
EIENLMSQV

SEQ ID NO: 202705 - protein, 9 aa, Homo Sapiens
KRSVLQDYI

SEQ ID NO: 202706 - protein, 9 aa, Homo Sapiens
PLVVHTGAP

SEQ ID NO: 202707 - protein, 9 aa, Homo Sapiens
VMVMELLWP

SEQ ID NO: 202708 - protein, 9 aa, Homo Sapiens
IGGLVYLQR

SEQ ID NO: 202709 - protein, 9 aa, Homo Sapiens
KQVCEPENT

SEQ ID NO: 202710 - protein, 9 aa, Homo Sapiens
PCSVYLFSF

SEQ ID NO: 202711 - protein, 9 aa, Homo Sapiens
AKVLPQLPL

SEQ ID NO: 202712 - protein, 9 aa, Homo Sapiens
ILDADFTKM

SEQ ID NO: 202713 - protein, 9 aa, Homo Sapiens
AVLNAAKEK

SEQ ID NO: 202714 - protein, 9 aa, Homo Sapiens
KQCAAPKVS

SEQ ID NO: 202715 - protein, 9 aa, Homo Sapiens
SFAQVVIEV

SEQ ID NO: 202716 - protein, 9 aa, Homo Sapiens
FPPPECCRR

SEQ ID NO: 202717 - protein, 9 aa, Homo Sapiens
VELYTWDNS

SEQ ID NO: 202718 - protein, 9 aa, Homo Sapiens
LSGLWTQVH

SEQ ID NO: 202719 - protein, 9 aa, Homo Sapiens
FQKLVDLQE

SEQ ID NO: 202720 - protein, 9 aa, Homo Sapiens
PAPDKPVQM

SEQ ID NO: 202721 - protein, 9 aa, Homo Sapiens
TPRLNASLS

SEQ ID NO: 202722 - protein, 9 aa, Homo Sapiens
LEHWERSLQ

SEQ ID NO: 202723 - protein, 9 aa, Homo Sapiens
HIPCTPQLP

SEQ ID NO: 202724 - protein, 9 aa, Homo Sapiens
VRTTPVTSS

SEQ ID NO: 202725 - protein, 9 aa, Homo Sapiens
VVGREPQCW

SEQ ID NO: 202726 - protein, 9 aa, Homo Sapiens
IYPDPGLLS

SEQ ID NO: 202727 - protein, 9 aa, Homo Sapiens
KEHCNMKRH

SEQ ID NO: 202728 - protein, 9 aa, Homo Sapiens
AKDLEGQMF

SEQ ID NO: 202729 - protein, 9 aa, Homo Sapiens
RDSPPGGGG

SEQ ID NO: 202730 - protein, 9 aa, Homo Sapiens
CCRSSCCGS

SEQ ID NO: 202731 - protein, 9 aa, Homo Sapiens
LDESIQENV

SEQ ID NO: 202732 - protein, 9 aa, Homo Sapiens
CGRDGHIAK

SEQ ID NO: 202733 - protein, 9 aa, Homo Sapiens
VSDGSLLSM

SEQ ID NO: 202734 - protein, 9 aa, Homo Sapiens
IGDVHSLVL

SEQ ID NO: 202735 - protein, 9 aa, Homo Sapiens
NQTSSLRQE

SEQ ID NO: 202736 - protein, 9 aa, Homo Sapiens
VIASDLIIQ

SEQ ID NO: 202737 - protein, 9 aa, Homo Sapiens
LTQRGLSRS

SEQ ID NO: 202738 - protein, 9 aa, Homo Sapiens
VGVGASKEG

SEQ ID NO: 202739 - protein, 9 aa, Homo Sapiens
SMYSTPSSL

SEQ ID NO: 202740 - protein, 9 aa, Homo Sapiens
TNYDFSLYM

SEQ ID NO: 202741 - protein, 9 aa, Homo Sapiens
EELDSTRGR

SEQ ID NO: 202742 - protein, 9 aa, Homo Sapiens
LLFNGYILF

SEQ ID NO: 202743 - protein, 9 aa, Homo Sapiens
GDKLYKPKR

SEQ ID NO: 202744 - protein, 9 aa, Homo Sapiens
GVENLFIFG

SEQ ID NO: 202745 - protein, 9 aa, Homo Sapiens
NWFANYRRC

SEQ ID NO: 202746 - protein, 9 aa, Homo Sapiens
NCIFKNTLV

SEQ ID NO: 202747 - protein, 9 aa, Homo Sapiens
NTFMNTEKS

SEQ ID NO: 202748 - protein, 9 aa, Homo Sapiens
FLAFQIMPG

SEQ ID NO: 202749 - protein, 9 aa, Homo Sapiens
EVAAVPHAD

SEQ ID NO: 202750 - protein, 9 aa, Homo Sapiens
SWSPPLTAI

SEQ ID NO: 202751 - protein, 9 aa, Homo Sapiens
TKPEDSDCH

SEQ ID NO: 202752 - protein, 9 aa, Homo Sapiens
WPCPAVPLG

SEQ ID NO: 202753 - protein, 9 aa, Homo Sapiens
RMRGLVVNA

SEQ ID NO: 202754 - protein, 9 aa, Homo Sapiens
SWEQLSEYL

SEQ ID NO: 202755 - protein, 9 aa, Homo Sapiens
HGFKSPQLF

SEQ ID NO: 202756 - protein, 9 aa, Homo Sapiens
TGLSSPHLP

SEQ ID NO: 202757 - protein, 9 aa, Homo Sapiens
GGFCMYSKG

SEQ ID NO: 202758 - protein, 9 aa, Homo Sapiens
MDVARQREL

SEQ ID NO: 202759 - protein, 9 aa, Homo Sapiens
EEDEAGSAM

SEQ ID NO: 202760 - protein, 9 aa, Homo Sapiens
RSSSPTQLS

SEQ ID NO: 202761 - protein, 9 aa, Homo Sapiens
QTHSGEKPY

SEQ ID NO: 202762 - protein, 9 aa, Homo Sapiens
MSEPQHMAS

SEQ ID NO: 202763 - protein, 9 aa, Homo Sapiens
CWSAETPHK

SEQ ID NO: 202764 - protein, 9 aa, Homo Sapiens
LRIQDKPEE

SEQ ID NO: 202765 - protein, 9 aa, Homo Sapiens
APGPLGECI

SEQ ID NO: 202766 - protein, 9 aa, Homo Sapiens
KVRPCSVYL

SEQ ID NO: 202767 - protein, 9 aa, Homo Sapiens
SITHAYYRD

SEQ ID NO: 202768 - protein, 9 aa, Homo Sapiens
PAMPDNASQ

SEQ ID NO: 202769 - protein, 9 aa, Homo Sapiens
SRCRFLLAH

SEQ ID NO: 202770 - protein, 9 aa, Homo Sapiens
VIRTNFSTK

SEQ ID NO: 202771 - protein, 9 aa, Homo Sapiens
SNIGTVYEC

SEQ ID NO: 202772 - protein, 9 aa, Homo Sapiens
IDTGDALIY

SEQ ID NO: 202773 - protein, 9 aa, Homo Sapiens
LFWPSSRPA

SEQ ID NO: 202774 - protein, 9 aa, Homo Sapiens
AENELLMTP

SEQ ID NO: 202775 - protein, 9 aa, Homo Sapiens
KDFIQKLLV

SEQ ID NO: 202776 - protein, 9 aa, Homo Sapiens
AVLDALLVS

SEQ ID NO: 202777 - protein, 9 aa, Homo Sapiens
KYDSMIQDQ

SEQ ID NO: 202778 - protein, 9 aa, Homo Sapiens
RIPPVLISE

SEQ ID NO: 202779 - protein, 9 aa, Homo Sapiens
AAALRAVGT

SEQ ID NO: 202780 - protein, 9 aa, Homo Sapiens
MEELEKDPH

SEQ ID NO: 202781 - protein, 9 aa, Homo Sapiens
MSKVVNSLY

SEQ ID NO: 202782 - protein, 9 aa, Homo Sapiens
VELLTGTSL

SEQ ID NO: 202783 - protein, 9 aa, Homo Sapiens
LQTQQEQQI

SEQ ID NO: 202784 - protein, 9 aa, Homo Sapiens
GGHNAPASN

SEQ ID NO: 202785 - protein, 9 aa, Homo Sapiens
IGTVYECWW

SEQ ID NO: 202786 - protein, 9 aa, Homo Sapiens
DHGKSFYSS

SEQ ID NO: 202787 - protein, 9 aa, Homo Sapiens
GSSHLSGSL

SEQ ID NO: 202788 - protein, 9 aa, Homo Sapiens
TAQDALESL

SEQ ID NO: 202789 - protein, 9 aa, Homo Sapiens
RGIGRCLHT

SEQ ID NO: 202790 - protein, 9 aa, Homo Sapiens
FHTGQHAPP

SEQ ID NO: 202791 - protein, 9 aa, Homo Sapiens
CTWIYQWQR

SEQ ID NO: 202792 - protein, 9 aa, Homo Sapiens
WLPYHVLQA

SEQ ID NO: 202793 - protein, 9 aa, Homo Sapiens
YLPDFFWAP

SEQ ID NO: 202794 - protein, 9 aa, Homo Sapiens
TERQWIQQL

SEQ ID NO: 202795 - protein, 9 aa, Homo Sapiens
LLEQLEETR

SEQ ID NO: 202796 - protein, 9 aa, Homo Sapiens
WQTAMHMPG

SEQ ID NO: 202797 - protein, 9 aa, Homo Sapiens
FIKYNIWCS

SEQ ID NO: 202798 - protein, 9 aa, Homo Sapiens
RPGPSRAHC

SEQ ID NO: 202799 - protein, 9 aa, Homo Sapiens
IGWARARGQ

SEQ ID NO: 202800 - protein, 9 aa, Homo Sapiens
ELANFNPSR

SEQ ID NO: 202801 - protein, 9 aa, Homo Sapiens
CTPRCPPSG

SEQ ID NO: 202802 - protein, 9 aa, Homo Sapiens
PHQHSGEKR

SEQ ID NO: 202803 - protein, 9 aa, Homo Sapiens
WHTRDTESQ

SEQ ID NO: 202804 - protein, 9 aa, Homo Sapiens
RCQELEQDV

SEQ ID NO: 202805 - protein, 9 aa, Homo Sapiens
PAAPALAAA

SEQ ID NO: 202806 - protein, 9 aa, Homo Sapiens
EPSTARKGP

SEQ ID NO: 202807 - protein, 9 aa, Homo Sapiens
PVNELRVAS

SEQ ID NO: 202808 - protein, 9 aa, Homo Sapiens
VPQEPTARS

SEQ ID NO: 202809 - protein, 9 aa, Homo Sapiens
SQGWWTGDG

SEQ ID NO: 202810 - protein, 9 aa, Homo Sapiens
EGQMFEHLS

SEQ ID NO: 202811 - protein, 9 aa, Homo Sapiens
NTCKDKTHN

SEQ ID NO: 202812 - protein, 9 aa, Homo Sapiens
CTVPKVEVK

SEQ ID NO: 202813 - protein, 9 aa, Homo Sapiens
KSVKSWEQL

SEQ ID NO: 202814 - protein, 9 aa, Homo Sapiens
PEDGSQGSW

SEQ ID NO: 202815 - protein, 9 aa, Homo Sapiens
NLCVDYYKN

SEQ ID NO: 202816 - protein, 9 aa, Homo Sapiens
LGVYWREAV

SEQ ID NO: 202817 - protein, 9 aa, Homo Sapiens
GTDPDETIL

SEQ ID NO: 202818 - protein, 9 aa, Homo Sapiens
HVFDKESNG

SEQ ID NO: 202819 - protein, 9 aa, Homo Sapiens
SIKCLYPGS

SEQ ID NO: 202820 - protein, 9 aa, Homo Sapiens
IIPHQVFAP

SEQ ID NO: 202821 - protein, 9 aa, Homo Sapiens
CSEDSCMPP

SEQ ID NO: 202822 - protein, 9 aa, Homo Sapiens
VTLVGVGAQ

SEQ ID NO: 202823 - protein, 9 aa, Homo Sapiens
LPPSSHVRP

SEQ ID NO: 202824 - protein, 9 aa, Homo Sapiens
TTNYPFMFA

SEQ ID NO: 202825 - protein, 9 aa, Homo Sapiens
FYQAAHHAE

SEQ ID NO: 202826 - protein, 9 aa, Homo Sapiens
FQCLCTDPY

SEQ ID NO: 202827 - protein, 9 aa, Homo Sapiens
ATTTLHNLL

SEQ ID NO: 202828 - protein, 9 aa, Homo Sapiens
HQPLGPRQR

SEQ ID NO: 202829 - protein, 9 aa, Homo Sapiens
YDELLEILS

SEQ ID NO: 202830 - protein, 9 aa, Homo Sapiens
ITVCATNNS

SEQ ID NO: 202831 - protein, 9 aa, Homo Sapiens
PYNAMLSIH

SEQ ID NO: 202832 - protein, 9 aa, Homo Sapiens
KKSDGIQKV

SEQ ID NO: 202833 - protein, 9 aa, Homo Sapiens
TRPVQVFSQ

SEQ ID NO: 202834 - protein, 9 aa, Homo Sapiens
TAAILGYCH

SEQ ID NO: 202835 - protein, 9 aa, Homo Sapiens
IITDYMGIQ

SEQ ID NO: 202836 - protein, 9 aa, Homo Sapiens
SGKPFGVFL

SEQ ID NO: 202837 - protein, 9 aa, Homo Sapiens
ISPEKQHPF

SEQ ID NO: 202838 - protein, 9 aa, Homo Sapiens
EALEVLSTR

SEQ ID NO: 202839 - protein, 9 aa, Homo Sapiens
VCRAPSDQV

SEQ ID NO: 202840 - protein, 9 aa, Homo Sapiens
PPNPWADPE

SEQ ID NO: 202841 - protein, 9 aa, Homo Sapiens
CIPEARGDD

SEQ ID NO: 202842 - protein, 9 aa, Homo Sapiens
VPLLSVFTG

SEQ ID NO: 202843 - protein, 9 aa, Homo Sapiens
QRQPEYRHL

SEQ ID NO: 202844 - protein, 9 aa, Homo Sapiens
LLVAACVLV

SEQ ID NO: 202845 - protein, 9 aa, Homo Sapiens
GSCIWALQL

SEQ ID NO: 202846 - protein, 9 aa, Homo Sapiens
SSVPTLLSS

SEQ ID NO: 202847 - protein, 9 aa, Homo Sapiens
SQALSGRLQ

SEQ ID NO: 202848 - protein, 9 aa, Homo Sapiens
EVNPQTTEI

SEQ ID NO: 202849 - protein, 9 aa, Homo Sapiens
HRMRVEHFM

SEQ ID NO: 202850 - protein, 9 aa, Homo Sapiens
QASEKEDGR

SEQ ID NO: 202851 - protein, 9 aa, Homo Sapiens
LCSDEIIWL

SEQ ID NO: 202852 - protein, 9 aa, Homo Sapiens
ALRERLDGL

SEQ ID NO: 202853 - protein, 9 aa, Homo Sapiens
ELDSPDDIM

SEQ ID NO: 202854 - protein, 9 aa, Homo Sapiens
GVIDPQDLL

SEQ ID NO: 202855 - protein, 9 aa, Homo Sapiens
SVNDENCIL

SEQ ID NO: 202856 - protein, 9 aa, Homo Sapiens
KTLACILVG

SEQ ID NO: 202857 - protein, 9 aa, Homo Sapiens
QLWRTHQAD

SEQ ID NO: 202858 - protein, 9 aa, Homo Sapiens
PYNKYYVLL

SEQ ID NO: 202859 - protein, 9 aa, Homo Sapiens
APANAPLQC

SEQ ID NO: 202860 - protein, 9 aa, Homo Sapiens
EAERRHQAE

SEQ ID NO: 202861 - protein, 9 aa, Homo Sapiens
EVIAQAQKK

SEQ ID NO: 202862 - protein, 9 aa, Homo Sapiens
GVGASKEGG

SEQ ID NO: 202863 - protein, 9 aa, Homo Sapiens
WARLGESPR

SEQ ID NO: 202864 - protein, 9 aa, Homo Sapiens
LGVQDYILF

SEQ ID NO: 202865 - protein, 9 aa, Homo Sapiens
GFPQGAAPE

SEQ ID NO: 202866 - protein, 9 aa, Homo Sapiens
LVRRIKRLE

SEQ ID NO: 202867 - protein, 9 aa, Homo Sapiens
YAMLYSQGS

SEQ ID NO: 202868 - protein, 9 aa, Homo Sapiens
QGGTSSSIS

SEQ ID NO: 202869 - protein, 9 aa, Homo Sapiens
ANASSLRKN

SEQ ID NO: 202870 - protein, 9 aa, Homo Sapiens
NTDEPMGIA

SEQ ID NO: 202871 - protein, 9 aa, Homo Sapiens
HNIENVHVC

SEQ ID NO: 202872 - protein, 9 aa, Homo Sapiens
HAFIVSDLL

SEQ ID NO: 202873 - protein, 9 aa, Homo Sapiens
KQHPFQNLL

SEQ ID NO: 202874 - protein, 9 aa, Homo Sapiens
CMSRPVLKL

SEQ ID NO: 202875 - protein, 9 aa, Homo Sapiens
HRNPRTNIK

SEQ ID NO: 202876 - protein, 9 aa, Homo Sapiens
TTTLHNLLL

SEQ ID NO: 202877 - protein, 9 aa, Homo Sapiens
FSKMTKFLY

SEQ ID NO: 202878 - protein, 9 aa, Homo Sapiens
TQLCGPAVN

SEQ ID NO: 202879 - protein, 9 aa, Homo Sapiens
GLSAVVWAK

SEQ ID NO: 202880 - protein, 9 aa, Homo Sapiens
APTRHGSLP

SEQ ID NO: 202881 - protein, 9 aa, Homo Sapiens
VYLRQCLAS

SEQ ID NO: 202882 - protein, 9 aa, Homo Sapiens
SYLFSFSVQ

SEQ ID NO: 202883 - protein, 9 aa, Homo Sapiens
ALHRAPGPD

SEQ ID NO: 202884 - protein, 9 aa, Homo Sapiens
NQQEFAVPD

SEQ ID NO: 202885 - protein, 9 aa, Homo Sapiens
PSLIMDKAL

SEQ ID NO: 202886 - protein, 9 aa, Homo Sapiens
EGEDDEEEE

SEQ ID NO: 202887 - protein, 9 aa, Homo Sapiens
ENVLAYKTQ

SEQ ID NO: 202888 - protein, 9 aa, Homo Sapiens
TAARHVVFA

SEQ ID NO: 202889 - protein, 9 aa, Homo Sapiens
ACKKLQKKK

SEQ ID NO: 202890 - protein, 9 aa, Homo Sapiens
VVNSLYNKA

SEQ ID NO: 202891 - protein, 9 aa, Homo Sapiens
PKTSQCSVF

SEQ ID NO: 202892 - protein, 9 aa, Homo Sapiens
LVIPLTDVK

SEQ ID NO: 202893 - protein, 9 aa, Homo Sapiens
GGGGREPAP

SEQ ID NO: 202894 - protein, 9 aa, Homo Sapiens
QKTQVVQNA

SEQ ID NO: 202895 - protein, 9 aa, Homo Sapiens
DPHHHMHVP

SEQ ID NO: 202896 - protein, 9 aa, Homo Sapiens
QSQGWWTGD

SEQ ID NO: 202897 - protein, 9 aa, Homo Sapiens
QPHRGRRQA

SEQ ID NO: 202898 - protein, 9 aa, Homo Sapiens
CRQRQEVEK

SEQ ID NO: 202899 - protein, 9 aa, Homo Sapiens
HTTVDRTAG

SEQ ID NO: 202900 - protein, 9 aa, Homo Sapiens
YLQSVSRIL

SEQ ID NO: 202901 - protein, 9 aa, Homo Sapiens
MAAKRHAFA

SEQ ID NO: 202902 - protein, 9 aa, Homo Sapiens
QKRELEHRL

SEQ ID NO: 202903 - protein, 9 aa, Homo Sapiens
PGGGGREPA

SEQ ID NO: 202904 - protein, 9 aa, Homo Sapiens
KTLISDVPP

SEQ ID NO: 202905 - protein, 9 aa, Homo Sapiens
SLSSMSLRD

SEQ ID NO: 202906 - protein, 9 aa, Homo Sapiens
VFMPYSAAF

SEQ ID NO: 202907 - protein, 9 aa, Homo Sapiens
PTLPTRRGL

SEQ ID NO: 202908 - protein, 9 aa, Homo Sapiens
LLELQGQAG

SEQ ID NO: 202909 - protein, 9 aa, Homo Sapiens
LYCWAGQGS

SEQ ID NO: 202910 - protein, 9 aa, Homo Sapiens
QRIHIGERP

SEQ ID NO: 202911 - protein, 9 aa, Homo Sapiens
DEDPAADPA

SEQ ID NO: 202912 - protein, 9 aa, Homo Sapiens
YCSHCRARQ

SEQ ID NO: 202913 - protein, 9 aa, Homo Sapiens
LIPQQAQEL

SEQ ID NO: 202914 - protein, 9 aa, Homo Sapiens
LRDISGHLL

SEQ ID NO: 202915 - protein, 9 aa, Homo Sapiens
YSYSLEHHV

SEQ ID NO: 202916 - protein, 9 aa, Homo Sapiens
CPPPTPRLN

SEQ ID NO: 202917 - protein, 9 aa, Homo Sapiens
MEEHVIPTE

SEQ ID NO: 202918 - protein, 9 aa, Homo Sapiens
YCSTVADIK

SEQ ID NO: 202919 - protein, 9 aa, Homo Sapiens
DRLDHGDWS

SEQ ID NO: 202920 - protein, 9 aa, Homo Sapiens
SGCGKSFSQ

SEQ ID NO: 202921 - protein, 9 aa, Homo Sapiens
LDRDVLKQS

SEQ ID NO: 202922 - protein, 8 aa, Homo Sapiens
DGTNGSTQ

SEQ ID NO: 202923 - protein, 9 aa, Homo Sapiens
QKDPAQPLD

SEQ ID NO: 202924 - protein, 9 aa, Homo Sapiens
QETLRDVLS

SEQ ID NO: 202925 - protein, 9 aa, Homo Sapiens
GPHCFCPSP

SEQ ID NO: 202926 - protein, 9 aa, Homo Sapiens
VRIHDLHSG

SEQ ID NO: 202927 - protein, 9 aa, Homo Sapiens
SDELSGDPS

SEQ ID NO: 202928 - protein, 9 aa, Homo Sapiens
RLGESPRYS

SEQ ID NO: 202929 - protein, 9 aa, Homo Sapiens
DLSEPNSTT

SEQ ID NO: 202930 - protein, 9 aa, Homo Sapiens
VFLQHYGFS

SEQ ID NO: 202931 - protein, 9 aa, Homo Sapiens
DSMIQDQAR

SEQ ID NO: 202932 - protein, 9 aa, Homo Sapiens
GGPCPQTPC

SEQ ID NO: 202933 - protein, 9 aa, Homo Sapiens
SILRPSLQV

SEQ ID NO: 202934 - protein, 9 aa, Homo Sapiens
TLLDLINFF

SEQ ID NO: 202935 - protein, 9 aa, Homo Sapiens
KYYPTAKAN

SEQ ID NO: 202936 - protein, 9 aa, Homo Sapiens
WRQLATLGG

SEQ ID NO: 202937 - protein, 9 aa, Homo Sapiens
TGKSPVFLF

SEQ ID NO: 202938 - protein, 9 aa, Homo Sapiens
AMFLEIMAH

SEQ ID NO: 202939 - protein, 9 aa, Homo Sapiens
PSHSSKDAN

SEQ ID NO: 202940 - protein, 9 aa, Homo Sapiens
AVRNPVKYS

SEQ ID NO: 202941 - protein, 9 aa, Homo Sapiens
YVGDLNLVA

SEQ ID NO: 202942 - protein, 9 aa, Homo Sapiens
VLFPPWIDG

SEQ ID NO: 202943 - protein, 9 aa, Homo Sapiens
SAPVPPMRF

SEQ ID NO: 202944 - protein, 9 aa, Homo Sapiens
SGPGAFSYA

SEQ ID NO: 202945 - protein, 9 aa, Homo Sapiens
SQWVMSQTQ

SEQ ID NO: 202946 - protein, 9 aa, Homo Sapiens
SEFCLPETE

SEQ ID NO: 202947 - protein, 9 aa, Homo Sapiens
QWVMSQTQQ

SEQ ID NO: 202948 - protein, 9 aa, Homo Sapiens
VSPLQCHAV

SEQ ID NO: 202949 - protein, 9 aa, Homo Sapiens
KVHLKYAMF

SEQ ID NO: 202950 - protein, 9 aa, Homo Sapiens
EKVMLTGSV

SEQ ID NO: 202951 - protein, 9 aa, Homo Sapiens
VTPAPPRAR

SEQ ID NO: 202952 - protein, 9 aa, Homo Sapiens
YPWASCNQV

SEQ ID NO: 202953 - protein, 9 aa, Homo Sapiens
SKKDKECQL

SEQ ID NO: 202954 - protein, 9 aa, Homo Sapiens
NMSHCQLVT

SEQ ID NO: 202955 - protein, 9 aa, Homo Sapiens
GGNNSCTMC

SEQ ID NO: 202956 - protein, 9 aa, Homo Sapiens
LGHFVAEHY

SEQ ID NO: 202957 - protein, 9 aa, Homo Sapiens
GTSSSISVY

SEQ ID NO: 202958 - protein, 9 aa, Homo Sapiens
RWSHQATVS

SEQ ID NO: 202959 - protein, 9 aa, Homo Sapiens
TDHNVSPNI

SEQ ID NO: 202960 - protein, 9 aa, Homo Sapiens
AKPPPIPVK

SEQ ID NO: 202961 - protein, 9 aa, Homo Sapiens
DSDGSVGPV

SEQ ID NO: 202962 - protein, 9 aa, Homo Sapiens
VKKIENIPK

SEQ ID NO: 202963 - protein, 9 aa, Homo Sapiens
ANMEEQTEV

SEQ ID NO: 202964 - protein, 9 aa, Homo Sapiens
HSVQINSVG

SEQ ID NO: 202965 - protein, 9 aa, Homo Sapiens
VSYSNATNK

SEQ ID NO: 202966 - protein, 9 aa, Homo Sapiens
GPAFTDAIC

SEQ ID NO: 202967 - protein, 9 aa, Homo Sapiens
VARAYSNLQ

SEQ ID NO: 202968 - protein, 9 aa, Homo Sapiens
PGTMGPPPG

SEQ ID NO: 202969 - protein, 9 aa, Homo Sapiens
RDLKANMWA

SEQ ID NO: 202970 - protein, 9 aa, Homo Sapiens
IIIKGTTLN

SEQ ID NO: 202971 - protein, 9 aa, Homo Sapiens
HEETKKDPA

SEQ ID NO: 202972 - protein, 9 aa, Homo Sapiens
RDLVHQGRL

SEQ ID NO: 202973 - protein, 9 aa, Homo Sapiens
PTVIGDRGT

SEQ ID NO: 202974 - protein, 9 aa, Homo Sapiens
LEANSERDN

SEQ ID NO: 202975 - protein, 9 aa, Homo Sapiens
LLLDTSTTS

SEQ ID NO: 202976 - protein, 9 aa, Homo Sapiens
ADRVTEFCQ

SEQ ID NO: 202977 - protein, 9 aa, Homo Sapiens
TSPEGSTTS

SEQ ID NO: 202978 - protein, 9 aa, Homo Sapiens
RVAALVFEQ

SEQ ID NO: 202979 - protein, 9 aa, Homo Sapiens
GLVSHTCYP

SEQ ID NO: 202980 - protein, 9 aa, Homo Sapiens
MLRVSYIKA

SEQ ID NO: 202981 - protein, 9 aa, Homo Sapiens
WGIIHVYGD

SEQ ID NO: 202982 - protein, 9 aa, Homo Sapiens
GNYPPCICD

SEQ ID NO: 202983 - protein, 9 aa, Homo Sapiens
PVYLRQCLA

SEQ ID NO: 202984 - protein, 9 aa, Homo Sapiens
LPNHLTGRP

SEQ ID NO: 202985 - protein, 9 aa, Homo Sapiens
WGLGELRQR

SEQ ID NO: 202986 - protein, 9 aa, Homo Sapiens
NATATFKAY

SEQ ID NO: 202987 - protein, 9 aa, Homo Sapiens
SWAQQESLQ

SEQ ID NO: 202988 - protein, 9 aa, Homo Sapiens
MGLTKSGGS

SEQ ID NO: 202989 - protein, 9 aa, Homo Sapiens
RHGIWSPGI

SEQ ID NO: 202990 - protein, 9 aa, Homo Sapiens
LLGPGESRK

SEQ ID NO: 202991 - protein, 9 aa, Homo Sapiens
LAQETLRDV

SEQ ID NO: 202992 - protein, 9 aa, Homo Sapiens
YDEISGQGV

SEQ ID NO: 202993 - protein, 9 aa, Homo Sapiens
YVADGLGET

SEQ ID NO: 202994 - protein, 9 aa, Homo Sapiens
KRLEQLGTQ

SEQ ID NO: 202995 - protein, 9 aa, Homo Sapiens
LELKLVVVK

SEQ ID NO: 202996 - protein, 9 aa, Homo Sapiens
EVIYTIEAG

SEQ ID NO: 202997 - protein, 9 aa, Homo Sapiens
GFGGGGRFG

SEQ ID NO: 202998 - protein, 9 aa, Homo Sapiens
AQPGAVPGP

SEQ ID NO: 202999 - protein, 9 aa, Homo Sapiens
LWPGQPHRG

SEQ ID NO: 203000 - protein, 9 aa, Homo Sapiens
QLLQCFRHG

SEQ ID NO: 203001 - protein, 9 aa, Homo Sapiens
PASVSPSHR

SEQ ID NO: 203002 - protein, 9 aa, Homo Sapiens
SCDTLNRWL

SEQ ID NO: 203003 - protein, 9 aa, Homo Sapiens
WQREEQQQR

SEQ ID NO: 203004 - protein, 9 aa, Homo Sapiens
CNMTFVTSG

SEQ ID NO: 203005 - protein, 9 aa, Homo Sapiens
QVGDALWLE

SEQ ID NO: 203006 - protein, 9 aa, Homo Sapiens
IALVSFYED

SEQ ID NO: 203007 - protein, 9 aa, Homo Sapiens
GAEEGTRGW

SEQ ID NO: 203008 - protein, 9 aa, Homo Sapiens
PNSTTIQTS

SEQ ID NO: 203009 - protein, 9 aa, Homo Sapiens
APGAGGGDP

SEQ ID NO: 203010 - protein, 9 aa, Homo Sapiens
ILEALSLFK

SEQ ID NO: 203011 - protein, 9 aa, Homo Sapiens
VCRMLGFRC

SEQ ID NO: 203012 - protein, 9 aa, Homo Sapiens
LHPPPASVS

SEQ ID NO: 203013 - protein, 9 aa, Homo Sapiens
FFVMPLHHG

SEQ ID NO: 203014 - protein, 9 aa, Homo Sapiens
MKAVYHIRN

SEQ ID NO: 203015 - protein, 9 aa, Homo Sapiens
SRIRGLGVS

SEQ ID NO: 203016 - protein, 9 aa, Homo Sapiens
SNFHDGHKA

SEQ ID NO: 203017 - protein, 9 aa, Homo Sapiens
LCCDAAQFR

SEQ ID NO: 203018 - protein, 9 aa, Homo Sapiens
NEDPATPQV

SEQ ID NO: 203019 - protein, 9 aa, Homo Sapiens
KEKQDYVFA

SEQ ID NO: 203020 - protein, 9 aa, Homo Sapiens
NDITGQGPQ

SEQ ID NO: 203021 - protein, 9 aa, Homo Sapiens
VATCDRCAP

SEQ ID NO: 203022 - protein, 9 aa, Homo Sapiens
YFIALSIGM

SEQ ID NO: 203023 - protein, 9 aa, Homo Sapiens
DVVSTTEPC

SEQ ID NO: 203024 - protein, 9 aa, Homo Sapiens
RTFDGLLFD

SEQ ID NO: 203025 - protein, 9 aa, Homo Sapiens
IIFSLFGMQ

SEQ ID NO: 203026 - protein, 9 aa, Homo Sapiens
GPLGECIFP

SEQ ID NO: 203027 - protein, 9 aa, Homo Sapiens
TILWMIMAS

SEQ ID NO: 203028 - protein, 9 aa, Homo Sapiens
DNLLDPWRE

SEQ ID NO: 203029 - protein, 9 aa, Homo Sapiens
YLSGYHFKL

SEQ ID NO: 203030 - protein, 9 aa, Homo Sapiens
RHVVFAELY

SEQ ID NO: 203031 - protein, 9 aa, Homo Sapiens
VLDALLVSK

SEQ ID NO: 203032 - protein, 9 aa, Homo Sapiens
EKLSRNEMQ

SEQ ID NO: 203033 - protein, 9 aa, Homo Sapiens
WVQKIKVAS

SEQ ID NO: 203034 - protein, 9 aa, Homo Sapiens
DIVSDSRRE

SEQ ID NO: 203035 - protein, 9 aa, Homo Sapiens
HTSAKPFQC

SEQ ID NO: 203036 - protein, 9 aa, Homo Sapiens
NAMNVEQSF

SEQ ID NO: 203037 - protein, 9 aa, Homo Sapiens
IRLDSTIRL

SEQ ID NO: 203038 - protein, 9 aa, Homo Sapiens
LGECIFPLF

SEQ ID NO: 203039 - protein, 9 aa, Homo Sapiens
RDGPLELEG

SEQ ID NO: 203040 - protein, 9 aa, Homo Sapiens
ILCSDEIIW

SEQ ID NO: 203041 - protein, 9 aa, Homo Sapiens
HNTMGSYKC

SEQ ID NO: 203042 - protein, 9 aa, Homo Sapiens
RLSTLFESH

SEQ ID NO: 203043 - protein, 9 aa, Homo Sapiens
LQKKKNKEE

SEQ ID NO: 203044 - protein, 9 aa, Homo Sapiens
ASRVQAQQK

SEQ ID NO: 203045 - protein, 9 aa, Homo Sapiens
ENLACIGDA

SEQ ID NO: 203046 - protein, 9 aa, Homo Sapiens
KQEETVISY

SEQ ID NO: 203047 - protein, 9 aa, Homo Sapiens
LLDKWDVVS

SEQ ID NO: 203048 - protein, 9 aa, Homo Sapiens
FACMVRVRD

SEQ ID NO: 203049 - protein, 9 aa, Homo Sapiens
HCMVILFAF

SEQ ID NO: 203050 - protein, 9 aa, Homo Sapiens
NQLQYVQNV

SEQ ID NO: 203051 - protein, 9 aa, Homo Sapiens
QYESCAPPY

SEQ ID NO: 203052 - protein, 9 aa, Homo Sapiens
GRERRDRRP

SEQ ID NO: 203053 - protein, 9 aa, Homo Sapiens
QQKVELLPA

SEQ ID NO: 203054 - protein, 9 aa, Homo Sapiens
HREVMFSML

SEQ ID NO: 203055 - protein, 9 aa, Homo Sapiens
RAITNSSHL

SEQ ID NO: 203056 - protein, 9 aa, Homo Sapiens
GGPVPQEPT

SEQ ID NO: 203057 - protein, 9 aa, Homo Sapiens
YGMHFIMSP

SEQ ID NO: 203058 - protein, 9 aa, Homo Sapiens
GDVDEDEAV

SEQ ID NO: 203059 - protein, 9 aa, Homo Sapiens
IAELNPYVR

SEQ ID NO: 203060 - protein, 9 aa, Homo Sapiens
LGQSQMAAK

SEQ ID NO: 203061 - protein, 9 aa, Homo Sapiens
LQKGTGCIE

SEQ ID NO: 203062 - protein, 9 aa, Homo Sapiens
KLSSPAIIT

SEQ ID NO: 203063 - protein, 9 aa, Homo Sapiens
LEVELKVAP

SEQ ID NO: 203064 - protein, 9 aa, Homo Sapiens
ALVRFYCYT

SEQ ID NO: 203065 - protein, 9 aa, Homo Sapiens
CLCTDPYEL

SEQ ID NO: 203066 - protein, 9 aa, Homo Sapiens
SWRQHREVA

SEQ ID NO: 203067 - protein, 9 aa, Homo Sapiens
SPDPHIPCT

SEQ ID NO: 203068 - protein, 9 aa, Homo Sapiens
EEEEGGNVE

SEQ ID NO: 203069 - protein, 9 aa, Homo Sapiens
AWRPPGTNG

SEQ ID NO: 203070 - protein, 9 aa, Homo Sapiens
HRGSVVSEV

SEQ ID NO: 203071 - protein, 9 aa, Homo Sapiens
PSRSAACGG

SEQ ID NO: 203072 - protein, 9 aa, Homo Sapiens
TKGAYPNHR

SEQ ID NO: 203073 - protein, 9 aa, Homo Sapiens
IPLVRKRQF

SEQ ID NO: 203074 - protein, 9 aa, Homo Sapiens
FMRHLCELG

SEQ ID NO: 203075 - protein, 9 aa, Homo Sapiens
MIVAMLMKN

SEQ ID NO: 203076 - protein, 9 aa, Homo Sapiens
IHRFIKYNI

SEQ ID NO: 203077 - protein, 9 aa, Homo Sapiens
ELEAAWRVE

SEQ ID NO: 203078 - protein, 9 aa, Homo Sapiens
EEHVIPTEK

SEQ ID NO: 203079 - protein, 9 aa, Homo Sapiens
FGCDECTLG

SEQ ID NO: 203080 - protein, 9 aa, Homo Sapiens
SVTPLPLQP

SEQ ID NO: 203081 - protein, 9 aa, Homo Sapiens
LSRHIYLQM

SEQ ID NO: 203082 - protein, 9 aa, Homo Sapiens
VCKDVAQCI

SEQ ID NO: 203083 - protein, 9 aa, Homo Sapiens
HSCPESVKN

SEQ ID NO: 203084 - protein, 9 aa, Homo Sapiens
SKPPVLQAP

SEQ ID NO: 203085 - protein, 9 aa, Homo Sapiens
EHTVAYINV

SEQ ID NO: 203086 - protein, 9 aa, Homo Sapiens
VQSHLRHGE

SEQ ID NO: 203087 - protein, 9 aa, Homo Sapiens
THLKEREDI

SEQ ID NO: 203088 - protein, 9 aa, Homo Sapiens
RYPNIHDLD

SEQ ID NO: 203089 - protein, 9 aa, Homo Sapiens
CDNRDLLVH

SEQ ID NO: 203090 - protein, 9 aa, Homo Sapiens
PPSPLESSV

SEQ ID NO: 203091 - protein, 9 aa, Homo Sapiens
ETAQQQQAL

SEQ ID NO: 203092 - protein, 9 aa, Homo Sapiens
WPFGDFACC

SEQ ID NO: 203093 - protein, 9 aa, Homo Sapiens
GLVNTVLKH

SEQ ID NO: 203094 - protein, 9 aa, Homo Sapiens
GDPGLQGTT

SEQ ID NO: 203095 - protein, 9 aa, Homo Sapiens
KACMTSFHR

SEQ ID NO: 203096 - protein, 9 aa, Homo Sapiens
LSDLPLAVQ

SEQ ID NO: 203097 - protein, 9 aa, Homo Sapiens
RDPTAFAPI

SEQ ID NO: 203098 - protein, 9 aa, Homo Sapiens
DRAGAEHVR

SEQ ID NO: 203099 - protein, 9 aa, Homo Sapiens
DCTCVRDSC

SEQ ID NO: 203100 - protein, 9 aa, Homo Sapiens
PPVLISEGK

SEQ ID NO: 203101 - protein, 9 aa, Homo Sapiens
ELELQHENY

SEQ ID NO: 203102 - protein, 9 aa, Homo Sapiens
LESSVCPMR

SEQ ID NO: 203103 - protein, 9 aa, Homo Sapiens
AVLAPEDVL

SEQ ID NO: 203104 - protein, 9 aa, Homo Sapiens
VLGILVGSF

SEQ ID NO: 203105 - protein, 9 aa, Homo Sapiens
GVHRKQYHL

SEQ ID NO: 203106 - protein, 9 aa, Homo Sapiens
SDEIIWLEP

SEQ ID NO: 203107 - protein, 9 aa, Homo Sapiens
KTAAFQNSF

SEQ ID NO: 203108 - protein, 9 aa, Homo Sapiens
GLQGTTEPD

SEQ ID NO: 203109 - protein, 9 aa, Homo Sapiens
MTGIVPDWG

SEQ ID NO: 203110 - protein, 9 aa, Homo Sapiens
RELITNKNV

SEQ ID NO: 203111 - protein, 9 aa, Homo Sapiens
LGTCRGMAR

SEQ ID NO: 203112 - protein, 9 aa, Homo Sapiens
HAVGKIPLD

SEQ ID NO: 203113 - protein, 9 aa, Homo Sapiens
EPVEALALE

SEQ ID NO: 203114 - protein, 9 aa, Homo Sapiens
KKIYKKKQF

SEQ ID NO: 203115 - protein, 9 aa, Homo Sapiens
EMVCALSAQ

SEQ ID NO: 203116 - protein, 9 aa, Homo Sapiens
SSSLPPLLM

SEQ ID NO: 203117 - protein, 9 aa, Homo Sapiens
QAGWRLSSG

SEQ ID NO: 203118 - protein, 9 aa, Homo Sapiens
IDFDRLTLL

SEQ ID NO: 203119 - protein, 9 aa, Homo Sapiens
HDDLYLNAN

SEQ ID NO: 203120 - protein, 9 aa, Homo Sapiens
VSRILTRSQ

SEQ ID NO: 203121 - protein, 9 aa, Homo Sapiens
RPSRQFWMM

SEQ ID NO: 203122 - protein, 9 aa, Homo Sapiens
CVWEQATPL

SEQ ID NO: 203123 - protein, 9 aa, Homo Sapiens
LQSVSRILT

SEQ ID NO: 203124 - protein, 9 aa, Homo Sapiens
HYKRRRAME

SEQ ID NO: 203125 - protein, 9 aa, Homo Sapiens
NQIQQQSAL

SEQ ID NO: 203126 - protein, 9 aa, Homo Sapiens
PWLQALLNI

SEQ ID NO: 203127 - protein, 9 aa, Homo Sapiens
CHIHQHRQS

SEQ ID NO: 203128 - protein, 9 aa, Homo Sapiens
DKQQSTMPN

SEQ ID NO: 203129 - protein, 9 aa, Homo Sapiens
QACSCLLLG

SEQ ID NO: 203130 - protein, 9 aa, Homo Sapiens
YEAMPDYLD

SEQ ID NO: 203131 - protein, 9 aa, Homo Sapiens
IVYVGDLNL

SEQ ID NO: 203132 - protein, 9 aa, Homo Sapiens
GRDGFINLM

SEQ ID NO: 203133 - protein, 9 aa, Homo Sapiens
LVLAVKQGR

SEQ ID NO: 203134 - protein, 9 aa, Homo Sapiens
LCRKTINGH

SEQ ID NO: 203135 - protein, 9 aa, Homo Sapiens
RRDRRPGPS

SEQ ID NO: 203136 - protein, 9 aa, Homo Sapiens
GSMATLSST

SEQ ID NO: 203137 - protein, 9 aa, Homo Sapiens
NSTINIHHT

SEQ ID NO: 203138 - protein, 9 aa, Homo Sapiens
PPSLGTHAE

SEQ ID NO: 203139 - protein, 9 aa, Homo Sapiens
LQRTRQADG

SEQ ID NO: 203140 - protein, 9 aa, Homo Sapiens
GSLAGVYAK

SEQ ID NO: 203141 - protein, 9 aa, Homo Sapiens
SMIQDQARE

SEQ ID NO: 203142 - protein, 9 aa, Homo Sapiens
HSWSPPLTA

SEQ ID NO: 203143 - protein, 9 aa, Homo Sapiens
GLIKNIKRK

SEQ ID NO: 203144 - protein, 9 aa, Homo Sapiens
QQVHTGKKP

SEQ ID NO: 203145 - protein, 9 aa, Homo Sapiens
SNMRRMHTA

SEQ ID NO: 203146 - protein, 9 aa, Homo Sapiens
YEALKKRRT

SEQ ID NO: 203147 - protein, 9 aa, Homo Sapiens
NATNKYEVD

SEQ ID NO: 203148 - protein, 9 aa, Homo Sapiens
PLHQHQLQH

SEQ ID NO: 203149 - protein, 9 aa, Homo Sapiens
TLEVISELQ

SEQ ID NO: 203150 - protein, 9 aa, Homo Sapiens
INNKLQQLE

SEQ ID NO: 203151 - protein, 9 aa, Homo Sapiens
LLRGCTLRS

SEQ ID NO: 203152 - protein, 9 aa, Homo Sapiens
PLLASPSCS

SEQ ID NO: 203153 - protein, 9 aa, Homo Sapiens
ERAAAALRA

SEQ ID NO: 203154 - protein, 9 aa, Homo Sapiens
VKSWEQLSE

SEQ ID NO: 203155 - protein, 9 aa, Homo Sapiens
KQAHCMHIL

SEQ ID NO: 203156 - protein, 9 aa, Homo Sapiens
TRKRCSASS

SEQ ID NO: 203157 - protein, 9 aa, Homo Sapiens
RNIGSHRMR

SEQ ID NO: 203158 - protein, 9 aa, Homo Sapiens
HQALMGPPL

SEQ ID NO: 203159 - protein, 9 aa, Homo Sapiens
KTKTEHFQA

SEQ ID NO: 203160 - protein, 9 aa, Homo Sapiens
FTRSVGLKW

SEQ ID NO: 203161 - protein, 9 aa, Homo Sapiens
QATVSSVKT

SEQ ID NO: 203162 - protein, 9 aa, Homo Sapiens
HHHHPPQHN

SEQ ID NO: 203163 - protein, 9 aa, Homo Sapiens
SWQTAMHMP

SEQ ID NO: 203164 - protein, 9 aa, Homo Sapiens
YRGASQFLV

SEQ ID NO: 203165 - protein, 9 aa, Homo Sapiens
ALSIGMLLS

SEQ ID NO: 203166 - protein, 9 aa, Homo Sapiens
PLQCIRSTS

SEQ ID NO: 203167 - protein, 9 aa, Homo Sapiens
WRLLWASPP

SEQ ID NO: 203168 - protein, 9 aa, Homo Sapiens
YVLLPLVAK

SEQ ID NO: 203169 - protein, 9 aa, Homo Sapiens
LPPAVPQSQ

SEQ ID NO: 203170 - protein, 9 aa, Homo Sapiens
PSWQTAMHM

SEQ ID NO: 203171 - protein, 9 aa, Homo Sapiens
PSPRQPLLG

SEQ ID NO: 203172 - protein, 9 aa, Homo Sapiens
ALLVSKQHW

SEQ ID NO: 203173 - protein, 9 aa, Homo Sapiens
SNCYRGGGR

SEQ ID NO: 203174 - protein, 9 aa, Homo Sapiens
VSASSSTTC

SEQ ID NO: 203175 - protein, 9 aa, Homo Sapiens
HRIVTYHHH

SEQ ID NO: 203176 - protein, 9 aa, Homo Sapiens
KEGRFEMQP

SEQ ID NO: 203177 - protein, 9 aa, Homo Sapiens
AYDRLDHGD

SEQ ID NO: 203178 - protein, 9 aa, Homo Sapiens
CREIAQTVG

SEQ ID NO: 203179 - protein, 9 aa, Homo Sapiens
ERQEWICHI

SEQ ID NO: 203180 - protein, 9 aa, Homo Sapiens
TSPCTKEPR

SEQ ID NO: 203181 - protein, 9 aa, Homo Sapiens
DFISAIHRN

SEQ ID NO: 203182 - protein, 9 aa, Homo Sapiens
ALNVILVCF

SEQ ID NO: 203183 - protein, 9 aa, Homo Sapiens
SVPRFYWKD

SEQ ID NO: 203184 - protein, 9 aa, Homo Sapiens
ENFTPSGPL

SEQ ID NO: 203185 - protein, 9 aa, Homo Sapiens
VLVGMAQLR

SEQ ID NO: 203186 - protein, 9 aa, Homo Sapiens
VIAWWGLGE

SEQ ID NO: 203187 - protein, 9 aa, Homo Sapiens
FEDPSSERN

SEQ ID NO: 203188 - protein, 9 aa, Homo Sapiens
IEVNSWWSL

SEQ ID NO: 203189 - protein, 9 aa, Homo Sapiens
ARTPAWMEN

SEQ ID NO: 203190 - protein, 9 aa, Homo Sapiens
VLGVTVMRT

SEQ ID NO: 203191 - protein, 9 aa, Homo Sapiens
QCLVHGGQV

SEQ ID NO: 203192 - protein, 9 aa, Homo Sapiens
HHLLPGIGG

SEQ ID NO: 203193 - protein, 9 aa, Homo Sapiens
ESHYSKTSY

SEQ ID NO: 203194 - protein, 9 aa, Homo Sapiens
QHMDRPLSV

SEQ ID NO: 203195 - protein, 9 aa, Homo Sapiens
SHLRSPSVL

SEQ ID NO: 203196 - protein, 9 aa, Homo Sapiens
SSYSDQKLP

SEQ ID NO: 203197 - protein, 9 aa, Homo Sapiens
CGSTPPPPP

SEQ ID NO: 203198 - protein, 9 aa, Homo Sapiens
ALSGQVLGG

SEQ ID NO: 203199 - protein, 9 aa, Homo Sapiens
ISGSKKKTQ

SEQ ID NO: 203200 - protein, 9 aa, Homo Sapiens
MATQGEPGY

SEQ ID NO: 203201 - protein, 9 aa, Homo Sapiens
QWIQQLAFV

SEQ ID NO: 203202 - protein, 9 aa, Homo Sapiens
STLSYDSVK

SEQ ID NO: 203203 - protein, 9 aa, Homo Sapiens
APPPGTMGP

SEQ ID NO: 203204 - protein, 9 aa, Homo Sapiens
ADSKPLNLP

SEQ ID NO: 203205 - protein, 9 aa, Homo Sapiens
GTSSCLLRS

SEQ ID NO: 203206 - protein, 9 aa, Homo Sapiens
RIKAGNVIS

SEQ ID NO: 203207 - protein, 9 aa, Homo Sapiens
VCTECGQDF

SEQ ID NO: 203208 - protein, 9 aa, Homo Sapiens
NDNSDYCDI

SEQ ID NO: 203209 - protein, 9 aa, Homo Sapiens
EPLSERLEV

SEQ ID NO: 203210 - protein, 9 aa, Homo Sapiens
SIRDKWSRL

SEQ ID NO: 203211 - protein, 9 aa, Homo Sapiens
ALGLPSMGY

SEQ ID NO: 203212 - protein, 9 aa, Homo Sapiens
YCIKPEALK

SEQ ID NO: 203213 - protein, 9 aa, Homo Sapiens
EDLQDGLPV

SEQ ID NO: 203214 - protein, 9 aa, Homo Sapiens
SSSISGEEA

SEQ ID NO: 203215 - protein, 9 aa, Homo Sapiens
MEVLTELGL

SEQ ID NO: 203216 - protein, 9 aa, Homo Sapiens
PSSRPANGG

SEQ ID NO: 203217 - protein, 9 aa, Homo Sapiens
TSTTSPVDS

SEQ ID NO: 203218 - protein, 9 aa, Homo Sapiens
ANMWALELA

SEQ ID NO: 203219 - protein, 9 aa, Homo Sapiens
PNGPELGGS

SEQ ID NO: 203220 - protein, 9 aa, Homo Sapiens
CLAERGLMI

SEQ ID NO: 203221 - protein, 9 aa, Homo Sapiens
SNGEQFPDL

SEQ ID NO: 203222 - protein, 9 aa, Homo Sapiens
PPGTNGVVP

SEQ ID NO: 203223 - protein, 9 aa, Homo Sapiens
GPPPIDHQK

SEQ ID NO: 203224 - protein, 9 aa, Homo Sapiens
IFFVGQLEA

SEQ ID NO: 203225 - protein, 9 aa, Homo Sapiens
VRIINCKVK

SEQ ID NO: 203226 - protein, 9 aa, Homo Sapiens
NGPELGGSD

SEQ ID NO: 203227 - protein, 9 aa, Homo Sapiens
HQKLNSVDR

SEQ ID NO: 203228 - protein, 9 aa, Homo Sapiens
EIYELSYAW

SEQ ID NO: 203229 - protein, 9 aa, Homo Sapiens
HRPWMVWDS

SEQ ID NO: 203230 - protein, 9 aa, Homo Sapiens
MAIRLLNKY

SEQ ID NO: 203231 - protein, 9 aa, Homo Sapiens
QAQVKKNQC

SEQ ID NO: 203232 - protein, 9 aa, Homo Sapiens
LSIWCPSSD

SEQ ID NO: 203233 - protein, 9 aa, Homo Sapiens
QGIQKPGPA

SEQ ID NO: 203234 - protein, 9 aa, Homo Sapiens
GLGSVTLGR

SEQ ID NO: 203235 - protein, 9 aa, Homo Sapiens
HRRTQMHLN

SEQ ID NO: 203236 - protein, 9 aa, Homo Sapiens
QSPQGGTSS

SEQ ID NO: 203237 - protein, 9 aa, Homo Sapiens
AELYGIWLT

SEQ ID NO: 203238 - protein, 9 aa, Homo Sapiens
GWVDGRMLH

SEQ ID NO: 203239 - protein, 9 aa, Homo Sapiens
AVRRAFCVW

SEQ ID NO: 203240 - protein, 9 aa, Homo Sapiens
FHTTFVGPD

SEQ ID NO: 203241 - protein, 9 aa, Homo Sapiens
MQLIIVNIE

SEQ ID NO: 203242 - protein, 9 aa, Homo Sapiens
GEQLHRTTR

SEQ ID NO: 203243 - protein, 9 aa, Homo Sapiens
SKAGGLPGT

SEQ ID NO: 203244 - protein, 9 aa, Homo Sapiens
NNFLSYYHL

SEQ ID NO: 203245 - protein, 9 aa, Homo Sapiens
TMQTIALIT

SEQ ID NO: 203246 - protein, 9 aa, Homo Sapiens
RALERELKG

SEQ ID NO: 203247 - protein, 9 aa, Homo Sapiens
LPATHIWGK

SEQ ID NO: 203248 - protein, 9 aa, Homo Sapiens
AAEFDDRQG

SEQ ID NO: 203249 - protein, 9 aa, Homo Sapiens
PLRHGMPPT

SEQ ID NO: 203250 - protein, 9 aa, Homo Sapiens
LGDEELTLM

SEQ ID NO: 203251 - protein, 9 aa, Homo Sapiens
MISETCSVR

SEQ ID NO: 203252 - protein, 9 aa, Homo Sapiens
VHGHLRERA

SEQ ID NO: 203253 - protein, 9 aa, Homo Sapiens
IKPPHEEFL

SEQ ID NO: 203254 - protein, 9 aa, Homo Sapiens
QKLLRSPQK

SEQ ID NO: 203255 - protein, 9 aa, Homo Sapiens
SLYPPPHPP

SEQ ID NO: 203256 - protein, 9 aa, Homo Sapiens
PEWTVWLIL

SEQ ID NO: 203257 - protein, 9 aa, Homo Sapiens
TLPHVLSEP

SEQ ID NO: 203258 - protein, 9 aa, Homo Sapiens
GTFVCTECG

SEQ ID NO: 203259 - protein, 9 aa, Homo Sapiens
STDAVVGIV

SEQ ID NO: 203260 - protein, 9 aa, Homo Sapiens
LKKENLACI

SEQ ID NO: 203261 - protein, 9 aa, Homo Sapiens
KHRGNPSRL

SEQ ID NO: 203262 - protein, 9 aa, Homo Sapiens
ISRMLNYIE

SEQ ID NO: 203263 - protein, 9 aa, Homo Sapiens
LGIPLIPQQ

SEQ ID NO: 203264 - protein, 9 aa, Homo Sapiens
YRELIDVDS

SEQ ID NO: 203265 - protein, 9 aa, Homo Sapiens
VSCHITDLY

SEQ ID NO: 203266 - protein, 9 aa, Homo Sapiens
RHFGCPVSS

SEQ ID NO: 203267 - protein, 9 aa, Homo Sapiens
RYANERDKT

SEQ ID NO: 203268 - protein, 9 aa, Homo Sapiens
FWTTVGSKF

SEQ ID NO: 203269 - protein, 9 aa, Homo Sapiens
KEERHGSLD

SEQ ID NO: 203270 - protein, 9 aa, Homo Sapiens
VNCYWAQLD

SEQ ID NO: 203271 - protein, 9 aa, Homo Sapiens
IYGEVFVDQ

SEQ ID NO: 203272 - protein, 9 aa, Homo Sapiens
ISDLVRCVR

SEQ ID NO: 203273 - protein, 9 aa, Homo Sapiens
IKCLYPGSV

SEQ ID NO: 203274 - protein, 9 aa, Homo Sapiens
ESKLAMEHE

SEQ ID NO: 203275 - protein, 9 aa, Homo Sapiens
SSQELLSVW

SEQ ID NO: 203276 - protein, 9 aa, Homo Sapiens
LSVPRPSRQ

SEQ ID NO: 203277 - protein, 9 aa, Homo Sapiens
PKGNKKNTG

SEQ ID NO: 203278 - protein, 9 aa, Homo Sapiens
YDFWRPLAQ

SEQ ID NO: 203279 - protein, 9 aa, Homo Sapiens
DFIQKLLVK

SEQ ID NO: 203280 - protein, 9 aa, Homo Sapiens
VHCSTGIGR

SEQ ID NO: 203281 - protein, 9 aa, Homo Sapiens
WMVWDSQAS

SEQ ID NO: 203282 - protein, 9 aa, Homo Sapiens
HGWPVTKNE

SEQ ID NO: 203283 - protein, 9 aa, Homo Sapiens
VGSGLGLCG

SEQ ID NO: 203284 - protein, 9 aa, Homo Sapiens
TTVFLAECT

SEQ ID NO: 203285 - protein, 9 aa, Homo Sapiens
SHGKRFSQS

SEQ ID NO: 203286 - protein, 9 aa, Homo Sapiens
RRTGLSDGD

SEQ ID NO: 203287 - protein, 9 aa, Homo Sapiens
RQPEYRHLS

SEQ ID NO: 203288 - protein, 9 aa, Homo Sapiens
VQALKACMT

SEQ ID NO: 203289 - protein, 9 aa, Homo Sapiens
LATHVGSIA

SEQ ID NO: 203290 - protein, 9 aa, Homo Sapiens
SRARKATAR

SEQ ID NO: 203291 - protein, 9 aa, Homo Sapiens
CRVGFEVAT

SEQ ID NO: 203292 - protein, 9 aa, Homo Sapiens
AIEDMVASM

SEQ ID NO: 203293 - protein, 9 aa, Homo Sapiens
YDSVTKPEN

SEQ ID NO: 203294 - protein, 9 aa, Homo Sapiens
QHNHHHHQP

SEQ ID NO: 203295 - protein, 9 aa, Homo Sapiens
IASDLDETH

SEQ ID NO: 203296 - protein, 9 aa, Homo Sapiens
KLGVSLVLT

SEQ ID NO: 203297 - protein, 9 aa, Homo Sapiens
ADTAQRSIS

SEQ ID NO: 203298 - protein, 9 aa, Homo Sapiens
SRKECDRQK

SEQ ID NO: 203299 - protein, 9 aa, Homo Sapiens
ESCARFWYG

SEQ ID NO: 203300 - protein, 9 aa, Homo Sapiens
EHGRSRLSL

SEQ ID NO: 203301 - protein, 9 aa, Homo Sapiens
DILILWICT

SEQ ID NO: 203302 - protein, 9 aa, Homo Sapiens
EQPCSLLVY

SEQ ID NO: 203303 - protein, 9 aa, Homo Sapiens
LPYSYISLT

SEQ ID NO: 203304 - protein, 9 aa, Homo Sapiens
GQGPQILMI

SEQ ID NO: 203305 - protein, 9 aa, Homo Sapiens
SDHKIQEVY

SEQ ID NO: 203306 - protein, 9 aa, Homo Sapiens
NPMVAKRNM

SEQ ID NO: 203307 - protein, 9 aa, Homo Sapiens
AIITDKVIP

SEQ ID NO: 203308 - protein, 9 aa, Homo Sapiens
AAQRPSAWL

SEQ ID NO: 203309 - protein, 9 aa, Homo Sapiens
EYRLKPAMD

SEQ ID NO: 203310 - protein, 9 aa, Homo Sapiens
RRLGISCLQ

SEQ ID NO: 203311 - protein, 9 aa, Homo Sapiens
VQAQQKQID

SEQ ID NO: 203312 - protein, 9 aa, Homo Sapiens
MFYGMHFIM

SEQ ID NO: 203313 - protein, 9 aa, Homo Sapiens
QDRRELEKI

SEQ ID NO: 203314 - protein, 9 aa, Homo Sapiens
AQDALESLV

SEQ ID NO: 203315 - protein, 9 aa, Homo Sapiens
STCIVNGAY

SEQ ID NO: 203316 - protein, 9 aa, Homo Sapiens
EEGDRKMGK

SEQ ID NO: 203317 - protein, 9 aa, Homo Sapiens
ETKDLPSKK

SEQ ID NO: 203318 - protein, 9 aa, Homo Sapiens
VHTDLRQYM

SEQ ID NO: 203319 - protein, 9 aa, Homo Sapiens
QLQYVQNVV

SEQ ID NO: 203320 - protein, 9 aa, Homo Sapiens
LLWKVFEEW

SEQ ID NO: 203321 - protein, 9 aa, Homo Sapiens
PDPPPGPRG

SEQ ID NO: 203322 - protein, 9 aa, Homo Sapiens
NTESCARFW

SEQ ID NO: 203323 - protein, 9 aa, Homo Sapiens
RIWDVADYI

SEQ ID NO: 203324 - protein, 9 aa, Homo Sapiens
SPAIVFPTQ

SEQ ID NO: 203325 - protein, 9 aa, Homo Sapiens
SKVVNSLYN

SEQ ID NO: 203326 - protein, 9 aa, Homo Sapiens
TIWQLISAH

SEQ ID NO: 203327 - protein, 9 aa, Homo Sapiens
ELPNLKAFM

SEQ ID NO: 203328 - protein, 9 aa, Homo Sapiens
VYSWPIMNS

SEQ ID NO: 203329 - protein, 9 aa, Homo Sapiens
PNVIRYFYT

SEQ ID NO: 203330 - protein, 9 aa, Homo Sapiens
FTGSMFGSV

SEQ ID NO: 203331 - protein, 9 aa, Homo Sapiens
HAKGDSCTD

SEQ ID NO: 203332 - protein, 9 aa, Homo Sapiens
QPVDWNNEY

SEQ ID NO: 203333 - protein, 9 aa, Homo Sapiens
FWAPNSTNL

SEQ ID NO: 203334 - protein, 9 aa, Homo Sapiens
FDVVVNPGQ

SEQ ID NO: 203335 - protein, 9 aa, Homo Sapiens
IRAELYGIW

SEQ ID NO: 203336 - protein, 9 aa, Homo Sapiens
VGNGPCEVM

SEQ ID NO: 203337 - protein, 9 aa, Homo Sapiens
NGENASNSM

SEQ ID NO: 203338 - protein, 9 aa, Homo Sapiens
EPVSPMELM

SEQ ID NO: 203339 - protein, 9 aa, Homo Sapiens
LPLEHLVFF

SEQ ID NO: 203340 - protein, 9 aa, Homo Sapiens
THVGSIAEL

SEQ ID NO: 203341 - protein, 9 aa, Homo Sapiens
HPRALASSP

SEQ ID NO: 203342 - protein, 9 aa, Homo Sapiens
AGAAGRVTR

SEQ ID NO: 203343 - protein, 9 aa, Homo Sapiens
ATATPPCSP

SEQ ID NO: 203344 - protein, 9 aa, Homo Sapiens
FKQHLAKWR

SEQ ID NO: 203345 - protein, 9 aa, Homo Sapiens
LDTSTTSPV

SEQ ID NO: 203346 - protein, 9 aa, Homo Sapiens
TLLPTTGVR

SEQ ID NO: 203347 - protein, 9 aa, Homo Sapiens
SSTPTILGY

SEQ ID NO: 203348 - protein, 9 aa, Homo Sapiens
ELEFKCLAS

SEQ ID NO: 203349 - protein, 9 aa, Homo Sapiens
TILVAHQRT

SEQ ID NO: 203350 - protein, 9 aa, Homo Sapiens
TPWKHGGEK

SEQ ID NO: 203351 - protein, 9 aa, Homo Sapiens
MEQSRNCDD

SEQ ID NO: 203352 - protein, 9 aa, Homo Sapiens
FSNEERLRG

SEQ ID NO: 203353 - protein, 9 aa, Homo Sapiens
ALPPTAKSW

SEQ ID NO: 203354 - protein, 9 aa, Homo Sapiens
CSAEEICRA

SEQ ID NO: 203355 - protein, 9 aa, Homo Sapiens
FPWSMGEDM

SEQ ID NO: 203356 - protein, 9 aa, Homo Sapiens
EWQLREEQR

SEQ ID NO: 203357 - protein, 9 aa, Homo Sapiens
ECKIGAHNC

SEQ ID NO: 203358 - protein, 9 aa, Homo Sapiens
VLDCVPDER

SEQ ID NO: 203359 - protein, 9 aa, Homo Sapiens
KQTHVLPPT

SEQ ID NO: 203360 - protein, 9 aa, Homo Sapiens
FFLANIPFL

SEQ ID NO: 203361 - protein, 9 aa, Homo Sapiens
QRTQLSKGD

SEQ ID NO: 203362 - protein, 9 aa, Homo Sapiens
LCGTADVTH

SEQ ID NO: 203363 - protein, 9 aa, Homo Sapiens
CNFTRASEA

SEQ ID NO: 203364 - protein, 9 aa, Homo Sapiens
YTSNAMPSQ

SEQ ID NO: 203365 - protein, 9 aa, Homo Sapiens
PDSPYKVYM

SEQ ID NO: 203366 - protein, 9 aa, Homo Sapiens
TELLLRMAT

SEQ ID NO: 203367 - protein, 9 aa, Homo Sapiens
QEWICHIEE

SEQ ID NO: 203368 - protein, 9 aa, Homo Sapiens
DMLKAHSFE

SEQ ID NO: 203369 - protein, 9 aa, Homo Sapiens
SVWPKKINN

SEQ ID NO: 203370 - protein, 9 aa, Homo Sapiens
APVPPMRFP

SEQ ID NO: 203371 - protein, 9 aa, Homo Sapiens
QCVEHYHLL

SEQ ID NO: 203372 - protein, 9 aa, Homo Sapiens
PTGIVLLQL

SEQ ID NO: 203373 - protein, 9 aa, Homo Sapiens
TEFTPWKHG

SEQ ID NO: 203374 - protein, 9 aa, Homo Sapiens
ILLNLSCQS

SEQ ID NO: 203375 - protein, 9 aa, Homo Sapiens
QELEQDVIS

SEQ ID NO: 203376 - protein, 9 aa, Homo Sapiens
PQRRICRWL

SEQ ID NO: 203377 - protein, 9 aa, Homo Sapiens
ADMERHHIL

SEQ ID NO: 203378 - protein, 9 aa, Homo Sapiens
CQYESCAPP

SEQ ID NO: 203379 - protein, 9 aa, Homo Sapiens
YGEVFVDQI

SEQ ID NO: 203380 - protein, 9 aa, Homo Sapiens
IQCVDGEWP

SEQ ID NO: 203381 - protein, 9 aa, Homo Sapiens
GPMIVAMLM

SEQ ID NO: 203382 - protein, 9 aa, Homo Sapiens
GDSRHSSYS

SEQ ID NO: 203383 - protein, 9 aa, Homo Sapiens
GKTAAFQNS

SEQ ID NO: 203384 - protein, 9 aa, Homo Sapiens
SKLAMEHEE

SEQ ID NO: 203385 - protein, 9 aa, Homo Sapiens
NAKVRPPFT

SEQ ID NO: 203386 - protein, 9 aa, Homo Sapiens
QAHLAQHHR

SEQ ID NO: 203387 - protein, 9 aa, Homo Sapiens
AECVKGMKT

SEQ ID NO: 203388 - protein, 9 aa, Homo Sapiens
KTPAPIPES

SEQ ID NO: 203389 - protein, 9 aa, Homo Sapiens
TTIQTSEGA

SEQ ID NO: 203390 - protein, 9 aa, Homo Sapiens
SALKHNQVG

SEQ ID NO: 203391 - protein, 9 aa, Homo Sapiens
LATAAVLNT

SEQ ID NO: 203392 - protein, 9 aa, Homo Sapiens
HVGSIAELS

SEQ ID NO: 203393 - protein, 9 aa, Homo Sapiens
WLLLVDLTS

SEQ ID NO: 203394 - protein, 9 aa, Homo Sapiens
EFLYKTVGG

SEQ ID NO: 203395 - protein, 9 aa, Homo Sapiens
QMLKDLAIE

SEQ ID NO: 203396 - protein, 9 aa, Homo Sapiens
IHTEGLFQK

SEQ ID NO: 203397 - protein, 9 aa, Homo Sapiens
YRMEQSRNC

SEQ ID NO: 203398 - protein, 9 aa, Homo Sapiens
GTLNGWTGW

SEQ ID NO: 203399 - protein, 9 aa, Homo Sapiens
RAPWNQAAG

SEQ ID NO: 203400 - protein, 9 aa, Homo Sapiens
RVGSQLKQH

SEQ ID NO: 203401 - protein, 9 aa, Homo Sapiens
DDPDQNSPQ

SEQ ID NO: 203402 - protein, 9 aa, Homo Sapiens
CMEDESAKA

SEQ ID NO: 203403 - protein, 9 aa, Homo Sapiens
VIDLCTVPK

SEQ ID NO: 203404 - protein, 9 aa, Homo Sapiens
KNCSSRRCW

SEQ ID NO: 203405 - protein, 9 aa, Homo Sapiens
QNMSKVVNS

SEQ ID NO: 203406 - protein, 9 aa, Homo Sapiens
TTPLADMTP

SEQ ID NO: 203407 - protein, 9 aa, Homo Sapiens
IFYTISLCT

SEQ ID NO: 203408 - protein, 9 aa, Homo Sapiens
SPHNQRKAL

SEQ ID NO: 203409 - protein, 9 aa, Homo Sapiens
FLILLFQRI

SEQ ID NO: 203410 - protein, 9 aa, Homo Sapiens
FRQYHMNKN

SEQ ID NO: 203411 - protein, 9 aa, Homo Sapiens
AVLIETLIT

SEQ ID NO: 203412 - protein, 9 aa, Homo Sapiens
ATHIWGKCS

SEQ ID NO: 203413 - protein, 9 aa, Homo Sapiens
DITGQGPQI

SEQ ID NO: 203414 - protein, 9 aa, Homo Sapiens
KGPSFGADG

SEQ ID NO: 203415 - protein, 9 aa, Homo Sapiens
RESLLQRTR

SEQ ID NO: 203416 - protein, 9 aa, Homo Sapiens
GLHVFDKES

SEQ ID NO: 203417 - protein, 9 aa, Homo Sapiens
TLDHPIKKG

SEQ ID NO: 203418 - protein, 9 aa, Homo Sapiens
HRAQMSIIS

SEQ ID NO: 203419 - protein, 9 aa, Homo Sapiens
YDCACSPGY

SEQ ID NO: 203420 - protein, 9 aa, Homo Sapiens
LKIKLAMKI

SEQ ID NO: 203421 - protein, 9 aa, Homo Sapiens
HVYPICFTM

SEQ ID NO: 203422 - protein, 9 aa, Homo Sapiens
KMISETCSV

SEQ ID NO: 203423 - protein, 9 aa, Homo Sapiens
NPYVRVTSS

SEQ ID NO: 203424 - protein, 9 aa, Homo Sapiens
DYILFAEML

SEQ ID NO: 203425 - protein, 9 aa, Homo Sapiens
ISGEEARLP

SEQ ID NO: 203426 - protein, 9 aa, Homo Sapiens
DQQMYLCYY

SEQ ID NO: 203427 - protein, 9 aa, Homo Sapiens
DSFTFYIWD

SEQ ID NO: 203428 - protein, 9 aa, Homo Sapiens
GDNFTSPKR

SEQ ID NO: 203429 - protein, 9 aa, Homo Sapiens
PGLPGDQGA

SEQ ID NO: 203430 - protein, 9 aa, Homo Sapiens
THLMWACAL

SEQ ID NO: 203431 - protein, 9 aa, Homo Sapiens
ADPDEVACR

SEQ ID NO: 203432 - protein, 9 aa, Homo Sapiens
EYPSIRDKW

SEQ ID NO: 203433 - protein, 9 aa, Homo Sapiens
GGDGDILTA

SEQ ID NO: 203434 - protein, 9 aa, Homo Sapiens
ETRREGERR

SEQ ID NO: 203435 - protein, 9 aa, Homo Sapiens
NTCCSTKID

SEQ ID NO: 203436 - protein, 9 aa, Homo Sapiens
MLALALSQG

SEQ ID NO: 203437 - protein, 9 aa, Homo Sapiens
LAFQIMPGA

SEQ ID NO: 203438 - protein, 9 aa, Homo Sapiens
GMMRDEKKS

SEQ ID NO: 203439 - protein, 9 aa, Homo Sapiens
GLTYQVCQM

SEQ ID NO: 203440 - protein, 9 aa, Homo Sapiens
LLAAMAYDW

SEQ ID NO: 203441 - protein, 9 aa, Homo Sapiens
CCQDNITTA

SEQ ID NO: 203442 - protein, 9 aa, Homo Sapiens
EHSRHLISS

SEQ ID NO: 203443 - protein, 9 aa, Homo Sapiens
HRKQYHLTQ

SEQ ID NO: 203444 - protein, 9 aa, Homo Sapiens
LEQDVISLQ

SEQ ID NO: 203445 - protein, 9 aa, Homo Sapiens
LVDDHSRET

SEQ ID NO: 203446 - protein, 9 aa, Homo Sapiens
DLALQGTKE

SEQ ID NO: 203447 - protein, 9 aa, Homo Sapiens
EKSPLVDIH

SEQ ID NO: 203448 - protein, 9 aa, Homo Sapiens
IQLLQKLWS

SEQ ID NO: 203449 - protein, 9 aa, Homo Sapiens
VAELKDPTD

SEQ ID NO: 203450 - protein, 9 aa, Homo Sapiens
EPATERPSV

SEQ ID NO: 203451 - protein, 9 aa, Homo Sapiens
GSSQRQTGP

SEQ ID NO: 203452 - protein, 9 aa, Homo Sapiens
RAAAALRAV

SEQ ID NO: 203453 - protein, 9 aa, Homo Sapiens
LGHMKPNTL

SEQ ID NO: 203454 - protein, 9 aa, Homo Sapiens
QQMYLCYYQ

SEQ ID NO: 203455 - protein, 9 aa, Homo Sapiens
NEMNDELQG

SEQ ID NO: 203456 - protein, 9 aa, Homo Sapiens
RQFQLRRCM

SEQ ID NO: 203457 - protein, 9 aa, Homo Sapiens
GIIKLFQYP

SEQ ID NO: 203458 - protein, 9 aa, Homo Sapiens
LYKHRRTQM

SEQ ID NO: 203459 - protein, 9 aa, Homo Sapiens
YEGGVQEPA

SEQ ID NO: 203460 - protein, 9 aa, Homo Sapiens
EAVAVAARQ

SEQ ID NO: 203461 - protein, 9 aa, Homo Sapiens
LTGYQSLTS

SEQ ID NO: 203462 - protein, 9 aa, Homo Sapiens
NGGTASLVG

SEQ ID NO: 203463 - protein, 9 aa, Homo Sapiens
QMEVLTELG

SEQ ID NO: 203464 - protein, 9 aa, Homo Sapiens
IPSPSRKPS

SEQ ID NO: 203465 - protein, 9 aa, Homo Sapiens
AATTNSSLS

SEQ ID NO: 203466 - protein, 9 aa, Homo Sapiens
HCNMKRHEM

SEQ ID NO: 203467 - protein, 9 aa, Homo Sapiens
ASDLDETHA

SEQ ID NO: 203468 - protein, 9 aa, Homo Sapiens
SISKYRCVI

SEQ ID NO: 203469 - protein, 9 aa, Homo Sapiens
QDYILFAEM

SEQ ID NO: 203470 - protein, 9 aa, Homo Sapiens
WSTCGDSEV

SEQ ID NO: 203471 - protein, 9 aa, Homo Sapiens
KIENIPKTS

SEQ ID NO: 203472 - protein, 9 aa, Homo Sapiens
PRGCCKSVS

SEQ ID NO: 203473 - protein, 9 aa, Homo Sapiens
ARRGGVKRV

SEQ ID NO: 203474 - protein, 9 aa, Homo Sapiens
KSIFFVGQL

SEQ ID NO: 203475 - protein, 9 aa, Homo Sapiens
RQEWICHIE

SEQ ID NO: 203476 - protein, 9 aa, Homo Sapiens
LQVSTLRQL

SEQ ID NO: 203477 - protein, 9 aa, Homo Sapiens
GSDPGSLTP

SEQ ID NO: 203478 - protein, 9 aa, Homo Sapiens
VRGPTGVAE

SEQ ID NO: 203479 - protein, 9 aa, Homo Sapiens
LQKLWSGSA

SEQ ID NO: 203480 - protein, 9 aa, Homo Sapiens
LSISSDSGH

SEQ ID NO: 203481 - protein, 9 aa, Homo Sapiens
CKDPLNING

SEQ ID NO: 203482 - protein, 9 aa, Homo Sapiens
DAIREIDDS

SEQ ID NO: 203483 - protein, 9 aa, Homo Sapiens
NSEETCFIS

SEQ ID NO: 203484 - protein, 9 aa, Homo Sapiens
RLTPSLARR

SEQ ID NO: 203485 - protein, 9 aa, Homo Sapiens
QQCQAETEE

SEQ ID NO: 203486 - protein, 9 aa, Homo Sapiens
SVVEAERLV

SEQ ID NO: 203487 - protein, 9 aa, Homo Sapiens
WSHKAEFSK

SEQ ID NO: 203488 - protein, 9 aa, Homo Sapiens
NMPLHLAAC

SEQ ID NO: 203489 - protein, 9 aa, Homo Sapiens
VMATTGTVT

SEQ ID NO: 203490 - protein, 9 aa, Homo Sapiens
FVVFLVIYL

SEQ ID NO: 203491 - protein, 9 aa, Homo Sapiens
IFFACMVRV

SEQ ID NO: 203492 - protein, 9 aa, Homo Sapiens
YMMDPHENI

SEQ ID NO: 203493 - protein, 9 aa, Homo Sapiens
FIPREMTYQ

SEQ ID NO: 203494 - protein, 9 aa, Homo Sapiens
GNKKNTGFT

SEQ ID NO: 203495 - protein, 9 aa, Homo Sapiens
CMEVNFFGT

SEQ ID NO: 203496 - protein, 9 aa, Homo Sapiens
LYKKSDGIQ

SEQ ID NO: 203497 - protein, 9 aa, Homo Sapiens
QNFPLEPIK

SEQ ID NO: 203498 - protein, 9 aa, Homo Sapiens
GLENVPGIF

SEQ ID NO: 203499 - protein, 9 aa, Homo Sapiens
ELKKELLPR

SEQ ID NO: 203500 - protein, 9 aa, Homo Sapiens
VDSVLFYAT

SEQ ID NO: 203501 - protein, 9 aa, Homo Sapiens
QRDSIDEKY

SEQ ID NO: 203502 - protein, 9 aa, Homo Sapiens
EHEAILQVL

SEQ ID NO: 203503 - protein, 9 aa, Homo Sapiens
YAIGGHNAP

SEQ ID NO: 203504 - protein, 9 aa, Homo Sapiens
AQRPSAWLL

SEQ ID NO: 203505 - protein, 9 aa, Homo Sapiens
LPYHVLQAS

SEQ ID NO: 203506 - protein, 9 aa, Homo Sapiens
VWEHHPESG

SEQ ID NO: 203507 - protein, 9 aa, Homo Sapiens
QIANAQDRR

SEQ ID NO: 203508 - protein, 9 aa, Homo Sapiens
TASIFRPTL

SEQ ID NO: 203509 - protein, 9 aa, Homo Sapiens
VNPQTTEIL

SEQ ID NO: 203510 - protein, 9 aa, Homo Sapiens
LMVFLQHYG

SEQ ID NO: 203511 - protein, 9 aa, Homo Sapiens
DYTPSYRGF

SEQ ID NO: 203512 - protein, 9 aa, Homo Sapiens
LFGWLFCRV

SEQ ID NO: 203513 - protein, 9 aa, Homo Sapiens
RRSGMHTVA

SEQ ID NO: 203514 - protein, 9 aa, Homo Sapiens
LGSCIWALQ

SEQ ID NO: 203515 - protein, 9 aa, Homo Sapiens
LLREQKRIL

SEQ ID NO: 203516 - protein, 9 aa, Homo Sapiens
GGRERRDRR

SEQ ID NO: 203517 - protein, 9 aa, Homo Sapiens
AGSRRSRHQ

SEQ ID NO: 203518 - protein, 9 aa, Homo Sapiens
RVEIHMVPT

SEQ ID NO: 203519 - protein, 9 aa, Homo Sapiens
AEAQAQLQL

SEQ ID NO: 203520 - protein, 9 aa, Homo Sapiens
DKNFAKMEK

SEQ ID NO: 203521 - protein, 9 aa, Homo Sapiens
LFEVGGSPV

SEQ ID NO: 203522 - protein, 9 aa, Homo Sapiens
PLELNGEDK

SEQ ID NO: 203523 - protein, 9 aa, Homo Sapiens
MFANYGIWK

SEQ ID NO: 203524 - protein, 9 aa, Homo Sapiens
PCQRVDSDQ

SEQ ID NO: 203525 - protein, 9 aa, Homo Sapiens
CISLLNQRQ

SEQ ID NO: 203526 - protein, 9 aa, Homo Sapiens
ASRHSSLSS

SEQ ID NO: 203527 - protein, 9 aa, Homo Sapiens
ELTDASGGW

SEQ ID NO: 203528 - protein, 9 aa, Homo Sapiens
RPLRGGKRH

SEQ ID NO: 203529 - protein, 9 aa, Homo Sapiens
LMQAAGLGH

SEQ ID NO: 203530 - protein, 9 aa, Homo Sapiens
KLCGTADVT

SEQ ID NO: 203531 - protein, 9 aa, Homo Sapiens
AFRVGSQLK

SEQ ID NO: 203532 - protein, 9 aa, Homo Sapiens
ERSQAHVTV

SEQ ID NO: 203533 - protein, 9 aa, Homo Sapiens
LDRVTNDME

SEQ ID NO: 203534 - protein, 9 aa, Homo Sapiens
PLILTPSRS

SEQ ID NO: 203535 - protein, 9 aa, Homo Sapiens
INATDNPSG

SEQ ID NO: 203536 - protein, 9 aa, Homo Sapiens
TGAHLEPPY

SEQ ID NO: 203537 - protein, 9 aa, Homo Sapiens
ANSFLALIN

SEQ ID NO: 203538 - protein, 9 aa, Homo Sapiens
KISLSGIHH

SEQ ID NO: 203539 - protein, 9 aa, Homo Sapiens
KKSCHTTVD

SEQ ID NO: 203540 - protein, 9 aa, Homo Sapiens
PLRDWLEIS

SEQ ID NO: 203541 - protein, 9 aa, Homo Sapiens
LVLTARRVH

SEQ ID NO: 203542 - protein, 9 aa, Homo Sapiens
KHEVSPLQC

SEQ ID NO: 203543 - protein, 9 aa, Homo Sapiens
GRFEMQPNV

SEQ ID NO: 203544 - protein, 9 aa, Homo Sapiens
AGTHILMAV

SEQ ID NO: 203545 - protein, 9 aa, Homo Sapiens
DKTQFLSKE

SEQ ID NO: 203546 - protein, 9 aa, Homo Sapiens
DYYKNRMYL

SEQ ID NO: 203547 - protein, 9 aa, Homo Sapiens
HARESELEQ

SEQ ID NO: 203548 - protein, 9 aa, Homo Sapiens
QTLPALTIL

SEQ ID NO: 203549 - protein, 9 aa, Homo Sapiens
CDRIPPVLI

SEQ ID NO: 203550 - protein, 9 aa, Homo Sapiens
EVCDVNTGP

SEQ ID NO: 203551 - protein, 9 aa, Homo Sapiens
EFLCKFPAG

SEQ ID NO: 203552 - protein, 9 aa, Homo Sapiens
SVSLLVVSP

SEQ ID NO: 203553 - protein, 9 aa, Homo Sapiens
RIHVAQKPY

SEQ ID NO: 203554 - protein, 9 aa, Homo Sapiens
AMACFTAIT

SEQ ID NO: 203555 - protein, 9 aa, Homo Sapiens
RHGSLDQPV

SEQ ID NO: 203556 - protein, 9 aa, Homo Sapiens
KEMTHSWSP

SEQ ID NO: 203557 - protein, 9 aa, Homo Sapiens
ELHSLQSLP

SEQ ID NO: 203558 - protein, 9 aa, Homo Sapiens
GDVIDLCTV

SEQ ID NO: 203559 - protein, 9 aa, Homo Sapiens
DPVHGHLRE

SEQ ID NO: 203560 - protein, 9 aa, Homo Sapiens
TPHMSSVPA

SEQ ID NO: 203561 - protein, 9 aa, Homo Sapiens
MMSKYLTHF

SEQ ID NO: 203562 - protein, 9 aa, Homo Sapiens
MGLQEYHSH

SEQ ID NO: 203563 - protein, 9 aa, Homo Sapiens
YRRRRQQCQ

SEQ ID NO: 203564 - protein, 9 aa, Homo Sapiens
VPPMRFPYS

SEQ ID NO: 203565 - protein, 9 aa, Homo Sapiens
PSALGSWSL

SEQ ID NO: 203566 - protein, 9 aa, Homo Sapiens
DHMTSVIAY

SEQ ID NO: 203567 - protein, 9 aa, Homo Sapiens
PTAEEPTGI

SEQ ID NO: 203568 - protein, 9 aa, Homo Sapiens
AMVLEMIRC

SEQ ID NO: 203569 - protein, 9 aa, Homo Sapiens
STNCSTPGV

SEQ ID NO: 203570 - protein, 9 aa, Homo Sapiens
RFTHTRWVA

SEQ ID NO: 203571 - protein, 9 aa, Homo Sapiens
IGGVPERQG

SEQ ID NO: 203572 - protein, 9 aa, Homo Sapiens
YTHFCQGGH

SEQ ID NO: 203573 - protein, 9 aa, Homo Sapiens
SENMTLNIL

SEQ ID NO: 203574 - protein, 9 aa, Homo Sapiens
SMEDQGLSV

SEQ ID NO: 203575 - protein, 9 aa, Homo Sapiens
HELLEAVDA

SEQ ID NO: 203576 - protein, 9 aa, Homo Sapiens
TTPTSMATD

SEQ ID NO: 203577 - protein, 9 aa, Homo Sapiens
VQERTTLCY

SEQ ID NO: 203578 - protein, 9 aa, Homo Sapiens
GTEIVLESD

SEQ ID NO: 203579 - protein, 9 aa, Homo Sapiens
TYSLYIRHL

SEQ ID NO: 203580 - protein, 9 aa, Homo Sapiens
VGDVIDLCT

SEQ ID NO: 203581 - protein, 9 aa, Homo Sapiens
DSHILASFE

SEQ ID NO: 203582 - protein, 9 aa, Homo Sapiens
TTAATGSMA

SEQ ID NO: 203583 - protein, 9 aa, Homo Sapiens
HVQLMRPLG

SEQ ID NO: 203584 - protein, 9 aa, Homo Sapiens
QSHLRHGED

SEQ ID NO: 203585 - protein, 9 aa, Homo Sapiens
VLRTTPLAD

SEQ ID NO: 203586 - protein, 9 aa, Homo Sapiens
ICRCLCQFS

SEQ ID NO: 203587 - protein, 9 aa, Homo Sapiens
ACRLVFFNK

SEQ ID NO: 203588 - protein, 9 aa, Homo Sapiens
WLECVVASK

SEQ ID NO: 203589 - protein, 9 aa, Homo Sapiens
ASPSSVIRT

SEQ ID NO: 203590 - protein, 9 aa, Homo Sapiens
HGFPGQDGL

SEQ ID NO: 203591 - protein, 9 aa, Homo Sapiens
GSDLLVPYN

SEQ ID NO: 203592 - protein, 9 aa, Homo Sapiens
RLYVDQTLQ

SEQ ID NO: 203593 - protein, 9 aa, Homo Sapiens
SVGTTLMPA

SEQ ID NO: 203594 - protein, 9 aa, Homo Sapiens
SLPELLPTS

SEQ ID NO: 203595 - protein, 9 aa, Homo Sapiens
GKCVENING

SEQ ID NO: 203596 - protein, 9 aa, Homo Sapiens
AEDYPRYPN

SEQ ID NO: 203597 - protein, 9 aa, Homo Sapiens
NCIHTLTGY

SEQ ID NO: 203598 - protein, 9 aa, Homo Sapiens
FSEGGFLML

SEQ ID NO: 203599 - protein, 9 aa, Homo Sapiens
IRQYRISPT

SEQ ID NO: 203600 - protein, 9 aa, Homo Sapiens
VHCIIPNET

SEQ ID NO: 203601 - protein, 9 aa, Homo Sapiens
IQQDNGSVH

SEQ ID NO: 203602 - protein, 9 aa, Homo Sapiens
LLPGLLAYL

SEQ ID NO: 203603 - protein, 9 aa, Homo Sapiens
IAYCTTDHN

SEQ ID NO: 203604 - protein, 9 aa, Homo Sapiens
YHIRNMCNI

SEQ ID NO: 203605 - protein, 9 aa, Homo Sapiens
LSLELQMDS

SEQ ID NO: 203606 - protein, 9 aa, Homo Sapiens
GEHPQRLPA

SEQ ID NO: 203607 - protein, 9 aa, Homo Sapiens
VLQSSRAVM

SEQ ID NO: 203608 - protein, 9 aa, Homo Sapiens
TPYKPPAGH

SEQ ID NO: 203609 - protein, 9 aa, Homo Sapiens
SQVYSYQDI

SEQ ID NO: 203610 - protein, 9 aa, Homo Sapiens
DDRQGVLRS

SEQ ID NO: 203611 - protein, 9 aa, Homo Sapiens
VYHIRNMCN

SEQ ID NO: 203612 - protein, 9 aa, Homo Sapiens
LASLSSMSL

SEQ ID NO: 203613 - protein, 9 aa, Homo Sapiens
LRQRLGLAP

SEQ ID NO: 203614 - protein, 9 aa, Homo Sapiens
HCLAVLVPF

SEQ ID NO: 203615 - protein, 9 aa, Homo Sapiens
AVLQSSRAV

SEQ ID NO: 203616 - protein, 9 aa, Homo Sapiens
EFFNMSHCQ

SEQ ID NO: 203617 - protein, 9 aa, Homo Sapiens
FKEESNAMR

SEQ ID NO: 203618 - protein, 9 aa, Homo Sapiens
LQSKSENMT

SEQ ID NO: 203619 - protein, 9 aa, Homo Sapiens
KSPLVDIHV

SEQ ID NO: 203620 - protein, 9 aa, Homo Sapiens
ILTASSDGT

SEQ ID NO: 203621 - protein, 9 aa, Homo Sapiens
GEAVRHPIF

SEQ ID NO: 203622 - protein, 9 aa, Homo Sapiens
LVGKLSAGV

SEQ ID NO: 203623 - protein, 9 aa, Homo Sapiens
GGSCCRSSC

SEQ ID NO: 203624 - protein, 9 aa, Homo Sapiens
GGAAMKASV

SEQ ID NO: 203625 - protein, 9 aa, Homo Sapiens
TPYSHGNVT

SEQ ID NO: 203626 - protein, 9 aa, Homo Sapiens
GQTIWQLIS

SEQ ID NO: 203627 - protein, 9 aa, Homo Sapiens
WAPVIRPGG

SEQ ID NO: 203628 - protein, 9 aa, Homo Sapiens
HTCYPLFKD

SEQ ID NO: 203629 - protein, 9 aa, Homo Sapiens
IISPEKQHP

SEQ ID NO: 203630 - protein, 9 aa, Homo Sapiens
RGSEQGKCV

SEQ ID NO: 203631 - protein, 9 aa, Homo Sapiens
KYRRCGFLQ

SEQ ID NO: 203632 - protein, 9 aa, Homo Sapiens
ANIVDGTTA

SEQ ID NO: 203633 - protein, 9 aa, Homo Sapiens
TLWEHVPNG

SEQ ID NO: 203634 - protein, 9 aa, Homo Sapiens
KCRVKKADP

SEQ ID NO: 203635 - protein, 9 aa, Homo Sapiens
NRQRSHTQM

SEQ ID NO: 203636 - protein, 9 aa, Homo Sapiens
GVKRVSGLI

SEQ ID NO: 203637 - protein, 9 aa, Homo Sapiens
LKGDVDEDE

SEQ ID NO: 203638 - protein, 9 aa, Homo Sapiens
LAKVLPQLP

SEQ ID NO: 203639 - protein, 9 aa, Homo Sapiens
EWVENRRAF

SEQ ID NO: 203640 - protein, 9 aa, Homo Sapiens
AHCMHILLG

SEQ ID NO: 203641 - protein, 9 aa, Homo Sapiens
FSRSNHRGS

SEQ ID NO: 203642 - protein, 9 aa, Homo Sapiens
HMSSVPAVI

SEQ ID NO: 203643 - protein, 9 aa, Homo Sapiens
GLPGTAQGP

SEQ ID NO: 203644 - protein, 9 aa, Homo Sapiens
LDETHAFKV

SEQ ID NO: 203645 - protein, 9 aa, Homo Sapiens
PFMFANYGI

SEQ ID NO: 203646 - protein, 9 aa, Homo Sapiens
AVLRTTPLA

SEQ ID NO: 203647 - protein, 9 aa, Homo Sapiens
KDSTHLMNG

SEQ ID NO: 203648 - protein, 9 aa, Homo Sapiens
HFAVEMKCS

SEQ ID NO: 203649 - protein, 9 aa, Homo Sapiens
PSCARSQRP

SEQ ID NO: 203650 - protein, 9 aa, Homo Sapiens
GLPSMGYTL

SEQ ID NO: 203651 - protein, 9 aa, Homo Sapiens
EAVKEEAVA

SEQ ID NO: 203652 - protein, 9 aa, Homo Sapiens
YFELPDLGP

SEQ ID NO: 203653 - protein, 9 aa, Homo Sapiens
FYIWDGNNR

SEQ ID NO: 203654 - protein, 9 aa, Homo Sapiens
IIESTKSGL

SEQ ID NO: 203655 - protein, 9 aa, Homo Sapiens
RVQAQQKQI

SEQ ID NO: 203656 - protein, 9 aa, Homo Sapiens
VLKSKDPRH

SEQ ID NO: 203657 - protein, 9 aa, Homo Sapiens
MVASMEDQG

SEQ ID NO: 203658 - protein, 9 aa, Homo Sapiens
TLELTKGLL

SEQ ID NO: 203659 - protein, 9 aa, Homo Sapiens
LKELEHEAI

SEQ ID NO: 203660 - protein, 9 aa, Homo Sapiens
EFKCLASSK

SEQ ID NO: 203661 - protein, 9 aa, Homo Sapiens
HVERIMSET

SEQ ID NO: 203662 - protein, 9 aa, Homo Sapiens
ILIKYHHSW

SEQ ID NO: 203663 - protein, 9 aa, Homo Sapiens
DVKALRAFH

SEQ ID NO: 203664 - protein, 9 aa, Homo Sapiens
SWLTSCYFF

SEQ ID NO: 203665 - protein, 9 aa, Homo Sapiens
LWRTHQADH

SEQ ID NO: 203666 - protein, 9 aa, Homo Sapiens
CISTEFTPW

SEQ ID NO: 203667 - protein, 9 aa, Homo Sapiens
CPANGAGWP

SEQ ID NO: 203668 - protein, 9 aa, Homo Sapiens
TTNLCEGHI

SEQ ID NO: 203669 - protein, 9 aa, Homo Sapiens
CVDVAGHFP

SEQ ID NO: 203670 - protein, 9 aa, Homo Sapiens
ELARLRRDP

SEQ ID NO: 203671 - protein, 9 aa, Homo Sapiens
VRNPVKYSV

SEQ ID NO: 203672 - protein, 9 aa, Homo Sapiens
LSLSWALGS

SEQ ID NO: 203673 - protein, 9 aa, Homo Sapiens
LRLQHMDRP

SEQ ID NO: 203674 - protein, 9 aa, Homo Sapiens
QILTASSDG

SEQ ID NO: 203675 - protein, 9 aa, Homo Sapiens
PPPGTMGPP

SEQ ID NO: 203676 - protein, 9 aa, Homo Sapiens
WLQQTTGCS

SEQ ID NO: 203677 - protein, 9 aa, Homo Sapiens
ASGDSRHSS

SEQ ID NO: 203678 - protein, 9 aa, Homo Sapiens
AHTGEKPYT

SEQ ID NO: 203679 - protein, 9 aa, Homo Sapiens
VSFVVIMFE

SEQ ID NO: 203680 - protein, 9 aa, Homo Sapiens
TLVPGAHPQ

SEQ ID NO: 203681 - protein, 9 aa, Homo Sapiens
ALVGDPAMV

SEQ ID NO: 203682 - protein, 9 aa, Homo Sapiens
ERKYAPRLA

SEQ ID NO: 203683 - protein, 9 aa, Homo Sapiens
FTKMTPKQR

SEQ ID NO: 203684 - protein, 9 aa, Homo Sapiens
RRCTRKFGL

SEQ ID NO: 203685 - protein, 9 aa, Homo Sapiens
VYSYQDIQK

SEQ ID NO: 203686 - protein, 9 aa, Homo Sapiens
PFGDFACCL

SEQ ID NO: 203687 - protein, 9 aa, Homo Sapiens
DSCEKYVHG

SEQ ID NO: 203688 - protein, 9 aa, Homo Sapiens
ASPSCSLYP

SEQ ID NO: 203689 - protein, 9 aa, Homo Sapiens
VSDTEIEYT

SEQ ID NO: 203690 - protein, 9 aa, Homo Sapiens
RKILATQGQ

SEQ ID NO: 203691 - protein, 9 aa, Homo Sapiens
PTPRLNASL

SEQ ID NO: 203692 - protein, 9 aa, Homo Sapiens
YPQRWSYTS

SEQ ID NO: 203693 - protein, 9 aa, Homo Sapiens
PQVHWTTVG

SEQ ID NO: 203694 - protein, 9 aa, Homo Sapiens
PDFPWSMGE

SEQ ID NO: 203695 - protein, 9 aa, Homo Sapiens
NCILDEQET

SEQ ID NO: 203696 - protein, 9 aa, Homo Sapiens
SGKLDVPCS

SEQ ID NO: 203697 - protein, 9 aa, Homo Sapiens
NKLNDKHIT

SEQ ID NO: 203698 - protein, 9 aa, Homo Sapiens
SHLARVSCH

SEQ ID NO: 203699 - protein, 9 aa, Homo Sapiens
ARSQRPSSS

SEQ ID NO: 203700 - protein, 9 aa, Homo Sapiens
ICMYRQSKE

SEQ ID NO: 203701 - protein, 9 aa, Homo Sapiens
KKGDILRIQ

SEQ ID NO: 203702 - protein, 9 aa, Homo Sapiens
KPGEQRCFA

SEQ ID NO: 203703 - protein, 9 aa, Homo Sapiens
YIATVVGNG

SEQ ID NO: 203704 - protein, 9 aa, Homo Sapiens
KKLKDALTM

SEQ ID NO: 203705 - protein, 9 aa, Homo Sapiens
AQVGDALWL

SEQ ID NO: 203706 - protein, 9 aa, Homo Sapiens
LETSAKNAM

SEQ ID NO: 203707 - protein, 9 aa, Homo Sapiens
APAPPAAPA

SEQ ID NO: 203708 - protein, 9 aa, Homo Sapiens
DMERHHILF

SEQ ID NO: 203709 - protein, 9 aa, Homo Sapiens
NKKLKRVGL

SEQ ID NO: 203710 - protein, 9 aa, Homo Sapiens
FHYLKVQVI

SEQ ID NO: 203711 - protein, 9 aa, Homo Sapiens
QSTNAGTSG

SEQ ID NO: 203712 - protein, 9 aa, Homo Sapiens
DISDLVRCV

SEQ ID NO: 203713 - protein, 9 aa, Homo Sapiens
LTHQRHHSR

SEQ ID NO: 203714 - protein, 9 aa, Homo Sapiens
TRDKFEEDR

SEQ ID NO: 203715 - protein, 9 aa, Homo Sapiens
CNAANICCH

SEQ ID NO: 203716 - protein, 9 aa, Homo Sapiens
FLNIKGCAM

SEQ ID NO: 203717 - protein, 9 aa, Homo Sapiens
MVAIQVYWN

SEQ ID NO: 203718 - protein, 9 aa, Homo Sapiens
LVLHTEQPG

SEQ ID NO: 203719 - protein, 9 aa, Homo Sapiens
PINYQGLCF

SEQ ID NO: 203720 - protein, 9 aa, Homo Sapiens
GSFRRLDYG

SEQ ID NO: 203721 - protein, 9 aa, Homo Sapiens
SNEERLRGL

SEQ ID NO: 203722 - protein, 9 aa, Homo Sapiens
PVEALALEA

SEQ ID NO: 203723 - protein, 9 aa, Homo Sapiens
MNDELQGNA

SEQ ID NO: 203724 - protein, 9 aa, Homo Sapiens
APPFRAARD

SEQ ID NO: 203725 - protein, 9 aa, Homo Sapiens
LHRAQMSII

SEQ ID NO: 203726 - protein, 9 aa, Homo Sapiens
LDPKRPPPP

SEQ ID NO: 203727 - protein, 9 aa, Homo Sapiens
RENVLAYKT

SEQ ID NO: 203728 - protein, 9 aa, Homo Sapiens
FFREECGVH

SEQ ID NO: 203729 - protein, 9 aa, Homo Sapiens
LGVDSATVF

SEQ ID NO: 203730 - protein, 9 aa, Homo Sapiens
FRSPLPTTS

SEQ ID NO: 203731 - protein, 9 aa, Homo Sapiens
SIYVHLDFP

SEQ ID NO: 203732 - protein, 9 aa, Homo Sapiens
CGQTPIKQN

SEQ ID NO: 203733 - protein, 9 aa, Homo Sapiens
CLGHERIHT

SEQ ID NO: 203734 - protein, 9 aa, Homo Sapiens
VTWVNAHTY

SEQ ID NO: 203735 - protein, 9 aa, Homo Sapiens
IENVHVCSE

SEQ ID NO: 203736 - protein, 9 aa, Homo Sapiens
PPASSSAPV

SEQ ID NO: 203737 - protein, 9 aa, Homo Sapiens
FNQDPKAVD

SEQ ID NO: 203738 - protein, 9 aa, Homo Sapiens
GGGHVKIES

SEQ ID NO: 203739 - protein, 9 aa, Homo Sapiens
LMGPPLPGP

SEQ ID NO: 203740 - protein, 9 aa, Homo Sapiens
KEQRLPQDD

SEQ ID NO: 203741 - protein, 9 aa, Homo Sapiens
SLNGKADVT

SEQ ID NO: 203742 - protein, 9 aa, Homo Sapiens
PTRHGSLPL

SEQ ID NO: 203743 - protein, 9 aa, Homo Sapiens
LVAAQPENH

SEQ ID NO: 203744 - protein, 9 aa, Homo Sapiens
LPNLKAFMC

SEQ ID NO: 203745 - protein, 9 aa, Homo Sapiens
WGVHKCKPQ

SEQ ID NO: 203746 - protein, 9 aa, Homo Sapiens
NWNLPPRRT

SEQ ID NO: 203747 - protein, 9 aa, Homo Sapiens
EAKCRQASE

SEQ ID NO: 203748 - protein, 9 aa, Homo Sapiens
NFKENIEVE

SEQ ID NO: 203749 - protein, 9 aa, Homo Sapiens
WYYDPNTES

SEQ ID NO: 203750 - protein, 9 aa, Homo Sapiens
NLSGWMGMT

SEQ ID NO: 203751 - protein, 9 aa, Homo Sapiens
CRPGMPSFV

SEQ ID NO: 203752 - protein, 8 aa, Homo Sapiens
TAGKSPSL

SEQ ID NO: 203753 - protein, 9 aa, Homo Sapiens
SEQRDSIDE

SEQ ID NO: 203754 - protein, 9 aa, Homo Sapiens
ITETEISVK

SEQ ID NO: 203755 - protein, 9 aa, Homo Sapiens
GRCMDLLTQ

SEQ ID NO: 203756 - protein, 9 aa, Homo Sapiens
VPLRCTIHL

SEQ ID NO: 203757 - protein, 9 aa, Homo Sapiens
TTADVIARK

SEQ ID NO: 203758 - protein, 9 aa, Homo Sapiens
GFHHLWLQM

SEQ ID NO: 203759 - protein, 9 aa, Homo Sapiens
GRECLWPGQ

SEQ ID NO: 203760 - protein, 9 aa, Homo Sapiens
VPGLTRSVC

SEQ ID NO: 203761 - protein, 9 aa, Homo Sapiens
VKELCRHWY

SEQ ID NO: 203762 - protein, 9 aa, Homo Sapiens
GPDPPTGIG

SEQ ID NO: 203763 - protein, 9 aa, Homo Sapiens
ASPPSCARS

SEQ ID NO: 203764 - protein, 9 aa, Homo Sapiens
FVQALKACM

SEQ ID NO: 203765 - protein, 9 aa, Homo Sapiens
FIVHSLRTA

SEQ ID NO: 203766 - protein, 9 aa, Homo Sapiens
HSSYSYCGR

SEQ ID NO: 203767 - protein, 9 aa, Homo Sapiens
PEPKPAMAC

SEQ ID NO: 203768 - protein, 9 aa, Homo Sapiens
NFQGKRYEL

SEQ ID NO: 203769 - protein, 9 aa, Homo Sapiens
WVCCNPDSN

SEQ ID NO: 203770 - protein, 9 aa, Homo Sapiens
TDLKEEMDK

SEQ ID NO: 203771 - protein, 9 aa, Homo Sapiens
AEFADCPKL

SEQ ID NO: 203772 - protein, 9 aa, Homo Sapiens
VKKARKYPH

SEQ ID NO: 203773 - protein, 9 aa, Homo Sapiens
GAGGGDPRR

SEQ ID NO: 203774 - protein, 9 aa, Homo Sapiens
NLLDPWREI

SEQ ID NO: 203775 - protein, 9 aa, Homo Sapiens
ELRVASALN

SEQ ID NO: 203776 - protein, 9 aa, Homo Sapiens
THPHFVHCI

SEQ ID NO: 203777 - protein, 9 aa, Homo Sapiens
LVYLQRSNM

SEQ ID NO: 203778 - protein, 9 aa, Homo Sapiens
GWMGMTGPG

SEQ ID NO: 203779 - protein, 9 aa, Homo Sapiens
HPPPASVSP

SEQ ID NO: 203780 - protein, 9 aa, Homo Sapiens
CPRCPSSFR

SEQ ID NO: 203781 - protein, 9 aa, Homo Sapiens
MDKMRKMIE

SEQ ID NO: 203782 - protein, 9 aa, Homo Sapiens
FELSTDTDG

SEQ ID NO: 203783 - protein, 9 aa, Homo Sapiens
MAHHCLGFV

SEQ ID NO: 203784 - protein, 9 aa, Homo Sapiens
ISTLKLKPA

SEQ ID NO: 203785 - protein, 9 aa, Homo Sapiens
AKACSTGRM

SEQ ID NO: 203786 - protein, 9 aa, Homo Sapiens
QTEVITAAE

SEQ ID NO: 203787 - protein, 9 aa, Homo Sapiens
VSKPPVLQA

SEQ ID NO: 203788 - protein, 9 aa, Homo Sapiens
LELLMCSLG

SEQ ID NO: 203789 - protein, 9 aa, Homo Sapiens
STNLEGCYL

SEQ ID NO: 203790 - protein, 9 aa, Homo Sapiens
LSYDELLEI

SEQ ID NO: 203791 - protein, 9 aa, Homo Sapiens
QMDSHMKQL

SEQ ID NO: 203792 - protein, 9 aa, Homo Sapiens
WDGVACMRF

SEQ ID NO: 203793 - protein, 9 aa, Homo Sapiens
ESPHYLYII

SEQ ID NO: 203794 - protein, 9 aa, Homo Sapiens
CFSGVNDTD

SEQ ID NO: 203795 - protein, 9 aa, Homo Sapiens
MGLHGLSGN

SEQ ID NO: 203796 - protein, 9 aa, Homo Sapiens
QVHWTTVGL

SEQ ID NO: 203797 - protein, 9 aa, Homo Sapiens
PHFPAAPTR

SEQ ID NO: 203798 - protein, 9 aa, Homo Sapiens
IKPANMEEQ

SEQ ID NO: 203799 - protein, 9 aa, Homo Sapiens
YSAKWSHKA

SEQ ID NO: 203800 - protein, 9 aa, Homo Sapiens
SQMAAKRHA

SEQ ID NO: 203801 - protein, 9 aa, Homo Sapiens
SVQKLFAKP

SEQ ID NO: 203802 - protein, 9 aa, Homo Sapiens
MVRVRDGLP

SEQ ID NO: 203803 - protein, 9 aa, Homo Sapiens
CSSMSLYTA

SEQ ID NO: 203804 - protein, 9 aa, Homo Sapiens
RYGDAIREI

SEQ ID NO: 203805 - protein, 9 aa, Homo Sapiens
RLGIDPINE

SEQ ID NO: 203806 - protein, 9 aa, Homo Sapiens
DVEFELSTD

SEQ ID NO: 203807 - protein, 9 aa, Homo Sapiens
KDKECQLKE

SEQ ID NO: 203808 - protein, 9 aa, Homo Sapiens
LTPSRSQWV

SEQ ID NO: 203809 - protein, 9 aa, Homo Sapiens
SDADDKMCQ

SEQ ID NO: 203810 - protein, 9 aa, Homo Sapiens
QLEHWERSL

SEQ ID NO: 203811 - protein, 9 aa, Homo Sapiens
TTFVGPDGE

SEQ ID NO: 203812 - protein, 9 aa, Homo Sapiens
RRTQMHLNN

SEQ ID NO: 203813 - protein, 9 aa, Homo Sapiens
KAIECYRRS

SEQ ID NO: 203814 - protein, 9 aa, Homo Sapiens
QHLPLSDLP

SEQ ID NO: 203815 - protein, 9 aa, Homo Sapiens
KQRRRSRSC

SEQ ID NO: 203816 - protein, 9 aa, Homo Sapiens
VTAQDPDAV

SEQ ID NO: 203817 - protein, 9 aa, Homo Sapiens
NHCACRLVF

SEQ ID NO: 203818 - protein, 9 aa, Homo Sapiens
QPGPYSHHL

SEQ ID NO: 203819 - protein, 9 aa, Homo Sapiens
DPGLQGTTE

SEQ ID NO: 203820 - protein, 9 aa, Homo Sapiens
QTGGRVLIT

SEQ ID NO: 203821 - protein, 9 aa, Homo Sapiens
QRIIGHVHL

SEQ ID NO: 203822 - protein, 9 aa, Homo Sapiens
KGTGCIEGH

SEQ ID NO: 203823 - protein, 9 aa, Homo Sapiens
TMCSLANIS

SEQ ID NO: 203824 - protein, 9 aa, Homo Sapiens
RRQAPGALQ

SEQ ID NO: 203825 - protein, 9 aa, Homo Sapiens
QIERKHLIQ

SEQ ID NO: 203826 - protein, 9 aa, Homo Sapiens
GSIYNILAA

SEQ ID NO: 203827 - protein, 9 aa, Homo Sapiens
KKNAFRLKK

SEQ ID NO: 203828 - protein, 9 aa, Homo Sapiens
AQPSCCLGR

SEQ ID NO: 203829 - protein, 9 aa, Homo Sapiens
RCEDSDKAY

SEQ ID NO: 203830 - protein, 9 aa, Homo Sapiens
TAPRPHTIP

SEQ ID NO: 203831 - protein, 9 aa, Homo Sapiens
TCNRIKQSA

SEQ ID NO: 203832 - protein, 9 aa, Homo Sapiens
QTAGAWIIT

SEQ ID NO: 203833 - protein, 9 aa, Homo Sapiens
VPLPPHLGI

SEQ ID NO: 203834 - protein, 9 aa, Homo Sapiens
NHLTGRPGE

SEQ ID NO: 203835 - protein, 9 aa, Homo Sapiens
ESNAMRNFL

SEQ ID NO: 203836 - protein, 9 aa, Homo Sapiens
LTAKTLACI

SEQ ID NO: 203837 - protein, 9 aa, Homo Sapiens
TKERAHQQK

SEQ ID NO: 203838 - protein, 9 aa, Homo Sapiens
WNGKKMLSL

SEQ ID NO: 203839 - protein, 9 aa, Homo Sapiens
EGLLIINTL

SEQ ID NO: 203840 - protein, 9 aa, Homo Sapiens
LRQGYTIHI

SEQ ID NO: 203841 - protein, 9 aa, Homo Sapiens
YELSYAWEP

SEQ ID NO: 203842 - protein, 9 aa, Homo Sapiens
ARAPPFPQS

SEQ ID NO: 203843 - protein, 9 aa, Homo Sapiens
CPLPPPPAY

SEQ ID NO: 203844 - protein, 9 aa, Homo Sapiens
TGRMERCTC

SEQ ID NO: 203845 - protein, 9 aa, Homo Sapiens
DGILDTIAK

SEQ ID NO: 203846 - protein, 9 aa, Homo Sapiens
LGDKWSHFD

SEQ ID NO: 203847 - protein, 9 aa, Homo Sapiens
QTNIQTLDH

SEQ ID NO: 203848 - protein, 9 aa, Homo Sapiens
YFIVHSLRT

SEQ ID NO: 203849 - protein, 9 aa, Homo Sapiens
SGCGQTPIK

SEQ ID NO: 203850 - protein, 9 aa, Homo Sapiens
VLAYKTQQK

SEQ ID NO: 203851 - protein, 9 aa, Homo Sapiens
GDLSNWCNG

SEQ ID NO: 203852 - protein, 9 aa, Homo Sapiens
PLHTYGMFS

SEQ ID NO: 203853 - protein, 9 aa, Homo Sapiens
KPAMDKDGK

SEQ ID NO: 203854 - protein, 9 aa, Homo Sapiens
YAHVLTPHM

SEQ ID NO: 203855 - protein, 9 aa, Homo Sapiens
GCAAVMTSH

SEQ ID NO: 203856 - protein, 9 aa, Homo Sapiens
WLTCLLRRE

SEQ ID NO: 203857 - protein, 9 aa, Homo Sapiens
AVKQGRREA

SEQ ID NO: 203858 - protein, 9 aa, Homo Sapiens
GFSGPSFPM

SEQ ID NO: 203859 - protein, 9 aa, Homo Sapiens
QAESGEAVR

SEQ ID NO: 203860 - protein, 9 aa, Homo Sapiens
ADYLQRAAE

SEQ ID NO: 203861 - protein, 9 aa, Homo Sapiens
AQLQAECRL

SEQ ID NO: 203862 - protein, 9 aa, Homo Sapiens
IFGGILVGV

SEQ ID NO: 203863 - protein, 9 aa, Homo Sapiens
FLPVYIATV

SEQ ID NO: 203864 - protein, 9 aa, Homo Sapiens
QEHTVAYIN

SEQ ID NO: 203865 - protein, 9 aa, Homo Sapiens
RLTELLLRM

SEQ ID NO: 203866 - protein, 9 aa, Homo Sapiens
HPHFVHCII

SEQ ID NO: 203867 - protein, 9 aa, Homo Sapiens
KKELLPREV

SEQ ID NO: 203868 - protein, 9 aa, Homo Sapiens
KLKEALSPI

SEQ ID NO: 203869 - protein, 9 aa, Homo Sapiens
ADGLGETED

SEQ ID NO: 203870 - protein, 9 aa, Homo Sapiens
PVLWTNDGG

SEQ ID NO: 203871 - protein, 9 aa, Homo Sapiens
YSDCDGRGM

SEQ ID NO: 203872 - protein, 9 aa, Homo Sapiens
ELQHENYDE

SEQ ID NO: 203873 - protein, 9 aa, Homo Sapiens
GPSLTGCQS

SEQ ID NO: 203874 - protein, 9 aa, Homo Sapiens
HQQFKYRDG

SEQ ID NO: 203875 - protein, 9 aa, Homo Sapiens
DNLEAAPRD

SEQ ID NO: 203876 - protein, 9 aa, Homo Sapiens
RAQMKVCNL

SEQ ID NO: 203877 - protein, 9 aa, Homo Sapiens
SIGTLLAYL

SEQ ID NO: 203878 - protein, 9 aa, Homo Sapiens
LCNFTRASE

SEQ ID NO: 203879 - protein, 9 aa, Homo Sapiens
PGAGGGDPR

SEQ ID NO: 203880 - protein, 9 aa, Homo Sapiens
TRGWWPSAL

SEQ ID NO: 203881 - protein, 9 aa, Homo Sapiens
GSCCRSSCC

SEQ ID NO: 203882 - protein, 9 aa, Homo Sapiens
KLQKKKNKE

SEQ ID NO: 203883 - protein, 9 aa, Homo Sapiens
NCIDLPVLS

SEQ ID NO: 203884 - protein, 9 aa, Homo Sapiens
SSSGKLDVP

SEQ ID NO: 203885 - protein, 9 aa, Homo Sapiens
LSGRLQAIL

SEQ ID NO: 203886 - protein, 9 aa, Homo Sapiens
SLPDIVGQL

SEQ ID NO: 203887 - protein, 9 aa, Homo Sapiens
AVMTSHSME

SEQ ID NO: 203888 - protein, 9 aa, Homo Sapiens
DMVEKTNKI

SEQ ID NO: 203889 - protein, 9 aa, Homo Sapiens
AMSFVLDEP

SEQ ID NO: 203890 - protein, 9 aa, Homo Sapiens
QSKGYSSFG

SEQ ID NO: 203891 - protein, 9 aa, Homo Sapiens
ELKLVVVKE

SEQ ID NO: 203892 - protein, 9 aa, Homo Sapiens
PRGPLVVGP

SEQ ID NO: 203893 - protein, 9 aa, Homo Sapiens
PACAPSVVH

SEQ ID NO: 203894 - protein, 9 aa, Homo Sapiens
APPILPWRR

SEQ ID NO: 203895 - protein, 9 aa, Homo Sapiens
SPADSKPLN

SEQ ID NO: 203896 - protein, 9 aa, Homo Sapiens
TCIEPPQHR

SEQ ID NO: 203897 - protein, 9 aa, Homo Sapiens
AESENQIQQ

SEQ ID NO: 203898 - protein, 9 aa, Homo Sapiens
SMLPLTQTP

SEQ ID NO: 203899 - protein, 9 aa, Homo Sapiens
LFVGSSLAS

SEQ ID NO: 203900 - protein, 9 aa, Homo Sapiens
VVEKRVVLL

SEQ ID NO: 203901 - protein, 9 aa, Homo Sapiens
EHEFHLQAD

SEQ ID NO: 203902 - protein, 9 aa, Homo Sapiens
HLCELGADG

SEQ ID NO: 203903 - protein, 9 aa, Homo Sapiens
LYRALTEVC

SEQ ID NO: 203904 - protein, 9 aa, Homo Sapiens
TSCPRCPSS

SEQ ID NO: 203905 - protein, 9 aa, Homo Sapiens
DSDGQRCSM

SEQ ID NO: 203906 - protein, 9 aa, Homo Sapiens
QGTTSTAAP

SEQ ID NO: 203907 - protein, 9 aa, Homo Sapiens
YPFMFANYG

SEQ ID NO: 203908 - protein, 9 aa, Homo Sapiens
YVPGGTLTR

SEQ ID NO: 203909 - protein, 9 aa, Homo Sapiens
IYNILAAIL

SEQ ID NO: 203910 - protein, 9 aa, Homo Sapiens
NPRTNIKRK

SEQ ID NO: 203911 - protein, 9 aa, Homo Sapiens
MSLVSSVSF

SEQ ID NO: 203912 - protein, 9 aa, Homo Sapiens
SPRQPLLGP

SEQ ID NO: 203913 - protein, 9 aa, Homo Sapiens
PQAKKPATP

SEQ ID NO: 203914 - protein, 9 aa, Homo Sapiens
WPINYQGLC

SEQ ID NO: 203915 - protein, 9 aa, Homo Sapiens
DEEEAAREW

SEQ ID NO: 203916 - protein, 9 aa, Homo Sapiens
NKHLRGGGS

SEQ ID NO: 203917 - protein, 9 aa, Homo Sapiens
KSECVGILS

SEQ ID NO: 203918 - protein, 9 aa, Homo Sapiens
FPAICFGFQ

SEQ ID NO: 203919 - protein, 9 aa, Homo Sapiens
DGEWPTLPV

SEQ ID NO: 203920 - protein, 9 aa, Homo Sapiens
ELLMCSLGD

SEQ ID NO: 203921 - protein, 9 aa, Homo Sapiens
LEEKFESLK

SEQ ID NO: 203922 - protein, 9 aa, Homo Sapiens
CKDSRFPPT

SEQ ID NO: 203923 - protein, 9 aa, Homo Sapiens
HTLPGSFRL

SEQ ID NO: 203924 - protein, 9 aa, Homo Sapiens
NEKLSRNEM

SEQ ID NO: 203925 - protein, 9 aa, Homo Sapiens
NGAAQPGAV

SEQ ID NO: 203926 - protein, 9 aa, Homo Sapiens
EDRSSTPTI

SEQ ID NO: 203927 - protein, 9 aa, Homo Sapiens
ALMYFIVHS

SEQ ID NO: 203928 - protein, 9 aa, Homo Sapiens
CNYVPGGTL

SEQ ID NO: 203929 - protein, 9 aa, Homo Sapiens
LPGIGGVPE

SEQ ID NO: 203930 - protein, 9 aa, Homo Sapiens
TVHHERKYA

SEQ ID NO: 203931 - protein, 9 aa, Homo Sapiens
GYKGPHCQE

SEQ ID NO: 203932 - protein, 9 aa, Homo Sapiens
PILRRSGMH

SEQ ID NO: 203933 - protein, 9 aa, Homo Sapiens
DTIAKEGCS

SEQ ID NO: 203934 - protein, 9 aa, Homo Sapiens
NFYCTGRLH

SEQ ID NO: 203935 - protein, 9 aa, Homo Sapiens
ESENQIQQQ

SEQ ID NO: 203936 - protein, 9 aa, Homo Sapiens
DDIHRFIKY

SEQ ID NO: 203937 - protein, 9 aa, Homo Sapiens
RHCRMLTPA

SEQ ID NO: 203938 - protein, 9 aa, Homo Sapiens
QAELAEAQA

SEQ ID NO: 203939 - protein, 9 aa, Homo Sapiens
GDSFPDDRV

SEQ ID NO: 203940 - protein, 9 aa, Homo Sapiens
TGLLLCEPT

SEQ ID NO: 203941 - protein, 9 aa, Homo Sapiens
TGVHRKQYH

SEQ ID NO: 203942 - protein, 9 aa, Homo Sapiens
AATRLQPSV

SEQ ID NO: 203943 - protein, 9 aa, Homo Sapiens
TTAATTNSS

SEQ ID NO: 203944 - protein, 9 aa, Homo Sapiens
EEHRGSMVL

SEQ ID NO: 203945 - protein, 9 aa, Homo Sapiens
FISAIHRNS

SEQ ID NO: 203946 - protein, 9 aa, Homo Sapiens
GPWRKECTV

SEQ ID NO: 203947 - protein, 9 aa, Homo Sapiens
HGLTQKMIS

SEQ ID NO: 203948 - protein, 9 aa, Homo Sapiens
SESFGTEVE

SEQ ID NO: 203949 - protein, 9 aa, Homo Sapiens
GVACMRFQP

SEQ ID NO: 203950 - protein, 9 aa, Homo Sapiens
LEHHVCLGF

SEQ ID NO: 203951 - protein, 9 aa, Homo Sapiens
GLSFGNKSA

SEQ ID NO: 203952 - protein, 9 aa, Homo Sapiens
DELQAYTQL

SEQ ID NO: 203953 - protein, 9 aa, Homo Sapiens
LSDGDGDKL

SEQ ID NO: 203954 - protein, 9 aa, Homo Sapiens
TCVLMKNGD

SEQ ID NO: 203955 - protein, 9 aa, Homo Sapiens
EGDRKMGKQ

SEQ ID NO: 203956 - protein, 9 aa, Homo Sapiens
VLELGEEVI

SEQ ID NO: 203957 - protein, 9 aa, Homo Sapiens
LWQLLSGVS

SEQ ID NO: 203958 - protein, 9 aa, Homo Sapiens
QSTMPNRHQ

SEQ ID NO: 203959 - protein, 9 aa, Homo Sapiens
YLDDGKVNV

SEQ ID NO: 203960 - protein, 9 aa, Homo Sapiens
RRTICREDL

SEQ ID NO: 203961 - protein, 9 aa, Homo Sapiens
HWEGWWSAQ

SEQ ID NO: 203962 - protein, 9 aa, Homo Sapiens
IHTAFAPVT

SEQ ID NO: 203963 - protein, 9 aa, Homo Sapiens
PAPPAAPAL

SEQ ID NO: 203964 - protein, 9 aa, Homo Sapiens
TLSISSDSG

SEQ ID NO: 203965 - protein, 9 aa, Homo Sapiens
QLEETRREG

SEQ ID NO: 203966 - protein, 9 aa, Homo Sapiens
NHPLLHLQY

SEQ ID NO: 203967 - protein, 9 aa, Homo Sapiens
APLQCIRST

SEQ ID NO: 203968 - protein, 9 aa, Homo Sapiens
SHLFDNDLP

SEQ ID NO: 203969 - protein, 9 aa, Homo Sapiens
DPSTVSSLQ

SEQ ID NO: 203970 - protein, 9 aa, Homo Sapiens
TIGVLWAIF

SEQ ID NO: 203971 - protein, 9 aa, Homo Sapiens
EVTDINDST

SEQ ID NO: 203972 - protein, 9 aa, Homo Sapiens
SDHTLSISS

SEQ ID NO: 203973 - protein, 9 aa, Homo Sapiens
VILYIMVCS

SEQ ID NO: 203974 - protein, 9 aa, Homo Sapiens
ELRQRLGLA

SEQ ID NO: 203975 - protein, 9 aa, Homo Sapiens
RISCRLSQY

SEQ ID NO: 203976 - protein, 9 aa, Homo Sapiens
GQFDGLMEL

SEQ ID NO: 203977 - protein, 9 aa, Homo Sapiens
QRLENNRPL

SEQ ID NO: 203978 - protein, 9 aa, Homo Sapiens
EENSTGELI

SEQ ID NO: 203979 - protein, 9 aa, Homo Sapiens
TQVVQNAAS

SEQ ID NO: 203980 - protein, 9 aa, Homo Sapiens
RESVHARTV

SEQ ID NO: 203981 - protein, 9 aa, Homo Sapiens
PSNPSHCIQ

SEQ ID NO: 203982 - protein, 9 aa, Homo Sapiens
MESALPATG

SEQ ID NO: 203983 - protein, 9 aa, Homo Sapiens
FVVIMFELT

SEQ ID NO: 203984 - protein, 9 aa, Homo Sapiens
QRELLRRCY

SEQ ID NO: 203985 - protein, 9 aa, Homo Sapiens
HEQLLLDTS

SEQ ID NO: 203986 - protein, 9 aa, Homo Sapiens
RSQWVMSQT

SEQ ID NO: 203987 - protein, 9 aa, Homo Sapiens
LWEKLCEKI

SEQ ID NO: 203988 - protein, 9 aa, Homo Sapiens
CAAVMTSHS

SEQ ID NO: 203989 - protein, 9 aa, Homo Sapiens
INGHLDSYE

SEQ ID NO: 203990 - protein, 9 aa, Homo Sapiens
EFVKLSYSV

SEQ ID NO: 203991 - protein, 9 aa, Homo Sapiens
KSNQYVKVQ

SEQ ID NO: 203992 - protein, 9 aa, Homo Sapiens
RGRRQAPGA

SEQ ID NO: 203993 - protein, 9 aa, Homo Sapiens
WIGIDFDRL

SEQ ID NO: 203994 - protein, 9 aa, Homo Sapiens
TCQLQHSGP

SEQ ID NO: 203995 - protein, 9 aa, Homo Sapiens
VVNQTSSLR

SEQ ID NO: 203996 - protein, 9 aa, Homo Sapiens
LDAFVWFEF

SEQ ID NO: 203997 - protein, 9 aa, Homo Sapiens
KVRQCLQEW

SEQ ID NO: 203998 - protein, 9 aa, Homo Sapiens
RPWMVWDSQ

SEQ ID NO: 203999 - protein, 9 aa, Homo Sapiens
GKAKSRPVQ

SEQ ID NO: 204000 - protein, 9 aa, Homo Sapiens
HKIQEVYIP

SEQ ID NO: 204001 - protein, 9 aa, Homo Sapiens
QRPSSSQPR

SEQ ID NO: 204002 - protein, 9 aa, Homo Sapiens
LVLWNEKCH

SEQ ID NO: 204003 - protein, 9 aa, Homo Sapiens
EQPAPPILP

SEQ ID NO: 204004 - protein, 9 aa, Homo Sapiens
NGTEIVLES

SEQ ID NO: 204005 - protein, 9 aa, Homo Sapiens
SENQIQQQS

SEQ ID NO: 204006 - protein, 9 aa, Homo Sapiens
EDKLVFTLV

SEQ ID NO: 204007 - protein, 9 aa, Homo Sapiens
QMAAKRHAF

SEQ ID NO: 204008 - protein, 9 aa, Homo Sapiens
TVCATNNSY

SEQ ID NO: 204009 - protein, 9 aa, Homo Sapiens
KNIKRKAPF

SEQ ID NO: 204010 - protein, 9 aa, Homo Sapiens
QHNGQQEPS

SEQ ID NO: 204011 - protein, 9 aa, Homo Sapiens
AVDWLVLAV

SEQ ID NO: 204012 - protein, 9 aa, Homo Sapiens
GCKGFFRQT

SEQ ID NO: 204013 - protein, 9 aa, Homo Sapiens
ASPVPLAQG

SEQ ID NO: 204014 - protein, 9 aa, Homo Sapiens
DVLKSNQYV

SEQ ID NO: 204015 - protein, 9 aa, Homo Sapiens
VLALQLAMQ

SEQ ID NO: 204016 - protein, 9 aa, Homo Sapiens
YWIGPVEVE

SEQ ID NO: 204017 - protein, 9 aa, Homo Sapiens
MLSIHQLVE

SEQ ID NO: 204018 - protein, 9 aa, Homo Sapiens
EGDDIVNIN

SEQ ID NO: 204019 - protein, 9 aa, Homo Sapiens
GKAMEQGGA

SEQ ID NO: 204020 - protein, 9 aa, Homo Sapiens
HSSKDANKE

SEQ ID NO: 204021 - protein, 9 aa, Homo Sapiens
QQQAQTLVI

SEQ ID NO: 204022 - protein, 9 aa, Homo Sapiens
RLNPKAMTL

SEQ ID NO: 204023 - protein, 9 aa, Homo Sapiens
GSLLSMLAH

SEQ ID NO: 204024 - protein, 9 aa, Homo Sapiens
CTCVRDSCS

SEQ ID NO: 204025 - protein, 9 aa, Homo Sapiens
AESIDRTMM

SEQ ID NO: 204026 - protein, 9 aa, Homo Sapiens
RGQTSSKTA

SEQ ID NO: 204027 - protein, 9 aa, Homo Sapiens
HISRMLNYI

SEQ ID NO: 204028 - protein, 9 aa, Homo Sapiens
ATDAQAGGR

SEQ ID NO: 204029 - protein, 9 aa, Homo Sapiens
QDTELLQIQ

SEQ ID NO: 204030 - protein, 9 aa, Homo Sapiens
PRPRLTPSL

SEQ ID NO: 204031 - protein, 9 aa, Homo Sapiens
HLLREVNAP

SEQ ID NO: 204032 - protein, 9 aa, Homo Sapiens
GGDNNAPSL

SEQ ID NO: 204033 - protein, 9 aa, Homo Sapiens
LSDYEEEPV

SEQ ID NO: 204034 - protein, 9 aa, Homo Sapiens
TTDLIRPVA

SEQ ID NO: 204035 - protein, 9 aa, Homo Sapiens
ICHTLAEYS

SEQ ID NO: 204036 - protein, 9 aa, Homo Sapiens
VFLSEQDEA

SEQ ID NO: 204037 - protein, 9 aa, Homo Sapiens
PTTGVRTRG

SEQ ID NO: 204038 - protein, 9 aa, Homo Sapiens
VARIAYCTT

SEQ ID NO: 204039 - protein, 9 aa, Homo Sapiens
NAGTSGLGQ

SEQ ID NO: 204040 - protein, 9 aa, Homo Sapiens
ASEKSEQAV

SEQ ID NO: 204041 - protein, 9 aa, Homo Sapiens
KTMQTIALI

SEQ ID NO: 204042 - protein, 9 aa, Homo Sapiens
LGLCALVGS

SEQ ID NO: 204043 - protein, 9 aa, Homo Sapiens
GCELVVGRE

SEQ ID NO: 204044 - protein, 9 aa, Homo Sapiens
YNAMLSIHQ

SEQ ID NO: 204045 - protein, 9 aa, Homo Sapiens
DDGKVNVHK

SEQ ID NO: 204046 - protein, 9 aa, Homo Sapiens
GTAMWFCTY

SEQ ID NO: 204047 - protein, 9 aa, Homo Sapiens
DPQDQQAGW

SEQ ID NO: 204048 - protein, 9 aa, Homo Sapiens
GREPAPGAG

SEQ ID NO: 204049 - protein, 9 aa, Homo Sapiens
PSSHVRPMA

SEQ ID NO: 204050 - protein, 9 aa, Homo Sapiens
ESEGDNFTS

SEQ ID NO: 204051 - protein, 9 aa, Homo Sapiens
IENIEEDFQ

SEQ ID NO: 204052 - protein, 9 aa, Homo Sapiens
KTNQLQYVQ

SEQ ID NO: 204053 - protein, 9 aa, Homo Sapiens
LLFDFVGAC

SEQ ID NO: 204054 - protein, 9 aa, Homo Sapiens
TPRGNSVIV

SEQ ID NO: 204055 - protein, 9 aa, Homo Sapiens
KLCEKIRSF

SEQ ID NO: 204056 - protein, 9 aa, Homo Sapiens
GSVLHDAVA

SEQ ID NO: 204057 - protein, 9 aa, Homo Sapiens
QQQEEEGIY

SEQ ID NO: 204058 - protein, 9 aa, Homo Sapiens
QGAPGSPGP

SEQ ID NO: 204059 - protein, 9 aa, Homo Sapiens
MTIRACRCD

SEQ ID NO: 204060 - protein, 9 aa, Homo Sapiens
VNPGQTFRG

SEQ ID NO: 204061 - protein, 9 aa, Homo Sapiens
GEQARWSLW

SEQ ID NO: 204062 - protein, 9 aa, Homo Sapiens
ASGGWHDAL

SEQ ID NO: 204063 - protein, 9 aa, Homo Sapiens
PANAVLHKA

SEQ ID NO: 204064 - protein, 9 aa, Homo Sapiens
MESDINYLL

SEQ ID NO: 204065 - protein, 9 aa, Homo Sapiens
EEHEEGSVV

SEQ ID NO: 204066 - protein, 9 aa, Homo Sapiens
SEATKSCRK

SEQ ID NO: 204067 - protein, 9 aa, Homo Sapiens
LPLLGYSMS

SEQ ID NO: 204068 - protein, 9 aa, Homo Sapiens
SRERSGGSV

SEQ ID NO: 204069 - protein, 9 aa, Homo Sapiens
NKRVKPLSQ

SEQ ID NO: 204070 - protein, 9 aa, Homo Sapiens
LVTMWSFTE

SEQ ID NO: 204071 - protein, 9 aa, Homo Sapiens
IWCPSSDLY

SEQ ID NO: 204072 - protein, 9 aa, Homo Sapiens
ENYLGNRDH

SEQ ID NO: 204073 - protein, 9 aa, Homo Sapiens
NPQRRICRW

SEQ ID NO: 204074 - protein, 9 aa, Homo Sapiens
QRRHTGEMS

SEQ ID NO: 204075 - protein, 9 aa, Homo Sapiens
DQDTGTIER

SEQ ID NO: 204076 - protein, 9 aa, Homo Sapiens
VWSPWMPCT

SEQ ID NO: 204077 - protein, 9 aa, Homo Sapiens
KEIHGLRIF

SEQ ID NO: 204078 - protein, 9 aa, Homo Sapiens
PSSFSRARK

SEQ ID NO: 204079 - protein, 9 aa, Homo Sapiens
RVEYEALAE

SEQ ID NO: 204080 - protein, 9 aa, Homo Sapiens
IISKGMEAN

SEQ ID NO: 204081 - protein, 9 aa, Homo Sapiens
GNQEVANNP

SEQ ID NO: 204082 - protein, 9 aa, Homo Sapiens
TVLKGPSRL

SEQ ID NO: 204083 - protein, 9 aa, Homo Sapiens
GKAIQGSLW

SEQ ID NO: 204084 - protein, 9 aa, Homo Sapiens
KALWQLLSG

SEQ ID NO: 204085 - protein, 9 aa, Homo Sapiens
IVTYHHHLY

SEQ ID NO: 204086 - protein, 9 aa, Homo Sapiens
QQMASWDKA

SEQ ID NO: 204087 - protein, 9 aa, Homo Sapiens
PIPRDYSPE

SEQ ID NO: 204088 - protein, 9 aa, Homo Sapiens
QGVSSQDTK

SEQ ID NO: 204089 - protein, 9 aa, Homo Sapiens
TVMRTALLT

SEQ ID NO: 204090 - protein, 9 aa, Homo Sapiens
ANECLFRMA

SEQ ID NO: 204091 - protein, 9 aa, Homo Sapiens
LQTKTDIKK

SEQ ID NO: 204092 - protein, 9 aa, Homo Sapiens
LSSEDLVKL

SEQ ID NO: 204093 - protein, 9 aa, Homo Sapiens
TQIANAQDR

SEQ ID NO: 204094 - protein, 9 aa, Homo Sapiens
TEKDNATLA

SEQ ID NO: 204095 - protein, 9 aa, Homo Sapiens
ATFKAYSNI

SEQ ID NO: 204096 - protein, 9 aa, Homo Sapiens
LLVKCYKIP

SEQ ID NO: 204097 - protein, 9 aa, Homo Sapiens
MDFHSFPFV

SEQ ID NO: 204098 - protein, 9 aa, Homo Sapiens
GEVIAWWGL

SEQ ID NO: 204099 - protein, 9 aa, Homo Sapiens
TSAKNAMNV

SEQ ID NO: 204100 - protein, 9 aa, Homo Sapiens
ESECPPGCP

SEQ ID NO: 204101 - protein, 9 aa, Homo Sapiens
ANGAKGTKV

SEQ ID NO: 204102 - protein, 9 aa, Homo Sapiens
GRLLQGPES

SEQ ID NO: 204103 - protein, 9 aa, Homo Sapiens
SSGKLDVPC

SEQ ID NO: 204104 - protein, 9 aa, Homo Sapiens
NCSSRRCWT

SEQ ID NO: 204105 - protein, 9 aa, Homo Sapiens
ETEISVKRQ

SEQ ID NO: 204106 - protein, 9 aa, Homo Sapiens
NTMTIRACR

SEQ ID NO: 204107 - protein, 9 aa, Homo Sapiens
LRKAGCSAE

SEQ ID NO: 204108 - protein, 9 aa, Homo Sapiens
PVHGHLRER

SEQ ID NO: 204109 - protein, 9 aa, Homo Sapiens
DKAITISAL

SEQ ID NO: 204110 - protein, 9 aa, Homo Sapiens
IEKGPLLRH

SEQ ID NO: 204111 - protein, 9 aa, Homo Sapiens
FTSPCTKEP

SEQ ID NO: 204112 - protein, 9 aa, Homo Sapiens
VGHKPSLNL

SEQ ID NO: 204113 - protein, 9 aa, Homo Sapiens
ALHIKKTLS

SEQ ID NO: 204114 - protein, 9 aa, Homo Sapiens
EWAVREVDF

SEQ ID NO: 204115 - protein, 9 aa, Homo Sapiens
HHERKYAPR

SEQ ID NO: 204116 - protein, 9 aa, Homo Sapiens
CSATHLLRV

SEQ ID NO: 204117 - protein, 9 aa, Homo Sapiens
LAILALCRL

SEQ ID NO: 204118 - protein, 9 aa, Homo Sapiens
KEREWVENR

SEQ ID NO: 204119 - protein, 9 aa, Homo Sapiens
ERAAAGAAG

SEQ ID NO: 204120 - protein, 9 aa, Homo Sapiens
LYWCAHNMS

SEQ ID NO: 204121 - protein, 9 aa, Homo Sapiens
CAGDDVQMG

SEQ ID NO: 204122 - protein, 9 aa, Homo Sapiens
KEFMKCLDG

SEQ ID NO: 204123 - protein, 9 aa, Homo Sapiens
QDLLNADYL

SEQ ID NO: 204124 - protein, 9 aa, Homo Sapiens
QEQFCREGF

SEQ ID NO: 204125 - protein, 9 aa, Homo Sapiens
PECCRRRRL

SEQ ID NO: 204126 - protein, 9 aa, Homo Sapiens
LETCIVNIA

SEQ ID NO: 204127 - protein, 9 aa, Homo Sapiens
HVRSPLEPT

SEQ ID NO: 204128 - protein, 9 aa, Homo Sapiens
MKNYESKKH

SEQ ID NO: 204129 - protein, 9 aa, Homo Sapiens
AATGGCQGG

SEQ ID NO: 204130 - protein, 9 aa, Homo Sapiens
GSSVTTDCV

SEQ ID NO: 204131 - protein, 9 aa, Homo Sapiens
ILGYCHGEA

SEQ ID NO: 204132 - protein, 9 aa, Homo Sapiens
PGNVQSRAQ

SEQ ID NO: 204133 - protein, 9 aa, Homo Sapiens
HLAKWRRSE

SEQ ID NO: 204134 - protein, 9 aa, Homo Sapiens
SFSRARKAT

SEQ ID NO: 204135 - protein, 9 aa, Homo Sapiens
SVIMGPSPI

SEQ ID NO: 204136 - protein, 9 aa, Homo Sapiens
RTLQNMPSL

SEQ ID NO: 204137 - protein, 9 aa, Homo Sapiens
MTAAHCMDY

SEQ ID NO: 204138 - protein, 9 aa, Homo Sapiens
TKYWDSLPQ

SEQ ID NO: 204139 - protein, 9 aa, Homo Sapiens
VVYSSLELA

SEQ ID NO: 204140 - protein, 9 aa, Homo Sapiens
SVIFFACMV

SEQ ID NO: 204141 - protein, 9 aa, Homo Sapiens
LLQNAQVHP

SEQ ID NO: 204142 - protein, 9 aa, Homo Sapiens
PPRAREDAA

SEQ ID NO: 204143 - protein, 9 aa, Homo Sapiens
QQAHLAQHH

SEQ ID NO: 204144 - protein, 9 aa, Homo Sapiens
SDLPLAVQL

SEQ ID NO: 204145 - protein, 9 aa, Homo Sapiens
VDSVSEFCL

SEQ ID NO: 204146 - protein, 9 aa, Homo Sapiens
SSRLHRASS

SEQ ID NO: 204147 - protein, 9 aa, Homo Sapiens
RFGGGGGGG

SEQ ID NO: 204148 - protein, 9 aa, Homo Sapiens
RPGMPSFVQ

SEQ ID NO: 204149 - protein, 9 aa, Homo Sapiens
QGEQLHRTT

SEQ ID NO: 204150 - protein, 9 aa, Homo Sapiens
SSDVWKGEN

SEQ ID NO: 204151 - protein, 9 aa, Homo Sapiens
YKIRMDIDM

SEQ ID NO: 204152 - protein, 9 aa, Homo Sapiens
RVKQNIYSL

SEQ ID NO: 204153 - protein, 9 aa, Homo Sapiens
SECVGILSG

SEQ ID NO: 204154 - protein, 9 aa, Homo Sapiens
INIDECSEE

SEQ ID NO: 204155 - protein, 9 aa, Homo Sapiens
CVGSRRRFS

SEQ ID NO: 204156 - protein, 9 aa, Homo Sapiens
KCLASSKAH

SEQ ID NO: 204157 - protein, 9 aa, Homo Sapiens
SYNISIWDI

SEQ ID NO: 204158 - protein, 9 aa, Homo Sapiens
LQGEADPVH

SEQ ID NO: 204159 - protein, 9 aa, Homo Sapiens
PPGTFVCTE

SEQ ID NO: 204160 - protein, 9 aa, Homo Sapiens
PSRQFWMMA

SEQ ID NO: 204161 - protein, 9 aa, Homo Sapiens
PFVGRLHSL

SEQ ID NO: 204162 - protein, 9 aa, Homo Sapiens
DGLMELATI

SEQ ID NO: 204163 - protein, 9 aa, Homo Sapiens
VQGIQKPGP

SEQ ID NO: 204164 - protein, 9 aa, Homo Sapiens
MDILLMDDF

SEQ ID NO: 204165 - protein, 9 aa, Homo Sapiens
DLLTQRGLS

SEQ ID NO: 204166 - protein, 9 aa, Homo Sapiens
GTTSTAAPC

SEQ ID NO: 204167 - protein, 9 aa, Homo Sapiens
VEIHMVPTI

SEQ ID NO: 204168 - protein, 9 aa, Homo Sapiens
NRVHPYPAQ

SEQ ID NO: 204169 - protein, 9 aa, Homo Sapiens
RKQLQYLEK

SEQ ID NO: 204170 - protein, 9 aa, Homo Sapiens
EVITYTSEA

SEQ ID NO: 204171 - protein, 9 aa, Homo Sapiens
QAIVLYHEM

SEQ ID NO: 204172 - protein, 9 aa, Homo Sapiens
PPSSQMSPM

SEQ ID NO: 204173 - protein, 9 aa, Homo Sapiens
PPSLLSCDP

SEQ ID NO: 204174 - protein, 9 aa, Homo Sapiens
SPMELMGPE

SEQ ID NO: 204175 - protein, 9 aa, Homo Sapiens
YDVSPSDHK

SEQ ID NO: 204176 - protein, 9 aa, Homo Sapiens
ECKDPLNIN

SEQ ID NO: 204177 - protein, 9 aa, Homo Sapiens
TEIFYHRGG

SEQ ID NO: 204178 - protein, 9 aa, Homo Sapiens
DKTLISDVP

SEQ ID NO: 204179 - protein, 9 aa, Homo Sapiens
MVKCVVQNV

SEQ ID NO: 204180 - protein, 9 aa, Homo Sapiens
KMKEKDKQN

SEQ ID NO: 204181 - protein, 9 aa, Homo Sapiens
MTQKEIAKA

SEQ ID NO: 204182 - protein, 9 aa, Homo Sapiens
QALLDQVEH

SEQ ID NO: 204183 - protein, 9 aa, Homo Sapiens
KAMEQGGAF

SEQ ID NO: 204184 - protein, 9 aa, Homo Sapiens
IFRWLWQLQ

SEQ ID NO: 204185 - protein, 9 aa, Homo Sapiens
MDGILDTIA

SEQ ID NO: 204186 - protein, 9 aa, Homo Sapiens
LKMVLWSLV

SEQ ID NO: 204187 - protein, 9 aa, Homo Sapiens
LKLNICPLL

SEQ ID NO: 204188 - protein, 9 aa, Homo Sapiens
VDFAYKFKC

SEQ ID NO: 204189 - protein, 9 aa, Homo Sapiens
GQNRSAQIA

SEQ ID NO: 204190 - protein, 9 aa, Homo Sapiens
IHVAQKPYR

SEQ ID NO: 204191 - protein, 9 aa, Homo Sapiens
ISKYRCVIR

SEQ ID NO: 204192 - protein, 9 aa, Homo Sapiens
QGNARETEL

SEQ ID NO: 204193 - protein, 9 aa, Homo Sapiens
AFLLCHQRA

SEQ ID NO: 204194 - protein, 9 aa, Homo Sapiens
QIWNLTVLT

SEQ ID NO: 204195 - protein, 9 aa, Homo Sapiens
SVSPSHRAL

SEQ ID NO: 204196 - protein, 9 aa, Homo Sapiens
QRSSFNFEC

SEQ ID NO: 204197 - protein, 9 aa, Homo Sapiens
ADCDWEKED

SEQ ID NO: 204198 - protein, 9 aa, Homo Sapiens
ESALPATGF

SEQ ID NO: 204199 - protein, 9 aa, Homo Sapiens
CLIDRWGSH

SEQ ID NO: 204200 - protein, 9 aa, Homo Sapiens
GWWPSALGS

SEQ ID NO: 204201 - protein, 9 aa, Homo Sapiens
YKEFLGQGW

SEQ ID NO: 204202 - protein, 9 aa, Homo Sapiens
FTQMPGFQT

SEQ ID NO: 204203 - protein, 9 aa, Homo Sapiens
ATLQKDVGP

SEQ ID NO: 204204 - protein, 9 aa, Homo Sapiens
CSDEIIWLE

SEQ ID NO: 204205 - protein, 9 aa, Homo Sapiens
IEKMKEKDK

SEQ ID NO: 204206 - protein, 9 aa, Homo Sapiens
PDIIYVLAL

SEQ ID NO: 204207 - protein, 9 aa, Homo Sapiens
KKPYEFNDH

SEQ ID NO: 204208 - protein, 9 aa, Homo Sapiens
DPRRRRRLC

SEQ ID NO: 204209 - protein, 9 aa, Homo Sapiens
AQDLGGDFW

SEQ ID NO: 204210 - protein, 9 aa, Homo Sapiens
LDLFFHWLF

SEQ ID NO: 204211 - protein, 9 aa, Homo Sapiens
LFQYPCLRK

SEQ ID NO: 204212 - protein, 9 aa, Homo Sapiens
RCRFLLAHV

SEQ ID NO: 204213 - protein, 9 aa, Homo Sapiens
TAMAQTVPI

SEQ ID NO: 204214 - protein, 9 aa, Homo Sapiens
FSLFGMQLF

SEQ ID NO: 204215 - protein, 9 aa, Homo Sapiens
DQASAGRTV

SEQ ID NO: 204216 - protein, 9 aa, Homo Sapiens
NISFNATAT

SEQ ID NO: 204217 - protein, 9 aa, Homo Sapiens
THTGEKPYC

SEQ ID NO: 204218 - protein, 9 aa, Homo Sapiens
MEHEETKKD

SEQ ID NO: 204219 - protein, 9 aa, Homo Sapiens
QVHPLVLQN

SEQ ID NO: 204220 - protein, 9 aa, Homo Sapiens
QVLGGEVIA

SEQ ID NO: 204221 - protein, 9 aa, Homo Sapiens
YKSYSPYGM

SEQ ID NO: 204222 - protein, 9 aa, Homo Sapiens
ELQGNARET

SEQ ID NO: 204223 - protein, 9 aa, Homo Sapiens
AGALLVYGI

SEQ ID NO: 204224 - protein, 9 aa, Homo Sapiens
GLVGKLSAG

SEQ ID NO: 204225 - protein, 9 aa, Homo Sapiens
SPQLFKNVF

SEQ ID NO: 204226 - protein, 9 aa, Homo Sapiens
RVVQEALDQ

SEQ ID NO: 204227 - protein, 9 aa, Homo Sapiens
GPHQEYSEN

SEQ ID NO: 204228 - protein, 9 aa, Homo Sapiens
AVVWAKILS

SEQ ID NO: 204229 - protein, 9 aa, Homo Sapiens
LEHEAILQV

SEQ ID NO: 204230 - protein, 9 aa, Homo Sapiens
ALSQGDGLY

SEQ ID NO: 204231 - protein, 9 aa, Homo Sapiens
ADYIIPAQG

SEQ ID NO: 204232 - protein, 9 aa, Homo Sapiens
ANERDKTQF

SEQ ID NO: 204233 - protein, 9 aa, Homo Sapiens
DFACCLVRF

SEQ ID NO: 204234 - protein, 9 aa, Homo Sapiens
HQEYSENNE

SEQ ID NO: 204235 - protein, 9 aa, Homo Sapiens
ERAINGLAN

SEQ ID NO: 204236 - protein, 9 aa, Homo Sapiens
IATVVGNGL

SEQ ID NO: 204237 - protein, 9 aa, Homo Sapiens
TGCQSDIIS

SEQ ID NO: 204238 - protein, 9 aa, Homo Sapiens
EDIVSDSRR

SEQ ID NO: 204239 - protein, 9 aa, Homo Sapiens
IHHFARAAS

SEQ ID NO: 204240 - protein, 9 aa, Homo Sapiens
FRTTTFSTD

SEQ ID NO: 204241 - protein, 9 aa, Homo Sapiens
PLWRQDGTG

SEQ ID NO: 204242 - protein, 9 aa, Homo Sapiens
VPLGPARTG

SEQ ID NO: 204243 - protein, 9 aa, Homo Sapiens
GMTGPGFTS

SEQ ID NO: 204244 - protein, 9 aa, Homo Sapiens
LILNVTALP

SEQ ID NO: 204245 - protein, 9 aa, Homo Sapiens
PIAVGAASA

SEQ ID NO: 204246 - protein, 9 aa, Homo Sapiens
WYSRGRIRS

SEQ ID NO: 204247 - protein, 9 aa, Homo Sapiens
LPATGFLYW

SEQ ID NO: 204248 - protein, 9 aa, Homo Sapiens
TDINGALQM

SEQ ID NO: 204249 - protein, 9 aa, Homo Sapiens
NKSISFPGC

SEQ ID NO: 204250 - protein, 9 aa, Homo Sapiens
EDYPRYPNI

SEQ ID NO: 204251 - protein, 9 aa, Homo Sapiens
DEVLTKRQL

SEQ ID NO: 204252 - protein, 9 aa, Homo Sapiens
SGLQRRKRP

SEQ ID NO: 204253 - protein, 9 aa, Homo Sapiens
TMGSYKCMC

SEQ ID NO: 204254 - protein, 9 aa, Homo Sapiens
DVISLQQEN

SEQ ID NO: 204255 - protein, 9 aa, Homo Sapiens
QIPHLLGWL

SEQ ID NO: 204256 - protein, 9 aa, Homo Sapiens
LLLDKWDVV

SEQ ID NO: 204257 - protein, 9 aa, Homo Sapiens
GSIPTSLMA

SEQ ID NO: 204258 - protein, 9 aa, Homo Sapiens
DEEEEAAAE

SEQ ID NO: 204259 - protein, 9 aa, Homo Sapiens
ANIPFLDMS

SEQ ID NO: 204260 - protein, 9 aa, Homo Sapiens
DCACSPGYE

SEQ ID NO: 204261 - protein, 9 aa, Homo Sapiens
CVLSLFYTV

SEQ ID NO: 204262 - protein, 9 aa, Homo Sapiens
EGEQARWSL

SEQ ID NO: 204263 - protein, 9 aa, Homo Sapiens
PGTIWNEID

SEQ ID NO: 204264 - protein, 9 aa, Homo Sapiens
NFTGVSGVT

SEQ ID NO: 204265 - protein, 9 aa, Homo Sapiens
EDFQDGLKL

SEQ ID NO: 204266 - protein, 9 aa, Homo Sapiens
HNAWLPYHV

SEQ ID NO: 204267 - protein, 9 aa, Homo Sapiens
AFQAAINTA

SEQ ID NO: 204268 - protein, 9 aa, Homo Sapiens
VKAFSTHSS

SEQ ID NO: 204269 - protein, 9 aa, Homo Sapiens
LFQKSGSVI

SEQ ID NO: 204270 - protein, 9 aa, Homo Sapiens
TYSAPPPGP

SEQ ID NO: 204271 - protein, 9 aa, Homo Sapiens
DIHRFIKYN

SEQ ID NO: 204272 - protein, 9 aa, Homo Sapiens
FKVKSKMVP

SEQ ID NO: 204273 - protein, 9 aa, Homo Sapiens
EDCVFSVIY

SEQ ID NO: 204274 - protein, 9 aa, Homo Sapiens
TPETERQWI

SEQ ID NO: 204275 - protein, 9 aa, Homo Sapiens
YRCEDSDKA

SEQ ID NO: 204276 - protein, 9 aa, Homo Sapiens
LCARDFNID

SEQ ID NO: 204277 - protein, 9 aa, Homo Sapiens
PNVCLISIQ

SEQ ID NO: 204278 - protein, 9 aa, Homo Sapiens
FRSITHAYY

SEQ ID NO: 204279 - protein, 9 aa, Homo Sapiens
YLCPPWVLP

SEQ ID NO: 204280 - protein, 9 aa, Homo Sapiens
CCVSRNIPG

SEQ ID NO: 204281 - protein, 9 aa, Homo Sapiens
GMPLKLGGN

SEQ ID NO: 204282 - protein, 9 aa, Homo Sapiens
KFKCSKRFC

SEQ ID NO: 204283 - protein, 9 aa, Homo Sapiens
SNCEVPQPS

SEQ ID NO: 204284 - protein, 9 aa, Homo Sapiens
CCNPDSNSA

SEQ ID NO: 204285 - protein, 9 aa, Homo Sapiens
RDLLVVEAV

SEQ ID NO: 204286 - protein, 9 aa, Homo Sapiens
GCSSVSSSD

SEQ ID NO: 204287 - protein, 9 aa, Homo Sapiens
INPTGIVLL

SEQ ID NO: 204288 - protein, 9 aa, Homo Sapiens
GHLFTIGRH

SEQ ID NO: 204289 - protein, 9 aa, Homo Sapiens
ELPIFTILL

SEQ ID NO: 204290 - protein, 9 aa, Homo Sapiens
MVVDDLRLC

SEQ ID NO: 204291 - protein, 9 aa, Homo Sapiens
PGRVAFVSG

SEQ ID NO: 204292 - protein, 9 aa, Homo Sapiens
NPSLAFIRP

SEQ ID NO: 204293 - protein, 9 aa, Homo Sapiens
LELQCLVHG

SEQ ID NO: 204294 - protein, 9 aa, Homo Sapiens
KGAYPNHRS

SEQ ID NO: 204295 - protein, 9 aa, Homo Sapiens
RMEQSRNCD

SEQ ID NO: 204296 - protein, 9 aa, Homo Sapiens
VSLGHTSSS

SEQ ID NO: 204297 - protein, 9 aa, Homo Sapiens
ALGENHSQA

SEQ ID NO: 204298 - protein, 9 aa, Homo Sapiens
RVAQPSCCL

SEQ ID NO: 204299 - protein, 9 aa, Homo Sapiens
SIGYEEIEG

SEQ ID NO: 204300 - protein, 9 aa, Homo Sapiens
SLDMIGFLL

SEQ ID NO: 204301 - protein, 9 aa, Homo Sapiens
KAVFWLCVG

SEQ ID NO: 204302 - protein, 9 aa, Homo Sapiens
LMELATICA

SEQ ID NO: 204303 - protein, 9 aa, Homo Sapiens
KSYSPYGML

SEQ ID NO: 204304 - protein, 9 aa, Homo Sapiens
RLMKEVAEL

SEQ ID NO: 204305 - protein, 9 aa, Homo Sapiens
SALPATGFL

SEQ ID NO: 204306 - protein, 9 aa, Homo Sapiens
NPSHCIQCA

SEQ ID NO: 204307 - protein, 9 aa, Homo Sapiens
TAPDKTLIS

SEQ ID NO: 204308 - protein, 9 aa, Homo Sapiens
QERFRSITH

SEQ ID NO: 204309 - protein, 9 aa, Homo Sapiens
RALTEVCDV

SEQ ID NO: 204310 - protein, 9 aa, Homo Sapiens
ATIRHRPEA

SEQ ID NO: 204311 - protein, 9 aa, Homo Sapiens
NAHTYPAQW

SEQ ID NO: 204312 - protein, 9 aa, Homo Sapiens
EYCSSGGMQ

SEQ ID NO: 204313 - protein, 9 aa, Homo Sapiens
LTHMNISAR

SEQ ID NO: 204314 - protein, 9 aa, Homo Sapiens
HTASPPSCA

SEQ ID NO: 204315 - protein, 9 aa, Homo Sapiens
MIVYVGDLN

SEQ ID NO: 204316 - protein, 9 aa, Homo Sapiens
VDTLQEWAD

SEQ ID NO: 204317 - protein, 9 aa, Homo Sapiens
FLMEVSSDV

SEQ ID NO: 204318 - protein, 9 aa, Homo Sapiens
DQVSCCQQT

SEQ ID NO: 204319 - protein, 9 aa, Homo Sapiens
GLMDWSFTE

SEQ ID NO: 204320 - protein, 9 aa, Homo Sapiens
FNTMWTLGC

SEQ ID NO: 204321 - protein, 9 aa, Homo Sapiens
HGPDFPWSM

SEQ ID NO: 204322 - protein, 9 aa, Homo Sapiens
LQRCLELKP

SEQ ID NO: 204323 - protein, 9 aa, Homo Sapiens
GQTMVCQLM

SEQ ID NO: 204324 - protein, 9 aa, Homo Sapiens
PLAFLASWL

SEQ ID NO: 204325 - protein, 9 aa, Homo Sapiens
LQHMDRPLS

SEQ ID NO: 204326 - protein, 9 aa, Homo Sapiens
MAYDWYAAI

SEQ ID NO: 204327 - protein, 9 aa, Homo Sapiens
LQLQGTTST

SEQ ID NO: 204328 - protein, 9 aa, Homo Sapiens
ESIHGWPVT

SEQ ID NO: 204329 - protein, 9 aa, Homo Sapiens
LRLTLWPPR

SEQ ID NO: 204330 - protein, 9 aa, Homo Sapiens
PASPREWTN

SEQ ID NO: 204331 - protein, 9 aa, Homo Sapiens
GSWFCLSFV

SEQ ID NO: 204332 - protein, 9 aa, Homo Sapiens
GVAPMGQYP

SEQ ID NO: 204333 - protein, 9 aa, Homo Sapiens
SRDWDRNLE

SEQ ID NO: 204334 - protein, 9 aa, Homo Sapiens
RARQDSLKK

SEQ ID NO: 204335 - protein, 9 aa, Homo Sapiens
LSCICHTLA

SEQ ID NO: 204336 - protein, 9 aa, Homo Sapiens
DLEGQMFEH

SEQ ID NO: 204337 - protein, 9 aa, Homo Sapiens
VMFSMLMHS

SEQ ID NO: 204338 - protein, 9 aa, Homo Sapiens
CVCYMPYAA

SEQ ID NO: 204339 - protein, 9 aa, Homo Sapiens
NDHGKSFYS

SEQ ID NO: 204340 - protein, 9 aa, Homo Sapiens
EPVSAVPNI

SEQ ID NO: 204341 - protein, 9 aa, Homo Sapiens
LHLQYYTAE

SEQ ID NO: 204342 - protein, 9 aa, Homo Sapiens
ELDRRSMIF

SEQ ID NO: 204343 - protein, 9 aa, Homo Sapiens
ASGPHCFCP

SEQ ID NO: 204344 - protein, 9 aa, Homo Sapiens
VHPEPLQPH

SEQ ID NO: 204345 - protein, 9 aa, Homo Sapiens
FSPRPPETQ

SEQ ID NO: 204346 - protein, 9 aa, Homo Sapiens
METTDPSTV

SEQ ID NO: 204347 - protein, 9 aa, Homo Sapiens
QQAQTLVIQ

SEQ ID NO: 204348 - protein, 9 aa, Homo Sapiens
ITISALQAG

SEQ ID NO: 204349 - protein, 9 aa, Homo Sapiens
PIKDEKRDI

SEQ ID NO: 204350 - protein, 9 aa, Homo Sapiens
GHNYLGDKW

SEQ ID NO: 204351 - protein, 9 aa, Homo Sapiens
CSHLFDNDL

SEQ ID NO: 204352 - protein, 9 aa, Homo Sapiens
LMMSKYLTH

SEQ ID NO: 204353 - protein, 9 aa, Homo Sapiens
GEAIVKQIN

SEQ ID NO: 204354 - protein, 9 aa, Homo Sapiens
GIYPDPGLL

SEQ ID NO: 204355 - protein, 9 aa, Homo Sapiens
DNATLARET

SEQ ID NO: 204356 - protein, 9 aa, Homo Sapiens
EELQAWVWE

SEQ ID NO: 204357 - protein, 9 aa, Homo Sapiens
FTGYQLRVL

SEQ ID NO: 204358 - protein, 9 aa, Homo Sapiens
LPPIPRDYS

SEQ ID NO: 204359 - protein, 9 aa, Homo Sapiens
LYFLGSDLL

SEQ ID NO: 204360 - protein, 9 aa, Homo Sapiens
KYAPRLAPL

SEQ ID NO: 204361 - protein, 9 aa, Homo Sapiens
YNKYYVLLP

SEQ ID NO: 204362 - protein, 9 aa, Homo Sapiens
QHNKGTPNP

SEQ ID NO: 204363 - protein, 9 aa, Homo Sapiens
SIYNILAAI

SEQ ID NO: 204364 - protein, 9 aa, Homo Sapiens
YPNRVHPYP

SEQ ID NO: 204365 - protein, 9 aa, Homo Sapiens
NDLEDSYRQ

SEQ ID NO: 204366 - protein, 9 aa, Homo Sapiens
TDASGGWHD

SEQ ID NO: 204367 - protein, 9 aa, Homo Sapiens
PPILPWRRH

SEQ ID NO: 204368 - protein, 9 aa, Homo Sapiens
GHERIHTAF

SEQ ID NO: 204369 - protein, 9 aa, Homo Sapiens
GEDAASEAK

SEQ ID NO: 204370 - protein, 9 aa, Homo Sapiens
QQAQNVQCK

SEQ ID NO: 204371 - protein, 9 aa, Homo Sapiens
HSGKRLRVV

SEQ ID NO: 204372 - protein, 9 aa, Homo Sapiens
RKRECNQQL

SEQ ID NO: 204373 - protein, 9 aa, Homo Sapiens
MEKELANFN

SEQ ID NO: 204374 - protein, 9 aa, Homo Sapiens
KREQKAARW

SEQ ID NO: 204375 - protein, 9 aa, Homo Sapiens
FLIFKLPCQ

SEQ ID NO: 204376 - protein, 9 aa, Homo Sapiens
EFADCPKLK

SEQ ID NO: 204377 - protein, 9 aa, Homo Sapiens
HRPGGGHVK

SEQ ID NO: 204378 - protein, 9 aa, Homo Sapiens
RELIACLEQ

SEQ ID NO: 204379 - protein, 9 aa, Homo Sapiens
DVEHSRHLI

SEQ ID NO: 204380 - protein, 9 aa, Homo Sapiens
CASHISRML

SEQ ID NO: 204381 - protein, 9 aa, Homo Sapiens
SVPTLLSSS

SEQ ID NO: 204382 - protein, 9 aa, Homo Sapiens
IIMLFDAHK

SEQ ID NO: 204383 - protein, 9 aa, Homo Sapiens
YLVLDCVPD

SEQ ID NO: 204384 - protein, 9 aa, Homo Sapiens
VTEGPHQEY

SEQ ID NO: 204385 - protein, 9 aa, Homo Sapiens
PVVAITSTW

SEQ ID NO: 204386 - protein, 9 aa, Homo Sapiens
PASRSFPDH

SEQ ID NO: 204387 - protein, 9 aa, Homo Sapiens
FGNQGCSWT

SEQ ID NO: 204388 - protein, 9 aa, Homo Sapiens
QVGDPITEG

SEQ ID NO: 204389 - protein, 9 aa, Homo Sapiens
MKKLWTTMV

SEQ ID NO: 204390 - protein, 9 aa, Homo Sapiens
GQPGERGLP

SEQ ID NO: 204391 - protein, 9 aa, Homo Sapiens
ETCFISDDG

SEQ ID NO: 204392 - protein, 9 aa, Homo Sapiens
QDVVNQTSS

SEQ ID NO: 204393 - protein, 9 aa, Homo Sapiens
PPPPGWLPR

SEQ ID NO: 204394 - protein, 9 aa, Homo Sapiens
FLASWLTSC

SEQ ID NO: 204395 - protein, 9 aa, Homo Sapiens
GSLSKLWPQ

SEQ ID NO: 204396 - protein, 9 aa, Homo Sapiens
PDGSLLLTS

SEQ ID NO: 204397 - protein, 9 aa, Homo Sapiens
RTGMQPHEP

SEQ ID NO: 204398 - protein, 9 aa, Homo Sapiens
ALDQASAGR

SEQ ID NO: 204399 - protein, 9 aa, Homo Sapiens
PGLELHRAQ

SEQ ID NO: 204400 - protein, 9 aa, Homo Sapiens
YCTGRLHMM

SEQ ID NO: 204401 - protein, 9 aa, Homo Sapiens
AVDDLDEDE

SEQ ID NO: 204402 - protein, 9 aa, Homo Sapiens
LAKDFIQKL

SEQ ID NO: 204403 - protein, 9 aa, Homo Sapiens
ALKEEIKEI

SEQ ID NO: 204404 - protein, 9 aa, Homo Sapiens
EKILRGHRQ

SEQ ID NO: 204405 - protein, 9 aa, Homo Sapiens
IIWSHWTDV

SEQ ID NO: 204406 - protein, 9 aa, Homo Sapiens
VTLHAKGDS

SEQ ID NO: 204407 - protein, 9 aa, Homo Sapiens
PWVLPSSRD

SEQ ID NO: 204408 - protein, 9 aa, Homo Sapiens
VRQTGGRVL

SEQ ID NO: 204409 - protein, 9 aa, Homo Sapiens
MQVAKMQLD

SEQ ID NO: 204410 - protein, 9 aa, Homo Sapiens
GGFGLNLQS

SEQ ID NO: 204411 - protein, 9 aa, Homo Sapiens
TFLWPYYQT

SEQ ID NO: 204412 - protein, 9 aa, Homo Sapiens
FVSQMPFVP

SEQ ID NO: 204413 - protein, 9 aa, Homo Sapiens
FLANIPFLD

SEQ ID NO: 204414 - protein, 9 aa, Homo Sapiens
HQVPLILTP

SEQ ID NO: 204415 - protein, 9 aa, Homo Sapiens
PSLTFSEDA

SEQ ID NO: 204416 - protein, 9 aa, Homo Sapiens
VASALNRLL

SEQ ID NO: 204417 - protein, 9 aa, Homo Sapiens
EEIEILMHY

SEQ ID NO: 204418 - protein, 9 aa, Homo Sapiens
QLQYLEKLN

SEQ ID NO: 204419 - protein, 9 aa, Homo Sapiens
PGIKCFAVC

SEQ ID NO: 204420 - protein, 9 aa, Homo Sapiens
ELDSTRGRY

SEQ ID NO: 204421 - protein, 9 aa, Homo Sapiens
PEKQHPFQN

SEQ ID NO: 204422 - protein, 9 aa, Homo Sapiens
RVGTTDRGS

SEQ ID NO: 204423 - protein, 9 aa, Homo Sapiens
ALNQLEELL

SEQ ID NO: 204424 - protein, 9 aa, Homo Sapiens
KRIMQLSLE

SEQ ID NO: 204425 - protein, 9 aa, Homo Sapiens
IKVVKLVRL

SEQ ID NO: 204426 - protein, 9 aa, Homo Sapiens
EFTEGKDKI

SEQ ID NO: 204427 - protein, 9 aa, Homo Sapiens
SAVLVKWQP

SEQ ID NO: 204428 - protein, 9 aa, Homo Sapiens
EKLNLRVGH

SEQ ID NO: 204429 - protein, 9 aa, Homo Sapiens
PSCSLYPPP

SEQ ID NO: 204430 - protein, 9 aa, Homo Sapiens
TLPALTILD

SEQ ID NO: 204431 - protein, 9 aa, Homo Sapiens
GTTLNNSLY

SEQ ID NO: 204432 - protein, 9 aa, Homo Sapiens
PNKPRPQSP

SEQ ID NO: 204433 - protein, 9 aa, Homo Sapiens
IPTNLRRRS

SEQ ID NO: 204434 - protein, 9 aa, Homo Sapiens
ALKKRRTYA

SEQ ID NO: 204435 - protein, 9 aa, Homo Sapiens
VYVGDLNLV

SEQ ID NO: 204436 - protein, 9 aa, Homo Sapiens
SGQGVSSQD

SEQ ID NO: 204437 - protein, 9 aa, Homo Sapiens
TNYSKDILN

SEQ ID NO: 204438 - protein, 9 aa, Homo Sapiens
SVNESAEVE

SEQ ID NO: 204439 - protein, 9 aa, Homo Sapiens
TDYDQYAML

SEQ ID NO: 204440 - protein, 9 aa, Homo Sapiens
AVLVKWQPV

SEQ ID NO: 204441 - protein, 9 aa, Homo Sapiens
RRSAPSLIM

SEQ ID NO: 204442 - protein, 9 aa, Homo Sapiens
SEEMDPGVP

SEQ ID NO: 204443 - protein, 9 aa, Homo Sapiens
EHESSSEDC

SEQ ID NO: 204444 - protein, 9 aa, Homo Sapiens
QVQSDHCIN

SEQ ID NO: 204445 - protein, 9 aa, Homo Sapiens
VYLEWIQQE

SEQ ID NO: 204446 - protein, 9 aa, Homo Sapiens
FLVSASSST

SEQ ID NO: 204447 - protein, 9 aa, Homo Sapiens
FTGIFYMCA

SEQ ID NO: 204448 - protein, 9 aa, Homo Sapiens
MESPQELAA

SEQ ID NO: 204449 - protein, 9 aa, Homo Sapiens
HHGDFSADE

SEQ ID NO: 204450 - protein, 9 aa, Homo Sapiens
YVSLDNTVL

SEQ ID NO: 204451 - protein, 9 aa, Homo Sapiens
AQQDPDTLV

SEQ ID NO: 204452 - protein, 9 aa, Homo Sapiens
KSWEQLSEY

SEQ ID NO: 204453 - protein, 9 aa, Homo Sapiens
DETILHAFK

SEQ ID NO: 204454 - protein, 9 aa, Homo Sapiens
VEMAEEAGV

SEQ ID NO: 204455 - protein, 9 aa, Homo Sapiens
ILDNFKENI

SEQ ID NO: 204456 - protein, 9 aa, Homo Sapiens
LPGRECLWP

SEQ ID NO: 204457 - protein, 9 aa, Homo Sapiens
SLTSASLVS

SEQ ID NO: 204458 - protein, 9 aa, Homo Sapiens
ATDNPSGSH

SEQ ID NO: 204459 - protein, 9 aa, Homo Sapiens
LGLHPILGH

SEQ ID NO: 204460 - protein, 9 aa, Homo Sapiens
CLCFTSPQW

SEQ ID NO: 204461 - protein, 9 aa, Homo Sapiens
GRLQTHLKE

SEQ ID NO: 204462 - protein, 9 aa, Homo Sapiens
RGCCKSVSK

SEQ ID NO: 204463 - protein, 9 aa, Homo Sapiens
DCVPDERRK

SEQ ID NO: 204464 - protein, 9 aa, Homo Sapiens
AARDFYHDM

SEQ ID NO: 204465 - protein, 9 aa, Homo Sapiens
TQMHLNNSR

SEQ ID NO: 204466 - protein, 9 aa, Homo Sapiens
TMPPHDLAA

SEQ ID NO: 204467 - protein, 9 aa, Homo Sapiens
TSPASMRDG

SEQ ID NO: 204468 - protein, 9 aa, Homo Sapiens
SECSLRSFF

SEQ ID NO: 204469 - protein, 9 aa, Homo Sapiens
TFTGIPVSL

SEQ ID NO: 204470 - protein, 9 aa, Homo Sapiens
RGWWPSALG

SEQ ID NO: 204471 - protein, 9 aa, Homo Sapiens
MESSLVASK

SEQ ID NO: 204472 - protein, 9 aa, Homo Sapiens
VGPPNPWAD

SEQ ID NO: 204473 - protein, 9 aa, Homo Sapiens
SISLNFYKE

SEQ ID NO: 204474 - protein, 9 aa, Homo Sapiens
QMEHDIQHY

SEQ ID NO: 204475 - protein, 9 aa, Homo Sapiens
GALQMAIRL

SEQ ID NO: 204476 - protein, 9 aa, Homo Sapiens
VGSEKPSPC

SEQ ID NO: 204477 - protein, 9 aa, Homo Sapiens
KLVDLQELA

SEQ ID NO: 204478 - protein, 9 aa, Homo Sapiens
LDNTVLGDD

SEQ ID NO: 204479 - protein, 9 aa, Homo Sapiens
IAVGAASAG

SEQ ID NO: 204480 - protein, 9 aa, Homo Sapiens
CCKFDIDIR

SEQ ID NO: 204481 - protein, 9 aa, Homo Sapiens
QTVVGSIGW

SEQ ID NO: 204482 - protein, 9 aa, Homo Sapiens
PEEFINFVF

SEQ ID NO: 204483 - protein, 9 aa, Homo Sapiens
RLELCVDVA

SEQ ID NO: 204484 - protein, 9 aa, Homo Sapiens
LILWICTRY

SEQ ID NO: 204485 - protein, 9 aa, Homo Sapiens
SLFQSTNAG

SEQ ID NO: 204486 - protein, 9 aa, Homo Sapiens
FQAKCHIHQ

SEQ ID NO: 204487 - protein, 9 aa, Homo Sapiens
GAAGRVTRG

SEQ ID NO: 204488 - protein, 9 aa, Homo Sapiens
ILDTIAKEG

SEQ ID NO: 204489 - protein, 9 aa, Homo Sapiens
SKGMEANTQ

SEQ ID NO: 204490 - protein, 9 aa, Homo Sapiens
LATATPPCS

SEQ ID NO: 204491 - protein, 9 aa, Homo Sapiens
KVYQPVPEQ

SEQ ID NO: 204492 - protein, 9 aa, Homo Sapiens
TDLIRPVAL

SEQ ID NO: 204493 - protein, 9 aa, Homo Sapiens
GDGLYLVLH

SEQ ID NO: 204494 - protein, 9 aa, Homo Sapiens
CRHWYPEEY

SEQ ID NO: 204495 - protein, 9 aa, Homo Sapiens
SLTTTEDNV

SEQ ID NO: 204496 - protein, 9 aa, Homo Sapiens
CAAPKVSPH

SEQ ID NO: 204497 - protein, 9 aa, Homo Sapiens
SWELLLALS

SEQ ID NO: 204498 - protein, 9 aa, Homo Sapiens
TSLDRYVAI

SEQ ID NO: 204499 - protein, 9 aa, Homo Sapiens
DAGEALEGH

SEQ ID NO: 204500 - protein, 9 aa, Homo Sapiens
PCRPRPRVA

SEQ ID NO: 204501 - protein, 9 aa, Homo Sapiens
QQREKTRWP

SEQ ID NO: 204502 - protein, 9 aa, Homo Sapiens
GADGVGKSA

SEQ ID NO: 204503 - protein, 9 aa, Homo Sapiens
PNPAYRANL

SEQ ID NO: 204504 - protein, 9 aa, Homo Sapiens
PPIPRDYSP

SEQ ID NO: 204505 - protein, 9 aa, Homo Sapiens
PVPPMRFPY

SEQ ID NO: 204506 - protein, 9 aa, Homo Sapiens
GEWRLKYEW

SEQ ID NO: 204507 - protein, 9 aa, Homo Sapiens
SVFSVFPAI

SEQ ID NO: 204508 - protein, 9 aa, Homo Sapiens
QDGTGHYLC

SEQ ID NO: 204509 - protein, 9 aa, Homo Sapiens
SSISGEEAR

SEQ ID NO: 204510 - protein, 9 aa, Homo Sapiens
GQGVSSQDT

SEQ ID NO: 204511 - protein, 9 aa, Homo Sapiens
LVKKIENIP

SEQ ID NO: 204512 - protein, 9 aa, Homo Sapiens
LTQACSCLL

SEQ ID NO: 204513 - protein, 9 aa, Homo Sapiens
GIPVLGGLV

SEQ ID NO: 204514 - protein, 9 aa, Homo Sapiens
CGVSKPTTF

SEQ ID NO: 204515 - protein, 9 aa, Homo Sapiens
TEGLTYQVC

SEQ ID NO: 204516 - protein, 9 aa, Homo Sapiens
HWAPVIRPG

SEQ ID NO: 204517 - protein, 9 aa, Homo Sapiens
DSEEMDPGV

SEQ ID NO: 204518 - protein, 9 aa, Homo Sapiens
NISFSIYHD

SEQ ID NO: 204519 - protein, 9 aa, Homo Sapiens
AQTAGAWII

SEQ ID NO: 204520 - protein, 9 aa, Homo Sapiens
NSGGFHPGT

SEQ ID NO: 204521 - protein, 9 aa, Homo Sapiens
PNETDGKSI

SEQ ID NO: 204522 - protein, 9 aa, Homo Sapiens
PVVDWDACP

SEQ ID NO: 204523 - protein, 9 aa, Homo Sapiens
TGIGRSGTF

SEQ ID NO: 204524 - protein, 9 aa, Homo Sapiens
SAPPPGPGP

SEQ ID NO: 204525 - protein, 9 aa, Homo Sapiens
PPLPPESLE

SEQ ID NO: 204526 - protein, 9 aa, Homo Sapiens
STGGGRVRA

SEQ ID NO: 204527 - protein, 9 aa, Homo Sapiens
TMVQPFTTI

SEQ ID NO: 204528 - protein, 9 aa, Homo Sapiens
AVCSLGWVE

SEQ ID NO: 204529 - protein, 9 aa, Homo Sapiens
RQPHRGRRQ

SEQ ID NO: 204530 - protein, 9 aa, Homo Sapiens
RSGNESECP

SEQ ID NO: 204531 - protein, 9 aa, Homo Sapiens
PVVTTFSES

SEQ ID NO: 204532 - protein, 9 aa, Homo Sapiens
PLRAPWNQA

SEQ ID NO: 204533 - protein, 9 aa, Homo Sapiens
QRGWGLQTK

SEQ ID NO: 204534 - protein, 9 aa, Homo Sapiens
GCTLRSTDA

SEQ ID NO: 204535 - protein, 9 aa, Homo Sapiens
TRLVSDWSK

SEQ ID NO: 204536 - protein, 9 aa, Homo Sapiens
PWVQLSDEM

SEQ ID NO: 204537 - protein, 9 aa, Homo Sapiens
CMDVNECEA

SEQ ID NO: 204538 - protein, 9 aa, Homo Sapiens
LAAMAYDWY

SEQ ID NO: 204539 - protein, 9 aa, Homo Sapiens
WTTVFLAEC

SEQ ID NO: 204540 - protein, 9 aa, Homo Sapiens
AIHRNSAAS

SEQ ID NO: 204541 - protein, 9 aa, Homo Sapiens
SPVRVRPPH

SEQ ID NO: 204542 - protein, 9 aa, Homo Sapiens
GNHMTDIPL

SEQ ID NO: 204543 - protein, 9 aa, Homo Sapiens
KVVKLVRLS

SEQ ID NO: 204544 - protein, 9 aa, Homo Sapiens
AFIRPRWIY

SEQ ID NO: 204545 - protein, 9 aa, Homo Sapiens
AVRHPIFRP

SEQ ID NO: 204546 - protein, 9 aa, Homo Sapiens
MILKIFVQP

SEQ ID NO: 204547 - protein, 9 aa, Homo Sapiens
PSDQVSCCQ

SEQ ID NO: 204548 - protein, 9 aa, Homo Sapiens
LLMPPCSSW

SEQ ID NO: 204549 - protein, 9 aa, Homo Sapiens
TGEMSYKCI

SEQ ID NO: 204550 - protein, 9 aa, Homo Sapiens
DACPLPPPP

SEQ ID NO: 204551 - protein, 9 aa, Homo Sapiens
TAALEAGED

SEQ ID NO: 204552 - protein, 9 aa, Homo Sapiens
PVRGRTTSA

SEQ ID NO: 204553 - protein, 9 aa, Homo Sapiens
RDGIQIRLP

SEQ ID NO: 204554 - protein, 9 aa, Homo Sapiens
ELQCLVHGG

SEQ ID NO: 204555 - protein, 9 aa, Homo Sapiens
QQEPSTARK

SEQ ID NO: 204556 - protein, 9 aa, Homo Sapiens
MFRAQPHST

SEQ ID NO: 204557 - protein, 9 aa, Homo Sapiens
QDCKDALEL

SEQ ID NO: 204558 - protein, 9 aa, Homo Sapiens
SRMDRIVEM

SEQ ID NO: 204559 - protein, 9 aa, Homo Sapiens
CILANIVDG

SEQ ID NO: 204560 - protein, 9 aa, Homo Sapiens
KPYECIKCV

SEQ ID NO: 204561 - protein, 9 aa, Homo Sapiens
FILTLPHVL

SEQ ID NO: 204562 - protein, 9 aa, Homo Sapiens
VVFETGPAM

SEQ ID NO: 204563 - protein, 9 aa, Homo Sapiens
LFPPWIDGR

SEQ ID NO: 204564 - protein, 9 aa, Homo Sapiens
TAILVTGTQ

SEQ ID NO: 204565 - protein, 9 aa, Homo Sapiens
SDQVSCCQQ

SEQ ID NO: 204566 - protein, 9 aa, Homo Sapiens
LDHLTDQKL

SEQ ID NO: 204567 - protein, 9 aa, Homo Sapiens
PATHIWGKC

SEQ ID NO: 204568 - protein, 9 aa, Homo Sapiens
PNQLLLIWN

SEQ ID NO: 204569 - protein, 9 aa, Homo Sapiens
KDQQTFTRS

SEQ ID NO: 204570 - protein, 9 aa, Homo Sapiens
ALGIPLIPQ

SEQ ID NO: 204571 - protein, 9 aa, Homo Sapiens
KSISFPGCF

SEQ ID NO: 204572 - protein, 9 aa, Homo Sapiens
LENVLAVST

SEQ ID NO: 204573 - protein, 9 aa, Homo Sapiens
LVFLQMPSE

SEQ ID NO: 204574 - protein, 9 aa, Homo Sapiens
IKDEKRDIS

SEQ ID NO: 204575 - protein, 9 aa, Homo Sapiens
WDNSMTWEA

SEQ ID NO: 204576 - protein, 9 aa, Homo Sapiens
HTTFVGPDG

SEQ ID NO: 204577 - protein, 9 aa, Homo Sapiens
DYCDISEGM

SEQ ID NO: 204578 - protein, 9 aa, Homo Sapiens
WEPPGLIFN

SEQ ID NO: 204579 - protein, 9 aa, Homo Sapiens
HLPYNKYYV

SEQ ID NO: 204580 - protein, 9 aa, Homo Sapiens
WQPVDLAQV

SEQ ID NO: 204581 - protein, 9 aa, Homo Sapiens
QILEALSLF

SEQ ID NO: 204582 - protein, 9 aa, Homo Sapiens
YLSDFEMPQ

SEQ ID NO: 204583 - protein, 9 aa, Homo Sapiens
HEAILQVLY

SEQ ID NO: 204584 - protein, 9 aa, Homo Sapiens
DIVGLRFSI

SEQ ID NO: 204585 - protein, 9 aa, Homo Sapiens
LLNIYDCLQ

SEQ ID NO: 204586 - protein, 9 aa, Homo Sapiens
TEIEYTIDV

SEQ ID NO: 204587 - protein, 9 aa, Homo Sapiens
VCCICQQAR

SEQ ID NO: 204588 - protein, 9 aa, Homo Sapiens
RVALSHSSC

SEQ ID NO: 204589 - protein, 9 aa, Homo Sapiens
TNYPFMFAN

SEQ ID NO: 204590 - protein, 9 aa, Homo Sapiens
SLALTGDVV

SEQ ID NO: 204591 - protein, 9 aa, Homo Sapiens
GNVQSRAQM

SEQ ID NO: 204592 - protein, 9 aa, Homo Sapiens
DLNLVAVNT

SEQ ID NO: 204593 - protein, 9 aa, Homo Sapiens
TMTIRACRC

SEQ ID NO: 204594 - protein, 9 aa, Homo Sapiens
TSLVLGILV

SEQ ID NO: 204595 - protein, 9 aa, Homo Sapiens
TEFCQQTCI

SEQ ID NO: 204596 - protein, 9 aa, Homo Sapiens
MDLKIKLAM

SEQ ID NO: 204597 - protein, 9 aa, Homo Sapiens
RMTVSFVVI

SEQ ID NO: 204598 - protein, 9 aa, Homo Sapiens
SKEREIRRN

SEQ ID NO: 204599 - protein, 9 aa, Homo Sapiens
PPSCARSQR

SEQ ID NO: 204600 - protein, 9 aa, Homo Sapiens
APDKTLISD

SEQ ID NO: 204601 - protein, 9 aa, Homo Sapiens
TAKSWLPLH

SEQ ID NO: 204602 - protein, 9 aa, Homo Sapiens
ILESFQALT

SEQ ID NO: 204603 - protein, 9 aa, Homo Sapiens
QCGELELQH

SEQ ID NO: 204604 - protein, 9 aa, Homo Sapiens
EQHEKIKQF

SEQ ID NO: 204605 - protein, 9 aa, Homo Sapiens
AAQRKILAT

SEQ ID NO: 204606 - protein, 9 aa, Homo Sapiens
RWVCTERQC

SEQ ID NO: 204607 - protein, 9 aa, Homo Sapiens
VLAGTANPM

SEQ ID NO: 204608 - protein, 9 aa, Homo Sapiens
NHIKEILNK

SEQ ID NO: 204609 - protein, 9 aa, Homo Sapiens
KECQLKELT

SEQ ID NO: 204610 - protein, 9 aa, Homo Sapiens
RNSRTIGVL

SEQ ID NO: 204611 - protein, 9 aa, Homo Sapiens
ESGVWALLG

SEQ ID NO: 204612 - protein, 9 aa, Homo Sapiens
FLGKKERCD

SEQ ID NO: 204613 - protein, 9 aa, Homo Sapiens
DGHKAQQHI

SEQ ID NO: 204614 - protein, 9 aa, Homo Sapiens
TTTTQALAL

SEQ ID NO: 204615 - protein, 9 aa, Homo Sapiens
NLLANDMDF

SEQ ID NO: 204616 - protein, 9 aa, Homo Sapiens
IQQQSALKV

SEQ ID NO: 204617 - protein, 9 aa, Homo Sapiens
QEPTTTPDT

SEQ ID NO: 204618 - protein, 9 aa, Homo Sapiens
SKSSPQAWG

SEQ ID NO: 204619 - protein, 9 aa, Homo Sapiens
GDPRRRRRL

SEQ ID NO: 204620 - protein, 9 aa, Homo Sapiens
PGALQPGVH

SEQ ID NO: 204621 - protein, 9 aa, Homo Sapiens
RRLCLPGRE

SEQ ID NO: 204622 - protein, 9 aa, Homo Sapiens
VVPPGEKHW

SEQ ID NO: 204623 - protein, 9 aa, Homo Sapiens
HVRAQEHEL

SEQ ID NO: 204624 - protein, 9 aa, Homo Sapiens
QNMPSLHSR

SEQ ID NO: 204625 - protein, 9 aa, Homo Sapiens
DVNAQNWLG

SEQ ID NO: 204626 - protein, 9 aa, Homo Sapiens
PLQPKLPNH

SEQ ID NO: 204627 - protein, 9 aa, Homo Sapiens
YSSLELAQV

SEQ ID NO: 204628 - protein, 9 aa, Homo Sapiens
QLGDLSNWC

SEQ ID NO: 204629 - protein, 9 aa, Homo Sapiens
ALYRLRLLV

SEQ ID NO: 204630 - protein, 9 aa, Homo Sapiens
GNASTTVLR

SEQ ID NO: 204631 - protein, 9 aa, Homo Sapiens
NIFQDTELL

SEQ ID NO: 204632 - protein, 9 aa, Homo Sapiens
DSCTDDAVG

SEQ ID NO: 204633 - protein, 9 aa, Homo Sapiens
DGRCYGPYI

SEQ ID NO: 204634 - protein, 9 aa, Homo Sapiens
QRIHVAQKP

SEQ ID NO: 204635 - protein, 9 aa, Homo Sapiens
IEQLQAQIW

SEQ ID NO: 204636 - protein, 9 aa, Homo Sapiens
QAPGALQPG

SEQ ID NO: 204637 - protein, 9 aa, Homo Sapiens
PAYRANLGM

SEQ ID NO: 204638 - protein, 9 aa, Homo Sapiens
QAHFAPLSP

SEQ ID NO: 204639 - protein, 9 aa, Homo Sapiens
WTNIEAELH

SEQ ID NO: 204640 - protein, 9 aa, Homo Sapiens
ILICFSTST

SEQ ID NO: 204641 - protein, 9 aa, Homo Sapiens
SLIGNLQLA

SEQ ID NO: 204642 - protein, 9 aa, Homo Sapiens
ILLMDDFKL

SEQ ID NO: 204643 - protein, 9 aa, Homo Sapiens
KSPQLFKNV

SEQ ID NO: 204644 - protein, 9 aa, Homo Sapiens
LFQRITRLK

SEQ ID NO: 204645 - protein, 9 aa, Homo Sapiens
NMEAFTEMM

SEQ ID NO: 204646 - protein, 9 aa, Homo Sapiens
TETEGSYTL

SEQ ID NO: 204647 - protein, 9 aa, Homo Sapiens
HCMDYQKTF

SEQ ID NO: 204648 - protein, 9 aa, Homo Sapiens
SQGHFQAQL

SEQ ID NO: 204649 - protein, 9 aa, Homo Sapiens
LKVQVIIFA

SEQ ID NO: 204650 - protein, 9 aa, Homo Sapiens
RNPQRRICR

SEQ ID NO: 204651 - protein, 9 aa, Homo Sapiens
GWDLQIALV

SEQ ID NO: 204652 - protein, 9 aa, Homo Sapiens
FITEGNNIH

SEQ ID NO: 204653 - protein, 9 aa, Homo Sapiens
LQDSVKTPK

SEQ ID NO: 204654 - protein, 9 aa, Homo Sapiens
HWKAENFIF

SEQ ID NO: 204655 - protein, 9 aa, Homo Sapiens
NTVLGDDKF

SEQ ID NO: 204656 - protein, 9 aa, Homo Sapiens
VGAASAGVL

SEQ ID NO: 204657 - protein, 9 aa, Homo Sapiens
GGGREPAPG

SEQ ID NO: 204658 - protein, 9 aa, Homo Sapiens
RRKGPHYER

SEQ ID NO: 204659 - protein, 9 aa, Homo Sapiens
VGTTLMPAS

SEQ ID NO: 204660 - protein, 9 aa, Homo Sapiens
GEGCSHCCP

SEQ ID NO: 204661 - protein, 9 aa, Homo Sapiens
HHPPQHNHH

SEQ ID NO: 204662 - protein, 9 aa, Homo Sapiens
IRNPNGGFC

SEQ ID NO: 204663 - protein, 9 aa, Homo Sapiens
ELQGQLFVV

SEQ ID NO: 204664 - protein, 9 aa, Homo Sapiens
PYHVLQASE

SEQ ID NO: 204665 - protein, 9 aa, Homo Sapiens
GIPVSLTHH

SEQ ID NO: 204666 - protein, 9 aa, Homo Sapiens
HMHVPAIPP

SEQ ID NO: 204667 - protein, 9 aa, Homo Sapiens
VAASTDGKV

SEQ ID NO: 204668 - protein, 9 aa, Homo Sapiens
MAEKCCQTN

SEQ ID NO: 204669 - protein, 9 aa, Homo Sapiens
WARMITETE

SEQ ID NO: 204670 - protein, 9 aa, Homo Sapiens
SPQKPTRKI

SEQ ID NO: 204671 - protein, 9 aa, Homo Sapiens
ASDTMDSQM

SEQ ID NO: 204672 - protein, 9 aa, Homo Sapiens
IHKEDLQDG

SEQ ID NO: 204673 - protein, 9 aa, Homo Sapiens
ASAMASFLN

SEQ ID NO: 204674 - protein, 9 aa, Homo Sapiens
YLGNRDHFA

SEQ ID NO: 204675 - protein, 9 aa, Homo Sapiens
AIECYRRSV

SEQ ID NO: 204676 - protein, 9 aa, Homo Sapiens
LVVGPLRAQ

SEQ ID NO: 204677 - protein, 9 aa, Homo Sapiens
HHTEKLPAG

SEQ ID NO: 204678 - protein, 9 aa, Homo Sapiens
QCISLLNQR

SEQ ID NO: 204679 - protein, 9 aa, Homo Sapiens
VRVRPPHVL

SEQ ID NO: 204680 - protein, 9 aa, Homo Sapiens
HKETDDCNA

SEQ ID NO: 204681 - protein, 9 aa, Homo Sapiens
CQRALPQHM

SEQ ID NO: 204682 - protein, 9 aa, Homo Sapiens
FPKSVKSWE

SEQ ID NO: 204683 - protein, 9 aa, Homo Sapiens
GHRQSFLVG

SEQ ID NO: 204684 - protein, 9 aa, Homo Sapiens
PAGDPRLAH

SEQ ID NO: 204685 - protein, 9 aa, Homo Sapiens
GTKERAHQQ

SEQ ID NO: 204686 - protein, 9 aa, Homo Sapiens
IPLAFLASW

SEQ ID NO: 204687 - protein, 9 aa, Homo Sapiens
FGLNLQSAD

SEQ ID NO: 204688 - protein, 9 aa, Homo Sapiens
EALLIQEAK

SEQ ID NO: 204689 - protein, 9 aa, Homo Sapiens
IINCKVKPR

SEQ ID NO: 204690 - protein, 9 aa, Homo Sapiens
QASEKQVVL

SEQ ID NO: 204691 - protein, 9 aa, Homo Sapiens
SSLRQETLA

SEQ ID NO: 204692 - protein, 9 aa, Homo Sapiens
HMVPTIRSG

SEQ ID NO: 204693 - protein, 9 aa, Homo Sapiens
GTPALMSRG

SEQ ID NO: 204694 - protein, 9 aa, Homo Sapiens
PPSSHVRPM

SEQ ID NO: 204695 - protein, 9 aa, Homo Sapiens
LAPPRPAAG

SEQ ID NO: 204696 - protein, 9 aa, Homo Sapiens
RQGYTIHIL

SEQ ID NO: 204697 - protein, 9 aa, Homo Sapiens
TCYPLFKDQ

SEQ ID NO: 204698 - protein, 9 aa, Homo Sapiens
VLRVPSTIV

SEQ ID NO: 204699 - protein, 9 aa, Homo Sapiens
LSTRAGGFG

SEQ ID NO: 204700 - protein, 9 aa, Homo Sapiens
RKYPHSWMK

SEQ ID NO: 204701 - protein, 9 aa, Homo Sapiens
LFGMQLFGG

SEQ ID NO: 204702 - protein, 9 aa, Homo Sapiens
YRRCGFLQL

SEQ ID NO: 204703 - protein, 9 aa, Homo Sapiens
QYEREQYAD

SEQ ID NO: 204704 - protein, 9 aa, Homo Sapiens
WDLQIALVS

SEQ ID NO: 204705 - protein, 9 aa, Homo Sapiens
PSRLPPVDR

SEQ ID NO: 204706 - protein, 9 aa, Homo Sapiens
HARTVFGVT

SEQ ID NO: 204707 - protein, 9 aa, Homo Sapiens
EVMVQSPTP

SEQ ID NO: 204708 - protein, 9 aa, Homo Sapiens
LGDLSNWCN

SEQ ID NO: 204709 - protein, 9 aa, Homo Sapiens
RHFVSQMPF

SEQ ID NO: 204710 - protein, 9 aa, Homo Sapiens
QLPKATLQK

SEQ ID NO: 204711 - protein, 9 aa, Homo Sapiens
GRDLLVVEA

SEQ ID NO: 204712 - protein, 9 aa, Homo Sapiens
TFPNTRNQQ

SEQ ID NO: 204713 - protein, 9 aa, Homo Sapiens
GTTYEGGVQ

SEQ ID NO: 204714 - protein, 9 aa, Homo Sapiens
AKQEEFFNM

SEQ ID NO: 204715 - protein, 9 aa, Homo Sapiens
CSLRSFFVG

SEQ ID NO: 204716 - protein, 9 aa, Homo Sapiens
SHLPYNKYY

SEQ ID NO: 204717 - protein, 9 aa, Homo Sapiens
CTNCMEDES

SEQ ID NO: 204718 - protein, 9 aa, Homo Sapiens
SKGYSSFGC

SEQ ID NO: 204719 - protein, 9 aa, Homo Sapiens
RSRSCCNTS

SEQ ID NO: 204720 - protein, 9 aa, Homo Sapiens
DGESGRPGQ

SEQ ID NO: 204721 - protein, 9 aa, Homo Sapiens
ELMGPEDGA

SEQ ID NO: 204722 - protein, 9 aa, Homo Sapiens
KKVAWDPRF

SEQ ID NO: 204723 - protein, 9 aa, Homo Sapiens
HWTTVGLCF

SEQ ID NO: 204724 - protein, 9 aa, Homo Sapiens
SEIPAEFAD

SEQ ID NO: 204725 - protein, 9 aa, Homo Sapiens
RRHQAEKPK

SEQ ID NO: 204726 - protein, 9 aa, Homo Sapiens
VLSITTTTQ

SEQ ID NO: 204727 - protein, 9 aa, Homo Sapiens
CGKFFSWHS

SEQ ID NO: 204728 - protein, 9 aa, Homo Sapiens
PPFRAARDA

SEQ ID NO: 204729 - protein, 9 aa, Homo Sapiens
DISVTPLPL

SEQ ID NO: 204730 - protein, 9 aa, Homo Sapiens
LYIMVCSSM

SEQ ID NO: 204731 - protein, 9 aa, Homo Sapiens
IECYRRSVE

SEQ ID NO: 204732 - protein, 9 aa, Homo Sapiens
MDTPITHIS

SEQ ID NO: 204733 - protein, 9 aa, Homo Sapiens
ESIKCLYPG

SEQ ID NO: 204734 - protein, 9 aa, Homo Sapiens
LLRSSSPTQ

SEQ ID NO: 204735 - protein, 9 aa, Homo Sapiens
WMAPEAINF

SEQ ID NO: 204736 - protein, 9 aa, Homo Sapiens
AQRKILATQ

SEQ ID NO: 204737 - protein, 9 aa, Homo Sapiens
SSYSMHTLY

SEQ ID NO: 204738 - protein, 9 aa, Homo Sapiens
PVLGGLVNT

SEQ ID NO: 204739 - protein, 9 aa, Homo Sapiens
NVVLSGFPV

SEQ ID NO: 204740 - protein, 9 aa, Homo Sapiens
LLRRERIHT

SEQ ID NO: 204741 - protein, 9 aa, Homo Sapiens
SSSPTQLSS

SEQ ID NO: 204742 - protein, 9 aa, Homo Sapiens
GPPLPPESL

SEQ ID NO: 204743 - protein, 9 aa, Homo Sapiens
LLAYLLVAA

SEQ ID NO: 204744 - protein, 9 aa, Homo Sapiens
HPNVIRYFY

SEQ ID NO: 204745 - protein, 9 aa, Homo Sapiens
ALGGPPALR

SEQ ID NO: 204746 - protein, 9 aa, Homo Sapiens
LLFSHHTVI

SEQ ID NO: 204747 - protein, 9 aa, Homo Sapiens
SEEHFHVEL

SEQ ID NO: 204748 - protein, 9 aa, Homo Sapiens
ARKATARER

SEQ ID NO: 204749 - protein, 9 aa, Homo Sapiens
VEYEALAEQ

SEQ ID NO: 204750 - protein, 9 aa, Homo Sapiens
EYMDLEEFC

SEQ ID NO: 204751 - protein, 9 aa, Homo Sapiens
RAGGFGLNL

SEQ ID NO: 204752 - protein, 9 aa, Homo Sapiens
QMSPMPKTN

SEQ ID NO: 204753 - protein, 9 aa, Homo Sapiens
PEGLLIINT

SEQ ID NO: 204754 - protein, 9 aa, Homo Sapiens
HTIPAPEPV

SEQ ID NO: 204755 - protein, 9 aa, Homo Sapiens
RAYYKKCPS

SEQ ID NO: 204756 - protein, 9 aa, Homo Sapiens
LVGEAIVKQ

SEQ ID NO: 204757 - protein, 9 aa, Homo Sapiens
EIHGLRIFT

SEQ ID NO: 204758 - protein, 9 aa, Homo Sapiens
QRCSMDAPS

SEQ ID NO: 204759 - protein, 9 aa, Homo Sapiens
QVAVRGPTG

SEQ ID NO: 204760 - protein, 9 aa, Homo Sapiens
PPGTMGPPP

SEQ ID NO: 204761 - protein, 9 aa, Homo Sapiens
VEGNPDWLQ

SEQ ID NO: 204762 - protein, 9 aa, Homo Sapiens
SWFCLSFVY

SEQ ID NO: 204763 - protein, 9 aa, Homo Sapiens
NFLLTTNYP

SEQ ID NO: 204764 - protein, 9 aa, Homo Sapiens
LLQCFRHGQ

SEQ ID NO: 204765 - protein, 9 aa, Homo Sapiens
AAINTAIIE

SEQ ID NO: 204766 - protein, 9 aa, Homo Sapiens
HSGNIALSL

SEQ ID NO: 204767 - protein, 9 aa, Homo Sapiens
QALMGPPLP

SEQ ID NO: 204768 - protein, 9 aa, Homo Sapiens
KDVNAAIVT

SEQ ID NO: 204769 - protein, 9 aa, Homo Sapiens
QEGDPVDCT

SEQ ID NO: 204770 - protein, 9 aa, Homo Sapiens
GGGRVRALN

SEQ ID NO: 204771 - protein, 9 aa, Homo Sapiens
YRQGHIAKM

SEQ ID NO: 204772 - protein, 9 aa, Homo Sapiens
PISKKVAWD

SEQ ID NO: 204773 - protein, 9 aa, Homo Sapiens
KSDGIQKVW

SEQ ID NO: 204774 - protein, 9 aa, Homo Sapiens
RLVSGYRHI

SEQ ID NO: 204775 - protein, 9 aa, Homo Sapiens
IRGLGVSLQ

SEQ ID NO: 204776 - protein, 9 aa, Homo Sapiens
TYGLGATTI

SEQ ID NO: 204777 - protein, 9 aa, Homo Sapiens
AIFSEGGFL

SEQ ID NO: 204778 - protein, 9 aa, Homo Sapiens
SLGAPRMYM

SEQ ID NO: 204779 - protein, 9 aa, Homo Sapiens
DPVPQNDDP

SEQ ID NO: 204780 - protein, 9 aa, Homo Sapiens
GSDSDKEVV

SEQ ID NO: 204781 - protein, 9 aa, Homo Sapiens
RVEIQNHWF

SEQ ID NO: 204782 - protein, 9 aa, Homo Sapiens
KYLPSLLRS

SEQ ID NO: 204783 - protein, 9 aa, Homo Sapiens
VNAHTYPAQ

SEQ ID NO: 204784 - protein, 9 aa, Homo Sapiens
CLDILILWI

SEQ ID NO: 204785 - protein, 9 aa, Homo Sapiens
SPVFLFLRT

SEQ ID NO: 204786 - protein, 9 aa, Homo Sapiens
PFGVFLMNS

SEQ ID NO: 204787 - protein, 9 aa, Homo Sapiens
FVSGPGAFS

SEQ ID NO: 204788 - protein, 9 aa, Homo Sapiens
KKHSDPSQP

SEQ ID NO: 204789 - protein, 9 aa, Homo Sapiens
RRERIHTGE

SEQ ID NO: 204790 - protein, 9 aa, Homo Sapiens
LWPSLEDLF

SEQ ID NO: 204791 - protein, 9 aa, Homo Sapiens
PAAGHCAGG

SEQ ID NO: 204792 - protein, 9 aa, Homo Sapiens
AGESALVSI

SEQ ID NO: 204793 - protein, 9 aa, Homo Sapiens
TAAHCMDYQ

SEQ ID NO: 204794 - protein, 9 aa, Homo Sapiens
SSKDANKES

SEQ ID NO: 204795 - protein, 9 aa, Homo Sapiens
KFCPLLCTM

SEQ ID NO: 204796 - protein, 9 aa, Homo Sapiens
FRVGTTDRG

SEQ ID NO: 204797 - protein, 9 aa, Homo Sapiens
ASMLRVSYI

SEQ ID NO: 204798 - protein, 9 aa, Homo Sapiens
HTGQHAPPI

SEQ ID NO: 204799 - protein, 9 aa, Homo Sapiens
KWYYDPNTE

SEQ ID NO: 204800 - protein, 9 aa, Homo Sapiens
GTHAEGPGT

SEQ ID NO: 204801 - protein, 9 aa, Homo Sapiens
RMLGFRCVE

SEQ ID NO: 204802 - protein, 9 aa, Homo Sapiens
ALYPNRVHP

SEQ ID NO: 204803 - protein, 9 aa, Homo Sapiens
SNSSMNPII

SEQ ID NO: 204804 - protein, 9 aa, Homo Sapiens
LCTCSATHL

SEQ ID NO: 204805 - protein, 9 aa, Homo Sapiens
FLAECTGPL

SEQ ID NO: 204806 - protein, 9 aa, Homo Sapiens
RGGGHRGHG

SEQ ID NO: 204807 - protein, 9 aa, Homo Sapiens
EEKCLKVKG

SEQ ID NO: 204808 - protein, 9 aa, Homo Sapiens
KKMVKEGPF

SEQ ID NO: 204809 - protein, 9 aa, Homo Sapiens
LDELPNLKA

SEQ ID NO: 204810 - protein, 9 aa, Homo Sapiens
AAGEVQRRC

SEQ ID NO: 204811 - protein, 9 aa, Homo Sapiens
SITPGLHPG

SEQ ID NO: 204812 - protein, 9 aa, Homo Sapiens
LLANDMDFH

SEQ ID NO: 204813 - protein, 9 aa, Homo Sapiens
EGLHVFDKE

SEQ ID NO: 204814 - protein, 9 aa, Homo Sapiens
PLVRKRQFQ

SEQ ID NO: 204815 - protein, 9 aa, Homo Sapiens
RRRKGPHYE

SEQ ID NO: 204816 - protein, 9 aa, Homo Sapiens
QINSVGSTA

SEQ ID NO: 204817 - protein, 9 aa, Homo Sapiens
ITYTSEASK

SEQ ID NO: 204818 - protein, 9 aa, Homo Sapiens
KEWQGDRSS

SEQ ID NO: 204819 - protein, 9 aa, Homo Sapiens
EPVLWTNDG

SEQ ID NO: 204820 - protein, 9 aa, Homo Sapiens
QKEFQNNFV

SEQ ID NO: 204821 - protein, 9 aa, Homo Sapiens
ALTILWMIM

SEQ ID NO: 204822 - protein, 9 aa, Homo Sapiens
WTFRTTTFS

SEQ ID NO: 204823 - protein, 9 aa, Homo Sapiens
GLDVESADE

SEQ ID NO: 204824 - protein, 9 aa, Homo Sapiens
NYDFSLYMM

SEQ ID NO: 204825 - protein, 9 aa, Homo Sapiens
IQKLLVKET

SEQ ID NO: 204826 - protein, 9 aa, Homo Sapiens
YIMVCSSMP

SEQ ID NO: 204827 - protein, 9 aa, Homo Sapiens
GLGELRQRL

SEQ ID NO: 204828 - protein, 9 aa, Homo Sapiens
SKDPRHRAL

SEQ ID NO: 204829 - protein, 9 aa, Homo Sapiens
NLQSKSENM

SEQ ID NO: 204830 - protein, 9 aa, Homo Sapiens
HLTINATDN

SEQ ID NO: 204831 - protein, 9 aa, Homo Sapiens
LYDEEGKQL

SEQ ID NO: 204832 - protein, 9 aa, Homo Sapiens
GTFCACAMV

SEQ ID NO: 204833 - protein, 9 aa, Homo Sapiens
SDLVVPDLP

SEQ ID NO: 204834 - protein, 9 aa, Homo Sapiens
ENIGYDLER

SEQ ID NO: 204835 - protein, 9 aa, Homo Sapiens
KIISKGMEA

SEQ ID NO: 204836 - protein, 9 aa, Homo Sapiens
GSLESSIPM

SEQ ID NO: 204837 - protein, 9 aa, Homo Sapiens
CPMRRSRRL

SEQ ID NO: 204838 - protein, 9 aa, Homo Sapiens
YHRFLPTKD

SEQ ID NO: 204839 - protein, 9 aa, Homo Sapiens
SWLTCLLRR

SEQ ID NO: 204840 - protein, 9 aa, Homo Sapiens
FANYRRCQR

SEQ ID NO: 204841 - protein, 9 aa, Homo Sapiens
LRRSGMHTV

SEQ ID NO: 204842 - protein, 9 aa, Homo Sapiens
ISEFKPMTQ

SEQ ID NO: 204843 - protein, 9 aa, Homo Sapiens
DGELAPLHT

SEQ ID NO: 204844 - protein, 9 aa, Homo Sapiens
PVSLTHHPV

SEQ ID NO: 204845 - protein, 9 aa, Homo Sapiens
ALQGTKERA

SEQ ID NO: 204846 - protein, 9 aa, Homo Sapiens
RAPLQVAVR

SEQ ID NO: 204847 - protein, 9 aa, Homo Sapiens
LMEVSSDVF

SEQ ID NO: 204848 - protein, 9 aa, Homo Sapiens
LRVGHKPSL

SEQ ID NO: 204849 - protein, 9 aa, Homo Sapiens
LNPYVRVTS

SEQ ID NO: 204850 - protein, 9 aa, Homo Sapiens
TSVQLQTQQ

SEQ ID NO: 204851 - protein, 9 aa, Homo Sapiens
QECRRAITN

SEQ ID NO: 204852 - protein, 9 aa, Homo Sapiens
ERLRGLLHT

SEQ ID NO: 204853 - protein, 9 aa, Homo Sapiens
CQRVDSDQS

SEQ ID NO: 204854 - protein, 9 aa, Homo Sapiens
QMYSEIIAL

SEQ ID NO: 204855 - protein, 9 aa, Homo Sapiens
SAKKRASVS

SEQ ID NO: 204856 - protein, 9 aa, Homo Sapiens
SHPQHRYCM

SEQ ID NO: 204857 - protein, 9 aa, Homo Sapiens
CICDNRDLL

SEQ ID NO: 204858 - protein, 9 aa, Homo Sapiens
TPLKLAGWQ

SEQ ID NO: 204859 - protein, 9 aa, Homo Sapiens
LLKGHQEGW

SEQ ID NO: 204860 - protein, 9 aa, Homo Sapiens
LHVFDKESN

SEQ ID NO: 204861 - protein, 9 aa, Homo Sapiens
VRAYYKKCP

SEQ ID NO: 204862 - protein, 9 aa, Homo Sapiens
KRSGAQHDS

SEQ ID NO: 204863 - protein, 9 aa, Homo Sapiens
QKTILVAHQ

SEQ ID NO: 204864 - protein, 9 aa, Homo Sapiens
LESSIPMDV

SEQ ID NO: 204865 - protein, 9 aa, Homo Sapiens
WIIKAAPSC

SEQ ID NO: 204866 - protein, 9 aa, Homo Sapiens
AGDRGLVCP

SEQ ID NO: 204867 - protein, 9 aa, Homo Sapiens
RSGGSVTRS

SEQ ID NO: 204868 - protein, 9 aa, Homo Sapiens
GTAQGPPNL

SEQ ID NO: 204869 - protein, 9 aa, Homo Sapiens
ERLWGPTEM

SEQ ID NO: 204870 - protein, 9 aa, Homo Sapiens
AKSSWAQQE

SEQ ID NO: 204871 - protein, 9 aa, Homo Sapiens
CDAAQFRLL

SEQ ID NO: 204872 - protein, 9 aa, Homo Sapiens
KRVSGLIYE

SEQ ID NO: 204873 - protein, 9 aa, Homo Sapiens
CRRAITNSS

SEQ ID NO: 204874 - protein, 9 aa, Homo Sapiens
MRRSRRLNP

SEQ ID NO: 204875 - protein, 9 aa, Homo Sapiens
ALEGHTASP

SEQ ID NO: 204876 - protein, 9 aa, Homo Sapiens
SKLIAKVCC

SEQ ID NO: 204877 - protein, 9 aa, Homo Sapiens
QPGAVPGPG

SEQ ID NO: 204878 - protein, 9 aa, Homo Sapiens
FRGIQVVEH

SEQ ID NO: 204879 - protein, 9 aa, Homo Sapiens
WARWMWTVV

SEQ ID NO: 204880 - protein, 9 aa, Homo Sapiens
DLKANMWAL

SEQ ID NO: 204881 - protein, 9 aa, Homo Sapiens
KQNIYSLQR

SEQ ID NO: 204882 - protein, 9 aa, Homo Sapiens
QHPLDRLFS

SEQ ID NO: 204883 - protein, 9 aa, Homo Sapiens
RILSRYVRT

SEQ ID NO: 204884 - protein, 9 aa, Homo Sapiens
ILRIQDKPE

SEQ ID NO: 204885 - protein, 9 aa, Homo Sapiens
NLSCQSCTF

SEQ ID NO: 204886 - protein, 9 aa, Homo Sapiens
FYRKTIVYK

SEQ ID NO: 204887 - protein, 9 aa, Homo Sapiens
LSSLDLFFH

SEQ ID NO: 204888 - protein, 9 aa, Homo Sapiens
SSSQPRRWS

SEQ ID NO: 204889 - protein, 9 aa, Homo Sapiens
VTTPPMPEQ

SEQ ID NO: 204890 - protein, 9 aa, Homo Sapiens
PARSPPPIM

SEQ ID NO: 204891 - protein, 9 aa, Homo Sapiens
TVQHPLDRL

SEQ ID NO: 204892 - protein, 9 aa, Homo Sapiens
MLTGSVMGT

SEQ ID NO: 204893 - protein, 9 aa, Homo Sapiens
YKFKCSKRF

SEQ ID NO: 204894 - protein, 9 aa, Homo Sapiens
ECQLKELTM

SEQ ID NO: 204895 - protein, 9 aa, Homo Sapiens
GKLPTLISL

SEQ ID NO: 204896 - protein, 9 aa, Homo Sapiens
HDGRRLVVR

SEQ ID NO: 204897 - protein, 9 aa, Homo Sapiens
SVQMEPDQL

SEQ ID NO: 204898 - protein, 9 aa, Homo Sapiens
DVLAMSLHF

SEQ ID NO: 204899 - protein, 9 aa, Homo Sapiens
AMDTYSAPP

SEQ ID NO: 204900 - protein, 9 aa, Homo Sapiens
TEISVKRQM

SEQ ID NO: 204901 - protein, 9 aa, Homo Sapiens
DSPAGPWRK

SEQ ID NO: 204902 - protein, 9 aa, Homo Sapiens
LSRYVRTWS

SEQ ID NO: 204903 - protein, 9 aa, Homo Sapiens
TSVSLLVVS

SEQ ID NO: 204904 - protein, 9 aa, Homo Sapiens
VSTLQRWCL

SEQ ID NO: 204905 - protein, 9 aa, Homo Sapiens
KASVKEGDR

SEQ ID NO: 204906 - protein, 9 aa, Homo Sapiens
TNQLQYVQN

SEQ ID NO: 204907 - protein, 9 aa, Homo Sapiens
KPDQSNMRR

SEQ ID NO: 204908 - protein, 9 aa, Homo Sapiens
PPFRLLIID

SEQ ID NO: 204909 - protein, 9 aa, Homo Sapiens
STLRLQHMD

SEQ ID NO: 204910 - protein, 9 aa, Homo Sapiens
GFTNSCINP

SEQ ID NO: 204911 - protein, 9 aa, Homo Sapiens
LEQGKEHCN

SEQ ID NO: 204912 - protein, 9 aa, Homo Sapiens
VGAYAPCPT

SEQ ID NO: 204913 - protein, 9 aa, Homo Sapiens
ASMRDGPLE

SEQ ID NO: 204914 - protein, 9 aa, Homo Sapiens
HMNVTHSHM

SEQ ID NO: 204915 - protein, 9 aa, Homo Sapiens
VVFLPVYIA

SEQ ID NO: 204916 - protein, 9 aa, Homo Sapiens
IPHPGCVHS

SEQ ID NO: 204917 - protein, 9 aa, Homo Sapiens
ESTAGSDPG

SEQ ID NO: 204918 - protein, 9 aa, Homo Sapiens
GENASNSML

SEQ ID NO: 204919 - protein, 9 aa, Homo Sapiens
HHIKGEDKN

SEQ ID NO: 204920 - protein, 9 aa, Homo Sapiens
VSIYVHLDF

SEQ ID NO: 204921 - protein, 9 aa, Homo Sapiens
EAQVGDALW

SEQ ID NO: 204922 - protein, 9 aa, Homo Sapiens
GDVWTFGVN

SEQ ID NO: 204923 - protein, 9 aa, Homo Sapiens
FTILLSSCV

SEQ ID NO: 204924 - protein, 9 aa, Homo Sapiens
IKKPDYVMT

SEQ ID NO: 204925 - protein, 9 aa, Homo Sapiens
VNQLNTKYW

SEQ ID NO: 204926 - protein, 9 aa, Homo Sapiens
TLQEREAGT

SEQ ID NO: 204927 - protein, 9 aa, Homo Sapiens
GNWQDVAKQ

SEQ ID NO: 204928 - protein, 9 aa, Homo Sapiens
TPTNLAMCL

SEQ ID NO: 204929 - protein, 9 aa, Homo Sapiens
RRAFCVWEQ

SEQ ID NO: 204930 - protein, 9 aa, Homo Sapiens
WRQHREVAA

SEQ ID NO: 204931 - protein, 9 aa, Homo Sapiens
RDRPLQERG

SEQ ID NO: 204932 - protein, 9 aa, Homo Sapiens
CQCGELELQ

SEQ ID NO: 204933 - protein, 9 aa, Homo Sapiens
IQDKPEEQW

SEQ ID NO: 204934 - protein, 9 aa, Homo Sapiens
LQWSQEFST

SEQ ID NO: 204935 - protein, 9 aa, Homo Sapiens
LRASQCEYE

SEQ ID NO: 204936 - protein, 9 aa, Homo Sapiens
WLEISLLTE

SEQ ID NO: 204937 - protein, 9 aa, Homo Sapiens
SLLSCDPAA

SEQ ID NO: 204938 - protein, 9 aa, Homo Sapiens
SKMTKFLYH

SEQ ID NO: 204939 - protein, 9 aa, Homo Sapiens
PATIILACY

SEQ ID NO: 204940 - protein, 9 aa, Homo Sapiens
GEADPVHGH

SEQ ID NO: 204941 - protein, 9 aa, Homo Sapiens
MLPLTQTPT

SEQ ID NO: 204942 - protein, 9 aa, Homo Sapiens
GKAFRNQSM

SEQ ID NO: 204943 - protein, 9 aa, Homo Sapiens
EGPMGQGGP

SEQ ID NO: 204944 - protein, 9 aa, Homo Sapiens
GGVKRVSGL

SEQ ID NO: 204945 - protein, 9 aa, Homo Sapiens
KDLALLFPL

SEQ ID NO: 204946 - protein, 9 aa, Homo Sapiens
HLFLCYQQE

SEQ ID NO: 204947 - protein, 9 aa, Homo Sapiens
VEPQAKKPA

SEQ ID NO: 204948 - protein, 9 aa, Homo Sapiens
EIVPATLHR

SEQ ID NO: 204949 - protein, 9 aa, Homo Sapiens
HVAHTVGCS

SEQ ID NO: 204950 - protein, 9 aa, Homo Sapiens
KITSLPRAY

SEQ ID NO: 204951 - protein, 9 aa, Homo Sapiens
LVVGREPQC

SEQ ID NO: 204952 - protein, 9 aa, Homo Sapiens
TITKNLALK

SEQ ID NO: 204953 - protein, 9 aa, Homo Sapiens
EANSERDNG

SEQ ID NO: 204954 - protein, 9 aa, Homo Sapiens
AILVTGTQL

SEQ ID NO: 204955 - protein, 9 aa, Homo Sapiens
FCQQTCIKL

SEQ ID NO: 204956 - protein, 9 aa, Homo Sapiens
PRCPSSFRW

SEQ ID NO: 204957 - protein, 9 aa, Homo Sapiens
MQGVSLGHT

SEQ ID NO: 204958 - protein, 9 aa, Homo Sapiens
VSVHTESGK

SEQ ID NO: 204959 - protein, 9 aa, Homo Sapiens
ANWLSAVIQ

SEQ ID NO: 204960 - protein, 9 aa, Homo Sapiens
AVPNITWTE

SEQ ID NO: 204961 - protein, 9 aa, Homo Sapiens
TGASGLPAI

SEQ ID NO: 204962 - protein, 9 aa, Homo Sapiens
RDGHIAKDC

SEQ ID NO: 204963 - protein, 9 aa, Homo Sapiens
WTNDGGELP

SEQ ID NO: 204964 - protein, 9 aa, Homo Sapiens
LVLDCVPDE

SEQ ID NO: 204965 - protein, 9 aa, Homo Sapiens
GDKTKETVS

SEQ ID NO: 204966 - protein, 9 aa, Homo Sapiens
ELDYNPPWV

SEQ ID NO: 204967 - protein, 9 aa, Homo Sapiens
DFDLTAAQA

SEQ ID NO: 204968 - protein, 9 aa, Homo Sapiens
NEALYPQRW

SEQ ID NO: 204969 - protein, 9 aa, Homo Sapiens
NPDSWSNAA

SEQ ID NO: 204970 - protein, 9 aa, Homo Sapiens
KKNTGFTPQ

SEQ ID NO: 204971 - protein, 9 aa, Homo Sapiens
GGRVTEGPH

SEQ ID NO: 204972 - protein, 9 aa, Homo Sapiens
HQRACRKRI

SEQ ID NO: 204973 - protein, 9 aa, Homo Sapiens
AHCPANGAG

SEQ ID NO: 204974 - protein, 9 aa, Homo Sapiens
SCRKINFSL

SEQ ID NO: 204975 - protein, 9 aa, Homo Sapiens
RMVFKGGRM

SEQ ID NO: 204976 - protein, 9 aa, Homo Sapiens
SSFCMCKNG

SEQ ID NO: 204977 - protein, 9 aa, Homo Sapiens
SSVPHAYCP

SEQ ID NO: 204978 - protein, 9 aa, Homo Sapiens
TQKWFKQHL

SEQ ID NO: 204979 - protein, 9 aa, Homo Sapiens
LNNSLYIQN

SEQ ID NO: 204980 - protein, 9 aa, Homo Sapiens
VAHSSKLLG

SEQ ID NO: 204981 - protein, 9 aa, Homo Sapiens
SNYQTMFRA

SEQ ID NO: 204982 - protein, 9 aa, Homo Sapiens
KEEAVAVAA

SEQ ID NO: 204983 - protein, 9 aa, Homo Sapiens
VHMEGKSYD

SEQ ID NO: 204984 - protein, 9 aa, Homo Sapiens
GAQCHVCTL

SEQ ID NO: 204985 - protein, 9 aa, Homo Sapiens
DTEIEYTID

SEQ ID NO: 204986 - protein, 9 aa, Homo Sapiens
TTLMPASEP

SEQ ID NO: 204987 - protein, 9 aa, Homo Sapiens
NDNTVLRNP

SEQ ID NO: 204988 - protein, 9 aa, Homo Sapiens
DDDEDGNYL

SEQ ID NO: 204989 - protein, 9 aa, Homo Sapiens
SLQIFITEG

SEQ ID NO: 204990 - protein, 9 aa, Homo Sapiens
SSLDHLTDQ

SEQ ID NO: 204991 - protein, 9 aa, Homo Sapiens
SEDDIHRFI

SEQ ID NO: 204992 - protein, 9 aa, Homo Sapiens
QHMTEVVRH

SEQ ID NO: 204993 - protein, 9 aa, Homo Sapiens
FNCIDLPVL

SEQ ID NO: 204994 - protein, 9 aa, Homo Sapiens
SIHGWPVTK

SEQ ID NO: 204995 - protein, 9 aa, Homo Sapiens
LVSADENSV

SEQ ID NO: 204996 - protein, 9 aa, Homo Sapiens
APSDQVSCC

SEQ ID NO: 204997 - protein, 9 aa, Homo Sapiens
GKKSCHTTV

SEQ ID NO: 204998 - protein, 9 aa, Homo Sapiens
PRCQELEQD

SEQ ID NO: 204999 - protein, 9 aa, Homo Sapiens
EEGSDEMYK

SEQ ID NO: 205000 - protein, 9 aa, Homo Sapiens
IHQVPLILT

SEQ ID NO: 205001 - protein, 9 aa, Homo Sapiens
QGYTIHILL

SEQ ID NO: 205002 - protein, 9 aa, Homo Sapiens
VKCVVQNVH

SEQ ID NO: 205003 - protein, 9 aa, Homo Sapiens
SQNLLLHSP

SEQ ID NO: 205004 - protein, 9 aa, Homo Sapiens
LCRLGRQRN

SEQ ID NO: 205005 - protein, 9 aa, Homo Sapiens
SCKHNMRGQ

SEQ ID NO: 205006 - protein, 9 aa, Homo Sapiens
KRLRVVSPF

SEQ ID NO: 205007 - protein, 9 aa, Homo Sapiens
YRLQPGRGW

SEQ ID NO: 205008 - protein, 9 aa, Homo Sapiens
LSSSGKLDV

SEQ ID NO: 205009 - protein, 9 aa, Homo Sapiens
LSCPLSECH

SEQ ID NO: 205010 - protein, 9 aa, Homo Sapiens
LKEEMDKMR

SEQ ID NO: 205011 - protein, 9 aa, Homo Sapiens
EMDPGVPRP

SEQ ID NO: 205012 - protein, 9 aa, Homo Sapiens
GMHHRDRPT

SEQ ID NO: 205013 - protein, 9 aa, Homo Sapiens
KDETYTSNA

SEQ ID NO: 205014 - protein, 9 aa, Homo Sapiens
GCIEGHTGT

SEQ ID NO: 205015 - protein, 9 aa, Homo Sapiens
GIQKVWQKR

SEQ ID NO: 205016 - protein, 9 aa, Homo Sapiens
YGQVRDTAI

SEQ ID NO: 205017 - protein, 9 aa, Homo Sapiens
NCSEDSCMP

SEQ ID NO: 205018 - protein, 9 aa, Homo Sapiens
DPPLLTSTF

SEQ ID NO: 205019 - protein, 9 aa, Homo Sapiens
AARLPAGPR

SEQ ID NO: 205020 - protein, 9 aa, Homo Sapiens
ELHYKRRRA

SEQ ID NO: 205021 - protein, 9 aa, Homo Sapiens
ADTELENFT

SEQ ID NO: 205022 - protein, 9 aa, Homo Sapiens
LSSDTSTLS

SEQ ID NO: 205023 - protein, 9 aa, Homo Sapiens
LCTWIYQWQ

SEQ ID NO: 205024 - protein, 9 aa, Homo Sapiens
TSGKPFGVF

SEQ ID NO: 205025 - protein, 9 aa, Homo Sapiens
LLCEEEVLD

SEQ ID NO: 205026 - protein, 9 aa, Homo Sapiens
TLVGEAIVK

SEQ ID NO: 205027 - protein, 9 aa, Homo Sapiens
CKKLQKKKN

SEQ ID NO: 205028 - protein, 9 aa, Homo Sapiens
QALESWLPW

SEQ ID NO: 205029 - protein, 9 aa, Homo Sapiens
LTYMSHRNP

SEQ ID NO: 205030 - protein, 9 aa, Homo Sapiens
PRAREDAAE

SEQ ID NO: 205031 - protein, 9 aa, Homo Sapiens
LYPNRVHPY

SEQ ID NO: 205032 - protein, 9 aa, Homo Sapiens
QEVANNPSS

SEQ ID NO: 205033 - protein, 9 aa, Homo Sapiens
NLTFLWPYY

SEQ ID NO: 205034 - protein, 9 aa, Homo Sapiens
LGSIYNILA

SEQ ID NO: 205035 - protein, 9 aa, Homo Sapiens
LRTLKERLS

SEQ ID NO: 205036 - protein, 9 aa, Homo Sapiens
LQIFITEGN

SEQ ID NO: 205037 - protein, 9 aa, Homo Sapiens
GFFHYLKVQ

SEQ ID NO: 205038 - protein, 9 aa, Homo Sapiens
LSMLAHHLG

SEQ ID NO: 205039 - protein, 9 aa, Homo Sapiens
GRLYVADGL

SEQ ID NO: 205040 - protein, 9 aa, Homo Sapiens
ILRPSLQVS

SEQ ID NO: 205041 - protein, 9 aa, Homo Sapiens
GSEQGKCVE

SEQ ID NO: 205042 - protein, 9 aa, Homo Sapiens
HTGAPYRLT

SEQ ID NO: 205043 - protein, 9 aa, Homo Sapiens
DLPNLEILM

SEQ ID NO: 205044 - protein, 9 aa, Homo Sapiens
LLRSPQKPT

SEQ ID NO: 205045 - protein, 9 aa, Homo Sapiens
QAGNRTPVP

SEQ ID NO: 205046 - protein, 9 aa, Homo Sapiens
QRGLVLWNE

SEQ ID NO: 205047 - protein, 9 aa, Homo Sapiens
RSFMDLKIK

SEQ ID NO: 205048 - protein, 9 aa, Homo Sapiens
DGPLELEGE

SEQ ID NO: 205049 - protein, 9 aa, Homo Sapiens
PVSTGLPTA

SEQ ID NO: 205050 - protein, 9 aa, Homo Sapiens
DPNPVVQII

SEQ ID NO: 205051 - protein, 9 aa, Homo Sapiens
PDKKASHHI

SEQ ID NO: 205052 - protein, 9 aa, Homo Sapiens
RKALWQLLS

SEQ ID NO: 205053 - protein, 9 aa, Homo Sapiens
PQRGPRPLH

SEQ ID NO: 205054 - protein, 9 aa, Homo Sapiens
CTLGATVDA

SEQ ID NO: 205055 - protein, 9 aa, Homo Sapiens
LHTWAASIY

SEQ ID NO: 205056 - protein, 9 aa, Homo Sapiens
ALPELAKVE

SEQ ID NO: 205057 - protein, 9 aa, Homo Sapiens
DAAHAVGKI

SEQ ID NO: 205058 - protein, 9 aa, Homo Sapiens
MEGRPQIPT

SEQ ID NO: 205059 - protein, 9 aa, Homo Sapiens
NMTSEERQC

SEQ ID NO: 205060 - protein, 9 aa, Homo Sapiens
MESIKCLYP

SEQ ID NO: 205061 - protein, 9 aa, Homo Sapiens
KRPFPHLCN

SEQ ID NO: 205062 - protein, 9 aa, Homo Sapiens
CCRRRRLGS

SEQ ID NO: 205063 - protein, 9 aa, Homo Sapiens
FFQEPASAM

SEQ ID NO: 205064 - protein, 9 aa, Homo Sapiens
DKTKETVSI

SEQ ID NO: 205065 - protein, 9 aa, Homo Sapiens
ESVAHSSKL

SEQ ID NO: 205066 - protein, 9 aa, Homo Sapiens
RLWGVHKCK

SEQ ID NO: 205067 - protein, 9 aa, Homo Sapiens
MKASVKEGD

SEQ ID NO: 205068 - protein, 9 aa, Homo Sapiens
AHGYHRFLP

SEQ ID NO: 205069 - protein, 9 aa, Homo Sapiens
CSPLLRQSS

SEQ ID NO: 205070 - protein, 9 aa, Homo Sapiens
HCRARQDSL

SEQ ID NO: 205071 - protein, 9 aa, Homo Sapiens
NKSENLLFV

SEQ ID NO: 205072 - protein, 9 aa, Homo Sapiens
KKMLSLTHL

SEQ ID NO: 205073 - protein, 9 aa, Homo Sapiens
AECTGPLLI

SEQ ID NO: 205074 - protein, 9 aa, Homo Sapiens
IAQARDQLR

SEQ ID NO: 205075 - protein, 9 aa, Homo Sapiens
LYYKSAVEQ

SEQ ID NO: 205076 - protein, 9 aa, Homo Sapiens
DLERGTHLP

SEQ ID NO: 205077 - protein, 9 aa, Homo Sapiens
DRGLVCPYM

SEQ ID NO: 205078 - protein, 9 aa, Homo Sapiens
SMEEHVIPT

SEQ ID NO: 205079 - protein, 9 aa, Homo Sapiens
MTSHSMEEC

SEQ ID NO: 205080 - protein, 9 aa, Homo Sapiens
FSHHTVISV

SEQ ID NO: 205081 - protein, 9 aa, Homo Sapiens
TLVKDFHMD

SEQ ID NO: 205082 - protein, 9 aa, Homo Sapiens
SLAFPPPEC

SEQ ID NO: 205083 - protein, 9 aa, Homo Sapiens
YQYHSLDMI

SEQ ID NO: 205084 - protein, 9 aa, Homo Sapiens
RHGQSLALH

SEQ ID NO: 205085 - protein, 9 aa, Homo Sapiens
TAHAIQRKP

SEQ ID NO: 205086 - protein, 9 aa, Homo Sapiens
LVDEFALED

SEQ ID NO: 205087 - protein, 9 aa, Homo Sapiens
SVAGNQEVA

SEQ ID NO: 205088 - protein, 9 aa, Homo Sapiens
LVASKLPLL

SEQ ID NO: 205089 - protein, 9 aa, Homo Sapiens
YLTKHKQIH

SEQ ID NO: 205090 - protein, 9 aa, Homo Sapiens
GLCGGSSYS

SEQ ID NO: 205091 - protein, 9 aa, Homo Sapiens
RLSLSWALG

SEQ ID NO: 205092 - protein, 9 aa, Homo Sapiens
FGFKAFVES

SEQ ID NO: 205093 - protein, 9 aa, Homo Sapiens
YPERKGSPM

SEQ ID NO: 205094 - protein, 9 aa, Homo Sapiens
NHGFPGQDG

SEQ ID NO: 205095 - protein, 9 aa, Homo Sapiens
SYHCAMNNK

SEQ ID NO: 205096 - protein, 9 aa, Homo Sapiens
RLCLPGREC

SEQ ID NO: 205097 - protein, 9 aa, Homo Sapiens
QYAMLYSQG

SEQ ID NO: 205098 - protein, 9 aa, Homo Sapiens
EALANPITE

SEQ ID NO: 205099 - protein, 9 aa, Homo Sapiens
TSRATGLFS

SEQ ID NO: 205100 - protein, 9 aa, Homo Sapiens
ELTGLHHSL

SEQ ID NO: 205101 - protein, 9 aa, Homo Sapiens
DFLRLPLEH

SEQ ID NO: 205102 - protein, 9 aa, Homo Sapiens
DKARVEIQN

SEQ ID NO: 205103 - protein, 9 aa, Homo Sapiens
VPGGVGPMI

SEQ ID NO: 205104 - protein, 9 aa, Homo Sapiens
GERCLTQSW

SEQ ID NO: 205105 - protein, 9 aa, Homo Sapiens
TAIHQVPLI

SEQ ID NO: 205106 - protein, 9 aa, Homo Sapiens
DNITTARGV

SEQ ID NO: 205107 - protein, 9 aa, Homo Sapiens
GGGRFGGGG

SEQ ID NO: 205108 - protein, 9 aa, Homo Sapiens
LDYGGGYGG

SEQ ID NO: 205109 - protein, 9 aa, Homo Sapiens
ARRLLGVDS

SEQ ID NO: 205110 - protein, 9 aa, Homo Sapiens
VAVAARQET

SEQ ID NO: 205111 - protein, 9 aa, Homo Sapiens
QCGLSFGNK

SEQ ID NO: 205112 - protein, 9 aa, Homo Sapiens
ATGGCQGGR

SEQ ID NO: 205113 - protein, 9 aa, Homo Sapiens
PRLVSGYRH

SEQ ID NO: 205114 - protein, 9 aa, Homo Sapiens
FLQPHLDVV

SEQ ID NO: 205115 - protein, 9 aa, Homo Sapiens
ALCRLGRQR

SEQ ID NO: 205116 - protein, 9 aa, Homo Sapiens
AVFWLCVGK

SEQ ID NO: 205117 - protein, 9 aa, Homo Sapiens
LLATHVGSI

SEQ ID NO: 205118 - protein, 9 aa, Homo Sapiens
ENVLAVSTK

SEQ ID NO: 205119 - protein, 9 aa, Homo Sapiens
PKYASLGAP

SEQ ID NO: 205120 - protein, 9 aa, Homo Sapiens
FAIVLQMLK

SEQ ID NO: 205121 - protein, 9 aa, Homo Sapiens
KRSWSTCGD

SEQ ID NO: 205122 - protein, 9 aa, Homo Sapiens
PHEEFLNSR

SEQ ID NO: 205123 - protein, 9 aa, Homo Sapiens
TINGHLDSY

SEQ ID NO: 205124 - protein, 9 aa, Homo Sapiens
LVSVRAYYK

SEQ ID NO: 205125 - protein, 9 aa, Homo Sapiens
EDTSGKPFG

SEQ ID NO: 205126 - protein, 9 aa, Homo Sapiens
EVLFTTDLI

SEQ ID NO: 205127 - protein, 9 aa, Homo Sapiens
ESIQENVRE

SEQ ID NO: 205128 - protein, 9 aa, Homo Sapiens
NCYRGGGRY

SEQ ID NO: 205129 - protein, 9 aa, Homo Sapiens
LCEKIRSFV

SEQ ID NO: 205130 - protein, 9 aa, Homo Sapiens
TRRTGLSDG

SEQ ID NO: 205131 - protein, 9 aa, Homo Sapiens
STETLQQVN

SEQ ID NO: 205132 - protein, 9 aa, Homo Sapiens
NTAIIEVTT

SEQ ID NO: 205133 - protein, 9 aa, Homo Sapiens
QPPSSELHY

SEQ ID NO: 205134 - protein, 9 aa, Homo Sapiens
SNRQAHKIQ

SEQ ID NO: 205135 - protein, 9 aa, Homo Sapiens
THLFSMESP

SEQ ID NO: 205136 - protein, 9 aa, Homo Sapiens
YISNHALAE

SEQ ID NO: 205137 - protein, 9 aa, Homo Sapiens
WQLLSGVSS

SEQ ID NO: 205138 - protein, 9 aa, Homo Sapiens
GGCRVPRRD

SEQ ID NO: 205139 - protein, 9 aa, Homo Sapiens
RSAACGGRE

SEQ ID NO: 205140 - protein, 9 aa, Homo Sapiens
FGDFACCLV

SEQ ID NO: 205141 - protein, 9 aa, Homo Sapiens
ANLQSKSEN

SEQ ID NO: 205142 - protein, 9 aa, Homo Sapiens
LDAPQQMYS

SEQ ID NO: 205143 - protein, 9 aa, Homo Sapiens
SLQSLPRGT

SEQ ID NO: 205144 - protein, 9 aa, Homo Sapiens
EVLTELGLH

SEQ ID NO: 205145 - protein, 9 aa, Homo Sapiens
PQSPQGGTS

SEQ ID NO: 205146 - protein, 9 aa, Homo Sapiens
LQWWCRKTH

SEQ ID NO: 205147 - protein, 9 aa, Homo Sapiens
QVPLRDLSV

SEQ ID NO: 205148 - protein, 9 aa, Homo Sapiens
VLHTEQPGP

SEQ ID NO: 205149 - protein, 9 aa, Homo Sapiens
YTEKDRQFQ

SEQ ID NO: 205150 - protein, 9 aa, Homo Sapiens
GSVVACAYD

SEQ ID NO: 205151 - protein, 9 aa, Homo Sapiens
VSHNKGHKS

SEQ ID NO: 205152 - protein, 9 aa, Homo Sapiens
GVDTHLFSM

SEQ ID NO: 205153 - protein, 9 aa, Homo Sapiens
QPTVVGEEL

SEQ ID NO: 205154 - protein, 9 aa, Homo Sapiens
LKPGEQRCF

SEQ ID NO: 205155 - protein, 9 aa, Homo Sapiens
GLCALVGSE

SEQ ID NO: 205156 - protein, 9 aa, Homo Sapiens
PCQKTKGAY

SEQ ID NO: 205157 - protein, 9 aa, Homo Sapiens
IGDTANYTC

SEQ ID NO: 205158 - protein, 9 aa, Homo Sapiens
HVLVTGSVG

SEQ ID NO: 205159 - protein, 9 aa, Homo Sapiens
PWETPGRLE

SEQ ID NO: 205160 - protein, 9 aa, Homo Sapiens
VIFRSIPYK

SEQ ID NO: 205161 - protein, 9 aa, Homo Sapiens
EAQAQLQLL

SEQ ID NO: 205162 - protein, 9 aa, Homo Sapiens
SALKELEHE

SEQ ID NO: 205163 - protein, 9 aa, Homo Sapiens
LVYFPPFRL

SEQ ID NO: 205164 - protein, 9 aa, Homo Sapiens
ILLPGLLAY

SEQ ID NO: 205165 - protein, 9 aa, Homo Sapiens
SVLGVTVMR

SEQ ID NO: 205166 - protein, 9 aa, Homo Sapiens
FSMLMHSSS

SEQ ID NO: 205167 - protein, 9 aa, Homo Sapiens
PYSHHLQGE

SEQ ID NO: 205168 - protein, 9 aa, Homo Sapiens
MNLVVLPDS

SEQ ID NO: 205169 - protein, 9 aa, Homo Sapiens
KPWETPGRL

SEQ ID NO: 205170 - protein, 9 aa, Homo Sapiens
EDTGTAHAI

SEQ ID NO: 205171 - protein, 9 aa, Homo Sapiens
RHSSYSYCG

SEQ ID NO: 205172 - protein, 9 aa, Homo Sapiens
LKDRHMENL

SEQ ID NO: 205173 - protein, 9 aa, Homo Sapiens
HFQARKKQK

SEQ ID NO: 205174 - protein, 9 aa, Homo Sapiens
PVSSPMNPG

SEQ ID NO: 205175 - protein, 9 aa, Homo Sapiens
PLGPARTGL

SEQ ID NO: 205176 - protein, 9 aa, Homo Sapiens
TTFSESRIL

SEQ ID NO: 205177 - protein, 9 aa, Homo Sapiens
LKKKIYKKK

SEQ ID NO: 205178 - protein, 9 aa, Homo Sapiens
IYQRQPEYR

SEQ ID NO: 205179 - protein, 9 aa, Homo Sapiens
INTFSGIVR

SEQ ID NO: 205180 - protein, 9 aa, Homo Sapiens
SIGMLLSNA

SEQ ID NO: 205181 - protein, 9 aa, Homo Sapiens
FPMNFITAY

SEQ ID NO: 205182 - protein, 9 aa, Homo Sapiens
ERQIERKHL

SEQ ID NO: 205183 - protein, 9 aa, Homo Sapiens
KRSCLVDSL

SEQ ID NO: 205184 - protein, 9 aa, Homo Sapiens
ANYRRCQRA

SEQ ID NO: 205185 - protein, 9 aa, Homo Sapiens
AGSGVAKIH

SEQ ID NO: 205186 - protein, 9 aa, Homo Sapiens
TLRSTDAVV

SEQ ID NO: 205187 - protein, 9 aa, Homo Sapiens
RETNRLLQE

SEQ ID NO: 205188 - protein, 9 aa, Homo Sapiens
GIMHRDLKP

SEQ ID NO: 205189 - protein, 9 aa, Homo Sapiens
ENEKQQRAE

SEQ ID NO: 205190 - protein, 9 aa, Homo Sapiens
CKGFFRQTI

SEQ ID NO: 205191 - protein, 9 aa, Homo Sapiens
CNHCACRLV

SEQ ID NO: 205192 - protein, 9 aa, Homo Sapiens
GRPKNATSE

SEQ ID NO: 205193 - protein, 9 aa, Homo Sapiens
FSMESPQEL

SEQ ID NO: 205194 - protein, 9 aa, Homo Sapiens
LWTNDGGEL

SEQ ID NO: 205195 - protein, 9 aa, Homo Sapiens
RVPSTIVWR

SEQ ID NO: 205196 - protein, 9 aa, Homo Sapiens
RLFPPRQLN

SEQ ID NO: 205197 - protein, 9 aa, Homo Sapiens
PPRPAAGHC

SEQ ID NO: 205198 - protein, 9 aa, Homo Sapiens
EDAGEYMCL

SEQ ID NO: 205199 - protein, 9 aa, Homo Sapiens
LPEPVLWTN

SEQ ID NO: 205200 - protein, 9 aa, Homo Sapiens
LEATLQRAK

SEQ ID NO: 205201 - protein, 9 aa, Homo Sapiens
KGDILRIQD

SEQ ID NO: 205202 - protein, 9 aa, Homo Sapiens
PHADPGPEA

SEQ ID NO: 205203 - protein, 9 aa, Homo Sapiens
GSLFQSTNA

SEQ ID NO: 205204 - protein, 9 aa, Homo Sapiens
ACRWGKRKN

SEQ ID NO: 205205 - protein, 9 aa, Homo Sapiens
FVHCIIPNE

SEQ ID NO: 205206 - protein, 9 aa, Homo Sapiens
QPGYDRHSA

SEQ ID NO: 205207 - protein, 9 aa, Homo Sapiens
SAGGPKVGV

SEQ ID NO: 205208 - protein, 9 aa, Homo Sapiens
VLAMSLHFM

SEQ ID NO: 205209 - protein, 9 aa, Homo Sapiens
WPALDARPS

SEQ ID NO: 205210 - protein, 9 aa, Homo Sapiens
SVHWSETSV

SEQ ID NO: 205211 - protein, 9 aa, Homo Sapiens
AENIGYDLE

SEQ ID NO: 205212 - protein, 9 aa, Homo Sapiens
PSGHRLQAF

SEQ ID NO: 205213 - protein, 9 aa, Homo Sapiens
AAICHPLLY

SEQ ID NO: 205214 - protein, 9 aa, Homo Sapiens
VVSYSNATN

SEQ ID NO: 205215 - protein, 9 aa, Homo Sapiens
EGERCLTQS

SEQ ID NO: 205216 - protein, 9 aa, Homo Sapiens
GLFAGFLPW

SEQ ID NO: 205217 - protein, 9 aa, Homo Sapiens
MPGFSTRRG

SEQ ID NO: 205218 - protein, 9 aa, Homo Sapiens
RYKSYSPYG

SEQ ID NO: 205219 - protein, 9 aa, Homo Sapiens
RPIKKLGEH

SEQ ID NO: 205220 - protein, 9 aa, Homo Sapiens
PQTTEILHH

SEQ ID NO: 205221 - protein, 9 aa, Homo Sapiens
SAPPPPLPP

SEQ ID NO: 205222 - protein, 9 aa, Homo Sapiens
PPGAASSPA

SEQ ID NO: 205223 - protein, 9 aa, Homo Sapiens
ELLPTSTAT

SEQ ID NO: 205224 - protein, 9 aa, Homo Sapiens
ACRTWSQKR

SEQ ID NO: 205225 - protein, 9 aa, Homo Sapiens
KAEALIYQI

SEQ ID NO: 205226 - protein, 9 aa, Homo Sapiens
SSYLTKHKQ

SEQ ID NO: 205227 - protein, 9 aa, Homo Sapiens
NKEHESSSE

SEQ ID NO: 205228 - protein, 9 aa, Homo Sapiens
EGNPDWLQG

SEQ ID NO: 205229 - protein, 9 aa, Homo Sapiens
NDGNSYHLQ

SEQ ID NO: 205230 - protein, 9 aa, Homo Sapiens
PSRAHCPAN

SEQ ID NO: 205231 - protein, 9 aa, Homo Sapiens
VVRRVINSA

SEQ ID NO: 205232 - protein, 9 aa, Homo Sapiens
CSTVADIKR

SEQ ID NO: 205233 - protein, 9 aa, Homo Sapiens
RLQAILQNQ

SEQ ID NO: 205234 - protein, 9 aa, Homo Sapiens
ATREDRPFC

SEQ ID NO: 205235 - protein, 9 aa, Homo Sapiens
NMTFVTSGE

SEQ ID NO: 205236 - protein, 9 aa, Homo Sapiens
ALCSKYEAL

SEQ ID NO: 205237 - protein, 9 aa, Homo Sapiens
QNRSAQIAK

SEQ ID NO: 205238 - protein, 9 aa, Homo Sapiens
LPSLLRSGF

SEQ ID NO: 205239 - protein, 9 aa, Homo Sapiens
SLSWALGSR

SEQ ID NO: 205240 - protein, 9 aa, Homo Sapiens
ILTLPHVLS

SEQ ID NO: 205241 - protein, 9 aa, Homo Sapiens
LHNKPYSKK

SEQ ID NO: 205242 - protein, 9 aa, Homo Sapiens
ISDKQQSTM

SEQ ID NO: 205243 - protein, 9 aa, Homo Sapiens
GGQVPLRDL

SEQ ID NO: 205244 - protein, 9 aa, Homo Sapiens
VSGVTILFD

SEQ ID NO: 205245 - protein, 9 aa, Homo Sapiens
SVILSIWCP

SEQ ID NO: 205246 - protein, 9 aa, Homo Sapiens
LWFEVHDIS

SEQ ID NO: 205247 - protein, 9 aa, Homo Sapiens
RLHSLDSGI

SEQ ID NO: 205248 - protein, 9 aa, Homo Sapiens
FPKFFTFRT

SEQ ID NO: 205249 - protein, 9 aa, Homo Sapiens
DALPEDHDT

SEQ ID NO: 205250 - protein, 9 aa, Homo Sapiens
GGRFGGGGG

SEQ ID NO: 205251 - protein, 9 aa, Homo Sapiens
RAYSNLQRL

SEQ ID NO: 205252 - protein, 9 aa, Homo Sapiens
EDRKHQQRI

SEQ ID NO: 205253 - protein, 9 aa, Homo Sapiens
HKHRGNPSR

SEQ ID NO: 205254 - protein, 9 aa, Homo Sapiens
LSLRFLENV

SEQ ID NO: 205255 - protein, 9 aa, Homo Sapiens
VAKQCAAPK

SEQ ID NO: 205256 - protein, 9 aa, Homo Sapiens
ESGRPGQPG

SEQ ID NO: 205257 - protein, 9 aa, Homo Sapiens
CEQLLQCFR

SEQ ID NO: 205258 - protein, 9 aa, Homo Sapiens
LTFSEDARF

SEQ ID NO: 205259 - protein, 9 aa, Homo Sapiens
LTFTAARHV

SEQ ID NO: 205260 - protein, 9 aa, Homo Sapiens
GMELEFKCL

SEQ ID NO: 205261 - protein, 9 aa, Homo Sapiens
KAVYHIRNM

SEQ ID NO: 205262 - protein, 9 aa, Homo Sapiens
HHHPPQHNH

SEQ ID NO: 205263 - protein, 9 aa, Homo Sapiens
RNPPLFALD

SEQ ID NO: 205264 - protein, 9 aa, Homo Sapiens
QCVDGEWPT

SEQ ID NO: 205265 - protein, 9 aa, Homo Sapiens
CGQFDGLME

SEQ ID NO: 205266 - protein, 9 aa, Homo Sapiens
MGIQNESFM

SEQ ID NO: 205267 - protein, 9 aa, Homo Sapiens
HVRPMARSS

SEQ ID NO: 205268 - protein, 9 aa, Homo Sapiens
TAAFQNSFG

SEQ ID NO: 205269 - protein, 9 aa, Homo Sapiens
MDRIVEMFM

SEQ ID NO: 205270 - protein, 9 aa, Homo Sapiens
SLPRAYTCF

SEQ ID NO: 205271 - protein, 9 aa, Homo Sapiens
LRVSYIKAV

SEQ ID NO: 205272 - protein, 9 aa, Homo Sapiens
SRLYYIDAD

SEQ ID NO: 205273 - protein, 9 aa, Homo Sapiens
LSTDTDGWV

SEQ ID NO: 205274 - protein, 9 aa, Homo Sapiens
KMLSDQKRE

SEQ ID NO: 205275 - protein, 9 aa, Homo Sapiens
FCEQRFIEK

SEQ ID NO: 205276 - protein, 9 aa, Homo Sapiens
VVVKERLQQ

SEQ ID NO: 205277 - protein, 9 aa, Homo Sapiens
SISGEEARL

SEQ ID NO: 205278 - protein, 9 aa, Homo Sapiens
ILCTCSATH

SEQ ID NO: 205279 - protein, 9 aa, Homo Sapiens
GAKFPIKWM

SEQ ID NO: 205280 - protein, 9 aa, Homo Sapiens
VLTARRVHE

SEQ ID NO: 205281 - protein, 9 aa, Homo Sapiens
NPSRMDRIV

SEQ ID NO: 205282 - protein, 9 aa, Homo Sapiens
QEFLYKTVG

SEQ ID NO: 205283 - protein, 9 aa, Homo Sapiens
MEDESAKAK

SEQ ID NO: 205284 - protein, 9 aa, Homo Sapiens
VKLSYSVRE

SEQ ID NO: 205285 - protein, 9 aa, Homo Sapiens
DIGDTANYT

SEQ ID NO: 205286 - protein, 9 aa, Homo Sapiens
FNMSHCQLV

SEQ ID NO: 205287 - protein, 9 aa, Homo Sapiens
ILYLVVAGL

SEQ ID NO: 205288 - protein, 9 aa, Homo Sapiens
GVKRYAAEM

SEQ ID NO: 205289 - protein, 9 aa, Homo Sapiens
QGETGPNVC

SEQ ID NO: 205290 - protein, 9 aa, Homo Sapiens
AQPLDPKRP

SEQ ID NO: 205291 - protein, 9 aa, Homo Sapiens
REECGVHVE

SEQ ID NO: 205292 - protein, 9 aa, Homo Sapiens
PQPSTAPQR

SEQ ID NO: 205293 - protein, 9 aa, Homo Sapiens
ETTTSMEEH

SEQ ID NO: 205294 - protein, 9 aa, Homo Sapiens
SDNEDDDDD

SEQ ID NO: 205295 - protein, 9 aa, Homo Sapiens
VGHLFTIGR

SEQ ID NO: 205296 - protein, 9 aa, Homo Sapiens
MIDYRHFVS

SEQ ID NO: 205297 - protein, 9 aa, Homo Sapiens
RSPPPIMTD

SEQ ID NO: 205298 - protein, 9 aa, Homo Sapiens
MWSFTEGRV

SEQ ID NO: 205299 - protein, 9 aa, Homo Sapiens
PFCCGQCGR

SEQ ID NO: 205300 - protein, 9 aa, Homo Sapiens
HKAQQHIET

SEQ ID NO: 205301 - protein, 9 aa, Homo Sapiens
PSKSSPQAW

SEQ ID NO: 205302 - protein, 9 aa, Homo Sapiens
IGTLLAYLL

SEQ ID NO: 205303 - protein, 9 aa, Homo Sapiens
VDWLVLAVK

SEQ ID NO: 205304 - protein, 9 aa, Homo Sapiens
MHALHIEDL

SEQ ID NO: 205305 - protein, 9 aa, Homo Sapiens
TASSDGTCA

SEQ ID NO: 205306 - protein, 9 aa, Homo Sapiens
FVDSVSEFC

SEQ ID NO: 205307 - protein, 9 aa, Homo Sapiens
HLWDTYQSE

SEQ ID NO: 205308 - protein, 9 aa, Homo Sapiens
TPSSLVYTS

SEQ ID NO: 205309 - protein, 9 aa, Homo Sapiens
AVLMTFFTG

SEQ ID NO: 205310 - protein, 9 aa, Homo Sapiens
TDPYELGDD

SEQ ID NO: 205311 - protein, 9 aa, Homo Sapiens
IPSNPSHCI

SEQ ID NO: 205312 - protein, 9 aa, Homo Sapiens
EGKQLPPCI

SEQ ID NO: 205313 - protein, 9 aa, Homo Sapiens
KCNDCNMTF

SEQ ID NO: 205314 - protein, 9 aa, Homo Sapiens
VPRRDIEDI

SEQ ID NO: 205315 - protein, 9 aa, Homo Sapiens
PGEQRCFAR

SEQ ID NO: 205316 - protein, 9 aa, Homo Sapiens
SAVVWAKIL

SEQ ID NO: 205317 - protein, 9 aa, Homo Sapiens
AANELRRTK

SEQ ID NO: 205318 - protein, 9 aa, Homo Sapiens
TQFDWLSAQ

SEQ ID NO: 205319 - protein, 9 aa, Homo Sapiens
EGCAAVMTS

SEQ ID NO: 205320 - protein, 9 aa, Homo Sapiens
GSSSLPPLL

SEQ ID NO: 205321 - protein, 9 aa, Homo Sapiens
DMGLHGLSG

SEQ ID NO: 205322 - protein, 9 aa, Homo Sapiens
WSLVEYSQD

SEQ ID NO: 205323 - protein, 9 aa, Homo Sapiens
SQQAHSALG

SEQ ID NO: 205324 - protein, 9 aa, Homo Sapiens
ISIWDIAGR

SEQ ID NO: 205325 - protein, 9 aa, Homo Sapiens
YHSLDMIGF

SEQ ID NO: 205326 - protein, 9 aa, Homo Sapiens
APQPLSSSA

SEQ ID NO: 205327 - protein, 9 aa, Homo Sapiens
SQRQSPWHI

SEQ ID NO: 205328 - protein, 9 aa, Homo Sapiens
RRICRWLRR

SEQ ID NO: 205329 - protein, 9 aa, Homo Sapiens
PVPQEPTAR

SEQ ID NO: 205330 - protein, 9 aa, Homo Sapiens
LSVWQESVE

SEQ ID NO: 205331 - protein, 9 aa, Homo Sapiens
SERNEKKER

SEQ ID NO: 205332 - protein, 9 aa, Homo Sapiens
AIQVYWNII

SEQ ID NO: 205333 - protein, 9 aa, Homo Sapiens
TAYAHAEHV

SEQ ID NO: 205334 - protein, 9 aa, Homo Sapiens
VTALPLPDK

SEQ ID NO: 205335 - protein, 9 aa, Homo Sapiens
LEENTEKAI

SEQ ID NO: 205336 - protein, 9 aa, Homo Sapiens
DQYAMLYSQ

SEQ ID NO: 205337 - protein, 9 aa, Homo Sapiens
EARDLQGKD

SEQ ID NO: 205338 - protein, 9 aa, Homo Sapiens
RRTYAAIED

SEQ ID NO: 205339 - protein, 9 aa, Homo Sapiens
FDGLMELAT

SEQ ID NO: 205340 - protein, 9 aa, Homo Sapiens
MGEEPVPHQ

SEQ ID NO: 205341 - protein, 9 aa, Homo Sapiens
QTSRELTGL

SEQ ID NO: 205342 - protein, 9 aa, Homo Sapiens
VSSLQAKMK

SEQ ID NO: 205343 - protein, 9 aa, Homo Sapiens
DDIMGTIKR

SEQ ID NO: 205344 - protein, 9 aa, Homo Sapiens
GMLESIRKE

SEQ ID NO: 205345 - protein, 9 aa, Homo Sapiens
VQISSCMLC

SEQ ID NO: 205346 - protein, 9 aa, Homo Sapiens
VEEDFSVTS

SEQ ID NO: 205347 - protein, 9 aa, Homo Sapiens
AALEAGEDE

SEQ ID NO: 205348 - protein, 9 aa, Homo Sapiens
PHVLDGPGP

SEQ ID NO: 205349 - protein, 9 aa, Homo Sapiens
LPGLELHRA

SEQ ID NO: 205350 - protein, 9 aa, Homo Sapiens
SDSGSTSSG

SEQ ID NO: 205351 - protein, 9 aa, Homo Sapiens
SPYGMLANG

SEQ ID NO: 205352 - protein, 9 aa, Homo Sapiens
WWAANELRR

SEQ ID NO: 205353 - protein, 9 aa, Homo Sapiens
AQNVQCKQE

SEQ ID NO: 205354 - protein, 9 aa, Homo Sapiens
ITLGAEVQW

SEQ ID NO: 205355 - protein, 9 aa, Homo Sapiens
CKVKPREPK

SEQ ID NO: 205356 - protein, 9 aa, Homo Sapiens
LALCRLGRQ

SEQ ID NO: 205357 - protein, 9 aa, Homo Sapiens
GPLRAQEQV

SEQ ID NO: 205358 - protein, 9 aa, Homo Sapiens
RGRCHDHFG

SEQ ID NO: 205359 - protein, 9 aa, Homo Sapiens
SVEVKAKKR

SEQ ID NO: 205360 - protein, 9 aa, Homo Sapiens
QTGPSKQHL

SEQ ID NO: 205361 - protein, 9 aa, Homo Sapiens
AGGLPGTAQ

SEQ ID NO: 205362 - protein, 9 aa, Homo Sapiens
QDPDTLVWW

SEQ ID NO: 205363 - protein, 9 aa, Homo Sapiens
YWKVWPLLL

SEQ ID NO: 205364 - protein, 9 aa, Homo Sapiens
LLKKENLAC

SEQ ID NO: 205365 - protein, 9 aa, Homo Sapiens
DLVRRIKRL

SEQ ID NO: 205366 - protein, 9 aa, Homo Sapiens
QRLPQDDVD

SEQ ID NO: 205367 - protein, 9 aa, Homo Sapiens
NYPPCICDN

SEQ ID NO: 205368 - protein, 9 aa, Homo Sapiens
SYRQQWTYE

SEQ ID NO: 205369 - protein, 9 aa, Homo Sapiens
PKVGVGASK

SEQ ID NO: 205370 - protein, 9 aa, Homo Sapiens
TPVVDWDAC

SEQ ID NO: 205371 - protein, 9 aa, Homo Sapiens
RDVLKQSLV

SEQ ID NO: 205372 - protein, 9 aa, Homo Sapiens
HPGCVHSIC

SEQ ID NO: 205373 - protein, 9 aa, Homo Sapiens
MVSAIKPPH

SEQ ID NO: 205374 - protein, 9 aa, Homo Sapiens
AWVVQGPGR

SEQ ID NO: 205375 - protein, 9 aa, Homo Sapiens
RVTTVADTD

SEQ ID NO: 205376 - protein, 9 aa, Homo Sapiens
LQRALEREL

SEQ ID NO: 205377 - protein, 9 aa, Homo Sapiens
LELGEEVIL

SEQ ID NO: 205378 - protein, 9 aa, Homo Sapiens
GALQPGVHL

SEQ ID NO: 205379 - protein, 9 aa, Homo Sapiens
RTCGNQDYK

SEQ ID NO: 205380 - protein, 9 aa, Homo Sapiens
EGPPVGGQV

SEQ ID NO: 205381 - protein, 9 aa, Homo Sapiens
REWREHSLE

SEQ ID NO: 205382 - protein, 9 aa, Homo Sapiens
FEQGSSDLV

SEQ ID NO: 205383 - protein, 9 aa, Homo Sapiens
KALLSSEDL

SEQ ID NO: 205384 - protein, 9 aa, Homo Sapiens
AIHKEDLQD

SEQ ID NO: 205385 - protein, 9 aa, Homo Sapiens
DFPWSMGED

SEQ ID NO: 205386 - protein, 9 aa, Homo Sapiens
HNMRGQHCQ

SEQ ID NO: 205387 - protein, 9 aa, Homo Sapiens
KLPNHLTGR

SEQ ID NO: 205388 - protein, 9 aa, Homo Sapiens
RSHGKRFSQ

SEQ ID NO: 205389 - protein, 9 aa, Homo Sapiens
AVPHADPGP

SEQ ID NO: 205390 - protein, 9 aa, Homo Sapiens
CIIQDLTET

SEQ ID NO: 205391 - protein, 9 aa, Homo Sapiens
AFQIMPGAG

SEQ ID NO: 205392 - protein, 9 aa, Homo Sapiens
LAEDVRGNP

SEQ ID NO: 205393 - protein, 9 aa, Homo Sapiens
LLVYGITSR

SEQ ID NO: 205394 - protein, 9 aa, Homo Sapiens
FFNKLQEHT

SEQ ID NO: 205395 - protein, 9 aa, Homo Sapiens
KEDLQDGLP

SEQ ID NO: 205396 - protein, 9 aa, Homo Sapiens
TQFDEGWVD

SEQ ID NO: 205397 - protein, 9 aa, Homo Sapiens
QVSAAATRP

SEQ ID NO: 205398 - protein, 9 aa, Homo Sapiens
STGDAGEAL

SEQ ID NO: 205399 - protein, 9 aa, Homo Sapiens
EGEEEEEGG

SEQ ID NO: 205400 - protein, 9 aa, Homo Sapiens
DSYRQQWTY

SEQ ID NO: 205401 - protein, 9 aa, Homo Sapiens
FLEIMAHVY

SEQ ID NO: 205402 - protein, 9 aa, Homo Sapiens
GEKPYCCPH

SEQ ID NO: 205403 - protein, 9 aa, Homo Sapiens
ELNGEDKLV

SEQ ID NO: 205404 - protein, 9 aa, Homo Sapiens
SIPHLFPQR

SEQ ID NO: 205405 - protein, 9 aa, Homo Sapiens
MDVNECEAE

SEQ ID NO: 205406 - protein, 9 aa, Homo Sapiens
LTGVPVRTT

SEQ ID NO: 205407 - protein, 9 aa, Homo Sapiens
ATIILACYF

SEQ ID NO: 205408 - protein, 9 aa, Homo Sapiens
KYASLGAPR

SEQ ID NO: 205409 - protein, 9 aa, Homo Sapiens
GKKMVKEGP

SEQ ID NO: 205410 - protein, 9 aa, Homo Sapiens
AQHHRVHTG

SEQ ID NO: 205411 - protein, 9 aa, Homo Sapiens
SMMLRLSTL

SEQ ID NO: 205412 - protein, 9 aa, Homo Sapiens
ILRGHRQSF

SEQ ID NO: 205413 - protein, 9 aa, Homo Sapiens
NSSPESASH

SEQ ID NO: 205414 - protein, 9 aa, Homo Sapiens
KLVVVGADG

SEQ ID NO: 205415 - protein, 9 aa, Homo Sapiens
SPSTENKHE

SEQ ID NO: 205416 - protein, 9 aa, Homo Sapiens
AGRDSPPGG

SEQ ID NO: 205417 - protein, 9 aa, Homo Sapiens
YETVQHPLD

SEQ ID NO: 205418 - protein, 9 aa, Homo Sapiens
CSGCGKSFS

SEQ ID NO: 205419 - protein, 9 aa, Homo Sapiens
SSCPARVVV

SEQ ID NO: 205420 - protein, 9 aa, Homo Sapiens
KDMLKAHSF

SEQ ID NO: 205421 - protein, 9 aa, Homo Sapiens
LLAHVLGYL

SEQ ID NO: 205422 - protein, 9 aa, Homo Sapiens
NKVGQDEQL

SEQ ID NO: 205423 - protein, 9 aa, Homo Sapiens
ATLATSIKE

SEQ ID NO: 205424 - protein, 9 aa, Homo Sapiens
EEAKCRQAS

SEQ ID NO: 205425 - protein, 9 aa, Homo Sapiens
ARKNRPAGT

SEQ ID NO: 205426 - protein, 9 aa, Homo Sapiens
VTPLKLAGW

SEQ ID NO: 205427 - protein, 9 aa, Homo Sapiens
VHWSETSVE

SEQ ID NO: 205428 - protein, 9 aa, Homo Sapiens
PNGEDSPPH

SEQ ID NO: 205429 - protein, 9 aa, Homo Sapiens
QTSVRCLAT

SEQ ID NO: 205430 - protein, 9 aa, Homo Sapiens
DMQILTASS

SEQ ID NO: 205431 - protein, 9 aa, Homo Sapiens
DVVNQTSSL

SEQ ID NO: 205432 - protein, 9 aa, Homo Sapiens
NATLARETD

SEQ ID NO: 205433 - protein, 9 aa, Homo Sapiens
CYWAQLDET

SEQ ID NO: 205434 - protein, 9 aa, Homo Sapiens
ANELRRTKK

SEQ ID NO: 205435 - protein, 9 aa, Homo Sapiens
KDEKRDIST

SEQ ID NO: 205436 - protein, 9 aa, Homo Sapiens
HCHQQFKYR

SEQ ID NO: 205437 - protein, 9 aa, Homo Sapiens
QDQQAGWRL

SEQ ID NO: 205438 - protein, 9 aa, Homo Sapiens
ASDLIIQHP

SEQ ID NO: 205439 - protein, 9 aa, Homo Sapiens
GCDECTLGA

SEQ ID NO: 205440 - protein, 9 aa, Homo Sapiens
WDVADYIIP

SEQ ID NO: 205441 - protein, 9 aa, Homo Sapiens
LWMIMASAF

SEQ ID NO: 205442 - protein, 9 aa, Homo Sapiens
EYRRRRQQC

SEQ ID NO: 205443 - protein, 9 aa, Homo Sapiens
ALARGVLVG

SEQ ID NO: 205444 - protein, 9 aa, Homo Sapiens
IAVTPLKLA

SEQ ID NO: 205445 - protein, 9 aa, Homo Sapiens
IPHLLGWLV

SEQ ID NO: 205446 - protein, 9 aa, Homo Sapiens
QVVAKILKQ

SEQ ID NO: 205447 - protein, 9 aa, Homo Sapiens
TAMWFCTYM

SEQ ID NO: 205448 - protein, 9 aa, Homo Sapiens
EATKSCRKI

SEQ ID NO: 205449 - protein, 9 aa, Homo Sapiens
TPLLNGLDY

SEQ ID NO: 205450 - protein, 9 aa, Homo Sapiens
TFLGKKERC

SEQ ID NO: 205451 - protein, 9 aa, Homo Sapiens
LGPARTGLL

SEQ ID NO: 205452 - protein, 9 aa, Homo Sapiens
LSNWCNGLL

SEQ ID NO: 205453 - protein, 9 aa, Homo Sapiens
TVKELCRHW

SEQ ID NO: 205454 - protein, 9 aa, Homo Sapiens
GQAHASQGH

SEQ ID NO: 205455 - protein, 9 aa, Homo Sapiens
NNGNHMTDI

SEQ ID NO: 205456 - protein, 9 aa, Homo Sapiens
LELDYNPPW

SEQ ID NO: 205457 - protein, 9 aa, Homo Sapiens
SRHGIWSPG

SEQ ID NO: 205458 - protein, 9 aa, Homo Sapiens
VLQAPAAPA

SEQ ID NO: 205459 - protein, 9 aa, Homo Sapiens
ITAYVMLFE

SEQ ID NO: 205460 - protein, 9 aa, Homo Sapiens
HSRHLISSP

SEQ ID NO: 205461 - protein, 9 aa, Homo Sapiens
AGEALEGHT

SEQ ID NO: 205462 - protein, 9 aa, Homo Sapiens
SSFSRARKA

SEQ ID NO: 205463 - protein, 9 aa, Homo Sapiens
GRVRALNES

SEQ ID NO: 205464 - protein, 9 aa, Homo Sapiens
TCSDCKSRF

SEQ ID NO: 205465 - protein, 9 aa, Homo Sapiens
AVAAADSPA

SEQ ID NO: 205466 - protein, 9 aa, Homo Sapiens
HILENKEFM

SEQ ID NO: 205467 - protein, 9 aa, Homo Sapiens
SFPDHRGLY

SEQ ID NO: 205468 - protein, 9 aa, Homo Sapiens
WSRHCRMLT

SEQ ID NO: 205469 - protein, 9 aa, Homo Sapiens
YKLVVVGAD

SEQ ID NO: 205470 - protein, 9 aa, Homo Sapiens
GASGLPAIS

SEQ ID NO: 205471 - protein, 9 aa, Homo Sapiens
TAILCSDEI

SEQ ID NO: 205472 - protein, 9 aa, Homo Sapiens
HWLFDKKFL

SEQ ID NO: 205473 - protein, 9 aa, Homo Sapiens
AVCQEKQKE

SEQ ID NO: 205474 - protein, 9 aa, Homo Sapiens
CRMLGFRCV

SEQ ID NO: 205475 - protein, 9 aa, Homo Sapiens
ADVIARKLR

SEQ ID NO: 205476 - protein, 9 aa, Homo Sapiens
DPKCLDELP

SEQ ID NO: 205477 - protein, 9 aa, Homo Sapiens
AVYEAVLQS

SEQ ID NO: 205478 - protein, 9 aa, Homo Sapiens
AHSTHVGHA

SEQ ID NO: 205479 - protein, 9 aa, Homo Sapiens
DHFTKAQWK

SEQ ID NO: 205480 - protein, 9 aa, Homo Sapiens
SSKMYPTKG

SEQ ID NO: 205481 - protein, 9 aa, Homo Sapiens
SCSRSFTLD

SEQ ID NO: 205482 - protein, 9 aa, Homo Sapiens
NIGHHCYVI

SEQ ID NO: 205483 - protein, 9 aa, Homo Sapiens
WCGSEEVVV

SEQ ID NO: 205484 - protein, 9 aa, Homo Sapiens
DRLNIYNSV

SEQ ID NO: 205485 - protein, 9 aa, Homo Sapiens
YCTTGQMWV

SEQ ID NO: 205486 - protein, 9 aa, Homo Sapiens
GTDVNIVAK

SEQ ID NO: 205487 - protein, 9 aa, Homo Sapiens
MCYVQKQLA

SEQ ID NO: 205488 - protein, 9 aa, Homo Sapiens
SVSAKPDLP

SEQ ID NO: 205489 - protein, 9 aa, Homo Sapiens
HLLWETWAD

SEQ ID NO: 205490 - protein, 9 aa, Homo Sapiens
KNPSLIPLL

SEQ ID NO: 205491 - protein, 9 aa, Homo Sapiens
LYVTFEMLS

SEQ ID NO: 205492 - protein, 9 aa, Homo Sapiens
DFKFSPVCC

SEQ ID NO: 205493 - protein, 9 aa, Homo Sapiens
KGSHMHIKQ

SEQ ID NO: 205494 - protein, 9 aa, Homo Sapiens
HTVTPTRKR

SEQ ID NO: 205495 - protein, 9 aa, Homo Sapiens
VKPKKDCQN

SEQ ID NO: 205496 - protein, 9 aa, Homo Sapiens
EGKKAFATC

SEQ ID NO: 205497 - protein, 9 aa, Homo Sapiens
NQSSNLTAH

SEQ ID NO: 205498 - protein, 9 aa, Homo Sapiens
KSDGENDFK

SEQ ID NO: 205499 - protein, 9 aa, Homo Sapiens
DLPLFYTPI

SEQ ID NO: 205500 - protein, 9 aa, Homo Sapiens
FEVEEADGH

SEQ ID NO: 205501 - protein, 9 aa, Homo Sapiens
MYVGMMCTA

SEQ ID NO: 205502 - protein, 9 aa, Homo Sapiens
PGTAIRNGV

SEQ ID NO: 205503 - protein, 9 aa, Homo Sapiens
ATELASPLV

SEQ ID NO: 205504 - protein, 9 aa, Homo Sapiens
INGVQNYKL

SEQ ID NO: 205505 - protein, 9 aa, Homo Sapiens
WRDNSLNNP

SEQ ID NO: 205506 - protein, 9 aa, Homo Sapiens
ESNNYIYTT

SEQ ID NO: 205507 - protein, 9 aa, Homo Sapiens
DGWIMLVTT

SEQ ID NO: 205508 - protein, 9 aa, Homo Sapiens
HQNNNLTNF

SEQ ID NO: 205509 - protein, 9 aa, Homo Sapiens
AHILCAVFC

SEQ ID NO: 205510 - protein, 9 aa, Homo Sapiens
ATIKSYDLD

SEQ ID NO: 205511 - protein, 9 aa, Homo Sapiens
VKHNGTKPQ

SEQ ID NO: 205512 - protein, 9 aa, Homo Sapiens
VSIVCSILW

SEQ ID NO: 205513 - protein, 9 aa, Homo Sapiens
GADGVGKSA

SEQ ID NO: 205514 - protein, 9 aa, Homo Sapiens
EYVLRGCKN

SEQ ID NO: 205515 - protein, 9 aa, Homo Sapiens
GASVSAKPD

SEQ ID NO: 205516 - protein, 9 aa, Homo Sapiens
KPLYFPDQL

SEQ ID NO: 205517 - protein, 9 aa, Homo Sapiens
CPWEAVIFK

SEQ ID NO: 205518 - protein, 9 aa, Homo Sapiens
VPGPADRKT

SEQ ID NO: 205519 - protein, 9 aa, Homo Sapiens
STELHTQLA

SEQ ID NO: 205520 - protein, 9 aa, Homo Sapiens
AGIQNIGIW

SEQ ID NO: 205521 - protein, 9 aa, Homo Sapiens
YPLQIPVSS

SEQ ID NO: 205522 - protein, 9 aa, Homo Sapiens
IPPAPDVCK

SEQ ID NO: 205523 - protein, 9 aa, Homo Sapiens
TIKSYDLDP

SEQ ID NO: 205524 - protein, 9 aa, Homo Sapiens
PADRKTGIP

SEQ ID NO: 205525 - protein, 9 aa, Homo Sapiens
SAVPGPADR

SEQ ID NO: 205526 - protein, 9 aa, Homo Sapiens
SILWIHTSE

SEQ ID NO: 205527 - protein, 9 aa, Homo Sapiens
PPPTIPPAP

SEQ ID NO: 205528 - protein, 9 aa, Homo Sapiens
GANATQDEL

SEQ ID NO: 205529 - protein, 9 aa, Homo Sapiens
YVFSGAYVP

SEQ ID NO: 205530 - protein, 9 aa, Homo Sapiens
EETEIIRKY

SEQ ID NO: 205531 - protein, 9 aa, Homo Sapiens
YNEYVLRGC

SEQ ID NO: 205532 - protein, 9 aa, Homo Sapiens
FPDQLYDSM

SEQ ID NO: 205533 - protein, 9 aa, Homo Sapiens
FERAVEHGA

SEQ ID NO: 205534 - protein, 9 aa, Homo Sapiens
LYGHTSTVH

SEQ ID NO: 205535 - protein, 9 aa, Homo Sapiens
KNKLCVLQK

SEQ ID NO: 205536 - protein, 9 aa, Homo Sapiens
TIKEHLELY

SEQ ID NO: 205537 - protein, 9 aa, Homo Sapiens
LLEILQRLC

SEQ ID NO: 205538 - protein, 9 aa, Homo Sapiens
FDKIKVREE

SEQ ID NO: 205539 - protein, 9 aa, Homo Sapiens
DGEDVKHNG

SEQ ID NO: 205540 - protein, 9 aa, Homo Sapiens
STVHCMHLH

SEQ ID NO: 205541 - protein, 9 aa, Homo Sapiens
CYVIPKVTE

SEQ ID NO: 205542 - protein, 9 aa, Homo Sapiens
PTIPPAPDV

SEQ ID NO: 205543 - protein, 9 aa, Homo Sapiens
EEGTDVNIV

SEQ ID NO: 205544 - protein, 9 aa, Homo Sapiens
NKEDKVVGI

SEQ ID NO: 205545 - protein, 9 aa, Homo Sapiens
LTAHKIIYT

SEQ ID NO: 205546 - protein, 9 aa, Homo Sapiens
CSRSFTLDD

SEQ ID NO: 205547 - protein, 9 aa, Homo Sapiens
ADGHKQWWF

SEQ ID NO: 205548 - protein, 9 aa, Homo Sapiens
NISKLQYKE

SEQ ID NO: 205549 - protein, 9 aa, Homo Sapiens
KENFARRQC

SEQ ID NO: 205550 - protein, 9 aa, Homo Sapiens
LSSKMYPTK

SEQ ID NO: 205551 - protein, 9 aa, Homo Sapiens
PLYFPDQLY

SEQ ID NO: 205552 - protein, 9 aa, Homo Sapiens
EQTKNKLCV

SEQ ID NO: 205553 - protein, 9 aa, Homo Sapiens
PVPLDALSI

SEQ ID NO: 205554 - protein, 9 aa, Homo Sapiens
WKNISVWCK

SEQ ID NO: 205555 - protein, 9 aa, Homo Sapiens
ADRKTGIPT

SEQ ID NO: 205556 - protein, 9 aa, Homo Sapiens
SEEVVVVLQ

SEQ ID NO: 205557 - protein, 9 aa, Homo Sapiens
LNCIDRLNI

SEQ ID NO: 205558 - protein, 9 aa, Homo Sapiens
SMIIDTQIS

SEQ ID NO: 205559 - protein, 9 aa, Homo Sapiens
GVQNYKLIK

SEQ ID NO: 205560 - protein, 9 aa, Homo Sapiens
KLTIKEHLE

SEQ ID NO: 205561 - protein, 9 aa, Homo Sapiens
GKKAFATCA

SEQ ID NO: 205562 - protein, 9 aa, Homo Sapiens
AEGKKAFAT

SEQ ID NO: 205563 - protein, 9 aa, Homo Sapiens
YWGWATIKS

SEQ ID NO: 205564 - protein, 9 aa, Homo Sapiens
HYACEMKNP

SEQ ID NO: 205565 - protein, 9 aa, Homo Sapiens
IFTVSICQV

SEQ ID NO: 205566 - protein, 9 aa, Homo Sapiens
IDECECNPL

SEQ ID NO: 205567 - protein, 9 aa, Homo Sapiens
EGTDVNIVA

SEQ ID NO: 205568 - protein, 9 aa, Homo Sapiens
ELASPLVPF

SEQ ID NO: 205569 - protein, 9 aa, Homo Sapiens
EGFPQYPLQ

SEQ ID NO: 205570 - protein, 9 aa, Homo Sapiens
DEVFHFFSV

SEQ ID NO: 205571 - protein, 9 aa, Homo Sapiens
DVNIVAKIK

SEQ ID NO: 205572 - protein, 9 aa, Homo Sapiens
HNGTKPQRA

SEQ ID NO: 205573 - protein, 9 aa, Homo Sapiens
KQKVLVNEK

SEQ ID NO: 205574 - protein, 9 aa, Homo Sapiens
EVFHFFSVL

SEQ ID NO: 205575 - protein, 9 aa, Homo Sapiens
QNYKLIKSQ

SEQ ID NO: 205576 - protein, 9 aa, Homo Sapiens
FFSVLASHS

SEQ ID NO: 205577 - protein, 9 aa, Homo Sapiens
KDGWIMLVT

SEQ ID NO: 205578 - protein, 9 aa, Homo Sapiens
IIGKSRFGE

SEQ ID NO: 205579 - protein, 9 aa, Homo Sapiens
SHEKNLVIV

SEQ ID NO: 205580 - protein, 9 aa, Homo Sapiens
PLSEITKQE

SEQ ID NO: 205581 - protein, 9 aa, Homo Sapiens
KNHASQKQK

SEQ ID NO: 205582 - protein, 9 aa, Homo Sapiens
QDILPRHIQ

SEQ ID NO: 205583 - protein, 9 aa, Homo Sapiens
FARRQCLAQ

SEQ ID NO: 205584 - protein, 9 aa, Homo Sapiens
VQKQLAPHS

SEQ ID NO: 205585 - protein, 9 aa, Homo Sapiens
DKIKVREEE

SEQ ID NO: 205586 - protein, 9 aa, Homo Sapiens
HKQWWFGGG

SEQ ID NO: 205587 - protein, 9 aa, Homo Sapiens
DYIVHLLWE

SEQ ID NO: 205588 - protein, 9 aa, Homo Sapiens
VVVGADGVG

SEQ ID NO: 205589 - protein, 9 aa, Homo Sapiens
KNVYYKHCW

SEQ ID NO: 205590 - protein, 9 aa, Homo Sapiens
SKELMSCHD

SEQ ID NO: 205591 - protein, 9 aa, Homo Sapiens
RLQPGLGDA

SEQ ID NO: 205592 - protein, 9 aa, Homo Sapiens
EKVMPICLP

SEQ ID NO: 205593 - protein, 9 aa, Homo Sapiens
QLDRIVKGS

SEQ ID NO: 205594 - protein, 9 aa, Homo Sapiens
STCEDVNEC

SEQ ID NO: 205595 - protein, 9 aa, Homo Sapiens
TECGKAFNS

SEQ ID NO: 205596 - protein, 9 aa, Homo Sapiens
SFEAVKDQC

SEQ ID NO: 205597 - protein, 9 aa, Homo Sapiens
CHRETRLSF

SEQ ID NO: 205598 - protein, 9 aa, Homo Sapiens
MLGHGLYVT

SEQ ID NO: 205599 - protein, 9 aa, Homo Sapiens
TQISNALNA

SEQ ID NO: 205600 - protein, 9 aa, Homo Sapiens
GWATIKSYD

SEQ ID NO: 205601 - protein, 9 aa, Homo Sapiens
MVCANKEDK

SEQ ID NO: 205602 - protein, 9 aa, Homo Sapiens
EKKGSHMHI

SEQ ID NO: 205603 - protein, 9 aa, Homo Sapiens
LQWEIRMAQ

SEQ ID NO: 205604 - protein, 9 aa, Homo Sapiens
SKLQYKEQN

SEQ ID NO: 205605 - protein, 9 aa, Homo Sapiens
HLCSVVIDR

SEQ ID NO: 205606 - protein, 9 aa, Homo Sapiens
WYDCHRETR

SEQ ID NO: 205607 - protein, 9 aa, Homo Sapiens
QRKKTLQFA

SEQ ID NO: 205608 - protein, 9 aa, Homo Sapiens
SSCSRSFTL

SEQ ID NO: 205609 - protein, 9 aa, Homo Sapiens
YPTKGQEGS

SEQ ID NO: 205610 - protein, 9 aa, Homo Sapiens
AFTSHSHLI

SEQ ID NO: 205611 - protein, 9 aa, Homo Sapiens
QAKEMITKE

SEQ ID NO: 205612 - protein, 9 aa, Homo Sapiens
VFLGFAVSK

SEQ ID NO: 205613 - protein, 9 aa, Homo Sapiens
IDRLNIYNS

SEQ ID NO: 205614 - protein, 9 aa, Homo Sapiens
MEKKGSHMH

SEQ ID NO: 205615 - protein, 9 aa, Homo Sapiens
GLYVTFEML

SEQ ID NO: 205616 - protein, 9 aa, Homo Sapiens
GLHHGHHTG

SEQ ID NO: 205617 - protein, 9 aa, Homo Sapiens
FLSLSSFIL

SEQ ID NO: 205618 - protein, 9 aa, Homo Sapiens
PGPADRKTG

SEQ ID NO: 205619 - protein, 9 aa, Homo Sapiens
EVVVVLQES

SEQ ID NO: 205620 - protein, 9 aa, Homo Sapiens
RNSTCEDVN

SEQ ID NO: 205621 - protein, 9 aa, Homo Sapiens
TVSICQVHK

SEQ ID NO: 205622 - protein, 9 aa, Homo Sapiens
ELMSCHDES

SEQ ID NO: 205623 - protein, 9 aa, Homo Sapiens
VDFKTRWLM

SEQ ID NO: 205624 - protein, 9 aa, Homo Sapiens
IDIIVFATE

SEQ ID NO: 205625 - protein, 9 aa, Homo Sapiens
VFLKIQDIL

SEQ ID NO: 205626 - protein, 9 aa, Homo Sapiens
RSHAIFTVS

SEQ ID NO: 205627 - protein, 9 aa, Homo Sapiens
SLTSELRSK

SEQ ID NO: 205628 - protein, 9 aa, Homo Sapiens
LLWETWADL

SEQ ID NO: 205629 - protein, 9 aa, Homo Sapiens
EAWTLRKPF

SEQ ID NO: 205630 - protein, 9 aa, Homo Sapiens
NEYVLRGCK

SEQ ID NO: 205631 - protein, 9 aa, Homo Sapiens
EQLTLGHLL

SEQ ID NO: 205632 - protein, 9 aa, Homo Sapiens
GNSNSQYTL

SEQ ID NO: 205633 - protein, 9 aa, Homo Sapiens
SSSCSRSFT

SEQ ID NO: 205634 - protein, 9 aa, Homo Sapiens
LCAGFPDGG

SEQ ID NO: 205635 - protein, 9 aa, Homo Sapiens
TLQFAQWWK

SEQ ID NO: 205636 - protein, 9 aa, Homo Sapiens
NKTPGSQVF

SEQ ID NO: 205637 - protein, 9 aa, Homo Sapiens
KMTQVTTQL

SEQ ID NO: 205638 - protein, 9 aa, Homo Sapiens
RQIQQLFWM

SEQ ID NO: 205639 - protein, 9 aa, Homo Sapiens
YKLIKSQNI

SEQ ID NO: 205640 - protein, 9 aa, Homo Sapiens
NLLKSQSEQ

SEQ ID NO: 205641 - protein, 9 aa, Homo Sapiens
NNLLKSQSE

SEQ ID NO: 205642 - protein, 9 aa, Homo Sapiens
KAFTSHSHL

SEQ ID NO: 205643 - protein, 9 aa, Homo Sapiens
VRSSYLGAV

SEQ ID NO: 205644 - protein, 9 aa, Homo Sapiens
QKNISKLQY

SEQ ID NO: 205645 - protein, 9 aa, Homo Sapiens
EKATELASP

SEQ ID NO: 205646 - protein, 9 aa, Homo Sapiens
SRSSSSCSR

SEQ ID NO: 205647 - protein, 9 aa, Homo Sapiens
DGVGKSALT

SEQ ID NO: 205648 - protein, 9 aa, Homo Sapiens
YYRTDLVFG

SEQ ID NO: 205649 - protein, 9 aa, Homo Sapiens
LAEQEPALQ

SEQ ID NO: 205650 - protein, 9 aa, Homo Sapiens
SFEDQRKKT

SEQ ID NO: 205651 - protein, 9 aa, Homo Sapiens
SFERAVEHG

SEQ ID NO: 205652 - protein, 9 aa, Homo Sapiens
RKDGWIMLV

SEQ ID NO: 205653 - protein, 9 aa, Homo Sapiens
NCIDRLNIY

SEQ ID NO: 205654 - protein, 9 aa, Homo Sapiens
GLQKYYRTD

SEQ ID NO: 205655 - protein, 9 aa, Homo Sapiens
DFYNPIVNV

SEQ ID NO: 205656 - protein, 9 aa, Homo Sapiens
NLVFLGFAV

SEQ ID NO: 205657 - protein, 9 aa, Homo Sapiens
CWVAEHYFL

SEQ ID NO: 205658 - protein, 9 aa, Homo Sapiens
ITVFQYYSY

SEQ ID NO: 205659 - protein, 9 aa, Homo Sapiens
NGNKTPGSQ

SEQ ID NO: 205660 - protein, 9 aa, Homo Sapiens
APYWGWATI

SEQ ID NO: 205661 - protein, 9 aa, Homo Sapiens
ETEIIRKYV

SEQ ID NO: 205662 - protein, 9 aa, Homo Sapiens
SHAIFTVSI

SEQ ID NO: 205663 - protein, 9 aa, Homo Sapiens
GASELETFS

SEQ ID NO: 205664 - protein, 9 aa, Homo Sapiens
FMEKKGSHM

SEQ ID NO: 205665 - protein, 9 aa, Homo Sapiens
INLMNESTE

SEQ ID NO: 205666 - protein, 9 aa, Homo Sapiens
GRQIQQLFW

SEQ ID NO: 205667 - protein, 9 aa, Homo Sapiens
WGWATIKSY

SEQ ID NO: 205668 - protein, 9 aa, Homo Sapiens
FPDGGMDAC

SEQ ID NO: 205669 - protein, 9 aa, Homo Sapiens
PDQLYDSMK

SEQ ID NO: 205670 - protein, 9 aa, Homo Sapiens
RIVKGSGGK

SEQ ID NO: 205671 - protein, 9 aa, Homo Sapiens
DLEALQWEI

SEQ ID NO: 205672 - protein, 9 aa, Homo Sapiens
PKKDCQNVQ

SEQ ID NO: 205673 - protein, 9 aa, Homo Sapiens
PSSGARHTV

SEQ ID NO: 205674 - protein, 9 aa, Homo Sapiens
MNESTELHT

SEQ ID NO: 205675 - protein, 9 aa, Homo Sapiens
VSAKPDLPL

SEQ ID NO: 205676 - protein, 9 aa, Homo Sapiens
MDIDECECN

SEQ ID NO: 205677 - protein, 9 aa, Homo Sapiens
SRSHAIFTV

SEQ ID NO: 205678 - protein, 9 aa, Homo Sapiens
FKLINKGRQ

SEQ ID NO: 205679 - protein, 9 aa, Homo Sapiens
ETKFFNSEY

SEQ ID NO: 205680 - protein, 9 aa, Homo Sapiens
CEDVNECAD

SEQ ID NO: 205681 - protein, 9 aa, Homo Sapiens
FEDQRKKTL

SEQ ID NO: 205682 - protein, 9 aa, Homo Sapiens
LSSEVITVF

SEQ ID NO: 205683 - protein, 9 aa, Homo Sapiens
NSLWPKLTI

SEQ ID NO: 205684 - protein, 9 aa, Homo Sapiens
DNSLNNPQQ

SEQ ID NO: 205685 - protein, 9 aa, Homo Sapiens
SRSNFHKHQ

SEQ ID NO: 205686 - protein, 9 aa, Homo Sapiens
LMNESTELH

SEQ ID NO: 205687 - protein, 9 aa, Homo Sapiens
GQNHADIND

SEQ ID NO: 205688 - protein, 9 aa, Homo Sapiens
YYKHCWVAE

SEQ ID NO: 205689 - protein, 9 aa, Homo Sapiens
SEESSSLTS

SEQ ID NO: 205690 - protein, 9 aa, Homo Sapiens
VVVLQESIS

SEQ ID NO: 205691 - protein, 9 aa, Homo Sapiens
EITKQEKDF

SEQ ID NO: 205692 - protein, 9 aa, Homo Sapiens
LGHGLYVTF

SEQ ID NO: 205693 - protein, 9 aa, Homo Sapiens
IYTTLGVNK

SEQ ID NO: 205694 - protein, 9 aa, Homo Sapiens
MTQVTTQLL

SEQ ID NO: 205695 - protein, 9 aa, Homo Sapiens
PSLGSNIPS

SEQ ID NO: 205696 - protein, 9 aa, Homo Sapiens
PGSQVFKPL

SEQ ID NO: 205697 - protein, 9 aa, Homo Sapiens
CANKEDKVV

SEQ ID NO: 205698 - protein, 9 aa, Homo Sapiens
WLMYWYRKL

SEQ ID NO: 205699 - protein, 9 aa, Homo Sapiens
KQEKDFLWS

SEQ ID NO: 205700 - protein, 9 aa, Homo Sapiens
SPPGLHHGH

SEQ ID NO: 205701 - protein, 9 aa, Homo Sapiens
QGANATQDE

SEQ ID NO: 205702 - protein, 9 aa, Homo Sapiens
EIKQMLLDV

SEQ ID NO: 205703 - protein, 9 aa, Homo Sapiens
SAEGKKAFA

SEQ ID NO: 205704 - protein, 9 aa, Homo Sapiens
APDVCKGAK

SEQ ID NO: 205705 - protein, 9 aa, Homo Sapiens
GSEEVVVVL

SEQ ID NO: 205706 - protein, 9 aa, Homo Sapiens
KEDKVVGIH

SEQ ID NO: 205707 - protein, 9 aa, Homo Sapiens
EDKVVGIHM

SEQ ID NO: 205708 - protein, 9 aa, Homo Sapiens
IQAKEMITK

SEQ ID NO: 205709 - protein, 9 aa, Homo Sapiens
MAGIQNIGI

SEQ ID NO: 205710 - protein, 9 aa, Homo Sapiens
HCMHLHEKR

SEQ ID NO: 205711 - protein, 9 aa, Homo Sapiens
VCANKEDKV

SEQ ID NO: 205712 - protein, 9 aa, Homo Sapiens
ESSSLTSEL

SEQ ID NO: 205713 - protein, 9 aa, Homo Sapiens
PYWGWATIK

SEQ ID NO: 205714 - protein, 9 aa, Homo Sapiens
IRKDGWIML

SEQ ID NO: 205715 - protein, 9 aa, Homo Sapiens
TDDEDESFV

SEQ ID NO: 205716 - protein, 9 aa, Homo Sapiens
IQDILPRHI

SEQ ID NO: 205717 - protein, 9 aa, Homo Sapiens
VQNYKLIKS

SEQ ID NO: 205718 - protein, 9 aa, Homo Sapiens
WTLRKPFHM

SEQ ID NO: 205719 - protein, 9 aa, Homo Sapiens
CIDRLNIYN

SEQ ID NO: 205720 - protein, 9 aa, Homo Sapiens
RTTSSHCPW

SEQ ID NO: 205721 - protein, 9 aa, Homo Sapiens
LVNEKVMPI

SEQ ID NO: 205722 - protein, 9 aa, Homo Sapiens
MYPTKGQEG

SEQ ID NO: 205723 - protein, 9 aa, Homo Sapiens
ENNLLKSQS

SEQ ID NO: 205724 - protein, 9 aa, Homo Sapiens
TKQEKDFLW

SEQ ID NO: 205725 - protein, 9 aa, Homo Sapiens
YVGMMCTAK

SEQ ID NO: 205726 - protein, 9 aa, Homo Sapiens
DKNGEGTSQ

SEQ ID NO: 205727 - protein, 9 aa, Homo Sapiens
TDVNIVAKI

SEQ ID NO: 205728 - protein, 9 aa, Homo Sapiens
EFDKIKVRE

SEQ ID NO: 205729 - protein, 9 aa, Homo Sapiens
SGAYVPLSC

SEQ ID NO: 205730 - protein, 9 aa, Homo Sapiens
KHNGTKPQR

SEQ ID NO: 205731 - protein, 9 aa, Homo Sapiens
SHCPWEAVI

SEQ ID NO: 205732 - protein, 9 aa, Homo Sapiens
FFNSEYPYK

SEQ ID NO: 205733 - protein, 9 aa, Homo Sapiens
SSSMIIDTQ

SEQ ID NO: 205734 - protein, 9 aa, Homo Sapiens
RDNSLNNPQ

SEQ ID NO: 205735 - protein, 9 aa, Homo Sapiens
SSLTSELRS

SEQ ID NO: 205736 - protein, 9 aa, Homo Sapiens
NESTELHTQ

SEQ ID NO: 205737 - protein, 9 aa, Homo Sapiens
IQNIGIWFF

SEQ ID NO: 205738 - protein, 9 aa, Homo Sapiens
GGMDACQGD

SEQ ID NO: 205739 - protein, 9 aa, Homo Sapiens
DNPNHHVNY

SEQ ID NO: 205740 - protein, 9 aa, Homo Sapiens
RRQCLAQEY

SEQ ID NO: 205741 - protein, 9 aa, Homo Sapiens
FNVFLKIQD

SEQ ID NO: 205742 - protein, 9 aa, Homo Sapiens
VMLGHGLYV

SEQ ID NO: 205743 - protein, 9 aa, Homo Sapiens
HAIFTVSIC

SEQ ID NO: 205744 - protein, 9 aa, Homo Sapiens
LHFLNMKKV

SEQ ID NO: 205745 - protein, 9 aa, Homo Sapiens
DEKNHASQK

SEQ ID NO: 205746 - protein, 9 aa, Homo Sapiens
RGCAEQLTL

SEQ ID NO: 205747 - protein, 9 aa, Homo Sapiens
LDRIVKGSG

SEQ ID NO: 205748 - protein, 9 aa, Homo Sapiens
FLKIQDILP

SEQ ID NO: 205749 - protein, 9 aa, Homo Sapiens
TIPPAPDVC

SEQ ID NO: 205750 - protein, 9 aa, Homo Sapiens
TELASPLVP

SEQ ID NO: 205751 - protein, 9 aa, Homo Sapiens
FCLPSQDAC

SEQ ID NO: 205752 - protein, 9 aa, Homo Sapiens
LRGCKNKCH

SEQ ID NO: 205753 - protein, 9 aa, Homo Sapiens
SSLSSEVIT

SEQ ID NO: 205754 - protein, 9 aa, Homo Sapiens
LQPGLGDAV

SEQ ID NO: 205755 - protein, 9 aa, Homo Sapiens
LDGYDNRLQ

SEQ ID NO: 205756 - protein, 9 aa, Homo Sapiens
NFEEEKLTE

SEQ ID NO: 205757 - protein, 9 aa, Homo Sapiens
VIDRFYAIC

SEQ ID NO: 205758 - protein, 9 aa, Homo Sapiens
KSQSEQKAR

SEQ ID NO: 205759 - protein, 9 aa, Homo Sapiens
HPCFWRDNS

SEQ ID NO: 205760 - protein, 9 aa, Homo Sapiens
GARHTVTPT

SEQ ID NO: 205761 - protein, 9 aa, Homo Sapiens
HASQKQKVI

SEQ ID NO: 205762 - protein, 9 aa, Homo Sapiens
KAFNSRSNF

SEQ ID NO: 205763 - protein, 9 aa, Homo Sapiens
VGASELETF

SEQ ID NO: 205764 - protein, 9 aa, Homo Sapiens
SSKELMSCH

SEQ ID NO: 205765 - protein, 9 aa, Homo Sapiens
GENDFKFSP

SEQ ID NO: 205766 - protein, 9 aa, Homo Sapiens
GLHPHQVEV

SEQ ID NO: 205767 - protein, 9 aa, Homo Sapiens
ECNPLLCRG

SEQ ID NO: 205768 - protein, 9 aa, Homo Sapiens
RETRLSFSD

SEQ ID NO: 205769 - protein, 9 aa, Homo Sapiens
TEIIRKYVK

SEQ ID NO: 205770 - protein, 9 aa, Homo Sapiens
PADLEALQW

SEQ ID NO: 205771 - protein, 9 aa, Homo Sapiens
NIPSLQNSL

SEQ ID NO: 205772 - protein, 9 aa, Homo Sapiens
ANKEDKVVG

SEQ ID NO: 205773 - protein, 9 aa, Homo Sapiens
FLGFAVSKL

SEQ ID NO: 205774 - protein, 9 aa, Homo Sapiens
MYILLGNLA

SEQ ID NO: 205775 - protein, 9 aa, Homo Sapiens
FATEYTFAF

SEQ ID NO: 205776 - protein, 9 aa, Homo Sapiens
AFNSRSNFH

SEQ ID NO: 205777 - protein, 9 aa, Homo Sapiens
VKDQCFSAK

SEQ ID NO: 205778 - protein, 9 aa, Homo Sapiens
NNLTNFEEE

SEQ ID NO: 205779 - protein, 9 aa, Homo Sapiens
TFMEKKGSH

SEQ ID NO: 205780 - protein, 9 aa, Homo Sapiens
YDNRLQPGL

SEQ ID NO: 205781 - protein, 9 aa, Homo Sapiens
DDEDESFVL

SEQ ID NO: 205782 - protein, 9 aa, Homo Sapiens
QWKNISVWC

SEQ ID NO: 205783 - protein, 9 aa, Homo Sapiens
PIVNVAQKR

SEQ ID NO: 205784 - protein, 9 aa, Homo Sapiens
WVRSSYLGA

SEQ ID NO: 205785 - protein, 9 aa, Homo Sapiens
SELETFSLS

SEQ ID NO: 205786 - protein, 9 aa, Homo Sapiens
SPPEKATEL

SEQ ID NO: 205787 - protein, 9 aa, Homo Sapiens
SMAGIQNIG

SEQ ID NO: 205788 - protein, 9 aa, Homo Sapiens
KDEVFHFFS

SEQ ID NO: 205789 - protein, 9 aa, Homo Sapiens
KGSGGKLTR

SEQ ID NO: 205790 - protein, 9 aa, Homo Sapiens
TTSSHCPWE

SEQ ID NO: 205791 - protein, 9 aa, Homo Sapiens
VGADGVGKS

SEQ ID NO: 205792 - protein, 9 aa, Homo Sapiens
TGQMWVRSS

SEQ ID NO: 205793 - protein, 9 aa, Homo Sapiens
DIDECECNP

SEQ ID NO: 205794 - protein, 9 aa, Homo Sapiens
YFPDQLYDS

SEQ ID NO: 205795 - protein, 9 aa, Homo Sapiens
FTSMAGIQN

SEQ ID NO: 205796 - protein, 9 aa, Homo Sapiens
KLQYKEQNY

SEQ ID NO: 205797 - protein, 9 aa, Homo Sapiens
TAHKIIYTG

SEQ ID NO: 205798 - protein, 9 aa, Homo Sapiens
KFFNSEYPY

SEQ ID NO: 205799 - protein, 9 aa, Homo Sapiens
NEVKPKKDC

SEQ ID NO: 205800 - protein, 9 aa, Homo Sapiens
VKGSGGKLT

SEQ ID NO: 205801 - protein, 9 aa, Homo Sapiens
PCFWRDNSL

SEQ ID NO: 205802 - protein, 9 aa, Homo Sapiens
KISDEKNHA

SEQ ID NO: 205803 - protein, 9 aa, Homo Sapiens
AKEMITKED

SEQ ID NO: 205804 - protein, 9 aa, Homo Sapiens
VHCMHLHEK

SEQ ID NO: 205805 - protein, 9 aa, Homo Sapiens
AYVFSGAYV

SEQ ID NO: 205806 - protein, 9 aa, Homo Sapiens
MEQTKNKLC

SEQ ID NO: 205807 - protein, 9 aa, Homo Sapiens
TWQGANATQ

SEQ ID NO: 205808 - protein, 9 aa, Homo Sapiens
QSEQKAREV

SEQ ID NO: 205809 - protein, 9 aa, Homo Sapiens
LLGNLALVD

SEQ ID NO: 205810 - protein, 9 aa, Homo Sapiens
QYPLQIPVS

SEQ ID NO: 205811 - protein, 9 aa, Homo Sapiens
KNGEGTSQD

SEQ ID NO: 205812 - protein, 9 aa, Homo Sapiens
RSSSSCSRS

SEQ ID NO: 205813 - protein, 9 aa, Homo Sapiens
GQMWVRSSY

SEQ ID NO: 205814 - protein, 9 aa, Homo Sapiens
LCVLQKELS

SEQ ID NO: 205815 - protein, 9 aa, Homo Sapiens
NGEGTSQDV

SEQ ID NO: 205816 - protein, 9 aa, Homo Sapiens
MMSFERAVE

SEQ ID NO: 205817 - protein, 9 aa, Homo Sapiens
KKTLQFAQW

SEQ ID NO: 205818 - protein, 9 aa, Homo Sapiens
CGSEEVVVV

SEQ ID NO: 205819 - protein, 9 aa, Homo Sapiens
CYVQKQLAP

SEQ ID NO: 205820 - protein, 9 aa, Homo Sapiens
NYKLIKSQN

SEQ ID NO: 205821 - protein, 9 aa, Homo Sapiens
TSMAGIQNI

SEQ ID NO: 205822 - protein, 9 aa, Homo Sapiens
ANVQRWAPG

SEQ ID NO: 205823 - protein, 9 aa, Homo Sapiens
TTLGVNKQT

SEQ ID NO: 205824 - protein, 9 aa, Homo Sapiens
CSILWIHTS

SEQ ID NO: 205825 - protein, 9 aa, Homo Sapiens
ANATQDELT

SEQ ID NO: 205826 - protein, 9 aa, Homo Sapiens
EVGLHPHQV

SEQ ID NO: 205827 - protein, 9 aa, Homo Sapiens
TFGISSKEL

SEQ ID NO: 205828 - protein, 9 aa, Homo Sapiens
RKSDGENDF

SEQ ID NO: 205829 - protein, 9 aa, Homo Sapiens
HFTKAQWKN

SEQ ID NO: 205830 - protein, 9 aa, Homo Sapiens
EEFDKIKVR

SEQ ID NO: 205831 - protein, 9 aa, Homo Sapiens
CLPSQDACQ

SEQ ID NO: 205832 - protein, 9 aa, Homo Sapiens
SHSHLIRHQ

SEQ ID NO: 205833 - protein, 9 aa, Homo Sapiens
IDYIVHLLW

SEQ ID NO: 205834 - protein, 9 aa, Homo Sapiens
EYTFAFPFL

SEQ ID NO: 205835 - protein, 9 aa, Homo Sapiens
EDVNECADP

SEQ ID NO: 205836 - protein, 9 aa, Homo Sapiens
WDGEDVKHN

SEQ ID NO: 205837 - protein, 9 aa, Homo Sapiens
NECADPRAC

SEQ ID NO: 205838 - protein, 9 aa, Homo Sapiens
VSKAEEFDK

SEQ ID NO: 205839 - protein, 9 aa, Homo Sapiens
TQDELTTSA

SEQ ID NO: 205840 - protein, 9 aa, Homo Sapiens
QLAPHSHRM

SEQ ID NO: 205841 - protein, 9 aa, Homo Sapiens
GHHCYVIPK

SEQ ID NO: 205842 - protein, 9 aa, Homo Sapiens
GSNIPSLQN

SEQ ID NO: 205843 - protein, 9 aa, Homo Sapiens
NYPKTESAT

SEQ ID NO: 205844 - protein, 9 aa, Homo Sapiens
IIRKDGWIM

SEQ ID NO: 205845 - protein, 9 aa, Homo Sapiens
AEQLTLGHL

SEQ ID NO: 205846 - protein, 9 aa, Homo Sapiens
EALQWEIRM

SEQ ID NO: 205847 - protein, 9 aa, Homo Sapiens
NHQNNNLTN

SEQ ID NO: 205848 - protein, 9 aa, Homo Sapiens
IQNKPLYFP

SEQ ID NO: 205849 - protein, 9 aa, Homo Sapiens
ESTELHTQL

SEQ ID NO: 205850 - protein, 9 aa, Homo Sapiens
KNISKLQYK

SEQ ID NO: 205851 - protein, 9 aa, Homo Sapiens
IKQMLLDVV

SEQ ID NO: 205852 - protein, 9 aa, Homo Sapiens
VNECADPRA

SEQ ID NO: 205853 - protein, 9 aa, Homo Sapiens
PDLPLFYTP

SEQ ID NO: 205854 - protein, 9 aa, Homo Sapiens
NLVIVHEGD

SEQ ID NO: 205855 - protein, 9 aa, Homo Sapiens
VTFEMLSSW

SEQ ID NO: 205856 - protein, 9 aa, Homo Sapiens
EIIGKSRFG

SEQ ID NO: 205857 - protein, 9 aa, Homo Sapiens
TLRKPFHMK

SEQ ID NO: 205858 - protein, 9 aa, Homo Sapiens
AGFPDGGMD

SEQ ID NO: 205859 - protein, 9 aa, Homo Sapiens
ALAEQEPAL

SEQ ID NO: 205860 - protein, 9 aa, Homo Sapiens
KATELASPL

SEQ ID NO: 205861 - protein, 9 aa, Homo Sapiens
VVDRDSEET

SEQ ID NO: 205862 - protein, 9 aa, Homo Sapiens
NHASQKQKV

SEQ ID NO: 205863 - protein, 9 aa, Homo Sapiens
SSSLTSELR

SEQ ID NO: 205864 - protein, 9 aa, Homo Sapiens
NPIVNVAQK

SEQ ID NO: 205865 - protein, 9 aa, Homo Sapiens
NNYIYTTLG

SEQ ID NO: 205866 - protein, 9 aa, Homo Sapiens
VETKFFNSE

SEQ ID NO: 205867 - protein, 9 aa, Homo Sapiens
MSFERAVEH

SEQ ID NO: 205868 - protein, 9 aa, Homo Sapiens
YDKNGEGTS

SEQ ID NO: 205869 - protein, 9 aa, Homo Sapiens
EINLMNEST

SEQ ID NO: 205870 - protein, 9 aa, Homo Sapiens
MGNSNSQYT

SEQ ID NO: 205871 - protein, 9 aa, Homo Sapiens
NIYNSVAHF

SEQ ID NO: 205872 - protein, 9 aa, Homo Sapiens
NSRSNFHKH

SEQ ID NO: 205873 - protein, 9 aa, Homo Sapiens
MWVRSSYLG

SEQ ID NO: 205874 - protein, 9 aa, Homo Sapiens
NSTCEDVNE

SEQ ID NO: 205875 - protein, 9 aa, Homo Sapiens
QKVLVNEKV

SEQ ID NO: 205876 - protein, 9 aa, Homo Sapiens
KALAEQEPA

SEQ ID NO: 205877 - protein, 9 aa, Homo Sapiens
KGRQIQQLF

SEQ ID NO: 205878 - protein, 9 aa, Homo Sapiens
ISSKELMSC

SEQ ID NO: 205879 - protein, 9 aa, Homo Sapiens
VYNEYVLRG

SEQ ID NO: 205880 - protein, 9 aa, Homo Sapiens
KYYRTDLVF

SEQ ID NO: 205881 - protein, 9 aa, Homo Sapiens
LDVVPLSCN

SEQ ID NO: 205882 - protein, 9 aa, Homo Sapiens
ERKSDGEND

SEQ ID NO: 205883 - protein, 9 aa, Homo Sapiens
IFTSMAGIQ

SEQ ID NO: 205884 - protein, 9 aa, Homo Sapiens
KHCWVAEHY

SEQ ID NO: 205885 - protein, 9 aa, Homo Sapiens
TSQDVLQDL

SEQ ID NO: 205886 - protein, 9 aa, Homo Sapiens
HVETKFFNS

SEQ ID NO: 205887 - protein, 9 aa, Homo Sapiens
DECECNPLL

SEQ ID NO: 205888 - protein, 9 aa, Homo Sapiens
MLCAGFPDG

SEQ ID NO: 205889 - protein, 9 aa, Homo Sapiens
IVFATEYTF

SEQ ID NO: 205890 - protein, 9 aa, Homo Sapiens
YVIPKVTEE

SEQ ID NO: 205891 - protein, 9 aa, Homo Sapiens
EAVKDQCFS

SEQ ID NO: 205892 - protein, 9 aa, Homo Sapiens
VHLLWETWA

SEQ ID NO: 205893 - protein, 9 aa, Homo Sapiens
ITKEDTQTN

SEQ ID NO: 205894 - protein, 9 aa, Homo Sapiens
HGHHTGGNT

SEQ ID NO: 205895 - protein, 9 aa, Homo Sapiens
IVHLLWETW

SEQ ID NO: 205896 - protein, 9 aa, Homo Sapiens
HMHIKQETG

SEQ ID NO: 205897 - protein, 9 aa, Homo Sapiens
NDFKFSPVC

SEQ ID NO: 205898 - protein, 9 aa, Homo Sapiens
AHKIIYTGE

SEQ ID NO: 205899 - protein, 9 aa, Homo Sapiens
GISSKELMS

SEQ ID NO: 205900 - protein, 9 aa, Homo Sapiens
NGVQNYKLI

SEQ ID NO: 205901 - protein, 9 aa, Homo Sapiens
ADGVGKSAL

SEQ ID NO: 205902 - protein, 9 aa, Homo Sapiens
QVTTQLLEI

SEQ ID NO: 205903 - protein, 9 aa, Homo Sapiens
VITVFQYYS

SEQ ID NO: 205904 - protein, 9 aa, Homo Sapiens
AQEEVGLHP

SEQ ID NO: 205905 - protein, 9 aa, Homo Sapiens
NMKKVKTDT

SEQ ID NO: 205906 - protein, 9 aa, Homo Sapiens
LMSCHDESS

SEQ ID NO: 205907 - protein, 9 aa, Homo Sapiens
DGGMDACQG

SEQ ID NO: 205908 - protein, 9 aa, Homo Sapiens
QMWVRSSYL

SEQ ID NO: 205909 - protein, 9 aa, Homo Sapiens
KEMITKEDT

SEQ ID NO: 205910 - protein, 9 aa, Homo Sapiens
KIKVREEEI

SEQ ID NO: 205911 - protein, 9 aa, Homo Sapiens
WEAVIFKTK

SEQ ID NO: 205912 - protein, 9 aa, Homo Sapiens
KKGSHMHIK

SEQ ID NO: 205913 - protein, 9 aa, Homo Sapiens
SNNYIYTTL

SEQ ID NO: 205914 - protein, 9 aa, Homo Sapiens
RLNIYNSVA

SEQ ID NO: 205915 - protein, 9 aa, Homo Sapiens
CMDIDECEC

SEQ ID NO: 205916 - protein, 9 aa, Homo Sapiens
QKYYRTDLV

SEQ ID NO: 205917 - protein, 9 aa, Homo Sapiens
NLTNFEEEK

SEQ ID NO: 205918 - protein, 9 aa, Homo Sapiens
LHPHQVEVV

SEQ ID NO: 205919 - protein, 9 aa, Homo Sapiens
EVEEGTDVN

SEQ ID NO: 205920 - protein, 9 aa, Homo Sapiens
KFAVDFKTR

SEQ ID NO: 205921 - protein, 9 aa, Homo Sapiens
PPEKATELA

SEQ ID NO: 205922 - protein, 9 aa, Homo Sapiens
IRDFYNPIV

SEQ ID NO: 205923 - protein, 9 aa, Homo Sapiens
SSHCPWEAV

SEQ ID NO: 205924 - protein, 9 aa, Homo Sapiens
GKNVYYKHC

SEQ ID NO: 205925 - protein, 9 aa, Homo Sapiens
MIIDTQISN

SEQ ID NO: 205926 - protein, 9 aa, Homo Sapiens
KVLVNEKVM

SEQ ID NO: 205927 - protein, 9 aa, Homo Sapiens
QEIIGKSRF

SEQ ID NO: 205928 - protein, 9 aa, Homo Sapiens
EESSSLTSE

SEQ ID NO: 205929 - protein, 9 aa, Homo Sapiens
YILNTLYPK

SEQ ID NO: 205930 - protein, 9 aa, Homo Sapiens
LASPLVPFL

SEQ ID NO: 205931 - protein, 9 aa, Homo Sapiens
DNNGGGGGF

SEQ ID NO: 205932 - protein, 9 aa, Homo Sapiens
FNSRSNFHK

SEQ ID NO: 205933 - protein, 9 aa, Homo Sapiens
SLWPKLTIK

SEQ ID NO: 205934 - protein, 9 aa, Homo Sapiens
VDRDSEETE

SEQ ID NO: 205935 - protein, 9 aa, Homo Sapiens
EDRANVQRW

SEQ ID NO: 205936 - protein, 9 aa, Homo Sapiens
KENQKNISK

SEQ ID NO: 205937 - protein, 9 aa, Homo Sapiens
SIFHLCSVV

SEQ ID NO: 205938 - protein, 9 aa, Homo Sapiens
EKISDEKNH

SEQ ID NO: 205939 - protein, 9 aa, Homo Sapiens
GHKQWWFGG

SEQ ID NO: 205940 - protein, 9 aa, Homo Sapiens
KKDCQNVQQ

SEQ ID NO: 205941 - protein, 9 aa, Homo Sapiens
KAQWKNISV

SEQ ID NO: 205942 - protein, 9 aa, Homo Sapiens
AVFCLPSQD

SEQ ID NO: 205943 - protein, 9 aa, Homo Sapiens
ETFSLSSFP

SEQ ID NO: 205944 - protein, 9 aa, Homo Sapiens
ECECNPLLC

SEQ ID NO: 205945 - protein, 9 aa, Homo Sapiens
VLRGCKNKC

SEQ ID NO: 205946 - protein, 9 aa, Homo Sapiens
IKEHLELYA

SEQ ID NO: 205947 - protein, 9 aa, Homo Sapiens
EGTSQDVLQ

SEQ ID NO: 205948 - protein, 9 aa, Homo Sapiens
NHHVNYLEH

SEQ ID NO: 205949 - protein, 9 aa, Homo Sapiens
GHTSTVHCM

SEQ ID NO: 205950 - protein, 9 aa, Homo Sapiens
SSSSCSRSF

SEQ ID NO: 205951 - protein, 9 aa, Homo Sapiens
DQCFSAKRR

SEQ ID NO: 205952 - protein, 9 aa, Homo Sapiens
DGHKQWWFG

SEQ ID NO: 205953 - protein, 9 aa, Homo Sapiens
PNHHVNYLE

SEQ ID NO: 205954 - protein, 9 aa, Homo Sapiens
NYYILNTLY

SEQ ID NO: 205955 - protein, 9 aa, Homo Sapiens
VIVHEGDPA

SEQ ID NO: 205956 - protein, 9 aa, Homo Sapiens
LNYYILNTL

SEQ ID NO: 205957 - protein, 9 aa, Homo Sapiens
LLDVVPLSC

SEQ ID NO: 205958 - protein, 9 aa, Homo Sapiens
TKFFNSEYP

SEQ ID NO: 205959 - protein, 9 aa, Homo Sapiens
KSRFGEVWR

SEQ ID NO: 205960 - protein, 9 aa, Homo Sapiens
HHVNYLEHV

SEQ ID NO: 205961 - protein, 9 aa, Homo Sapiens
LSSFILLVV

SEQ ID NO: 205962 - protein, 9 aa, Homo Sapiens
SDNNGGGGG

SEQ ID NO: 205963 - protein, 9 aa, Homo Sapiens
QIQQLFWMN

SEQ ID NO: 205964 - protein, 9 aa, Homo Sapiens
FTSHSHLIR

SEQ ID NO: 205965 - protein, 9 aa, Homo Sapiens
PTKGQEGSV

SEQ ID NO: 205966 - protein, 9 aa, Homo Sapiens
LMQWIIRKD

SEQ ID NO: 205967 - protein, 9 aa, Homo Sapiens
AAVEKLRQL

SEQ ID NO: 205968 - protein, 9 aa, Homo Sapiens
ENYPKTESA

SEQ ID NO: 205969 - protein, 9 aa, Homo Sapiens
QKQLAPHSH

SEQ ID NO: 205970 - protein, 9 aa, Homo Sapiens
SEVITVFQY

SEQ ID NO: 205971 - protein, 9 aa, Homo Sapiens
SKMYPTKGQ

SEQ ID NO: 205972 - protein, 9 aa, Homo Sapiens
FSGAYVPLS

SEQ ID NO: 205973 - protein, 9 aa, Homo Sapiens
QNNNLTNFE

SEQ ID NO: 205974 - protein, 9 aa, Homo Sapiens
HGLYVTFEM

SEQ ID NO: 205975 - protein, 9 aa, Homo Sapiens
VCSILWIHT

SEQ ID NO: 205976 - protein, 9 aa, Homo Sapiens
LEALQWEIR

SEQ ID NO: 205977 - protein, 9 aa, Homo Sapiens
FKTRWLMYW

SEQ ID NO: 205978 - protein, 9 aa, Homo Sapiens
WQGANATQD

SEQ ID NO: 205979 - protein, 9 aa, Homo Sapiens
LNTLYPKFN

SEQ ID NO: 205980 - protein, 9 aa, Homo Sapiens
TFSLSSFPD

SEQ ID NO: 205981 - protein, 9 aa, Homo Sapiens
SQDVLQDLQ

SEQ ID NO: 205982 - protein, 9 aa, Homo Sapiens
CAVFCLPSQ

SEQ ID NO: 205983 - protein, 9 aa, Homo Sapiens
GFLSLSSFI

SEQ ID NO: 205984 - protein, 9 aa, Homo Sapiens
DGYDNRLQP

SEQ ID NO: 205985 - protein, 9 aa, Homo Sapiens
NPSLIPLLL

SEQ ID NO: 205986 - protein, 9 aa, Homo Sapiens
DVNECADPR

SEQ ID NO: 205987 - protein, 9 aa, Homo Sapiens
EMITKEDTQ

SEQ ID NO: 205988 - protein, 9 aa, Homo Sapiens
DNRLQPGLG

SEQ ID NO: 205989 - protein, 9 aa, Homo Sapiens
PPGLHHGHH

SEQ ID NO: 205990 - protein, 9 aa, Homo Sapiens
GNIGHHCYV

SEQ ID NO: 205991 - protein, 9 aa, Homo Sapiens
EVKPKKDCQ

SEQ ID NO: 205992 - protein, 9 aa, Homo Sapiens
RTTENYPKT

SEQ ID NO: 205993 - protein, 9 aa, Homo Sapiens
VLQEIIGKS

SEQ ID NO: 205994 - protein, 9 aa, Homo Sapiens
IGKSRFGEV

SEQ ID NO: 205995 - protein, 9 aa, Homo Sapiens
GCSDNPNHH

SEQ ID NO: 205996 - protein, 9 aa, Homo Sapiens
YIVHLLWET

SEQ ID NO: 205997 - protein, 9 aa, Homo Sapiens
KENNLLKSQ

SEQ ID NO: 205998 - protein, 9 aa, Homo Sapiens
SLGSNIPSL

SEQ ID NO: 205999 - protein, 9 aa, Homo Sapiens
WATIKSYDL

SEQ ID NO: 206000 - protein, 9 aa, Homo Sapiens
ASVSAKPDL

SEQ ID NO: 206001 - protein, 9 aa, Homo Sapiens
PVGASELET

SEQ ID NO: 206002 - protein, 9 aa, Homo Sapiens
EQLDRIVKG

SEQ ID NO: 206003 - protein, 9 aa, Homo Sapiens
HHGHHTGGN

SEQ ID NO: 206004 - protein, 9 aa, Homo Sapiens
TTLSSKMYP

SEQ ID NO: 206005 - protein, 9 aa, Homo Sapiens
TEYTFAFPF

SEQ ID NO: 206006 - protein, 9 aa, Homo Sapiens
ADLEALQWE

SEQ ID NO: 206007 - protein, 9 aa, Homo Sapiens
VVGADGVGK

SEQ ID NO: 206008 - protein, 9 aa, Homo Sapiens
GINGVQNYK

SEQ ID NO: 206009 - protein, 9 aa, Homo Sapiens
ISDEKNHAS

SEQ ID NO: 206010 - protein, 9 aa, Homo Sapiens
NALGQNHAD

SEQ ID NO: 206011 - protein, 9 aa, Homo Sapiens
GKAFNSRSN

SEQ ID NO: 206012 - protein, 9 aa, Homo Sapiens
YYILNTLYP

SEQ ID NO: 206013 - protein, 9 aa, Homo Sapiens
KTLQFAQWW

SEQ ID NO: 206014 - protein, 9 aa, Homo Sapiens
ILNTLYPKF

SEQ ID NO: 206015 - protein, 9 aa, Homo Sapiens
IIVFATEYT

SEQ ID NO: 206016 - protein, 9 aa, Homo Sapiens
CNPLLCRGG

SEQ ID NO: 206017 - protein, 9 aa, Homo Sapiens
TPGSQVFKP

SEQ ID NO: 206018 - protein, 9 aa, Homo Sapiens
FGISSKELM

SEQ ID NO: 206019 - protein, 9 aa, Homo Sapiens
DPLSEITKQ

SEQ ID NO: 206020 - protein, 9 aa, Homo Sapiens
HPHQVEVVC

SEQ ID NO: 206021 - protein, 9 aa, Homo Sapiens
ETRLSFSDT

SEQ ID NO: 206022 - protein, 9 aa, Homo Sapiens
PAPDVCKGA

SEQ ID NO: 206023 - protein, 9 aa, Homo Sapiens
EMKNPSLIP

SEQ ID NO: 206024 - protein, 9 aa, Homo Sapiens
IVHEGDPAW

SEQ ID NO: 206025 - protein, 9 aa, Homo Sapiens
VFSGAYVPL

SEQ ID NO: 206026 - protein, 9 aa, Homo Sapiens
QRWAPGMRQ

SEQ ID NO: 206027 - protein, 9 aa, Homo Sapiens
VTTQLLEIL

SEQ ID NO: 206028 - protein, 9 aa, Homo Sapiens
GFAVSKLDL

SEQ ID NO: 206029 - protein, 9 aa, Homo Sapiens
PKLTIKEHL

SEQ ID NO: 206030 - protein, 9 aa, Homo Sapiens
SGARHTVTP

SEQ ID NO: 206031 - protein, 9 aa, Homo Sapiens
ITKQEKDFL

SEQ ID NO: 206032 - protein, 9 aa, Homo Sapiens
VQRWAPGMR

SEQ ID NO: 206033 - protein, 9 aa, Homo Sapiens
PSLIPLLLE

SEQ ID NO: 206034 - protein, 9 aa, Homo Sapiens
NPSLGSNIP

SEQ ID NO: 206035 - protein, 9 aa, Homo Sapiens
FLHFLNMKK

SEQ ID NO: 206036 - protein, 9 aa, Homo Sapiens
VYYKHCWVA

SEQ ID NO: 206037 - protein, 9 aa, Homo Sapiens
LNMKKVKTD

SEQ ID NO: 206038 - protein, 9 aa, Homo Sapiens
SQSEQKARE

SEQ ID NO: 206039 - protein, 9 aa, Homo Sapiens
SNSQYTLQG

SEQ ID NO: 206040 - protein, 9 aa, Homo Sapiens
AWTLRKPFH

SEQ ID NO: 206041 - protein, 9 aa, Homo Sapiens
GHGLYVTFE

SEQ ID NO: 206042 - protein, 9 aa, Homo Sapiens
SIVCSILWI

SEQ ID NO: 206043 - protein, 9 aa, Homo Sapiens
DRDSEETEI

SEQ ID NO: 206044 - protein, 9 aa, Homo Sapiens
AEEFDKIKV

SEQ ID NO: 206045 - protein, 9 aa, Homo Sapiens
ERAVEHGAH

SEQ ID NO: 206046 - protein, 9 aa, Homo Sapiens
IFHLCSVVI

SEQ ID NO: 206047 - protein, 9 aa, Homo Sapiens
NPNHHVNYL

SEQ ID NO: 206048 - protein, 9 aa, Homo Sapiens
LNIYNSVAH

SEQ ID NO: 206049 - protein, 9 aa, Homo Sapiens
ASELETFSL

SEQ ID NO: 206050 - protein, 9 aa, Homo Sapiens
PEKATELAS

SEQ ID NO: 206051 - protein, 9 aa, Homo Sapiens
ITRGLQKYY

SEQ ID NO: 206052 - protein, 9 aa, Homo Sapiens
YPKTESATP

SEQ ID NO: 206053 - protein, 9 aa, Homo Sapiens
GGSGSYDSD

SEQ ID NO: 206054 - protein, 9 aa, Homo Sapiens
YDSDNNGGG

SEQ ID NO: 206055 - protein, 9 aa, Homo Sapiens
FAVSKLDLI

SEQ ID NO: 206056 - protein, 9 aa, Homo Sapiens
FEAVKDQCF

SEQ ID NO: 206057 - protein, 9 aa, Homo Sapiens
FPQYPLQIP

SEQ ID NO: 206058 - protein, 9 aa, Homo Sapiens
ENQKNISKL

SEQ ID NO: 206059 - protein, 9 aa, Homo Sapiens
DSDNNGGGG

SEQ ID NO: 206060 - protein, 9 aa, Homo Sapiens
HCYVIPKVT

SEQ ID NO: 206061 - protein, 9 aa, Homo Sapiens
DESFVLEDP

SEQ ID NO: 206062 - protein, 9 aa, Homo Sapiens
DSEETEIIR

SEQ ID NO: 206063 - protein, 9 aa, Homo Sapiens
MEVEEGTDV

SEQ ID NO: 206064 - protein, 9 aa, Homo Sapiens
RDPLSEITK

SEQ ID NO: 206065 - protein, 9 aa, Homo Sapiens
GSHMHIKQE

SEQ ID NO: 206066 - protein, 9 aa, Homo Sapiens
QWEIRMAQE

SEQ ID NO: 206067 - protein, 9 aa, Homo Sapiens
DIIVFATEY

SEQ ID NO: 206068 - protein, 9 aa, Homo Sapiens
FWRDNSLNN

SEQ ID NO: 206069 - protein, 9 aa, Homo Sapiens
DFKTRWLMY

SEQ ID NO: 206070 - protein, 9 aa, Homo Sapiens
KMVCANKED

SEQ ID NO: 206071 - protein, 9 aa, Homo Sapiens
HFVPSAEEK

SEQ ID NO: 206072 - protein, 9 aa, Homo Sapiens
FNSEYPYKQ

SEQ ID NO: 206073 - protein, 9 aa, Homo Sapiens
AVKDQCFSA

SEQ ID NO: 206074 - protein, 9 aa, Homo Sapiens
AVPGPADRK

SEQ ID NO: 206075 - protein, 9 aa, Homo Sapiens
TTGQMWVRS

SEQ ID NO: 206076 - protein, 9 aa, Homo Sapiens
LKIQDILPR

SEQ ID NO: 206077 - protein, 9 aa, Homo Sapiens
SSSLSSEVI

SEQ ID NO: 206078 - protein, 9 aa, Homo Sapiens
RANVQRWAP

SEQ ID NO: 206079 - protein, 9 aa, Homo Sapiens
GCAEQLTLG

SEQ ID NO: 206080 - protein, 9 aa, Homo Sapiens
TSTVHCMHL

SEQ ID NO: 206081 - protein, 9 aa, Homo Sapiens
FMEVEEGTD

SEQ ID NO: 206082 - protein, 9 aa, Homo Sapiens
NQKNISKLQ

SEQ ID NO: 206083 - protein, 9 aa, Homo Sapiens
GFPQYPLQI

SEQ ID NO: 206084 - protein, 9 aa, Homo Sapiens
GFIDYIVHL

SEQ ID NO: 206085 - protein, 9 aa, Homo Sapiens
LETFSLSSF

SEQ ID NO: 206086 - protein, 9 aa, Homo Sapiens
STFEGFPQY

SEQ ID NO: 206087 - protein, 9 aa, Homo Sapiens
KLVVVGADG

SEQ ID NO: 206088 - protein, 9 aa, Homo Sapiens
GSGGKLTRR

SEQ ID NO: 206089 - protein, 9 aa, Homo Sapiens
NSQYTLQGS

SEQ ID NO: 206090 - protein, 9 aa, Homo Sapiens
LYFPDQLYD

SEQ ID NO: 206091 - protein, 9 aa, Homo Sapiens
FTVSICQVH

SEQ ID NO: 206092 - protein, 9 aa, Homo Sapiens
LCAVFCLPS

SEQ ID NO: 206093 - protein, 9 aa, Homo Sapiens
GKSRFGEVW

SEQ ID NO: 206094 - protein, 9 aa, Homo Sapiens
LESRSSSSC

SEQ ID NO: 206095 - protein, 9 aa, Homo Sapiens
SHMHIKQET

SEQ ID NO: 206096 - protein, 9 aa, Homo Sapiens
TNFEEEKLT

SEQ ID NO: 206097 - protein, 9 aa, Homo Sapiens
SEITKQEKD

SEQ ID NO: 206098 - protein, 9 aa, Homo Sapiens
TQLLEILQR

SEQ ID NO: 206099 - protein, 9 aa, Homo Sapiens
LKSQSEQKA

SEQ ID NO: 206100 - protein, 9 aa, Homo Sapiens
VFATEYTFA

SEQ ID NO: 206101 - protein, 9 aa, Homo Sapiens
GEDVKHNGT

SEQ ID NO: 206102 - protein, 9 aa, Homo Sapiens
IITRGLQKY

SEQ ID NO: 206103 - protein, 9 aa, Homo Sapiens
GEGTSQDVL

SEQ ID NO: 206104 - protein, 9 aa, Homo Sapiens
NFARRQCLA

SEQ ID NO: 206105 - protein, 9 aa, Homo Sapiens
NVQRWAPGM

SEQ ID NO: 206106 - protein, 9 aa, Homo Sapiens
EDVKHNGTK

SEQ ID NO: 206107 - protein, 9 aa, Homo Sapiens
PDVCKGAKA

SEQ ID NO: 206108 - protein, 9 aa, Homo Sapiens
EVYNEYVLR

SEQ ID NO: 206109 - protein, 9 aa, Homo Sapiens
KDCQNVQQN

SEQ ID NO: 206110 - protein, 9 aa, Homo Sapiens
PRDMAYVFS

SEQ ID NO: 206111 - protein, 9 aa, Homo Sapiens
QWIIRKDGW

SEQ ID NO: 206112 - protein, 9 aa, Homo Sapiens
VFCLPSQDA

SEQ ID NO: 206113 - protein, 9 aa, Homo Sapiens
IGHHCYVIP

SEQ ID NO: 206114 - protein, 9 aa, Homo Sapiens
KPFHMKKSS

SEQ ID NO: 206115 - protein, 9 aa, Homo Sapiens
AQWKNISVW

SEQ ID NO: 206116 - protein, 9 aa, Homo Sapiens
DFLHFLNMK

SEQ ID NO: 206117 - protein, 9 aa, Homo Sapiens
KELMSCHDE

SEQ ID NO: 206118 - protein, 9 aa, Homo Sapiens
VFHFFSVLA

SEQ ID NO: 206119 - protein, 9 aa, Homo Sapiens
NNNLTNFEE

SEQ ID NO: 206120 - protein, 9 aa, Homo Sapiens
ARRQCLAQE

SEQ ID NO: 206121 - protein, 9 aa, Homo Sapiens
VVPLSCNIS

SEQ ID NO: 206122 - protein, 9 aa, Homo Sapiens
HILCAVFCL

SEQ ID NO: 206123 - protein, 9 aa, Homo Sapiens
CLAQEYRKQ

SEQ ID NO: 206124 - protein, 9 aa, Homo Sapiens
ISPSSGARH

SEQ ID NO: 206125 - protein, 9 aa, Homo Sapiens
YVQKQLAPH

SEQ ID NO: 206126 - protein, 9 aa, Homo Sapiens
QPGLGDAVT

SEQ ID NO: 206127 - protein, 9 aa, Homo Sapiens
NATQDELTT

SEQ ID NO: 206128 - protein, 9 aa, Homo Sapiens
KPDLPLFYT

SEQ ID NO: 206129 - protein, 9 aa, Homo Sapiens
TMMSFERAV

SEQ ID NO: 206130 - protein, 9 aa, Homo Sapiens
QEPALQFSA

SEQ ID NO: 206131 - protein, 9 aa, Homo Sapiens
HRETRLSFS

SEQ ID NO: 206132 - protein, 9 aa, Homo Sapiens
QEEVGLHPH

SEQ ID NO: 206133 - protein, 9 aa, Homo Sapiens
FHFFSVLAS

SEQ ID NO: 206134 - protein, 9 aa, Homo Sapiens
KLIKSQNIF

SEQ ID NO: 206135 - protein, 9 aa, Homo Sapiens
KEDTQTNFS

SEQ ID NO: 206136 - protein, 9 aa, Homo Sapiens
KMCYVQKQL

SEQ ID NO: 206137 - protein, 9 aa, Homo Sapiens
SGCSDNPNH

SEQ ID NO: 206138 - protein, 9 aa, Homo Sapiens
RQCLAQEYR

SEQ ID NO: 206139 - protein, 9 aa, Homo Sapiens
IDTQISNAL

SEQ ID NO: 206140 - protein, 9 aa, Homo Sapiens
SLSSFILLV

SEQ ID NO: 206141 - protein, 9 aa, Homo Sapiens
DCQNVQQNE

SEQ ID NO: 206142 - protein, 9 aa, Homo Sapiens
KAEEFDKIK

SEQ ID NO: 206143 - protein, 9 aa, Homo Sapiens
FYNPIVNVA

SEQ ID NO: 206144 - protein, 9 aa, Homo Sapiens
MKKVKTDTE

SEQ ID NO: 206145 - protein, 9 aa, Homo Sapiens
QLLEILQRL

SEQ ID NO: 206146 - protein, 9 aa, Homo Sapiens
MLLDVVPLS

SEQ ID NO: 206147 - protein, 9 aa, Homo Sapiens
WPKLTIKEH

SEQ ID NO: 206148 - protein, 9 aa, Homo Sapiens
QDELTTSAF

SEQ ID NO: 206149 - protein, 9 aa, Homo Sapiens
GIQNIGIWF

SEQ ID NO: 206150 - protein, 9 aa, Homo Sapiens
SDNPNHHVN

SEQ ID NO: 206151 - protein, 9 aa, Homo Sapiens
SFNVFLKIQ

SEQ ID NO: 206152 - protein, 9 aa, Homo Sapiens
DQRKKTLQF

SEQ ID NO: 206153 - protein, 9 aa, Homo Sapiens
YNPIVNVAQ

SEQ ID NO: 206154 - protein, 9 aa, Homo Sapiens
GNKTPGSQV

SEQ ID NO: 206155 - protein, 9 aa, Homo Sapiens
NTSEESSSL

SEQ ID NO: 206156 - protein, 9 aa, Homo Sapiens
TSNPSLGSN

SEQ ID NO: 206157 - protein, 9 aa, Homo Sapiens
ESFVLEDPT

SEQ ID NO: 206158 - protein, 9 aa, Homo Sapiens
LQEIIGKSR

SEQ ID NO: 206159 - protein, 9 aa, Homo Sapiens
QCFSAKRRK

SEQ ID NO: 206160 - protein, 9 aa, Homo Sapiens
TKEDTQTNF

SEQ ID NO: 206161 - protein, 9 aa, Homo Sapiens
SDEKNHASQ

SEQ ID NO: 206162 - protein, 9 aa, Homo Sapiens
PWEAVIFKT

SEQ ID NO: 206163 - protein, 9 aa, Homo Sapiens
SFILLVVSY

SEQ ID NO: 206164 - protein, 9 aa, Homo Sapiens
CECNPLLCR

SEQ ID NO: 206165 - protein, 9 aa, Homo Sapiens
SSFILLVVS

SEQ ID NO: 206166 - protein, 9 aa, Homo Sapiens
ILCAVFCLP

SEQ ID NO: 206167 - protein, 9 aa, Homo Sapiens
VEEGTDVNI

SEQ ID NO: 206168 - protein, 9 aa, Homo Sapiens
FHLCSVVID

SEQ ID NO: 206169 - protein, 9 aa, Homo Sapiens
SFVLEDPTL

SEQ ID NO: 206170 - protein, 9 aa, Homo Sapiens
TRLSFSDTY

SEQ ID NO: 206171 - protein, 9 aa, Homo Sapiens
CSVVIDRFY

SEQ ID NO: 206172 - protein, 9 aa, Homo Sapiens
EAQEEVGLH

SEQ ID NO: 206173 - protein, 9 aa, Homo Sapiens
KVMPICLPS

SEQ ID NO: 206174 - protein, 9 aa, Homo Sapiens
MKNPSLIPL

SEQ ID NO: 206175 - protein, 9 aa, Homo Sapiens
TRGLQKYYR

SEQ ID NO: 206176 - protein, 9 aa, Homo Sapiens
FEGFPQYPL

SEQ ID NO: 206177 - protein, 9 aa, Homo Sapiens
HADINDQML

SEQ ID NO: 206178 - protein, 9 aa, Homo Sapiens
MEAWTLRKP

SEQ ID NO: 206179 - protein, 9 aa, Homo Sapiens
IIDTQISNA

SEQ ID NO: 206180 - protein, 9 aa, Homo Sapiens
YNGNKTPGS

SEQ ID NO: 206181 - protein, 9 aa, Homo Sapiens
VVIDRFYAI

SEQ ID NO: 206182 - protein, 9 aa, Homo Sapiens
IYSVKTKQI

SEQ ID NO: 206183 - protein, 9 aa, Homo Sapiens
ELETFSLSS

SEQ ID NO: 206184 - protein, 9 aa, Homo Sapiens
VNEKVMPIC

SEQ ID NO: 206185 - protein, 9 aa, Homo Sapiens
HFLNMKKVK

SEQ ID NO: 206186 - protein, 9 aa, Homo Sapiens
LWPKLTIKE

SEQ ID NO: 206187 - protein, 9 aa, Homo Sapiens
VHEGDPAWR

SEQ ID NO: 206188 - protein, 9 aa, Homo Sapiens
SEETEIIRK

SEQ ID NO: 206189 - protein, 9 aa, Homo Sapiens
PDGGMDACQ

SEQ ID NO: 206190 - protein, 9 aa, Homo Sapiens
QEVYNEYVL

SEQ ID NO: 206191 - protein, 9 aa, Homo Sapiens
CSDNPNHHV

SEQ ID NO: 206192 - protein, 9 aa, Homo Sapiens
ARHTVTPTR

SEQ ID NO: 206193 - protein, 9 aa, Homo Sapiens
RKKTLQFAQ

SEQ ID NO: 206194 - protein, 9 aa, Homo Sapiens
LAPHSHRMS

SEQ ID NO: 206195 - protein, 9 aa, Homo Sapiens
NYIYTTLGV

SEQ ID NO: 206196 - protein, 9 aa, Homo Sapiens
TSHSHLIRH

SEQ ID NO: 206197 - protein, 9 aa, Homo Sapiens
NLTAHKIIY

SEQ ID NO: 206198 - protein, 9 aa, Homo Sapiens
IIRDFYNPI

SEQ ID NO: 206199 - protein, 9 aa, Homo Sapiens
LGQNHADIN

SEQ ID NO: 206200 - protein, 9 aa, Homo Sapiens
MITKEDTQT

SEQ ID NO: 206201 - protein, 9 aa, Homo Sapiens
KMEQTKNKL

SEQ ID NO: 206202 - protein, 9 aa, Homo Sapiens
QNHADINDQ

SEQ ID NO: 206203 - protein, 9 aa, Homo Sapiens
ATEYTFAFP

SEQ ID NO: 206204 - protein, 9 aa, Homo Sapiens
EEVVVVLQE

SEQ ID NO: 206205 - protein, 9 aa, Homo Sapiens
CFWRDNSLN

SEQ ID NO: 206206 - protein, 9 aa, Homo Sapiens
TCEDVNECA

SEQ ID NO: 206207 - protein, 9 aa, Homo Sapiens
RDSEETEII

SEQ ID NO: 206208 - protein, 9 aa, Homo Sapiens
SPSSGARHT

SEQ ID NO: 206209 - protein, 9 aa, Homo Sapiens
EDESFVLED

SEQ ID NO: 206210 - protein, 9 aa, Homo Sapiens
KLCVLQKEL

SEQ ID NO: 206211 - protein, 9 aa, Homo Sapiens
TKAQWKNIS

SEQ ID NO: 206212 - protein, 9 aa, Homo Sapiens
LCSVVIDRF

SEQ ID NO: 206213 - protein, 9 aa, Homo Sapiens
RNLVFLGFA

SEQ ID NO: 206214 - protein, 9 aa, Homo Sapiens
AKPDLPLFY

SEQ ID NO: 206215 - protein, 9 aa, Homo Sapiens
SSGARHTVT

SEQ ID NO: 206216 - protein, 9 aa, Homo Sapiens
TLGHLLVHL

SEQ ID NO: 206217 - protein, 9 aa, Homo Sapiens
NRLQPGLGD

SEQ ID NO: 206218 - protein, 9 aa, Homo Sapiens
DMAYVFSGA

SEQ ID NO: 206219 - protein, 9 aa, Homo Sapiens
IIYSVKTKQ

SEQ ID NO: 206220 - protein, 9 aa, Homo Sapiens
SGSYDSDNN

SEQ ID NO: 206221 - protein, 9 aa, Homo Sapiens
RWLMYWYRK

SEQ ID NO: 206222 - protein, 9 aa, Homo Sapiens
CAEQLTLGH

SEQ ID NO: 206223 - protein, 9 aa, Homo Sapiens
SLSSEVITV

SEQ ID NO: 206224 - protein, 9 aa, Homo Sapiens
WIHTSEGRH

SEQ ID NO: 206225 - protein, 9 aa, Homo Sapiens
CTTGQMWVR

SEQ ID NO: 206226 - protein, 9 aa, Homo Sapiens
TTQLLEILQ

SEQ ID NO: 206227 - protein, 9 aa, Homo Sapiens
FAVDFKTRW

SEQ ID NO: 206228 - protein, 9 aa, Homo Sapiens
HFFSVLASH

SEQ ID NO: 206229 - protein, 9 aa, Homo Sapiens
KTPGSQVFK

SEQ ID NO: 206230 - protein, 9 aa, Homo Sapiens
NNALGQNHA

SEQ ID NO: 206231 - protein, 9 aa, Homo Sapiens
NHADINDQM

SEQ ID NO: 206232 - protein, 9 aa, Homo Sapiens
KPKKDCQNV

SEQ ID NO: 206233 - protein, 9 aa, Homo Sapiens
HSHLIRHQR

SEQ ID NO: 206234 - protein, 9 aa, Homo Sapiens
TLSSKMYPT

SEQ ID NO: 206235 - protein, 9 aa, Homo Sapiens
AIFTVSICQ

SEQ ID NO: 206236 - protein, 9 aa, Homo Sapiens
KNTSEESSS

SEQ ID NO: 206237 - protein, 9 aa, Homo Sapiens
TRWLMYWYR

SEQ ID NO: 206238 - protein, 9 aa, Homo Sapiens
SRGCAEQLT

SEQ ID NO: 206239 - protein, 9 aa, Homo Sapiens
FHVETKFFN

SEQ ID NO: 206240 - protein, 9 aa, Homo Sapiens
DRIVKGSGG

SEQ ID NO: 206241 - protein, 9 aa, Homo Sapiens
KQMLLDVVP

SEQ ID NO: 206242 - protein, 9 aa, Homo Sapiens
SDGENDFKF

SEQ ID NO: 206243 - protein, 9 aa, Homo Sapiens
AAAKALAEQ

SEQ ID NO: 206244 - protein, 9 aa, Homo Sapiens
GSQVFKPLE

SEQ ID NO: 206245 - protein, 9 aa, Homo Sapiens
DGENDFKFS

SEQ ID NO: 206246 - protein, 9 aa, Homo Sapiens
RKPFHMKKS

SEQ ID NO: 206247 - protein, 9 aa, Homo Sapiens
ILLGNLALV

SEQ ID NO: 206248 - protein, 9 aa, Homo Sapiens
WIIRKDGWI

SEQ ID NO: 206249 - protein, 9 aa, Homo Sapiens
SVVIDRFYA

SEQ ID NO: 206250 - protein, 9 aa, Homo Sapiens
VLEDPTLLN

SEQ ID NO: 206251 - protein, 9 aa, Homo Sapiens
GNNALGQNH

SEQ ID NO: 206252 - protein, 9 aa, Homo Sapiens
NSEYPYKQV

SEQ ID NO: 206253 - protein, 9 aa, Homo Sapiens
FLNMKKVKT

SEQ ID NO: 206254 - protein, 9 aa, Homo Sapiens
NKGRQIQQL

SEQ ID NO: 206255 - protein, 9 aa, Homo Sapiens
LLKSQSEQK

SEQ ID NO: 206256 - protein, 9 aa, Homo Sapiens
RWAPGMRQI

SEQ ID NO: 206257 - protein, 9 aa, Homo Sapiens
RDFYNPIVN

SEQ ID NO: 206258 - protein, 9 aa, Homo Sapiens
RGLQKYYRT

SEQ ID NO: 206259 - protein, 9 aa, Homo Sapiens
EDQRKKTLQ

SEQ ID NO: 206260 - protein, 9 aa, Homo Sapiens
GSYDSDNNG

SEQ ID NO: 206261 - protein, 9 aa, Homo Sapiens
FIDYIVHLL

SEQ ID NO: 206262 - protein, 9 aa, Homo Sapiens
YILLGNLAL

SEQ ID NO: 206263 - protein, 9 aa, Homo Sapiens
LRTTENYPK

SEQ ID NO: 206264 - protein, 9 aa, Homo Sapiens
DRANVQRWA

SEQ ID NO: 206265 - protein, 9 aa, Homo Sapiens
LTNFEEEKL

SEQ ID NO: 206266 - protein, 9 aa, Homo Sapiens
ILLVVSYTV

SEQ ID NO: 206267 - protein, 9 aa, Homo Sapiens
TSSSMIIDT

SEQ ID NO: 206268 - protein, 9 aa, Homo Sapiens
YKLVVVGAD

SEQ ID NO: 206269 - protein, 9 aa, Homo Sapiens
LSLSSFILL

SEQ ID NO: 206270 - protein, 9 aa, Homo Sapiens
RHTVTPTRK

SEQ ID NO: 206271 - protein, 9 aa, Homo Sapiens
SSMIIDTQI

SEQ ID NO: 206272 - protein, 9 aa, Homo Sapiens
YVLRGCKNK

SEQ ID NO: 206273 - protein, 9 aa, Homo Sapiens
EQEPALQFS

SEQ ID NO: 206274 - protein, 9 aa, Homo Sapiens
LVFLGFAVS

SEQ ID NO: 206275 - protein, 9 aa, Homo Sapiens
ESRSSSSCS

SEQ ID NO: 206276 - protein, 9 aa, Homo Sapiens
TMEAWTLRK

SEQ ID NO: 206277 - protein, 9 aa, Homo Sapiens
PPTIPPAPD

SEQ ID NO: 206278 - protein, 9 aa, Homo Sapiens
YVTFEMLSS

SEQ ID NO: 206279 - protein, 9 aa, Homo Sapiens
VVLQESISL

SEQ ID NO: 206280 - protein, 9 aa, Homo Sapiens
LSEITKQEK

SEQ ID NO: 206281 - protein, 9 aa, Homo Sapiens
NVFLKIQDI

SEQ ID NO: 206282 - protein, 9 aa, Homo Sapiens
DVVPLSCNI

SEQ ID NO: 206283 - protein, 9 aa, Homo Sapiens
EEADGHKQW

SEQ ID NO: 206284 - protein, 9 aa, Homo Sapiens
PPAPDVCKG

SEQ ID NO: 206285 - protein, 9 aa, Homo Sapiens
GPADRKTGI

SEQ ID NO: 206286 - protein, 9 aa, Homo Sapiens
SNIPSLQNS

SEQ ID NO: 206287 - protein, 9 aa, Homo Sapiens
ALQWEIRMA

SEQ ID NO: 206288 - protein, 9 aa, Homo Sapiens
IVCSILWIH

SEQ ID NO: 206289 - protein, 9 aa, Homo Sapiens
TELHTQLAK

SEQ ID NO: 206290 - protein, 9 aa, Homo Sapiens
YIYTTLGVN

SEQ ID NO: 206291 - protein, 9 aa, Homo Sapiens
RAVEHGAHG

SEQ ID NO: 206292 - protein, 9 aa, Homo Sapiens
EKNLVIVHE

SEQ ID NO: 206293 - protein, 9 aa, Homo Sapiens
RTLRTTENY

SEQ ID NO: 206294 - protein, 9 aa, Homo Sapiens
PQYPLQIPV

SEQ ID NO: 206295 - protein, 9 aa, Homo Sapiens
NEKVMPICL

SEQ ID NO: 206296 - protein, 9 aa, Homo Sapiens
LVIVHEGDP

SEQ ID NO: 206297 - protein, 9 aa, Homo Sapiens
EVITVFQYY

SEQ ID NO: 206298 - protein, 9 aa, Homo Sapiens
AAKALAEQE

SEQ ID NO: 206299 - protein, 9 aa, Homo Sapiens
CEMKNPSLI

SEQ ID NO: 206300 - protein, 9 aa, Homo Sapiens
ISKLQYKEQ

SEQ ID NO: 206301 - protein, 9 aa, Homo Sapiens
TSSHCPWEA

SEQ ID NO: 206302 - protein, 9 aa, Homo Sapiens
NLMNESTEL

SEQ ID NO: 206303 - protein, 9 aa, Homo Sapiens
KQLAPHSHR

SEQ ID NO: 206304 - protein, 9 aa, Homo Sapiens
DKVVGIHMQ

SEQ ID NO: 206305 - protein, 9 aa, Homo Sapiens
KLINKGRQI

SEQ ID NO: 206306 - protein, 9 aa, Homo Sapiens
MAYVFSGAY

SEQ ID NO: 206307 - protein, 9 aa, Homo Sapiens
WEIRMAQER

SEQ ID NO: 206308 - protein, 9 aa, Homo Sapiens
LINKGRQIQ

SEQ ID NO: 206309 - protein, 9 aa, Homo Sapiens
KMYPTKGQE

SEQ ID NO: 206310 - protein, 9 aa, Homo Sapiens
PMYILLGNL

SEQ ID NO: 206311 - protein, 9 aa, Homo Sapiens
NGTKPQRAS

SEQ ID NO: 206312 - protein, 9 aa, Homo Sapiens
TFEGFPQYP

SEQ ID NO: 206313 - protein, 9 aa, Homo Sapiens
SLNNPQQLT

SEQ ID NO: 206314 - protein, 9 aa, Homo Sapiens
INKGRQIQQ

SEQ ID NO: 206315 - protein, 9 aa, Homo Sapiens
HEKNLVIVH

SEQ ID NO: 206316 - protein, 9 aa, Homo Sapiens
ENDFKFSPV

SEQ ID NO: 206317 - protein, 9 aa, Homo Sapiens
HCWVAEHYF

SEQ ID NO: 206318 - protein, 9 aa, Homo Sapiens
WAPGMRQIY

SEQ ID NO: 206319 - protein, 9 aa, Homo Sapiens
SSEVITVFQ

SEQ ID NO: 206320 - protein, 9 aa, Homo Sapiens
SRFGEVWRG

SEQ ID NO: 206321 - protein, 9 aa, Homo Sapiens
VSICQVHKN

SEQ ID NO: 206322 - protein, 9 aa, Homo Sapiens
TSEESSSLT

SEQ ID NO: 206323 - protein, 9 aa, Homo Sapiens
QNKPLYFPD

SEQ ID NO: 206324 - protein, 9 aa, Homo Sapiens
SNPSLGSNI

SEQ ID NO: 206325 - protein, 9 aa, Homo Sapiens
DCHRETRLS

SEQ ID NO: 206326 - protein, 9 aa, Homo Sapiens
GHHTGGNTV

SEQ ID NO: 206327 - protein, 9 aa, Homo Sapiens
EKNHASQKQ

SEQ ID NO: 206328 - protein, 9 aa, Homo Sapiens
AEQEPALQF

SEQ ID NO: 206329 - protein, 9 aa, Homo Sapiens
NTLYPKFND

SEQ ID NO: 206330 - protein, 9 aa, Homo Sapiens
ENTMMSFER

SEQ ID NO: 206331 - protein, 9 aa, Homo Sapiens
DEDESFVLE

SEQ ID NO: 206332 - protein, 9 aa, Homo Sapiens
KIQDILPRH

SEQ ID NO: 206333 - protein, 9 aa, Homo Sapiens
AKALAEQEP

SEQ ID NO: 206334 - protein, 9 aa, Homo Sapiens
GYDNRLQPG

SEQ ID NO: 206335 - protein, 9 aa, Homo Sapiens
GDFLHFLNM

SEQ ID NO: 206336 - protein, 9 aa, Homo Sapiens
VVVVLQESI

SEQ ID NO: 206337 - protein, 9 aa, Homo Sapiens
SYDSDNNGG

SEQ ID NO: 206338 - protein, 9 aa, Homo Sapiens
ATQDELTTS

SEQ ID NO: 206339 - protein, 9 aa, Homo Sapiens
LHHGHHTGG

SEQ ID NO: 206340 - protein, 9 aa, Homo Sapiens
TTENYPKTE

SEQ ID NO: 206341 - protein, 9 aa, Homo Sapiens
AVDFKTRWL

SEQ ID NO: 206342 - protein, 9 aa, Homo Sapiens
YKHCWVAEH

SEQ ID NO: 206343 - protein, 9 aa, Homo Sapiens
LTLGHLLVH

SEQ ID NO: 206344 - protein, 9 aa, Homo Sapiens
LTIKEHLEL

SEQ ID NO: 206345 - protein, 9 aa, Homo Sapiens
WDHFTKAQW

SEQ ID NO: 206346 - protein, 9 aa, Homo Sapiens
QCLAQEYRK

SEQ ID NO: 206347 - protein, 9 aa, Homo Sapiens
ACEMKNPSL

SEQ ID NO: 206348 - protein, 9 aa, Homo Sapiens
EVEEADGHK

SEQ ID NO: 206349 - protein, 9 aa, Homo Sapiens
NKPLYFPDQ

SEQ ID NO: 206350 - protein, 9 aa, Homo Sapiens
GFPDGGMDA

SEQ ID NO: 206351 - protein, 9 aa, Homo Sapiens
VGLHPHQVE

SEQ ID NO: 206352 - protein, 9 aa, Homo Sapiens
KNLVIVHEG

SEQ ID NO: 206353 - protein, 9 aa, Homo Sapiens
YRNLVFLGF

SEQ ID NO: 206354 - protein, 9 aa, Homo Sapiens
EADGHKQWW

SEQ ID NO: 206355 - protein, 9 aa, Homo Sapiens
QLTLGHLLV

SEQ ID NO: 206356 - protein, 9 aa, Homo Sapiens
HTSTVHCMH

SEQ ID NO: 206357 - protein, 9 aa, Homo Sapiens
TQVTTQLLE

SEQ ID NO: 206358 - protein, 9 aa, Homo Sapiens
HHCYVIPKV

SEQ ID NO: 206359 - protein, 9 aa, Homo Sapiens
HHTGGNTVF

SEQ ID NO: 206360 - protein, 9 aa, Homo Sapiens
NSNSQYTLQ

SEQ ID NO: 206361 - protein, 9 aa, Homo Sapiens
MQWIIRKDG

SEQ ID NO: 206362 - protein, 9 aa, Homo Sapiens
TESNNYIYT

SEQ ID NO: 206363 - protein, 9 aa, Homo Sapiens
LYPKFNDKL

SEQ ID NO: 206364 - protein, 9 aa, Homo Sapiens
HCPWEAVIF

SEQ ID NO: 206365 - protein, 9 aa, Homo Sapiens
LQKYYRTDL

SEQ ID NO: 206366 - protein, 9 aa, Homo Sapiens
LWIHTSEGR

SEQ ID NO: 206367 - protein, 9 aa, Homo Sapiens
NSLNNPQQL

SEQ ID NO: 206368 - protein, 9 aa, Homo Sapiens
TKNKLCVLQ

SEQ ID NO: 206369 - protein, 9 aa, Homo Sapiens
GSGSYDSDN

SEQ ID NO: 206370 - protein, 9 aa, Homo Sapiens
QSSNLTAHK

SEQ ID NO: 206371 - protein, 9 aa, Homo Sapiens
DTQISNALN

SEQ ID NO: 206372 - protein, 9 aa, Homo Sapiens
SSFEAVKDQ

SEQ ID NO: 206373 - protein, 9 aa, Homo Sapiens
NKLCVLQKE

SEQ ID NO: 206374 - protein, 9 aa, Homo Sapiens
NTMMSFERA

SEQ ID NO: 206375 - protein, 9 aa, Homo Sapiens
TLRTTENYP

SEQ ID NO: 206376 - protein, 9 aa, Homo Sapiens
FILLVVSYT

SEQ ID NO: 206377 - protein, 9 aa, Homo Sapiens
KTRWLMYWY

SEQ ID NO: 206378 - protein, 9 aa, Homo Sapiens
SAPYWGWAT

SEQ ID NO: 206379 - protein, 9 aa, Homo Sapiens
ILWIHTSEG

SEQ ID NO: 206380 - protein, 9 aa, Homo Sapiens
LVVVGADGV

SEQ ID NO: 206381 - protein, 9 aa, Homo Sapiens
VEEADGHKQ

SEQ ID NO: 206382 - protein, 9 aa, Homo Sapiens
DVKHNGTKP

SEQ ID NO: 206383 - protein, 9 aa, Homo Sapiens
YGHTSTVHC

SEQ ID NO: 206384 - protein, 9 aa, Homo Sapiens
LGSNIPSLQ

SEQ ID NO: 206385 - protein, 9 aa, Homo Sapiens
ALGQNHADI

SEQ ID NO: 206386 - protein, 9 aa, Homo Sapiens
YDCHRETRL

SEQ ID NO: 206387 - protein, 9 aa, Homo Sapiens
YACEMKNPS

SEQ ID NO: 206388 - protein, 9 aa, Homo Sapiens
YTTLGVNKQ

SEQ ID NO: 206389 - protein, 9 aa, Homo Sapiens
LGFAVSKLD

SEQ ID NO: 206390 - protein, 9 aa, Homo Sapiens
FVLEDPTLL

SEQ ID NO: 206391 - protein, 9 aa, Homo Sapiens
LRKPFHMKK

SEQ ID NO: 206392 - protein, 9 aa, Homo Sapiens
SAKPDLPLF

SEQ ID NO: 206393 - protein, 9 aa, Homo Sapiens
QNIGIWFFW

SEQ ID NO: 206394 - protein, 9 aa, Homo Sapiens
FTKAQWKNI

SEQ ID NO: 206395 - protein, 9 aa, Homo Sapiens
TVHCMHLHE

SEQ ID NO: 206396 - protein, 9 aa, Homo Sapiens
CAGFPDGGM

SEQ ID NO: 206397 - protein, 9 aa, Homo Sapiens
IVKGSGGKL

SEQ ID NO: 206398 - protein, 9 aa, Homo Sapiens
EEVGLHPHQ

SEQ ID NO: 206399 - protein, 9 aa, Homo Sapiens
PGLHHGHHT

SEQ ID NO: 206400 - protein, 9 aa, Homo Sapiens
NVYYKHCWV

SEQ ID NO: 206401 - protein, 9 aa, Homo Sapiens
QTKNKLCVL

SEQ ID NO: 206402 - protein, 9 aa, Homo Sapiens
TLYPKFNDK

SEQ ID NO: 206403 - protein, 9 aa, Homo Sapiens
VIPKVTEEV

SEQ ID NO: 206404 - protein, 9 aa, Homo Sapiens
VLVNEKVMP

SEQ ID NO: 206405 - protein, 9 aa, Homo Sapiens
GYNGNKTPG

SEQ ID NO: 206406 - protein, 9 aa, Homo Sapiens
QMLLDVVPL

SEQ ID NO: 206407 - protein, 9 aa, Homo Sapiens
VGMMCTAKK

SEQ ID NO: 206408 - protein, 9 aa, Homo Sapiens
KDQCFSAKR

SEQ ID NO: 206409 - protein, 9 aa, Homo Sapiens
DWYDCHRET

SEQ ID NO: 206410 - protein, 9 aa, Homo Sapiens
CQNVQQNED

SEQ ID NO: 206411 - protein, 9 aa, Homo Sapiens
IYNSVAHFA

SEQ ID NO: 206412 - protein, 9 aa, Homo Sapiens
GTSQDVLQD

SEQ ID NO: 206413 - protein, 9 aa, Homo Sapiens
SKAEEFDKI

SEQ ID NO: 206414 - protein, 9 aa, Homo Sapiens
RDMAYVFSG

SEQ ID NO: 206415 - protein, 9 aa, Homo Sapiens
TENYPKTES

SEQ ID NO: 206416 - protein, 9 aa, Homo Sapiens
ENFARRQCL

SEQ ID NO: 206417 - protein, 9 aa, Homo Sapiens
IHWLRVHAP

SEQ ID NO: 206418 - protein, 9 aa, Homo Sapiens
ATAHARLHL

SEQ ID NO: 206419 - protein, 9 aa, Homo Sapiens
GATAHARLH

SEQ ID NO: 206420 - protein, 9 aa, Homo Sapiens
CLDFDYKKK

SEQ ID NO: 206421 - protein, 9 aa, Homo Sapiens
KYIHRDLRA

SEQ ID NO: 206422 - protein, 9 aa, Homo Sapiens
AQVLHRAAV

SEQ ID NO: 206423 - protein, 9 aa, Homo Sapiens
VFVTFIILG

SEQ ID NO: 206424 - protein, 9 aa, Homo Sapiens
YPDHWIVPG

SEQ ID NO: 206425 - protein, 9 aa, Homo Sapiens
LGVTQRDQK

SEQ ID NO: 206426 - protein, 9 aa, Homo Sapiens
EFLILLQCP

SEQ ID NO: 206427 - protein, 9 aa, Homo Sapiens
QHSDKRIHL

SEQ ID NO: 206428 - protein, 9 aa, Homo Sapiens
WQTVAQCPM

SEQ ID NO: 206429 - protein, 9 aa, Homo Sapiens
GVRGLTSPI

SEQ ID NO: 206430 - protein, 9 aa, Homo Sapiens
YPSYQDNRC

SEQ ID NO: 206431 - protein, 9 aa, Homo Sapiens
PVRVPDQEP

SEQ ID NO: 206432 - protein, 9 aa, Homo Sapiens
KTSESSTTL

SEQ ID NO: 206433 - protein, 9 aa, Homo Sapiens
LGKVEFSSV

SEQ ID NO: 206434 - protein, 9 aa, Homo Sapiens
APGILPLQM

SEQ ID NO: 206435 - protein, 9 aa, Homo Sapiens
TFVAFAIQM

SEQ ID NO: 206436 - protein, 9 aa, Homo Sapiens
LQDFRDQNV

SEQ ID NO: 206437 - protein, 9 aa, Homo Sapiens
KLGKVEFSS

SEQ ID NO: 206438 - protein, 9 aa, Homo Sapiens
MSNQFVLST

SEQ ID NO: 206439 - protein, 9 aa, Homo Sapiens
EEWQGSDVE

SEQ ID NO: 206440 - protein, 9 aa, Homo Sapiens
NWIIAIHSA

SEQ ID NO: 206441 - protein, 9 aa, Homo Sapiens
AGAWGLLPG

SEQ ID NO: 206442 - protein, 9 aa, Homo Sapiens
PLHYPVLMT

SEQ ID NO: 206443 - protein, 9 aa, Homo Sapiens
LTTDFVCIR

SEQ ID NO: 206444 - protein, 9 aa, Homo Sapiens
ALVLHHQWK

SEQ ID NO: 206445 - protein, 9 aa, Homo Sapiens
RKGAAFGLN

SEQ ID NO: 206446 - protein, 9 aa, Homo Sapiens
IDGDPDNYI

SEQ ID NO: 206447 - protein, 9 aa, Homo Sapiens
FYLEKPSVQ

SEQ ID NO: 206448 - protein, 9 aa, Homo Sapiens
VAQCPMPQF

SEQ ID NO: 206449 - protein, 9 aa, Homo Sapiens
TPPQGPAQA

SEQ ID NO: 206450 - protein, 9 aa, Homo Sapiens
KKLMVLLSL

SEQ ID NO: 206451 - protein, 9 aa, Homo Sapiens
RTLCRLFVA

SEQ ID NO: 206452 - protein, 9 aa, Homo Sapiens
CSSIMVSST

SEQ ID NO: 206453 - protein, 9 aa, Homo Sapiens
MVSSTSSLE

SEQ ID NO: 206454 - protein, 9 aa, Homo Sapiens
AQLEPTHIS

SEQ ID NO: 206455 - protein, 9 aa, Homo Sapiens
TYERKDNTM

SEQ ID NO: 206456 - protein, 9 aa, Homo Sapiens
QCPRLPVQP

SEQ ID NO: 206457 - protein, 9 aa, Homo Sapiens
RGAADDRVH

SEQ ID NO: 206458 - protein, 9 aa, Homo Sapiens
FMVWCGSFQ

SEQ ID NO: 206459 - protein, 9 aa, Homo Sapiens
AKTCPVQRW

SEQ ID NO: 206460 - protein, 9 aa, Homo Sapiens
GTSGYSQQV

SEQ ID NO: 206461 - protein, 9 aa, Homo Sapiens
HTPGMVGSL

SEQ ID NO: 206462 - protein, 9 aa, Homo Sapiens
LITLPATFV

SEQ ID NO: 206463 - protein, 9 aa, Homo Sapiens
LAEDMTLCV

SEQ ID NO: 206464 - protein, 9 aa, Homo Sapiens
VYVARAPRF

SEQ ID NO: 206465 - protein, 9 aa, Homo Sapiens
KRTMQEDLL

SEQ ID NO: 206466 - protein, 9 aa, Homo Sapiens
APAGAWSFQ

SEQ ID NO: 206467 - protein, 9 aa, Homo Sapiens
CELRMPCTL

SEQ ID NO: 206468 - protein, 9 aa, Homo Sapiens
TYRRLWTLI

SEQ ID NO: 206469 - protein, 9 aa, Homo Sapiens
HQGTLRMGN

SEQ ID NO: 206470 - protein, 9 aa, Homo Sapiens
GAGGNRVHH

SEQ ID NO: 206471 - protein, 9 aa, Homo Sapiens
SSTTLVVRY

SEQ ID NO: 206472 - protein, 9 aa, Homo Sapiens
AAVLNPRGV

SEQ ID NO: 206473 - protein, 9 aa, Homo Sapiens
YNCVELSEI

SEQ ID NO: 206474 - protein, 9 aa, Homo Sapiens
LCVADFGLS

SEQ ID NO: 206475 - protein, 9 aa, Homo Sapiens
ILGNTHIGA

SEQ ID NO: 206476 - protein, 9 aa, Homo Sapiens
RKSDLHLTL

SEQ ID NO: 206477 - protein, 9 aa, Homo Sapiens
GLNVIATRA

SEQ ID NO: 206478 - protein, 9 aa, Homo Sapiens
INGFQKAMV

SEQ ID NO: 206479 - protein, 9 aa, Homo Sapiens
CSEIPCYWE

SEQ ID NO: 206480 - protein, 9 aa, Homo Sapiens
TYLMSNQFV

SEQ ID NO: 206481 - protein, 9 aa, Homo Sapiens
SYQDNRCFV

SEQ ID NO: 206482 - protein, 9 aa, Homo Sapiens
HGSRGAADD

SEQ ID NO: 206483 - protein, 9 aa, Homo Sapiens
AEDMTLCVA

SEQ ID NO: 206484 - protein, 9 aa, Homo Sapiens
TDFVCIRFL

SEQ ID NO: 206485 - protein, 9 aa, Homo Sapiens
DINYYNRRF

SEQ ID NO: 206486 - protein, 9 aa, Homo Sapiens
PQGPAQAPL

SEQ ID NO: 206487 - protein, 9 aa, Homo Sapiens
ELVHQPRAN

SEQ ID NO: 206488 - protein, 9 aa, Homo Sapiens
ARCKEEIKH

SEQ ID NO: 206489 - protein, 9 aa, Homo Sapiens
LATFLFYLS

SEQ ID NO: 206490 - protein, 9 aa, Homo Sapiens
FLISLLFDV

SEQ ID NO: 206491 - protein, 9 aa, Homo Sapiens
FVTFIILGS

SEQ ID NO: 206492 - protein, 9 aa, Homo Sapiens
NEEVLQTEK

SEQ ID NO: 206493 - protein, 9 aa, Homo Sapiens
DLSIEKQFL

SEQ ID NO: 206494 - protein, 9 aa, Homo Sapiens
TPVNLTELA

SEQ ID NO: 206495 - protein, 9 aa, Homo Sapiens
RRLWTLIEH

SEQ ID NO: 206496 - protein, 9 aa, Homo Sapiens
ASAAVLNPR

SEQ ID NO: 206497 - protein, 9 aa, Homo Sapiens
VQRWVDSTP

SEQ ID NO: 206498 - protein, 9 aa, Homo Sapiens
KIITAAPKI

SEQ ID NO: 206499 - protein, 9 aa, Homo Sapiens
YLVHNRRML

SEQ ID NO: 206500 - protein, 9 aa, Homo Sapiens
GGRPGQCAG

SEQ ID NO: 206501 - protein, 9 aa, Homo Sapiens
LMLEKEPTI

SEQ ID NO: 206502 - protein, 9 aa, Homo Sapiens
SVHLKAGEQ

SEQ ID NO: 206503 - protein, 9 aa, Homo Sapiens
ERKCSSIMV

SEQ ID NO: 206504 - protein, 9 aa, Homo Sapiens
RGVNRLAEH

SEQ ID NO: 206505 - protein, 9 aa, Homo Sapiens
QEDLLSLAI

SEQ ID NO: 206506 - protein, 9 aa, Homo Sapiens
RDLTNLRRL

SEQ ID NO: 206507 - protein, 9 aa, Homo Sapiens
KETSVLKSH

SEQ ID NO: 206508 - protein, 9 aa, Homo Sapiens
PGWGQWHLG

SEQ ID NO: 206509 - protein, 9 aa, Homo Sapiens
FVMNTSNAG

SEQ ID NO: 206510 - protein, 9 aa, Homo Sapiens
CLVPKGPLP

SEQ ID NO: 206511 - protein, 9 aa, Homo Sapiens
RTQVFLEGE

SEQ ID NO: 206512 - protein, 9 aa, Homo Sapiens
RKCSSIMVS

SEQ ID NO: 206513 - protein, 9 aa, Homo Sapiens
EHPLVNEME

SEQ ID NO: 206514 - protein, 9 aa, Homo Sapiens
MTLCVADFG

SEQ ID NO: 206515 - protein, 9 aa, Homo Sapiens
HSPTDIDAG

SEQ ID NO: 206516 - protein, 9 aa, Homo Sapiens
SIMVSSTSS

SEQ ID NO: 206517 - protein, 9 aa, Homo Sapiens
TTDFGLARE

SEQ ID NO: 206518 - protein, 9 aa, Homo Sapiens
YVPTEDGSN

SEQ ID NO: 206519 - protein, 9 aa, Homo Sapiens
PDGRYMHSW

SEQ ID NO: 206520 - protein, 9 aa, Homo Sapiens
HLTPSLVYA

SEQ ID NO: 206521 - protein, 9 aa, Homo Sapiens
YLEEFQFED

SEQ ID NO: 206522 - protein, 9 aa, Homo Sapiens
GGGPGPAQA

SEQ ID NO: 206523 - protein, 9 aa, Homo Sapiens
IEKQFLDLL

SEQ ID NO: 206524 - protein, 9 aa, Homo Sapiens
VKEYGLPDI

SEQ ID NO: 206525 - protein, 9 aa, Homo Sapiens
IEERKYIHR

SEQ ID NO: 206526 - protein, 9 aa, Homo Sapiens
TATAQPTDT

SEQ ID NO: 206527 - protein, 9 aa, Homo Sapiens
ELEQEEEQL

SEQ ID NO: 206528 - protein, 9 aa, Homo Sapiens
RMLRFPLGS

SEQ ID NO: 206529 - protein, 9 aa, Homo Sapiens
DINILLFQN

SEQ ID NO: 206530 - protein, 9 aa, Homo Sapiens
QGYVPDHGR

SEQ ID NO: 206531 - protein, 9 aa, Homo Sapiens
KNDETESKE

SEQ ID NO: 206532 - protein, 9 aa, Homo Sapiens
AGEQISQKS

SEQ ID NO: 206533 - protein, 9 aa, Homo Sapiens
KLMVLLSLI

SEQ ID NO: 206534 - protein, 9 aa, Homo Sapiens
TDIDAGITD

SEQ ID NO: 206535 - protein, 9 aa, Homo Sapiens
LKLKLCDGP

SEQ ID NO: 206536 - protein, 9 aa, Homo Sapiens
QGRTSSLLS

SEQ ID NO: 206537 - protein, 9 aa, Homo Sapiens
GGGVNEYGK

SEQ ID NO: 206538 - protein, 9 aa, Homo Sapiens
PTHISPAIP

SEQ ID NO: 206539 - protein, 9 aa, Homo Sapiens
APLHPQPAP

SEQ ID NO: 206540 - protein, 9 aa, Homo Sapiens
DDIIALLDL

SEQ ID NO: 206541 - protein, 9 aa, Homo Sapiens
TLVITIQLE

SEQ ID NO: 206542 - protein, 9 aa, Homo Sapiens
WHEGFERDL

SEQ ID NO: 206543 - protein, 9 aa, Homo Sapiens
LLGLEKMAF

SEQ ID NO: 206544 - protein, 9 aa, Homo Sapiens
TAQLCAWHW

SEQ ID NO: 206545 - protein, 9 aa, Homo Sapiens
PYDHTPGMV

SEQ ID NO: 206546 - protein, 9 aa, Homo Sapiens
SSFYLEKPS

SEQ ID NO: 206547 - protein, 9 aa, Homo Sapiens
EVVTAMGDV

SEQ ID NO: 206548 - protein, 9 aa, Homo Sapiens
AEGDRGPRA

SEQ ID NO: 206549 - protein, 9 aa, Homo Sapiens
GLQPAVKAG

SEQ ID NO: 206550 - protein, 9 aa, Homo Sapiens
MVLIWYGST

SEQ ID NO: 206551 - protein, 9 aa, Homo Sapiens
CRLFVAELC

SEQ ID NO: 206552 - protein, 9 aa, Homo Sapiens
AFAIQMFFS

SEQ ID NO: 206553 - protein, 9 aa, Homo Sapiens
SRIYGFPPS

SEQ ID NO: 206554 - protein, 9 aa, Homo Sapiens
DQGPWRPLH

SEQ ID NO: 206555 - protein, 9 aa, Homo Sapiens
WLLITLPAT

SEQ ID NO: 206556 - protein, 9 aa, Homo Sapiens
EKVKLDNRL

SEQ ID NO: 206557 - protein, 9 aa, Homo Sapiens
GRCELRMPC

SEQ ID NO: 206558 - protein, 9 aa, Homo Sapiens
SVRGNALSQ

SEQ ID NO: 206559 - protein, 9 aa, Homo Sapiens
RAFRDLTNL

SEQ ID NO: 206560 - protein, 9 aa, Homo Sapiens
MCTPGNQEL

SEQ ID NO: 206561 - protein, 9 aa, Homo Sapiens
LLITLPATF

SEQ ID NO: 206562 - protein, 9 aa, Homo Sapiens
ITLPATFVN

SEQ ID NO: 206563 - protein, 9 aa, Homo Sapiens
LCAWHWPTD

SEQ ID NO: 206564 - protein, 9 aa, Homo Sapiens
NRRMLIHFG

SEQ ID NO: 206565 - protein, 9 aa, Homo Sapiens
SDDENIEYE

SEQ ID NO: 206566 - protein, 9 aa, Homo Sapiens
FLGCMGSTK

SEQ ID NO: 206567 - protein, 9 aa, Homo Sapiens
VNEYGKTDL

SEQ ID NO: 206568 - protein, 9 aa, Homo Sapiens
HFFCEIPAM

SEQ ID NO: 206569 - protein, 9 aa, Homo Sapiens
PGTYAGLHN

SEQ ID NO: 206570 - protein, 9 aa, Homo Sapiens
GSRGAADDR

SEQ ID NO: 206571 - protein, 9 aa, Homo Sapiens
GRCLVPKGP

SEQ ID NO: 206572 - protein, 9 aa, Homo Sapiens
ICTIRSFEG

SEQ ID NO: 206573 - protein, 9 aa, Homo Sapiens
EPTHISPAI

SEQ ID NO: 206574 - protein, 9 aa, Homo Sapiens
PSALRPKPS

SEQ ID NO: 206575 - protein, 9 aa, Homo Sapiens
NGDMEKIHL

SEQ ID NO: 206576 - protein, 9 aa, Homo Sapiens
DHTPGMVGS

SEQ ID NO: 206577 - protein, 9 aa, Homo Sapiens
LRRDAPSLE

SEQ ID NO: 206578 - protein, 9 aa, Homo Sapiens
DQEPTHTGH

SEQ ID NO: 206579 - protein, 9 aa, Homo Sapiens
SMWRCSFYL

SEQ ID NO: 206580 - protein, 9 aa, Homo Sapiens
PAGAWSFQP

SEQ ID NO: 206581 - protein, 9 aa, Homo Sapiens
VGSLGYHPY

SEQ ID NO: 206582 - protein, 9 aa, Homo Sapiens
VRKSCFDPD

SEQ ID NO: 206583 - protein, 9 aa, Homo Sapiens
EWQGSDVEK

SEQ ID NO: 206584 - protein, 9 aa, Homo Sapiens
HQQPMLSGV

SEQ ID NO: 206585 - protein, 9 aa, Homo Sapiens
ELRRDAPSL

SEQ ID NO: 206586 - protein, 9 aa, Homo Sapiens
WRPLHTAGG

SEQ ID NO: 206587 - protein, 9 aa, Homo Sapiens
SCQPSCCET

SEQ ID NO: 206588 - protein, 9 aa, Homo Sapiens
ARERPAEGD

SEQ ID NO: 206589 - protein, 9 aa, Homo Sapiens
MPRTLCRLF

SEQ ID NO: 206590 - protein, 9 aa, Homo Sapiens
WHWPTDVLT

SEQ ID NO: 206591 - protein, 9 aa, Homo Sapiens
NQELISLAK

SEQ ID NO: 206592 - protein, 9 aa, Homo Sapiens
KFLISLLFD

SEQ ID NO: 206593 - protein, 9 aa, Homo Sapiens
ANAPSLSSG

SEQ ID NO: 206594 - protein, 9 aa, Homo Sapiens
RGVVHRRAA

SEQ ID NO: 206595 - protein, 9 aa, Homo Sapiens
NATTNIPEH

SEQ ID NO: 206596 - protein, 9 aa, Homo Sapiens
KDNTMVTRL

SEQ ID NO: 206597 - protein, 9 aa, Homo Sapiens
AIDGDPDNY

SEQ ID NO: 206598 - protein, 9 aa, Homo Sapiens
VDDIIALLD

SEQ ID NO: 206599 - protein, 9 aa, Homo Sapiens
PLHPQPAPA

SEQ ID NO: 206600 - protein, 9 aa, Homo Sapiens
AHREECAVH

SEQ ID NO: 206601 - protein, 9 aa, Homo Sapiens
GDLNQNEEV

SEQ ID NO: 206602 - protein, 9 aa, Homo Sapiens
LCRPSQSLP

SEQ ID NO: 206603 - protein, 9 aa, Homo Sapiens
HWIVPGGGM

SEQ ID NO: 206604 - protein, 9 aa, Homo Sapiens
LILLQCPRL

SEQ ID NO: 206605 - protein, 9 aa, Homo Sapiens
GYNQKNTEG

SEQ ID NO: 206606 - protein, 9 aa, Homo Sapiens
LVVLFGAMA

SEQ ID NO: 206607 - protein, 9 aa, Homo Sapiens
QCDMLELHT

SEQ ID NO: 206608 - protein, 9 aa, Homo Sapiens
SSSRYPDHW

SEQ ID NO: 206609 - protein, 9 aa, Homo Sapiens
HAAIDGDPD

SEQ ID NO: 206610 - protein, 9 aa, Homo Sapiens
PKGPLPGHL

SEQ ID NO: 206611 - protein, 9 aa, Homo Sapiens
HKLLVTPPQ

SEQ ID NO: 206612 - protein, 9 aa, Homo Sapiens
SDLHLTLPA

SEQ ID NO: 206613 - protein, 9 aa, Homo Sapiens
LFRICTIRS

SEQ ID NO: 206614 - protein, 9 aa, Homo Sapiens
TLPATFVNS

SEQ ID NO: 206615 - protein, 9 aa, Homo Sapiens
GIHWLRVHA

SEQ ID NO: 206616 - protein, 9 aa, Homo Sapiens
DIDAGITDN

SEQ ID NO: 206617 - protein, 9 aa, Homo Sapiens
CMLAEDMTL

SEQ ID NO: 206618 - protein, 9 aa, Homo Sapiens
HLKKLEGRC

SEQ ID NO: 206619 - protein, 9 aa, Homo Sapiens
DICNKTLKT

SEQ ID NO: 206620 - protein, 9 aa, Homo Sapiens
GSNTKKNAD

SEQ ID NO: 206621 - protein, 9 aa, Homo Sapiens
SALRPKPSL

SEQ ID NO: 206622 - protein, 9 aa, Homo Sapiens
RICTIRSFE

SEQ ID NO: 206623 - protein, 9 aa, Homo Sapiens
VVTAMGDVR

SEQ ID NO: 206624 - protein, 9 aa, Homo Sapiens
IKHGIQKLL

SEQ ID NO: 206625 - protein, 9 aa, Homo Sapiens
AVLNPRGVV

SEQ ID NO: 206626 - protein, 9 aa, Homo Sapiens
DWHWTTDQS

SEQ ID NO: 206627 - protein, 9 aa, Homo Sapiens
GAWSFQPAS

SEQ ID NO: 206628 - protein, 9 aa, Homo Sapiens
WKRNNLMTL

SEQ ID NO: 206629 - protein, 9 aa, Homo Sapiens
LQRWHEGFE

SEQ ID NO: 206630 - protein, 9 aa, Homo Sapiens
IIAIHSACA

SEQ ID NO: 206631 - protein, 9 aa, Homo Sapiens
PHTIPGRSR

SEQ ID NO: 206632 - protein, 9 aa, Homo Sapiens
LPVQPGAGG

SEQ ID NO: 206633 - protein, 9 aa, Homo Sapiens
DPAEAEQEG

SEQ ID NO: 206634 - protein, 9 aa, Homo Sapiens
GWGQWHLGA

SEQ ID NO: 206635 - protein, 9 aa, Homo Sapiens
LKGGGVNEY

SEQ ID NO: 206636 - protein, 9 aa, Homo Sapiens
HIPGRCELR

SEQ ID NO: 206637 - protein, 9 aa, Homo Sapiens
LVITIQLEA

SEQ ID NO: 206638 - protein, 9 aa, Homo Sapiens
WQGSDVEKR

SEQ ID NO: 206639 - protein, 9 aa, Homo Sapiens
CPMPQFSGK

SEQ ID NO: 206640 - protein, 9 aa, Homo Sapiens
VHNRRMLIH

SEQ ID NO: 206641 - protein, 9 aa, Homo Sapiens
DGRYMHSWL

SEQ ID NO: 206642 - protein, 9 aa, Homo Sapiens
EKMAFRIYA

SEQ ID NO: 206643 - protein, 9 aa, Homo Sapiens
SQFHAAIDG

SEQ ID NO: 206644 - protein, 9 aa, Homo Sapiens
NLKLKLCDG

SEQ ID NO: 206645 - protein, 9 aa, Homo Sapiens
INYRFSACY

SEQ ID NO: 206646 - protein, 9 aa, Homo Sapiens
LTSPGTYAG

SEQ ID NO: 206647 - protein, 9 aa, Homo Sapiens
HIHFQRTVI

SEQ ID NO: 206648 - protein, 9 aa, Homo Sapiens
PSLSSGQLK

SEQ ID NO: 206649 - protein, 9 aa, Homo Sapiens
AQPTDTCLS

SEQ ID NO: 206650 - protein, 9 aa, Homo Sapiens
WLLWRICRG

SEQ ID NO: 206651 - protein, 9 aa, Homo Sapiens
MWRCSFYLY

SEQ ID NO: 206652 - protein, 9 aa, Homo Sapiens
PVQPGAGGN

SEQ ID NO: 206653 - protein, 9 aa, Homo Sapiens
KNWLLMAES

SEQ ID NO: 206654 - protein, 9 aa, Homo Sapiens
HTGHLWLGT

SEQ ID NO: 206655 - protein, 9 aa, Homo Sapiens
LAKTCPVQR

SEQ ID NO: 206656 - protein, 9 aa, Homo Sapiens
LAKLEVKFS

SEQ ID NO: 206657 - protein, 9 aa, Homo Sapiens
RKDNTMVTR

SEQ ID NO: 206658 - protein, 9 aa, Homo Sapiens
KHGIQKLLQ

SEQ ID NO: 206659 - protein, 9 aa, Homo Sapiens
PLLPAFMVW

SEQ ID NO: 206660 - protein, 9 aa, Homo Sapiens
WTTDQSVGD

SEQ ID NO: 206661 - protein, 9 aa, Homo Sapiens
ETYLMSNQF

SEQ ID NO: 206662 - protein, 9 aa, Homo Sapiens
LPAFMVWCG

SEQ ID NO: 206663 - protein, 9 aa, Homo Sapiens
QFHAAIDGD

SEQ ID NO: 206664 - protein, 9 aa, Homo Sapiens
RWHEGFERD

SEQ ID NO: 206665 - protein, 9 aa, Homo Sapiens
AMLKLSCTD

SEQ ID NO: 206666 - protein, 9 aa, Homo Sapiens
PPQGRTSSL

SEQ ID NO: 206667 - protein, 9 aa, Homo Sapiens
CIRFLEYWP

SEQ ID NO: 206668 - protein, 9 aa, Homo Sapiens
CCGLDPHTI

SEQ ID NO: 206669 - protein, 9 aa, Homo Sapiens
DHWIVPGGG

SEQ ID NO: 206670 - protein, 9 aa, Homo Sapiens
AVKAGTEDE

SEQ ID NO: 206671 - protein, 9 aa, Homo Sapiens
QTVAQCPMP

SEQ ID NO: 206672 - protein, 9 aa, Homo Sapiens
YERKDNTMV

SEQ ID NO: 206673 - protein, 9 aa, Homo Sapiens
CRPSQSLPL

SEQ ID NO: 206674 - protein, 9 aa, Homo Sapiens
KLDNRLILF

SEQ ID NO: 206675 - protein, 9 aa, Homo Sapiens
NEYGKTDLM

SEQ ID NO: 206676 - protein, 9 aa, Homo Sapiens
WSAPGILPL

SEQ ID NO: 206677 - protein, 9 aa, Homo Sapiens
AKIITAAPK

SEQ ID NO: 206678 - protein, 9 aa, Homo Sapiens
VEENRPLQN

SEQ ID NO: 206679 - protein, 9 aa, Homo Sapiens
NIKQILGNT

SEQ ID NO: 206680 - protein, 9 aa, Homo Sapiens
RRDAPSLES

SEQ ID NO: 206681 - protein, 9 aa, Homo Sapiens
APDGRYMHS

SEQ ID NO: 206682 - protein, 9 aa, Homo Sapiens
TKEIKHGIQ

SEQ ID NO: 206683 - protein, 9 aa, Homo Sapiens
LRFPLGSSS

SEQ ID NO: 206684 - protein, 9 aa, Homo Sapiens
SHHGSRGAA

SEQ ID NO: 206685 - protein, 9 aa, Homo Sapiens
FLILLQCPR

SEQ ID NO: 206686 - protein, 9 aa, Homo Sapiens
LPDINILLF

SEQ ID NO: 206687 - protein, 9 aa, Homo Sapiens
TEDGSNTKK

SEQ ID NO: 206688 - protein, 9 aa, Homo Sapiens
GRCDCDHSD

SEQ ID NO: 206689 - protein, 9 aa, Homo Sapiens
LEGRCLDFD

SEQ ID NO: 206690 - protein, 9 aa, Homo Sapiens
AASGPTGTT

SEQ ID NO: 206691 - protein, 9 aa, Homo Sapiens
PAPAGAWSF

SEQ ID NO: 206692 - protein, 9 aa, Homo Sapiens
TEPINGFQK

SEQ ID NO: 206693 - protein, 9 aa, Homo Sapiens
NYYNRRFSG

SEQ ID NO: 206694 - protein, 9 aa, Homo Sapiens
VKAGTEDEL

SEQ ID NO: 206695 - protein, 9 aa, Homo Sapiens
IVELSKKNW

SEQ ID NO: 206696 - protein, 9 aa, Homo Sapiens
GEGCAGRCD

SEQ ID NO: 206697 - protein, 9 aa, Homo Sapiens
IGINKKLVK

SEQ ID NO: 206698 - protein, 9 aa, Homo Sapiens
VTPPQGPAQ

SEQ ID NO: 206699 - protein, 9 aa, Homo Sapiens
KCSHIPGRC

SEQ ID NO: 206700 - protein, 9 aa, Homo Sapiens
GVRTKEIKH

SEQ ID NO: 206701 - protein, 9 aa, Homo Sapiens
RPSQSLPLT

SEQ ID NO: 206702 - protein, 9 aa, Homo Sapiens
SDSSFYLEK

SEQ ID NO: 206703 - protein, 9 aa, Homo Sapiens
SKETSVLKS

SEQ ID NO: 206704 - protein, 9 aa, Homo Sapiens
VPKGPLPGH

SEQ ID NO: 206705 - protein, 9 aa, Homo Sapiens
GPAQASAAV

SEQ ID NO: 206706 - protein, 9 aa, Homo Sapiens
IHLDAQHES

SEQ ID NO: 206707 - protein, 9 aa, Homo Sapiens
LELRRDAPS

SEQ ID NO: 206708 - protein, 9 aa, Homo Sapiens
GAAFGLNVI

SEQ ID NO: 206709 - protein, 9 aa, Homo Sapiens
VTAMGDVRG

SEQ ID NO: 206710 - protein, 9 aa, Homo Sapiens
SAPGILPLQ

SEQ ID NO: 206711 - protein, 9 aa, Homo Sapiens
AWGLLPGWG

SEQ ID NO: 206712 - protein, 9 aa, Homo Sapiens
KVKLDNRLI

SEQ ID NO: 206713 - protein, 9 aa, Homo Sapiens
QGPAQAPLH

SEQ ID NO: 206714 - protein, 9 aa, Homo Sapiens
VVVGAVGVG

SEQ ID NO: 206715 - protein, 9 aa, Homo Sapiens
DDPAEAEQE

SEQ ID NO: 206716 - protein, 9 aa, Homo Sapiens
PLHTAGGGG

SEQ ID NO: 206717 - protein, 9 aa, Homo Sapiens
MGDVRGAGT

SEQ ID NO: 206718 - protein, 9 aa, Homo Sapiens
EGIYVAIQH

SEQ ID NO: 206719 - protein, 9 aa, Homo Sapiens
YRFSACYFT

SEQ ID NO: 206720 - protein, 9 aa, Homo Sapiens
CCRMPRTLC

SEQ ID NO: 206721 - protein, 9 aa, Homo Sapiens
ERPAEGDRG

SEQ ID NO: 206722 - protein, 9 aa, Homo Sapiens
QDRAFRDLT

SEQ ID NO: 206723 - protein, 9 aa, Homo Sapiens
HGIQKLLQR

SEQ ID NO: 206724 - protein, 9 aa, Homo Sapiens
MNTSNAGAG

SEQ ID NO: 206725 - protein, 9 aa, Homo Sapiens
GAVGVGKSA

SEQ ID NO: 206726 - protein, 9 aa, Homo Sapiens
IPGRCELRM

SEQ ID NO: 206727 - protein, 9 aa, Homo Sapiens
LMSNQFVLS

SEQ ID NO: 206728 - protein, 9 aa, Homo Sapiens
DLHSPTDID

SEQ ID NO: 206729 - protein, 9 aa, Homo Sapiens
LVEEVLCAE

SEQ ID NO: 206730 - protein, 9 aa, Homo Sapiens
RLAQKLGVT

SEQ ID NO: 206731 - protein, 9 aa, Homo Sapiens
PGNQELISL

SEQ ID NO: 206732 - protein, 9 aa, Homo Sapiens
EEQLSKEWE

SEQ ID NO: 206733 - protein, 9 aa, Homo Sapiens
GEQISQKSA

SEQ ID NO: 206734 - protein, 9 aa, Homo Sapiens
ASFEWLLWR

SEQ ID NO: 206735 - protein, 9 aa, Homo Sapiens
LWSAGTEAG

SEQ ID NO: 206736 - protein, 9 aa, Homo Sapiens
SLKKLRVNN

SEQ ID NO: 206737 - protein, 9 aa, Homo Sapiens
LHLTLPAGR

SEQ ID NO: 206738 - protein, 9 aa, Homo Sapiens
RKYIHRDLR

SEQ ID NO: 206739 - protein, 9 aa, Homo Sapiens
ITFVAFAIQ

SEQ ID NO: 206740 - protein, 9 aa, Homo Sapiens
ICNKTLKTT

SEQ ID NO: 206741 - protein, 9 aa, Homo Sapiens
HMRTHSGER

SEQ ID NO: 206742 - protein, 9 aa, Homo Sapiens
SSTPGAHRQ

SEQ ID NO: 206743 - protein, 9 aa, Homo Sapiens
ALRPKPSLD

SEQ ID NO: 206744 - protein, 9 aa, Homo Sapiens
HYPVLMTAK

SEQ ID NO: 206745 - protein, 9 aa, Homo Sapiens
KMAFRIYAV

SEQ ID NO: 206746 - protein, 9 aa, Homo Sapiens
VSTTIYNLC

SEQ ID NO: 206747 - protein, 9 aa, Homo Sapiens
MLSDVNDNA

SEQ ID NO: 206748 - protein, 9 aa, Homo Sapiens
SVDDIIALL

SEQ ID NO: 206749 - protein, 9 aa, Homo Sapiens
LVHNRRMLI

SEQ ID NO: 206750 - protein, 9 aa, Homo Sapiens
FPQFPPQGR

SEQ ID NO: 206751 - protein, 9 aa, Homo Sapiens
YNLCKHAAA

SEQ ID NO: 206752 - protein, 9 aa, Homo Sapiens
VVHRRAAAP

SEQ ID NO: 206753 - protein, 9 aa, Homo Sapiens
VRTKEIKHG

SEQ ID NO: 206754 - protein, 9 aa, Homo Sapiens
DLVEEVLCA

SEQ ID NO: 206755 - protein, 9 aa, Homo Sapiens
DGSNTKKNA

SEQ ID NO: 206756 - protein, 9 aa, Homo Sapiens
LTLPAGRYS

SEQ ID NO: 206757 - protein, 9 aa, Homo Sapiens
TLFRICTIR

SEQ ID NO: 206758 - protein, 9 aa, Homo Sapiens
CDMLELHTE

SEQ ID NO: 206759 - protein, 9 aa, Homo Sapiens
WTLIEHQKI

SEQ ID NO: 206760 - protein, 9 aa, Homo Sapiens
PQGRTSSLL

SEQ ID NO: 206761 - protein, 9 aa, Homo Sapiens
THSGERPFE

SEQ ID NO: 206762 - protein, 9 aa, Homo Sapiens
EDGSNTKKN

SEQ ID NO: 206763 - protein, 9 aa, Homo Sapiens
NEMEGSSRT

SEQ ID NO: 206764 - protein, 9 aa, Homo Sapiens
PSAPDDQGP

SEQ ID NO: 206765 - protein, 9 aa, Homo Sapiens
RCKEEIKHG

SEQ ID NO: 206766 - protein, 9 aa, Homo Sapiens
QIENIKQIL

SEQ ID NO: 206767 - protein, 9 aa, Homo Sapiens
HWTTDQSVG

SEQ ID NO: 206768 - protein, 9 aa, Homo Sapiens
CLGGRLERG

SEQ ID NO: 206769 - protein, 9 aa, Homo Sapiens
TVHMRTHSG

SEQ ID NO: 206770 - protein, 9 aa, Homo Sapiens
LGLEKMAFR

SEQ ID NO: 206771 - protein, 9 aa, Homo Sapiens
LKPWQLEVN

SEQ ID NO: 206772 - protein, 9 aa, Homo Sapiens
HARLHLTPS

SEQ ID NO: 206773 - protein, 9 aa, Homo Sapiens
SSIMVSSTS

SEQ ID NO: 206774 - protein, 9 aa, Homo Sapiens
TEYNITVML

SEQ ID NO: 206775 - protein, 9 aa, Homo Sapiens
GMVGSLGYH

SEQ ID NO: 206776 - protein, 9 aa, Homo Sapiens
LCRLFVAEL

SEQ ID NO: 206777 - protein, 9 aa, Homo Sapiens
ERKDNTMVT

SEQ ID NO: 206778 - protein, 9 aa, Homo Sapiens
GTYAGLHNI

SEQ ID NO: 206779 - protein, 9 aa, Homo Sapiens
AATRLPART

SEQ ID NO: 206780 - protein, 9 aa, Homo Sapiens
RERMASFEW

SEQ ID NO: 206781 - protein, 9 aa, Homo Sapiens
YLEKPSVQL

SEQ ID NO: 206782 - protein, 9 aa, Homo Sapiens
ENWIIAIHS

SEQ ID NO: 206783 - protein, 9 aa, Homo Sapiens
PINGFQKAM

SEQ ID NO: 206784 - protein, 9 aa, Homo Sapiens
GRPGQCAGA

SEQ ID NO: 206785 - protein, 9 aa, Homo Sapiens
KTTDFGLAR

SEQ ID NO: 206786 - protein, 9 aa, Homo Sapiens
DAQLEPTHI

SEQ ID NO: 206787 - protein, 9 aa, Homo Sapiens
GISYLEEFQ

SEQ ID NO: 206788 - protein, 9 aa, Homo Sapiens
IPEHVRKEK

SEQ ID NO: 206789 - protein, 9 aa, Homo Sapiens
PMPQFSGKE

SEQ ID NO: 206790 - protein, 9 aa, Homo Sapiens
EFVMNTSNA

SEQ ID NO: 206791 - protein, 9 aa, Homo Sapiens
CAGRCDCDH

SEQ ID NO: 206792 - protein, 9 aa, Homo Sapiens
QPAVKAGTE

SEQ ID NO: 206793 - protein, 9 aa, Homo Sapiens
TEAGTMVKQ

SEQ ID NO: 206794 - protein, 9 aa, Homo Sapiens
MKKLMVLLS

SEQ ID NO: 206795 - protein, 9 aa, Homo Sapiens
TAWFLQELP

SEQ ID NO: 206796 - protein, 9 aa, Homo Sapiens
GCLGGRLER

SEQ ID NO: 206797 - protein, 9 aa, Homo Sapiens
GGGCLGGRL

SEQ ID NO: 206798 - protein, 9 aa, Homo Sapiens
QHDTQDLVE

SEQ ID NO: 206799 - protein, 9 aa, Homo Sapiens
TAADATEFL

SEQ ID NO: 206800 - protein, 9 aa, Homo Sapiens
VLNPRGVVH

SEQ ID NO: 206801 - protein, 9 aa, Homo Sapiens
LHHQWKRNN

SEQ ID NO: 206802 - protein, 9 aa, Homo Sapiens
MLVLGYNQK

SEQ ID NO: 206803 - protein, 9 aa, Homo Sapiens
ITAAPKIAT

SEQ ID NO: 206804 - protein, 9 aa, Homo Sapiens
YNHDIRFAN

SEQ ID NO: 206805 - protein, 9 aa, Homo Sapiens
YEVVTAMGD

SEQ ID NO: 206806 - protein, 9 aa, Homo Sapiens
TDRQGQNSH

SEQ ID NO: 206807 - protein, 9 aa, Homo Sapiens
VPDQEPTHT

SEQ ID NO: 206808 - protein, 9 aa, Homo Sapiens
QFGEGCAGR

SEQ ID NO: 206809 - protein, 9 aa, Homo Sapiens
HLLGLEKMA

SEQ ID NO: 206810 - protein, 9 aa, Homo Sapiens
SPGTYAGLH

SEQ ID NO: 206811 - protein, 9 aa, Homo Sapiens
IYVAIQHSD

SEQ ID NO: 206812 - protein, 9 aa, Homo Sapiens
GIYVAIQHS

SEQ ID NO: 206813 - protein, 9 aa, Homo Sapiens
FDVSKGSRI

SEQ ID NO: 206814 - protein, 9 aa, Homo Sapiens
EGLQPAVKA

SEQ ID NO: 206815 - protein, 9 aa, Homo Sapiens
PPQGPAQAP

SEQ ID NO: 206816 - protein, 9 aa, Homo Sapiens
CETSSCQPS

SEQ ID NO: 206817 - protein, 9 aa, Homo Sapiens
GILPLQMKK

SEQ ID NO: 206818 - protein, 9 aa, Homo Sapiens
PDINILLFQ

SEQ ID NO: 206819 - protein, 9 aa, Homo Sapiens
GLLPGWGQW

SEQ ID NO: 206820 - protein, 9 aa, Homo Sapiens
TMVTRLLNI

SEQ ID NO: 206821 - protein, 9 aa, Homo Sapiens
PWRPLHTAG

SEQ ID NO: 206822 - protein, 9 aa, Homo Sapiens
KEYGLPDIN

SEQ ID NO: 206823 - protein, 9 aa, Homo Sapiens
TPYTHYRFQ

SEQ ID NO: 206824 - protein, 9 aa, Homo Sapiens
RQGRVYVAR

SEQ ID NO: 206825 - protein, 9 aa, Homo Sapiens
CLSHLCANG

SEQ ID NO: 206826 - protein, 9 aa, Homo Sapiens
NKKLVKSAK

SEQ ID NO: 206827 - protein, 9 aa, Homo Sapiens
QLSKEWEDS

SEQ ID NO: 206828 - protein, 9 aa, Homo Sapiens
LWTLIEHQK

SEQ ID NO: 206829 - protein, 9 aa, Homo Sapiens
LHIHFQRTV

SEQ ID NO: 206830 - protein, 9 aa, Homo Sapiens
SMIQDRAFR

SEQ ID NO: 206831 - protein, 9 aa, Homo Sapiens
LGAQVLHRA

SEQ ID NO: 206832 - protein, 9 aa, Homo Sapiens
SPIGPPGPA

SEQ ID NO: 206833 - protein, 9 aa, Homo Sapiens
HWPTDVLTG

SEQ ID NO: 206834 - protein, 9 aa, Homo Sapiens
NHDIRFANI

SEQ ID NO: 206835 - protein, 9 aa, Homo Sapiens
NISVDDIIA

SEQ ID NO: 206836 - protein, 9 aa, Homo Sapiens
LEKMAFRIY

SEQ ID NO: 206837 - protein, 9 aa, Homo Sapiens
REECAVHQG

SEQ ID NO: 206838 - protein, 9 aa, Homo Sapiens
VMNTSNAGA

SEQ ID NO: 206839 - protein, 9 aa, Homo Sapiens
AEDSLGAQV

SEQ ID NO: 206840 - protein, 9 aa, Homo Sapiens
PGAGGNRVH

SEQ ID NO: 206841 - protein, 9 aa, Homo Sapiens
HLCANGSTC

SEQ ID NO: 206842 - protein, 9 aa, Homo Sapiens
PGILPLQMK

SEQ ID NO: 206843 - protein, 9 aa, Homo Sapiens
QEEEQLSKE

SEQ ID NO: 206844 - protein, 9 aa, Homo Sapiens
IIALLDLAE

SEQ ID NO: 206845 - protein, 9 aa, Homo Sapiens
QPASSHHGS

SEQ ID NO: 206846 - protein, 9 aa, Homo Sapiens
NLCKHAAAN

SEQ ID NO: 206847 - protein, 9 aa, Homo Sapiens
SNDKFLISL

SEQ ID NO: 206848 - protein, 9 aa, Homo Sapiens
SSVRGNALS

SEQ ID NO: 206849 - protein, 9 aa, Homo Sapiens
TQGAPSGGG

SEQ ID NO: 206850 - protein, 9 aa, Homo Sapiens
RLAEHQRIH

SEQ ID NO: 206851 - protein, 9 aa, Homo Sapiens
IEYEDESGH

SEQ ID NO: 206852 - protein, 9 aa, Homo Sapiens
TFIILGSLV

SEQ ID NO: 206853 - protein, 9 aa, Homo Sapiens
HGRDQGRHP

SEQ ID NO: 206854 - protein, 9 aa, Homo Sapiens
SRMLRFPLG

SEQ ID NO: 206855 - protein, 9 aa, Homo Sapiens
PLVNEMEGS

SEQ ID NO: 206856 - protein, 9 aa, Homo Sapiens
MLEKEPTIA

SEQ ID NO: 206857 - protein, 9 aa, Homo Sapiens
PLGSSSPNI

SEQ ID NO: 206858 - protein, 9 aa, Homo Sapiens
CAWHWPTDV

SEQ ID NO: 206859 - protein, 9 aa, Homo Sapiens
NTTLVITIQ

SEQ ID NO: 206860 - protein, 9 aa, Homo Sapiens
DDRVHEQGY

SEQ ID NO: 206861 - protein, 9 aa, Homo Sapiens
APTAEKREW

SEQ ID NO: 206862 - protein, 9 aa, Homo Sapiens
RIYGFPPSS

SEQ ID NO: 206863 - protein, 9 aa, Homo Sapiens
LWLGTLCPG

SEQ ID NO: 206864 - protein, 9 aa, Homo Sapiens
ATTNIPEHV

SEQ ID NO: 206865 - protein, 9 aa, Homo Sapiens
EEVPGVFSR

SEQ ID NO: 206866 - protein, 9 aa, Homo Sapiens
FGEGCAGRC

SEQ ID NO: 206867 - protein, 9 aa, Homo Sapiens
LRPKPSLDR

SEQ ID NO: 206868 - protein, 9 aa, Homo Sapiens
ATPVNLTEL

SEQ ID NO: 206869 - protein, 9 aa, Homo Sapiens
AHRSPSAPD

SEQ ID NO: 206870 - protein, 9 aa, Homo Sapiens
NITVMLSDV

SEQ ID NO: 206871 - protein, 9 aa, Homo Sapiens
TAGGGGGPG

SEQ ID NO: 206872 - protein, 9 aa, Homo Sapiens
EAEQEGNEM

SEQ ID NO: 206873 - protein, 9 aa, Homo Sapiens
RHPVRVPDQ

SEQ ID NO: 206874 - protein, 9 aa, Homo Sapiens
WTDACLSHL

SEQ ID NO: 206875 - protein, 9 aa, Homo Sapiens
YTHYRFQMK

SEQ ID NO: 206876 - protein, 9 aa, Homo Sapiens
CRMPRTLCR

SEQ ID NO: 206877 - protein, 9 aa, Homo Sapiens
HLKAGEQIS

SEQ ID NO: 206878 - protein, 9 aa, Homo Sapiens
TSPIGPPGP

SEQ ID NO: 206879 - protein, 9 aa, Homo Sapiens
IQHSDKRIH

SEQ ID NO: 206880 - protein, 9 aa, Homo Sapiens
FVAFAIQMF

SEQ ID NO: 206881 - protein, 9 aa, Homo Sapiens
VGVGKSALT

SEQ ID NO: 206882 - protein, 9 aa, Homo Sapiens
LHLTPSLVY

SEQ ID NO: 206883 - protein, 9 aa, Homo Sapiens
QPAPAGAWS

SEQ ID NO: 206884 - protein, 9 aa, Homo Sapiens
NGFQKAMVK

SEQ ID NO: 206885 - protein, 9 aa, Homo Sapiens
AEQEGNEME

SEQ ID NO: 206886 - protein, 9 aa, Homo Sapiens
LGNTHIGAA

SEQ ID NO: 206887 - protein, 9 aa, Homo Sapiens
LEEWQGSDV

SEQ ID NO: 206888 - protein, 9 aa, Homo Sapiens
PRGVVHRRA

SEQ ID NO: 206889 - protein, 9 aa, Homo Sapiens
TSGYSQQVV

SEQ ID NO: 206890 - protein, 9 aa, Homo Sapiens
GVTQRDQKQ

SEQ ID NO: 206891 - protein, 9 aa, Homo Sapiens
IERKSDLHL

SEQ ID NO: 206892 - protein, 9 aa, Homo Sapiens
GEPPVFSSP

SEQ ID NO: 206893 - protein, 9 aa, Homo Sapiens
YMHSWLEPT

SEQ ID NO: 206894 - protein, 9 aa, Homo Sapiens
QEGLQPAVK

SEQ ID NO: 206895 - protein, 9 aa, Homo Sapiens
LLQWLLITL

SEQ ID NO: 206896 - protein, 9 aa, Homo Sapiens
SHIPGRCEL

SEQ ID NO: 206897 - protein, 9 aa, Homo Sapiens
HPVRVPDQE

SEQ ID NO: 206898 - protein, 9 aa, Homo Sapiens
VNLTELAKL

SEQ ID NO: 206899 - protein, 9 aa, Homo Sapiens
TTDQSVGDN

SEQ ID NO: 206900 - protein, 9 aa, Homo Sapiens
LGIHWLRVH

SEQ ID NO: 206901 - protein, 9 aa, Homo Sapiens
SSHLTMVLI

SEQ ID NO: 206902 - protein, 9 aa, Homo Sapiens
ARAPRFNHT

SEQ ID NO: 206903 - protein, 9 aa, Homo Sapiens
LAQKLGVTQ

SEQ ID NO: 206904 - protein, 9 aa, Homo Sapiens
FSSVRGNAL

SEQ ID NO: 206905 - protein, 9 aa, Homo Sapiens
QFLDLLEPL

SEQ ID NO: 206906 - protein, 9 aa, Homo Sapiens
IHFQRTVIL

SEQ ID NO: 206907 - protein, 9 aa, Homo Sapiens
PAMLKLSCT

SEQ ID NO: 206908 - protein, 9 aa, Homo Sapiens
GAPSHQQPM

SEQ ID NO: 206909 - protein, 9 aa, Homo Sapiens
ISVDDIIAL

SEQ ID NO: 206910 - protein, 9 aa, Homo Sapiens
DLNQNEEVL

SEQ ID NO: 206911 - protein, 9 aa, Homo Sapiens
ESSTTLVVR

SEQ ID NO: 206912 - protein, 9 aa, Homo Sapiens
HDIRFANIY

SEQ ID NO: 206913 - protein, 9 aa, Homo Sapiens
KGSRIYGFP

SEQ ID NO: 206914 - protein, 9 aa, Homo Sapiens
VLGYNQKNT

SEQ ID NO: 206915 - protein, 9 aa, Homo Sapiens
VELSKKNWL

SEQ ID NO: 206916 - protein, 9 aa, Homo Sapiens
LLWSAGTEA

SEQ ID NO: 206917 - protein, 9 aa, Homo Sapiens
ASRGHRGAH

SEQ ID NO: 206918 - protein, 9 aa, Homo Sapiens
THTGHLWLG

SEQ ID NO: 206919 - protein, 9 aa, Homo Sapiens
DETYLMSNQ

SEQ ID NO: 206920 - protein, 9 aa, Homo Sapiens
TCSSHLTMV

SEQ ID NO: 206921 - protein, 9 aa, Homo Sapiens
LLFDVAEGS

SEQ ID NO: 206922 - protein, 9 aa, Homo Sapiens
LHLLGLEKM

SEQ ID NO: 206923 - protein, 9 aa, Homo Sapiens
CESMWRCSF

SEQ ID NO: 206924 - protein, 9 aa, Homo Sapiens
MEGSSRTRH

SEQ ID NO: 206925 - protein, 9 aa, Homo Sapiens
YDWHWTTDQ

SEQ ID NO: 206926 - protein, 9 aa, Homo Sapiens
AQLCAWHWP

SEQ ID NO: 206927 - protein, 9 aa, Homo Sapiens
RVYEVVTAM

SEQ ID NO: 206928 - protein, 9 aa, Homo Sapiens
RTAWFLQEL

SEQ ID NO: 206929 - protein, 9 aa, Homo Sapiens
STKENKCLL

SEQ ID NO: 206930 - protein, 9 aa, Homo Sapiens
KSDSSFYLE

SEQ ID NO: 206931 - protein, 9 aa, Homo Sapiens
YVAIQHSDK

SEQ ID NO: 206932 - protein, 9 aa, Homo Sapiens
FCEIPAMLK

SEQ ID NO: 206933 - protein, 9 aa, Homo Sapiens
NPAEFVMNT

SEQ ID NO: 206934 - protein, 9 aa, Homo Sapiens
EQEGNEMEG

SEQ ID NO: 206935 - protein, 9 aa, Homo Sapiens
ALQRWHEGF

SEQ ID NO: 206936 - protein, 9 aa, Homo Sapiens
STTIYNLCK

SEQ ID NO: 206937 - protein, 9 aa, Homo Sapiens
QCAGAWGLL

SEQ ID NO: 206938 - protein, 9 aa, Homo Sapiens
EKEPTIASP

SEQ ID NO: 206939 - protein, 9 aa, Homo Sapiens
QRLAQKLGV

SEQ ID NO: 206940 - protein, 9 aa, Homo Sapiens
LSIEKQFLD

SEQ ID NO: 206941 - protein, 9 aa, Homo Sapiens
CSHIPGRCE

SEQ ID NO: 206942 - protein, 9 aa, Homo Sapiens
KTCPVQRWV

SEQ ID NO: 206943 - protein, 9 aa, Homo Sapiens
GRTSSLLSR

SEQ ID NO: 206944 - protein, 9 aa, Homo Sapiens
LTMVLIWYG

SEQ ID NO: 206945 - protein, 9 aa, Homo Sapiens
GVNEYGKTD

SEQ ID NO: 206946 - protein, 9 aa, Homo Sapiens
VSSTPGAHR

SEQ ID NO: 206947 - protein, 9 aa, Homo Sapiens
VLHHQWKRN

SEQ ID NO: 206948 - protein, 9 aa, Homo Sapiens
NFSVVLGIH

SEQ ID NO: 206949 - protein, 9 aa, Homo Sapiens
PDHGRDQGR

SEQ ID NO: 206950 - protein, 9 aa, Homo Sapiens
QKNTEGTQK

SEQ ID NO: 206951 - protein, 9 aa, Homo Sapiens
DNTMVTRLL

SEQ ID NO: 206952 - protein, 9 aa, Homo Sapiens
RVNNISGIE

SEQ ID NO: 206953 - protein, 9 aa, Homo Sapiens
DACLSHLCA

SEQ ID NO: 206954 - protein, 9 aa, Homo Sapiens
PGPAQASAA

SEQ ID NO: 206955 - protein, 9 aa, Homo Sapiens
TAAPKIATG

SEQ ID NO: 206956 - protein, 9 aa, Homo Sapiens
LGAASRGHR

SEQ ID NO: 206957 - protein, 9 aa, Homo Sapiens
VVLGIHWLR

SEQ ID NO: 206958 - protein, 9 aa, Homo Sapiens
EDMTLCVAD

SEQ ID NO: 206959 - protein, 9 aa, Homo Sapiens
LVVVGAVGV

SEQ ID NO: 206960 - protein, 9 aa, Homo Sapiens
PGGRPGQCA

SEQ ID NO: 206961 - protein, 9 aa, Homo Sapiens
ALGRMFMYF

SEQ ID NO: 206962 - protein, 9 aa, Homo Sapiens
WGQWHLGAA

SEQ ID NO: 206963 - protein, 9 aa, Homo Sapiens
GPAQAPLHP

SEQ ID NO: 206964 - protein, 9 aa, Homo Sapiens
LRLHQDINY

SEQ ID NO: 206965 - protein, 9 aa, Homo Sapiens
PTDIDAGIT

SEQ ID NO: 206966 - protein, 9 aa, Homo Sapiens
RSQRTQVFL

SEQ ID NO: 206967 - protein, 9 aa, Homo Sapiens
YNITVMLSD

SEQ ID NO: 206968 - protein, 9 aa, Homo Sapiens
FANIYISTY

SEQ ID NO: 206969 - protein, 9 aa, Homo Sapiens
DVRKSCFDP

SEQ ID NO: 206970 - protein, 9 aa, Homo Sapiens
SNVDKGIYQ

SEQ ID NO: 206971 - protein, 9 aa, Homo Sapiens
DVSKGSRIY

SEQ ID NO: 206972 - protein, 9 aa, Homo Sapiens
VRVPDQEPT

SEQ ID NO: 206973 - protein, 9 aa, Homo Sapiens
EIDKKCSEI

SEQ ID NO: 206974 - protein, 9 aa, Homo Sapiens
GVNRLAEHQ

SEQ ID NO: 206975 - protein, 9 aa, Homo Sapiens
CFVSQETGN

SEQ ID NO: 206976 - protein, 9 aa, Homo Sapiens
VPDHGRDQG

SEQ ID NO: 206977 - protein, 9 aa, Homo Sapiens
LHTAGGGGG

SEQ ID NO: 206978 - protein, 9 aa, Homo Sapiens
LREEVPGVF

SEQ ID NO: 206979 - protein, 9 aa, Homo Sapiens
TIASPDIMF

SEQ ID NO: 206980 - protein, 9 aa, Homo Sapiens
IRFLEYWPV

SEQ ID NO: 206981 - protein, 9 aa, Homo Sapiens
LFGAMAGAL

SEQ ID NO: 206982 - protein, 9 aa, Homo Sapiens
DETESKETS

SEQ ID NO: 206983 - protein, 9 aa, Homo Sapiens
LPYDYNCVE

SEQ ID NO: 206984 - protein, 9 aa, Homo Sapiens
AAFGLNVIA

SEQ ID NO: 206985 - protein, 9 aa, Homo Sapiens
DTAADATEF

SEQ ID NO: 206986 - protein, 9 aa, Homo Sapiens
LQFSLKKLR

SEQ ID NO: 206987 - protein, 9 aa, Homo Sapiens
ENIKQILGN

SEQ ID NO: 206988 - protein, 9 aa, Homo Sapiens
QNVPGCESL

SEQ ID NO: 206989 - protein, 9 aa, Homo Sapiens
MLRFPLGSS

SEQ ID NO: 206990 - protein, 9 aa, Homo Sapiens
FQPASSHHG

SEQ ID NO: 206991 - protein, 9 aa, Homo Sapiens
MHSWLEPTP

SEQ ID NO: 206992 - protein, 9 aa, Homo Sapiens
SESSTTLVV

SEQ ID NO: 206993 - protein, 9 aa, Homo Sapiens
VNEMEGSSR

SEQ ID NO: 206994 - protein, 9 aa, Homo Sapiens
LGSSSPNIL

SEQ ID NO: 206995 - protein, 9 aa, Homo Sapiens
SVGRCLVPK

SEQ ID NO: 206996 - protein, 9 aa, Homo Sapiens
TGHLWLGTL

SEQ ID NO: 206997 - protein, 9 aa, Homo Sapiens
KLRVNNISG

SEQ ID NO: 206998 - protein, 9 aa, Homo Sapiens
PGRCELRMP

SEQ ID NO: 206999 - protein, 9 aa, Homo Sapiens
AASRGHRGA

SEQ ID NO: 207000 - protein, 9 aa, Homo Sapiens
GPSHCARCK

SEQ ID NO: 207001 - protein, 9 aa, Homo Sapiens
MAGAPSHQQ

SEQ ID NO: 207002 - protein, 9 aa, Homo Sapiens
GSVFVTFII

SEQ ID NO: 207003 - protein, 9 aa, Homo Sapiens
FEWLLWRIC

SEQ ID NO: 207004 - protein, 9 aa, Homo Sapiens
CSFYLYVFT

SEQ ID NO: 207005 - protein, 9 aa, Homo Sapiens
ALPIAIINY

SEQ ID NO: 207006 - protein, 9 aa, Homo Sapiens
ILPYDYNCV

SEQ ID NO: 207007 - protein, 9 aa, Homo Sapiens
CVELSEING

SEQ ID NO: 207008 - protein, 9 aa, Homo Sapiens
HLTLPAGRY

SEQ ID NO: 207009 - protein, 9 aa, Homo Sapiens
TPGMVGSLG

SEQ ID NO: 207010 - protein, 9 aa, Homo Sapiens
LENWIIAIH

SEQ ID NO: 207011 - protein, 9 aa, Homo Sapiens
FQMKQVNIV

SEQ ID NO: 207012 - protein, 9 aa, Homo Sapiens
DYNLKLKLC

SEQ ID NO: 207013 - protein, 9 aa, Homo Sapiens
IAIHSACAT

SEQ ID NO: 207014 - protein, 9 aa, Homo Sapiens
PYTHYRFQM

SEQ ID NO: 207015 - protein, 9 aa, Homo Sapiens
LLPGWGQWH

SEQ ID NO: 207016 - protein, 9 aa, Homo Sapiens
QGRHPVRVP

SEQ ID NO: 207017 - protein, 9 aa, Homo Sapiens
FSLKKLRVN

SEQ ID NO: 207018 - protein, 9 aa, Homo Sapiens
KQILGNTHI

SEQ ID NO: 207019 - protein, 9 aa, Homo Sapiens
VLHRAAVTG

SEQ ID NO: 207020 - protein, 9 aa, Homo Sapiens
DFRDQNVPG

SEQ ID NO: 207021 - protein, 9 aa, Homo Sapiens
LMVLLSLIA

SEQ ID NO: 207022 - protein, 9 aa, Homo Sapiens
LHQDINYYN

SEQ ID NO: 207023 - protein, 9 aa, Homo Sapiens
GGPGPAQAS

SEQ ID NO: 207024 - protein, 9 aa, Homo Sapiens
TTNIPEHVR

SEQ ID NO: 207025 - protein, 9 aa, Homo Sapiens
EYGLPDINI

SEQ ID NO: 207026 - protein, 9 aa, Homo Sapiens
SFIMKLHIH

SEQ ID NO: 207027 - protein, 9 aa, Homo Sapiens
ISQPKRTMQ

SEQ ID NO: 207028 - protein, 9 aa, Homo Sapiens
SYNHDIRFA

SEQ ID NO: 207029 - protein, 9 aa, Homo Sapiens
HMWSAPGIL

SEQ ID NO: 207030 - protein, 9 aa, Homo Sapiens
WLLMAESEG

SEQ ID NO: 207031 - protein, 9 aa, Homo Sapiens
AGAPSHQQP

SEQ ID NO: 207032 - protein, 9 aa, Homo Sapiens
EQLSKEWED

SEQ ID NO: 207033 - protein, 9 aa, Homo Sapiens
QWHLGAASR

SEQ ID NO: 207034 - protein, 9 aa, Homo Sapiens
NTMVTRLLN

SEQ ID NO: 207035 - protein, 9 aa, Homo Sapiens
LVLHHQWKR

SEQ ID NO: 207036 - protein, 9 aa, Homo Sapiens
IRFANIYIS

SEQ ID NO: 207037 - protein, 9 aa, Homo Sapiens
ELETLFRIC

SEQ ID NO: 207038 - protein, 9 aa, Homo Sapiens
KQIGINKKL

SEQ ID NO: 207039 - protein, 9 aa, Homo Sapiens
LLQCPRLPV

SEQ ID NO: 207040 - protein, 9 aa, Homo Sapiens
GDMEKIHLD

SEQ ID NO: 207041 - protein, 9 aa, Homo Sapiens
YNQKNTEGT

SEQ ID NO: 207042 - protein, 9 aa, Homo Sapiens
LCLATFLFY

SEQ ID NO: 207043 - protein, 9 aa, Homo Sapiens
LNVIATRAG

SEQ ID NO: 207044 - protein, 9 aa, Homo Sapiens
TMQEDLLSL

SEQ ID NO: 207045 - protein, 9 aa, Homo Sapiens
KGPLPGHLV

SEQ ID NO: 207046 - protein, 9 aa, Homo Sapiens
SLVVLFGAM

SEQ ID NO: 207047 - protein, 9 aa, Homo Sapiens
KKCSEIPCY

SEQ ID NO: 207048 - protein, 9 aa, Homo Sapiens
NLTELAKLE

SEQ ID NO: 207049 - protein, 9 aa, Homo Sapiens
QASAAVLNP

SEQ ID NO: 207050 - protein, 9 aa, Homo Sapiens
SRGAADDRV

SEQ ID NO: 207051 - protein, 9 aa, Homo Sapiens
AWHWPTDVL

SEQ ID NO: 207052 - protein, 9 aa, Homo Sapiens
CGISYLEEF

SEQ ID NO: 207053 - protein, 9 aa, Homo Sapiens
MAGALGRDL

SEQ ID NO: 207054 - protein, 9 aa, Homo Sapiens
LLSLIAAAW

SEQ ID NO: 207055 - protein, 9 aa, Homo Sapiens
THYRFQMKQ

SEQ ID NO: 207056 - protein, 9 aa, Homo Sapiens
LETLFRICT

SEQ ID NO: 207057 - protein, 9 aa, Homo Sapiens
DQGRHPVRV

SEQ ID NO: 207058 - protein, 9 aa, Homo Sapiens
QRTQVFLEG

SEQ ID NO: 207059 - protein, 9 aa, Homo Sapiens
EENRPLQNN

SEQ ID NO: 207060 - protein, 9 aa, Homo Sapiens
PAQAPLHPQ

SEQ ID NO: 207061 - protein, 9 aa, Homo Sapiens
EDSLGAQVL

SEQ ID NO: 207062 - protein, 9 aa, Homo Sapiens
SGPTGTTQG

SEQ ID NO: 207063 - protein, 9 aa, Homo Sapiens
QLEPTHISP

SEQ ID NO: 207064 - protein, 9 aa, Homo Sapiens
VITIQLEAS

SEQ ID NO: 207065 - protein, 9 aa, Homo Sapiens
TAQPTDTCL

SEQ ID NO: 207066 - protein, 9 aa, Homo Sapiens
PIKSDSSFY

SEQ ID NO: 207067 - protein, 9 aa, Homo Sapiens
RTMQEDLLS

SEQ ID NO: 207068 - protein, 9 aa, Homo Sapiens
LALVLHHQW

SEQ ID NO: 207069 - protein, 9 aa, Homo Sapiens
PSYQDNRCF

SEQ ID NO: 207070 - protein, 9 aa, Homo Sapiens
QDNRCFVSQ

SEQ ID NO: 207071 - protein, 9 aa, Homo Sapiens
RDAPSLESR

SEQ ID NO: 207072 - protein, 9 aa, Homo Sapiens
LEALGRMFM

SEQ ID NO: 207073 - protein, 9 aa, Homo Sapiens
DMTLCVADF

SEQ ID NO: 207074 - protein, 9 aa, Homo Sapiens
LQPAVKAGT

SEQ ID NO: 207075 - protein, 9 aa, Homo Sapiens
VTFIILGSL

SEQ ID NO: 207076 - protein, 9 aa, Homo Sapiens
PQFPPQGRT

SEQ ID NO: 207077 - protein, 9 aa, Homo Sapiens
ELHTEIEYM

SEQ ID NO: 207078 - protein, 9 aa, Homo Sapiens
ATRLPARTA

SEQ ID NO: 207079 - protein, 9 aa, Homo Sapiens
LTVHMRTHS

SEQ ID NO: 207080 - protein, 9 aa, Homo Sapiens
GSDVEKRRR

SEQ ID NO: 207081 - protein, 9 aa, Homo Sapiens
LPARTAWFL

SEQ ID NO: 207082 - protein, 9 aa, Homo Sapiens
CAGAWGLLP

SEQ ID NO: 207083 - protein, 9 aa, Homo Sapiens
TYAGLHNIP

SEQ ID NO: 207084 - protein, 9 aa, Homo Sapiens
EEVLQTEKI

SEQ ID NO: 207085 - protein, 9 aa, Homo Sapiens
SNQFVLSTS

SEQ ID NO: 207086 - protein, 9 aa, Homo Sapiens
GAADDRVHE

SEQ ID NO: 207087 - protein, 9 aa, Homo Sapiens
ARLHLTPSL

SEQ ID NO: 207088 - protein, 9 aa, Homo Sapiens
TTLVVRYRR

SEQ ID NO: 207089 - protein, 9 aa, Homo Sapiens
LNMCTPGNQ

SEQ ID NO: 207090 - protein, 9 aa, Homo Sapiens
DKGIYQLEK

SEQ ID NO: 207091 - protein, 9 aa, Homo Sapiens
DLHLTLPAG

SEQ ID NO: 207092 - protein, 9 aa, Homo Sapiens
TELAKLEVK

SEQ ID NO: 207093 - protein, 9 aa, Homo Sapiens
VQALQRWHE

SEQ ID NO: 207094 - protein, 9 aa, Homo Sapiens
FHAAIDGDP

SEQ ID NO: 207095 - protein, 9 aa, Homo Sapiens
NGSLTSPGT

SEQ ID NO: 207096 - protein, 9 aa, Homo Sapiens
LHTEIEYMM

SEQ ID NO: 207097 - protein, 9 aa, Homo Sapiens
VYEVVTAMG

SEQ ID NO: 207098 - protein, 9 aa, Homo Sapiens
KKNWLLMAE

SEQ ID NO: 207099 - protein, 9 aa, Homo Sapiens
SHCARCKEE

SEQ ID NO: 207100 - protein, 9 aa, Homo Sapiens
YDYNLKLKL

SEQ ID NO: 207101 - protein, 9 aa, Homo Sapiens
DQSVGDNSS

SEQ ID NO: 207102 - protein, 9 aa, Homo Sapiens
ANIYISTYF

SEQ ID NO: 207103 - protein, 9 aa, Homo Sapiens
QFSLKKLRV

SEQ ID NO: 207104 - protein, 9 aa, Homo Sapiens
EKNDETESK

SEQ ID NO: 207105 - protein, 9 aa, Homo Sapiens
TVMLSDVND

SEQ ID NO: 207106 - protein, 9 aa, Homo Sapiens
KKLEGRCLD

SEQ ID NO: 207107 - protein, 9 aa, Homo Sapiens
ETSSCQPSC

SEQ ID NO: 207108 - protein, 9 aa, Homo Sapiens
SRKGAAFGL

SEQ ID NO: 207109 - protein, 9 aa, Homo Sapiens
LKAGEQISQ

SEQ ID NO: 207110 - protein, 9 aa, Homo Sapiens
CTPGNQELI

SEQ ID NO: 207111 - protein, 9 aa, Homo Sapiens
FFDVSKGSR

SEQ ID NO: 207112 - protein, 9 aa, Homo Sapiens
DNRCFVSQE

SEQ ID NO: 207113 - protein, 9 aa, Homo Sapiens
RGAHRSPSA

SEQ ID NO: 207114 - protein, 9 aa, Homo Sapiens
AFLGCMGST

SEQ ID NO: 207115 - protein, 9 aa, Homo Sapiens
GPTGTTQGA

SEQ ID NO: 207116 - protein, 9 aa, Homo Sapiens
CGLDPHTIP

SEQ ID NO: 207117 - protein, 9 aa, Homo Sapiens
QPGAGGNRV

SEQ ID NO: 207118 - protein, 9 aa, Homo Sapiens
FPLGSSSPN

SEQ ID NO: 207119 - protein, 9 aa, Homo Sapiens
RGPSHCARC

SEQ ID NO: 207120 - protein, 9 aa, Homo Sapiens
INKKLVKSA

SEQ ID NO: 207121 - protein, 9 aa, Homo Sapiens
MVTRLLNIN

SEQ ID NO: 207122 - protein, 9 aa, Homo Sapiens
VKLDNRLIL

SEQ ID NO: 207123 - protein, 9 aa, Homo Sapiens
QCPMPQFSG

SEQ ID NO: 207124 - protein, 9 aa, Homo Sapiens
GSTKENKCL

SEQ ID NO: 207125 - protein, 9 aa, Homo Sapiens
TEFLILLQC

SEQ ID NO: 207126 - protein, 9 aa, Homo Sapiens
FGAMAGALG

SEQ ID NO: 207127 - protein, 9 aa, Homo Sapiens
LEPTHISPA

SEQ ID NO: 207128 - protein, 9 aa, Homo Sapiens
NIEYEDESG

SEQ ID NO: 207129 - protein, 9 aa, Homo Sapiens
HLGAASRGH

SEQ ID NO: 207130 - protein, 9 aa, Homo Sapiens
AMGDVRGAG

SEQ ID NO: 207131 - protein, 9 aa, Homo Sapiens
MVGSLGYHP

SEQ ID NO: 207132 - protein, 9 aa, Homo Sapiens
ASSHHGSRG

SEQ ID NO: 207133 - protein, 9 aa, Homo Sapiens
RGLTSPIGP

SEQ ID NO: 207134 - protein, 9 aa, Homo Sapiens
HNGDMEKIH

SEQ ID NO: 207135 - protein, 9 aa, Homo Sapiens
SAGTEAGTM

SEQ ID NO: 207136 - protein, 9 aa, Homo Sapiens
DKFLISLLF

SEQ ID NO: 207137 - protein, 9 aa, Homo Sapiens
QGPWRPLHT

SEQ ID NO: 207138 - protein, 9 aa, Homo Sapiens
ATFLFYLSK

SEQ ID NO: 207139 - protein, 9 aa, Homo Sapiens
PPSALRPKP

SEQ ID NO: 207140 - protein, 9 aa, Homo Sapiens
VGRCLVPKG

SEQ ID NO: 207141 - protein, 9 aa, Homo Sapiens
LDNRLILFN

SEQ ID NO: 207142 - protein, 9 aa, Homo Sapiens
DLEALGRMF

SEQ ID NO: 207143 - protein, 9 aa, Homo Sapiens
RDDLEALGR

SEQ ID NO: 207144 - protein, 9 aa, Homo Sapiens
VVGAVGVGK

SEQ ID NO: 207145 - protein, 9 aa, Homo Sapiens
DYNCVELSE

SEQ ID NO: 207146 - protein, 9 aa, Homo Sapiens
EVLQTEKIT

SEQ ID NO: 207147 - protein, 9 aa, Homo Sapiens
RVPDQEPTH

SEQ ID NO: 207148 - protein, 9 aa, Homo Sapiens
SHLCANGST

SEQ ID NO: 207149 - protein, 9 aa, Homo Sapiens
VRGLTSPIG

SEQ ID NO: 207150 - protein, 9 aa, Homo Sapiens
VLQTEKITF

SEQ ID NO: 207151 - protein, 9 aa, Homo Sapiens
TSPGTYAGL

SEQ ID NO: 207152 - protein, 9 aa, Homo Sapiens
RLPVQPGAG

SEQ ID NO: 207153 - protein, 9 aa, Homo Sapiens
GPWRPLHTA

SEQ ID NO: 207154 - protein, 9 aa, Homo Sapiens
SHQQPMLSG

SEQ ID NO: 207155 - protein, 9 aa, Homo Sapiens
VLLSLIAAA

SEQ ID NO: 207156 - protein, 9 aa, Homo Sapiens
HYRFQMKQV

SEQ ID NO: 207157 - protein, 9 aa, Homo Sapiens
GSLTSPGTY

SEQ ID NO: 207158 - protein, 9 aa, Homo Sapiens
GTTQGAPSG

SEQ ID NO: 207159 - protein, 9 aa, Homo Sapiens
PTEDGSNTK

SEQ ID NO: 207160 - protein, 9 aa, Homo Sapiens
TKENKCLLM

SEQ ID NO: 207161 - protein, 9 aa, Homo Sapiens
QLEVNHSPS

SEQ ID NO: 207162 - protein, 9 aa, Homo Sapiens
AADATEFLI

SEQ ID NO: 207163 - protein, 9 aa, Homo Sapiens
DSDDENIEY

SEQ ID NO: 207164 - protein, 9 aa, Homo Sapiens
DILPYDYNC

SEQ ID NO: 207165 - protein, 9 aa, Homo Sapiens
IERKCSSIM

SEQ ID NO: 207166 - protein, 9 aa, Homo Sapiens
PDHWIVPGG

SEQ ID NO: 207167 - protein, 9 aa, Homo Sapiens
HWLRVHAPE

SEQ ID NO: 207168 - protein, 9 aa, Homo Sapiens
HNRRMLIHF

SEQ ID NO: 207169 - protein, 9 aa, Homo Sapiens
YDHTPGMVG

SEQ ID NO: 207170 - protein, 9 aa, Homo Sapiens
RLWTLIEHQ

SEQ ID NO: 207171 - protein, 9 aa, Homo Sapiens
LGRMFMYFL

SEQ ID NO: 207172 - protein, 9 aa, Homo Sapiens
PRTLCRLFV

SEQ ID NO: 207173 - protein, 9 aa, Homo Sapiens
KEPTIASPD

SEQ ID NO: 207174 - protein, 9 aa, Homo Sapiens
RTKEIKHGI

SEQ ID NO: 207175 - protein, 9 aa, Homo Sapiens
LGYNQKNTE

SEQ ID NO: 207176 - protein, 9 aa, Homo Sapiens
AIQHSDKRI

SEQ ID NO: 207177 - protein, 9 aa, Homo Sapiens
TRLPARTAW

SEQ ID NO: 207178 - protein, 9 aa, Homo Sapiens
PIAIINYRF

SEQ ID NO: 207179 - protein, 9 aa, Homo Sapiens
FPPQGRTSS

SEQ ID NO: 207180 - protein, 9 aa, Homo Sapiens
LILFNLLPA

SEQ ID NO: 207181 - protein, 9 aa, Homo Sapiens
FSVQALQRW

SEQ ID NO: 207182 - protein, 9 aa, Homo Sapiens
AHRQPSAER

SEQ ID NO: 207183 - protein, 9 aa, Homo Sapiens
HPLVNEMEG

SEQ ID NO: 207184 - protein, 9 aa, Homo Sapiens
VHEQGYVPD

SEQ ID NO: 207185 - protein, 9 aa, Homo Sapiens
IKSDSSFYL

SEQ ID NO: 207186 - protein, 9 aa, Homo Sapiens
ILPLQMKKF

SEQ ID NO: 207187 - protein, 9 aa, Homo Sapiens
ESMWRCSFY

SEQ ID NO: 207188 - protein, 9 aa, Homo Sapiens
MGSTKENKC

SEQ ID NO: 207189 - protein, 9 aa, Homo Sapiens
EIPAMLKLS

SEQ ID NO: 207190 - protein, 9 aa, Homo Sapiens
KAGEQISQK

SEQ ID NO: 207191 - protein, 9 aa, Homo Sapiens
GGGGGPGPA

SEQ ID NO: 207192 - protein, 9 aa, Homo Sapiens
DSLGAQVLH

SEQ ID NO: 207193 - protein, 9 aa, Homo Sapiens
VSSSRYPDH

SEQ ID NO: 207194 - protein, 9 aa, Homo Sapiens
GLTSPIGPP

SEQ ID NO: 207195 - protein, 9 aa, Homo Sapiens
VQMAGAPSH

SEQ ID NO: 207196 - protein, 9 aa, Homo Sapiens
QRWVDSTPP

SEQ ID NO: 207197 - protein, 9 aa, Homo Sapiens
THISPAIPV

SEQ ID NO: 207198 - protein, 9 aa, Homo Sapiens
RTSSLLSRV

SEQ ID NO: 207199 - protein, 9 aa, Homo Sapiens
LVPKGPLPG

SEQ ID NO: 207200 - protein, 9 aa, Homo Sapiens
GAASRGHRG

SEQ ID NO: 207201 - protein, 9 aa, Homo Sapiens
PSHQQPMLS

SEQ ID NO: 207202 - protein, 9 aa, Homo Sapiens
VGAVGVGKS

SEQ ID NO: 207203 - protein, 9 aa, Homo Sapiens
NQKNTEGTQ

SEQ ID NO: 207204 - protein, 9 aa, Homo Sapiens
KSCFDPDSP

SEQ ID NO: 207205 - protein, 9 aa, Homo Sapiens
RPGQCAGAW

SEQ ID NO: 207206 - protein, 9 aa, Homo Sapiens
TAHARLHLT

SEQ ID NO: 207207 - protein, 9 aa, Homo Sapiens
GLEKMAFRI

SEQ ID NO: 207208 - protein, 9 aa, Homo Sapiens
KTEPINGFQ

SEQ ID NO: 207209 - protein, 9 aa, Homo Sapiens
SRGHRGAHR

SEQ ID NO: 207210 - protein, 9 aa, Homo Sapiens
RDQGRHPVR

SEQ ID NO: 207211 - protein, 9 aa, Homo Sapiens
NLLWSAGTE

SEQ ID NO: 207212 - protein, 9 aa, Homo Sapiens
PKRTMQEDL

SEQ ID NO: 207213 - protein, 9 aa, Homo Sapiens
QGRVYVARA

SEQ ID NO: 207214 - protein, 9 aa, Homo Sapiens
GRMFMYFLR

SEQ ID NO: 207215 - protein, 9 aa, Homo Sapiens
SSCQPSCCE

SEQ ID NO: 207216 - protein, 9 aa, Homo Sapiens
EDAQLEPTH

SEQ ID NO: 207217 - protein, 9 aa, Homo Sapiens
DENIEYEDE

SEQ ID NO: 207218 - protein, 9 aa, Homo Sapiens
NQNEEVLQT

SEQ ID NO: 207219 - protein, 9 aa, Homo Sapiens
EGDRGPRAA

SEQ ID NO: 207220 - protein, 9 aa, Homo Sapiens
HRSITFVAF

SEQ ID NO: 207221 - protein, 9 aa, Homo Sapiens
YVPDHGRDQ

SEQ ID NO: 207222 - protein, 9 aa, Homo Sapiens
RHMEIDKKC

SEQ ID NO: 207223 - protein, 9 aa, Homo Sapiens
LVNEMEGSS

SEQ ID NO: 207224 - protein, 9 aa, Homo Sapiens
WHWTTDQSV

SEQ ID NO: 207225 - protein, 9 aa, Homo Sapiens
QEGNEMEGE

SEQ ID NO: 207226 - protein, 9 aa, Homo Sapiens
AIINYRFSA

SEQ ID NO: 207227 - protein, 9 aa, Homo Sapiens
HREECAVHQ

SEQ ID NO: 207228 - protein, 9 aa, Homo Sapiens
LHMWSAPGI

SEQ ID NO: 207229 - protein, 9 aa, Homo Sapiens
IGTSGYSQQ

SEQ ID NO: 207230 - protein, 9 aa, Homo Sapiens
DRGPRAARG

SEQ ID NO: 207231 - protein, 9 aa, Homo Sapiens
ARTAWFLQE

SEQ ID NO: 207232 - protein, 9 aa, Homo Sapiens
VEEVLCAER

SEQ ID NO: 207233 - protein, 9 aa, Homo Sapiens
GAHRSPSAP

SEQ ID NO: 207234 - protein, 9 aa, Homo Sapiens
RPLQNNLGF

SEQ ID NO: 207235 - protein, 9 aa, Homo Sapiens
TTDFVCIRF

SEQ ID NO: 207236 - protein, 9 aa, Homo Sapiens
HTEIEYMME

SEQ ID NO: 207237 - protein, 9 aa, Homo Sapiens
SAAVLNPRG

SEQ ID NO: 207238 - protein, 9 aa, Homo Sapiens
SVFVTFIIL

SEQ ID NO: 207239 - protein, 9 aa, Homo Sapiens
VDKGIYQLE

SEQ ID NO: 207240 - protein, 9 aa, Homo Sapiens
SYLEEFQFE

SEQ ID NO: 207241 - protein, 9 aa, Homo Sapiens
KLKLCDGPV

SEQ ID NO: 207242 - protein, 9 aa, Homo Sapiens
ISLLFDVAE

SEQ ID NO: 207243 - protein, 9 aa, Homo Sapiens
ERKYIHRDL

SEQ ID NO: 207244 - protein, 9 aa, Homo Sapiens
NPRGVVHRR

SEQ ID NO: 207245 - protein, 9 aa, Homo Sapiens
QEPTHTGHL

SEQ ID NO: 207246 - protein, 9 aa, Homo Sapiens
CMGSTKENK

SEQ ID NO: 207247 - protein, 9 aa, Homo Sapiens
VMLSDVNDN

SEQ ID NO: 207248 - protein, 9 aa, Homo Sapiens
PAQASAAVL

SEQ ID NO: 207249 - protein, 9 aa, Homo Sapiens
QTDRQGQNS

SEQ ID NO: 207250 - protein, 9 aa, Homo Sapiens
RMASFEWLL

SEQ ID NO: 207251 - protein, 9 aa, Homo Sapiens
HLTMVLIWY

SEQ ID NO: 207252 - protein, 9 aa, Homo Sapiens
MEKIHLDAQ

SEQ ID NO: 207253 - protein, 9 aa, Homo Sapiens
RSRMLRFPL

SEQ ID NO: 207254 - protein, 9 aa, Homo Sapiens
AWSFQPASS

SEQ ID NO: 207255 - protein, 9 aa, Homo Sapiens
EECAVHQGT

SEQ ID NO: 207256 - protein, 9 aa, Homo Sapiens
DRVHEQGYV

SEQ ID NO: 207257 - protein, 9 aa, Homo Sapiens
YLMSNQFVL

SEQ ID NO: 207258 - protein, 9 aa, Homo Sapiens
YGLPDINIL

SEQ ID NO: 207259 - protein, 9 aa, Homo Sapiens
ERKSDLHLT

SEQ ID NO: 207260 - protein, 9 aa, Homo Sapiens
DWAWRPLCR

SEQ ID NO: 207261 - protein, 9 aa, Homo Sapiens
KKLVKSAKD

SEQ ID NO: 207262 - protein, 9 aa, Homo Sapiens
ACLSHLCAN

SEQ ID NO: 207263 - protein, 9 aa, Homo Sapiens
EEEQLSKEW

SEQ ID NO: 207264 - protein, 9 aa, Homo Sapiens
AGGGGGPGP

SEQ ID NO: 207265 - protein, 9 aa, Homo Sapiens
PSHCARCKE

SEQ ID NO: 207266 - protein, 9 aa, Homo Sapiens
RCLVPKGPL

SEQ ID NO: 207267 - protein, 9 aa, Homo Sapiens
RWVDSTPPP

SEQ ID NO: 207268 - protein, 9 aa, Homo Sapiens
HRSPSAPDD

SEQ ID NO: 207269 - protein, 9 aa, Homo Sapiens
GSRIYGFPP

SEQ ID NO: 207270 - protein, 9 aa, Homo Sapiens
HQDINYYNR

SEQ ID NO: 207271 - protein, 9 aa, Homo Sapiens
KSDLHLTLP

SEQ ID NO: 207272 - protein, 9 aa, Homo Sapiens
TQDLVEEVL

SEQ ID NO: 207273 - protein, 9 aa, Homo Sapiens
QMKQVNIVG

SEQ ID NO: 207274 - protein, 9 aa, Homo Sapiens
LQWLLITLP

SEQ ID NO: 207275 - protein, 9 aa, Homo Sapiens
LDLHSPTDI

SEQ ID NO: 207276 - protein, 9 aa, Homo Sapiens
TSESSTTLV

SEQ ID NO: 207277 - protein, 9 aa, Homo Sapiens
EYNITVMLS

SEQ ID NO: 207278 - protein, 9 aa, Homo Sapiens
SQPKRTMQE

SEQ ID NO: 207279 - protein, 9 aa, Homo Sapiens
QISQKSAEN

SEQ ID NO: 207280 - protein, 9 aa, Homo Sapiens
STPGAHRQP

SEQ ID NO: 207281 - protein, 9 aa, Homo Sapiens
QVLHRAAVT

SEQ ID NO: 207282 - protein, 9 aa, Homo Sapiens
GAWGLLPGW

SEQ ID NO: 207283 - protein, 9 aa, Homo Sapiens
KLGVTQRDQ

SEQ ID NO: 207284 - protein, 9 aa, Homo Sapiens
ASGPTGTTQ

SEQ ID NO: 207285 - protein, 9 aa, Homo Sapiens
QPLLPAFMV

SEQ ID NO: 207286 - protein, 9 aa, Homo Sapiens
LHPQPAPAG

SEQ ID NO: 207287 - protein, 9 aa, Homo Sapiens
TVSSTPGAH

SEQ ID NO: 207288 - protein, 9 aa, Homo Sapiens
TGTTQGAPS

SEQ ID NO: 207289 - protein, 9 aa, Homo Sapiens
KDGVRGLTS

SEQ ID NO: 207290 - protein, 9 aa, Homo Sapiens
MLKLSCTDT

SEQ ID NO: 207291 - protein, 9 aa, Homo Sapiens
WGLLPGWGQ

SEQ ID NO: 207292 - protein, 9 aa, Homo Sapiens
PAVKAGTED

SEQ ID NO: 207293 - protein, 9 aa, Homo Sapiens
AAIDGDPDN

SEQ ID NO: 207294 - protein, 9 aa, Homo Sapiens
DADLSIEKQ

SEQ ID NO: 207295 - protein, 9 aa, Homo Sapiens
EVDSDDENI

SEQ ID NO: 207296 - protein, 9 aa, Homo Sapiens
WSFQPASSH

SEQ ID NO: 207297 - protein, 9 aa, Homo Sapiens
DAPSLESRP

SEQ ID NO: 207298 - protein, 9 aa, Homo Sapiens
SNTKKNADD

SEQ ID NO: 207299 - protein, 9 aa, Homo Sapiens
NKTLKTTDF

SEQ ID NO: 207300 - protein, 9 aa, Homo Sapiens
LFYLSKYTP

SEQ ID NO: 207301 - protein, 9 aa, Homo Sapiens
SSHHGSRGA

SEQ ID NO: 207302 - protein, 9 aa, Homo Sapiens
QMAGAPSHQ

SEQ ID NO: 207303 - protein, 9 aa, Homo Sapiens
SGYSQQVVC

SEQ ID NO: 207304 - protein, 9 aa, Homo Sapiens
DKKCSEIPC

SEQ ID NO: 207305 - protein, 9 aa, Homo Sapiens
IPPSALRPK

SEQ ID NO: 207306 - protein, 9 aa, Homo Sapiens
NYRFSACYF

SEQ ID NO: 207307 - protein, 9 aa, Homo Sapiens
DIRFANIYI

SEQ ID NO: 207308 - protein, 9 aa, Homo Sapiens
AQASAAVLN

SEQ ID NO: 207309 - protein, 9 aa, Homo Sapiens
LQSANAPSL

SEQ ID NO: 207310 - protein, 9 aa, Homo Sapiens
FLFYLSKYT

SEQ ID NO: 207311 - protein, 9 aa, Homo Sapiens
GQTDRQGQN

SEQ ID NO: 207312 - protein, 9 aa, Homo Sapiens
GRCLDFDYK

SEQ ID NO: 207313 - protein, 9 aa, Homo Sapiens
EEFQFEDGF

SEQ ID NO: 207314 - protein, 9 aa, Homo Sapiens
CPVQRWVDS

SEQ ID NO: 207315 - protein, 9 aa, Homo Sapiens
ENIEYEDES

SEQ ID NO: 207316 - protein, 9 aa, Homo Sapiens
PWQLEVNHS

SEQ ID NO: 207317 - protein, 9 aa, Homo Sapiens
EPTIASPDI

SEQ ID NO: 207318 - protein, 9 aa, Homo Sapiens
LLVTPPQGP

SEQ ID NO: 207319 - protein, 9 aa, Homo Sapiens
IENIKQILG

SEQ ID NO: 207320 - protein, 9 aa, Homo Sapiens
DAGEPPVFS

SEQ ID NO: 207321 - protein, 9 aa, Homo Sapiens
LISLLFDVA

SEQ ID NO: 207322 - protein, 9 aa, Homo Sapiens
NRLILFNLL

SEQ ID NO: 207323 - protein, 9 aa, Homo Sapiens
VHLKAGEQI

SEQ ID NO: 207324 - protein, 9 aa, Homo Sapiens
AGTEAGTMV

SEQ ID NO: 207325 - protein, 9 aa, Homo Sapiens
LLTTDFVCI

SEQ ID NO: 207326 - protein, 9 aa, Homo Sapiens
HTAGGGGGP

SEQ ID NO: 207327 - protein, 9 aa, Homo Sapiens
EKIHLDAQH

SEQ ID NO: 207328 - protein, 9 aa, Homo Sapiens
QNEEVLQTE

SEQ ID NO: 207329 - protein, 9 aa, Homo Sapiens
YYNRRFSGQ

SEQ ID NO: 207330 - protein, 9 aa, Homo Sapiens
QPTDTCLSQ

SEQ ID NO: 207331 - protein, 9 aa, Homo Sapiens
IRGPSHCAR

SEQ ID NO: 207332 - protein, 9 aa, Homo Sapiens
CTIRSFEGI

SEQ ID NO: 207333 - protein, 9 aa, Homo Sapiens
TIPGRSREA

SEQ ID NO: 207334 - protein, 9 aa, Homo Sapiens
DDQGPWRPL

SEQ ID NO: 207335 - protein, 9 aa, Homo Sapiens
NDETESKET

SEQ ID NO: 207336 - protein, 9 aa, Homo Sapiens
WTAQLCAWH

SEQ ID NO: 207337 - protein, 9 aa, Homo Sapiens
YQDNRCFVS

SEQ ID NO: 207338 - protein, 9 aa, Homo Sapiens
RCLDFDYKK

SEQ ID NO: 207339 - protein, 9 aa, Homo Sapiens
LNQNEEVLQ

SEQ ID NO: 207340 - protein, 9 aa, Homo Sapiens
FIEERKYIH

SEQ ID NO: 207341 - protein, 9 aa, Homo Sapiens
SLQSANAPS

SEQ ID NO: 207342 - protein, 9 aa, Homo Sapiens
LTSPIGPPG

SEQ ID NO: 207343 - protein, 9 aa, Homo Sapiens
APSHQQPML

SEQ ID NO: 207344 - protein, 9 aa, Homo Sapiens
EALGRMFMY

SEQ ID NO: 207345 - protein, 9 aa, Homo Sapiens
VPELVHQPR

SEQ ID NO: 207346 - protein, 9 aa, Homo Sapiens
FFCEIPAML

SEQ ID NO: 207347 - protein, 9 aa, Homo Sapiens
MQEDLLSLA

SEQ ID NO: 207348 - protein, 9 aa, Homo Sapiens
PAKIITAAP

SEQ ID NO: 207349 - protein, 9 aa, Homo Sapiens
IMKLHIHFQ

SEQ ID NO: 207350 - protein, 9 aa, Homo Sapiens
MASFEWLLW

SEQ ID NO: 207351 - protein, 9 aa, Homo Sapiens
VPRGGGCLG

SEQ ID NO: 207352 - protein, 9 aa, Homo Sapiens
DHKLKPWQL

SEQ ID NO: 207353 - protein, 9 aa, Homo Sapiens
SKGSRIYGF

SEQ ID NO: 207354 - protein, 9 aa, Homo Sapiens
TAMGDVRGA

SEQ ID NO: 207355 - protein, 9 aa, Homo Sapiens
RRMLIHFGQ

SEQ ID NO: 207356 - protein, 9 aa, Homo Sapiens
PGMVGSLGY

SEQ ID NO: 207357 - protein, 9 aa, Homo Sapiens
AFMVWCGSF

SEQ ID NO: 207358 - protein, 9 aa, Homo Sapiens
FYLSKYTPL

SEQ ID NO: 207359 - protein, 9 aa, Homo Sapiens
ADLSIEKQF

SEQ ID NO: 207360 - protein, 9 aa, Homo Sapiens
PARTAWFLQ

SEQ ID NO: 207361 - protein, 9 aa, Homo Sapiens
KQFLDLLEP

SEQ ID NO: 207362 - protein, 9 aa, Homo Sapiens
ATAQPTDTC

SEQ ID NO: 207363 - protein, 9 aa, Homo Sapiens
LVTPPQGPA

SEQ ID NO: 207364 - protein, 9 aa, Homo Sapiens
KCSEIPCYW

SEQ ID NO: 207365 - protein, 9 aa, Homo Sapiens
SFYLEKPSV

SEQ ID NO: 207366 - protein, 9 aa, Homo Sapiens
LQCPRLPVQ

SEQ ID NO: 207367 - protein, 9 aa, Homo Sapiens
ADDRVHEQG

SEQ ID NO: 207368 - protein, 9 aa, Homo Sapiens
GANTTLVIT

SEQ ID NO: 207369 - protein, 9 aa, Homo Sapiens
AGEPPVFSS

SEQ ID NO: 207370 - protein, 9 aa, Homo Sapiens
WRPLCRPSQ

SEQ ID NO: 207371 - protein, 9 aa, Homo Sapiens
GTLCPGGRP

SEQ ID NO: 207372 - protein, 9 aa, Homo Sapiens
GMAFIEERK

SEQ ID NO: 207373 - protein, 9 aa, Homo Sapiens
EQGYVPDHG

SEQ ID NO: 207374 - protein, 9 aa, Homo Sapiens
KGAAFGLNV

SEQ ID NO: 207375 - protein, 9 aa, Homo Sapiens
RVYVARAPR

SEQ ID NO: 207376 - protein, 9 aa, Homo Sapiens
LDHKLKPWQ

SEQ ID NO: 207377 - protein, 9 aa, Homo Sapiens
RTHSGERPF

SEQ ID NO: 207378 - protein, 9 aa, Homo Sapiens
GNQELISLA

SEQ ID NO: 207379 - protein, 9 aa, Homo Sapiens
RIPPSALRP

SEQ ID NO: 207380 - protein, 9 aa, Homo Sapiens
LIVGSVFVT

SEQ ID NO: 207381 - protein, 9 aa, Homo Sapiens
RMPRTLCRL

SEQ ID NO: 207382 - protein, 9 aa, Homo Sapiens
AGAWSFQPA

SEQ ID NO: 207383 - protein, 9 aa, Homo Sapiens
LCDGPVLIT

SEQ ID NO: 207384 - protein, 9 aa, Homo Sapiens
VNRLAEHQR

SEQ ID NO: 207385 - protein, 9 aa, Homo Sapiens
SITFVAFAI

SEQ ID NO: 207386 - protein, 9 aa, Homo Sapiens
MAFRIYAVS

SEQ ID NO: 207387 - protein, 9 aa, Homo Sapiens
LVLGYNQKN

SEQ ID NO: 207388 - protein, 9 aa, Homo Sapiens
VARAPRFNH

SEQ ID NO: 207389 - protein, 9 aa, Homo Sapiens
RFANIYIST

SEQ ID NO: 207390 - protein, 9 aa, Homo Sapiens
GHLWLGTLC

SEQ ID NO: 207391 - protein, 9 aa, Homo Sapiens
LHSPTDIDA

SEQ ID NO: 207392 - protein, 9 aa, Homo Sapiens
VEDAGEPPV

SEQ ID NO: 207393 - protein, 9 aa, Homo Sapiens
TTQGAPSGG

SEQ ID NO: 207394 - protein, 9 aa, Homo Sapiens
TGNPAEFVM

SEQ ID NO: 207395 - protein, 9 aa, Homo Sapiens
EPTHTGHLW

SEQ ID NO: 207396 - protein, 9 aa, Homo Sapiens
GKVEFSSVR

SEQ ID NO: 207397 - protein, 9 aa, Homo Sapiens
GQWHLGAAS

SEQ ID NO: 207398 - protein, 9 aa, Homo Sapiens
SAPDDQGPW

SEQ ID NO: 207399 - protein, 9 aa, Homo Sapiens
KLHIHFQRT

SEQ ID NO: 207400 - protein, 9 aa, Homo Sapiens
QIGINKKLV

SEQ ID NO: 207401 - protein, 9 aa, Homo Sapiens
SPTDIDAGI

SEQ ID NO: 207402 - protein, 9 aa, Homo Sapiens
MIQDRAFRD

SEQ ID NO: 207403 - protein, 9 aa, Homo Sapiens
NIPEHVRKE

SEQ ID NO: 207404 - protein, 9 aa, Homo Sapiens
ECAVHQGTL

SEQ ID NO: 207405 - protein, 9 aa, Homo Sapiens
RLPARTAWF

SEQ ID NO: 207406 - protein, 9 aa, Homo Sapiens
GCAGRCDCD

SEQ ID NO: 207407 - protein, 9 aa, Homo Sapiens
LGTLCPGGR

SEQ ID NO: 207408 - protein, 9 aa, Homo Sapiens
GYSQQVVCY

SEQ ID NO: 207409 - protein, 9 aa, Homo Sapiens
ISYLEEFQF

SEQ ID NO: 207410 - protein, 9 aa, Homo Sapiens
SSNLTATAQ

SEQ ID NO: 207411 - protein, 9 aa, Homo Sapiens
EGRCLDFDY

SEQ ID NO: 207412 - protein, 9 aa, Homo Sapiens
MYLVHNRRM

SEQ ID NO: 207413 - protein, 9 aa, Homo Sapiens
RPAEGDRGP

SEQ ID NO: 207414 - protein, 9 aa, Homo Sapiens
LDPHTIPGR

SEQ ID NO: 207415 - protein, 9 aa, Homo Sapiens
PDQEPTHTG

SEQ ID NO: 207416 - protein, 9 aa, Homo Sapiens
SCFDPDSPK

SEQ ID NO: 207417 - protein, 9 aa, Homo Sapiens
KTLKTTDFG

SEQ ID NO: 207418 - protein, 9 aa, Homo Sapiens
KLEGRCLDF

SEQ ID NO: 207419 - protein, 9 aa, Homo Sapiens
HQWKRNNLM

SEQ ID NO: 207420 - protein, 9 aa, Homo Sapiens
GINKKLVKS

SEQ ID NO: 207421 - protein, 9 aa, Homo Sapiens
WIIAIHSAC

SEQ ID NO: 207422 - protein, 9 aa, Homo Sapiens
LYNATTNIP

SEQ ID NO: 207423 - protein, 9 aa, Homo Sapiens
LNPRGVVHR

SEQ ID NO: 207424 - protein, 9 aa, Homo Sapiens
QDFRDQNVP

SEQ ID NO: 207425 - protein, 9 aa, Homo Sapiens
QDLVEEVLC

SEQ ID NO: 207426 - protein, 9 aa, Homo Sapiens
AAPKIATGH

SEQ ID NO: 207427 - protein, 9 aa, Homo Sapiens
NEVLEEWQG

SEQ ID NO: 207428 - protein, 9 aa, Homo Sapiens
LKKLEGRCL

SEQ ID NO: 207429 - protein, 9 aa, Homo Sapiens
RCELRMPCT

SEQ ID NO: 207430 - protein, 9 aa, Homo Sapiens
WSAGTEAGT

SEQ ID NO: 207431 - protein, 9 aa, Homo Sapiens
SLGAQVLHR

SEQ ID NO: 207432 - protein, 9 aa, Homo Sapiens
GRYMHSWLE

SEQ ID NO: 207433 - protein, 9 aa, Homo Sapiens
RQHDTQDLV

SEQ ID NO: 207434 - protein, 9 aa, Homo Sapiens
VTQRDQKQI

SEQ ID NO: 207435 - protein, 9 aa, Homo Sapiens
SQQVVCYTL

SEQ ID NO: 207436 - protein, 9 aa, Homo Sapiens
MVWCGSFQV

SEQ ID NO: 207437 - protein, 9 aa, Homo Sapiens
LLPAFMVWC

SEQ ID NO: 207438 - protein, 9 aa, Homo Sapiens
DFVCIRFLE

SEQ ID NO: 207439 - protein, 9 aa, Homo Sapiens
YSLQSANAP

SEQ ID NO: 207440 - protein, 9 aa, Homo Sapiens
CPGGRPGQC

SEQ ID NO: 207441 - protein, 9 aa, Homo Sapiens
LGCMGSTKE

SEQ ID NO: 207442 - protein, 9 aa, Homo Sapiens
EDDPAEAEQ

SEQ ID NO: 207443 - protein, 9 aa, Homo Sapiens
IPAMLKLSC

SEQ ID NO: 207444 - protein, 9 aa, Homo Sapiens
EERKYIHRD

SEQ ID NO: 207445 - protein, 9 aa, Homo Sapiens
ANTTLVITI

SEQ ID NO: 207446 - protein, 9 aa, Homo Sapiens
HEQGYVPDH

SEQ ID NO: 207447 - protein, 9 aa, Homo Sapiens
TLCVADFGL

SEQ ID NO: 207448 - protein, 9 aa, Homo Sapiens
VHMRTHSGE

SEQ ID NO: 207449 - protein, 9 aa, Homo Sapiens
VADVRKSCF

SEQ ID NO: 207450 - protein, 9 aa, Homo Sapiens
NWLLMAESE

SEQ ID NO: 207451 - protein, 9 aa, Homo Sapiens
AHARLHLTP

SEQ ID NO: 207452 - protein, 9 aa, Homo Sapiens
EVPGVFSRS

SEQ ID NO: 207453 - protein, 9 aa, Homo Sapiens
SLTSPGTYA

SEQ ID NO: 207454 - protein, 9 aa, Homo Sapiens
TELENWIIA

SEQ ID NO: 207455 - protein, 9 aa, Homo Sapiens
QFPPQGRTS

SEQ ID NO: 207456 - protein, 9 aa, Homo Sapiens
GYVPDHGRD

SEQ ID NO: 207457 - protein, 9 aa, Homo Sapiens
LVKSAKDGT

SEQ ID NO: 207458 - protein, 9 aa, Homo Sapiens
KEIKHGIQK

SEQ ID NO: 207459 - protein, 9 aa, Homo Sapiens
HSWLEPTPG

SEQ ID NO: 207460 - protein, 9 aa, Homo Sapiens
EWLLWRICR

SEQ ID NO: 207461 - protein, 9 aa, Homo Sapiens
INYYNRRFS

SEQ ID NO: 207462 - protein, 9 aa, Homo Sapiens
YVARAPRFN

SEQ ID NO: 207463 - protein, 9 aa, Homo Sapiens
DKTEPINGF

SEQ ID NO: 207464 - protein, 9 aa, Homo Sapiens
PRLPVQPGA

SEQ ID NO: 207465 - protein, 9 aa, Homo Sapiens
RGGGCLGGR

SEQ ID NO: 207466 - protein, 9 aa, Homo Sapiens
KPWQLEVNH

SEQ ID NO: 207467 - protein, 9 aa, Homo Sapiens
LPGWGQWHL

SEQ ID NO: 207468 - protein, 9 aa, Homo Sapiens
LSQFHAAID

SEQ ID NO: 207469 - protein, 9 aa, Homo Sapiens
FAIQMFFSF

SEQ ID NO: 207470 - protein, 9 aa, Homo Sapiens
KTEYNITVM

SEQ ID NO: 207471 - protein, 9 aa, Homo Sapiens
EMEGSSRTR

SEQ ID NO: 207472 - protein, 9 aa, Homo Sapiens
HKLKPWQLE

SEQ ID NO: 207473 - protein, 9 aa, Homo Sapiens
VLEEWQGSD

SEQ ID NO: 207474 - protein, 9 aa, Homo Sapiens
PCCGLDPHT

SEQ ID NO: 207475 - protein, 9 aa, Homo Sapiens
RCSFYLYVF

SEQ ID NO: 207476 - protein, 9 aa, Homo Sapiens
LTATAQPTD

SEQ ID NO: 207477 - protein, 9 aa, Homo Sapiens
PLCRPSQSL

SEQ ID NO: 207478 - protein, 9 aa, Homo Sapiens
ADVRKSCFD

SEQ ID NO: 207479 - protein, 9 aa, Homo Sapiens
PSLESRPAA

SEQ ID NO: 207480 - protein, 9 aa, Homo Sapiens
VSKGSRIYG

SEQ ID NO: 207481 - protein, 9 aa, Homo Sapiens
TSSLLSRVL

SEQ ID NO: 207482 - protein, 9 aa, Homo Sapiens
SLLFDVAEG

SEQ ID NO: 207483 - protein, 9 aa, Homo Sapiens
VLFGAMAGA

SEQ ID NO: 207484 - protein, 9 aa, Homo Sapiens
RGHRGAHRS

SEQ ID NO: 207485 - protein, 9 aa, Homo Sapiens
GNISVDDII

SEQ ID NO: 207486 - protein, 9 aa, Homo Sapiens
MAFIEERKY

SEQ ID NO: 207487 - protein, 9 aa, Homo Sapiens
VVLFGAMAG

SEQ ID NO: 207488 - protein, 9 aa, Homo Sapiens
DQNVPGCES

SEQ ID NO: 207489 - protein, 9 aa, Homo Sapiens
NDKFLISLL

SEQ ID NO: 207490 - protein, 9 aa, Homo Sapiens
DGVRGLTSP

SEQ ID NO: 207491 - protein, 9 aa, Homo Sapiens
NMYLVHNRR

SEQ ID NO: 207492 - protein, 9 aa, Homo Sapiens
NRLAEHQRI

SEQ ID NO: 207493 - protein, 9 aa, Homo Sapiens
EFSSVRGNA

SEQ ID NO: 207494 - protein, 9 aa, Homo Sapiens
AQEGLQPAV

SEQ ID NO: 207495 - protein, 9 aa, Homo Sapiens
APSLESRPA

SEQ ID NO: 207496 - protein, 9 aa, Homo Sapiens
LKTSESSTT

SEQ ID NO: 207497 - protein, 9 aa, Homo Sapiens
LKLCDGPVL

SEQ ID NO: 207498 - protein, 9 aa, Homo Sapiens
TPGAHRQPS

SEQ ID NO: 207499 - protein, 9 aa, Homo Sapiens
ILLQCPRLP

SEQ ID NO: 207500 - protein, 9 aa, Homo Sapiens
PAEFVMNTS

SEQ ID NO: 207501 - protein, 9 aa, Homo Sapiens
EVCGISYLE

SEQ ID NO: 207502 - protein, 9 aa, Homo Sapiens
KLCDGPVLI

SEQ ID NO: 207503 - protein, 9 aa, Homo Sapiens
LCANGSTCT

SEQ ID NO: 207504 - protein, 9 aa, Homo Sapiens
KIHLDAQHE

SEQ ID NO: 207505 - protein, 9 aa, Homo Sapiens
EGCAGRCDC

SEQ ID NO: 207506 - protein, 9 aa, Homo Sapiens
HHGSRGAAD

SEQ ID NO: 207507 - protein, 9 aa, Homo Sapiens
LPIAIINYR

SEQ ID NO: 207508 - protein, 9 aa, Homo Sapiens
YGKTDLMAV

SEQ ID NO: 207509 - protein, 9 aa, Homo Sapiens
DIIALLDLA

SEQ ID NO: 207510 - protein, 9 aa, Homo Sapiens
KLLVTPPQG

SEQ ID NO: 207511 - protein, 9 aa, Homo Sapiens
LTELAKLEV

SEQ ID NO: 207512 - protein, 9 aa, Homo Sapiens
QGSDVEKRR

SEQ ID NO: 207513 - protein, 9 aa, Homo Sapiens
QWLLITLPA

SEQ ID NO: 207514 - protein, 9 aa, Homo Sapiens
GGGGPGPAQ

SEQ ID NO: 207515 - protein, 9 aa, Homo Sapiens
SPSAPDDQG

SEQ ID NO: 207516 - protein, 9 aa, Homo Sapiens
GKDKTEPIN

SEQ ID NO: 207517 - protein, 9 aa, Homo Sapiens
LCKHAAANS

SEQ ID NO: 207518 - protein, 9 aa, Homo Sapiens
GQFGEGCAG

SEQ ID NO: 207519 - protein, 9 aa, Homo Sapiens
RFQMKQVNI

SEQ ID NO: 207520 - protein, 9 aa, Homo Sapiens
MWSAPGILP

SEQ ID NO: 207521 - protein, 9 aa, Homo Sapiens
GRVYVARAP

SEQ ID NO: 207522 - protein, 9 aa, Homo Sapiens
QSVGDNSSD

SEQ ID NO: 207523 - protein, 9 aa, Homo Sapiens
EQEEEQLSK

SEQ ID NO: 207524 - protein, 9 aa, Homo Sapiens
CNKTLKTTD

SEQ ID NO: 207525 - protein, 9 aa, Homo Sapiens
HRQPSAERL

SEQ ID NO: 207526 - protein, 9 aa, Homo Sapiens
LEEFQFEDG

SEQ ID NO: 207527 - protein, 9 aa, Homo Sapiens
AMGANTTLV

SEQ ID NO: 207528 - protein, 9 aa, Homo Sapiens
CAVHQGTLR

SEQ ID NO: 207529 - protein, 9 aa, Homo Sapiens
PVNLTELAK

SEQ ID NO: 207530 - protein, 9 aa, Homo Sapiens
EKQFLDLLE

SEQ ID NO: 207531 - protein, 9 aa, Homo Sapiens
QALQRWHEG

SEQ ID NO: 207532 - protein, 9 aa, Homo Sapiens
GDRGPRAAR

SEQ ID NO: 207533 - protein, 9 aa, Homo Sapiens
ELENWIIAI

SEQ ID NO: 207534 - protein, 9 aa, Homo Sapiens
AQCPMPQFS

SEQ ID NO: 207535 - protein, 9 aa, Homo Sapiens
APKIATGHG

SEQ ID NO: 207536 - protein, 9 aa, Homo Sapiens
SVQALQRWH

SEQ ID NO: 207537 - protein, 9 aa, Homo Sapiens
ITVMLSDVN

SEQ ID NO: 207538 - protein, 9 aa, Homo Sapiens
GELEQEEEQ

SEQ ID NO: 207539 - protein, 9 aa, Homo Sapiens
KSFRGVNRL

SEQ ID NO: 207540 - protein, 9 aa, Homo Sapiens
RCFVSQETG

SEQ ID NO: 207541 - protein, 9 aa, Homo Sapiens
SSRYPDHWI

SEQ ID NO: 207542 - protein, 9 aa, Homo Sapiens
NLTATAQPT

SEQ ID NO: 207543 - protein, 9 aa, Homo Sapiens
CSSHLTMVL

SEQ ID NO: 207544 - protein, 9 aa, Homo Sapiens
RPLCRPSQS

SEQ ID NO: 207545 - protein, 9 aa, Homo Sapiens
LSKKNWLLM

SEQ ID NO: 207546 - protein, 9 aa, Homo Sapiens
DVSTTIYNL

SEQ ID NO: 207547 - protein, 9 aa, Homo Sapiens
NRCFVSQET

SEQ ID NO: 207548 - protein, 9 aa, Homo Sapiens
PTAEKREWT

SEQ ID NO: 207549 - protein, 9 aa, Homo Sapiens
SIEKQFLDL

SEQ ID NO: 207550 - protein, 9 aa, Homo Sapiens
TQPLLPAFM

SEQ ID NO: 207551 - protein, 9 aa, Homo Sapiens
VLGIHWLRV

SEQ ID NO: 207552 - protein, 9 aa, Homo Sapiens
EVEENRPLQ

SEQ ID NO: 207553 - protein, 9 aa, Homo Sapiens
WLGTLCPGG

SEQ ID NO: 207554 - protein, 9 aa, Homo Sapiens
VPTEDGSNT

SEQ ID NO: 207555 - protein, 9 aa, Homo Sapiens
GQCAGAWGL

SEQ ID NO: 207556 - protein, 9 aa, Homo Sapiens
HLWLGTLCP

SEQ ID NO: 207557 - protein, 9 aa, Homo Sapiens
MKLHIHFQR

SEQ ID NO: 207558 - protein, 9 aa, Homo Sapiens
HTIPGRSRE

SEQ ID NO: 207559 - protein, 9 aa, Homo Sapiens
RYPDHWIVP

SEQ ID NO: 207560 - protein, 9 aa, Homo Sapiens
HPQPAPAGA

SEQ ID NO: 207561 - protein, 9 aa, Homo Sapiens
KGGGVNEYG

SEQ ID NO: 207562 - protein, 9 aa, Homo Sapiens
RVPRGGGCL

SEQ ID NO: 207563 - protein, 9 aa, Homo Sapiens
DRAFRDLTN

SEQ ID NO: 207564 - protein, 9 aa, Homo Sapiens
VMLVLGYNQ

SEQ ID NO: 207565 - protein, 9 aa, Homo Sapiens
TNKEVPELV

SEQ ID NO: 207566 - protein, 9 aa, Homo Sapiens
TLVVRYRRN

SEQ ID NO: 207567 - protein, 9 aa, Homo Sapiens
QRWHEGFER

SEQ ID NO: 207568 - protein, 9 aa, Homo Sapiens
CPRLPVQPG

SEQ ID NO: 207569 - protein, 9 aa, Homo Sapiens
YDYNCVELS

SEQ ID NO: 207570 - protein, 9 aa, Homo Sapiens
VAIQHSDKR

SEQ ID NO: 207571 - protein, 9 aa, Homo Sapiens
PQVADVRKS

SEQ ID NO: 207572 - protein, 9 aa, Homo Sapiens
DDLEALGRM

SEQ ID NO: 207573 - protein, 9 aa, Homo Sapiens
WAWRPLCRP

SEQ ID NO: 207574 - protein, 9 aa, Homo Sapiens
TIYNLCKHA

SEQ ID NO: 207575 - protein, 9 aa, Homo Sapiens
IQDRAFRDL

SEQ ID NO: 207576 - protein, 9 aa, Homo Sapiens
MLELHTEIE

SEQ ID NO: 207577 - protein, 9 aa, Homo Sapiens
GAQVLHRAA

SEQ ID NO: 207578 - protein, 9 aa, Homo Sapiens
REEVPGVFS

SEQ ID NO: 207579 - protein, 9 aa, Homo Sapiens
AQCDMLELH

SEQ ID NO: 207580 - protein, 9 aa, Homo Sapiens
QDINYYNRR

SEQ ID NO: 207581 - protein, 9 aa, Homo Sapiens
QPKRTMQED

SEQ ID NO: 207582 - protein, 9 aa, Homo Sapiens
LKKLRVNNI

SEQ ID NO: 207583 - protein, 9 aa, Homo Sapiens
QLCAWHWPT

SEQ ID NO: 207584 - protein, 9 aa, Homo Sapiens
DATEFLILL

SEQ ID NO: 207585 - protein, 9 aa, Homo Sapiens
FIMKLHIHF

SEQ ID NO: 207586 - protein, 9 aa, Homo Sapiens
NQFVLSTSQ

SEQ ID NO: 207587 - protein, 9 aa, Homo Sapiens
RFPLGSSSP

SEQ ID NO: 207588 - protein, 9 aa, Homo Sapiens
HCARCKEEI

SEQ ID NO: 207589 - protein, 9 aa, Homo Sapiens
ANLLWSAGT

SEQ ID NO: 207590 - protein, 9 aa, Homo Sapiens
IITAAPKIA

SEQ ID NO: 207591 - protein, 9 aa, Homo Sapiens
ELAKLEVKF

SEQ ID NO: 207592 - protein, 9 aa, Homo Sapiens
LSNVDKGIY

SEQ ID NO: 207593 - protein, 9 aa, Homo Sapiens
IVGSVFVTF

SEQ ID NO: 207594 - protein, 9 aa, Homo Sapiens
MEIDKKCSE

SEQ ID NO: 207595 - protein, 9 aa, Homo Sapiens
RLHQDINYY

SEQ ID NO: 207596 - protein, 9 aa, Homo Sapiens
PVQRWVDST

SEQ ID NO: 207597 - protein, 9 aa, Homo Sapiens
LELHTEIEY

SEQ ID NO: 207598 - protein, 9 aa, Homo Sapiens
SFEWLLWRI

SEQ ID NO: 207599 - protein, 9 aa, Homo Sapiens
PGQCAGAWG

SEQ ID NO: 207600 - protein, 9 aa, Homo Sapiens
ELSKKNWLL

SEQ ID NO: 207601 - protein, 9 aa, Homo Sapiens
MVLLSLIAA

SEQ ID NO: 207602 - protein, 9 aa, Homo Sapiens
YNLKLKLCD

SEQ ID NO: 207603 - protein, 9 aa, Homo Sapiens
PRGGGCLGG

SEQ ID NO: 207604 - protein, 9 aa, Homo Sapiens
TTIYNLCKH

SEQ ID NO: 207605 - protein, 9 aa, Homo Sapiens
QKLGVTQRD

SEQ ID NO: 207606 - protein, 9 aa, Homo Sapiens
FRICTIRSF

SEQ ID NO: 207607 - protein, 9 aa, Homo Sapiens
QVADVRKSC

SEQ ID NO: 207608 - protein, 9 aa, Homo Sapiens
IMVSSTSSL

SEQ ID NO: 207609 - protein, 9 aa, Homo Sapiens
NVDKGIYQL

SEQ ID NO: 207610 - protein, 9 aa, Homo Sapiens
KKLRVNNIS

SEQ ID NO: 207611 - protein, 9 aa, Homo Sapiens
REVEENRPL

SEQ ID NO: 207612 - protein, 9 aa, Homo Sapiens
QFVLSTSQV

SEQ ID NO: 207613 - protein, 9 aa, Homo Sapiens
GLNMCTPGN

SEQ ID NO: 207614 - protein, 9 aa, Homo Sapiens
KVEFSSVRG

SEQ ID NO: 207615 - protein, 9 aa, Homo Sapiens
PYDYNCVEL

SEQ ID NO: 207616 - protein, 9 aa, Homo Sapiens
YNATTNIPE

SEQ ID NO: 207617 - protein, 9 aa, Homo Sapiens
SHLTMVLIW

SEQ ID NO: 207618 - protein, 9 aa, Homo Sapiens
AEAEQEGNE

SEQ ID NO: 207619 - protein, 9 aa, Homo Sapiens
GLMLEKEPT

SEQ ID NO: 207620 - protein, 9 aa, Homo Sapiens
SLESRPAAA

SEQ ID NO: 207621 - protein, 9 aa, Homo Sapiens
VKIVVEDAG

SEQ ID NO: 207622 - protein, 9 aa, Homo Sapiens
ETESKETSV

SEQ ID NO: 207623 - protein, 9 aa, Homo Sapiens
TNIPEHVRK

SEQ ID NO: 207624 - protein, 9 aa, Homo Sapiens
ETLFRICTI

SEQ ID NO: 207625 - protein, 9 aa, Homo Sapiens
TDQSVGDNS

SEQ ID NO: 207626 - protein, 9 aa, Homo Sapiens
LCPGGRPGQ

SEQ ID NO: 207627 - protein, 9 aa, Homo Sapiens
VEFSSVRGN

SEQ ID NO: 207628 - protein, 9 aa, Homo Sapiens
CRVPRGGGC

SEQ ID NO: 207629 - protein, 9 aa, Homo Sapiens
ENRPLQNNL

SEQ ID NO: 207630 - protein, 9 aa, Homo Sapiens
LSHLCANGS

SEQ ID NO: 207631 - protein, 9 aa, Homo Sapiens
YRRLWTLIE

SEQ ID NO: 207632 - protein, 9 aa, Homo Sapiens
APSLSSGQL

SEQ ID NO: 207633 - protein, 9 aa, Homo Sapiens
GCMGSTKEN

SEQ ID NO: 207634 - protein, 9 aa, Homo Sapiens
LRVNNISGI

SEQ ID NO: 207635 - protein, 9 aa, Homo Sapiens
RLHLTPSLV

SEQ ID NO: 207636 - protein, 9 aa, Homo Sapiens
INILLFQNI

SEQ ID NO: 207637 - protein, 9 aa, Homo Sapiens
GLDPHTIPG

SEQ ID NO: 207638 - protein, 9 aa, Homo Sapiens
PTIASPDIM

SEQ ID NO: 207639 - protein, 9 aa, Homo Sapiens
TCPVQRWVD

SEQ ID NO: 207640 - protein, 9 aa, Homo Sapiens
GVVHRRAAA

SEQ ID NO: 207641 - protein, 9 aa, Homo Sapiens
DPHTIPGRS

SEQ ID NO: 207642 - protein, 9 aa, Homo Sapiens
SFRGVNRLA

SEQ ID NO: 207643 - protein, 9 aa, Homo Sapiens
RMFMYFLRG

SEQ ID NO: 207644 - protein, 9 aa, Homo Sapiens
RFCESMWRC

SEQ ID NO: 207645 - protein, 9 aa, Homo Sapiens
ESKETSVLK

SEQ ID NO: 207646 - protein, 9 aa, Homo Sapiens
WQLEVNHSP

SEQ ID NO: 207647 - protein, 9 aa, Homo Sapiens
KLKPWQLEV

SEQ ID NO: 207648 - protein, 9 aa, Homo Sapiens
VPGVFSRSV

SEQ ID NO: 207649 - protein, 9 aa, Homo Sapiens
ADATEFLIL

SEQ ID NO: 207650 - protein, 9 aa, Homo Sapiens
QTELENWII

SEQ ID NO: 207651 - protein, 9 aa, Homo Sapiens
FRDQNVPGC

SEQ ID NO: 207652 - protein, 9 aa, Homo Sapiens
AQKLGVTQR

SEQ ID NO: 207653 - protein, 9 aa, Homo Sapiens
GRHPVRVPD

SEQ ID NO: 207654 - protein, 9 aa, Homo Sapiens
PEHVRKEKA

SEQ ID NO: 207655 - protein, 9 aa, Homo Sapiens
YLSKYTPLK

SEQ ID NO: 207656 - protein, 9 aa, Homo Sapiens
FSVVLGIHW

SEQ ID NO: 207657 - protein, 9 aa, Homo Sapiens
IVVEDAGEP

SEQ ID NO: 207658 - protein, 9 aa, Homo Sapiens
PAEAEQEGN

SEQ ID NO: 207659 - protein, 9 aa, Homo Sapiens
PTHTGHLWL

SEQ ID NO: 207660 - protein, 9 aa, Homo Sapiens
QAPLHPQPA

SEQ ID NO: 207661 - protein, 9 aa, Homo Sapiens
IYVPTEDGS

SEQ ID NO: 207662 - protein, 9 aa, Homo Sapiens
LEKEPTIAS

SEQ ID NO: 207663 - protein, 9 aa, Homo Sapiens
AADDRVHEQ

SEQ ID NO: 207664 - protein, 9 aa, Homo Sapiens
RKSCFDPDS

SEQ ID NO: 207665 - protein, 9 aa, Homo Sapiens
PDDQGPWRP

SEQ ID NO: 207666 - protein, 9 aa, Homo Sapiens
KGIYQLEKG

SEQ ID NO: 207667 - protein, 9 aa, Homo Sapiens
TVAQCPMPQ

SEQ ID NO: 207668 - protein, 9 aa, Homo Sapiens
RPLHTAGGG

SEQ ID NO: 207669 - protein, 9 aa, Homo Sapiens
TMVLIWYGS

SEQ ID NO: 207670 - protein, 9 aa, Homo Sapiens
PAFMVWCGS

SEQ ID NO: 207671 - protein, 9 aa, Homo Sapiens
NRPLQNNLG

SEQ ID NO: 207672 - protein, 9 aa, Homo Sapiens
DMLELHTEI

SEQ ID NO: 207673 - protein, 9 aa, Homo Sapiens
SEDAQLEPT

SEQ ID NO: 207674 - protein, 9 aa, Homo Sapiens
GAHRQPSAE

SEQ ID NO: 207675 - protein, 9 aa, Homo Sapiens
RERPAEGDR

SEQ ID NO: 207676 - protein, 9 aa, Homo Sapiens
RLILFNLLP

SEQ ID NO: 207677 - protein, 9 aa, Homo Sapiens
MPQFSGKEP

SEQ ID NO: 207678 - protein, 9 aa, Homo Sapiens
RSITFVAFA

SEQ ID NO: 207679 - protein, 9 aa, Homo Sapiens
GRDQGRHPV

SEQ ID NO: 207680 - protein, 9 aa, Homo Sapiens
ILDLHSPTD

SEQ ID NO: 207681 - protein, 9 aa, Homo Sapiens
VCIRFLEYW

SEQ ID NO: 207682 - protein, 9 aa, Homo Sapiens
STCSSHLTM

SEQ ID NO: 207683 - protein, 9 aa, Homo Sapiens
YSQQVVCYT

SEQ ID NO: 207684 - protein, 9 aa, Homo Sapiens
FGLNVIATR

SEQ ID NO: 207685 - protein, 9 aa, Homo Sapiens
TDACLSHLC

SEQ ID NO: 207686 - protein, 9 aa, Homo Sapiens
PTGTTQGAP

SEQ ID NO: 207687 - protein, 9 aa, Homo Sapiens
KTNKEVPEL

SEQ ID NO: 207688 - protein, 9 aa, Homo Sapiens
ELLSNVDKG

SEQ ID NO: 207689 - protein, 9 aa, Homo Sapiens
GTEAGTMVK

SEQ ID NO: 207690 - protein, 9 aa, Homo Sapiens
LKTTDFGLA

SEQ ID NO: 207691 - protein, 9 aa, Homo Sapiens
FVCIRFLEY

SEQ ID NO: 207692 - protein, 9 aa, Homo Sapiens
QQVVCYTLG

SEQ ID NO: 207693 - protein, 9 aa, Homo Sapiens
AVGVGKSAL

SEQ ID NO: 207694 - protein, 9 aa, Homo Sapiens
PRSQRTQVF

SEQ ID NO: 207695 - protein, 9 aa, Homo Sapiens
VDSDDENIE

SEQ ID NO: 207696 - protein, 9 aa, Homo Sapiens
RYMHSWLEP

SEQ ID NO: 207697 - protein, 9 aa, Homo Sapiens
HSDKRIHLA

SEQ ID NO: 207698 - protein, 9 aa, Homo Sapiens
TFLFYLSKY

SEQ ID NO: 207699 - protein, 9 aa, Homo Sapiens
TPGNQELIS

SEQ ID NO: 207700 - protein, 9 aa, Homo Sapiens
VCGISYLEE

SEQ ID NO: 207701 - protein, 9 aa, Homo Sapiens
PAEGDRGPR

SEQ ID NO: 207702 - protein, 9 aa, Homo Sapiens
WRCSFYLYV

SEQ ID NO: 207703 - protein, 9 aa, Homo Sapiens
DDENIEYED

SEQ ID NO: 207704 - protein, 9 aa, Homo Sapiens
GGVNEYGKT

SEQ ID NO: 207705 - protein, 9 aa, Homo Sapiens
TLCPGGRPG

SEQ ID NO: 207706 - protein, 9 aa, Homo Sapiens
RAPRFNHTG

SEQ ID NO: 207707 - protein, 9 aa, Homo Sapiens
PQPAPAGAW

SEQ ID NO: 207708 - protein, 9 aa, Homo Sapiens
WHLGAASRG

SEQ ID NO: 207709 - protein, 9 aa, Homo Sapiens
QVVCYTLGN

SEQ ID NO: 207710 - protein, 9 aa, Homo Sapiens
TESKETSVL

SEQ ID NO: 207711 - protein, 9 aa, Homo Sapiens
EDAGEPPVF

SEQ ID NO: 207712 - protein, 9 aa, Homo Sapiens
MSFIMKLHI

SEQ ID NO: 207713 - protein, 9 aa, Homo Sapiens
PPRSQRTQV

SEQ ID NO: 207714 - protein, 9 aa, Homo Sapiens
LEQEEEQLS

SEQ ID NO: 207715 - protein, 9 aa, Homo Sapiens
VHQGTLRMG

SEQ ID NO: 207716 - protein, 9 aa, Homo Sapiens
NGNISVDDI

SEQ ID NO: 207717 - protein, 9 aa, Homo Sapiens
KELLSNVDK

SEQ ID NO: 207718 - protein, 9 aa, Homo Sapiens
AEFVMNTSN

SEQ ID NO: 207719 - protein, 9 aa, Homo Sapiens
EPINGFQKA

SEQ ID NO: 207720 - protein, 9 aa, Homo Sapiens
GKSFRGVNR

SEQ ID NO: 207721 - protein, 9 aa, Homo Sapiens
WRIPPSALR

SEQ ID NO: 207722 - protein, 9 aa, Homo Sapiens
CLATFLFYL

SEQ ID NO: 207723 - protein, 9 aa, Homo Sapiens
SNLTATAQP

SEQ ID NO: 207724 - protein, 9 aa, Homo Sapiens
PGAHRQPSA

SEQ ID NO: 207725 - protein, 9 aa, Homo Sapiens
EIKHGIQKL

SEQ ID NO: 207726 - protein, 9 aa, Homo Sapiens
IINYRFSAC

SEQ ID NO: 207727 - protein, 9 aa, Homo Sapiens
HLDAQHESG

SEQ ID NO: 207728 - protein, 9 aa, Homo Sapiens
TLKTTDFGL

SEQ ID NO: 207729 - protein, 9 aa, Homo Sapiens
AAPDGRYMH

SEQ ID NO: 207730 - protein, 9 aa, Homo Sapiens
APDDQGPWR

SEQ ID NO: 207731 - protein, 9 aa, Homo Sapiens
EVLEEWQGS

SEQ ID NO: 207732 - protein, 9 aa, Homo Sapiens
SANAPSLSS

SEQ ID NO: 207733 - protein, 9 aa, Homo Sapiens
AFRDLTNLR

SEQ ID NO: 207734 - protein, 9 aa, Homo Sapiens
YRFQMKQVN

SEQ ID NO: 207735 - protein, 9 aa, Homo Sapiens
FEHPLVNEM

SEQ ID NO: 207736 - protein, 9 aa, Homo Sapiens
DNRLILFNL

SEQ ID NO: 207737 - protein, 9 aa, Homo Sapiens
RSPSAPDDQ

SEQ ID NO: 207738 - protein, 9 aa, Homo Sapiens
VVEDAGEPP

SEQ ID NO: 207739 - protein, 9 aa, Homo Sapiens
PASSHHGSR

SEQ ID NO: 207740 - protein, 9 aa, Homo Sapiens
PELVHQPRA

SEQ ID NO: 207741 - protein, 9 aa, Homo Sapiens
VQPGAGGNR

SEQ ID NO: 207742 - protein, 9 aa, Homo Sapiens
STTLVVRYR

SEQ ID NO: 207743 - protein, 9 aa, Homo Sapiens
VPGCESLGL

SEQ ID NO: 207744 - protein, 9 aa, Homo Sapiens
IAIINYRFS

SEQ ID NO: 207745 - protein, 9 aa, Homo Sapiens
CARCKEEIK

SEQ ID NO: 207746 - protein, 9 aa, Homo Sapiens
EVPELVHQP

SEQ ID NO: 207747 - protein, 9 aa, Homo Sapiens
DHGRDQGRH

SEQ ID NO: 207748 - protein, 9 aa, Homo Sapiens
QWKRNNLMT

SEQ ID NO: 207749 - protein, 9 aa, Homo Sapiens
NVPGCESLG

SEQ ID NO: 207750 - protein, 9 aa, Homo Sapiens
VGSVFVTFI

SEQ ID NO: 207751 - protein, 9 aa, Homo Sapiens
AFGLNVIAT

SEQ ID NO: 207752 - protein, 9 aa, Homo Sapiens
EYGKTDLMA

SEQ ID NO: 207753 - protein, 9 aa, Homo Sapiens
SFQPASSHH

SEQ ID NO: 207754 - protein, 9 aa, Homo Sapiens
IKQILGNTH

SEQ ID NO: 207755 - protein, 9 aa, Homo Sapiens
DMEKIHLDA

SEQ ID NO: 207756 - protein, 9 aa, Homo Sapiens
HRGAHRSPS

SEQ ID NO: 207757 - protein, 9 aa, Homo Sapiens
MLAEDMTLC

SEQ ID NO: 207758 - protein, 9 aa, Homo Sapiens
KLVVVGAVG

SEQ ID NO: 207759 - protein, 9 aa, Homo Sapiens
IDKKCSEIP

SEQ ID NO: 207760 - protein, 9 aa, Homo Sapiens
AFIEERKYI

SEQ ID NO: 207761 - protein, 9 aa, Homo Sapiens
KIVVEDAGE

SEQ ID NO: 207762 - protein, 9 aa, Homo Sapiens
SRYPDHWIV

SEQ ID NO: 207763 - protein, 9 aa, Homo Sapiens
AQAPLHPQP

SEQ ID NO: 207764 - protein, 9 aa, Homo Sapiens
AVHQGTLRM

SEQ ID NO: 207765 - protein, 9 aa, Homo Sapiens
TLCRLFVAE

SEQ ID NO: 207766 - protein, 9 aa, Homo Sapiens
NAPSLSSGQ

SEQ ID NO: 207767 - protein, 9 aa, Homo Sapiens
PWRIPPSAL

SEQ ID NO: 207768 - protein, 9 aa, Homo Sapiens
GHRGAHRSP

SEQ ID NO: 207769 - protein, 9 aa, Homo Sapiens
KLVKSAKDG

SEQ ID NO: 207770 - protein, 9 aa, Homo Sapiens
MRTHSGERP

SEQ ID NO: 207771 - protein, 9 aa, Homo Sapiens
KCSSIMVSS

SEQ ID NO: 207772 - protein, 9 aa, Homo Sapiens
LHYPVLMTA

SEQ ID NO: 207773 - protein, 9 aa, Homo Sapiens
AMAGALGRD

SEQ ID NO: 207774 - protein, 9 aa, Homo Sapiens
ALSQFHAAI

SEQ ID NO: 207775 - protein, 9 aa, Homo Sapiens
HDTQDLVEE

SEQ ID NO: 207776 - protein, 9 aa, Homo Sapiens
KEVPELVHQ

SEQ ID NO: 207777 - protein, 9 aa, Homo Sapiens
AWRPLCRPS

SEQ ID NO: 207778 - protein, 9 aa, Homo Sapiens
FRDLTNLRR

SEQ ID NO: 207779 - protein, 9 aa, Homo Sapiens
LLSNVDKGI

SEQ ID NO: 207780 - protein, 9 aa, Homo Sapiens
IYNLCKHAA

SEQ ID NO: 207781 - protein, 9 aa, Homo Sapiens
TLIEHQKIH

SEQ ID NO: 207782 - protein, 9 aa, Homo Sapiens
QLLQWLLIT

SEQ ID NO: 207783 - protein, 9 aa, Homo Sapiens
RDQNVPGCE

SEQ ID NO: 207784 - protein, 9 aa, Homo Sapiens
GAMAGALGR

SEQ ID NO: 207785 - protein, 9 aa, Homo Sapiens
ATEFLILLQ

SEQ ID NO: 207786 - protein, 9 aa, Homo Sapiens
GNPAEFVMN

SEQ ID NO: 207787 - protein, 9 aa, Homo Sapiens
NMCTPGNQE

SEQ ID NO: 207788 - protein, 9 aa, Homo Sapiens
QILGNTHIG

SEQ ID NO: 207789 - protein, 9 aa, Homo Sapiens
GLPDINILL

SEQ ID NO: 207790 - protein, 9 aa, Homo Sapiens
HHQWKRNNL

SEQ ID NO: 207791 - protein, 9 aa, Homo Sapiens
ERMASFEWL

SEQ ID NO: 207792 - protein, 9 aa, Homo Sapiens
NCVELSEIN

SEQ ID NO: 207793 - protein, 9 aa, Homo Sapiens
SKKNWLLMA

SEQ ID NO: 207794 - protein, 9 aa, Homo Sapiens
TQVFLEGEP

SEQ ID NO: 207795 - protein, 9 aa, Homo Sapiens
NKEVPELVH

SEQ ID NO: 207796 - protein, 9 aa, Homo Sapiens
APAKIITAA

SEQ ID NO: 207797 - protein, 9 aa, Homo Sapiens
VAFAIQMFF

SEQ ID NO: 207798 - protein, 9 aa, Homo Sapiens
KDKTEPING

SEQ ID NO: 207799 - protein, 9 aa, Homo Sapiens
DTQDLVEEV

SEQ ID NO: 207800 - protein, 9 aa, Homo Sapiens
AGRCDCDHS

SEQ ID NO: 207801 - protein, 9 aa, Homo Sapiens
QSANAPSLS

SEQ ID NO: 207802 - protein, 9 aa, Homo Sapiens
RVHEQGYVP

SEQ ID NO: 207803 - protein, 9 aa, Homo Sapiens
MGANTTLVI

SEQ ID NO: 207804 - protein, 9 aa, Homo Sapiens
LKTNKEVPE

SEQ ID NO: 207805 - protein, 9 aa, Homo Sapiens
YNMYLVHNR

SEQ ID NO: 207806 - protein, 9 aa, Homo Sapiens
CEIPAMLKL

SEQ ID NO: 207807 - protein, 9 aa, Homo Sapiens
TTLVITIQL

SEQ ID NO: 207808 - protein, 9 aa, Homo Sapiens
DSSFYLEKP

SEQ ID NO: 207809 - protein, 9 aa, Homo Sapiens
SVVLGIHWL

SEQ ID NO: 207810 - protein, 9 aa, Homo Sapiens
HMEIDKKCS

SEQ ID NO: 207811 - protein, 9 aa, Homo Sapiens
EQISQKSAE

SEQ ID NO: 207812 - protein, 9 aa, Homo Sapiens
FCESMWRCS

SEQ ID NO: 207813 - protein, 9 aa, Homo Sapiens
FRGVNRLAE

SEQ ID NO: 207814 - protein, 9 aa, Homo Sapiens
SQRTQVFLE

SEQ ID NO: 207815 - protein, 9 aa, Homo Sapiens
GGCLGGRLE

SEQ ID NO: 207816 - protein, 9 aa, Homo Sapiens
GPGPAQASA

SEQ ID NO: 207817 - protein, 9 aa, Homo Sapiens
YKLVVVGAV

SEQ ID NO: 207818 - protein, 9 aa, Homo Sapiens
LPRQSNRQD

SEQ ID NO: 207819 - protein, 9 aa, Homo Sapiens
MRKILLCLA

SEQ ID NO: 207820 - protein, 9 aa, Homo Sapiens
LAGWKPSMY

SEQ ID NO: 207821 - protein, 9 aa, Homo Sapiens
CQGNGKCCH

SEQ ID NO: 207822 - protein, 9 aa, Homo Sapiens
EEERSHKRK

SEQ ID NO: 207823 - protein, 9 aa, Homo Sapiens
FQCLVTKYQ

SEQ ID NO: 207824 - protein, 9 aa, Homo Sapiens
NWDFHKEAD

SEQ ID NO: 207825 - protein, 9 aa, Homo Sapiens
KHVVQEHLP

SEQ ID NO: 207826 - protein, 9 aa, Homo Sapiens
CKEAINVLS

SEQ ID NO: 207827 - protein, 9 aa, Homo Sapiens
VSAATTAAA

SEQ ID NO: 207828 - protein, 9 aa, Homo Sapiens
VYRITTAAT

SEQ ID NO: 207829 - protein, 9 aa, Homo Sapiens
ICRAATNRV

SEQ ID NO: 207830 - protein, 9 aa, Homo Sapiens
DASEEHLYW

SEQ ID NO: 207831 - protein, 9 aa, Homo Sapiens
GYWVAMLML

SEQ ID NO: 207832 - protein, 9 aa, Homo Sapiens
FDASEEHLY

SEQ ID NO: 207833 - protein, 9 aa, Homo Sapiens
DMLRDDPEM

SEQ ID NO: 207834 - protein, 9 aa, Homo Sapiens
TVMMKESKL

SEQ ID NO: 207835 - protein, 9 aa, Homo Sapiens
SAFQCLVTK

SEQ ID NO: 207836 - protein, 9 aa, Homo Sapiens
PDKREIYVA

SEQ ID NO: 207837 - protein, 9 aa, Homo Sapiens
GMNRVDRTL

SEQ ID NO: 207838 - protein, 9 aa, Homo Sapiens
LDALHTFIR

SEQ ID NO: 207839 - protein, 9 aa, Homo Sapiens
EDNKYIHQK

SEQ ID NO: 207840 - protein, 9 aa, Homo Sapiens
PSHSSGCPM

SEQ ID NO: 207841 - protein, 9 aa, Homo Sapiens
QQACSNGCW

SEQ ID NO: 207842 - protein, 9 aa, Homo Sapiens
LKKRSSLLK

SEQ ID NO: 207843 - protein, 9 aa, Homo Sapiens
KMPLKKRSS

SEQ ID NO: 207844 - protein, 9 aa, Homo Sapiens
ELSGWTPDP

SEQ ID NO: 207845 - protein, 9 aa, Homo Sapiens
LIGIVHYPV

SEQ ID NO: 207846 - protein, 9 aa, Homo Sapiens
NSTGLALVD

SEQ ID NO: 207847 - protein, 9 aa, Homo Sapiens
LQRQRDRLE

SEQ ID NO: 207848 - protein, 9 aa, Homo Sapiens
EELQRQRDR

SEQ ID NO: 207849 - protein, 9 aa, Homo Sapiens
QSNRQDVYS

SEQ ID NO: 207850 - protein, 9 aa, Homo Sapiens
AQSTEMLKH

SEQ ID NO: 207851 - protein, 9 aa, Homo Sapiens
TGCSEPFPP

SEQ ID NO: 207852 - protein, 9 aa, Homo Sapiens
EEMEQAKHN

SEQ ID NO: 207853 - protein, 9 aa, Homo Sapiens
ENCIEVLAE

SEQ ID NO: 207854 - protein, 9 aa, Homo Sapiens
LASCLSFLC

SEQ ID NO: 207855 - protein, 9 aa, Homo Sapiens
AMLMLYWVG

SEQ ID NO: 207856 - protein, 9 aa, Homo Sapiens
KYIHQKLRK

SEQ ID NO: 207857 - protein, 9 aa, Homo Sapiens
FHKEADLQV

SEQ ID NO: 207858 - protein, 9 aa, Homo Sapiens
FWVLTRKRS

SEQ ID NO: 207859 - protein, 9 aa, Homo Sapiens
VICRAATNR

SEQ ID NO: 207860 - protein, 9 aa, Homo Sapiens
DFHKEADLQ

SEQ ID NO: 207861 - protein, 9 aa, Homo Sapiens
NSVSGRVLN

SEQ ID NO: 207862 - protein, 9 aa, Homo Sapiens
RTKEPISQT

SEQ ID NO: 207863 - protein, 9 aa, Homo Sapiens
DVAGDTPVA

SEQ ID NO: 207864 - protein, 9 aa, Homo Sapiens
RGISSRTDL

SEQ ID NO: 207865 - protein, 9 aa, Homo Sapiens
SYFWVLTRK

SEQ ID NO: 207866 - protein, 9 aa, Homo Sapiens
QLHNKKKRG

SEQ ID NO: 207867 - protein, 9 aa, Homo Sapiens
FVICRAATN

SEQ ID NO: 207868 - protein, 9 aa, Homo Sapiens
PTGGHVSVF

SEQ ID NO: 207869 - protein, 9 aa, Homo Sapiens
YRITTAATL

SEQ ID NO: 207870 - protein, 9 aa, Homo Sapiens
ARGEGAMRK

SEQ ID NO: 207871 - protein, 9 aa, Homo Sapiens
KLMSPTGGH

SEQ ID NO: 207872 - protein, 9 aa, Homo Sapiens
NGDKEFVIC

SEQ ID NO: 207873 - protein, 9 aa, Homo Sapiens
VLETLASFL

SEQ ID NO: 207874 - protein, 9 aa, Homo Sapiens
YTHLVLGNH

SEQ ID NO: 207875 - protein, 9 aa, Homo Sapiens
LGNSVSGRV

SEQ ID NO: 207876 - protein, 9 aa, Homo Sapiens
ARMSAFQCL

SEQ ID NO: 207877 - protein, 9 aa, Homo Sapiens
LQAAQEELQ

SEQ ID NO: 207878 - protein, 9 aa, Homo Sapiens
KLDMLRDDP

SEQ ID NO: 207879 - protein, 9 aa, Homo Sapiens
EAINVLSHL

SEQ ID NO: 207880 - protein, 9 aa, Homo Sapiens
MAVDHYVAI

SEQ ID NO: 207881 - protein, 9 aa, Homo Sapiens
SVLASLSLL

SEQ ID NO: 207882 - protein, 9 aa, Homo Sapiens
HQKLRKSVF

SEQ ID NO: 207883 - protein, 9 aa, Homo Sapiens
HSKGLTWKS

SEQ ID NO: 207884 - protein, 9 aa, Homo Sapiens
EGNLRVECL

SEQ ID NO: 207885 - protein, 9 aa, Homo Sapiens
KDPEKLQVM

SEQ ID NO: 207886 - protein, 9 aa, Homo Sapiens
GKPRTKEPI

SEQ ID NO: 207887 - protein, 9 aa, Homo Sapiens
YNCKEAINV

SEQ ID NO: 207888 - protein, 9 aa, Homo Sapiens
TTAATLSLN

SEQ ID NO: 207889 - protein, 9 aa, Homo Sapiens
QDTKFKTNG

SEQ ID NO: 207890 - protein, 9 aa, Homo Sapiens
IFTAENLRL

SEQ ID NO: 207891 - protein, 9 aa, Homo Sapiens
QAKHNHQRV

SEQ ID NO: 207892 - protein, 9 aa, Homo Sapiens
FILIGIVHY

SEQ ID NO: 207893 - protein, 9 aa, Homo Sapiens
QRQRDRLEE

SEQ ID NO: 207894 - protein, 9 aa, Homo Sapiens
NRQGRTLYG

SEQ ID NO: 207895 - protein, 9 aa, Homo Sapiens
GAMRKILLC

SEQ ID NO: 207896 - protein, 9 aa, Homo Sapiens
WTPDPRIVP

SEQ ID NO: 207897 - protein, 9 aa, Homo Sapiens
VYALNRQGR

SEQ ID NO: 207898 - protein, 9 aa, Homo Sapiens
PSCCHLASC

SEQ ID NO: 207899 - protein, 9 aa, Homo Sapiens
ALNRQGRTL

SEQ ID NO: 207900 - protein, 9 aa, Homo Sapiens
KYGDLLPAN

SEQ ID NO: 207901 - protein, 9 aa, Homo Sapiens
RLFPEIFTA

SEQ ID NO: 207902 - protein, 9 aa, Homo Sapiens
ISACIFILI

SEQ ID NO: 207903 - protein, 9 aa, Homo Sapiens
IQDTKFKTN

SEQ ID NO: 207904 - protein, 9 aa, Homo Sapiens
VSAFVHVLH

SEQ ID NO: 207905 - protein, 9 aa, Homo Sapiens
ISSRTDLLP

SEQ ID NO: 207906 - protein, 9 aa, Homo Sapiens
AMDQFFHVD

SEQ ID NO: 207907 - protein, 9 aa, Homo Sapiens
SVSAATTAA

SEQ ID NO: 207908 - protein, 9 aa, Homo Sapiens
IFILIGIVH

SEQ ID NO: 207909 - protein, 9 aa, Homo Sapiens
AVSTRVRWC

SEQ ID NO: 207910 - protein, 9 aa, Homo Sapiens
AGDTPVAVR

SEQ ID NO: 207911 - protein, 9 aa, Homo Sapiens
VRLFPEIFT

SEQ ID NO: 207912 - protein, 9 aa, Homo Sapiens
QVQKQIIVY

SEQ ID NO: 207913 - protein, 9 aa, Homo Sapiens
KPRTKEPIS

SEQ ID NO: 207914 - protein, 9 aa, Homo Sapiens
RKPNIDLFR

SEQ ID NO: 207915 - protein, 9 aa, Homo Sapiens
LLPRQSNRQ

SEQ ID NO: 207916 - protein, 9 aa, Homo Sapiens
PLKKRSSLL

SEQ ID NO: 207917 - protein, 9 aa, Homo Sapiens
WKSTRTPSI

SEQ ID NO: 207918 - protein, 9 aa, Homo Sapiens
TRTPSIRNS

SEQ ID NO: 207919 - protein, 9 aa, Homo Sapiens
TMVSASCSQ

SEQ ID NO: 207920 - protein, 9 aa, Homo Sapiens
GWTPDPRIV

SEQ ID NO: 207921 - protein, 9 aa, Homo Sapiens
QGNGKCCHR

SEQ ID NO: 207922 - protein, 9 aa, Homo Sapiens
KLEASELCS

SEQ ID NO: 207923 - protein, 9 aa, Homo Sapiens
DALHTFIRD

SEQ ID NO: 207924 - protein, 9 aa, Homo Sapiens
GLEPTTMVS

SEQ ID NO: 207925 - protein, 9 aa, Homo Sapiens
GCTAMDQFF

SEQ ID NO: 207926 - protein, 9 aa, Homo Sapiens
KKRGISSRT

SEQ ID NO: 207927 - protein, 9 aa, Homo Sapiens
DCTITGCSE

SEQ ID NO: 207928 - protein, 9 aa, Homo Sapiens
ASFLHTLKF

SEQ ID NO: 207929 - protein, 9 aa, Homo Sapiens
IARKVEGLL

SEQ ID NO: 207930 - protein, 9 aa, Homo Sapiens
LIGIQTKIN

SEQ ID NO: 207931 - protein, 9 aa, Homo Sapiens
NKYIHQKLR

SEQ ID NO: 207932 - protein, 9 aa, Homo Sapiens
KKRSSLLKS

SEQ ID NO: 207933 - protein, 9 aa, Homo Sapiens
DTPVAVRGL

SEQ ID NO: 207934 - protein, 9 aa, Homo Sapiens
EIARKVEGL

SEQ ID NO: 207935 - protein, 9 aa, Homo Sapiens
TPGTCELLT

SEQ ID NO: 207936 - protein, 9 aa, Homo Sapiens
HTFIRDLHW

SEQ ID NO: 207937 - protein, 9 aa, Homo Sapiens
FWKQRKLSL

SEQ ID NO: 207938 - protein, 9 aa, Homo Sapiens
CRNNSTGLA

SEQ ID NO: 207939 - protein, 9 aa, Homo Sapiens
GLLPELPTE

SEQ ID NO: 207940 - protein, 9 aa, Homo Sapiens
CTAMDQFFH

SEQ ID NO: 207941 - protein, 9 aa, Homo Sapiens
CTQMYHYSC

SEQ ID NO: 207942 - protein, 9 aa, Homo Sapiens
LKLPDKREI

SEQ ID NO: 207943 - protein, 9 aa, Homo Sapiens
ACNWDFHKE

SEQ ID NO: 207944 - protein, 9 aa, Homo Sapiens
CTITGCSEP

SEQ ID NO: 207945 - protein, 9 aa, Homo Sapiens
KPSMYYVML

SEQ ID NO: 207946 - protein, 9 aa, Homo Sapiens
QVMHLERCL

SEQ ID NO: 207947 - protein, 9 aa, Homo Sapiens
KLCEGENCI

SEQ ID NO: 207948 - protein, 9 aa, Homo Sapiens
MLYWVGVRR

SEQ ID NO: 207949 - protein, 9 aa, Homo Sapiens
GASVSAATT

SEQ ID NO: 207950 - protein, 9 aa, Homo Sapiens
NLRVECLDD

SEQ ID NO: 207951 - protein, 9 aa, Homo Sapiens
STEMLKHVV

SEQ ID NO: 207952 - protein, 9 aa, Homo Sapiens
CELLTVMMK

SEQ ID NO: 207953 - protein, 9 aa, Homo Sapiens
TARRGKPRT

SEQ ID NO: 207954 - protein, 9 aa, Homo Sapiens
TQMYHYSCA

SEQ ID NO: 207955 - protein, 9 aa, Homo Sapiens
MCHPSHSSG

SEQ ID NO: 207956 - protein, 9 aa, Homo Sapiens
STRTPSIRN

SEQ ID NO: 207957 - protein, 9 aa, Homo Sapiens
ILMAVDHYV

SEQ ID NO: 207958 - protein, 9 aa, Homo Sapiens
YIWIVLENS

SEQ ID NO: 207959 - protein, 9 aa, Homo Sapiens
HHAGMNRVD

SEQ ID NO: 207960 - protein, 9 aa, Homo Sapiens
ITGCSEPFP

SEQ ID NO: 207961 - protein, 9 aa, Homo Sapiens
AEQQACSNG

SEQ ID NO: 207962 - protein, 9 aa, Homo Sapiens
GSLGNSVSG

SEQ ID NO: 207963 - protein, 9 aa, Homo Sapiens
DEEMEQAKH

SEQ ID NO: 207964 - protein, 9 aa, Homo Sapiens
HNHQRVVDS

SEQ ID NO: 207965 - protein, 9 aa, Homo Sapiens
LTVMMKESK

SEQ ID NO: 207966 - protein, 9 aa, Homo Sapiens
PAGLLPELP

SEQ ID NO: 207967 - protein, 9 aa, Homo Sapiens
YSCAAGAGT

SEQ ID NO: 207968 - protein, 9 aa, Homo Sapiens
PCRNNSTGL

SEQ ID NO: 207969 - protein, 9 aa, Homo Sapiens
CLDQGAEDS

SEQ ID NO: 207970 - protein, 9 aa, Homo Sapiens
WKLDALHTF

SEQ ID NO: 207971 - protein, 9 aa, Homo Sapiens
GGDGNVGWV

SEQ ID NO: 207972 - protein, 9 aa, Homo Sapiens
HAGMNRVDR

SEQ ID NO: 207973 - protein, 9 aa, Homo Sapiens
NGLDEGLEY

SEQ ID NO: 207974 - protein, 9 aa, Homo Sapiens
CEGENCIEV

SEQ ID NO: 207975 - protein, 9 aa, Homo Sapiens
ALGLPEMDV

SEQ ID NO: 207976 - protein, 9 aa, Homo Sapiens
TKINEKLQI

SEQ ID NO: 207977 - protein, 9 aa, Homo Sapiens
KPNIDLFRT

SEQ ID NO: 207978 - protein, 9 aa, Homo Sapiens
RLKLPDKRE

SEQ ID NO: 207979 - protein, 9 aa, Homo Sapiens
TGCTAMDQF

SEQ ID NO: 207980 - protein, 9 aa, Homo Sapiens
NAFENSFFK

SEQ ID NO: 207981 - protein, 9 aa, Homo Sapiens
SLGNSVSGR

SEQ ID NO: 207982 - protein, 9 aa, Homo Sapiens
AMRKILLCL

SEQ ID NO: 207983 - protein, 9 aa, Homo Sapiens
NCIEVLAEV

SEQ ID NO: 207984 - protein, 9 aa, Homo Sapiens
QLQVSAFVH

SEQ ID NO: 207985 - protein, 9 aa, Homo Sapiens
EGENCIEVL

SEQ ID NO: 207986 - protein, 9 aa, Homo Sapiens
CGGDGNVGW

SEQ ID NO: 207987 - protein, 9 aa, Homo Sapiens
CSNGCWSQP

SEQ ID NO: 207988 - protein, 9 aa, Homo Sapiens
HLASCLSFL

SEQ ID NO: 207989 - protein, 9 aa, Homo Sapiens
HPSHSSGCP

SEQ ID NO: 207990 - protein, 9 aa, Homo Sapiens
KFWKQRKLS

SEQ ID NO: 207991 - protein, 9 aa, Homo Sapiens
DVVYALNRQ

SEQ ID NO: 207992 - protein, 9 aa, Homo Sapiens
MSPTGGHVS

SEQ ID NO: 207993 - protein, 9 aa, Homo Sapiens
LVIPNRDHT

SEQ ID NO: 207994 - protein, 9 aa, Homo Sapiens
LEPTTMVSA

SEQ ID NO: 207995 - protein, 9 aa, Homo Sapiens
LHNKKKRGI

SEQ ID NO: 207996 - protein, 9 aa, Homo Sapiens
SVSGRVLNS

SEQ ID NO: 207997 - protein, 9 aa, Homo Sapiens
FMEAFSRRC

SEQ ID NO: 207998 - protein, 9 aa, Homo Sapiens
GLALVDANQ

SEQ ID NO: 207999 - protein, 9 aa, Homo Sapiens
MLMLYWVGV

SEQ ID NO: 208000 - protein, 9 aa, Homo Sapiens
IHHAGMNRV

SEQ ID NO: 208001 - protein, 9 aa, Homo Sapiens
MNRVDRTLV

SEQ ID NO: 208002 - protein, 9 aa, Homo Sapiens
SNGCWSQPA

SEQ ID NO: 208003 - protein, 9 aa, Homo Sapiens
DMALGLPEM

SEQ ID NO: 208004 - protein, 9 aa, Homo Sapiens
MYYVMLILC

SEQ ID NO: 208005 - protein, 9 aa, Homo Sapiens
EQAKHNHQR

SEQ ID NO: 208006 - protein, 9 aa, Homo Sapiens
CCHLASCLS

SEQ ID NO: 208007 - protein, 9 aa, Homo Sapiens
TAMDQFFHV

SEQ ID NO: 208008 - protein, 9 aa, Homo Sapiens
YALNRQGRT

SEQ ID NO: 208009 - protein, 9 aa, Homo Sapiens
FFHVDCFTC

SEQ ID NO: 208010 - protein, 9 aa, Homo Sapiens
SGAVSTRVR

SEQ ID NO: 208011 - protein, 9 aa, Homo Sapiens
NNSTGLALV

SEQ ID NO: 208012 - protein, 9 aa, Homo Sapiens
CLVTKYQRD

SEQ ID NO: 208013 - protein, 9 aa, Homo Sapiens
DEVDTKFWK

SEQ ID NO: 208014 - protein, 9 aa, Homo Sapiens
NPCRNNSTG

SEQ ID NO: 208015 - protein, 9 aa, Homo Sapiens
RGKPRTKEP

SEQ ID NO: 208016 - protein, 9 aa, Homo Sapiens
LLGCKPEVT

SEQ ID NO: 208017 - protein, 9 aa, Homo Sapiens
HKEADLQVH

SEQ ID NO: 208018 - protein, 9 aa, Homo Sapiens
VCGGSLGNS

SEQ ID NO: 208019 - protein, 9 aa, Homo Sapiens
IKLCEGENC

SEQ ID NO: 208020 - protein, 9 aa, Homo Sapiens
APAGLLPEL

SEQ ID NO: 208021 - protein, 9 aa, Homo Sapiens
AKHNHQRVV

SEQ ID NO: 208022 - protein, 9 aa, Homo Sapiens
RVLETLASF

SEQ ID NO: 208023 - protein, 9 aa, Homo Sapiens
AFSRRCCEA

SEQ ID NO: 208024 - protein, 9 aa, Homo Sapiens
WEAAAMTSS

SEQ ID NO: 208025 - protein, 9 aa, Homo Sapiens
DTKFKTNGL

SEQ ID NO: 208026 - protein, 9 aa, Homo Sapiens
TASMNSGAG

SEQ ID NO: 208027 - protein, 9 aa, Homo Sapiens
QMYHYSCAA

SEQ ID NO: 208028 - protein, 9 aa, Homo Sapiens
SEEERSHKR

SEQ ID NO: 208029 - protein, 9 aa, Homo Sapiens
WTLTFEDIP

SEQ ID NO: 208030 - protein, 9 aa, Homo Sapiens
MLSENPGMC

SEQ ID NO: 208031 - protein, 9 aa, Homo Sapiens
AINVLSHLP

SEQ ID NO: 208032 - protein, 9 aa, Homo Sapiens
TQWEAAAMT

SEQ ID NO: 208033 - protein, 9 aa, Homo Sapiens
ASMNSGAGG

SEQ ID NO: 208034 - protein, 9 aa, Homo Sapiens
LVLGNHSKG

SEQ ID NO: 208035 - protein, 9 aa, Homo Sapiens
NGCWSQPAE

SEQ ID NO: 208036 - protein, 9 aa, Homo Sapiens
CSKTRRLYT

SEQ ID NO: 208037 - protein, 9 aa, Homo Sapiens
GALGEKGPQ

SEQ ID NO: 208038 - protein, 9 aa, Homo Sapiens
RTPSIRNSK

SEQ ID NO: 208039 - protein, 9 aa, Homo Sapiens
TDLLPRQSN

SEQ ID NO: 208040 - protein, 9 aa, Homo Sapiens
SRRCCEALK

SEQ ID NO: 208041 - protein, 9 aa, Homo Sapiens
AGLLPELPT

SEQ ID NO: 208042 - protein, 9 aa, Homo Sapiens
DKREIYVAI

SEQ ID NO: 208043 - protein, 9 aa, Homo Sapiens
SAATTAAAA

SEQ ID NO: 208044 - protein, 9 aa, Homo Sapiens
VKKKKIKHE

SEQ ID NO: 208045 - protein, 9 aa, Homo Sapiens
SKTRRLYTH

SEQ ID NO: 208046 - protein, 9 aa, Homo Sapiens
GNSVSGRVL

SEQ ID NO: 208047 - protein, 9 aa, Homo Sapiens
PRQSNRQDV

SEQ ID NO: 208048 - protein, 9 aa, Homo Sapiens
NSKMPLKKR

SEQ ID NO: 208049 - protein, 9 aa, Homo Sapiens
GNHSKGLTW

SEQ ID NO: 208050 - protein, 9 aa, Homo Sapiens
QSTEMLKHV

SEQ ID NO: 208051 - protein, 9 aa, Homo Sapiens
AIEDNKYIH

SEQ ID NO: 208052 - protein, 9 aa, Homo Sapiens
MNSGAGGTS

SEQ ID NO: 208053 - protein, 9 aa, Homo Sapiens
DKEFVICRA

SEQ ID NO: 208054 - protein, 9 aa, Homo Sapiens
KVEGLLGCK

SEQ ID NO: 208055 - protein, 9 aa, Homo Sapiens
EERSHKRKL

SEQ ID NO: 208056 - protein, 9 aa, Homo Sapiens
EQQACSNGC

SEQ ID NO: 208057 - protein, 9 aa, Homo Sapiens
LPEMDVRKK

SEQ ID NO: 208058 - protein, 9 aa, Homo Sapiens
KKIKHEIKI

SEQ ID NO: 208059 - protein, 9 aa, Homo Sapiens
LSENPGMCG

SEQ ID NO: 208060 - protein, 9 aa, Homo Sapiens
LQVSAFVHV

SEQ ID NO: 208061 - protein, 9 aa, Homo Sapiens
TTAAAAGGG

SEQ ID NO: 208062 - protein, 9 aa, Homo Sapiens
AEKETTKKD

SEQ ID NO: 208063 - protein, 9 aa, Homo Sapiens
LASFLHTLK

SEQ ID NO: 208064 - protein, 9 aa, Homo Sapiens
QDAYIWIVL

SEQ ID NO: 208065 - protein, 9 aa, Homo Sapiens
HLYWTDIKT

SEQ ID NO: 208066 - protein, 9 aa, Homo Sapiens
CHPSHSSGC

SEQ ID NO: 208067 - protein, 9 aa, Homo Sapiens
GPAGEKGAL

SEQ ID NO: 208068 - protein, 9 aa, Homo Sapiens
QGAEDSDRA

SEQ ID NO: 208069 - protein, 9 aa, Homo Sapiens
RTDLLPRQS

SEQ ID NO: 208070 - protein, 9 aa, Homo Sapiens
ERKPNIDLF

SEQ ID NO: 208071 - protein, 9 aa, Homo Sapiens
ECLDDRNTF

SEQ ID NO: 208072 - protein, 9 aa, Homo Sapiens
LLPANGVLI

SEQ ID NO: 208073 - protein, 9 aa, Homo Sapiens
TPSIRNSKM

SEQ ID NO: 208074 - protein, 9 aa, Homo Sapiens
KHHQDAYIW

SEQ ID NO: 208075 - protein, 9 aa, Homo Sapiens
LHTFIRDLH

SEQ ID NO: 208076 - protein, 9 aa, Homo Sapiens
TWKSTRTPS

SEQ ID NO: 208077 - protein, 9 aa, Homo Sapiens
PVAVRGLLK

SEQ ID NO: 208078 - protein, 9 aa, Homo Sapiens
SGWTPDPRI

SEQ ID NO: 208079 - protein, 9 aa, Homo Sapiens
RDVAGDTPV

SEQ ID NO: 208080 - protein, 9 aa, Homo Sapiens
NSGAGGTST

SEQ ID NO: 208081 - protein, 9 aa, Homo Sapiens
VLILMAVDH

SEQ ID NO: 208082 - protein, 9 aa, Homo Sapiens
QCLVTKYQR

SEQ ID NO: 208083 - protein, 9 aa, Homo Sapiens
LNARGEGAM

SEQ ID NO: 208084 - protein, 9 aa, Homo Sapiens
GKRPSEGAF

SEQ ID NO: 208085 - protein, 9 aa, Homo Sapiens
ALHTFIRDL

SEQ ID NO: 208086 - protein, 9 aa, Homo Sapiens
KKKRGISSR

SEQ ID NO: 208087 - protein, 9 aa, Homo Sapiens
GNGKCCHRS

SEQ ID NO: 208088 - protein, 9 aa, Homo Sapiens
DLLPRQSNR

SEQ ID NO: 208089 - protein, 9 aa, Homo Sapiens
IISPNSYFW

SEQ ID NO: 208090 - protein, 9 aa, Homo Sapiens
ARKVEGLLG

SEQ ID NO: 208091 - protein, 9 aa, Homo Sapiens
PTTMVSASC

SEQ ID NO: 208092 - protein, 9 aa, Homo Sapiens
MYHYSCAAG

SEQ ID NO: 208093 - protein, 9 aa, Homo Sapiens
IPNRDHTDE

SEQ ID NO: 208094 - protein, 9 aa, Homo Sapiens
MVSASCSQR

SEQ ID NO: 208095 - protein, 9 aa, Homo Sapiens
HLSTCATQW

SEQ ID NO: 208096 - protein, 9 aa, Homo Sapiens
ELLTVMMKE

SEQ ID NO: 208097 - protein, 9 aa, Homo Sapiens
INVLSHLPS

SEQ ID NO: 208098 - protein, 9 aa, Homo Sapiens
EAAPAGLLP

SEQ ID NO: 208099 - protein, 9 aa, Homo Sapiens
HVVQEHLPL

SEQ ID NO: 208100 - protein, 9 aa, Homo Sapiens
LPANGVLIQ

SEQ ID NO: 208101 - protein, 9 aa, Homo Sapiens
SCCHLASCL

SEQ ID NO: 208102 - protein, 9 aa, Homo Sapiens
SMNSGAGGT

SEQ ID NO: 208103 - protein, 9 aa, Homo Sapiens
GDGNVGWVL

SEQ ID NO: 208104 - protein, 9 aa, Homo Sapiens
ELCSKTRRL

SEQ ID NO: 208105 - protein, 9 aa, Homo Sapiens
SLLRKASLS

SEQ ID NO: 208106 - protein, 9 aa, Homo Sapiens
EEHLYWTDI

SEQ ID NO: 208107 - protein, 9 aa, Homo Sapiens
GAEDSDRAI

SEQ ID NO: 208108 - protein, 9 aa, Homo Sapiens
NETLGKRPS

SEQ ID NO: 208109 - protein, 9 aa, Homo Sapiens
ARRGKPRTK

SEQ ID NO: 208110 - protein, 9 aa, Homo Sapiens
CSEPFPPYP

SEQ ID NO: 208111 - protein, 9 aa, Homo Sapiens
ALGEKGPQG

SEQ ID NO: 208112 - protein, 9 aa, Homo Sapiens
VRWCRPDCR

SEQ ID NO: 208113 - protein, 9 aa, Homo Sapiens
LYTHLVLGN

SEQ ID NO: 208114 - protein, 9 aa, Homo Sapiens
NKKKRGISS

SEQ ID NO: 208115 - protein, 9 aa, Homo Sapiens
AEDSDRAIL

SEQ ID NO: 208116 - protein, 9 aa, Homo Sapiens
TPVAVRGLL

SEQ ID NO: 208117 - protein, 9 aa, Homo Sapiens
KIKHEIKIL

SEQ ID NO: 208118 - protein, 9 aa, Homo Sapiens
GHVSVFQTQ

SEQ ID NO: 208119 - protein, 9 aa, Homo Sapiens
SLAGWKPSM

SEQ ID NO: 208120 - protein, 9 aa, Homo Sapiens
VSTRVRWCR

SEQ ID NO: 208121 - protein, 9 aa, Homo Sapiens
KQIIVYSNG

SEQ ID NO: 208122 - protein, 9 aa, Homo Sapiens
VLGNHSKGL

SEQ ID NO: 208123 - protein, 9 aa, Homo Sapiens
QAAQEELQR

SEQ ID NO: 208124 - protein, 9 aa, Homo Sapiens
LEASELCSK

SEQ ID NO: 208125 - protein, 9 aa, Homo Sapiens
WFHPKLDML

SEQ ID NO: 208126 - protein, 9 aa, Homo Sapiens
SELSGWTPD

SEQ ID NO: 208127 - protein, 9 aa, Homo Sapiens
KENETLGKR

SEQ ID NO: 208128 - protein, 9 aa, Homo Sapiens
GNLRVECLD

SEQ ID NO: 208129 - protein, 9 aa, Homo Sapiens
MEAFSRRCC

SEQ ID NO: 208130 - protein, 9 aa, Homo Sapiens
LMAVDHYVA

SEQ ID NO: 208131 - protein, 9 aa, Homo Sapiens
HVSVFQTQL

SEQ ID NO: 208132 - protein, 9 aa, Homo Sapiens
AAPAGLLPE

SEQ ID NO: 208133 - protein, 9 aa, Homo Sapiens
RSCAEKETT

SEQ ID NO: 208134 - protein, 9 aa, Homo Sapiens
TGERKPNID

SEQ ID NO: 208135 - protein, 9 aa, Homo Sapiens
RGEGAMRKI

SEQ ID NO: 208136 - protein, 9 aa, Homo Sapiens
ASELCSKTR

SEQ ID NO: 208137 - protein, 9 aa, Homo Sapiens
NCKEAINVL

SEQ ID NO: 208138 - protein, 9 aa, Homo Sapiens
ENHLLRMLS

SEQ ID NO: 208139 - protein, 9 aa, Homo Sapiens
WVAMLMLYW

SEQ ID NO: 208140 - protein, 9 aa, Homo Sapiens
FAIHHAGMN

SEQ ID NO: 208141 - protein, 9 aa, Homo Sapiens
DPEKLQVMH

SEQ ID NO: 208142 - protein, 9 aa, Homo Sapiens
MARMSAFQC

SEQ ID NO: 208143 - protein, 9 aa, Homo Sapiens
DQGAEDSDR

SEQ ID NO: 208144 - protein, 9 aa, Homo Sapiens
AYIWIVLEN

SEQ ID NO: 208145 - protein, 9 aa, Homo Sapiens
DQFFHVDCF

SEQ ID NO: 208146 - protein, 9 aa, Homo Sapiens
IRNSKMPLK

SEQ ID NO: 208147 - protein, 9 aa, Homo Sapiens
QWEAAAMTS

SEQ ID NO: 208148 - protein, 9 aa, Homo Sapiens
ANGVLIQAN

SEQ ID NO: 208149 - protein, 9 aa, Homo Sapiens
RMLSENPGM

SEQ ID NO: 208150 - protein, 9 aa, Homo Sapiens
MSAFQCLVT

SEQ ID NO: 208151 - protein, 9 aa, Homo Sapiens
STGLALVDA

SEQ ID NO: 208152 - protein, 9 aa, Homo Sapiens
AFWRPSLWT

SEQ ID NO: 208153 - protein, 9 aa, Homo Sapiens
ACGGDGNVG

SEQ ID NO: 208154 - protein, 9 aa, Homo Sapiens
ATTAAAAGG

SEQ ID NO: 208155 - protein, 9 aa, Homo Sapiens
GSVLASLSL

SEQ ID NO: 208156 - protein, 9 aa, Homo Sapiens
HYSCAAGAG

SEQ ID NO: 208157 - protein, 9 aa, Homo Sapiens
SDQVQKQII

SEQ ID NO: 208158 - protein, 9 aa, Homo Sapiens
TGGLEPTTM

SEQ ID NO: 208159 - protein, 9 aa, Homo Sapiens
NVLSHLPSH

SEQ ID NO: 208160 - protein, 9 aa, Homo Sapiens
WIVLENSSR

SEQ ID NO: 208161 - protein, 9 aa, Homo Sapiens
VAMLMLYWV

SEQ ID NO: 208162 - protein, 9 aa, Homo Sapiens
LASLSLLRK

SEQ ID NO: 208163 - protein, 9 aa, Homo Sapiens
KHEIKILEN

SEQ ID NO: 208164 - protein, 9 aa, Homo Sapiens
VLSHLPSHH

SEQ ID NO: 208165 - protein, 9 aa, Homo Sapiens
RMSAFQCLV

SEQ ID NO: 208166 - protein, 9 aa, Homo Sapiens
SRTDLLPRQ

SEQ ID NO: 208167 - protein, 9 aa, Homo Sapiens
EKETTKKDD

SEQ ID NO: 208168 - protein, 9 aa, Homo Sapiens
ERSHKRKLD

SEQ ID NO: 208169 - protein, 9 aa, Homo Sapiens
PANGVLIQA

SEQ ID NO: 208170 - protein, 9 aa, Homo Sapiens
TGGHVSVFQ

SEQ ID NO: 208171 - protein, 9 aa, Homo Sapiens
QDVYSECQG

SEQ ID NO: 208172 - protein, 9 aa, Homo Sapiens
CQPSCCHLA

SEQ ID NO: 208173 - protein, 9 aa, Homo Sapiens
VDMALGLPE

SEQ ID NO: 208174 - protein, 9 aa, Homo Sapiens
AAQEELQRQ

SEQ ID NO: 208175 - protein, 9 aa, Homo Sapiens
MLKHVVQEH

SEQ ID NO: 208176 - protein, 9 aa, Homo Sapiens
EIFTAENLR

SEQ ID NO: 208177 - protein, 9 aa, Homo Sapiens
VECLDDRNT

SEQ ID NO: 208178 - protein, 9 aa, Homo Sapiens
SLDEVDTKF

SEQ ID NO: 208179 - protein, 9 aa, Homo Sapiens
ISELSGWTP

SEQ ID NO: 208180 - protein, 9 aa, Homo Sapiens
EDSDRAILY

SEQ ID NO: 208181 - protein, 9 aa, Homo Sapiens
SEEHLYWTD

SEQ ID NO: 208182 - protein, 9 aa, Homo Sapiens
NRVDRTLVE

SEQ ID NO: 208183 - protein, 9 aa, Homo Sapiens
TACNWDFHK

SEQ ID NO: 208184 - protein, 9 aa, Homo Sapiens
RVRWCRPDC

SEQ ID NO: 208185 - protein, 9 aa, Homo Sapiens
HLLRMLSEN

SEQ ID NO: 208186 - protein, 9 aa, Homo Sapiens
EFVICRAAT

SEQ ID NO: 208187 - protein, 9 aa, Homo Sapiens
AFENSFFKD

SEQ ID NO: 208188 - protein, 9 aa, Homo Sapiens
SPTGGHVSV

SEQ ID NO: 208189 - protein, 9 aa, Homo Sapiens
KKKIKHEIK

SEQ ID NO: 208190 - protein, 9 aa, Homo Sapiens
VAVRGLLKD

SEQ ID NO: 208191 - protein, 9 aa, Homo Sapiens
KHNHQRVVD

SEQ ID NO: 208192 - protein, 9 aa, Homo Sapiens
SLWTLTFED

SEQ ID NO: 208193 - protein, 9 aa, Homo Sapiens
ASEEHLYWT

SEQ ID NO: 208194 - protein, 9 aa, Homo Sapiens
FLHTLKFRH

SEQ ID NO: 208195 - protein, 9 aa, Homo Sapiens
ENETLGKRP

SEQ ID NO: 208196 - protein, 9 aa, Homo Sapiens
SACIFILIG

SEQ ID NO: 208197 - protein, 9 aa, Homo Sapiens
ENSFFKDSF

SEQ ID NO: 208198 - protein, 9 aa, Homo Sapiens
GRLKLPDKR

SEQ ID NO: 208199 - protein, 9 aa, Homo Sapiens
ECQGNGKCC

SEQ ID NO: 208200 - protein, 9 aa, Homo Sapiens
SSGAVSTRV

SEQ ID NO: 208201 - protein, 9 aa, Homo Sapiens
KLDALHTFI

SEQ ID NO: 208202 - protein, 9 aa, Homo Sapiens
VDTKFWKQR

SEQ ID NO: 208203 - protein, 9 aa, Homo Sapiens
LGLPEMDVR

SEQ ID NO: 208204 - protein, 9 aa, Homo Sapiens
VDHYVAICK

SEQ ID NO: 208205 - protein, 9 aa, Homo Sapiens
GLTWKSTRT

SEQ ID NO: 208206 - protein, 9 aa, Homo Sapiens
NRQDVYSEC

SEQ ID NO: 208207 - protein, 9 aa, Homo Sapiens
FENSFFKDS

SEQ ID NO: 208208 - protein, 9 aa, Homo Sapiens
SELCSKTRR

SEQ ID NO: 208209 - protein, 9 aa, Homo Sapiens
VGYWVAMLM

SEQ ID NO: 208210 - protein, 9 aa, Homo Sapiens
WVLTRKRSD

SEQ ID NO: 208211 - protein, 9 aa, Homo Sapiens
FPEIFTAEN

SEQ ID NO: 208212 - protein, 9 aa, Homo Sapiens
NHSKGLTWK

SEQ ID NO: 208213 - protein, 9 aa, Homo Sapiens
GGSLGNSVS

SEQ ID NO: 208214 - protein, 9 aa, Homo Sapiens
LILMAVDHY

SEQ ID NO: 208215 - protein, 9 aa, Homo Sapiens
VIPNRDHTD

SEQ ID NO: 208216 - protein, 9 aa, Homo Sapiens
SNRQDVYSE

SEQ ID NO: 208217 - protein, 9 aa, Homo Sapiens
HPKLDMLRD

SEQ ID NO: 208218 - protein, 9 aa, Homo Sapiens
ITGERKPNI

SEQ ID NO: 208219 - protein, 9 aa, Homo Sapiens
PKLDMLRDD

SEQ ID NO: 208220 - protein, 9 aa, Homo Sapiens
LDEVDTKFW

SEQ ID NO: 208221 - protein, 9 aa, Homo Sapiens
TNGLDEGLE

SEQ ID NO: 208222 - protein, 9 aa, Homo Sapiens
TEMLKHVVQ

SEQ ID NO: 208223 - protein, 9 aa, Homo Sapiens
LGNHSKGLT

SEQ ID NO: 208224 - protein, 9 aa, Homo Sapiens
AFVHVLHCH

SEQ ID NO: 208225 - protein, 9 aa, Homo Sapiens
ILIGIQTKI

SEQ ID NO: 208226 - protein, 9 aa, Homo Sapiens
DRISELSGW

SEQ ID NO: 208227 - protein, 9 aa, Homo Sapiens
TKFWKQRKL

SEQ ID NO: 208228 - protein, 9 aa, Homo Sapiens
RVECLDDRN

SEQ ID NO: 208229 - protein, 9 aa, Homo Sapiens
RDCTITGCS

SEQ ID NO: 208230 - protein, 9 aa, Homo Sapiens
DGNVGWVLD

SEQ ID NO: 208231 - protein, 9 aa, Homo Sapiens
EASELCSKT

SEQ ID NO: 208232 - protein, 9 aa, Homo Sapiens
FKTNGLDEG

SEQ ID NO: 208233 - protein, 9 aa, Homo Sapiens
VLASLSLLR

SEQ ID NO: 208234 - protein, 9 aa, Homo Sapiens
LLTVMMKES

SEQ ID NO: 208235 - protein, 9 aa, Homo Sapiens
EMEQAKHNH

SEQ ID NO: 208236 - protein, 9 aa, Homo Sapiens
LNRQGRTLY

SEQ ID NO: 208237 - protein, 9 aa, Homo Sapiens
AGEKGALGE

SEQ ID NO: 208238 - protein, 9 aa, Homo Sapiens
SDRAILYPC

SEQ ID NO: 208239 - protein, 9 aa, Homo Sapiens
GEKGALGEK

SEQ ID NO: 208240 - protein, 9 aa, Homo Sapiens
YGDLLPANG

SEQ ID NO: 208241 - protein, 9 aa, Homo Sapiens
GEGAMRKIL

SEQ ID NO: 208242 - protein, 9 aa, Homo Sapiens
WKPSMYYVM

SEQ ID NO: 208243 - protein, 9 aa, Homo Sapiens
DLLPANGVL

SEQ ID NO: 208244 - protein, 9 aa, Homo Sapiens
PKDPEKLQV

SEQ ID NO: 208245 - protein, 9 aa, Homo Sapiens
CRAATNRVL

SEQ ID NO: 208246 - protein, 9 aa, Homo Sapiens
LCEGENCIE

SEQ ID NO: 208247 - protein, 9 aa, Homo Sapiens
KVTASMNSG

SEQ ID NO: 208248 - protein, 9 aa, Homo Sapiens
GLLGCKPEV

SEQ ID NO: 208249 - protein, 9 aa, Homo Sapiens
LSTCATQWE

SEQ ID NO: 208250 - protein, 9 aa, Homo Sapiens
TKKDDIPEE

SEQ ID NO: 208251 - protein, 9 aa, Homo Sapiens
LRMLSENPG

SEQ ID NO: 208252 - protein, 9 aa, Homo Sapiens
STCATQWEA

SEQ ID NO: 208253 - protein, 9 aa, Homo Sapiens
TTMVSASCS

SEQ ID NO: 208254 - protein, 9 aa, Homo Sapiens
STDNAFENS

SEQ ID NO: 208255 - protein, 9 aa, Homo Sapiens
LLRMLSENP

SEQ ID NO: 208256 - protein, 9 aa, Homo Sapiens
TLSLNKATR

SEQ ID NO: 208257 - protein, 9 aa, Homo Sapiens
KLVIPNRDH

SEQ ID NO: 208258 - protein, 9 aa, Homo Sapiens
AATTAAAAG

SEQ ID NO: 208259 - protein, 9 aa, Homo Sapiens
STARRGKPR

SEQ ID NO: 208260 - protein, 9 aa, Homo Sapiens
MDQFFHVDC

SEQ ID NO: 208261 - protein, 9 aa, Homo Sapiens
MPVFGVASK

SEQ ID NO: 208262 - protein, 9 aa, Homo Sapiens
SIRNSKMPL

SEQ ID NO: 208263 - protein, 9 aa, Homo Sapiens
DSDRAILYP

SEQ ID NO: 208264 - protein, 9 aa, Homo Sapiens
PNRDHTDES

SEQ ID NO: 208265 - protein, 9 aa, Homo Sapiens
PNSYFWVLT

SEQ ID NO: 208266 - protein, 9 aa, Homo Sapiens
EKLQVMHLE

SEQ ID NO: 208267 - protein, 9 aa, Homo Sapiens
LWTLTFEDI

SEQ ID NO: 208268 - protein, 9 aa, Homo Sapiens
EPTTMVSAS

SEQ ID NO: 208269 - protein, 9 aa, Homo Sapiens
QIIVYSNGN

SEQ ID NO: 208270 - protein, 9 aa, Homo Sapiens
VTASMNSGA

SEQ ID NO: 208271 - protein, 9 aa, Homo Sapiens
RNNSTGLAL

SEQ ID NO: 208272 - protein, 9 aa, Homo Sapiens
GIQTKINEK

SEQ ID NO: 208273 - protein, 9 aa, Homo Sapiens
HQDAYIWIV

SEQ ID NO: 208274 - protein, 9 aa, Homo Sapiens
SAFVHVLHC

SEQ ID NO: 208275 - protein, 9 aa, Homo Sapiens
KRGISSRTD

SEQ ID NO: 208276 - protein, 9 aa, Homo Sapiens
LSLLRKASL

SEQ ID NO: 208277 - protein, 9 aa, Homo Sapiens
TRVRWCRPD

SEQ ID NO: 208278 - protein, 9 aa, Homo Sapiens
IHQKLRKSV

SEQ ID NO: 208279 - protein, 9 aa, Homo Sapiens
FHPKLDMLR

SEQ ID NO: 208280 - protein, 9 aa, Homo Sapiens
RLYTHLVLG

SEQ ID NO: 208281 - protein, 9 aa, Homo Sapiens
LACGGDGNV

SEQ ID NO: 208282 - protein, 9 aa, Homo Sapiens
NSYFWVLTR

SEQ ID NO: 208283 - protein, 9 aa, Homo Sapiens
EWFHPKLDM

SEQ ID NO: 208284 - protein, 9 aa, Homo Sapiens
EVDMALGLP

SEQ ID NO: 208285 - protein, 9 aa, Homo Sapiens
GWKPSMYYV

SEQ ID NO: 208286 - protein, 9 aa, Homo Sapiens
ASLSLLRKA

SEQ ID NO: 208287 - protein, 9 aa, Homo Sapiens
LMLYWVGVR

SEQ ID NO: 208288 - protein, 9 aa, Homo Sapiens
NHLLRMLSE

SEQ ID NO: 208289 - protein, 9 aa, Homo Sapiens
RQDVYSECQ

SEQ ID NO: 208290 - protein, 9 aa, Homo Sapiens
KEFVICRAA

SEQ ID NO: 208291 - protein, 9 aa, Homo Sapiens
PGTCELLTV

SEQ ID NO: 208292 - protein, 9 aa, Homo Sapiens
AQEELQRQR

SEQ ID NO: 208293 - protein, 9 aa, Homo Sapiens
LVRLFPEIF

SEQ ID NO: 208294 - protein, 9 aa, Homo Sapiens
CGGSLGNSV

SEQ ID NO: 208295 - protein, 9 aa, Homo Sapiens
AIHHAGMNR

SEQ ID NO: 208296 - protein, 9 aa, Homo Sapiens
VEGLLGCKP

SEQ ID NO: 208297 - protein, 9 aa, Homo Sapiens
GGLEPTTMV

SEQ ID NO: 208298 - protein, 9 aa, Homo Sapiens
LQLHNKKKR

SEQ ID NO: 208299 - protein, 9 aa, Homo Sapiens
GGHVSVFQT

SEQ ID NO: 208300 - protein, 9 aa, Homo Sapiens
IKHEIKILE

SEQ ID NO: 208301 - protein, 9 aa, Homo Sapiens
IQTKINEKL

SEQ ID NO: 208302 - protein, 9 aa, Homo Sapiens
GDTPVAVRG

SEQ ID NO: 208303 - protein, 9 aa, Homo Sapiens
GAVSTRVRW

SEQ ID NO: 208304 - protein, 9 aa, Homo Sapiens
WRPSLWTLT

SEQ ID NO: 208305 - protein, 9 aa, Homo Sapiens
ACSNGCWSQ

SEQ ID NO: 208306 - protein, 9 aa, Homo Sapiens
QFFHVDCFT

SEQ ID NO: 208307 - protein, 9 aa, Homo Sapiens
THLVLGNHS

SEQ ID NO: 208308 - protein, 9 aa, Homo Sapiens
SSRTDLLPR

SEQ ID NO: 208309 - protein, 9 aa, Homo Sapiens
IWIVLENSS

SEQ ID NO: 208310 - protein, 9 aa, Homo Sapiens
AGKVTASMN

SEQ ID NO: 208311 - protein, 9 aa, Homo Sapiens
EEAAPAGLL

SEQ ID NO: 208312 - protein, 9 aa, Homo Sapiens
GLPEMDVRK

SEQ ID NO: 208313 - protein, 9 aa, Homo Sapiens
KFKTNGLDE

SEQ ID NO: 208314 - protein, 9 aa, Homo Sapiens
FWKLDALHT

SEQ ID NO: 208315 - protein, 9 aa, Homo Sapiens
KKKKIKHEI

SEQ ID NO: 208316 - protein, 9 aa, Homo Sapiens
TDNAFENSF

SEQ ID NO: 208317 - protein, 9 aa, Homo Sapiens
KCTQMYHYS

SEQ ID NO: 208318 - protein, 9 aa, Homo Sapiens
YKGRLKLPD

SEQ ID NO: 208319 - protein, 9 aa, Homo Sapiens
LFPEIFTAE

SEQ ID NO: 208320 - protein, 9 aa, Homo Sapiens
KEAINVLSH

SEQ ID NO: 208321 - protein, 9 aa, Homo Sapiens
PEKLQVMHL

SEQ ID NO: 208322 - protein, 9 aa, Homo Sapiens
KETTKKDDI

SEQ ID NO: 208323 - protein, 9 aa, Homo Sapiens
EKGALGEKG

SEQ ID NO: 208324 - protein, 9 aa, Homo Sapiens
ENKENETLG

SEQ ID NO: 208325 - protein, 9 aa, Homo Sapiens
PSMYYVMLI

SEQ ID NO: 208326 - protein, 9 aa, Homo Sapiens
HNKKKRGIS

SEQ ID NO: 208327 - protein, 9 aa, Homo Sapiens
IGIVHYPVF

SEQ ID NO: 208328 - protein, 9 aa, Homo Sapiens
DQVQKQIIV

SEQ ID NO: 208329 - protein, 9 aa, Homo Sapiens
LFWKLDALH

SEQ ID NO: 208330 - protein, 9 aa, Homo Sapiens
DTKFWKQRK

SEQ ID NO: 208331 - protein, 9 aa, Homo Sapiens
CEEAAPAGL

SEQ ID NO: 208332 - protein, 9 aa, Homo Sapiens
SLSLLRKAS

SEQ ID NO: 208333 - protein, 9 aa, Homo Sapiens
SECQGNGKC

SEQ ID NO: 208334 - protein, 9 aa, Homo Sapiens
AGWKPSMYY

SEQ ID NO: 208335 - protein, 9 aa, Homo Sapiens
LQVMHLERC

SEQ ID NO: 208336 - protein, 9 aa, Homo Sapiens
VVYALNRQG

SEQ ID NO: 208337 - protein, 9 aa, Homo Sapiens
LSGWTPDPR

SEQ ID NO: 208338 - protein, 9 aa, Homo Sapiens
STRVRWCRP

SEQ ID NO: 208339 - protein, 9 aa, Homo Sapiens
TLASFLHTL

SEQ ID NO: 208340 - protein, 9 aa, Homo Sapiens
CHLASCLSF

SEQ ID NO: 208341 - protein, 9 aa, Homo Sapiens
EGAMRKILL

SEQ ID NO: 208342 - protein, 9 aa, Homo Sapiens
RRCCEALKL

SEQ ID NO: 208343 - protein, 9 aa, Homo Sapiens
TGASVSAAT

SEQ ID NO: 208344 - protein, 9 aa, Homo Sapiens
ATLSLNKAT

SEQ ID NO: 208345 - protein, 9 aa, Homo Sapiens
LKHVVQEHL

SEQ ID NO: 208346 - protein, 9 aa, Homo Sapiens
QVSAFVHVL

SEQ ID NO: 208347 - protein, 9 aa, Homo Sapiens
MITGERKPN

SEQ ID NO: 208348 - protein, 9 aa, Homo Sapiens
NRDHTDESK

SEQ ID NO: 208349 - protein, 9 aa, Homo Sapiens
KTRRLYTHL

SEQ ID NO: 208350 - protein, 9 aa, Homo Sapiens
DFDASEEHL

SEQ ID NO: 208351 - protein, 9 aa, Homo Sapiens
HEIKILENL

SEQ ID NO: 208352 - protein, 9 aa, Homo Sapiens
GERKPNIDL

SEQ ID NO: 208353 - protein, 9 aa, Homo Sapiens
QEELQRQRD

SEQ ID NO: 208354 - protein, 9 aa, Homo Sapiens
WKQRKLSLS

SEQ ID NO: 208355 - protein, 9 aa, Homo Sapiens
GNVGWVLDC

SEQ ID NO: 208356 - protein, 9 aa, Homo Sapiens
EAEQQACSN

SEQ ID NO: 208357 - protein, 9 aa, Homo Sapiens
GCSEPFPPY

SEQ ID NO: 208358 - protein, 9 aa, Homo Sapiens
GKVTASMNS

SEQ ID NO: 208359 - protein, 9 aa, Homo Sapiens
DVSEEERSH

SEQ ID NO: 208360 - protein, 9 aa, Homo Sapiens
CCEALKLMV

SEQ ID NO: 208361 - protein, 9 aa, Homo Sapiens
FVHVLHCHV

SEQ ID NO: 208362 - protein, 9 aa, Homo Sapiens
HLVLGNHSK

SEQ ID NO: 208363 - protein, 9 aa, Homo Sapiens
HHQDAYIWI

SEQ ID NO: 208364 - protein, 9 aa, Homo Sapiens
PSIRNSKMP

SEQ ID NO: 208365 - protein, 9 aa, Homo Sapiens
MPLKKRSSL

SEQ ID NO: 208366 - protein, 9 aa, Homo Sapiens
TGLALVDAN

SEQ ID NO: 208367 - protein, 9 aa, Homo Sapiens
KLPDKREIY

SEQ ID NO: 208368 - protein, 9 aa, Homo Sapiens
DNAFENSFF

SEQ ID NO: 208369 - protein, 9 aa, Homo Sapiens
LRVECLDDR

SEQ ID NO: 208370 - protein, 9 aa, Homo Sapiens
SHKRKLDEK

SEQ ID NO: 208371 - protein, 9 aa, Homo Sapiens
IEDNKYIHQ

SEQ ID NO: 208372 - protein, 9 aa, Homo Sapiens
IDFDASEEH

SEQ ID NO: 208373 - protein, 9 aa, Homo Sapiens
AATLSLNKA

SEQ ID NO: 208374 - protein, 9 aa, Homo Sapiens
RISELSGWT

SEQ ID NO: 208375 - protein, 9 aa, Homo Sapiens
YWVAMLMLY

SEQ ID NO: 208376 - protein, 9 aa, Homo Sapiens
AGMNRVDRT

SEQ ID NO: 208377 - protein, 9 aa, Homo Sapiens
RNSKMPLKK

SEQ ID NO: 208378 - protein, 9 aa, Homo Sapiens
PNIDLFRTC

SEQ ID NO: 208379 - protein, 9 aa, Homo Sapiens
CAEKETTKK

SEQ ID NO: 208380 - protein, 9 aa, Homo Sapiens
RSHKRKLDE

SEQ ID NO: 208381 - protein, 9 aa, Homo Sapiens
GDLLPANGV

SEQ ID NO: 208382 - protein, 9 aa, Homo Sapiens
RRLYTHLVL

SEQ ID NO: 208383 - protein, 9 aa, Homo Sapiens
LLVRLFPEI

SEQ ID NO: 208384 - protein, 9 aa, Homo Sapiens
AVDHYVAIC

SEQ ID NO: 208385 - protein, 9 aa, Homo Sapiens
KGLTWKSTR

SEQ ID NO: 208386 - protein, 9 aa, Homo Sapiens
QPSCCHLAS

SEQ ID NO: 208387 - protein, 9 aa, Homo Sapiens
LGEKGPQGP

SEQ ID NO: 208388 - protein, 9 aa, Homo Sapiens
FWRPSLWTL

SEQ ID NO: 208389 - protein, 9 aa, Homo Sapiens
ETTKKDDIP

SEQ ID NO: 208390 - protein, 9 aa, Homo Sapiens
LEVDMALGL

SEQ ID NO: 208391 - protein, 9 aa, Homo Sapiens
PSDQVQKQI

SEQ ID NO: 208392 - protein, 9 aa, Homo Sapiens
QKQIIVYSN

SEQ ID NO: 208393 - protein, 9 aa, Homo Sapiens
ILIGIVHYP

SEQ ID NO: 208394 - protein, 9 aa, Homo Sapiens
ATQWEAAAM

SEQ ID NO: 208395 - protein, 9 aa, Homo Sapiens
KGALGEKGP

SEQ ID NO: 208396 - protein, 9 aa, Homo Sapiens
HTDESKDSS

SEQ ID NO: 208397 - protein, 9 aa, Homo Sapiens
EMLKHVVQE

SEQ ID NO: 208398 - protein, 9 aa, Homo Sapiens
DVYSECQGN

SEQ ID NO: 208399 - protein, 9 aa, Homo Sapiens
KSTRTPSIR

SEQ ID NO: 208400 - protein, 9 aa, Homo Sapiens
AFQCLVTKY

SEQ ID NO: 208401 - protein, 9 aa, Homo Sapiens
VEGNLRVEC

SEQ ID NO: 208402 - protein, 9 aa, Homo Sapiens
FSRRCCEAL

SEQ ID NO: 208403 - protein, 9 aa, Homo Sapiens
TTKKDDIPE

SEQ ID NO: 208404 - protein, 9 aa, Homo Sapiens
AMDVVYALN

SEQ ID NO: 208405 - protein, 9 aa, Homo Sapiens
YHYSCAAGA

SEQ ID NO: 208406 - protein, 9 aa, Homo Sapiens
GTCELLTVM

SEQ ID NO: 208407 - protein, 9 aa, Homo Sapiens
SCQPSCCHL

SEQ ID NO: 208408 - protein, 9 aa, Homo Sapiens
LLRKASLSS

SEQ ID NO: 208409 - protein, 9 aa, Homo Sapiens
PSLWTLTFE

SEQ ID NO: 208410 - protein, 9 aa, Homo Sapiens
SCAEKETTK

SEQ ID NO: 208411 - protein, 9 aa, Homo Sapiens
YIHQKLRKS

SEQ ID NO: 208412 - protein, 9 aa, Homo Sapiens
SKGLTWKST

SEQ ID NO: 208413 - protein, 9 aa, Homo Sapiens
GISSRTDLL

SEQ ID NO: 208414 - protein, 9 aa, Homo Sapiens
TKFKTNGLD

SEQ ID NO: 208415 - protein, 9 aa, Homo Sapiens
TCELLTVMM

SEQ ID NO: 208416 - protein, 9 aa, Homo Sapiens
SKMPLKKRS

SEQ ID NO: 208417 - protein, 9 aa, Homo Sapiens
SCAAGAGTF

SEQ ID NO: 208418 - protein, 9 aa, Homo Sapiens
SMYYVMLIL

SEQ ID NO: 208419 - protein, 9 aa, Homo Sapiens
PRTKEPISQ

SEQ ID NO: 208420 - protein, 9 aa, Homo Sapiens
EAFSRRCCE

SEQ ID NO: 208421 - protein, 9 aa, Homo Sapiens
SSLDEVDTK

SEQ ID NO: 208422 - protein, 9 aa, Homo Sapiens
VFGVASKLR

SEQ ID NO: 208423 - protein, 9 aa, Homo Sapiens
TITGCSEPF

SEQ ID NO: 208424 - protein, 9 aa, Homo Sapiens
YSECQGNGK

SEQ ID NO: 208425 - protein, 9 aa, Homo Sapiens
VLACGGDGN

SEQ ID NO: 208426 - protein, 9 aa, Homo Sapiens
EGLLGCKPE

SEQ ID NO: 208427 - protein, 9 aa, Homo Sapiens
RDHTDESKD

SEQ ID NO: 208428 - protein, 9 aa, Homo Sapiens
DILIGIQTK

SEQ ID NO: 208429 - protein, 9 aa, Homo Sapiens
ISPNSYFWV

SEQ ID NO: 208430 - protein, 9 aa, Homo Sapiens
LCSKTRRLY

SEQ ID NO: 208431 - protein, 9 aa, Homo Sapiens
TCATQWEAA

SEQ ID NO: 208432 - protein, 9 aa, Homo Sapiens
NKENETLGK

SEQ ID NO: 208433 - protein, 9 aa, Homo Sapiens
RRGKPRTKE

SEQ ID NO: 208434 - protein, 9 aa, Homo Sapiens
CIEVLAEVW

SEQ ID NO: 208435 - protein, 9 aa, Homo Sapiens
VMHLERCLR

SEQ ID NO: 208436 - protein, 9 aa, Homo Sapiens
QACSNGCWS

SEQ ID NO: 208437 - protein, 9 aa, Homo Sapiens
KRDCTITGC

SEQ ID NO: 208438 - protein, 9 aa, Homo Sapiens
ELQRQRDRL

SEQ ID NO: 208439 - protein, 9 aa, Homo Sapiens
CATQWEAAA

SEQ ID NO: 208440 - protein, 9 aa, Homo Sapiens
RKVEGLLGC

SEQ ID NO: 208441 - protein, 9 aa, Homo Sapiens
NARGEGAMR

SEQ ID NO: 208442 - protein, 9 aa, Homo Sapiens
VQKQIIVYS

SEQ ID NO: 208443 - protein, 9 aa, Homo Sapiens
TRRLYTHLV

SEQ ID NO: 208444 - protein, 9 aa, Homo Sapiens
DAYIWIVLE

SEQ ID NO: 208445 - protein, 9 aa, Homo Sapiens
RCCEALKLM

SEQ ID NO: 208446 - protein, 9 aa, Homo Sapiens
ITTAATLSL

SEQ ID NO: 208447 - protein, 9 aa, Homo Sapiens
CNWDFHKEA

SEQ ID NO: 208448 - protein, 9 aa, Homo Sapiens
PVKKKKIKH

SEQ ID NO: 208449 - protein, 9 aa, Homo Sapiens
RITTAATLS

SEQ ID NO: 208450 - protein, 9 aa, Homo Sapiens
MALGLPEMD

SEQ ID NO: 208451 - protein, 9 aa, Homo Sapiens
YFWVLTRKR

SEQ ID NO: 208452 - protein, 9 aa, Homo Sapiens
PAGEKGALG

SEQ ID NO: 208453 - protein, 9 aa, Homo Sapiens
FGVASKLRQ

SEQ ID NO: 208454 - protein, 9 aa, Homo Sapiens
NSFFKDSFG

SEQ ID NO: 208455 - protein, 9 aa, Homo Sapiens
DNKYIHQKL

SEQ ID NO: 208456 - protein, 9 aa, Homo Sapiens
KLQVMHLER

SEQ ID NO: 208457 - protein, 9 aa, Homo Sapiens
SPNSYFWVL

SEQ ID NO: 208458 - protein, 9 aa, Homo Sapiens
LPDKREIYV

SEQ ID NO: 208459 - protein, 9 aa, Homo Sapiens
VYSECQGNG

SEQ ID NO: 208460 - protein, 9 aa, Homo Sapiens
ASVSAATTA

SEQ ID NO: 208461 - protein, 9 aa, Homo Sapiens
TLGKRPSEG

SEQ ID NO: 208462 - protein, 9 aa, Homo Sapiens
VAGDTPVAV

SEQ ID NO: 208463 - protein, 9 aa, Homo Sapiens
KGRLKLPDK

SEQ ID NO: 208464 - protein, 9 aa, Homo Sapiens
PVFGVASKL

SEQ ID NO: 208465 - protein, 9 aa, Homo Sapiens
EKLEASELC

SEQ ID NO: 208466 - protein, 9 aa, Homo Sapiens
NGVLIQAND

SEQ ID NO: 208467 - protein, 9 aa, Homo Sapiens
HKRKLDEKE

SEQ ID NO: 208468 - protein, 9 aa, Homo Sapiens
SFLHTLKFR

SEQ ID NO: 208469 - protein, 9 aa, Homo Sapiens
LETLASFLH

SEQ ID NO: 208470 - protein, 9 aa, Homo Sapiens
MLRDDPEMQ

SEQ ID NO: 208471 - protein, 9 aa, Homo Sapiens
CTACNWDFH

SEQ ID NO: 208472 - protein, 9 aa, Homo Sapiens
NIDLFRTCI

SEQ ID NO: 208473 - protein, 9 aa, Homo Sapiens
KTNGLDEGL

SEQ ID NO: 208474 - protein, 9 aa, Homo Sapiens
LDQGAEDSD

SEQ ID NO: 208475 - protein, 9 aa, Homo Sapiens
GENCIEVLA

SEQ ID NO: 208476 - protein, 9 aa, Homo Sapiens
ETLGKRPSE

SEQ ID NO: 208477 - protein, 9 aa, Homo Sapiens
MEQAKHNHQ

SEQ ID NO: 208478 - protein, 9 aa, Homo Sapiens
KINEKLQIQ

SEQ ID NO: 208479 - protein, 9 aa, Homo Sapiens
CLDDRNTFR

SEQ ID NO: 208480 - protein, 9 aa, Homo Sapiens
YLQLHNKKK

SEQ ID NO: 208481 - protein, 9 aa, Homo Sapiens
VHVLHCHVA

SEQ ID NO: 208482 - protein, 9 aa, Homo Sapiens
WDFHKEADL

SEQ ID NO: 208483 - protein, 9 aa, Homo Sapiens
LDMLRDDPE

SEQ ID NO: 208484 - protein, 9 aa, Homo Sapiens
GDKEFVICR

SEQ ID NO: 208485 - protein, 9 aa, Homo Sapiens
PEIFTAENL

SEQ ID NO: 208486 - protein, 9 aa, Homo Sapiens
KENHLLRML

SEQ ID NO: 208487 - protein, 9 aa, Homo Sapiens
CIFILIGIV

SEQ ID NO: 208488 - protein, 9 aa, Homo Sapiens
LGKRPSEGA

SEQ ID NO: 208489 - protein, 9 aa, Homo Sapiens
YAFWRPSLW

SEQ ID NO: 208490 - protein, 9 aa, Homo Sapiens
HVLHCHVAP

SEQ ID NO: 208491 - protein, 9 aa, Homo Sapiens
LTWKSTRTP

SEQ ID NO: 208492 - protein, 9 aa, Homo Sapiens
ETLASFLHT

SEQ ID NO: 208493 - protein, 9 aa, Homo Sapiens
IGIQTKINE

SEQ ID NO: 208494 - protein, 9 aa, Homo Sapiens
SFFKDSFGS

SEQ ID NO: 208495 - protein, 9 aa, Homo Sapiens
RPSLWTLTF

SEQ ID NO: 208496 - protein, 9 aa, Homo Sapiens
QTKINEKLQ

SEQ ID NO: 208497 - protein, 9 aa, Homo Sapiens
RQSNRQDVY

SEQ ID NO: 208498 - protein, 9 aa, Homo Sapiens
DHTDESKDS

SEQ ID NO: 208499 - protein, 9 aa, Homo Sapiens
VSEEERSHK

SEQ ID NO: 208500 - protein, 9 aa, Homo Sapiens
LLPELPTEA

SEQ ID NO: 208501 - protein, 9 aa, Homo Sapiens
SSSLDEVDT

SEQ ID NO: 208502 - protein, 9 aa, Homo Sapiens
IPSDQVQKQ

SEQ ID NO: 208503 - protein, 9 aa, Homo Sapiens
ACIFILIGI

SEQ ID NO: 208504 - protein, 9 aa, Homo Sapiens
TAATLSLNK

SEQ ID NO: 208505 - protein, 9 aa, Homo Sapiens
EVDTKFWKQ

SEQ ID NO: 208506 - protein, 9 aa, Homo Sapiens
LMSPTGGHV

SEQ ID NO: 208507 - protein, 9 aa, Homo Sapiens
MDVVYALNR

SEQ ID NO: 208508 - protein, 9 aa, Homo Sapiens
EHLYWTDIK

SEQ ID NO: 208509 - protein, 9 aa, Homo Sapiens
NVGWVLDCI

SEQ ID NO: 208510 - protein, 9 aa, Homo Sapiens
EECMKRKNE

SEQ ID NO: 208511 - protein, 9 aa, Homo Sapiens
MLEDLAETL

SEQ ID NO: 208512 - protein, 9 aa, Homo Sapiens
ALWPKRRGS

SEQ ID NO: 208513 - protein, 9 aa, Homo Sapiens
ISSSRKLIH

SEQ ID NO: 208514 - protein, 9 aa, Homo Sapiens
QLRQSIDAQ

SEQ ID NO: 208515 - protein, 9 aa, Homo Sapiens
AAAGTVLQW

SEQ ID NO: 208516 - protein, 9 aa, Homo Sapiens
GVIYRSLSF

SEQ ID NO: 208517 - protein, 9 aa, Homo Sapiens
PDLFGAVPR

SEQ ID NO: 208518 - protein, 9 aa, Homo Sapiens
TLMDAHKGA

SEQ ID NO: 208519 - protein, 9 aa, Homo Sapiens
KRRSSATIN

SEQ ID NO: 208520 - protein, 9 aa, Homo Sapiens
CKWMDSLLS

SEQ ID NO: 208521 - protein, 9 aa, Homo Sapiens
GFAPFCQPA

SEQ ID NO: 208522 - protein, 9 aa, Homo Sapiens
KTKSCTSLS

SEQ ID NO: 208523 - protein, 9 aa, Homo Sapiens
EDIAHRLNF

SEQ ID NO: 208524 - protein, 9 aa, Homo Sapiens
CLDAISFLL

SEQ ID NO: 208525 - protein, 9 aa, Homo Sapiens
FIVFLFFAS

SEQ ID NO: 208526 - protein, 9 aa, Homo Sapiens
DPQPPALGT

SEQ ID NO: 208527 - protein, 9 aa, Homo Sapiens
ITSASNTTR

SEQ ID NO: 208528 - protein, 9 aa, Homo Sapiens
ALGTTRLHT

SEQ ID NO: 208529 - protein, 9 aa, Homo Sapiens
IPRRKKIDR

SEQ ID NO: 208530 - protein, 9 aa, Homo Sapiens
TTQGPIVST

SEQ ID NO: 208531 - protein, 9 aa, Homo Sapiens
REARLWRGR

SEQ ID NO: 208532 - protein, 9 aa, Homo Sapiens
FMDICYTTT

SEQ ID NO: 208533 - protein, 9 aa, Homo Sapiens
PEKPKDPSA

SEQ ID NO: 208534 - protein, 9 aa, Homo Sapiens
FISLSYTVV

SEQ ID NO: 208535 - protein, 9 aa, Homo Sapiens
GERQSLLSG

SEQ ID NO: 208536 - protein, 9 aa, Homo Sapiens
CSRGSGGLG

SEQ ID NO: 208537 - protein, 9 aa, Homo Sapiens
REEEECMKR

SEQ ID NO: 208538 - protein, 9 aa, Homo Sapiens
DTIYQTIDF

SEQ ID NO: 208539 - protein, 9 aa, Homo Sapiens
VSYEKQRKA

SEQ ID NO: 208540 - protein, 9 aa, Homo Sapiens
RDRVKGVLA

SEQ ID NO: 208541 - protein, 9 aa, Homo Sapiens
FPGKAEIDQ

SEQ ID NO: 208542 - protein, 9 aa, Homo Sapiens
EGARFTLVR

SEQ ID NO: 208543 - protein, 9 aa, Homo Sapiens
VSTPQDITL

SEQ ID NO: 208544 - protein, 9 aa, Homo Sapiens
QDITLMDAH

SEQ ID NO: 208545 - protein, 9 aa, Homo Sapiens
KVAEATNDY

SEQ ID NO: 208546 - protein, 9 aa, Homo Sapiens
PGKAEIDQI

SEQ ID NO: 208547 - protein, 9 aa, Homo Sapiens
VPRYPLMDR

SEQ ID NO: 208548 - protein, 9 aa, Homo Sapiens
ECMKRKNEA

SEQ ID NO: 208549 - protein, 9 aa, Homo Sapiens
ESQLKSKSQ

SEQ ID NO: 208550 - protein, 9 aa, Homo Sapiens
IKIFEDIPM

SEQ ID NO: 208551 - protein, 9 aa, Homo Sapiens
QIRCVYPTR

SEQ ID NO: 208552 - protein, 9 aa, Homo Sapiens
QPPALGTTR

SEQ ID NO: 208553 - protein, 9 aa, Homo Sapiens
YEKQRKACM

SEQ ID NO: 208554 - protein, 9 aa, Homo Sapiens
GPGLPLSVP

SEQ ID NO: 208555 - protein, 9 aa, Homo Sapiens
GGEEKVYIT

SEQ ID NO: 208556 - protein, 9 aa, Homo Sapiens
WLKLQLAFL

SEQ ID NO: 208557 - protein, 9 aa, Homo Sapiens
VTRSSTASS

SEQ ID NO: 208558 - protein, 9 aa, Homo Sapiens
HQAMEEAKK

SEQ ID NO: 208559 - protein, 9 aa, Homo Sapiens
SKRLTVQTE

SEQ ID NO: 208560 - protein, 9 aa, Homo Sapiens
TTPEKPKDP

SEQ ID NO: 208561 - protein, 9 aa, Homo Sapiens
SQLKSKSQE

SEQ ID NO: 208562 - protein, 9 aa, Homo Sapiens
LKLQLAFLA

SEQ ID NO: 208563 - protein, 9 aa, Homo Sapiens
RMGPRAVLG

SEQ ID NO: 208564 - protein, 9 aa, Homo Sapiens
ISKLVESGI

SEQ ID NO: 208565 - protein, 9 aa, Homo Sapiens
CNYPLMMLA

SEQ ID NO: 208566 - protein, 9 aa, Homo Sapiens
IKHLDDFKG

SEQ ID NO: 208567 - protein, 9 aa, Homo Sapiens
PFHPADPQP

SEQ ID NO: 208568 - protein, 9 aa, Homo Sapiens
NVVKNEGIM

SEQ ID NO: 208569 - protein, 9 aa, Homo Sapiens
QRMLFCTLL

SEQ ID NO: 208570 - protein, 9 aa, Homo Sapiens
ICFEDNLLT

SEQ ID NO: 208571 - protein, 9 aa, Homo Sapiens
LMSCSQPKV

SEQ ID NO: 208572 - protein, 9 aa, Homo Sapiens
RQSLLSGEG

SEQ ID NO: 208573 - protein, 9 aa, Homo Sapiens
WTPVSKRWC

SEQ ID NO: 208574 - protein, 9 aa, Homo Sapiens
SQHSPFPSG

SEQ ID NO: 208575 - protein, 9 aa, Homo Sapiens
AMDESGLWV

SEQ ID NO: 208576 - protein, 9 aa, Homo Sapiens
PLKLAGWQC

SEQ ID NO: 208577 - protein, 9 aa, Homo Sapiens
THHQSELLR

SEQ ID NO: 208578 - protein, 9 aa, Homo Sapiens
VGSPQDKVA

SEQ ID NO: 208579 - protein, 9 aa, Homo Sapiens
VVVGKLPVE

SEQ ID NO: 208580 - protein, 9 aa, Homo Sapiens
PGLPLSVPP

SEQ ID NO: 208581 - protein, 9 aa, Homo Sapiens
LSSGTLMPG

SEQ ID NO: 208582 - protein, 9 aa, Homo Sapiens
VSDTMVEPY

SEQ ID NO: 208583 - protein, 9 aa, Homo Sapiens
DVKREEEEC

SEQ ID NO: 208584 - protein, 9 aa, Homo Sapiens
LEEIREFSK

SEQ ID NO: 208585 - protein, 9 aa, Homo Sapiens
LNFAVEQVN

SEQ ID NO: 208586 - protein, 9 aa, Homo Sapiens
HRIILPSDF

SEQ ID NO: 208587 - protein, 9 aa, Homo Sapiens
TPVSKRWCD

SEQ ID NO: 208588 - protein, 9 aa, Homo Sapiens
LQPLKVKLE

SEQ ID NO: 208589 - protein, 9 aa, Homo Sapiens
YPATLRKQR

SEQ ID NO: 208590 - protein, 9 aa, Homo Sapiens
AQWEQALSS

SEQ ID NO: 208591 - protein, 9 aa, Homo Sapiens
QHSPFPSGS

SEQ ID NO: 208592 - protein, 9 aa, Homo Sapiens
KIEGLKETL

SEQ ID NO: 208593 - protein, 9 aa, Homo Sapiens
EELQPLKVK

SEQ ID NO: 208594 - protein, 9 aa, Homo Sapiens
HSDIDFAMD

SEQ ID NO: 208595 - protein, 9 aa, Homo Sapiens
ISFLLYLPP

SEQ ID NO: 208596 - protein, 9 aa, Homo Sapiens
RLTVQTEFM

SEQ ID NO: 208597 - protein, 9 aa, Homo Sapiens
VIAQHVRSM

SEQ ID NO: 208598 - protein, 9 aa, Homo Sapiens
GCKWMDSLL

SEQ ID NO: 208599 - protein, 9 aa, Homo Sapiens
LPDADTLLI

SEQ ID NO: 208600 - protein, 9 aa, Homo Sapiens
QWLIQEQLR

SEQ ID NO: 208601 - protein, 9 aa, Homo Sapiens
SLYHQAMEE

SEQ ID NO: 208602 - protein, 9 aa, Homo Sapiens
LQYYASQHS

SEQ ID NO: 208603 - protein, 9 aa, Homo Sapiens
NTDFTHFYK

SEQ ID NO: 208604 - protein, 9 aa, Homo Sapiens
GIIPVIYYS

SEQ ID NO: 208605 - protein, 9 aa, Homo Sapiens
FLAYACMAN

SEQ ID NO: 208606 - protein, 9 aa, Homo Sapiens
RFLTLVHHL

SEQ ID NO: 208607 - protein, 9 aa, Homo Sapiens
LLGEEREKR

SEQ ID NO: 208608 - protein, 9 aa, Homo Sapiens
YQTIDFSGI

SEQ ID NO: 208609 - protein, 9 aa, Homo Sapiens
GSHPTQKGD

SEQ ID NO: 208610 - protein, 9 aa, Homo Sapiens
WEDLFCYWE

SEQ ID NO: 208611 - protein, 9 aa, Homo Sapiens
SDTMVEPYN

SEQ ID NO: 208612 - protein, 9 aa, Homo Sapiens
RHLWGPFHP

SEQ ID NO: 208613 - protein, 9 aa, Homo Sapiens
DIAHRLNFA

SEQ ID NO: 208614 - protein, 9 aa, Homo Sapiens
DFTHFYKLG

SEQ ID NO: 208615 - protein, 9 aa, Homo Sapiens
LDVSYEKQR

SEQ ID NO: 208616 - protein, 9 aa, Homo Sapiens
PWLKLQLAF

SEQ ID NO: 208617 - protein, 9 aa, Homo Sapiens
MYTFGDGCH

SEQ ID NO: 208618 - protein, 9 aa, Homo Sapiens
GDAKKEPGT

SEQ ID NO: 208619 - protein, 9 aa, Homo Sapiens
LNGAGEPHV

SEQ ID NO: 208620 - protein, 9 aa, Homo Sapiens
EDRAGSHPT

SEQ ID NO: 208621 - protein, 9 aa, Homo Sapiens
KGVLAKPFI

SEQ ID NO: 208622 - protein, 9 aa, Homo Sapiens
KEMPLVFGK

SEQ ID NO: 208623 - protein, 9 aa, Homo Sapiens
TLMTGHHCE

SEQ ID NO: 208624 - protein, 9 aa, Homo Sapiens
PKVSDTMVE

SEQ ID NO: 208625 - protein, 9 aa, Homo Sapiens
GLPLSVPPI

SEQ ID NO: 208626 - protein, 9 aa, Homo Sapiens
AEIDQINKV

SEQ ID NO: 208627 - protein, 9 aa, Homo Sapiens
CTSLSARYL

SEQ ID NO: 208628 - protein, 9 aa, Homo Sapiens
PDADTLLIL

SEQ ID NO: 208629 - protein, 9 aa, Homo Sapiens
NVVSLAFFF

SEQ ID NO: 208630 - protein, 9 aa, Homo Sapiens
RASNTMMNN

SEQ ID NO: 208631 - protein, 9 aa, Homo Sapiens
RKSLLAFIV

SEQ ID NO: 208632 - protein, 9 aa, Homo Sapiens
LEEDRAGSH

SEQ ID NO: 208633 - protein, 9 aa, Homo Sapiens
PQRMLFCTL

SEQ ID NO: 208634 - protein, 9 aa, Homo Sapiens
EFTEDQTAP

SEQ ID NO: 208635 - protein, 9 aa, Homo Sapiens
VTILKQVVV

SEQ ID NO: 208636 - protein, 9 aa, Homo Sapiens
LPEFTEDQT

SEQ ID NO: 208637 - protein, 9 aa, Homo Sapiens
RRSSATINR

SEQ ID NO: 208638 - protein, 9 aa, Homo Sapiens
YSESLYHQA

SEQ ID NO: 208639 - protein, 9 aa, Homo Sapiens
FHNISNRFS

SEQ ID NO: 208640 - protein, 9 aa, Homo Sapiens
HTHHQSELL

SEQ ID NO: 208641 - protein, 9 aa, Homo Sapiens
EPGTECFHF

SEQ ID NO: 208642 - protein, 9 aa, Homo Sapiens
GYPATLRKQ

SEQ ID NO: 208643 - protein, 9 aa, Homo Sapiens
PHKFITQDL

SEQ ID NO: 208644 - protein, 9 aa, Homo Sapiens
EEIREFSKA

SEQ ID NO: 208645 - protein, 9 aa, Homo Sapiens
GNNCDLPSR

SEQ ID NO: 208646 - protein, 9 aa, Homo Sapiens
VWTPVSKRW

SEQ ID NO: 208647 - protein, 9 aa, Homo Sapiens
LKLAGWQCP

SEQ ID NO: 208648 - protein, 9 aa, Homo Sapiens
CPSSDTWED

SEQ ID NO: 208649 - protein, 9 aa, Homo Sapiens
GLIPRRKKI

SEQ ID NO: 208650 - protein, 9 aa, Homo Sapiens
TPQDITLMD

SEQ ID NO: 208651 - protein, 9 aa, Homo Sapiens
SNRFSYADH

SEQ ID NO: 208652 - protein, 9 aa, Homo Sapiens
ATEIKEKKI

SEQ ID NO: 208653 - protein, 9 aa, Homo Sapiens
EIREFSKAF

SEQ ID NO: 208654 - protein, 9 aa, Homo Sapiens
VSCSRGSGG

SEQ ID NO: 208655 - protein, 9 aa, Homo Sapiens
SEIDHKRRS

SEQ ID NO: 208656 - protein, 9 aa, Homo Sapiens
FLTLVHHLA

SEQ ID NO: 208657 - protein, 9 aa, Homo Sapiens
DMAGFAPFC

SEQ ID NO: 208658 - protein, 9 aa, Homo Sapiens
PAQRPMYHP

SEQ ID NO: 208659 - protein, 9 aa, Homo Sapiens
SCSQPKVYI

SEQ ID NO: 208660 - protein, 9 aa, Homo Sapiens
EDQTAPDDK

SEQ ID NO: 208661 - protein, 9 aa, Homo Sapiens
KRLTVQTEF

SEQ ID NO: 208662 - protein, 9 aa, Homo Sapiens
RSPSGERQS

SEQ ID NO: 208663 - protein, 9 aa, Homo Sapiens
SPCVAGIIP

SEQ ID NO: 208664 - protein, 9 aa, Homo Sapiens
QQEAKQLQK

SEQ ID NO: 208665 - protein, 9 aa, Homo Sapiens
WCDSGGSAT

SEQ ID NO: 208666 - protein, 9 aa, Homo Sapiens
ERQSLLSGE

SEQ ID NO: 208667 - protein, 9 aa, Homo Sapiens
GEPHVFRPR

SEQ ID NO: 208668 - protein, 9 aa, Homo Sapiens
FPAPQAIVA

SEQ ID NO: 208669 - protein, 9 aa, Homo Sapiens
LFPAPQAIV

SEQ ID NO: 208670 - protein, 9 aa, Homo Sapiens
ILILGVIYR

SEQ ID NO: 208671 - protein, 9 aa, Homo Sapiens
SDIDFAMDE

SEQ ID NO: 208672 - protein, 9 aa, Homo Sapiens
GEEREKRRR

SEQ ID NO: 208673 - protein, 9 aa, Homo Sapiens
IFEDIPMLE

SEQ ID NO: 208674 - protein, 9 aa, Homo Sapiens
NNCDLPSRT

SEQ ID NO: 208675 - protein, 9 aa, Homo Sapiens
GARFTLVRE

SEQ ID NO: 208676 - protein, 9 aa, Homo Sapiens
PPGPGLPLS

SEQ ID NO: 208677 - protein, 9 aa, Homo Sapiens
SEYCSCISS

SEQ ID NO: 208678 - protein, 9 aa, Homo Sapiens
EMPLVFGKD

SEQ ID NO: 208679 - protein, 9 aa, Homo Sapiens
MDESGLWVI

SEQ ID NO: 208680 - protein, 9 aa, Homo Sapiens
AKTKSCTSL

SEQ ID NO: 208681 - protein, 9 aa, Homo Sapiens
RLWRGRQTP

SEQ ID NO: 208682 - protein, 9 aa, Homo Sapiens
WEQALSSCS

SEQ ID NO: 208683 - protein, 9 aa, Homo Sapiens
HRLNFAVEQ

SEQ ID NO: 208684 - protein, 9 aa, Homo Sapiens
DFKGTFAQL

SEQ ID NO: 208685 - protein, 9 aa, Homo Sapiens
PMLEDLAET

SEQ ID NO: 208686 - protein, 9 aa, Homo Sapiens
SPKVSDTMV

SEQ ID NO: 208687 - protein, 9 aa, Homo Sapiens
LATEIKEKK

SEQ ID NO: 208688 - protein, 9 aa, Homo Sapiens
SFMDICYTT

SEQ ID NO: 208689 - protein, 9 aa, Homo Sapiens
DLLRLHRRF

SEQ ID NO: 208690 - protein, 9 aa, Homo Sapiens
PQEESQLKS

SEQ ID NO: 208691 - protein, 9 aa, Homo Sapiens
IREFSKAFK

SEQ ID NO: 208692 - protein, 9 aa, Homo Sapiens
PRPPGPGLP

SEQ ID NO: 208693 - protein, 9 aa, Homo Sapiens
LLRLHRRFM

SEQ ID NO: 208694 - protein, 9 aa, Homo Sapiens
RLHRRFMRD

SEQ ID NO: 208695 - protein, 9 aa, Homo Sapiens
NYSESLYHQ

SEQ ID NO: 208696 - protein, 9 aa, Homo Sapiens
EDNLLTGEQ

SEQ ID NO: 208697 - protein, 9 aa, Homo Sapiens
KVSDTMVEP

SEQ ID NO: 208698 - protein, 9 aa, Homo Sapiens
APQAIVARS

SEQ ID NO: 208699 - protein, 9 aa, Homo Sapiens
EKVYITTQG

SEQ ID NO: 208700 - protein, 9 aa, Homo Sapiens
LWGPFHPAD

SEQ ID NO: 208701 - protein, 9 aa, Homo Sapiens
KKEMPLVFG

SEQ ID NO: 208702 - protein, 9 aa, Homo Sapiens
VQTEFMELL

SEQ ID NO: 208703 - protein, 9 aa, Homo Sapiens
VGTHLDVSY

SEQ ID NO: 208704 - protein, 9 aa, Homo Sapiens
MPGSPTLPA

SEQ ID NO: 208705 - protein, 9 aa, Homo Sapiens
VFSSCQEWS

SEQ ID NO: 208706 - protein, 9 aa, Homo Sapiens
FFLGNLSFM

SEQ ID NO: 208707 - protein, 9 aa, Homo Sapiens
LGTTRLHTA

SEQ ID NO: 208708 - protein, 9 aa, Homo Sapiens
QALSSCSGF

SEQ ID NO: 208709 - protein, 9 aa, Homo Sapiens
GHHCEVHQM

SEQ ID NO: 208710 - protein, 9 aa, Homo Sapiens
QEESQLKSK

SEQ ID NO: 208711 - protein, 9 aa, Homo Sapiens
FGAVPRYPL

SEQ ID NO: 208712 - protein, 9 aa, Homo Sapiens
LCLISLNMN

SEQ ID NO: 208713 - protein, 9 aa, Homo Sapiens
EGEPQEESQ

SEQ ID NO: 208714 - protein, 9 aa, Homo Sapiens
VCAHELCCE

SEQ ID NO: 208715 - protein, 9 aa, Homo Sapiens
MEELQPLKV

SEQ ID NO: 208716 - protein, 9 aa, Homo Sapiens
FAMDESGLW

SEQ ID NO: 208717 - protein, 9 aa, Homo Sapiens
EAYNPQRML

SEQ ID NO: 208718 - protein, 9 aa, Homo Sapiens
PKVIAQHVR

SEQ ID NO: 208719 - protein, 9 aa, Homo Sapiens
QSELLRGPE

SEQ ID NO: 208720 - protein, 9 aa, Homo Sapiens
KLQLAFLAY

SEQ ID NO: 208721 - protein, 9 aa, Homo Sapiens
ELCCEDCQL

SEQ ID NO: 208722 - protein, 9 aa, Homo Sapiens
ILGVIYRSL

SEQ ID NO: 208723 - protein, 9 aa, Homo Sapiens
PHVFRPRDR

SEQ ID NO: 208724 - protein, 9 aa, Homo Sapiens
LFGAVPRYP

SEQ ID NO: 208725 - protein, 9 aa, Homo Sapiens
MTGHHCEVH

SEQ ID NO: 208726 - protein, 9 aa, Homo Sapiens
IDTIYQTID

SEQ ID NO: 208727 - protein, 9 aa, Homo Sapiens
YSDHLENIS

SEQ ID NO: 208728 - protein, 9 aa, Homo Sapiens
GHRIILPSD

SEQ ID NO: 208729 - protein, 9 aa, Homo Sapiens
FSSCQEWSR

SEQ ID NO: 208730 - protein, 9 aa, Homo Sapiens
PLRFLTLVH

SEQ ID NO: 208731 - protein, 9 aa, Homo Sapiens
CISSSRKLI

SEQ ID NO: 208732 - protein, 9 aa, Homo Sapiens
MLPDVNDRI

SEQ ID NO: 208733 - protein, 9 aa, Homo Sapiens
KRWCDSGGS

SEQ ID NO: 208734 - protein, 9 aa, Homo Sapiens
VVSLAFFFN

SEQ ID NO: 208735 - protein, 9 aa, Homo Sapiens
VFLMALSEN

SEQ ID NO: 208736 - protein, 9 aa, Homo Sapiens
TPVTRSSTA

SEQ ID NO: 208737 - protein, 9 aa, Homo Sapiens
SGVNAVMYY

SEQ ID NO: 208738 - protein, 9 aa, Homo Sapiens
DTMVEPYNA

SEQ ID NO: 208739 - protein, 9 aa, Homo Sapiens
AGFAPFCQP

SEQ ID NO: 208740 - protein, 9 aa, Homo Sapiens
FAVEQVNKR

SEQ ID NO: 208741 - protein, 9 aa, Homo Sapiens
FTEDQTAPD

SEQ ID NO: 208742 - protein, 9 aa, Homo Sapiens
CAIIIPCNY

SEQ ID NO: 208743 - protein, 9 aa, Homo Sapiens
SGERQSLLS

SEQ ID NO: 208744 - protein, 9 aa, Homo Sapiens
LSENAVLIL

SEQ ID NO: 208745 - protein, 9 aa, Homo Sapiens
PQDITLMDA

SEQ ID NO: 208746 - protein, 9 aa, Homo Sapiens
NRFSYADHS

SEQ ID NO: 208747 - protein, 9 aa, Homo Sapiens
GKAEIDQIN

SEQ ID NO: 208748 - protein, 9 aa, Homo Sapiens
YYASQHSPF

SEQ ID NO: 208749 - protein, 9 aa, Homo Sapiens
AKQLQKDCI

SEQ ID NO: 208750 - protein, 9 aa, Homo Sapiens
YLSEINVVS

SEQ ID NO: 208751 - protein, 9 aa, Homo Sapiens
NDRIEQFSQ

SEQ ID NO: 208752 - protein, 9 aa, Homo Sapiens
LLILPRKVL

SEQ ID NO: 208753 - protein, 9 aa, Homo Sapiens
QLLGEEREK

SEQ ID NO: 208754 - protein, 9 aa, Homo Sapiens
CMKRKNEAP

SEQ ID NO: 208755 - protein, 9 aa, Homo Sapiens
CLISLNMNF

SEQ ID NO: 208756 - protein, 9 aa, Homo Sapiens
PKDPSALSK

SEQ ID NO: 208757 - protein, 9 aa, Homo Sapiens
NRFISLSYT

SEQ ID NO: 208758 - protein, 9 aa, Homo Sapiens
KKIEGLKET

SEQ ID NO: 208759 - protein, 9 aa, Homo Sapiens
MALYSGLKP

SEQ ID NO: 208760 - protein, 9 aa, Homo Sapiens
LKSLSLCPC

SEQ ID NO: 208761 - protein, 9 aa, Homo Sapiens
RTLRGHLTK

SEQ ID NO: 208762 - protein, 9 aa, Homo Sapiens
TSASNTTRI

SEQ ID NO: 208763 - protein, 9 aa, Homo Sapiens
ARFTLVRED

SEQ ID NO: 208764 - protein, 9 aa, Homo Sapiens
VNDRIEQFS

SEQ ID NO: 208765 - protein, 9 aa, Homo Sapiens
DVPDLFGAV

SEQ ID NO: 208766 - protein, 9 aa, Homo Sapiens
RVKGVLAKP

SEQ ID NO: 208767 - protein, 9 aa, Homo Sapiens
LVGSPQDKV

SEQ ID NO: 208768 - protein, 9 aa, Homo Sapiens
RCCISATPY

SEQ ID NO: 208769 - protein, 9 aa, Homo Sapiens
GTPVTRSST

SEQ ID NO: 208770 - protein, 9 aa, Homo Sapiens
LKDGHRIIL

SEQ ID NO: 208771 - protein, 9 aa, Homo Sapiens
EKPKDPSAL

SEQ ID NO: 208772 - protein, 9 aa, Homo Sapiens
DGCHGKLGL

SEQ ID NO: 208773 - protein, 9 aa, Homo Sapiens
IAQHVRSMD

SEQ ID NO: 208774 - protein, 9 aa, Homo Sapiens
AHELCCEDC

SEQ ID NO: 208775 - protein, 9 aa, Homo Sapiens
SPYPGLCLI

SEQ ID NO: 208776 - protein, 9 aa, Homo Sapiens
IDFAMDESG

SEQ ID NO: 208777 - protein, 9 aa, Homo Sapiens
VPDLFGAVP

SEQ ID NO: 208778 - protein, 9 aa, Homo Sapiens
TKIYAMHWG

SEQ ID NO: 208779 - protein, 9 aa, Homo Sapiens
RDPLSKITE

SEQ ID NO: 208780 - protein, 9 aa, Homo Sapiens
VKREEEECM

SEQ ID NO: 208781 - protein, 9 aa, Homo Sapiens
TRLHTAHST

SEQ ID NO: 208782 - protein, 9 aa, Homo Sapiens
TEIKEKKIE

SEQ ID NO: 208783 - protein, 9 aa, Homo Sapiens
LSLCPCHIS

SEQ ID NO: 208784 - protein, 9 aa, Homo Sapiens
KEKQQEAKQ

SEQ ID NO: 208785 - protein, 9 aa, Homo Sapiens
AQHVRSMDC

SEQ ID NO: 208786 - protein, 9 aa, Homo Sapiens
SSATINRIT

SEQ ID NO: 208787 - protein, 9 aa, Homo Sapiens
YHPHRRHLW

SEQ ID NO: 208788 - protein, 9 aa, Homo Sapiens
PLFPGKAEI

SEQ ID NO: 208789 - protein, 9 aa, Homo Sapiens
LMPGSPTLP

SEQ ID NO: 208790 - protein, 9 aa, Homo Sapiens
EEECMKRKN

SEQ ID NO: 208791 - protein, 9 aa, Homo Sapiens
KYSDHLENI

SEQ ID NO: 208792 - protein, 9 aa, Homo Sapiens
MYYAETIFE

SEQ ID NO: 208793 - protein, 9 aa, Homo Sapiens
LLAFIVFLF

SEQ ID NO: 208794 - protein, 9 aa, Homo Sapiens
MYHPHRRHL

SEQ ID NO: 208795 - protein, 9 aa, Homo Sapiens
EGIMALYSG

SEQ ID NO: 208796 - protein, 9 aa, Homo Sapiens
IKEKKIEGL

SEQ ID NO: 208797 - protein, 9 aa, Homo Sapiens
RFTLVREDR

SEQ ID NO: 208798 - protein, 9 aa, Homo Sapiens
EIKEKKIEG

SEQ ID NO: 208799 - protein, 9 aa, Homo Sapiens
PYPGLCLIS

SEQ ID NO: 208800 - protein, 9 aa, Homo Sapiens
SSGTLMPGS

SEQ ID NO: 208801 - protein, 9 aa, Homo Sapiens
GIMALYSGL

SEQ ID NO: 208802 - protein, 9 aa, Homo Sapiens
HLIYGEPHK

SEQ ID NO: 208803 - protein, 9 aa, Homo Sapiens
FEDNLLTGE

SEQ ID NO: 208804 - protein, 9 aa, Homo Sapiens
KSCTSLSAR

SEQ ID NO: 208805 - protein, 9 aa, Homo Sapiens
HELCCEDCQ

SEQ ID NO: 208806 - protein, 9 aa, Homo Sapiens
FLMALSENA

SEQ ID NO: 208807 - protein, 9 aa, Homo Sapiens
LMTGHHCEV

SEQ ID NO: 208808 - protein, 9 aa, Homo Sapiens
DFAMDESGL

SEQ ID NO: 208809 - protein, 9 aa, Homo Sapiens
PSVGYPATL

SEQ ID NO: 208810 - protein, 9 aa, Homo Sapiens
SISVSCSRG

SEQ ID NO: 208811 - protein, 9 aa, Homo Sapiens
LKKEMPLVF

SEQ ID NO: 208812 - protein, 9 aa, Homo Sapiens
LDDFKGTFA

SEQ ID NO: 208813 - protein, 9 aa, Homo Sapiens
LKQVVVGKL

SEQ ID NO: 208814 - protein, 9 aa, Homo Sapiens
PCNYPLMML

SEQ ID NO: 208815 - protein, 9 aa, Homo Sapiens
GEEKVYITT

SEQ ID NO: 208816 - protein, 9 aa, Homo Sapiens
QGAGQLRQS

SEQ ID NO: 208817 - protein, 9 aa, Homo Sapiens
CCISATPYR

SEQ ID NO: 208818 - protein, 9 aa, Homo Sapiens
EPHVFRPRD

SEQ ID NO: 208819 - protein, 9 aa, Homo Sapiens
RMLFCTLLI

SEQ ID NO: 208820 - protein, 9 aa, Homo Sapiens
SALWPKRRG

SEQ ID NO: 208821 - protein, 9 aa, Homo Sapiens
DTTPEKPKD

SEQ ID NO: 208822 - protein, 9 aa, Homo Sapiens
TSQNRFISL

SEQ ID NO: 208823 - protein, 9 aa, Homo Sapiens
HKRRSSATI

SEQ ID NO: 208824 - protein, 9 aa, Homo Sapiens
SDTWEDLFC

SEQ ID NO: 208825 - protein, 9 aa, Homo Sapiens
TPLKLAGWQ

SEQ ID NO: 208826 - protein, 9 aa, Homo Sapiens
RKVLQMDFL

SEQ ID NO: 208827 - protein, 9 aa, Homo Sapiens
DAVCAHELC

SEQ ID NO: 208828 - protein, 9 aa, Homo Sapiens
TPEKPKDPS

SEQ ID NO: 208829 - protein, 9 aa, Homo Sapiens
EIDHKRRSS

SEQ ID NO: 208830 - protein, 9 aa, Homo Sapiens
PNTDELMSC

SEQ ID NO: 208831 - protein, 9 aa, Homo Sapiens
RLNFAVEQV

SEQ ID NO: 208832 - protein, 9 aa, Homo Sapiens
TAPDDKNKT

SEQ ID NO: 208833 - protein, 9 aa, Homo Sapiens
TSEYCSCIS

SEQ ID NO: 208834 - protein, 9 aa, Homo Sapiens
SKAFKIRRL

SEQ ID NO: 208835 - protein, 9 aa, Homo Sapiens
RSPCVAGII

SEQ ID NO: 208836 - protein, 9 aa, Homo Sapiens
DRVKGVLAK

SEQ ID NO: 208837 - protein, 9 aa, Homo Sapiens
TLLILPRKV

SEQ ID NO: 208838 - protein, 9 aa, Homo Sapiens
DHLENISKL

SEQ ID NO: 208839 - protein, 9 aa, Homo Sapiens
DITLMDAHK

SEQ ID NO: 208840 - protein, 9 aa, Homo Sapiens
HHTHHQSEL

SEQ ID NO: 208841 - protein, 9 aa, Homo Sapiens
EEEECMKRK

SEQ ID NO: 208842 - protein, 9 aa, Homo Sapiens
EFSKAFKIR

SEQ ID NO: 208843 - protein, 9 aa, Homo Sapiens
PRLRASNTM

SEQ ID NO: 208844 - protein, 9 aa, Homo Sapiens
PCVAGIIPV

SEQ ID NO: 208845 - protein, 9 aa, Homo Sapiens
GEPQEESQL

SEQ ID NO: 208846 - protein, 9 aa, Homo Sapiens
CHGKLGLGL

SEQ ID NO: 208847 - protein, 9 aa, Homo Sapiens
LPRKVLQMD

SEQ ID NO: 208848 - protein, 9 aa, Homo Sapiens
QAIVARSGE

SEQ ID NO: 208849 - protein, 9 aa, Homo Sapiens
CVAGIIPVI

SEQ ID NO: 208850 - protein, 9 aa, Homo Sapiens
SVSCSRGSG

SEQ ID NO: 208851 - protein, 9 aa, Homo Sapiens
PLVFGKDNK

SEQ ID NO: 208852 - protein, 9 aa, Homo Sapiens
TEFMELLEP

SEQ ID NO: 208853 - protein, 9 aa, Homo Sapiens
VYITTQGPI

SEQ ID NO: 208854 - protein, 9 aa, Homo Sapiens
SCTSLSARY

SEQ ID NO: 208855 - protein, 9 aa, Homo Sapiens
RAVLGLRLA

SEQ ID NO: 208856 - protein, 9 aa, Homo Sapiens
GAVPRYPLM

SEQ ID NO: 208857 - protein, 9 aa, Homo Sapiens
LYHQAMEEA

SEQ ID NO: 208858 - protein, 9 aa, Homo Sapiens
VGKLPVEFN

SEQ ID NO: 208859 - protein, 9 aa, Homo Sapiens
PGLCLISLN

SEQ ID NO: 208860 - protein, 9 aa, Homo Sapiens
PCHISDDGI

SEQ ID NO: 208861 - protein, 9 aa, Homo Sapiens
LVGNNCDLP

SEQ ID NO: 208862 - protein, 9 aa, Homo Sapiens
IRCVYPTRV

SEQ ID NO: 208863 - protein, 9 aa, Homo Sapiens
NLLTGEQLG

SEQ ID NO: 208864 - protein, 9 aa, Homo Sapiens
TRDPLSKIT

SEQ ID NO: 208865 - protein, 9 aa, Homo Sapiens
DADTLLILP

SEQ ID NO: 208866 - protein, 9 aa, Homo Sapiens
LRASNTMMN

SEQ ID NO: 208867 - protein, 9 aa, Homo Sapiens
PSSDTWEDL

SEQ ID NO: 208868 - protein, 9 aa, Homo Sapiens
TWEDLFCYW

SEQ ID NO: 208869 - protein, 9 aa, Homo Sapiens
TSLSARYLI

SEQ ID NO: 208870 - protein, 9 aa, Homo Sapiens
AFIVFLFFA

SEQ ID NO: 208871 - protein, 9 aa, Homo Sapiens
GHLTKIYAM

SEQ ID NO: 208872 - protein, 9 aa, Homo Sapiens
GPRLRASNT

SEQ ID NO: 208873 - protein, 9 aa, Homo Sapiens
TLVHHLART

SEQ ID NO: 208874 - protein, 9 aa, Homo Sapiens
NVITVFSSC

SEQ ID NO: 208875 - protein, 9 aa, Homo Sapiens
LVHHLARTE

SEQ ID NO: 208876 - protein, 9 aa, Homo Sapiens
EAKQLQKDC

SEQ ID NO: 208877 - protein, 9 aa, Homo Sapiens
LSEINVVSL

SEQ ID NO: 208878 - protein, 9 aa, Homo Sapiens
DPGCKWMDS

SEQ ID NO: 208879 - protein, 9 aa, Homo Sapiens
YTLMTGHHC

SEQ ID NO: 208880 - protein, 9 aa, Homo Sapiens
MVEPYNATL

SEQ ID NO: 208881 - protein, 9 aa, Homo Sapiens
DGHRIILPS

SEQ ID NO: 208882 - protein, 9 aa, Homo Sapiens
AKKEPGTEC

SEQ ID NO: 208883 - protein, 9 aa, Homo Sapiens
QYYASQHSP

SEQ ID NO: 208884 - protein, 9 aa, Homo Sapiens
KQVVVGKLP

SEQ ID NO: 208885 - protein, 9 aa, Homo Sapiens
TILKQVVVG

SEQ ID NO: 208886 - protein, 9 aa, Homo Sapiens
SATPYRGVS

SEQ ID NO: 208887 - protein, 9 aa, Homo Sapiens
LENISKLVE

SEQ ID NO: 208888 - protein, 9 aa, Homo Sapiens
EDPGCKWMD

SEQ ID NO: 208889 - protein, 9 aa, Homo Sapiens
LLRGPEIAL

SEQ ID NO: 208890 - protein, 9 aa, Homo Sapiens
YPGLCLISL

SEQ ID NO: 208891 - protein, 9 aa, Homo Sapiens
ESLYHQAME

SEQ ID NO: 208892 - protein, 9 aa, Homo Sapiens
HHQSELLRG

SEQ ID NO: 208893 - protein, 9 aa, Homo Sapiens
GRTDLLRLH

SEQ ID NO: 208894 - protein, 9 aa, Homo Sapiens
GTECFHFSL

SEQ ID NO: 208895 - protein, 9 aa, Homo Sapiens
LGLRLALLL

SEQ ID NO: 208896 - protein, 9 aa, Homo Sapiens
TGEQLGNVA

SEQ ID NO: 208897 - protein, 9 aa, Homo Sapiens
ERSPCVAGI

SEQ ID NO: 208898 - protein, 9 aa, Homo Sapiens
KSLSLCPCH

SEQ ID NO: 208899 - protein, 9 aa, Homo Sapiens
LAKTKSCTS

SEQ ID NO: 208900 - protein, 9 aa, Homo Sapiens
PADPQPPAL

SEQ ID NO: 208901 - protein, 9 aa, Homo Sapiens
LTKIYAMHW

SEQ ID NO: 208902 - protein, 9 aa, Homo Sapiens
TLRGHLTKI

SEQ ID NO: 208903 - protein, 9 aa, Homo Sapiens
VNAVMYYAE

SEQ ID NO: 208904 - protein, 9 aa, Homo Sapiens
SSCQEWSRF

SEQ ID NO: 208905 - protein, 9 aa, Homo Sapiens
ILPRKVLQM

SEQ ID NO: 208906 - protein, 9 aa, Homo Sapiens
PDVNDRIEQ

SEQ ID NO: 208907 - protein, 9 aa, Homo Sapiens
PPALGTTRL

SEQ ID NO: 208908 - protein, 9 aa, Homo Sapiens
IIPCNYPLM

SEQ ID NO: 208909 - protein, 9 aa, Homo Sapiens
PMYHPHRRH

SEQ ID NO: 208910 - protein, 9 aa, Homo Sapiens
QSIDAQDRV

SEQ ID NO: 208911 - protein, 9 aa, Homo Sapiens
SFLLYLPPE

SEQ ID NO: 208912 - protein, 9 aa, Homo Sapiens
IDHKRRSSA

SEQ ID NO: 208913 - protein, 9 aa, Homo Sapiens
TPYRGVSCY

SEQ ID NO: 208914 - protein, 9 aa, Homo Sapiens
IAKNRGLIP

SEQ ID NO: 208915 - protein, 9 aa, Homo Sapiens
DTWEDLFCY

SEQ ID NO: 208916 - protein, 9 aa, Homo Sapiens
GVCAIIIPC

SEQ ID NO: 208917 - protein, 9 aa, Homo Sapiens
NCNNTDFTH

SEQ ID NO: 208918 - protein, 9 aa, Homo Sapiens
KKEPGTECF

SEQ ID NO: 208919 - protein, 9 aa, Homo Sapiens
DDFKGTFAQ

SEQ ID NO: 208920 - protein, 9 aa, Homo Sapiens
RFISLSYTV

SEQ ID NO: 208921 - protein, 9 aa, Homo Sapiens
EPQEESQLK

SEQ ID NO: 208922 - protein, 9 aa, Homo Sapiens
RRTLRGHLT

SEQ ID NO: 208923 - protein, 9 aa, Homo Sapiens
YGEPHKFIT

SEQ ID NO: 208924 - protein, 9 aa, Homo Sapiens
FKGTFAQLS

SEQ ID NO: 208925 - protein, 9 aa, Homo Sapiens
NISNRFSYA

SEQ ID NO: 208926 - protein, 9 aa, Homo Sapiens
HLDVSYEKQ

SEQ ID NO: 208927 - protein, 9 aa, Homo Sapiens
QMDFLVHPA

SEQ ID NO: 208928 - protein, 9 aa, Homo Sapiens
TDLLRLHRR

SEQ ID NO: 208929 - protein, 9 aa, Homo Sapiens
ARLWRGRQT

SEQ ID NO: 208930 - protein, 9 aa, Homo Sapiens
QAQWEQALS

SEQ ID NO: 208931 - protein, 9 aa, Homo Sapiens
GEPHKFITQ

SEQ ID NO: 208932 - protein, 9 aa, Homo Sapiens
NNTDFTHFY

SEQ ID NO: 208933 - protein, 9 aa, Homo Sapiens
VLGLRLALL

SEQ ID NO: 208934 - protein, 9 aa, Homo Sapiens
EILILGVIY

SEQ ID NO: 208935 - protein, 9 aa, Homo Sapiens
LPLSVPPIL

SEQ ID NO: 208936 - protein, 9 aa, Homo Sapiens
HNISNRFSY

SEQ ID NO: 208937 - protein, 9 aa, Homo Sapiens
NFAVEQVNK

SEQ ID NO: 208938 - protein, 9 aa, Homo Sapiens
HHCEVHQMI

SEQ ID NO: 208939 - protein, 9 aa, Homo Sapiens
HSPFPSGSL

SEQ ID NO: 208940 - protein, 9 aa, Homo Sapiens
PAPQAIVAR

SEQ ID NO: 208941 - protein, 9 aa, Homo Sapiens
VCAIIIPCN

SEQ ID NO: 208942 - protein, 9 aa, Homo Sapiens
AVCAHELCC

SEQ ID NO: 208943 - protein, 9 aa, Homo Sapiens
YASQHSPFP

SEQ ID NO: 208944 - protein, 9 aa, Homo Sapiens
LMALSENAV

SEQ ID NO: 208945 - protein, 9 aa, Homo Sapiens
KSLLAFIVF

SEQ ID NO: 208946 - protein, 9 aa, Homo Sapiens
PGCKWMDSL

SEQ ID NO: 208947 - protein, 9 aa, Homo Sapiens
LRLHRRFMR

SEQ ID NO: 208948 - protein, 9 aa, Homo Sapiens
AIDTIYQTI

SEQ ID NO: 208949 - protein, 9 aa, Homo Sapiens
VTPLKLAGW

SEQ ID NO: 208950 - protein, 9 aa, Homo Sapiens
EFMELLEPL

SEQ ID NO: 208951 - protein, 9 aa, Homo Sapiens
ADPQPPALG

SEQ ID NO: 208952 - protein, 9 aa, Homo Sapiens
KEKKIEGLK

SEQ ID NO: 208953 - protein, 9 aa, Homo Sapiens
NYYTLMTGH

SEQ ID NO: 208954 - protein, 9 aa, Homo Sapiens
NRGLIPRRK

SEQ ID NO: 208955 - protein, 9 aa, Homo Sapiens
SSCSGFFFY

SEQ ID NO: 208956 - protein, 9 aa, Homo Sapiens
IYGEPHKFI

SEQ ID NO: 208957 - protein, 9 aa, Homo Sapiens
EEDRAGSHP

SEQ ID NO: 208958 - protein, 9 aa, Homo Sapiens
GNLFPAPQA

SEQ ID NO: 208959 - protein, 9 aa, Homo Sapiens
PMVLVGNNC

SEQ ID NO: 208960 - protein, 9 aa, Homo Sapiens
IDFSGIRNI

SEQ ID NO: 208961 - protein, 9 aa, Homo Sapiens
SQNRFISLS

SEQ ID NO: 208962 - protein, 9 aa, Homo Sapiens
TEDQTAPDD

SEQ ID NO: 208963 - protein, 9 aa, Homo Sapiens
NISKLVESG

SEQ ID NO: 208964 - protein, 9 aa, Homo Sapiens
GPRAVLGLR

SEQ ID NO: 208965 - protein, 9 aa, Homo Sapiens
VVGKLPVEF

SEQ ID NO: 208966 - protein, 9 aa, Homo Sapiens
ISTRDPLSK

SEQ ID NO: 208967 - protein, 9 aa, Homo Sapiens
ASALWPKRR

SEQ ID NO: 208968 - protein, 9 aa, Homo Sapiens
AVPRYPLMD

SEQ ID NO: 208969 - protein, 9 aa, Homo Sapiens
LAKPFIETV

SEQ ID NO: 208970 - protein, 9 aa, Homo Sapiens
KVIAQHVRS

SEQ ID NO: 208971 - protein, 9 aa, Homo Sapiens
VYPTRVLGN

SEQ ID NO: 208972 - protein, 9 aa, Homo Sapiens
SELLRGPEI

SEQ ID NO: 208973 - protein, 9 aa, Homo Sapiens
GTTRLHTAH

SEQ ID NO: 208974 - protein, 9 aa, Homo Sapiens
TGHHCEVHQ

SEQ ID NO: 208975 - protein, 9 aa, Homo Sapiens
MSCSQPKVY

SEQ ID NO: 208976 - protein, 9 aa, Homo Sapiens
PVSKRWCDS

SEQ ID NO: 208977 - protein, 9 aa, Homo Sapiens
NCDLPSRTV

SEQ ID NO: 208978 - protein, 9 aa, Homo Sapiens
YQIRCVYPT

SEQ ID NO: 208979 - protein, 9 aa, Homo Sapiens
CFEDNLLTG

SEQ ID NO: 208980 - protein, 9 aa, Homo Sapiens
LSSCSGFFF

SEQ ID NO: 208981 - protein, 9 aa, Homo Sapiens
PGTECFHFS

SEQ ID NO: 208982 - protein, 9 aa, Homo Sapiens
AGTVLQWLI

SEQ ID NO: 208983 - protein, 9 aa, Homo Sapiens
GLKSLSLCP

SEQ ID NO: 208984 - protein, 9 aa, Homo Sapiens
AEAYNPQRM

SEQ ID NO: 208985 - protein, 9 aa, Homo Sapiens
MLFCTLLIR

SEQ ID NO: 208986 - protein, 9 aa, Homo Sapiens
LDAISFLLY

SEQ ID NO: 208987 - protein, 9 aa, Homo Sapiens
EKQQEAKQL

SEQ ID NO: 208988 - protein, 9 aa, Homo Sapiens
LWPKRRGSP

SEQ ID NO: 208989 - protein, 9 aa, Homo Sapiens
EKKIEGLKE

SEQ ID NO: 208990 - protein, 9 aa, Homo Sapiens
HRRFMRDQE

SEQ ID NO: 208991 - protein, 9 aa, Homo Sapiens
STSQNRFIS

SEQ ID NO: 208992 - protein, 9 aa, Homo Sapiens
EEKVYITTQ

SEQ ID NO: 208993 - protein, 9 aa, Homo Sapiens
SLAFFFNLG

SEQ ID NO: 208994 - protein, 9 aa, Homo Sapiens
THLDVSYEK

SEQ ID NO: 208995 - protein, 9 aa, Homo Sapiens
QKPLFPGKA

SEQ ID NO: 208996 - protein, 9 aa, Homo Sapiens
IAVTPLKLA

SEQ ID NO: 208997 - protein, 9 aa, Homo Sapiens
IVSTPQDIT

SEQ ID NO: 208998 - protein, 9 aa, Homo Sapiens
LSKITEQEK

SEQ ID NO: 208999 - protein, 9 aa, Homo Sapiens
KQQEAKQLQ

SEQ ID NO: 209000 - protein, 9 aa, Homo Sapiens
GSPQDKVAE

SEQ ID NO: 209001 - protein, 9 aa, Homo Sapiens
ALSPYPGLC

SEQ ID NO: 209002 - protein, 9 aa, Homo Sapiens
QSLLSGEGQ

SEQ ID NO: 209003 - protein, 9 aa, Homo Sapiens
LAFIVFLFF

SEQ ID NO: 209004 - protein, 9 aa, Homo Sapiens
VSKRWCDSG

SEQ ID NO: 209005 - protein, 9 aa, Homo Sapiens
LAGWQCPEC

SEQ ID NO: 209006 - protein, 9 aa, Homo Sapiens
ILNGAGEPH

SEQ ID NO: 209007 - protein, 9 aa, Homo Sapiens
YHQAMEEAK

SEQ ID NO: 209008 - protein, 9 aa, Homo Sapiens
ELMSCSQPK

SEQ ID NO: 209009 - protein, 9 aa, Homo Sapiens
PDAVCAHEL

SEQ ID NO: 209010 - protein, 9 aa, Homo Sapiens
KKQMEELQP

SEQ ID NO: 209011 - protein, 9 aa, Homo Sapiens
EEDPGCKWM

SEQ ID NO: 209012 - protein, 9 aa, Homo Sapiens
PRAVLGLRL

SEQ ID NO: 209013 - protein, 9 aa, Homo Sapiens
IRCLDAISF

SEQ ID NO: 209014 - protein, 9 aa, Homo Sapiens
FSYADHSNK

SEQ ID NO: 209015 - protein, 9 aa, Homo Sapiens
ASNTMMNNN

SEQ ID NO: 209016 - protein, 9 aa, Homo Sapiens
TDFTHFYKL

SEQ ID NO: 209017 - protein, 9 aa, Homo Sapiens
CISATPYRG

SEQ ID NO: 209018 - protein, 9 aa, Homo Sapiens
YTFGDGCHG

SEQ ID NO: 209019 - protein, 9 aa, Homo Sapiens
GNRCCISAT

SEQ ID NO: 209020 - protein, 9 aa, Homo Sapiens
VAGIIPVIY

SEQ ID NO: 209021 - protein, 9 aa, Homo Sapiens
MALSENAVL

SEQ ID NO: 209022 - protein, 9 aa, Homo Sapiens
MVLVGNNCD

SEQ ID NO: 209023 - protein, 9 aa, Homo Sapiens
TIYQTIDFS

SEQ ID NO: 209024 - protein, 9 aa, Homo Sapiens
TMVEPYNAT

SEQ ID NO: 209025 - protein, 9 aa, Homo Sapiens
DVSYEKQRK

SEQ ID NO: 209026 - protein, 9 aa, Homo Sapiens
STSEYCSCI

SEQ ID NO: 209027 - protein, 9 aa, Homo Sapiens
HHLARTEQP

SEQ ID NO: 209028 - protein, 9 aa, Homo Sapiens
VAEATNDYE

SEQ ID NO: 209029 - protein, 9 aa, Homo Sapiens
RFSYADHSN

SEQ ID NO: 209030 - protein, 9 aa, Homo Sapiens
SEINVVSLA

SEQ ID NO: 209031 - protein, 9 aa, Homo Sapiens
HVRSMDCRV

SEQ ID NO: 209032 - protein, 9 aa, Homo Sapiens
ISVSCSRGS

SEQ ID NO: 209033 - protein, 9 aa, Homo Sapiens
AGIIPVIYY

SEQ ID NO: 209034 - protein, 9 aa, Homo Sapiens
QMGTPVTRS

SEQ ID NO: 209035 - protein, 9 aa, Homo Sapiens
KLKDGHRII

SEQ ID NO: 209036 - protein, 9 aa, Homo Sapiens
NLEEIREFS

SEQ ID NO: 209037 - protein, 9 aa, Homo Sapiens
ECFEEDPGC

SEQ ID NO: 209038 - protein, 9 aa, Homo Sapiens
NPQRMLFCT

SEQ ID NO: 209039 - protein, 9 aa, Homo Sapiens
NRCCISATP

SEQ ID NO: 209040 - protein, 9 aa, Homo Sapiens
SKITEQEKD

SEQ ID NO: 209041 - protein, 9 aa, Homo Sapiens
KEPGTECFH

SEQ ID NO: 209042 - protein, 9 aa, Homo Sapiens
SPFPSGSLM

SEQ ID NO: 209043 - protein, 9 aa, Homo Sapiens
ASQHSPFPS

SEQ ID NO: 209044 - protein, 9 aa, Homo Sapiens
LTGEQLGNV

SEQ ID NO: 209045 - protein, 9 aa, Homo Sapiens
REFSKAFKI

SEQ ID NO: 209046 - protein, 9 aa, Homo Sapiens
FSKAFKIRR

SEQ ID NO: 209047 - protein, 9 aa, Homo Sapiens
FLLYLPPEQ

SEQ ID NO: 209048 - protein, 9 aa, Homo Sapiens
AKNRGLIPR

SEQ ID NO: 209049 - protein, 9 aa, Homo Sapiens
LSAYQIRCV

SEQ ID NO: 209050 - protein, 9 aa, Homo Sapiens
CAHELCCED

SEQ ID NO: 209051 - protein, 9 aa, Homo Sapiens
MAGFAPFCQ

SEQ ID NO: 209052 - protein, 9 aa, Homo Sapiens
MDICYTTTS

SEQ ID NO: 209053 - protein, 9 aa, Homo Sapiens
SPSGERQSL

SEQ ID NO: 209054 - protein, 9 aa, Homo Sapiens
SSISVSCSR

SEQ ID NO: 209055 - protein, 9 aa, Homo Sapiens
PQAIVARSG

SEQ ID NO: 209056 - protein, 9 aa, Homo Sapiens
SLLAFIVFL

SEQ ID NO: 209057 - protein, 9 aa, Homo Sapiens
VVKNEGIMA

SEQ ID NO: 209058 - protein, 9 aa, Homo Sapiens
YITTQGPIV

SEQ ID NO: 209059 - protein, 9 aa, Homo Sapiens
AQRPMYHPH

SEQ ID NO: 209060 - protein, 9 aa, Homo Sapiens
LGEEREKRR

SEQ ID NO: 209061 - protein, 9 aa, Homo Sapiens
ISNRFSYAD

SEQ ID NO: 209062 - protein, 9 aa, Homo Sapiens
IIIPCNYPL

SEQ ID NO: 209063 - protein, 9 aa, Homo Sapiens
ALSSCSGFF

SEQ ID NO: 209064 - protein, 9 aa, Homo Sapiens
HLTKIYAMH

SEQ ID NO: 209065 - protein, 9 aa, Homo Sapiens
PEFTEDQTA

SEQ ID NO: 209066 - protein, 9 aa, Homo Sapiens
EESQLKSKS

SEQ ID NO: 209067 - protein, 9 aa, Homo Sapiens
VIYRSLSFE

SEQ ID NO: 209068 - protein, 9 aa, Homo Sapiens
WLIQEQLRY

SEQ ID NO: 209069 - protein, 9 aa, Homo Sapiens
LQLAFLAYA

SEQ ID NO: 209070 - protein, 9 aa, Homo Sapiens
RRSPSGERQ

SEQ ID NO: 209071 - protein, 9 aa, Homo Sapiens
DELMSCSQP

SEQ ID NO: 209072 - protein, 9 aa, Homo Sapiens
RLLSSGTLM

SEQ ID NO: 209073 - protein, 9 aa, Homo Sapiens
LPDVNDRIE

SEQ ID NO: 209074 - protein, 9 aa, Homo Sapiens
VLAKPFIET

SEQ ID NO: 209075 - protein, 9 aa, Homo Sapiens
TFGDGCHGK

SEQ ID NO: 209076 - protein, 9 aa, Homo Sapiens
AGEPHVFRP

SEQ ID NO: 209077 - protein, 9 aa, Homo Sapiens
ITLMDAHKG

SEQ ID NO: 209078 - protein, 9 aa, Homo Sapiens
VVFLMALSE

SEQ ID NO: 209079 - protein, 9 aa, Homo Sapiens
RTDLLRLHR

SEQ ID NO: 209080 - protein, 9 aa, Homo Sapiens
SNTMMNNND

SEQ ID NO: 209081 - protein, 9 aa, Homo Sapiens
CVYPTRVLG

SEQ ID NO: 209082 - protein, 9 aa, Homo Sapiens
NTMMNNNDL

SEQ ID NO: 209083 - protein, 9 aa, Homo Sapiens
FTLVREDRG

SEQ ID NO: 209084 - protein, 9 aa, Homo Sapiens
EHLIYGEPH

SEQ ID NO: 209085 - protein, 9 aa, Homo Sapiens
LPRPPGPGL

SEQ ID NO: 209086 - protein, 9 aa, Homo Sapiens
FHPADPQPP

SEQ ID NO: 209087 - protein, 9 aa, Homo Sapiens
AVTPLKLAG

SEQ ID NO: 209088 - protein, 9 aa, Homo Sapiens
VHHLARTEQ

SEQ ID NO: 209089 - protein, 9 aa, Homo Sapiens
TVLQWLIQE

SEQ ID NO: 209090 - protein, 9 aa, Homo Sapiens
FAPFCQPAG

SEQ ID NO: 209091 - protein, 9 aa, Homo Sapiens
GLCLISLNM

SEQ ID NO: 209092 - protein, 9 aa, Homo Sapiens
PVTRSSTAS

SEQ ID NO: 209093 - protein, 9 aa, Homo Sapiens
YSTSQNRFI

SEQ ID NO: 209094 - protein, 9 aa, Homo Sapiens
TTRLHTAHS

SEQ ID NO: 209095 - protein, 9 aa, Homo Sapiens
RAGSHPTQK

SEQ ID NO: 209096 - protein, 9 aa, Homo Sapiens
HVFRPRDRD

SEQ ID NO: 209097 - protein, 9 aa, Homo Sapiens
KNRGLIPRR

SEQ ID NO: 209098 - protein, 9 aa, Homo Sapiens
DQTAPDDKN

SEQ ID NO: 209099 - protein, 9 aa, Homo Sapiens
EPHKFITQD

SEQ ID NO: 209100 - protein, 9 aa, Homo Sapiens
KNEGIMALY

SEQ ID NO: 209101 - protein, 9 aa, Homo Sapiens
HRRHLWGPF

SEQ ID NO: 209102 - protein, 9 aa, Homo Sapiens
IIPVIYYSV

SEQ ID NO: 209103 - protein, 9 aa, Homo Sapiens
AGQLRQSID

SEQ ID NO: 209104 - protein, 9 aa, Homo Sapiens
PASALWPKR

SEQ ID NO: 209105 - protein, 9 aa, Homo Sapiens
QVVVGKLPV

SEQ ID NO: 209106 - protein, 9 aa, Homo Sapiens
LLSSGTLMP

SEQ ID NO: 209107 - protein, 9 aa, Homo Sapiens
LEGARFTLV

SEQ ID NO: 209108 - protein, 9 aa, Homo Sapiens
SYEKQRKAC

SEQ ID NO: 209109 - protein, 9 aa, Homo Sapiens
EARLWRGRQ

SEQ ID NO: 209110 - protein, 9 aa, Homo Sapiens
LRDRVKGVL

SEQ ID NO: 209111 - protein, 9 aa, Homo Sapiens
SAYQIRCVY

SEQ ID NO: 209112 - protein, 9 aa, Homo Sapiens
GTHLDVSYE

SEQ ID NO: 209113 - protein, 9 aa, Homo Sapiens
CSQPKVYIS

SEQ ID NO: 209114 - protein, 9 aa, Homo Sapiens
LGVIYRSLS

SEQ ID NO: 209115 - protein, 9 aa, Homo Sapiens
VLQWLIQEQ

SEQ ID NO: 209116 - protein, 9 aa, Homo Sapiens
GDTTPEKPK

SEQ ID NO: 209117 - protein, 9 aa, Homo Sapiens
HPTQKGDLR

SEQ ID NO: 209118 - protein, 9 aa, Homo Sapiens
QTIDFSGIR

SEQ ID NO: 209119 - protein, 9 aa, Homo Sapiens
RPPGPGLPL

SEQ ID NO: 209120 - protein, 9 aa, Homo Sapiens
ITTQGPIVS

SEQ ID NO: 209121 - protein, 9 aa, Homo Sapiens
LIPRRKKID

SEQ ID NO: 209122 - protein, 9 aa, Homo Sapiens
TLMPGSPTL

SEQ ID NO: 209123 - protein, 9 aa, Homo Sapiens
VKGVLAKPF

SEQ ID NO: 209124 - protein, 9 aa, Homo Sapiens
GHSDIDFAM

SEQ ID NO: 209125 - protein, 9 aa, Homo Sapiens
LILPRKVLQ

SEQ ID NO: 209126 - protein, 9 aa, Homo Sapiens
VGNNCDLPS

SEQ ID NO: 209127 - protein, 9 aa, Homo Sapiens
RCLDAISFL

SEQ ID NO: 209128 - protein, 9 aa, Homo Sapiens
VSLAFFFNL

SEQ ID NO: 209129 - protein, 9 aa, Homo Sapiens
GVNAVMYYA

SEQ ID NO: 209130 - protein, 9 aa, Homo Sapiens
TLAKTKSCT

SEQ ID NO: 209131 - protein, 9 aa, Homo Sapiens
TIDFSGIRN

SEQ ID NO: 209132 - protein, 9 aa, Homo Sapiens
QDKVAEATN

SEQ ID NO: 209133 - protein, 9 aa, Homo Sapiens
PKRRGSPLR

SEQ ID NO: 209134 - protein, 9 aa, Homo Sapiens
LSGVNAVMY

SEQ ID NO: 209135 - protein, 9 aa, Homo Sapiens
TDELMSCSQ

SEQ ID NO: 209136 - protein, 9 aa, Homo Sapiens
VPMVLVGNN

SEQ ID NO: 209137 - protein, 9 aa, Homo Sapiens
DVNDRIEQF

SEQ ID NO: 209138 - protein, 9 aa, Homo Sapiens
SESLYHQAM

SEQ ID NO: 209139 - protein, 9 aa, Homo Sapiens
LCPCHISDD

SEQ ID NO: 209140 - protein, 9 aa, Homo Sapiens
LMYTFGDGC

SEQ ID NO: 209141 - protein, 9 aa, Homo Sapiens
QMEELQPLK

SEQ ID NO: 209142 - protein, 9 aa, Homo Sapiens
GQMGTPVTR

SEQ ID NO: 209143 - protein, 9 aa, Homo Sapiens
AAGTVLQWL

SEQ ID NO: 209144 - protein, 9 aa, Homo Sapiens
RQSIDAQDR

SEQ ID NO: 209145 - protein, 9 aa, Homo Sapiens
VLQMDFLVH

SEQ ID NO: 209146 - protein, 9 aa, Homo Sapiens
PATLRKQRR

SEQ ID NO: 209147 - protein, 9 aa, Homo Sapiens
NGAGEPHVF

SEQ ID NO: 209148 - protein, 9 aa, Homo Sapiens
VRSMDCRVA

SEQ ID NO: 209149 - protein, 9 aa, Homo Sapiens
ILPSDFQHK

SEQ ID NO: 209150 - protein, 9 aa, Homo Sapiens
KPKDPSALS

SEQ ID NO: 209151 - protein, 9 aa, Homo Sapiens
WPKRRGSPL

SEQ ID NO: 209152 - protein, 9 aa, Homo Sapiens
AIKHLDDFK

SEQ ID NO: 209153 - protein, 9 aa, Homo Sapiens
DRMGPRAVL

SEQ ID NO: 209154 - protein, 9 aa, Homo Sapiens
DRIEQFSQE

SEQ ID NO: 209155 - protein, 9 aa, Homo Sapiens
ISATPYRGV

SEQ ID NO: 209156 - protein, 9 aa, Homo Sapiens
KHLDDFKGT

SEQ ID NO: 209157 - protein, 9 aa, Homo Sapiens
NFHNISNRF

SEQ ID NO: 209158 - protein, 9 aa, Homo Sapiens
IYRSLSFED

SEQ ID NO: 209159 - protein, 9 aa, Homo Sapiens
TVFSSCQEW

SEQ ID NO: 209160 - protein, 9 aa, Homo Sapiens
SPQDKVAEA

SEQ ID NO: 209161 - protein, 9 aa, Homo Sapiens
AVLGLRLAL

SEQ ID NO: 209162 - protein, 9 aa, Homo Sapiens
RSSTASSNS

SEQ ID NO: 209163 - protein, 9 aa, Homo Sapiens
ELLRGPEIA

SEQ ID NO: 209164 - protein, 9 aa, Homo Sapiens
KVLQMDFLV

SEQ ID NO: 209165 - protein, 9 aa, Homo Sapiens
SCQEWSRFF

SEQ ID NO: 209166 - protein, 9 aa, Homo Sapiens
AVMYYAETI

SEQ ID NO: 209167 - protein, 9 aa, Homo Sapiens
DAIKHLDDF

SEQ ID NO: 209168 - protein, 9 aa, Homo Sapiens
HKFITQDLV

SEQ ID NO: 209169 - protein, 9 aa, Homo Sapiens
IMALYSGLK

SEQ ID NO: 209170 - protein, 9 aa, Homo Sapiens
QTAPDDKNK

SEQ ID NO: 209171 - protein, 9 aa, Homo Sapiens
EYCSCISSS

SEQ ID NO: 209172 - protein, 9 aa, Homo Sapiens
PLSKITEQE

SEQ ID NO: 209173 - protein, 9 aa, Homo Sapiens
YYTLMTGHH

SEQ ID NO: 209174 - protein, 9 aa, Homo Sapiens
SSDTWEDLF

SEQ ID NO: 209175 - protein, 9 aa, Homo Sapiens
VMYYAETIF

SEQ ID NO: 209176 - protein, 9 aa, Homo Sapiens
PQDKVAEAT

SEQ ID NO: 209177 - protein, 9 aa, Homo Sapiens
AGSHPTQKG

SEQ ID NO: 209178 - protein, 9 aa, Homo Sapiens
VITVFSSCQ

SEQ ID NO: 209179 - protein, 9 aa, Homo Sapiens
CFEEDPGCK

SEQ ID NO: 209180 - protein, 9 aa, Homo Sapiens
KRRGSPLRG

SEQ ID NO: 209181 - protein, 9 aa, Homo Sapiens
DPLSKITEQ

SEQ ID NO: 209182 - protein, 9 aa, Homo Sapiens
CNNTDFTHF

SEQ ID NO: 209183 - protein, 9 aa, Homo Sapiens
INVVSLAFF

SEQ ID NO: 209184 - protein, 9 aa, Homo Sapiens
LRGHLTKIY

SEQ ID NO: 209185 - protein, 9 aa, Homo Sapiens
QEAKQLQKD

SEQ ID NO: 209186 - protein, 9 aa, Homo Sapiens
IPMLEDLAE

SEQ ID NO: 209187 - protein, 9 aa, Homo Sapiens
GCHGKLGLG

SEQ ID NO: 209188 - protein, 9 aa, Homo Sapiens
PSGERQSLL

SEQ ID NO: 209189 - protein, 9 aa, Homo Sapiens
AISFLLYLP

SEQ ID NO: 209190 - protein, 9 aa, Homo Sapiens
SCISSSRKL

SEQ ID NO: 209191 - protein, 9 aa, Homo Sapiens
GFSSISVSC

SEQ ID NO: 209192 - protein, 9 aa, Homo Sapiens
RPMYHPHRR

SEQ ID NO: 209193 - protein, 9 aa, Homo Sapiens
APLEGARFT

SEQ ID NO: 209194 - protein, 9 aa, Homo Sapiens
ILKQVVVGK

SEQ ID NO: 209195 - protein, 9 aa, Homo Sapiens
IVFLFFASI

SEQ ID NO: 209196 - protein, 9 aa, Homo Sapiens
LAFLAYACM

SEQ ID NO: 209197 - protein, 9 aa, Homo Sapiens
LRFLTLVHH

SEQ ID NO: 209198 - protein, 9 aa, Homo Sapiens
LRQSIDAQD

SEQ ID NO: 209199 - protein, 9 aa, Homo Sapiens
QWEQALSSC

SEQ ID NO: 209200 - protein, 9 aa, Homo Sapiens
DAKKEPGTE

SEQ ID NO: 209201 - protein, 9 aa, Homo Sapiens
SCSRGSGGL

SEQ ID NO: 209202 - protein, 9 aa, Homo Sapiens
KDPSALSKQ

SEQ ID NO: 209203 - protein, 9 aa, Homo Sapiens
QPLKVKLEM

SEQ ID NO: 209204 - protein, 9 aa, Homo Sapiens
GAGEPHVFR

SEQ ID NO: 209205 - protein, 9 aa, Homo Sapiens
SLKKEMPLV

SEQ ID NO: 209206 - protein, 9 aa, Homo Sapiens
DTLLILPRK

SEQ ID NO: 209207 - protein, 9 aa, Homo Sapiens
KIFEDIPML

SEQ ID NO: 209208 - protein, 9 aa, Homo Sapiens
PALGTTRLH

SEQ ID NO: 209209 - protein, 9 aa, Homo Sapiens
LVFGKDNKK

SEQ ID NO: 209210 - protein, 9 aa, Homo Sapiens
SGTLMPGSP

SEQ ID NO: 209211 - protein, 9 aa, Homo Sapiens
CPCHISDDG

SEQ ID NO: 209212 - protein, 9 aa, Homo Sapiens
LQWLIQEQL

SEQ ID NO: 209213 - protein, 9 aa, Homo Sapiens
HLDDFKGTF

SEQ ID NO: 209214 - protein, 9 aa, Homo Sapiens
EDIPMLEDL

SEQ ID NO: 209215 - protein, 9 aa, Homo Sapiens
PQPPALGTT

SEQ ID NO: 209216 - protein, 9 aa, Homo Sapiens
TVQTEFMEL

SEQ ID NO: 209217 - protein, 9 aa, Homo Sapiens
IILPSDFQH

SEQ ID NO: 209218 - protein, 9 aa, Homo Sapiens
KLAGWQCPE

SEQ ID NO: 209219 - protein, 9 aa, Homo Sapiens
SHPTQKGDL

SEQ ID NO: 209220 - protein, 9 aa, Homo Sapiens
WGPFHPADP

SEQ ID NO: 209221 - protein, 9 aa, Homo Sapiens
DKVAEATND

SEQ ID NO: 209222 - protein, 9 aa, Homo Sapiens
RRHLWGPFH

SEQ ID NO: 209223 - protein, 9 aa, Homo Sapiens
DHKRRSSAT

SEQ ID NO: 209224 - protein, 9 aa, Homo Sapiens
LLTGEQLGN

SEQ ID NO: 209225 - protein, 9 aa, Homo Sapiens
RWCDSGGSA

SEQ ID NO: 209226 - protein, 9 aa, Homo Sapiens
RCVYPTRVL

SEQ ID NO: 209227 - protein, 9 aa, Homo Sapiens
MPLVFGKDN

SEQ ID NO: 209228 - protein, 9 aa, Homo Sapiens
APFCQPAGL

SEQ ID NO: 209229 - protein, 9 aa, Homo Sapiens
SVGYPATLR

SEQ ID NO: 209230 - protein, 9 aa, Homo Sapiens
SDHLENISK

SEQ ID NO: 209231 - protein, 9 aa, Homo Sapiens
RSMDCRVAR

SEQ ID NO: 209232 - protein, 9 aa, Homo Sapiens
QLKSKSQEE

SEQ ID NO: 209233 - protein, 9 aa, Homo Sapiens
LWRGRQTPG

SEQ ID NO: 209234 - protein, 9 aa, Homo Sapiens
ADTLLILPR

SEQ ID NO: 209235 - protein, 9 aa, Homo Sapiens
GQLRQSIDA

SEQ ID NO: 209236 - protein, 9 aa, Homo Sapiens
TRSSTASSN

SEQ ID NO: 209237 - protein, 9 aa, Homo Sapiens
AFLAYACMA

SEQ ID NO: 209238 - protein, 9 aa, Homo Sapiens
NLFPAPQAI

SEQ ID NO: 209239 - protein, 9 aa, Homo Sapiens
HLWGPFHPA

SEQ ID NO: 209240 - protein, 9 aa, Homo Sapiens
RGHLTKIYA

SEQ ID NO: 209241 - protein, 9 aa, Homo Sapiens
MGTPVTRSS

SEQ ID NO: 209242 - protein, 9 aa, Homo Sapiens
HLENISKLV

SEQ ID NO: 209243 - protein, 9 aa, Homo Sapiens
RLHTAHSTL

SEQ ID NO: 209244 - protein, 9 aa, Homo Sapiens
DLFGAVPRY

SEQ ID NO: 209245 - protein, 9 aa, Homo Sapiens
QNRFISLSY

SEQ ID NO: 209246 - protein, 9 aa, Homo Sapiens
GDGCHGKLG

SEQ ID NO: 209247 - protein, 9 aa, Homo Sapiens
VLVGNNCDL

SEQ ID NO: 209248 - protein, 9 aa, Homo Sapiens
NPAQRPMYH

SEQ ID NO: 209249 - protein, 9 aa, Homo Sapiens
GTLMPGSPT

SEQ ID NO: 209250 - protein, 9 aa, Homo Sapiens
FTHFYKLGV

SEQ ID NO: 209251 - protein, 9 aa, Homo Sapiens
ITVFSSCQE

SEQ ID NO: 209252 - protein, 9 aa, Homo Sapiens
STRDPLSKI

SEQ ID NO: 209253 - protein, 9 aa, Homo Sapiens
INYSESLYH

SEQ ID NO: 209254 - protein, 9 aa, Homo Sapiens
PLEGARFTL

SEQ ID NO: 209255 - protein, 9 aa, Homo Sapiens
MGPRAVLGL

SEQ ID NO: 209256 - protein, 9 aa, Homo Sapiens
KDGHRIILP

SEQ ID NO: 209257 - protein, 9 aa, Homo Sapiens
DIDFAMDES

SEQ ID NO: 209258 - protein, 9 aa, Homo Sapiens
PLKVKLEMK

SEQ ID NO: 209259 - protein, 9 aa, Homo Sapiens
ELQPLKVKL

SEQ ID NO: 209260 - protein, 9 aa, Homo Sapiens
YNPQRMLFC

SEQ ID NO: 209261 - protein, 9 aa, Homo Sapiens
KVYITTQGP

SEQ ID NO: 209262 - protein, 9 aa, Homo Sapiens
LRKQRRERT

SEQ ID NO: 209263 - protein, 9 aa, Homo Sapiens
LCPSSDTWE

SEQ ID NO: 209264 - protein, 9 aa, Homo Sapiens
KQMEELQPL

SEQ ID NO: 209265 - protein, 9 aa, Homo Sapiens
KNCNNTDFT

SEQ ID NO: 209266 - protein, 9 aa, Homo Sapiens
NTDELMSCS

SEQ ID NO: 209267 - protein, 9 aa, Homo Sapiens
MEILILGVI

SEQ ID NO: 209268 - protein, 9 aa, Homo Sapiens
TLRKQRRER

SEQ ID NO: 209269 - protein, 9 aa, Homo Sapiens
TLVREDRGG

SEQ ID NO: 209270 - protein, 9 aa, Homo Sapiens
EQALSSCSG

SEQ ID NO: 209271 - protein, 9 aa, Homo Sapiens
SKRWCDSGG

SEQ ID NO: 209272 - protein, 9 aa, Homo Sapiens
ENISKLVES

SEQ ID NO: 209273 - protein, 9 aa, Homo Sapiens
QLAFLAYAC

SEQ ID NO: 209274 - protein, 9 aa, Homo Sapiens
VQGAGQLRQ

SEQ ID NO: 209275 - protein, 9 aa, Homo Sapiens
AYQIRCVYP

SEQ ID NO: 209276 - protein, 9 aa, Homo Sapiens
ATPYRGVSC

SEQ ID NO: 209277 - protein, 9 aa, Homo Sapiens
GTVLQWLIQ

SEQ ID NO: 209278 - protein, 9 aa, Homo Sapiens
TMMNNNDLV

SEQ ID NO: 209279 - protein, 9 aa, Homo Sapiens
LLKEKQQEA

SEQ ID NO: 209280 - protein, 9 aa, Homo Sapiens
FSSISVSCS

SEQ ID NO: 209281 - protein, 9 aa, Homo Sapiens
KPLFPGKAE

SEQ ID NO: 209282 - protein, 9 aa, Homo Sapiens
FEEDPGCKW

SEQ ID NO: 209283 - protein, 9 aa, Homo Sapiens
CSCISSSRK

SEQ ID NO: 209284 - protein, 9 aa, Homo Sapiens
RPASALWPK

SEQ ID NO: 209285 - protein, 9 aa, Homo Sapiens
PSPKVSDTM

SEQ ID NO: 209286 - protein, 9 aa, Homo Sapiens
KAEIDQINK

SEQ ID NO: 209287 - protein, 9 aa, Homo Sapiens
WMLPDVNDR

SEQ ID NO: 209288 - protein, 9 aa, Homo Sapiens
QLCPSSDTW

SEQ ID NO: 209289 - protein, 9 aa, Homo Sapiens
IYQTIDFSG

SEQ ID NO: 209290 - protein, 9 aa, Homo Sapiens
ALSENAVLI

SEQ ID NO: 209291 - protein, 9 aa, Homo Sapiens
YCSCISSSR

SEQ ID NO: 209292 - protein, 9 aa, Homo Sapiens
LQMDFLVHP

SEQ ID NO: 209293 - protein, 9 aa, Homo Sapiens
DNLLTGEQL

SEQ ID NO: 209294 - protein, 9 aa, Homo Sapiens
FGDGCHGKL

SEQ ID NO: 209295 - protein, 9 aa, Homo Sapiens
PGPGLPLSV

SEQ ID NO: 209296 - protein, 9 aa, Homo Sapiens
ATLRKQRRE

SEQ ID NO: 209297 - protein, 9 aa, Homo Sapiens
RSSATINRI

SEQ ID NO: 209298 - protein, 9 aa, Homo Sapiens
GPFHPADPQ

SEQ ID NO: 209299 - protein, 9 aa, Homo Sapiens
DIPMLEDLA

SEQ ID NO: 209300 - protein, 9 aa, Homo Sapiens
DIAVTPLKL

SEQ ID NO: 209301 - protein, 9 aa, Homo Sapiens
EKNCNNTDF

SEQ ID NO: 209302 - protein, 9 aa, Homo Sapiens
QIAKNRGLI

SEQ ID NO: 209303 - protein, 9 aa, Homo Sapiens
LIYGEPHKF

SEQ ID NO: 209304 - protein, 9 aa, Homo Sapiens
GVLAKPFIE

SEQ ID NO: 209305 - protein, 9 aa, Homo Sapiens
LTVQTEFME

SEQ ID NO: 209306 - protein, 9 aa, Homo Sapiens
IAHRLNFAV

SEQ ID NO: 209307 - protein, 9 aa, Homo Sapiens
NAVMYYAET

SEQ ID NO: 209308 - protein, 9 aa, Homo Sapiens
PRKVLQMDF

SEQ ID NO: 209309 - protein, 9 aa, Homo Sapiens
SENAVLILL

SEQ ID NO: 209310 - protein, 9 aa, Homo Sapiens
SLCPCHISD

SEQ ID NO: 209311 - protein, 9 aa, Homo Sapiens
VFLFFASII

SEQ ID NO: 209312 - protein, 9 aa, Homo Sapiens
RGLIPRRKK

SEQ ID NO: 209313 - protein, 9 aa, Homo Sapiens
SYSTSQNRF

SEQ ID NO: 209314 - protein, 9 aa, Homo Sapiens
VKNEGIMAL

SEQ ID NO: 209315 - protein, 9 aa, Homo Sapiens
ENAVLILLI

SEQ ID NO: 209316 - protein, 9 aa, Homo Sapiens
AIIIPCNYP

SEQ ID NO: 209317 - protein, 9 aa, Homo Sapiens
SSLKKEMPL

SEQ ID NO: 209318 - protein, 9 aa, Homo Sapiens
DRAGSHPTQ

SEQ ID NO: 209319 - protein, 9 aa, Homo Sapiens
STPQDITLM

SEQ ID NO: 209320 - protein, 9 aa, Homo Sapiens
HQSELLRGP

SEQ ID NO: 209321 - protein, 9 aa, Homo Sapiens
TKSCTSLSA

SEQ ID NO: 209322 - protein, 9 aa, Homo Sapiens
AYNPQRMLF

SEQ ID NO: 209323 - protein, 9 aa, Homo Sapiens
EINVVSLAF

SEQ ID NO: 209324 - protein, 9 aa, Homo Sapiens
YYAETIFEE

SEQ ID NO: 209325 - protein, 9 aa, Homo Sapiens
FEDIPMLED

SEQ ID NO: 209326 - protein, 9 aa, Homo Sapiens
AHRLNFAVE

SEQ ID NO: 209327 - protein, 9 aa, Homo Sapiens
LILGVIYRS

SEQ ID NO: 209328 - protein, 9 aa, Homo Sapiens
KPDAVCAHE

SEQ ID NO: 209329 - protein, 9 aa, Homo Sapiens
KREEEECMK

SEQ ID NO: 209330 - protein, 9 aa, Homo Sapiens
IPCNYPLMM

SEQ ID NO: 209331 - protein, 9 aa, Homo Sapiens
PHRRHLWGP

SEQ ID NO: 209332 - protein, 9 aa, Homo Sapiens
KITEQEKDF

SEQ ID NO: 209333 - protein, 9 aa, Homo Sapiens
HPHRRHLWG

SEQ ID NO: 209334 - protein, 9 aa, Homo Sapiens
RLRASNTMM

SEQ ID NO: 209335 - protein, 9 aa, Homo Sapiens
QHVRSMDCR

SEQ ID NO: 209336 - protein, 9 aa, Homo Sapiens
LFPGKAEID

SEQ ID NO: 209337 - protein, 9 aa, Homo Sapiens
LKEKQQEAK

SEQ ID NO: 209338 - protein, 9 aa, Homo Sapiens
TECFHFSLC

SEQ ID NO: 209339 - protein, 9 aa, Homo Sapiens
LTLVHHLAR

SEQ ID NO: 209340 - protein, 9 aa, Homo Sapiens
HPADPQPPA

SEQ ID NO: 209341 - protein, 9 aa, Homo Sapiens
VGYPATLRK

SEQ ID NO: 209342 - protein, 9 aa, Homo Sapiens
QRPMYHPHR

SEQ ID NO: 209343 - protein, 9 aa, Homo Sapiens
RIILPSDFQ

SEQ ID NO: 209344 - protein, 9 aa, Homo Sapiens
LHRRFMRDQ

SEQ ID NO: 209345 - protein, 9 aa, Homo Sapiens
GAGQLRQSI

SEQ ID NO: 209346 - protein, 9 aa, Homo Sapiens
AIVARSGEG

SEQ ID NO: 209347 - protein, 9 aa, Homo Sapiens
SLSLCPCHI

SEQ ID NO: 209348 - protein, 9 aa, Homo Sapiens
LSPYPGLCL

SEQ ID NO: 209349 - protein, 9 aa, Homo Sapiens
QTEFMELLE

SEQ ID NO: 209350 - protein, 9 aa, Homo Sapiens
TWMLPDVND

SEQ ID NO: 209351 - protein, 9 aa, Homo Sapiens
NEGIMALYS

SEQ ID NO: 209352 - protein, 9 aa, Homo Sapiens
DAISFLLYL

SEQ ID NO: 209353 - protein, 9 aa, Homo Sapiens
SQDWAPTAG

SEQ ID NO: 209354 - protein, 9 aa, Homo Sapiens
SMSVRFKLP

SEQ ID NO: 209355 - protein, 9 aa, Homo Sapiens
LPTVVWCLP

SEQ ID NO: 209356 - protein, 9 aa, Homo Sapiens
ILPKILYER

SEQ ID NO: 209357 - protein, 9 aa, Homo Sapiens
SVALLGGGP

SEQ ID NO: 209358 - protein, 9 aa, Homo Sapiens
LRYTNSCLN

SEQ ID NO: 209359 - protein, 9 aa, Homo Sapiens
IANNVQYPE

SEQ ID NO: 209360 - protein, 9 aa, Homo Sapiens
TIEKLRCVH

SEQ ID NO: 209361 - protein, 9 aa, Homo Sapiens
GMKFFQIKM

SEQ ID NO: 209362 - protein, 9 aa, Homo Sapiens
GDDIIQKDQ

SEQ ID NO: 209363 - protein, 9 aa, Homo Sapiens
DDIIQKDQG

SEQ ID NO: 209364 - protein, 9 aa, Homo Sapiens
ERDYEEDDY

SEQ ID NO: 209365 - protein, 9 aa, Homo Sapiens
NNIRHIRPH

SEQ ID NO: 209366 - protein, 9 aa, Homo Sapiens
VKEMAKKAS

SEQ ID NO: 209367 - protein, 9 aa, Homo Sapiens
YFSEISARK

SEQ ID NO: 209368 - protein, 9 aa, Homo Sapiens
TRGAELMCQ

SEQ ID NO: 209369 - protein, 9 aa, Homo Sapiens
VVSGLSLKS

SEQ ID NO: 209370 - protein, 9 aa, Homo Sapiens
VAPESSNTE

SEQ ID NO: 209371 - protein, 9 aa, Homo Sapiens
VWEHHPESG

SEQ ID NO: 209372 - protein, 9 aa, Homo Sapiens
LIWGFGILC

SEQ ID NO: 209373 - protein, 9 aa, Homo Sapiens
KQRRKQKRK

SEQ ID NO: 209374 - protein, 9 aa, Homo Sapiens
IIYLIPRYV

SEQ ID NO: 209375 - protein, 9 aa, Homo Sapiens
GADGVGKSA

SEQ ID NO: 209376 - protein, 9 aa, Homo Sapiens
FKPREATEA

SEQ ID NO: 209377 - protein, 9 aa, Homo Sapiens
LRQQAKNGV

SEQ ID NO: 209378 - protein, 9 aa, Homo Sapiens
KTIQKAVLL

SEQ ID NO: 209379 - protein, 9 aa, Homo Sapiens
VLELETVQQ

SEQ ID NO: 209380 - protein, 9 aa, Homo Sapiens
VTRNVSLEL

SEQ ID NO: 209381 - protein, 9 aa, Homo Sapiens
QDKNQSSSK

SEQ ID NO: 209382 - protein, 9 aa, Homo Sapiens
TTVAPESSN

SEQ ID NO: 209383 - protein, 9 aa, Homo Sapiens
WFQNRCYKT

SEQ ID NO: 209384 - protein, 9 aa, Homo Sapiens
AYCSIIFLG

SEQ ID NO: 209385 - protein, 9 aa, Homo Sapiens
LTNIKRWAV

SEQ ID NO: 209386 - protein, 9 aa, Homo Sapiens
FILLSILGM

SEQ ID NO: 209387 - protein, 9 aa, Homo Sapiens
FSFLLSIFH

SEQ ID NO: 209388 - protein, 9 aa, Homo Sapiens
GQTLKLLVT

SEQ ID NO: 209389 - protein, 9 aa, Homo Sapiens
TNNSGTPKE

SEQ ID NO: 209390 - protein, 9 aa, Homo Sapiens
KRVQQLQSD

SEQ ID NO: 209391 - protein, 9 aa, Homo Sapiens
EWNEVKNIK

SEQ ID NO: 209392 - protein, 9 aa, Homo Sapiens
EKVRPNQNC

SEQ ID NO: 209393 - protein, 9 aa, Homo Sapiens
VVTTKIVEL

SEQ ID NO: 209394 - protein, 9 aa, Homo Sapiens
CCIVILREI

SEQ ID NO: 209395 - protein, 9 aa, Homo Sapiens
SIIFLGVIG

SEQ ID NO: 209396 - protein, 9 aa, Homo Sapiens
AAQNGLICN

SEQ ID NO: 209397 - protein, 9 aa, Homo Sapiens
FPSPASIFE

SEQ ID NO: 209398 - protein, 9 aa, Homo Sapiens
KKNTEFEDQ

SEQ ID NO: 209399 - protein, 9 aa, Homo Sapiens
MHTLAGAFD

SEQ ID NO: 209400 - protein, 9 aa, Homo Sapiens
LERIGYSNK

SEQ ID NO: 209401 - protein, 9 aa, Homo Sapiens
DNMAKMRLQ

SEQ ID NO: 209402 - protein, 9 aa, Homo Sapiens
VVRPNGHSQ

SEQ ID NO: 209403 - protein, 9 aa, Homo Sapiens
CIHFFLALY

SEQ ID NO: 209404 - protein, 9 aa, Homo Sapiens
VLLSPGDPA

SEQ ID NO: 209405 - protein, 9 aa, Homo Sapiens
KVVSGLSLK

SEQ ID NO: 209406 - protein, 9 aa, Homo Sapiens
KRKLQAPAT

SEQ ID NO: 209407 - protein, 9 aa, Homo Sapiens
VEKRVQQLQ

SEQ ID NO: 209408 - protein, 9 aa, Homo Sapiens
HQPNRRRQP

SEQ ID NO: 209409 - protein, 9 aa, Homo Sapiens
NPTIKKNTE

SEQ ID NO: 209410 - protein, 9 aa, Homo Sapiens
HQEKKESTP

SEQ ID NO: 209411 - protein, 9 aa, Homo Sapiens
VCTRVSVFV

SEQ ID NO: 209412 - protein, 9 aa, Homo Sapiens
GNLCPPANE

SEQ ID NO: 209413 - protein, 9 aa, Homo Sapiens
TCFLEYIPT

SEQ ID NO: 209414 - protein, 9 aa, Homo Sapiens
IEKLRCVHP

SEQ ID NO: 209415 - protein, 9 aa, Homo Sapiens
NDIVMYFSV

SEQ ID NO: 209416 - protein, 9 aa, Homo Sapiens
DRDILPKIL

SEQ ID NO: 209417 - protein, 9 aa, Homo Sapiens
PKEHDSPEN

SEQ ID NO: 209418 - protein, 9 aa, Homo Sapiens
SLEVMHEMD

SEQ ID NO: 209419 - protein, 9 aa, Homo Sapiens
KPREATEAV

SEQ ID NO: 209420 - protein, 9 aa, Homo Sapiens
SLCNKEVFR

SEQ ID NO: 209421 - protein, 9 aa, Homo Sapiens
TVAPESSNT

SEQ ID NO: 209422 - protein, 9 aa, Homo Sapiens
IIFDHFSHP

SEQ ID NO: 209423 - protein, 9 aa, Homo Sapiens
CNRFKLPPQ

SEQ ID NO: 209424 - protein, 9 aa, Homo Sapiens
RGAELMCQD

SEQ ID NO: 209425 - protein, 9 aa, Homo Sapiens
WRCDKCNDC

SEQ ID NO: 209426 - protein, 9 aa, Homo Sapiens
QKAVLLSPG

SEQ ID NO: 209427 - protein, 9 aa, Homo Sapiens
RGVKLCLTV

SEQ ID NO: 209428 - protein, 9 aa, Homo Sapiens
TIQKAVLLS

SEQ ID NO: 209429 - protein, 9 aa, Homo Sapiens
MPSWAQNRG

SEQ ID NO: 209430 - protein, 9 aa, Homo Sapiens
RHIRPHRTI

SEQ ID NO: 209431 - protein, 9 aa, Homo Sapiens
IKRWAVSPK

SEQ ID NO: 209432 - protein, 9 aa, Homo Sapiens
QKRKSEMLQ

SEQ ID NO: 209433 - protein, 9 aa, Homo Sapiens
VMYFSVALL

SEQ ID NO: 209434 - protein, 9 aa, Homo Sapiens
VKIWFQNRC

SEQ ID NO: 209435 - protein, 9 aa, Homo Sapiens
AEEIRETVF

SEQ ID NO: 209436 - protein, 9 aa, Homo Sapiens
AADWPEMHT

SEQ ID NO: 209437 - protein, 9 aa, Homo Sapiens
RVDDVQFPS

SEQ ID NO: 209438 - protein, 9 aa, Homo Sapiens
VDDVQFPSP

SEQ ID NO: 209439 - protein, 9 aa, Homo Sapiens
QHQPNRRRQ

SEQ ID NO: 209440 - protein, 9 aa, Homo Sapiens
VYGLSEAFV

SEQ ID NO: 209441 - protein, 9 aa, Homo Sapiens
SVTAEEIRE

SEQ ID NO: 209442 - protein, 9 aa, Homo Sapiens
DWPEMHTLA

SEQ ID NO: 209443 - protein, 9 aa, Homo Sapiens
RFKLPNSPA

SEQ ID NO: 209444 - protein, 9 aa, Homo Sapiens
LEVMHEMDD

SEQ ID NO: 209445 - protein, 9 aa, Homo Sapiens
HKDGGIQLE

SEQ ID NO: 209446 - protein, 9 aa, Homo Sapiens
SWHFCIALR

SEQ ID NO: 209447 - protein, 9 aa, Homo Sapiens
RRKQKRKSE

SEQ ID NO: 209448 - protein, 9 aa, Homo Sapiens
TDADSGRNA

SEQ ID NO: 209449 - protein, 9 aa, Homo Sapiens
KKQRRKQKR

SEQ ID NO: 209450 - protein, 9 aa, Homo Sapiens
TRDSSLEVM

SEQ ID NO: 209451 - protein, 9 aa, Homo Sapiens
VVVGADGVG

SEQ ID NO: 209452 - protein, 9 aa, Homo Sapiens
FSHPKFVEQ

SEQ ID NO: 209453 - protein, 9 aa, Homo Sapiens
AYAAQNGLI

SEQ ID NO: 209454 - protein, 9 aa, Homo Sapiens
GVKLCLTVV

SEQ ID NO: 209455 - protein, 9 aa, Homo Sapiens
GYSNKWYLN

SEQ ID NO: 209456 - protein, 9 aa, Homo Sapiens
TRSRWPAVC

SEQ ID NO: 209457 - protein, 9 aa, Homo Sapiens
NPLIYSLCN

SEQ ID NO: 209458 - protein, 9 aa, Homo Sapiens
SRSDEDSES

SEQ ID NO: 209459 - protein, 9 aa, Homo Sapiens
SPTFIELQK

SEQ ID NO: 209460 - protein, 9 aa, Homo Sapiens
ESSNTEATT

SEQ ID NO: 209461 - protein, 9 aa, Homo Sapiens
RYTNSCLNP

SEQ ID NO: 209462 - protein, 9 aa, Homo Sapiens
TEMVEKRVQ

SEQ ID NO: 209463 - protein, 9 aa, Homo Sapiens
LQPHGGDLM

SEQ ID NO: 209464 - protein, 9 aa, Homo Sapiens
LVTIIRYTL

SEQ ID NO: 209465 - protein, 9 aa, Homo Sapiens
NTEFEDQGY

SEQ ID NO: 209466 - protein, 9 aa, Homo Sapiens
RVQQLQSDE

SEQ ID NO: 209467 - protein, 9 aa, Homo Sapiens
EKTEQDKNQ

SEQ ID NO: 209468 - protein, 9 aa, Homo Sapiens
NRNTCAQFS

SEQ ID NO: 209469 - protein, 9 aa, Homo Sapiens
KLRCVHPSR

SEQ ID NO: 209470 - protein, 9 aa, Homo Sapiens
APEYWRSIA

SEQ ID NO: 209471 - protein, 9 aa, Homo Sapiens
TTVQERKEW

SEQ ID NO: 209472 - protein, 9 aa, Homo Sapiens
YWRSIAYFE

SEQ ID NO: 209473 - protein, 9 aa, Homo Sapiens
LVTRNVSLE

SEQ ID NO: 209474 - protein, 9 aa, Homo Sapiens
KQPQDLTEE

SEQ ID NO: 209475 - protein, 9 aa, Homo Sapiens
WEHHPESGE

SEQ ID NO: 209476 - protein, 9 aa, Homo Sapiens
GDLMKAAHN

SEQ ID NO: 209477 - protein, 9 aa, Homo Sapiens
HMQHQPNRR

SEQ ID NO: 209478 - protein, 9 aa, Homo Sapiens
RDSSLEVMH

SEQ ID NO: 209479 - protein, 9 aa, Homo Sapiens
IFDHFSHPK

SEQ ID NO: 209480 - protein, 9 aa, Homo Sapiens
PESSNTEAT

SEQ ID NO: 209481 - protein, 9 aa, Homo Sapiens
RCDKCNDCV

SEQ ID NO: 209482 - protein, 9 aa, Homo Sapiens
AFILLSILG

SEQ ID NO: 209483 - protein, 9 aa, Homo Sapiens
FKLPNSPAA

SEQ ID NO: 209484 - protein, 9 aa, Homo Sapiens
QRRKQKRKS

SEQ ID NO: 209485 - protein, 9 aa, Homo Sapiens
VRPNGHSQG

SEQ ID NO: 209486 - protein, 9 aa, Homo Sapiens
LDARQVYGL

SEQ ID NO: 209487 - protein, 9 aa, Homo Sapiens
RIGYSNKWY

SEQ ID NO: 209488 - protein, 9 aa, Homo Sapiens
KAVLLSPGD

SEQ ID NO: 209489 - protein, 9 aa, Homo Sapiens
IRHIRPHRT

SEQ ID NO: 209490 - protein, 9 aa, Homo Sapiens
VDRDILPKI

SEQ ID NO: 209491 - protein, 9 aa, Homo Sapiens
VVEFAKQIT

SEQ ID NO: 209492 - protein, 9 aa, Homo Sapiens
EYWRSIAYF

SEQ ID NO: 209493 - protein, 9 aa, Homo Sapiens
HFIIYLIPR

SEQ ID NO: 209494 - protein, 9 aa, Homo Sapiens
MKTAFILLS

SEQ ID NO: 209495 - protein, 9 aa, Homo Sapiens
DGVGKSALT

SEQ ID NO: 209496 - protein, 9 aa, Homo Sapiens
WLVTIIRYT

SEQ ID NO: 209497 - protein, 9 aa, Homo Sapiens
QSLKCIANG

SEQ ID NO: 209498 - protein, 9 aa, Homo Sapiens
KNPTIKKNT

SEQ ID NO: 209499 - protein, 9 aa, Homo Sapiens
EADSANTCK

SEQ ID NO: 209500 - protein, 9 aa, Homo Sapiens
CYFSHSASN

SEQ ID NO: 209501 - protein, 9 aa, Homo Sapiens
ANNVQYPEC

SEQ ID NO: 209502 - protein, 9 aa, Homo Sapiens
RSRWPAVCT

SEQ ID NO: 209503 - protein, 9 aa, Homo Sapiens
WKDIFTISM

SEQ ID NO: 209504 - protein, 9 aa, Homo Sapiens
VHPSRPPRG

SEQ ID NO: 209505 - protein, 9 aa, Homo Sapiens
WNEVKNIKS

SEQ ID NO: 209506 - protein, 9 aa, Homo Sapiens
QGKAFVKQS

SEQ ID NO: 209507 - protein, 9 aa, Homo Sapiens
VSISAVHDE

SEQ ID NO: 209508 - protein, 9 aa, Homo Sapiens
EPTFLWTKD

SEQ ID NO: 209509 - protein, 9 aa, Homo Sapiens
IIFLGVIGN

SEQ ID NO: 209510 - protein, 9 aa, Homo Sapiens
NLGSMSVRF

SEQ ID NO: 209511 - protein, 9 aa, Homo Sapiens
TQGKAFVKQ

SEQ ID NO: 209512 - protein, 9 aa, Homo Sapiens
SWQYQCIHF

SEQ ID NO: 209513 - protein, 9 aa, Homo Sapiens
CKYCFVYSQ

SEQ ID NO: 209514 - protein, 9 aa, Homo Sapiens
ILAYCSIIF

SEQ ID NO: 209515 - protein, 9 aa, Homo Sapiens
VRFKLPNSP

SEQ ID NO: 209516 - protein, 9 aa, Homo Sapiens
KWISVTAEE

SEQ ID NO: 209517 - protein, 9 aa, Homo Sapiens
KFFQIKMYP

SEQ ID NO: 209518 - protein, 9 aa, Homo Sapiens
KEHDSPENG

SEQ ID NO: 209519 - protein, 9 aa, Homo Sapiens
PPANETRKC

SEQ ID NO: 209520 - protein, 9 aa, Homo Sapiens
NLCPPANET

SEQ ID NO: 209521 - protein, 9 aa, Homo Sapiens
FQIKMYPVE

SEQ ID NO: 209522 - protein, 9 aa, Homo Sapiens
QCIHFFLAL

SEQ ID NO: 209523 - protein, 9 aa, Homo Sapiens
IRCCGSPFY

SEQ ID NO: 209524 - protein, 9 aa, Homo Sapiens
NQNCCIVIL

SEQ ID NO: 209525 - protein, 9 aa, Homo Sapiens
GNRLDDVCN

SEQ ID NO: 209526 - protein, 9 aa, Homo Sapiens
SSLESASYI

SEQ ID NO: 209527 - protein, 9 aa, Homo Sapiens
NIKSIVPMI

SEQ ID NO: 209528 - protein, 9 aa, Homo Sapiens
GLEENMTSD

SEQ ID NO: 209529 - protein, 9 aa, Homo Sapiens
RVNTAWKTK

SEQ ID NO: 209530 - protein, 9 aa, Homo Sapiens
LLLLLRQQA

SEQ ID NO: 209531 - protein, 9 aa, Homo Sapiens
EITKQEKDF

SEQ ID NO: 209532 - protein, 9 aa, Homo Sapiens
QVWDDSSGD

SEQ ID NO: 209533 - protein, 9 aa, Homo Sapiens
ERKEWKLRE

SEQ ID NO: 209534 - protein, 9 aa, Homo Sapiens
QPNRRRQPV

SEQ ID NO: 209535 - protein, 9 aa, Homo Sapiens
LGNRLDDVC

SEQ ID NO: 209536 - protein, 9 aa, Homo Sapiens
KGNPEPTFL

SEQ ID NO: 209537 - protein, 9 aa, Homo Sapiens
LKLLVTRNV

SEQ ID NO: 209538 - protein, 9 aa, Homo Sapiens
KQEKDFLWS

SEQ ID NO: 209539 - protein, 9 aa, Homo Sapiens
SNKWYLNRL

SEQ ID NO: 209540 - protein, 9 aa, Homo Sapiens
NKWISVTAE

SEQ ID NO: 209541 - protein, 9 aa, Homo Sapiens
IMGMKFFQI

SEQ ID NO: 209542 - protein, 9 aa, Homo Sapiens
PQDLTEEKG

SEQ ID NO: 209543 - protein, 9 aa, Homo Sapiens
SVRFKLPNS

SEQ ID NO: 209544 - protein, 9 aa, Homo Sapiens
FGSVSLMYV

SEQ ID NO: 209545 - protein, 9 aa, Homo Sapiens
WLDARQVYG

SEQ ID NO: 209546 - protein, 9 aa, Homo Sapiens
KASTGQLTV

SEQ ID NO: 209547 - protein, 9 aa, Homo Sapiens
YIELQTTNT

SEQ ID NO: 209548 - protein, 9 aa, Homo Sapiens
WAQNRGIEG

SEQ ID NO: 209549 - protein, 9 aa, Homo Sapiens
WHFCIALRY

SEQ ID NO: 209550 - protein, 9 aa, Homo Sapiens
RKQKRKSEM

SEQ ID NO: 209551 - protein, 9 aa, Homo Sapiens
MAKMRLQLD

SEQ ID NO: 209552 - protein, 9 aa, Homo Sapiens
RYTLGIPDV

SEQ ID NO: 209553 - protein, 9 aa, Homo Sapiens
IPTVEEIVK

SEQ ID NO: 209554 - protein, 9 aa, Homo Sapiens
VTAEEIRET

SEQ ID NO: 209555 - protein, 9 aa, Homo Sapiens
HGGDLMKAA

SEQ ID NO: 209556 - protein, 9 aa, Homo Sapiens
NIKRWAVSP

SEQ ID NO: 209557 - protein, 9 aa, Homo Sapiens
LLWGSLENT

SEQ ID NO: 209558 - protein, 9 aa, Homo Sapiens
LEQGGIRCC

SEQ ID NO: 209559 - protein, 9 aa, Homo Sapiens
GSVSLMYVR

SEQ ID NO: 209560 - protein, 9 aa, Homo Sapiens
EEEDEERDY

SEQ ID NO: 209561 - protein, 9 aa, Homo Sapiens
TKQEKDFLW

SEQ ID NO: 209562 - protein, 9 aa, Homo Sapiens
SLESASYIE

SEQ ID NO: 209563 - protein, 9 aa, Homo Sapiens
ESASYIELQ

SEQ ID NO: 209564 - protein, 9 aa, Homo Sapiens
SGTTVAPES

SEQ ID NO: 209565 - protein, 9 aa, Homo Sapiens
RWAVSPKSF

SEQ ID NO: 209566 - protein, 9 aa, Homo Sapiens
QEADSANTC

SEQ ID NO: 209567 - protein, 9 aa, Homo Sapiens
FLNKKTKQP

SEQ ID NO: 209568 - protein, 9 aa, Homo Sapiens
SDEDSESEL

SEQ ID NO: 209569 - protein, 9 aa, Homo Sapiens
HGGLEENMT

SEQ ID NO: 209570 - protein, 9 aa, Homo Sapiens
GGLEENMTS

SEQ ID NO: 209571 - protein, 9 aa, Homo Sapiens
AVLLSPGDP

SEQ ID NO: 209572 - protein, 9 aa, Homo Sapiens
LLVTRNVSL

SEQ ID NO: 209573 - protein, 9 aa, Homo Sapiens
DDVCNRFKL

SEQ ID NO: 209574 - protein, 9 aa, Homo Sapiens
EDSESELFS

SEQ ID NO: 209575 - protein, 9 aa, Homo Sapiens
PKILYERDA

SEQ ID NO: 209576 - protein, 9 aa, Homo Sapiens
QNKWISVTA

SEQ ID NO: 209577 - protein, 9 aa, Homo Sapiens
QKKKKKKVL

SEQ ID NO: 209578 - protein, 9 aa, Homo Sapiens
DIFTISMNE

SEQ ID NO: 209579 - protein, 9 aa, Homo Sapiens
LPAYAAQNG

SEQ ID NO: 209580 - protein, 9 aa, Homo Sapiens
VAGDVVTTK

SEQ ID NO: 209581 - protein, 9 aa, Homo Sapiens
FLEQGGIRC

SEQ ID NO: 209582 - protein, 9 aa, Homo Sapiens
LPSWQYQCI

SEQ ID NO: 209583 - protein, 9 aa, Homo Sapiens
IGFILNNIR

SEQ ID NO: 209584 - protein, 9 aa, Homo Sapiens
IKKNTEFED

SEQ ID NO: 209585 - protein, 9 aa, Homo Sapiens
IRYTLGIPD

SEQ ID NO: 209586 - protein, 9 aa, Homo Sapiens
PNQNCCIVI

SEQ ID NO: 209587 - protein, 9 aa, Homo Sapiens
TFLWTKDGN

SEQ ID NO: 209588 - protein, 9 aa, Homo Sapiens
TSSITSCYF

SEQ ID NO: 209589 - protein, 9 aa, Homo Sapiens
VKLCLTVVD

SEQ ID NO: 209590 - protein, 9 aa, Homo Sapiens
CIALRYTNS

SEQ ID NO: 209591 - protein, 9 aa, Homo Sapiens
NQNLVLELE

SEQ ID NO: 209592 - protein, 9 aa, Homo Sapiens
PVIEMRDHK

SEQ ID NO: 209593 - protein, 9 aa, Homo Sapiens
MHEMDDYGN

SEQ ID NO: 209594 - protein, 9 aa, Homo Sapiens
CPPANETRK

SEQ ID NO: 209595 - protein, 9 aa, Homo Sapiens
FFQIKMYPV

SEQ ID NO: 209596 - protein, 9 aa, Homo Sapiens
GNKIANNVQ

SEQ ID NO: 209597 - protein, 9 aa, Homo Sapiens
HFCIALRYT

SEQ ID NO: 209598 - protein, 9 aa, Homo Sapiens
NAYFSEISA

SEQ ID NO: 209599 - protein, 9 aa, Homo Sapiens
CSIIFLGVI

SEQ ID NO: 209600 - protein, 9 aa, Homo Sapiens
PAHWRCDKC

SEQ ID NO: 209601 - protein, 9 aa, Homo Sapiens
TKKKRVNTA

SEQ ID NO: 209602 - protein, 9 aa, Homo Sapiens
VKQSLKCIA

SEQ ID NO: 209603 - protein, 9 aa, Homo Sapiens
GLPAYAAQN

SEQ ID NO: 209604 - protein, 9 aa, Homo Sapiens
EGQKKKKKK

SEQ ID NO: 209605 - protein, 9 aa, Homo Sapiens
YTVSISAVH

SEQ ID NO: 209606 - protein, 9 aa, Homo Sapiens
STGQLTVPP

SEQ ID NO: 209607 - protein, 9 aa, Homo Sapiens
QAPATDNSD

SEQ ID NO: 209608 - protein, 9 aa, Homo Sapiens
PTTRGAELM

SEQ ID NO: 209609 - protein, 9 aa, Homo Sapiens
DKCNDCVDG

SEQ ID NO: 209610 - protein, 9 aa, Homo Sapiens
ATDADSGRN

SEQ ID NO: 209611 - protein, 9 aa, Homo Sapiens
RNAVIAYTV

SEQ ID NO: 209612 - protein, 9 aa, Homo Sapiens
SAHGGLEEN

SEQ ID NO: 209613 - protein, 9 aa, Homo Sapiens
NLVLELETV

SEQ ID NO: 209614 - protein, 9 aa, Homo Sapiens
DVCNRFKLP

SEQ ID NO: 209615 - protein, 9 aa, Homo Sapiens
FIIYLIPRY

SEQ ID NO: 209616 - protein, 9 aa, Homo Sapiens
KWYLNRLRI

SEQ ID NO: 209617 - protein, 9 aa, Homo Sapiens
NIRHIRPHR

SEQ ID NO: 209618 - protein, 9 aa, Homo Sapiens
FAKQITGFM

SEQ ID NO: 209619 - protein, 9 aa, Homo Sapiens
QYQCIHFFL

SEQ ID NO: 209620 - protein, 9 aa, Homo Sapiens
VGADGVGKS

SEQ ID NO: 209621 - protein, 9 aa, Homo Sapiens
KQSLKCIAN

SEQ ID NO: 209622 - protein, 9 aa, Homo Sapiens
TCAQFSNNL

SEQ ID NO: 209623 - protein, 9 aa, Homo Sapiens
CVHPSRPPR

SEQ ID NO: 209624 - protein, 9 aa, Homo Sapiens
CGDDIIQKD

SEQ ID NO: 209625 - protein, 9 aa, Homo Sapiens
CENAYFSEI

SEQ ID NO: 209626 - protein, 9 aa, Homo Sapiens
VVLPTVVWC

SEQ ID NO: 209627 - protein, 9 aa, Homo Sapiens
VLPTVVWCL

SEQ ID NO: 209628 - protein, 9 aa, Homo Sapiens
MYVRFSDTY

SEQ ID NO: 209629 - protein, 9 aa, Homo Sapiens
NKWYLNRLR

SEQ ID NO: 209630 - protein, 9 aa, Homo Sapiens
GLSLKSCAL

SEQ ID NO: 209631 - protein, 9 aa, Homo Sapiens
EMRDHKDGG

SEQ ID NO: 209632 - protein, 9 aa, Homo Sapiens
VTGNKIANN

SEQ ID NO: 209633 - protein, 9 aa, Homo Sapiens
SISAVHDEG

SEQ ID NO: 209634 - protein, 9 aa, Homo Sapiens
KKKVLLETK

SEQ ID NO: 209635 - protein, 9 aa, Homo Sapiens
KKKKVLLET

SEQ ID NO: 209636 - protein, 9 aa, Homo Sapiens
EKEKTEQDK

SEQ ID NO: 209637 - protein, 9 aa, Homo Sapiens
AVSPKSFTL

SEQ ID NO: 209638 - protein, 9 aa, Homo Sapiens
ERIGYSNKW

SEQ ID NO: 209639 - protein, 9 aa, Homo Sapiens
EERDYEEDD

SEQ ID NO: 209640 - protein, 9 aa, Homo Sapiens
QAVVLPTVV

SEQ ID NO: 209641 - protein, 9 aa, Homo Sapiens
KILYERDAS

SEQ ID NO: 209642 - protein, 9 aa, Homo Sapiens
SCYFSHSAS

SEQ ID NO: 209643 - protein, 9 aa, Homo Sapiens
GGDLMKAAH

SEQ ID NO: 209644 - protein, 9 aa, Homo Sapiens
YAAQNGLIC

SEQ ID NO: 209645 - protein, 9 aa, Homo Sapiens
HSFQVWDDS

SEQ ID NO: 209646 - protein, 9 aa, Homo Sapiens
KDGGIQLEC

SEQ ID NO: 209647 - protein, 9 aa, Homo Sapiens
KIWFQNRCY

SEQ ID NO: 209648 - protein, 9 aa, Homo Sapiens
EMVEKRVQQ

SEQ ID NO: 209649 - protein, 9 aa, Homo Sapiens
LIRGNRNTC

SEQ ID NO: 209650 - protein, 9 aa, Homo Sapiens
AWVWEHHPE

SEQ ID NO: 209651 - protein, 9 aa, Homo Sapiens
IKHFIIYLI

SEQ ID NO: 209652 - protein, 9 aa, Homo Sapiens
FILNNIRHI

SEQ ID NO: 209653 - protein, 9 aa, Homo Sapiens
TNIKRWAVS

SEQ ID NO: 209654 - protein, 9 aa, Homo Sapiens
DADSGRNAV

SEQ ID NO: 209655 - protein, 9 aa, Homo Sapiens
QHSGVVRPN

SEQ ID NO: 209656 - protein, 9 aa, Homo Sapiens
VYSQDWAPT

SEQ ID NO: 209657 - protein, 9 aa, Homo Sapiens
TAWKTKKTS

SEQ ID NO: 209658 - protein, 9 aa, Homo Sapiens
LENGGTHQE

SEQ ID NO: 209659 - protein, 9 aa, Homo Sapiens
KQKRKSEML

SEQ ID NO: 209660 - protein, 9 aa, Homo Sapiens
LYTVSISAV

SEQ ID NO: 209661 - protein, 9 aa, Homo Sapiens
FLWTKDGNP

SEQ ID NO: 209662 - protein, 9 aa, Homo Sapiens
PSWQYQCIH

SEQ ID NO: 209663 - protein, 9 aa, Homo Sapiens
SLMYVRFSD

SEQ ID NO: 209664 - protein, 9 aa, Homo Sapiens
IYTCFLEYI

SEQ ID NO: 209665 - protein, 9 aa, Homo Sapiens
GSMSVRFKL

SEQ ID NO: 209666 - protein, 9 aa, Homo Sapiens
SPASIFEVE

SEQ ID NO: 209667 - protein, 9 aa, Homo Sapiens
QIIFDHFSH

SEQ ID NO: 209668 - protein, 9 aa, Homo Sapiens
IWGFGILCI

SEQ ID NO: 209669 - protein, 9 aa, Homo Sapiens
DIIQKDQGE

SEQ ID NO: 209670 - protein, 9 aa, Homo Sapiens
LMKAAHNNS

SEQ ID NO: 209671 - protein, 9 aa, Homo Sapiens
RDILPKILY

SEQ ID NO: 209672 - protein, 9 aa, Homo Sapiens
VKNIKSIVP

SEQ ID NO: 209673 - protein, 9 aa, Homo Sapiens
TSCYFSHSA

SEQ ID NO: 209674 - protein, 9 aa, Homo Sapiens
DILPKILYE

SEQ ID NO: 209675 - protein, 9 aa, Homo Sapiens
TTKIVELSK

SEQ ID NO: 209676 - protein, 9 aa, Homo Sapiens
ILYERDASE

SEQ ID NO: 209677 - protein, 9 aa, Homo Sapiens
KYCFVYSQD

SEQ ID NO: 209678 - protein, 9 aa, Homo Sapiens
HPKFVEQLI

SEQ ID NO: 209679 - protein, 9 aa, Homo Sapiens
CFVYSQDWA

SEQ ID NO: 209680 - protein, 9 aa, Homo Sapiens
VEFAKQITG

SEQ ID NO: 209681 - protein, 9 aa, Homo Sapiens
RLDDVCNRF

SEQ ID NO: 209682 - protein, 9 aa, Homo Sapiens
PHKRKLQAP

SEQ ID NO: 209683 - protein, 9 aa, Homo Sapiens
FCIALRYTN

SEQ ID NO: 209684 - protein, 9 aa, Homo Sapiens
QNRCYKTKR

SEQ ID NO: 209685 - protein, 9 aa, Homo Sapiens
SITSCYFSH

SEQ ID NO: 209686 - protein, 9 aa, Homo Sapiens
DEDSESELF

SEQ ID NO: 209687 - protein, 9 aa, Homo Sapiens
MYFSVALLG

SEQ ID NO: 209688 - protein, 9 aa, Homo Sapiens
EQGGIRCCG

SEQ ID NO: 209689 - protein, 9 aa, Homo Sapiens
IALRYTNSC

SEQ ID NO: 209690 - protein, 9 aa, Homo Sapiens
AVCTRVSVF

SEQ ID NO: 209691 - protein, 9 aa, Homo Sapiens
AVVLPTVVW

SEQ ID NO: 209692 - protein, 9 aa, Homo Sapiens
SHPKFVEQL

SEQ ID NO: 209693 - protein, 9 aa, Homo Sapiens
PEELQAWVW

SEQ ID NO: 209694 - protein, 9 aa, Homo Sapiens
HPAPEYWRS

SEQ ID NO: 209695 - protein, 9 aa, Homo Sapiens
IFHSKYHGY

SEQ ID NO: 209696 - protein, 9 aa, Homo Sapiens
NHPAPEYWR

SEQ ID NO: 209697 - protein, 9 aa, Homo Sapiens
RCVHPSRPP

SEQ ID NO: 209698 - protein, 9 aa, Homo Sapiens
ERGVKLCLT

SEQ ID NO: 209699 - protein, 9 aa, Homo Sapiens
TPKEHDSPE

SEQ ID NO: 209700 - protein, 9 aa, Homo Sapiens
PEPTFLWTK

SEQ ID NO: 209701 - protein, 9 aa, Homo Sapiens
SGLPAYAAQ

SEQ ID NO: 209702 - protein, 9 aa, Homo Sapiens
IELQKIYGK

SEQ ID NO: 209703 - protein, 9 aa, Homo Sapiens
WVWEHHPES

SEQ ID NO: 209704 - protein, 9 aa, Homo Sapiens
RDHKDGGIQ

SEQ ID NO: 209705 - protein, 9 aa, Homo Sapiens
KCNDCVDGS

SEQ ID NO: 209706 - protein, 9 aa, Homo Sapiens
ADGVGKSAL

SEQ ID NO: 209707 - protein, 9 aa, Homo Sapiens
GGIRCCGSP

SEQ ID NO: 209708 - protein, 9 aa, Homo Sapiens
CFLLWGSLE

SEQ ID NO: 209709 - protein, 9 aa, Homo Sapiens
ITKQEKDFL

SEQ ID NO: 209710 - protein, 9 aa, Homo Sapiens
VSGTTVAPE

SEQ ID NO: 209711 - protein, 9 aa, Homo Sapiens
IEERGVKLC

SEQ ID NO: 209712 - protein, 9 aa, Homo Sapiens
SGYCGDDII

SEQ ID NO: 209713 - protein, 9 aa, Homo Sapiens
SSITSCYFS

SEQ ID NO: 209714 - protein, 9 aa, Homo Sapiens
FGLLLLLRQ

SEQ ID NO: 209715 - protein, 9 aa, Homo Sapiens
DVTGNKIAN

SEQ ID NO: 209716 - protein, 9 aa, Homo Sapiens
GVVRPNGHS

SEQ ID NO: 209717 - protein, 9 aa, Homo Sapiens
PSISSSNFK

SEQ ID NO: 209718 - protein, 9 aa, Homo Sapiens
ENGGTHQEK

SEQ ID NO: 209719 - protein, 9 aa, Homo Sapiens
VSGLPAYAA

SEQ ID NO: 209720 - protein, 9 aa, Homo Sapiens
NRCYKTKRK

SEQ ID NO: 209721 - protein, 9 aa, Homo Sapiens
RSIAYFEMD

SEQ ID NO: 209722 - protein, 9 aa, Homo Sapiens
SSSNFKPRE

SEQ ID NO: 209723 - protein, 9 aa, Homo Sapiens
GTPKEHDSP

SEQ ID NO: 209724 - protein, 9 aa, Homo Sapiens
LIMGMKFFQ

SEQ ID NO: 209725 - protein, 9 aa, Homo Sapiens
LHSFQVWDD

SEQ ID NO: 209726 - protein, 9 aa, Homo Sapiens
RKAMTKKKR

SEQ ID NO: 209727 - protein, 9 aa, Homo Sapiens
KEMAKKAST

SEQ ID NO: 209728 - protein, 9 aa, Homo Sapiens
QITGFMELC

SEQ ID NO: 209729 - protein, 9 aa, Homo Sapiens
PTIKKNTEF

SEQ ID NO: 209730 - protein, 9 aa, Homo Sapiens
IYSLCNKEV

SEQ ID NO: 209731 - protein, 9 aa, Homo Sapiens
NNVQYPECL

SEQ ID NO: 209732 - protein, 9 aa, Homo Sapiens
NFKPREATE

SEQ ID NO: 209733 - protein, 9 aa, Homo Sapiens
CFLEYIPTV

SEQ ID NO: 209734 - protein, 9 aa, Homo Sapiens
KDIFTISMN

SEQ ID NO: 209735 - protein, 9 aa, Homo Sapiens
YCKYCFVYS

SEQ ID NO: 209736 - protein, 9 aa, Homo Sapiens
IWFQNRCYK

SEQ ID NO: 209737 - protein, 9 aa, Homo Sapiens
AYFSEISAR

SEQ ID NO: 209738 - protein, 9 aa, Homo Sapiens
NSGTPKEHD

SEQ ID NO: 209739 - protein, 9 aa, Homo Sapiens
WRSIAYFEM

SEQ ID NO: 209740 - protein, 9 aa, Homo Sapiens
EFAKQITGF

SEQ ID NO: 209741 - protein, 9 aa, Homo Sapiens
VQERKEWKL

SEQ ID NO: 209742 - protein, 9 aa, Homo Sapiens
SIFHSKYHG

SEQ ID NO: 209743 - protein, 9 aa, Homo Sapiens
DDVQFPSPA

SEQ ID NO: 209744 - protein, 9 aa, Homo Sapiens
LDDVCNRFK

SEQ ID NO: 209745 - protein, 9 aa, Homo Sapiens
DPPHKRKLQ

SEQ ID NO: 209746 - protein, 9 aa, Homo Sapiens
ISVTAEEIR

SEQ ID NO: 209747 - protein, 9 aa, Homo Sapiens
YLIPRYVRD

SEQ ID NO: 209748 - protein, 9 aa, Homo Sapiens
WGFGILCIT

SEQ ID NO: 209749 - protein, 9 aa, Homo Sapiens
ASYIELQTT

SEQ ID NO: 209750 - protein, 9 aa, Homo Sapiens
CDKCNDCVD

SEQ ID NO: 209751 - protein, 9 aa, Homo Sapiens
FMPSPTFIE

SEQ ID NO: 209752 - protein, 9 aa, Homo Sapiens
AEERNQNLV

SEQ ID NO: 209753 - protein, 9 aa, Homo Sapiens
RPNGHSQGA

SEQ ID NO: 209754 - protein, 9 aa, Homo Sapiens
VNLHSFQVW

SEQ ID NO: 209755 - protein, 9 aa, Homo Sapiens
MAKKASTGQ

SEQ ID NO: 209756 - protein, 9 aa, Homo Sapiens
LKTIQKAVL

SEQ ID NO: 209757 - protein, 9 aa, Homo Sapiens
IIRYTLGIP

SEQ ID NO: 209758 - protein, 9 aa, Homo Sapiens
VTIIRYTLG

SEQ ID NO: 209759 - protein, 9 aa, Homo Sapiens
YGLSEAFVS

SEQ ID NO: 209760 - protein, 9 aa, Homo Sapiens
QFPSPASIF

SEQ ID NO: 209761 - protein, 9 aa, Homo Sapiens
SGTPKEHDS

SEQ ID NO: 209762 - protein, 9 aa, Homo Sapiens
KLLVTRNVS

SEQ ID NO: 209763 - protein, 9 aa, Homo Sapiens
EQDKNQSSS

SEQ ID NO: 209764 - protein, 9 aa, Homo Sapiens
PNRRRQPVS

SEQ ID NO: 209765 - protein, 9 aa, Homo Sapiens
TEFEDQGYY

SEQ ID NO: 209766 - protein, 9 aa, Homo Sapiens
VALLIWGFG

SEQ ID NO: 209767 - protein, 9 aa, Homo Sapiens
ERNQNLVLE

SEQ ID NO: 209768 - protein, 9 aa, Homo Sapiens
PIEGQKKKK

SEQ ID NO: 209769 - protein, 9 aa, Homo Sapiens
ITSCYFSHS

SEQ ID NO: 209770 - protein, 9 aa, Homo Sapiens
CNKEVFRAL

SEQ ID NO: 209771 - protein, 9 aa, Homo Sapiens
IFTISMNEK

SEQ ID NO: 209772 - protein, 9 aa, Homo Sapiens
ANETRKCTV

SEQ ID NO: 209773 - protein, 9 aa, Homo Sapiens
TFIELQKIY

SEQ ID NO: 209774 - protein, 9 aa, Homo Sapiens
EYIPTVEEI

SEQ ID NO: 209775 - protein, 9 aa, Homo Sapiens
DIVMYFSVA

SEQ ID NO: 209776 - protein, 9 aa, Homo Sapiens
SNFKPREAT

SEQ ID NO: 209777 - protein, 9 aa, Homo Sapiens
NMAKMRLQL

SEQ ID NO: 209778 - protein, 9 aa, Homo Sapiens
ALLIWGFGI

SEQ ID NO: 209779 - protein, 9 aa, Homo Sapiens
PHGGDLMKA

SEQ ID NO: 209780 - protein, 9 aa, Homo Sapiens
YCGDDIIQK

SEQ ID NO: 209781 - protein, 9 aa, Homo Sapiens
HQWLDARQV

SEQ ID NO: 209782 - protein, 9 aa, Homo Sapiens
SFLLSIFHS

SEQ ID NO: 209783 - protein, 9 aa, Homo Sapiens
PTTSSITSC

SEQ ID NO: 209784 - protein, 9 aa, Homo Sapiens
TISMNEKFD

SEQ ID NO: 209785 - protein, 9 aa, Homo Sapiens
YCSIIFLGV

SEQ ID NO: 209786 - protein, 9 aa, Homo Sapiens
YCFVYSQDW

SEQ ID NO: 209787 - protein, 9 aa, Homo Sapiens
VIEMRDHKD

SEQ ID NO: 209788 - protein, 9 aa, Homo Sapiens
VWLVTIIRY

SEQ ID NO: 209789 - protein, 9 aa, Homo Sapiens
EERNQNLVL

SEQ ID NO: 209790 - protein, 9 aa, Homo Sapiens
LIPRYVRDL

SEQ ID NO: 209791 - protein, 9 aa, Homo Sapiens
FLLWGSLEN

SEQ ID NO: 209792 - protein, 9 aa, Homo Sapiens
FQVWDDSSG

SEQ ID NO: 209793 - protein, 9 aa, Homo Sapiens
CYKTKRKQL

SEQ ID NO: 209794 - protein, 9 aa, Homo Sapiens
VVGADGVGK

SEQ ID NO: 209795 - protein, 9 aa, Homo Sapiens
CLTVVDTPG

SEQ ID NO: 209796 - protein, 9 aa, Homo Sapiens
LRCVHPSRP

SEQ ID NO: 209797 - protein, 9 aa, Homo Sapiens
EERGVKLCL

SEQ ID NO: 209798 - protein, 9 aa, Homo Sapiens
ALKTIQKAV

SEQ ID NO: 209799 - protein, 9 aa, Homo Sapiens
QTLKLLVTR

SEQ ID NO: 209800 - protein, 9 aa, Homo Sapiens
NPEPTFLWT

SEQ ID NO: 209801 - protein, 9 aa, Homo Sapiens
DPLSEITKQ

SEQ ID NO: 209802 - protein, 9 aa, Homo Sapiens
RNTCAQFSN

SEQ ID NO: 209803 - protein, 9 aa, Homo Sapiens
YSLCNKEVF

SEQ ID NO: 209804 - protein, 9 aa, Homo Sapiens
HSKYHGYPY

SEQ ID NO: 209805 - protein, 9 aa, Homo Sapiens
VTTKIVELS

SEQ ID NO: 209806 - protein, 9 aa, Homo Sapiens
TIKKNTEFE

SEQ ID NO: 209807 - protein, 9 aa, Homo Sapiens
GNRNTCAQF

SEQ ID NO: 209808 - protein, 9 aa, Homo Sapiens
PEYWRSIAY

SEQ ID NO: 209809 - protein, 9 aa, Homo Sapiens
WKLREKFPC

SEQ ID NO: 209810 - protein, 9 aa, Homo Sapiens
LAYCSIIFL

SEQ ID NO: 209811 - protein, 9 aa, Homo Sapiens
SQIFPPTTR

SEQ ID NO: 209812 - protein, 9 aa, Homo Sapiens
TKQPQDLTE

SEQ ID NO: 209813 - protein, 9 aa, Homo Sapiens
KMRLQLDAS

SEQ ID NO: 209814 - protein, 9 aa, Homo Sapiens
SSLEVMHEM

SEQ ID NO: 209815 - protein, 9 aa, Homo Sapiens
GIRCCGSPF

SEQ ID NO: 209816 - protein, 9 aa, Homo Sapiens
SGLSLKSCA

SEQ ID NO: 209817 - protein, 9 aa, Homo Sapiens
CNDCVDGSD

SEQ ID NO: 209818 - protein, 9 aa, Homo Sapiens
LCLTVVDTP

SEQ ID NO: 209819 - protein, 9 aa, Homo Sapiens
QNCCIVILR

SEQ ID NO: 209820 - protein, 9 aa, Homo Sapiens
EKLRCVHPS

SEQ ID NO: 209821 - protein, 9 aa, Homo Sapiens
FGILCITNS

SEQ ID NO: 209822 - protein, 9 aa, Homo Sapiens
KVRPNQNCC

SEQ ID NO: 209823 - protein, 9 aa, Homo Sapiens
TTRGAELMC

SEQ ID NO: 209824 - protein, 9 aa, Homo Sapiens
PLIYSLCNK

SEQ ID NO: 209825 - protein, 9 aa, Homo Sapiens
AGVAGDVVT

SEQ ID NO: 209826 - protein, 9 aa, Homo Sapiens
KLCLTVVDT

SEQ ID NO: 209827 - protein, 9 aa, Homo Sapiens
SASYIELQT

SEQ ID NO: 209828 - protein, 9 aa, Homo Sapiens
FSVALLGGG

SEQ ID NO: 209829 - protein, 9 aa, Homo Sapiens
LNNIRHIRP

SEQ ID NO: 209830 - protein, 9 aa, Homo Sapiens
MRDHKDGGI

SEQ ID NO: 209831 - protein, 9 aa, Homo Sapiens
EHDSPENGA

SEQ ID NO: 209832 - protein, 9 aa, Homo Sapiens
DHFSHPKFV

SEQ ID NO: 209833 - protein, 9 aa, Homo Sapiens
LVLELETVQ

SEQ ID NO: 209834 - protein, 9 aa, Homo Sapiens
SGVVRPNGH

SEQ ID NO: 209835 - protein, 9 aa, Homo Sapiens
DLMKAAHNN

SEQ ID NO: 209836 - protein, 9 aa, Homo Sapiens
KIANNVQYP

SEQ ID NO: 209837 - protein, 9 aa, Homo Sapiens
RDPLSEITK

SEQ ID NO: 209838 - protein, 9 aa, Homo Sapiens
DGEKEKTEQ

SEQ ID NO: 209839 - protein, 9 aa, Homo Sapiens
HFGLLLLLR

SEQ ID NO: 209840 - protein, 9 aa, Homo Sapiens
CTRVSVFVD

SEQ ID NO: 209841 - protein, 9 aa, Homo Sapiens
MGMKFFQIK

SEQ ID NO: 209842 - protein, 9 aa, Homo Sapiens
KAMTKKKRV

SEQ ID NO: 209843 - protein, 9 aa, Homo Sapiens
DHKDGGIQL

SEQ ID NO: 209844 - protein, 9 aa, Homo Sapiens
IQKAVLLSP

SEQ ID NO: 209845 - protein, 9 aa, Homo Sapiens
SEITKQEKD

SEQ ID NO: 209846 - protein, 9 aa, Homo Sapiens
MVEKRVQQL

SEQ ID NO: 209847 - protein, 9 aa, Homo Sapiens
GTHQEKKES

SEQ ID NO: 209848 - protein, 9 aa, Homo Sapiens
DSGRNAVIA

SEQ ID NO: 209849 - protein, 9 aa, Homo Sapiens
TTSSITSCY

SEQ ID NO: 209850 - protein, 9 aa, Homo Sapiens
AHWRCDKCN

SEQ ID NO: 209851 - protein, 9 aa, Homo Sapiens
DEERDYEED

SEQ ID NO: 209852 - protein, 9 aa, Homo Sapiens
ILNNIRHIR

SEQ ID NO: 209853 - protein, 9 aa, Homo Sapiens
AFVKQSLKC

SEQ ID NO: 209854 - protein, 9 aa, Homo Sapiens
ASAHGGLEE

SEQ ID NO: 209855 - protein, 9 aa, Homo Sapiens
ISMNEKFDL

SEQ ID NO: 209856 - protein, 9 aa, Homo Sapiens
LKKQRRKQK

SEQ ID NO: 209857 - protein, 9 aa, Homo Sapiens
KRWAVSPKS

SEQ ID NO: 209858 - protein, 9 aa, Homo Sapiens
QIKMYPVED

SEQ ID NO: 209859 - protein, 9 aa, Homo Sapiens
FIELQKIYG

SEQ ID NO: 209860 - protein, 9 aa, Homo Sapiens
VSLMYVRFS

SEQ ID NO: 209861 - protein, 9 aa, Homo Sapiens
MKFFQIKMY

SEQ ID NO: 209862 - protein, 9 aa, Homo Sapiens
KVYGLSEAF

SEQ ID NO: 209863 - protein, 9 aa, Homo Sapiens
YIPTVEEIV

SEQ ID NO: 209864 - protein, 9 aa, Homo Sapiens
RPNQNCCIV

SEQ ID NO: 209865 - protein, 9 aa, Homo Sapiens
LNKKTKQPQ

SEQ ID NO: 209866 - protein, 9 aa, Homo Sapiens
FLGVIGNSL

SEQ ID NO: 209867 - protein, 9 aa, Homo Sapiens
VCNRFKLPP

SEQ ID NO: 209868 - protein, 9 aa, Homo Sapiens
PAYAAQNGL

SEQ ID NO: 209869 - protein, 9 aa, Homo Sapiens
KTAFILLSI

SEQ ID NO: 209870 - protein, 9 aa, Homo Sapiens
GLPSWQYQC

SEQ ID NO: 209871 - protein, 9 aa, Homo Sapiens
NLHSFQVWD

SEQ ID NO: 209872 - protein, 9 aa, Homo Sapiens
GKAFVKQSL

SEQ ID NO: 209873 - protein, 9 aa, Homo Sapiens
GFILNNIRH

SEQ ID NO: 209874 - protein, 9 aa, Homo Sapiens
KNTEFEDQG

SEQ ID NO: 209875 - protein, 9 aa, Homo Sapiens
NTAWKTKKT

SEQ ID NO: 209876 - protein, 9 aa, Homo Sapiens
AQNRGIEGT

SEQ ID NO: 209877 - protein, 9 aa, Homo Sapiens
AKQITGFME

SEQ ID NO: 209878 - protein, 9 aa, Homo Sapiens
KTEQDKNQS

SEQ ID NO: 209879 - protein, 9 aa, Homo Sapiens
LESASYIEL

SEQ ID NO: 209880 - protein, 9 aa, Homo Sapiens
KKTKQPQDL

SEQ ID NO: 209881 - protein, 9 aa, Homo Sapiens
IRGNRNTCA

SEQ ID NO: 209882 - protein, 9 aa, Homo Sapiens
QPQDLTEEK

SEQ ID NO: 209883 - protein, 9 aa, Homo Sapiens
EEEEDEERD

SEQ ID NO: 209884 - protein, 9 aa, Homo Sapiens
WPAVCTRVS

SEQ ID NO: 209885 - protein, 9 aa, Homo Sapiens
GILCITNSY

SEQ ID NO: 209886 - protein, 9 aa, Homo Sapiens
IFPPTTRGA

SEQ ID NO: 209887 - protein, 9 aa, Homo Sapiens
NKKTKQPQD

SEQ ID NO: 209888 - protein, 9 aa, Homo Sapiens
ASTGQLTVP

SEQ ID NO: 209889 - protein, 9 aa, Homo Sapiens
LWKDIFTIS

SEQ ID NO: 209890 - protein, 9 aa, Homo Sapiens
LSIFHSKYH

SEQ ID NO: 209891 - protein, 9 aa, Homo Sapiens
LLLLRQQAK

SEQ ID NO: 209892 - protein, 9 aa, Homo Sapiens
FVYSQDWAP

SEQ ID NO: 209893 - protein, 9 aa, Homo Sapiens
QWLDARQVY

SEQ ID NO: 209894 - protein, 9 aa, Homo Sapiens
KTKKTSFSL

SEQ ID NO: 209895 - protein, 9 aa, Homo Sapiens
LVSGLPAYA

SEQ ID NO: 209896 - protein, 9 aa, Homo Sapiens
LNPLIYSLC

SEQ ID NO: 209897 - protein, 9 aa, Homo Sapiens
ALCCFLLWG

SEQ ID NO: 209898 - protein, 9 aa, Homo Sapiens
MQHQPNRRR

SEQ ID NO: 209899 - protein, 9 aa, Homo Sapiens
WDDSSGDRD

SEQ ID NO: 209900 - protein, 9 aa, Homo Sapiens
MSVRFKLPN

SEQ ID NO: 209901 - protein, 9 aa, Homo Sapiens
LLIWGFGIL

SEQ ID NO: 209902 - protein, 9 aa, Homo Sapiens
KKRVNTAWK

SEQ ID NO: 209903 - protein, 9 aa, Homo Sapiens
KRVNTAWKT

SEQ ID NO: 209904 - protein, 9 aa, Homo Sapiens
WKTKKTSFS

SEQ ID NO: 209905 - protein, 9 aa, Homo Sapiens
QIFPPTTRG

SEQ ID NO: 209906 - protein, 9 aa, Homo Sapiens
LEYIPTVEE

SEQ ID NO: 209907 - protein, 9 aa, Homo Sapiens
LMYVRFSDT

SEQ ID NO: 209908 - protein, 9 aa, Homo Sapiens
RNQNLVLEL

SEQ ID NO: 209909 - protein, 9 aa, Homo Sapiens
PEMHTLAGA

SEQ ID NO: 209910 - protein, 9 aa, Homo Sapiens
SYIELQTTN

SEQ ID NO: 209911 - protein, 9 aa, Homo Sapiens
YQCIHFFLA

SEQ ID NO: 209912 - protein, 9 aa, Homo Sapiens
LLRQQAKNG

SEQ ID NO: 209913 - protein, 9 aa, Homo Sapiens
ADWPEMHTL

SEQ ID NO: 209914 - protein, 9 aa, Homo Sapiens
MKAAHNNSE

SEQ ID NO: 209915 - protein, 9 aa, Homo Sapiens
DSESELFSG

SEQ ID NO: 209916 - protein, 9 aa, Homo Sapiens
LWGSLENTL

SEQ ID NO: 209917 - protein, 9 aa, Homo Sapiens
GSGYCGDDI

SEQ ID NO: 209918 - protein, 9 aa, Homo Sapiens
NGGTHQEKK

SEQ ID NO: 209919 - protein, 9 aa, Homo Sapiens
GRNAVIAYT

SEQ ID NO: 209920 - protein, 9 aa, Homo Sapiens
PTFIELQKI

SEQ ID NO: 209921 - protein, 9 aa, Homo Sapiens
VSGLSLKSC

SEQ ID NO: 209922 - protein, 9 aa, Homo Sapiens
TAFILLSIL

SEQ ID NO: 209923 - protein, 9 aa, Homo Sapiens
PNGHSQGAP

SEQ ID NO: 209924 - protein, 9 aa, Homo Sapiens
LIYSLCNKE

SEQ ID NO: 209925 - protein, 9 aa, Homo Sapiens
TLYTVSISA

SEQ ID NO: 209926 - protein, 9 aa, Homo Sapiens
VRFSDTYPP

SEQ ID NO: 209927 - protein, 9 aa, Homo Sapiens
GDVVTTKIV

SEQ ID NO: 209928 - protein, 9 aa, Homo Sapiens
MRLQLDASG

SEQ ID NO: 209929 - protein, 9 aa, Homo Sapiens
CCFLLWGSL

SEQ ID NO: 209930 - protein, 9 aa, Homo Sapiens
GYCGDDIIQ

SEQ ID NO: 209931 - protein, 9 aa, Homo Sapiens
PSPASIFEV

SEQ ID NO: 209932 - protein, 9 aa, Homo Sapiens
MPSPTFIEL

SEQ ID NO: 209933 - protein, 9 aa, Homo Sapiens
KEKTEQDKN

SEQ ID NO: 209934 - protein, 9 aa, Homo Sapiens
EVMPSWAQN

SEQ ID NO: 209935 - protein, 9 aa, Homo Sapiens
HFSHPKFVE

SEQ ID NO: 209936 - protein, 9 aa, Homo Sapiens
RSDEDSESE

SEQ ID NO: 209937 - protein, 9 aa, Homo Sapiens
ALIRGNRNT

SEQ ID NO: 209938 - protein, 9 aa, Homo Sapiens
KKASTGQLT

SEQ ID NO: 209939 - protein, 9 aa, Homo Sapiens
VNTAWKTKK

SEQ ID NO: 209940 - protein, 9 aa, Homo Sapiens
VQASAHGGL

SEQ ID NO: 209941 - protein, 9 aa, Homo Sapiens
IYLIPRYVR

SEQ ID NO: 209942 - protein, 9 aa, Homo Sapiens
FVKQSLKCI

SEQ ID NO: 209943 - protein, 9 aa, Homo Sapiens
RLQLDASGE

SEQ ID NO: 209944 - protein, 9 aa, Homo Sapiens
NRGIEGTYA

SEQ ID NO: 209945 - protein, 9 aa, Homo Sapiens
QAWVWEHHP

SEQ ID NO: 209946 - protein, 9 aa, Homo Sapiens
ADSGRNAVI

SEQ ID NO: 209947 - protein, 9 aa, Homo Sapiens
IKSIVPMIH

SEQ ID NO: 209948 - protein, 9 aa, Homo Sapiens
ATPTFHQWL

SEQ ID NO: 209949 - protein, 9 aa, Homo Sapiens
VRPNQNCCI

SEQ ID NO: 209950 - protein, 9 aa, Homo Sapiens
NTCAQFSNN

SEQ ID NO: 209951 - protein, 9 aa, Homo Sapiens
DSSLEVMHE

SEQ ID NO: 209952 - protein, 9 aa, Homo Sapiens
LNDIVMYFS

SEQ ID NO: 209953 - protein, 9 aa, Homo Sapiens
AWKTKKTSF

SEQ ID NO: 209954 - protein, 9 aa, Homo Sapiens
PPTTRGAEL

SEQ ID NO: 209955 - protein, 9 aa, Homo Sapiens
IGYSNKWYL

SEQ ID NO: 209956 - protein, 9 aa, Homo Sapiens
DVQFPSPAS

SEQ ID NO: 209957 - protein, 9 aa, Homo Sapiens
FHQWLDARQ

SEQ ID NO: 209958 - protein, 9 aa, Homo Sapiens
KQDSRSDED

SEQ ID NO: 209959 - protein, 9 aa, Homo Sapiens
DVVTTKIVE

SEQ ID NO: 209960 - protein, 9 aa, Homo Sapiens
HSGVVRPNG

SEQ ID NO: 209961 - protein, 9 aa, Homo Sapiens
RCYKTKRKQ

SEQ ID NO: 209962 - protein, 9 aa, Homo Sapiens
LEENMTSDI

SEQ ID NO: 209963 - protein, 9 aa, Homo Sapiens
TAADWPEMH

SEQ ID NO: 209964 - protein, 9 aa, Homo Sapiens
SISSSNFKP

SEQ ID NO: 209965 - protein, 9 aa, Homo Sapiens
IAFLEQGGI

SEQ ID NO: 209966 - protein, 9 aa, Homo Sapiens
AKMRLQLDA

SEQ ID NO: 209967 - protein, 9 aa, Homo Sapiens
PSPTFIELQ

SEQ ID NO: 209968 - protein, 9 aa, Homo Sapiens
QNRGIEGTY

SEQ ID NO: 209969 - protein, 9 aa, Homo Sapiens
ISSSNFKPR

SEQ ID NO: 209970 - protein, 9 aa, Homo Sapiens
APESSNTEA

SEQ ID NO: 209971 - protein, 9 aa, Homo Sapiens
KKKRVNTAW

SEQ ID NO: 209972 - protein, 9 aa, Homo Sapiens
HTLAGAFDS

SEQ ID NO: 209973 - protein, 9 aa, Homo Sapiens
EDEERDYEE

SEQ ID NO: 209974 - protein, 9 aa, Homo Sapiens
LLLRQQAKN

SEQ ID NO: 209975 - protein, 9 aa, Homo Sapiens
QPHGGDLMK

SEQ ID NO: 209976 - protein, 9 aa, Homo Sapiens
PPHKRKLQA

SEQ ID NO: 209977 - protein, 9 aa, Homo Sapiens
WPEMHTLAG

SEQ ID NO: 209978 - protein, 9 aa, Homo Sapiens
LQAPATDNS

SEQ ID NO: 209979 - protein, 9 aa, Homo Sapiens
EEDEERDYE

SEQ ID NO: 209980 - protein, 9 aa, Homo Sapiens
VWDDSSGDR

SEQ ID NO: 209981 - protein, 9 aa, Homo Sapiens
SQTLYTVSI

SEQ ID NO: 209982 - protein, 9 aa, Homo Sapiens
FIKHFIIYL

SEQ ID NO: 209983 - protein, 9 aa, Homo Sapiens
QDSRSDEDS

SEQ ID NO: 209984 - protein, 9 aa, Homo Sapiens
AHGGLEENM

SEQ ID NO: 209985 - protein, 9 aa, Homo Sapiens
TFHQWLDAR

SEQ ID NO: 209986 - protein, 9 aa, Homo Sapiens
FLEYIPTVE

SEQ ID NO: 209987 - protein, 9 aa, Homo Sapiens
LTEMVEKRV

SEQ ID NO: 209988 - protein, 9 aa, Homo Sapiens
SGRNAVIAY

SEQ ID NO: 209989 - protein, 9 aa, Homo Sapiens
TAEEIRETV

SEQ ID NO: 209990 - protein, 9 aa, Homo Sapiens
AKGNLCPPA

SEQ ID NO: 209991 - protein, 9 aa, Homo Sapiens
TPTFHQWLD

SEQ ID NO: 209992 - protein, 9 aa, Homo Sapiens
PAPEYWRSI

SEQ ID NO: 209993 - protein, 9 aa, Homo Sapiens
KAFVKQSLK

SEQ ID NO: 209994 - protein, 9 aa, Homo Sapiens
AMTKKKRVN

SEQ ID NO: 209995 - protein, 9 aa, Homo Sapiens
SRWPAVCTR

SEQ ID NO: 209996 - protein, 9 aa, Homo Sapiens
LCNKEVFRA

SEQ ID NO: 209997 - protein, 9 aa, Homo Sapiens
SFQVWDDSS

SEQ ID NO: 209998 - protein, 9 aa, Homo Sapiens
YVVEFAKQI

SEQ ID NO: 209999 - protein, 9 aa, Homo Sapiens
EVMHEMDDY

SEQ ID NO: 210000 - protein, 9 aa, Homo Sapiens
NATDADSGR

SEQ ID NO: 210001 - protein, 9 aa, Homo Sapiens
FPPTTRGAE

SEQ ID NO: 210002 - protein, 9 aa, Homo Sapiens
PSWAQNRGI

SEQ ID NO: 210003 - protein, 9 aa, Homo Sapiens
LCPPANETR

SEQ ID NO: 210004 - protein, 9 aa, Homo Sapiens
NEVKNIKSI

SEQ ID NO: 210005 - protein, 9 aa, Homo Sapiens
SVSLMYVRF

SEQ ID NO: 210006 - protein, 9 aa, Homo Sapiens
LDKVVSGLS

SEQ ID NO: 210007 - protein, 9 aa, Homo Sapiens
RQQAKNGVM

SEQ ID NO: 210008 - protein, 9 aa, Homo Sapiens
YSNKWYLNR

SEQ ID NO: 210009 - protein, 9 aa, Homo Sapiens
AFLEQGGIR

SEQ ID NO: 210010 - protein, 9 aa, Homo Sapiens
NRLDDVCNR

SEQ ID NO: 210011 - protein, 9 aa, Homo Sapiens
LGSMSVRFK

SEQ ID NO: 210012 - protein, 9 aa, Homo Sapiens
VMPSWAQNR

SEQ ID NO: 210013 - protein, 9 aa, Homo Sapiens
GLKKQRRKQ

SEQ ID NO: 210014 - protein, 9 aa, Homo Sapiens
NNSGTPKEH

SEQ ID NO: 210015 - protein, 9 aa, Homo Sapiens
EWKLREKFP

SEQ ID NO: 210016 - protein, 9 aa, Homo Sapiens
ISAVHDEGE

SEQ ID NO: 210017 - protein, 9 aa, Homo Sapiens
TIIRYTLGI

SEQ ID NO: 210018 - protein, 9 aa, Homo Sapiens
KKKKKKVLL

SEQ ID NO: 210019 - protein, 9 aa, Homo Sapiens
KEWKLREKF

SEQ ID NO: 210020 - protein, 9 aa, Homo Sapiens
GEKEKTEQD

SEQ ID NO: 210021 - protein, 9 aa, Homo Sapiens
FDNMAKMRL

SEQ ID NO: 210022 - protein, 9 aa, Homo Sapiens
KHFIIYLIP

SEQ ID NO: 210023 - protein, 9 aa, Homo Sapiens
WISVTAEEI

SEQ ID NO: 210024 - protein, 9 aa, Homo Sapiens
RGNRNTCAQ

SEQ ID NO: 210025 - protein, 9 aa, Homo Sapiens
VQQLQSDEL

SEQ ID NO: 210026 - protein, 9 aa, Homo Sapiens
LSEITKQEK

SEQ ID NO: 210027 - protein, 9 aa, Homo Sapiens
RDYEEDDYD

SEQ ID NO: 210028 - protein, 9 aa, Homo Sapiens
GLWKDIFTI

SEQ ID NO: 210029 - protein, 9 aa, Homo Sapiens
PTFHQWLDA

SEQ ID NO: 210030 - protein, 9 aa, Homo Sapiens
QERKEWKLR

SEQ ID NO: 210031 - protein, 9 aa, Homo Sapiens
EMHTLAGAF

SEQ ID NO: 210032 - protein, 9 aa, Homo Sapiens
KTKQPQDLT

SEQ ID NO: 210033 - protein, 9 aa, Homo Sapiens
RWPAVCTRV

SEQ ID NO: 210034 - protein, 9 aa, Homo Sapiens
TGNKIANNV

SEQ ID NO: 210035 - protein, 9 aa, Homo Sapiens
LQAWVWEHH

SEQ ID NO: 210036 - protein, 9 aa, Homo Sapiens
QYVVEFAKQ

SEQ ID NO: 210037 - protein, 9 aa, Homo Sapiens
MTKKKRVNT

SEQ ID NO: 210038 - protein, 9 aa, Homo Sapiens
LLSIFHSKY

SEQ ID NO: 210039 - protein, 9 aa, Homo Sapiens
PAVCTRVSV

SEQ ID NO: 210040 - protein, 9 aa, Homo Sapiens
FDHFSHPKF

SEQ ID NO: 210041 - protein, 9 aa, Homo Sapiens
KLVVVGADG

SEQ ID NO: 210042 - protein, 9 aa, Homo Sapiens
GLLLLLRQQ

SEQ ID NO: 210043 - protein, 9 aa, Homo Sapiens
THQEKKEST

SEQ ID NO: 210044 - protein, 9 aa, Homo Sapiens
LCENAYFSE

SEQ ID NO: 210045 - protein, 9 aa, Homo Sapiens
GVAGDVVTT

SEQ ID NO: 210046 - protein, 9 aa, Homo Sapiens
EELQAWVWE

SEQ ID NO: 210047 - protein, 9 aa, Homo Sapiens
RKEWKLREK

SEQ ID NO: 210048 - protein, 9 aa, Homo Sapiens
TVSISAVHD

SEQ ID NO: 210049 - protein, 9 aa, Homo Sapiens
EMAKKASTG

SEQ ID NO: 210050 - protein, 9 aa, Homo Sapiens
IEMRDHKDG

SEQ ID NO: 210051 - protein, 9 aa, Homo Sapiens
SWAQNRGIE

SEQ ID NO: 210052 - protein, 9 aa, Homo Sapiens
GHMQHQPNR

SEQ ID NO: 210053 - protein, 9 aa, Homo Sapiens
DSRSDEDSE

SEQ ID NO: 210054 - protein, 9 aa, Homo Sapiens
NKIANNVQY

SEQ ID NO: 210055 - protein, 9 aa, Homo Sapiens
KQITGFMEL

SEQ ID NO: 210056 - protein, 9 aa, Homo Sapiens
QASAHGGLE

SEQ ID NO: 210057 - protein, 9 aa, Homo Sapiens
LPKILYERD

SEQ ID NO: 210058 - protein, 9 aa, Homo Sapiens
FTISMNEKF

SEQ ID NO: 210059 - protein, 9 aa, Homo Sapiens
GQKKKKKKV

SEQ ID NO: 210060 - protein, 9 aa, Homo Sapiens
QTLYTVSIS

SEQ ID NO: 210061 - protein, 9 aa, Homo Sapiens
GNPEPTFLW

SEQ ID NO: 210062 - protein, 9 aa, Homo Sapiens
VSPKSFTLD

SEQ ID NO: 210063 - protein, 9 aa, Homo Sapiens
YSQDWAPTA

SEQ ID NO: 210064 - protein, 9 aa, Homo Sapiens
FLLSIFHSK

SEQ ID NO: 210065 - protein, 9 aa, Homo Sapiens
FQNRCYKTK

SEQ ID NO: 210066 - protein, 9 aa, Homo Sapiens
AFMPSPTFI

SEQ ID NO: 210067 - protein, 9 aa, Homo Sapiens
FSEISARKG

SEQ ID NO: 210068 - protein, 9 aa, Homo Sapiens
HPSRPPRGF

SEQ ID NO: 210069 - protein, 9 aa, Homo Sapiens
RKLQAPATD

SEQ ID NO: 210070 - protein, 9 aa, Homo Sapiens
QGGIRCCGS

SEQ ID NO: 210071 - protein, 9 aa, Homo Sapiens
EVKNIKSIV

SEQ ID NO: 210072 - protein, 9 aa, Homo Sapiens
MVWLVTIIR

SEQ ID NO: 210073 - protein, 9 aa, Homo Sapiens
ALRYTNSCL

SEQ ID NO: 210074 - protein, 9 aa, Homo Sapiens
GTTVAPESS

SEQ ID NO: 210075 - protein, 9 aa, Homo Sapiens
TLKLLVTRN

SEQ ID NO: 210076 - protein, 9 aa, Homo Sapiens
YVRFSDTYP

SEQ ID NO: 210077 - protein, 9 aa, Homo Sapiens
NRRRQPVSP

SEQ ID NO: 210078 - protein, 9 aa, Homo Sapiens
PLSEITKQE

SEQ ID NO: 210079 - protein, 9 aa, Homo Sapiens
TVQERKEWK

SEQ ID NO: 210080 - protein, 9 aa, Homo Sapiens
YEWNEVKNI

SEQ ID NO: 210081 - protein, 9 aa, Homo Sapiens
NGHSQGAPN

SEQ ID NO: 210082 - protein, 9 aa, Homo Sapiens
KKKKKVLLE

SEQ ID NO: 210083 - protein, 9 aa, Homo Sapiens
YTCFLEYIP

SEQ ID NO: 210084 - protein, 9 aa, Homo Sapiens
PTFLWTKDG

SEQ ID NO: 210085 - protein, 9 aa, Homo Sapiens
GGTHQEKKE

SEQ ID NO: 210086 - protein, 9 aa, Homo Sapiens
WGSLENTLG

SEQ ID NO: 210087 - protein, 9 aa, Homo Sapiens
KLQAPATDN

SEQ ID NO: 210088 - protein, 9 aa, Homo Sapiens
TRNVSLELS

SEQ ID NO: 210089 - protein, 9 aa, Homo Sapiens
KNIKSIVPM

SEQ ID NO: 210090 - protein, 9 aa, Homo Sapiens
FHSKYHGYP

SEQ ID NO: 210091 - protein, 9 aa, Homo Sapiens
ELQAWVWEH

SEQ ID NO: 210092 - protein, 9 aa, Homo Sapiens
TGHMQHQPN

SEQ ID NO: 210093 - protein, 9 aa, Homo Sapiens
ENAYFSEIS

SEQ ID NO: 210094 - protein, 9 aa, Homo Sapiens
SSNFKPREA

SEQ ID NO: 210095 - protein, 9 aa, Homo Sapiens
VLCENAYFS

SEQ ID NO: 210096 - protein, 9 aa, Homo Sapiens
TEQDKNQSS

SEQ ID NO: 210097 - protein, 9 aa, Homo Sapiens
LCCFLLWGS

SEQ ID NO: 210098 - protein, 9 aa, Homo Sapiens
TSSLESASY

SEQ ID NO: 210099 - protein, 9 aa, Homo Sapiens
KLDKVVSGL

SEQ ID NO: 210100 - protein, 9 aa, Homo Sapiens
GFGILCITN

SEQ ID NO: 210101 - protein, 9 aa, Homo Sapiens
LQLDASGEP

SEQ ID NO: 210102 - protein, 9 aa, Homo Sapiens
EKRVQQLQS

SEQ ID NO: 210103 - protein, 9 aa, Homo Sapiens
HWRCDKCND

SEQ ID NO: 210104 - protein, 9 aa, Homo Sapiens
LVVVGADGV

SEQ ID NO: 210105 - protein, 9 aa, Homo Sapiens
WAVSPKSFT

SEQ ID NO: 210106 - protein, 9 aa, Homo Sapiens
KGNLCPPAN

SEQ ID NO: 210107 - protein, 9 aa, Homo Sapiens
YFSVALLGG

SEQ ID NO: 210108 - protein, 9 aa, Homo Sapiens
AGDVVTTKI

SEQ ID NO: 210109 - protein, 9 aa, Homo Sapiens
VALCCFLLW

SEQ ID NO: 210110 - protein, 9 aa, Homo Sapiens
IFLGVIGNS

SEQ ID NO: 210111 - protein, 9 aa, Homo Sapiens
LWTKDGNPF

SEQ ID NO: 210112 - protein, 9 aa, Homo Sapiens
KLENGGTHQ

SEQ ID NO: 210113 - protein, 9 aa, Homo Sapiens
PANETRKCT

SEQ ID NO: 210114 - protein, 9 aa, Homo Sapiens
HGSGYCGDD

SEQ ID NO: 210115 - protein, 9 aa, Homo Sapiens
DKVVSGLSL

SEQ ID NO: 210116 - protein, 9 aa, Homo Sapiens
VQFPSPASI

SEQ ID NO: 210117 - protein, 9 aa, Homo Sapiens
IVMYFSVAL

SEQ ID NO: 210118 - protein, 9 aa, Homo Sapiens
QEKKESTPS

SEQ ID NO: 210119 - protein, 9 aa, Homo Sapiens
NCCIVILRE

SEQ ID NO: 210120 - protein, 9 aa, Homo Sapiens
YKLVVVGAD

SEQ ID NO: 210121 - protein, 9 aa, Homo Sapiens
WQYQCIHFF

SEQ ID NO: 210122 - protein, 9 aa, Homo Sapiens
HKRKLQAPA

SEQ ID NO: 210123 - protein, 9 aa, Homo Sapiens
VMHEMDDYG

SEQ ID NO: 210124 - protein, 9 aa, Homo Sapiens
QNLVLELET

SEQ ID NO: 210125 - protein, 9 aa, Homo Sapiens
LSLKSCALS

SEQ ID NO: 210126 - protein, 9 aa, Homo Sapiens
IEGQKKKKK

SEQ ID NO: 210127 - protein, 9 aa, Homo Sapiens
AKKASTGQL

SEQ ID NO: 210128 - protein, 9 aa, Homo Sapiens
AEEGGSSPI

SEQ ID NO: 210129 - protein, 9 aa, Homo Sapiens
EPQKCPECG

SEQ ID NO: 210130 - protein, 9 aa, Homo Sapiens
GPRGPAGGG

SEQ ID NO: 210131 - protein, 9 aa, Homo Sapiens
AFDPLPISP

SEQ ID NO: 210132 - protein, 9 aa, Homo Sapiens
LFIRNIIMH

SEQ ID NO: 210133 - protein, 9 aa, Homo Sapiens
LKKDPVVPE

SEQ ID NO: 210134 - protein, 9 aa, Homo Sapiens
GASTTGSLF

SEQ ID NO: 210135 - protein, 9 aa, Homo Sapiens
IGEIHKVQY

SEQ ID NO: 210136 - protein, 9 aa, Homo Sapiens
LSSSGPNSK

SEQ ID NO: 210137 - protein, 9 aa, Homo Sapiens
IAENKDAFC

SEQ ID NO: 210138 - protein, 9 aa, Homo Sapiens
TICCCCCWA

SEQ ID NO: 210139 - protein, 9 aa, Homo Sapiens
EEHGVERAE

SEQ ID NO: 210140 - protein, 9 aa, Homo Sapiens
GLNLPSVLT

SEQ ID NO: 210141 - protein, 9 aa, Homo Sapiens
RFHFISNNC

SEQ ID NO: 210142 - protein, 9 aa, Homo Sapiens
IAIQSKGQY

SEQ ID NO: 210143 - protein, 9 aa, Homo Sapiens
HSFNRPERL

SEQ ID NO: 210144 - protein, 9 aa, Homo Sapiens
ISNNCIKLN

SEQ ID NO: 210145 - protein, 9 aa, Homo Sapiens
QDSQSYRKK

SEQ ID NO: 210146 - protein, 9 aa, Homo Sapiens
TAINKASRD

SEQ ID NO: 210147 - protein, 9 aa, Homo Sapiens
LLSGVCSRS

SEQ ID NO: 210148 - protein, 9 aa, Homo Sapiens
KKEGLQSSR

SEQ ID NO: 210149 - protein, 9 aa, Homo Sapiens
LAATGLNLP

SEQ ID NO: 210150 - protein, 9 aa, Homo Sapiens
VQSNTYETK

SEQ ID NO: 210151 - protein, 9 aa, Homo Sapiens
TYTEIKRVA

SEQ ID NO: 210152 - protein, 9 aa, Homo Sapiens
RHCPPARWV

SEQ ID NO: 210153 - protein, 9 aa, Homo Sapiens
HYKTLGSND

SEQ ID NO: 210154 - protein, 9 aa, Homo Sapiens
PTGLYELDG

SEQ ID NO: 210155 - protein, 9 aa, Homo Sapiens
VDPIIYVLA

SEQ ID NO: 210156 - protein, 9 aa, Homo Sapiens
NQIQQTAGF

SEQ ID NO: 210157 - protein, 9 aa, Homo Sapiens
MLDGAGGGP

SEQ ID NO: 210158 - protein, 9 aa, Homo Sapiens
TPQHGLSAL

SEQ ID NO: 210159 - protein, 9 aa, Homo Sapiens
FAENMYLEC

SEQ ID NO: 210160 - protein, 9 aa, Homo Sapiens
KIHACSMSV

SEQ ID NO: 210161 - protein, 9 aa, Homo Sapiens
GSNDTYIAK

SEQ ID NO: 210162 - protein, 9 aa, Homo Sapiens
IRYFMQEDI

SEQ ID NO: 210163 - protein, 9 aa, Homo Sapiens
LSGVCSRSY

SEQ ID NO: 210164 - protein, 9 aa, Homo Sapiens
WVAIKSQPP

SEQ ID NO: 210165 - protein, 9 aa, Homo Sapiens
PLNFTANPP

SEQ ID NO: 210166 - protein, 9 aa, Homo Sapiens
TVGSFLQDV

SEQ ID NO: 210167 - protein, 9 aa, Homo Sapiens
LLSGLMESL

SEQ ID NO: 210168 - protein, 9 aa, Homo Sapiens
WEKVAPERN

SEQ ID NO: 210169 - protein, 9 aa, Homo Sapiens
VHPEDCEKG

SEQ ID NO: 210170 - protein, 9 aa, Homo Sapiens
EYQHSFNRP

SEQ ID NO: 210171 - protein, 9 aa, Homo Sapiens
TLGSNDTYI

SEQ ID NO: 210172 - protein, 9 aa, Homo Sapiens
NSKLYMKLV

SEQ ID NO: 210173 - protein, 9 aa, Homo Sapiens
KMKKEGLQS

SEQ ID NO: 210174 - protein, 9 aa, Homo Sapiens
PDLTDSFTR

SEQ ID NO: 210175 - protein, 9 aa, Homo Sapiens
GSIFIWASG

SEQ ID NO: 210176 - protein, 9 aa, Homo Sapiens
LEVYRPIRK

SEQ ID NO: 210177 - protein, 9 aa, Homo Sapiens
TAMQFKIVY

SEQ ID NO: 210178 - protein, 9 aa, Homo Sapiens
QVGFVCTVL

SEQ ID NO: 210179 - protein, 9 aa, Homo Sapiens
VQLCHSHSA

SEQ ID NO: 210180 - protein, 9 aa, Homo Sapiens
MPPLKSMAM

SEQ ID NO: 210181 - protein, 9 aa, Homo Sapiens
AIGEIHKVQ

SEQ ID NO: 210182 - protein, 9 aa, Homo Sapiens
CEWIRKPAQ

SEQ ID NO: 210183 - protein, 9 aa, Homo Sapiens
HRWARVAQR

SEQ ID NO: 210184 - protein, 9 aa, Homo Sapiens
EKFYKCEEY

SEQ ID NO: 210185 - protein, 9 aa, Homo Sapiens
TNDWDRRTL

SEQ ID NO: 210186 - protein, 9 aa, Homo Sapiens
GLCLSILPT

SEQ ID NO: 210187 - protein, 9 aa, Homo Sapiens
AVHLGGWTC

SEQ ID NO: 210188 - protein, 9 aa, Homo Sapiens
PSCGACNCG

SEQ ID NO: 210189 - protein, 9 aa, Homo Sapiens
RCNLRHCPP

SEQ ID NO: 210190 - protein, 9 aa, Homo Sapiens
EEEHGVERA

SEQ ID NO: 210191 - protein, 9 aa, Homo Sapiens
FLRLNANPC

SEQ ID NO: 210192 - protein, 9 aa, Homo Sapiens
NVGQQALYN

SEQ ID NO: 210193 - protein, 9 aa, Homo Sapiens
SRDTTRCKV

SEQ ID NO: 210194 - protein, 9 aa, Homo Sapiens
LWNIGISIF

SEQ ID NO: 210195 - protein, 9 aa, Homo Sapiens
HYLQGLSSI

SEQ ID NO: 210196 - protein, 9 aa, Homo Sapiens
PKLLGKILN

SEQ ID NO: 210197 - protein, 9 aa, Homo Sapiens
DPSAEVEMT

SEQ ID NO: 210198 - protein, 9 aa, Homo Sapiens
GERSLPRIL

SEQ ID NO: 210199 - protein, 9 aa, Homo Sapiens
NNCIKLNTD

SEQ ID NO: 210200 - protein, 9 aa, Homo Sapiens
EIHKVQYIN

SEQ ID NO: 210201 - protein, 9 aa, Homo Sapiens
FQDEKILEI

SEQ ID NO: 210202 - protein, 9 aa, Homo Sapiens
HSPVCGRTL

SEQ ID NO: 210203 - protein, 9 aa, Homo Sapiens
SIFIQDGPF

SEQ ID NO: 210204 - protein, 9 aa, Homo Sapiens
PRYDKAYPG

SEQ ID NO: 210205 - protein, 9 aa, Homo Sapiens
ERAIKKNER

SEQ ID NO: 210206 - protein, 9 aa, Homo Sapiens
TGLSDSYAP

SEQ ID NO: 210207 - protein, 9 aa, Homo Sapiens
DLSSYDSDC

SEQ ID NO: 210208 - protein, 9 aa, Homo Sapiens
PSTWEESGP

SEQ ID NO: 210209 - protein, 9 aa, Homo Sapiens
HFNRYLTRH

SEQ ID NO: 210210 - protein, 9 aa, Homo Sapiens
ELHPQPNPE

SEQ ID NO: 210211 - protein, 9 aa, Homo Sapiens
GRVTNDWDR

SEQ ID NO: 210212 - protein, 9 aa, Homo Sapiens
TPISSPRLP

SEQ ID NO: 210213 - protein, 9 aa, Homo Sapiens
PSTHAPFTE

SEQ ID NO: 210214 - protein, 9 aa, Homo Sapiens
MELSPRSPL

SEQ ID NO: 210215 - protein, 9 aa, Homo Sapiens
TARMPPVWI

SEQ ID NO: 210216 - protein, 9 aa, Homo Sapiens
WRSRPLNCV

SEQ ID NO: 210217 - protein, 9 aa, Homo Sapiens
NTYNDNLIP

SEQ ID NO: 210218 - protein, 9 aa, Homo Sapiens
ATAINKASR

SEQ ID NO: 210219 - protein, 9 aa, Homo Sapiens
IHKVQYINS

SEQ ID NO: 210220 - protein, 9 aa, Homo Sapiens
DVRHYLQGL

SEQ ID NO: 210221 - protein, 9 aa, Homo Sapiens
MKKEGLQSS

SEQ ID NO: 210222 - protein, 9 aa, Homo Sapiens
GGRVTNDWD

SEQ ID NO: 210223 - protein, 9 aa, Homo Sapiens
RTDDGYMPM

SEQ ID NO: 210224 - protein, 9 aa, Homo Sapiens
FDPLPISPS

SEQ ID NO: 210225 - protein, 9 aa, Homo Sapiens
DHRWARVAQ

SEQ ID NO: 210226 - protein, 9 aa, Homo Sapiens
GTYTEIKRV

SEQ ID NO: 210227 - protein, 9 aa, Homo Sapiens
ENLQKLKLE

SEQ ID NO: 210228 - protein, 9 aa, Homo Sapiens
VSFLENNLE

SEQ ID NO: 210229 - protein, 9 aa, Homo Sapiens
VVDPIIYVL

SEQ ID NO: 210230 - protein, 9 aa, Homo Sapiens
ADAQCQDRP

SEQ ID NO: 210231 - protein, 9 aa, Homo Sapiens
EEVSLSHVH

SEQ ID NO: 210232 - protein, 9 aa, Homo Sapiens
YLQENREKF

SEQ ID NO: 210233 - protein, 9 aa, Homo Sapiens
LGKQIGFYR

SEQ ID NO: 210234 - protein, 9 aa, Homo Sapiens
EVLEWVNSK

SEQ ID NO: 210235 - protein, 9 aa, Homo Sapiens
FYKCEEYGK

SEQ ID NO: 210236 - protein, 9 aa, Homo Sapiens
HPQNRRAAG

SEQ ID NO: 210237 - protein, 9 aa, Homo Sapiens
GVTLYEMIV

SEQ ID NO: 210238 - protein, 9 aa, Homo Sapiens
TPLTIGEKK

SEQ ID NO: 210239 - protein, 9 aa, Homo Sapiens
HPQPNPEEK

SEQ ID NO: 210240 - protein, 9 aa, Homo Sapiens
RMIRPSGRG

SEQ ID NO: 210241 - protein, 9 aa, Homo Sapiens
PRPRGPSHS

SEQ ID NO: 210242 - protein, 9 aa, Homo Sapiens
VPAVSQHQN

SEQ ID NO: 210243 - protein, 9 aa, Homo Sapiens
ENRRCHMVE

SEQ ID NO: 210244 - protein, 9 aa, Homo Sapiens
TPILCLFWL

SEQ ID NO: 210245 - protein, 9 aa, Homo Sapiens
EQGCDEEHC

SEQ ID NO: 210246 - protein, 9 aa, Homo Sapiens
SRMNRFQQS

SEQ ID NO: 210247 - protein, 9 aa, Homo Sapiens
ETKRDIYYT

SEQ ID NO: 210248 - protein, 9 aa, Homo Sapiens
NDTYIAKTT

SEQ ID NO: 210249 - protein, 9 aa, Homo Sapiens
LQQSTACVV

SEQ ID NO: 210250 - protein, 9 aa, Homo Sapiens
GGILNRTSG

SEQ ID NO: 210251 - protein, 9 aa, Homo Sapiens
FLLANTQGF

SEQ ID NO: 210252 - protein, 9 aa, Homo Sapiens
MPPVWISTT

SEQ ID NO: 210253 - protein, 9 aa, Homo Sapiens
QDEKILEIG

SEQ ID NO: 210254 - protein, 9 aa, Homo Sapiens
IESKVTQML

SEQ ID NO: 210255 - protein, 9 aa, Homo Sapiens
LAGLYMGHS

SEQ ID NO: 210256 - protein, 9 aa, Homo Sapiens
ASRDTTRCK

SEQ ID NO: 210257 - protein, 9 aa, Homo Sapiens
LRPPTHPSR

SEQ ID NO: 210258 - protein, 9 aa, Homo Sapiens
KWSQSICWT

SEQ ID NO: 210259 - protein, 9 aa, Homo Sapiens
EEPQKCPEC

SEQ ID NO: 210260 - protein, 9 aa, Homo Sapiens
GSSPIPLPF

SEQ ID NO: 210261 - protein, 9 aa, Homo Sapiens
PKMIKDYLT

SEQ ID NO: 210262 - protein, 9 aa, Homo Sapiens
AKRSNELSF

SEQ ID NO: 210263 - protein, 9 aa, Homo Sapiens
SQDCVKHKG

SEQ ID NO: 210264 - protein, 9 aa, Homo Sapiens
CAFNGAQLD

SEQ ID NO: 210265 - protein, 9 aa, Homo Sapiens
RAPPPPPLP

SEQ ID NO: 210266 - protein, 9 aa, Homo Sapiens
ASIHPMVTP

SEQ ID NO: 210267 - protein, 9 aa, Homo Sapiens
GPPRMCTRS

SEQ ID NO: 210268 - protein, 9 aa, Homo Sapiens
GITALLGCF

SEQ ID NO: 210269 - protein, 9 aa, Homo Sapiens
QNEMNNQGV

SEQ ID NO: 210270 - protein, 9 aa, Homo Sapiens
LNFQDEKIL

SEQ ID NO: 210271 - protein, 9 aa, Homo Sapiens
YNSGISEVE

SEQ ID NO: 210272 - protein, 9 aa, Homo Sapiens
EDSDRIQPS

SEQ ID NO: 210273 - protein, 9 aa, Homo Sapiens
HVQDPIDRR

SEQ ID NO: 210274 - protein, 9 aa, Homo Sapiens
QRTLSARMQ

SEQ ID NO: 210275 - protein, 9 aa, Homo Sapiens
PDSSTLRTD

SEQ ID NO: 210276 - protein, 9 aa, Homo Sapiens
LLGKILNMS

SEQ ID NO: 210277 - protein, 9 aa, Homo Sapiens
THHPQNRRA

SEQ ID NO: 210278 - protein, 9 aa, Homo Sapiens
HFCPIAENK

SEQ ID NO: 210279 - protein, 9 aa, Homo Sapiens
DSSTLRTDD

SEQ ID NO: 210280 - protein, 9 aa, Homo Sapiens
QQNLRYALF

SEQ ID NO: 210281 - protein, 9 aa, Homo Sapiens
QEQERANIH

SEQ ID NO: 210282 - protein, 9 aa, Homo Sapiens
NAPKWSQSI

SEQ ID NO: 210283 - protein, 9 aa, Homo Sapiens
AATSLATAA

SEQ ID NO: 210284 - protein, 9 aa, Homo Sapiens
RSQRSRHRR

SEQ ID NO: 210285 - protein, 9 aa, Homo Sapiens
RNRVSWWGS

SEQ ID NO: 210286 - protein, 9 aa, Homo Sapiens
SKGQYTANL

SEQ ID NO: 210287 - protein, 9 aa, Homo Sapiens
RYLTRHRRI

SEQ ID NO: 210288 - protein, 9 aa, Homo Sapiens
STACVVVVF

SEQ ID NO: 210289 - protein, 9 aa, Homo Sapiens
VGTLGTYTE

SEQ ID NO: 210290 - protein, 9 aa, Homo Sapiens
FATPKMIKD

SEQ ID NO: 210291 - protein, 9 aa, Homo Sapiens
LTTAMQFKI

SEQ ID NO: 210292 - protein, 9 aa, Homo Sapiens
RALLAATGL

SEQ ID NO: 210293 - protein, 9 aa, Homo Sapiens
GPGGPRGPA

SEQ ID NO: 210294 - protein, 9 aa, Homo Sapiens
NLNIFLLGV

SEQ ID NO: 210295 - protein, 9 aa, Homo Sapiens
DSFTRLESA

SEQ ID NO: 210296 - protein, 9 aa, Homo Sapiens
SPGTARMPP

SEQ ID NO: 210297 - protein, 9 aa, Homo Sapiens
HFDYNTYND

SEQ ID NO: 210298 - protein, 9 aa, Homo Sapiens
SNLLSGLME

SEQ ID NO: 210299 - protein, 9 aa, Homo Sapiens
ENMYLECVY

SEQ ID NO: 210300 - protein, 9 aa, Homo Sapiens
KKDPVVPED

SEQ ID NO: 210301 - protein, 9 aa, Homo Sapiens
QHSFNRPER

SEQ ID NO: 210302 - protein, 9 aa, Homo Sapiens
MNRFQQSLP

SEQ ID NO: 210303 - protein, 9 aa, Homo Sapiens
KVSFLENNL

SEQ ID NO: 210304 - protein, 9 aa, Homo Sapiens
IPTASSTPP

SEQ ID NO: 210305 - protein, 9 aa, Homo Sapiens
ACNCGAAAV

SEQ ID NO: 210306 - protein, 9 aa, Homo Sapiens
IWASGNGGR

SEQ ID NO: 210307 - protein, 9 aa, Homo Sapiens
IHYLQENRE

SEQ ID NO: 210308 - protein, 9 aa, Homo Sapiens
QQSTACVVV

SEQ ID NO: 210309 - protein, 9 aa, Homo Sapiens
KVAPERNGK

SEQ ID NO: 210310 - protein, 9 aa, Homo Sapiens
VPMVLVGNN

SEQ ID NO: 210311 - protein, 9 aa, Homo Sapiens
ERLHAGTML

SEQ ID NO: 210312 - protein, 9 aa, Homo Sapiens
ARIHCYLDL

SEQ ID NO: 210313 - protein, 9 aa, Homo Sapiens
PERYISHFN

SEQ ID NO: 210314 - protein, 9 aa, Homo Sapiens
SAAQKQKVS

SEQ ID NO: 210315 - protein, 9 aa, Homo Sapiens
YTEIKRVAE

SEQ ID NO: 210316 - protein, 9 aa, Homo Sapiens
KNILGGFLS

SEQ ID NO: 210317 - protein, 9 aa, Homo Sapiens
PPPRPSLSL

SEQ ID NO: 210318 - protein, 9 aa, Homo Sapiens
HKVQYINSI

SEQ ID NO: 210319 - protein, 9 aa, Homo Sapiens
KLQQSTACV

SEQ ID NO: 210320 - protein, 9 aa, Homo Sapiens
QYTANLSPQ

SEQ ID NO: 210321 - protein, 9 aa, Homo Sapiens
WDRPRPRGP

SEQ ID NO: 210322 - protein, 9 aa, Homo Sapiens
AHQLEDQIQ

SEQ ID NO: 210323 - protein, 9 aa, Homo Sapiens
VGAGSGGTG

SEQ ID NO: 210324 - protein, 9 aa, Homo Sapiens
LSSYDSDCS

SEQ ID NO: 210325 - protein, 9 aa, Homo Sapiens
HIFKIHACS

SEQ ID NO: 210326 - protein, 9 aa, Homo Sapiens
IYPLNFTAN

SEQ ID NO: 210327 - protein, 9 aa, Homo Sapiens
GVYLSSSAT

SEQ ID NO: 210328 - protein, 9 aa, Homo Sapiens
LEMLEESDC

SEQ ID NO: 210329 - protein, 9 aa, Homo Sapiens
GQAQVAVEH

SEQ ID NO: 210330 - protein, 9 aa, Homo Sapiens
TKTPHPVLT

SEQ ID NO: 210331 - protein, 9 aa, Homo Sapiens
LLFARSAPA

SEQ ID NO: 210332 - protein, 9 aa, Homo Sapiens
AICKDHRWA

SEQ ID NO: 210333 - protein, 9 aa, Homo Sapiens
DKMKKEGLQ

SEQ ID NO: 210334 - protein, 9 aa, Homo Sapiens
ACTYTFVLE

SEQ ID NO: 210335 - protein, 9 aa, Homo Sapiens
NFQDEKILE

SEQ ID NO: 210336 - protein, 9 aa, Homo Sapiens
ITLGKQIGF

SEQ ID NO: 210337 - protein, 9 aa, Homo Sapiens
TPESCDMPP

SEQ ID NO: 210338 - protein, 9 aa, Homo Sapiens
CIHYLQENR

SEQ ID NO: 210339 - protein, 9 aa, Homo Sapiens
ISSPRLPPT

SEQ ID NO: 210340 - protein, 9 aa, Homo Sapiens
TRTADGWRR

SEQ ID NO: 210341 - protein, 9 aa, Homo Sapiens
GKPLCDNVN

SEQ ID NO: 210342 - protein, 9 aa, Homo Sapiens
FTRLESAQA

SEQ ID NO: 210343 - protein, 9 aa, Homo Sapiens
EFPRDQLKL

SEQ ID NO: 210344 - protein, 9 aa, Homo Sapiens
DPVVPEDTA

SEQ ID NO: 210345 - protein, 9 aa, Homo Sapiens
WNIGISIFI

SEQ ID NO: 210346 - protein, 9 aa, Homo Sapiens
PGRGASEGP

SEQ ID NO: 210347 - protein, 9 aa, Homo Sapiens
DLLFARSAP

SEQ ID NO: 210348 - protein, 9 aa, Homo Sapiens
PGWEKRMIR

SEQ ID NO: 210349 - protein, 9 aa, Homo Sapiens
PQPNPEEKP

SEQ ID NO: 210350 - protein, 9 aa, Homo Sapiens
PQYQTNKMP

SEQ ID NO: 210351 - protein, 9 aa, Homo Sapiens
KAWSHMPEI

SEQ ID NO: 210352 - protein, 9 aa, Homo Sapiens
VSLSHVHPE

SEQ ID NO: 210353 - protein, 9 aa, Homo Sapiens
REDSDRIQP

SEQ ID NO: 210354 - protein, 9 aa, Homo Sapiens
CKDHRWARV

SEQ ID NO: 210355 - protein, 9 aa, Homo Sapiens
QKVSFLENN

SEQ ID NO: 210356 - protein, 9 aa, Homo Sapiens
QIGFYRIRG

SEQ ID NO: 210357 - protein, 9 aa, Homo Sapiens
RALFIRNII

SEQ ID NO: 210358 - protein, 9 aa, Homo Sapiens
ADGWRRITP

SEQ ID NO: 210359 - protein, 9 aa, Homo Sapiens
LVQSNTYET

SEQ ID NO: 210360 - protein, 9 aa, Homo Sapiens
AMQFKIVYK

SEQ ID NO: 210361 - protein, 9 aa, Homo Sapiens
LTRHRRIEI

SEQ ID NO: 210362 - protein, 9 aa, Homo Sapiens
PNQVARIHC

SEQ ID NO: 210363 - protein, 9 aa, Homo Sapiens
EVLSHQSHF

SEQ ID NO: 210364 - protein, 9 aa, Homo Sapiens
PPQPRVGSL

SEQ ID NO: 210365 - protein, 9 aa, Homo Sapiens
LCHSHSALL

SEQ ID NO: 210366 - protein, 9 aa, Homo Sapiens
GVAGRKNLQ

SEQ ID NO: 210367 - protein, 9 aa, Homo Sapiens
HGVERAESV

SEQ ID NO: 210368 - protein, 9 aa, Homo Sapiens
CSLEHRAYS

SEQ ID NO: 210369 - protein, 9 aa, Homo Sapiens
PRAPPPPPL

SEQ ID NO: 210370 - protein, 9 aa, Homo Sapiens
QQALYNSGI

SEQ ID NO: 210371 - protein, 9 aa, Homo Sapiens
LPPTAFIHT

SEQ ID NO: 210372 - protein, 9 aa, Homo Sapiens
HAFPELHPQ

SEQ ID NO: 210373 - protein, 9 aa, Homo Sapiens
LDPKLLGKI

SEQ ID NO: 210374 - protein, 9 aa, Homo Sapiens
YAPCCLSLG

SEQ ID NO: 210375 - protein, 9 aa, Homo Sapiens
RQEERLHAG

SEQ ID NO: 210376 - protein, 9 aa, Homo Sapiens
GASEGPPRM

SEQ ID NO: 210377 - protein, 9 aa, Homo Sapiens
YQHSFNRPE

SEQ ID NO: 210378 - protein, 9 aa, Homo Sapiens
NTENLQKLK

SEQ ID NO: 210379 - protein, 9 aa, Homo Sapiens
LSPRSPLEM

SEQ ID NO: 210380 - protein, 9 aa, Homo Sapiens
YNTYNDNLI

SEQ ID NO: 210381 - protein, 9 aa, Homo Sapiens
EYKVGQDSE

SEQ ID NO: 210382 - protein, 9 aa, Homo Sapiens
RSLPRILPP

SEQ ID NO: 210383 - protein, 9 aa, Homo Sapiens
DHRNQGENR

SEQ ID NO: 210384 - protein, 9 aa, Homo Sapiens
CLGVYLSSS

SEQ ID NO: 210385 - protein, 9 aa, Homo Sapiens
GKGSIFIWA

SEQ ID NO: 210386 - protein, 9 aa, Homo Sapiens
GERRRLKWQ

SEQ ID NO: 210387 - protein, 9 aa, Homo Sapiens
KFYKCEEYG

SEQ ID NO: 210388 - protein, 9 aa, Homo Sapiens
ILIVGLGLA

SEQ ID NO: 210389 - protein, 9 aa, Homo Sapiens
STTKTPHPV

SEQ ID NO: 210390 - protein, 9 aa, Homo Sapiens
AATGTAAAT

SEQ ID NO: 210391 - protein, 9 aa, Homo Sapiens
MADAQCQDR

SEQ ID NO: 210392 - protein, 9 aa, Homo Sapiens
ELNFQDEKI

SEQ ID NO: 210393 - protein, 9 aa, Homo Sapiens
NLLLCAFRC

SEQ ID NO: 210394 - protein, 9 aa, Homo Sapiens
HVHPEDCEK

SEQ ID NO: 210395 - protein, 9 aa, Homo Sapiens
LSTVNGVVD

SEQ ID NO: 210396 - protein, 9 aa, Homo Sapiens
SRSGSRSQR

SEQ ID NO: 210397 - protein, 9 aa, Homo Sapiens
QGKGSIFIW

SEQ ID NO: 210398 - protein, 9 aa, Homo Sapiens
YNCTPISSP

SEQ ID NO: 210399 - protein, 9 aa, Homo Sapiens
ERAESVPEG

SEQ ID NO: 210400 - protein, 9 aa, Homo Sapiens
SAPAWLRRR

SEQ ID NO: 210401 - protein, 9 aa, Homo Sapiens
HFISNNCIK

SEQ ID NO: 210402 - protein, 9 aa, Homo Sapiens
PEQQNLRYA

SEQ ID NO: 210403 - protein, 9 aa, Homo Sapiens
TVNGVVDPI

SEQ ID NO: 210404 - protein, 9 aa, Homo Sapiens
AKGVGLVGI

SEQ ID NO: 210405 - protein, 9 aa, Homo Sapiens
TNTENLQKL

SEQ ID NO: 210406 - protein, 9 aa, Homo Sapiens
VLAEDAQTL

SEQ ID NO: 210407 - protein, 9 aa, Homo Sapiens
ATPKMIKDY

SEQ ID NO: 210408 - protein, 9 aa, Homo Sapiens
FQQSLPLSR

SEQ ID NO: 210409 - protein, 9 aa, Homo Sapiens
DPLPISPSD

SEQ ID NO: 210410 - protein, 9 aa, Homo Sapiens
AEDAQTLHS

SEQ ID NO: 210411 - protein, 9 aa, Homo Sapiens
DAFYSDWET

SEQ ID NO: 210412 - protein, 9 aa, Homo Sapiens
ILNRTSGAV

SEQ ID NO: 210413 - protein, 9 aa, Homo Sapiens
THAPFTEIT

SEQ ID NO: 210414 - protein, 9 aa, Homo Sapiens
RQTGVGSYS

SEQ ID NO: 210415 - protein, 9 aa, Homo Sapiens
GQYTANLSP

SEQ ID NO: 210416 - protein, 9 aa, Homo Sapiens
IKDYLTGHK

SEQ ID NO: 210417 - protein, 9 aa, Homo Sapiens
MAYDHCLAI

SEQ ID NO: 210418 - protein, 9 aa, Homo Sapiens
PGEQGCDEE

SEQ ID NO: 210419 - protein, 9 aa, Homo Sapiens
VGQAQVAVE

SEQ ID NO: 210420 - protein, 9 aa, Homo Sapiens
QGGAGVQEL

SEQ ID NO: 210421 - protein, 9 aa, Homo Sapiens
AQVAVEHSY

SEQ ID NO: 210422 - protein, 9 aa, Homo Sapiens
SHFNTDIAP

SEQ ID NO: 210423 - protein, 9 aa, Homo Sapiens
AENMYLECV

SEQ ID NO: 210424 - protein, 9 aa, Homo Sapiens
VLAGLYMGH

SEQ ID NO: 210425 - protein, 9 aa, Homo Sapiens
YLTRHRRIE

SEQ ID NO: 210426 - protein, 9 aa, Homo Sapiens
RSRSGSRSQ

SEQ ID NO: 210427 - protein, 9 aa, Homo Sapiens
VNNSLTEAL

SEQ ID NO: 210428 - protein, 9 aa, Homo Sapiens
AAHQLEDQI

SEQ ID NO: 210429 - protein, 9 aa, Homo Sapiens
CLSILPTVL

SEQ ID NO: 210430 - protein, 9 aa, Homo Sapiens
QGPPTTHHP

SEQ ID NO: 210431 - protein, 9 aa, Homo Sapiens
IDRRLRPIY

SEQ ID NO: 210432 - protein, 9 aa, Homo Sapiens
VGLVGITAL

SEQ ID NO: 210433 - protein, 9 aa, Homo Sapiens
KRGNKDLWA

SEQ ID NO: 210434 - protein, 9 aa, Homo Sapiens
SGPNSKLYM

SEQ ID NO: 210435 - protein, 9 aa, Homo Sapiens
ATPILCLFW

SEQ ID NO: 210436 - protein, 9 aa, Homo Sapiens
TLSARMQRR

SEQ ID NO: 210437 - protein, 9 aa, Homo Sapiens
TGGPGGPRG

SEQ ID NO: 210438 - protein, 9 aa, Homo Sapiens
GTLGTYTEI

SEQ ID NO: 210439 - protein, 9 aa, Homo Sapiens
SHQRALHML

SEQ ID NO: 210440 - protein, 9 aa, Homo Sapiens
VARIHCYLD

SEQ ID NO: 210441 - protein, 9 aa, Homo Sapiens
LLMAVVSCV

SEQ ID NO: 210442 - protein, 9 aa, Homo Sapiens
EQGGAGVQE

SEQ ID NO: 210443 - protein, 9 aa, Homo Sapiens
GLHVRSRKV

SEQ ID NO: 210444 - protein, 9 aa, Homo Sapiens
LFARSAPAW

SEQ ID NO: 210445 - protein, 9 aa, Homo Sapiens
NLAASKGLT

SEQ ID NO: 210446 - protein, 9 aa, Homo Sapiens
DLMADAQCQ

SEQ ID NO: 210447 - protein, 9 aa, Homo Sapiens
HRCSLEHRA

SEQ ID NO: 210448 - protein, 9 aa, Homo Sapiens
SCGACNCGA

SEQ ID NO: 210449 - protein, 9 aa, Homo Sapiens
ESKVTQMLI

SEQ ID NO: 210450 - protein, 9 aa, Homo Sapiens
TLGKQIGFY

SEQ ID NO: 210451 - protein, 9 aa, Homo Sapiens
LDHFKKAKK

SEQ ID NO: 210452 - protein, 9 aa, Homo Sapiens
NDGFPAGEE

SEQ ID NO: 210453 - protein, 9 aa, Homo Sapiens
ATSLATAAD

SEQ ID NO: 210454 - protein, 9 aa, Homo Sapiens
VPIVPSTLG

SEQ ID NO: 210455 - protein, 9 aa, Homo Sapiens
EVSLSHVHP

SEQ ID NO: 210456 - protein, 9 aa, Homo Sapiens
PVLAEDAQT

SEQ ID NO: 210457 - protein, 9 aa, Homo Sapiens
GGPRPALHS

SEQ ID NO: 210458 - protein, 9 aa, Homo Sapiens
SSVNNSLTE

SEQ ID NO: 210459 - protein, 9 aa, Homo Sapiens
DLGLCLSIL

SEQ ID NO: 210460 - protein, 9 aa, Homo Sapiens
GLSSIAGLL

SEQ ID NO: 210461 - protein, 9 aa, Homo Sapiens
SHSPVCGRT

SEQ ID NO: 210462 - protein, 9 aa, Homo Sapiens
WVTPESCDM

SEQ ID NO: 210463 - protein, 9 aa, Homo Sapiens
VETRTADGW

SEQ ID NO: 210464 - protein, 9 aa, Homo Sapiens
TTVEVLSHQ

SEQ ID NO: 210465 - protein, 9 aa, Homo Sapiens
QVARIHCYL

SEQ ID NO: 210466 - protein, 9 aa, Homo Sapiens
RDQLKLGKP

SEQ ID NO: 210467 - protein, 9 aa, Homo Sapiens
APQYQTNKM

SEQ ID NO: 210468 - protein, 9 aa, Homo Sapiens
QGENRRCHM

SEQ ID NO: 210469 - protein, 9 aa, Homo Sapiens
THPSRGEEL

SEQ ID NO: 210470 - protein, 9 aa, Homo Sapiens
RTADGWRRI

SEQ ID NO: 210471 - protein, 9 aa, Homo Sapiens
LRHCPPARW

SEQ ID NO: 210472 - protein, 9 aa, Homo Sapiens
LQENREKFE

SEQ ID NO: 210473 - protein, 9 aa, Homo Sapiens
LIVGLGLAM

SEQ ID NO: 210474 - protein, 9 aa, Homo Sapiens
HQLEDQIQD

SEQ ID NO: 210475 - protein, 9 aa, Homo Sapiens
GSGGTGAGV

SEQ ID NO: 210476 - protein, 9 aa, Homo Sapiens
SSSATHNSH

SEQ ID NO: 210477 - protein, 9 aa, Homo Sapiens
RGHVQDPID

SEQ ID NO: 210478 - protein, 9 aa, Homo Sapiens
DHCLAICYP

SEQ ID NO: 210479 - protein, 9 aa, Homo Sapiens
EASHQRALH

SEQ ID NO: 210480 - protein, 9 aa, Homo Sapiens
EEGGSSPIP

SEQ ID NO: 210481 - protein, 9 aa, Homo Sapiens
ERRRLKWQH

SEQ ID NO: 210482 - protein, 9 aa, Homo Sapiens
APCCLSLGC

SEQ ID NO: 210483 - protein, 9 aa, Homo Sapiens
QSTACVVVV

SEQ ID NO: 210484 - protein, 9 aa, Homo Sapiens
QSPFNLAAS

SEQ ID NO: 210485 - protein, 9 aa, Homo Sapiens
QHGLSALSA

SEQ ID NO: 210486 - protein, 9 aa, Homo Sapiens
HSDSDQSLL

SEQ ID NO: 210487 - protein, 9 aa, Homo Sapiens
SKRGNKDLW

SEQ ID NO: 210488 - protein, 9 aa, Homo Sapiens
IKLACTYTF

SEQ ID NO: 210489 - protein, 9 aa, Homo Sapiens
FHSRAEEGG

SEQ ID NO: 210490 - protein, 9 aa, Homo Sapiens
YHGGKPLCD

SEQ ID NO: 210491 - protein, 9 aa, Homo Sapiens
ESLEPTTSL

SEQ ID NO: 210492 - protein, 9 aa, Homo Sapiens
PAVSQHQNQ

SEQ ID NO: 210493 - protein, 9 aa, Homo Sapiens
KCHFDYNTY

SEQ ID NO: 210494 - protein, 9 aa, Homo Sapiens
NANPCACDC

SEQ ID NO: 210495 - protein, 9 aa, Homo Sapiens
TATAINKAS

SEQ ID NO: 210496 - protein, 9 aa, Homo Sapiens
LYEMIVARG

SEQ ID NO: 210497 - protein, 9 aa, Homo Sapiens
VKCHFDYNT

SEQ ID NO: 210498 - protein, 9 aa, Homo Sapiens
LTICCCCCW

SEQ ID NO: 210499 - protein, 9 aa, Homo Sapiens
HRDNLYPTK

SEQ ID NO: 210500 - protein, 9 aa, Homo Sapiens
QMLIPYYIS

SEQ ID NO: 210501 - protein, 9 aa, Homo Sapiens
VGSFLQDVQ

SEQ ID NO: 210502 - protein, 9 aa, Homo Sapiens
DGWRRITPL

SEQ ID NO: 210503 - protein, 9 aa, Homo Sapiens
TVDWIRHVI

SEQ ID NO: 210504 - protein, 9 aa, Homo Sapiens
EQERANIHQ

SEQ ID NO: 210505 - protein, 9 aa, Homo Sapiens
KGVGLVGIT

SEQ ID NO: 210506 - protein, 9 aa, Homo Sapiens
DAQTLHSLV

SEQ ID NO: 210507 - protein, 9 aa, Homo Sapiens
FLLGVAGRK

SEQ ID NO: 210508 - protein, 9 aa, Homo Sapiens
QTPQHGLSA

SEQ ID NO: 210509 - protein, 9 aa, Homo Sapiens
SPFNLAASK

SEQ ID NO: 210510 - protein, 9 aa, Homo Sapiens
RIHCYLDLV

SEQ ID NO: 210511 - protein, 9 aa, Homo Sapiens
YGGRVTNDW

SEQ ID NO: 210512 - protein, 9 aa, Homo Sapiens
SRSQRSRHR

SEQ ID NO: 210513 - protein, 9 aa, Homo Sapiens
FYEPQDPSA

SEQ ID NO: 210514 - protein, 9 aa, Homo Sapiens
LWARADAHN

SEQ ID NO: 210515 - protein, 9 aa, Homo Sapiens
HTVDWIRHV

SEQ ID NO: 210516 - protein, 9 aa, Homo Sapiens
SEGPPRMCT

SEQ ID NO: 210517 - protein, 9 aa, Homo Sapiens
NLRHCPPAR

SEQ ID NO: 210518 - protein, 9 aa, Homo Sapiens
PLNCVPPFS

SEQ ID NO: 210519 - protein, 9 aa, Homo Sapiens
DIESKVTQM

SEQ ID NO: 210520 - protein, 9 aa, Homo Sapiens
LPPPPPPRM

SEQ ID NO: 210521 - protein, 9 aa, Homo Sapiens
AHIRLRDVE

SEQ ID NO: 210522 - protein, 9 aa, Homo Sapiens
QRSRHRRSR

SEQ ID NO: 210523 - protein, 9 aa, Homo Sapiens
ENRILQGER

SEQ ID NO: 210524 - protein, 9 aa, Homo Sapiens
PRGPSHSPV

SEQ ID NO: 210525 - protein, 9 aa, Homo Sapiens
ISHFNTDIA

SEQ ID NO: 210526 - protein, 9 aa, Homo Sapiens
NCAFNGAQL

SEQ ID NO: 210527 - protein, 9 aa, Homo Sapiens
SLSHVHPED

SEQ ID NO: 210528 - protein, 9 aa, Homo Sapiens
SSSGPNSKL

SEQ ID NO: 210529 - protein, 9 aa, Homo Sapiens
PTTHHPQNR

SEQ ID NO: 210530 - protein, 9 aa, Homo Sapiens
CEEYGKAFS

SEQ ID NO: 210531 - protein, 9 aa, Homo Sapiens
VRSRKVEED

SEQ ID NO: 210532 - protein, 9 aa, Homo Sapiens
RKKKDAMYG

SEQ ID NO: 210533 - protein, 9 aa, Homo Sapiens
TPRASIHPM

SEQ ID NO: 210534 - protein, 9 aa, Homo Sapiens
SQSYRKKKD

SEQ ID NO: 210535 - protein, 9 aa, Homo Sapiens
YEAICKDHR

SEQ ID NO: 210536 - protein, 9 aa, Homo Sapiens
QNRRAAGQG

SEQ ID NO: 210537 - protein, 9 aa, Homo Sapiens
NQVARIHCY

SEQ ID NO: 210538 - protein, 9 aa, Homo Sapiens
ATGTAAATS

SEQ ID NO: 210539 - protein, 9 aa, Homo Sapiens
GTGGPGGPR

SEQ ID NO: 210540 - protein, 9 aa, Homo Sapiens
GTGSCELLM

SEQ ID NO: 210541 - protein, 9 aa, Homo Sapiens
TIGEKKPKF

SEQ ID NO: 210542 - protein, 9 aa, Homo Sapiens
TRLESAQAS

SEQ ID NO: 210543 - protein, 9 aa, Homo Sapiens
MRCNLRHCP

SEQ ID NO: 210544 - protein, 9 aa, Homo Sapiens
GTARMPPVW

SEQ ID NO: 210545 - protein, 9 aa, Homo Sapiens
TGAGVTGAG

SEQ ID NO: 210546 - protein, 9 aa, Homo Sapiens
CTPISSPRL

SEQ ID NO: 210547 - protein, 9 aa, Homo Sapiens
GPPVGQAQV

SEQ ID NO: 210548 - protein, 9 aa, Homo Sapiens
TFEYQHSFN

SEQ ID NO: 210549 - protein, 9 aa, Homo Sapiens
LVGITALLG

SEQ ID NO: 210550 - protein, 9 aa, Homo Sapiens
CALDTRHVS

SEQ ID NO: 210551 - protein, 9 aa, Homo Sapiens
RNLCEWIRK

SEQ ID NO: 210552 - protein, 9 aa, Homo Sapiens
RTLSARMQR

SEQ ID NO: 210553 - protein, 9 aa, Homo Sapiens
HNCAFNGAQ

SEQ ID NO: 210554 - protein, 9 aa, Homo Sapiens
SSPGTARMP

SEQ ID NO: 210555 - protein, 9 aa, Homo Sapiens
YDYKAKRSN

SEQ ID NO: 210556 - protein, 9 aa, Homo Sapiens
LYPTKTEKI

SEQ ID NO: 210557 - protein, 9 aa, Homo Sapiens
CWDRPRPRG

SEQ ID NO: 210558 - protein, 9 aa, Homo Sapiens
GFADFYSQN

SEQ ID NO: 210559 - protein, 9 aa, Homo Sapiens
WVNSKGYKV

SEQ ID NO: 210560 - protein, 9 aa, Homo Sapiens
HLGGWTCVP

SEQ ID NO: 210561 - protein, 9 aa, Homo Sapiens
QIQDFVRRV

SEQ ID NO: 210562 - protein, 9 aa, Homo Sapiens
FEYQHSFNR

SEQ ID NO: 210563 - protein, 9 aa, Homo Sapiens
PRPSLSLAA

SEQ ID NO: 210564 - protein, 9 aa, Homo Sapiens
PIAENKDAF

SEQ ID NO: 210565 - protein, 9 aa, Homo Sapiens
IVYKTGDVP

SEQ ID NO: 210566 - protein, 9 aa, Homo Sapiens
PLPISPSDD

SEQ ID NO: 210567 - protein, 9 aa, Homo Sapiens
FPAGEEEEA

SEQ ID NO: 210568 - protein, 9 aa, Homo Sapiens
DFYSQNEMN

SEQ ID NO: 210569 - protein, 9 aa, Homo Sapiens
HSHSALLHR

SEQ ID NO: 210570 - protein, 9 aa, Homo Sapiens
QNLRYALFL

SEQ ID NO: 210571 - protein, 9 aa, Homo Sapiens
EEEAGRPGA

SEQ ID NO: 210572 - protein, 9 aa, Homo Sapiens
ERNGKSPTV

SEQ ID NO: 210573 - protein, 9 aa, Homo Sapiens
LSAFDPLPI

SEQ ID NO: 210574 - protein, 9 aa, Homo Sapiens
RTGIYHGGK

SEQ ID NO: 210575 - protein, 9 aa, Homo Sapiens
KAVIYPLNF

SEQ ID NO: 210576 - protein, 9 aa, Homo Sapiens
VGLGLAMLV

SEQ ID NO: 210577 - protein, 9 aa, Homo Sapiens
CSMSVERDI

SEQ ID NO: 210578 - protein, 9 aa, Homo Sapiens
HCMLVRNRV

SEQ ID NO: 210579 - protein, 9 aa, Homo Sapiens
QLAGSRRRE

SEQ ID NO: 210580 - protein, 9 aa, Homo Sapiens
NLQKLKLEY

SEQ ID NO: 210581 - protein, 9 aa, Homo Sapiens
PTAFIHTLF

SEQ ID NO: 210582 - protein, 9 aa, Homo Sapiens
SHVHPEDCE

SEQ ID NO: 210583 - protein, 9 aa, Homo Sapiens
ICCCCCWAP

SEQ ID NO: 210584 - protein, 9 aa, Homo Sapiens
LQGLSSIAG

SEQ ID NO: 210585 - protein, 9 aa, Homo Sapiens
MGHSDTQLV

SEQ ID NO: 210586 - protein, 9 aa, Homo Sapiens
RSPLEMLEE

SEQ ID NO: 210587 - protein, 9 aa, Homo Sapiens
NCGAAAVRL

SEQ ID NO: 210588 - protein, 9 aa, Homo Sapiens
SLAAAPSAP

SEQ ID NO: 210589 - protein, 9 aa, Homo Sapiens
GHSDTQLVV

SEQ ID NO: 210590 - protein, 9 aa, Homo Sapiens
LRTDDGYMP

SEQ ID NO: 210591 - protein, 9 aa, Homo Sapiens
ERSLPRILP

SEQ ID NO: 210592 - protein, 9 aa, Homo Sapiens
VYRPIRKGD

SEQ ID NO: 210593 - protein, 9 aa, Homo Sapiens
NLYPTKTEK

SEQ ID NO: 210594 - protein, 9 aa, Homo Sapiens
QALYNSGIS

SEQ ID NO: 210595 - protein, 9 aa, Homo Sapiens
DPIDRRLRP

SEQ ID NO: 210596 - protein, 9 aa, Homo Sapiens
KAKRSNELS

SEQ ID NO: 210597 - protein, 9 aa, Homo Sapiens
PVGQAQVAV

SEQ ID NO: 210598 - protein, 9 aa, Homo Sapiens
AGSRRREDS

SEQ ID NO: 210599 - protein, 9 aa, Homo Sapiens
RLRDVEAIP

SEQ ID NO: 210600 - protein, 9 aa, Homo Sapiens
ATMRCNLRH

SEQ ID NO: 210601 - protein, 9 aa, Homo Sapiens
NRTSGAVGS

SEQ ID NO: 210602 - protein, 9 aa, Homo Sapiens
AAATSLATA

SEQ ID NO: 210603 - protein, 9 aa, Homo Sapiens
ERANIHQTE

SEQ ID NO: 210604 - protein, 9 aa, Homo Sapiens
SSTLRTDDG

SEQ ID NO: 210605 - protein, 9 aa, Homo Sapiens
PLPPTAFIH

SEQ ID NO: 210606 - protein, 9 aa, Homo Sapiens
GNSRALFIR

SEQ ID NO: 210607 - protein, 9 aa, Homo Sapiens
QSNTYETKR

SEQ ID NO: 210608 - protein, 9 aa, Homo Sapiens
LMESLEPTT

SEQ ID NO: 210609 - protein, 9 aa, Homo Sapiens
GSAAQKQKV

SEQ ID NO: 210610 - protein, 9 aa, Homo Sapiens
NIFLLGVAG

SEQ ID NO: 210611 - protein, 9 aa, Homo Sapiens
FLQDVQNED

SEQ ID NO: 210612 - protein, 9 aa, Homo Sapiens
DQIQDFVRR

SEQ ID NO: 210613 - protein, 9 aa, Homo Sapiens
NRILQGERR

SEQ ID NO: 210614 - protein, 9 aa, Homo Sapiens
RASIHPMVT

SEQ ID NO: 210615 - protein, 9 aa, Homo Sapiens
GLQSSRDIM

SEQ ID NO: 210616 - protein, 9 aa, Homo Sapiens
VCTVLALVC

SEQ ID NO: 210617 - protein, 9 aa, Homo Sapiens
PQPRVGSLG

SEQ ID NO: 210618 - protein, 9 aa, Homo Sapiens
PISSPRLPP

SEQ ID NO: 210619 - protein, 9 aa, Homo Sapiens
NCTPISSPR

SEQ ID NO: 210620 - protein, 9 aa, Homo Sapiens
GSCELLMAV

SEQ ID NO: 210621 - protein, 9 aa, Homo Sapiens
QHQNQIQQT

SEQ ID NO: 210622 - protein, 9 aa, Homo Sapiens
QGLSSIAGL

SEQ ID NO: 210623 - protein, 9 aa, Homo Sapiens
RIAIQSKGQ

SEQ ID NO: 210624 - protein, 9 aa, Homo Sapiens
FSRMNRFQQ

SEQ ID NO: 210625 - protein, 9 aa, Homo Sapiens
STAVHLGGW

SEQ ID NO: 210626 - protein, 9 aa, Homo Sapiens
GLQDAFYSD

SEQ ID NO: 210627 - protein, 9 aa, Homo Sapiens
GQSQGPPTT

SEQ ID NO: 210628 - protein, 9 aa, Homo Sapiens
LEWVNSKGY

SEQ ID NO: 210629 - protein, 9 aa, Homo Sapiens
YETKRDIYY

SEQ ID NO: 210630 - protein, 9 aa, Homo Sapiens
KLYMKLVMR

SEQ ID NO: 210631 - protein, 9 aa, Homo Sapiens
PIVPSTLGE

SEQ ID NO: 210632 - protein, 9 aa, Homo Sapiens
RGPSHSPVC

SEQ ID NO: 210633 - protein, 9 aa, Homo Sapiens
LRLNANPCA

SEQ ID NO: 210634 - protein, 9 aa, Homo Sapiens
YLSSSATHN

SEQ ID NO: 210635 - protein, 9 aa, Homo Sapiens
VTGVLNEPT

SEQ ID NO: 210636 - protein, 9 aa, Homo Sapiens
QGCDEEHCK

SEQ ID NO: 210637 - protein, 9 aa, Homo Sapiens
IHNCAFNGA

SEQ ID NO: 210638 - protein, 9 aa, Homo Sapiens
SQGPPTTHH

SEQ ID NO: 210639 - protein, 9 aa, Homo Sapiens
IKKNERNAP

SEQ ID NO: 210640 - protein, 9 aa, Homo Sapiens
HPERYISHF

SEQ ID NO: 210641 - protein, 9 aa, Homo Sapiens
GWRRITPLC

SEQ ID NO: 210642 - protein, 9 aa, Homo Sapiens
SSATHNSHT

SEQ ID NO: 210643 - protein, 9 aa, Homo Sapiens
RAIKKNERN

SEQ ID NO: 210644 - protein, 9 aa, Homo Sapiens
LNANPCACD

SEQ ID NO: 210645 - protein, 9 aa, Homo Sapiens
VAHCMLVRN

SEQ ID NO: 210646 - protein, 9 aa, Homo Sapiens
ASHQRALHM

SEQ ID NO: 210647 - protein, 9 aa, Homo Sapiens
RYFMQEDIN

SEQ ID NO: 210648 - protein, 9 aa, Homo Sapiens
RRRLKWQHE

SEQ ID NO: 210649 - protein, 9 aa, Homo Sapiens
VERAESVPE

SEQ ID NO: 210650 - protein, 9 aa, Homo Sapiens
RLNANPCAC

SEQ ID NO: 210651 - protein, 9 aa, Homo Sapiens
SLLSGVCSR

SEQ ID NO: 210652 - protein, 9 aa, Homo Sapiens
STVNGVVDP

SEQ ID NO: 210653 - protein, 9 aa, Homo Sapiens
PTASSTPPG

SEQ ID NO: 210654 - protein, 9 aa, Homo Sapiens
QCQDRPFFL

SEQ ID NO: 210655 - protein, 9 aa, Homo Sapiens
SGGPRPALH

SEQ ID NO: 210656 - protein, 9 aa, Homo Sapiens
HPMVTPATV

SEQ ID NO: 210657 - protein, 9 aa, Homo Sapiens
RIHSGEEPQ

SEQ ID NO: 210658 - protein, 9 aa, Homo Sapiens
DKLQQSTAC

SEQ ID NO: 210659 - protein, 9 aa, Homo Sapiens
CIKLNTDFL

SEQ ID NO: 210660 - protein, 9 aa, Homo Sapiens
SYAPCCLSL

SEQ ID NO: 210661 - protein, 9 aa, Homo Sapiens
HSRAEEGGS

SEQ ID NO: 210662 - protein, 9 aa, Homo Sapiens
SQRSRHRRS

SEQ ID NO: 210663 - protein, 9 aa, Homo Sapiens
THIFKIHAC

SEQ ID NO: 210664 - protein, 9 aa, Homo Sapiens
REITLGKQI

SEQ ID NO: 210665 - protein, 9 aa, Homo Sapiens
RPRGPSHSP

SEQ ID NO: 210666 - protein, 9 aa, Homo Sapiens
YSQNEMNNQ

SEQ ID NO: 210667 - protein, 9 aa, Homo Sapiens
EEYGKAFSR

SEQ ID NO: 210668 - protein, 9 aa, Homo Sapiens
PPRMCTRSL

SEQ ID NO: 210669 - protein, 9 aa, Homo Sapiens
PGGPRGPAG

SEQ ID NO: 210670 - protein, 9 aa, Homo Sapiens
RERQTGVGS

SEQ ID NO: 210671 - protein, 9 aa, Homo Sapiens
QVVATPILC

SEQ ID NO: 210672 - protein, 9 aa, Homo Sapiens
SGAVGSKVH

SEQ ID NO: 210673 - protein, 9 aa, Homo Sapiens
YDHCLAICY

SEQ ID NO: 210674 - protein, 9 aa, Homo Sapiens
PRSPLEMLE

SEQ ID NO: 210675 - protein, 9 aa, Homo Sapiens
TGLNLPSVL

SEQ ID NO: 210676 - protein, 9 aa, Homo Sapiens
PLEMLEESD

SEQ ID NO: 210677 - protein, 9 aa, Homo Sapiens
EELNFQDEK

SEQ ID NO: 210678 - protein, 9 aa, Homo Sapiens
AYDHCLAIC

SEQ ID NO: 210679 - protein, 9 aa, Homo Sapiens
VVATPILCL

SEQ ID NO: 210680 - protein, 9 aa, Homo Sapiens
ISFLLANTQ

SEQ ID NO: 210681 - protein, 9 aa, Homo Sapiens
VRHYLQGLS

SEQ ID NO: 210682 - protein, 9 aa, Homo Sapiens
IQPEQQNLR

SEQ ID NO: 210683 - protein, 9 aa, Homo Sapiens
CSRSYSCSS

SEQ ID NO: 210684 - protein, 9 aa, Homo Sapiens
PRVGSLGCE

SEQ ID NO: 210685 - protein, 9 aa, Homo Sapiens
LAEVLEWVN

SEQ ID NO: 210686 - protein, 9 aa, Homo Sapiens
DVQNEDKGI

SEQ ID NO: 210687 - protein, 9 aa, Homo Sapiens
CNLEPSTHA

SEQ ID NO: 210688 - protein, 9 aa, Homo Sapiens
TQMLIPYYI

SEQ ID NO: 210689 - protein, 9 aa, Homo Sapiens
PFNLAASKG

SEQ ID NO: 210690 - protein, 9 aa, Homo Sapiens
GDLLRPPTH

SEQ ID NO: 210691 - protein, 9 aa, Homo Sapiens
RVGSLGCEL

SEQ ID NO: 210692 - protein, 9 aa, Homo Sapiens
FQEQGGAGV

SEQ ID NO: 210693 - protein, 9 aa, Homo Sapiens
GGERSLPRI

SEQ ID NO: 210694 - protein, 9 aa, Homo Sapiens
GLSDSYAPC

SEQ ID NO: 210695 - protein, 9 aa, Homo Sapiens
AQTLHSLVS

SEQ ID NO: 210696 - protein, 9 aa, Homo Sapiens
IQSKGQYTA

SEQ ID NO: 210697 - protein, 9 aa, Homo Sapiens
QSQGPPTTH

SEQ ID NO: 210698 - protein, 9 aa, Homo Sapiens
NTYETKRDI

SEQ ID NO: 210699 - protein, 9 aa, Homo Sapiens
ESGPRYDKA

SEQ ID NO: 210700 - protein, 9 aa, Homo Sapiens
GFVCTVLAL

SEQ ID NO: 210701 - protein, 9 aa, Homo Sapiens
DHFKKAKKM

SEQ ID NO: 210702 - protein, 9 aa, Homo Sapiens
QPEQQNLRY

SEQ ID NO: 210703 - protein, 9 aa, Homo Sapiens
RAESVPEGV

SEQ ID NO: 210704 - protein, 9 aa, Homo Sapiens
YKHRDNLYP

SEQ ID NO: 210705 - protein, 9 aa, Homo Sapiens
GHFYEPQDP

SEQ ID NO: 210706 - protein, 9 aa, Homo Sapiens
CSQKAVIYP

SEQ ID NO: 210707 - protein, 9 aa, Homo Sapiens
PRPALHSDS

SEQ ID NO: 210708 - protein, 9 aa, Homo Sapiens
GNKDLWARA

SEQ ID NO: 210709 - protein, 9 aa, Homo Sapiens
NKDLWARAD

SEQ ID NO: 210710 - protein, 9 aa, Homo Sapiens
SKWEFPRDQ

SEQ ID NO: 210711 - protein, 9 aa, Homo Sapiens
QEQGGAGVQ

SEQ ID NO: 210712 - protein, 9 aa, Homo Sapiens
GFSWLSVFS

SEQ ID NO: 210713 - protein, 9 aa, Homo Sapiens
SGSRSQRSR

SEQ ID NO: 210714 - protein, 9 aa, Homo Sapiens
FYILIVGLG

SEQ ID NO: 210715 - protein, 9 aa, Homo Sapiens
DENGNSRAL

SEQ ID NO: 210716 - protein, 9 aa, Homo Sapiens
ALFIRNIIM

SEQ ID NO: 210717 - protein, 9 aa, Homo Sapiens
LYMGHSDTQ

SEQ ID NO: 210718 - protein, 9 aa, Homo Sapiens
LCEWIRKPA

SEQ ID NO: 210719 - protein, 9 aa, Homo Sapiens
DYNTYNDNL

SEQ ID NO: 210720 - protein, 9 aa, Homo Sapiens
DSQSYRKKK

SEQ ID NO: 210721 - protein, 9 aa, Homo Sapiens
WSHMPEITQ

SEQ ID NO: 210722 - protein, 9 aa, Homo Sapiens
LYKHRDNLY

SEQ ID NO: 210723 - protein, 9 aa, Homo Sapiens
APKWSQSIC

SEQ ID NO: 210724 - protein, 9 aa, Homo Sapiens
MIKDYLTGH

SEQ ID NO: 210725 - protein, 9 aa, Homo Sapiens
ARQTPQHGL

SEQ ID NO: 210726 - protein, 9 aa, Homo Sapiens
CMLVRNRVS

SEQ ID NO: 210727 - protein, 9 aa, Homo Sapiens
PKVPGEQGC

SEQ ID NO: 210728 - protein, 9 aa, Homo Sapiens
KKNERNAPK

SEQ ID NO: 210729 - protein, 9 aa, Homo Sapiens
VLSHQSHFP

SEQ ID NO: 210730 - protein, 9 aa, Homo Sapiens
TVKNILGGF

SEQ ID NO: 210731 - protein, 9 aa, Homo Sapiens
SKVTQMLIP

SEQ ID NO: 210732 - protein, 9 aa, Homo Sapiens
HAPFTEITQ

SEQ ID NO: 210733 - protein, 9 aa, Homo Sapiens
SIHPMVTPA

SEQ ID NO: 210734 - protein, 9 aa, Homo Sapiens
LAGSRRRED

SEQ ID NO: 210735 - protein, 9 aa, Homo Sapiens
QGTVKNILG

SEQ ID NO: 210736 - protein, 9 aa, Homo Sapiens
KLACTYTFV

SEQ ID NO: 210737 - protein, 9 aa, Homo Sapiens
CGACNCGAA

SEQ ID NO: 210738 - protein, 9 aa, Homo Sapiens
HHPQNRRAA

SEQ ID NO: 210739 - protein, 9 aa, Homo Sapiens
PYFLEVYRP

SEQ ID NO: 210740 - protein, 9 aa, Homo Sapiens
KMIKDYLTG

SEQ ID NO: 210741 - protein, 9 aa, Homo Sapiens
TRHRRIEIA

SEQ ID NO: 210742 - protein, 9 aa, Homo Sapiens
KNERNAPKW

SEQ ID NO: 210743 - protein, 9 aa, Homo Sapiens
DRPRPRGPS

SEQ ID NO: 210744 - protein, 9 aa, Homo Sapiens
KWEFPRDQL

SEQ ID NO: 210745 - protein, 9 aa, Homo Sapiens
TPKMIKDYL

SEQ ID NO: 210746 - protein, 9 aa, Homo Sapiens
RQGKGSIFI

SEQ ID NO: 210747 - protein, 9 aa, Homo Sapiens
HSDTQLVVR

SEQ ID NO: 210748 - protein, 9 aa, Homo Sapiens
TGSCELLMA

SEQ ID NO: 210749 - protein, 9 aa, Homo Sapiens
QKCPECGKR

SEQ ID NO: 210750 - protein, 9 aa, Homo Sapiens
DECSLNLLL

SEQ ID NO: 210751 - protein, 9 aa, Homo Sapiens
RALHMLEKA

SEQ ID NO: 210752 - protein, 9 aa, Homo Sapiens
SGPRYDKAY

SEQ ID NO: 210753 - protein, 9 aa, Homo Sapiens
GVLNEPTGL

SEQ ID NO: 210754 - protein, 9 aa, Homo Sapiens
HFKKAKKMG

SEQ ID NO: 210755 - protein, 9 aa, Homo Sapiens
SQNEMNNQG

SEQ ID NO: 210756 - protein, 9 aa, Homo Sapiens
CGASTTGSL

SEQ ID NO: 210757 - protein, 9 aa, Homo Sapiens
LSHVHPEDC

SEQ ID NO: 210758 - protein, 9 aa, Homo Sapiens
VTFQEQGGA

SEQ ID NO: 210759 - protein, 9 aa, Homo Sapiens
WRRITPLCI

SEQ ID NO: 210760 - protein, 9 aa, Homo Sapiens
FIHTLFGPH

SEQ ID NO: 210761 - protein, 9 aa, Homo Sapiens
SVPYSTTKT

SEQ ID NO: 210762 - protein, 9 aa, Homo Sapiens
RPVQLCHSH

SEQ ID NO: 210763 - protein, 9 aa, Homo Sapiens
TWEESGPRY

SEQ ID NO: 210764 - protein, 9 aa, Homo Sapiens
QDCVKHKGM

SEQ ID NO: 210765 - protein, 9 aa, Homo Sapiens
SVPFAENMY

SEQ ID NO: 210766 - protein, 9 aa, Homo Sapiens
SNELSFCRG

SEQ ID NO: 210767 - protein, 9 aa, Homo Sapiens
VHLGGWTCV

SEQ ID NO: 210768 - protein, 9 aa, Homo Sapiens
YKTLGSNDT

SEQ ID NO: 210769 - protein, 9 aa, Homo Sapiens
AVNQVVATP

SEQ ID NO: 210770 - protein, 9 aa, Homo Sapiens
SNNCIKLNT

SEQ ID NO: 210771 - protein, 9 aa, Homo Sapiens
GCDEEHCKE

SEQ ID NO: 210772 - protein, 9 aa, Homo Sapiens
AAERAIKKN

SEQ ID NO: 210773 - protein, 9 aa, Homo Sapiens
GAQLDELNL

SEQ ID NO: 210774 - protein, 9 aa, Homo Sapiens
RTGLSDSYA

SEQ ID NO: 210775 - protein, 9 aa, Homo Sapiens
LCLSILPTV

SEQ ID NO: 210776 - protein, 9 aa, Homo Sapiens
SPRSPLEML

SEQ ID NO: 210777 - protein, 9 aa, Homo Sapiens
LTIGEKKPK

SEQ ID NO: 210778 - protein, 9 aa, Homo Sapiens
NQVVATPIL

SEQ ID NO: 210779 - protein, 9 aa, Homo Sapiens
ELLMAVVSC

SEQ ID NO: 210780 - protein, 9 aa, Homo Sapiens
EHTVDWIRH

SEQ ID NO: 210781 - protein, 9 aa, Homo Sapiens
PIDRRLRPI

SEQ ID NO: 210782 - protein, 9 aa, Homo Sapiens
SRALFIRNI

SEQ ID NO: 210783 - protein, 9 aa, Homo Sapiens
RSNELSFCR

SEQ ID NO: 210784 - protein, 9 aa, Homo Sapiens
NIGISIFIQ

SEQ ID NO: 210785 - protein, 9 aa, Homo Sapiens
LIKLACTYT

SEQ ID NO: 210786 - protein, 9 aa, Homo Sapiens
SILPTVLGI

SEQ ID NO: 210787 - protein, 9 aa, Homo Sapiens
CSLNLLLCA

SEQ ID NO: 210788 - protein, 9 aa, Homo Sapiens
MACIHYLQE

SEQ ID NO: 210789 - protein, 9 aa, Homo Sapiens
CELLMAVVS

SEQ ID NO: 210790 - protein, 9 aa, Homo Sapiens
ACSMSVERD

SEQ ID NO: 210791 - protein, 9 aa, Homo Sapiens
RSRPLNCVP

SEQ ID NO: 210792 - protein, 9 aa, Homo Sapiens
LRDVEAIPR

SEQ ID NO: 210793 - protein, 9 aa, Homo Sapiens
LANTQGFPL

SEQ ID NO: 210794 - protein, 9 aa, Homo Sapiens
SGSEHTVDW

SEQ ID NO: 210795 - protein, 9 aa, Homo Sapiens
QGERRRLKW

SEQ ID NO: 210796 - protein, 9 aa, Homo Sapiens
DIVSSVNNS

SEQ ID NO: 210797 - protein, 9 aa, Homo Sapiens
YEMIVARGP

SEQ ID NO: 210798 - protein, 9 aa, Homo Sapiens
TASSTPPGD

SEQ ID NO: 210799 - protein, 9 aa, Homo Sapiens
ENKDAFCKD

SEQ ID NO: 210800 - protein, 9 aa, Homo Sapiens
ENGNSRALF

SEQ ID NO: 210801 - protein, 9 aa, Homo Sapiens
TFQEQGGAG

SEQ ID NO: 210802 - protein, 9 aa, Homo Sapiens
LQGLQDAFY

SEQ ID NO: 210803 - protein, 9 aa, Homo Sapiens
GFSRMNRFQ

SEQ ID NO: 210804 - protein, 9 aa, Homo Sapiens
DEDDVPIVP

SEQ ID NO: 210805 - protein, 9 aa, Homo Sapiens
DGSTAVHLG

SEQ ID NO: 210806 - protein, 9 aa, Homo Sapiens
GGTGAGVTG

SEQ ID NO: 210807 - protein, 9 aa, Homo Sapiens
NGGILNRTS

SEQ ID NO: 210808 - protein, 9 aa, Homo Sapiens
AAQKQKVSF

SEQ ID NO: 210809 - protein, 9 aa, Homo Sapiens
WEKRMIRPS

SEQ ID NO: 210810 - protein, 9 aa, Homo Sapiens
AMAYDHCLA

SEQ ID NO: 210811 - protein, 9 aa, Homo Sapiens
VTPESCDMP

SEQ ID NO: 210812 - protein, 9 aa, Homo Sapiens
LSGLMESLE

SEQ ID NO: 210813 - protein, 9 aa, Homo Sapiens
QTLHSLVSL

SEQ ID NO: 210814 - protein, 9 aa, Homo Sapiens
ELSPRSPLE

SEQ ID NO: 210815 - protein, 9 aa, Homo Sapiens
RAEEGGSSP

SEQ ID NO: 210816 - protein, 9 aa, Homo Sapiens
YFMQEDINQ

SEQ ID NO: 210817 - protein, 9 aa, Homo Sapiens
KSTPRASIH

SEQ ID NO: 210818 - protein, 9 aa, Homo Sapiens
FKKAKKMGG

SEQ ID NO: 210819 - protein, 9 aa, Homo Sapiens
MPSCGACNC

SEQ ID NO: 210820 - protein, 9 aa, Homo Sapiens
KHRDNLYPT

SEQ ID NO: 210821 - protein, 9 aa, Homo Sapiens
RDLLFARSA

SEQ ID NO: 210822 - protein, 9 aa, Homo Sapiens
EHGVERAES

SEQ ID NO: 210823 - protein, 9 aa, Homo Sapiens
VHFTTNTEN

SEQ ID NO: 210824 - protein, 9 aa, Homo Sapiens
LDTRHVSVR

SEQ ID NO: 210825 - protein, 9 aa, Homo Sapiens
RMQRRERER

SEQ ID NO: 210826 - protein, 9 aa, Homo Sapiens
AFIHTLFGP

SEQ ID NO: 210827 - protein, 9 aa, Homo Sapiens
KGSIFIWAS

SEQ ID NO: 210828 - protein, 9 aa, Homo Sapiens
QAQVAVEHS

SEQ ID NO: 210829 - protein, 9 aa, Homo Sapiens
GSSVPYSTT

SEQ ID NO: 210830 - protein, 9 aa, Homo Sapiens
CDMPPLKSM

SEQ ID NO: 210831 - protein, 9 aa, Homo Sapiens
MQQGTVKNI

SEQ ID NO: 210832 - protein, 9 aa, Homo Sapiens
QPNPEEKPP

SEQ ID NO: 210833 - protein, 9 aa, Homo Sapiens
NPCACDCRA

SEQ ID NO: 210834 - protein, 9 aa, Homo Sapiens
VYLSSSATH

SEQ ID NO: 210835 - protein, 9 aa, Homo Sapiens
QLIKLACTY

SEQ ID NO: 210836 - protein, 9 aa, Homo Sapiens
ANPCACDCR

SEQ ID NO: 210837 - protein, 9 aa, Homo Sapiens
SFLLANTQG

SEQ ID NO: 210838 - protein, 9 aa, Homo Sapiens
KGFSWLSVF

SEQ ID NO: 210839 - protein, 9 aa, Homo Sapiens
PSHSPVCGR

SEQ ID NO: 210840 - protein, 9 aa, Homo Sapiens
TDLGLCLSI

SEQ ID NO: 210841 - protein, 9 aa, Homo Sapiens
ERERQTGVG

SEQ ID NO: 210842 - protein, 9 aa, Homo Sapiens
LLGVAGRKN

SEQ ID NO: 210843 - protein, 9 aa, Homo Sapiens
ACVVVVFSP

SEQ ID NO: 210844 - protein, 9 aa, Homo Sapiens
FSGLHVRSR

SEQ ID NO: 210845 - protein, 9 aa, Homo Sapiens
VEYKVGQDS

SEQ ID NO: 210846 - protein, 9 aa, Homo Sapiens
NGTTGPVWV

SEQ ID NO: 210847 - protein, 9 aa, Homo Sapiens
SRAEEGGSS

SEQ ID NO: 210848 - protein, 9 aa, Homo Sapiens
RSYNCTPIS

SEQ ID NO: 210849 - protein, 9 aa, Homo Sapiens
IRLRDVEAI

SEQ ID NO: 210850 - protein, 9 aa, Homo Sapiens
QTGVGSYSQ

SEQ ID NO: 210851 - protein, 9 aa, Homo Sapiens
KRDEDDVPI

SEQ ID NO: 210852 - protein, 9 aa, Homo Sapiens
AFPELHPQP

SEQ ID NO: 210853 - protein, 9 aa, Homo Sapiens
LGLCLSILP

SEQ ID NO: 210854 - protein, 9 aa, Homo Sapiens
SYNCTPISS

SEQ ID NO: 210855 - protein, 9 aa, Homo Sapiens
KRSNELSFC

SEQ ID NO: 210856 - protein, 9 aa, Homo Sapiens
GFPAGEEEE

SEQ ID NO: 210857 - protein, 9 aa, Homo Sapiens
TPNQVARIH

SEQ ID NO: 210858 - protein, 9 aa, Homo Sapiens
HRNQGENRR

SEQ ID NO: 210859 - protein, 9 aa, Homo Sapiens
GGSSPIPLP

SEQ ID NO: 210860 - protein, 9 aa, Homo Sapiens
SFTRLESAQ

SEQ ID NO: 210861 - protein, 9 aa, Homo Sapiens
SRPLNCVPP

SEQ ID NO: 210862 - protein, 9 aa, Homo Sapiens
TTAMQFKIV

SEQ ID NO: 210863 - protein, 9 aa, Homo Sapiens
HDLMADAQC

SEQ ID NO: 210864 - protein, 9 aa, Homo Sapiens
SLAAHRCSL

SEQ ID NO: 210865 - protein, 9 aa, Homo Sapiens
IIRQEERLH

SEQ ID NO: 210866 - protein, 9 aa, Homo Sapiens
AGSGGTGAG

SEQ ID NO: 210867 - protein, 9 aa, Homo Sapiens
GPPTTHHPQ

SEQ ID NO: 210868 - protein, 9 aa, Homo Sapiens
VPFAENMYL

SEQ ID NO: 210869 - protein, 9 aa, Homo Sapiens
EGLQSSRDI

SEQ ID NO: 210870 - protein, 9 aa, Homo Sapiens
SSSPGTARM

SEQ ID NO: 210871 - protein, 9 aa, Homo Sapiens
VAGRKNLQD

SEQ ID NO: 210872 - protein, 9 aa, Homo Sapiens
VGFVCTVLA

SEQ ID NO: 210873 - protein, 9 aa, Homo Sapiens
LNRTSGAVG

SEQ ID NO: 210874 - protein, 9 aa, Homo Sapiens
EGGSSPIPL

SEQ ID NO: 210875 - protein, 9 aa, Homo Sapiens
PESCDMPPL

SEQ ID NO: 210876 - protein, 9 aa, Homo Sapiens
AERAIKKNE

SEQ ID NO: 210877 - protein, 9 aa, Homo Sapiens
STWEESGPR

SEQ ID NO: 210878 - protein, 9 aa, Homo Sapiens
KIVYKTGDV

SEQ ID NO: 210879 - protein, 9 aa, Homo Sapiens
HPSRGEELG

SEQ ID NO: 210880 - protein, 9 aa, Homo Sapiens
QERANIHQT

SEQ ID NO: 210881 - protein, 9 aa, Homo Sapiens
GTTGPVWVA

SEQ ID NO: 210882 - protein, 9 aa, Homo Sapiens
GILNRTSGA

SEQ ID NO: 210883 - protein, 9 aa, Homo Sapiens
EEDEEMVEY

SEQ ID NO: 210884 - protein, 9 aa, Homo Sapiens
CPDLTDSFT

SEQ ID NO: 210885 - protein, 9 aa, Homo Sapiens
DIDECSLNL

SEQ ID NO: 210886 - protein, 9 aa, Homo Sapiens
CVVVVFSPD

SEQ ID NO: 210887 - protein, 9 aa, Homo Sapiens
PRGPAGGGG

SEQ ID NO: 210888 - protein, 9 aa, Homo Sapiens
GKGFSWLSV

SEQ ID NO: 210889 - protein, 9 aa, Homo Sapiens
VLNEPTGLY

SEQ ID NO: 210890 - protein, 9 aa, Homo Sapiens
TTNTENLQK

SEQ ID NO: 210891 - protein, 9 aa, Homo Sapiens
LALDHFKKA

SEQ ID NO: 210892 - protein, 9 aa, Homo Sapiens
GLYMGHSDT

SEQ ID NO: 210893 - protein, 9 aa, Homo Sapiens
SGLHVRSRK

SEQ ID NO: 210894 - protein, 9 aa, Homo Sapiens
HCLAICYPL

SEQ ID NO: 210895 - protein, 9 aa, Homo Sapiens
MIPTASSTP

SEQ ID NO: 210896 - protein, 9 aa, Homo Sapiens
KQVHISFLL

SEQ ID NO: 210897 - protein, 9 aa, Homo Sapiens
MLVRNRVSW

SEQ ID NO: 210898 - protein, 9 aa, Homo Sapiens
AQLDELNLS

SEQ ID NO: 210899 - protein, 9 aa, Homo Sapiens
HVRSRKVEE

SEQ ID NO: 210900 - protein, 9 aa, Homo Sapiens
PTHPSRGEE

SEQ ID NO: 210901 - protein, 9 aa, Homo Sapiens
VPGEQGCDE

SEQ ID NO: 210902 - protein, 9 aa, Homo Sapiens
ERAPQYQTN

SEQ ID NO: 210903 - protein, 9 aa, Homo Sapiens
TTHHPQNRR

SEQ ID NO: 210904 - protein, 9 aa, Homo Sapiens
VGGERSLPR

SEQ ID NO: 210905 - protein, 9 aa, Homo Sapiens
HYLQENREK

SEQ ID NO: 210906 - protein, 9 aa, Homo Sapiens
VTNDWDRRT

SEQ ID NO: 210907 - protein, 9 aa, Homo Sapiens
SGLMESLEP

SEQ ID NO: 210908 - protein, 9 aa, Homo Sapiens
LLRFHFISN

SEQ ID NO: 210909 - protein, 9 aa, Homo Sapiens
ERQTGVGSY

SEQ ID NO: 210910 - protein, 9 aa, Homo Sapiens
GTGAGVTGA

SEQ ID NO: 210911 - protein, 9 aa, Homo Sapiens
ERYISHFNT

SEQ ID NO: 210912 - protein, 9 aa, Homo Sapiens
GIIERAPQY

SEQ ID NO: 210913 - protein, 9 aa, Homo Sapiens
KKAKKMGGK

SEQ ID NO: 210914 - protein, 9 aa, Homo Sapiens
TAAATSLAT

SEQ ID NO: 210915 - protein, 9 aa, Homo Sapiens
QSYRKKKDA

SEQ ID NO: 210916 - protein, 9 aa, Homo Sapiens
RSGSRSQRS

SEQ ID NO: 210917 - protein, 9 aa, Homo Sapiens
NQGENRRCH

SEQ ID NO: 210918 - protein, 9 aa, Homo Sapiens
DWIRHVIEI

SEQ ID NO: 210919 - protein, 9 aa, Homo Sapiens
GHVQDPIDR

SEQ ID NO: 210920 - protein, 9 aa, Homo Sapiens
NRFQQSLPL

SEQ ID NO: 210921 - protein, 9 aa, Homo Sapiens
PRASIHPMV

SEQ ID NO: 210922 - protein, 9 aa, Homo Sapiens
TYETKRDIY

SEQ ID NO: 210923 - protein, 9 aa, Homo Sapiens
AGTTFEYQH

SEQ ID NO: 210924 - protein, 9 aa, Homo Sapiens
SATHNSHTG

SEQ ID NO: 210925 - protein, 9 aa, Homo Sapiens
GTTFEYQHS

SEQ ID NO: 210926 - protein, 9 aa, Homo Sapiens
IFKIHACSM

SEQ ID NO: 210927 - protein, 9 aa, Homo Sapiens
RHLAEVLEW

SEQ ID NO: 210928 - protein, 9 aa, Homo Sapiens
AKKMGGKDF

SEQ ID NO: 210929 - protein, 9 aa, Homo Sapiens
LGVAGRKNL

SEQ ID NO: 210930 - protein, 9 aa, Homo Sapiens
IYHGGKPLC

SEQ ID NO: 210931 - protein, 9 aa, Homo Sapiens
SPVCGRTLQ

SEQ ID NO: 210932 - protein, 9 aa, Homo Sapiens
EITLGKQIG

SEQ ID NO: 210933 - protein, 9 aa, Homo Sapiens
AGVFYILIV

SEQ ID NO: 210934 - protein, 9 aa, Homo Sapiens
SNDTYIAKT

SEQ ID NO: 210935 - protein, 9 aa, Homo Sapiens
QPQDSQSYR

SEQ ID NO: 210936 - protein, 9 aa, Homo Sapiens
VTQMLIPYY

SEQ ID NO: 210937 - protein, 9 aa, Homo Sapiens
QQVGFVCTV

SEQ ID NO: 210938 - protein, 9 aa, Homo Sapiens
LTTVEVLSH

SEQ ID NO: 210939 - protein, 9 aa, Homo Sapiens
TRHVSVRNG

SEQ ID NO: 210940 - protein, 9 aa, Homo Sapiens
GWEKRMIRP

SEQ ID NO: 210941 - protein, 9 aa, Homo Sapiens
HFTTNTENL

SEQ ID NO: 210942 - protein, 9 aa, Homo Sapiens
WIRHVIEIH

SEQ ID NO: 210943 - protein, 9 aa, Homo Sapiens
RDEDDVPIV

SEQ ID NO: 210944 - protein, 9 aa, Homo Sapiens
RNGKSPTVP

SEQ ID NO: 210945 - protein, 9 aa, Homo Sapiens
EDEEMVEYK

SEQ ID NO: 210946 - protein, 9 aa, Homo Sapiens
RMNRFQQSL

SEQ ID NO: 210947 - protein, 9 aa, Homo Sapiens
PQQVGFVCT

SEQ ID NO: 210948 - protein, 9 aa, Homo Sapiens
KQKVSFLEN

SEQ ID NO: 210949 - protein, 9 aa, Homo Sapiens
SDSYAPCCL

SEQ ID NO: 210950 - protein, 9 aa, Homo Sapiens
KVTQMLIPY

SEQ ID NO: 210951 - protein, 9 aa, Homo Sapiens
HPEDCEKGG

SEQ ID NO: 210952 - protein, 9 aa, Homo Sapiens
YYVGTLGTY

SEQ ID NO: 210953 - protein, 9 aa, Homo Sapiens
GPSHSPVCG

SEQ ID NO: 210954 - protein, 9 aa, Homo Sapiens
IVSSVNNSL

SEQ ID NO: 210955 - protein, 9 aa, Homo Sapiens
LLRPPTHPS

SEQ ID NO: 210956 - protein, 9 aa, Homo Sapiens
SHSALLHRR

SEQ ID NO: 210957 - protein, 9 aa, Homo Sapiens
QYQTNKMPT

SEQ ID NO: 210958 - protein, 9 aa, Homo Sapiens
CNYGGRVTN

SEQ ID NO: 210959 - protein, 9 aa, Homo Sapiens
CGKGFSWLS

SEQ ID NO: 210960 - protein, 9 aa, Homo Sapiens
VTLYEMIVA

SEQ ID NO: 210961 - protein, 9 aa, Homo Sapiens
WRPVQLCHS

SEQ ID NO: 210962 - protein, 9 aa, Homo Sapiens
EESGPRYDK

SEQ ID NO: 210963 - protein, 9 aa, Homo Sapiens
QQSLPLSRS

SEQ ID NO: 210964 - protein, 9 aa, Homo Sapiens
RPSLSLAAA

SEQ ID NO: 210965 - protein, 9 aa, Homo Sapiens
DCVKHKGME

SEQ ID NO: 210966 - protein, 9 aa, Homo Sapiens
IHACSMSVE

SEQ ID NO: 210967 - protein, 9 aa, Homo Sapiens
NEMNNQGVE

SEQ ID NO: 210968 - protein, 9 aa, Homo Sapiens
PPVGQAQVA

SEQ ID NO: 210969 - protein, 9 aa, Homo Sapiens
KHPERYISH

SEQ ID NO: 210970 - protein, 9 aa, Homo Sapiens
PYSTTKTPH

SEQ ID NO: 210971 - protein, 9 aa, Homo Sapiens
KHKGMERGR

SEQ ID NO: 210972 - protein, 9 aa, Homo Sapiens
TTGPVWVAI

SEQ ID NO: 210973 - protein, 9 aa, Homo Sapiens
YAHIRLRDV

SEQ ID NO: 210974 - protein, 9 aa, Homo Sapiens
TGTAAATSL

SEQ ID NO: 210975 - protein, 9 aa, Homo Sapiens
LVGNNCDLP

SEQ ID NO: 210976 - protein, 9 aa, Homo Sapiens
PPTAFIHTL

SEQ ID NO: 210977 - protein, 9 aa, Homo Sapiens
DAQCQDRPF

SEQ ID NO: 210978 - protein, 9 aa, Homo Sapiens
RAPQYQTNK

SEQ ID NO: 210979 - protein, 9 aa, Homo Sapiens
IVTFQEQGG

SEQ ID NO: 210980 - protein, 9 aa, Homo Sapiens
TECWDRPRP

SEQ ID NO: 210981 - protein, 9 aa, Homo Sapiens
PVQLCHSHS

SEQ ID NO: 210982 - protein, 9 aa, Homo Sapiens
ESCDMPPLK

SEQ ID NO: 210983 - protein, 9 aa, Homo Sapiens
CLSTVNGVV

SEQ ID NO: 210984 - protein, 9 aa, Homo Sapiens
PQDSQSYRK

SEQ ID NO: 210985 - protein, 9 aa, Homo Sapiens
DDVPIVPST

SEQ ID NO: 210986 - protein, 9 aa, Homo Sapiens
VKHKGMERG

SEQ ID NO: 210987 - protein, 9 aa, Homo Sapiens
PVVPEDTAP

SEQ ID NO: 210988 - protein, 9 aa, Homo Sapiens
LKPYFLEVY

SEQ ID NO: 210989 - protein, 9 aa, Homo Sapiens
YLECVYPSM

SEQ ID NO: 210990 - protein, 9 aa, Homo Sapiens
NGVVDPIIY

SEQ ID NO: 210991 - protein, 9 aa, Homo Sapiens
GGPRGPAGG

SEQ ID NO: 210992 - protein, 9 aa, Homo Sapiens
YMGHSDTQL

SEQ ID NO: 210993 - protein, 9 aa, Homo Sapiens
DLWNIGISI

SEQ ID NO: 210994 - protein, 9 aa, Homo Sapiens
EWVNSKGYK

SEQ ID NO: 210995 - protein, 9 aa, Homo Sapiens
VKNILGGFL

SEQ ID NO: 210996 - protein, 9 aa, Homo Sapiens
MVEYKVGQD

SEQ ID NO: 210997 - protein, 9 aa, Homo Sapiens
GVFYILIVG

SEQ ID NO: 210998 - protein, 9 aa, Homo Sapiens
IHTLFGPHL

SEQ ID NO: 210999 - protein, 9 aa, Homo Sapiens
VGQQALYNS

SEQ ID NO: 211000 - protein, 9 aa, Homo Sapiens
HSPIRYFMQ

SEQ ID NO: 211001 - protein, 9 aa, Homo Sapiens
VLEWVNSKG

SEQ ID NO: 211002 - protein, 9 aa, Homo Sapiens
GEQGCDEEH

SEQ ID NO: 211003 - protein, 9 aa, Homo Sapiens
YSTTKTPHP

SEQ ID NO: 211004 - protein, 9 aa, Homo Sapiens
PHSPIRYFM

SEQ ID NO: 211005 - protein, 9 aa, Homo Sapiens
LLLCAFRCH

SEQ ID NO: 211006 - protein, 9 aa, Homo Sapiens
ARMQRRERE

SEQ ID NO: 211007 - protein, 9 aa, Homo Sapiens
IRKPAQQSL

SEQ ID NO: 211008 - protein, 9 aa, Homo Sapiens
SDGSTAVHL

SEQ ID NO: 211009 - protein, 9 aa, Homo Sapiens
AINKASRDT

SEQ ID NO: 211010 - protein, 9 aa, Homo Sapiens
EEMVEYKVG

SEQ ID NO: 211011 - protein, 9 aa, Homo Sapiens
DEKILEIGA

SEQ ID NO: 211012 - protein, 9 aa, Homo Sapiens
GGKPLCDNV

SEQ ID NO: 211013 - protein, 9 aa, Homo Sapiens
PMVLVGNNC

SEQ ID NO: 211014 - protein, 9 aa, Homo Sapiens
GIYHGGKPL

SEQ ID NO: 211015 - protein, 9 aa, Homo Sapiens
DPKLLGKIL

SEQ ID NO: 211016 - protein, 9 aa, Homo Sapiens
SGVCSRSYS

SEQ ID NO: 211017 - protein, 9 aa, Homo Sapiens
GLDPKLLGK

SEQ ID NO: 211018 - protein, 9 aa, Homo Sapiens
RRNLCEWIR

SEQ ID NO: 211019 - protein, 9 aa, Homo Sapiens
FVCTVLALV

SEQ ID NO: 211020 - protein, 9 aa, Homo Sapiens
LTDSFTRLE

SEQ ID NO: 211021 - protein, 9 aa, Homo Sapiens
LFSGLHVRS

SEQ ID NO: 211022 - protein, 9 aa, Homo Sapiens
PCACDCRAR

SEQ ID NO: 211023 - protein, 9 aa, Homo Sapiens
LGGWTCVPG

SEQ ID NO: 211024 - protein, 9 aa, Homo Sapiens
ARMPPVWIS

SEQ ID NO: 211025 - protein, 9 aa, Homo Sapiens
DSNGQSPFN

SEQ ID NO: 211026 - protein, 9 aa, Homo Sapiens
NCDLPSRTV

SEQ ID NO: 211027 - protein, 9 aa, Homo Sapiens
ATGLNLPSV

SEQ ID NO: 211028 - protein, 9 aa, Homo Sapiens
YAAIGEIHK

SEQ ID NO: 211029 - protein, 9 aa, Homo Sapiens
PPRPSLSLA

SEQ ID NO: 211030 - protein, 9 aa, Homo Sapiens
LEDQIQDFV

SEQ ID NO: 211031 - protein, 9 aa, Homo Sapiens
RCSLEHRAY

SEQ ID NO: 211032 - protein, 9 aa, Homo Sapiens
VPEDTAPLM

SEQ ID NO: 211033 - protein, 9 aa, Homo Sapiens
KTLGSNDTY

SEQ ID NO: 211034 - protein, 9 aa, Homo Sapiens
QKAVIYPLN

SEQ ID NO: 211035 - protein, 9 aa, Homo Sapiens
EKVAPERNG

SEQ ID NO: 211036 - protein, 9 aa, Homo Sapiens
ISIFIQDGP

SEQ ID NO: 211037 - protein, 9 aa, Homo Sapiens
WLYKHRDNL

SEQ ID NO: 211038 - protein, 9 aa, Homo Sapiens
PQNRRAAGQ

SEQ ID NO: 211039 - protein, 9 aa, Homo Sapiens
DEEMVEYKV

SEQ ID NO: 211040 - protein, 9 aa, Homo Sapiens
VAPERNGKS

SEQ ID NO: 211041 - protein, 9 aa, Homo Sapiens
PPTTHHPQN

SEQ ID NO: 211042 - protein, 9 aa, Homo Sapiens
SGEEPQKCP

SEQ ID NO: 211043 - protein, 9 aa, Homo Sapiens
GAVNQVVAT

SEQ ID NO: 211044 - protein, 9 aa, Homo Sapiens
LLAATGLNL

SEQ ID NO: 211045 - protein, 9 aa, Homo Sapiens
APERNGKSP

SEQ ID NO: 211046 - protein, 9 aa, Homo Sapiens
YEPQDPSAE

SEQ ID NO: 211047 - protein, 9 aa, Homo Sapiens
FNLAASKGL

SEQ ID NO: 211048 - protein, 9 aa, Homo Sapiens
YFLEVYRPI

SEQ ID NO: 211049 - protein, 9 aa, Homo Sapiens
GPRYDKAYP

SEQ ID NO: 211050 - protein, 9 aa, Homo Sapiens
MVLVGNNCD

SEQ ID NO: 211051 - protein, 9 aa, Homo Sapiens
YPLNFTANP

SEQ ID NO: 211052 - protein, 9 aa, Homo Sapiens
VPYSTTKTP

SEQ ID NO: 211053 - protein, 9 aa, Homo Sapiens
FYSQNEMNN

SEQ ID NO: 211054 - protein, 9 aa, Homo Sapiens
AKAWSHMPE

SEQ ID NO: 211055 - protein, 9 aa, Homo Sapiens
TLRTDDGYM

SEQ ID NO: 211056 - protein, 9 aa, Homo Sapiens
SAFDPLPIS

SEQ ID NO: 211057 - protein, 9 aa, Homo Sapiens
AERERQTGV

SEQ ID NO: 211058 - protein, 9 aa, Homo Sapiens
ALDTRHVSV

SEQ ID NO: 211059 - protein, 9 aa, Homo Sapiens
GSEHTVDWI

SEQ ID NO: 211060 - protein, 9 aa, Homo Sapiens
IDECSLNLL

SEQ ID NO: 211061 - protein, 9 aa, Homo Sapiens
FADFYSQNE

SEQ ID NO: 211062 - protein, 9 aa, Homo Sapiens
ALYNSGISE

SEQ ID NO: 211063 - protein, 9 aa, Homo Sapiens
DQLKLGKPL

SEQ ID NO: 211064 - protein, 9 aa, Homo Sapiens
QGLQDAFYS

SEQ ID NO: 211065 - protein, 9 aa, Homo Sapiens
DEEEHGVER

SEQ ID NO: 211066 - protein, 9 aa, Homo Sapiens
LNVGQQALY

SEQ ID NO: 211067 - protein, 9 aa, Homo Sapiens
FTTNTENLQ

SEQ ID NO: 211068 - protein, 9 aa, Homo Sapiens
TENLQKLKL

SEQ ID NO: 211069 - protein, 9 aa, Homo Sapiens
KESLLSGVC

SEQ ID NO: 211070 - protein, 9 aa, Homo Sapiens
ASEGPPRMC

SEQ ID NO: 211071 - protein, 9 aa, Homo Sapiens
GISIFIQDG

SEQ ID NO: 211072 - protein, 9 aa, Homo Sapiens
QRALHMLEK

SEQ ID NO: 211073 - protein, 9 aa, Homo Sapiens
LHMLEKARH

SEQ ID NO: 211074 - protein, 9 aa, Homo Sapiens
HSLAAHRCS

SEQ ID NO: 211075 - protein, 9 aa, Homo Sapiens
LPISPSDDK

SEQ ID NO: 211076 - protein, 9 aa, Homo Sapiens
SLSLAAAPS

SEQ ID NO: 211077 - protein, 9 aa, Homo Sapiens
KDLWARADA

SEQ ID NO: 211078 - protein, 9 aa, Homo Sapiens
LSILPTVLG

SEQ ID NO: 211079 - protein, 9 aa, Homo Sapiens
PISPSDDKA

SEQ ID NO: 211080 - protein, 9 aa, Homo Sapiens
VRNRVSWWG

SEQ ID NO: 211081 - protein, 9 aa, Homo Sapiens
GQQALYNSG

SEQ ID NO: 211082 - protein, 9 aa, Homo Sapiens
SFLQDVQNE

SEQ ID NO: 211083 - protein, 9 aa, Homo Sapiens
LYNSGISEV

SEQ ID NO: 211084 - protein, 9 aa, Homo Sapiens
FYSDWETGK

SEQ ID NO: 211085 - protein, 9 aa, Homo Sapiens
IHCYLDLVY

SEQ ID NO: 211086 - protein, 9 aa, Homo Sapiens
CVKHKGMER

SEQ ID NO: 211087 - protein, 9 aa, Homo Sapiens
EMVEYKVGQ

SEQ ID NO: 211088 - protein, 9 aa, Homo Sapiens
DYKAKRSNE

SEQ ID NO: 211089 - protein, 9 aa, Homo Sapiens
ECSLNLLLC

SEQ ID NO: 211090 - protein, 9 aa, Homo Sapiens
KASRDTTRC

SEQ ID NO: 211091 - protein, 9 aa, Homo Sapiens
VGNNCDLPS

SEQ ID NO: 211092 - protein, 9 aa, Homo Sapiens
NLEPSTHAP

SEQ ID NO: 211093 - protein, 9 aa, Homo Sapiens
CCNLEPSTH

SEQ ID NO: 211094 - protein, 9 aa, Homo Sapiens
PSLSLAAAP

SEQ ID NO: 211095 - protein, 9 aa, Homo Sapiens
PAGEEEEAG

SEQ ID NO: 211096 - protein, 9 aa, Homo Sapiens
KAKKMGGKD

SEQ ID NO: 211097 - protein, 9 aa, Homo Sapiens
KEGLQSSRD

SEQ ID NO: 211098 - protein, 9 aa, Homo Sapiens
CDEEHCKEH

SEQ ID NO: 211099 - protein, 9 aa, Homo Sapiens
MVGGERSLP

SEQ ID NO: 211100 - protein, 9 aa, Homo Sapiens
TADGWRRIT

SEQ ID NO: 211101 - protein, 9 aa, Homo Sapiens
PNSKLYMKL

SEQ ID NO: 211102 - protein, 9 aa, Homo Sapiens
MQEDINQGK

SEQ ID NO: 211103 - protein, 9 aa, Homo Sapiens
LRDLLFARS

SEQ ID NO: 211104 - protein, 9 aa, Homo Sapiens
AARQTPQHG

SEQ ID NO: 211105 - protein, 9 aa, Homo Sapiens
QDPSAEVEM

SEQ ID NO: 211106 - protein, 9 aa, Homo Sapiens
AVSQHQNQI

SEQ ID NO: 211107 - protein, 9 aa, Homo Sapiens
LAAAPSAPG

SEQ ID NO: 211108 - protein, 9 aa, Homo Sapiens
LMADAQCQD

SEQ ID NO: 211109 - protein, 9 aa, Homo Sapiens
FLEVYRPIR

SEQ ID NO: 211110 - protein, 9 aa, Homo Sapiens
AFYSDWETG

SEQ ID NO: 211111 - protein, 9 aa, Homo Sapiens
SSVPYSTTK

SEQ ID NO: 211112 - protein, 9 aa, Homo Sapiens
LDGAGGGPG

SEQ ID NO: 211113 - protein, 9 aa, Homo Sapiens
RDNLYPTKT

SEQ ID NO: 211114 - protein, 9 aa, Homo Sapiens
LAAHRCSLE

SEQ ID NO: 211115 - protein, 9 aa, Homo Sapiens
LACTYTFVL

SEQ ID NO: 211116 - protein, 9 aa, Homo Sapiens
NILGGFLSI

SEQ ID NO: 211117 - protein, 9 aa, Homo Sapiens
TMRCNLRHC

SEQ ID NO: 211118 - protein, 9 aa, Homo Sapiens
WEFPRDQLK

SEQ ID NO: 211119 - protein, 9 aa, Homo Sapiens
IFLLGVAGR

SEQ ID NO: 211120 - protein, 9 aa, Homo Sapiens
RRREDSDRI

SEQ ID NO: 211121 - protein, 9 aa, Homo Sapiens
QDAFYSDWE

SEQ ID NO: 211122 - protein, 9 aa, Homo Sapiens
GPNSKLYMK

SEQ ID NO: 211123 - protein, 9 aa, Homo Sapiens
NERNAPKWS

SEQ ID NO: 211124 - protein, 9 aa, Homo Sapiens
DSDCSYPLD

SEQ ID NO: 211125 - protein, 9 aa, Homo Sapiens
AQCQDRPFF

SEQ ID NO: 211126 - protein, 9 aa, Homo Sapiens
QDVQNEDKG

SEQ ID NO: 211127 - protein, 9 aa, Homo Sapiens
WEESGPRYD

SEQ ID NO: 211128 - protein, 9 aa, Homo Sapiens
AVIYPLNFT

SEQ ID NO: 211129 - protein, 9 aa, Homo Sapiens
DTYIAKTTV

SEQ ID NO: 211130 - protein, 9 aa, Homo Sapiens
DGAGGGPGL

SEQ ID NO: 211131 - protein, 9 aa, Homo Sapiens
IERAPQYQT

SEQ ID NO: 211132 - protein, 9 aa, Homo Sapiens
LSSSATHNS

SEQ ID NO: 211133 - protein, 9 aa, Homo Sapiens
RTSGAVGSK

SEQ ID NO: 211134 - protein, 9 aa, Homo Sapiens
GSLGCELYP

SEQ ID NO: 211135 - protein, 9 aa, Homo Sapiens
VLVGNNCDL

SEQ ID NO: 211136 - protein, 9 aa, Homo Sapiens
NSRALFIRN

SEQ ID NO: 211137 - protein, 9 aa, Homo Sapiens
AGLYMGHSD

SEQ ID NO: 211138 - protein, 9 aa, Homo Sapiens
PKIIRQEER

SEQ ID NO: 211139 - protein, 9 aa, Homo Sapiens
YLKPYFLEV

SEQ ID NO: 211140 - protein, 9 aa, Homo Sapiens
NGKSPTVPC

SEQ ID NO: 211141 - protein, 9 aa, Homo Sapiens
LGKILNMSS

SEQ ID NO: 211142 - protein, 9 aa, Homo Sapiens
FTPNQVARI

SEQ ID NO: 211143 - protein, 9 aa, Homo Sapiens
RANIHQTEH

SEQ ID NO: 211144 - protein, 9 aa, Homo Sapiens
NGAQLDELN

SEQ ID NO: 211145 - protein, 9 aa, Homo Sapiens
ALHSDSDQS

SEQ ID NO: 211146 - protein, 9 aa, Homo Sapiens
QENREKFEA

SEQ ID NO: 211147 - protein, 9 aa, Homo Sapiens
EPTGLYELD

SEQ ID NO: 211148 - protein, 9 aa, Homo Sapiens
PPTHPSRGE

SEQ ID NO: 211149 - protein, 9 aa, Homo Sapiens
SLEHRAYSP

SEQ ID NO: 211150 - protein, 9 aa, Homo Sapiens
FHFISNNCI

SEQ ID NO: 211151 - protein, 9 aa, Homo Sapiens
TRGHVQDPI

SEQ ID NO: 211152 - protein, 9 aa, Homo Sapiens
LCLFSGLHV

SEQ ID NO: 211153 - protein, 9 aa, Homo Sapiens
HVSVRNGEQ

SEQ ID NO: 211154 - protein, 9 aa, Homo Sapiens
LGPPVGQAQ

SEQ ID NO: 211155 - protein, 9 aa, Homo Sapiens
EWIRKPAQQ

SEQ ID NO: 211156 - protein, 9 aa, Homo Sapiens
VSSVNNSLT

SEQ ID NO: 211157 - protein, 9 aa, Homo Sapiens
RNQGENRRC

SEQ ID NO: 211158 - protein, 9 aa, Homo Sapiens
FMQEDINQG

SEQ ID NO: 211159 - protein, 9 aa, Homo Sapiens
TYNDNLIPC

SEQ ID NO: 211160 - protein, 9 aa, Homo Sapiens
CACDCRARP

SEQ ID NO: 211161 - protein, 9 aa, Homo Sapiens
DNLYPTKTE

SEQ ID NO: 211162 - protein, 9 aa, Homo Sapiens
KLVQSNTYE

SEQ ID NO: 211163 - protein, 9 aa, Homo Sapiens
DGCALDTRH

SEQ ID NO: 211164 - protein, 9 aa, Homo Sapiens
AGEEEEAGR

SEQ ID NO: 211165 - protein, 9 aa, Homo Sapiens
RGASEGPPR

SEQ ID NO: 211166 - protein, 9 aa, Homo Sapiens
VEVLSHQSH

SEQ ID NO: 211167 - protein, 9 aa, Homo Sapiens
KDHRWARVA

SEQ ID NO: 211168 - protein, 9 aa, Homo Sapiens
ARSAPAWLR

SEQ ID NO: 211169 - protein, 9 aa, Homo Sapiens
GTAAATSLA

SEQ ID NO: 211170 - protein, 9 aa, Homo Sapiens
IGISIFIQD

SEQ ID NO: 211171 - protein, 9 aa, Homo Sapiens
SLGCELYPG

SEQ ID NO: 211172 - protein, 9 aa, Homo Sapiens
AAHRCSLEH

SEQ ID NO: 211173 - protein, 9 aa, Homo Sapiens
GSRRREDSD

SEQ ID NO: 211174 - protein, 9 aa, Homo Sapiens
CHSHSALLH

SEQ ID NO: 211175 - protein, 9 aa, Homo Sapiens
EDAQTLHSL

SEQ ID NO: 211176 - protein, 9 aa, Homo Sapiens
DVPIVPSTL

SEQ ID NO: 211177 - protein, 9 aa, Homo Sapiens
VQNEDKGIK

SEQ ID NO: 211178 - protein, 9 aa, Homo Sapiens
CLFSGLHVR

SEQ ID NO: 211179 - protein, 9 aa, Homo Sapiens
AEELNFQDE

SEQ ID NO: 211180 - protein, 9 aa, Homo Sapiens
NDWDRRTLR

SEQ ID NO: 211181 - protein, 9 aa, Homo Sapiens
VREITLGKQ

SEQ ID NO: 211182 - protein, 9 aa, Homo Sapiens
SVNNSLTEA

SEQ ID NO: 211183 - protein, 9 aa, Homo Sapiens
PELHPQPNP

SEQ ID NO: 211184 - protein, 9 aa, Homo Sapiens
ILGGFLSIL

SEQ ID NO: 211185 - protein, 9 aa, Homo Sapiens
SLNLLLCAF

SEQ ID NO: 211186 - protein, 9 aa, Homo Sapiens
TSGAVGSKV

SEQ ID NO: 211187 - protein, 9 aa, Homo Sapiens
LGLDPKLLG

SEQ ID NO: 211188 - protein, 9 aa, Homo Sapiens
RMPPVWIST

SEQ ID NO: 211189 - protein, 9 aa, Homo Sapiens
HCPPARWVA

SEQ ID NO: 211190 - protein, 9 aa, Homo Sapiens
RNAPKWSQS

SEQ ID NO: 211191 - protein, 9 aa, Homo Sapiens
EEEEAGRPG

SEQ ID NO: 211192 - protein, 9 aa, Homo Sapiens
SNTYETKRD

SEQ ID NO: 211193 - protein, 9 aa, Homo Sapiens
REDIVSSVN

SEQ ID NO: 211194 - protein, 9 aa, Homo Sapiens
PNGTTGPVW

SEQ ID NO: 211195 - protein, 9 aa, Homo Sapiens
SKLYMKLVM

SEQ ID NO: 211196 - protein, 9 aa, Homo Sapiens
ACIHYLQEN

SEQ ID NO: 211197 - protein, 9 aa, Homo Sapiens
MESLEPTTS

SEQ ID NO: 211198 - protein, 9 aa, Homo Sapiens
LGTYTEIKR

SEQ ID NO: 211199 - protein, 9 aa, Homo Sapiens
IFIQDGPFL

SEQ ID NO: 211200 - protein, 9 aa, Homo Sapiens
EYGKAFSRL

SEQ ID NO: 211201 - protein, 9 aa, Homo Sapiens
YLQGLSSIA

SEQ ID NO: 211202 - protein, 9 aa, Homo Sapiens
AHRCSLEHR

SEQ ID NO: 211203 - protein, 9 aa, Homo Sapiens
NEPTGLYEL

SEQ ID NO: 211204 - protein, 9 aa, Homo Sapiens
LHPQPNPEE

SEQ ID NO: 211205 - protein, 9 aa, Homo Sapiens
PVWVAIKSQ

SEQ ID NO: 211206 - protein, 9 aa, Homo Sapiens
DTRHVSVRN

SEQ ID NO: 211207 - protein, 9 aa, Homo Sapiens
VHISFLLAN

SEQ ID NO: 211208 - protein, 9 aa, Homo Sapiens
SEHTVDWIR

SEQ ID NO: 211209 - protein, 9 aa, Homo Sapiens
YVGTLGTYT

SEQ ID NO: 211210 - protein, 9 aa, Homo Sapiens
YTFVLELLM

SEQ ID NO: 211211 - protein, 9 aa, Homo Sapiens
MLIPYYISV

SEQ ID NO: 211212 - protein, 9 aa, Homo Sapiens
RILQGERRR

SEQ ID NO: 211213 - protein, 9 aa, Homo Sapiens
ADFYSQNEM

SEQ ID NO: 211214 - protein, 9 aa, Homo Sapiens
FDYNTYNDN

SEQ ID NO: 211215 - protein, 9 aa, Homo Sapiens
TTFEYQHSF

SEQ ID NO: 211216 - protein, 9 aa, Homo Sapiens
IHSGEEPQK

SEQ ID NO: 211217 - protein, 9 aa, Homo Sapiens
CTVLALVCC

SEQ ID NO: 211218 - protein, 9 aa, Homo Sapiens
MIRPSGRGY

SEQ ID NO: 211219 - protein, 9 aa, Homo Sapiens
EMIVARGPF

SEQ ID NO: 211220 - protein, 9 aa, Homo Sapiens
QLCHSHSAL

SEQ ID NO: 211221 - protein, 9 aa, Homo Sapiens
IHPMVTPAT

SEQ ID NO: 211222 - protein, 9 aa, Homo Sapiens
AAIGEIHKV

SEQ ID NO: 211223 - protein, 9 aa, Homo Sapiens
RQTPQHGLS

SEQ ID NO: 211224 - protein, 9 aa, Homo Sapiens
LQDVQNEDK

SEQ ID NO: 211225 - protein, 9 aa, Homo Sapiens
EQQNLRYAL

SEQ ID NO: 211226 - protein, 9 aa, Homo Sapiens
HRRIEIAHT

SEQ ID NO: 211227 - protein, 9 aa, Homo Sapiens
DLWARADAH

SEQ ID NO: 211228 - protein, 9 aa, Homo Sapiens
GAGSGGTGA

SEQ ID NO: 211229 - protein, 9 aa, Homo Sapiens
EPQDPSAEV

SEQ ID NO: 211230 - protein, 9 aa, Homo Sapiens
RCWSQDCVK

SEQ ID NO: 211231 - protein, 9 aa, Homo Sapiens
DLLRPPTHP

SEQ ID NO: 211232 - protein, 9 aa, Homo Sapiens
ISPSDDKAL

SEQ ID NO: 211233 - protein, 9 aa, Homo Sapiens
LNIFLLGVA

SEQ ID NO: 211234 - protein, 9 aa, Homo Sapiens
IKLNTDFLF

SEQ ID NO: 211235 - protein, 9 aa, Homo Sapiens
GQSPFNLAA

SEQ ID NO: 211236 - protein, 9 aa, Homo Sapiens
NCVPPFSPL

SEQ ID NO: 211237 - protein, 9 aa, Homo Sapiens
GTVKNILGG

SEQ ID NO: 211238 - protein, 9 aa, Homo Sapiens
NYGGRVTND

SEQ ID NO: 211239 - protein, 9 aa, Homo Sapiens
NNCDLPSRT

SEQ ID NO: 211240 - protein, 9 aa, Homo Sapiens
LGSNDTYIA

SEQ ID NO: 211241 - protein, 9 aa, Homo Sapiens
SYDSDCSYP

SEQ ID NO: 211242 - protein, 9 aa, Homo Sapiens
KQIGFYRIR

SEQ ID NO: 211243 - protein, 9 aa, Homo Sapiens
YKVGQDSEL

SEQ ID NO: 211244 - protein, 9 aa, Homo Sapiens
RHVSVRNGE

SEQ ID NO: 211245 - protein, 9 aa, Homo Sapiens
PPGWEKRMI

SEQ ID NO: 211246 - protein, 9 aa, Homo Sapiens
YISHFNTDI

SEQ ID NO: 211247 - protein, 9 aa, Homo Sapiens
GKILNMSSG

SEQ ID NO: 211248 - protein, 9 aa, Homo Sapiens
LQDAFYSDW

SEQ ID NO: 211249 - protein, 9 aa, Homo Sapiens
GSRSQRSRH

SEQ ID NO: 211250 - protein, 9 aa, Homo Sapiens
LHVRSRKVE

SEQ ID NO: 211251 - protein, 9 aa, Homo Sapiens
SMVGGERSL

SEQ ID NO: 211252 - protein, 9 aa, Homo Sapiens
FNGAQLDEL

SEQ ID NO: 211253 - protein, 9 aa, Homo Sapiens
TVEVLSHQS

SEQ ID NO: 211254 - protein, 9 aa, Homo Sapiens
DCSYPLDLE

SEQ ID NO: 211255 - protein, 9 aa, Homo Sapiens
SQKAVIYPL

SEQ ID NO: 211256 - protein, 9 aa, Homo Sapiens
WRWRSRPLN

SEQ ID NO: 211257 - protein, 9 aa, Homo Sapiens
TAFIHTLFG

SEQ ID NO: 211258 - protein, 9 aa, Homo Sapiens
VAKGVGLVG

SEQ ID NO: 211259 - protein, 9 aa, Homo Sapiens
LSLAAAPSA

SEQ ID NO: 211260 - protein, 9 aa, Homo Sapiens
IVPSTLGEE

SEQ ID NO: 211261 - protein, 9 aa, Homo Sapiens
ECWDRPRPR

SEQ ID NO: 211262 - protein, 9 aa, Homo Sapiens
VGITALLGC

SEQ ID NO: 211263 - protein, 9 aa, Homo Sapiens
KRMIRPSGR

SEQ ID NO: 211264 - protein, 9 aa, Homo Sapiens
EDIVSSVNN

SEQ ID NO: 211265 - protein, 9 aa, Homo Sapiens
SSGPNSKLY

SEQ ID NO: 211266 - protein, 9 aa, Homo Sapiens
VGHFYEPQD

SEQ ID NO: 211267 - protein, 9 aa, Homo Sapiens
FARSAPAWL

SEQ ID NO: 211268 - protein, 9 aa, Homo Sapiens
PERNGKSPT

SEQ ID NO: 211269 - protein, 9 aa, Homo Sapiens
LNCVPPFSP

SEQ ID NO: 211270 - protein, 9 aa, Homo Sapiens
PVYAHIRLR

SEQ ID NO: 211271 - protein, 9 aa, Homo Sapiens
GDAARQTPQ

SEQ ID NO: 211272 - protein, 9 aa, Homo Sapiens
EVYRPIRKG

SEQ ID NO: 211273 - protein, 9 aa, Homo Sapiens
PRDQLKLGK

SEQ ID NO: 211274 - protein, 9 aa, Homo Sapiens
HACSMSVER

SEQ ID NO: 211275 - protein, 9 aa, Homo Sapiens
INKASRDTT

SEQ ID NO: 211276 - protein, 9 aa, Homo Sapiens
MIVARGPFR

SEQ ID NO: 211277 - protein, 9 aa, Homo Sapiens
ESLLSGVCS

SEQ ID NO: 211278 - protein, 9 aa, Homo Sapiens
PQKCPECGK

SEQ ID NO: 211279 - protein, 9 aa, Homo Sapiens
HLAEVLEWV

SEQ ID NO: 211280 - protein, 9 aa, Homo Sapiens
GPVWVAIKS

SEQ ID NO: 211281 - protein, 9 aa, Homo Sapiens
GVVDPIIYV

SEQ ID NO: 211282 - protein, 9 aa, Homo Sapiens
VCSRSYSCS

SEQ ID NO: 211283 - protein, 9 aa, Homo Sapiens
KAKAWSHMP

SEQ ID NO: 211284 - protein, 9 aa, Homo Sapiens
RGNKDLWAR

SEQ ID NO: 211285 - protein, 9 aa, Homo Sapiens
CNLRHCPPA

SEQ ID NO: 211286 - protein, 9 aa, Homo Sapiens
SQHQNQIQQ

SEQ ID NO: 211287 - protein, 9 aa, Homo Sapiens
TAVHLGGWT

SEQ ID NO: 211288 - protein, 9 aa, Homo Sapiens
STHAPFTEI

SEQ ID NO: 211289 - protein, 9 aa, Homo Sapiens
VARGPFRAR

SEQ ID NO: 211290 - protein, 9 aa, Homo Sapiens
QVHISFLLA

SEQ ID NO: 211291 - protein, 9 aa, Homo Sapiens
MAVVSCVVI

SEQ ID NO: 211292 - protein, 9 aa, Homo Sapiens
CNCGAAAVR

SEQ ID NO: 211293 - protein, 9 aa, Homo Sapiens
PQHGLSALS

SEQ ID NO: 211294 - protein, 9 aa, Homo Sapiens
AEVLEWVNS

SEQ ID NO: 211295 - protein, 9 aa, Homo Sapiens
MGAERERQT

SEQ ID NO: 211296 - protein, 9 aa, Homo Sapiens
SVGAGSGGT

SEQ ID NO: 211297 - protein, 9 aa, Homo Sapiens
VNGVVDPII

SEQ ID NO: 211298 - protein, 9 aa, Homo Sapiens
HIRLRDVEA

SEQ ID NO: 211299 - protein, 9 aa, Homo Sapiens
EVPAVSQHQ

SEQ ID NO: 211300 - protein, 9 aa, Homo Sapiens
GGPGGPRGP

SEQ ID NO: 211301 - protein, 9 aa, Homo Sapiens
GEIHKVQYI

SEQ ID NO: 211302 - protein, 9 aa, Homo Sapiens
YRKKKDAMY

SEQ ID NO: 211303 - protein, 9 aa, Homo Sapiens
LAAMAYDHC

SEQ ID NO: 211304 - protein, 9 aa, Homo Sapiens
TSLATAADS

SEQ ID NO: 211305 - protein, 9 aa, Homo Sapiens
EDDVPIVPS

SEQ ID NO: 211306 - protein, 9 aa, Homo Sapiens
HISFLLANT

SEQ ID NO: 211307 - protein, 9 aa, Homo Sapiens
YILIVGLGL

SEQ ID NO: 211308 - protein, 9 aa, Homo Sapiens
GLVGITALL

SEQ ID NO: 211309 - protein, 9 aa, Homo Sapiens
IVGLGLAML

SEQ ID NO: 211310 - protein, 9 aa, Homo Sapiens
RPRPRGPSH

SEQ ID NO: 211311 - protein, 9 aa, Homo Sapiens
NKDAFCKDY

SEQ ID NO: 211312 - protein, 9 aa, Homo Sapiens
GCALDTRHV

SEQ ID NO: 211313 - protein, 9 aa, Homo Sapiens
HQNQIQQTA

SEQ ID NO: 211314 - protein, 9 aa, Homo Sapiens
RPDSSTLRT

SEQ ID NO: 211315 - protein, 9 aa, Homo Sapiens
NLLSGLMES

SEQ ID NO: 211316 - protein, 9 aa, Homo Sapiens
AFNGAQLDE

SEQ ID NO: 211317 - protein, 9 aa, Homo Sapiens
HSGEEPQKC

SEQ ID NO: 211318 - protein, 9 aa, Homo Sapiens
VYAHIRLRD

SEQ ID NO: 211319 - protein, 9 aa, Homo Sapiens
HFYEPQDPS

SEQ ID NO: 211320 - protein, 9 aa, Homo Sapiens
NVAHCMLVR

SEQ ID NO: 211321 - protein, 9 aa, Homo Sapiens
KDKMKKEGL

SEQ ID NO: 211322 - protein, 9 aa, Homo Sapiens
EDQIQDFVR

SEQ ID NO: 211323 - protein, 9 aa, Homo Sapiens
RSAPAWLRR

SEQ ID NO: 211324 - protein, 9 aa, Homo Sapiens
NCIKLNTDF

SEQ ID NO: 211325 - protein, 9 aa, Homo Sapiens
WARADAHNT

SEQ ID NO: 211326 - protein, 9 aa, Homo Sapiens
DAARQTPQH

SEQ ID NO: 211327 - protein, 9 aa, Homo Sapiens
NIHQTEHRR

SEQ ID NO: 211328 - protein, 9 aa, Homo Sapiens
QRRNLCEWI

SEQ ID NO: 211329 - protein, 9 aa, Homo Sapiens
DKDKMKKEG

SEQ ID NO: 211330 - protein, 9 aa, Homo Sapiens
FISNNCIKL

SEQ ID NO: 211331 - protein, 9 aa, Homo Sapiens
LQGERRRLK

SEQ ID NO: 211332 - protein, 9 aa, Homo Sapiens
QSKGQYTAN

SEQ ID NO: 211333 - protein, 9 aa, Homo Sapiens
STPRASIHP

SEQ ID NO: 211334 - protein, 9 aa, Homo Sapiens
NGQSPFNLA

SEQ ID NO: 211335 - protein, 9 aa, Homo Sapiens
MQRRERERS

SEQ ID NO: 211336 - protein, 9 aa, Homo Sapiens
GAERERQTG

SEQ ID NO: 211337 - protein, 9 aa, Homo Sapiens
SFATPKMIK

SEQ ID NO: 211338 - protein, 9 aa, Homo Sapiens
LTECWDRPR

SEQ ID NO: 211339 - protein, 9 aa, Homo Sapiens
TLYEMIVAR

SEQ ID NO: 211340 - protein, 9 aa, Homo Sapiens
ANIHQTEHR

SEQ ID NO: 211341 - protein, 9 aa, Homo Sapiens
RLHAGTMLT

SEQ ID NO: 211342 - protein, 9 aa, Homo Sapiens
RYISHFNTD

SEQ ID NO: 211343 - protein, 9 aa, Homo Sapiens
GKQIGFYRI

SEQ ID NO: 211344 - protein, 9 aa, Homo Sapiens
MQFKIVYKT

SEQ ID NO: 211345 - protein, 9 aa, Homo Sapiens
TGLYELDGQ

SEQ ID NO: 211346 - protein, 9 aa, Homo Sapiens
KLLGKILNM

SEQ ID NO: 211347 - protein, 9 aa, Homo Sapiens
FPELHPQPN

SEQ ID NO: 211348 - protein, 9 aa, Homo Sapiens
SLPRILPPC

SEQ ID NO: 211349 - protein, 9 aa, Homo Sapiens
KPLCDNVNT

SEQ ID NO: 211350 - protein, 9 aa, Homo Sapiens
TYTFVLELL

SEQ ID NO: 211351 - protein, 9 aa, Homo Sapiens
VNQVVATPI

SEQ ID NO: 211352 - protein, 9 aa, Homo Sapiens
PIRYFMQED

SEQ ID NO: 211353 - protein, 9 aa, Homo Sapiens
AIQSKGQYT

SEQ ID NO: 211354 - protein, 9 aa, Homo Sapiens
RPALHSDSD

SEQ ID NO: 211355 - protein, 9 aa, Homo Sapiens
QNQIQQTAG

SEQ ID NO: 211356 - protein, 9 aa, Homo Sapiens
LNEPTGLYE

SEQ ID NO: 211357 - protein, 9 aa, Homo Sapiens
WIRKPAQQS

SEQ ID NO: 211358 - protein, 9 aa, Homo Sapiens
STLRTDDGY

SEQ ID NO: 211359 - protein, 9 aa, Homo Sapiens
TGVLNEPTG

SEQ ID NO: 211360 - protein, 9 aa, Homo Sapiens
IIERAPQYQ

SEQ ID NO: 211361 - protein, 9 aa, Homo Sapiens
TDSFTRLES

SEQ ID NO: 211362 - protein, 9 aa, Homo Sapiens
RFQQSLPLS

SEQ ID NO: 211363 - protein, 9 aa, Homo Sapiens
RREDSDRIQ

SEQ ID NO: 211364 - protein, 9 aa, Homo Sapiens
IRQEERLHA

SEQ ID NO: 211365 - protein, 9 aa, Homo Sapiens
VVPEDTAPL

SEQ ID NO: 211366 - protein, 9 aa, Homo Sapiens
YSDWETGKI

SEQ ID NO: 211367 - protein, 9 aa, Homo Sapiens
KDYLTGHKT

SEQ ID NO: 211368 - protein, 9 aa, Homo Sapiens
ALLAATGLN

SEQ ID NO: 211369 - protein, 9 aa, Homo Sapiens
SRRREDSDR

SEQ ID NO: 211370 - protein, 9 aa, Homo Sapiens
HGGKPLCDN

SEQ ID NO: 211371 - protein, 9 aa, Homo Sapiens
SIFIWASGN

SEQ ID NO: 211372 - protein, 9 aa, Homo Sapiens
GVERAESVP

SEQ ID NO: 211373 - protein, 9 aa, Homo Sapiens
PFAENMYLE

SEQ ID NO: 211374 - protein, 9 aa, Homo Sapiens
YDSDCSYPL

SEQ ID NO: 211375 - protein, 9 aa, Homo Sapiens
LPRILPPCT

SEQ ID NO: 211376 - protein, 9 aa, Homo Sapiens
QKQKVSFLE

SEQ ID NO: 211377 - protein, 9 aa, Homo Sapiens
GPRPALHSD

SEQ ID NO: 211378 - protein, 9 aa, Homo Sapiens
AAMAYDHCL

SEQ ID NO: 211379 - protein, 9 aa, Homo Sapiens
GVCSRSYSC

SEQ ID NO: 211380 - protein, 9 aa, Homo Sapiens
IFIWASGNG

SEQ ID NO: 211381 - protein, 9 aa, Homo Sapiens
SSYDSDCSY

SEQ ID NO: 211382 - protein, 9 aa, Homo Sapiens
PKWSQSICW

SEQ ID NO: 211383 - protein, 9 aa, Homo Sapiens
RHRRIEIAH

SEQ ID NO: 211384 - protein, 9 aa, Homo Sapiens
CTYTFVLEL

SEQ ID NO: 211385 - protein, 9 aa, Homo Sapiens
IGEKKPKFN

SEQ ID NO: 211386 - protein, 9 aa, Homo Sapiens
YKAKRSNEL

SEQ ID NO: 211387 - protein, 9 aa, Homo Sapiens
GSFLQDVQN

SEQ ID NO: 211388 - protein, 9 aa, Homo Sapiens
RPPTHPSRG

SEQ ID NO: 211389 - protein, 9 aa, Homo Sapiens
QQQEQERAN

SEQ ID NO: 211390 - protein, 9 aa, Homo Sapiens
HMLEKARHQ

SEQ ID NO: 211391 - protein, 9 aa, Homo Sapiens
PGTARMPPV

SEQ ID NO: 211392 - protein, 9 aa, Homo Sapiens
SYRKKKDAM

SEQ ID NO: 211393 - protein, 9 aa, Homo Sapiens
YGKAFSRLS

SEQ ID NO: 211394 - protein, 9 aa, Homo Sapiens
KDPVVPEDT

SEQ ID NO: 211395 - protein, 9 aa, Homo Sapiens
APPPPPLPP

SEQ ID NO: 211396 - protein, 9 aa, Homo Sapiens
DGFPAGEEE

SEQ ID NO: 211397 - protein, 9 aa, Homo Sapiens
NMYLECVYP

SEQ ID NO: 211398 - protein, 9 aa, Homo Sapiens
SCELLMAVV

SEQ ID NO: 211399 - protein, 9 aa, Homo Sapiens
CWSQDCVKH

SEQ ID NO: 211400 - protein, 9 aa, Homo Sapiens
LRFHFISNN

SEQ ID NO: 211401 - protein, 9 aa, Homo Sapiens
EPSTHAPFT

SEQ ID NO: 211402 - protein, 9 aa, Homo Sapiens
DSYAPCCLS

SEQ ID NO: 211403 - protein, 9 aa, Homo Sapiens
NGNSRALFI

SEQ ID NO: 211404 - protein, 9 aa, Homo Sapiens
YQTNKMPTS

SEQ ID NO: 211405 - protein, 9 aa, Homo Sapiens
AQKQKVSFL

SEQ ID NO: 211406 - protein, 9 aa, Homo Sapiens
LMAVVSCVV

SEQ ID NO: 211407 - protein, 9 aa, Homo Sapiens
QVAVEHSYR

SEQ ID NO: 211408 - protein, 9 aa, Homo Sapiens
HQRALHMLE

SEQ ID NO: 211409 - protein, 9 aa, Homo Sapiens
ECGKGFSWL

SEQ ID NO: 211410 - protein, 9 aa, Homo Sapiens
SCDMPPLKS

SEQ ID NO: 211411 - protein, 9 aa, Homo Sapiens
AIKKNERNA

SEQ ID NO: 211412 - protein, 9 aa, Homo Sapiens
ICKDHRWAR

SEQ ID NO: 211413 - protein, 9 aa, Homo Sapiens
KVPGEQGCD

SEQ ID NO: 211414 - protein, 9 aa, Homo Sapiens
TACVVVVFS

SEQ ID NO: 211415 - protein, 9 aa, Homo Sapiens
DMPPLKSMA

SEQ ID NO: 211416 - protein, 9 aa, Homo Sapiens
GSTAVHLGG

SEQ ID NO: 211417 - protein, 9 aa, Homo Sapiens
VWVAIKSQP

SEQ ID NO: 211418 - protein, 9 aa, Homo Sapiens
GYEAICKDH

SEQ ID NO: 211419 - protein, 9 aa, Homo Sapiens
MRSYNCTPI

SEQ ID NO: 211420 - protein, 9 aa, Homo Sapiens
PEDTAPLMF

SEQ ID NO: 211421 - protein, 9 aa, Homo Sapiens
QFKIVYKTG

SEQ ID NO: 211422 - protein, 9 aa, Homo Sapiens
VSQHQNQIQ

SEQ ID NO: 211423 - protein, 9 aa, Homo Sapiens
SPIRYFMQE

SEQ ID NO: 211424 - protein, 9 aa, Homo Sapiens
NLRYALFLA

SEQ ID NO: 211425 - protein, 9 aa, Homo Sapiens
WSQSICWTI

SEQ ID NO: 211426 - protein, 9 aa, Homo Sapiens
NKASRDTTR

SEQ ID NO: 211427 - protein, 9 aa, Homo Sapiens
AYAAIGEIH

SEQ ID NO: 211428 - protein, 9 aa, Homo Sapiens
ETLTECWDR

SEQ ID NO: 211429 - protein, 9 aa, Homo Sapiens
LPVYAHIRL

SEQ ID NO: 211430 - protein, 9 aa, Homo Sapiens
PQDPSAEVE

SEQ ID NO: 211431 - protein, 9 aa, Homo Sapiens
ALHMLEKAR

SEQ ID NO: 211432 - protein, 9 aa, Homo Sapiens
HFNTDIAPY

SEQ ID NO: 211433 - protein, 9 aa, Homo Sapiens
HRPDSSTLR

SEQ ID NO: 211434 - protein, 9 aa, Homo Sapiens
VIYPLNFTA

SEQ ID NO: 211435 - protein, 9 aa, Homo Sapiens
ILPTVLGIF

SEQ ID NO: 211436 - protein, 9 aa, Homo Sapiens
LGVYLSSSA

SEQ ID NO: 211437 - protein, 9 aa, Homo Sapiens
LNLLLCAFR

SEQ ID NO: 211438 - protein, 9 aa, Homo Sapiens
KPYFLEVYR

SEQ ID NO: 211439 - protein, 9 aa, Homo Sapiens
QAAHQLEDQ

SEQ ID NO: 211440 - protein, 9 aa, Homo Sapiens
LSARMQRRE

SEQ ID NO: 211441 - protein, 9 aa, Homo Sapiens
FPRDQLKLG

SEQ ID NO: 211442 - protein, 9 aa, Homo Sapiens
GEEPQKCPE

SEQ ID NO: 211443 - protein, 9 aa, Homo Sapiens
GLMESLEPT

SEQ ID NO: 211444 - protein, 9 aa, Homo Sapiens
FNRYLTRHR

SEQ ID NO: 211445 - protein, 9 aa, Homo Sapiens
QEERLHAGT

SEQ ID NO: 211446 - protein, 9 aa, Homo Sapiens
DLTDSFTRL

SEQ ID NO: 211447 - protein, 9 aa, Homo Sapiens
SPLEMLEES

SEQ ID NO: 211448 - protein, 9 aa, Homo Sapiens
ALDHFKKAK

SEQ ID NO: 211449 - protein, 9 aa, Homo Sapiens
KIIRQEERL

SEQ ID NO: 211450 - protein, 9 aa, Homo Sapiens
LHSDSDQSL

SEQ ID NO: 211451 - protein, 9 aa, Homo Sapiens
QQGTVKNIL

SEQ ID NO: 211452 - protein, 9 aa, Homo Sapiens
TLGTYTEIK

SEQ ID NO: 211453 - protein, 9 aa, Homo Sapiens
LVRNRVSWW

SEQ ID NO: 211454 - protein, 9 aa, Homo Sapiens
HTLFGPHLN

SEQ ID NO: 211455 - protein, 9 aa, Homo Sapiens
CPIAENKDA

SEQ ID NO: 211456 - protein, 9 aa, Homo Sapiens
EERLHAGTM

SEQ ID NO: 211457 - protein, 9 aa, Homo Sapiens
NRYLTRHRR

SEQ ID NO: 211458 - protein, 9 aa, Homo Sapiens
GVGLVGITA

SEQ ID NO: 211459 - protein, 9 aa, Homo Sapiens
AATGLNLPS

SEQ ID NO: 211460 - protein, 9 aa, Homo Sapiens
VQDPIDRRL

SEQ ID NO: 211461 - protein, 9 aa, Homo Sapiens
RHYLQGLSS

SEQ ID NO: 211462 - protein, 9 aa, Homo Sapiens
LSDSYAPCC

SEQ ID NO: 211463 - protein, 9 aa, Homo Sapiens
SNGQSPFNL

SEQ ID NO: 211464 - protein, 9 aa, Homo Sapiens
NLCEWIRKP

SEQ ID NO: 211465 - protein, 9 aa, Homo Sapiens
AWSHMPEIT

SEQ ID NO: 211466 - protein, 9 aa, Homo Sapiens
VFYILIVGL

SEQ ID NO: 211467 - protein, 9 aa, Homo Sapiens
IRPSGRGYY

SEQ ID NO: 211468 - protein, 9 aa, Homo Sapiens
TGIYHGGKP

SEQ ID NO: 211469 - protein, 9 aa, Homo Sapiens
RWRSRPLNC

SEQ ID NO: 211470 - protein, 9 aa, Homo Sapiens
CQDRPFFLY

SEQ ID NO: 211471 - protein, 9 aa, Homo Sapiens
PLTIGEKKP

SEQ ID NO: 211472 - protein, 9 aa, Homo Sapiens
SDCSYPLDL

SEQ ID NO: 211473 - protein, 9 aa, Homo Sapiens
VGSLGCELY

SEQ ID NO: 211474 - protein, 9 aa, Homo Sapiens
GNNCDLPSR

SEQ ID NO: 211475 - protein, 9 aa, Homo Sapiens
ERNAPKWSQ

SEQ ID NO: 211476 - protein, 9 aa, Homo Sapiens
KGQYTANLS

SEQ ID NO: 211477 - protein, 9 aa, Homo Sapiens
LLANTQGFP

SEQ ID NO: 211478 - protein, 9 aa, Homo Sapiens
QRRERERSP

SEQ ID NO: 211479 - protein, 9 aa, Homo Sapiens
EAICKDHRW

SEQ ID NO: 211480 - protein, 9 aa, Homo Sapiens
TGPVWVAIK

SEQ ID NO: 211481 - protein, 9 aa, Homo Sapiens
RGPAGGGGA

SEQ ID NO: 211482 - protein, 9 aa, Homo Sapiens
QLKLGKPLG

SEQ ID NO: 211483 - protein, 9 aa, Homo Sapiens
TVLALVCCA

SEQ ID NO: 211484 - protein, 9 aa, Homo Sapiens
GACNCGAAA

SEQ ID NO: 211485 - protein, 9 aa, Homo Sapiens
WSQDCVKHK

SEQ ID NO: 211486 - protein, 9 aa, Homo Sapiens
FKIVYKTGD

SEQ ID NO: 211487 - protein, 9 aa, Homo Sapiens
NELSFCRGA

SEQ ID NO: 211488 - protein, 9 aa, Homo Sapiens
RYALFLAMY

SEQ ID NO: 211489 - protein, 9 aa, Homo Sapiens
LNLPSVLTS

SEQ ID NO: 211490 - protein, 9 aa, Homo Sapiens
QPRVGSLGC

SEQ ID NO: 211491 - protein, 9 aa, Homo Sapiens
RPLNCVPPF

SEQ ID NO: 211492 - protein, 9 aa, Homo Sapiens
FKIHACSMS

SEQ ID NO: 211493 - protein, 9 aa, Homo Sapiens
TLTECWDRP

SEQ ID NO: 211494 - protein, 9 aa, Homo Sapiens
QLEDQIQDF

SEQ ID NO: 211495 - protein, 9 aa, Homo Sapiens
THFCPIAEN

SEQ ID NO: 211496 - protein, 9 aa, Homo Sapiens
GENRRCHMV

SEQ ID NO: 211497 - protein, 9 aa, Homo Sapiens
PALHSDSDQ

SEQ ID NO: 211498 - protein, 9 aa, Homo Sapiens
FCPIAENKD

SEQ ID NO: 211499 - protein, 9 aa, Homo Sapiens
CSYPLDLEG

SEQ ID NO: 211500 - protein, 9 aa, Homo Sapiens
EGPPRMCTR

SEQ ID NO: 211501 - protein, 9 aa, Homo Sapiens
AHCMLVRNR

SEQ ID NO: 211502 - protein, 9 aa, Homo Sapiens
EKRMIRPSG

SEQ ID NO: 211503 - protein, 9 aa, Homo Sapiens
LEPSTHAPF

SEQ ID NO: 211504 - protein, 9 aa, Homo Sapiens
CHFDYNTYN

SEQ ID NO: 211505 - protein, 9 aa, Homo Sapiens
VATPILCLF

SEQ ID NO: 211506 - protein, 9 aa, Homo Sapiens
LRYALFLAM

SEQ ID NO: 211507 - protein, 9 aa, Homo Sapiens
EKILEIGAG

SEQ ID NO: 211508 - protein, 9 aa, Homo Sapiens
DDHRNQGEN

SEQ ID NO: 211509 - protein, 9 aa, Homo Sapiens
LGCELYPGL

SEQ ID NO: 211510 - protein, 9 aa, Homo Sapiens
GEEEEAGRP

SEQ ID NO: 211511 - protein, 9 aa, Homo Sapiens
NREDIVSSV

SEQ ID NO: 211512 - protein, 9 aa, Homo Sapiens
MYLECVYPS

SEQ ID NO: 211513 - protein, 9 aa, Homo Sapiens
SARMQRRER

SEQ ID NO: 211514 - protein, 9 aa, Homo Sapiens
RVTNDWDRR

SEQ ID NO: 211515 - protein, 9 aa, Homo Sapiens
LSSIAGLLL

SEQ ID NO: 211516 - protein, 9 aa, Homo Sapiens
ETRTADGWR

SEQ ID NO: 211517 - protein, 9 aa, Homo Sapiens
QQEQERANI

SEQ ID NO: 211518 - protein, 9 aa, Homo Sapiens
LAEDAQTLH

SEQ ID NO: 211519 - protein, 9 aa, Homo Sapiens
AENKDAFCK

SEQ ID NO: 211520 - protein, 9 aa, Homo Sapiens
VDWIRHVIE

SEQ ID NO: 211521 - protein, 9 aa, Homo Sapiens
ILQGERRRL

SEQ ID NO: 211522 - protein, 9 aa, Homo Sapiens
SGGTGAGVT

SEQ ID NO: 211523 - protein, 9 aa, Homo Sapiens
IVARGPFRA

SEQ ID NO: 211524 - protein, 9 aa, Homo Sapiens
QDPIDRRLR

SEQ ID NO: 211525 - protein, 9 aa, Homo Sapiens
EDDHRNQGE

SEQ ID NO: 211526 - protein, 9 aa, Homo Sapiens
TTKTPHPVL

SEQ ID NO: 211527 - protein, 9 aa, Homo Sapiens
EDTAPLMFS

SEQ ID NO: 211528 - protein, 9 aa, Homo Sapiens
SCRSTSSSG

SEQ ID NO: 211529 - protein, 9 aa, Homo Sapiens
INNQTLQVI

SEQ ID NO: 211530 - protein, 9 aa, Homo Sapiens
GGCQYLRCG

SEQ ID NO: 211531 - protein, 9 aa, Homo Sapiens
LPALEEMEG

SEQ ID NO: 211532 - protein, 9 aa, Homo Sapiens
SDHVTMPVA

SEQ ID NO: 211533 - protein, 9 aa, Homo Sapiens
EAKWEEETT

SEQ ID NO: 211534 - protein, 9 aa, Homo Sapiens
VGEHCDINF

SEQ ID NO: 211535 - protein, 9 aa, Homo Sapiens
SWIEMVGDM

SEQ ID NO: 211536 - protein, 9 aa, Homo Sapiens
RPLPPQPGL

SEQ ID NO: 211537 - protein, 9 aa, Homo Sapiens
SVARQPPGC

SEQ ID NO: 211538 - protein, 9 aa, Homo Sapiens
CCLVFSREE

SEQ ID NO: 211539 - protein, 9 aa, Homo Sapiens
GTGSRRGCA

SEQ ID NO: 211540 - protein, 9 aa, Homo Sapiens
QVCANNSDT

SEQ ID NO: 211541 - protein, 9 aa, Homo Sapiens
CPNLLPAPS

SEQ ID NO: 211542 - protein, 9 aa, Homo Sapiens
GRTAPAEVH

SEQ ID NO: 211543 - protein, 9 aa, Homo Sapiens
VNIPCGDDN

SEQ ID NO: 211544 - protein, 9 aa, Homo Sapiens
NPGSSGWPN

SEQ ID NO: 211545 - protein, 9 aa, Homo Sapiens
ETKLNDVLL

SEQ ID NO: 211546 - protein, 9 aa, Homo Sapiens
RAAQRKSQS

SEQ ID NO: 211547 - protein, 9 aa, Homo Sapiens
PRHCLWLWC

SEQ ID NO: 211548 - protein, 9 aa, Homo Sapiens
MQGISKKLT

SEQ ID NO: 211549 - protein, 9 aa, Homo Sapiens
CFMKKTINM

SEQ ID NO: 211550 - protein, 9 aa, Homo Sapiens
AIIGSGMGV

SEQ ID NO: 211551 - protein, 9 aa, Homo Sapiens
TFYTLRVQA

SEQ ID NO: 211552 - protein, 9 aa, Homo Sapiens
LPEGEKNQL

SEQ ID NO: 211553 - protein, 9 aa, Homo Sapiens
IRELCISRQ

SEQ ID NO: 211554 - protein, 9 aa, Homo Sapiens
MFPPSRCES

SEQ ID NO: 211555 - protein, 9 aa, Homo Sapiens
DIKIFKEPI

SEQ ID NO: 211556 - protein, 9 aa, Homo Sapiens
VMIVLGAGD

SEQ ID NO: 211557 - protein, 9 aa, Homo Sapiens
KMILTLMYI

SEQ ID NO: 211558 - protein, 9 aa, Homo Sapiens
PMICQYCKR

SEQ ID NO: 211559 - protein, 9 aa, Homo Sapiens
KCDYTLGKF

SEQ ID NO: 211560 - protein, 9 aa, Homo Sapiens
SALDLPSAW

SEQ ID NO: 211561 - protein, 9 aa, Homo Sapiens
LLVTQGLCV

SEQ ID NO: 211562 - protein, 9 aa, Homo Sapiens
LLEAVDCGN

SEQ ID NO: 211563 - protein, 9 aa, Homo Sapiens
SLSELEHLK

SEQ ID NO: 211564 - protein, 9 aa, Homo Sapiens
CKVLPRNIA

SEQ ID NO: 211565 - protein, 9 aa, Homo Sapiens
TITHTVALI

SEQ ID NO: 211566 - protein, 9 aa, Homo Sapiens
HWDLSGSRF

SEQ ID NO: 211567 - protein, 9 aa, Homo Sapiens
CARISVCAC

SEQ ID NO: 211568 - protein, 9 aa, Homo Sapiens
SAHSSDISC

SEQ ID NO: 211569 - protein, 9 aa, Homo Sapiens
WLRRHMIPE

SEQ ID NO: 211570 - protein, 9 aa, Homo Sapiens
PPQATRARS

SEQ ID NO: 211571 - protein, 9 aa, Homo Sapiens
DPFLMGIPA

SEQ ID NO: 211572 - protein, 9 aa, Homo Sapiens
TQTMSAHIK

SEQ ID NO: 211573 - protein, 9 aa, Homo Sapiens
FCPMDHKPL

SEQ ID NO: 211574 - protein, 9 aa, Homo Sapiens
IVEGSPGSR

SEQ ID NO: 211575 - protein, 9 aa, Homo Sapiens
RLARRWALA

SEQ ID NO: 211576 - protein, 9 aa, Homo Sapiens
LGIKAGPRR

SEQ ID NO: 211577 - protein, 9 aa, Homo Sapiens
GSRKATAVG

SEQ ID NO: 211578 - protein, 9 aa, Homo Sapiens
VPKLGVAPS

SEQ ID NO: 211579 - protein, 9 aa, Homo Sapiens
NSLDVKPMR

SEQ ID NO: 211580 - protein, 9 aa, Homo Sapiens
DHVTMPVAY

SEQ ID NO: 211581 - protein, 9 aa, Homo Sapiens
HWRSRHTIC

SEQ ID NO: 211582 - protein, 9 aa, Homo Sapiens
PRTGRHETV

SEQ ID NO: 211583 - protein, 9 aa, Homo Sapiens
LLEEIEEKT

SEQ ID NO: 211584 - protein, 9 aa, Homo Sapiens
RFQLALCVS

SEQ ID NO: 211585 - protein, 9 aa, Homo Sapiens
HLRRSLSPA

SEQ ID NO: 211586 - protein, 9 aa, Homo Sapiens
GKWVNLLLE

SEQ ID NO: 211587 - protein, 9 aa, Homo Sapiens
EQLLMQLQD

SEQ ID NO: 211588 - protein, 9 aa, Homo Sapiens
SITVSFVGQ

SEQ ID NO: 211589 - protein, 9 aa, Homo Sapiens
ALIVFAIWL

SEQ ID NO: 211590 - protein, 9 aa, Homo Sapiens
LDGPADPQA

SEQ ID NO: 211591 - protein, 9 aa, Homo Sapiens
CSPRGPVFP

SEQ ID NO: 211592 - protein, 9 aa, Homo Sapiens
ASEIIWKCI

SEQ ID NO: 211593 - protein, 9 aa, Homo Sapiens
LRHFHTPHP

SEQ ID NO: 211594 - protein, 9 aa, Homo Sapiens
TSCDPLQIF

SEQ ID NO: 211595 - protein, 9 aa, Homo Sapiens
EECRDLVDA

SEQ ID NO: 211596 - protein, 9 aa, Homo Sapiens
TSTHCPLTT

SEQ ID NO: 211597 - protein, 9 aa, Homo Sapiens
TQRPPYCDD

SEQ ID NO: 211598 - protein, 9 aa, Homo Sapiens
LASVLREPA

SEQ ID NO: 211599 - protein, 9 aa, Homo Sapiens
YVEPRELLT

SEQ ID NO: 211600 - protein, 9 aa, Homo Sapiens
EDGVAGQVP

SEQ ID NO: 211601 - protein, 9 aa, Homo Sapiens
VWGKLSTWP

SEQ ID NO: 211602 - protein, 9 aa, Homo Sapiens
CTTIVCPDC

SEQ ID NO: 211603 - protein, 9 aa, Homo Sapiens
RMGHRVLGL

SEQ ID NO: 211604 - protein, 9 aa, Homo Sapiens
RQEAEQLWN

SEQ ID NO: 211605 - protein, 9 aa, Homo Sapiens
VFPPLIPLL

SEQ ID NO: 211606 - protein, 9 aa, Homo Sapiens
RPSHPSTLR

SEQ ID NO: 211607 - protein, 9 aa, Homo Sapiens
GSDLATREK

SEQ ID NO: 211608 - protein, 9 aa, Homo Sapiens
RDMFPCGPW

SEQ ID NO: 211609 - protein, 9 aa, Homo Sapiens
FAWMMLNYR

SEQ ID NO: 211610 - protein, 9 aa, Homo Sapiens
AGSGIGCGF

SEQ ID NO: 211611 - protein, 9 aa, Homo Sapiens
CPVSAWSLP

SEQ ID NO: 211612 - protein, 9 aa, Homo Sapiens
HLHEICDDI

SEQ ID NO: 211613 - protein, 9 aa, Homo Sapiens
VFLMVGIGL

SEQ ID NO: 211614 - protein, 9 aa, Homo Sapiens
RAFRWEELC

SEQ ID NO: 211615 - protein, 9 aa, Homo Sapiens
CGARGWGRR

SEQ ID NO: 211616 - protein, 9 aa, Homo Sapiens
HGHPLALAF

SEQ ID NO: 211617 - protein, 9 aa, Homo Sapiens
VIKDSKENK

SEQ ID NO: 211618 - protein, 9 aa, Homo Sapiens
SPRPPGASS

SEQ ID NO: 211619 - protein, 9 aa, Homo Sapiens
RLMFQSSTL

SEQ ID NO: 211620 - protein, 9 aa, Homo Sapiens
VDASRGLRF

SEQ ID NO: 211621 - protein, 9 aa, Homo Sapiens
VLSSSNVCV

SEQ ID NO: 211622 - protein, 9 aa, Homo Sapiens
LCWELHAKV

SEQ ID NO: 211623 - protein, 9 aa, Homo Sapiens
SAASSTGTR

SEQ ID NO: 211624 - protein, 9 aa, Homo Sapiens
KNAPHLQDY

SEQ ID NO: 211625 - protein, 9 aa, Homo Sapiens
CTCPPVFSY

SEQ ID NO: 211626 - protein, 9 aa, Homo Sapiens
KQVVNAIIE

SEQ ID NO: 211627 - protein, 9 aa, Homo Sapiens
HHTEPSSES

SEQ ID NO: 211628 - protein, 9 aa, Homo Sapiens
KELKKLKTF

SEQ ID NO: 211629 - protein, 9 aa, Homo Sapiens
AFSVGLGAS

SEQ ID NO: 211630 - protein, 9 aa, Homo Sapiens
KCVCYQQVP

SEQ ID NO: 211631 - protein, 9 aa, Homo Sapiens
TFYYFFSSM

SEQ ID NO: 211632 - protein, 9 aa, Homo Sapiens
EELWLVERD

SEQ ID NO: 211633 - protein, 9 aa, Homo Sapiens
WQPTRPFQS

SEQ ID NO: 211634 - protein, 9 aa, Homo Sapiens
VWHPVSSGT

SEQ ID NO: 211635 - protein, 9 aa, Homo Sapiens
GFLTEDKKN

SEQ ID NO: 211636 - protein, 9 aa, Homo Sapiens
LHPDGTKNM

SEQ ID NO: 211637 - protein, 9 aa, Homo Sapiens
AINRALGVL

SEQ ID NO: 211638 - protein, 9 aa, Homo Sapiens
AARRCLHDT

SEQ ID NO: 211639 - protein, 9 aa, Homo Sapiens
VHHGKISRE

SEQ ID NO: 211640 - protein, 9 aa, Homo Sapiens
AHSPERRCR

SEQ ID NO: 211641 - protein, 9 aa, Homo Sapiens
SPYWMKKVK

SEQ ID NO: 211642 - protein, 9 aa, Homo Sapiens
PRNLGCSPM

SEQ ID NO: 211643 - protein, 9 aa, Homo Sapiens
DQLHICDAS

SEQ ID NO: 211644 - protein, 9 aa, Homo Sapiens
NRPCQRGAR

SEQ ID NO: 211645 - protein, 9 aa, Homo Sapiens
IKIFKEPIL

SEQ ID NO: 211646 - protein, 9 aa, Homo Sapiens
GEVELSRKV

SEQ ID NO: 211647 - protein, 9 aa, Homo Sapiens
PNCQQQLPS

SEQ ID NO: 211648 - protein, 9 aa, Homo Sapiens
TQGNRDYIP

SEQ ID NO: 211649 - protein, 9 aa, Homo Sapiens
MGNAPLPRR

SEQ ID NO: 211650 - protein, 9 aa, Homo Sapiens
FVQLHEGDF

SEQ ID NO: 211651 - protein, 9 aa, Homo Sapiens
RQHCYPPTW

SEQ ID NO: 211652 - protein, 9 aa, Homo Sapiens
QIVRKITMV

SEQ ID NO: 211653 - protein, 9 aa, Homo Sapiens
NEHHGGEEV

SEQ ID NO: 211654 - protein, 9 aa, Homo Sapiens
IGFTLCRRY

SEQ ID NO: 211655 - protein, 9 aa, Homo Sapiens
EAVITLLEA

SEQ ID NO: 211656 - protein, 9 aa, Homo Sapiens
CGKNKQVVL

SEQ ID NO: 211657 - protein, 9 aa, Homo Sapiens
LYKFLIVIG

SEQ ID NO: 211658 - protein, 9 aa, Homo Sapiens
SQVFLLFSS

SEQ ID NO: 211659 - protein, 9 aa, Homo Sapiens
CTIWSFSHA

SEQ ID NO: 211660 - protein, 9 aa, Homo Sapiens
EDPGPPRPP

SEQ ID NO: 211661 - protein, 9 aa, Homo Sapiens
MLDAELELK

SEQ ID NO: 211662 - protein, 9 aa, Homo Sapiens
PSNSLMAGQ

SEQ ID NO: 211663 - protein, 9 aa, Homo Sapiens
LTAQLLLHG

SEQ ID NO: 211664 - protein, 9 aa, Homo Sapiens
AFQQYKKKS

SEQ ID NO: 211665 - protein, 9 aa, Homo Sapiens
GVGRGDRPI

SEQ ID NO: 211666 - protein, 9 aa, Homo Sapiens
IFVLDIVSR

SEQ ID NO: 211667 - protein, 9 aa, Homo Sapiens
GKGEAQCRG

SEQ ID NO: 211668 - protein, 9 aa, Homo Sapiens
DLVDAAKNY

SEQ ID NO: 211669 - protein, 9 aa, Homo Sapiens
TLEGCISVK

SEQ ID NO: 211670 - protein, 9 aa, Homo Sapiens
LALGAGVLA

SEQ ID NO: 211671 - protein, 9 aa, Homo Sapiens
VQKTSGSGW

SEQ ID NO: 211672 - protein, 9 aa, Homo Sapiens
RTTAVPRGP

SEQ ID NO: 211673 - protein, 9 aa, Homo Sapiens
RILQASVAA

SEQ ID NO: 211674 - protein, 9 aa, Homo Sapiens
SSDPPTLTS

SEQ ID NO: 211675 - protein, 9 aa, Homo Sapiens
TRICPLPPC

SEQ ID NO: 211676 - protein, 9 aa, Homo Sapiens
CALDNLPEL

SEQ ID NO: 211677 - protein, 9 aa, Homo Sapiens
SHNRGPHGR

SEQ ID NO: 211678 - protein, 9 aa, Homo Sapiens
DVEKKKKRT

SEQ ID NO: 211679 - protein, 9 aa, Homo Sapiens
SLGGCPLSL

SEQ ID NO: 211680 - protein, 9 aa, Homo Sapiens
LLQAVGLHS

SEQ ID NO: 211681 - protein, 9 aa, Homo Sapiens
VGVYGCQGY

SEQ ID NO: 211682 - protein, 9 aa, Homo Sapiens
EGQEAADMD

SEQ ID NO: 211683 - protein, 9 aa, Homo Sapiens
QDLILQQLN

SEQ ID NO: 211684 - protein, 9 aa, Homo Sapiens
IKKHELLSS

SEQ ID NO: 211685 - protein, 9 aa, Homo Sapiens
ATQDNPRTS

SEQ ID NO: 211686 - protein, 9 aa, Homo Sapiens
ACKCLLWKR

SEQ ID NO: 211687 - protein, 9 aa, Homo Sapiens
LPEEGSKPP

SEQ ID NO: 211688 - protein, 9 aa, Homo Sapiens
RKIQKRSKK

SEQ ID NO: 211689 - protein, 9 aa, Homo Sapiens
LDLSYNHIQ

SEQ ID NO: 211690 - protein, 9 aa, Homo Sapiens
RRYCTAFTR

SEQ ID NO: 211691 - protein, 9 aa, Homo Sapiens
VFLATHDGH

SEQ ID NO: 211692 - protein, 9 aa, Homo Sapiens
NKGNEHPPP

SEQ ID NO: 211693 - protein, 9 aa, Homo Sapiens
SQVGTCIVN

SEQ ID NO: 211694 - protein, 9 aa, Homo Sapiens
KGRNSHPSP

SEQ ID NO: 211695 - protein, 9 aa, Homo Sapiens
GNLGRIVTI

SEQ ID NO: 211696 - protein, 9 aa, Homo Sapiens
AGCYSAPRW

SEQ ID NO: 211697 - protein, 9 aa, Homo Sapiens
AAAGTWRGR

SEQ ID NO: 211698 - protein, 9 aa, Homo Sapiens
EGANNTGNI

SEQ ID NO: 211699 - protein, 9 aa, Homo Sapiens
DKDYFYTHG

SEQ ID NO: 211700 - protein, 9 aa, Homo Sapiens
AVHHGKISR

SEQ ID NO: 211701 - protein, 9 aa, Homo Sapiens
FTGVFTFGL

SEQ ID NO: 211702 - protein, 9 aa, Homo Sapiens
SPDEKSQIH

SEQ ID NO: 211703 - protein, 9 aa, Homo Sapiens
AGGHRPDLE

SEQ ID NO: 211704 - protein, 9 aa, Homo Sapiens
CDQLHICDA

SEQ ID NO: 211705 - protein, 9 aa, Homo Sapiens
RQSLFNRGK

SEQ ID NO: 211706 - protein, 9 aa, Homo Sapiens
LSPLGLALC

SEQ ID NO: 211707 - protein, 9 aa, Homo Sapiens
DTIPLMMPL

SEQ ID NO: 211708 - protein, 9 aa, Homo Sapiens
VACESSTPS

SEQ ID NO: 211709 - protein, 9 aa, Homo Sapiens
GTQQAGWQG

SEQ ID NO: 211710 - protein, 9 aa, Homo Sapiens
PERRCRYWG

SEQ ID NO: 211711 - protein, 9 aa, Homo Sapiens
QGRSIGTAK

SEQ ID NO: 211712 - protein, 9 aa, Homo Sapiens
RALLHSPVP

SEQ ID NO: 211713 - protein, 9 aa, Homo Sapiens
IDEQVHRHV

SEQ ID NO: 211714 - protein, 9 aa, Homo Sapiens
LVAGVNIPC

SEQ ID NO: 211715 - protein, 9 aa, Homo Sapiens
EHRCLPILV

SEQ ID NO: 211716 - protein, 9 aa, Homo Sapiens
KHPMYRSLV

SEQ ID NO: 211717 - protein, 9 aa, Homo Sapiens
KSVVRVLFI

SEQ ID NO: 211718 - protein, 9 aa, Homo Sapiens
RVPRGSCAL

SEQ ID NO: 211719 - protein, 9 aa, Homo Sapiens
TCPTAEPTA

SEQ ID NO: 211720 - protein, 9 aa, Homo Sapiens
AVQGPIHLL

SEQ ID NO: 211721 - protein, 9 aa, Homo Sapiens
RPGRLGVAP

SEQ ID NO: 211722 - protein, 9 aa, Homo Sapiens
GGPEVPRKY

SEQ ID NO: 211723 - protein, 9 aa, Homo Sapiens
GDFQKALLT

SEQ ID NO: 211724 - protein, 9 aa, Homo Sapiens
IILPCLSWP

SEQ ID NO: 211725 - protein, 9 aa, Homo Sapiens
SLPRLVGCP

SEQ ID NO: 211726 - protein, 9 aa, Homo Sapiens
STSLKKTYE

SEQ ID NO: 211727 - protein, 9 aa, Homo Sapiens
LPLLLGVTL

SEQ ID NO: 211728 - protein, 9 aa, Homo Sapiens
SALSYVGIT

SEQ ID NO: 211729 - protein, 9 aa, Homo Sapiens
QEKKLGGQD

SEQ ID NO: 211730 - protein, 9 aa, Homo Sapiens
ETWLSNSSA

SEQ ID NO: 211731 - protein, 9 aa, Homo Sapiens
IYNRRTMKR

SEQ ID NO: 211732 - protein, 9 aa, Homo Sapiens
AGPTSSPSS

SEQ ID NO: 211733 - protein, 9 aa, Homo Sapiens
DVFQQWKCC

SEQ ID NO: 211734 - protein, 9 aa, Homo Sapiens
TVLSCWTWM

SEQ ID NO: 211735 - protein, 9 aa, Homo Sapiens
QVSSLGDDP

SEQ ID NO: 211736 - protein, 9 aa, Homo Sapiens
KRQGKLHRC

SEQ ID NO: 211737 - protein, 9 aa, Homo Sapiens
AAKKNLGKV

SEQ ID NO: 211738 - protein, 9 aa, Homo Sapiens
QAKNDPFLM

SEQ ID NO: 211739 - protein, 9 aa, Homo Sapiens
NLEKNSGSQ

SEQ ID NO: 211740 - protein, 9 aa, Homo Sapiens
LPGPGVHGL

SEQ ID NO: 211741 - protein, 9 aa, Homo Sapiens
RMGNERYNF

SEQ ID NO: 211742 - protein, 9 aa, Homo Sapiens
VSGSWCGTW

SEQ ID NO: 211743 - protein, 9 aa, Homo Sapiens
QKTSGSGWL

SEQ ID NO: 211744 - protein, 9 aa, Homo Sapiens
CAAPACSPK

SEQ ID NO: 211745 - protein, 9 aa, Homo Sapiens
WVEGKLLDD

SEQ ID NO: 211746 - protein, 9 aa, Homo Sapiens
QSPDLGTQC

SEQ ID NO: 211747 - protein, 9 aa, Homo Sapiens
PLGGDTAPG

SEQ ID NO: 211748 - protein, 9 aa, Homo Sapiens
KELRPVMDK

SEQ ID NO: 211749 - protein, 9 aa, Homo Sapiens
QAEEREQIK

SEQ ID NO: 211750 - protein, 9 aa, Homo Sapiens
DRYHMPKET

SEQ ID NO: 211751 - protein, 9 aa, Homo Sapiens
DVDLEKPTA

SEQ ID NO: 211752 - protein, 9 aa, Homo Sapiens
REDYKQALV

SEQ ID NO: 211753 - protein, 9 aa, Homo Sapiens
LNYRLMFQS

SEQ ID NO: 211754 - protein, 9 aa, Homo Sapiens
AQDTAQRQE

SEQ ID NO: 211755 - protein, 9 aa, Homo Sapiens
REARVEEST

SEQ ID NO: 211756 - protein, 9 aa, Homo Sapiens
VCHGALTCL

SEQ ID NO: 211757 - protein, 9 aa, Homo Sapiens
STMMEKRKM

SEQ ID NO: 211758 - protein, 9 aa, Homo Sapiens
SSASSAWGS

SEQ ID NO: 211759 - protein, 9 aa, Homo Sapiens
PWATGPSVP

SEQ ID NO: 211760 - protein, 9 aa, Homo Sapiens
LSVLLPPPR

SEQ ID NO: 211761 - protein, 9 aa, Homo Sapiens
LEKCGYNKG

SEQ ID NO: 211762 - protein, 9 aa, Homo Sapiens
SRGPSTGSA

SEQ ID NO: 211763 - protein, 9 aa, Homo Sapiens
QPIIFALSN

SEQ ID NO: 211764 - protein, 9 aa, Homo Sapiens
PQGVVMKMG

SEQ ID NO: 211765 - protein, 9 aa, Homo Sapiens
APRQTPGQA

SEQ ID NO: 211766 - protein, 9 aa, Homo Sapiens
LDPATAHPN

SEQ ID NO: 211767 - protein, 9 aa, Homo Sapiens
RHFHTPHPT

SEQ ID NO: 211768 - protein, 9 aa, Homo Sapiens
NFAMRVSAL

SEQ ID NO: 211769 - protein, 9 aa, Homo Sapiens
KAYPSEKSN

SEQ ID NO: 211770 - protein, 9 aa, Homo Sapiens
LSQRIIRWP

SEQ ID NO: 211771 - protein, 9 aa, Homo Sapiens
SPCTPRAAE

SEQ ID NO: 211772 - protein, 9 aa, Homo Sapiens
SRLGRPLGC

SEQ ID NO: 211773 - protein, 9 aa, Homo Sapiens
LERRFIFQK

SEQ ID NO: 211774 - protein, 9 aa, Homo Sapiens
LLQRNLLRL

SEQ ID NO: 211775 - protein, 9 aa, Homo Sapiens
LVHGALQGH

SEQ ID NO: 211776 - protein, 9 aa, Homo Sapiens
VASIARARV

SEQ ID NO: 211777 - protein, 9 aa, Homo Sapiens
EDQEVCMLF

SEQ ID NO: 211778 - protein, 9 aa, Homo Sapiens
VLLGSGSMG

SEQ ID NO: 211779 - protein, 9 aa, Homo Sapiens
TVPRSSTPS

SEQ ID NO: 211780 - protein, 9 aa, Homo Sapiens
SMARAEPLD

SEQ ID NO: 211781 - protein, 9 aa, Homo Sapiens
ENPEVSRED

SEQ ID NO: 211782 - protein, 9 aa, Homo Sapiens
RGSSSTAKG

SEQ ID NO: 211783 - protein, 9 aa, Homo Sapiens
SFLFFIPFL

SEQ ID NO: 211784 - protein, 9 aa, Homo Sapiens
FCQAPSIRT

SEQ ID NO: 211785 - protein, 9 aa, Homo Sapiens
ISARSLLRL

SEQ ID NO: 211786 - protein, 9 aa, Homo Sapiens
GSNRKFGDP

SEQ ID NO: 211787 - protein, 9 aa, Homo Sapiens
SGVEQATQV

SEQ ID NO: 211788 - protein, 9 aa, Homo Sapiens
LKNIYRKSG

SEQ ID NO: 211789 - protein, 9 aa, Homo Sapiens
PRTSVEDAP

SEQ ID NO: 211790 - protein, 9 aa, Homo Sapiens
YIGRKKSRL

SEQ ID NO: 211791 - protein, 9 aa, Homo Sapiens
EEESKTGQK

SEQ ID NO: 211792 - protein, 9 aa, Homo Sapiens
LLLDTTANR

SEQ ID NO: 211793 - protein, 9 aa, Homo Sapiens
HTSKSPRDP

SEQ ID NO: 211794 - protein, 9 aa, Homo Sapiens
RRRIPAGRR

SEQ ID NO: 211795 - protein, 9 aa, Homo Sapiens
GRPRGGPAR

SEQ ID NO: 211796 - protein, 9 aa, Homo Sapiens
KALEQEQAA

SEQ ID NO: 211797 - protein, 9 aa, Homo Sapiens
YFCILDTTK

SEQ ID NO: 211798 - protein, 9 aa, Homo Sapiens
EVNVVSTKE

SEQ ID NO: 211799 - protein, 9 aa, Homo Sapiens
TTSALTCLP

SEQ ID NO: 211800 - protein, 9 aa, Homo Sapiens
GFTLCRRYW

SEQ ID NO: 211801 - protein, 9 aa, Homo Sapiens
WIFIPRSPL

SEQ ID NO: 211802 - protein, 9 aa, Homo Sapiens
WMAACAGIP

SEQ ID NO: 211803 - protein, 9 aa, Homo Sapiens
SSGRMCYET

SEQ ID NO: 211804 - protein, 9 aa, Homo Sapiens
ASYRQYGVY

SEQ ID NO: 211805 - protein, 9 aa, Homo Sapiens
RTVRDSDSE

SEQ ID NO: 211806 - protein, 9 aa, Homo Sapiens
LRLGSRPAP

SEQ ID NO: 211807 - protein, 9 aa, Homo Sapiens
QQVPWYPTV

SEQ ID NO: 211808 - protein, 9 aa, Homo Sapiens
VPKSASVSV

SEQ ID NO: 211809 - protein, 9 aa, Homo Sapiens
QAGAGLHVH

SEQ ID NO: 211810 - protein, 9 aa, Homo Sapiens
QANHVKDVK

SEQ ID NO: 211811 - protein, 9 aa, Homo Sapiens
RAPHAAHPA

SEQ ID NO: 211812 - protein, 9 aa, Homo Sapiens
NESPKDIPA

SEQ ID NO: 211813 - protein, 9 aa, Homo Sapiens
HPADASSHG

SEQ ID NO: 211814 - protein, 9 aa, Homo Sapiens
WASLAVDGS

SEQ ID NO: 211815 - protein, 9 aa, Homo Sapiens
RRGENTSLD

SEQ ID NO: 211816 - protein, 9 aa, Homo Sapiens
YTLTGGHHG

SEQ ID NO: 211817 - protein, 9 aa, Homo Sapiens
ADGASEIIW

SEQ ID NO: 211818 - protein, 9 aa, Homo Sapiens
DPGNNKLQV

SEQ ID NO: 211819 - protein, 9 aa, Homo Sapiens
SSGICFQET

SEQ ID NO: 211820 - protein, 9 aa, Homo Sapiens
DAPGLSSPP

SEQ ID NO: 211821 - protein, 9 aa, Homo Sapiens
MAVIIRDKS

SEQ ID NO: 211822 - protein, 9 aa, Homo Sapiens
QPLPARTLA

SEQ ID NO: 211823 - protein, 9 aa, Homo Sapiens
RLNPRRSCP

SEQ ID NO: 211824 - protein, 9 aa, Homo Sapiens
NDLYWHVRC

SEQ ID NO: 211825 - protein, 9 aa, Homo Sapiens
ATWMGSLLM

SEQ ID NO: 211826 - protein, 9 aa, Homo Sapiens
GGRRTICSV

SEQ ID NO: 211827 - protein, 9 aa, Homo Sapiens
TTTHTPPGV

SEQ ID NO: 211828 - protein, 9 aa, Homo Sapiens
VWVGAQEAV

SEQ ID NO: 211829 - protein, 9 aa, Homo Sapiens
RSLEEQLQH

SEQ ID NO: 211830 - protein, 9 aa, Homo Sapiens
LLSTTWIFG

SEQ ID NO: 211831 - protein, 9 aa, Homo Sapiens
LRWEGTCFS

SEQ ID NO: 211832 - protein, 9 aa, Homo Sapiens
ERNHTNVRF

SEQ ID NO: 211833 - protein, 9 aa, Homo Sapiens
GTYNRVPSA

SEQ ID NO: 211834 - protein, 9 aa, Homo Sapiens
LKDLVFDLY

SEQ ID NO: 211835 - protein, 9 aa, Homo Sapiens
HCQYKLTYT

SEQ ID NO: 211836 - protein, 9 aa, Homo Sapiens
MLKERLAEL

SEQ ID NO: 211837 - protein, 9 aa, Homo Sapiens
QRIIRWPSA

SEQ ID NO: 211838 - protein, 9 aa, Homo Sapiens
LSDSILTEK

SEQ ID NO: 211839 - protein, 9 aa, Homo Sapiens
RGLPHVTWS

SEQ ID NO: 211840 - protein, 9 aa, Homo Sapiens
TRSSRLRSW

SEQ ID NO: 211841 - protein, 9 aa, Homo Sapiens
DGPADPQAD

SEQ ID NO: 211842 - protein, 9 aa, Homo Sapiens
IFYFLRGLE

SEQ ID NO: 211843 - protein, 9 aa, Homo Sapiens
VGDMTMVNV

SEQ ID NO: 211844 - protein, 9 aa, Homo Sapiens
KQSLMLMTT

SEQ ID NO: 211845 - protein, 9 aa, Homo Sapiens
STVHSYMLA

SEQ ID NO: 211846 - protein, 9 aa, Homo Sapiens
ACDPHSRHC

SEQ ID NO: 211847 - protein, 9 aa, Homo Sapiens
YFTHQNHGS

SEQ ID NO: 211848 - protein, 9 aa, Homo Sapiens
ASQVSGMVE

SEQ ID NO: 211849 - protein, 9 aa, Homo Sapiens
ETVSAASSL

SEQ ID NO: 211850 - protein, 9 aa, Homo Sapiens
LLLGVTLTF

SEQ ID NO: 211851 - protein, 9 aa, Homo Sapiens
AERRQDLRA

SEQ ID NO: 211852 - protein, 9 aa, Homo Sapiens
PSPSTGTTS

SEQ ID NO: 211853 - protein, 9 aa, Homo Sapiens
SRKTWQRRL

SEQ ID NO: 211854 - protein, 9 aa, Homo Sapiens
RPVMDKWIK

SEQ ID NO: 211855 - protein, 9 aa, Homo Sapiens
YRGSRHVGQ

SEQ ID NO: 211856 - protein, 9 aa, Homo Sapiens
SLPLDRTFL

SEQ ID NO: 211857 - protein, 9 aa, Homo Sapiens
RTSGEPWDT

SEQ ID NO: 211858 - protein, 9 aa, Homo Sapiens
HSVPSTPPW

SEQ ID NO: 211859 - protein, 9 aa, Homo Sapiens
CWARVGPLV

SEQ ID NO: 211860 - protein, 9 aa, Homo Sapiens
EEEEEVVDL

SEQ ID NO: 211861 - protein, 9 aa, Homo Sapiens
PGTTPPRAE

SEQ ID NO: 211862 - protein, 9 aa, Homo Sapiens
EVSIATSQA

SEQ ID NO: 211863 - protein, 9 aa, Homo Sapiens
MPEQSNDYC

SEQ ID NO: 211864 - protein, 9 aa, Homo Sapiens
GLRRLAATT

SEQ ID NO: 211865 - protein, 9 aa, Homo Sapiens
HMRIHTGGK

SEQ ID NO: 211866 - protein, 9 aa, Homo Sapiens
AVFILLVTL

SEQ ID NO: 211867 - protein, 9 aa, Homo Sapiens
TPDREEWEV

SEQ ID NO: 211868 - protein, 9 aa, Homo Sapiens
HRVQERQRR

SEQ ID NO: 211869 - protein, 9 aa, Homo Sapiens
GKEPNSKDN

SEQ ID NO: 211870 - protein, 9 aa, Homo Sapiens
RMATDRRHL

SEQ ID NO: 211871 - protein, 9 aa, Homo Sapiens
RAIVRDNKD

SEQ ID NO: 211872 - protein, 9 aa, Homo Sapiens
NPEPVNWED

SEQ ID NO: 211873 - protein, 9 aa, Homo Sapiens
GVGPRDIKA

SEQ ID NO: 211874 - protein, 9 aa, Homo Sapiens
CALYFKHLL

SEQ ID NO: 211875 - protein, 9 aa, Homo Sapiens
RGLPLHLAN

SEQ ID NO: 211876 - protein, 9 aa, Homo Sapiens
ALSLGYVAS

SEQ ID NO: 211877 - protein, 9 aa, Homo Sapiens
GATHQSQGL

SEQ ID NO: 211878 - protein, 9 aa, Homo Sapiens
EGAPGARIP

SEQ ID NO: 211879 - protein, 9 aa, Homo Sapiens
GRHRRRGAP

SEQ ID NO: 211880 - protein, 9 aa, Homo Sapiens
HPDGTVDTI

SEQ ID NO: 211881 - protein, 9 aa, Homo Sapiens
VLQGPSPGS

SEQ ID NO: 211882 - protein, 9 aa, Homo Sapiens
FNTTGCLRK

SEQ ID NO: 211883 - protein, 9 aa, Homo Sapiens
LDALFAQKV

SEQ ID NO: 211884 - protein, 9 aa, Homo Sapiens
IQFERVLLK

SEQ ID NO: 211885 - protein, 9 aa, Homo Sapiens
HICKTWAQL

SEQ ID NO: 211886 - protein, 9 aa, Homo Sapiens
RCSRLVMCL

SEQ ID NO: 211887 - protein, 9 aa, Homo Sapiens
PGRYLTGGL

SEQ ID NO: 211888 - protein, 9 aa, Homo Sapiens
KAISNSHYA

SEQ ID NO: 211889 - protein, 9 aa, Homo Sapiens
MEETEVGAT

SEQ ID NO: 211890 - protein, 9 aa, Homo Sapiens
PPPHGFNRQ

SEQ ID NO: 211891 - protein, 9 aa, Homo Sapiens
DYRGLPLHL

SEQ ID NO: 211892 - protein, 9 aa, Homo Sapiens
FPESLVRFY

SEQ ID NO: 211893 - protein, 9 aa, Homo Sapiens
HVKRHAVNL

SEQ ID NO: 211894 - protein, 9 aa, Homo Sapiens
GGPELYQRA

SEQ ID NO: 211895 - protein, 9 aa, Homo Sapiens
LAQRPSASD

SEQ ID NO: 211896 - protein, 9 aa, Homo Sapiens
FVCQGINDF

SEQ ID NO: 211897 - protein, 9 aa, Homo Sapiens
KVHVWQLYG

SEQ ID NO: 211898 - protein, 9 aa, Homo Sapiens
RGGETKREA

SEQ ID NO: 211899 - protein, 9 aa, Homo Sapiens
MCTASFAAF

SEQ ID NO: 211900 - protein, 9 aa, Homo Sapiens
HSHQIFVTK

SEQ ID NO: 211901 - protein, 9 aa, Homo Sapiens
SMLCVEDPL

SEQ ID NO: 211902 - protein, 9 aa, Homo Sapiens
DVIISKFFD

SEQ ID NO: 211903 - protein, 9 aa, Homo Sapiens
PISKQLYRR

SEQ ID NO: 211904 - protein, 9 aa, Homo Sapiens
LTRERAAAA

SEQ ID NO: 211905 - protein, 9 aa, Homo Sapiens
PPPSAQPRR

SEQ ID NO: 211906 - protein, 9 aa, Homo Sapiens
PGAEGWWQL

SEQ ID NO: 211907 - protein, 9 aa, Homo Sapiens
EEQIKKKPE

SEQ ID NO: 211908 - protein, 9 aa, Homo Sapiens
SKQAQLIVE

SEQ ID NO: 211909 - protein, 9 aa, Homo Sapiens
TATECWIFI

SEQ ID NO: 211910 - protein, 9 aa, Homo Sapiens
APSRCIWQL

SEQ ID NO: 211911 - protein, 9 aa, Homo Sapiens
TYMEMHYGH

SEQ ID NO: 211912 - protein, 9 aa, Homo Sapiens
IKEPKSVFH

SEQ ID NO: 211913 - protein, 9 aa, Homo Sapiens
ALLQTCLHA

SEQ ID NO: 211914 - protein, 9 aa, Homo Sapiens
WGSASCFSN

SEQ ID NO: 211915 - protein, 9 aa, Homo Sapiens
RRLAGSVGV

SEQ ID NO: 211916 - protein, 9 aa, Homo Sapiens
MYRSLVHSA

SEQ ID NO: 211917 - protein, 9 aa, Homo Sapiens
SSSRPGGAE

SEQ ID NO: 211918 - protein, 9 aa, Homo Sapiens
SHSHLRYKG

SEQ ID NO: 211919 - protein, 9 aa, Homo Sapiens
RDWLSKKIS

SEQ ID NO: 211920 - protein, 9 aa, Homo Sapiens
TLTGRALLS

SEQ ID NO: 211921 - protein, 9 aa, Homo Sapiens
DVVDMAITE

SEQ ID NO: 211922 - protein, 9 aa, Homo Sapiens
HSPSELFAQ

SEQ ID NO: 211923 - protein, 9 aa, Homo Sapiens
VIEMVTAKR

SEQ ID NO: 211924 - protein, 9 aa, Homo Sapiens
SYEGSDLAT

SEQ ID NO: 211925 - protein, 9 aa, Homo Sapiens
QHNVRKDCL

SEQ ID NO: 211926 - protein, 9 aa, Homo Sapiens
TAPRHCLWL

SEQ ID NO: 211927 - protein, 9 aa, Homo Sapiens
LGEVIRGQG

SEQ ID NO: 211928 - protein, 9 aa, Homo Sapiens
AASPTTAAS

SEQ ID NO: 211929 - protein, 9 aa, Homo Sapiens
LGTQQAGWQ

SEQ ID NO: 211930 - protein, 9 aa, Homo Sapiens
GVRWGADDT

SEQ ID NO: 211931 - protein, 9 aa, Homo Sapiens
CSAGAYTLL

SEQ ID NO: 211932 - protein, 9 aa, Homo Sapiens
IRKQKEKIT

SEQ ID NO: 211933 - protein, 9 aa, Homo Sapiens
HHIFYQDKN

SEQ ID NO: 211934 - protein, 9 aa, Homo Sapiens
VNCMDCLDH

SEQ ID NO: 211935 - protein, 9 aa, Homo Sapiens
KKISFFFRV

SEQ ID NO: 211936 - protein, 9 aa, Homo Sapiens
DINFDDCQD

SEQ ID NO: 211937 - protein, 9 aa, Homo Sapiens
PVFPPLIPL

SEQ ID NO: 211938 - protein, 9 aa, Homo Sapiens
TSNNNMEKV

SEQ ID NO: 211939 - protein, 9 aa, Homo Sapiens
PENSEFPLV

SEQ ID NO: 211940 - protein, 9 aa, Homo Sapiens
ECSLEAVRE

SEQ ID NO: 211941 - protein, 9 aa, Homo Sapiens
GEGGLRRAS

SEQ ID NO: 211942 - protein, 9 aa, Homo Sapiens
CLRRRSRKA

SEQ ID NO: 211943 - protein, 9 aa, Homo Sapiens
LGLLLHHIL

SEQ ID NO: 211944 - protein, 9 aa, Homo Sapiens
CDPPSSMGT

SEQ ID NO: 211945 - protein, 9 aa, Homo Sapiens
PADHIPPEP

SEQ ID NO: 211946 - protein, 9 aa, Homo Sapiens
PYGGGHTLA

SEQ ID NO: 211947 - protein, 9 aa, Homo Sapiens
DPATAHPNL

SEQ ID NO: 211948 - protein, 9 aa, Homo Sapiens
SSPVPQLPD

SEQ ID NO: 211949 - protein, 9 aa, Homo Sapiens
QEAVQEVAD

SEQ ID NO: 211950 - protein, 9 aa, Homo Sapiens
RRRSHSWGP

SEQ ID NO: 211951 - protein, 9 aa, Homo Sapiens
TQIQPLPAD

SEQ ID NO: 211952 - protein, 9 aa, Homo Sapiens
SWGCTTGCC

SEQ ID NO: 211953 - protein, 9 aa, Homo Sapiens
ATHQSQGLG

SEQ ID NO: 211954 - protein, 9 aa, Homo Sapiens
CNECGKLSV

SEQ ID NO: 211955 - protein, 9 aa, Homo Sapiens
LPDGLPWGR

SEQ ID NO: 211956 - protein, 9 aa, Homo Sapiens
GNCCQTRSW

SEQ ID NO: 211957 - protein, 9 aa, Homo Sapiens
HQGISQVHH

SEQ ID NO: 211958 - protein, 9 aa, Homo Sapiens
NTLWIEGAN

SEQ ID NO: 211959 - protein, 9 aa, Homo Sapiens
DELSFDLDD

SEQ ID NO: 211960 - protein, 9 aa, Homo Sapiens
TWQDRLPLP

SEQ ID NO: 211961 - protein, 9 aa, Homo Sapiens
EVLVNHHQQ

SEQ ID NO: 211962 - protein, 9 aa, Homo Sapiens
PHLNQIMKR

SEQ ID NO: 211963 - protein, 9 aa, Homo Sapiens
LKLRCERVV

SEQ ID NO: 211964 - protein, 9 aa, Homo Sapiens
VGRGDRPIR

SEQ ID NO: 211965 - protein, 9 aa, Homo Sapiens
SYNHIQRIP

SEQ ID NO: 211966 - protein, 9 aa, Homo Sapiens
ARRWPRALR

SEQ ID NO: 211967 - protein, 9 aa, Homo Sapiens
MNAKKAAAN

SEQ ID NO: 211968 - protein, 9 aa, Homo Sapiens
AAPAGPRGS

SEQ ID NO: 211969 - protein, 9 aa, Homo Sapiens
PTPKAGQSQ

SEQ ID NO: 211970 - protein, 9 aa, Homo Sapiens
LPPTRPRPT

SEQ ID NO: 211971 - protein, 9 aa, Homo Sapiens
GGPIGPPGH

SEQ ID NO: 211972 - protein, 9 aa, Homo Sapiens
GSATGWWTP

SEQ ID NO: 211973 - protein, 9 aa, Homo Sapiens
TSTSPRRPG

SEQ ID NO: 211974 - protein, 9 aa, Homo Sapiens
RQDRPVCEG

SEQ ID NO: 211975 - protein, 9 aa, Homo Sapiens
WLHSTAYMM

SEQ ID NO: 211976 - protein, 9 aa, Homo Sapiens
SSGSRKATA

SEQ ID NO: 211977 - protein, 9 aa, Homo Sapiens
PIPFQQPKH

SEQ ID NO: 211978 - protein, 9 aa, Homo Sapiens
CSWRSRSTL

SEQ ID NO: 211979 - protein, 9 aa, Homo Sapiens
LCVVAHDVV

SEQ ID NO: 211980 - protein, 9 aa, Homo Sapiens
TVFATIIGA

SEQ ID NO: 211981 - protein, 9 aa, Homo Sapiens
GRLGVAPRV

SEQ ID NO: 211982 - protein, 9 aa, Homo Sapiens
CPSPPMRSP

SEQ ID NO: 211983 - protein, 9 aa, Homo Sapiens
RPPQATRAR

SEQ ID NO: 211984 - protein, 9 aa, Homo Sapiens
RGSRHVGQV

SEQ ID NO: 211985 - protein, 9 aa, Homo Sapiens
YDKEKKLYL

SEQ ID NO: 211986 - protein, 9 aa, Homo Sapiens
LWKRKYSSQ

SEQ ID NO: 211987 - protein, 9 aa, Homo Sapiens
GLFVKTMVC

SEQ ID NO: 211988 - protein, 9 aa, Homo Sapiens
TLLKLLVHW

SEQ ID NO: 211989 - protein, 9 aa, Homo Sapiens
LITRQMLTF

SEQ ID NO: 211990 - protein, 9 aa, Homo Sapiens
KGWQNSIWH

SEQ ID NO: 211991 - protein, 9 aa, Homo Sapiens
RGENTSLDL

SEQ ID NO: 211992 - protein, 9 aa, Homo Sapiens
GAAPVCGAR

SEQ ID NO: 211993 - protein, 9 aa, Homo Sapiens
IISTVAGGK

SEQ ID NO: 211994 - protein, 9 aa, Homo Sapiens
AVEEEAVGR

SEQ ID NO: 211995 - protein, 9 aa, Homo Sapiens
LRGHCAGAA

SEQ ID NO: 211996 - protein, 9 aa, Homo Sapiens
NDHVSTAKY

SEQ ID NO: 211997 - protein, 9 aa, Homo Sapiens
IGGIFLWMK

SEQ ID NO: 211998 - protein, 9 aa, Homo Sapiens
VLARLKGRN

SEQ ID NO: 211999 - protein, 9 aa, Homo Sapiens
DRITTEAGQ

SEQ ID NO: 212000 - protein, 9 aa, Homo Sapiens
LWSWCGTSQ

SEQ ID NO: 212001 - protein, 9 aa, Homo Sapiens
PDTELQSEL

SEQ ID NO: 212002 - protein, 9 aa, Homo Sapiens
MKKTTSQSQ

SEQ ID NO: 212003 - protein, 9 aa, Homo Sapiens
ATSSLEASG

SEQ ID NO: 212004 - protein, 9 aa, Homo Sapiens
APCQAQDTA

SEQ ID NO: 212005 - protein, 9 aa, Homo Sapiens
EAGERSAEP

SEQ ID NO: 212006 - protein, 9 aa, Homo Sapiens
YELTNLLRH

SEQ ID NO: 212007 - protein, 9 aa, Homo Sapiens
LSGGAWSMP

SEQ ID NO: 212008 - protein, 9 aa, Homo Sapiens
TLERNLTSV

SEQ ID NO: 212009 - protein, 9 aa, Homo Sapiens
EADEGVADE

SEQ ID NO: 212010 - protein, 9 aa, Homo Sapiens
DKVDRERAR

SEQ ID NO: 212011 - protein, 9 aa, Homo Sapiens
PPPREAIFP

SEQ ID NO: 212012 - protein, 9 aa, Homo Sapiens
TSMCQNLGY

SEQ ID NO: 212013 - protein, 9 aa, Homo Sapiens
ENRRLQRTL

SEQ ID NO: 212014 - protein, 9 aa, Homo Sapiens
KPLISLKKG

SEQ ID NO: 212015 - protein, 9 aa, Homo Sapiens
HLCCLVFSR

SEQ ID NO: 212016 - protein, 9 aa, Homo Sapiens
TWMTWCGWL

SEQ ID NO: 212017 - protein, 9 aa, Homo Sapiens
LRPLSLQCQ

SEQ ID NO: 212018 - protein, 9 aa, Homo Sapiens
TCQSCVNSI

SEQ ID NO: 212019 - protein, 9 aa, Homo Sapiens
VAVDQEGCI

SEQ ID NO: 212020 - protein, 9 aa, Homo Sapiens
LGIPVNHLT

SEQ ID NO: 212021 - protein, 9 aa, Homo Sapiens
CQSYGKTFS

SEQ ID NO: 212022 - protein, 9 aa, Homo Sapiens
ESREYWRWL

SEQ ID NO: 212023 - protein, 9 aa, Homo Sapiens
KKIAMTMDQ

SEQ ID NO: 212024 - protein, 9 aa, Homo Sapiens
HSKVQGEQS

SEQ ID NO: 212025 - protein, 9 aa, Homo Sapiens
APLQVTTTL

SEQ ID NO: 212026 - protein, 9 aa, Homo Sapiens
ESVQRATAL

SEQ ID NO: 212027 - protein, 9 aa, Homo Sapiens
ASASQANHV

SEQ ID NO: 212028 - protein, 9 aa, Homo Sapiens
LLILILADM

SEQ ID NO: 212029 - protein, 9 aa, Homo Sapiens
AGLLPVSYT

SEQ ID NO: 212030 - protein, 9 aa, Homo Sapiens
KKTTSQSQL

SEQ ID NO: 212031 - protein, 9 aa, Homo Sapiens
GMTLAAVCL

SEQ ID NO: 212032 - protein, 9 aa, Homo Sapiens
CRWLLCPFR

SEQ ID NO: 212033 - protein, 9 aa, Homo Sapiens
TLAVKNSKS

SEQ ID NO: 212034 - protein, 9 aa, Homo Sapiens
RGLRGHCAG

SEQ ID NO: 212035 - protein, 9 aa, Homo Sapiens
GIFLWMKIF

SEQ ID NO: 212036 - protein, 9 aa, Homo Sapiens
FLFFIPFLN

SEQ ID NO: 212037 - protein, 9 aa, Homo Sapiens
DGQGRGRGS

SEQ ID NO: 212038 - protein, 9 aa, Homo Sapiens
TTLKLILVM

SEQ ID NO: 212039 - protein, 9 aa, Homo Sapiens
ITPLSIQTQ

SEQ ID NO: 212040 - protein, 9 aa, Homo Sapiens
ALGDLCVVL

SEQ ID NO: 212041 - protein, 9 aa, Homo Sapiens
KTSSCQLSI

SEQ ID NO: 212042 - protein, 9 aa, Homo Sapiens
RALGLAPQA

SEQ ID NO: 212043 - protein, 9 aa, Homo Sapiens
AGLAVRLAS

SEQ ID NO: 212044 - protein, 9 aa, Homo Sapiens
SQGCALLVG

SEQ ID NO: 212045 - protein, 9 aa, Homo Sapiens
ERGQAFIQK

SEQ ID NO: 212046 - protein, 9 aa, Homo Sapiens
FGLATEKSR

SEQ ID NO: 212047 - protein, 9 aa, Homo Sapiens
QLALCVSRF

SEQ ID NO: 212048 - protein, 9 aa, Homo Sapiens
DLASPVLCS

SEQ ID NO: 212049 - protein, 9 aa, Homo Sapiens
FSQSFVDVW

SEQ ID NO: 212050 - protein, 9 aa, Homo Sapiens
YFLRGLEAS

SEQ ID NO: 212051 - protein, 9 aa, Homo Sapiens
QPQGSSGCK

SEQ ID NO: 212052 - protein, 9 aa, Homo Sapiens
PQHCYDACV

SEQ ID NO: 212053 - protein, 9 aa, Homo Sapiens
NNPVIEELQ

SEQ ID NO: 212054 - protein, 9 aa, Homo Sapiens
PALLGFRLV

SEQ ID NO: 212055 - protein, 9 aa, Homo Sapiens
TLGKFASSQ

SEQ ID NO: 212056 - protein, 9 aa, Homo Sapiens
PSCKARTSA

SEQ ID NO: 212057 - protein, 9 aa, Homo Sapiens
AGNFCFLRI

SEQ ID NO: 212058 - protein, 9 aa, Homo Sapiens
CSWRGQCNT

SEQ ID NO: 212059 - protein, 9 aa, Homo Sapiens
PQRLFRMKI

SEQ ID NO: 212060 - protein, 9 aa, Homo Sapiens
SSSHNRGPH

SEQ ID NO: 212061 - protein, 9 aa, Homo Sapiens
GRHGHLDSP

SEQ ID NO: 212062 - protein, 9 aa, Homo Sapiens
PLDDIIKCE

SEQ ID NO: 212063 - protein, 9 aa, Homo Sapiens
SGMPPSSPS

SEQ ID NO: 212064 - protein, 9 aa, Homo Sapiens
LRSRGKLAS

SEQ ID NO: 212065 - protein, 9 aa, Homo Sapiens
SCHDFHPEE

SEQ ID NO: 212066 - protein, 9 aa, Homo Sapiens
ALFAQKVRP

SEQ ID NO: 212067 - protein, 9 aa, Homo Sapiens
SHGVETIWD

SEQ ID NO: 212068 - protein, 9 aa, Homo Sapiens
KNGGGLKRK

SEQ ID NO: 212069 - protein, 9 aa, Homo Sapiens
LRGLFGVVG

SEQ ID NO: 212070 - protein, 9 aa, Homo Sapiens
LTSGADAIE

SEQ ID NO: 212071 - protein, 9 aa, Homo Sapiens
AAATGSSSS

SEQ ID NO: 212072 - protein, 9 aa, Homo Sapiens
TLAGQTSPK

SEQ ID NO: 212073 - protein, 9 aa, Homo Sapiens
EVKLRPETR

SEQ ID NO: 212074 - protein, 9 aa, Homo Sapiens
KTYMEMHYG

SEQ ID NO: 212075 - protein, 9 aa, Homo Sapiens
RPRPPLGGD

SEQ ID NO: 212076 - protein, 9 aa, Homo Sapiens
VSSCTGLDT

SEQ ID NO: 212077 - protein, 9 aa, Homo Sapiens
LALRRRRRL

SEQ ID NO: 212078 - protein, 9 aa, Homo Sapiens
KQTSIEVSV

SEQ ID NO: 212079 - protein, 9 aa, Homo Sapiens
YNFRMTILP

SEQ ID NO: 212080 - protein, 9 aa, Homo Sapiens
HRRLAGSVG

SEQ ID NO: 212081 - protein, 9 aa, Homo Sapiens
GKWSAVPPH

SEQ ID NO: 212082 - protein, 9 aa, Homo Sapiens
PQVAMLPKL

SEQ ID NO: 212083 - protein, 9 aa, Homo Sapiens
GDVLDKASA

SEQ ID NO: 212084 - protein, 9 aa, Homo Sapiens
SGLRVKGLW

SEQ ID NO: 212085 - protein, 9 aa, Homo Sapiens
TSNFQSLVA

SEQ ID NO: 212086 - protein, 9 aa, Homo Sapiens
DNSHSEATQ

SEQ ID NO: 212087 - protein, 9 aa, Homo Sapiens
PPSPDIQCD

SEQ ID NO: 212088 - protein, 9 aa, Homo Sapiens
LEGVIMAVL

SEQ ID NO: 212089 - protein, 9 aa, Homo Sapiens
GQISTLVLD

SEQ ID NO: 212090 - protein, 9 aa, Homo Sapiens
ALGKEVACE

SEQ ID NO: 212091 - protein, 9 aa, Homo Sapiens
RITNSCKNP

SEQ ID NO: 212092 - protein, 9 aa, Homo Sapiens
EGFPWQKKS

SEQ ID NO: 212093 - protein, 9 aa, Homo Sapiens
NRLLSNLTE

SEQ ID NO: 212094 - protein, 9 aa, Homo Sapiens
TRSEPFWMA

SEQ ID NO: 212095 - protein, 9 aa, Homo Sapiens
IRPPQSPPR

SEQ ID NO: 212096 - protein, 9 aa, Homo Sapiens
CMYVCARIS

SEQ ID NO: 212097 - protein, 9 aa, Homo Sapiens
ALPGPGVHG

SEQ ID NO: 212098 - protein, 9 aa, Homo Sapiens
LVFRLVVLC

SEQ ID NO: 212099 - protein, 9 aa, Homo Sapiens
ASSSAHHLV

SEQ ID NO: 212100 - protein, 9 aa, Homo Sapiens
EHMRSTLRK

SEQ ID NO: 212101 - protein, 9 aa, Homo Sapiens
VRFVKRLSG

SEQ ID NO: 212102 - protein, 9 aa, Homo Sapiens
ILWGEEVQV

SEQ ID NO: 212103 - protein, 9 aa, Homo Sapiens
NSLSNLGQD

SEQ ID NO: 212104 - protein, 9 aa, Homo Sapiens
SLIYWLLTQ

SEQ ID NO: 212105 - protein, 9 aa, Homo Sapiens
QKQWIAIAR

SEQ ID NO: 212106 - protein, 9 aa, Homo Sapiens
GHCLCRSGF

SEQ ID NO: 212107 - protein, 9 aa, Homo Sapiens
RRQERWQMK

SEQ ID NO: 212108 - protein, 9 aa, Homo Sapiens
EEKWLRRLE

SEQ ID NO: 212109 - protein, 9 aa, Homo Sapiens
AMDSLRPVR

SEQ ID NO: 212110 - protein, 9 aa, Homo Sapiens
IDRRSLAPP

SEQ ID NO: 212111 - protein, 9 aa, Homo Sapiens
LDYVNGSVS

SEQ ID NO: 212112 - protein, 9 aa, Homo Sapiens
DIVCDGRLY

SEQ ID NO: 212113 - protein, 9 aa, Homo Sapiens
IVQGSLQTS

SEQ ID NO: 212114 - protein, 9 aa, Homo Sapiens
WSMPRNGPW

SEQ ID NO: 212115 - protein, 9 aa, Homo Sapiens
DKKRHEMPP

SEQ ID NO: 212116 - protein, 9 aa, Homo Sapiens
LVTLDGQNW

SEQ ID NO: 212117 - protein, 9 aa, Homo Sapiens
RIQCCTADS

SEQ ID NO: 212118 - protein, 9 aa, Homo Sapiens
QEAERRQDL

SEQ ID NO: 212119 - protein, 9 aa, Homo Sapiens
QAPLRLWSW

SEQ ID NO: 212120 - protein, 9 aa, Homo Sapiens
VANFYCDIP

SEQ ID NO: 212121 - protein, 9 aa, Homo Sapiens
PSTGTTSAL

SEQ ID NO: 212122 - protein, 9 aa, Homo Sapiens
VCARISVCA

SEQ ID NO: 212123 - protein, 9 aa, Homo Sapiens
SEILGSVDQ

SEQ ID NO: 212124 - protein, 9 aa, Homo Sapiens
RGAQNMEFL

SEQ ID NO: 212125 - protein, 9 aa, Homo Sapiens
SQTTHRLYK

SEQ ID NO: 212126 - protein, 9 aa, Homo Sapiens
YCHIKHAWA

SEQ ID NO: 212127 - protein, 9 aa, Homo Sapiens
SGCGAPRSW

SEQ ID NO: 212128 - protein, 9 aa, Homo Sapiens
GEDVHSGPI

SEQ ID NO: 212129 - protein, 9 aa, Homo Sapiens
PAPRRGPAQ

SEQ ID NO: 212130 - protein, 9 aa, Homo Sapiens
TVMRETRCL

SEQ ID NO: 212131 - protein, 9 aa, Homo Sapiens
GTFILYKFL

SEQ ID NO: 212132 - protein, 9 aa, Homo Sapiens
LIMLLVYRM

SEQ ID NO: 212133 - protein, 9 aa, Homo Sapiens
SMQNPDRPT

SEQ ID NO: 212134 - protein, 9 aa, Homo Sapiens
PVRSTVCAM

SEQ ID NO: 212135 - protein, 9 aa, Homo Sapiens
DVEHVLLGE

SEQ ID NO: 212136 - protein, 9 aa, Homo Sapiens
LWLSHRLRL

SEQ ID NO: 212137 - protein, 9 aa, Homo Sapiens
ARARVCIVS

SEQ ID NO: 212138 - protein, 9 aa, Homo Sapiens
TRPDRDHHV

SEQ ID NO: 212139 - protein, 9 aa, Homo Sapiens
PVFGWVMFV

SEQ ID NO: 212140 - protein, 9 aa, Homo Sapiens
IEEYLTGED

SEQ ID NO: 212141 - protein, 9 aa, Homo Sapiens
KNNRCVPSR

SEQ ID NO: 212142 - protein, 9 aa, Homo Sapiens
STTSISVCG

SEQ ID NO: 212143 - protein, 9 aa, Homo Sapiens
MLSSVDLND

SEQ ID NO: 212144 - protein, 9 aa, Homo Sapiens
NLCVISIDR

SEQ ID NO: 212145 - protein, 9 aa, Homo Sapiens
ERRCDPIRT

SEQ ID NO: 212146 - protein, 9 aa, Homo Sapiens
ANARTRAWR

SEQ ID NO: 212147 - protein, 9 aa, Homo Sapiens
DTQKEIRVS

SEQ ID NO: 212148 - protein, 9 aa, Homo Sapiens
MYHPRAFIF

SEQ ID NO: 212149 - protein, 9 aa, Homo Sapiens
LARPQNGPQ

SEQ ID NO: 212150 - protein, 9 aa, Homo Sapiens
SRRAQRRCQ

SEQ ID NO: 212151 - protein, 9 aa, Homo Sapiens
RHLEFRKHI

SEQ ID NO: 212152 - protein, 9 aa, Homo Sapiens
GVHPGCQGT

SEQ ID NO: 212153 - protein, 9 aa, Homo Sapiens
GRGAAPLSP

SEQ ID NO: 212154 - protein, 9 aa, Homo Sapiens
LENALIVFA

SEQ ID NO: 212155 - protein, 9 aa, Homo Sapiens
SDEIRYRVV

SEQ ID NO: 212156 - protein, 9 aa, Homo Sapiens
TFQQAAQIL

SEQ ID NO: 212157 - protein, 9 aa, Homo Sapiens
HHGKISRET

SEQ ID NO: 212158 - protein, 9 aa, Homo Sapiens
MLYKKKAHL

SEQ ID NO: 212159 - protein, 9 aa, Homo Sapiens
PPTRPRRKP

SEQ ID NO: 212160 - protein, 9 aa, Homo Sapiens
SLCKMSDTC

SEQ ID NO: 212161 - protein, 9 aa, Homo Sapiens
YKENGPFLS

SEQ ID NO: 212162 - protein, 9 aa, Homo Sapiens
DVVVVFTEE

SEQ ID NO: 212163 - protein, 9 aa, Homo Sapiens
HHVSIVREN

SEQ ID NO: 212164 - protein, 9 aa, Homo Sapiens
IIDWILKTW

SEQ ID NO: 212165 - protein, 9 aa, Homo Sapiens
RSSDEDLIK

SEQ ID NO: 212166 - protein, 9 aa, Homo Sapiens
IKKKRSVCN

SEQ ID NO: 212167 - protein, 9 aa, Homo Sapiens
DHTQNSVTA

SEQ ID NO: 212168 - protein, 9 aa, Homo Sapiens
TWQRRLRAC

SEQ ID NO: 212169 - protein, 9 aa, Homo Sapiens
FFGGKQEDV

SEQ ID NO: 212170 - protein, 9 aa, Homo Sapiens
RRCGSATGW

SEQ ID NO: 212171 - protein, 9 aa, Homo Sapiens
KTSGSGWLS

SEQ ID NO: 212172 - protein, 9 aa, Homo Sapiens
RVTGVSGLS

SEQ ID NO: 212173 - protein, 9 aa, Homo Sapiens
SPWCLRRRS

SEQ ID NO: 212174 - protein, 9 aa, Homo Sapiens
PHGKRCNPC

SEQ ID NO: 212175 - protein, 9 aa, Homo Sapiens
FLLLDTTAN

SEQ ID NO: 212176 - protein, 9 aa, Homo Sapiens
VPSRWQCDY

SEQ ID NO: 212177 - protein, 9 aa, Homo Sapiens
LFAIFLIML

SEQ ID NO: 212178 - protein, 9 aa, Homo Sapiens
AGLHVHGSV

SEQ ID NO: 212179 - protein, 9 aa, Homo Sapiens
PSGPLDTGK

SEQ ID NO: 212180 - protein, 9 aa, Homo Sapiens
LHSTAYMMD

SEQ ID NO: 212181 - protein, 9 aa, Homo Sapiens
RWRCRGLWS

SEQ ID NO: 212182 - protein, 9 aa, Homo Sapiens
MVFQWLHST

SEQ ID NO: 212183 - protein, 9 aa, Homo Sapiens
EDIAQRAVE

SEQ ID NO: 212184 - protein, 9 aa, Homo Sapiens
EEELPRERK

SEQ ID NO: 212185 - protein, 9 aa, Homo Sapiens
FLKDIIEKT

SEQ ID NO: 212186 - protein, 9 aa, Homo Sapiens
NPDRELWPW

SEQ ID NO: 212187 - protein, 9 aa, Homo Sapiens
CWGPQRGQG

SEQ ID NO: 212188 - protein, 9 aa, Homo Sapiens
GHLSILWGE

SEQ ID NO: 212189 - protein, 9 aa, Homo Sapiens
PVAPTPVNP

SEQ ID NO: 212190 - protein, 9 aa, Homo Sapiens
SLIRRTRQA

SEQ ID NO: 212191 - protein, 9 aa, Homo Sapiens
YQGAAVACP

SEQ ID NO: 212192 - protein, 9 aa, Homo Sapiens
RPPAPRRGP

SEQ ID NO: 212193 - protein, 9 aa, Homo Sapiens
INRQRKESF

SEQ ID NO: 212194 - protein, 9 aa, Homo Sapiens
QAARIRAAR

SEQ ID NO: 212195 - protein, 9 aa, Homo Sapiens
ECPVSTQSL

SEQ ID NO: 212196 - protein, 9 aa, Homo Sapiens
FNGVQMCVD

SEQ ID NO: 212197 - protein, 9 aa, Homo Sapiens
FSPYWMKKV

SEQ ID NO: 212198 - protein, 9 aa, Homo Sapiens
GEEAQAGAG

SEQ ID NO: 212199 - protein, 9 aa, Homo Sapiens
CSVPPCLTA

SEQ ID NO: 212200 - protein, 9 aa, Homo Sapiens
LKDRDIGRS

SEQ ID NO: 212201 - protein, 9 aa, Homo Sapiens
YRGHAYPVW

SEQ ID NO: 212202 - protein, 9 aa, Homo Sapiens
FENREFLSI

SEQ ID NO: 212203 - protein, 9 aa, Homo Sapiens
PDRRRELYK

SEQ ID NO: 212204 - protein, 9 aa, Homo Sapiens
VRDNKDGTY

SEQ ID NO: 212205 - protein, 9 aa, Homo Sapiens
SNSLTTLSQ

SEQ ID NO: 212206 - protein, 9 aa, Homo Sapiens
ILAIALHLR

SEQ ID NO: 212207 - protein, 9 aa, Homo Sapiens
YVTENRDDV

SEQ ID NO: 212208 - protein, 9 aa, Homo Sapiens
VAGQVPVDD

SEQ ID NO: 212209 - protein, 9 aa, Homo Sapiens
HGLVVLLGL

SEQ ID NO: 212210 - protein, 9 aa, Homo Sapiens
VQIWEIPEG

SEQ ID NO: 212211 - protein, 9 aa, Homo Sapiens
SWTSAGSAA

SEQ ID NO: 212212 - protein, 9 aa, Homo Sapiens
GVVLHSILN

SEQ ID NO: 212213 - protein, 9 aa, Homo Sapiens
NLGCSPMLA

SEQ ID NO: 212214 - protein, 9 aa, Homo Sapiens
FTGFLGMVT

SEQ ID NO: 212215 - protein, 9 aa, Homo Sapiens
QHGSCALAT

SEQ ID NO: 212216 - protein, 9 aa, Homo Sapiens
VFVLLWAFS

SEQ ID NO: 212217 - protein, 9 aa, Homo Sapiens
CPKIPPPKA

SEQ ID NO: 212218 - protein, 9 aa, Homo Sapiens
APGGGGSPR

SEQ ID NO: 212219 - protein, 9 aa, Homo Sapiens
IEESWNDEA

SEQ ID NO: 212220 - protein, 9 aa, Homo Sapiens
FPAELALKN

SEQ ID NO: 212221 - protein, 9 aa, Homo Sapiens
GRVPGQAAK

SEQ ID NO: 212222 - protein, 9 aa, Homo Sapiens
QSAECQPHC

SEQ ID NO: 212223 - protein, 9 aa, Homo Sapiens
RAENFTKTS

SEQ ID NO: 212224 - protein, 9 aa, Homo Sapiens
LNVHSKLEA

SEQ ID NO: 212225 - protein, 9 aa, Homo Sapiens
IRREIDDFL

SEQ ID NO: 212226 - protein, 9 aa, Homo Sapiens
AQGRKRKKQ

SEQ ID NO: 212227 - protein, 9 aa, Homo Sapiens
RNSWAIGVL

SEQ ID NO: 212228 - protein, 9 aa, Homo Sapiens
TGRAPNCWH

SEQ ID NO: 212229 - protein, 9 aa, Homo Sapiens
VGVVVPDTA

SEQ ID NO: 212230 - protein, 9 aa, Homo Sapiens
GLGAAPLPP

SEQ ID NO: 212231 - protein, 9 aa, Homo Sapiens
QQQLAYARV

SEQ ID NO: 212232 - protein, 9 aa, Homo Sapiens
RIHFPALPC

SEQ ID NO: 212233 - protein, 9 aa, Homo Sapiens
FMTNGPLTF

SEQ ID NO: 212234 - protein, 9 aa, Homo Sapiens
ILKGSVQQA

SEQ ID NO: 212235 - protein, 9 aa, Homo Sapiens
FSQTPSRGF

SEQ ID NO: 212236 - protein, 9 aa, Homo Sapiens
SCLQTSNNN

SEQ ID NO: 212237 - protein, 9 aa, Homo Sapiens
LWRPGWGCV

SEQ ID NO: 212238 - protein, 9 aa, Homo Sapiens
FLLHQPLPG

SEQ ID NO: 212239 - protein, 9 aa, Homo Sapiens
PILEILDEE

SEQ ID NO: 212240 - protein, 9 aa, Homo Sapiens
GEIVCSIPR

SEQ ID NO: 212241 - protein, 9 aa, Homo Sapiens
RALCMLKLG

SEQ ID NO: 212242 - protein, 9 aa, Homo Sapiens
SPPNTHPSP

SEQ ID NO: 212243 - protein, 9 aa, Homo Sapiens
GCVYAATPV

SEQ ID NO: 212244 - protein, 9 aa, Homo Sapiens
IMRKMQTLM

SEQ ID NO: 212245 - protein, 9 aa, Homo Sapiens
RSETSSIPQ

SEQ ID NO: 212246 - protein, 9 aa, Homo Sapiens
QHSTPVPAA

SEQ ID NO: 212247 - protein, 9 aa, Homo Sapiens
GDRSRGAME

SEQ ID NO: 212248 - protein, 9 aa, Homo Sapiens
TRPMICQYC

SEQ ID NO: 212249 - protein, 9 aa, Homo Sapiens
TVSTGGHTH

SEQ ID NO: 212250 - protein, 9 aa, Homo Sapiens
VCTGEHYYS

SEQ ID NO: 212251 - protein, 9 aa, Homo Sapiens
EGCHKKTSQ

SEQ ID NO: 212252 - protein, 9 aa, Homo Sapiens
NMASSWVTA

SEQ ID NO: 212253 - protein, 9 aa, Homo Sapiens
YLTTLTDSN

SEQ ID NO: 212254 - protein, 9 aa, Homo Sapiens
SPLVAPRQT

SEQ ID NO: 212255 - protein, 9 aa, Homo Sapiens
EEEDGEDMD

SEQ ID NO: 212256 - protein, 9 aa, Homo Sapiens
HTVALIGLS

SEQ ID NO: 212257 - protein, 9 aa, Homo Sapiens
FYFAGVPLI

SEQ ID NO: 212258 - protein, 9 aa, Homo Sapiens
EASKRELEL

SEQ ID NO: 212259 - protein, 9 aa, Homo Sapiens
EQNGTMVGA

SEQ ID NO: 212260 - protein, 9 aa, Homo Sapiens
CNGTQVPQF

SEQ ID NO: 212261 - protein, 9 aa, Homo Sapiens
KGKIKELFS

SEQ ID NO: 212262 - protein, 9 aa, Homo Sapiens
TWEQLENGM

SEQ ID NO: 212263 - protein, 9 aa, Homo Sapiens
TIQDLVSGS

SEQ ID NO: 212264 - protein, 9 aa, Homo Sapiens
CVNLMRGWE

SEQ ID NO: 212265 - protein, 9 aa, Homo Sapiens
LRQSLFNRG

SEQ ID NO: 212266 - protein, 9 aa, Homo Sapiens
LDPCFQRDL

SEQ ID NO: 212267 - protein, 9 aa, Homo Sapiens
SATCTWTSA

SEQ ID NO: 212268 - protein, 9 aa, Homo Sapiens
IEVNARLAR

SEQ ID NO: 212269 - protein, 9 aa, Homo Sapiens
NLGQDLPNN

SEQ ID NO: 212270 - protein, 9 aa, Homo Sapiens
GLPALEEME

SEQ ID NO: 212271 - protein, 9 aa, Homo Sapiens
FPLGRVSWW

SEQ ID NO: 212272 - protein, 9 aa, Homo Sapiens
HREREAMIL

SEQ ID NO: 212273 - protein, 9 aa, Homo Sapiens
NVGVTLDGP

SEQ ID NO: 212274 - protein, 9 aa, Homo Sapiens
WKSQMQSGM

SEQ ID NO: 212275 - protein, 9 aa, Homo Sapiens
HFLGERDCG

SEQ ID NO: 212276 - protein, 9 aa, Homo Sapiens
NANHVFFLL

SEQ ID NO: 212277 - protein, 9 aa, Homo Sapiens
IEKNSPFGS

SEQ ID NO: 212278 - protein, 9 aa, Homo Sapiens
AAITMDERV

SEQ ID NO: 212279 - protein, 9 aa, Homo Sapiens
FWGGSQCRW

SEQ ID NO: 212280 - protein, 9 aa, Homo Sapiens
RATVPRHSS

SEQ ID NO: 212281 - protein, 9 aa, Homo Sapiens
DAQQRPAQS

SEQ ID NO: 212282 - protein, 9 aa, Homo Sapiens
MDNIRELCI

SEQ ID NO: 212283 - protein, 9 aa, Homo Sapiens
TVTKYTSSK

SEQ ID NO: 212284 - protein, 9 aa, Homo Sapiens
GSFGQAVKA

SEQ ID NO: 212285 - protein, 9 aa, Homo Sapiens
LFMVTMAVI

SEQ ID NO: 212286 - protein, 9 aa, Homo Sapiens
EGHQLLIKA

SEQ ID NO: 212287 - protein, 9 aa, Homo Sapiens
EMLGMYRRP

SEQ ID NO: 212288 - protein, 9 aa, Homo Sapiens
PPYSIPSMI

SEQ ID NO: 212289 - protein, 9 aa, Homo Sapiens
VSGLDPNTM

SEQ ID NO: 212290 - protein, 9 aa, Homo Sapiens
STLQQRHPQ

SEQ ID NO: 212291 - protein, 9 aa, Homo Sapiens
VLAVAPAVL

SEQ ID NO: 212292 - protein, 9 aa, Homo Sapiens
VPRSWSSGG

SEQ ID NO: 212293 - protein, 9 aa, Homo Sapiens
GGEFHFIIL

SEQ ID NO: 212294 - protein, 9 aa, Homo Sapiens
IAMALEQEI

SEQ ID NO: 212295 - protein, 9 aa, Homo Sapiens
NMDIPRESG

SEQ ID NO: 212296 - protein, 9 aa, Homo Sapiens
NWSLLKDYD

SEQ ID NO: 212297 - protein, 9 aa, Homo Sapiens
ELGFCIHVK

SEQ ID NO: 212298 - protein, 9 aa, Homo Sapiens
RHTICVKTH

SEQ ID NO: 212299 - protein, 9 aa, Homo Sapiens
SAGPASASG

SEQ ID NO: 212300 - protein, 9 aa, Homo Sapiens
PENSPKGAH

SEQ ID NO: 212301 - protein, 9 aa, Homo Sapiens
FFLQIIWLK

SEQ ID NO: 212302 - protein, 9 aa, Homo Sapiens
YAKCFENKI

SEQ ID NO: 212303 - protein, 9 aa, Homo Sapiens
PSIWYENLS

SEQ ID NO: 212304 - protein, 9 aa, Homo Sapiens
LLIAQELTD

SEQ ID NO: 212305 - protein, 9 aa, Homo Sapiens
QRRKYRLMG

SEQ ID NO: 212306 - protein, 9 aa, Homo Sapiens
HSNSPCPRS

SEQ ID NO: 212307 - protein, 9 aa, Homo Sapiens
EEAMLFTYF

SEQ ID NO: 212308 - protein, 9 aa, Homo Sapiens
SPASPAHSP

SEQ ID NO: 212309 - protein, 9 aa, Homo Sapiens
GWRVAAAGT

SEQ ID NO: 212310 - protein, 9 aa, Homo Sapiens
GRTMTHEHL

SEQ ID NO: 212311 - protein, 9 aa, Homo Sapiens
GVFRVASRS

SEQ ID NO: 212312 - protein, 9 aa, Homo Sapiens
CHNQVDPNG

SEQ ID NO: 212313 - protein, 9 aa, Homo Sapiens
GSIKRSCSA

SEQ ID NO: 212314 - protein, 9 aa, Homo Sapiens
GLCSLQHQE

SEQ ID NO: 212315 - protein, 9 aa, Homo Sapiens
DTKYFRFVV

SEQ ID NO: 212316 - protein, 9 aa, Homo Sapiens
SLKGNRAEN

SEQ ID NO: 212317 - protein, 9 aa, Homo Sapiens
TANEKITPF

SEQ ID NO: 212318 - protein, 9 aa, Homo Sapiens
REFMKHRRD

SEQ ID NO: 212319 - protein, 9 aa, Homo Sapiens
PGCALPAAA

SEQ ID NO: 212320 - protein, 9 aa, Homo Sapiens
SSTFLLACL

SEQ ID NO: 212321 - protein, 9 aa, Homo Sapiens
KLKLAPLQV

SEQ ID NO: 212322 - protein, 9 aa, Homo Sapiens
TLHAARPAD

SEQ ID NO: 212323 - protein, 9 aa, Homo Sapiens
RVGVPGTGA

SEQ ID NO: 212324 - protein, 9 aa, Homo Sapiens
AVTSTSLTF

SEQ ID NO: 212325 - protein, 9 aa, Homo Sapiens
LIKVQVALG

SEQ ID NO: 212326 - protein, 9 aa, Homo Sapiens
RFSMDVPMS

SEQ ID NO: 212327 - protein, 9 aa, Homo Sapiens
EETGVSTYN

SEQ ID NO: 212328 - protein, 9 aa, Homo Sapiens
EMYEESVPV

SEQ ID NO: 212329 - protein, 9 aa, Homo Sapiens
PSCGGLRQS

SEQ ID NO: 212330 - protein, 9 aa, Homo Sapiens
MSGSGHCLC

SEQ ID NO: 212331 - protein, 9 aa, Homo Sapiens
ASALSPDCR

SEQ ID NO: 212332 - protein, 9 aa, Homo Sapiens
SPASDADSW

SEQ ID NO: 212333 - protein, 9 aa, Homo Sapiens
QLENGMVAV

SEQ ID NO: 212334 - protein, 9 aa, Homo Sapiens
LECAARRQF

SEQ ID NO: 212335 - protein, 9 aa, Homo Sapiens
SPNRATQDN

SEQ ID NO: 212336 - protein, 9 aa, Homo Sapiens
QQLNQRLQH

SEQ ID NO: 212337 - protein, 9 aa, Homo Sapiens
PPMRSPSRR

SEQ ID NO: 212338 - protein, 9 aa, Homo Sapiens
SGSQSGTKM

SEQ ID NO: 212339 - protein, 9 aa, Homo Sapiens
KSYLALGDL

SEQ ID NO: 212340 - protein, 9 aa, Homo Sapiens
YVGSSSRIP

SEQ ID NO: 212341 - protein, 9 aa, Homo Sapiens
LSLIYTVYS

SEQ ID NO: 212342 - protein, 9 aa, Homo Sapiens
QDLASPVLC

SEQ ID NO: 212343 - protein, 9 aa, Homo Sapiens
FGMCKYTTP

SEQ ID NO: 212344 - protein, 9 aa, Homo Sapiens
TVNMSKVET

SEQ ID NO: 212345 - protein, 9 aa, Homo Sapiens
DRPSMRSDR

SEQ ID NO: 212346 - protein, 9 aa, Homo Sapiens
QEKDCWAAT

SEQ ID NO: 212347 - protein, 9 aa, Homo Sapiens
QEKPDRRRE

SEQ ID NO: 212348 - protein, 9 aa, Homo Sapiens
GGKLCQCRC

SEQ ID NO: 212349 - protein, 9 aa, Homo Sapiens
GDWAKPSFV

SEQ ID NO: 212350 - protein, 9 aa, Homo Sapiens
RGALSVPLS

SEQ ID NO: 212351 - protein, 9 aa, Homo Sapiens
AREDGDGDK

SEQ ID NO: 212352 - protein, 9 aa, Homo Sapiens
MKIFRSGPW

SEQ ID NO: 212353 - protein, 9 aa, Homo Sapiens
MKNHRDSEY

SEQ ID NO: 212354 - protein, 9 aa, Homo Sapiens
PATPPFGLI

SEQ ID NO: 212355 - protein, 9 aa, Homo Sapiens
FNEQPIIFA

SEQ ID NO: 212356 - protein, 9 aa, Homo Sapiens
VFVDFLIGS

SEQ ID NO: 212357 - protein, 9 aa, Homo Sapiens
PGLSSPPLW

SEQ ID NO: 212358 - protein, 9 aa, Homo Sapiens
KRKFSGQRR

SEQ ID NO: 212359 - protein, 9 aa, Homo Sapiens
GAQGVGSGG

SEQ ID NO: 212360 - protein, 9 aa, Homo Sapiens
RAPAGGRGR

SEQ ID NO: 212361 - protein, 9 aa, Homo Sapiens
DYFLRPLHS

SEQ ID NO: 212362 - protein, 9 aa, Homo Sapiens
KGKQKVLKI

SEQ ID NO: 212363 - protein, 9 aa, Homo Sapiens
TIGWAWGHP

SEQ ID NO: 212364 - protein, 9 aa, Homo Sapiens
PLKEVHFVF

SEQ ID NO: 212365 - protein, 9 aa, Homo Sapiens
YAAFVLFRC

SEQ ID NO: 212366 - protein, 9 aa, Homo Sapiens
TLEFTLERN

SEQ ID NO: 212367 - protein, 9 aa, Homo Sapiens
LKQLAEQRT

SEQ ID NO: 212368 - protein, 9 aa, Homo Sapiens
NGPGLVATR

SEQ ID NO: 212369 - protein, 9 aa, Homo Sapiens
VPPTWASPP

SEQ ID NO: 212370 - protein, 9 aa, Homo Sapiens
SSHYAREWS

SEQ ID NO: 212371 - protein, 9 aa, Homo Sapiens
NLAKFHKLQ

SEQ ID NO: 212372 - protein, 9 aa, Homo Sapiens
ISGESGTGK

SEQ ID NO: 212373 - protein, 9 aa, Homo Sapiens
DILLSPVLA

SEQ ID NO: 212374 - protein, 9 aa, Homo Sapiens
MMLNYRLMF

SEQ ID NO: 212375 - protein, 9 aa, Homo Sapiens
GHQVPPTWA

SEQ ID NO: 212376 - protein, 9 aa, Homo Sapiens
HYALELTLP

SEQ ID NO: 212377 - protein, 9 aa, Homo Sapiens
CTNRLLSNL

SEQ ID NO: 212378 - protein, 9 aa, Homo Sapiens
LATHNKNSN

SEQ ID NO: 212379 - protein, 9 aa, Homo Sapiens
LYPSPSTGT

SEQ ID NO: 212380 - protein, 9 aa, Homo Sapiens
SGSWNYRQP

SEQ ID NO: 212381 - protein, 9 aa, Homo Sapiens
RPPQSPPRT

SEQ ID NO: 212382 - protein, 9 aa, Homo Sapiens
EVKVVLGLL

SEQ ID NO: 212383 - protein, 9 aa, Homo Sapiens
STAATASTS

SEQ ID NO: 212384 - protein, 9 aa, Homo Sapiens
MTVIAGAHH

SEQ ID NO: 212385 - protein, 9 aa, Homo Sapiens
LHVHGSVDV

SEQ ID NO: 212386 - protein, 9 aa, Homo Sapiens
KYWECKHLR

SEQ ID NO: 212387 - protein, 9 aa, Homo Sapiens
YVAGNFCFL

SEQ ID NO: 212388 - protein, 9 aa, Homo Sapiens
TFKEFFAAM

SEQ ID NO: 212389 - protein, 9 aa, Homo Sapiens
TEKSRWSGS

SEQ ID NO: 212390 - protein, 9 aa, Homo Sapiens
SCGQGSVLL

SEQ ID NO: 212391 - protein, 9 aa, Homo Sapiens
CRLRMLLVA

SEQ ID NO: 212392 - protein, 9 aa, Homo Sapiens
AVAHMDERR

SEQ ID NO: 212393 - protein, 9 aa, Homo Sapiens
PVDDWGAAG

SEQ ID NO: 212394 - protein, 9 aa, Homo Sapiens
CRQMLPTLS

SEQ ID NO: 212395 - protein, 9 aa, Homo Sapiens
LVSMTVCVF

SEQ ID NO: 212396 - protein, 9 aa, Homo Sapiens
YLIIQVPRE

SEQ ID NO: 212397 - protein, 9 aa, Homo Sapiens
DFRVPPLQR

SEQ ID NO: 212398 - protein, 9 aa, Homo Sapiens
PLGTGQDVG

SEQ ID NO: 212399 - protein, 9 aa, Homo Sapiens
RATFSACST

SEQ ID NO: 212400 - protein, 9 aa, Homo Sapiens
ACYNFIRSM

SEQ ID NO: 212401 - protein, 9 aa, Homo Sapiens
ENGMVAVRT

SEQ ID NO: 212402 - protein, 9 aa, Homo Sapiens
VRDDNHPKG

SEQ ID NO: 212403 - protein, 9 aa, Homo Sapiens
NNFTKKTQL

SEQ ID NO: 212404 - protein, 9 aa, Homo Sapiens
NGGSSKRQT

SEQ ID NO: 212405 - protein, 9 aa, Homo Sapiens
NHLCCLVFS

SEQ ID NO: 212406 - protein, 9 aa, Homo Sapiens
PHQSPGHLG

SEQ ID NO: 212407 - protein, 9 aa, Homo Sapiens
RERSWAASR

SEQ ID NO: 212408 - protein, 9 aa, Homo Sapiens
VMSSPSWRA

SEQ ID NO: 212409 - protein, 9 aa, Homo Sapiens
LSASSSSSS

SEQ ID NO: 212410 - protein, 9 aa, Homo Sapiens
ALARCAVPH

SEQ ID NO: 212411 - protein, 9 aa, Homo Sapiens
YSCIALGKP

SEQ ID NO: 212412 - protein, 9 aa, Homo Sapiens
IMSRGGVSD

SEQ ID NO: 212413 - protein, 9 aa, Homo Sapiens
LPEVKLPEV

SEQ ID NO: 212414 - protein, 9 aa, Homo Sapiens
ATASQESSS

SEQ ID NO: 212415 - protein, 9 aa, Homo Sapiens
LLLALAMGL

SEQ ID NO: 212416 - protein, 9 aa, Homo Sapiens
LALKEDLLY

SEQ ID NO: 212417 - protein, 9 aa, Homo Sapiens
QPPLCSTSA

SEQ ID NO: 212418 - protein, 9 aa, Homo Sapiens
ATQQVLCVV

SEQ ID NO: 212419 - protein, 9 aa, Homo Sapiens
EQEKLEATD

SEQ ID NO: 212420 - protein, 9 aa, Homo Sapiens
QYSPLRAYR

SEQ ID NO: 212421 - protein, 9 aa, Homo Sapiens
WNTMQWNNK

SEQ ID NO: 212422 - protein, 9 aa, Homo Sapiens
GIGDRSQHG

SEQ ID NO: 212423 - protein, 9 aa, Homo Sapiens
PHHSLKMRN

SEQ ID NO: 212424 - protein, 9 aa, Homo Sapiens
EWKLLSETG

SEQ ID NO: 212425 - protein, 9 aa, Homo Sapiens
KVTELRQAP

SEQ ID NO: 212426 - protein, 9 aa, Homo Sapiens
TSGTVIPSN

SEQ ID NO: 212427 - protein, 9 aa, Homo Sapiens
VIEELQNQP

SEQ ID NO: 212428 - protein, 9 aa, Homo Sapiens
PGHLGLFLL

SEQ ID NO: 212429 - protein, 9 aa, Homo Sapiens
KTFYTLRVQ

SEQ ID NO: 212430 - protein, 9 aa, Homo Sapiens
CAWPAIFFM

SEQ ID NO: 212431 - protein, 9 aa, Homo Sapiens
RAWRTRCAS

SEQ ID NO: 212432 - protein, 9 aa, Homo Sapiens
GLDDRSPQA

SEQ ID NO: 212433 - protein, 9 aa, Homo Sapiens
DLEEAVSGS

SEQ ID NO: 212434 - protein, 9 aa, Homo Sapiens
EVQVPKFLS

SEQ ID NO: 212435 - protein, 9 aa, Homo Sapiens
SARAPRSWP

SEQ ID NO: 212436 - protein, 9 aa, Homo Sapiens
SSGGEKEED

SEQ ID NO: 212437 - protein, 9 aa, Homo Sapiens
TRVNFIDSV

SEQ ID NO: 212438 - protein, 9 aa, Homo Sapiens
MAEYEIKKT

SEQ ID NO: 212439 - protein, 9 aa, Homo Sapiens
WKPLLWLPC

SEQ ID NO: 212440 - protein, 9 aa, Homo Sapiens
SGLPELFCQ

SEQ ID NO: 212441 - protein, 9 aa, Homo Sapiens
RPRRCWTGA

SEQ ID NO: 212442 - protein, 9 aa, Homo Sapiens
VPRQDRPVC

SEQ ID NO: 212443 - protein, 9 aa, Homo Sapiens
SMGKSSLAL

SEQ ID NO: 212444 - protein, 9 aa, Homo Sapiens
ISKQLYRRL

SEQ ID NO: 212445 - protein, 9 aa, Homo Sapiens
LLVNDNTDP

SEQ ID NO: 212446 - protein, 9 aa, Homo Sapiens
LCRQMLPTL

SEQ ID NO: 212447 - protein, 9 aa, Homo Sapiens
KSPKRPKIL

SEQ ID NO: 212448 - protein, 9 aa, Homo Sapiens
SGRSRPTRG

SEQ ID NO: 212449 - protein, 9 aa, Homo Sapiens
GYPWAGFPF

SEQ ID NO: 212450 - protein, 9 aa, Homo Sapiens
SAKSGSTAS

SEQ ID NO: 212451 - protein, 9 aa, Homo Sapiens
HEVSLTTDW

SEQ ID NO: 212452 - protein, 9 aa, Homo Sapiens
ARVTGHAMA

SEQ ID NO: 212453 - protein, 9 aa, Homo Sapiens
SSSTNSSTG

SEQ ID NO: 212454 - protein, 9 aa, Homo Sapiens
PLISLMIEY

SEQ ID NO: 212455 - protein, 9 aa, Homo Sapiens
NSVDFSEVE

SEQ ID NO: 212456 - protein, 9 aa, Homo Sapiens
GTCFSEVQA

SEQ ID NO: 212457 - protein, 9 aa, Homo Sapiens
RPHSETEEM

SEQ ID NO: 212458 - protein, 9 aa, Homo Sapiens
VLDNAPRAA

SEQ ID NO: 212459 - protein, 9 aa, Homo Sapiens
PCSLPLDRT

SEQ ID NO: 212460 - protein, 9 aa, Homo Sapiens
VWPSVPSST

SEQ ID NO: 212461 - protein, 9 aa, Homo Sapiens
SALASCARP

SEQ ID NO: 212462 - protein, 9 aa, Homo Sapiens
PEERVTARA

SEQ ID NO: 212463 - protein, 9 aa, Homo Sapiens
TSTPGPWAA

SEQ ID NO: 212464 - protein, 9 aa, Homo Sapiens
GHQAPQVAM

SEQ ID NO: 212465 - protein, 9 aa, Homo Sapiens
GVGDLECAA

SEQ ID NO: 212466 - protein, 9 aa, Homo Sapiens
LTHKSFINL

SEQ ID NO: 212467 - protein, 9 aa, Homo Sapiens
VTSTSPRRP

SEQ ID NO: 212468 - protein, 9 aa, Homo Sapiens
QFTILNSKQ

SEQ ID NO: 212469 - protein, 9 aa, Homo Sapiens
HKSCKLRII

SEQ ID NO: 212470 - protein, 9 aa, Homo Sapiens
KTFWNHMLL

SEQ ID NO: 212471 - protein, 9 aa, Homo Sapiens
ALIKCVQVS

SEQ ID NO: 212472 - protein, 9 aa, Homo Sapiens
KVILQVRST

SEQ ID NO: 212473 - protein, 9 aa, Homo Sapiens
VGKARRRNA

SEQ ID NO: 212474 - protein, 9 aa, Homo Sapiens
TSRSSPWPS

SEQ ID NO: 212475 - protein, 9 aa, Homo Sapiens
SSSAHHLVP

SEQ ID NO: 212476 - protein, 9 aa, Homo Sapiens
WNFFPGSGA

SEQ ID NO: 212477 - protein, 9 aa, Homo Sapiens
CKVHQWVDS

SEQ ID NO: 212478 - protein, 9 aa, Homo Sapiens
VDGSAAVAT

SEQ ID NO: 212479 - protein, 9 aa, Homo Sapiens
SWQPGGRSS

SEQ ID NO: 212480 - protein, 9 aa, Homo Sapiens
GTCIVNSEN

SEQ ID NO: 212481 - protein, 9 aa, Homo Sapiens
LSEEPSNGI

SEQ ID NO: 212482 - protein, 9 aa, Homo Sapiens
PHTRATHTK

SEQ ID NO: 212483 - protein, 9 aa, Homo Sapiens
STAKATTCT

SEQ ID NO: 212484 - protein, 9 aa, Homo Sapiens
QVHGLGLLL

SEQ ID NO: 212485 - protein, 9 aa, Homo Sapiens
LRLSSLQAE

SEQ ID NO: 212486 - protein, 9 aa, Homo Sapiens
RMGTLCYLG

SEQ ID NO: 212487 - protein, 9 aa, Homo Sapiens
GARWPPLTL

SEQ ID NO: 212488 - protein, 9 aa, Homo Sapiens
GSAYGGGAK

SEQ ID NO: 212489 - protein, 9 aa, Homo Sapiens
QPEKKVMSN

SEQ ID NO: 212490 - protein, 9 aa, Homo Sapiens
NGKSSEREA

SEQ ID NO: 212491 - protein, 9 aa, Homo Sapiens
KEEHHTEPS

SEQ ID NO: 212492 - protein, 9 aa, Homo Sapiens
HRHVDQHEV

SEQ ID NO: 212493 - protein, 9 aa, Homo Sapiens
YFLVTRKTP

SEQ ID NO: 212494 - protein, 9 aa, Homo Sapiens
RWLLCPFRG

SEQ ID NO: 212495 - protein, 9 aa, Homo Sapiens
TSIRYSPLT

SEQ ID NO: 212496 - protein, 9 aa, Homo Sapiens
IIIQQPQTT

SEQ ID NO: 212497 - protein, 9 aa, Homo Sapiens
LRLVDGVTL

SEQ ID NO: 212498 - protein, 9 aa, Homo Sapiens
SRLPRMPGP

SEQ ID NO: 212499 - protein, 9 aa, Homo Sapiens
HCVASCNDT

SEQ ID NO: 212500 - protein, 9 aa, Homo Sapiens
LKHQRVHCA

SEQ ID NO: 212501 - protein, 9 aa, Homo Sapiens
RRKPRPLPP

SEQ ID NO: 212502 - protein, 9 aa, Homo Sapiens
PELFCQAPS

SEQ ID NO: 212503 - protein, 9 aa, Homo Sapiens
TVCAMDSLR

SEQ ID NO: 212504 - protein, 9 aa, Homo Sapiens
TCETSGIRH

SEQ ID NO: 212505 - protein, 9 aa, Homo Sapiens
SSSARFMPC

SEQ ID NO: 212506 - protein, 9 aa, Homo Sapiens
VSRGFDLDA

SEQ ID NO: 212507 - protein, 9 aa, Homo Sapiens
NVGATSGLV

SEQ ID NO: 212508 - protein, 9 aa, Homo Sapiens
RKQLEMAEY

SEQ ID NO: 212509 - protein, 9 aa, Homo Sapiens
PQGSNSSDS

SEQ ID NO: 212510 - protein, 9 aa, Homo Sapiens
RQERAVAHM

SEQ ID NO: 212511 - protein, 9 aa, Homo Sapiens
HKSGSETPL

SEQ ID NO: 212512 - protein, 9 aa, Homo Sapiens
IFWMAMFQQ

SEQ ID NO: 212513 - protein, 9 aa, Homo Sapiens
LVSLKEPRV

SEQ ID NO: 212514 - protein, 9 aa, Homo Sapiens
PQSAGTTSP

SEQ ID NO: 212515 - protein, 9 aa, Homo Sapiens
SGRRMFPPS

SEQ ID NO: 212516 - protein, 9 aa, Homo Sapiens
RSGKGEAQC

SEQ ID NO: 212517 - protein, 9 aa, Homo Sapiens
SRYEVCGPP

SEQ ID NO: 212518 - protein, 9 aa, Homo Sapiens
LKSNILKSA

SEQ ID NO: 212519 - protein, 9 aa, Homo Sapiens
TSAASSAGS

SEQ ID NO: 212520 - protein, 9 aa, Homo Sapiens
TSAQPLRPL

SEQ ID NO: 212521 - protein, 9 aa, Homo Sapiens
PVSSGTPDC

SEQ ID NO: 212522 - protein, 9 aa, Homo Sapiens
PGSPYVSWT

SEQ ID NO: 212523 - protein, 9 aa, Homo Sapiens
ERNEEDAVN

SEQ ID NO: 212524 - protein, 9 aa, Homo Sapiens
TWGPARPLP

SEQ ID NO: 212525 - protein, 9 aa, Homo Sapiens
SSFVCQGIN

SEQ ID NO: 212526 - protein, 9 aa, Homo Sapiens
CLHDTALAH

SEQ ID NO: 212527 - protein, 9 aa, Homo Sapiens
VAHTQDVIS

SEQ ID NO: 212528 - protein, 9 aa, Homo Sapiens
ILRKQHLLL

SEQ ID NO: 212529 - protein, 9 aa, Homo Sapiens
DNILNVGAI

SEQ ID NO: 212530 - protein, 9 aa, Homo Sapiens
SIDPRTAHR

SEQ ID NO: 212531 - protein, 9 aa, Homo Sapiens
RSWRTNSSS

SEQ ID NO: 212532 - protein, 9 aa, Homo Sapiens
LDRQLSYFL

SEQ ID NO: 212533 - protein, 9 aa, Homo Sapiens
GQRPARWWM

SEQ ID NO: 212534 - protein, 9 aa, Homo Sapiens
ARLEEECGK

SEQ ID NO: 212535 - protein, 9 aa, Homo Sapiens
CESAAWTRR

SEQ ID NO: 212536 - protein, 9 aa, Homo Sapiens
QRMEAAACP

SEQ ID NO: 212537 - protein, 9 aa, Homo Sapiens
SALGGGAPR

SEQ ID NO: 212538 - protein, 9 aa, Homo Sapiens
PCKCHECGK

SEQ ID NO: 212539 - protein, 9 aa, Homo Sapiens
SYLRELLEP

SEQ ID NO: 212540 - protein, 9 aa, Homo Sapiens
LLGPLNTGG

SEQ ID NO: 212541 - protein, 9 aa, Homo Sapiens
QDNPRTSCA

SEQ ID NO: 212542 - protein, 9 aa, Homo Sapiens
ELHYDKLHV

SEQ ID NO: 212543 - protein, 9 aa, Homo Sapiens
LSHKSCKLR

SEQ ID NO: 212544 - protein, 9 aa, Homo Sapiens
SDLATREKV

SEQ ID NO: 212545 - protein, 9 aa, Homo Sapiens
ICPSDSGSY

SEQ ID NO: 212546 - protein, 9 aa, Homo Sapiens
HNCQSYGKT

SEQ ID NO: 212547 - protein, 9 aa, Homo Sapiens
SAGTTSPWP

SEQ ID NO: 212548 - protein, 9 aa, Homo Sapiens
SPFTHRRLP

SEQ ID NO: 212549 - protein, 9 aa, Homo Sapiens
ARLARSSAL

SEQ ID NO: 212550 - protein, 9 aa, Homo Sapiens
ESTESRISF

SEQ ID NO: 212551 - protein, 9 aa, Homo Sapiens
GSALFDMVS

SEQ ID NO: 212552 - protein, 9 aa, Homo Sapiens
LSSSPSALP

SEQ ID NO: 212553 - protein, 9 aa, Homo Sapiens
TGEKPCKCH

SEQ ID NO: 212554 - protein, 9 aa, Homo Sapiens
SGIRHLLLR

SEQ ID NO: 212555 - protein, 9 aa, Homo Sapiens
FNFILTSTN

SEQ ID NO: 212556 - protein, 9 aa, Homo Sapiens
GNKYAKCFE

SEQ ID NO: 212557 - protein, 9 aa, Homo Sapiens
SLQRLAYLI

SEQ ID NO: 212558 - protein, 9 aa, Homo Sapiens
QQWKRPMGL

SEQ ID NO: 212559 - protein, 9 aa, Homo Sapiens
SPTCPQPPH

SEQ ID NO: 212560 - protein, 9 aa, Homo Sapiens
SQWPPCAAT

SEQ ID NO: 212561 - protein, 9 aa, Homo Sapiens
LVVLTAYSL

SEQ ID NO: 212562 - protein, 9 aa, Homo Sapiens
QLPPLSSLG

SEQ ID NO: 212563 - protein, 9 aa, Homo Sapiens
DTTKLRQSL

SEQ ID NO: 212564 - protein, 9 aa, Homo Sapiens
SEMKSHIED

SEQ ID NO: 212565 - protein, 9 aa, Homo Sapiens
LNQKIRSSS

SEQ ID NO: 212566 - protein, 9 aa, Homo Sapiens
SRMEKMMDR

SEQ ID NO: 212567 - protein, 9 aa, Homo Sapiens
DSWSPNSVQ

SEQ ID NO: 212568 - protein, 9 aa, Homo Sapiens
ELCISRQLW

SEQ ID NO: 212569 - protein, 9 aa, Homo Sapiens
FEAWLLLLL

SEQ ID NO: 212570 - protein, 9 aa, Homo Sapiens
KKHHESFPL

SEQ ID NO: 212571 - protein, 9 aa, Homo Sapiens
QKEIRVSII

SEQ ID NO: 212572 - protein, 9 aa, Homo Sapiens
DLFPVLSTS

SEQ ID NO: 212573 - protein, 9 aa, Homo Sapiens
PYVYTTLPF

SEQ ID NO: 212574 - protein, 9 aa, Homo Sapiens
ASCGQGSVL

SEQ ID NO: 212575 - protein, 9 aa, Homo Sapiens
PASAVSTAA

SEQ ID NO: 212576 - protein, 9 aa, Homo Sapiens
RTLLVVARD

SEQ ID NO: 212577 - protein, 9 aa, Homo Sapiens
PYLNDDSPE

SEQ ID NO: 212578 - protein, 9 aa, Homo Sapiens
EVMERYAKD

SEQ ID NO: 212579 - protein, 9 aa, Homo Sapiens
AVGCQELQR

SEQ ID NO: 212580 - protein, 9 aa, Homo Sapiens
LREFMKHRR

SEQ ID NO: 212581 - protein, 9 aa, Homo Sapiens
VRRKKKETE

SEQ ID NO: 212582 - protein, 9 aa, Homo Sapiens
FQDRGQFCL

SEQ ID NO: 212583 - protein, 9 aa, Homo Sapiens
TWQWSVPIR

SEQ ID NO: 212584 - protein, 9 aa, Homo Sapiens
PSEAWMQTN

SEQ ID NO: 212585 - protein, 9 aa, Homo Sapiens
FLEKTMIFF

SEQ ID NO: 212586 - protein, 9 aa, Homo Sapiens
KPLHAPVGF

SEQ ID NO: 212587 - protein, 9 aa, Homo Sapiens
EQLGVDGDS

SEQ ID NO: 212588 - protein, 9 aa, Homo Sapiens
GWAPCGWPA

SEQ ID NO: 212589 - protein, 9 aa, Homo Sapiens
KRIMEEESK

SEQ ID NO: 212590 - protein, 9 aa, Homo Sapiens
PAVTSNFQS

SEQ ID NO: 212591 - protein, 9 aa, Homo Sapiens
LSPGVVTDL

SEQ ID NO: 212592 - protein, 9 aa, Homo Sapiens
PRSSTSCST

SEQ ID NO: 212593 - protein, 9 aa, Homo Sapiens
NEFEYPKLL

SEQ ID NO: 212594 - protein, 9 aa, Homo Sapiens
PPGCALPAA

SEQ ID NO: 212595 - protein, 9 aa, Homo Sapiens
YGGTYNRVP

SEQ ID NO: 212596 - protein, 9 aa, Homo Sapiens
LLDLSYNHI

SEQ ID NO: 212597 - protein, 9 aa, Homo Sapiens
GNVLAELTA

SEQ ID NO: 212598 - protein, 9 aa, Homo Sapiens
IEEYCRNSS

SEQ ID NO: 212599 - protein, 9 aa, Homo Sapiens
PVASCPAPH

SEQ ID NO: 212600 - protein, 9 aa, Homo Sapiens
AVVGIGVPI

SEQ ID NO: 212601 - protein, 9 aa, Homo Sapiens
GFAGEDAPR

SEQ ID NO: 212602 - protein, 9 aa, Homo Sapiens
HIQRIPKDA

SEQ ID NO: 212603 - protein, 9 aa, Homo Sapiens
PVPRLPRAG

SEQ ID NO: 212604 - protein, 9 aa, Homo Sapiens
VQHQTGQAP

SEQ ID NO: 212605 - protein, 9 aa, Homo Sapiens
GPQPGRSPL

SEQ ID NO: 212606 - protein, 9 aa, Homo Sapiens
RGASTCPNR

SEQ ID NO: 212607 - protein, 9 aa, Homo Sapiens
LFSTAHKPC

SEQ ID NO: 212608 - protein, 9 aa, Homo Sapiens
VLSYGDVDL

SEQ ID NO: 212609 - protein, 9 aa, Homo Sapiens
RGCAWYLCS

SEQ ID NO: 212610 - protein, 9 aa, Homo Sapiens
SKPPNSCVL

SEQ ID NO: 212611 - protein, 9 aa, Homo Sapiens
VYTTLPFVR

SEQ ID NO: 212612 - protein, 9 aa, Homo Sapiens
CKSALLLVL

SEQ ID NO: 212613 - protein, 9 aa, Homo Sapiens
QRCLRGTPS

SEQ ID NO: 212614 - protein, 9 aa, Homo Sapiens
TLAAVCLAL

SEQ ID NO: 212615 - protein, 9 aa, Homo Sapiens
KDVNIIETK

SEQ ID NO: 212616 - protein, 9 aa, Homo Sapiens
VVQQRHLGV

SEQ ID NO: 212617 - protein, 9 aa, Homo Sapiens
TSQAMATES

SEQ ID NO: 212618 - protein, 9 aa, Homo Sapiens
KDRDIGRSK

SEQ ID NO: 212619 - protein, 9 aa, Homo Sapiens
APPCQSAEC

SEQ ID NO: 212620 - protein, 9 aa, Homo Sapiens
STPTASETL

SEQ ID NO: 212621 - protein, 9 aa, Homo Sapiens
RIALGGCSS

SEQ ID NO: 212622 - protein, 9 aa, Homo Sapiens
RGGSRGAET

SEQ ID NO: 212623 - protein, 9 aa, Homo Sapiens
GQVGHGVWV

SEQ ID NO: 212624 - protein, 9 aa, Homo Sapiens
GLCPQCPGL

SEQ ID NO: 212625 - protein, 9 aa, Homo Sapiens
TKTVTKYTS

SEQ ID NO: 212626 - protein, 9 aa, Homo Sapiens
SVALNTAHA

SEQ ID NO: 212627 - protein, 9 aa, Homo Sapiens
VSLLWVTED

SEQ ID NO: 212628 - protein, 9 aa, Homo Sapiens
TNGPDVNHE

SEQ ID NO: 212629 - protein, 9 aa, Homo Sapiens
LIFVPDSVL

SEQ ID NO: 212630 - protein, 9 aa, Homo Sapiens
SSGFSGSLG

SEQ ID NO: 212631 - protein, 9 aa, Homo Sapiens
ETGLLPECF

SEQ ID NO: 212632 - protein, 9 aa, Homo Sapiens
DVASLKSFD

SEQ ID NO: 212633 - protein, 9 aa, Homo Sapiens
LTHLSLIYT

SEQ ID NO: 212634 - protein, 9 aa, Homo Sapiens
PPPSRPRSP

SEQ ID NO: 212635 - protein, 9 aa, Homo Sapiens
QPAKPPTRT

SEQ ID NO: 212636 - protein, 9 aa, Homo Sapiens
TATWMGSLL

SEQ ID NO: 212637 - protein, 9 aa, Homo Sapiens
SSTRHCARQ

SEQ ID NO: 212638 - protein, 9 aa, Homo Sapiens
HQARRDAER

SEQ ID NO: 212639 - protein, 9 aa, Homo Sapiens
LCPFRGLRG

SEQ ID NO: 212640 - protein, 9 aa, Homo Sapiens
LDFFSRSHL

SEQ ID NO: 212641 - protein, 9 aa, Homo Sapiens
PSPPSPSSL

SEQ ID NO: 212642 - protein, 9 aa, Homo Sapiens
LGSGSMGKS

SEQ ID NO: 212643 - protein, 9 aa, Homo Sapiens
NFWGGSQCR

SEQ ID NO: 212644 - protein, 9 aa, Homo Sapiens
IYQLIHKKI

SEQ ID NO: 212645 - protein, 9 aa, Homo Sapiens
PGWGCVPFC

SEQ ID NO: 212646 - protein, 9 aa, Homo Sapiens
THVQMGQAE

SEQ ID NO: 212647 - protein, 9 aa, Homo Sapiens
QVLITEGPY

SEQ ID NO: 212648 - protein, 9 aa, Homo Sapiens
GLVSDVPKS

SEQ ID NO: 212649 - protein, 9 aa, Homo Sapiens
RCLPILVQL

SEQ ID NO: 212650 - protein, 9 aa, Homo Sapiens
ATFPNEKQL

SEQ ID NO: 212651 - protein, 9 aa, Homo Sapiens
HHRPSLFHR

SEQ ID NO: 212652 - protein, 9 aa, Homo Sapiens
AMSRQTQSQ

SEQ ID NO: 212653 - protein, 9 aa, Homo Sapiens
SVAYHADDV

SEQ ID NO: 212654 - protein, 9 aa, Homo Sapiens
AIWSAEVFK

SEQ ID NO: 212655 - protein, 9 aa, Homo Sapiens
LRGWGQHTG

SEQ ID NO: 212656 - protein, 9 aa, Homo Sapiens
RLKPRTSVE

SEQ ID NO: 212657 - protein, 9 aa, Homo Sapiens
LSSVDLNDQ

SEQ ID NO: 212658 - protein, 9 aa, Homo Sapiens
AALKRHFTV

SEQ ID NO: 212659 - protein, 9 aa, Homo Sapiens
TGTTAAGWI

SEQ ID NO: 212660 - protein, 9 aa, Homo Sapiens
TEVGATEET

SEQ ID NO: 212661 - protein, 9 aa, Homo Sapiens
EGVEVQTEY

SEQ ID NO: 212662 - protein, 9 aa, Homo Sapiens
LLVLQGRPE

SEQ ID NO: 212663 - protein, 9 aa, Homo Sapiens
PGRCRTSRQ

SEQ ID NO: 212664 - protein, 9 aa, Homo Sapiens
SSSWPAPTH

SEQ ID NO: 212665 - protein, 9 aa, Homo Sapiens
PRRRWPLAP

SEQ ID NO: 212666 - protein, 9 aa, Homo Sapiens
RKYDAVNVS

SEQ ID NO: 212667 - protein, 9 aa, Homo Sapiens
PGQSASSSP

SEQ ID NO: 212668 - protein, 9 aa, Homo Sapiens
VDKQDSMHG

SEQ ID NO: 212669 - protein, 9 aa, Homo Sapiens
MVTMAVIIR

SEQ ID NO: 212670 - protein, 9 aa, Homo Sapiens
GGRTPASCV

SEQ ID NO: 212671 - protein, 9 aa, Homo Sapiens
PLLKGVLGY

SEQ ID NO: 212672 - protein, 9 aa, Homo Sapiens
FHKDILLSP

SEQ ID NO: 212673 - protein, 9 aa, Homo Sapiens
LDEAVGCQE

SEQ ID NO: 212674 - protein, 9 aa, Homo Sapiens
GDSFNPTLW

SEQ ID NO: 212675 - protein, 9 aa, Homo Sapiens
SGYPWAGFP

SEQ ID NO: 212676 - protein, 9 aa, Homo Sapiens
LVSVDRCAL

SEQ ID NO: 212677 - protein, 9 aa, Homo Sapiens
GGCGSTPPP

SEQ ID NO: 212678 - protein, 9 aa, Homo Sapiens
KESQRMSGE

SEQ ID NO: 212679 - protein, 9 aa, Homo Sapiens
IVSRLMQVG

SEQ ID NO: 212680 - protein, 9 aa, Homo Sapiens
LGSQRLLLS

SEQ ID NO: 212681 - protein, 9 aa, Homo Sapiens
EDAIQILLV

SEQ ID NO: 212682 - protein, 9 aa, Homo Sapiens
LIVIGGVQP

SEQ ID NO: 212683 - protein, 9 aa, Homo Sapiens
LRCPQAAAR

SEQ ID NO: 212684 - protein, 9 aa, Homo Sapiens
RPAHKYYLA

SEQ ID NO: 212685 - protein, 9 aa, Homo Sapiens
GTGAQTGCM

SEQ ID NO: 212686 - protein, 9 aa, Homo Sapiens
TDHCNEVWF

SEQ ID NO: 212687 - protein, 9 aa, Homo Sapiens
YRLMFQSST

SEQ ID NO: 212688 - protein, 9 aa, Homo Sapiens
VNENTFLWF

SEQ ID NO: 212689 - protein, 9 aa, Homo Sapiens
RYTLNNGNL

SEQ ID NO: 212690 - protein, 9 aa, Homo Sapiens
CTFDHMGHG

SEQ ID NO: 212691 - protein, 9 aa, Homo Sapiens
LPQMSKVKV

SEQ ID NO: 212692 - protein, 9 aa, Homo Sapiens
GVLAAGPTS

SEQ ID NO: 212693 - protein, 9 aa, Homo Sapiens
PTVLQGPSP

SEQ ID NO: 212694 - protein, 9 aa, Homo Sapiens
KEIRVSIID

SEQ ID NO: 212695 - protein, 9 aa, Homo Sapiens
SLLAFGIVQ

SEQ ID NO: 212696 - protein, 9 aa, Homo Sapiens
GRGSKPVME

SEQ ID NO: 212697 - protein, 9 aa, Homo Sapiens
APHRSPPRA

SEQ ID NO: 212698 - protein, 9 aa, Homo Sapiens
IDCYSCTAN

SEQ ID NO: 212699 - protein, 9 aa, Homo Sapiens
TIKTKHTIQ

SEQ ID NO: 212700 - protein, 9 aa, Homo Sapiens
SSLTPLTTQ

SEQ ID NO: 212701 - protein, 9 aa, Homo Sapiens
PGCGGKRNA

SEQ ID NO: 212702 - protein, 9 aa, Homo Sapiens
GHGREEAIM

SEQ ID NO: 212703 - protein, 9 aa, Homo Sapiens
DAAKNYLLL

SEQ ID NO: 212704 - protein, 9 aa, Homo Sapiens
EESKTGQKV

SEQ ID NO: 212705 - protein, 9 aa, Homo Sapiens
GHAGGRELE

SEQ ID NO: 212706 - protein, 9 aa, Homo Sapiens
PQIEAEKKP

SEQ ID NO: 212707 - protein, 9 aa, Homo Sapiens
LGVVFPEHQ

SEQ ID NO: 212708 - protein, 9 aa, Homo Sapiens
WLMWTATEC

SEQ ID NO: 212709 - protein, 9 aa, Homo Sapiens
PGSSRTTWG

SEQ ID NO: 212710 - protein, 9 aa, Homo Sapiens
PNPCPVGKQ

SEQ ID NO: 212711 - protein, 9 aa, Homo Sapiens
EKMSPEDRV

SEQ ID NO: 212712 - protein, 9 aa, Homo Sapiens
DVNHEYSTS

SEQ ID NO: 212713 - protein, 9 aa, Homo Sapiens
ARWPPLTLQ

SEQ ID NO: 212714 - protein, 9 aa, Homo Sapiens
DATILEYLT

SEQ ID NO: 212715 - protein, 9 aa, Homo Sapiens
PRGPVFPPL

SEQ ID NO: 212716 - protein, 9 aa, Homo Sapiens
KKEDKEKET

SEQ ID NO: 212717 - protein, 9 aa, Homo Sapiens
INKKHHESF

SEQ ID NO: 212718 - protein, 9 aa, Homo Sapiens
INHPAHLRR

SEQ ID NO: 212719 - protein, 9 aa, Homo Sapiens
LTLGLELSE

SEQ ID NO: 212720 - protein, 9 aa, Homo Sapiens
KMMIGSQHL

SEQ ID NO: 212721 - protein, 9 aa, Homo Sapiens
NDDPRRPSH

SEQ ID NO: 212722 - protein, 9 aa, Homo Sapiens
EDPAPWAER

SEQ ID NO: 212723 - protein, 9 aa, Homo Sapiens
LPVSVYCLQ

SEQ ID NO: 212724 - protein, 9 aa, Homo Sapiens
GQHTGQPQG

SEQ ID NO: 212725 - protein, 9 aa, Homo Sapiens
SGDEDFESL

SEQ ID NO: 212726 - protein, 9 aa, Homo Sapiens
VPMSLACSI

SEQ ID NO: 212727 - protein, 9 aa, Homo Sapiens
NFVRFVQGA

SEQ ID NO: 212728 - protein, 9 aa, Homo Sapiens
WCRAMTKNT

SEQ ID NO: 212729 - protein, 9 aa, Homo Sapiens
WSNFWGGSQ

SEQ ID NO: 212730 - protein, 9 aa, Homo Sapiens
VRSGLFGQV

SEQ ID NO: 212731 - protein, 9 aa, Homo Sapiens
FVENTWNPV

SEQ ID NO: 212732 - protein, 9 aa, Homo Sapiens
ETEQGLVVL

SEQ ID NO: 212733 - protein, 9 aa, Homo Sapiens
QMLRSEIDH

SEQ ID NO: 212734 - protein, 9 aa, Homo Sapiens
CRSSDEDLI

SEQ ID NO: 212735 - protein, 9 aa, Homo Sapiens
TVDTIGEKT

SEQ ID NO: 212736 - protein, 9 aa, Homo Sapiens
EYVSLDSPT

SEQ ID NO: 212737 - protein, 9 aa, Homo Sapiens
RIEESWNDE

SEQ ID NO: 212738 - protein, 9 aa, Homo Sapiens
EVTKENLVD

SEQ ID NO: 212739 - protein, 9 aa, Homo Sapiens
ASGRASRKT

SEQ ID NO: 212740 - protein, 9 aa, Homo Sapiens
DILSIMLSE

SEQ ID NO: 212741 - protein, 9 aa, Homo Sapiens
LDTTKLRQS

SEQ ID NO: 212742 - protein, 9 aa, Homo Sapiens
PAAWRITSL

SEQ ID NO: 212743 - protein, 9 aa, Homo Sapiens
QDVGVGFDG

SEQ ID NO: 212744 - protein, 9 aa, Homo Sapiens
AWTRRPSIS

SEQ ID NO: 212745 - protein, 9 aa, Homo Sapiens
GQPSRDCSW

SEQ ID NO: 212746 - protein, 9 aa, Homo Sapiens
LATGLHLHR

SEQ ID NO: 212747 - protein, 9 aa, Homo Sapiens
PIQISRQSS

SEQ ID NO: 212748 - protein, 9 aa, Homo Sapiens
NQGIPGRYL

SEQ ID NO: 212749 - protein, 9 aa, Homo Sapiens
QKIRSSSRP

SEQ ID NO: 212750 - protein, 9 aa, Homo Sapiens
PASGRASRK

SEQ ID NO: 212751 - protein, 9 aa, Homo Sapiens
TGTCWLLCG

SEQ ID NO: 212752 - protein, 9 aa, Homo Sapiens
PGLHVGLRS

SEQ ID NO: 212753 - protein, 9 aa, Homo Sapiens
LSSGSRKAT

SEQ ID NO: 212754 - protein, 9 aa, Homo Sapiens
LDGVGVLGA

SEQ ID NO: 212755 - protein, 9 aa, Homo Sapiens
WETPSMSKQ

SEQ ID NO: 212756 - protein, 9 aa, Homo Sapiens
PWPTHLPSA

SEQ ID NO: 212757 - protein, 9 aa, Homo Sapiens
EQKVHSEEE

SEQ ID NO: 212758 - protein, 9 aa, Homo Sapiens
EDLYLFKLP

SEQ ID NO: 212759 - protein, 9 aa, Homo Sapiens
ATTVTDVPF

SEQ ID NO: 212760 - protein, 9 aa, Homo Sapiens
NIIINGKGL

SEQ ID NO: 212761 - protein, 9 aa, Homo Sapiens
GKFAPFFVP

SEQ ID NO: 212762 - protein, 9 aa, Homo Sapiens
SSQTTHRLY

SEQ ID NO: 212763 - protein, 9 aa, Homo Sapiens
AASRLPRMP

SEQ ID NO: 212764 - protein, 9 aa, Homo Sapiens
LAMLSWGPQ

SEQ ID NO: 212765 - protein, 9 aa, Homo Sapiens
RQPPHHLVP

SEQ ID NO: 212766 - protein, 9 aa, Homo Sapiens
ACLTSGTLS

SEQ ID NO: 212767 - protein, 9 aa, Homo Sapiens
GPLDKTIVE

SEQ ID NO: 212768 - protein, 9 aa, Homo Sapiens
RKPALLEPF

SEQ ID NO: 212769 - protein, 9 aa, Homo Sapiens
IIWKCIGED

SEQ ID NO: 212770 - protein, 9 aa, Homo Sapiens
RSMLSKVVH

SEQ ID NO: 212771 - protein, 9 aa, Homo Sapiens
SAQSLLRLE

SEQ ID NO: 212772 - protein, 9 aa, Homo Sapiens
NNLRGSSST

SEQ ID NO: 212773 - protein, 9 aa, Homo Sapiens
GPVSCRSTS

SEQ ID NO: 212774 - protein, 9 aa, Homo Sapiens
IAMTMDQYP

SEQ ID NO: 212775 - protein, 9 aa, Homo Sapiens
SAQSLLRLA

SEQ ID NO: 212776 - protein, 9 aa, Homo Sapiens
QTPSPVSGS

SEQ ID NO: 212777 - protein, 9 aa, Homo Sapiens
GLGASSCRR

SEQ ID NO: 212778 - protein, 9 aa, Homo Sapiens
QMFLFSEFC

SEQ ID NO: 212779 - protein, 9 aa, Homo Sapiens
TLPFVRVTH

SEQ ID NO: 212780 - protein, 9 aa, Homo Sapiens
ELNSPGRGG

SEQ ID NO: 212781 - protein, 9 aa, Homo Sapiens
CLRGTPSRT

SEQ ID NO: 212782 - protein, 9 aa, Homo Sapiens
WQNSIWHNL

SEQ ID NO: 212783 - protein, 9 aa, Homo Sapiens
PRLMSGVEQ

SEQ ID NO: 212784 - protein, 9 aa, Homo Sapiens
KHTSSGSIK

SEQ ID NO: 212785 - protein, 9 aa, Homo Sapiens
AHSIPQPWS

SEQ ID NO: 212786 - protein, 9 aa, Homo Sapiens
RCGPRGWPL

SEQ ID NO: 212787 - protein, 9 aa, Homo Sapiens
DRDIGRSKE

SEQ ID NO: 212788 - protein, 9 aa, Homo Sapiens
LGFPVSAQS

SEQ ID NO: 212789 - protein, 9 aa, Homo Sapiens
PLPFNMALS

SEQ ID NO: 212790 - protein, 9 aa, Homo Sapiens
PTTVRKAKF

SEQ ID NO: 212791 - protein, 9 aa, Homo Sapiens
VGVGFDGGT

SEQ ID NO: 212792 - protein, 9 aa, Homo Sapiens
STPPPPPGW

SEQ ID NO: 212793 - protein, 9 aa, Homo Sapiens
NRDTRHSTR

SEQ ID NO: 212794 - protein, 9 aa, Homo Sapiens
FPLPFNMAL

SEQ ID NO: 212795 - protein, 9 aa, Homo Sapiens
LLACLTSGT

SEQ ID NO: 212796 - protein, 9 aa, Homo Sapiens
HPLALAFVE

SEQ ID NO: 212797 - protein, 9 aa, Homo Sapiens
APKTTLPGL

SEQ ID NO: 212798 - protein, 9 aa, Homo Sapiens
EQHNAGVES

SEQ ID NO: 212799 - protein, 9 aa, Homo Sapiens
DPRLHPQLP

SEQ ID NO: 212800 - protein, 9 aa, Homo Sapiens
VSNNPVIEE

SEQ ID NO: 212801 - protein, 9 aa, Homo Sapiens
RRGTTLRTT

SEQ ID NO: 212802 - protein, 9 aa, Homo Sapiens
VILSNQAGG

SEQ ID NO: 212803 - protein, 9 aa, Homo Sapiens
NVHDIRWNF

SEQ ID NO: 212804 - protein, 9 aa, Homo Sapiens
KHQHEEGAG

SEQ ID NO: 212805 - protein, 9 aa, Homo Sapiens
NYRTLFQEI

SEQ ID NO: 212806 - protein, 9 aa, Homo Sapiens
LPPCSLPTA

SEQ ID NO: 212807 - protein, 9 aa, Homo Sapiens
TLCIVFPMT

SEQ ID NO: 212808 - protein, 9 aa, Homo Sapiens
PPSFKQFLV

SEQ ID NO: 212809 - protein, 9 aa, Homo Sapiens
MRRVPRLRK

SEQ ID NO: 212810 - protein, 9 aa, Homo Sapiens
PAGPNSWRA

SEQ ID NO: 212811 - protein, 9 aa, Homo Sapiens
IEQHNAGVE

SEQ ID NO: 212812 - protein, 9 aa, Homo Sapiens
RRANRRKEG

SEQ ID NO: 212813 - protein, 9 aa, Homo Sapiens
LGGHDSPGC

SEQ ID NO: 212814 - protein, 9 aa, Homo Sapiens
GQERQGNKS

SEQ ID NO: 212815 - protein, 9 aa, Homo Sapiens
RGTTLRTTS

SEQ ID NO: 212816 - protein, 9 aa, Homo Sapiens
GHGLLGQAL

SEQ ID NO: 212817 - protein, 9 aa, Homo Sapiens
QCRVTKYCS

SEQ ID NO: 212818 - protein, 9 aa, Homo Sapiens
TSVNVKSAG

SEQ ID NO: 212819 - protein, 9 aa, Homo Sapiens
GLSTSPAAV

SEQ ID NO: 212820 - protein, 9 aa, Homo Sapiens
QGPLGFFGL

SEQ ID NO: 212821 - protein, 9 aa, Homo Sapiens
HLDAHGQAM

SEQ ID NO: 212822 - protein, 9 aa, Homo Sapiens
WELWVEGKL

SEQ ID NO: 212823 - protein, 9 aa, Homo Sapiens
IIRWPSATT

SEQ ID NO: 212824 - protein, 9 aa, Homo Sapiens
AGNEEIPQI

SEQ ID NO: 212825 - protein, 9 aa, Homo Sapiens
TEDPAPWAE

SEQ ID NO: 212826 - protein, 9 aa, Homo Sapiens
HHSRSFSDL

SEQ ID NO: 212827 - protein, 9 aa, Homo Sapiens
VHAPRALSV

SEQ ID NO: 212828 - protein, 9 aa, Homo Sapiens
HTSRNCTAA

SEQ ID NO: 212829 - protein, 9 aa, Homo Sapiens
CSTISCPPL

SEQ ID NO: 212830 - protein, 9 aa, Homo Sapiens
HVAREIVET

SEQ ID NO: 212831 - protein, 9 aa, Homo Sapiens
GTHSANIQQ

SEQ ID NO: 212832 - protein, 9 aa, Homo Sapiens
PSGDMMSSG

SEQ ID NO: 212833 - protein, 9 aa, Homo Sapiens
GRGRGSSQA

SEQ ID NO: 212834 - protein, 9 aa, Homo Sapiens
GMPETYQVR

SEQ ID NO: 212835 - protein, 9 aa, Homo Sapiens
PSSVLTLTV

SEQ ID NO: 212836 - protein, 9 aa, Homo Sapiens
MCVGHDQHM

SEQ ID NO: 212837 - protein, 9 aa, Homo Sapiens
ALQLAHFQD

SEQ ID NO: 212838 - protein, 9 aa, Homo Sapiens
GRTASATTS

SEQ ID NO: 212839 - protein, 9 aa, Homo Sapiens
ILDVCLDLP

SEQ ID NO: 212840 - protein, 9 aa, Homo Sapiens
KHMLNFNVP

SEQ ID NO: 212841 - protein, 9 aa, Homo Sapiens
HMEESKALF

SEQ ID NO: 212842 - protein, 9 aa, Homo Sapiens
EGIPLDIPV

SEQ ID NO: 212843 - protein, 9 aa, Homo Sapiens
AYPSEKSNK

SEQ ID NO: 212844 - protein, 9 aa, Homo Sapiens
IRFTGVFTF

SEQ ID NO: 212845 - protein, 9 aa, Homo Sapiens
RGVRSFYLI

SEQ ID NO: 212846 - protein, 9 aa, Homo Sapiens
RGSCALQPA

SEQ ID NO: 212847 - protein, 9 aa, Homo Sapiens
YTKGTFQQA

SEQ ID NO: 212848 - protein, 9 aa, Homo Sapiens
SSTLLFTKT

SEQ ID NO: 212849 - protein, 9 aa, Homo Sapiens
TPTFPSSVL

SEQ ID NO: 212850 - protein, 9 aa, Homo Sapiens
DGTTQGNRD

SEQ ID NO: 212851 - protein, 9 aa, Homo Sapiens
VNDVQLLQD

SEQ ID NO: 212852 - protein, 9 aa, Homo Sapiens
RLGCPVSTR

SEQ ID NO: 212853 - protein, 9 aa, Homo Sapiens
LPVASCPAP

SEQ ID NO: 212854 - protein, 9 aa, Homo Sapiens
AEVQEGHGS

SEQ ID NO: 212855 - protein, 9 aa, Homo Sapiens
RETLNPPGC

SEQ ID NO: 212856 - protein, 9 aa, Homo Sapiens
LSVLQSFRL

SEQ ID NO: 212857 - protein, 9 aa, Homo Sapiens
TLFQEILNT

SEQ ID NO: 212858 - protein, 9 aa, Homo Sapiens
TAQRQECNL

SEQ ID NO: 212859 - protein, 9 aa, Homo Sapiens
VDDWGAAGV

SEQ ID NO: 212860 - protein, 9 aa, Homo Sapiens
PLYWKGGER

SEQ ID NO: 212861 - protein, 9 aa, Homo Sapiens
RQMPSFGEF

SEQ ID NO: 212862 - protein, 9 aa, Homo Sapiens
VLGAGVVLA

SEQ ID NO: 212863 - protein, 9 aa, Homo Sapiens
HVTMPVAYK

SEQ ID NO: 212864 - protein, 9 aa, Homo Sapiens
CPPVFSYSW

SEQ ID NO: 212865 - protein, 9 aa, Homo Sapiens
PGCVICSPR

SEQ ID NO: 212866 - protein, 9 aa, Homo Sapiens
SHAPPVAEE

SEQ ID NO: 212867 - protein, 9 aa, Homo Sapiens
LRALCMLKL

SEQ ID NO: 212868 - protein, 9 aa, Homo Sapiens
ARSLQRLAY

SEQ ID NO: 212869 - protein, 9 aa, Homo Sapiens
NKTNQPITL

SEQ ID NO: 212870 - protein, 9 aa, Homo Sapiens
LVKIHVKME

SEQ ID NO: 212871 - protein, 9 aa, Homo Sapiens
YKDLYANIV

SEQ ID NO: 212872 - protein, 9 aa, Homo Sapiens
LVDSGDKVV

SEQ ID NO: 212873 - protein, 9 aa, Homo Sapiens
LGLLDLLRG

SEQ ID NO: 212874 - protein, 9 aa, Homo Sapiens
QRGQGLFIL

SEQ ID NO: 212875 - protein, 9 aa, Homo Sapiens
VPLTPCSHS

SEQ ID NO: 212876 - protein, 9 aa, Homo Sapiens
KNIQDRVNS

SEQ ID NO: 212877 - protein, 9 aa, Homo Sapiens
FQNSHSLLN

SEQ ID NO: 212878 - protein, 9 aa, Homo Sapiens
CGNWRVPLT

SEQ ID NO: 212879 - protein, 9 aa, Homo Sapiens
FHTPHPTGV

SEQ ID NO: 212880 - protein, 9 aa, Homo Sapiens
PPPRPQLLP

SEQ ID NO: 212881 - protein, 9 aa, Homo Sapiens
ELVWGPPDQ

SEQ ID NO: 212882 - protein, 9 aa, Homo Sapiens
RKSQSWCLL

SEQ ID NO: 212883 - protein, 9 aa, Homo Sapiens
TLRKSHTLQ

SEQ ID NO: 212884 - protein, 9 aa, Homo Sapiens
RQYGVYREQ

SEQ ID NO: 212885 - protein, 9 aa, Homo Sapiens
FSEVEWEDQ

SEQ ID NO: 212886 - protein, 9 aa, Homo Sapiens
TLELGGRTP

SEQ ID NO: 212887 - protein, 9 aa, Homo Sapiens
IENIIAWEY

SEQ ID NO: 212888 - protein, 9 aa, Homo Sapiens
RLQKYPQAA

SEQ ID NO: 212889 - protein, 9 aa, Homo Sapiens
QLSIDASLT

SEQ ID NO: 212890 - protein, 9 aa, Homo Sapiens
PRMPGPPWP

SEQ ID NO: 212891 - protein, 9 aa, Homo Sapiens
RLRSWRTNS

SEQ ID NO: 212892 - protein, 9 aa, Homo Sapiens
VWPSSRRAT

SEQ ID NO: 212893 - protein, 9 aa, Homo Sapiens
LMYILEKQR

SEQ ID NO: 212894 - protein, 9 aa, Homo Sapiens
EAQRQVVLH

SEQ ID NO: 212895 - protein, 9 aa, Homo Sapiens
WKALIVIRY

SEQ ID NO: 212896 - protein, 9 aa, Homo Sapiens
IPTGGDGKT

SEQ ID NO: 212897 - protein, 9 aa, Homo Sapiens
CLPILVQLV

SEQ ID NO: 212898 - protein, 9 aa, Homo Sapiens
ILPLLLSKT

SEQ ID NO: 212899 - protein, 9 aa, Homo Sapiens
PASSTAAPI

SEQ ID NO: 212900 - protein, 9 aa, Homo Sapiens
PRLRTATAR

SEQ ID NO: 212901 - protein, 9 aa, Homo Sapiens
SCSEEELNS

SEQ ID NO: 212902 - protein, 9 aa, Homo Sapiens
GRPRRCWTG

SEQ ID NO: 212903 - protein, 9 aa, Homo Sapiens
STTTVEHTP

SEQ ID NO: 212904 - protein, 9 aa, Homo Sapiens
AWYLCSSAS

SEQ ID NO: 212905 - protein, 9 aa, Homo Sapiens
TAKATTCTW

SEQ ID NO: 212906 - protein, 9 aa, Homo Sapiens
LTITEHVPL

SEQ ID NO: 212907 - protein, 9 aa, Homo Sapiens
ELDVMDHLQ

SEQ ID NO: 212908 - protein, 9 aa, Homo Sapiens
HAIVPNKSN

SEQ ID NO: 212909 - protein, 9 aa, Homo Sapiens
TVAPTVLQG

SEQ ID NO: 212910 - protein, 9 aa, Homo Sapiens
SPARGVVGP

SEQ ID NO: 212911 - protein, 9 aa, Homo Sapiens
FSLGTTTHT

SEQ ID NO: 212912 - protein, 9 aa, Homo Sapiens
RSWNTMQWN

SEQ ID NO: 212913 - protein, 9 aa, Homo Sapiens
QYSRDEGFM

SEQ ID NO: 212914 - protein, 9 aa, Homo Sapiens
RCSAGAYTL

SEQ ID NO: 212915 - protein, 9 aa, Homo Sapiens
SSRPGGAEK

SEQ ID NO: 212916 - protein, 9 aa, Homo Sapiens
ITTPSKKKL

SEQ ID NO: 212917 - protein, 9 aa, Homo Sapiens
TAHAYATVL

SEQ ID NO: 212918 - protein, 9 aa, Homo Sapiens
EEEVVDLAC

SEQ ID NO: 212919 - protein, 9 aa, Homo Sapiens
CQYKLTYTK

SEQ ID NO: 212920 - protein, 9 aa, Homo Sapiens
RCDPIRTSM

SEQ ID NO: 212921 - protein, 9 aa, Homo Sapiens
ILPDPSVKL

SEQ ID NO: 212922 - protein, 9 aa, Homo Sapiens
PWMMCTASF

SEQ ID NO: 212923 - protein, 9 aa, Homo Sapiens
PGNCCSYSE

SEQ ID NO: 212924 - protein, 9 aa, Homo Sapiens
GGLWRPGWG

SEQ ID NO: 212925 - protein, 9 aa, Homo Sapiens
VAIMITRLV

SEQ ID NO: 212926 - protein, 9 aa, Homo Sapiens
LYLRTSGEP

SEQ ID NO: 212927 - protein, 9 aa, Homo Sapiens
EMEGIRGLG

SEQ ID NO: 212928 - protein, 9 aa, Homo Sapiens
TSMQNPDRP

SEQ ID NO: 212929 - protein, 9 aa, Homo Sapiens
SSRLRSWRT

SEQ ID NO: 212930 - protein, 9 aa, Homo Sapiens
VSLIYWLLT

SEQ ID NO: 212931 - protein, 9 aa, Homo Sapiens
LPAAWRITS

SEQ ID NO: 212932 - protein, 9 aa, Homo Sapiens
GTVWPPTAA

SEQ ID NO: 212933 - protein, 9 aa, Homo Sapiens
ALGQNDADI

SEQ ID NO: 212934 - protein, 9 aa, Homo Sapiens
AVGKARRRN

SEQ ID NO: 212935 - protein, 9 aa, Homo Sapiens
LQERIELKA

SEQ ID NO: 212936 - protein, 9 aa, Homo Sapiens
LAAVHAWRT

SEQ ID NO: 212937 - protein, 9 aa, Homo Sapiens
WPWCFTTDP

SEQ ID NO: 212938 - protein, 9 aa, Homo Sapiens
SSSSTRHCA

SEQ ID NO: 212939 - protein, 9 aa, Homo Sapiens
SGPWMMCTA

SEQ ID NO: 212940 - protein, 9 aa, Homo Sapiens
VGVVALQLP

SEQ ID NO: 212941 - protein, 9 aa, Homo Sapiens
DVHSGPIGH

SEQ ID NO: 212942 - protein, 9 aa, Homo Sapiens
PDGTPPGCR

SEQ ID NO: 212943 - protein, 9 aa, Homo Sapiens
DKLRWRMNE

SEQ ID NO: 212944 - protein, 9 aa, Homo Sapiens
EAKQIVRKI

SEQ ID NO: 212945 - protein, 9 aa, Homo Sapiens
FEPGKTSRG

SEQ ID NO: 212946 - protein, 9 aa, Homo Sapiens
KIRSLEEQL

SEQ ID NO: 212947 - protein, 9 aa, Homo Sapiens
PLCALTFKL

SEQ ID NO: 212948 - protein, 9 aa, Homo Sapiens
EAVVLNEDG

SEQ ID NO: 212949 - protein, 9 aa, Homo Sapiens
AVPHATHRD

SEQ ID NO: 212950 - protein, 9 aa, Homo Sapiens
AVNVSLIFD

SEQ ID NO: 212951 - protein, 9 aa, Homo Sapiens
LSILWGEEV

SEQ ID NO: 212952 - protein, 9 aa, Homo Sapiens
LDIVSRLMQ

SEQ ID NO: 212953 - protein, 9 aa, Homo Sapiens
LVVARDHVF

SEQ ID NO: 212954 - protein, 9 aa, Homo Sapiens
YAVATASCG

SEQ ID NO: 212955 - protein, 9 aa, Homo Sapiens
PEPVNWEDR

SEQ ID NO: 212956 - protein, 9 aa, Homo Sapiens
AAEPKVNQG

SEQ ID NO: 212957 - protein, 9 aa, Homo Sapiens
ASATGAPGM

SEQ ID NO: 212958 - protein, 9 aa, Homo Sapiens
RSYICIERG

SEQ ID NO: 212959 - protein, 9 aa, Homo Sapiens
GKSHLLEFQ

SEQ ID NO: 212960 - protein, 9 aa, Homo Sapiens
LEVEVLQEG

SEQ ID NO: 212961 - protein, 9 aa, Homo Sapiens
NSLPRSSSQ

SEQ ID NO: 212962 - protein, 9 aa, Homo Sapiens
MPGCLLRGL

SEQ ID NO: 212963 - protein, 9 aa, Homo Sapiens
TLDESCDLV

SEQ ID NO: 212964 - protein, 9 aa, Homo Sapiens
NRVSVIIFS

SEQ ID NO: 212965 - protein, 9 aa, Homo Sapiens
GEVIRGQGS

SEQ ID NO: 212966 - protein, 9 aa, Homo Sapiens
LPMTCPTAE

SEQ ID NO: 212967 - protein, 9 aa, Homo Sapiens
NGGELFSTY

SEQ ID NO: 212968 - protein, 9 aa, Homo Sapiens
YPSPSTGTT

SEQ ID NO: 212969 - protein, 9 aa, Homo Sapiens
VGLRGFGLR

SEQ ID NO: 212970 - protein, 9 aa, Homo Sapiens
GQSQQDDRS

SEQ ID NO: 212971 - protein, 9 aa, Homo Sapiens
HIVELAQLG

SEQ ID NO: 212972 - protein, 9 aa, Homo Sapiens
CTSSSRTYQ

SEQ ID NO: 212973 - protein, 9 aa, Homo Sapiens
QLIVEQKVH

SEQ ID NO: 212974 - protein, 9 aa, Homo Sapiens
GRANVGATS

SEQ ID NO: 212975 - protein, 9 aa, Homo Sapiens
GLGQPWPPT

SEQ ID NO: 212976 - protein, 9 aa, Homo Sapiens
FLATHDGHP

SEQ ID NO: 212977 - protein, 9 aa, Homo Sapiens
AQKKSDSKN

SEQ ID NO: 212978 - protein, 9 aa, Homo Sapiens
STMCPAPWW

SEQ ID NO: 212979 - protein, 9 aa, Homo Sapiens
VTAPRHCLW

SEQ ID NO: 212980 - protein, 9 aa, Homo Sapiens
EKPMAYTSR

SEQ ID NO: 212981 - protein, 9 aa, Homo Sapiens
ASGILSPMA

SEQ ID NO: 212982 - protein, 9 aa, Homo Sapiens
GTLLLALAM

SEQ ID NO: 212983 - protein, 9 aa, Homo Sapiens
MSAASYGRR

SEQ ID NO: 212984 - protein, 9 aa, Homo Sapiens
YQCLMTVAE

SEQ ID NO: 212985 - protein, 9 aa, Homo Sapiens
PLSLQCQSL

SEQ ID NO: 212986 - protein, 9 aa, Homo Sapiens
EGADCSVEV

SEQ ID NO: 212987 - protein, 9 aa, Homo Sapiens
AGPSASLHP

SEQ ID NO: 212988 - protein, 9 aa, Homo Sapiens
LDHGVSLSI

SEQ ID NO: 212989 - protein, 9 aa, Homo Sapiens
NGQLMSTER

SEQ ID NO: 212990 - protein, 9 aa, Homo Sapiens
LSLLFGDVA

SEQ ID NO: 212991 - protein, 9 aa, Homo Sapiens
YRCALPNRP

SEQ ID NO: 212992 - protein, 9 aa, Homo Sapiens
NASRPPQAT

SEQ ID NO: 212993 - protein, 9 aa, Homo Sapiens
AQSLLRLAY

SEQ ID NO: 212994 - protein, 9 aa, Homo Sapiens
AHAYATVLT

SEQ ID NO: 212995 - protein, 9 aa, Homo Sapiens
PEDRVKCFE

SEQ ID NO: 212996 - protein, 9 aa, Homo Sapiens
LECPISAQS

SEQ ID NO: 212997 - protein, 9 aa, Homo Sapiens
IRLNNKIPL

SEQ ID NO: 212998 - protein, 9 aa, Homo Sapiens
LWSRLSLLA

SEQ ID NO: 212999 - protein, 9 aa, Homo Sapiens
RGSEGTKVS

SEQ ID NO: 213000 - protein, 9 aa, Homo Sapiens
RLQVHCNDF

SEQ ID NO: 213001 - protein, 9 aa, Homo Sapiens
ITLDADGFF

SEQ ID NO: 213002 - protein, 9 aa, Homo Sapiens
CVVRQVTHP

SEQ ID NO: 213003 - protein, 9 aa, Homo Sapiens
RTVFLRCIA

SEQ ID NO: 213004 - protein, 9 aa, Homo Sapiens
QRPARWWMS

SEQ ID NO: 213005 - protein, 9 aa, Homo Sapiens
CSSCWTPTP

SEQ ID NO: 213006 - protein, 9 aa, Homo Sapiens
KVENICKKF

SEQ ID NO: 213007 - protein, 9 aa, Homo Sapiens
GSRPAPARA

SEQ ID NO: 213008 - protein, 9 aa, Homo Sapiens
IWEPMWEHR

SEQ ID NO: 213009 - protein, 9 aa, Homo Sapiens
TRITRAHTG

SEQ ID NO: 213010 - protein, 9 aa, Homo Sapiens
YHNLCTHDP

SEQ ID NO: 213011 - protein, 9 aa, Homo Sapiens
PYEDFWILV

SEQ ID NO: 213012 - protein, 9 aa, Homo Sapiens
ISEESSDSE

SEQ ID NO: 213013 - protein, 9 aa, Homo Sapiens
KFCIFSSPP

SEQ ID NO: 213014 - protein, 9 aa, Homo Sapiens
DVGVGFDGG

SEQ ID NO: 213015 - protein, 9 aa, Homo Sapiens
IHGPTHIGK

SEQ ID NO: 213016 - protein, 9 aa, Homo Sapiens
LKPLSVIMG

SEQ ID NO: 213017 - protein, 9 aa, Homo Sapiens
DHCNEVWFC

SEQ ID NO: 213018 - protein, 9 aa, Homo Sapiens
SRCIWQLGR

SEQ ID NO: 213019 - protein, 9 aa, Homo Sapiens
RRPQPWKRG

SEQ ID NO: 213020 - protein, 9 aa, Homo Sapiens
VNMESVFDC

SEQ ID NO: 213021 - protein, 9 aa, Homo Sapiens
FAATWPSSV

SEQ ID NO: 213022 - protein, 9 aa, Homo Sapiens
SERSEQNRS

SEQ ID NO: 213023 - protein, 9 aa, Homo Sapiens
CQYLRCGVK

SEQ ID NO: 213024 - protein, 9 aa, Homo Sapiens
SFPPAVQRW

SEQ ID NO: 213025 - protein, 9 aa, Homo Sapiens
VPPPSSSSS

SEQ ID NO: 213026 - protein, 9 aa, Homo Sapiens
PALLEPFLI

SEQ ID NO: 213027 - protein, 9 aa, Homo Sapiens
SYIISKMRG

SEQ ID NO: 213028 - protein, 9 aa, Homo Sapiens
KRHFTVNMS

SEQ ID NO: 213029 - protein, 9 aa, Homo Sapiens
AQGVGSGGV

SEQ ID NO: 213030 - protein, 9 aa, Homo Sapiens
FLQRLVESD

SEQ ID NO: 213031 - protein, 9 aa, Homo Sapiens
VASCNDTVI

SEQ ID NO: 213032 - protein, 9 aa, Homo Sapiens
ISSTHCTGA

SEQ ID NO: 213033 - protein, 9 aa, Homo Sapiens
VHFLLHNGK

SEQ ID NO: 213034 - protein, 9 aa, Homo Sapiens
TSLNSATIF

SEQ ID NO: 213035 - protein, 9 aa, Homo Sapiens
ANRRKEGKL

SEQ ID NO: 213036 - protein, 9 aa, Homo Sapiens
MEETVVVAV

SEQ ID NO: 213037 - protein, 9 aa, Homo Sapiens
QQPQTTVTA

SEQ ID NO: 213038 - protein, 9 aa, Homo Sapiens
IPKEEHHTE

SEQ ID NO: 213039 - protein, 9 aa, Homo Sapiens
SQANHVKDV

SEQ ID NO: 213040 - protein, 9 aa, Homo Sapiens
YSDHMIDRS

SEQ ID NO: 213041 - protein, 9 aa, Homo Sapiens
VDSIPDILQ

SEQ ID NO: 213042 - protein, 9 aa, Homo Sapiens
YGCQGYCSF

SEQ ID NO: 213043 - protein, 9 aa, Homo Sapiens
CFKLDLSLN

SEQ ID NO: 213044 - protein, 9 aa, Homo Sapiens
ILLSPVLAL

SEQ ID NO: 213045 - protein, 9 aa, Homo Sapiens
EKGSAYGGG

SEQ ID NO: 213046 - protein, 9 aa, Homo Sapiens
NTHPSPLAL

SEQ ID NO: 213047 - protein, 9 aa, Homo Sapiens
AWGSPSPWC

SEQ ID NO: 213048 - protein, 9 aa, Homo Sapiens
PFTHRRLPD

SEQ ID NO: 213049 - protein, 9 aa, Homo Sapiens
SFVCQGIND

SEQ ID NO: 213050 - protein, 9 aa, Homo Sapiens
RQERHIQVT

SEQ ID NO: 213051 - protein, 9 aa, Homo Sapiens
SPYGGGHTL

SEQ ID NO: 213052 - protein, 9 aa, Homo Sapiens
PPPPRPQLL

SEQ ID NO: 213053 - protein, 9 aa, Homo Sapiens
VSSGTPDCY

SEQ ID NO: 213054 - protein, 9 aa, Homo Sapiens
ELERRFIFQ

SEQ ID NO: 213055 - protein, 9 aa, Homo Sapiens
KYPTNAPGV

SEQ ID NO: 213056 - protein, 9 aa, Homo Sapiens
LPSAPAAAP

SEQ ID NO: 213057 - protein, 9 aa, Homo Sapiens
PSAWDIRDY

SEQ ID NO: 213058 - protein, 9 aa, Homo Sapiens
PVCTNRLLS

SEQ ID NO: 213059 - protein, 9 aa, Homo Sapiens
VLGRVFSFC

SEQ ID NO: 213060 - protein, 9 aa, Homo Sapiens
SSSGLQGCV

SEQ ID NO: 213061 - protein, 9 aa, Homo Sapiens
RQTSIRYSP

SEQ ID NO: 213062 - protein, 9 aa, Homo Sapiens
WPRPPCSQR

SEQ ID NO: 213063 - protein, 9 aa, Homo Sapiens
TPWQPTRPF

SEQ ID NO: 213064 - protein, 9 aa, Homo Sapiens
LSSPPLWAA

SEQ ID NO: 213065 - protein, 9 aa, Homo Sapiens
PTSTPGPWA

SEQ ID NO: 213066 - protein, 9 aa, Homo Sapiens
LLLQPRRGR

SEQ ID NO: 213067 - protein, 9 aa, Homo Sapiens
KHHESFPLS

SEQ ID NO: 213068 - protein, 9 aa, Homo Sapiens
EDKKVRRQW

SEQ ID NO: 213069 - protein, 9 aa, Homo Sapiens
RDLVDAAKN

SEQ ID NO: 213070 - protein, 9 aa, Homo Sapiens
LAAWNEKVS

SEQ ID NO: 213071 - protein, 9 aa, Homo Sapiens
LDGQLYCLS

SEQ ID NO: 213072 - protein, 9 aa, Homo Sapiens
NSQVGTCIV

SEQ ID NO: 213073 - protein, 9 aa, Homo Sapiens
GHRPDLEEA

SEQ ID NO: 213074 - protein, 9 aa, Homo Sapiens
APPGPRLRT

SEQ ID NO: 213075 - protein, 9 aa, Homo Sapiens
HRRFSATDS

SEQ ID NO: 213076 - protein, 9 aa, Homo Sapiens
SPVLCSVSI

SEQ ID NO: 213077 - protein, 9 aa, Homo Sapiens
STTRCRRPR

SEQ ID NO: 213078 - protein, 9 aa, Homo Sapiens
LAKPECNIF

SEQ ID NO: 213079 - protein, 9 aa, Homo Sapiens
RSCSASVSF

SEQ ID NO: 213080 - protein, 9 aa, Homo Sapiens
GFGMCKYTT

SEQ ID NO: 213081 - protein, 9 aa, Homo Sapiens
VNIIETKPS

SEQ ID NO: 213082 - protein, 9 aa, Homo Sapiens
ADVDKQDSM

SEQ ID NO: 213083 - protein, 9 aa, Homo Sapiens
LKHMLNFNV

SEQ ID NO: 213084 - protein, 9 aa, Homo Sapiens
MCSRARLAL

SEQ ID NO: 213085 - protein, 9 aa, Homo Sapiens
YETDHQDYR

SEQ ID NO: 213086 - protein, 9 aa, Homo Sapiens
GEPCDQLHI

SEQ ID NO: 213087 - protein, 9 aa, Homo Sapiens
QLQDLHSHF

SEQ ID NO: 213088 - protein, 9 aa, Homo Sapiens
NKFESLELC

SEQ ID NO: 213089 - protein, 9 aa, Homo Sapiens
LRVQSVLLL

SEQ ID NO: 213090 - protein, 9 aa, Homo Sapiens
SVPPCLTAT

SEQ ID NO: 213091 - protein, 9 aa, Homo Sapiens
LKSRLPEWG

SEQ ID NO: 213092 - protein, 9 aa, Homo Sapiens
GVEQATQVR

SEQ ID NO: 213093 - protein, 9 aa, Homo Sapiens
VSLASALSP

SEQ ID NO: 213094 - protein, 9 aa, Homo Sapiens
PRWRCRGLW

SEQ ID NO: 213095 - protein, 9 aa, Homo Sapiens
VILILRLPF

SEQ ID NO: 213096 - protein, 9 aa, Homo Sapiens
LEGVEVQTE

SEQ ID NO: 213097 - protein, 9 aa, Homo Sapiens
RRRGCSGRS

SEQ ID NO: 213098 - protein, 9 aa, Homo Sapiens
AAGPVSCRS

SEQ ID NO: 213099 - protein, 9 aa, Homo Sapiens
INIFWMAMF

SEQ ID NO: 213100 - protein, 9 aa, Homo Sapiens
KWKTPTATW

SEQ ID NO: 213101 - protein, 9 aa, Homo Sapiens
VDPEVFFNT

SEQ ID NO: 213102 - protein, 9 aa, Homo Sapiens
GKYLTLAVK

SEQ ID NO: 213103 - protein, 9 aa, Homo Sapiens
DPQCPPDGC

SEQ ID NO: 213104 - protein, 9 aa, Homo Sapiens
HLLLSHKSC

SEQ ID NO: 213105 - protein, 9 aa, Homo Sapiens
RGAGISGCS

SEQ ID NO: 213106 - protein, 9 aa, Homo Sapiens
LWSWPPPSA

SEQ ID NO: 213107 - protein, 9 aa, Homo Sapiens
AVREENVPK

SEQ ID NO: 213108 - protein, 9 aa, Homo Sapiens
TAPAEVHKA

SEQ ID NO: 213109 - protein, 9 aa, Homo Sapiens
SALLGSPMC

SEQ ID NO: 213110 - protein, 9 aa, Homo Sapiens
PCIWQPVMD

SEQ ID NO: 213111 - protein, 9 aa, Homo Sapiens
LPSLGFPVS

SEQ ID NO: 213112 - protein, 9 aa, Homo Sapiens
RPLGCSGLP

SEQ ID NO: 213113 - protein, 9 aa, Homo Sapiens
KRGSPASPA

SEQ ID NO: 213114 - protein, 9 aa, Homo Sapiens
PPGCRSGRR

SEQ ID NO: 213115 - protein, 9 aa, Homo Sapiens
GPIGHLSIL

SEQ ID NO: 213116 - protein, 9 aa, Homo Sapiens
DMMSSGFSG

SEQ ID NO: 213117 - protein, 9 aa, Homo Sapiens
AARRVGVPG

SEQ ID NO: 213118 - protein, 9 aa, Homo Sapiens
RHFTVNMSK

SEQ ID NO: 213119 - protein, 9 aa, Homo Sapiens
VLARPQNGP

SEQ ID NO: 213120 - protein, 9 aa, Homo Sapiens
AAKSVVRVL

SEQ ID NO: 213121 - protein, 9 aa, Homo Sapiens
LPAPSALVL

SEQ ID NO: 213122 - protein, 9 aa, Homo Sapiens
TETPLALTY

SEQ ID NO: 213123 - protein, 9 aa, Homo Sapiens
RYASQQIKQ

SEQ ID NO: 213124 - protein, 9 aa, Homo Sapiens
GWGQHTGQP

SEQ ID NO: 213125 - protein, 9 aa, Homo Sapiens
RCLRGTPSR

SEQ ID NO: 213126 - protein, 9 aa, Homo Sapiens
SCKARTSAS

SEQ ID NO: 213127 - protein, 9 aa, Homo Sapiens
LSPHTVDHC

SEQ ID NO: 213128 - protein, 9 aa, Homo Sapiens
GAQRVCCLR

SEQ ID NO: 213129 - protein, 9 aa, Homo Sapiens
ESWGQRPAP

SEQ ID NO: 213130 - protein, 9 aa, Homo Sapiens
VIFYFLRGL

SEQ ID NO: 213131 - protein, 9 aa, Homo Sapiens
PGATRSLVR

SEQ ID NO: 213132 - protein, 9 aa, Homo Sapiens
GSSSTAKGP

SEQ ID NO: 213133 - protein, 9 aa, Homo Sapiens
LLHGEATQD

SEQ ID NO: 213134 - protein, 9 aa, Homo Sapiens
LEGLGPVVL

SEQ ID NO: 213135 - protein, 9 aa, Homo Sapiens
GLRKARMEG

SEQ ID NO: 213136 - protein, 9 aa, Homo Sapiens
TKRYDIPAM

SEQ ID NO: 213137 - protein, 9 aa, Homo Sapiens
YLALEHGCQ

SEQ ID NO: 213138 - protein, 9 aa, Homo Sapiens
MTTNQKKVL

SEQ ID NO: 213139 - protein, 9 aa, Homo Sapiens
PATRPTQRC

SEQ ID NO: 213140 - protein, 9 aa, Homo Sapiens
PPRTARGVT

SEQ ID NO: 213141 - protein, 9 aa, Homo Sapiens
PKTLLDDIK

SEQ ID NO: 213142 - protein, 9 aa, Homo Sapiens
RDLSVRRKN

SEQ ID NO: 213143 - protein, 9 aa, Homo Sapiens
SWGPMQPSS

SEQ ID NO: 213144 - protein, 9 aa, Homo Sapiens
VDKTLLVVL

SEQ ID NO: 213145 - protein, 9 aa, Homo Sapiens
GGRKRGHRR

SEQ ID NO: 213146 - protein, 9 aa, Homo Sapiens
GPFIGKNRM

SEQ ID NO: 213147 - protein, 9 aa, Homo Sapiens
HYMEVCESA

SEQ ID NO: 213148 - protein, 9 aa, Homo Sapiens
RPLWSRLSL

SEQ ID NO: 213149 - protein, 9 aa, Homo Sapiens
SAPPTKGAC

SEQ ID NO: 213150 - protein, 9 aa, Homo Sapiens
LSWASLAVD

SEQ ID NO: 213151 - protein, 9 aa, Homo Sapiens
LTNLLRHLD

SEQ ID NO: 213152 - protein, 9 aa, Homo Sapiens
LPSIRGVMI

SEQ ID NO: 213153 - protein, 9 aa, Homo Sapiens
KDTSVNVKS

SEQ ID NO: 213154 - protein, 9 aa, Homo Sapiens
GESGTGKTE

SEQ ID NO: 213155 - protein, 9 aa, Homo Sapiens
RVLLKWTEY

SEQ ID NO: 213156 - protein, 9 aa, Homo Sapiens
GKPKRAIVR

SEQ ID NO: 213157 - protein, 9 aa, Homo Sapiens
DMSQFYRPF

SEQ ID NO: 213158 - protein, 9 aa, Homo Sapiens
ASRGPSTGS

SEQ ID NO: 213159 - protein, 9 aa, Homo Sapiens
PSSLLSPCN

SEQ ID NO: 213160 - protein, 9 aa, Homo Sapiens
GPDWHWGAA

SEQ ID NO: 213161 - protein, 9 aa, Homo Sapiens
WTRRPSISC

SEQ ID NO: 213162 - protein, 9 aa, Homo Sapiens
NRSIALTQV

SEQ ID NO: 213163 - protein, 9 aa, Homo Sapiens
TIAECETRL

SEQ ID NO: 213164 - protein, 9 aa, Homo Sapiens
VVLHQAGAR

SEQ ID NO: 213165 - protein, 9 aa, Homo Sapiens
QVWFQNRRT

SEQ ID NO: 213166 - protein, 9 aa, Homo Sapiens
QAPPSGSRA

SEQ ID NO: 213167 - protein, 9 aa, Homo Sapiens
PRRSSSFRE

SEQ ID NO: 213168 - protein, 9 aa, Homo Sapiens
VIAMALEQE

SEQ ID NO: 213169 - protein, 9 aa, Homo Sapiens
QEAADMDEV

SEQ ID NO: 213170 - protein, 9 aa, Homo Sapiens
ARTSASRSA

SEQ ID NO: 213171 - protein, 9 aa, Homo Sapiens
IIKKKRSVC

SEQ ID NO: 213172 - protein, 9 aa, Homo Sapiens
LSGDWAKPS

SEQ ID NO: 213173 - protein, 9 aa, Homo Sapiens
GLRLRACWG

SEQ ID NO: 213174 - protein, 9 aa, Homo Sapiens
QFKRRGSEG

SEQ ID NO: 213175 - protein, 9 aa, Homo Sapiens
HKPHKRTRS

SEQ ID NO: 213176 - protein, 9 aa, Homo Sapiens
LQAVGLHSL

SEQ ID NO: 213177 - protein, 9 aa, Homo Sapiens
SDFRAVLVV

SEQ ID NO: 213178 - protein, 9 aa, Homo Sapiens
FSNGSWWAP

SEQ ID NO: 213179 - protein, 9 aa, Homo Sapiens
NFRRCCWYC

SEQ ID NO: 213180 - protein, 9 aa, Homo Sapiens
AVHAWRTLF

SEQ ID NO: 213181 - protein, 9 aa, Homo Sapiens
LLLVLQGRP

SEQ ID NO: 213182 - protein, 9 aa, Homo Sapiens
VPRHSSVLA

SEQ ID NO: 213183 - protein, 9 aa, Homo Sapiens
IYRPTSQGE

SEQ ID NO: 213184 - protein, 9 aa, Homo Sapiens
KCFEDYLEQ

SEQ ID NO: 213185 - protein, 9 aa, Homo Sapiens
RMRGTKSTP

SEQ ID NO: 213186 - protein, 9 aa, Homo Sapiens
SSLEEEGVL

SEQ ID NO: 213187 - protein, 9 aa, Homo Sapiens
KLKQMLNNK

SEQ ID NO: 213188 - protein, 9 aa, Homo Sapiens
LWGEEVQVP

SEQ ID NO: 213189 - protein, 9 aa, Homo Sapiens
LDPNTMYSF

SEQ ID NO: 213190 - protein, 9 aa, Homo Sapiens
FLTPGMPDP

SEQ ID NO: 213191 - protein, 9 aa, Homo Sapiens
EEIFIEEYL

SEQ ID NO: 213192 - protein, 9 aa, Homo Sapiens
NTSMWTSRT

SEQ ID NO: 213193 - protein, 9 aa, Homo Sapiens
GCQYLRCGV

SEQ ID NO: 213194 - protein, 9 aa, Homo Sapiens
RRGAPGGRA

SEQ ID NO: 213195 - protein, 9 aa, Homo Sapiens
EETNGGTQI

SEQ ID NO: 213196 - protein, 9 aa, Homo Sapiens
HMLDMDDLV

SEQ ID NO: 213197 - protein, 9 aa, Homo Sapiens
HWGAAATTL

SEQ ID NO: 213198 - protein, 9 aa, Homo Sapiens
CSLYGKKLV

SEQ ID NO: 213199 - protein, 9 aa, Homo Sapiens
EGCIIVADS

SEQ ID NO: 213200 - protein, 9 aa, Homo Sapiens
VSEDSPCES

SEQ ID NO: 213201 - protein, 9 aa, Homo Sapiens
GHYHFRAPS

SEQ ID NO: 213202 - protein, 9 aa, Homo Sapiens
KRRNHFWEL

SEQ ID NO: 213203 - protein, 9 aa, Homo Sapiens
RSVCSRSGE

SEQ ID NO: 213204 - protein, 9 aa, Homo Sapiens
VRRYCTAFT

SEQ ID NO: 213205 - protein, 9 aa, Homo Sapiens
RFVQGAPWL

SEQ ID NO: 213206 - protein, 9 aa, Homo Sapiens
RAVLETIKT

SEQ ID NO: 213207 - protein, 9 aa, Homo Sapiens
GTTPPRAEV

SEQ ID NO: 213208 - protein, 9 aa, Homo Sapiens
CHCLPSPPR

SEQ ID NO: 213209 - protein, 9 aa, Homo Sapiens
PTPLVAIMI

SEQ ID NO: 213210 - protein, 9 aa, Homo Sapiens
FQQWKCCTE

SEQ ID NO: 213211 - protein, 9 aa, Homo Sapiens
DWLSKKISF

SEQ ID NO: 213212 - protein, 9 aa, Homo Sapiens
SGWAGPAAT

SEQ ID NO: 213213 - protein, 9 aa, Homo Sapiens
QANTGPPRE

SEQ ID NO: 213214 - protein, 9 aa, Homo Sapiens
DNIADNPQL

SEQ ID NO: 213215 - protein, 9 aa, Homo Sapiens
PLVSLKEPR

SEQ ID NO: 213216 - protein, 9 aa, Homo Sapiens
ASLCWSTVA

SEQ ID NO: 213217 - protein, 9 aa, Homo Sapiens
GVHGLVVLL

SEQ ID NO: 213218 - protein, 9 aa, Homo Sapiens
YAEVKPISK

SEQ ID NO: 213219 - protein, 9 aa, Homo Sapiens
RSHLDFSPY

SEQ ID NO: 213220 - protein, 9 aa, Homo Sapiens
LLVFRLVVL

SEQ ID NO: 213221 - protein, 9 aa, Homo Sapiens
EKELPLYVR

SEQ ID NO: 213222 - protein, 9 aa, Homo Sapiens
PFGLIPRLP

SEQ ID NO: 213223 - protein, 9 aa, Homo Sapiens
FSGKEPNSK

SEQ ID NO: 213224 - protein, 9 aa, Homo Sapiens
AREWSPYKR

SEQ ID NO: 213225 - protein, 9 aa, Homo Sapiens
SNFWGGSQC

SEQ ID NO: 213226 - protein, 9 aa, Homo Sapiens
DCMNVLSVS

SEQ ID NO: 213227 - protein, 9 aa, Homo Sapiens
LHQVLRKLK

SEQ ID NO: 213228 - protein, 9 aa, Homo Sapiens
SWAIGVLWA

SEQ ID NO: 213229 - protein, 9 aa, Homo Sapiens
KLYNPPTIH

SEQ ID NO: 213230 - protein, 9 aa, Homo Sapiens
AVLHTERGI

SEQ ID NO: 213231 - protein, 9 aa, Homo Sapiens
AATFFSCIV

SEQ ID NO: 213232 - protein, 9 aa, Homo Sapiens
GGDTAPGGA

SEQ ID NO: 213233 - protein, 9 aa, Homo Sapiens
TAGMLIGYC

SEQ ID NO: 213234 - protein, 9 aa, Homo Sapiens
QFIGQVTVL

SEQ ID NO: 213235 - protein, 9 aa, Homo Sapiens
GSGSGLNAW

SEQ ID NO: 213236 - protein, 9 aa, Homo Sapiens
TGAQTGCMS

SEQ ID NO: 213237 - protein, 9 aa, Homo Sapiens
RGAMEETVV

SEQ ID NO: 213238 - protein, 9 aa, Homo Sapiens
IVRDNKDGT

SEQ ID NO: 213239 - protein, 9 aa, Homo Sapiens
RKMQTLMRT

SEQ ID NO: 213240 - protein, 9 aa, Homo Sapiens
GSFICSQTG

SEQ ID NO: 213241 - protein, 9 aa, Homo Sapiens
KVWKMNWKK

SEQ ID NO: 213242 - protein, 9 aa, Homo Sapiens
NVEGLSVLQ

SEQ ID NO: 213243 - protein, 9 aa, Homo Sapiens
ILRNNPYRM

SEQ ID NO: 213244 - protein, 9 aa, Homo Sapiens
VAPTPSSPL

SEQ ID NO: 213245 - protein, 9 aa, Homo Sapiens
TTTVEHTPI

SEQ ID NO: 213246 - protein, 9 aa, Homo Sapiens
MNRGDDTPC

SEQ ID NO: 213247 - protein, 9 aa, Homo Sapiens
SSVLATGLH

SEQ ID NO: 213248 - protein, 9 aa, Homo Sapiens
CWLLGTRCQ

SEQ ID NO: 213249 - protein, 9 aa, Homo Sapiens
PPRGRGGRG

SEQ ID NO: 213250 - protein, 9 aa, Homo Sapiens
NHARVLGGL

SEQ ID NO: 213251 - protein, 9 aa, Homo Sapiens
KSVREKNSL

SEQ ID NO: 213252 - protein, 9 aa, Homo Sapiens
GTQIQPLPA

SEQ ID NO: 213253 - protein, 9 aa, Homo Sapiens
YSNAGIPQH

SEQ ID NO: 213254 - protein, 9 aa, Homo Sapiens
AGAYTLLVQ

SEQ ID NO: 213255 - protein, 9 aa, Homo Sapiens
TAFCRPTTV

SEQ ID NO: 213256 - protein, 9 aa, Homo Sapiens
KYPQAAAVP

SEQ ID NO: 213257 - protein, 9 aa, Homo Sapiens
DGGEAGERS

SEQ ID NO: 213258 - protein, 9 aa, Homo Sapiens
CRNSSKNKI

SEQ ID NO: 213259 - protein, 9 aa, Homo Sapiens
IITGAPCLA

SEQ ID NO: 213260 - protein, 9 aa, Homo Sapiens
VLHHPVQHQ

SEQ ID NO: 213261 - protein, 9 aa, Homo Sapiens
KKRSVCNYY

SEQ ID NO: 213262 - protein, 9 aa, Homo Sapiens
RCSQCRVTK

SEQ ID NO: 213263 - protein, 9 aa, Homo Sapiens
LNSKQFIKY

SEQ ID NO: 213264 - protein, 9 aa, Homo Sapiens
SVGWNEALG

SEQ ID NO: 213265 - protein, 9 aa, Homo Sapiens
SSSGGRTAA

SEQ ID NO: 213266 - protein, 9 aa, Homo Sapiens
NTDPAPLSP

SEQ ID NO: 213267 - protein, 9 aa, Homo Sapiens
YIDNLEKNS

SEQ ID NO: 213268 - protein, 9 aa, Homo Sapiens
CFQRDLPQE

SEQ ID NO: 213269 - protein, 9 aa, Homo Sapiens
SFNGMMSTA

SEQ ID NO: 213270 - protein, 9 aa, Homo Sapiens
TFSPGLELV

SEQ ID NO: 213271 - protein, 9 aa, Homo Sapiens
MNTNPSRGH

SEQ ID NO: 213272 - protein, 9 aa, Homo Sapiens
GLAGLLPVS

SEQ ID NO: 213273 - protein, 9 aa, Homo Sapiens
EMKKTTSQS

SEQ ID NO: 213274 - protein, 9 aa, Homo Sapiens
IPVNHLTEG

SEQ ID NO: 213275 - protein, 9 aa, Homo Sapiens
NLGKETNSG

SEQ ID NO: 213276 - protein, 9 aa, Homo Sapiens
LMIDQLMSH

SEQ ID NO: 213277 - protein, 9 aa, Homo Sapiens
DPLQIFTYE

SEQ ID NO: 213278 - protein, 9 aa, Homo Sapiens
LTTIYMLTH

SEQ ID NO: 213279 - protein, 9 aa, Homo Sapiens
MTPVSGSRS

SEQ ID NO: 213280 - protein, 9 aa, Homo Sapiens
PPTWASPPN

SEQ ID NO: 213281 - protein, 9 aa, Homo Sapiens
VNILWSLGV

SEQ ID NO: 213282 - protein, 9 aa, Homo Sapiens
EVFRKQLEM

SEQ ID NO: 213283 - protein, 9 aa, Homo Sapiens
RPLARRCGS

SEQ ID NO: 213284 - protein, 9 aa, Homo Sapiens
AMCKLLKGI

SEQ ID NO: 213285 - protein, 9 aa, Homo Sapiens
HEGSHTGEK

SEQ ID NO: 213286 - protein, 9 aa, Homo Sapiens
KHLMKRYST

SEQ ID NO: 213287 - protein, 9 aa, Homo Sapiens
VGIEASLSD

SEQ ID NO: 213288 - protein, 9 aa, Homo Sapiens
GPGLVAGVN

SEQ ID NO: 213289 - protein, 9 aa, Homo Sapiens
LGPLNTGGG

SEQ ID NO: 213290 - protein, 9 aa, Homo Sapiens
AWTLTSLKY

SEQ ID NO: 213291 - protein, 9 aa, Homo Sapiens
EKRVLALGA

SEQ ID NO: 213292 - protein, 9 aa, Homo Sapiens
FSPGLELVF

SEQ ID NO: 213293 - protein, 9 aa, Homo Sapiens
LEFRKHIKD

SEQ ID NO: 213294 - protein, 9 aa, Homo Sapiens
CVHFLLHNG

SEQ ID NO: 213295 - protein, 9 aa, Homo Sapiens
FIPFIDVVK

SEQ ID NO: 213296 - protein, 9 aa, Homo Sapiens
QEEMMQDGT

SEQ ID NO: 213297 - protein, 9 aa, Homo Sapiens
PPGSYAVAT

SEQ ID NO: 213298 - protein, 9 aa, Homo Sapiens
MEDAIQILL

SEQ ID NO: 213299 - protein, 9 aa, Homo Sapiens
YRKSGTHQM

SEQ ID NO: 213300 - protein, 9 aa, Homo Sapiens
DDFLKQMTL

SEQ ID NO: 213301 - protein, 9 aa, Homo Sapiens
SVASTLAPA

SEQ ID NO: 213302 - protein, 9 aa, Homo Sapiens
GPGMPNSLN

SEQ ID NO: 213303 - protein, 9 aa, Homo Sapiens
RPRVHAPEG

SEQ ID NO: 213304 - protein, 9 aa, Homo Sapiens
LQPPLCSTS

SEQ ID NO: 213305 - protein, 9 aa, Homo Sapiens
SRIPRRTHL

SEQ ID NO: 213306 - protein, 9 aa, Homo Sapiens
SNSRSQQNH

SEQ ID NO: 213307 - protein, 9 aa, Homo Sapiens
NNYDAETKL

SEQ ID NO: 213308 - protein, 9 aa, Homo Sapiens
EKFTFAATW

SEQ ID NO: 213309 - protein, 9 aa, Homo Sapiens
CTTGCCSAA

SEQ ID NO: 213310 - protein, 9 aa, Homo Sapiens
QMQKNNGCF

SEQ ID NO: 213311 - protein, 9 aa, Homo Sapiens
SYRMDQTFK

SEQ ID NO: 213312 - protein, 9 aa, Homo Sapiens
IVLDYFLFL

SEQ ID NO: 213313 - protein, 9 aa, Homo Sapiens
PTASTTRCR

SEQ ID NO: 213314 - protein, 9 aa, Homo Sapiens
LIVGVKKGA

SEQ ID NO: 213315 - protein, 9 aa, Homo Sapiens
PKSSFIGDG

SEQ ID NO: 213316 - protein, 9 aa, Homo Sapiens
DRYATICNP

SEQ ID NO: 213317 - protein, 9 aa, Homo Sapiens
LQPRRGRLP

SEQ ID NO: 213318 - protein, 9 aa, Homo Sapiens
VCLDLPGTF

SEQ ID NO: 213319 - protein, 9 aa, Homo Sapiens
GFTLQNVGH

SEQ ID NO: 213320 - protein, 9 aa, Homo Sapiens
WLWCRPSWK

SEQ ID NO: 213321 - protein, 9 aa, Homo Sapiens
LQVSAPNLT

SEQ ID NO: 213322 - protein, 9 aa, Homo Sapiens
GAGSQESVK

SEQ ID NO: 213323 - protein, 9 aa, Homo Sapiens
FGKDMTLYS

SEQ ID NO: 213324 - protein, 9 aa, Homo Sapiens
WALCDRDVT

SEQ ID NO: 213325 - protein, 9 aa, Homo Sapiens
KIAFHIKSI

SEQ ID NO: 213326 - protein, 9 aa, Homo Sapiens
EAPSIFWMR

SEQ ID NO: 213327 - protein, 9 aa, Homo Sapiens
KSSFIGDGD

SEQ ID NO: 213328 - protein, 9 aa, Homo Sapiens
NSRSQQNHH

SEQ ID NO: 213329 - protein, 9 aa, Homo Sapiens
IVLSGSTTM

SEQ ID NO: 213330 - protein, 9 aa, Homo Sapiens
LEGLDALFA

SEQ ID NO: 213331 - protein, 9 aa, Homo Sapiens
ISDGGQSVV

SEQ ID NO: 213332 - protein, 9 aa, Homo Sapiens
SASASQANH

SEQ ID NO: 213333 - protein, 9 aa, Homo Sapiens
LTTGMRRGL

SEQ ID NO: 213334 - protein, 9 aa, Homo Sapiens
STRMGSSLT

SEQ ID NO: 213335 - protein, 9 aa, Homo Sapiens
HNQVDPNGS

SEQ ID NO: 213336 - protein, 9 aa, Homo Sapiens
YLCTGRGDP

SEQ ID NO: 213337 - protein, 9 aa, Homo Sapiens
TVALKHMLN

SEQ ID NO: 213338 - protein, 9 aa, Homo Sapiens
HSSPADWTR

SEQ ID NO: 213339 - protein, 9 aa, Homo Sapiens
ADDVVGSAL

SEQ ID NO: 213340 - protein, 9 aa, Homo Sapiens
YLGYHFLGE

SEQ ID NO: 213341 - protein, 9 aa, Homo Sapiens
PTCPQPPHV

SEQ ID NO: 213342 - protein, 9 aa, Homo Sapiens
APPGMPAVV

SEQ ID NO: 213343 - protein, 9 aa, Homo Sapiens
AGAVVWPSV

SEQ ID NO: 213344 - protein, 9 aa, Homo Sapiens
LLFIIDSFE

SEQ ID NO: 213345 - protein, 9 aa, Homo Sapiens
VFKTEEYVA

SEQ ID NO: 213346 - protein, 9 aa, Homo Sapiens
LTACKCLLW

SEQ ID NO: 213347 - protein, 9 aa, Homo Sapiens
DPRNLGCSP

SEQ ID NO: 213348 - protein, 9 aa, Homo Sapiens
VLLGESMTS

SEQ ID NO: 213349 - protein, 9 aa, Homo Sapiens
VTLLLVLQG

SEQ ID NO: 213350 - protein, 9 aa, Homo Sapiens
TGRPPKTAS

SEQ ID NO: 213351 - protein, 9 aa, Homo Sapiens
VESYTASSI

SEQ ID NO: 213352 - protein, 9 aa, Homo Sapiens
WAGPAATSS

SEQ ID NO: 213353 - protein, 9 aa, Homo Sapiens
RWAPLWTCL

SEQ ID NO: 213354 - protein, 9 aa, Homo Sapiens
DKNGDNKTN

SEQ ID NO: 213355 - protein, 9 aa, Homo Sapiens
MIVLGAGDT

SEQ ID NO: 213356 - protein, 9 aa, Homo Sapiens
CRAMTKNTS

SEQ ID NO: 213357 - protein, 9 aa, Homo Sapiens
GCGRVCYLK

SEQ ID NO: 213358 - protein, 9 aa, Homo Sapiens
TTLCQGPLG

SEQ ID NO: 213359 - protein, 9 aa, Homo Sapiens
LSLLAPKTT

SEQ ID NO: 213360 - protein, 9 aa, Homo Sapiens
PSFGEFPGF

SEQ ID NO: 213361 - protein, 9 aa, Homo Sapiens
WCLRRRSRK

SEQ ID NO: 213362 - protein, 9 aa, Homo Sapiens
ELGFTLLKL

SEQ ID NO: 213363 - protein, 9 aa, Homo Sapiens
DTFMGFITP

SEQ ID NO: 213364 - protein, 9 aa, Homo Sapiens
MLPTLSTLQ

SEQ ID NO: 213365 - protein, 9 aa, Homo Sapiens
PGLELVFAL

SEQ ID NO: 213366 - protein, 9 aa, Homo Sapiens
SRGHPRTGR

SEQ ID NO: 213367 - protein, 9 aa, Homo Sapiens
LQASVAAWP

SEQ ID NO: 213368 - protein, 9 aa, Homo Sapiens
IPWKGHNRH

SEQ ID NO: 213369 - protein, 9 aa, Homo Sapiens
STGTTSALT

SEQ ID NO: 213370 - protein, 9 aa, Homo Sapiens
AEINRMIQM

SEQ ID NO: 213371 - protein, 9 aa, Homo Sapiens
LVAMVFQWL

SEQ ID NO: 213372 - protein, 9 aa, Homo Sapiens
SSVAQTHQL

SEQ ID NO: 213373 - protein, 9 aa, Homo Sapiens
KQALMMMKF

SEQ ID NO: 213374 - protein, 9 aa, Homo Sapiens
YRPSMLCVE

SEQ ID NO: 213375 - protein, 9 aa, Homo Sapiens
CLQTSNNNM

SEQ ID NO: 213376 - protein, 9 aa, Homo Sapiens
KQLAEQRTD

SEQ ID NO: 213377 - protein, 9 aa, Homo Sapiens
SKELVSRHL

SEQ ID NO: 213378 - protein, 9 aa, Homo Sapiens
GCGSTPPPP

SEQ ID NO: 213379 - protein, 9 aa, Homo Sapiens
DDLGRGSKP

SEQ ID NO: 213380 - protein, 9 aa, Homo Sapiens
CFPRGMAFV

SEQ ID NO: 213381 - protein, 9 aa, Homo Sapiens
SMHGWTALM

SEQ ID NO: 213382 - protein, 9 aa, Homo Sapiens
GGKYLTLAV

SEQ ID NO: 213383 - protein, 9 aa, Homo Sapiens
LVILQTGAP

SEQ ID NO: 213384 - protein, 9 aa, Homo Sapiens
SSVDLNDQD

SEQ ID NO: 213385 - protein, 9 aa, Homo Sapiens
ILNLFGLGI

SEQ ID NO: 213386 - protein, 9 aa, Homo Sapiens
GAWSMPRNG

SEQ ID NO: 213387 - protein, 9 aa, Homo Sapiens
PPSRKCSGP

SEQ ID NO: 213388 - protein, 9 aa, Homo Sapiens
ATGLHLHRQ

SEQ ID NO: 213389 - protein, 9 aa, Homo Sapiens
QKPIHSWVL

SEQ ID NO: 213390 - protein, 9 aa, Homo Sapiens
APHPPPAAA

SEQ ID NO: 213391 - protein, 9 aa, Homo Sapiens
ISLAVRKIV

SEQ ID NO: 213392 - protein, 9 aa, Homo Sapiens
NHSKCITEC

SEQ ID NO: 213393 - protein, 9 aa, Homo Sapiens
QGGGQLAAG

SEQ ID NO: 213394 - protein, 9 aa, Homo Sapiens
LILPMKIPR

SEQ ID NO: 213395 - protein, 9 aa, Homo Sapiens
LMGSGFGFC

SEQ ID NO: 213396 - protein, 9 aa, Homo Sapiens
TALLQEALL

SEQ ID NO: 213397 - protein, 9 aa, Homo Sapiens
RTNSSSTNS

SEQ ID NO: 213398 - protein, 9 aa, Homo Sapiens
AAQRKSQSW

SEQ ID NO: 213399 - protein, 9 aa, Homo Sapiens
PSEKSNKKI

SEQ ID NO: 213400 - protein, 9 aa, Homo Sapiens
ISVKDHRTS

SEQ ID NO: 213401 - protein, 9 aa, Homo Sapiens
GQVTAHTGG

SEQ ID NO: 213402 - protein, 9 aa, Homo Sapiens
SRARAMLSV

SEQ ID NO: 213403 - protein, 9 aa, Homo Sapiens
RMEAAACPL

SEQ ID NO: 213404 - protein, 9 aa, Homo Sapiens
ETALKQYAC

SEQ ID NO: 213405 - protein, 9 aa, Homo Sapiens
NFDQAVELV

SEQ ID NO: 213406 - protein, 9 aa, Homo Sapiens
GTTSALTCL

SEQ ID NO: 213407 - protein, 9 aa, Homo Sapiens
QIFLEGFCS

SEQ ID NO: 213408 - protein, 9 aa, Homo Sapiens
EHAVRAPHA

SEQ ID NO: 213409 - protein, 9 aa, Homo Sapiens
DSAGPASAS

SEQ ID NO: 213410 - protein, 9 aa, Homo Sapiens
MKSHIEDGD

SEQ ID NO: 213411 - protein, 9 aa, Homo Sapiens
DTAVLPSFA

SEQ ID NO: 213412 - protein, 9 aa, Homo Sapiens
QEKTPKKKT

SEQ ID NO: 213413 - protein, 9 aa, Homo Sapiens
SPYNTDHTQ

SEQ ID NO: 213414 - protein, 9 aa, Homo Sapiens
PYSLQPPPY

SEQ ID NO: 213415 - protein, 9 aa, Homo Sapiens
RGYRERGGG

SEQ ID NO: 213416 - protein, 9 aa, Homo Sapiens
LGRPLGCSG

SEQ ID NO: 213417 - protein, 9 aa, Homo Sapiens
QLSYFLGLR

SEQ ID NO: 213418 - protein, 9 aa, Homo Sapiens
MLSVELGPE

SEQ ID NO: 213419 - protein, 9 aa, Homo Sapiens
QGPLPGCPA

SEQ ID NO: 213420 - protein, 9 aa, Homo Sapiens
GQGGQAPAC

SEQ ID NO: 213421 - protein, 9 aa, Homo Sapiens
EGLSVLQSF

SEQ ID NO: 213422 - protein, 9 aa, Homo Sapiens
AWNEKVSTE

SEQ ID NO: 213423 - protein, 9 aa, Homo Sapiens
VLVAATAVA

SEQ ID NO: 213424 - protein, 9 aa, Homo Sapiens
SGSWCGTWT

SEQ ID NO: 213425 - protein, 9 aa, Homo Sapiens
LQRTLARKA

SEQ ID NO: 213426 - protein, 9 aa, Homo Sapiens
VHRPRMIGC

SEQ ID NO: 213427 - protein, 9 aa, Homo Sapiens
PSALVLLAP

SEQ ID NO: 213428 - protein, 9 aa, Homo Sapiens
IILAVESQK

SEQ ID NO: 213429 - protein, 9 aa, Homo Sapiens
VGVPGTGAQ

SEQ ID NO: 213430 - protein, 9 aa, Homo Sapiens
SDVPKSCRP

SEQ ID NO: 213431 - protein, 9 aa, Homo Sapiens
LRTSLRFHL

SEQ ID NO: 213432 - protein, 9 aa, Homo Sapiens
LDGSEKVVP

SEQ ID NO: 213433 - protein, 9 aa, Homo Sapiens
VDNKKTHPC

SEQ ID NO: 213434 - protein, 9 aa, Homo Sapiens
RAGKLEVDS

SEQ ID NO: 213435 - protein, 9 aa, Homo Sapiens
VICSPRGPV

SEQ ID NO: 213436 - protein, 9 aa, Homo Sapiens
IHLHSYQLE

SEQ ID NO: 213437 - protein, 9 aa, Homo Sapiens
KELMEHLKK

SEQ ID NO: 213438 - protein, 9 aa, Homo Sapiens
GPAPEAPVQ

SEQ ID NO: 213439 - protein, 9 aa, Homo Sapiens
NAPLPRRSR

SEQ ID NO: 213440 - protein, 9 aa, Homo Sapiens
EEDSESISE

SEQ ID NO: 213441 - protein, 9 aa, Homo Sapiens
VCVNGASKS

SEQ ID NO: 213442 - protein, 9 aa, Homo Sapiens
ALEVLGAFL

SEQ ID NO: 213443 - protein, 9 aa, Homo Sapiens
SPRAPGSQL

SEQ ID NO: 213444 - protein, 9 aa, Homo Sapiens
QAQEGLCSL

SEQ ID NO: 213445 - protein, 9 aa, Homo Sapiens
LISNTWIVT

SEQ ID NO: 213446 - protein, 9 aa, Homo Sapiens
STAASMKMN

SEQ ID NO: 213447 - protein, 9 aa, Homo Sapiens
TPDAMPTHR

SEQ ID NO: 213448 - protein, 9 aa, Homo Sapiens
MGQTQPGEE

SEQ ID NO: 213449 - protein, 9 aa, Homo Sapiens
PQLLCQNPE

SEQ ID NO: 213450 - protein, 9 aa, Homo Sapiens
ARLWYKTFW

SEQ ID NO: 213451 - protein, 9 aa, Homo Sapiens
GAPGPCWSL

SEQ ID NO: 213452 - protein, 9 aa, Homo Sapiens
ISIYNRRTM

SEQ ID NO: 213453 - protein, 9 aa, Homo Sapiens
CGGIQSLVN

SEQ ID NO: 213454 - protein, 9 aa, Homo Sapiens
FTKKTQLLL

SEQ ID NO: 213455 - protein, 9 aa, Homo Sapiens
AARPPSSRT

SEQ ID NO: 213456 - protein, 9 aa, Homo Sapiens
SKLGRTMTH

SEQ ID NO: 213457 - protein, 9 aa, Homo Sapiens
MGARGLPHV

SEQ ID NO: 213458 - protein, 9 aa, Homo Sapiens
VKDHRTSQN

SEQ ID NO: 213459 - protein, 9 aa, Homo Sapiens
FIPRSPLSP

SEQ ID NO: 213460 - protein, 9 aa, Homo Sapiens
MTLAAVCLA

SEQ ID NO: 213461 - protein, 9 aa, Homo Sapiens
NKGKQKVLK

SEQ ID NO: 213462 - protein, 9 aa, Homo Sapiens
KGLAIVLLS

SEQ ID NO: 213463 - protein, 9 aa, Homo Sapiens
LVIQYNKNR

SEQ ID NO: 213464 - protein, 9 aa, Homo Sapiens
TKREARVEE

SEQ ID NO: 213465 - protein, 9 aa, Homo Sapiens
SDGNFAMRV

SEQ ID NO: 213466 - protein, 9 aa, Homo Sapiens
QSKEVTENP

SEQ ID NO: 213467 - protein, 9 aa, Homo Sapiens
RRFIFQKYL

SEQ ID NO: 213468 - protein, 9 aa, Homo Sapiens
IMRIALGGC

SEQ ID NO: 213469 - protein, 9 aa, Homo Sapiens
MRTAPSVWN

SEQ ID NO: 213470 - protein, 9 aa, Homo Sapiens
WNEKVSTEP

SEQ ID NO: 213471 - protein, 9 aa, Homo Sapiens
AGAVQQAQG

SEQ ID NO: 213472 - protein, 9 aa, Homo Sapiens
NVIAMALEQ

SEQ ID NO: 213473 - protein, 9 aa, Homo Sapiens
YECKECVKA

SEQ ID NO: 213474 - protein, 9 aa, Homo Sapiens
GILYAAPSS

SEQ ID NO: 213475 - protein, 9 aa, Homo Sapiens
HLSILWGEE

SEQ ID NO: 213476 - protein, 9 aa, Homo Sapiens
VTVIRRGEN

SEQ ID NO: 213477 - protein, 9 aa, Homo Sapiens
KAGQSQPCV

SEQ ID NO: 213478 - protein, 9 aa, Homo Sapiens
VGVLDYDKE

SEQ ID NO: 213479 - protein, 9 aa, Homo Sapiens
EAQAGAGLH

SEQ ID NO: 213480 - protein, 9 aa, Homo Sapiens
HPHQLEHSH

SEQ ID NO: 213481 - protein, 9 aa, Homo Sapiens
RRCRYWGRS

SEQ ID NO: 213482 - protein, 9 aa, Homo Sapiens
TALLHYLDN

SEQ ID NO: 213483 - protein, 9 aa, Homo Sapiens
EFRAQLGPA

SEQ ID NO: 213484 - protein, 9 aa, Homo Sapiens
STKASVARQ

SEQ ID NO: 213485 - protein, 9 aa, Homo Sapiens
ETRRARMFA

SEQ ID NO: 213486 - protein, 9 aa, Homo Sapiens
MPAVVLKSK

SEQ ID NO: 213487 - protein, 9 aa, Homo Sapiens
HDLSLHPDG

SEQ ID NO: 213488 - protein, 9 aa, Homo Sapiens
QRHPFLLLD

SEQ ID NO: 213489 - protein, 9 aa, Homo Sapiens
ELCEGPEHL

SEQ ID NO: 213490 - protein, 9 aa, Homo Sapiens
ETECDRVRQ

SEQ ID NO: 213491 - protein, 9 aa, Homo Sapiens
DLYWHVRCL

SEQ ID NO: 213492 - protein, 9 aa, Homo Sapiens
VNLMRGWER

SEQ ID NO: 213493 - protein, 9 aa, Homo Sapiens
IPLDIPVDV

SEQ ID NO: 213494 - protein, 9 aa, Homo Sapiens
ANRAMSRQT

SEQ ID NO: 213495 - protein, 9 aa, Homo Sapiens
TPCSHSLAL

SEQ ID NO: 213496 - protein, 9 aa, Homo Sapiens
PPAALVSWK

SEQ ID NO: 213497 - protein, 9 aa, Homo Sapiens
SGGVCQRMC

SEQ ID NO: 213498 - protein, 9 aa, Homo Sapiens
PLGLAAASC

SEQ ID NO: 213499 - protein, 9 aa, Homo Sapiens
VATTINLGD

SEQ ID NO: 213500 - protein, 9 aa, Homo Sapiens
YHFLGERDC

SEQ ID NO: 213501 - protein, 9 aa, Homo Sapiens
PTRTSRSSP

SEQ ID NO: 213502 - protein, 9 aa, Homo Sapiens
MPARLVLAS

SEQ ID NO: 213503 - protein, 9 aa, Homo Sapiens
AFFRSPHRM

SEQ ID NO: 213504 - protein, 9 aa, Homo Sapiens
GWAGPAATS

SEQ ID NO: 213505 - protein, 9 aa, Homo Sapiens
TPSRGFGRS

SEQ ID NO: 213506 - protein, 9 aa, Homo Sapiens
LLKKRNGMR

SEQ ID NO: 213507 - protein, 9 aa, Homo Sapiens
DRCALDNLP

SEQ ID NO: 213508 - protein, 9 aa, Homo Sapiens
IIQVILILR

SEQ ID NO: 213509 - protein, 9 aa, Homo Sapiens
ATAVFDMSY

SEQ ID NO: 213510 - protein, 9 aa, Homo Sapiens
ESLHGQRLV

SEQ ID NO: 213511 - protein, 9 aa, Homo Sapiens
NYRQPVDST

SEQ ID NO: 213512 - protein, 9 aa, Homo Sapiens
VAIDATGSR

SEQ ID NO: 213513 - protein, 9 aa, Homo Sapiens
KGFPINPNT

SEQ ID NO: 213514 - protein, 9 aa, Homo Sapiens
IALQLAHFQ

SEQ ID NO: 213515 - protein, 9 aa, Homo Sapiens
RTHPKGEDV

SEQ ID NO: 213516 - protein, 9 aa, Homo Sapiens
DGDSFNPTL

SEQ ID NO: 213517 - protein, 9 aa, Homo Sapiens
EDSNDSRCG

SEQ ID NO: 213518 - protein, 9 aa, Homo Sapiens
SADQAGIMG

SEQ ID NO: 213519 - protein, 9 aa, Homo Sapiens
TGKRPFIDE

SEQ ID NO: 213520 - protein, 9 aa, Homo Sapiens
LLLSPLDSS

SEQ ID NO: 213521 - protein, 9 aa, Homo Sapiens
CGLSFNKGE

SEQ ID NO: 213522 - protein, 9 aa, Homo Sapiens
LVVLLGLFE

SEQ ID NO: 213523 - protein, 9 aa, Homo Sapiens
YVKNFDQAV

SEQ ID NO: 213524 - protein, 9 aa, Homo Sapiens
IQNWSLLKD

SEQ ID NO: 213525 - protein, 9 aa, Homo Sapiens
LWVTEDPAP

SEQ ID NO: 213526 - protein, 9 aa, Homo Sapiens
GTPDCYYNV

SEQ ID NO: 213527 - protein, 9 aa, Homo Sapiens
LRAYRTSSA

SEQ ID NO: 213528 - protein, 9 aa, Homo Sapiens
CVGIEASLS

SEQ ID NO: 213529 - protein, 9 aa, Homo Sapiens
GGSYRKLFE

SEQ ID NO: 213530 - protein, 9 aa, Homo Sapiens
TTAVPRGPY

SEQ ID NO: 213531 - protein, 9 aa, Homo Sapiens
RHTIEVNRC

SEQ ID NO: 213532 - protein, 9 aa, Homo Sapiens
RQERWQMKR

SEQ ID NO: 213533 - protein, 9 aa, Homo Sapiens
WMAMFQQKT

SEQ ID NO: 213534 - protein, 9 aa, Homo Sapiens
TLQVEQNGT

SEQ ID NO: 213535 - protein, 9 aa, Homo Sapiens
GLPWGRPRG

SEQ ID NO: 213536 - protein, 9 aa, Homo Sapiens
STSSSGRMC

SEQ ID NO: 213537 - protein, 9 aa, Homo Sapiens
GGSGGCQYL

SEQ ID NO: 213538 - protein, 9 aa, Homo Sapiens
SVSTSLKKT

SEQ ID NO: 213539 - protein, 9 aa, Homo Sapiens
FEGADCSVE

SEQ ID NO: 213540 - protein, 9 aa, Homo Sapiens
EYTRTCGPW

SEQ ID NO: 213541 - protein, 9 aa, Homo Sapiens
STDRDWETV

SEQ ID NO: 213542 - protein, 9 aa, Homo Sapiens
FKELKRSKN

SEQ ID NO: 213543 - protein, 9 aa, Homo Sapiens
VRYLEKEEK

SEQ ID NO: 213544 - protein, 9 aa, Homo Sapiens
PNCWHRDSA

SEQ ID NO: 213545 - protein, 9 aa, Homo Sapiens
VGKSLWPGL

SEQ ID NO: 213546 - protein, 9 aa, Homo Sapiens
FGAARPDDL

SEQ ID NO: 213547 - protein, 9 aa, Homo Sapiens
LEKTMIFFT

SEQ ID NO: 213548 - protein, 9 aa, Homo Sapiens
RSADQAGIM

SEQ ID NO: 213549 - protein, 9 aa, Homo Sapiens
KRSVCNYYF

SEQ ID NO: 213550 - protein, 9 aa, Homo Sapiens
VCDGRLYAS

SEQ ID NO: 213551 - protein, 9 aa, Homo Sapiens
KVIEKNSPF

SEQ ID NO: 213552 - protein, 9 aa, Homo Sapiens
GPHAPCRAR

SEQ ID NO: 213553 - protein, 9 aa, Homo Sapiens
TWLMWTATE

SEQ ID NO: 213554 - protein, 9 aa, Homo Sapiens
VPCQDLGIG

SEQ ID NO: 213555 - protein, 9 aa, Homo Sapiens
TARALRIVC

SEQ ID NO: 213556 - protein, 9 aa, Homo Sapiens
PPPRLAPGG

SEQ ID NO: 213557 - protein, 9 aa, Homo Sapiens
TVHYIGSRL

SEQ ID NO: 213558 - protein, 9 aa, Homo Sapiens
LTGTHTEDW

SEQ ID NO: 213559 - protein, 9 aa, Homo Sapiens
VHRCSRLVM

SEQ ID NO: 213560 - protein, 9 aa, Homo Sapiens
CAFQAPPSC

SEQ ID NO: 213561 - protein, 9 aa, Homo Sapiens
ARVDEAKKP

SEQ ID NO: 213562 - protein, 9 aa, Homo Sapiens
GDLLLPPAP

SEQ ID NO: 213563 - protein, 9 aa, Homo Sapiens
RSVSENSLM

SEQ ID NO: 213564 - protein, 9 aa, Homo Sapiens
SRQATAGGR

SEQ ID NO: 213565 - protein, 9 aa, Homo Sapiens
AITSEECTK

SEQ ID NO: 213566 - protein, 9 aa, Homo Sapiens
IPFIDVVKV

SEQ ID NO: 213567 - protein, 9 aa, Homo Sapiens
LAQIFLEGF

SEQ ID NO: 213568 - protein, 9 aa, Homo Sapiens
RPSMRSDRL

SEQ ID NO: 213569 - protein, 9 aa, Homo Sapiens
AIGTHSANI

SEQ ID NO: 213570 - protein, 9 aa, Homo Sapiens
MEIRKETAK

SEQ ID NO: 213571 - protein, 9 aa, Homo Sapiens
GNRLVRPRE

SEQ ID NO: 213572 - protein, 9 aa, Homo Sapiens
NSWQPGGRS

SEQ ID NO: 213573 - protein, 9 aa, Homo Sapiens
QTYLQWPKE

SEQ ID NO: 213574 - protein, 9 aa, Homo Sapiens
HGVSLSITT

SEQ ID NO: 213575 - protein, 9 aa, Homo Sapiens
SASCFSNGS

SEQ ID NO: 213576 - protein, 9 aa, Homo Sapiens
AETVHYIGS

SEQ ID NO: 213577 - protein, 9 aa, Homo Sapiens
SNTSQVKAA

SEQ ID NO: 213578 - protein, 9 aa, Homo Sapiens
VDGSLKSNI

SEQ ID NO: 213579 - protein, 9 aa, Homo Sapiens
KNRISYNWY

SEQ ID NO: 213580 - protein, 9 aa, Homo Sapiens
AVLLQQDLD

SEQ ID NO: 213581 - protein, 9 aa, Homo Sapiens
GAMEETVVV

SEQ ID NO: 213582 - protein, 9 aa, Homo Sapiens
QVGHGVWVG

SEQ ID NO: 213583 - protein, 9 aa, Homo Sapiens
YPVLCSPRV

SEQ ID NO: 213584 - protein, 9 aa, Homo Sapiens
CYDACVFDS

SEQ ID NO: 213585 - protein, 9 aa, Homo Sapiens
ASLQVALHL

SEQ ID NO: 213586 - protein, 9 aa, Homo Sapiens
KKVILQVRS

SEQ ID NO: 213587 - protein, 9 aa, Homo Sapiens
KDCDPQGVE

SEQ ID NO: 213588 - protein, 9 aa, Homo Sapiens
KQLQIKLYN

SEQ ID NO: 213589 - protein, 9 aa, Homo Sapiens
SGDFQKALL

SEQ ID NO: 213590 - protein, 9 aa, Homo Sapiens
LFGDVASLK

SEQ ID NO: 213591 - protein, 9 aa, Homo Sapiens
LPPLSSLGT

SEQ ID NO: 213592 - protein, 9 aa, Homo Sapiens
AKFCIFSSP

SEQ ID NO: 213593 - protein, 9 aa, Homo Sapiens
FEDEDKKVR

SEQ ID NO: 213594 - protein, 9 aa, Homo Sapiens
VTMAVIIRD

SEQ ID NO: 213595 - protein, 9 aa, Homo Sapiens
VREVMERYA

SEQ ID NO: 213596 - protein, 9 aa, Homo Sapiens
NNMEKVTLK

SEQ ID NO: 213597 - protein, 9 aa, Homo Sapiens
FSAQPTNHV

SEQ ID NO: 213598 - protein, 9 aa, Homo Sapiens
TSQVSGTTA

SEQ ID NO: 213599 - protein, 9 aa, Homo Sapiens
HSLLNFLSG

SEQ ID NO: 213600 - protein, 9 aa, Homo Sapiens
CIALGKPLY

SEQ ID NO: 213601 - protein, 9 aa, Homo Sapiens
GPYVPRSWS

SEQ ID NO: 213602 - protein, 9 aa, Homo Sapiens
SAGGTAAGG

SEQ ID NO: 213603 - protein, 9 aa, Homo Sapiens
LGPSEHWQM

SEQ ID NO: 213604 - protein, 9 aa, Homo Sapiens
GSAAGTLGE

SEQ ID NO: 213605 - protein, 9 aa, Homo Sapiens
IGAPGNKLE

SEQ ID NO: 213606 - protein, 9 aa, Homo Sapiens
VFRKQLEMA

SEQ ID NO: 213607 - protein, 9 aa, Homo Sapiens
SFTNTVLYR

SEQ ID NO: 213608 - protein, 9 aa, Homo Sapiens
RGCLGNQFY

SEQ ID NO: 213609 - protein, 9 aa, Homo Sapiens
KDRSADQAG

SEQ ID NO: 213610 - protein, 9 aa, Homo Sapiens
AEGWWQLLG

SEQ ID NO: 213611 - protein, 9 aa, Homo Sapiens
LMGGMSRTP

SEQ ID NO: 213612 - protein, 9 aa, Homo Sapiens
RGLGRHHPS

SEQ ID NO: 213613 - protein, 9 aa, Homo Sapiens
AAQQRFHLV

SEQ ID NO: 213614 - protein, 9 aa, Homo Sapiens
ALCVRPRAR

SEQ ID NO: 213615 - protein, 9 aa, Homo Sapiens
PPPPPGWLP

SEQ ID NO: 213616 - protein, 9 aa, Homo Sapiens
MERYAKDYA

SEQ ID NO: 213617 - protein, 9 aa, Homo Sapiens
LHPHGKRCN

SEQ ID NO: 213618 - protein, 9 aa, Homo Sapiens
SHSWGPMQP

SEQ ID NO: 213619 - protein, 9 aa, Homo Sapiens
QGHGLLGQA

SEQ ID NO: 213620 - protein, 9 aa, Homo Sapiens
HHTLKEILR

SEQ ID NO: 213621 - protein, 9 aa, Homo Sapiens
CILTLPPTN

SEQ ID NO: 213622 - protein, 9 aa, Homo Sapiens
ARVGPLVHR

SEQ ID NO: 213623 - protein, 9 aa, Homo Sapiens
LQVEQNGTM

SEQ ID NO: 213624 - protein, 9 aa, Homo Sapiens
VSGLVTSHS

SEQ ID NO: 213625 - protein, 9 aa, Homo Sapiens
WVECQSKGK

SEQ ID NO: 213626 - protein, 9 aa, Homo Sapiens
KENLVDFIK

SEQ ID NO: 213627 - protein, 9 aa, Homo Sapiens
QQILTDHCN

SEQ ID NO: 213628 - protein, 9 aa, Homo Sapiens
PCTCPPVFS

SEQ ID NO: 213629 - protein, 9 aa, Homo Sapiens
PSASTHTSR

SEQ ID NO: 213630 - protein, 9 aa, Homo Sapiens
GSALDCFSF

SEQ ID NO: 213631 - protein, 9 aa, Homo Sapiens
GPIGPPGHP

SEQ ID NO: 213632 - protein, 9 aa, Homo Sapiens
VAPSSPTHG

SEQ ID NO: 213633 - protein, 9 aa, Homo Sapiens
IHVHTPLPT

SEQ ID NO: 213634 - protein, 9 aa, Homo Sapiens
LGRALKKRR

SEQ ID NO: 213635 - protein, 9 aa, Homo Sapiens
SKRKFSGQR

SEQ ID NO: 213636 - protein, 9 aa, Homo Sapiens
RKAKFCIFS

SEQ ID NO: 213637 - protein, 9 aa, Homo Sapiens
KFGDPSAAL

SEQ ID NO: 213638 - protein, 9 aa, Homo Sapiens
QSAPRRSHC

SEQ ID NO: 213639 - protein, 9 aa, Homo Sapiens
KPPNSCVLR

SEQ ID NO: 213640 - protein, 9 aa, Homo Sapiens
QQACYNFIR

SEQ ID NO: 213641 - protein, 9 aa, Homo Sapiens
QECQAEVQE

SEQ ID NO: 213642 - protein, 9 aa, Homo Sapiens
ATDAHYEVF

SEQ ID NO: 213643 - protein, 9 aa, Homo Sapiens
LAADDFSLK

SEQ ID NO: 213644 - protein, 9 aa, Homo Sapiens
FKHYPINMD

SEQ ID NO: 213645 - protein, 9 aa, Homo Sapiens
PAPSPCTPR

SEQ ID NO: 213646 - protein, 9 aa, Homo Sapiens
NSSEQLGVD

SEQ ID NO: 213647 - protein, 9 aa, Homo Sapiens
TTTLKLILV

SEQ ID NO: 213648 - protein, 9 aa, Homo Sapiens
SLSVMSSPS

SEQ ID NO: 213649 - protein, 9 aa, Homo Sapiens
HQLASGCFK

SEQ ID NO: 213650 - protein, 9 aa, Homo Sapiens
CGTWTAWMP

SEQ ID NO: 213651 - protein, 9 aa, Homo Sapiens
VAGVNIPCG

SEQ ID NO: 213652 - protein, 9 aa, Homo Sapiens
RHHPSQLCA

SEQ ID NO: 213653 - protein, 9 aa, Homo Sapiens
LQQEPAAMT

SEQ ID NO: 213654 - protein, 9 aa, Homo Sapiens
QACYNFIRS

SEQ ID NO: 213655 - protein, 9 aa, Homo Sapiens
PARLVLASL

SEQ ID NO: 213656 - protein, 9 aa, Homo Sapiens
KPKRAIVRD

SEQ ID NO: 213657 - protein, 9 aa, Homo Sapiens
IWLKLTKFY

SEQ ID NO: 213658 - protein, 9 aa, Homo Sapiens
KLKTFHMKC

SEQ ID NO: 213659 - protein, 9 aa, Homo Sapiens
ILYRNPNGT

SEQ ID NO: 213660 - protein, 9 aa, Homo Sapiens
ESPNLPAWT

SEQ ID NO: 213661 - protein, 9 aa, Homo Sapiens
QNMSVADSY

SEQ ID NO: 213662 - protein, 9 aa, Homo Sapiens
PLQQAAEVS

SEQ ID NO: 213663 - protein, 9 aa, Homo Sapiens
LDVKPMRKP

SEQ ID NO: 213664 - protein, 9 aa, Homo Sapiens
SAYGGGAKL

SEQ ID NO: 213665 - protein, 9 aa, Homo Sapiens
NNTNVQMVD

SEQ ID NO: 213666 - protein, 9 aa, Homo Sapiens
GQLAAGEAV

SEQ ID NO: 213667 - protein, 9 aa, Homo Sapiens
EARLISSPN

SEQ ID NO: 213668 - protein, 9 aa, Homo Sapiens
SPLGLALCP

SEQ ID NO: 213669 - protein, 9 aa, Homo Sapiens
GGHRPDLEE

SEQ ID NO: 213670 - protein, 9 aa, Homo Sapiens
LAPGSPYVS

SEQ ID NO: 213671 - protein, 9 aa, Homo Sapiens
PGYDVEIKV

SEQ ID NO: 213672 - protein, 9 aa, Homo Sapiens
SNVGTVISK

SEQ ID NO: 213673 - protein, 9 aa, Homo Sapiens
VPMSDLAEN

SEQ ID NO: 213674 - protein, 9 aa, Homo Sapiens
RPPYCDDTH

SEQ ID NO: 213675 - protein, 9 aa, Homo Sapiens
FLNPPGGGT

SEQ ID NO: 213676 - protein, 9 aa, Homo Sapiens
SDALIKCVQ

SEQ ID NO: 213677 - protein, 9 aa, Homo Sapiens
FRKLSMDVN

SEQ ID NO: 213678 - protein, 9 aa, Homo Sapiens
FKHLLDQGQ

SEQ ID NO: 213679 - protein, 9 aa, Homo Sapiens
IARARVCIV

SEQ ID NO: 213680 - protein, 9 aa, Homo Sapiens
PWPPTCSPQ

SEQ ID NO: 213681 - protein, 9 aa, Homo Sapiens
CQSTEPGDE

SEQ ID NO: 213682 - protein, 9 aa, Homo Sapiens
EEDHVDMSL

SEQ ID NO: 213683 - protein, 9 aa, Homo Sapiens
GQVTVLKYF

SEQ ID NO: 213684 - protein, 9 aa, Homo Sapiens
WRGRRRERS

SEQ ID NO: 213685 - protein, 9 aa, Homo Sapiens
WRRGLGLLD

SEQ ID NO: 213686 - protein, 9 aa, Homo Sapiens
KRLAKDLFY

SEQ ID NO: 213687 - protein, 9 aa, Homo Sapiens
ALPDLRSMR

SEQ ID NO: 213688 - protein, 9 aa, Homo Sapiens
AEAVHFSAI

SEQ ID NO: 213689 - protein, 9 aa, Homo Sapiens
PASSFVVDF

SEQ ID NO: 213690 - protein, 9 aa, Homo Sapiens
SGLSADSMA

SEQ ID NO: 213691 - protein, 9 aa, Homo Sapiens
RKESFQENE

SEQ ID NO: 213692 - protein, 9 aa, Homo Sapiens
ALLLTTTCS

SEQ ID NO: 213693 - protein, 9 aa, Homo Sapiens
LTRSSPGLP

SEQ ID NO: 213694 - protein, 9 aa, Homo Sapiens
KIYQLIHKK

SEQ ID NO: 213695 - protein, 9 aa, Homo Sapiens
CTSVTSTSP

SEQ ID NO: 213696 - protein, 9 aa, Homo Sapiens
NDCHEEKIR

SEQ ID NO: 213697 - protein, 9 aa, Homo Sapiens
MQEQLQDLH

SEQ ID NO: 213698 - protein, 9 aa, Homo Sapiens
EGCISVKDH

SEQ ID NO: 213699 - protein, 9 aa, Homo Sapiens
KGRLHEWVK

SEQ ID NO: 213700 - protein, 9 aa, Homo Sapiens
DEDFQSDGD

SEQ ID NO: 213701 - protein, 9 aa, Homo Sapiens
DDLTLISRN

SEQ ID NO: 213702 - protein, 9 aa, Homo Sapiens
ITMVVLSSE

SEQ ID NO: 213703 - protein, 9 aa, Homo Sapiens
RLVRPREED

SEQ ID NO: 213704 - protein, 9 aa, Homo Sapiens
TRCASCGTC

SEQ ID NO: 213705 - protein, 9 aa, Homo Sapiens
NLAPSYPAG

SEQ ID NO: 213706 - protein, 9 aa, Homo Sapiens
YEEFLNKVS

SEQ ID NO: 213707 - protein, 9 aa, Homo Sapiens
FPFTFSPIT

SEQ ID NO: 213708 - protein, 9 aa, Homo Sapiens
VGSSGICFQ

SEQ ID NO: 213709 - protein, 9 aa, Homo Sapiens
NICPSDSGS

SEQ ID NO: 213710 - protein, 9 aa, Homo Sapiens
LTALLQEAL

SEQ ID NO: 213711 - protein, 9 aa, Homo Sapiens
MTQMQGEES

SEQ ID NO: 213712 - protein, 9 aa, Homo Sapiens
MGGGSYRKL

SEQ ID NO: 213713 - protein, 9 aa, Homo Sapiens
RARCSAGAY

SEQ ID NO: 213714 - protein, 9 aa, Homo Sapiens
RGDRPIRHH

SEQ ID NO: 213715 - protein, 9 aa, Homo Sapiens
AGMLIGYCP

SEQ ID NO: 213716 - protein, 9 aa, Homo Sapiens
MHYGHQAPQ

SEQ ID NO: 213717 - protein, 9 aa, Homo Sapiens
SQHLLFEAW

SEQ ID NO: 213718 - protein, 9 aa, Homo Sapiens
PLSVIMGVF

SEQ ID NO: 213719 - protein, 9 aa, Homo Sapiens
QVGGTSFYD

SEQ ID NO: 213720 - protein, 9 aa, Homo Sapiens
HGCVVPESK

SEQ ID NO: 213721 - protein, 9 aa, Homo Sapiens
GTLCYLGNR

SEQ ID NO: 213722 - protein, 9 aa, Homo Sapiens
EKKLGGQDI

SEQ ID NO: 213723 - protein, 9 aa, Homo Sapiens
RRKEGKLFP

SEQ ID NO: 213724 - protein, 9 aa, Homo Sapiens
VEVGTVAIR

SEQ ID NO: 213725 - protein, 9 aa, Homo Sapiens
LLKQALTTG

SEQ ID NO: 213726 - protein, 9 aa, Homo Sapiens
GNLSPGVVT

SEQ ID NO: 213727 - protein, 9 aa, Homo Sapiens
MRRRRRDGF

SEQ ID NO: 213728 - protein, 9 aa, Homo Sapiens
KVADGLIKV

SEQ ID NO: 213729 - protein, 9 aa, Homo Sapiens
IEHAVRAPH

SEQ ID NO: 213730 - protein, 9 aa, Homo Sapiens
DHQDVGVGF

SEQ ID NO: 213731 - protein, 9 aa, Homo Sapiens
LCHDNIVRV

SEQ ID NO: 213732 - protein, 9 aa, Homo Sapiens
AIQILLVFM

SEQ ID NO: 213733 - protein, 9 aa, Homo Sapiens
RGPGMPNSL

SEQ ID NO: 213734 - protein, 9 aa, Homo Sapiens
GRGGSTPAP

SEQ ID NO: 213735 - protein, 9 aa, Homo Sapiens
TERNLRPLS

SEQ ID NO: 213736 - protein, 9 aa, Homo Sapiens
RNEEDAVND

SEQ ID NO: 213737 - protein, 9 aa, Homo Sapiens
GQPMRCLHL

SEQ ID NO: 213738 - protein, 9 aa, Homo Sapiens
DHHFFLQII

SEQ ID NO: 213739 - protein, 9 aa, Homo Sapiens
SPSWRAQSA

SEQ ID NO: 213740 - protein, 9 aa, Homo Sapiens
YIVQDGPPR

SEQ ID NO: 213741 - protein, 9 aa, Homo Sapiens
RQTPGQARA

SEQ ID NO: 213742 - protein, 9 aa, Homo Sapiens
RYTVKSCDD

SEQ ID NO: 213743 - protein, 9 aa, Homo Sapiens
PGRGYRALQ

SEQ ID NO: 213744 - protein, 9 aa, Homo Sapiens
PLTTQSWIP

SEQ ID NO: 213745 - protein, 9 aa, Homo Sapiens
HCHSYELFN

SEQ ID NO: 213746 - protein, 9 aa, Homo Sapiens
AVSTAASMK

SEQ ID NO: 213747 - protein, 9 aa, Homo Sapiens
PQLFSPYVE

SEQ ID NO: 213748 - protein, 9 aa, Homo Sapiens
GVENLRRMA

SEQ ID NO: 213749 - protein, 9 aa, Homo Sapiens
GGKQEDVYI

SEQ ID NO: 213750 - protein, 9 aa, Homo Sapiens
LECALYFKH

SEQ ID NO: 213751 - protein, 9 aa, Homo Sapiens
QSQLYLLDY

SEQ ID NO: 213752 - protein, 9 aa, Homo Sapiens
QAYILAHKD

SEQ ID NO: 213753 - protein, 9 aa, Homo Sapiens
LQLRFPIAD

SEQ ID NO: 213754 - protein, 9 aa, Homo Sapiens
CVQVTFSPG

SEQ ID NO: 213755 - protein, 9 aa, Homo Sapiens
KCAFQAPPS

SEQ ID NO: 213756 - protein, 9 aa, Homo Sapiens
GPGKLRQDR

SEQ ID NO: 213757 - protein, 9 aa, Homo Sapiens
NKLQVSAPN

SEQ ID NO: 213758 - protein, 9 aa, Homo Sapiens
ETLRCPQAA

SEQ ID NO: 213759 - protein, 9 aa, Homo Sapiens
VHWVTYIPS

SEQ ID NO: 213760 - protein, 9 aa, Homo Sapiens
PAPSALVLL

SEQ ID NO: 213761 - protein, 9 aa, Homo Sapiens
PEAPRYTVK

SEQ ID NO: 213762 - protein, 9 aa, Homo Sapiens
VTSQAMATE

SEQ ID NO: 213763 - protein, 9 aa, Homo Sapiens
PGITGICWL

SEQ ID NO: 213764 - protein, 9 aa, Homo Sapiens
MWSASGRNE

SEQ ID NO: 213765 - protein, 9 aa, Homo Sapiens
FTHRRLPDF

SEQ ID NO: 213766 - protein, 9 aa, Homo Sapiens
CSSSSAARG

SEQ ID NO: 213767 - protein, 9 aa, Homo Sapiens
PGPAPEAPV

SEQ ID NO: 213768 - protein, 9 aa, Homo Sapiens
GCPKIPPPK

SEQ ID NO: 213769 - protein, 9 aa, Homo Sapiens
YQVRLQQSF

SEQ ID NO: 213770 - protein, 9 aa, Homo Sapiens
KHELLSSTR

SEQ ID NO: 213771 - protein, 9 aa, Homo Sapiens
VRQIQEEMM

SEQ ID NO: 213772 - protein, 9 aa, Homo Sapiens
NWTEGCGSP

SEQ ID NO: 213773 - protein, 9 aa, Homo Sapiens
KKVWNLQGL

SEQ ID NO: 213774 - protein, 9 aa, Homo Sapiens
KHNRWEPEE

SEQ ID NO: 213775 - protein, 9 aa, Homo Sapiens
DGQSQPPSN

SEQ ID NO: 213776 - protein, 9 aa, Homo Sapiens
PHLLQEPCL

SEQ ID NO: 213777 - protein, 9 aa, Homo Sapiens
PSKEASSVF

SEQ ID NO: 213778 - protein, 9 aa, Homo Sapiens
FYVTSDDEL

SEQ ID NO: 213779 - protein, 9 aa, Homo Sapiens
PPSSCWSPR

SEQ ID NO: 213780 - protein, 9 aa, Homo Sapiens
LQEAQRQVV

SEQ ID NO: 213781 - protein, 9 aa, Homo Sapiens
TWTAWMPCW

SEQ ID NO: 213782 - protein, 9 aa, Homo Sapiens
CDQHIDCYS

SEQ ID NO: 213783 - protein, 9 aa, Homo Sapiens
DGVGVLGAH

SEQ ID NO: 213784 - protein, 9 aa, Homo Sapiens
DYIWDATIL

SEQ ID NO: 213785 - protein, 9 aa, Homo Sapiens
GPCPPPVTP

SEQ ID NO: 213786 - protein, 9 aa, Homo Sapiens
LLKPKISQN

SEQ ID NO: 213787 - protein, 9 aa, Homo Sapiens
IVDFLQRLV

SEQ ID NO: 213788 - protein, 9 aa, Homo Sapiens
RLCMSLQEK

SEQ ID NO: 213789 - protein, 9 aa, Homo Sapiens
TKYFRFVVS

SEQ ID NO: 213790 - protein, 9 aa, Homo Sapiens
CVVLPVLMN

SEQ ID NO: 213791 - protein, 9 aa, Homo Sapiens
STMECQKPE

SEQ ID NO: 213792 - protein, 9 aa, Homo Sapiens
PPGTTPPRA

SEQ ID NO: 213793 - protein, 9 aa, Homo Sapiens
VAMVFQWLH

SEQ ID NO: 213794 - protein, 9 aa, Homo Sapiens
HAVAASTGM

SEQ ID NO: 213795 - protein, 9 aa, Homo Sapiens
PLRRQTSIR

SEQ ID NO: 213796 - protein, 9 aa, Homo Sapiens
TGCMSICGP

SEQ ID NO: 213797 - protein, 9 aa, Homo Sapiens
QILKDIGEF

SEQ ID NO: 213798 - protein, 9 aa, Homo Sapiens
LDTLVVLHQ

SEQ ID NO: 213799 - protein, 9 aa, Homo Sapiens
PRWTPRTWQ

SEQ ID NO: 213800 - protein, 9 aa, Homo Sapiens
RKFSGQRRR

SEQ ID NO: 213801 - protein, 9 aa, Homo Sapiens
VSAAMMAIT

SEQ ID NO: 213802 - protein, 9 aa, Homo Sapiens
MRGWERAQK

SEQ ID NO: 213803 - protein, 9 aa, Homo Sapiens
HEFGNQTLF

SEQ ID NO: 213804 - protein, 9 aa, Homo Sapiens
GDMTMVNVG

SEQ ID NO: 213805 - protein, 9 aa, Homo Sapiens
TSSPVTFIH

SEQ ID NO: 213806 - protein, 9 aa, Homo Sapiens
TLLPAAWRI

SEQ ID NO: 213807 - protein, 9 aa, Homo Sapiens
QPVMDTVIL

SEQ ID NO: 213808 - protein, 9 aa, Homo Sapiens
PSRRCPRTP

SEQ ID NO: 213809 - protein, 9 aa, Homo Sapiens
LAKQFTILN

SEQ ID NO: 213810 - protein, 9 aa, Homo Sapiens
SPWCLSCSL

SEQ ID NO: 213811 - protein, 9 aa, Homo Sapiens
GIQSLVNLL

SEQ ID NO: 213812 - protein, 9 aa, Homo Sapiens
YNTLLQTGE

SEQ ID NO: 213813 - protein, 9 aa, Homo Sapiens
SGLYPSPST

SEQ ID NO: 213814 - protein, 9 aa, Homo Sapiens
HQYLYAMTG

SEQ ID NO: 213815 - protein, 9 aa, Homo Sapiens
SLPRSPPRL

SEQ ID NO: 213816 - protein, 9 aa, Homo Sapiens
GQAAKDELP

SEQ ID NO: 213817 - protein, 9 aa, Homo Sapiens
EASVKLRLN

SEQ ID NO: 213818 - protein, 9 aa, Homo Sapiens
QHCYPPTWR

SEQ ID NO: 213819 - protein, 9 aa, Homo Sapiens
SNSPCPRSK

SEQ ID NO: 213820 - protein, 9 aa, Homo Sapiens
CLHLPSPPV

SEQ ID NO: 213821 - protein, 9 aa, Homo Sapiens
GSPRYQGAA

SEQ ID NO: 213822 - protein, 9 aa, Homo Sapiens
VRGLGRHHP

SEQ ID NO: 213823 - protein, 9 aa, Homo Sapiens
RRVPRLRKF

SEQ ID NO: 213824 - protein, 9 aa, Homo Sapiens
WGPQRGQGL

SEQ ID NO: 213825 - protein, 9 aa, Homo Sapiens
LEVIFHQGI

SEQ ID NO: 213826 - protein, 9 aa, Homo Sapiens
GDPSAALDL

SEQ ID NO: 213827 - protein, 9 aa, Homo Sapiens
QLFSPYVEE

SEQ ID NO: 213828 - protein, 9 aa, Homo Sapiens
MAVLDEFPH

SEQ ID NO: 213829 - protein, 9 aa, Homo Sapiens
GAQEALSDS

SEQ ID NO: 213830 - protein, 9 aa, Homo Sapiens
PGKLRQDRV

SEQ ID NO: 213831 - protein, 9 aa, Homo Sapiens
RRWQAECFQ

SEQ ID NO: 213832 - protein, 9 aa, Homo Sapiens
SGKVYTLQP

SEQ ID NO: 213833 - protein, 9 aa, Homo Sapiens
LRARRSRVP

SEQ ID NO: 213834 - protein, 9 aa, Homo Sapiens
PTWASPPNT

SEQ ID NO: 213835 - protein, 9 aa, Homo Sapiens
VFNPDTELQ

SEQ ID NO: 213836 - protein, 9 aa, Homo Sapiens
GSKLLEIFA

SEQ ID NO: 213837 - protein, 9 aa, Homo Sapiens
TALLECPEY

SEQ ID NO: 213838 - protein, 9 aa, Homo Sapiens
GTHPTLKDL

SEQ ID NO: 213839 - protein, 9 aa, Homo Sapiens
RNTFRKLLK

SEQ ID NO: 213840 - protein, 9 aa, Homo Sapiens
ILNGGSSKR

SEQ ID NO: 213841 - protein, 9 aa, Homo Sapiens
VTKENLVDF

SEQ ID NO: 213842 - protein, 9 aa, Homo Sapiens
YRCKDCDQL

SEQ ID NO: 213843 - protein, 9 aa, Homo Sapiens
IQEWGCLCG

SEQ ID NO: 213844 - protein, 9 aa, Homo Sapiens
PGCQGTRRF

SEQ ID NO: 213845 - protein, 9 aa, Homo Sapiens
PVLSYGDVD

SEQ ID NO: 213846 - protein, 9 aa, Homo Sapiens
MGHRVLGLI

SEQ ID NO: 213847 - protein, 9 aa, Homo Sapiens
SQIDAQQRP

SEQ ID NO: 213848 - protein, 9 aa, Homo Sapiens
ATFFSCIVC

SEQ ID NO: 213849 - protein, 9 aa, Homo Sapiens
LGVAPRVCG

SEQ ID NO: 213850 - protein, 9 aa, Homo Sapiens
WCWRCPWRT

SEQ ID NO: 213851 - protein, 9 aa, Homo Sapiens
DSPCESVQE

SEQ ID NO: 213852 - protein, 9 aa, Homo Sapiens
MKQRKNQVF

SEQ ID NO: 213853 - protein, 9 aa, Homo Sapiens
PRVVAAYQP

SEQ ID NO: 213854 - protein, 9 aa, Homo Sapiens
EGLDALFAQ

SEQ ID NO: 213855 - protein, 9 aa, Homo Sapiens
FMYLSLSLA

SEQ ID NO: 213856 - protein, 9 aa, Homo Sapiens
PNAGHRTIA

SEQ ID NO: 213857 - protein, 9 aa, Homo Sapiens
SKRSSSSHN

SEQ ID NO: 213858 - protein, 9 aa, Homo Sapiens
LLFRQDFLW

SEQ ID NO: 213859 - protein, 9 aa, Homo Sapiens
SSETSGDFQ

SEQ ID NO: 213860 - protein, 9 aa, Homo Sapiens
EPCLELLEV

SEQ ID NO: 213861 - protein, 9 aa, Homo Sapiens
VKLRLNVDE

SEQ ID NO: 213862 - protein, 9 aa, Homo Sapiens
CLSSYIKRY

SEQ ID NO: 213863 - protein, 9 aa, Homo Sapiens
EKNQLTRDW

SEQ ID NO: 213864 - protein, 9 aa, Homo Sapiens
YTLNNGNLG

SEQ ID NO: 213865 - protein, 9 aa, Homo Sapiens
ANHVKDVKK

SEQ ID NO: 213866 - protein, 9 aa, Homo Sapiens
RWTPRTWQD

SEQ ID NO: 213867 - protein, 9 aa, Homo Sapiens
RSRPCAHDA

SEQ ID NO: 213868 - protein, 9 aa, Homo Sapiens
LEDVWWGPG

SEQ ID NO: 213869 - protein, 9 aa, Homo Sapiens
RREQWLRLR

SEQ ID NO: 213870 - protein, 9 aa, Homo Sapiens
AIKQVVNAI

SEQ ID NO: 213871 - protein, 9 aa, Homo Sapiens
SELEHLKLQ

SEQ ID NO: 213872 - protein, 9 aa, Homo Sapiens
KPRTSVEDA

SEQ ID NO: 213873 - protein, 9 aa, Homo Sapiens
RAPALPGPG

SEQ ID NO: 213874 - protein, 9 aa, Homo Sapiens
SQWSLCPAE

SEQ ID NO: 213875 - protein, 9 aa, Homo Sapiens
FSKELKKLK

SEQ ID NO: 213876 - protein, 9 aa, Homo Sapiens
VVIEMVTAK

SEQ ID NO: 213877 - protein, 9 aa, Homo Sapiens
NARTRAWRT

SEQ ID NO: 213878 - protein, 9 aa, Homo Sapiens
PSARGAPSL

SEQ ID NO: 213879 - protein, 9 aa, Homo Sapiens
RNLRPLSLQ

SEQ ID NO: 213880 - protein, 9 aa, Homo Sapiens
VISERTHHS

SEQ ID NO: 213881 - protein, 9 aa, Homo Sapiens
PISLHMSYA

SEQ ID NO: 213882 - protein, 9 aa, Homo Sapiens
YFFLHYGHH

SEQ ID NO: 213883 - protein, 9 aa, Homo Sapiens
VFLDGVGVL

SEQ ID NO: 213884 - protein, 9 aa, Homo Sapiens
LERREQLKR

SEQ ID NO: 213885 - protein, 9 aa, Homo Sapiens
GKLASGVLP

SEQ ID NO: 213886 - protein, 9 aa, Homo Sapiens
DPHSRHCLC

SEQ ID NO: 213887 - protein, 9 aa, Homo Sapiens
LRRMATDRR

SEQ ID NO: 213888 - protein, 9 aa, Homo Sapiens
FCNKIQGIV

SEQ ID NO: 213889 - protein, 9 aa, Homo Sapiens
LLGLFEELL

SEQ ID NO: 213890 - protein, 9 aa, Homo Sapiens
PSKTQTMSA

SEQ ID NO: 213891 - protein, 9 aa, Homo Sapiens
ENMLKFVEN

SEQ ID NO: 213892 - protein, 9 aa, Homo Sapiens
IGPLTITHT

SEQ ID NO: 213893 - protein, 9 aa, Homo Sapiens
KKSDSKNAP

SEQ ID NO: 213894 - protein, 9 aa, Homo Sapiens
IFVPDSVLF

SEQ ID NO: 213895 - protein, 9 aa, Homo Sapiens
FVDFLIGSG

SEQ ID NO: 213896 - protein, 9 aa, Homo Sapiens
SNDSRCGSG

SEQ ID NO: 213897 - protein, 9 aa, Homo Sapiens
VCCLRCCFS

SEQ ID NO: 213898 - protein, 9 aa, Homo Sapiens
KLAPLQVTT

SEQ ID NO: 213899 - protein, 9 aa, Homo Sapiens
SRHTICVKT

SEQ ID NO: 213900 - protein, 9 aa, Homo Sapiens
TNRHRKITS

SEQ ID NO: 213901 - protein, 9 aa, Homo Sapiens
GVYREQPLP

SEQ ID NO: 213902 - protein, 9 aa, Homo Sapiens
QEKCAQCWP

SEQ ID NO: 213903 - protein, 9 aa, Homo Sapiens
STVRLLHFF

SEQ ID NO: 213904 - protein, 9 aa, Homo Sapiens
SSSIQRACC

SEQ ID NO: 213905 - protein, 9 aa, Homo Sapiens
VEDAPSEEV

SEQ ID NO: 213906 - protein, 9 aa, Homo Sapiens
DPKGKGHRR

SEQ ID NO: 213907 - protein, 9 aa, Homo Sapiens
SERFNPGSS

SEQ ID NO: 213908 - protein, 9 aa, Homo Sapiens
NLYHLSPHL

SEQ ID NO: 213909 - protein, 9 aa, Homo Sapiens
ASSSPTPGR

SEQ ID NO: 213910 - protein, 9 aa, Homo Sapiens
RKIGARIHA

SEQ ID NO: 213911 - protein, 9 aa, Homo Sapiens
GIGAPGNKL

SEQ ID NO: 213912 - protein, 9 aa, Homo Sapiens
QVVEMLGHK

SEQ ID NO: 213913 - protein, 9 aa, Homo Sapiens
QCRPAWTAA

SEQ ID NO: 213914 - protein, 9 aa, Homo Sapiens
GTTAAGWIG

SEQ ID NO: 213915 - protein, 9 aa, Homo Sapiens
PMPIQISRQ

SEQ ID NO: 213916 - protein, 9 aa, Homo Sapiens
RHCDRHLIK

SEQ ID NO: 213917 - protein, 9 aa, Homo Sapiens
IGTVPIGEF

SEQ ID NO: 213918 - protein, 9 aa, Homo Sapiens
HAGPSGCGV

SEQ ID NO: 213919 - protein, 9 aa, Homo Sapiens
GWWISNDRL

SEQ ID NO: 213920 - protein, 9 aa, Homo Sapiens
ESGTGKTES

SEQ ID NO: 213921 - protein, 9 aa, Homo Sapiens
IWDILPDTS

SEQ ID NO: 213922 - protein, 9 aa, Homo Sapiens
KEWHHIFYQ

SEQ ID NO: 213923 - protein, 9 aa, Homo Sapiens
TLAAWNEKV

SEQ ID NO: 213924 - protein, 9 aa, Homo Sapiens
AECFQDGRL

SEQ ID NO: 213925 - protein, 9 aa, Homo Sapiens
VLDKASANI

SEQ ID NO: 213926 - protein, 9 aa, Homo Sapiens
GTQQDAWQE

SEQ ID NO: 213927 - protein, 9 aa, Homo Sapiens
GAGAVAVDL

SEQ ID NO: 213928 - protein, 9 aa, Homo Sapiens
GQTKVKSVF

SEQ ID NO: 213929 - protein, 9 aa, Homo Sapiens
AIMWLTMSS

SEQ ID NO: 213930 - protein, 9 aa, Homo Sapiens
IVRIASIAV

SEQ ID NO: 213931 - protein, 9 aa, Homo Sapiens
PSPLVAPRQ

SEQ ID NO: 213932 - protein, 9 aa, Homo Sapiens
VWVIGGGGG

SEQ ID NO: 213933 - protein, 9 aa, Homo Sapiens
YCSFKCLNS

SEQ ID NO: 213934 - protein, 9 aa, Homo Sapiens
RRQHCYPPT

SEQ ID NO: 213935 - protein, 9 aa, Homo Sapiens
GGSQCRWLL

SEQ ID NO: 213936 - protein, 9 aa, Homo Sapiens
GHDSPGCVI

SEQ ID NO: 213937 - protein, 9 aa, Homo Sapiens
AASSAGSSW

SEQ ID NO: 213938 - protein, 9 aa, Homo Sapiens
SMPILGHSL

SEQ ID NO: 213939 - protein, 9 aa, Homo Sapiens
RHCLWLWCR

SEQ ID NO: 213940 - protein, 9 aa, Homo Sapiens
DVNLLCVPR

SEQ ID NO: 213941 - protein, 9 aa, Homo Sapiens
RAYPPLSVI

SEQ ID NO: 213942 - protein, 9 aa, Homo Sapiens
HTQDVISDL

SEQ ID NO: 213943 - protein, 9 aa, Homo Sapiens
IKTYLTITD

SEQ ID NO: 213944 - protein, 9 aa, Homo Sapiens
ICIVGKSLW

SEQ ID NO: 213945 - protein, 9 aa, Homo Sapiens
VKCDYTLGK

SEQ ID NO: 213946 - protein, 9 aa, Homo Sapiens
IFRSGPWMM

SEQ ID NO: 213947 - protein, 9 aa, Homo Sapiens
FSMDVPMSD

SEQ ID NO: 213948 - protein, 9 aa, Homo Sapiens
PTCENKTYS

SEQ ID NO: 213949 - protein, 9 aa, Homo Sapiens
QHTGQPQGS

SEQ ID NO: 213950 - protein, 9 aa, Homo Sapiens
VVALQLPRA

SEQ ID NO: 213951 - protein, 9 aa, Homo Sapiens
RVRIEKAYA

SEQ ID NO: 213952 - protein, 9 aa, Homo Sapiens
TKFCNDHVS

SEQ ID NO: 213953 - protein, 9 aa, Homo Sapiens
ERSEQNRSS

SEQ ID NO: 213954 - protein, 9 aa, Homo Sapiens
QPPHHLVPL

SEQ ID NO: 213955 - protein, 9 aa, Homo Sapiens
SPGCVICSP

SEQ ID NO: 213956 - protein, 9 aa, Homo Sapiens
RNPRQPATR

SEQ ID NO: 213957 - protein, 9 aa, Homo Sapiens
GVLKDRGWW

SEQ ID NO: 213958 - protein, 9 aa, Homo Sapiens
NPPGCALPA

SEQ ID NO: 213959 - protein, 9 aa, Homo Sapiens
VKQVQGLID

SEQ ID NO: 213960 - protein, 9 aa, Homo Sapiens
QPPGCSWRS

SEQ ID NO: 213961 - protein, 9 aa, Homo Sapiens
CLDLPGTFI

SEQ ID NO: 213962 - protein, 9 aa, Homo Sapiens
CDPGVPIGL

SEQ ID NO: 213963 - protein, 9 aa, Homo Sapiens
IDAQQRPAQ

SEQ ID NO: 213964 - protein, 9 aa, Homo Sapiens
ILEDSSEIQ

SEQ ID NO: 213965 - protein, 9 aa, Homo Sapiens
KRFRHLALM

SEQ ID NO: 213966 - protein, 9 aa, Homo Sapiens
AGCVCGVAY

SEQ ID NO: 213967 - protein, 9 aa, Homo Sapiens
CPRSKSQRS

SEQ ID NO: 213968 - protein, 9 aa, Homo Sapiens
LLGDLDRNT

SEQ ID NO: 213969 - protein, 9 aa, Homo Sapiens
ARSSALASK

SEQ ID NO: 213970 - protein, 9 aa, Homo Sapiens
VVHSTEQGT

SEQ ID NO: 213971 - protein, 9 aa, Homo Sapiens
DLLGPLNTG

SEQ ID NO: 213972 - protein, 9 aa, Homo Sapiens
AEVFKENDG

SEQ ID NO: 213973 - protein, 9 aa, Homo Sapiens
WTLSSVAQT

SEQ ID NO: 213974 - protein, 9 aa, Homo Sapiens
EKKKKRTRI

SEQ ID NO: 213975 - protein, 9 aa, Homo Sapiens
QYVGVSADL

SEQ ID NO: 213976 - protein, 9 aa, Homo Sapiens
TDPAPLSPE

SEQ ID NO: 213977 - protein, 9 aa, Homo Sapiens
CRPTTVRKA

SEQ ID NO: 213978 - protein, 9 aa, Homo Sapiens
STEVNSPPP

SEQ ID NO: 213979 - protein, 9 aa, Homo Sapiens
YHRALQHHS

SEQ ID NO: 213980 - protein, 9 aa, Homo Sapiens
TLLGQELWL

SEQ ID NO: 213981 - protein, 9 aa, Homo Sapiens
PFYTNDRNI

SEQ ID NO: 213982 - protein, 9 aa, Homo Sapiens
GVWVGAQEA

SEQ ID NO: 213983 - protein, 9 aa, Homo Sapiens
RPYTLTGGH

SEQ ID NO: 213984 - protein, 9 aa, Homo Sapiens
LSGLAGGAQ

SEQ ID NO: 213985 - protein, 9 aa, Homo Sapiens
ALRIVCFTK

SEQ ID NO: 213986 - protein, 9 aa, Homo Sapiens
GGPPSSSRT

SEQ ID NO: 213987 - protein, 9 aa, Homo Sapiens
FPALLFHGL

SEQ ID NO: 213988 - protein, 9 aa, Homo Sapiens
LSMDVNLLC

SEQ ID NO: 213989 - protein, 9 aa, Homo Sapiens
DMAITMALM

SEQ ID NO: 213990 - protein, 9 aa, Homo Sapiens
PGTHPTLKD

SEQ ID NO: 213991 - protein, 9 aa, Homo Sapiens
ILYAAPSSA

SEQ ID NO: 213992 - protein, 9 aa, Homo Sapiens
VELKTVRLP

SEQ ID NO: 213993 - protein, 9 aa, Homo Sapiens
PRGRGGRGA

SEQ ID NO: 213994 - protein, 9 aa, Homo Sapiens
EWHHIFYQD

SEQ ID NO: 213995 - protein, 9 aa, Homo Sapiens
LRRRRRLLV

SEQ ID NO: 213996 - protein, 9 aa, Homo Sapiens
KKRQKPLIS

SEQ ID NO: 213997 - protein, 9 aa, Homo Sapiens
KQAQLIVEQ

SEQ ID NO: 213998 - protein, 9 aa, Homo Sapiens
VSPEPPRPH

SEQ ID NO: 213999 - protein, 9 aa, Homo Sapiens
GTLLSGDYH

SEQ ID NO: 214000 - protein, 9 aa, Homo Sapiens
DCSINSVHD

SEQ ID NO: 214001 - protein, 9 aa, Homo Sapiens
TDIKIFKEP

SEQ ID NO: 214002 - protein, 9 aa, Homo Sapiens
ICDASQGLV

SEQ ID NO: 214003 - protein, 9 aa, Homo Sapiens
ARLVLASLQ

SEQ ID NO: 214004 - protein, 9 aa, Homo Sapiens
AFHIKSIAA

SEQ ID NO: 214005 - protein, 9 aa, Homo Sapiens
PDCYIHNSV

SEQ ID NO: 214006 - protein, 9 aa, Homo Sapiens
LQRTHPKGE

SEQ ID NO: 214007 - protein, 9 aa, Homo Sapiens
TTVTAGQTQ

SEQ ID NO: 214008 - protein, 9 aa, Homo Sapiens
LFYIVLDYF

SEQ ID NO: 214009 - protein, 9 aa, Homo Sapiens
YQTLNLMRQ

SEQ ID NO: 214010 - protein, 9 aa, Homo Sapiens
TVAYVRATL

SEQ ID NO: 214011 - protein, 9 aa, Homo Sapiens
TLQPLDHEE

SEQ ID NO: 214012 - protein, 9 aa, Homo Sapiens
AVNDVQLLQ

SEQ ID NO: 214013 - protein, 9 aa, Homo Sapiens
HHLLLYHTP

SEQ ID NO: 214014 - protein, 9 aa, Homo Sapiens
QISHTSKSP

SEQ ID NO: 214015 - protein, 9 aa, Homo Sapiens
LNSPGRGGG

SEQ ID NO: 214016 - protein, 9 aa, Homo Sapiens
PIDTSQYSK

SEQ ID NO: 214017 - protein, 9 aa, Homo Sapiens
FSRARCCRP

SEQ ID NO: 214018 - protein, 9 aa, Homo Sapiens
AFQVVQTML

SEQ ID NO: 214019 - protein, 9 aa, Homo Sapiens
AGQSQPCVD

SEQ ID NO: 214020 - protein, 9 aa, Homo Sapiens
AEQRTDIFG

SEQ ID NO: 214021 - protein, 9 aa, Homo Sapiens
VIIDCRCPY

SEQ ID NO: 214022 - protein, 9 aa, Homo Sapiens
SGFSGSLGT

SEQ ID NO: 214023 - protein, 9 aa, Homo Sapiens
WPAGPNSWR

SEQ ID NO: 214024 - protein, 9 aa, Homo Sapiens
CPQPPHVPR

SEQ ID NO: 214025 - protein, 9 aa, Homo Sapiens
TAGHCTSSS

SEQ ID NO: 214026 - protein, 9 aa, Homo Sapiens
LALLGLYPV

SEQ ID NO: 214027 - protein, 9 aa, Homo Sapiens
SESVQRATA

SEQ ID NO: 214028 - protein, 9 aa, Homo Sapiens
PRSSPPSPP

SEQ ID NO: 214029 - protein, 9 aa, Homo Sapiens
QIWEIPEGG

SEQ ID NO: 214030 - protein, 9 aa, Homo Sapiens
AIWLAPSLH

SEQ ID NO: 214031 - protein, 9 aa, Homo Sapiens
TSRLWPHSK

SEQ ID NO: 214032 - protein, 9 aa, Homo Sapiens
KEEAHEFGN

SEQ ID NO: 214033 - protein, 9 aa, Homo Sapiens
GCASCPSPP

SEQ ID NO: 214034 - protein, 9 aa, Homo Sapiens
IPQGVVMKM

SEQ ID NO: 214035 - protein, 9 aa, Homo Sapiens
CSAASSTGT

SEQ ID NO: 214036 - protein, 9 aa, Homo Sapiens
LEEMEGIRG

SEQ ID NO: 214037 - protein, 9 aa, Homo Sapiens
LTTVEDLYL

SEQ ID NO: 214038 - protein, 9 aa, Homo Sapiens
PPEAKLLVA

SEQ ID NO: 214039 - protein, 9 aa, Homo Sapiens
FHIKSIAAA

SEQ ID NO: 214040 - protein, 9 aa, Homo Sapiens
SCWTWMTWC

SEQ ID NO: 214041 - protein, 9 aa, Homo Sapiens
GEGGKPCPT

SEQ ID NO: 214042 - protein, 9 aa, Homo Sapiens
PLKLLKNQK

SEQ ID NO: 214043 - protein, 9 aa, Homo Sapiens
ASTGMWTLV

SEQ ID NO: 214044 - protein, 9 aa, Homo Sapiens
PSPDIQCDD

SEQ ID NO: 214045 - protein, 9 aa, Homo Sapiens
GSAFCSGCL

SEQ ID NO: 214046 - protein, 9 aa, Homo Sapiens
SVDLNDQDR

SEQ ID NO: 214047 - protein, 9 aa, Homo Sapiens
GVKRRHHKH

SEQ ID NO: 214048 - protein, 9 aa, Homo Sapiens
HEERQYRCK

SEQ ID NO: 214049 - protein, 9 aa, Homo Sapiens
LSGSTPTAS

SEQ ID NO: 214050 - protein, 9 aa, Homo Sapiens
HGREEAIMK

SEQ ID NO: 214051 - protein, 9 aa, Homo Sapiens
TGFLGMVTG

SEQ ID NO: 214052 - protein, 9 aa, Homo Sapiens
KMCAHLFTA

SEQ ID NO: 214053 - protein, 9 aa, Homo Sapiens
IRHHNSLPR

SEQ ID NO: 214054 - protein, 9 aa, Homo Sapiens
RSWAASRRR

SEQ ID NO: 214055 - protein, 9 aa, Homo Sapiens
PTSPYLNDD

SEQ ID NO: 214056 - protein, 9 aa, Homo Sapiens
LIFTCETSG

SEQ ID NO: 214057 - protein, 9 aa, Homo Sapiens
APSSPTHGP

SEQ ID NO: 214058 - protein, 9 aa, Homo Sapiens
AHRKGGCDS

SEQ ID NO: 214059 - protein, 9 aa, Homo Sapiens
CVIDTIVRI

SEQ ID NO: 214060 - protein, 9 aa, Homo Sapiens
KPDRRRELY

SEQ ID NO: 214061 - protein, 9 aa, Homo Sapiens
VSPSNSLMA

SEQ ID NO: 214062 - protein, 9 aa, Homo Sapiens
LLAAVHAWR

SEQ ID NO: 214063 - protein, 9 aa, Homo Sapiens
RAHTGWAHS

SEQ ID NO: 214064 - protein, 9 aa, Homo Sapiens
KLLSETGKR

SEQ ID NO: 214065 - protein, 9 aa, Homo Sapiens
QTPSRGFGR

SEQ ID NO: 214066 - protein, 9 aa, Homo Sapiens
ALHLRRSLS

SEQ ID NO: 214067 - protein, 9 aa, Homo Sapiens
ATQVRSSGS

SEQ ID NO: 214068 - protein, 9 aa, Homo Sapiens
HGSSSNPLI

SEQ ID NO: 214069 - protein, 9 aa, Homo Sapiens
LLAPKTTLP

SEQ ID NO: 214070 - protein, 9 aa, Homo Sapiens
EPAAMTQMQ

SEQ ID NO: 214071 - protein, 9 aa, Homo Sapiens
KFYFAWMML

SEQ ID NO: 214072 - protein, 9 aa, Homo Sapiens
WLRNRIQCC

SEQ ID NO: 214073 - protein, 9 aa, Homo Sapiens
SRKVTELRQ

SEQ ID NO: 214074 - protein, 9 aa, Homo Sapiens
NNGNLGRIV

SEQ ID NO: 214075 - protein, 9 aa, Homo Sapiens
LGGGLGGKR

SEQ ID NO: 214076 - protein, 9 aa, Homo Sapiens
APLACLHLP

SEQ ID NO: 214077 - protein, 9 aa, Homo Sapiens
ECPISARSL

SEQ ID NO: 214078 - protein, 9 aa, Homo Sapiens
FILPLLLSK

SEQ ID NO: 214079 - protein, 9 aa, Homo Sapiens
VGSGGVCQR

SEQ ID NO: 214080 - protein, 9 aa, Homo Sapiens
KKEEPIDTS

SEQ ID NO: 214081 - protein, 9 aa, Homo Sapiens
DHQDYREVC

SEQ ID NO: 214082 - protein, 9 aa, Homo Sapiens
VEQLVKCSH

SEQ ID NO: 214083 - protein, 9 aa, Homo Sapiens
VQHQPDVVV

SEQ ID NO: 214084 - protein, 9 aa, Homo Sapiens
LKSVKGGAE

SEQ ID NO: 214085 - protein, 9 aa, Homo Sapiens
RTSATCTWT

SEQ ID NO: 214086 - protein, 9 aa, Homo Sapiens
GGGAPRALQ

SEQ ID NO: 214087 - protein, 9 aa, Homo Sapiens
IGAFKHYPI

SEQ ID NO: 214088 - protein, 9 aa, Homo Sapiens
RNIDQEEQL

SEQ ID NO: 214089 - protein, 9 aa, Homo Sapiens
YPGYDVEIK

SEQ ID NO: 214090 - protein, 9 aa, Homo Sapiens
PDSQWPPCA

SEQ ID NO: 214091 - protein, 9 aa, Homo Sapiens
IPLPQRLFR

SEQ ID NO: 214092 - protein, 9 aa, Homo Sapiens
EALLHFGLP

SEQ ID NO: 214093 - protein, 9 aa, Homo Sapiens
PFQEKRIHF

SEQ ID NO: 214094 - protein, 9 aa, Homo Sapiens
FAQKVRPRR

SEQ ID NO: 214095 - protein, 9 aa, Homo Sapiens
TWCGWLCPT

SEQ ID NO: 214096 - protein, 9 aa, Homo Sapiens
STGGHTHTP

SEQ ID NO: 214097 - protein, 9 aa, Homo Sapiens
AYYQTLNLM

SEQ ID NO: 214098 - protein, 9 aa, Homo Sapiens
RRHMIPETN

SEQ ID NO: 214099 - protein, 9 aa, Homo Sapiens
HCLCRSGFA

SEQ ID NO: 214100 - protein, 9 aa, Homo Sapiens
LISGESGTG

SEQ ID NO: 214101 - protein, 9 aa, Homo Sapiens
RDIEQHNAG

SEQ ID NO: 214102 - protein, 9 aa, Homo Sapiens
PTPSASTHT

SEQ ID NO: 214103 - protein, 9 aa, Homo Sapiens
VSAQSLLRL

SEQ ID NO: 214104 - protein, 9 aa, Homo Sapiens
DCQLLQQMC

SEQ ID NO: 214105 - protein, 9 aa, Homo Sapiens
SFSCVSLLI

SEQ ID NO: 214106 - protein, 9 aa, Homo Sapiens
DDVGCVGIE

SEQ ID NO: 214107 - protein, 9 aa, Homo Sapiens
MLRSEIDHV

SEQ ID NO: 214108 - protein, 9 aa, Homo Sapiens
VNVVSTKEV

SEQ ID NO: 214109 - protein, 9 aa, Homo Sapiens
PPYLGYHFL

SEQ ID NO: 214110 - protein, 9 aa, Homo Sapiens
SAIKQVVNA

SEQ ID NO: 214111 - protein, 9 aa, Homo Sapiens
DHKINHLCC

SEQ ID NO: 214112 - protein, 9 aa, Homo Sapiens
VSLLDPPET

SEQ ID NO: 214113 - protein, 9 aa, Homo Sapiens
RQISLPLRG

SEQ ID NO: 214114 - protein, 9 aa, Homo Sapiens
HAHRKGGCD

SEQ ID NO: 214115 - protein, 9 aa, Homo Sapiens
PLAHQHRLL

SEQ ID NO: 214116 - protein, 9 aa, Homo Sapiens
IHDRDQSEA

SEQ ID NO: 214117 - protein, 9 aa, Homo Sapiens
ADKNEDLGH

SEQ ID NO: 214118 - protein, 9 aa, Homo Sapiens
GRGDRPIRH

SEQ ID NO: 214119 - protein, 9 aa, Homo Sapiens
KHVLAHQPG

SEQ ID NO: 214120 - protein, 9 aa, Homo Sapiens
LGLHGLLAL

SEQ ID NO: 214121 - protein, 9 aa, Homo Sapiens
SWVRKGQLH

SEQ ID NO: 214122 - protein, 9 aa, Homo Sapiens
PEAAAPALP

SEQ ID NO: 214123 - protein, 9 aa, Homo Sapiens
DIMATEMAH

SEQ ID NO: 214124 - protein, 9 aa, Homo Sapiens
KGGEQAQVT

SEQ ID NO: 214125 - protein, 9 aa, Homo Sapiens
AAGVQFGEV

SEQ ID NO: 214126 - protein, 9 aa, Homo Sapiens
QHLLFEAWL

SEQ ID NO: 214127 - protein, 9 aa, Homo Sapiens
SNSHYALEL

SEQ ID NO: 214128 - protein, 9 aa, Homo Sapiens
RGQSAKSGS

SEQ ID NO: 214129 - protein, 9 aa, Homo Sapiens
LMTTSNEGS

SEQ ID NO: 214130 - protein, 9 aa, Homo Sapiens
SPSNSLMAG

SEQ ID NO: 214131 - protein, 9 aa, Homo Sapiens
ESVFDCSIN

SEQ ID NO: 214132 - protein, 9 aa, Homo Sapiens
HSLVHGLTL

SEQ ID NO: 214133 - protein, 9 aa, Homo Sapiens
RVQARDRAT

SEQ ID NO: 214134 - protein, 9 aa, Homo Sapiens
QCLMTVAEG

SEQ ID NO: 214135 - protein, 9 aa, Homo Sapiens
SWRGQCNTT

SEQ ID NO: 214136 - protein, 9 aa, Homo Sapiens
IIPQGVVMK

SEQ ID NO: 214137 - protein, 9 aa, Homo Sapiens
DTGKSDPES

SEQ ID NO: 214138 - protein, 9 aa, Homo Sapiens
PPSPPQRRP

SEQ ID NO: 214139 - protein, 9 aa, Homo Sapiens
LRSSGKKIA

SEQ ID NO: 214140 - protein, 9 aa, Homo Sapiens
IEASLSDCP

SEQ ID NO: 214141 - protein, 9 aa, Homo Sapiens
TEYVPLLNS

SEQ ID NO: 214142 - protein, 9 aa, Homo Sapiens
KNSGSQSGT

SEQ ID NO: 214143 - protein, 9 aa, Homo Sapiens
ERQYRCKDC

SEQ ID NO: 214144 - protein, 9 aa, Homo Sapiens
NMNIKGVDV

SEQ ID NO: 214145 - protein, 9 aa, Homo Sapiens
GQQEQLLMQ

SEQ ID NO: 214146 - protein, 9 aa, Homo Sapiens
IQLKAYFLG

SEQ ID NO: 214147 - protein, 9 aa, Homo Sapiens
FCWARVGPL

SEQ ID NO: 214148 - protein, 9 aa, Homo Sapiens
LSVPLSCPL

SEQ ID NO: 214149 - protein, 9 aa, Homo Sapiens
PCPNLLPAP

SEQ ID NO: 214150 - protein, 9 aa, Homo Sapiens
SPPSPPQRR

SEQ ID NO: 214151 - protein, 9 aa, Homo Sapiens
EAEVNVVST

SEQ ID NO: 214152 - protein, 9 aa, Homo Sapiens
SGILRKQHL

SEQ ID NO: 214153 - protein, 9 aa, Homo Sapiens
RNARNCPIG

SEQ ID NO: 214154 - protein, 9 aa, Homo Sapiens
GTVIPSNED

SEQ ID NO: 214155 - protein, 9 aa, Homo Sapiens
PHGFNRQPP

SEQ ID NO: 214156 - protein, 9 aa, Homo Sapiens
DWETVSAAS

SEQ ID NO: 214157 - protein, 9 aa, Homo Sapiens
SQVHHMLHL

SEQ ID NO: 214158 - protein, 9 aa, Homo Sapiens
MINREGIPL

SEQ ID NO: 214159 - protein, 9 aa, Homo Sapiens
AEEEPPRLL

SEQ ID NO: 214160 - protein, 9 aa, Homo Sapiens
MLTHKSFIN

SEQ ID NO: 214161 - protein, 9 aa, Homo Sapiens
AQLIVEQKV

SEQ ID NO: 214162 - protein, 9 aa, Homo Sapiens
CGPWTRNPR

SEQ ID NO: 214163 - protein, 9 aa, Homo Sapiens
EETGVVAAM

SEQ ID NO: 214164 - protein, 9 aa, Homo Sapiens
DWSPEAPRY

SEQ ID NO: 214165 - protein, 9 aa, Homo Sapiens
GGRGQSAKS

SEQ ID NO: 214166 - protein, 9 aa, Homo Sapiens
PWTRNPRQP

SEQ ID NO: 214167 - protein, 9 aa, Homo Sapiens
FNTGGRGFK

SEQ ID NO: 214168 - protein, 9 aa, Homo Sapiens
VAEGHLEGL

SEQ ID NO: 214169 - protein, 9 aa, Homo Sapiens
DFIFVLDIV

SEQ ID NO: 214170 - protein, 9 aa, Homo Sapiens
LKCQDSKQA

SEQ ID NO: 214171 - protein, 9 aa, Homo Sapiens
RWLRKQNIW

SEQ ID NO: 214172 - protein, 9 aa, Homo Sapiens
ECPISAQSL

SEQ ID NO: 214173 - protein, 9 aa, Homo Sapiens
EFENPEVSR

SEQ ID NO: 214174 - protein, 9 aa, Homo Sapiens
EEDQNPPRP

SEQ ID NO: 214175 - protein, 9 aa, Homo Sapiens
WYQQQLHRV

SEQ ID NO: 214176 - protein, 9 aa, Homo Sapiens
CTKHDRQFD

SEQ ID NO: 214177 - protein, 9 aa, Homo Sapiens
VICITFYYF

SEQ ID NO: 214178 - protein, 9 aa, Homo Sapiens
APVQEGPGS

SEQ ID NO: 214179 - protein, 9 aa, Homo Sapiens
FILFFINAL

SEQ ID NO: 214180 - protein, 9 aa, Homo Sapiens
LLPVSYTAP

SEQ ID NO: 214181 - protein, 9 aa, Homo Sapiens
VTLEKCGYN

SEQ ID NO: 214182 - protein, 9 aa, Homo Sapiens
LGTCSVPPC

SEQ ID NO: 214183 - protein, 9 aa, Homo Sapiens
TSVQHGSCA

SEQ ID NO: 214184 - protein, 9 aa, Homo Sapiens
QQETLTTVH

SEQ ID NO: 214185 - protein, 9 aa, Homo Sapiens
LDFQYSHLQ

SEQ ID NO: 214186 - protein, 9 aa, Homo Sapiens
WQEEEGLRL

SEQ ID NO: 214187 - protein, 9 aa, Homo Sapiens
LAKDLFYIV

SEQ ID NO: 214188 - protein, 9 aa, Homo Sapiens
PLSPLGLAL

SEQ ID NO: 214189 - protein, 9 aa, Homo Sapiens
HQLEHSHQI

SEQ ID NO: 214190 - protein, 9 aa, Homo Sapiens
SPLALALSS

SEQ ID NO: 214191 - protein, 9 aa, Homo Sapiens
TAVFILLVT

SEQ ID NO: 214192 - protein, 9 aa, Homo Sapiens
RATQDNPRT

SEQ ID NO: 214193 - protein, 9 aa, Homo Sapiens
RSLLRLECP

SEQ ID NO: 214194 - protein, 9 aa, Homo Sapiens
DMKQALMMM

SEQ ID NO: 214195 - protein, 9 aa, Homo Sapiens
LILILADMS

SEQ ID NO: 214196 - protein, 9 aa, Homo Sapiens
SATGARWPP

SEQ ID NO: 214197 - protein, 9 aa, Homo Sapiens
ATRITRAHT

SEQ ID NO: 214198 - protein, 9 aa, Homo Sapiens
RTPRGRAPQ

SEQ ID NO: 214199 - protein, 9 aa, Homo Sapiens
SGVLEWCIG

SEQ ID NO: 214200 - protein, 9 aa, Homo Sapiens
QDAGHAGGR

SEQ ID NO: 214201 - protein, 9 aa, Homo Sapiens
CGQGSVLLW

SEQ ID NO: 214202 - protein, 9 aa, Homo Sapiens
QQHEVAGAV

SEQ ID NO: 214203 - protein, 9 aa, Homo Sapiens
ASHQKAARA

SEQ ID NO: 214204 - protein, 9 aa, Homo Sapiens
HAHNHPKRG

SEQ ID NO: 214205 - protein, 9 aa, Homo Sapiens
FVGQISTLV

SEQ ID NO: 214206 - protein, 9 aa, Homo Sapiens
RWRMNEEMD

SEQ ID NO: 214207 - protein, 9 aa, Homo Sapiens
ILTSTNSDQ

SEQ ID NO: 214208 - protein, 9 aa, Homo Sapiens
RAPRSWPRP

SEQ ID NO: 214209 - protein, 9 aa, Homo Sapiens
WSPYKRDNT

SEQ ID NO: 214210 - protein, 9 aa, Homo Sapiens
SLPETALKQ

SEQ ID NO: 214211 - protein, 9 aa, Homo Sapiens
EETEVGATE

SEQ ID NO: 214212 - protein, 9 aa, Homo Sapiens
SSTTPPASS

SEQ ID NO: 214213 - protein, 9 aa, Homo Sapiens
SEATQAEAA

SEQ ID NO: 214214 - protein, 9 aa, Homo Sapiens
SANQSKEVT

SEQ ID NO: 214215 - protein, 9 aa, Homo Sapiens
FQQYKKKSG

SEQ ID NO: 214216 - protein, 9 aa, Homo Sapiens
AVDQEGCII

SEQ ID NO: 214217 - protein, 9 aa, Homo Sapiens
GAVQQAQGG

SEQ ID NO: 214218 - protein, 9 aa, Homo Sapiens
RGHYHFRAP

SEQ ID NO: 214219 - protein, 9 aa, Homo Sapiens
VAVAATDAH

SEQ ID NO: 214220 - protein, 9 aa, Homo Sapiens
EPNPSVTDA

SEQ ID NO: 214221 - protein, 9 aa, Homo Sapiens
PHAQAPQLL

SEQ ID NO: 214222 - protein, 9 aa, Homo Sapiens
CVRPRARVH

SEQ ID NO: 214223 - protein, 9 aa, Homo Sapiens
WSLLKDYDP

SEQ ID NO: 214224 - protein, 9 aa, Homo Sapiens
TRPSRQLVG

SEQ ID NO: 214225 - protein, 9 aa, Homo Sapiens
VEEEEDDDD

SEQ ID NO: 214226 - protein, 9 aa, Homo Sapiens
SHSLALLLT

SEQ ID NO: 214227 - protein, 9 aa, Homo Sapiens
DKVHVWQLY

SEQ ID NO: 214228 - protein, 9 aa, Homo Sapiens
APRALSVLL

SEQ ID NO: 214229 - protein, 9 aa, Homo Sapiens
VWRPHHGKA

SEQ ID NO: 214230 - protein, 9 aa, Homo Sapiens
LGPGSGYPW

SEQ ID NO: 214231 - protein, 9 aa, Homo Sapiens
GTWTAWMPC

SEQ ID NO: 214232 - protein, 9 aa, Homo Sapiens
FLLFFSFIH

SEQ ID NO: 214233 - protein, 9 aa, Homo Sapiens
AFLDQPHML

SEQ ID NO: 214234 - protein, 9 aa, Homo Sapiens
KLKKDTSVN

SEQ ID NO: 214235 - protein, 9 aa, Homo Sapiens
GQYSPLRAY

SEQ ID NO: 214236 - protein, 9 aa, Homo Sapiens
GRPIYPNHR

SEQ ID NO: 214237 - protein, 9 aa, Homo Sapiens
QPIYRSSLS

SEQ ID NO: 214238 - protein, 9 aa, Homo Sapiens
QLRLNTGMD

SEQ ID NO: 214239 - protein, 9 aa, Homo Sapiens
GFAKQLRVG

SEQ ID NO: 214240 - protein, 9 aa, Homo Sapiens
SSSTAKGPP

SEQ ID NO: 214241 - protein, 9 aa, Homo Sapiens
TPWLCQSTE

SEQ ID NO: 214242 - protein, 9 aa, Homo Sapiens
LSVTLVDIY

SEQ ID NO: 214243 - protein, 9 aa, Homo Sapiens
WERAQKVVT

SEQ ID NO: 214244 - protein, 9 aa, Homo Sapiens
PMVPGETGL

SEQ ID NO: 214245 - protein, 9 aa, Homo Sapiens
LCTALLNVP

SEQ ID NO: 214246 - protein, 9 aa, Homo Sapiens
NCMDCLDHT

SEQ ID NO: 214247 - protein, 9 aa, Homo Sapiens
SQREAEWKE

SEQ ID NO: 214248 - protein, 9 aa, Homo Sapiens
SYKVKVMGL

SEQ ID NO: 214249 - protein, 9 aa, Homo Sapiens
LTPQQVQEL

SEQ ID NO: 214250 - protein, 9 aa, Homo Sapiens
TWRGRRRER

SEQ ID NO: 214251 - protein, 9 aa, Homo Sapiens
TGLRKARME

SEQ ID NO: 214252 - protein, 9 aa, Homo Sapiens
TIKTYLTIT

SEQ ID NO: 214253 - protein, 9 aa, Homo Sapiens
TSTRIDRLE

SEQ ID NO: 214254 - protein, 9 aa, Homo Sapiens
YWLLFRQDF

SEQ ID NO: 214255 - protein, 9 aa, Homo Sapiens
QGNKSHPPE

SEQ ID NO: 214256 - protein, 9 aa, Homo Sapiens
ILSIMLSED

SEQ ID NO: 214257 - protein, 9 aa, Homo Sapiens
LGNRLRLQG

SEQ ID NO: 214258 - protein, 9 aa, Homo Sapiens
PQCPPDGCY

SEQ ID NO: 214259 - protein, 9 aa, Homo Sapiens
GMPNSLNQG

SEQ ID NO: 214260 - protein, 9 aa, Homo Sapiens
PLRPGAPGL

SEQ ID NO: 214261 - protein, 9 aa, Homo Sapiens
AMTQMQGEE

SEQ ID NO: 214262 - protein, 9 aa, Homo Sapiens
GLRCQRRDT

SEQ ID NO: 214263 - protein, 9 aa, Homo Sapiens
GLQFLQRHC

SEQ ID NO: 214264 - protein, 9 aa, Homo Sapiens
GGDANLDRP

SEQ ID NO: 214265 - protein, 9 aa, Homo Sapiens
MITRLVVGF

SEQ ID NO: 214266 - protein, 9 aa, Homo Sapiens
DLLLPPAPK

SEQ ID NO: 214267 - protein, 9 aa, Homo Sapiens
ITMALMGGI

SEQ ID NO: 214268 - protein, 9 aa, Homo Sapiens
SKRIMRDLR

SEQ ID NO: 214269 - protein, 9 aa, Homo Sapiens
CNGQPIPFQ

SEQ ID NO: 214270 - protein, 9 aa, Homo Sapiens
PDVVVQQRH

SEQ ID NO: 214271 - protein, 9 aa, Homo Sapiens
GAKTFKKDR

SEQ ID NO: 214272 - protein, 9 aa, Homo Sapiens
DLDPKTDPR

SEQ ID NO: 214273 - protein, 9 aa, Homo Sapiens
VDMGARGLP

SEQ ID NO: 214274 - protein, 9 aa, Homo Sapiens
AFMYLSLSL

SEQ ID NO: 214275 - protein, 9 aa, Homo Sapiens
MFLVSVIFL

SEQ ID NO: 214276 - protein, 9 aa, Homo Sapiens
NAGVESVFN

SEQ ID NO: 214277 - protein, 9 aa, Homo Sapiens
RHVDQHEVR

SEQ ID NO: 214278 - protein, 9 aa, Homo Sapiens
RGPLDKTIV

SEQ ID NO: 214279 - protein, 9 aa, Homo Sapiens
FKKLMKYCH

SEQ ID NO: 214280 - protein, 9 aa, Homo Sapiens
SIWHNLSLN

SEQ ID NO: 214281 - protein, 9 aa, Homo Sapiens
VQQRHLGVV

SEQ ID NO: 214282 - protein, 9 aa, Homo Sapiens
GAPGNKLEL

SEQ ID NO: 214283 - protein, 9 aa, Homo Sapiens
WLLGTRCQL

SEQ ID NO: 214284 - protein, 9 aa, Homo Sapiens
AAKWKTPTA

SEQ ID NO: 214285 - protein, 9 aa, Homo Sapiens
RPVRLQKYP

SEQ ID NO: 214286 - protein, 9 aa, Homo Sapiens
VCANNSDTL

SEQ ID NO: 214287 - protein, 9 aa, Homo Sapiens
HELLSSTRE

SEQ ID NO: 214288 - protein, 9 aa, Homo Sapiens
RRGSISSGI

SEQ ID NO: 214289 - protein, 9 aa, Homo Sapiens
VSVYCLQTP

SEQ ID NO: 214290 - protein, 9 aa, Homo Sapiens
KLLKNQKYQ

SEQ ID NO: 214291 - protein, 9 aa, Homo Sapiens
PPSSRTGRP

SEQ ID NO: 214292 - protein, 9 aa, Homo Sapiens
PIGLDFQYS

SEQ ID NO: 214293 - protein, 9 aa, Homo Sapiens
SHYALELTL

SEQ ID NO: 214294 - protein, 9 aa, Homo Sapiens
SSTSCSTAA

SEQ ID NO: 214295 - protein, 9 aa, Homo Sapiens
ILKDIGEFI

SEQ ID NO: 214296 - protein, 9 aa, Homo Sapiens
YSCVHFLLH

SEQ ID NO: 214297 - protein, 9 aa, Homo Sapiens
CEPCSPNVH

SEQ ID NO: 214298 - protein, 9 aa, Homo Sapiens
PVNHLTEGS

SEQ ID NO: 214299 - protein, 9 aa, Homo Sapiens
NVACLINEH

SEQ ID NO: 214300 - protein, 9 aa, Homo Sapiens
QELLATSAV

SEQ ID NO: 214301 - protein, 9 aa, Homo Sapiens
GVSADLKGG

SEQ ID NO: 214302 - protein, 9 aa, Homo Sapiens
QLRVGNGLL

SEQ ID NO: 214303 - protein, 9 aa, Homo Sapiens
NERYNFPNP

SEQ ID NO: 214304 - protein, 9 aa, Homo Sapiens
GVHPHPHPM

SEQ ID NO: 214305 - protein, 9 aa, Homo Sapiens
TLVMFAWYR

SEQ ID NO: 214306 - protein, 9 aa, Homo Sapiens
GPSCRILDN

SEQ ID NO: 214307 - protein, 9 aa, Homo Sapiens
HQGVGSSRL

SEQ ID NO: 214308 - protein, 9 aa, Homo Sapiens
YDPWMPSSL

SEQ ID NO: 214309 - protein, 9 aa, Homo Sapiens
TPLLNPLIH

SEQ ID NO: 214310 - protein, 9 aa, Homo Sapiens
DKVVAEGHL

SEQ ID NO: 214311 - protein, 9 aa, Homo Sapiens
MATDRRHLG

SEQ ID NO: 214312 - protein, 9 aa, Homo Sapiens
NRRLQRTLA

SEQ ID NO: 214313 - protein, 9 aa, Homo Sapiens
EKTRTVSSP

SEQ ID NO: 214314 - protein, 9 aa, Homo Sapiens
KKLLSEEPS

SEQ ID NO: 214315 - protein, 9 aa, Homo Sapiens
AHVCTGEHY

SEQ ID NO: 214316 - protein, 9 aa, Homo Sapiens
PSLGSQPIY

SEQ ID NO: 214317 - protein, 9 aa, Homo Sapiens
GEGNHHHPD

SEQ ID NO: 214318 - protein, 9 aa, Homo Sapiens
DLSGLRVKG

SEQ ID NO: 214319 - protein, 9 aa, Homo Sapiens
ECDNENHME

SEQ ID NO: 214320 - protein, 9 aa, Homo Sapiens
EGTYNFRMT

SEQ ID NO: 214321 - protein, 9 aa, Homo Sapiens
YSREEELPR

SEQ ID NO: 214322 - protein, 9 aa, Homo Sapiens
QILQERIEL

SEQ ID NO: 214323 - protein, 9 aa, Homo Sapiens
LHVHPRNGL

SEQ ID NO: 214324 - protein, 9 aa, Homo Sapiens
TIYQIMHSC

SEQ ID NO: 214325 - protein, 9 aa, Homo Sapiens
RALKKRRIQ

SEQ ID NO: 214326 - protein, 9 aa, Homo Sapiens
IDPPTIIKG

SEQ ID NO: 214327 - protein, 9 aa, Homo Sapiens
EKYQLQVFM

SEQ ID NO: 214328 - protein, 9 aa, Homo Sapiens
MSSGFSGSL

SEQ ID NO: 214329 - protein, 9 aa, Homo Sapiens
SQRIIRWPS

SEQ ID NO: 214330 - protein, 9 aa, Homo Sapiens
WSPEAPRYT

SEQ ID NO: 214331 - protein, 9 aa, Homo Sapiens
PPSVTIHSF

SEQ ID NO: 214332 - protein, 9 aa, Homo Sapiens
PPHVPRWRC

SEQ ID NO: 214333 - protein, 9 aa, Homo Sapiens
LEPASSFVV

SEQ ID NO: 214334 - protein, 9 aa, Homo Sapiens
RLYKVQPFL

SEQ ID NO: 214335 - protein, 9 aa, Homo Sapiens
VHTQLINPL

SEQ ID NO: 214336 - protein, 9 aa, Homo Sapiens
VTLVDIYRE

SEQ ID NO: 214337 - protein, 9 aa, Homo Sapiens
WSWPPPSAQ

SEQ ID NO: 214338 - protein, 9 aa, Homo Sapiens
KQALTTGMR

SEQ ID NO: 214339 - protein, 9 aa, Homo Sapiens
PELLGGHDS

SEQ ID NO: 214340 - protein, 9 aa, Homo Sapiens
YINLWKIIK

SEQ ID NO: 214341 - protein, 9 aa, Homo Sapiens
GVVGKMRVP

SEQ ID NO: 214342 - protein, 9 aa, Homo Sapiens
FCNDHVSTA

SEQ ID NO: 214343 - protein, 9 aa, Homo Sapiens
DLSYDSTLE

SEQ ID NO: 214344 - protein, 9 aa, Homo Sapiens
KLQPRALAC

SEQ ID NO: 214345 - protein, 9 aa, Homo Sapiens
ALDVVDMAI

SEQ ID NO: 214346 - protein, 9 aa, Homo Sapiens
YPQNPWLRQ

SEQ ID NO: 214347 - protein, 9 aa, Homo Sapiens
EGHGFKQEY

SEQ ID NO: 214348 - protein, 9 aa, Homo Sapiens
IDCRCPYEY

SEQ ID NO: 214349 - protein, 9 aa, Homo Sapiens
EERVTARAG

SEQ ID NO: 214350 - protein, 9 aa, Homo Sapiens
DPAPWAERD

SEQ ID NO: 214351 - protein, 9 aa, Homo Sapiens
TNQPITLTV

SEQ ID NO: 214352 - protein, 9 aa, Homo Sapiens
NFIVHKNRI

SEQ ID NO: 214353 - protein, 9 aa, Homo Sapiens
NREGIPLDI

SEQ ID NO: 214354 - protein, 9 aa, Homo Sapiens
RKLDLLGSG

SEQ ID NO: 214355 - protein, 9 aa, Homo Sapiens
TEEKDPCSP

SEQ ID NO: 214356 - protein, 9 aa, Homo Sapiens
SSGWPNSRP

SEQ ID NO: 214357 - protein, 9 aa, Homo Sapiens
PSLFHRRRH

SEQ ID NO: 214358 - protein, 9 aa, Homo Sapiens
DLDPCFQRD

SEQ ID NO: 214359 - protein, 9 aa, Homo Sapiens
RAGHGAGAW

SEQ ID NO: 214360 - protein, 9 aa, Homo Sapiens
HLVPLFIWT

SEQ ID NO: 214361 - protein, 9 aa, Homo Sapiens
GTTSPWPSP

SEQ ID NO: 214362 - protein, 9 aa, Homo Sapiens
PQLLQGSLL

SEQ ID NO: 214363 - protein, 9 aa, Homo Sapiens
VVTDLFPVL

SEQ ID NO: 214364 - protein, 9 aa, Homo Sapiens
SVDRSVHSG

SEQ ID NO: 214365 - protein, 9 aa, Homo Sapiens
GTMEDSESV

SEQ ID NO: 214366 - protein, 9 aa, Homo Sapiens
FLFLQMLPC

SEQ ID NO: 214367 - protein, 9 aa, Homo Sapiens
TVCESAIKQ

SEQ ID NO: 214368 - protein, 9 aa, Homo Sapiens
ENSEFPLVS

SEQ ID NO: 214369 - protein, 9 aa, Homo Sapiens
TEKDVNIIE

SEQ ID NO: 214370 - protein, 9 aa, Homo Sapiens
KQLRVGNGL

SEQ ID NO: 214371 - protein, 9 aa, Homo Sapiens
TPGMPDPSL

SEQ ID NO: 214372 - protein, 9 aa, Homo Sapiens
PKRCNKKIA

SEQ ID NO: 214373 - protein, 9 aa, Homo Sapiens
RNWLTVLSC

SEQ ID NO: 214374 - protein, 9 aa, Homo Sapiens
SSGCGAPRS

SEQ ID NO: 214375 - protein, 9 aa, Homo Sapiens
ILDTTKLRQ

SEQ ID NO: 214376 - protein, 9 aa, Homo Sapiens
MLGNVAGAW

SEQ ID NO: 214377 - protein, 9 aa, Homo Sapiens
KPLLWLPCT

SEQ ID NO: 214378 - protein, 9 aa, Homo Sapiens
GWGRRWSWA

SEQ ID NO: 214379 - protein, 9 aa, Homo Sapiens
ILGDLLLNC

SEQ ID NO: 214380 - protein, 9 aa, Homo Sapiens
ASGCVVLPV

SEQ ID NO: 214381 - protein, 9 aa, Homo Sapiens
HALPDDLVE

SEQ ID NO: 214382 - protein, 9 aa, Homo Sapiens
AGPASASGD

SEQ ID NO: 214383 - protein, 9 aa, Homo Sapiens
LFYGMGFGV

SEQ ID NO: 214384 - protein, 9 aa, Homo Sapiens
LGCPKIPPP

SEQ ID NO: 214385 - protein, 9 aa, Homo Sapiens
KPEEFSVEE

SEQ ID NO: 214386 - protein, 9 aa, Homo Sapiens
LWSLGVVFR

SEQ ID NO: 214387 - protein, 9 aa, Homo Sapiens
MYILEKQRL

SEQ ID NO: 214388 - protein, 9 aa, Homo Sapiens
GTSSRYRAK

SEQ ID NO: 214389 - protein, 9 aa, Homo Sapiens
YMLAKLYEA

SEQ ID NO: 214390 - protein, 9 aa, Homo Sapiens
FRHTFWVVF

SEQ ID NO: 214391 - protein, 9 aa, Homo Sapiens
TQDGTTQGN

SEQ ID NO: 214392 - protein, 9 aa, Homo Sapiens
DIKVEQVEF

SEQ ID NO: 214393 - protein, 9 aa, Homo Sapiens
FCWRSINSS

SEQ ID NO: 214394 - protein, 9 aa, Homo Sapiens
SSTSSSLTP

SEQ ID NO: 214395 - protein, 9 aa, Homo Sapiens
SCQLSIDAS

SEQ ID NO: 214396 - protein, 9 aa, Homo Sapiens
FSHAPPVAE

SEQ ID NO: 214397 - protein, 9 aa, Homo Sapiens
FPCQPSRGR

SEQ ID NO: 214398 - protein, 9 aa, Homo Sapiens
LLLAAVHAW

SEQ ID NO: 214399 - protein, 9 aa, Homo Sapiens
TNNNNHHQP

SEQ ID NO: 214400 - protein, 9 aa, Homo Sapiens
RTRADAHNT

SEQ ID NO: 214401 - protein, 9 aa, Homo Sapiens
TIHSFSGLV

SEQ ID NO: 214402 - protein, 9 aa, Homo Sapiens
ASGQEFWPR

SEQ ID NO: 214403 - protein, 9 aa, Homo Sapiens
PECFRHAPP

SEQ ID NO: 214404 - protein, 9 aa, Homo Sapiens
RYVPVFTIH

SEQ ID NO: 214405 - protein, 9 aa, Homo Sapiens
LLWRLRGGV

SEQ ID NO: 214406 - protein, 9 aa, Homo Sapiens
KSFSCVSLL

SEQ ID NO: 214407 - protein, 9 aa, Homo Sapiens
KRVHLGPDC

SEQ ID NO: 214408 - protein, 9 aa, Homo Sapiens
NNPEIITVG

SEQ ID NO: 214409 - protein, 9 aa, Homo Sapiens
HLDFSPYWM

SEQ ID NO: 214410 - protein, 9 aa, Homo Sapiens
AEEKKSISF

SEQ ID NO: 214411 - protein, 9 aa, Homo Sapiens
LGGAPGGGG

SEQ ID NO: 214412 - protein, 9 aa, Homo Sapiens
SVDMVFSRK

SEQ ID NO: 214413 - protein, 9 aa, Homo Sapiens
MATEMAHRV

SEQ ID NO: 214414 - protein, 9 aa, Homo Sapiens
RRQRSSTTP

SEQ ID NO: 214415 - protein, 9 aa, Homo Sapiens
LKAPVRALP

SEQ ID NO: 214416 - protein, 9 aa, Homo Sapiens
AKAEPPKAL

SEQ ID NO: 214417 - protein, 9 aa, Homo Sapiens
PGRLGVAPR

SEQ ID NO: 214418 - protein, 9 aa, Homo Sapiens
GMRFQLALC

SEQ ID NO: 214419 - protein, 9 aa, Homo Sapiens
FFYGYTYCV

SEQ ID NO: 214420 - protein, 9 aa, Homo Sapiens
ALASCARPA

SEQ ID NO: 214421 - protein, 9 aa, Homo Sapiens
HAAHPADAS

SEQ ID NO: 214422 - protein, 9 aa, Homo Sapiens
RVHRCSRLV

SEQ ID NO: 214423 - protein, 9 aa, Homo Sapiens
PTPTPPPGR

SEQ ID NO: 214424 - protein, 9 aa, Homo Sapiens
AVQEVADGG

SEQ ID NO: 214425 - protein, 9 aa, Homo Sapiens
PPCTALVEH

SEQ ID NO: 214426 - protein, 9 aa, Homo Sapiens
RPLAQRPSA

SEQ ID NO: 214427 - protein, 9 aa, Homo Sapiens
QLAEQRTDI

SEQ ID NO: 214428 - protein, 9 aa, Homo Sapiens
PASSGTSAQ

SEQ ID NO: 214429 - protein, 9 aa, Homo Sapiens
WENLALIMC

SEQ ID NO: 214430 - protein, 9 aa, Homo Sapiens
EQAKDNKAQ

SEQ ID NO: 214431 - protein, 9 aa, Homo Sapiens
MASGPIQAY

SEQ ID NO: 214432 - protein, 9 aa, Homo Sapiens
GVPGTGAQT

SEQ ID NO: 214433 - protein, 9 aa, Homo Sapiens
SSALCVRPR

SEQ ID NO: 214434 - protein, 9 aa, Homo Sapiens
RVKWQEEEG

SEQ ID NO: 214435 - protein, 9 aa, Homo Sapiens
LLPVAGDLT

SEQ ID NO: 214436 - protein, 9 aa, Homo Sapiens
TNLQQLVSQ

SEQ ID NO: 214437 - protein, 9 aa, Homo Sapiens
TFDHMGHGR

SEQ ID NO: 214438 - protein, 9 aa, Homo Sapiens
GATEETEVA

SEQ ID NO: 214439 - protein, 9 aa, Homo Sapiens
GDLTSLGLH

SEQ ID NO: 214440 - protein, 9 aa, Homo Sapiens
SVKLVWTEV

SEQ ID NO: 214441 - protein, 9 aa, Homo Sapiens
RCFMKKTIN

SEQ ID NO: 214442 - protein, 9 aa, Homo Sapiens
LSGYSTLTR

SEQ ID NO: 214443 - protein, 9 aa, Homo Sapiens
NDIIRKLDL

SEQ ID NO: 214444 - protein, 9 aa, Homo Sapiens
YVNGSVSFF

SEQ ID NO: 214445 - protein, 9 aa, Homo Sapiens
AKQGAQGVG

SEQ ID NO: 214446 - protein, 9 aa, Homo Sapiens
PFRGLRGHC

SEQ ID NO: 214447 - protein, 9 aa, Homo Sapiens
EHLEAATQQ

SEQ ID NO: 214448 - protein, 9 aa, Homo Sapiens
GQTSHWCPT

SEQ ID NO: 214449 - protein, 9 aa, Homo Sapiens
HGADLDEAV

SEQ ID NO: 214450 - protein, 9 aa, Homo Sapiens
CGRCGATSS

SEQ ID NO: 214451 - protein, 9 aa, Homo Sapiens
QTFKILYLV

SEQ ID NO: 214452 - protein, 9 aa, Homo Sapiens
TFKILYLVI

SEQ ID NO: 214453 - protein, 9 aa, Homo Sapiens
TIIGAFVAA

SEQ ID NO: 214454 - protein, 9 aa, Homo Sapiens
PKLLGKGTF

SEQ ID NO: 214455 - protein, 9 aa, Homo Sapiens
SETLRCPQA

SEQ ID NO: 214456 - protein, 9 aa, Homo Sapiens
RTLGSLPLS

SEQ ID NO: 214457 - protein, 9 aa, Homo Sapiens
RRVPRGSCA

SEQ ID NO: 214458 - protein, 9 aa, Homo Sapiens
LAVRLASVL

SEQ ID NO: 214459 - protein, 9 aa, Homo Sapiens
RCGTWAWRA

SEQ ID NO: 214460 - protein, 9 aa, Homo Sapiens
LPGNCCSYS

SEQ ID NO: 214461 - protein, 9 aa, Homo Sapiens
EFMKHRRDF

SEQ ID NO: 214462 - protein, 9 aa, Homo Sapiens
PMYRSLVHS

SEQ ID NO: 214463 - protein, 9 aa, Homo Sapiens
LRCCFSPLK

SEQ ID NO: 214464 - protein, 9 aa, Homo Sapiens
GTGQDVGRS

SEQ ID NO: 214465 - protein, 9 aa, Homo Sapiens
IKLYNPPTI

SEQ ID NO: 214466 - protein, 9 aa, Homo Sapiens
LHAHNHPKR

SEQ ID NO: 214467 - protein, 9 aa, Homo Sapiens
LKEDLLYLR

SEQ ID NO: 214468 - protein, 9 aa, Homo Sapiens
DNTLNDITS

SEQ ID NO: 214469 - protein, 9 aa, Homo Sapiens
QGLCVVAHD

SEQ ID NO: 214470 - protein, 9 aa, Homo Sapiens
HFQDRGQFC

SEQ ID NO: 214471 - protein, 9 aa, Homo Sapiens
WTPGRRGGT

SEQ ID NO: 214472 - protein, 9 aa, Homo Sapiens
GGGGRTPGI

SEQ ID NO: 214473 - protein, 9 aa, Homo Sapiens
HLEGLGPVV

SEQ ID NO: 214474 - protein, 9 aa, Homo Sapiens
GLLMVLAQL

SEQ ID NO: 214475 - protein, 9 aa, Homo Sapiens
LNTGGGPWS

SEQ ID NO: 214476 - protein, 9 aa, Homo Sapiens
KVVAEGHLE

SEQ ID NO: 214477 - protein, 9 aa, Homo Sapiens
LVGGQVGHG

SEQ ID NO: 214478 - protein, 9 aa, Homo Sapiens
DLRSMRINN

SEQ ID NO: 214479 - protein, 9 aa, Homo Sapiens
CPVSTQSLP

SEQ ID NO: 214480 - protein, 9 aa, Homo Sapiens
RSSGSALAF

SEQ ID NO: 214481 - protein, 9 aa, Homo Sapiens
KKHRAACLI

SEQ ID NO: 214482 - protein, 9 aa, Homo Sapiens
IHSFSGLVG

SEQ ID NO: 214483 - protein, 9 aa, Homo Sapiens
SRGHYHFRA

SEQ ID NO: 214484 - protein, 9 aa, Homo Sapiens
VLPDAPTGF

SEQ ID NO: 214485 - protein, 9 aa, Homo Sapiens
VVNILWSLG

SEQ ID NO: 214486 - protein, 9 aa, Homo Sapiens
SLYSVAVWP

SEQ ID NO: 214487 - protein, 9 aa, Homo Sapiens
PRRPRCSSS

SEQ ID NO: 214488 - protein, 9 aa, Homo Sapiens
GNDLFREDY

SEQ ID NO: 214489 - protein, 9 aa, Homo Sapiens
YTGSHQLAS

SEQ ID NO: 214490 - protein, 9 aa, Homo Sapiens
WDIRDYVLQ

SEQ ID NO: 214491 - protein, 9 aa, Homo Sapiens
MVTQDVLKN

SEQ ID NO: 214492 - protein, 9 aa, Homo Sapiens
LILRLPFVA

SEQ ID NO: 214493 - protein, 9 aa, Homo Sapiens
SRGAETVHY

SEQ ID NO: 214494 - protein, 9 aa, Homo Sapiens
SQVAGASPL

SEQ ID NO: 214495 - protein, 9 aa, Homo Sapiens
CWAATLFLC

SEQ ID NO: 214496 - protein, 9 aa, Homo Sapiens
MYHYSCAAG

SEQ ID NO: 214497 - protein, 9 aa, Homo Sapiens
MVGSAASQR

SEQ ID NO: 214498 - protein, 9 aa, Homo Sapiens
LALALSSRD

SEQ ID NO: 214499 - protein, 9 aa, Homo Sapiens
VALNTAHAY

SEQ ID NO: 214500 - protein, 9 aa, Homo Sapiens
GEGAAEPPG

SEQ ID NO: 214501 - protein, 9 aa, Homo Sapiens
ITVSFVGQI

SEQ ID NO: 214502 - protein, 9 aa, Homo Sapiens
ALPMTCPTA

SEQ ID NO: 214503 - protein, 9 aa, Homo Sapiens
GKQKVLKIQ

SEQ ID NO: 214504 - protein, 9 aa, Homo Sapiens
ECIKQELMV

SEQ ID NO: 214505 - protein, 9 aa, Homo Sapiens
RSEALGKEV

SEQ ID NO: 214506 - protein, 9 aa, Homo Sapiens
FGCRWFLPW

SEQ ID NO: 214507 - protein, 9 aa, Homo Sapiens
PVSARSLPR

SEQ ID NO: 214508 - protein, 9 aa, Homo Sapiens
EYDREKPMA

SEQ ID NO: 214509 - protein, 9 aa, Homo Sapiens
QSLLSLYSV

SEQ ID NO: 214510 - protein, 9 aa, Homo Sapiens
VKTKRNWTE

SEQ ID NO: 214511 - protein, 9 aa, Homo Sapiens
CCQTRSWRM

SEQ ID NO: 214512 - protein, 9 aa, Homo Sapiens
LPRRSRPGF

SEQ ID NO: 214513 - protein, 9 aa, Homo Sapiens
QQMGYPKST

SEQ ID NO: 214514 - protein, 9 aa, Homo Sapiens
SMDVPMSDL

SEQ ID NO: 214515 - protein, 9 aa, Homo Sapiens
LLFHGLGEG

SEQ ID NO: 214516 - protein, 9 aa, Homo Sapiens
LMKRYSTSP

SEQ ID NO: 214517 - protein, 9 aa, Homo Sapiens
NPAAQDGAR

SEQ ID NO: 214518 - protein, 9 aa, Homo Sapiens
VEAMEETGV

SEQ ID NO: 214519 - protein, 9 aa, Homo Sapiens
TGLLPECFR

SEQ ID NO: 214520 - protein, 9 aa, Homo Sapiens
WLLFRQDFL

SEQ ID NO: 214521 - protein, 9 aa, Homo Sapiens
GLNAWNGFS

SEQ ID NO: 214522 - protein, 9 aa, Homo Sapiens
EHQQHEVAG

SEQ ID NO: 214523 - protein, 9 aa, Homo Sapiens
EYINQGGSP

SEQ ID NO: 214524 - protein, 9 aa, Homo Sapiens
ATRALQQNR

SEQ ID NO: 214525 - protein, 9 aa, Homo Sapiens
SRRCPRTPR

SEQ ID NO: 214526 - protein, 9 aa, Homo Sapiens
STSTAPTTP

SEQ ID NO: 214527 - protein, 9 aa, Homo Sapiens
GQRVLQEAQ

SEQ ID NO: 214528 - protein, 9 aa, Homo Sapiens
ASLHPASGR

SEQ ID NO: 214529 - protein, 9 aa, Homo Sapiens
HSSVLATGL

SEQ ID NO: 214530 - protein, 9 aa, Homo Sapiens
VPGQAAKDE

SEQ ID NO: 214531 - protein, 9 aa, Homo Sapiens
SRPGGAEKE

SEQ ID NO: 214532 - protein, 9 aa, Homo Sapiens
WDPVNVHDI

SEQ ID NO: 214533 - protein, 9 aa, Homo Sapiens
AYHRALQHH

SEQ ID NO: 214534 - protein, 9 aa, Homo Sapiens
SSAGSSWTP

SEQ ID NO: 214535 - protein, 9 aa, Homo Sapiens
FSFCNKIQG

SEQ ID NO: 214536 - protein, 9 aa, Homo Sapiens
WKQSQQSLS

SEQ ID NO: 214537 - protein, 9 aa, Homo Sapiens
NIRKQKEKI

SEQ ID NO: 214538 - protein, 9 aa, Homo Sapiens
FPSSVLTLT

SEQ ID NO: 214539 - protein, 9 aa, Homo Sapiens
AAAVPPPSS

SEQ ID NO: 214540 - protein, 9 aa, Homo Sapiens
GPIQAYILA

SEQ ID NO: 214541 - protein, 9 aa, Homo Sapiens
RQAITSHMH

SEQ ID NO: 214542 - protein, 9 aa, Homo Sapiens
GLDALFAQK

SEQ ID NO: 214543 - protein, 9 aa, Homo Sapiens
NKDLRTRAD

SEQ ID NO: 214544 - protein, 9 aa, Homo Sapiens
VPPSFKQFL

SEQ ID NO: 214545 - protein, 9 aa, Homo Sapiens
FVIGRFLTG

SEQ ID NO: 214546 - protein, 9 aa, Homo Sapiens
IHNSVIRAR

SEQ ID NO: 214547 - protein, 9 aa, Homo Sapiens
GDKVVAEGH

SEQ ID NO: 214548 - protein, 9 aa, Homo Sapiens
PDEKSQIHS

SEQ ID NO: 214549 - protein, 9 aa, Homo Sapiens
LWRRGLGLL

SEQ ID NO: 214550 - protein, 9 aa, Homo Sapiens
TTHTVTSSK

SEQ ID NO: 214551 - protein, 9 aa, Homo Sapiens
TSTNSDQLF

SEQ ID NO: 214552 - protein, 9 aa, Homo Sapiens
LGPVVLGAD

SEQ ID NO: 214553 - protein, 9 aa, Homo Sapiens
GMPAVVLKS

SEQ ID NO: 214554 - protein, 9 aa, Homo Sapiens
SCTGLDTWE

SEQ ID NO: 214555 - protein, 9 aa, Homo Sapiens
RPPCSQRLW

SEQ ID NO: 214556 - protein, 9 aa, Homo Sapiens
RWWTRKVIC

SEQ ID NO: 214557 - protein, 9 aa, Homo Sapiens
VLGCPKIPP

SEQ ID NO: 214558 - protein, 9 aa, Homo Sapiens
LYCLTKIYQ

SEQ ID NO: 214559 - protein, 9 aa, Homo Sapiens
GKVCHGALT

SEQ ID NO: 214560 - protein, 9 aa, Homo Sapiens
ERAVAHMDE

SEQ ID NO: 214561 - protein, 9 aa, Homo Sapiens
FQEKPDRRR

SEQ ID NO: 214562 - protein, 9 aa, Homo Sapiens
GSEKVVPVS

SEQ ID NO: 214563 - protein, 9 aa, Homo Sapiens
KWSELWKKS

SEQ ID NO: 214564 - protein, 9 aa, Homo Sapiens
TPWVFIGGL

SEQ ID NO: 214565 - protein, 9 aa, Homo Sapiens
ERRRGCSGR

SEQ ID NO: 214566 - protein, 9 aa, Homo Sapiens
TGVFTFGLF

SEQ ID NO: 214567 - protein, 9 aa, Homo Sapiens
EKELMEHLK

SEQ ID NO: 214568 - protein, 9 aa, Homo Sapiens
LRHRLSGQR

SEQ ID NO: 214569 - protein, 9 aa, Homo Sapiens
QINHPAHLR

SEQ ID NO: 214570 - protein, 9 aa, Homo Sapiens
RRASGTLLS

SEQ ID NO: 214571 - protein, 9 aa, Homo Sapiens
REYWRWLRK

SEQ ID NO: 214572 - protein, 9 aa, Homo Sapiens
GLHVHPRNG

SEQ ID NO: 214573 - protein, 9 aa, Homo Sapiens
ERTHHSFRV

SEQ ID NO: 214574 - protein, 9 aa, Homo Sapiens
TSLILAAAQ

SEQ ID NO: 214575 - protein, 9 aa, Homo Sapiens
WASPPNTHP

SEQ ID NO: 214576 - protein, 9 aa, Homo Sapiens
WSVPIRECS

SEQ ID NO: 214577 - protein, 9 aa, Homo Sapiens
GSCCTPTCA

SEQ ID NO: 214578 - protein, 9 aa, Homo Sapiens
GRVFSFCNK

SEQ ID NO: 214579 - protein, 9 aa, Homo Sapiens
DATPGVDLS

SEQ ID NO: 214580 - protein, 9 aa, Homo Sapiens
EKDHWRSRH

SEQ ID NO: 214581 - protein, 9 aa, Homo Sapiens
TLNLMRQLY

SEQ ID NO: 214582 - protein, 9 aa, Homo Sapiens
EGLGPVVLG

SEQ ID NO: 214583 - protein, 9 aa, Homo Sapiens
TGSCCWRGW

SEQ ID NO: 214584 - protein, 9 aa, Homo Sapiens
NILWSLGVV

SEQ ID NO: 214585 - protein, 9 aa, Homo Sapiens
DIVSRLMQV

SEQ ID NO: 214586 - protein, 9 aa, Homo Sapiens
APRGPGMPN

SEQ ID NO: 214587 - protein, 9 aa, Homo Sapiens
PRGGPARSG

SEQ ID NO: 214588 - protein, 9 aa, Homo Sapiens
RDAEVWFNE

SEQ ID NO: 214589 - protein, 9 aa, Homo Sapiens
KGLLKKRNG

SEQ ID NO: 214590 - protein, 9 aa, Homo Sapiens
IPFQQPKHF

SEQ ID NO: 214591 - protein, 9 aa, Homo Sapiens
VPRGSCALQ

SEQ ID NO: 214592 - protein, 9 aa, Homo Sapiens
GHCAGAACW

SEQ ID NO: 214593 - protein, 9 aa, Homo Sapiens
KPECNIFSN

SEQ ID NO: 214594 - protein, 9 aa, Homo Sapiens
TGRPAGAAP

SEQ ID NO: 214595 - protein, 9 aa, Homo Sapiens
INATALLEC

SEQ ID NO: 214596 - protein, 9 aa, Homo Sapiens
EDNLIEAGK

SEQ ID NO: 214597 - protein, 9 aa, Homo Sapiens
EEETTTEMI

SEQ ID NO: 214598 - protein, 9 aa, Homo Sapiens
LTTLTDSNI

SEQ ID NO: 214599 - protein, 9 aa, Homo Sapiens
QGLIDELTA

SEQ ID NO: 214600 - protein, 9 aa, Homo Sapiens
GLLIENICP

SEQ ID NO: 214601 - protein, 9 aa, Homo Sapiens
SFGYLSGDW

SEQ ID NO: 214602 - protein, 9 aa, Homo Sapiens
EIRVSIIDD

SEQ ID NO: 214603 - protein, 9 aa, Homo Sapiens
KPLSNETAT

SEQ ID NO: 214604 - protein, 9 aa, Homo Sapiens
PADASSHGV

SEQ ID NO: 214605 - protein, 9 aa, Homo Sapiens
TWTCGPSTP

SEQ ID NO: 214606 - protein, 9 aa, Homo Sapiens
DSELEQMSI

SEQ ID NO: 214607 - protein, 9 aa, Homo Sapiens
QGSKAEDPV

SEQ ID NO: 214608 - protein, 9 aa, Homo Sapiens
KTHNCYHEG

SEQ ID NO: 214609 - protein, 9 aa, Homo Sapiens
SCSASVSFT

SEQ ID NO: 214610 - protein, 9 aa, Homo Sapiens
SPSTGTTSA

SEQ ID NO: 214611 - protein, 9 aa, Homo Sapiens
FFLLLEKSF

SEQ ID NO: 214612 - protein, 9 aa, Homo Sapiens
TSVSSVKLV

SEQ ID NO: 214613 - protein, 9 aa, Homo Sapiens
WTPLHCVAS

SEQ ID NO: 214614 - protein, 9 aa, Homo Sapiens
SPSFPKAAW

SEQ ID NO: 214615 - protein, 9 aa, Homo Sapiens
PNVHFLPRQ

SEQ ID NO: 214616 - protein, 9 aa, Homo Sapiens
RQHYRDELG

SEQ ID NO: 214617 - protein, 9 aa, Homo Sapiens
LGPAFIKTY

SEQ ID NO: 214618 - protein, 9 aa, Homo Sapiens
NHRRFSATD

SEQ ID NO: 214619 - protein, 9 aa, Homo Sapiens
AGGPPSSSR

SEQ ID NO: 214620 - protein, 9 aa, Homo Sapiens
FCMAGTVRC

SEQ ID NO: 214621 - protein, 9 aa, Homo Sapiens
FHKMAFDYY

SEQ ID NO: 214622 - protein, 9 aa, Homo Sapiens
AENYRTLFQ

SEQ ID NO: 214623 - protein, 9 aa, Homo Sapiens
PWARNPTSL

SEQ ID NO: 214624 - protein, 9 aa, Homo Sapiens
HVGVTQRVP

SEQ ID NO: 214625 - protein, 9 aa, Homo Sapiens
CVPSRWQCD

SEQ ID NO: 214626 - protein, 9 aa, Homo Sapiens
APSIRTPRG

SEQ ID NO: 214627 - protein, 9 aa, Homo Sapiens
EPKVNQGNA

SEQ ID NO: 214628 - protein, 9 aa, Homo Sapiens
IGQLSAPTA

SEQ ID NO: 214629 - protein, 9 aa, Homo Sapiens
GAAGVQEAE

SEQ ID NO: 214630 - protein, 9 aa, Homo Sapiens
GLYTLRIMS

SEQ ID NO: 214631 - protein, 9 aa, Homo Sapiens
AEVNVVSTK

SEQ ID NO: 214632 - protein, 9 aa, Homo Sapiens
RASGTLLSG

SEQ ID NO: 214633 - protein, 9 aa, Homo Sapiens
KWSAVPPHV

SEQ ID NO: 214634 - protein, 9 aa, Homo Sapiens
LEHGQSPIE

SEQ ID NO: 214635 - protein, 9 aa, Homo Sapiens
PWRSKISGF

SEQ ID NO: 214636 - protein, 9 aa, Homo Sapiens
WEGAPGARI

SEQ ID NO: 214637 - protein, 9 aa, Homo Sapiens
ECFRHAPPP

SEQ ID NO: 214638 - protein, 9 aa, Homo Sapiens
ECAARRQFQ

SEQ ID NO: 214639 - protein, 9 aa, Homo Sapiens
SWGPQWPAG

SEQ ID NO: 214640 - protein, 9 aa, Homo Sapiens
LIENICPSD

SEQ ID NO: 214641 - protein, 9 aa, Homo Sapiens
NIHQKDTEG

SEQ ID NO: 214642 - protein, 9 aa, Homo Sapiens
SPTSTPGPW

SEQ ID NO: 214643 - protein, 9 aa, Homo Sapiens
KEEKKCYIN

SEQ ID NO: 214644 - protein, 9 aa, Homo Sapiens
CPPPHRCCL

SEQ ID NO: 214645 - protein, 9 aa, Homo Sapiens
GELFSTYKE

SEQ ID NO: 214646 - protein, 9 aa, Homo Sapiens
RTLHAARPA

SEQ ID NO: 214647 - protein, 9 aa, Homo Sapiens
VNGLLKVAL

SEQ ID NO: 214648 - protein, 9 aa, Homo Sapiens
GPSSTFLLA

SEQ ID NO: 214649 - protein, 9 aa, Homo Sapiens
GLELVFALR

SEQ ID NO: 214650 - protein, 9 aa, Homo Sapiens
AQAISYVGC

SEQ ID NO: 214651 - protein, 9 aa, Homo Sapiens
CSGWRVAAA

SEQ ID NO: 214652 - protein, 9 aa, Homo Sapiens
GCSQEQSVK

SEQ ID NO: 214653 - protein, 9 aa, Homo Sapiens
ALGAGVLAA

SEQ ID NO: 214654 - protein, 9 aa, Homo Sapiens
LKGRNSHPS

SEQ ID NO: 214655 - protein, 9 aa, Homo Sapiens
GLGGCRDHC

SEQ ID NO: 214656 - protein, 9 aa, Homo Sapiens
SEDSPCESV

SEQ ID NO: 214657 - protein, 9 aa, Homo Sapiens
CCSAASSTG

SEQ ID NO: 214658 - protein, 9 aa, Homo Sapiens
FHQGISQVH

SEQ ID NO: 214659 - protein, 9 aa, Homo Sapiens
GSQHLFTIK

SEQ ID NO: 214660 - protein, 9 aa, Homo Sapiens
VQLYCLTKI

SEQ ID NO: 214661 - protein, 9 aa, Homo Sapiens
LPSCKKKSS

SEQ ID NO: 214662 - protein, 9 aa, Homo Sapiens
PESCHDFHP

SEQ ID NO: 214663 - protein, 9 aa, Homo Sapiens
EAVLLQQDL

SEQ ID NO: 214664 - protein, 9 aa, Homo Sapiens
ATEMAHRVG

SEQ ID NO: 214665 - protein, 9 aa, Homo Sapiens
DIQCDDPQP

SEQ ID NO: 214666 - protein, 9 aa, Homo Sapiens
FTFGLFATD

SEQ ID NO: 214667 - protein, 9 aa, Homo Sapiens
GCSGRSRPT

SEQ ID NO: 214668 - protein, 9 aa, Homo Sapiens
ADSMARAEP

SEQ ID NO: 214669 - protein, 9 aa, Homo Sapiens
CLWLWCRPS

SEQ ID NO: 214670 - protein, 9 aa, Homo Sapiens
LELQPPGDC

SEQ ID NO: 214671 - protein, 9 aa, Homo Sapiens
CDPIRTSMC

SEQ ID NO: 214672 - protein, 9 aa, Homo Sapiens
LSAQENIVG

SEQ ID NO: 214673 - protein, 9 aa, Homo Sapiens
TGSASSSAH

SEQ ID NO: 214674 - protein, 9 aa, Homo Sapiens
PPCSLPTAS

SEQ ID NO: 214675 - protein, 9 aa, Homo Sapiens
IYKDLYANI

SEQ ID NO: 214676 - protein, 9 aa, Homo Sapiens
HVLAHQPGP

SEQ ID NO: 214677 - protein, 9 aa, Homo Sapiens
IGGTGGWSA

SEQ ID NO: 214678 - protein, 9 aa, Homo Sapiens
NNKKMAMTV

SEQ ID NO: 214679 - protein, 9 aa, Homo Sapiens
LRIMSRGGV

SEQ ID NO: 214680 - protein, 9 aa, Homo Sapiens
LDEFLMGGM

SEQ ID NO: 214681 - protein, 9 aa, Homo Sapiens
ATPGHWGQR

SEQ ID NO: 214682 - protein, 9 aa, Homo Sapiens
APCTSVTST

SEQ ID NO: 214683 - protein, 9 aa, Homo Sapiens
VGRLLLPAL

SEQ ID NO: 214684 - protein, 9 aa, Homo Sapiens
EKKCYINLW

SEQ ID NO: 214685 - protein, 9 aa, Homo Sapiens
DLDEAVVLN

SEQ ID NO: 214686 - protein, 9 aa, Homo Sapiens
FSELSFPPA

SEQ ID NO: 214687 - protein, 9 aa, Homo Sapiens
AVCGPGFSA

SEQ ID NO: 214688 - protein, 9 aa, Homo Sapiens
ITRQMLTFY

SEQ ID NO: 214689 - protein, 9 aa, Homo Sapiens
KSASVSVLS

SEQ ID NO: 214690 - protein, 9 aa, Homo Sapiens
NLAAITMDE

SEQ ID NO: 214691 - protein, 9 aa, Homo Sapiens
WWMSAASYG

SEQ ID NO: 214692 - protein, 9 aa, Homo Sapiens
LPVSYTAPI

SEQ ID NO: 214693 - protein, 9 aa, Homo Sapiens
SVVTLFYGM

SEQ ID NO: 214694 - protein, 9 aa, Homo Sapiens
NPRQPATRP

SEQ ID NO: 214695 - protein, 9 aa, Homo Sapiens
VQGPIHLLV

SEQ ID NO: 214696 - protein, 9 aa, Homo Sapiens
GNEHPPPPL

SEQ ID NO: 214697 - protein, 9 aa, Homo Sapiens
HCDRHLIKM

SEQ ID NO: 214698 - protein, 9 aa, Homo Sapiens
TCADTFLFE

SEQ ID NO: 214699 - protein, 9 aa, Homo Sapiens
FIRKYDAVN

SEQ ID NO: 214700 - protein, 9 aa, Homo Sapiens
WYKTFWNHM

SEQ ID NO: 214701 - protein, 9 aa, Homo Sapiens
VDQWLKCQD

SEQ ID NO: 214702 - protein, 9 aa, Homo Sapiens
LPGTFILYK

SEQ ID NO: 214703 - protein, 9 aa, Homo Sapiens
HIQVTLRKW

SEQ ID NO: 214704 - protein, 9 aa, Homo Sapiens
VQGAPWLWP

SEQ ID NO: 214705 - protein, 9 aa, Homo Sapiens
DFNVIVPIV

SEQ ID NO: 214706 - protein, 9 aa, Homo Sapiens
SQSFVDVWE

SEQ ID NO: 214707 - protein, 9 aa, Homo Sapiens
MWLTMSSTM

SEQ ID NO: 214708 - protein, 9 aa, Homo Sapiens
NAGIYVRPQ

SEQ ID NO: 214709 - protein, 9 aa, Homo Sapiens
NPFRCKLAA

SEQ ID NO: 214710 - protein, 9 aa, Homo Sapiens
RERQERHIQ

SEQ ID NO: 214711 - protein, 9 aa, Homo Sapiens
PGPPGPQDL

SEQ ID NO: 214712 - protein, 9 aa, Homo Sapiens
THSCSRPFS

SEQ ID NO: 214713 - protein, 9 aa, Homo Sapiens
YPPQSPCRL

SEQ ID NO: 214714 - protein, 9 aa, Homo Sapiens
TAASSPPGR

SEQ ID NO: 214715 - protein, 9 aa, Homo Sapiens
ARPDDLTLI

SEQ ID NO: 214716 - protein, 9 aa, Homo Sapiens
DEDKKVRGE

SEQ ID NO: 214717 - protein, 9 aa, Homo Sapiens
GSALQIATH

SEQ ID NO: 214718 - protein, 9 aa, Homo Sapiens
NEETSMQNP

SEQ ID NO: 214719 - protein, 9 aa, Homo Sapiens
ERGVLQWDR

SEQ ID NO: 214720 - protein, 9 aa, Homo Sapiens
NTGGGPWSC

SEQ ID NO: 214721 - protein, 9 aa, Homo Sapiens
CASNGIHHF

SEQ ID NO: 214722 - protein, 9 aa, Homo Sapiens
TCSPQGRRK

SEQ ID NO: 214723 - protein, 9 aa, Homo Sapiens
CISVHVSAC

SEQ ID NO: 214724 - protein, 9 aa, Homo Sapiens
IKRSCSASV

SEQ ID NO: 214725 - protein, 9 aa, Homo Sapiens
AKKNLGKVF

SEQ ID NO: 214726 - protein, 9 aa, Homo Sapiens
MICMPVGGQ

SEQ ID NO: 214727 - protein, 9 aa, Homo Sapiens
PTSCPPLLE

SEQ ID NO: 214728 - protein, 9 aa, Homo Sapiens
QGTRRFRMR

SEQ ID NO: 214729 - protein, 9 aa, Homo Sapiens
SASSAWGSA

SEQ ID NO: 214730 - protein, 9 aa, Homo Sapiens
PPTKDNLAP

SEQ ID NO: 214731 - protein, 9 aa, Homo Sapiens
SNGTSRRSG

SEQ ID NO: 214732 - protein, 9 aa, Homo Sapiens
MTWCGWLCP

SEQ ID NO: 214733 - protein, 9 aa, Homo Sapiens
SQMQKNNGC

SEQ ID NO: 214734 - protein, 9 aa, Homo Sapiens
SNWDYRGLP

SEQ ID NO: 214735 - protein, 9 aa, Homo Sapiens
INPNTLKEG

SEQ ID NO: 214736 - protein, 9 aa, Homo Sapiens
DGNFAMRVS

SEQ ID NO: 214737 - protein, 9 aa, Homo Sapiens
ESVFKAEFV

SEQ ID NO: 214738 - protein, 9 aa, Homo Sapiens
LRFTKTCRK

SEQ ID NO: 214739 - protein, 9 aa, Homo Sapiens
MMSTASVHT

SEQ ID NO: 214740 - protein, 9 aa, Homo Sapiens
RGALQNQLR

SEQ ID NO: 214741 - protein, 9 aa, Homo Sapiens
SPASPASPS

SEQ ID NO: 214742 - protein, 9 aa, Homo Sapiens
LAGHYTHRQ

SEQ ID NO: 214743 - protein, 9 aa, Homo Sapiens
RQKPLISLK

SEQ ID NO: 214744 - protein, 9 aa, Homo Sapiens
LRACGNWRV

SEQ ID NO: 214745 - protein, 9 aa, Homo Sapiens
ASASGDNSW

SEQ ID NO: 214746 - protein, 9 aa, Homo Sapiens
GSSSCKGCL

SEQ ID NO: 214747 - protein, 9 aa, Homo Sapiens
FQVVQTMLR

SEQ ID NO: 214748 - protein, 9 aa, Homo Sapiens
VSQINHPAH

SEQ ID NO: 214749 - protein, 9 aa, Homo Sapiens
GPKGQVTAH

SEQ ID NO: 214750 - protein, 9 aa, Homo Sapiens
MLLVYRMRK

SEQ ID NO: 214751 - protein, 9 aa, Homo Sapiens
FSKVLIKLP

SEQ ID NO: 214752 - protein, 9 aa, Homo Sapiens
QERIELKAK

SEQ ID NO: 214753 - protein, 9 aa, Homo Sapiens
KGSFGQAVK

SEQ ID NO: 214754 - protein, 9 aa, Homo Sapiens
IPYVTVLDS

SEQ ID NO: 214755 - protein, 9 aa, Homo Sapiens
QWSLCPAED

SEQ ID NO: 214756 - protein, 9 aa, Homo Sapiens
SRCRQRCGP

SEQ ID NO: 214757 - protein, 9 aa, Homo Sapiens
TLAGMGTQQ

SEQ ID NO: 214758 - protein, 9 aa, Homo Sapiens
SLAIGGTGG

SEQ ID NO: 214759 - protein, 9 aa, Homo Sapiens
PLTPCSHSL

SEQ ID NO: 214760 - protein, 9 aa, Homo Sapiens
CWSLSEYTR

SEQ ID NO: 214761 - protein, 9 aa, Homo Sapiens
LIDELTALL

SEQ ID NO: 214762 - protein, 9 aa, Homo Sapiens
LQQWKRPMG

SEQ ID NO: 214763 - protein, 9 aa, Homo Sapiens
RRGLGLLDL

SEQ ID NO: 214764 - protein, 9 aa, Homo Sapiens
EIALHRRMR

SEQ ID NO: 214765 - protein, 9 aa, Homo Sapiens
IVCPDCEVA

SEQ ID NO: 214766 - protein, 9 aa, Homo Sapiens
GDFGLATEK

SEQ ID NO: 214767 - protein, 9 aa, Homo Sapiens
GNWKSHLIV

SEQ ID NO: 214768 - protein, 9 aa, Homo Sapiens
WKGKGASAP

SEQ ID NO: 214769 - protein, 9 aa, Homo Sapiens
GLMNANHVF

SEQ ID NO: 214770 - protein, 9 aa, Homo Sapiens
SLEEEGVLI

SEQ ID NO: 214771 - protein, 9 aa, Homo Sapiens
KKMIGAFKH

SEQ ID NO: 214772 - protein, 9 aa, Homo Sapiens
TILNSKQFI

SEQ ID NO: 214773 - protein, 9 aa, Homo Sapiens
IPLLGDQLV

SEQ ID NO: 214774 - protein, 9 aa, Homo Sapiens
PGQVCANNS

SEQ ID NO: 214775 - protein, 9 aa, Homo Sapiens
QEGEAEAEV

SEQ ID NO: 214776 - protein, 9 aa, Homo Sapiens
GGVCQRMCQ

SEQ ID NO: 214777 - protein, 9 aa, Homo Sapiens
CRVTKYCSA

SEQ ID NO: 214778 - protein, 9 aa, Homo Sapiens
SCRPWHSNS

SEQ ID NO: 214779 - protein, 9 aa, Homo Sapiens
RDNKDGTYA

SEQ ID NO: 214780 - protein, 9 aa, Homo Sapiens
GKFASSQKA

SEQ ID NO: 214781 - protein, 9 aa, Homo Sapiens
PPEERVTAR

SEQ ID NO: 214782 - protein, 9 aa, Homo Sapiens
PGLSGLPGS

SEQ ID NO: 214783 - protein, 9 aa, Homo Sapiens
YQKFIPFID

SEQ ID NO: 214784 - protein, 9 aa, Homo Sapiens
GEGRMVQDE

SEQ ID NO: 214785 - protein, 9 aa, Homo Sapiens
LGSPQSRWL

SEQ ID NO: 214786 - protein, 9 aa, Homo Sapiens
SWASLQSPR

SEQ ID NO: 214787 - protein, 9 aa, Homo Sapiens
RREIDDFLK

SEQ ID NO: 214788 - protein, 9 aa, Homo Sapiens
QEDVMFSSD

SEQ ID NO: 214789 - protein, 9 aa, Homo Sapiens
INMLQIEFK

SEQ ID NO: 214790 - protein, 9 aa, Homo Sapiens
CECDVNECF

SEQ ID NO: 214791 - protein, 9 aa, Homo Sapiens
LGSCNGTQV

SEQ ID NO: 214792 - protein, 9 aa, Homo Sapiens
QVEFSELNL

SEQ ID NO: 214793 - protein, 9 aa, Homo Sapiens
QCLRMGNER

SEQ ID NO: 214794 - protein, 9 aa, Homo Sapiens
RGCYLTVAC

SEQ ID NO: 214795 - protein, 9 aa, Homo Sapiens
KSPVISRWD

SEQ ID NO: 214796 - protein, 9 aa, Homo Sapiens
SALCVRPRA

SEQ ID NO: 214797 - protein, 9 aa, Homo Sapiens
VNVSLIFDN

SEQ ID NO: 214798 - protein, 9 aa, Homo Sapiens
SLVHGLTLE

SEQ ID NO: 214799 - protein, 9 aa, Homo Sapiens
KHKKDKKEN

SEQ ID NO: 214800 - protein, 9 aa, Homo Sapiens
TFFSCIVCV

SEQ ID NO: 214801 - protein, 9 aa, Homo Sapiens
CSYSESKRI

SEQ ID NO: 214802 - protein, 9 aa, Homo Sapiens
KVRYRERIA

SEQ ID NO: 214803 - protein, 9 aa, Homo Sapiens
HLLFEAWLL

SEQ ID NO: 214804 - protein, 9 aa, Homo Sapiens
VRKCGGIQS

SEQ ID NO: 214805 - protein, 9 aa, Homo Sapiens
LTLEFHTLL

SEQ ID NO: 214806 - protein, 9 aa, Homo Sapiens
VPPHVKRHA

SEQ ID NO: 214807 - protein, 9 aa, Homo Sapiens
RNILTLSTM

SEQ ID NO: 214808 - protein, 9 aa, Homo Sapiens
KVLKPLSVI

SEQ ID NO: 214809 - protein, 9 aa, Homo Sapiens
LSLEVARHH

SEQ ID NO: 214810 - protein, 9 aa, Homo Sapiens
GQRRRRRNS

SEQ ID NO: 214811 - protein, 9 aa, Homo Sapiens
FSSASAELL

SEQ ID NO: 214812 - protein, 9 aa, Homo Sapiens
LQSSLKNWL

SEQ ID NO: 214813 - protein, 9 aa, Homo Sapiens
AEAMCVGHD

SEQ ID NO: 214814 - protein, 9 aa, Homo Sapiens
QVIKDSKEN

SEQ ID NO: 214815 - protein, 9 aa, Homo Sapiens
MLNYRLMFQ

SEQ ID NO: 214816 - protein, 9 aa, Homo Sapiens
APPPAPPAA

SEQ ID NO: 214817 - protein, 9 aa, Homo Sapiens
RDLPQERYL

SEQ ID NO: 214818 - protein, 9 aa, Homo Sapiens
CQKPEPLWH

SEQ ID NO: 214819 - protein, 9 aa, Homo Sapiens
VRALPMTCP

SEQ ID NO: 214820 - protein, 9 aa, Homo Sapiens
WGMTSWGTL

SEQ ID NO: 214821 - protein, 9 aa, Homo Sapiens
MLREWYAHN

SEQ ID NO: 214822 - protein, 9 aa, Homo Sapiens
RVSVKLHNR

SEQ ID NO: 214823 - protein, 9 aa, Homo Sapiens
LSCSLTATL

SEQ ID NO: 214824 - protein, 9 aa, Homo Sapiens
PSPVQHQTG

SEQ ID NO: 214825 - protein, 9 aa, Homo Sapiens
LSGLYPSPS

SEQ ID NO: 214826 - protein, 9 aa, Homo Sapiens
HRLYKVQPF

SEQ ID NO: 214827 - protein, 9 aa, Homo Sapiens
TGSRRGCAW

SEQ ID NO: 214828 - protein, 9 aa, Homo Sapiens
IHPLLKGVL

SEQ ID NO: 214829 - protein, 9 aa, Homo Sapiens
NSVQKTSGS

SEQ ID NO: 214830 - protein, 9 aa, Homo Sapiens
HKPCAEVIP

SEQ ID NO: 214831 - protein, 9 aa, Homo Sapiens
LEKIRTTET

SEQ ID NO: 214832 - protein, 9 aa, Homo Sapiens
LYRSYCSTR

SEQ ID NO: 214833 - protein, 9 aa, Homo Sapiens
YFLRPLHSH

SEQ ID NO: 214834 - protein, 9 aa, Homo Sapiens
ETKREARVE

SEQ ID NO: 214835 - protein, 9 aa, Homo Sapiens
VDLSYDSTL

SEQ ID NO: 214836 - protein, 9 aa, Homo Sapiens
VLSCWTWMT

SEQ ID NO: 214837 - protein, 9 aa, Homo Sapiens
GAPRHPHRS

SEQ ID NO: 214838 - protein, 9 aa, Homo Sapiens
VRSTVCAMD

SEQ ID NO: 214839 - protein, 9 aa, Homo Sapiens
ASIARARVC

SEQ ID NO: 214840 - protein, 9 aa, Homo Sapiens
SCIALGKPL

SEQ ID NO: 214841 - protein, 9 aa, Homo Sapiens
ICSVSGRGS

SEQ ID NO: 214842 - protein, 9 aa, Homo Sapiens
HFPFTFSPI

SEQ ID NO: 214843 - protein, 9 aa, Homo Sapiens
IGSNCQTAI

SEQ ID NO: 214844 - protein, 9 aa, Homo Sapiens
TSSIPQKDL

SEQ ID NO: 214845 - protein, 9 aa, Homo Sapiens
CKQCWRAFS

SEQ ID NO: 214846 - protein, 9 aa, Homo Sapiens
RHLDFKVVS

SEQ ID NO: 214847 - protein, 9 aa, Homo Sapiens
VSYPRRSQE

SEQ ID NO: 214848 - protein, 9 aa, Homo Sapiens
LHRYDEWNF

SEQ ID NO: 214849 - protein, 9 aa, Homo Sapiens
MVIIGPRGL

SEQ ID NO: 214850 - protein, 9 aa, Homo Sapiens
RRSHSWGPM

SEQ ID NO: 214851 - protein, 9 aa, Homo Sapiens
DVLSNSDFL

SEQ ID NO: 214852 - protein, 9 aa, Homo Sapiens
PSCLQAVFE

SEQ ID NO: 214853 - protein, 9 aa, Homo Sapiens
PLSSSQVSA

SEQ ID NO: 214854 - protein, 9 aa, Homo Sapiens
LHGDSSPLQ

SEQ ID NO: 214855 - protein, 9 aa, Homo Sapiens
QAPTPKAGQ

SEQ ID NO: 214856 - protein, 9 aa, Homo Sapiens
VHFPFTFSP

SEQ ID NO: 214857 - protein, 9 aa, Homo Sapiens
VSVSLIYWL

SEQ ID NO: 214858 - protein, 9 aa, Homo Sapiens
TKSTPWQPT

SEQ ID NO: 214859 - protein, 9 aa, Homo Sapiens
GRGSSQAET

SEQ ID NO: 214860 - protein, 9 aa, Homo Sapiens
SYTRPMICQ

SEQ ID NO: 214861 - protein, 9 aa, Homo Sapiens
RFIFQKYLA

SEQ ID NO: 214862 - protein, 9 aa, Homo Sapiens
DFSPYWMKK

SEQ ID NO: 214863 - protein, 9 aa, Homo Sapiens
CLRGKHAHR

SEQ ID NO: 214864 - protein, 9 aa, Homo Sapiens
CKNCGSAFC

SEQ ID NO: 214865 - protein, 9 aa, Homo Sapiens
KPLVGSQHL

SEQ ID NO: 214866 - protein, 9 aa, Homo Sapiens
RSRGKLASG

SEQ ID NO: 214867 - protein, 9 aa, Homo Sapiens
FYDSWSPNS

SEQ ID NO: 214868 - protein, 9 aa, Homo Sapiens
ALNLKHGQF

SEQ ID NO: 214869 - protein, 9 aa, Homo Sapiens
EDYKQALVQ

SEQ ID NO: 214870 - protein, 9 aa, Homo Sapiens
PFFVPMSLA

SEQ ID NO: 214871 - protein, 9 aa, Homo Sapiens
SHYAREWSP

SEQ ID NO: 214872 - protein, 9 aa, Homo Sapiens
HGDGLRLRA

SEQ ID NO: 214873 - protein, 9 aa, Homo Sapiens
DVREVMERY

SEQ ID NO: 214874 - protein, 9 aa, Homo Sapiens
GPWHLCMGL

SEQ ID NO: 214875 - protein, 9 aa, Homo Sapiens
QHPGSSRTT

SEQ ID NO: 214876 - protein, 9 aa, Homo Sapiens
WQQQRMPDP

SEQ ID NO: 214877 - protein, 9 aa, Homo Sapiens
NEARLISSP

SEQ ID NO: 214878 - protein, 9 aa, Homo Sapiens
RKCGGIQSL

SEQ ID NO: 214879 - protein, 9 aa, Homo Sapiens
LKDISKIFP

SEQ ID NO: 214880 - protein, 9 aa, Homo Sapiens
FNTPRLQVH

SEQ ID NO: 214881 - protein, 9 aa, Homo Sapiens
YGLEHGQSP

SEQ ID NO: 214882 - protein, 9 aa, Homo Sapiens
VILQVRSTA

SEQ ID NO: 214883 - protein, 9 aa, Homo Sapiens
CIFSSPPSV

SEQ ID NO: 214884 - protein, 9 aa, Homo Sapiens
VLPSCKKKS

SEQ ID NO: 214885 - protein, 9 aa, Homo Sapiens
SGTVIPSNE

SEQ ID NO: 214886 - protein, 9 aa, Homo Sapiens
AALPGPPTQ

SEQ ID NO: 214887 - protein, 9 aa, Homo Sapiens
PQMARVTGV

SEQ ID NO: 214888 - protein, 9 aa, Homo Sapiens
SSPSMASLC

SEQ ID NO: 214889 - protein, 9 aa, Homo Sapiens
PLTITHTVA

SEQ ID NO: 214890 - protein, 9 aa, Homo Sapiens
VEHVPAVHA

SEQ ID NO: 214891 - protein, 9 aa, Homo Sapiens
DSWDIIIDP

SEQ ID NO: 214892 - protein, 9 aa, Homo Sapiens
HRCSRLVMC

SEQ ID NO: 214893 - protein, 9 aa, Homo Sapiens
APALPTSTL

SEQ ID NO: 214894 - protein, 9 aa, Homo Sapiens
CQGTRRFRM

SEQ ID NO: 214895 - protein, 9 aa, Homo Sapiens
AAVPPPSSS

SEQ ID NO: 214896 - protein, 9 aa, Homo Sapiens
KDDKIRSLE

SEQ ID NO: 214897 - protein, 9 aa, Homo Sapiens
SQLYLLDYF

SEQ ID NO: 214898 - protein, 9 aa, Homo Sapiens
GSTPTASET

SEQ ID NO: 214899 - protein, 9 aa, Homo Sapiens
AKPLVGSQH

SEQ ID NO: 214900 - protein, 9 aa, Homo Sapiens
QKKQELEKW

SEQ ID NO: 214901 - protein, 9 aa, Homo Sapiens
AGHLLGQLH

SEQ ID NO: 214902 - protein, 9 aa, Homo Sapiens
LELGGRTPA

SEQ ID NO: 214903 - protein, 9 aa, Homo Sapiens
CPGLKVTLT

SEQ ID NO: 214904 - protein, 9 aa, Homo Sapiens
PNLLLTADL

SEQ ID NO: 214905 - protein, 9 aa, Homo Sapiens
SPEEAVAQV

SEQ ID NO: 214906 - protein, 9 aa, Homo Sapiens
RFTKTCRKP

SEQ ID NO: 214907 - protein, 9 aa, Homo Sapiens
RASSGCGAP

SEQ ID NO: 214908 - protein, 9 aa, Homo Sapiens
VNGSVSFFD

SEQ ID NO: 214909 - protein, 9 aa, Homo Sapiens
RVGPLVHRR

SEQ ID NO: 214910 - protein, 9 aa, Homo Sapiens
GLAVRLASV

SEQ ID NO: 214911 - protein, 9 aa, Homo Sapiens
SRNCTAALC

SEQ ID NO: 214912 - protein, 9 aa, Homo Sapiens
TSSPSSTPP

SEQ ID NO: 214913 - protein, 9 aa, Homo Sapiens
CTWSIITGE

SEQ ID NO: 214914 - protein, 9 aa, Homo Sapiens
SCSEDTSVQ

SEQ ID NO: 214915 - protein, 9 aa, Homo Sapiens
LFTYFETIN

SEQ ID NO: 214916 - protein, 9 aa, Homo Sapiens
AAVHAWRTL

SEQ ID NO: 214917 - protein, 9 aa, Homo Sapiens
LVPCAHRNC

SEQ ID NO: 214918 - protein, 9 aa, Homo Sapiens
KKKRTRIIM

SEQ ID NO: 214919 - protein, 9 aa, Homo Sapiens
QIDAQQRPA

SEQ ID NO: 214920 - protein, 9 aa, Homo Sapiens
PVPQLPDRP

SEQ ID NO: 214921 - protein, 9 aa, Homo Sapiens
CRDLVDAAK

SEQ ID NO: 214922 - protein, 9 aa, Homo Sapiens
TALKQYACT

SEQ ID NO: 214923 - protein, 9 aa, Homo Sapiens
AFYFAGVPL

SEQ ID NO: 214924 - protein, 9 aa, Homo Sapiens
CQGINDFLV

SEQ ID NO: 214925 - protein, 9 aa, Homo Sapiens
GQGSNRGSG

SEQ ID NO: 214926 - protein, 9 aa, Homo Sapiens
KLILVMLEI

SEQ ID NO: 214927 - protein, 9 aa, Homo Sapiens
PSCRILDNS

SEQ ID NO: 214928 - protein, 9 aa, Homo Sapiens
QMCYPIWLI

SEQ ID NO: 214929 - protein, 9 aa, Homo Sapiens
LLCGTEDSR

SEQ ID NO: 214930 - protein, 9 aa, Homo Sapiens
LVTQGLCVV

SEQ ID NO: 214931 - protein, 9 aa, Homo Sapiens
GGTIQPQAT

SEQ ID NO: 214932 - protein, 9 aa, Homo Sapiens
MRGTKSTPW

SEQ ID NO: 214933 - protein, 9 aa, Homo Sapiens
KARTSASRS

SEQ ID NO: 214934 - protein, 9 aa, Homo Sapiens
NILTLSTMD

SEQ ID NO: 214935 - protein, 9 aa, Homo Sapiens
SEKSNKKIS

SEQ ID NO: 214936 - protein, 9 aa, Homo Sapiens
PAAQDGARC

SEQ ID NO: 214937 - protein, 9 aa, Homo Sapiens
GSRPIKLHK

SEQ ID NO: 214938 - protein, 9 aa, Homo Sapiens
PCGSGPSRC

SEQ ID NO: 214939 - protein, 9 aa, Homo Sapiens
TVILDFTRV

SEQ ID NO: 214940 - protein, 9 aa, Homo Sapiens
PHASPTSTP

SEQ ID NO: 214941 - protein, 9 aa, Homo Sapiens
DSCLKYDHH

SEQ ID NO: 214942 - protein, 9 aa, Homo Sapiens
HQYGGTYNR

SEQ ID NO: 214943 - protein, 9 aa, Homo Sapiens
ACRGATAVF

SEQ ID NO: 214944 - protein, 9 aa, Homo Sapiens
NQLTRDWKA

SEQ ID NO: 214945 - protein, 9 aa, Homo Sapiens
DYLEQKYVQ

SEQ ID NO: 214946 - protein, 9 aa, Homo Sapiens
DPVAPTPVN

SEQ ID NO: 214947 - protein, 9 aa, Homo Sapiens
ARPPSSRTG

SEQ ID NO: 214948 - protein, 9 aa, Homo Sapiens
TAHTGGQER

SEQ ID NO: 214949 - protein, 9 aa, Homo Sapiens
RRAPAGGRG

SEQ ID NO: 214950 - protein, 9 aa, Homo Sapiens
LRVKGLWRR

SEQ ID NO: 214951 - protein, 9 aa, Homo Sapiens
SADNANFNQ

SEQ ID NO: 214952 - protein, 9 aa, Homo Sapiens
TRAHTGWAH

SEQ ID NO: 214953 - protein, 9 aa, Homo Sapiens
LVDIYRELY

SEQ ID NO: 214954 - protein, 9 aa, Homo Sapiens
VLLGLFEEL

SEQ ID NO: 214955 - protein, 9 aa, Homo Sapiens
FLCAEGHGD

SEQ ID NO: 214956 - protein, 9 aa, Homo Sapiens
GWWTPWSPL

SEQ ID NO: 214957 - protein, 9 aa, Homo Sapiens
IIPTIGWCW

SEQ ID NO: 214958 - protein, 9 aa, Homo Sapiens
AGLKLTGTH

SEQ ID NO: 214959 - protein, 9 aa, Homo Sapiens
PLPRASLRA

SEQ ID NO: 214960 - protein, 9 aa, Homo Sapiens
AVDGSAAVA

SEQ ID NO: 214961 - protein, 9 aa, Homo Sapiens
WQSPCPAPG

SEQ ID NO: 214962 - protein, 9 aa, Homo Sapiens
SKKVSTRKN

SEQ ID NO: 214963 - protein, 9 aa, Homo Sapiens
FADYLVRYV

SEQ ID NO: 214964 - protein, 9 aa, Homo Sapiens
CWRPLAQRP

SEQ ID NO: 214965 - protein, 9 aa, Homo Sapiens
QLPLGLAAA

SEQ ID NO: 214966 - protein, 9 aa, Homo Sapiens
EGIRGLGVD

SEQ ID NO: 214967 - protein, 9 aa, Homo Sapiens
SLHMSYAPR

SEQ ID NO: 214968 - protein, 9 aa, Homo Sapiens
LLPECFRHA

SEQ ID NO: 214969 - protein, 9 aa, Homo Sapiens
YKDCDPQGV

SEQ ID NO: 214970 - protein, 9 aa, Homo Sapiens
KMKQRKNQV

SEQ ID NO: 214971 - protein, 9 aa, Homo Sapiens
MPVCVNGAS

SEQ ID NO: 214972 - protein, 9 aa, Homo Sapiens
RKTTSPKGE

SEQ ID NO: 214973 - protein, 9 aa, Homo Sapiens
QCCTADSQL

SEQ ID NO: 214974 - protein, 9 aa, Homo Sapiens
EQEVRDDNH

SEQ ID NO: 214975 - protein, 9 aa, Homo Sapiens
CSPGMQRRR

SEQ ID NO: 214976 - protein, 9 aa, Homo Sapiens
GRCGTWAWR

SEQ ID NO: 214977 - protein, 9 aa, Homo Sapiens
GDLECAARR

SEQ ID NO: 214978 - protein, 9 aa, Homo Sapiens
FHSVDARGG

SEQ ID NO: 214979 - protein, 9 aa, Homo Sapiens
AYLISARSL

SEQ ID NO: 214980 - protein, 9 aa, Homo Sapiens
HAYATVLTF

SEQ ID NO: 214981 - protein, 9 aa, Homo Sapiens
FYTHGLRCQ

SEQ ID NO: 214982 - protein, 9 aa, Homo Sapiens
RAYRTSSAT

SEQ ID NO: 214983 - protein, 9 aa, Homo Sapiens
KCIGEDSVP

SEQ ID NO: 214984 - protein, 9 aa, Homo Sapiens
GRSSGRQCG

SEQ ID NO: 214985 - protein, 9 aa, Homo Sapiens
QAAIAEKNH

SEQ ID NO: 214986 - protein, 9 aa, Homo Sapiens
SVQQAPSNV

SEQ ID NO: 214987 - protein, 9 aa, Homo Sapiens
KKLQSSLKN

SEQ ID NO: 214988 - protein, 9 aa, Homo Sapiens
DQVGGTSFY

SEQ ID NO: 214989 - protein, 9 aa, Homo Sapiens
GVEEEEDDD

SEQ ID NO: 214990 - protein, 9 aa, Homo Sapiens
WSTWLSLWS

SEQ ID NO: 214991 - protein, 9 aa, Homo Sapiens
AGMTLAAVC

SEQ ID NO: 214992 - protein, 9 aa, Homo Sapiens
LLFGDVASL

SEQ ID NO: 214993 - protein, 9 aa, Homo Sapiens
QALTTGMRR

SEQ ID NO: 214994 - protein, 9 aa, Homo Sapiens
LCLCCADRG

SEQ ID NO: 214995 - protein, 9 aa, Homo Sapiens
QHHSKVQGE

SEQ ID NO: 214996 - protein, 9 aa, Homo Sapiens
PHAAHPADA

SEQ ID NO: 214997 - protein, 9 aa, Homo Sapiens
NDADINDQM

SEQ ID NO: 214998 - protein, 9 aa, Homo Sapiens
GKGFPINPN

SEQ ID NO: 214999 - protein, 9 aa, Homo Sapiens
CPNRSPHSW

SEQ ID NO: 215000 - protein, 9 aa, Homo Sapiens
ERMGLMNAN

SEQ ID NO: 215001 - protein, 9 aa, Homo Sapiens
EPYKCSECG

SEQ ID NO: 215002 - protein, 9 aa, Homo Sapiens
ISHTSKSPR

SEQ ID NO: 215003 - protein, 9 aa, Homo Sapiens
VCSTWHVAH

SEQ ID NO: 215004 - protein, 9 aa, Homo Sapiens
EEHAVEEEA

SEQ ID NO: 215005 - protein, 9 aa, Homo Sapiens
YGKKLVKIS

SEQ ID NO: 215006 - protein, 9 aa, Homo Sapiens
SFLESVFKA

SEQ ID NO: 215007 - protein, 9 aa, Homo Sapiens
RCYTGSHQL

SEQ ID NO: 215008 - protein, 9 aa, Homo Sapiens
ISILYRNPN

SEQ ID NO: 215009 - protein, 9 aa, Homo Sapiens
SRRRPRPPL

SEQ ID NO: 215010 - protein, 9 aa, Homo Sapiens
PDFNVIVPI

SEQ ID NO: 215011 - protein, 9 aa, Homo Sapiens
LRIIGIQFQ

SEQ ID NO: 215012 - protein, 9 aa, Homo Sapiens
PCFQRDLPQ

SEQ ID NO: 215013 - protein, 9 aa, Homo Sapiens
PNVVDSFFV

SEQ ID NO: 215014 - protein, 9 aa, Homo Sapiens
RARAMLSVE

SEQ ID NO: 215015 - protein, 9 aa, Homo Sapiens
QMLPTLSTL

SEQ ID NO: 215016 - protein, 9 aa, Homo Sapiens
RSRGLGRPP

SEQ ID NO: 215017 - protein, 9 aa, Homo Sapiens
VAQMDDNNI

SEQ ID NO: 215018 - protein, 9 aa, Homo Sapiens
QLLQDAGHA

SEQ ID NO: 215019 - protein, 9 aa, Homo Sapiens
SSLQAETKE

SEQ ID NO: 215020 - protein, 9 aa, Homo Sapiens
KWGMTSWGT

SEQ ID NO: 215021 - protein, 9 aa, Homo Sapiens
YYFCILDTT

SEQ ID NO: 215022 - protein, 9 aa, Homo Sapiens
SGSGHCLCR

SEQ ID NO: 215023 - protein, 9 aa, Homo Sapiens
NLVRLMGPW

SEQ ID NO: 215024 - protein, 9 aa, Homo Sapiens
ILDFTRVNF

SEQ ID NO: 215025 - protein, 9 aa, Homo Sapiens
LLVTLVMFA

SEQ ID NO: 215026 - protein, 9 aa, Homo Sapiens
LVISERTHH

SEQ ID NO: 215027 - protein, 9 aa, Homo Sapiens
DCVAAAEPF

SEQ ID NO: 215028 - protein, 9 aa, Homo Sapiens
HRTIAECET

SEQ ID NO: 215029 - protein, 9 aa, Homo Sapiens
EKINAVHAI

SEQ ID NO: 215030 - protein, 9 aa, Homo Sapiens
RKTWQRRLR

SEQ ID NO: 215031 - protein, 9 aa, Homo Sapiens
NHPAHLRRY

SEQ ID NO: 215032 - protein, 9 aa, Homo Sapiens
HADDVKIFH

SEQ ID NO: 215033 - protein, 9 aa, Homo Sapiens
TSSPARSPA

SEQ ID NO: 215034 - protein, 9 aa, Homo Sapiens
TVEAVLLQQ

SEQ ID NO: 215035 - protein, 9 aa, Homo Sapiens
RRCQPHQAG

SEQ ID NO: 215036 - protein, 9 aa, Homo Sapiens
SIQFERVLL

SEQ ID NO: 215037 - protein, 9 aa, Homo Sapiens
MDLPSSLRP

SEQ ID NO: 215038 - protein, 9 aa, Homo Sapiens
KDVEKKKKR

SEQ ID NO: 215039 - protein, 9 aa, Homo Sapiens
VGPRDIKAF

SEQ ID NO: 215040 - protein, 9 aa, Homo Sapiens
GTSTIGLAL

SEQ ID NO: 215041 - protein, 9 aa, Homo Sapiens
ARGVTARSP

SEQ ID NO: 215042 - protein, 9 aa, Homo Sapiens
VVKQVQGLI

SEQ ID NO: 215043 - protein, 9 aa, Homo Sapiens
AKCQKPVTA

SEQ ID NO: 215044 - protein, 9 aa, Homo Sapiens
YGRRRSRAT

SEQ ID NO: 215045 - protein, 9 aa, Homo Sapiens
DNANFNQGL

SEQ ID NO: 215046 - protein, 9 aa, Homo Sapiens
STESRISFS

SEQ ID NO: 215047 - protein, 9 aa, Homo Sapiens
VRLQKYPQA

SEQ ID NO: 215048 - protein, 9 aa, Homo Sapiens
LLPLRVTDF

SEQ ID NO: 215049 - protein, 9 aa, Homo Sapiens
HSRSGSISQ

SEQ ID NO: 215050 - protein, 9 aa, Homo Sapiens
RGLWSWPPP

SEQ ID NO: 215051 - protein, 9 aa, Homo Sapiens
PPQPGLPDE

SEQ ID NO: 215052 - protein, 9 aa, Homo Sapiens
SASRSAASA

SEQ ID NO: 215053 - protein, 9 aa, Homo Sapiens
LSFAHPRQL

SEQ ID NO: 215054 - protein, 9 aa, Homo Sapiens
DSGDKVVAE

SEQ ID NO: 215055 - protein, 9 aa, Homo Sapiens
GASVSHHYG

SEQ ID NO: 215056 - protein, 9 aa, Homo Sapiens
ESQKPIHSW

SEQ ID NO: 215057 - protein, 9 aa, Homo Sapiens
EHIRQVHWD

SEQ ID NO: 215058 - protein, 9 aa, Homo Sapiens
DLRSCVAAS

SEQ ID NO: 215059 - protein, 9 aa, Homo Sapiens
LVSRGFDLD

SEQ ID NO: 215060 - protein, 9 aa, Homo Sapiens
SVDFSEVEW

SEQ ID NO: 215061 - protein, 9 aa, Homo Sapiens
MAVNKPAEF

SEQ ID NO: 215062 - protein, 9 aa, Homo Sapiens
SQCHCLPSP

SEQ ID NO: 215063 - protein, 9 aa, Homo Sapiens
YTLQPLDHE

SEQ ID NO: 215064 - protein, 9 aa, Homo Sapiens
AYAQGTLQG

SEQ ID NO: 215065 - protein, 9 aa, Homo Sapiens
GSRRRPRPP

SEQ ID NO: 215066 - protein, 9 aa, Homo Sapiens
TGRHTAGLK

SEQ ID NO: 215067 - protein, 9 aa, Homo Sapiens
NLNTLDRYG

SEQ ID NO: 215068 - protein, 9 aa, Homo Sapiens
PARGVVGPR

SEQ ID NO: 215069 - protein, 9 aa, Homo Sapiens
CTQRKTDSI

SEQ ID NO: 215070 - protein, 9 aa, Homo Sapiens
INLWKIIKK

SEQ ID NO: 215071 - protein, 9 aa, Homo Sapiens
EQATQVRSS

SEQ ID NO: 215072 - protein, 9 aa, Homo Sapiens
PRATSDSNP

SEQ ID NO: 215073 - protein, 9 aa, Homo Sapiens
GPASASGDN

SEQ ID NO: 215074 - protein, 9 aa, Homo Sapiens
GSFLTPGMP

SEQ ID NO: 215075 - protein, 9 aa, Homo Sapiens
GPWARNPTS

SEQ ID NO: 215076 - protein, 9 aa, Homo Sapiens
LLNPLIHSV

SEQ ID NO: 215077 - protein, 9 aa, Homo Sapiens
WDILPDTSL

SEQ ID NO: 215078 - protein, 9 aa, Homo Sapiens
TAEIFHSVD

SEQ ID NO: 215079 - protein, 9 aa, Homo Sapiens
TVEDLYLFK

SEQ ID NO: 215080 - protein, 9 aa, Homo Sapiens
SRLSLLAPK

SEQ ID NO: 215081 - protein, 9 aa, Homo Sapiens
CPMDHKPLV

SEQ ID NO: 215082 - protein, 9 aa, Homo Sapiens
LCGRCGATS

SEQ ID NO: 215083 - protein, 9 aa, Homo Sapiens
PSHKLTLEF

SEQ ID NO: 215084 - protein, 9 aa, Homo Sapiens
KRYDIPAMY

SEQ ID NO: 215085 - protein, 9 aa, Homo Sapiens
TEACDPHSR

SEQ ID NO: 215086 - protein, 9 aa, Homo Sapiens
VCQVKKSNT

SEQ ID NO: 215087 - protein, 9 aa, Homo Sapiens
LCSSASSAW

SEQ ID NO: 215088 - protein, 9 aa, Homo Sapiens
NTAHAYATV

SEQ ID NO: 215089 - protein, 9 aa, Homo Sapiens
MRSRGESGD

SEQ ID NO: 215090 - protein, 9 aa, Homo Sapiens
DLPSAWDIR

SEQ ID NO: 215091 - protein, 9 aa, Homo Sapiens
ETSGIRHLL

SEQ ID NO: 215092 - protein, 9 aa, Homo Sapiens
DGPPRALQT

SEQ ID NO: 215093 - protein, 9 aa, Homo Sapiens
LCVRPRARV

SEQ ID NO: 215094 - protein, 9 aa, Homo Sapiens
FLMGIPAAT

SEQ ID NO: 215095 - protein, 9 aa, Homo Sapiens
FIDVVKVGL

SEQ ID NO: 215096 - protein, 9 aa, Homo Sapiens
DLFREDYKQ

SEQ ID NO: 215097 - protein, 9 aa, Homo Sapiens
ELLEPLMTF

SEQ ID NO: 215098 - protein, 9 aa, Homo Sapiens
YLVRYVTEN

SEQ ID NO: 215099 - protein, 9 aa, Homo Sapiens
KSCRPWHSN

SEQ ID NO: 215100 - protein, 9 aa, Homo Sapiens
SSTTSISVC

SEQ ID NO: 215101 - protein, 9 aa, Homo Sapiens
HSYQLEGVN

SEQ ID NO: 215102 - protein, 9 aa, Homo Sapiens
GLWRPGWGC

SEQ ID NO: 215103 - protein, 9 aa, Homo Sapiens
PPGCSWRSR

SEQ ID NO: 215104 - protein, 9 aa, Homo Sapiens
NPPRPRLSG

SEQ ID NO: 215105 - protein, 9 aa, Homo Sapiens
GVVLARLKG

SEQ ID NO: 215106 - protein, 9 aa, Homo Sapiens
GGNKCVACG

SEQ ID NO: 215107 - protein, 9 aa, Homo Sapiens
SNAMCKLLK

SEQ ID NO: 215108 - protein, 9 aa, Homo Sapiens
SSRYRAKRR

SEQ ID NO: 215109 - protein, 9 aa, Homo Sapiens
RRHTLGGPE

SEQ ID NO: 215110 - protein, 9 aa, Homo Sapiens
TSSRYRAKR

SEQ ID NO: 215111 - protein, 9 aa, Homo Sapiens
IKVLGCPKI

SEQ ID NO: 215112 - protein, 9 aa, Homo Sapiens
SAGYTVLWI

SEQ ID NO: 215113 - protein, 9 aa, Homo Sapiens
LLVRYWHYF

SEQ ID NO: 215114 - protein, 9 aa, Homo Sapiens
HPSQLCAGP

SEQ ID NO: 215115 - protein, 9 aa, Homo Sapiens
EPSKLGRTM

SEQ ID NO: 215116 - protein, 9 aa, Homo Sapiens
VPGTGAQTG

SEQ ID NO: 215117 - protein, 9 aa, Homo Sapiens
QMSKVKVMP

SEQ ID NO: 215118 - protein, 9 aa, Homo Sapiens
HNRWEPEEN

SEQ ID NO: 215119 - protein, 9 aa, Homo Sapiens
HVLTPKTLL

SEQ ID NO: 215120 - protein, 9 aa, Homo Sapiens
AIFFMTTKL

SEQ ID NO: 215121 - protein, 9 aa, Homo Sapiens
KGGAEINTS

SEQ ID NO: 215122 - protein, 9 aa, Homo Sapiens
LLPALLGFR

SEQ ID NO: 215123 - protein, 9 aa, Homo Sapiens
SLEVARHHE

SEQ ID NO: 215124 - protein, 9 aa, Homo Sapiens
LADDVVGSA

SEQ ID NO: 215125 - protein, 9 aa, Homo Sapiens
CIGEDSVPH

SEQ ID NO: 215126 - protein, 9 aa, Homo Sapiens
WRSRSTLSL

SEQ ID NO: 215127 - protein, 9 aa, Homo Sapiens
FLDYVNGSV

SEQ ID NO: 215128 - protein, 9 aa, Homo Sapiens
EMDATPGVD

SEQ ID NO: 215129 - protein, 9 aa, Homo Sapiens
WPQLLQGSL

SEQ ID NO: 215130 - protein, 9 aa, Homo Sapiens
RCQPHQAGS

SEQ ID NO: 215131 - protein, 9 aa, Homo Sapiens
HSSDISCVG

SEQ ID NO: 215132 - protein, 9 aa, Homo Sapiens
PRRTHLCSA

SEQ ID NO: 215133 - protein, 9 aa, Homo Sapiens
AEETNGGTQ

SEQ ID NO: 215134 - protein, 9 aa, Homo Sapiens
NYRLMFQSS

SEQ ID NO: 215135 - protein, 9 aa, Homo Sapiens
AISEGFLKA

SEQ ID NO: 215136 - protein, 9 aa, Homo Sapiens
AFSAPQGNC

SEQ ID NO: 215137 - protein, 9 aa, Homo Sapiens
VAVHHGKIS

SEQ ID NO: 215138 - protein, 9 aa, Homo Sapiens
LFEHLSHIG

SEQ ID NO: 215139 - protein, 9 aa, Homo Sapiens
RPPLGGDTA

SEQ ID NO: 215140 - protein, 9 aa, Homo Sapiens
MNVLSVSPG

SEQ ID NO: 215141 - protein, 9 aa, Homo Sapiens
DTRHSTRPA

SEQ ID NO: 215142 - protein, 9 aa, Homo Sapiens
LGISILYRN

SEQ ID NO: 215143 - protein, 9 aa, Homo Sapiens
CRTQLVDTA

SEQ ID NO: 215144 - protein, 9 aa, Homo Sapiens
PPDTTEEVH

SEQ ID NO: 215145 - protein, 9 aa, Homo Sapiens
LLSLYDPWM

SEQ ID NO: 215146 - protein, 9 aa, Homo Sapiens
VCQHNVRKD

SEQ ID NO: 215147 - protein, 9 aa, Homo Sapiens
SLMAMDFSG

SEQ ID NO: 215148 - protein, 9 aa, Homo Sapiens
NTGGRGFKA

SEQ ID NO: 215149 - protein, 9 aa, Homo Sapiens
PGCLLRGLW

SEQ ID NO: 215150 - protein, 9 aa, Homo Sapiens
PHAGPSGCG

SEQ ID NO: 215151 - protein, 9 aa, Homo Sapiens
AVHFSAITK

SEQ ID NO: 215152 - protein, 9 aa, Homo Sapiens
VFQQWKCCT

SEQ ID NO: 215153 - protein, 9 aa, Homo Sapiens
LSGGQKQWI

SEQ ID NO: 215154 - protein, 9 aa, Homo Sapiens
IGTHSANIQ

SEQ ID NO: 215155 - protein, 9 aa, Homo Sapiens
KRYLQDTWS

SEQ ID NO: 215156 - protein, 9 aa, Homo Sapiens
TPPSRPRTA

SEQ ID NO: 215157 - protein, 9 aa, Homo Sapiens
GSRGAWTNN

SEQ ID NO: 215158 - protein, 9 aa, Homo Sapiens
PKSVFHTGW

SEQ ID NO: 215159 - protein, 9 aa, Homo Sapiens
VETIWDILP

SEQ ID NO: 215160 - protein, 9 aa, Homo Sapiens
SVILKSCTQ

SEQ ID NO: 215161 - protein, 9 aa, Homo Sapiens
FARSKIPMK

SEQ ID NO: 215162 - protein, 9 aa, Homo Sapiens
TYSGPPQGQ

SEQ ID NO: 215163 - protein, 9 aa, Homo Sapiens
SPELGIKAG

SEQ ID NO: 215164 - protein, 9 aa, Homo Sapiens
TCFTGFLGM

SEQ ID NO: 215165 - protein, 9 aa, Homo Sapiens
EDHVDMSLS

SEQ ID NO: 215166 - protein, 9 aa, Homo Sapiens
SEKRKEVNG

SEQ ID NO: 215167 - protein, 9 aa, Homo Sapiens
SGPIQAYIL

SEQ ID NO: 215168 - protein, 9 aa, Homo Sapiens
QSLPRLGCP

SEQ ID NO: 215169 - protein, 9 aa, Homo Sapiens
SFPKAAWQF

SEQ ID NO: 215170 - protein, 9 aa, Homo Sapiens
YVRNSWAIG

SEQ ID NO: 215171 - protein, 9 aa, Homo Sapiens
VIQYNKNRQ

SEQ ID NO: 215172 - protein, 9 aa, Homo Sapiens
RTSKELVSR

SEQ ID NO: 215173 - protein, 9 aa, Homo Sapiens
YRTSSATSG

SEQ ID NO: 215174 - protein, 9 aa, Homo Sapiens
IFTCETSGI

SEQ ID NO: 215175 - protein, 9 aa, Homo Sapiens
MEHLKKLSV

SEQ ID NO: 215176 - protein, 9 aa, Homo Sapiens
KHSDNAELN

SEQ ID NO: 215177 - protein, 9 aa, Homo Sapiens
ILPMKIPRQ

SEQ ID NO: 215178 - protein, 9 aa, Homo Sapiens
NWIDMKQAL

SEQ ID NO: 215179 - protein, 9 aa, Homo Sapiens
EVQFDLVSR

SEQ ID NO: 215180 - protein, 9 aa, Homo Sapiens
VFTFGLFAT

SEQ ID NO: 215181 - protein, 9 aa, Homo Sapiens
PSDRQSCPS

SEQ ID NO: 215182 - protein, 9 aa, Homo Sapiens
HVAHTFLLM

SEQ ID NO: 215183 - protein, 9 aa, Homo Sapiens
NYNSVDFSE

SEQ ID NO: 215184 - protein, 9 aa, Homo Sapiens
GLHSLVHGL

SEQ ID NO: 215185 - protein, 9 aa, Homo Sapiens
PSMRSDRLA

SEQ ID NO: 215186 - protein, 9 aa, Homo Sapiens
LGGAQAARI

SEQ ID NO: 215187 - protein, 9 aa, Homo Sapiens
HQAGSPRYQ

SEQ ID NO: 215188 - protein, 9 aa, Homo Sapiens
NVGAIVLAN

SEQ ID NO: 215189 - protein, 9 aa, Homo Sapiens
LTLRTSKEL

SEQ ID NO: 215190 - protein, 9 aa, Homo Sapiens
TGGGPWSCV

SEQ ID NO: 215191 - protein, 9 aa, Homo Sapiens
LQAETKEDL

SEQ ID NO: 215192 - protein, 9 aa, Homo Sapiens
LRAFLDQPH

SEQ ID NO: 215193 - protein, 9 aa, Homo Sapiens
QQDLDPCFQ

SEQ ID NO: 215194 - protein, 9 aa, Homo Sapiens
FPMVPGETG

SEQ ID NO: 215195 - protein, 9 aa, Homo Sapiens
LPETALKQY

SEQ ID NO: 215196 - protein, 9 aa, Homo Sapiens
AKSPLNQKI

SEQ ID NO: 215197 - protein, 9 aa, Homo Sapiens
VCQGINDFL

SEQ ID NO: 215198 - protein, 9 aa, Homo Sapiens
EYQGAVPCQ

SEQ ID NO: 215199 - protein, 9 aa, Homo Sapiens
SKTGQKVNP

SEQ ID NO: 215200 - protein, 9 aa, Homo Sapiens
SPRGPVFPP

SEQ ID NO: 215201 - protein, 9 aa, Homo Sapiens
PIYRSSLSH

SEQ ID NO: 215202 - protein, 9 aa, Homo Sapiens
IIRKLDLLG

SEQ ID NO: 215203 - protein, 9 aa, Homo Sapiens
EGLTFKDVV

SEQ ID NO: 215204 - protein, 9 aa, Homo Sapiens
LLVPCAHRN

SEQ ID NO: 215205 - protein, 9 aa, Homo Sapiens
RPSQLCSQG

SEQ ID NO: 215206 - protein, 9 aa, Homo Sapiens
LSLQQWKRP

SEQ ID NO: 215207 - protein, 9 aa, Homo Sapiens
NGVLDFFSR

SEQ ID NO: 215208 - protein, 9 aa, Homo Sapiens
TFLVLSDEE

SEQ ID NO: 215209 - protein, 9 aa, Homo Sapiens
YPGGKEETL

SEQ ID NO: 215210 - protein, 9 aa, Homo Sapiens
KKQMQHVHN

SEQ ID NO: 215211 - protein, 9 aa, Homo Sapiens
SREYWRWLR

SEQ ID NO: 215212 - protein, 9 aa, Homo Sapiens
SVMQLRLNT

SEQ ID NO: 215213 - protein, 9 aa, Homo Sapiens
GFNRQPPHM

SEQ ID NO: 215214 - protein, 9 aa, Homo Sapiens
DAETKLNDV

SEQ ID NO: 215215 - protein, 9 aa, Homo Sapiens
CGAPRSWGC

SEQ ID NO: 215216 - protein, 9 aa, Homo Sapiens
ATTCTWTCG

SEQ ID NO: 215217 - protein, 9 aa, Homo Sapiens
SPQQRNWLT

SEQ ID NO: 215218 - protein, 9 aa, Homo Sapiens
LAFSAPQGN

SEQ ID NO: 215219 - protein, 9 aa, Homo Sapiens
RRIPAGRRS

SEQ ID NO: 215220 - protein, 9 aa, Homo Sapiens
ESFQENEDG

SEQ ID NO: 215221 - protein, 9 aa, Homo Sapiens
GQLSAPTAP

SEQ ID NO: 215222 - protein, 9 aa, Homo Sapiens
TEISVGTYE

SEQ ID NO: 215223 - protein, 9 aa, Homo Sapiens
PMQPSSTWT

SEQ ID NO: 215224 - protein, 9 aa, Homo Sapiens
MTSPISSGS

SEQ ID NO: 215225 - protein, 9 aa, Homo Sapiens
CGCYVLHQK

SEQ ID NO: 215226 - protein, 9 aa, Homo Sapiens
HKARSGKGE

SEQ ID NO: 215227 - protein, 9 aa, Homo Sapiens
PVATDDPDE

SEQ ID NO: 215228 - protein, 9 aa, Homo Sapiens
ARARASYSP

SEQ ID NO: 215229 - protein, 9 aa, Homo Sapiens
LWKRLKVFS

SEQ ID NO: 215230 - protein, 9 aa, Homo Sapiens
KVMPHHSLK

SEQ ID NO: 215231 - protein, 9 aa, Homo Sapiens
CAVPHATHR

SEQ ID NO: 215232 - protein, 9 aa, Homo Sapiens
RAGPHAPCR

SEQ ID NO: 215233 - protein, 9 aa, Homo Sapiens
RLRKFYKEE

SEQ ID NO: 215234 - protein, 9 aa, Homo Sapiens
GSSLTSQLM

SEQ ID NO: 215235 - protein, 9 aa, Homo Sapiens
HLKLQETAY

SEQ ID NO: 215236 - protein, 9 aa, Homo Sapiens
KDKVDHTVN

SEQ ID NO: 215237 - protein, 9 aa, Homo Sapiens
GSTQNNTNV

SEQ ID NO: 215238 - protein, 9 aa, Homo Sapiens
PQGNCCQTR

SEQ ID NO: 215239 - protein, 9 aa, Homo Sapiens
RVPLTPCSH

SEQ ID NO: 215240 - protein, 9 aa, Homo Sapiens
GLGLLLHHI

SEQ ID NO: 215241 - protein, 9 aa, Homo Sapiens
PHTVLSHEP

SEQ ID NO: 215242 - protein, 9 aa, Homo Sapiens
GRKRKKQTS

SEQ ID NO: 215243 - protein, 9 aa, Homo Sapiens
ISWDPVNVH

SEQ ID NO: 215244 - protein, 9 aa, Homo Sapiens
PWTRANART

SEQ ID NO: 215245 - protein, 9 aa, Homo Sapiens
VSPGSCLEE

SEQ ID NO: 215246 - protein, 9 aa, Homo Sapiens
NRISYNWYA

SEQ ID NO: 215247 - protein, 9 aa, Homo Sapiens
SCKLRIIGI

SEQ ID NO: 215248 - protein, 9 aa, Homo Sapiens
LNKVSILES

SEQ ID NO: 215249 - protein, 9 aa, Homo Sapiens
EKDFCPMDH

SEQ ID NO: 215250 - protein, 9 aa, Homo Sapiens
GLRIHGPTH

SEQ ID NO: 215251 - protein, 9 aa, Homo Sapiens
IGQVTVLKY

SEQ ID NO: 215252 - protein, 9 aa, Homo Sapiens
EHSHQIFVT

SEQ ID NO: 215253 - protein, 9 aa, Homo Sapiens
PSKKKLKLA

SEQ ID NO: 215254 - protein, 9 aa, Homo Sapiens
TSPRRPGSA

SEQ ID NO: 215255 - protein, 9 aa, Homo Sapiens
EGAAWAPGA

SEQ ID NO: 215256 - protein, 9 aa, Homo Sapiens
CWIFIPRSP

SEQ ID NO: 215257 - protein, 9 aa, Homo Sapiens
AMEETEVGA

SEQ ID NO: 215258 - protein, 9 aa, Homo Sapiens
KSNKKISVL

SEQ ID NO: 215259 - protein, 9 aa, Homo Sapiens
QVALHLDDL

SEQ ID NO: 215260 - protein, 9 aa, Homo Sapiens
QEGETIMMR

SEQ ID NO: 215261 - protein, 9 aa, Homo Sapiens
RRKWGMTSW

SEQ ID NO: 215262 - protein, 9 aa, Homo Sapiens
QTLQVIIDF

SEQ ID NO: 215263 - protein, 9 aa, Homo Sapiens
ITPFPAEPT

SEQ ID NO: 215264 - protein, 9 aa, Homo Sapiens
SEEELNSPG

SEQ ID NO: 215265 - protein, 9 aa, Homo Sapiens
DTYSGPPQG

SEQ ID NO: 215266 - protein, 9 aa, Homo Sapiens
KSRLECYTK

SEQ ID NO: 215267 - protein, 9 aa, Homo Sapiens
KPVNMDNLG

SEQ ID NO: 215268 - protein, 9 aa, Homo Sapiens
TLKMILTLM

SEQ ID NO: 215269 - protein, 9 aa, Homo Sapiens
PRPSQLCSQ

SEQ ID NO: 215270 - protein, 9 aa, Homo Sapiens
PGTGAQTGC

SEQ ID NO: 215271 - protein, 9 aa, Homo Sapiens
GRVSWWPRE

SEQ ID NO: 215272 - protein, 9 aa, Homo Sapiens
EHKRKLESI

SEQ ID NO: 215273 - protein, 9 aa, Homo Sapiens
HSVKNSEVK

SEQ ID NO: 215274 - protein, 9 aa, Homo Sapiens
KCDKAFTRS

SEQ ID NO: 215275 - protein, 9 aa, Homo Sapiens
ELSFPPAVQ

SEQ ID NO: 215276 - protein, 9 aa, Homo Sapiens
AHTFLLMPR

SEQ ID NO: 215277 - protein, 9 aa, Homo Sapiens
KAPKSSFIG

SEQ ID NO: 215278 - protein, 9 aa, Homo Sapiens
EITTIMVNN

SEQ ID NO: 215279 - protein, 9 aa, Homo Sapiens
VTPLGTGQD

SEQ ID NO: 215280 - protein, 9 aa, Homo Sapiens
VLELERRFI

SEQ ID NO: 215281 - protein, 9 aa, Homo Sapiens
HSKCFEDYL

SEQ ID NO: 215282 - protein, 9 aa, Homo Sapiens
NSWRAWGSP

SEQ ID NO: 215283 - protein, 9 aa, Homo Sapiens
TLMYILEKQ

SEQ ID NO: 215284 - protein, 9 aa, Homo Sapiens
HHGGEEVLL

SEQ ID NO: 215285 - protein, 9 aa, Homo Sapiens
RTLTWTWQW

SEQ ID NO: 215286 - protein, 9 aa, Homo Sapiens
IQKKTKCQE

SEQ ID NO: 215287 - protein, 9 aa, Homo Sapiens
GGTVWPPTA

SEQ ID NO: 215288 - protein, 9 aa, Homo Sapiens
ATRGCLGNQ

SEQ ID NO: 215289 - protein, 9 aa, Homo Sapiens
QLQIKLYNP

SEQ ID NO: 215290 - protein, 9 aa, Homo Sapiens
TDLLVNDNT

SEQ ID NO: 215291 - protein, 9 aa, Homo Sapiens
QVILILRLP

SEQ ID NO: 215292 - protein, 9 aa, Homo Sapiens
VHAWRTLFF

SEQ ID NO: 215293 - protein, 9 aa, Homo Sapiens
KKTINMLQI

SEQ ID NO: 215294 - protein, 9 aa, Homo Sapiens
GPYAEVKPI

SEQ ID NO: 215295 - protein, 9 aa, Homo Sapiens
GVEEIRQAN

SEQ ID NO: 215296 - protein, 9 aa, Homo Sapiens
APSIFWMRR

SEQ ID NO: 215297 - protein, 9 aa, Homo Sapiens
QILSDFRAV

SEQ ID NO: 215298 - protein, 9 aa, Homo Sapiens
QRVPGASNG

SEQ ID NO: 215299 - protein, 9 aa, Homo Sapiens
MSLACSITV

SEQ ID NO: 215300 - protein, 9 aa, Homo Sapiens
PRALQAGGF

SEQ ID NO: 215301 - protein, 9 aa, Homo Sapiens
PGLVATRAL

SEQ ID NO: 215302 - protein, 9 aa, Homo Sapiens
CRGAQNMEF

SEQ ID NO: 215303 - protein, 9 aa, Homo Sapiens
GFSPRGRER

SEQ ID NO: 215304 - protein, 9 aa, Homo Sapiens
YGFGLSLEV

SEQ ID NO: 215305 - protein, 9 aa, Homo Sapiens
LGLAPQAHP

SEQ ID NO: 215306 - protein, 9 aa, Homo Sapiens
WLSQMQKNN

SEQ ID NO: 215307 - protein, 9 aa, Homo Sapiens
PPPEYSLFM

SEQ ID NO: 215308 - protein, 9 aa, Homo Sapiens
GGKFAPFFV

SEQ ID NO: 215309 - protein, 9 aa, Homo Sapiens
TRSSPGLPS

SEQ ID NO: 215310 - protein, 9 aa, Homo Sapiens
VPVDDWGAA

SEQ ID NO: 215311 - protein, 9 aa, Homo Sapiens
APRSWGCTT

SEQ ID NO: 215312 - protein, 9 aa, Homo Sapiens
YFNTPRLQV

SEQ ID NO: 215313 - protein, 9 aa, Homo Sapiens
PNKALFIKE

SEQ ID NO: 215314 - protein, 9 aa, Homo Sapiens
STKKILKLT

SEQ ID NO: 215315 - protein, 9 aa, Homo Sapiens
QRRLRACRA

SEQ ID NO: 215316 - protein, 9 aa, Homo Sapiens
DTTEEVHHK

SEQ ID NO: 215317 - protein, 9 aa, Homo Sapiens
CQDLGIGQL

SEQ ID NO: 215318 - protein, 9 aa, Homo Sapiens
PPKALEQEQ

SEQ ID NO: 215319 - protein, 9 aa, Homo Sapiens
PLYGFHAHE

SEQ ID NO: 215320 - protein, 9 aa, Homo Sapiens
LLQEALLHF

SEQ ID NO: 215321 - protein, 9 aa, Homo Sapiens
MKRYSTSPS

SEQ ID NO: 215322 - protein, 9 aa, Homo Sapiens
ALLFLLSTT

SEQ ID NO: 215323 - protein, 9 aa, Homo Sapiens
MTIIITVMD

SEQ ID NO: 215324 - protein, 9 aa, Homo Sapiens
SRSMLREWY

SEQ ID NO: 215325 - protein, 9 aa, Homo Sapiens
SDLPPGTKF

SEQ ID NO: 215326 - protein, 9 aa, Homo Sapiens
QEFVQLHEG

SEQ ID NO: 215327 - protein, 9 aa, Homo Sapiens
CWTPTPCSS

SEQ ID NO: 215328 - protein, 9 aa, Homo Sapiens
TWLSLWSHR

SEQ ID NO: 215329 - protein, 9 aa, Homo Sapiens
VLDVSSISH

SEQ ID NO: 215330 - protein, 9 aa, Homo Sapiens
SERTHHSFR

SEQ ID NO: 215331 - protein, 9 aa, Homo Sapiens
TLDGPADPQ

SEQ ID NO: 215332 - protein, 9 aa, Homo Sapiens
PPSGDMMSS

SEQ ID NO: 215333 - protein, 9 aa, Homo Sapiens
TWHVAHTFL

SEQ ID NO: 215334 - protein, 9 aa, Homo Sapiens
DLRCPLTAP

SEQ ID NO: 215335 - protein, 9 aa, Homo Sapiens
VLSPWCLSC

SEQ ID NO: 215336 - protein, 9 aa, Homo Sapiens
SLGYPVSTW

SEQ ID NO: 215337 - protein, 9 aa, Homo Sapiens
SLAGNDRHP

SEQ ID NO: 215338 - protein, 9 aa, Homo Sapiens
DAVAVHHGK

SEQ ID NO: 215339 - protein, 9 aa, Homo Sapiens
AAASCSQTV

SEQ ID NO: 215340 - protein, 9 aa, Homo Sapiens
EILKDQVGG

SEQ ID NO: 215341 - protein, 9 aa, Homo Sapiens
QELEKWLLD

SEQ ID NO: 215342 - protein, 9 aa, Homo Sapiens
EMLDAELEL

SEQ ID NO: 215343 - protein, 9 aa, Homo Sapiens
GKLYLLLAF

SEQ ID NO: 215344 - protein, 9 aa, Homo Sapiens
QVFPCAKGN

SEQ ID NO: 215345 - protein, 9 aa, Homo Sapiens
VRLDGQLYC

SEQ ID NO: 215346 - protein, 9 aa, Homo Sapiens
ERILAVPVH

SEQ ID NO: 215347 - protein, 9 aa, Homo Sapiens
LILQQLNQR

SEQ ID NO: 215348 - protein, 9 aa, Homo Sapiens
EEDIVDFLQ

SEQ ID NO: 215349 - protein, 9 aa, Homo Sapiens
APRYTVKSC

SEQ ID NO: 215350 - protein, 9 aa, Homo Sapiens
SLSGGAWSM

SEQ ID NO: 215351 - protein, 9 aa, Homo Sapiens
VGPRGQDPV

SEQ ID NO: 215352 - protein, 9 aa, Homo Sapiens
GGAQAISYV

SEQ ID NO: 215353 - protein, 9 aa, Homo Sapiens
THTSRNCTA

SEQ ID NO: 215354 - protein, 9 aa, Homo Sapiens
SVTLVDIYR

SEQ ID NO: 215355 - protein, 9 aa, Homo Sapiens
GKVYTLQPL

SEQ ID NO: 215356 - protein, 9 aa, Homo Sapiens
AWGSASCFS

SEQ ID NO: 215357 - protein, 9 aa, Homo Sapiens
GGWLRRHMI

SEQ ID NO: 215358 - protein, 9 aa, Homo Sapiens
YHYSCAAGA

SEQ ID NO: 215359 - protein, 9 aa, Homo Sapiens
HSPERRCRY

SEQ ID NO: 215360 - protein, 9 aa, Homo Sapiens
SACSTAKAT

SEQ ID NO: 215361 - protein, 9 aa, Homo Sapiens
EPPRPHASP

SEQ ID NO: 215362 - protein, 9 aa, Homo Sapiens
LATHDGHPQ

SEQ ID NO: 215363 - protein, 9 aa, Homo Sapiens
DIGRSKELT

SEQ ID NO: 215364 - protein, 9 aa, Homo Sapiens
SDFNTGGRG

SEQ ID NO: 215365 - protein, 9 aa, Homo Sapiens
RTWIGNQRR

SEQ ID NO: 215366 - protein, 9 aa, Homo Sapiens
FIQSNLQGV

SEQ ID NO: 215367 - protein, 9 aa, Homo Sapiens
VFFCICGAS

SEQ ID NO: 215368 - protein, 9 aa, Homo Sapiens
PPGGGTIQP

SEQ ID NO: 215369 - protein, 9 aa, Homo Sapiens
QNMIPQMAR

SEQ ID NO: 215370 - protein, 9 aa, Homo Sapiens
CLDHTNVVQ

SEQ ID NO: 215371 - protein, 9 aa, Homo Sapiens
TVIAGAHHC

SEQ ID NO: 215372 - protein, 9 aa, Homo Sapiens
RALQHHSKV

SEQ ID NO: 215373 - protein, 9 aa, Homo Sapiens
DQANKLKKM

SEQ ID NO: 215374 - protein, 9 aa, Homo Sapiens
PQSRTTTHF

SEQ ID NO: 215375 - protein, 9 aa, Homo Sapiens
PASRGPSTG

SEQ ID NO: 215376 - protein, 9 aa, Homo Sapiens
QLEHSHQIF

SEQ ID NO: 215377 - protein, 9 aa, Homo Sapiens
MYWLLFRQD

SEQ ID NO: 215378 - protein, 9 aa, Homo Sapiens
QQVLCVVRQ

SEQ ID NO: 215379 - protein, 9 aa, Homo Sapiens
LSASNSSSR

SEQ ID NO: 215380 - protein, 9 aa, Homo Sapiens
IRELFSTFV

SEQ ID NO: 215381 - protein, 9 aa, Homo Sapiens
TIVRIASIA

SEQ ID NO: 215382 - protein, 9 aa, Homo Sapiens
CDPHSRHCL

SEQ ID NO: 215383 - protein, 9 aa, Homo Sapiens
LMIRKQILK

SEQ ID NO: 215384 - protein, 9 aa, Homo Sapiens
IFLESPNLP

SEQ ID NO: 215385 - protein, 9 aa, Homo Sapiens
AAGGQPSRD

SEQ ID NO: 215386 - protein, 9 aa, Homo Sapiens
ANSGHQVPP

SEQ ID NO: 215387 - protein, 9 aa, Homo Sapiens
QQRNWLTVL

SEQ ID NO: 215388 - protein, 9 aa, Homo Sapiens
NDDSPESAN

SEQ ID NO: 215389 - protein, 9 aa, Homo Sapiens
TSHSSPADW

SEQ ID NO: 215390 - protein, 9 aa, Homo Sapiens
SNVCVIKDK

SEQ ID NO: 215391 - protein, 9 aa, Homo Sapiens
VQTEYVPLL

SEQ ID NO: 215392 - protein, 9 aa, Homo Sapiens
RMDQTFKIL

SEQ ID NO: 215393 - protein, 9 aa, Homo Sapiens
SGRPRRCWT

SEQ ID NO: 215394 - protein, 9 aa, Homo Sapiens
CVTAPRHCL

SEQ ID NO: 215395 - protein, 9 aa, Homo Sapiens
KLVWTEVLV

SEQ ID NO: 215396 - protein, 9 aa, Homo Sapiens
FWFVEGFPW

SEQ ID NO: 215397 - protein, 9 aa, Homo Sapiens
QCRGRPARS

SEQ ID NO: 215398 - protein, 9 aa, Homo Sapiens
LEFRRERIQ

SEQ ID NO: 215399 - protein, 9 aa, Homo Sapiens
LYNVIAMAL

SEQ ID NO: 215400 - protein, 9 aa, Homo Sapiens
SYPRRSQER

SEQ ID NO: 215401 - protein, 9 aa, Homo Sapiens
VCYLKKAFN

SEQ ID NO: 215402 - protein, 9 aa, Homo Sapiens
VNLAKFHKL

SEQ ID NO: 215403 - protein, 9 aa, Homo Sapiens
TPPASSGTS

SEQ ID NO: 215404 - protein, 9 aa, Homo Sapiens
TPPRAEVSQ

SEQ ID NO: 215405 - protein, 9 aa, Homo Sapiens
HSGPIGHLS

SEQ ID NO: 215406 - protein, 9 aa, Homo Sapiens
ANEKITPFP

SEQ ID NO: 215407 - protein, 9 aa, Homo Sapiens
CGSATGWWT

SEQ ID NO: 215408 - protein, 9 aa, Homo Sapiens
TKYCSAKCQ

SEQ ID NO: 215409 - protein, 9 aa, Homo Sapiens
AVRLASVLR

SEQ ID NO: 215410 - protein, 9 aa, Homo Sapiens
YRLAGLPRE

SEQ ID NO: 215411 - protein, 9 aa, Homo Sapiens
SSGRQCGPC

SEQ ID NO: 215412 - protein, 9 aa, Homo Sapiens
PLCSTSAGK

SEQ ID NO: 215413 - protein, 9 aa, Homo Sapiens
KYPSCGGLR

SEQ ID NO: 215414 - protein, 9 aa, Homo Sapiens
RSRGAMEET

SEQ ID NO: 215415 - protein, 9 aa, Homo Sapiens
EVEDDEKMT

SEQ ID NO: 215416 - protein, 9 aa, Homo Sapiens
LPKRCNKKI

SEQ ID NO: 215417 - protein, 9 aa, Homo Sapiens
SVSNNPVIE

SEQ ID NO: 215418 - protein, 9 aa, Homo Sapiens
PAGGFEDED

SEQ ID NO: 215419 - protein, 9 aa, Homo Sapiens
ARHAAKMAD

SEQ ID NO: 215420 - protein, 9 aa, Homo Sapiens
EQPEKKVMS

SEQ ID NO: 215421 - protein, 9 aa, Homo Sapiens
GQAPACLER

SEQ ID NO: 215422 - protein, 9 aa, Homo Sapiens
GQCNTTTGS

SEQ ID NO: 215423 - protein, 9 aa, Homo Sapiens
DAQVSNGSN

SEQ ID NO: 215424 - protein, 9 aa, Homo Sapiens
LEGHLVRQD

SEQ ID NO: 215425 - protein, 9 aa, Homo Sapiens
VYPGYDVEI

SEQ ID NO: 215426 - protein, 9 aa, Homo Sapiens
TASSTTSIS

SEQ ID NO: 215427 - protein, 9 aa, Homo Sapiens
TAASMKMNA

SEQ ID NO: 215428 - protein, 9 aa, Homo Sapiens
WLLCPFRGL

SEQ ID NO: 215429 - protein, 9 aa, Homo Sapiens
MRSTLRKLK

SEQ ID NO: 215430 - protein, 9 aa, Homo Sapiens
AVKAYDHQT

SEQ ID NO: 215431 - protein, 9 aa, Homo Sapiens
HLNPNRTYL

SEQ ID NO: 215432 - protein, 9 aa, Homo Sapiens
ALSSRDRAM

SEQ ID NO: 215433 - protein, 9 aa, Homo Sapiens
KGVLGYKID

SEQ ID NO: 215434 - protein, 9 aa, Homo Sapiens
ALVATTINL

SEQ ID NO: 215435 - protein, 9 aa, Homo Sapiens
NLRRMATDR

SEQ ID NO: 215436 - protein, 9 aa, Homo Sapiens
IFPESLVRF

SEQ ID NO: 215437 - protein, 9 aa, Homo Sapiens
LVVAVQGPI

SEQ ID NO: 215438 - protein, 9 aa, Homo Sapiens
VVLLGLFEE

SEQ ID NO: 215439 - protein, 9 aa, Homo Sapiens
DHVSTAKYN

SEQ ID NO: 215440 - protein, 9 aa, Homo Sapiens
QVSAPNLTP

SEQ ID NO: 215441 - protein, 9 aa, Homo Sapiens
VDTIGEKTD

SEQ ID NO: 215442 - protein, 9 aa, Homo Sapiens
STSCSTAAT

SEQ ID NO: 215443 - protein, 9 aa, Homo Sapiens
LSNQAGGPE

SEQ ID NO: 215444 - protein, 9 aa, Homo Sapiens
VLKELGFCI

SEQ ID NO: 215445 - protein, 9 aa, Homo Sapiens
AASRRRAGG

SEQ ID NO: 215446 - protein, 9 aa, Homo Sapiens
YEDKVHVWQ

SEQ ID NO: 215447 - protein, 9 aa, Homo Sapiens
EGPYVPRSW

SEQ ID NO: 215448 - protein, 9 aa, Homo Sapiens
INAVHAIVP

SEQ ID NO: 215449 - protein, 9 aa, Homo Sapiens
NPVEEIFIE

SEQ ID NO: 215450 - protein, 9 aa, Homo Sapiens
GPGGSVSTS

SEQ ID NO: 215451 - protein, 9 aa, Homo Sapiens
QRYEDMKNH

SEQ ID NO: 215452 - protein, 9 aa, Homo Sapiens
RLAGSVGVL

SEQ ID NO: 215453 - protein, 9 aa, Homo Sapiens
VIIDFILER

SEQ ID NO: 215454 - protein, 9 aa, Homo Sapiens
YSSHYAREW

SEQ ID NO: 215455 - protein, 9 aa, Homo Sapiens
SGGEKEEDK

SEQ ID NO: 215456 - protein, 9 aa, Homo Sapiens
FFMTTKLPL

SEQ ID NO: 215457 - protein, 9 aa, Homo Sapiens
GATAVFDMS

SEQ ID NO: 215458 - protein, 9 aa, Homo Sapiens
LCMLKLGRH

SEQ ID NO: 215459 - protein, 9 aa, Homo Sapiens
DPSPDYCVH

SEQ ID NO: 215460 - protein, 9 aa, Homo Sapiens
QPPGDCPRT

SEQ ID NO: 215461 - protein, 9 aa, Homo Sapiens
AVPVHTDAQ

SEQ ID NO: 215462 - protein, 9 aa, Homo Sapiens
IWDATILEY

SEQ ID NO: 215463 - protein, 9 aa, Homo Sapiens
GEFHFIILV

SEQ ID NO: 215464 - protein, 9 aa, Homo Sapiens
GFFWAKSPL

SEQ ID NO: 215465 - protein, 9 aa, Homo Sapiens
QLLCQNPEK

SEQ ID NO: 215466 - protein, 9 aa, Homo Sapiens
GFHIKSPKR

SEQ ID NO: 215467 - protein, 9 aa, Homo Sapiens
EVWFNEKSA

SEQ ID NO: 215468 - protein, 9 aa, Homo Sapiens
LDTTANRTQ

SEQ ID NO: 215469 - protein, 9 aa, Homo Sapiens
IKDSKENKE

SEQ ID NO: 215470 - protein, 9 aa, Homo Sapiens
DMGARGLPH

SEQ ID NO: 215471 - protein, 9 aa, Homo Sapiens
LGPPTCSFV

SEQ ID NO: 215472 - protein, 9 aa, Homo Sapiens
ELFCQAPSI

SEQ ID NO: 215473 - protein, 9 aa, Homo Sapiens
SWGLPRLMS

SEQ ID NO: 215474 - protein, 9 aa, Homo Sapiens
YVPRSWSSG

SEQ ID NO: 215475 - protein, 9 aa, Homo Sapiens
RSPPRLECP

SEQ ID NO: 215476 - protein, 9 aa, Homo Sapiens
PPVTPLRVQ

SEQ ID NO: 215477 - protein, 9 aa, Homo Sapiens
SQAMATESS

SEQ ID NO: 215478 - protein, 9 aa, Homo Sapiens
WRGQCNTTT

SEQ ID NO: 215479 - protein, 9 aa, Homo Sapiens
RISFSQHAR

SEQ ID NO: 215480 - protein, 9 aa, Homo Sapiens
LTKIYQLIH

SEQ ID NO: 215481 - protein, 9 aa, Homo Sapiens
AAHWVFLAT

SEQ ID NO: 215482 - protein, 9 aa, Homo Sapiens
PSSTPPSRP

SEQ ID NO: 215483 - protein, 9 aa, Homo Sapiens
LVHMIEHTQ

SEQ ID NO: 215484 - protein, 9 aa, Homo Sapiens
HLEEHAVEE

SEQ ID NO: 215485 - protein, 9 aa, Homo Sapiens
RLVLASLQV

SEQ ID NO: 215486 - protein, 9 aa, Homo Sapiens
LRKFYKEEK

SEQ ID NO: 215487 - protein, 9 aa, Homo Sapiens
LDVMDHLQS

SEQ ID NO: 215488 - protein, 9 aa, Homo Sapiens
VAAQMFLFS

SEQ ID NO: 215489 - protein, 9 aa, Homo Sapiens
PGWAPCGWP

SEQ ID NO: 215490 - protein, 9 aa, Homo Sapiens
VLGAHHPLA

SEQ ID NO: 215491 - protein, 9 aa, Homo Sapiens
KRMCKQKRR

SEQ ID NO: 215492 - protein, 9 aa, Homo Sapiens
IVDVPGNPS

SEQ ID NO: 215493 - protein, 9 aa, Homo Sapiens
SNIALRSSL

SEQ ID NO: 215494 - protein, 9 aa, Homo Sapiens
ARVTGVSGL

SEQ ID NO: 215495 - protein, 9 aa, Homo Sapiens
WIAIARALL

SEQ ID NO: 215496 - protein, 9 aa, Homo Sapiens
IFSGCFAMG

SEQ ID NO: 215497 - protein, 9 aa, Homo Sapiens
QREAEWKEE

SEQ ID NO: 215498 - protein, 9 aa, Homo Sapiens
QLGVDGDSS

SEQ ID NO: 215499 - protein, 9 aa, Homo Sapiens
SGDWAKPSF

SEQ ID NO: 215500 - protein, 9 aa, Homo Sapiens
KTLKNDRNG

SEQ ID NO: 215501 - protein, 9 aa, Homo Sapiens
AKPYVYTTL

SEQ ID NO: 215502 - protein, 9 aa, Homo Sapiens
VAGVYKKVW

SEQ ID NO: 215503 - protein, 9 aa, Homo Sapiens
WSSKHNRWE

SEQ ID NO: 215504 - protein, 9 aa, Homo Sapiens
AHMDERREE

SEQ ID NO: 215505 - protein, 9 aa, Homo Sapiens
LMAGQSQKA

SEQ ID NO: 215506 - protein, 9 aa, Homo Sapiens
GALQNQLRV

SEQ ID NO: 215507 - protein, 9 aa, Homo Sapiens
LLPAAWRIT

SEQ ID NO: 215508 - protein, 9 aa, Homo Sapiens
PSGRPRRCW

SEQ ID NO: 215509 - protein, 9 aa, Homo Sapiens
SASVSVLSL

SEQ ID NO: 215510 - protein, 9 aa, Homo Sapiens
LAKFHKLQH

SEQ ID NO: 215511 - protein, 9 aa, Homo Sapiens
SLACSITVS

SEQ ID NO: 215512 - protein, 9 aa, Homo Sapiens
ACCAPGGTV

SEQ ID NO: 215513 - protein, 9 aa, Homo Sapiens
GSTPPPPPG

SEQ ID NO: 215514 - protein, 9 aa, Homo Sapiens
ASGDNSWQP

SEQ ID NO: 215515 - protein, 9 aa, Homo Sapiens
AMLSWGPQW

SEQ ID NO: 215516 - protein, 9 aa, Homo Sapiens
LLKKCSLYG

SEQ ID NO: 215517 - protein, 9 aa, Homo Sapiens
NTFRKLLKF

SEQ ID NO: 215518 - protein, 9 aa, Homo Sapiens
TDHTQNSVT

SEQ ID NO: 215519 - protein, 9 aa, Homo Sapiens
LGRVSWWPR

SEQ ID NO: 215520 - protein, 9 aa, Homo Sapiens
RVQSVLLLG

SEQ ID NO: 215521 - protein, 9 aa, Homo Sapiens
LQHHSKVQG

SEQ ID NO: 215522 - protein, 9 aa, Homo Sapiens
MPTGLRKAR

SEQ ID NO: 215523 - protein, 9 aa, Homo Sapiens
QAQPLPART

SEQ ID NO: 215524 - protein, 9 aa, Homo Sapiens
LLHPHGKRC

SEQ ID NO: 215525 - protein, 9 aa, Homo Sapiens
SVEVDECAS

SEQ ID NO: 215526 - protein, 9 aa, Homo Sapiens
FRKQLEMAE

SEQ ID NO: 215527 - protein, 9 aa, Homo Sapiens
HHLVQRQFR

SEQ ID NO: 215528 - protein, 9 aa, Homo Sapiens
SGPPQGQAR

SEQ ID NO: 215529 - protein, 9 aa, Homo Sapiens
RTASATTSR

SEQ ID NO: 215530 - protein, 9 aa, Homo Sapiens
PPSRPRTAC

SEQ ID NO: 215531 - protein, 9 aa, Homo Sapiens
WTPWSPLST

SEQ ID NO: 215532 - protein, 9 aa, Homo Sapiens
LIGGCGRVC

SEQ ID NO: 215533 - protein, 9 aa, Homo Sapiens
VSWKQSQQS

SEQ ID NO: 215534 - protein, 9 aa, Homo Sapiens
QLAYARVTG

SEQ ID NO: 215535 - protein, 9 aa, Homo Sapiens
SFDLDDVIT

SEQ ID NO: 215536 - protein, 9 aa, Homo Sapiens
NNKLQVSAP

SEQ ID NO: 215537 - protein, 9 aa, Homo Sapiens
IPAGRRSGG

SEQ ID NO: 215538 - protein, 9 aa, Homo Sapiens
GDPDAVVAS

SEQ ID NO: 215539 - protein, 9 aa, Homo Sapiens
EEATRGCLG

SEQ ID NO: 215540 - protein, 9 aa, Homo Sapiens
QAKSVGVKT

SEQ ID NO: 215541 - protein, 9 aa, Homo Sapiens
IREKGSAYG

SEQ ID NO: 215542 - protein, 9 aa, Homo Sapiens
ATWPSSVLI

SEQ ID NO: 215543 - protein, 9 aa, Homo Sapiens
LFTKTSLFR

SEQ ID NO: 215544 - protein, 9 aa, Homo Sapiens
VGVHSSPND

SEQ ID NO: 215545 - protein, 9 aa, Homo Sapiens
EVNGKSSER

SEQ ID NO: 215546 - protein, 9 aa, Homo Sapiens
GAGELSSEV

SEQ ID NO: 215547 - protein, 9 aa, Homo Sapiens
EFILERNHT

SEQ ID NO: 215548 - protein, 9 aa, Homo Sapiens
KNHARVLGG

SEQ ID NO: 215549 - protein, 9 aa, Homo Sapiens
ISSHKPHKR

SEQ ID NO: 215550 - protein, 9 aa, Homo Sapiens
KKRHCDRHL

SEQ ID NO: 215551 - protein, 9 aa, Homo Sapiens
SRGAMEETV

SEQ ID NO: 215552 - protein, 9 aa, Homo Sapiens
SAQSLPSLG

SEQ ID NO: 215553 - protein, 9 aa, Homo Sapiens
GHKSGSETP

SEQ ID NO: 215554 - protein, 9 aa, Homo Sapiens
EPKSVFHTG

SEQ ID NO: 215555 - protein, 9 aa, Homo Sapiens
EEKRYLQDT

SEQ ID NO: 215556 - protein, 9 aa, Homo Sapiens
RGQRPARWW

SEQ ID NO: 215557 - protein, 9 aa, Homo Sapiens
SFKQFLVVL

SEQ ID NO: 215558 - protein, 9 aa, Homo Sapiens
RILLQRNLL

SEQ ID NO: 215559 - protein, 9 aa, Homo Sapiens
CQGPLGFFG

SEQ ID NO: 215560 - protein, 9 aa, Homo Sapiens
PSSCWSPRP

SEQ ID NO: 215561 - protein, 9 aa, Homo Sapiens
TPLTTQSWI

SEQ ID NO: 215562 - protein, 9 aa, Homo Sapiens
SLGSQPIYR

SEQ ID NO: 215563 - protein, 9 aa, Homo Sapiens
EELQNQPVR

SEQ ID NO: 215564 - protein, 9 aa, Homo Sapiens
EAVGRGPAG

SEQ ID NO: 215565 - protein, 9 aa, Homo Sapiens
TEGDIVKTE

SEQ ID NO: 215566 - protein, 9 aa, Homo Sapiens
KLSMDVNLL

SEQ ID NO: 215567 - protein, 9 aa, Homo Sapiens
RPGFSPRGR

SEQ ID NO: 215568 - protein, 9 aa, Homo Sapiens
WAATLFLCK

SEQ ID NO: 215569 - protein, 9 aa, Homo Sapiens
QTDGTWSSP

SEQ ID NO: 215570 - protein, 9 aa, Homo Sapiens
RRREYCKSA

SEQ ID NO: 215571 - protein, 9 aa, Homo Sapiens
GPGLRARSR

SEQ ID NO: 215572 - protein, 9 aa, Homo Sapiens
LLTTTEQSH

SEQ ID NO: 215573 - protein, 9 aa, Homo Sapiens
RRRRPPGRC

SEQ ID NO: 215574 - protein, 9 aa, Homo Sapiens
EVGTVAIRG

SEQ ID NO: 215575 - protein, 9 aa, Homo Sapiens
ACECDVNEC

SEQ ID NO: 215576 - protein, 9 aa, Homo Sapiens
GISQVHHML

SEQ ID NO: 215577 - protein, 9 aa, Homo Sapiens
SWGQRPAPR

SEQ ID NO: 215578 - protein, 9 aa, Homo Sapiens
YPDTTHTKN

SEQ ID NO: 215579 - protein, 9 aa, Homo Sapiens
VMAYDRYMV

SEQ ID NO: 215580 - protein, 9 aa, Homo Sapiens
HLPVASCPA

SEQ ID NO: 215581 - protein, 9 aa, Homo Sapiens
IDDDNPPCL

SEQ ID NO: 215582 - protein, 9 aa, Homo Sapiens
SSSVWSSAA

SEQ ID NO: 215583 - protein, 9 aa, Homo Sapiens
QQHVLGAGV

SEQ ID NO: 215584 - protein, 9 aa, Homo Sapiens
RHTLGGPEV

SEQ ID NO: 215585 - protein, 9 aa, Homo Sapiens
YVRPIFLRL

SEQ ID NO: 215586 - protein, 9 aa, Homo Sapiens
CSEDTSVQI

SEQ ID NO: 215587 - protein, 9 aa, Homo Sapiens
SGEELGEQE

SEQ ID NO: 215588 - protein, 9 aa, Homo Sapiens
LYWHVRCLS

SEQ ID NO: 215589 - protein, 9 aa, Homo Sapiens
RIPLPQRLF

SEQ ID NO: 215590 - protein, 9 aa, Homo Sapiens
KPYECKECV

SEQ ID NO: 215591 - protein, 9 aa, Homo Sapiens
RGLGSQRLL

SEQ ID NO: 215592 - protein, 9 aa, Homo Sapiens
GIKAGPRRP

SEQ ID NO: 215593 - protein, 9 aa, Homo Sapiens
RVDEAKKPF

SEQ ID NO: 215594 - protein, 9 aa, Homo Sapiens
NRGPVTVQT

SEQ ID NO: 215595 - protein, 9 aa, Homo Sapiens
SGFSFFPAS

SEQ ID NO: 215596 - protein, 9 aa, Homo Sapiens
CNMNIKGVD

SEQ ID NO: 215597 - protein, 9 aa, Homo Sapiens
VQLEWDEYA

SEQ ID NO: 215598 - protein, 9 aa, Homo Sapiens
CARCRDETR

SEQ ID NO: 215599 - protein, 9 aa, Homo Sapiens
LKEVHFVFS

SEQ ID NO: 215600 - protein, 9 aa, Homo Sapiens
GTSQTYFGS

SEQ ID NO: 215601 - protein, 9 aa, Homo Sapiens
VVFKSDFNT

SEQ ID NO: 215602 - protein, 9 aa, Homo Sapiens
VTLLVRYWH

SEQ ID NO: 215603 - protein, 9 aa, Homo Sapiens
NISINKVNG

SEQ ID NO: 215604 - protein, 9 aa, Homo Sapiens
AGHRTIAEC

SEQ ID NO: 215605 - protein, 9 aa, Homo Sapiens
RTKWKKRKK

SEQ ID NO: 215606 - protein, 9 aa, Homo Sapiens
FSAGGTAAG

SEQ ID NO: 215607 - protein, 9 aa, Homo Sapiens
RAGRLNVMS

SEQ ID NO: 215608 - protein, 9 aa, Homo Sapiens
AGGPELYQR

SEQ ID NO: 215609 - protein, 9 aa, Homo Sapiens
CRFPYFEAS

SEQ ID NO: 215610 - protein, 9 aa, Homo Sapiens
FYHKKTIQN

SEQ ID NO: 215611 - protein, 9 aa, Homo Sapiens
CQTDGTWSS

SEQ ID NO: 215612 - protein, 9 aa, Homo Sapiens
PGQHLWLSH

SEQ ID NO: 215613 - protein, 9 aa, Homo Sapiens
VPTLRPRSH

SEQ ID NO: 215614 - protein, 9 aa, Homo Sapiens
DVVRRPRAT

SEQ ID NO: 215615 - protein, 9 aa, Homo Sapiens
EKASAQSTA

SEQ ID NO: 215616 - protein, 9 aa, Homo Sapiens
DMLRHFHTP

SEQ ID NO: 215617 - protein, 9 aa, Homo Sapiens
HRRLPDFNV

SEQ ID NO: 215618 - protein, 9 aa, Homo Sapiens
VIFLESPNL

SEQ ID NO: 215619 - protein, 9 aa, Homo Sapiens
LVRYVTENR

SEQ ID NO: 215620 - protein, 9 aa, Homo Sapiens
SIAGKVIKC

SEQ ID NO: 215621 - protein, 9 aa, Homo Sapiens
CITECVRTA

SEQ ID NO: 215622 - protein, 9 aa, Homo Sapiens
TGLDTWESP

SEQ ID NO: 215623 - protein, 9 aa, Homo Sapiens
SILTEKTIT

SEQ ID NO: 215624 - protein, 9 aa, Homo Sapiens
KGCVLNQLL

SEQ ID NO: 215625 - protein, 9 aa, Homo Sapiens
LGDLLLNCC

SEQ ID NO: 215626 - protein, 9 aa, Homo Sapiens
GGQVGHGVW

SEQ ID NO: 215627 - protein, 9 aa, Homo Sapiens
HAPCRARVP

SEQ ID NO: 215628 - protein, 9 aa, Homo Sapiens
AALVSWKQS

SEQ ID NO: 215629 - protein, 9 aa, Homo Sapiens
SPNNAGLED

SEQ ID NO: 215630 - protein, 9 aa, Homo Sapiens
VKGGAEINT

SEQ ID NO: 215631 - protein, 9 aa, Homo Sapiens
ALSIRETPI

SEQ ID NO: 215632 - protein, 9 aa, Homo Sapiens
QKKVLKVEH

SEQ ID NO: 215633 - protein, 9 aa, Homo Sapiens
TTKRVHLGP

SEQ ID NO: 215634 - protein, 9 aa, Homo Sapiens
KLESTESRI

SEQ ID NO: 215635 - protein, 9 aa, Homo Sapiens
HTQLINPLQ

SEQ ID NO: 215636 - protein, 9 aa, Homo Sapiens
FFNTTGCLR

SEQ ID NO: 215637 - protein, 9 aa, Homo Sapiens
LQACQGRIN

SEQ ID NO: 215638 - protein, 9 aa, Homo Sapiens
LAVAQYLEE

SEQ ID NO: 215639 - protein, 9 aa, Homo Sapiens
LQSLLSLYS

SEQ ID NO: 215640 - protein, 9 aa, Homo Sapiens
SQRLWQSPC

SEQ ID NO: 215641 - protein, 9 aa, Homo Sapiens
PGAEWSFST

SEQ ID NO: 215642 - protein, 9 aa, Homo Sapiens
ALSDSLQLE

SEQ ID NO: 215643 - protein, 9 aa, Homo Sapiens
IGEDSVPHG

SEQ ID NO: 215644 - protein, 9 aa, Homo Sapiens
FLSITKIHQ

SEQ ID NO: 215645 - protein, 9 aa, Homo Sapiens
SERYVPVFT

SEQ ID NO: 215646 - protein, 9 aa, Homo Sapiens
ATVETEVEA

SEQ ID NO: 215647 - protein, 9 aa, Homo Sapiens
GLFRAGKLE

SEQ ID NO: 215648 - protein, 9 aa, Homo Sapiens
EECGKNKQV

SEQ ID NO: 215649 - protein, 9 aa, Homo Sapiens
HNQTLSLMI

SEQ ID NO: 215650 - protein, 9 aa, Homo Sapiens
SVQIWEIPE

SEQ ID NO: 215651 - protein, 9 aa, Homo Sapiens
TPPPGRRRS

SEQ ID NO: 215652 - protein, 9 aa, Homo Sapiens
GGQSVVSES

SEQ ID NO: 215653 - protein, 9 aa, Homo Sapiens
SDGGQSVVS

SEQ ID NO: 215654 - protein, 9 aa, Homo Sapiens
TRHSTRPAH

SEQ ID NO: 215655 - protein, 9 aa, Homo Sapiens
HSLKMRNLH

SEQ ID NO: 215656 - protein, 9 aa, Homo Sapiens
DLCWELHAK

SEQ ID NO: 215657 - protein, 9 aa, Homo Sapiens
FEGHACECD

SEQ ID NO: 215658 - protein, 9 aa, Homo Sapiens
GETPYKCSE

SEQ ID NO: 215659 - protein, 9 aa, Homo Sapiens
GTAAGAAYA

SEQ ID NO: 215660 - protein, 9 aa, Homo Sapiens
WEKLDPDAT

SEQ ID NO: 215661 - protein, 9 aa, Homo Sapiens
PSNWDYRGL

SEQ ID NO: 215662 - protein, 9 aa, Homo Sapiens
LGADGQRVL

SEQ ID NO: 215663 - protein, 9 aa, Homo Sapiens
ECKECVKAF

SEQ ID NO: 215664 - protein, 9 aa, Homo Sapiens
QDDRSPLAI

SEQ ID NO: 215665 - protein, 9 aa, Homo Sapiens
PEELPLPPC

SEQ ID NO: 215666 - protein, 9 aa, Homo Sapiens
ARLAPGSPY

SEQ ID NO: 215667 - protein, 9 aa, Homo Sapiens
RPRATSDSN

SEQ ID NO: 215668 - protein, 9 aa, Homo Sapiens
YLEFRRERI

SEQ ID NO: 215669 - protein, 9 aa, Homo Sapiens
AALRAVGTQ

SEQ ID NO: 215670 - protein, 9 aa, Homo Sapiens
SRDCSWRGQ

SEQ ID NO: 215671 - protein, 9 aa, Homo Sapiens
ARVPGLLER

SEQ ID NO: 215672 - protein, 9 aa, Homo Sapiens
DRQLSYFLG

SEQ ID NO: 215673 - protein, 9 aa, Homo Sapiens
KAEDPVLLK

SEQ ID NO: 215674 - protein, 9 aa, Homo Sapiens
RARQGTGSG

SEQ ID NO: 215675 - protein, 9 aa, Homo Sapiens
VEKRRCYSR

SEQ ID NO: 215676 - protein, 9 aa, Homo Sapiens
AEELSGLKI

SEQ ID NO: 215677 - protein, 9 aa, Homo Sapiens
YKLTYTKVW

SEQ ID NO: 215678 - protein, 9 aa, Homo Sapiens
EYWRWLRKQ

SEQ ID NO: 215679 - protein, 9 aa, Homo Sapiens
SIMCPLNPA

SEQ ID NO: 215680 - protein, 9 aa, Homo Sapiens
VYVATTSPA

SEQ ID NO: 215681 - protein, 9 aa, Homo Sapiens
RAGGFVIGR

SEQ ID NO: 215682 - protein, 9 aa, Homo Sapiens
SFVDVWERS

SEQ ID NO: 215683 - protein, 9 aa, Homo Sapiens
TCSFVQPCT

SEQ ID NO: 215684 - protein, 9 aa, Homo Sapiens
ELSFALVDS

SEQ ID NO: 215685 - protein, 9 aa, Homo Sapiens
GAPGMNIKE

SEQ ID NO: 215686 - protein, 9 aa, Homo Sapiens
SDTPQIEAE

SEQ ID NO: 215687 - protein, 9 aa, Homo Sapiens
SGGRGHPDG

SEQ ID NO: 215688 - protein, 9 aa, Homo Sapiens
WNPFRCKLA

SEQ ID NO: 215689 - protein, 9 aa, Homo Sapiens
ATRANPGPQ

SEQ ID NO: 215690 - protein, 9 aa, Homo Sapiens
ANNSDTLEL

SEQ ID NO: 215691 - protein, 9 aa, Homo Sapiens
GGGPWSCVT

SEQ ID NO: 215692 - protein, 9 aa, Homo Sapiens
EYEKESPCG

SEQ ID NO: 215693 - protein, 9 aa, Homo Sapiens
FRYGVEDFW

SEQ ID NO: 215694 - protein, 9 aa, Homo Sapiens
LWYKTFWNH

SEQ ID NO: 215695 - protein, 9 aa, Homo Sapiens
DLGTQCLVV

SEQ ID NO: 215696 - protein, 9 aa, Homo Sapiens
WKMNWKKMM

SEQ ID NO: 215697 - protein, 9 aa, Homo Sapiens
PRRPGSAWR

SEQ ID NO: 215698 - protein, 9 aa, Homo Sapiens
QPHQAGSPR

SEQ ID NO: 215699 - protein, 9 aa, Homo Sapiens
DACAGCRTQ

SEQ ID NO: 215700 - protein, 9 aa, Homo Sapiens
TAHPNLLLT

SEQ ID NO: 215701 - protein, 9 aa, Homo Sapiens
DYDLKSAGA

SEQ ID NO: 215702 - protein, 9 aa, Homo Sapiens
KSDFNTGGR

SEQ ID NO: 215703 - protein, 9 aa, Homo Sapiens
RPRCSGWRV

SEQ ID NO: 215704 - protein, 9 aa, Homo Sapiens
SNNFTKKTQ

SEQ ID NO: 215705 - protein, 9 aa, Homo Sapiens
ALCPSAPAM

SEQ ID NO: 215706 - protein, 9 aa, Homo Sapiens
EFRRERIQM

SEQ ID NO: 215707 - protein, 9 aa, Homo Sapiens
HAPPVAEEA

SEQ ID NO: 215708 - protein, 9 aa, Homo Sapiens
RQLRWKPLL

SEQ ID NO: 215709 - protein, 9 aa, Homo Sapiens
VFDNTEDIA

SEQ ID NO: 215710 - protein, 9 aa, Homo Sapiens
ANSWSTWLS

SEQ ID NO: 215711 - protein, 9 aa, Homo Sapiens
NARAGRLNV

SEQ ID NO: 215712 - protein, 9 aa, Homo Sapiens
GRVCYLKKA

SEQ ID NO: 215713 - protein, 9 aa, Homo Sapiens
YMVICYPLH

SEQ ID NO: 215714 - protein, 9 aa, Homo Sapiens
VLRKLKQML

SEQ ID NO: 215715 - protein, 9 aa, Homo Sapiens
GEQSLYSPA

SEQ ID NO: 215716 - protein, 9 aa, Homo Sapiens
GVPIGLDFQ

SEQ ID NO: 215717 - protein, 9 aa, Homo Sapiens
LQIIWLKLT

SEQ ID NO: 215718 - protein, 9 aa, Homo Sapiens
TAVEVGTVA

SEQ ID NO: 215719 - protein, 9 aa, Homo Sapiens
DISKIFPGK

SEQ ID NO: 215720 - protein, 9 aa, Homo Sapiens
VAQYLEETF

SEQ ID NO: 215721 - protein, 9 aa, Homo Sapiens
QLMSHSHLR

SEQ ID NO: 215722 - protein, 9 aa, Homo Sapiens
LEASGMPPS

SEQ ID NO: 215723 - protein, 9 aa, Homo Sapiens
LEKENTIIL

SEQ ID NO: 215724 - protein, 9 aa, Homo Sapiens
DVEEKNQVV

SEQ ID NO: 215725 - protein, 9 aa, Homo Sapiens
LLSFGYLSG

SEQ ID NO: 215726 - protein, 9 aa, Homo Sapiens
SRPTRGSSS

SEQ ID NO: 215727 - protein, 9 aa, Homo Sapiens
SHTSKSPRD

SEQ ID NO: 215728 - protein, 9 aa, Homo Sapiens
PTEKLREMT

SEQ ID NO: 215729 - protein, 9 aa, Homo Sapiens
SSVLTLTVE

SEQ ID NO: 215730 - protein, 9 aa, Homo Sapiens
LKNDRNGDF

SEQ ID NO: 215731 - protein, 9 aa, Homo Sapiens
HALDVVDMA

SEQ ID NO: 215732 - protein, 9 aa, Homo Sapiens
GGAPRALQA

SEQ ID NO: 215733 - protein, 9 aa, Homo Sapiens
SSCWTPTPC

SEQ ID NO: 215734 - protein, 9 aa, Homo Sapiens
TAEEDHVDM

SEQ ID NO: 215735 - protein, 9 aa, Homo Sapiens
CWHRDSAGP

SEQ ID NO: 215736 - protein, 9 aa, Homo Sapiens
EKEEDKKVR

SEQ ID NO: 215737 - protein, 9 aa, Homo Sapiens
PGMPAVVLK

SEQ ID NO: 215738 - protein, 9 aa, Homo Sapiens
NVHSKLEAD

SEQ ID NO: 215739 - protein, 9 aa, Homo Sapiens
LLGQALEVL

SEQ ID NO: 215740 - protein, 9 aa, Homo Sapiens
ELPLYVRPI

SEQ ID NO: 215741 - protein, 9 aa, Homo Sapiens
NRQRKESFQ

SEQ ID NO: 215742 - protein, 9 aa, Homo Sapiens
VSHNSVKAK

SEQ ID NO: 215743 - protein, 9 aa, Homo Sapiens
RVLFIREKY

SEQ ID NO: 215744 - protein, 9 aa, Homo Sapiens
NNDLQVADE

SEQ ID NO: 215745 - protein, 9 aa, Homo Sapiens
KGEAQCRGR

SEQ ID NO: 215746 - protein, 9 aa, Homo Sapiens
MALEQEIPF

SEQ ID NO: 215747 - protein, 9 aa, Homo Sapiens
PPPPPTKKR

SEQ ID NO: 215748 - protein, 9 aa, Homo Sapiens
DYFTHQNHG

SEQ ID NO: 215749 - protein, 9 aa, Homo Sapiens
FHGLGEGSA

SEQ ID NO: 215750 - protein, 9 aa, Homo Sapiens
AETKEDLYL

SEQ ID NO: 215751 - protein, 9 aa, Homo Sapiens
EAIFQSMEK

SEQ ID NO: 215752 - protein, 9 aa, Homo Sapiens
GIVDVPGNP

SEQ ID NO: 215753 - protein, 9 aa, Homo Sapiens
LGAGSQESV

SEQ ID NO: 215754 - protein, 9 aa, Homo Sapiens
LSSTREDLQ

SEQ ID NO: 215755 - protein, 9 aa, Homo Sapiens
DVWERSKGA

SEQ ID NO: 215756 - protein, 9 aa, Homo Sapiens
RLKVRVVKD

SEQ ID NO: 215757 - protein, 9 aa, Homo Sapiens
CIWQLGRPA

SEQ ID NO: 215758 - protein, 9 aa, Homo Sapiens
TSSSRTYQV

SEQ ID NO: 215759 - protein, 9 aa, Homo Sapiens
KFICIREKG

SEQ ID NO: 215760 - protein, 9 aa, Homo Sapiens
RGWRLPKAQ

SEQ ID NO: 215761 - protein, 9 aa, Homo Sapiens
SPFLARSWN

SEQ ID NO: 215762 - protein, 9 aa, Homo Sapiens
ATHTKPCGL

SEQ ID NO: 215763 - protein, 9 aa, Homo Sapiens
SHLHEICDD

SEQ ID NO: 215764 - protein, 9 aa, Homo Sapiens
DKKRNSYRM

SEQ ID NO: 215765 - protein, 9 aa, Homo Sapiens
LDACAGCRT

SEQ ID NO: 215766 - protein, 9 aa, Homo Sapiens
RNEPSRCQR

SEQ ID NO: 215767 - protein, 9 aa, Homo Sapiens
MTLKALVKT

SEQ ID NO: 215768 - protein, 9 aa, Homo Sapiens
TRPTQRCLR

SEQ ID NO: 215769 - protein, 9 aa, Homo Sapiens
ASSTRMGSS

SEQ ID NO: 215770 - protein, 9 aa, Homo Sapiens
RPGSPLFKI

SEQ ID NO: 215771 - protein, 9 aa, Homo Sapiens
EDYLEQKYV

SEQ ID NO: 215772 - protein, 9 aa, Homo Sapiens
SQNMIPQMA

SEQ ID NO: 215773 - protein, 9 aa, Homo Sapiens
ATTHTVTSS

SEQ ID NO: 215774 - protein, 9 aa, Homo Sapiens
TELRQAPRT

SEQ ID NO: 215775 - protein, 9 aa, Homo Sapiens
SASTFEQGI

SEQ ID NO: 215776 - protein, 9 aa, Homo Sapiens
ESISEESSD

SEQ ID NO: 215777 - protein, 9 aa, Homo Sapiens
RAQTLCSVK

SEQ ID NO: 215778 - protein, 9 aa, Homo Sapiens
MSLSCTLVP

SEQ ID NO: 215779 - protein, 9 aa, Homo Sapiens
AHTGWAHSG

SEQ ID NO: 215780 - protein, 9 aa, Homo Sapiens
EIVCSIPRN

SEQ ID NO: 215781 - protein, 9 aa, Homo Sapiens
NIISKELRP

SEQ ID NO: 215782 - protein, 9 aa, Homo Sapiens
NPLIHSVKN

SEQ ID NO: 215783 - protein, 9 aa, Homo Sapiens
GQSAKSGST

SEQ ID NO: 215784 - protein, 9 aa, Homo Sapiens
DISEGHQLL

SEQ ID NO: 215785 - protein, 9 aa, Homo Sapiens
GTCPTASTT

SEQ ID NO: 215786 - protein, 9 aa, Homo Sapiens
TPPGVHRRY

SEQ ID NO: 215787 - protein, 9 aa, Homo Sapiens
MSKQNRGLR

SEQ ID NO: 215788 - protein, 9 aa, Homo Sapiens
AWTPENSPK

SEQ ID NO: 215789 - protein, 9 aa, Homo Sapiens
PVNVHDIRW

SEQ ID NO: 215790 - protein, 9 aa, Homo Sapiens
DSIPDILQE

SEQ ID NO: 215791 - protein, 9 aa, Homo Sapiens
WVSVAMQFL

SEQ ID NO: 215792 - protein, 9 aa, Homo Sapiens
NLLPAPSAL

SEQ ID NO: 215793 - protein, 9 aa, Homo Sapiens
SHEEHWGAA

SEQ ID NO: 215794 - protein, 9 aa, Homo Sapiens
KCVQVSQEQ

SEQ ID NO: 215795 - protein, 9 aa, Homo Sapiens
RPTSQCHCL

SEQ ID NO: 215796 - protein, 9 aa, Homo Sapiens
GSGWLSKIL

SEQ ID NO: 215797 - protein, 9 aa, Homo Sapiens
LGCSPMLAR

SEQ ID NO: 215798 - protein, 9 aa, Homo Sapiens
GCGAILVAL

SEQ ID NO: 215799 - protein, 9 aa, Homo Sapiens
APISLHMSY

SEQ ID NO: 215800 - protein, 9 aa, Homo Sapiens
EDLGHMYNL

SEQ ID NO: 215801 - protein, 9 aa, Homo Sapiens
RPRSQHLPP

SEQ ID NO: 215802 - protein, 9 aa, Homo Sapiens
PEHRCLPIL

SEQ ID NO: 215803 - protein, 9 aa, Homo Sapiens
RSAASAPSL

SEQ ID NO: 215804 - protein, 9 aa, Homo Sapiens
TKWWPSTSM

SEQ ID NO: 215805 - protein, 9 aa, Homo Sapiens
TTEAGQLAH

SEQ ID NO: 215806 - protein, 9 aa, Homo Sapiens
DIIKCEQNT

SEQ ID NO: 215807 - protein, 9 aa, Homo Sapiens
LFFVLVNLE

SEQ ID NO: 215808 - protein, 9 aa, Homo Sapiens
WPSATTANR

SEQ ID NO: 215809 - protein, 9 aa, Homo Sapiens
KKKIEKASA

SEQ ID NO: 215810 - protein, 9 aa, Homo Sapiens
AAFNEQPII

SEQ ID NO: 215811 - protein, 9 aa, Homo Sapiens
KKMCAHLFT

SEQ ID NO: 215812 - protein, 9 aa, Homo Sapiens
TATTHTVTS

SEQ ID NO: 215813 - protein, 9 aa, Homo Sapiens
QVVNAIIES

SEQ ID NO: 215814 - protein, 9 aa, Homo Sapiens
EPQATRRDA

SEQ ID NO: 215815 - protein, 9 aa, Homo Sapiens
LGKSDVSDS

SEQ ID NO: 215816 - protein, 9 aa, Homo Sapiens
QGSNSSDSL

SEQ ID NO: 215817 - protein, 9 aa, Homo Sapiens
EEGVLIMFS

SEQ ID NO: 215818 - protein, 9 aa, Homo Sapiens
KKVMSNSPQ

SEQ ID NO: 215819 - protein, 9 aa, Homo Sapiens
GDDAPGLSS

SEQ ID NO: 215820 - protein, 9 aa, Homo Sapiens
IMLLVYRMR

SEQ ID NO: 215821 - protein, 9 aa, Homo Sapiens
GEEDQNPPR

SEQ ID NO: 215822 - protein, 9 aa, Homo Sapiens
TLSTLQQRH

SEQ ID NO: 215823 - protein, 9 aa, Homo Sapiens
SAASYGRRR

SEQ ID NO: 215824 - protein, 9 aa, Homo Sapiens
SLGLHGLLA

SEQ ID NO: 215825 - protein, 9 aa, Homo Sapiens
SRAEPQATR

SEQ ID NO: 215826 - protein, 9 aa, Homo Sapiens
HRGTVAYVR

SEQ ID NO: 215827 - protein, 9 aa, Homo Sapiens
RVWPSSRRA

SEQ ID NO: 215828 - protein, 9 aa, Homo Sapiens
GFGLSLEVA

SEQ ID NO: 215829 - protein, 9 aa, Homo Sapiens
GPLELQPPG

SEQ ID NO: 215830 - protein, 9 aa, Homo Sapiens
TCPQPPHVP

SEQ ID NO: 215831 - protein, 9 aa, Homo Sapiens
SARESRAGH

SEQ ID NO: 215832 - protein, 9 aa, Homo Sapiens
SLIDTFMGF

SEQ ID NO: 215833 - protein, 9 aa, Homo Sapiens
LHGEATQDP

SEQ ID NO: 215834 - protein, 9 aa, Homo Sapiens
DDNHPKGRE

SEQ ID NO: 215835 - protein, 9 aa, Homo Sapiens
SRWLSPGDL

SEQ ID NO: 215836 - protein, 9 aa, Homo Sapiens
VSQHPGSSR

SEQ ID NO: 215837 - protein, 9 aa, Homo Sapiens
DTNRHRKIT

SEQ ID NO: 215838 - protein, 9 aa, Homo Sapiens
LLTGESDTP

SEQ ID NO: 215839 - protein, 9 aa, Homo Sapiens
DTEGDIVKT

SEQ ID NO: 215840 - protein, 9 aa, Homo Sapiens
FPHLNPNRT

SEQ ID NO: 215841 - protein, 9 aa, Homo Sapiens
GLLWEPAGA

SEQ ID NO: 215842 - protein, 9 aa, Homo Sapiens
ACSEIFMDE

SEQ ID NO: 215843 - protein, 9 aa, Homo Sapiens
LVATRALQQ

SEQ ID NO: 215844 - protein, 9 aa, Homo Sapiens
CQPSRGRYQ

SEQ ID NO: 215845 - protein, 9 aa, Homo Sapiens
YEVWEKLDP

SEQ ID NO: 215846 - protein, 9 aa, Homo Sapiens
DCRGPNGVW

SEQ ID NO: 215847 - protein, 9 aa, Homo Sapiens
GAPGLLPSP

SEQ ID NO: 215848 - protein, 9 aa, Homo Sapiens
KKTYMEMHY

SEQ ID NO: 215849 - protein, 9 aa, Homo Sapiens
LRTLHAARP

SEQ ID NO: 215850 - protein, 9 aa, Homo Sapiens
DPWMPSSLG

SEQ ID NO: 215851 - protein, 9 aa, Homo Sapiens
IVGVKKGAP

SEQ ID NO: 215852 - protein, 9 aa, Homo Sapiens
MMQDGTWRT

SEQ ID NO: 215853 - protein, 9 aa, Homo Sapiens
RACANSWST

SEQ ID NO: 215854 - protein, 9 aa, Homo Sapiens
RYRERIAIL

SEQ ID NO: 215855 - protein, 9 aa, Homo Sapiens
EFRATPFIE

SEQ ID NO: 215856 - protein, 9 aa, Homo Sapiens
RGWERAQKV

SEQ ID NO: 215857 - protein, 9 aa, Homo Sapiens
GISILYRNP

SEQ ID NO: 215858 - protein, 9 aa, Homo Sapiens
KCYINLWKI

SEQ ID NO: 215859 - protein, 9 aa, Homo Sapiens
EGVIMAVLD

SEQ ID NO: 215860 - protein, 9 aa, Homo Sapiens
KYLCTGRGD

SEQ ID NO: 215861 - protein, 9 aa, Homo Sapiens
VGLLEVEVL

SEQ ID NO: 215862 - protein, 9 aa, Homo Sapiens
PQLLPPATA

SEQ ID NO: 215863 - protein, 9 aa, Homo Sapiens
QPIPKEEHH

SEQ ID NO: 215864 - protein, 9 aa, Homo Sapiens
ITDYPTALL

SEQ ID NO: 215865 - protein, 9 aa, Homo Sapiens
QIQEWGCLC

SEQ ID NO: 215866 - protein, 9 aa, Homo Sapiens
TASGVSLLW

SEQ ID NO: 215867 - protein, 9 aa, Homo Sapiens
IGNRESGSK

SEQ ID NO: 215868 - protein, 9 aa, Homo Sapiens
DRDWETVSA

SEQ ID NO: 215869 - protein, 9 aa, Homo Sapiens
ETIKTYLTI

SEQ ID NO: 215870 - protein, 9 aa, Homo Sapiens
AVEQPPSPL

SEQ ID NO: 215871 - protein, 9 aa, Homo Sapiens
PRALQTSTT

SEQ ID NO: 215872 - protein, 9 aa, Homo Sapiens
QDYQCLMTV

SEQ ID NO: 215873 - protein, 9 aa, Homo Sapiens
IMITRLVVG

SEQ ID NO: 215874 - protein, 9 aa, Homo Sapiens
SFTYSLSVI

SEQ ID NO: 215875 - protein, 9 aa, Homo Sapiens
AGRTTAVPR

SEQ ID NO: 215876 - protein, 9 aa, Homo Sapiens
WVREWPSQV

SEQ ID NO: 215877 - protein, 9 aa, Homo Sapiens
PPGAPPCQS

SEQ ID NO: 215878 - protein, 9 aa, Homo Sapiens
WTTSSVMSH

SEQ ID NO: 215879 - protein, 9 aa, Homo Sapiens
RGEGNHHHP

SEQ ID NO: 215880 - protein, 9 aa, Homo Sapiens
SLIFHKPSY

SEQ ID NO: 215881 - protein, 9 aa, Homo Sapiens
GIVQGSLQT

SEQ ID NO: 215882 - protein, 9 aa, Homo Sapiens
LENEDQEVC

SEQ ID NO: 215883 - protein, 9 aa, Homo Sapiens
VGVRWGADD

SEQ ID NO: 215884 - protein, 9 aa, Homo Sapiens
TARNLLTSG

SEQ ID NO: 215885 - protein, 9 aa, Homo Sapiens
MIGSQHLLF

SEQ ID NO: 215886 - protein, 9 aa, Homo Sapiens
RSGGRMRGT

SEQ ID NO: 215887 - protein, 9 aa, Homo Sapiens
WMSAASYGR

SEQ ID NO: 215888 - protein, 9 aa, Homo Sapiens
TGAQRVCCL

SEQ ID NO: 215889 - protein, 9 aa, Homo Sapiens
SGKEPNSKD

SEQ ID NO: 215890 - protein, 9 aa, Homo Sapiens
MAAHWVFLA

SEQ ID NO: 215891 - protein, 9 aa, Homo Sapiens
PTAEPTATP

SEQ ID NO: 215892 - protein, 9 aa, Homo Sapiens
QESSSPTEG

SEQ ID NO: 215893 - protein, 9 aa, Homo Sapiens
DLTLISRNS

SEQ ID NO: 215894 - protein, 9 aa, Homo Sapiens
NTWNPVMKM

SEQ ID NO: 215895 - protein, 9 aa, Homo Sapiens
KKQCRKTTA

SEQ ID NO: 215896 - protein, 9 aa, Homo Sapiens
DGASEIIWK

SEQ ID NO: 215897 - protein, 9 aa, Homo Sapiens
LWVEGKLLD

SEQ ID NO: 215898 - protein, 9 aa, Homo Sapiens
QVTTTLKLI

SEQ ID NO: 215899 - protein, 9 aa, Homo Sapiens
MAYDRYMVI

SEQ ID NO: 215900 - protein, 9 aa, Homo Sapiens
SSSSLSVMS

SEQ ID NO: 215901 - protein, 9 aa, Homo Sapiens
NKKIAMTMD

SEQ ID NO: 215902 - protein, 9 aa, Homo Sapiens
LWLTPVIPA

SEQ ID NO: 215903 - protein, 9 aa, Homo Sapiens
KVILNVHSK

SEQ ID NO: 215904 - protein, 9 aa, Homo Sapiens
WQAECFQDG

SEQ ID NO: 215905 - protein, 9 aa, Homo Sapiens
WGIQKKTKC

SEQ ID NO: 215906 - protein, 9 aa, Homo Sapiens
DPFCRLFDH

SEQ ID NO: 215907 - protein, 9 aa, Homo Sapiens
RGRAPQDQH

SEQ ID NO: 215908 - protein, 9 aa, Homo Sapiens
LATRAPCTS

SEQ ID NO: 215909 - protein, 9 aa, Homo Sapiens
MIQMLRSEI

SEQ ID NO: 215910 - protein, 9 aa, Homo Sapiens
KRIHFPALP

SEQ ID NO: 215911 - protein, 9 aa, Homo Sapiens
PQRRPGQSA

SEQ ID NO: 215912 - protein, 9 aa, Homo Sapiens
ILQEFVQLH

SEQ ID NO: 215913 - protein, 9 aa, Homo Sapiens
NVAGAWQVF

SEQ ID NO: 215914 - protein, 9 aa, Homo Sapiens
VCMLFKDLS

SEQ ID NO: 215915 - protein, 9 aa, Homo Sapiens
RRSRKASGI

SEQ ID NO: 215916 - protein, 9 aa, Homo Sapiens
DLQVADEQY

SEQ ID NO: 215917 - protein, 9 aa, Homo Sapiens
FDQAVELVN

SEQ ID NO: 215918 - protein, 9 aa, Homo Sapiens
STNSSTGRN

SEQ ID NO: 215919 - protein, 9 aa, Homo Sapiens
GVQPQSVLG

SEQ ID NO: 215920 - protein, 9 aa, Homo Sapiens
VCNNPEIIT

SEQ ID NO: 215921 - protein, 9 aa, Homo Sapiens
HSPPSLALR

SEQ ID NO: 215922 - protein, 9 aa, Homo Sapiens
KNKKEVGFF

SEQ ID NO: 215923 - protein, 9 aa, Homo Sapiens
SIARARVCI

SEQ ID NO: 215924 - protein, 9 aa, Homo Sapiens
VCIVSLGVR

SEQ ID NO: 215925 - protein, 9 aa, Homo Sapiens
LESTESRIS

SEQ ID NO: 215926 - protein, 9 aa, Homo Sapiens
EEKNQVVEM

SEQ ID NO: 215927 - protein, 9 aa, Homo Sapiens
LIHSVKNSE

SEQ ID NO: 215928 - protein, 9 aa, Homo Sapiens
HVGLRSGPC

SEQ ID NO: 215929 - protein, 9 aa, Homo Sapiens
YSQDYQCLM

SEQ ID NO: 215930 - protein, 9 aa, Homo Sapiens
DEQYQRLMA

SEQ ID NO: 215931 - protein, 9 aa, Homo Sapiens
LNDDSPESA

SEQ ID NO: 215932 - protein, 9 aa, Homo Sapiens
ILQVRSTAC

SEQ ID NO: 215933 - protein, 9 aa, Homo Sapiens
GALPDLRSM

SEQ ID NO: 215934 - protein, 9 aa, Homo Sapiens
LCPQCPGLK

SEQ ID NO: 215935 - protein, 9 aa, Homo Sapiens
CAGIPGWTN

SEQ ID NO: 215936 - protein, 9 aa, Homo Sapiens
CAAAAAAAC

SEQ ID NO: 215937 - protein, 9 aa, Homo Sapiens
TGWAHSGVS

SEQ ID NO: 215938 - protein, 9 aa, Homo Sapiens
APCGWPALP

SEQ ID NO: 215939 - protein, 9 aa, Homo Sapiens
ALGGCSSPL

SEQ ID NO: 215940 - protein, 9 aa, Homo Sapiens
LFAQKVRPR

SEQ ID NO: 215941 - protein, 9 aa, Homo Sapiens
TVVGVLIFV

SEQ ID NO: 215942 - protein, 9 aa, Homo Sapiens
LRQAPRTTA

SEQ ID NO: 215943 - protein, 9 aa, Homo Sapiens
ENTIILQEK

SEQ ID NO: 215944 - protein, 9 aa, Homo Sapiens
VLPELLGGH

SEQ ID NO: 215945 - protein, 9 aa, Homo Sapiens
MEFPAPRGT

SEQ ID NO: 215946 - protein, 9 aa, Homo Sapiens
SPKGEVVPL

SEQ ID NO: 215947 - protein, 9 aa, Homo Sapiens
AVEVGTVAI

SEQ ID NO: 215948 - protein, 9 aa, Homo Sapiens
KDCDQLFES

SEQ ID NO: 215949 - protein, 9 aa, Homo Sapiens
GGSSKRQTN

SEQ ID NO: 215950 - protein, 9 aa, Homo Sapiens
ITVVGVLIF

SEQ ID NO: 215951 - protein, 9 aa, Homo Sapiens
NGEIVCSIP

SEQ ID NO: 215952 - protein, 9 aa, Homo Sapiens
ILRTSLRFH

SEQ ID NO: 215953 - protein, 9 aa, Homo Sapiens
EETTTEMIS

SEQ ID NO: 215954 - protein, 9 aa, Homo Sapiens
DHDRCDQHI

SEQ ID NO: 215955 - protein, 9 aa, Homo Sapiens
FFSFIHVHT

SEQ ID NO: 215956 - protein, 9 aa, Homo Sapiens
QWNNKKMAM

SEQ ID NO: 215957 - protein, 9 aa, Homo Sapiens
SESKRIMRD

SEQ ID NO: 215958 - protein, 9 aa, Homo Sapiens
PVAEEAAAS

SEQ ID NO: 215959 - protein, 9 aa, Homo Sapiens
SCTQRKTDS

SEQ ID NO: 215960 - protein, 9 aa, Homo Sapiens
RCEEEMRRQ

SEQ ID NO: 215961 - protein, 9 aa, Homo Sapiens
NMGNAPLPR

SEQ ID NO: 215962 - protein, 9 aa, Homo Sapiens
TPAVLELTC

SEQ ID NO: 215963 - protein, 9 aa, Homo Sapiens
PEEHGIGVC

SEQ ID NO: 215964 - protein, 9 aa, Homo Sapiens
HSCWHELPE

SEQ ID NO: 215965 - protein, 9 aa, Homo Sapiens
SQIPASPGQ

SEQ ID NO: 215966 - protein, 9 aa, Homo Sapiens
RTCGPWARN

SEQ ID NO: 215967 - protein, 9 aa, Homo Sapiens
LSELQDTNL

SEQ ID NO: 215968 - protein, 9 aa, Homo Sapiens
DEMNDKKRQ

SEQ ID NO: 215969 - protein, 9 aa, Homo Sapiens
CWTGAVCGP

SEQ ID NO: 215970 - protein, 9 aa, Homo Sapiens
TNGGTQIQP

SEQ ID NO: 215971 - protein, 9 aa, Homo Sapiens
ACTPTPRRW

SEQ ID NO: 215972 - protein, 9 aa, Homo Sapiens
GLIRHQMTY

SEQ ID NO: 215973 - protein, 9 aa, Homo Sapiens
DDVKIFHGS

SEQ ID NO: 215974 - protein, 9 aa, Homo Sapiens
CTFLKNLKA

SEQ ID NO: 215975 - protein, 9 aa, Homo Sapiens
DVDKQDSMH

SEQ ID NO: 215976 - protein, 9 aa, Homo Sapiens
RPIKLHKSM

SEQ ID NO: 215977 - protein, 9 aa, Homo Sapiens
QLEGHLVRQ

SEQ ID NO: 215978 - protein, 9 aa, Homo Sapiens
AEQQALRQC

SEQ ID NO: 215979 - protein, 9 aa, Homo Sapiens
GVCQRMCQP

SEQ ID NO: 215980 - protein, 9 aa, Homo Sapiens
LWKIIKKKR

SEQ ID NO: 215981 - protein, 9 aa, Homo Sapiens
RSAEPPPSD

SEQ ID NO: 215982 - protein, 9 aa, Homo Sapiens
EEAVSGSGG

SEQ ID NO: 215983 - protein, 9 aa, Homo Sapiens
TQPRRVASR

SEQ ID NO: 215984 - protein, 9 aa, Homo Sapiens
TSPARDDKA

SEQ ID NO: 215985 - protein, 9 aa, Homo Sapiens
ETKEDLYLH

SEQ ID NO: 215986 - protein, 9 aa, Homo Sapiens
QRACCAPGG

SEQ ID NO: 215987 - protein, 9 aa, Homo Sapiens
GVGSGGVCQ

SEQ ID NO: 215988 - protein, 9 aa, Homo Sapiens
RNGPWETPS

SEQ ID NO: 215989 - protein, 9 aa, Homo Sapiens
EVERTEEKD

SEQ ID NO: 215990 - protein, 9 aa, Homo Sapiens
RRRGAPGGR

SEQ ID NO: 215991 - protein, 9 aa, Homo Sapiens
FVIIDCRCP

SEQ ID NO: 215992 - protein, 9 aa, Homo Sapiens
LPRSPPRLE

SEQ ID NO: 215993 - protein, 9 aa, Homo Sapiens
LDVSSISHW

SEQ ID NO: 215994 - protein, 9 aa, Homo Sapiens
TNYDLLSAF

SEQ ID NO: 215995 - protein, 9 aa, Homo Sapiens
FPFQEKRIH

SEQ ID NO: 215996 - protein, 9 aa, Homo Sapiens
HQKAARAQS

SEQ ID NO: 215997 - protein, 9 aa, Homo Sapiens
PADPRLHPQ

SEQ ID NO: 215998 - protein, 9 aa, Homo Sapiens
DFNTGGRGF

SEQ ID NO: 215999 - protein, 9 aa, Homo Sapiens
LHNRVVPGC

SEQ ID NO: 216000 - protein, 9 aa, Homo Sapiens
KLEAHRGDA

SEQ ID NO: 216001 - protein, 9 aa, Homo Sapiens
LDQGQLNKF

SEQ ID NO: 216002 - protein, 9 aa, Homo Sapiens
KGNEHPPPP

SEQ ID NO: 216003 - protein, 9 aa, Homo Sapiens
LGIIGPESP

SEQ ID NO: 216004 - protein, 9 aa, Homo Sapiens
PLVHRRLAG

SEQ ID NO: 216005 - protein, 9 aa, Homo Sapiens
GLSEDVIIS

SEQ ID NO: 216006 - protein, 9 aa, Homo Sapiens
RCAVPHATH

SEQ ID NO: 216007 - protein, 9 aa, Homo Sapiens
AAITVVGVL

SEQ ID NO: 216008 - protein, 9 aa, Homo Sapiens
ERQERAVAH

SEQ ID NO: 216009 - protein, 9 aa, Homo Sapiens
QIPASPGQA

SEQ ID NO: 216010 - protein, 9 aa, Homo Sapiens
LQEFVQLHE

SEQ ID NO: 216011 - protein, 9 aa, Homo Sapiens
FKQFLVVLW

SEQ ID NO: 216012 - protein, 9 aa, Homo Sapiens
WQKKSLEKL

SEQ ID NO: 216013 - protein, 9 aa, Homo Sapiens
VVTLLVRYW

SEQ ID NO: 216014 - protein, 9 aa, Homo Sapiens
VHPGCQGTR

SEQ ID NO: 216015 - protein, 9 aa, Homo Sapiens
TKKILKLTL

SEQ ID NO: 216016 - protein, 9 aa, Homo Sapiens
IINGKGLLK

SEQ ID NO: 216017 - protein, 9 aa, Homo Sapiens
VSTWSLPRL

SEQ ID NO: 216018 - protein, 9 aa, Homo Sapiens
LSPLKEVHF

SEQ ID NO: 216019 - protein, 9 aa, Homo Sapiens
CCADRGALS

SEQ ID NO: 216020 - protein, 9 aa, Homo Sapiens
TTVRQLVHA

SEQ ID NO: 216021 - protein, 9 aa, Homo Sapiens
RTLARKAVA

SEQ ID NO: 216022 - protein, 9 aa, Homo Sapiens
LDESCDLVV

SEQ ID NO: 216023 - protein, 9 aa, Homo Sapiens
RCGSGSPED

SEQ ID NO: 216024 - protein, 9 aa, Homo Sapiens
SWSTWLSLW

SEQ ID NO: 216025 - protein, 9 aa, Homo Sapiens
PPSSPVPQL

SEQ ID NO: 216026 - protein, 9 aa, Homo Sapiens
VDHGMEPGA

SEQ ID NO: 216027 - protein, 9 aa, Homo Sapiens
EREKSVREK

SEQ ID NO: 216028 - protein, 9 aa, Homo Sapiens
HTRPDRDHH

SEQ ID NO: 216029 - protein, 9 aa, Homo Sapiens
QPHKINPSH

SEQ ID NO: 216030 - protein, 9 aa, Homo Sapiens
ASRSTRTSA

SEQ ID NO: 216031 - protein, 9 aa, Homo Sapiens
EPGGCGWAS

SEQ ID NO: 216032 - protein, 9 aa, Homo Sapiens
DPRTAHRAV

SEQ ID NO: 216033 - protein, 9 aa, Homo Sapiens
MSIAGKVIK

SEQ ID NO: 216034 - protein, 9 aa, Homo Sapiens
NPAYSFHVS

SEQ ID NO: 216035 - protein, 9 aa, Homo Sapiens
SREEELPRE

SEQ ID NO: 216036 - protein, 9 aa, Homo Sapiens
DQELWSEKL

SEQ ID NO: 216037 - protein, 9 aa, Homo Sapiens
FCILDTTKL

SEQ ID NO: 216038 - protein, 9 aa, Homo Sapiens
ARCHEAESN

SEQ ID NO: 216039 - protein, 9 aa, Homo Sapiens
PKGKGHRRK

SEQ ID NO: 216040 - protein, 9 aa, Homo Sapiens
FRVGRGGGG

SEQ ID NO: 216041 - protein, 9 aa, Homo Sapiens
AVESQKPIH

SEQ ID NO: 216042 - protein, 9 aa, Homo Sapiens
CYLTVACIF

SEQ ID NO: 216043 - protein, 9 aa, Homo Sapiens
TNSHLDPPP

SEQ ID NO: 216044 - protein, 9 aa, Homo Sapiens
WQRRLRACR

SEQ ID NO: 216045 - protein, 9 aa, Homo Sapiens
RTEISVGTY

SEQ ID NO: 216046 - protein, 9 aa, Homo Sapiens
GGRPSHPST

SEQ ID NO: 216047 - protein, 9 aa, Homo Sapiens
QSDGDSFNP

SEQ ID NO: 216048 - protein, 9 aa, Homo Sapiens
HLPSAPAAA

SEQ ID NO: 216049 - protein, 9 aa, Homo Sapiens
RGTSSPARS

SEQ ID NO: 216050 - protein, 9 aa, Homo Sapiens
RRVGVPGTG

SEQ ID NO: 216051 - protein, 9 aa, Homo Sapiens
PSPLALPAS

SEQ ID NO: 216052 - protein, 9 aa, Homo Sapiens
ILQASVAAW

SEQ ID NO: 216053 - protein, 9 aa, Homo Sapiens
KDYFYTHGL

SEQ ID NO: 216054 - protein, 9 aa, Homo Sapiens
YEGLVIGLH

SEQ ID NO: 216055 - protein, 9 aa, Homo Sapiens
ATILEYLTY

SEQ ID NO: 216056 - protein, 9 aa, Homo Sapiens
TKGACTADK

SEQ ID NO: 216057 - protein, 9 aa, Homo Sapiens
LLSEEPSNG

SEQ ID NO: 216058 - protein, 9 aa, Homo Sapiens
ISLLRSHQR

SEQ ID NO: 216059 - protein, 9 aa, Homo Sapiens
RSKELTIRT

SEQ ID NO: 216060 - protein, 9 aa, Homo Sapiens
IKSPKRPKI

SEQ ID NO: 216061 - protein, 9 aa, Homo Sapiens
DSESVQRAT

SEQ ID NO: 216062 - protein, 9 aa, Homo Sapiens
THTPSASRE

SEQ ID NO: 216063 - protein, 9 aa, Homo Sapiens
DRCYTGSHQ

SEQ ID NO: 216064 - protein, 9 aa, Homo Sapiens
QAAARRVGV

SEQ ID NO: 216065 - protein, 9 aa, Homo Sapiens
RTRCASCGT

SEQ ID NO: 216066 - protein, 9 aa, Homo Sapiens
GLRGFGLRG

SEQ ID NO: 216067 - protein, 9 aa, Homo Sapiens
LWPQLGNLL

SEQ ID NO: 216068 - protein, 9 aa, Homo Sapiens
KEANSGHQV

SEQ ID NO: 216069 - protein, 9 aa, Homo Sapiens
ENSLMAMDF

SEQ ID NO: 216070 - protein, 9 aa, Homo Sapiens
PKHTEAKKA

SEQ ID NO: 216071 - protein, 9 aa, Homo Sapiens
LLSLYSVAV

SEQ ID NO: 216072 - protein, 9 aa, Homo Sapiens
TLQVIIDFI

SEQ ID NO: 216073 - protein, 9 aa, Homo Sapiens
LVASIARAR

SEQ ID NO: 216074 - protein, 9 aa, Homo Sapiens
RHLGVVFPE

SEQ ID NO: 216075 - protein, 9 aa, Homo Sapiens
TVRDIEKSI

SEQ ID NO: 216076 - protein, 9 aa, Homo Sapiens
PPAVNLATH

SEQ ID NO: 216077 - protein, 9 aa, Homo Sapiens
HYTHRQCCC

SEQ ID NO: 216078 - protein, 9 aa, Homo Sapiens
GRNARNCPI

SEQ ID NO: 216079 - protein, 9 aa, Homo Sapiens
FALESAQFL

SEQ ID NO: 216080 - protein, 9 aa, Homo Sapiens
NRATQDNPR

SEQ ID NO: 216081 - protein, 9 aa, Homo Sapiens
EKRKMTFRL

SEQ ID NO: 216082 - protein, 9 aa, Homo Sapiens
ASREWIRAA

SEQ ID NO: 216083 - protein, 9 aa, Homo Sapiens
LKTFHMKCF

SEQ ID NO: 216084 - protein, 9 aa, Homo Sapiens
EVNVEMDAT

SEQ ID NO: 216085 - protein, 9 aa, Homo Sapiens
RLNKPYIYR

SEQ ID NO: 216086 - protein, 9 aa, Homo Sapiens
KDELPHVGV

SEQ ID NO: 216087 - protein, 9 aa, Homo Sapiens
MAYTSRMPK

SEQ ID NO: 216088 - protein, 9 aa, Homo Sapiens
TVVVAVATV

SEQ ID NO: 216089 - protein, 9 aa, Homo Sapiens
AARPDDLTL

SEQ ID NO: 216090 - protein, 9 aa, Homo Sapiens
TYQVRLQQS

SEQ ID NO: 216091 - protein, 9 aa, Homo Sapiens
VTAKRPWHE

SEQ ID NO: 216092 - protein, 9 aa, Homo Sapiens
DTLVVLHQA

SEQ ID NO: 216093 - protein, 9 aa, Homo Sapiens
LRGQRPARW

SEQ ID NO: 216094 - protein, 9 aa, Homo Sapiens
VVMKMGMPE

SEQ ID NO: 216095 - protein, 9 aa, Homo Sapiens
SFASGCVVL

SEQ ID NO: 216096 - protein, 9 aa, Homo Sapiens
YGVEDFWEV

SEQ ID NO: 216097 - protein, 9 aa, Homo Sapiens
CYQYNTDVV

SEQ ID NO: 216098 - protein, 9 aa, Homo Sapiens
VNQGNAGVK

SEQ ID NO: 216099 - protein, 9 aa, Homo Sapiens
AWVFSNAMC

SEQ ID NO: 216100 - protein, 9 aa, Homo Sapiens
DPHTRATHT

SEQ ID NO: 216101 - protein, 9 aa, Homo Sapiens
PRDDDLNLW

SEQ ID NO: 216102 - protein, 9 aa, Homo Sapiens
PRAAAFGKG

SEQ ID NO: 216103 - protein, 9 aa, Homo Sapiens
KLLVASIAR

SEQ ID NO: 216104 - protein, 9 aa, Homo Sapiens
GDQLVGGQV

SEQ ID NO: 216105 - protein, 9 aa, Homo Sapiens
VENLRRMAT

SEQ ID NO: 216106 - protein, 9 aa, Homo Sapiens
DHCHSYELF

SEQ ID NO: 216107 - protein, 9 aa, Homo Sapiens
SCDLVVENK

SEQ ID NO: 216108 - protein, 9 aa, Homo Sapiens
TPPGCRSGR

SEQ ID NO: 216109 - protein, 9 aa, Homo Sapiens
FSCVSLLIQ

SEQ ID NO: 216110 - protein, 9 aa, Homo Sapiens
PMKIPRQLP

SEQ ID NO: 216111 - protein, 9 aa, Homo Sapiens
TKKRGKSQG

SEQ ID NO: 216112 - protein, 9 aa, Homo Sapiens
PSCKKKSSC

SEQ ID NO: 216113 - protein, 9 aa, Homo Sapiens
VDHCHSYEL

SEQ ID NO: 216114 - protein, 9 aa, Homo Sapiens
SSTGRNARN

SEQ ID NO: 216115 - protein, 9 aa, Homo Sapiens
SRSQQNHHS

SEQ ID NO: 216116 - protein, 9 aa, Homo Sapiens
ATFLCQEKY

SEQ ID NO: 216117 - protein, 9 aa, Homo Sapiens
REKSRDTNR

SEQ ID NO: 216118 - protein, 9 aa, Homo Sapiens
LEQMVTKLT

SEQ ID NO: 216119 - protein, 9 aa, Homo Sapiens
DLEKERKRL

SEQ ID NO: 216120 - protein, 9 aa, Homo Sapiens
WQPVMDTVI

SEQ ID NO: 216121 - protein, 9 aa, Homo Sapiens
GPAGPGKLR

SEQ ID NO: 216122 - protein, 9 aa, Homo Sapiens
GSRAEPQAT

SEQ ID NO: 216123 - protein, 9 aa, Homo Sapiens
QTRRQISHT

SEQ ID NO: 216124 - protein, 9 aa, Homo Sapiens
IRRGENTSL

SEQ ID NO: 216125 - protein, 9 aa, Homo Sapiens
QHYRDELGA

SEQ ID NO: 216126 - protein, 9 aa, Homo Sapiens
SPHTVDHCH

SEQ ID NO: 216127 - protein, 9 aa, Homo Sapiens
LPGPPTQLM

SEQ ID NO: 216128 - protein, 9 aa, Homo Sapiens
SICGPQGPL

SEQ ID NO: 216129 - protein, 9 aa, Homo Sapiens
ASVKLRLNV

SEQ ID NO: 216130 - protein, 9 aa, Homo Sapiens
LNPSATRAN

SEQ ID NO: 216131 - protein, 9 aa, Homo Sapiens
GDMMSSGFS

SEQ ID NO: 216132 - protein, 9 aa, Homo Sapiens
DTALAHRAA

SEQ ID NO: 216133 - protein, 9 aa, Homo Sapiens
DGGQSVVSE

SEQ ID NO: 216134 - protein, 9 aa, Homo Sapiens
KIHVKMEIT

SEQ ID NO: 216135 - protein, 9 aa, Homo Sapiens
KLLSEEPSN

SEQ ID NO: 216136 - protein, 9 aa, Homo Sapiens
STVMRETRC

SEQ ID NO: 216137 - protein, 9 aa, Homo Sapiens
VTLMINLYH

SEQ ID NO: 216138 - protein, 9 aa, Homo Sapiens
TGSHQLASG

SEQ ID NO: 216139 - protein, 9 aa, Homo Sapiens
GLGDVEQLV

SEQ ID NO: 216140 - protein, 9 aa, Homo Sapiens
VRTLTWTWQ

SEQ ID NO: 216141 - protein, 9 aa, Homo Sapiens
EVGLVGLGP

SEQ ID NO: 216142 - protein, 9 aa, Homo Sapiens
TAITGSFQV

SEQ ID NO: 216143 - protein, 9 aa, Homo Sapiens
MASSWVTAH

SEQ ID NO: 216144 - protein, 9 aa, Homo Sapiens
GANNTGNII

SEQ ID NO: 216145 - protein, 9 aa, Homo Sapiens
IQSAQSQHS

SEQ ID NO: 216146 - protein, 9 aa, Homo Sapiens
GAWVFSNAM

SEQ ID NO: 216147 - protein, 9 aa, Homo Sapiens
WLLRFTKTC

SEQ ID NO: 216148 - protein, 9 aa, Homo Sapiens
RNAHSIPQP

SEQ ID NO: 216149 - protein, 9 aa, Homo Sapiens
SLPRSSSQR

SEQ ID NO: 216150 - protein, 9 aa, Homo Sapiens
ILNLCVISI

SEQ ID NO: 216151 - protein, 9 aa, Homo Sapiens
ILTDHCNEV

SEQ ID NO: 216152 - protein, 9 aa, Homo Sapiens
GTATRNGPG

SEQ ID NO: 216153 - protein, 9 aa, Homo Sapiens
NPVYEALLY

SEQ ID NO: 216154 - protein, 9 aa, Homo Sapiens
NKKKKKEKE

SEQ ID NO: 216155 - protein, 9 aa, Homo Sapiens
LDNAPRAAA

SEQ ID NO: 216156 - protein, 9 aa, Homo Sapiens
EEEEVVDLA

SEQ ID NO: 216157 - protein, 9 aa, Homo Sapiens
NWRVPLTPC

SEQ ID NO: 216158 - protein, 9 aa, Homo Sapiens
LRLYILVST

SEQ ID NO: 216159 - protein, 9 aa, Homo Sapiens
YPNHREREA

SEQ ID NO: 216160 - protein, 9 aa, Homo Sapiens
SFGYRCALP

SEQ ID NO: 216161 - protein, 9 aa, Homo Sapiens
TGVVAAMEE

SEQ ID NO: 216162 - protein, 9 aa, Homo Sapiens
HCDINFDDC

SEQ ID NO: 216163 - protein, 9 aa, Homo Sapiens
VAMEAKWEE

SEQ ID NO: 216164 - protein, 9 aa, Homo Sapiens
STLSLSGGA

SEQ ID NO: 216165 - protein, 9 aa, Homo Sapiens
VCGQVSCHT

SEQ ID NO: 216166 - protein, 9 aa, Homo Sapiens
KYLTLAVKN

SEQ ID NO: 216167 - protein, 9 aa, Homo Sapiens
VLLLKPDKE

SEQ ID NO: 216168 - protein, 9 aa, Homo Sapiens
SQESTMECQ

SEQ ID NO: 216169 - protein, 9 aa, Homo Sapiens
RPPSSRTGR

SEQ ID NO: 216170 - protein, 9 aa, Homo Sapiens
DFSLKYENE

SEQ ID NO: 216171 - protein, 9 aa, Homo Sapiens
SSSSSTRHC

SEQ ID NO: 216172 - protein, 9 aa, Homo Sapiens
PEVFFNTTG

SEQ ID NO: 216173 - protein, 9 aa, Homo Sapiens
GQVCANNSD

SEQ ID NO: 216174 - protein, 9 aa, Homo Sapiens
SVEISILDV

SEQ ID NO: 216175 - protein, 9 aa, Homo Sapiens
GPIHLLVDL

SEQ ID NO: 216176 - protein, 9 aa, Homo Sapiens
NKTYSVPAH

SEQ ID NO: 216177 - protein, 9 aa, Homo Sapiens
CCLKTSCFK

SEQ ID NO: 216178 - protein, 9 aa, Homo Sapiens
YNTDHTQNS

SEQ ID NO: 216179 - protein, 9 aa, Homo Sapiens
QNVGHKSGS

SEQ ID NO: 216180 - protein, 9 aa, Homo Sapiens
CWWPTGRPA

SEQ ID NO: 216181 - protein, 9 aa, Homo Sapiens
AAWRITSLE

SEQ ID NO: 216182 - protein, 9 aa, Homo Sapiens
SKNIQDRVN

SEQ ID NO: 216183 - protein, 9 aa, Homo Sapiens
YRQANIITG

SEQ ID NO: 216184 - protein, 9 aa, Homo Sapiens
RSCPTLRAC

SEQ ID NO: 216185 - protein, 9 aa, Homo Sapiens
NRPRSQHLP

SEQ ID NO: 216186 - protein, 9 aa, Homo Sapiens
QPRRHCWWP

SEQ ID NO: 216187 - protein, 9 aa, Homo Sapiens
AEVKPISKA

SEQ ID NO: 216188 - protein, 9 aa, Homo Sapiens
MAACAGIPG

SEQ ID NO: 216189 - protein, 9 aa, Homo Sapiens
PPMEFPAPR

SEQ ID NO: 216190 - protein, 9 aa, Homo Sapiens
MSGVEQATQ

SEQ ID NO: 216191 - protein, 9 aa, Homo Sapiens
IHALCTLIK

SEQ ID NO: 216192 - protein, 9 aa, Homo Sapiens
QTLCSTISC

SEQ ID NO: 216193 - protein, 9 aa, Homo Sapiens
ELEGRDVGA

SEQ ID NO: 216194 - protein, 9 aa, Homo Sapiens
EQLQQEIKD

SEQ ID NO: 216195 - protein, 9 aa, Homo Sapiens
TDRVGEGRA

SEQ ID NO: 216196 - protein, 9 aa, Homo Sapiens
VTKCAFQAP

SEQ ID NO: 216197 - protein, 9 aa, Homo Sapiens
GLDALVATT

SEQ ID NO: 216198 - protein, 9 aa, Homo Sapiens
VVLARLKGR

SEQ ID NO: 216199 - protein, 9 aa, Homo Sapiens
MKQALMMMK

SEQ ID NO: 216200 - protein, 9 aa, Homo Sapiens
GFCSPRQVA

SEQ ID NO: 216201 - protein, 9 aa, Homo Sapiens
STLSSSPNN

SEQ ID NO: 216202 - protein, 9 aa, Homo Sapiens
IKSIAAALK

SEQ ID NO: 216203 - protein, 9 aa, Homo Sapiens
RPARWWMSA

SEQ ID NO: 216204 - protein, 9 aa, Homo Sapiens
THMLTAITG

SEQ ID NO: 216205 - protein, 9 aa, Homo Sapiens
QDLRAPALP

SEQ ID NO: 216206 - protein, 9 aa, Homo Sapiens
PASCVRTLT

SEQ ID NO: 216207 - protein, 9 aa, Homo Sapiens
VQVHGLGLL

SEQ ID NO: 216208 - protein, 9 aa, Homo Sapiens
SKQVCNDVD

SEQ ID NO: 216209 - protein, 9 aa, Homo Sapiens
SHRLRLRLP

SEQ ID NO: 216210 - protein, 9 aa, Homo Sapiens
WTCSQTRPL

SEQ ID NO: 216211 - protein, 9 aa, Homo Sapiens
LNNYDAETK

SEQ ID NO: 216212 - protein, 9 aa, Homo Sapiens
VPRLPRAGG

SEQ ID NO: 216213 - protein, 9 aa, Homo Sapiens
ATEETEVAM

SEQ ID NO: 216214 - protein, 9 aa, Homo Sapiens
VPVFTIHLG

SEQ ID NO: 216215 - protein, 9 aa, Homo Sapiens
KEFENPEVS

SEQ ID NO: 216216 - protein, 9 aa, Homo Sapiens
KSTPWQPTR

SEQ ID NO: 216217 - protein, 9 aa, Homo Sapiens
PLWLWKAST

SEQ ID NO: 216218 - protein, 9 aa, Homo Sapiens
LRKQHLLLS

SEQ ID NO: 216219 - protein, 9 aa, Homo Sapiens
EGNHHHPDA

SEQ ID NO: 216220 - protein, 9 aa, Homo Sapiens
WHPVSSGTP

SEQ ID NO: 216221 - protein, 9 aa, Homo Sapiens
PTPPRRSSS

SEQ ID NO: 216222 - protein, 9 aa, Homo Sapiens
NEKITPFPA

SEQ ID NO: 216223 - protein, 9 aa, Homo Sapiens
FSGQRRRRR

SEQ ID NO: 216224 - protein, 9 aa, Homo Sapiens
LQVTTTLKL

SEQ ID NO: 216225 - protein, 9 aa, Homo Sapiens
AAWNEKVST

SEQ ID NO: 216226 - protein, 9 aa, Homo Sapiens
KMTGSQDLI

SEQ ID NO: 216227 - protein, 9 aa, Homo Sapiens
FQQACYNFI

SEQ ID NO: 216228 - protein, 9 aa, Homo Sapiens
KWLRNRIQC

SEQ ID NO: 216229 - protein, 9 aa, Homo Sapiens
VPRPALRPT

SEQ ID NO: 216230 - protein, 9 aa, Homo Sapiens
IRYAGNKYA

SEQ ID NO: 216231 - protein, 9 aa, Homo Sapiens
PGVPIGLDF

SEQ ID NO: 216232 - protein, 9 aa, Homo Sapiens
QEEEGLRLV

SEQ ID NO: 216233 - protein, 9 aa, Homo Sapiens
NSSGFAEDS

SEQ ID NO: 216234 - protein, 9 aa, Homo Sapiens
ANCTWSIIT

SEQ ID NO: 216235 - protein, 9 aa, Homo Sapiens
AYLYEHGLG

SEQ ID NO: 216236 - protein, 9 aa, Homo Sapiens
ASGSWNYRQ

SEQ ID NO: 216237 - protein, 9 aa, Homo Sapiens
WERSKGASS

SEQ ID NO: 216238 - protein, 9 aa, Homo Sapiens
ELTCADTFL

SEQ ID NO: 216239 - protein, 9 aa, Homo Sapiens
VEGFPWQKK

SEQ ID NO: 216240 - protein, 9 aa, Homo Sapiens
CAEVIPCSY

SEQ ID NO: 216241 - protein, 9 aa, Homo Sapiens
SGGCQYLRC

SEQ ID NO: 216242 - protein, 9 aa, Homo Sapiens
INFDDCQDN

SEQ ID NO: 216243 - protein, 9 aa, Homo Sapiens
ASRLSEAGR

SEQ ID NO: 216244 - protein, 9 aa, Homo Sapiens
RNLTSVMSV

SEQ ID NO: 216245 - protein, 9 aa, Homo Sapiens
LKTSCFKLD

SEQ ID NO: 216246 - protein, 9 aa, Homo Sapiens
VLILRLPFV

SEQ ID NO: 216247 - protein, 9 aa, Homo Sapiens
GDANLDRPP

SEQ ID NO: 216248 - protein, 9 aa, Homo Sapiens
HMGHGREEA

SEQ ID NO: 216249 - protein, 9 aa, Homo Sapiens
GSSKNNMGA

SEQ ID NO: 216250 - protein, 9 aa, Homo Sapiens
QQWKCCTEM

SEQ ID NO: 216251 - protein, 9 aa, Homo Sapiens
GCAWYLCSS

SEQ ID NO: 216252 - protein, 9 aa, Homo Sapiens
TNEETSMQN

SEQ ID NO: 216253 - protein, 9 aa, Homo Sapiens
MEKRKMTFR

SEQ ID NO: 216254 - protein, 9 aa, Homo Sapiens
SRLCMSLQE

SEQ ID NO: 216255 - protein, 9 aa, Homo Sapiens
QRKLRACGN

SEQ ID NO: 216256 - protein, 9 aa, Homo Sapiens
VSRAAEPGY

SEQ ID NO: 216257 - protein, 9 aa, Homo Sapiens
LSALNLKHG

SEQ ID NO: 216258 - protein, 9 aa, Homo Sapiens
VARCHEAES

SEQ ID NO: 216259 - protein, 9 aa, Homo Sapiens
RPSRLEHVA

SEQ ID NO: 216260 - protein, 9 aa, Homo Sapiens
CHIKHAWAR

SEQ ID NO: 216261 - protein, 9 aa, Homo Sapiens
QLKRPILFL

SEQ ID NO: 216262 - protein, 9 aa, Homo Sapiens
EERLKGLGK

SEQ ID NO: 216263 - protein, 9 aa, Homo Sapiens
TWTQFRNYP

SEQ ID NO: 216264 - protein, 9 aa, Homo Sapiens
GSDELSFDL

SEQ ID NO: 216265 - protein, 9 aa, Homo Sapiens
KVRVVKDLR

SEQ ID NO: 216266 - protein, 9 aa, Homo Sapiens
RQRKESFQE

SEQ ID NO: 216267 - protein, 9 aa, Homo Sapiens
IPLMMPLDV

SEQ ID NO: 216268 - protein, 9 aa, Homo Sapiens
PKWRRRIPA

SEQ ID NO: 216269 - protein, 9 aa, Homo Sapiens
WGCLCGRCG

SEQ ID NO: 216270 - protein, 9 aa, Homo Sapiens
LGDVEQLVK

SEQ ID NO: 216271 - protein, 9 aa, Homo Sapiens
DHMGHGREE

SEQ ID NO: 216272 - protein, 9 aa, Homo Sapiens
LTEGSQKCV

SEQ ID NO: 216273 - protein, 9 aa, Homo Sapiens
PSPPQRRPG

SEQ ID NO: 216274 - protein, 9 aa, Homo Sapiens
IGSQELGFT

SEQ ID NO: 216275 - protein, 9 aa, Homo Sapiens
DLGIGQLSA

SEQ ID NO: 216276 - protein, 9 aa, Homo Sapiens
KKSRLPHQS

SEQ ID NO: 216277 - protein, 9 aa, Homo Sapiens
RTTSPMTFT

SEQ ID NO: 216278 - protein, 9 aa, Homo Sapiens
KPHGVKRRH

SEQ ID NO: 216279 - protein, 9 aa, Homo Sapiens
SSPPSVTIH

SEQ ID NO: 216280 - protein, 9 aa, Homo Sapiens
SWCGTWTAW

SEQ ID NO: 216281 - protein, 9 aa, Homo Sapiens
VTAGHCTSS

SEQ ID NO: 216282 - protein, 9 aa, Homo Sapiens
QKPLISLKK

SEQ ID NO: 216283 - protein, 9 aa, Homo Sapiens
GCLGNQFYV

SEQ ID NO: 216284 - protein, 9 aa, Homo Sapiens
VLIKLPDNH

SEQ ID NO: 216285 - protein, 9 aa, Homo Sapiens
AAGTLGESG

SEQ ID NO: 216286 - protein, 9 aa, Homo Sapiens
SSRTGRPPK

SEQ ID NO: 216287 - protein, 9 aa, Homo Sapiens
PYCDDTHRS

SEQ ID NO: 216288 - protein, 9 aa, Homo Sapiens
KQSQLYLLD

SEQ ID NO: 216289 - protein, 9 aa, Homo Sapiens
QEAEQLWNQ

SEQ ID NO: 216290 - protein, 9 aa, Homo Sapiens
GKGHRRKEI

SEQ ID NO: 216291 - protein, 9 aa, Homo Sapiens
IGRKKSRLP

SEQ ID NO: 216292 - protein, 9 aa, Homo Sapiens
YLKAPEDSS

SEQ ID NO: 216293 - protein, 9 aa, Homo Sapiens
IEVTSWTVD

SEQ ID NO: 216294 - protein, 9 aa, Homo Sapiens
CLSHHRPSL

SEQ ID NO: 216295 - protein, 9 aa, Homo Sapiens
SWTTSSVMS

SEQ ID NO: 216296 - protein, 9 aa, Homo Sapiens
CLLLSLYDP

SEQ ID NO: 216297 - protein, 9 aa, Homo Sapiens
VGVKKGAPG

SEQ ID NO: 216298 - protein, 9 aa, Homo Sapiens
LEVARHHEN

SEQ ID NO: 216299 - protein, 9 aa, Homo Sapiens
PFRHTFWVV

SEQ ID NO: 216300 - protein, 9 aa, Homo Sapiens
ALLHYLDNH

SEQ ID NO: 216301 - protein, 9 aa, Homo Sapiens
LLLPPAPKW

SEQ ID NO: 216302 - protein, 9 aa, Homo Sapiens
LSKILRNNP

SEQ ID NO: 216303 - protein, 9 aa, Homo Sapiens
TPQGSNSSD

SEQ ID NO: 216304 - protein, 9 aa, Homo Sapiens
IRQVHWDLS

SEQ ID NO: 216305 - protein, 9 aa, Homo Sapiens
EWCRAMTKN

SEQ ID NO: 216306 - protein, 9 aa, Homo Sapiens
PTSTLRGTS

SEQ ID NO: 216307 - protein, 9 aa, Homo Sapiens
PWSPTCPQP

SEQ ID NO: 216308 - protein, 9 aa, Homo Sapiens
DTALTLVAG

SEQ ID NO: 216309 - protein, 9 aa, Homo Sapiens
YLAIMWLTM

SEQ ID NO: 216310 - protein, 9 aa, Homo Sapiens
KRSARAPRS

SEQ ID NO: 216311 - protein, 9 aa, Homo Sapiens
FALASHQKA

SEQ ID NO: 216312 - protein, 9 aa, Homo Sapiens
VCSVGPLSK

SEQ ID NO: 216313 - protein, 9 aa, Homo Sapiens
QVAMLPKLL

SEQ ID NO: 216314 - protein, 9 aa, Homo Sapiens
TCSQTRPLW

SEQ ID NO: 216315 - protein, 9 aa, Homo Sapiens
QCNTTTGSC

SEQ ID NO: 216316 - protein, 9 aa, Homo Sapiens
KMSDTCSPG

SEQ ID NO: 216317 - protein, 9 aa, Homo Sapiens
SARFMPCTI

SEQ ID NO: 216318 - protein, 9 aa, Homo Sapiens
CSLPLDRTF

SEQ ID NO: 216319 - protein, 9 aa, Homo Sapiens
CCTADSQLA

SEQ ID NO: 216320 - protein, 9 aa, Homo Sapiens
ASTTRCRRP

SEQ ID NO: 216321 - protein, 9 aa, Homo Sapiens
KKKPEEFSV

SEQ ID NO: 216322 - protein, 9 aa, Homo Sapiens
KTQTMSAHI

SEQ ID NO: 216323 - protein, 9 aa, Homo Sapiens
GSASCFSNG

SEQ ID NO: 216324 - protein, 9 aa, Homo Sapiens
HRKSDFCWC

SEQ ID NO: 216325 - protein, 9 aa, Homo Sapiens
GNALKAIIT

SEQ ID NO: 216326 - protein, 9 aa, Homo Sapiens
AESGKVYTL

SEQ ID NO: 216327 - protein, 9 aa, Homo Sapiens
SEAEEAIKG

SEQ ID NO: 216328 - protein, 9 aa, Homo Sapiens
PGQARAAQR

SEQ ID NO: 216329 - protein, 9 aa, Homo Sapiens
EALLEAVDC

SEQ ID NO: 216330 - protein, 9 aa, Homo Sapiens
VSVAMQFLR

SEQ ID NO: 216331 - protein, 9 aa, Homo Sapiens
KFDLRLYIL

SEQ ID NO: 216332 - protein, 9 aa, Homo Sapiens
PREGHILIF

SEQ ID NO: 216333 - protein, 9 aa, Homo Sapiens
GIVSELQFT

SEQ ID NO: 216334 - protein, 9 aa, Homo Sapiens
KVPPYLGYH

SEQ ID NO: 216335 - protein, 9 aa, Homo Sapiens
QTGQAPHLG

SEQ ID NO: 216336 - protein, 9 aa, Homo Sapiens
TPQQVQELG

SEQ ID NO: 216337 - protein, 9 aa, Homo Sapiens
TSGSGWLSK

SEQ ID NO: 216338 - protein, 9 aa, Homo Sapiens
LPSLRSRVT

SEQ ID NO: 216339 - protein, 9 aa, Homo Sapiens
TKVKSVFVD

SEQ ID NO: 216340 - protein, 9 aa, Homo Sapiens
SLSKKERKV

SEQ ID NO: 216341 - protein, 9 aa, Homo Sapiens
LPRASLRAT

SEQ ID NO: 216342 - protein, 9 aa, Homo Sapiens
FGDPSAALD

SEQ ID NO: 216343 - protein, 9 aa, Homo Sapiens
EAVSGSGGR

SEQ ID NO: 216344 - protein, 9 aa, Homo Sapiens
IFSRARCCR

SEQ ID NO: 216345 - protein, 9 aa, Homo Sapiens
YWHVRCLSC

SEQ ID NO: 216346 - protein, 9 aa, Homo Sapiens
CLCGRCGAT

SEQ ID NO: 216347 - protein, 9 aa, Homo Sapiens
ELPHVGVTQ

SEQ ID NO: 216348 - protein, 9 aa, Homo Sapiens
RQVVLHHPV

SEQ ID NO: 216349 - protein, 9 aa, Homo Sapiens
FMTTKLPLP

SEQ ID NO: 216350 - protein, 9 aa, Homo Sapiens
CHTCFKRQG

SEQ ID NO: 216351 - protein, 9 aa, Homo Sapiens
TLRVQARDR

SEQ ID NO: 216352 - protein, 9 aa, Homo Sapiens
HVDMSLSCT

SEQ ID NO: 216353 - protein, 9 aa, Homo Sapiens
PTLHYAISE

SEQ ID NO: 216354 - protein, 9 aa, Homo Sapiens
AWEYKMPGG

SEQ ID NO: 216355 - protein, 9 aa, Homo Sapiens
HGCQFMDNM

SEQ ID NO: 216356 - protein, 9 aa, Homo Sapiens
PLPPQPGLP

SEQ ID NO: 216357 - protein, 9 aa, Homo Sapiens
LMVGIGLSF

SEQ ID NO: 216358 - protein, 9 aa, Homo Sapiens
LFRQDFLWT

SEQ ID NO: 216359 - protein, 9 aa, Homo Sapiens
WWPTGRPAG

SEQ ID NO: 216360 - protein, 9 aa, Homo Sapiens
NKKISVLSF

SEQ ID NO: 216361 - protein, 9 aa, Homo Sapiens
VGTVAIRGL

SEQ ID NO: 216362 - protein, 9 aa, Homo Sapiens
FSTYKENGP

SEQ ID NO: 216363 - protein, 9 aa, Homo Sapiens
GTTLAVLHT

SEQ ID NO: 216364 - protein, 9 aa, Homo Sapiens
QCRCITDSR

SEQ ID NO: 216365 - protein, 9 aa, Homo Sapiens
IPSMILPDP

SEQ ID NO: 216366 - protein, 9 aa, Homo Sapiens
NIFWMAMFQ

SEQ ID NO: 216367 - protein, 9 aa, Homo Sapiens
CIGTVPIGE

SEQ ID NO: 216368 - protein, 9 aa, Homo Sapiens
TSWTVDASR

SEQ ID NO: 216369 - protein, 9 aa, Homo Sapiens
SATRANPGP

SEQ ID NO: 216370 - protein, 9 aa, Homo Sapiens
RTPQPSGLH

SEQ ID NO: 216371 - protein, 9 aa, Homo Sapiens
MAGRTTAVP

SEQ ID NO: 216372 - protein, 9 aa, Homo Sapiens
TPDIEIWER

SEQ ID NO: 216373 - protein, 9 aa, Homo Sapiens
LKKGLAIVL

SEQ ID NO: 216374 - protein, 9 aa, Homo Sapiens
LHAARPADH

SEQ ID NO: 216375 - protein, 9 aa, Homo Sapiens
HQQHEVAGA

SEQ ID NO: 216376 - protein, 9 aa, Homo Sapiens
VEKFLSKKG

SEQ ID NO: 216377 - protein, 9 aa, Homo Sapiens
LERNLTSVM

SEQ ID NO: 216378 - protein, 9 aa, Homo Sapiens
QGSNRGSGS

SEQ ID NO: 216379 - protein, 9 aa, Homo Sapiens
SPPLWAALA

SEQ ID NO: 216380 - protein, 9 aa, Homo Sapiens
RSINSSLKQ

SEQ ID NO: 216381 - protein, 9 aa, Homo Sapiens
FEYEKESPC

SEQ ID NO: 216382 - protein, 9 aa, Homo Sapiens
RHIHTGEKP

SEQ ID NO: 216383 - protein, 9 aa, Homo Sapiens
PALLFHGLG

SEQ ID NO: 216384 - protein, 9 aa, Homo Sapiens
ADRGALSVP

SEQ ID NO: 216385 - protein, 9 aa, Homo Sapiens
SPPTSCPPL

SEQ ID NO: 216386 - protein, 9 aa, Homo Sapiens
GGKEETLAS

SEQ ID NO: 216387 - protein, 9 aa, Homo Sapiens
MEETGVVAA

SEQ ID NO: 216388 - protein, 9 aa, Homo Sapiens
DHTNVVQAA

SEQ ID NO: 216389 - protein, 9 aa, Homo Sapiens
DASCGYLDI

SEQ ID NO: 216390 - protein, 9 aa, Homo Sapiens
VEGMLRIGS

SEQ ID NO: 216391 - protein, 9 aa, Homo Sapiens
SEAWSKIYS

SEQ ID NO: 216392 - protein, 9 aa, Homo Sapiens
RSVCNYYFC

SEQ ID NO: 216393 - protein, 9 aa, Homo Sapiens
ATTINLGDL

SEQ ID NO: 216394 - protein, 9 aa, Homo Sapiens
SASPSTLSS

SEQ ID NO: 216395 - protein, 9 aa, Homo Sapiens
FECNKYGKS

SEQ ID NO: 216396 - protein, 9 aa, Homo Sapiens
AWNRVDIAC

SEQ ID NO: 216397 - protein, 9 aa, Homo Sapiens
SPPAGAVVW

SEQ ID NO: 216398 - protein, 9 aa, Homo Sapiens
TTVEDLYLF

SEQ ID NO: 216399 - protein, 9 aa, Homo Sapiens
WGPPDQGVA

SEQ ID NO: 216400 - protein, 9 aa, Homo Sapiens
STTTRMVLD

SEQ ID NO: 216401 - protein, 9 aa, Homo Sapiens
VHSYMLAKL

SEQ ID NO: 216402 - protein, 9 aa, Homo Sapiens
PHRSPPTSC

SEQ ID NO: 216403 - protein, 9 aa, Homo Sapiens
VADGLIKVQ

SEQ ID NO: 216404 - protein, 9 aa, Homo Sapiens
LTQGPSSTF

SEQ ID NO: 216405 - protein, 9 aa, Homo Sapiens
KITMVVLSS

SEQ ID NO: 216406 - protein, 9 aa, Homo Sapiens
SVSTSQPVE

SEQ ID NO: 216407 - protein, 9 aa, Homo Sapiens
TQAEAAAVV

SEQ ID NO: 216408 - protein, 9 aa, Homo Sapiens
LSIMLSEDN

SEQ ID NO: 216409 - protein, 9 aa, Homo Sapiens
AQELKTLLG

SEQ ID NO: 216410 - protein, 9 aa, Homo Sapiens
GHYTHRQCC

SEQ ID NO: 216411 - protein, 9 aa, Homo Sapiens
PHTTPDKGW

SEQ ID NO: 216412 - protein, 9 aa, Homo Sapiens
QRLVESDPQ

SEQ ID NO: 216413 - protein, 9 aa, Homo Sapiens
VGRVLAVAP

SEQ ID NO: 216414 - protein, 9 aa, Homo Sapiens
DLELKKEQR

SEQ ID NO: 216415 - protein, 9 aa, Homo Sapiens
TPRAGGFVI

SEQ ID NO: 216416 - protein, 9 aa, Homo Sapiens
FLWMKIFRS

SEQ ID NO: 216417 - protein, 9 aa, Homo Sapiens
AKDNKAQDW

SEQ ID NO: 216418 - protein, 9 aa, Homo Sapiens
RKDCLDRSF

SEQ ID NO: 216419 - protein, 9 aa, Homo Sapiens
SLEAVREEN

SEQ ID NO: 216420 - protein, 9 aa, Homo Sapiens
SLTGTTAAG

SEQ ID NO: 216421 - protein, 9 aa, Homo Sapiens
GPPTCSFVQ

SEQ ID NO: 216422 - protein, 9 aa, Homo Sapiens
SCFQERVRI

SEQ ID NO: 216423 - protein, 9 aa, Homo Sapiens
CSTWHVAHT

SEQ ID NO: 216424 - protein, 9 aa, Homo Sapiens
RYPPQSPCR

SEQ ID NO: 216425 - protein, 9 aa, Homo Sapiens
LLATSAVEQ

SEQ ID NO: 216426 - protein, 9 aa, Homo Sapiens
IGSLIFHKP

SEQ ID NO: 216427 - protein, 9 aa, Homo Sapiens
CYLALEHGC

SEQ ID NO: 216428 - protein, 9 aa, Homo Sapiens
GSWCGTWTA

SEQ ID NO: 216429 - protein, 9 aa, Homo Sapiens
FEYINQGGS

SEQ ID NO: 216430 - protein, 9 aa, Homo Sapiens
FWGLVTDAR

SEQ ID NO: 216431 - protein, 9 aa, Homo Sapiens
QATRRDAGL

SEQ ID NO: 216432 - protein, 9 aa, Homo Sapiens
WISNDRLGS

SEQ ID NO: 216433 - protein, 9 aa, Homo Sapiens
HTVTSSKAT

SEQ ID NO: 216434 - protein, 9 aa, Homo Sapiens
LMMPLDVNQ

SEQ ID NO: 216435 - protein, 9 aa, Homo Sapiens
DDTHRSERV

SEQ ID NO: 216436 - protein, 9 aa, Homo Sapiens
PKVNQGNAG

SEQ ID NO: 216437 - protein, 9 aa, Homo Sapiens
WWAPSRSTC

SEQ ID NO: 216438 - protein, 9 aa, Homo Sapiens
TWTWQWSVP

SEQ ID NO: 216439 - protein, 9 aa, Homo Sapiens
ATGSRGAWT

SEQ ID NO: 216440 - protein, 9 aa, Homo Sapiens
ERTEEKDPC

SEQ ID NO: 216441 - protein, 9 aa, Homo Sapiens
RGKWVNLLL

SEQ ID NO: 216442 - protein, 9 aa, Homo Sapiens
NRRLPQEES

SEQ ID NO: 216443 - protein, 9 aa, Homo Sapiens
TIVQGHYRE

SEQ ID NO: 216444 - protein, 9 aa, Homo Sapiens
VTPLRVQSV

SEQ ID NO: 216445 - protein, 9 aa, Homo Sapiens
EVPGSHLHF

SEQ ID NO: 216446 - protein, 9 aa, Homo Sapiens
PPFGLIPRL

SEQ ID NO: 216447 - protein, 9 aa, Homo Sapiens
GGGQLAAGE

SEQ ID NO: 216448 - protein, 9 aa, Homo Sapiens
RFLQSQNLN

SEQ ID NO: 216449 - protein, 9 aa, Homo Sapiens
QELQETQEH

SEQ ID NO: 216450 - protein, 9 aa, Homo Sapiens
PASMRWRSS

SEQ ID NO: 216451 - protein, 9 aa, Homo Sapiens
TTCHSILSS

SEQ ID NO: 216452 - protein, 9 aa, Homo Sapiens
SPEAPRYTV

SEQ ID NO: 216453 - protein, 9 aa, Homo Sapiens
SQHSTPVPA

SEQ ID NO: 216454 - protein, 9 aa, Homo Sapiens
VDFSEVEWE

SEQ ID NO: 216455 - protein, 9 aa, Homo Sapiens
DPVNVHDIR

SEQ ID NO: 216456 - protein, 9 aa, Homo Sapiens
KVLGCPKIP

SEQ ID NO: 216457 - protein, 9 aa, Homo Sapiens
TDWRKSHLI

SEQ ID NO: 216458 - protein, 9 aa, Homo Sapiens
MQSGMRNKE

SEQ ID NO: 216459 - protein, 9 aa, Homo Sapiens
DIIRKLDLL

SEQ ID NO: 216460 - protein, 9 aa, Homo Sapiens
REVWDTVVA

SEQ ID NO: 216461 - protein, 9 aa, Homo Sapiens
GAGLHVHGS

SEQ ID NO: 216462 - protein, 9 aa, Homo Sapiens
PSPAFSVGL

SEQ ID NO: 216463 - protein, 9 aa, Homo Sapiens
RAQLGPAFI

SEQ ID NO: 216464 - protein, 9 aa, Homo Sapiens
ISCPPLPCV

SEQ ID NO: 216465 - protein, 9 aa, Homo Sapiens
PRERKRLGV

SEQ ID NO: 216466 - protein, 9 aa, Homo Sapiens
PPTSPYLND

SEQ ID NO: 216467 - protein, 9 aa, Homo Sapiens
FLLDHGVSL

SEQ ID NO: 216468 - protein, 9 aa, Homo Sapiens
CAEGHGDQE

SEQ ID NO: 216469 - protein, 9 aa, Homo Sapiens
PDREPPPRE

SEQ ID NO: 216470 - protein, 9 aa, Homo Sapiens
SNTWIVTAA

SEQ ID NO: 216471 - protein, 9 aa, Homo Sapiens
KSVKGGAEI

SEQ ID NO: 216472 - protein, 9 aa, Homo Sapiens
HTGQPQGSS

SEQ ID NO: 216473 - protein, 9 aa, Homo Sapiens
CMLKLGRHS

SEQ ID NO: 216474 - protein, 9 aa, Homo Sapiens
LSPWCLSCS

SEQ ID NO: 216475 - protein, 9 aa, Homo Sapiens
NKVNGLLKV

SEQ ID NO: 216476 - protein, 9 aa, Homo Sapiens
VSELQFTPD

SEQ ID NO: 216477 - protein, 9 aa, Homo Sapiens
MPPPPSRPR

SEQ ID NO: 216478 - protein, 9 aa, Homo Sapiens
LMGPWHLCM

SEQ ID NO: 216479 - protein, 9 aa, Homo Sapiens
SSASTFEQG

SEQ ID NO: 216480 - protein, 9 aa, Homo Sapiens
LMNANHVFF

SEQ ID NO: 216481 - protein, 9 aa, Homo Sapiens
GSLQTSSSG

SEQ ID NO: 216482 - protein, 9 aa, Homo Sapiens
VVVPDTAVL

SEQ ID NO: 216483 - protein, 9 aa, Homo Sapiens
VHGLVVLLG

SEQ ID NO: 216484 - protein, 9 aa, Homo Sapiens
RVCENRRGS

SEQ ID NO: 216485 - protein, 9 aa, Homo Sapiens
DCHEEKIRK

SEQ ID NO: 216486 - protein, 9 aa, Homo Sapiens
IVFPMTCKP

SEQ ID NO: 216487 - protein, 9 aa, Homo Sapiens
GQLHRALDV

SEQ ID NO: 216488 - protein, 9 aa, Homo Sapiens
SFAHPRQLR

SEQ ID NO: 216489 - protein, 9 aa, Homo Sapiens
EQRVILDCE

SEQ ID NO: 216490 - protein, 9 aa, Homo Sapiens
HQNRVSVII

SEQ ID NO: 216491 - protein, 9 aa, Homo Sapiens
SDTGGLTLR

SEQ ID NO: 216492 - protein, 9 aa, Homo Sapiens
VPLGNLSPG

SEQ ID NO: 216493 - protein, 9 aa, Homo Sapiens
VLETIKTYL

SEQ ID NO: 216494 - protein, 9 aa, Homo Sapiens
WMKIFRSGP

SEQ ID NO: 216495 - protein, 9 aa, Homo Sapiens
SKCITECVR

SEQ ID NO: 216496 - protein, 9 aa, Homo Sapiens
THPCTMLLP

SEQ ID NO: 216497 - protein, 9 aa, Homo Sapiens
ELDHHFFLQ

SEQ ID NO: 216498 - protein, 9 aa, Homo Sapiens
RLNNKIPLL

SEQ ID NO: 216499 - protein, 9 aa, Homo Sapiens
PRRGPAQRA

SEQ ID NO: 216500 - protein, 9 aa, Homo Sapiens
CARRLAKKE

SEQ ID NO: 216501 - protein, 9 aa, Homo Sapiens
IQSRFLQSQ

SEQ ID NO: 216502 - protein, 9 aa, Homo Sapiens
WLSKILRNN

SEQ ID NO: 216503 - protein, 9 aa, Homo Sapiens
CSFVQPCTC

SEQ ID NO: 216504 - protein, 9 aa, Homo Sapiens
GDGDKDGPA

SEQ ID NO: 216505 - protein, 9 aa, Homo Sapiens
DVLDHGEDV

SEQ ID NO: 216506 - protein, 9 aa, Homo Sapiens
DMMGTGPPY

SEQ ID NO: 216507 - protein, 9 aa, Homo Sapiens
VFMVIGNRE

SEQ ID NO: 216508 - protein, 9 aa, Homo Sapiens
HHLVPGPCS

SEQ ID NO: 216509 - protein, 9 aa, Homo Sapiens
AAGEAVQGQ

SEQ ID NO: 216510 - protein, 9 aa, Homo Sapiens
PQLLPPRSR

SEQ ID NO: 216511 - protein, 9 aa, Homo Sapiens
YVDAAWGGG

SEQ ID NO: 216512 - protein, 9 aa, Homo Sapiens
DIVQREVWD

SEQ ID NO: 216513 - protein, 9 aa, Homo Sapiens
WKKMMIGSQ

SEQ ID NO: 216514 - protein, 9 aa, Homo Sapiens
WRPGWGCVP

SEQ ID NO: 216515 - protein, 9 aa, Homo Sapiens
FQDGRLGKE

SEQ ID NO: 216516 - protein, 9 aa, Homo Sapiens
EAPVQEGPG

SEQ ID NO: 216517 - protein, 9 aa, Homo Sapiens
PLAEDHPRI

SEQ ID NO: 216518 - protein, 9 aa, Homo Sapiens
ATDDPDEEV

SEQ ID NO: 216519 - protein, 9 aa, Homo Sapiens
GPNSWRAWG

SEQ ID NO: 216520 - protein, 9 aa, Homo Sapiens
QTMSAHIKS

SEQ ID NO: 216521 - protein, 9 aa, Homo Sapiens
QCCLYECGG

SEQ ID NO: 216522 - protein, 9 aa, Homo Sapiens
IAGAHHCQY

SEQ ID NO: 216523 - protein, 9 aa, Homo Sapiens
VGLFRAGKL

SEQ ID NO: 216524 - protein, 9 aa, Homo Sapiens
LGSVDQYLG

SEQ ID NO: 216525 - protein, 9 aa, Homo Sapiens
KMTFRLVVL

SEQ ID NO: 216526 - protein, 9 aa, Homo Sapiens
TGLPPQRPG

SEQ ID NO: 216527 - protein, 9 aa, Homo Sapiens
APEQFIGQV

SEQ ID NO: 216528 - protein, 9 aa, Homo Sapiens
SVPSSTSSS

SEQ ID NO: 216529 - protein, 9 aa, Homo Sapiens
SCRILDNST

SEQ ID NO: 216530 - protein, 9 aa, Homo Sapiens
GHWGQRDVS

SEQ ID NO: 216531 - protein, 9 aa, Homo Sapiens
PGTLYKPFG

SEQ ID NO: 216532 - protein, 9 aa, Homo Sapiens
PREYLKAPE

SEQ ID NO: 216533 - protein, 9 aa, Homo Sapiens
MLCFPRGMA

SEQ ID NO: 216534 - protein, 9 aa, Homo Sapiens
SGLVGLFRA

SEQ ID NO: 216535 - protein, 9 aa, Homo Sapiens
KRLKVFSRD

SEQ ID NO: 216536 - protein, 9 aa, Homo Sapiens
FTMLARLDS

SEQ ID NO: 216537 - protein, 9 aa, Homo Sapiens
KDWSKLHAE

SEQ ID NO: 216538 - protein, 9 aa, Homo Sapiens
GLLKPKISQ

SEQ ID NO: 216539 - protein, 9 aa, Homo Sapiens
FKKDRLSAS

SEQ ID NO: 216540 - protein, 9 aa, Homo Sapiens
TGKTESTKL

SEQ ID NO: 216541 - protein, 9 aa, Homo Sapiens
EEQNPEPVN

SEQ ID NO: 216542 - protein, 9 aa, Homo Sapiens
YLLKVNDLY

SEQ ID NO: 216543 - protein, 9 aa, Homo Sapiens
VEMLGHKYG

SEQ ID NO: 216544 - protein, 9 aa, Homo Sapiens
WGSLCTLCQ

SEQ ID NO: 216545 - protein, 9 aa, Homo Sapiens
IYPNHRERE

SEQ ID NO: 216546 - protein, 9 aa, Homo Sapiens
SATIFGPNL

SEQ ID NO: 216547 - protein, 9 aa, Homo Sapiens
EQMVTKLTR

SEQ ID NO: 216548 - protein, 9 aa, Homo Sapiens
ESAAWTRRP

SEQ ID NO: 216549 - protein, 9 aa, Homo Sapiens
RSHLHEICD

SEQ ID NO: 216550 - protein, 9 aa, Homo Sapiens
ILNVGAIVL

SEQ ID NO: 216551 - protein, 9 aa, Homo Sapiens
WRKSHLIFP

SEQ ID NO: 216552 - protein, 9 aa, Homo Sapiens
QLKIIACLP

SEQ ID NO: 216553 - protein, 9 aa, Homo Sapiens
VGGTSFYDS

SEQ ID NO: 216554 - protein, 9 aa, Homo Sapiens
TAARLGRTQ

SEQ ID NO: 216555 - protein, 9 aa, Homo Sapiens
LSELEHLKL

SEQ ID NO: 216556 - protein, 9 aa, Homo Sapiens
HNSSGALSI

SEQ ID NO: 216557 - protein, 9 aa, Homo Sapiens
NGTMVGAGE

SEQ ID NO: 216558 - protein, 9 aa, Homo Sapiens
NTMQWNNKK

SEQ ID NO: 216559 - protein, 9 aa, Homo Sapiens
SLQEFTPPS

SEQ ID NO: 216560 - protein, 9 aa, Homo Sapiens
SVELGPEKL

SEQ ID NO: 216561 - protein, 9 aa, Homo Sapiens
QLGPAFIKT

SEQ ID NO: 216562 - protein, 9 aa, Homo Sapiens
LNPRRSCPT

SEQ ID NO: 216563 - protein, 9 aa, Homo Sapiens
TEESATASQ

SEQ ID NO: 216564 - protein, 9 aa, Homo Sapiens
LNDCHEEKI

SEQ ID NO: 216565 - protein, 9 aa, Homo Sapiens
QAVELVNTW

SEQ ID NO: 216566 - protein, 9 aa, Homo Sapiens
KVDHTVNEN

SEQ ID NO: 216567 - protein, 9 aa, Homo Sapiens
PTAPEVLVA

SEQ ID NO: 216568 - protein, 9 aa, Homo Sapiens
VFVVNGPAS

SEQ ID NO: 216569 - protein, 9 aa, Homo Sapiens
YPSGPLDTG

SEQ ID NO: 216570 - protein, 9 aa, Homo Sapiens
IAGKVIKCK

SEQ ID NO: 216571 - protein, 9 aa, Homo Sapiens
DTAPGGAAT

SEQ ID NO: 216572 - protein, 9 aa, Homo Sapiens
LLGLYPVLC

SEQ ID NO: 216573 - protein, 9 aa, Homo Sapiens
NYVRNSWAI

SEQ ID NO: 216574 - protein, 9 aa, Homo Sapiens
IFYQDKNLH

SEQ ID NO: 216575 - protein, 9 aa, Homo Sapiens
PGGTVWPPT

SEQ ID NO: 216576 - protein, 9 aa, Homo Sapiens
LMRGWERAQ

SEQ ID NO: 216577 - protein, 9 aa, Homo Sapiens
RNPLSRQPV

SEQ ID NO: 216578 - protein, 9 aa, Homo Sapiens
HRLILPMKI

SEQ ID NO: 216579 - protein, 9 aa, Homo Sapiens
LGSRPAPAR

SEQ ID NO: 216580 - protein, 9 aa, Homo Sapiens
SSGGKLCQC

SEQ ID NO: 216581 - protein, 9 aa, Homo Sapiens
TRNGPGLVA

SEQ ID NO: 216582 - protein, 9 aa, Homo Sapiens
EAFMYLSLS

SEQ ID NO: 216583 - protein, 9 aa, Homo Sapiens
QPSVQFSKV

SEQ ID NO: 216584 - protein, 9 aa, Homo Sapiens
AQPRRHCWW

SEQ ID NO: 216585 - protein, 9 aa, Homo Sapiens
IWDMGLEVF

SEQ ID NO: 216586 - protein, 9 aa, Homo Sapiens
GAPGGGGSP

SEQ ID NO: 216587 - protein, 9 aa, Homo Sapiens
IQFQNSHSL

SEQ ID NO: 216588 - protein, 9 aa, Homo Sapiens
ACCLPVLRT

SEQ ID NO: 216589 - protein, 9 aa, Homo Sapiens
SSGCKVHQW

SEQ ID NO: 216590 - protein, 9 aa, Homo Sapiens
HMIEHTQKE

SEQ ID NO: 216591 - protein, 9 aa, Homo Sapiens
CLPSPPRGR

SEQ ID NO: 216592 - protein, 9 aa, Homo Sapiens
SHCLTWASS

SEQ ID NO: 216593 - protein, 9 aa, Homo Sapiens
SFIGDGDIF

SEQ ID NO: 216594 - protein, 9 aa, Homo Sapiens
RAPQDQHGD

SEQ ID NO: 216595 - protein, 9 aa, Homo Sapiens
LLLPRRPQP

SEQ ID NO: 216596 - protein, 9 aa, Homo Sapiens
CSRSGERWG

SEQ ID NO: 216597 - protein, 9 aa, Homo Sapiens
RMGVEAVIT

SEQ ID NO: 216598 - protein, 9 aa, Homo Sapiens
DWLLRFTKT

SEQ ID NO: 216599 - protein, 9 aa, Homo Sapiens
IIDFILERN

SEQ ID NO: 216600 - protein, 9 aa, Homo Sapiens
NIRELCISR

SEQ ID NO: 216601 - protein, 9 aa, Homo Sapiens
GNKCVACGR

SEQ ID NO: 216602 - protein, 9 aa, Homo Sapiens
TGVSGLSAA

SEQ ID NO: 216603 - protein, 9 aa, Homo Sapiens
VSCFQERVR

SEQ ID NO: 216604 - protein, 9 aa, Homo Sapiens
KRSSSSHNR

SEQ ID NO: 216605 - protein, 9 aa, Homo Sapiens
RCRYWGRSG

SEQ ID NO: 216606 - protein, 9 aa, Homo Sapiens
LVDAAKNYL

SEQ ID NO: 216607 - protein, 9 aa, Homo Sapiens
QSASSSPTP

SEQ ID NO: 216608 - protein, 9 aa, Homo Sapiens
YFKHLLDQG

SEQ ID NO: 216609 - protein, 9 aa, Homo Sapiens
LQDLSSPRP

SEQ ID NO: 216610 - protein, 9 aa, Homo Sapiens
SKIYSCHCQ

SEQ ID NO: 216611 - protein, 9 aa, Homo Sapiens
FPEHQQHEV

SEQ ID NO: 216612 - protein, 9 aa, Homo Sapiens
DHIPPEPPS

SEQ ID NO: 216613 - protein, 9 aa, Homo Sapiens
LKERFMMLY

SEQ ID NO: 216614 - protein, 9 aa, Homo Sapiens
TTPVNPAPT

SEQ ID NO: 216615 - protein, 9 aa, Homo Sapiens
IPAHEVTGS

SEQ ID NO: 216616 - protein, 9 aa, Homo Sapiens
FGLRGLQKD

SEQ ID NO: 216617 - protein, 9 aa, Homo Sapiens
HPASGRASR

SEQ ID NO: 216618 - protein, 9 aa, Homo Sapiens
CPFRGLRGH

SEQ ID NO: 216619 - protein, 9 aa, Homo Sapiens
VERSETSSI

SEQ ID NO: 216620 - protein, 9 aa, Homo Sapiens
DCDPQGVEE

SEQ ID NO: 216621 - protein, 9 aa, Homo Sapiens
SLPRPERPI

SEQ ID NO: 216622 - protein, 9 aa, Homo Sapiens
PPAAAGCSW

SEQ ID NO: 216623 - protein, 9 aa, Homo Sapiens
PSPRWTPRT

SEQ ID NO: 216624 - protein, 9 aa, Homo Sapiens
IIINGKGLL

SEQ ID NO: 216625 - protein, 9 aa, Homo Sapiens
QTCLHAAWV

SEQ ID NO: 216626 - protein, 9 aa, Homo Sapiens
GKHAHRKGG

SEQ ID NO: 216627 - protein, 9 aa, Homo Sapiens
VDVLDHGED

SEQ ID NO: 216628 - protein, 9 aa, Homo Sapiens
SKELTIRTQ

SEQ ID NO: 216629 - protein, 9 aa, Homo Sapiens
PKDYTTDNE

SEQ ID NO: 216630 - protein, 9 aa, Homo Sapiens
PHRSPPRAQ

SEQ ID NO: 216631 - protein, 9 aa, Homo Sapiens
RVHLEEHAV

SEQ ID NO: 216632 - protein, 9 aa, Homo Sapiens
GLPLHLANF

SEQ ID NO: 216633 - protein, 9 aa, Homo Sapiens
AAARRVGVP

SEQ ID NO: 216634 - protein, 9 aa, Homo Sapiens
SLSPVVLLR

SEQ ID NO: 216635 - protein, 9 aa, Homo Sapiens
ALLHSPVPR

SEQ ID NO: 216636 - protein, 9 aa, Homo Sapiens
PDASYLGNV

SEQ ID NO: 216637 - protein, 9 aa, Homo Sapiens
VASRVWPST

SEQ ID NO: 216638 - protein, 9 aa, Homo Sapiens
GHHLVQRQF

SEQ ID NO: 216639 - protein, 9 aa, Homo Sapiens
LISARSLLR

SEQ ID NO: 216640 - protein, 9 aa, Homo Sapiens
HGFKQEYES

SEQ ID NO: 216641 - protein, 9 aa, Homo Sapiens
GNIVKSADE

SEQ ID NO: 216642 - protein, 9 aa, Homo Sapiens
LSHRLRLRL

SEQ ID NO: 216643 - protein, 9 aa, Homo Sapiens
YGDVDLEKP

SEQ ID NO: 216644 - protein, 9 aa, Homo Sapiens
RLSLLAPKT

SEQ ID NO: 216645 - protein, 9 aa, Homo Sapiens
ADIGPVTSI

SEQ ID NO: 216646 - protein, 9 aa, Homo Sapiens
WNYRQPVDS

SEQ ID NO: 216647 - protein, 9 aa, Homo Sapiens
LHQARRDAE

SEQ ID NO: 216648 - protein, 9 aa, Homo Sapiens
LALEHGCQF

SEQ ID NO: 216649 - protein, 9 aa, Homo Sapiens
HMIPETNSR

SEQ ID NO: 216650 - protein, 9 aa, Homo Sapiens
LLSPVLALS

SEQ ID NO: 216651 - protein, 9 aa, Homo Sapiens
QTPGQARAA

SEQ ID NO: 216652 - protein, 9 aa, Homo Sapiens
WRTRCASCG

SEQ ID NO: 216653 - protein, 9 aa, Homo Sapiens
QRCGPRGWP

SEQ ID NO: 216654 - protein, 9 aa, Homo Sapiens
FPSLGYPVS

SEQ ID NO: 216655 - protein, 9 aa, Homo Sapiens
SRILRTSQG

SEQ ID NO: 216656 - protein, 9 aa, Homo Sapiens
SKGVFGAGP

SEQ ID NO: 216657 - protein, 9 aa, Homo Sapiens
GPGLEKTGM

SEQ ID NO: 216658 - protein, 9 aa, Homo Sapiens
LIPGGRANV

SEQ ID NO: 216659 - protein, 9 aa, Homo Sapiens
KSPTHMLTA

SEQ ID NO: 216660 - protein, 9 aa, Homo Sapiens
LPFVRVTHG

SEQ ID NO: 216661 - protein, 9 aa, Homo Sapiens
DGLFMVTMA

SEQ ID NO: 216662 - protein, 9 aa, Homo Sapiens
SQRALLHSP

SEQ ID NO: 216663 - protein, 9 aa, Homo Sapiens
RCKLAAAIL

SEQ ID NO: 216664 - protein, 9 aa, Homo Sapiens
QDSMHGWTA

SEQ ID NO: 216665 - protein, 9 aa, Homo Sapiens
PRAGGHRPD

SEQ ID NO: 216666 - protein, 9 aa, Homo Sapiens
KLGRTMTHE

SEQ ID NO: 216667 - protein, 9 aa, Homo Sapiens
EKCGYNKGY

SEQ ID NO: 216668 - protein, 9 aa, Homo Sapiens
RRGCSGRSR

SEQ ID NO: 216669 - protein, 9 aa, Homo Sapiens
DGSFICSQT

SEQ ID NO: 216670 - protein, 9 aa, Homo Sapiens
ESWNDEARV

SEQ ID NO: 216671 - protein, 9 aa, Homo Sapiens
VIEKNSPFG

SEQ ID NO: 216672 - protein, 9 aa, Homo Sapiens
STPFTGSPS

SEQ ID NO: 216673 - protein, 9 aa, Homo Sapiens
PNSLSNLGQ

SEQ ID NO: 216674 - protein, 9 aa, Homo Sapiens
VTQGLCVVA

SEQ ID NO: 216675 - protein, 9 aa, Homo Sapiens
VAEEAAASR

SEQ ID NO: 216676 - protein, 9 aa, Homo Sapiens
VNVRNSEGE

SEQ ID NO: 216677 - protein, 9 aa, Homo Sapiens
PEIFTRVTE

SEQ ID NO: 216678 - protein, 9 aa, Homo Sapiens
QPGAEWSFS

SEQ ID NO: 216679 - protein, 9 aa, Homo Sapiens
SGRSTPRLP

SEQ ID NO: 216680 - protein, 9 aa, Homo Sapiens
LFPALLFHG

SEQ ID NO: 216681 - protein, 9 aa, Homo Sapiens
PTTAASSPP

SEQ ID NO: 216682 - protein, 9 aa, Homo Sapiens
LTFHKMAFD

SEQ ID NO: 216683 - protein, 9 aa, Homo Sapiens
VPPQHCYDA

SEQ ID NO: 216684 - protein, 9 aa, Homo Sapiens
SLILLTSSP

SEQ ID NO: 216685 - protein, 9 aa, Homo Sapiens
PPAGRGAPR

SEQ ID NO: 216686 - protein, 9 aa, Homo Sapiens
HQHRLLLVT

SEQ ID NO: 216687 - protein, 9 aa, Homo Sapiens
IHSLSELEH

SEQ ID NO: 216688 - protein, 9 aa, Homo Sapiens
FPVPQKRFR

SEQ ID NO: 216689 - protein, 9 aa, Homo Sapiens
RNVTLLPAA

SEQ ID NO: 216690 - protein, 9 aa, Homo Sapiens
GNPSKEASS

SEQ ID NO: 216691 - protein, 9 aa, Homo Sapiens
GAAYAQGTL

SEQ ID NO: 216692 - protein, 9 aa, Homo Sapiens
RHRLSGQRP

SEQ ID NO: 216693 - protein, 9 aa, Homo Sapiens
EVSQRALLH

SEQ ID NO: 216694 - protein, 9 aa, Homo Sapiens
AGGQPSRDC

SEQ ID NO: 216695 - protein, 9 aa, Homo Sapiens
LLEVIFHQG

SEQ ID NO: 216696 - protein, 9 aa, Homo Sapiens
ISQVHHMLH

SEQ ID NO: 216697 - protein, 9 aa, Homo Sapiens
MVDVGGRGQ

SEQ ID NO: 216698 - protein, 9 aa, Homo Sapiens
LHHPVQHQP

SEQ ID NO: 216699 - protein, 9 aa, Homo Sapiens
YRKLFESVE

SEQ ID NO: 216700 - protein, 9 aa, Homo Sapiens
EFPGFWFVE

SEQ ID NO: 216701 - protein, 9 aa, Homo Sapiens
HPSPLALPA

SEQ ID NO: 216702 - protein, 9 aa, Homo Sapiens
VVRRPRATS

SEQ ID NO: 216703 - protein, 9 aa, Homo Sapiens
REEKWLRRL

SEQ ID NO: 216704 - protein, 9 aa, Homo Sapiens
GKLCQCRCI

SEQ ID NO: 216705 - protein, 9 aa, Homo Sapiens
SGFDTETLG

SEQ ID NO: 216706 - protein, 9 aa, Homo Sapiens
LPELLGGHD

SEQ ID NO: 216707 - protein, 9 aa, Homo Sapiens
EVGVVALQL

SEQ ID NO: 216708 - protein, 9 aa, Homo Sapiens
NIKGVDVGL

SEQ ID NO: 216709 - protein, 9 aa, Homo Sapiens
SVKPSDMGN

SEQ ID NO: 216710 - protein, 9 aa, Homo Sapiens
ARCSAGAYT

SEQ ID NO: 216711 - protein, 9 aa, Homo Sapiens
IVGAGLSTS

SEQ ID NO: 216712 - protein, 9 aa, Homo Sapiens
HYDNILNVG

SEQ ID NO: 216713 - protein, 9 aa, Homo Sapiens
GPWTRNPRQ

SEQ ID NO: 216714 - protein, 9 aa, Homo Sapiens
DKKRQKPLI

SEQ ID NO: 216715 - protein, 9 aa, Homo Sapiens
LNLEDYKKT

SEQ ID NO: 216716 - protein, 9 aa, Homo Sapiens
INDFLVSQH

SEQ ID NO: 216717 - protein, 9 aa, Homo Sapiens
QGLVVLTAY

SEQ ID NO: 216718 - protein, 9 aa, Homo Sapiens
AGNKYAKCF

SEQ ID NO: 216719 - protein, 9 aa, Homo Sapiens
ERRQDLRAP

SEQ ID NO: 216720 - protein, 9 aa, Homo Sapiens
FEDNLIEAG

SEQ ID NO: 216721 - protein, 9 aa, Homo Sapiens
GPLQFKRRG

SEQ ID NO: 216722 - protein, 9 aa, Homo Sapiens
TNVRFVKRL

SEQ ID NO: 216723 - protein, 9 aa, Homo Sapiens
LSHEPGSSS

SEQ ID NO: 216724 - protein, 9 aa, Homo Sapiens
RPQNMSVAD

SEQ ID NO: 216725 - protein, 9 aa, Homo Sapiens
NDVQLLQDA

SEQ ID NO: 216726 - protein, 9 aa, Homo Sapiens
TFVELKTVR

SEQ ID NO: 216727 - protein, 9 aa, Homo Sapiens
KARMEGQPM

SEQ ID NO: 216728 - protein, 9 aa, Homo Sapiens
TFHMKCFLN

SEQ ID NO: 216729 - protein, 9 aa, Homo Sapiens
VTKYCSAKC

SEQ ID NO: 216730 - protein, 9 aa, Homo Sapiens
GQVHVFLDG

SEQ ID NO: 216731 - protein, 9 aa, Homo Sapiens
GCVICSPRG

SEQ ID NO: 216732 - protein, 9 aa, Homo Sapiens
IGEFILERN

SEQ ID NO: 216733 - protein, 9 aa, Homo Sapiens
HFGLPALEE

SEQ ID NO: 216734 - protein, 9 aa, Homo Sapiens
YEKESPCGL

SEQ ID NO: 216735 - protein, 9 aa, Homo Sapiens
HPLAHQHRL

SEQ ID NO: 216736 - protein, 9 aa, Homo Sapiens
RKVTLMINL

SEQ ID NO: 216737 - protein, 9 aa, Homo Sapiens
ETPYKCSEC

SEQ ID NO: 216738 - protein, 9 aa, Homo Sapiens
FAIATLPPA

SEQ ID NO: 216739 - protein, 9 aa, Homo Sapiens
GFFYGYTYC

SEQ ID NO: 216740 - protein, 9 aa, Homo Sapiens
CRAGGPAGW

SEQ ID NO: 216741 - protein, 9 aa, Homo Sapiens
KQVQGLIDE

SEQ ID NO: 216742 - protein, 9 aa, Homo Sapiens
FLVANQILK

SEQ ID NO: 216743 - protein, 9 aa, Homo Sapiens
QAECFQDGR

SEQ ID NO: 216744 - protein, 9 aa, Homo Sapiens
GINIFWMAM

SEQ ID NO: 216745 - protein, 9 aa, Homo Sapiens
NTMYSFLLD

SEQ ID NO: 216746 - protein, 9 aa, Homo Sapiens
LPRERKRLG

SEQ ID NO: 216747 - protein, 9 aa, Homo Sapiens
DHVIDFDEN

SEQ ID NO: 216748 - protein, 9 aa, Homo Sapiens
QYKLTYTKV

SEQ ID NO: 216749 - protein, 9 aa, Homo Sapiens
IIPTLHYAI

SEQ ID NO: 216750 - protein, 9 aa, Homo Sapiens
SWGTLWWAS

SEQ ID NO: 216751 - protein, 9 aa, Homo Sapiens
SHIEDGDIA

SEQ ID NO: 216752 - protein, 9 aa, Homo Sapiens
PASQMHVED

SEQ ID NO: 216753 - protein, 9 aa, Homo Sapiens
VTSNFQSLV

SEQ ID NO: 216754 - protein, 9 aa, Homo Sapiens
QPCTCPPVF

SEQ ID NO: 216755 - protein, 9 aa, Homo Sapiens
RRSSSFREM

SEQ ID NO: 216756 - protein, 9 aa, Homo Sapiens
AVVMRPGSP

SEQ ID NO: 216757 - protein, 9 aa, Homo Sapiens
HVWQLYGVR

SEQ ID NO: 216758 - protein, 9 aa, Homo Sapiens
QLYCLSSYI

SEQ ID NO: 216759 - protein, 9 aa, Homo Sapiens
EDEDKKVRG

SEQ ID NO: 216760 - protein, 9 aa, Homo Sapiens
EPPKALEQE

SEQ ID NO: 216761 - protein, 9 aa, Homo Sapiens
HTNYVRNSW

SEQ ID NO: 216762 - protein, 9 aa, Homo Sapiens
RSSPKRDME

SEQ ID NO: 216763 - protein, 9 aa, Homo Sapiens
DLQVIKDSK

SEQ ID NO: 216764 - protein, 9 aa, Homo Sapiens
SVKPGWLKA

SEQ ID NO: 216765 - protein, 9 aa, Homo Sapiens
ILHEGSHTG

SEQ ID NO: 216766 - protein, 9 aa, Homo Sapiens
LVFDLYEGQ

SEQ ID NO: 216767 - protein, 9 aa, Homo Sapiens
KKLKLAPLQ

SEQ ID NO: 216768 - protein, 9 aa, Homo Sapiens
TAAGVSRCS

SEQ ID NO: 216769 - protein, 9 aa, Homo Sapiens
CVYAATPVG

SEQ ID NO: 216770 - protein, 9 aa, Homo Sapiens
TWLSNSSAI

SEQ ID NO: 216771 - protein, 9 aa, Homo Sapiens
SLKQLAEQR

SEQ ID NO: 216772 - protein, 9 aa, Homo Sapiens
NGYSNAGIP

SEQ ID NO: 216773 - protein, 9 aa, Homo Sapiens
PMTCKPPLY

SEQ ID NO: 216774 - protein, 9 aa, Homo Sapiens
PTGRPAGAA

SEQ ID NO: 216775 - protein, 9 aa, Homo Sapiens
MVAAAVPPP

SEQ ID NO: 216776 - protein, 9 aa, Homo Sapiens
RPELSFALV

SEQ ID NO: 216777 - protein, 9 aa, Homo Sapiens
LLLEKSFLF

SEQ ID NO: 216778 - protein, 9 aa, Homo Sapiens
RHSTRPAHK

SEQ ID NO: 216779 - protein, 9 aa, Homo Sapiens
PTQTAISQT

SEQ ID NO: 216780 - protein, 9 aa, Homo Sapiens
QQLPSIWYE

SEQ ID NO: 216781 - protein, 9 aa, Homo Sapiens
TFNLKMTLL

SEQ ID NO: 216782 - protein, 9 aa, Homo Sapiens
RLRACWGPQ

SEQ ID NO: 216783 - protein, 9 aa, Homo Sapiens
LSEDVIISK

SEQ ID NO: 216784 - protein, 9 aa, Homo Sapiens
VTFSPGLEL

SEQ ID NO: 216785 - protein, 9 aa, Homo Sapiens
QGDMMGTGP

SEQ ID NO: 216786 - protein, 9 aa, Homo Sapiens
HTERGIRQW

SEQ ID NO: 216787 - protein, 9 aa, Homo Sapiens
EATDRYHMP

SEQ ID NO: 216788 - protein, 9 aa, Homo Sapiens
GVEVQTEYV

SEQ ID NO: 216789 - protein, 9 aa, Homo Sapiens
TIIKGKRRT

SEQ ID NO: 216790 - protein, 9 aa, Homo Sapiens
SILWGEEVQ

SEQ ID NO: 216791 - protein, 9 aa, Homo Sapiens
VMDGSFICS

SEQ ID NO: 216792 - protein, 9 aa, Homo Sapiens
GWTPLHVDA

SEQ ID NO: 216793 - protein, 9 aa, Homo Sapiens
REDWGIGSA

SEQ ID NO: 216794 - protein, 9 aa, Homo Sapiens
ARCAVPHAT

SEQ ID NO: 216795 - protein, 9 aa, Homo Sapiens
NPRRSCPTL

SEQ ID NO: 216796 - protein, 9 aa, Homo Sapiens
LSSLGTRMG

SEQ ID NO: 216797 - protein, 9 aa, Homo Sapiens
WRLPKAQSG

SEQ ID NO: 216798 - protein, 9 aa, Homo Sapiens
QAPRTTAFC

SEQ ID NO: 216799 - protein, 9 aa, Homo Sapiens
FIKEWHHIF

SEQ ID NO: 216800 - protein, 9 aa, Homo Sapiens
DFFFELDVM

SEQ ID NO: 216801 - protein, 9 aa, Homo Sapiens
SFYLIIQVP

SEQ ID NO: 216802 - protein, 9 aa, Homo Sapiens
QFPHLNPNR

SEQ ID NO: 216803 - protein, 9 aa, Homo Sapiens
RTVPSGRPR

SEQ ID NO: 216804 - protein, 9 aa, Homo Sapiens
EYDRDLSVR

SEQ ID NO: 216805 - protein, 9 aa, Homo Sapiens
TQQDAWQEL

SEQ ID NO: 216806 - protein, 9 aa, Homo Sapiens
RTPRRQRSS

SEQ ID NO: 216807 - protein, 9 aa, Homo Sapiens
SDTPSVMQL

SEQ ID NO: 216808 - protein, 9 aa, Homo Sapiens
CWSTVAQTP

SEQ ID NO: 216809 - protein, 9 aa, Homo Sapiens
SDGVIMTGA

SEQ ID NO: 216810 - protein, 9 aa, Homo Sapiens
THTEDWQPT

SEQ ID NO: 216811 - protein, 9 aa, Homo Sapiens
SEAEGSFLT

SEQ ID NO: 216812 - protein, 9 aa, Homo Sapiens
KRNGMRFQL

SEQ ID NO: 216813 - protein, 9 aa, Homo Sapiens
ARTVICMTC

SEQ ID NO: 216814 - protein, 9 aa, Homo Sapiens
GNNALGQND

SEQ ID NO: 216815 - protein, 9 aa, Homo Sapiens
ISSGISYEE

SEQ ID NO: 216816 - protein, 9 aa, Homo Sapiens
TGAVCGPGF

SEQ ID NO: 216817 - protein, 9 aa, Homo Sapiens
PREYQQRNI

SEQ ID NO: 216818 - protein, 9 aa, Homo Sapiens
KPCAEVIPC

SEQ ID NO: 216819 - protein, 9 aa, Homo Sapiens
FHFIILVAR

SEQ ID NO: 216820 - protein, 9 aa, Homo Sapiens
DCGNTEVPA

SEQ ID NO: 216821 - protein, 9 aa, Homo Sapiens
PRARVHRCS

SEQ ID NO: 216822 - protein, 9 aa, Homo Sapiens
PCQKKFWKT

SEQ ID NO: 216823 - protein, 9 aa, Homo Sapiens
QETQEHLEA

SEQ ID NO: 216824 - protein, 9 aa, Homo Sapiens
STTPPASSG

SEQ ID NO: 216825 - protein, 9 aa, Homo Sapiens
CTWTSALAS

SEQ ID NO: 216826 - protein, 9 aa, Homo Sapiens
LLPAPSALV

SEQ ID NO: 216827 - protein, 9 aa, Homo Sapiens
AIRLNNKIP

SEQ ID NO: 216828 - protein, 9 aa, Homo Sapiens
DATTVTDVP

SEQ ID NO: 216829 - protein, 9 aa, Homo Sapiens
ELKERFMML

SEQ ID NO: 216830 - protein, 9 aa, Homo Sapiens
SPPSVTIHS

SEQ ID NO: 216831 - protein, 9 aa, Homo Sapiens
LDEAVVLNE

SEQ ID NO: 216832 - protein, 9 aa, Homo Sapiens
TIQNEANFF

SEQ ID NO: 216833 - protein, 9 aa, Homo Sapiens
RYEVCGPPC

SEQ ID NO: 216834 - protein, 9 aa, Homo Sapiens
LALAMGLAQ

SEQ ID NO: 216835 - protein, 9 aa, Homo Sapiens
LTRRVGGRK

SEQ ID NO: 216836 - protein, 9 aa, Homo Sapiens
KFTFAATWP

SEQ ID NO: 216837 - protein, 9 aa, Homo Sapiens
ASSTGTRRR

SEQ ID NO: 216838 - protein, 9 aa, Homo Sapiens
DNLGKETNS

SEQ ID NO: 216839 - protein, 9 aa, Homo Sapiens
CVISIDRYT

SEQ ID NO: 216840 - protein, 9 aa, Homo Sapiens
LYAAPSSAP

SEQ ID NO: 216841 - protein, 9 aa, Homo Sapiens
LEMGLKDLE

SEQ ID NO: 216842 - protein, 9 aa, Homo Sapiens
QLEMAEYEI

SEQ ID NO: 216843 - protein, 9 aa, Homo Sapiens
VVKDLRGKK

SEQ ID NO: 216844 - protein, 9 aa, Homo Sapiens
LPLIDFCDA

SEQ ID NO: 216845 - protein, 9 aa, Homo Sapiens
HLLLYHTPH

SEQ ID NO: 216846 - protein, 9 aa, Homo Sapiens
AASSTGTRR

SEQ ID NO: 216847 - protein, 9 aa, Homo Sapiens
GAPWLWPAP

SEQ ID NO: 216848 - protein, 9 aa, Homo Sapiens
GKKIAFHIK

SEQ ID NO: 216849 - protein, 9 aa, Homo Sapiens
GSNRGSGSR

SEQ ID NO: 216850 - protein, 9 aa, Homo Sapiens
VKPMRKPRI

SEQ ID NO: 216851 - protein, 9 aa, Homo Sapiens
WAWKAGTGA

SEQ ID NO: 216852 - protein, 9 aa, Homo Sapiens
KLASGVLPQ

SEQ ID NO: 216853 - protein, 9 aa, Homo Sapiens
GRYASQQIK

SEQ ID NO: 216854 - protein, 9 aa, Homo Sapiens
HPDGTKNML

SEQ ID NO: 216855 - protein, 9 aa, Homo Sapiens
PRSKSQRSW

SEQ ID NO: 216856 - protein, 9 aa, Homo Sapiens
YSCAAGMTL

SEQ ID NO: 216857 - protein, 9 aa, Homo Sapiens
EMNDKKRQK

SEQ ID NO: 216858 - protein, 9 aa, Homo Sapiens
PFTFSPITP

SEQ ID NO: 216859 - protein, 9 aa, Homo Sapiens
WKCCTEMQL

SEQ ID NO: 216860 - protein, 9 aa, Homo Sapiens
EVNARLARS

SEQ ID NO: 216861 - protein, 9 aa, Homo Sapiens
GPKRSARAP

SEQ ID NO: 216862 - protein, 9 aa, Homo Sapiens
QSSTLLFTK

SEQ ID NO: 216863 - protein, 9 aa, Homo Sapiens
RFADYLVRY

SEQ ID NO: 216864 - protein, 9 aa, Homo Sapiens
YFFFFLLLE

SEQ ID NO: 216865 - protein, 9 aa, Homo Sapiens
LDSSPLQLL

SEQ ID NO: 216866 - protein, 9 aa, Homo Sapiens
RKKQTSIEV

SEQ ID NO: 216867 - protein, 9 aa, Homo Sapiens
PDKGWGRGT

SEQ ID NO: 216868 - protein, 9 aa, Homo Sapiens
LHYGHHLVQ

SEQ ID NO: 216869 - protein, 9 aa, Homo Sapiens
FILERNHTN

SEQ ID NO: 216870 - protein, 9 aa, Homo Sapiens
AMGSRWALS

SEQ ID NO: 216871 - protein, 9 aa, Homo Sapiens
ALAMLSWGP

SEQ ID NO: 216872 - protein, 9 aa, Homo Sapiens
EEAPRPWMS

SEQ ID NO: 216873 - protein, 9 aa, Homo Sapiens
TTANRAMSR

SEQ ID NO: 216874 - protein, 9 aa, Homo Sapiens
RANVGATSG

SEQ ID NO: 216875 - protein, 9 aa, Homo Sapiens
NTIILQEKI

SEQ ID NO: 216876 - protein, 9 aa, Homo Sapiens
AGGPAGWAR

SEQ ID NO: 216877 - protein, 9 aa, Homo Sapiens
LEFTLERNL

SEQ ID NO: 216878 - protein, 9 aa, Homo Sapiens
KHQRVHCAA

SEQ ID NO: 216879 - protein, 9 aa, Homo Sapiens
TTPDKGWGR

SEQ ID NO: 216880 - protein, 9 aa, Homo Sapiens
FLKQMTLSP

SEQ ID NO: 216881 - protein, 9 aa, Homo Sapiens
LPSEILGSV

SEQ ID NO: 216882 - protein, 9 aa, Homo Sapiens
ELTALLQEA

SEQ ID NO: 216883 - protein, 9 aa, Homo Sapiens
KWLRRLERR

SEQ ID NO: 216884 - protein, 9 aa, Homo Sapiens
IVRTWIGNQ

SEQ ID NO: 216885 - protein, 9 aa, Homo Sapiens
NIDQEEQLK

SEQ ID NO: 216886 - protein, 9 aa, Homo Sapiens
YCTAFTREQ

SEQ ID NO: 216887 - protein, 9 aa, Homo Sapiens
FKSVFTRSE

SEQ ID NO: 216888 - protein, 9 aa, Homo Sapiens
LDKSRLECY

SEQ ID NO: 216889 - protein, 9 aa, Homo Sapiens
DLLRGWGQH

SEQ ID NO: 216890 - protein, 9 aa, Homo Sapiens
HASGIGDRS

SEQ ID NO: 216891 - protein, 9 aa, Homo Sapiens
APRVKDRSA

SEQ ID NO: 216892 - protein, 9 aa, Homo Sapiens
AELALKNQN

SEQ ID NO: 216893 - protein, 9 aa, Homo Sapiens
AMTKNTSMW

SEQ ID NO: 216894 - protein, 9 aa, Homo Sapiens
KLSTWPSNR

SEQ ID NO: 216895 - protein, 9 aa, Homo Sapiens
EAQKKGRRS

SEQ ID NO: 216896 - protein, 9 aa, Homo Sapiens
ELMEHLKKL

SEQ ID NO: 216897 - protein, 9 aa, Homo Sapiens
MSKVKVMPH

SEQ ID NO: 216898 - protein, 9 aa, Homo Sapiens
FCICGASVS

SEQ ID NO: 216899 - protein, 9 aa, Homo Sapiens
ASSGAKTFK

SEQ ID NO: 216900 - protein, 9 aa, Homo Sapiens
MRCHSWKDK

SEQ ID NO: 216901 - protein, 9 aa, Homo Sapiens
TGGQERQGN

SEQ ID NO: 216902 - protein, 9 aa, Homo Sapiens
HTFLLMPRG

SEQ ID NO: 216903 - protein, 9 aa, Homo Sapiens
YDMVARESV

SEQ ID NO: 216904 - protein, 9 aa, Homo Sapiens
PLPRRSRPG

SEQ ID NO: 216905 - protein, 9 aa, Homo Sapiens
IQLKSVKGG

SEQ ID NO: 216906 - protein, 9 aa, Homo Sapiens
LGCPVSTRS

SEQ ID NO: 216907 - protein, 9 aa, Homo Sapiens
WKRLKVFSR

SEQ ID NO: 216908 - protein, 9 aa, Homo Sapiens
SKVETGLHV

SEQ ID NO: 216909 - protein, 9 aa, Homo Sapiens
QEHLEAATQ

SEQ ID NO: 216910 - protein, 9 aa, Homo Sapiens
GEAQCRGRP

SEQ ID NO: 216911 - protein, 9 aa, Homo Sapiens
FSYSWPRVP

SEQ ID NO: 216912 - protein, 9 aa, Homo Sapiens
MQFLRVTKQ

SEQ ID NO: 216913 - protein, 9 aa, Homo Sapiens
KQFLVVLWL

SEQ ID NO: 216914 - protein, 9 aa, Homo Sapiens
PPGPRLRTA

SEQ ID NO: 216915 - protein, 9 aa, Homo Sapiens
PNSLNQGIP

SEQ ID NO: 216916 - protein, 9 aa, Homo Sapiens
MEEEDPMPI

SEQ ID NO: 216917 - protein, 9 aa, Homo Sapiens
RPLCALTFK

SEQ ID NO: 216918 - protein, 9 aa, Homo Sapiens
SEVTMGGLE

SEQ ID NO: 216919 - protein, 9 aa, Homo Sapiens
TKHTIQFVD

SEQ ID NO: 216920 - protein, 9 aa, Homo Sapiens
QREGTYNFR

SEQ ID NO: 216921 - protein, 9 aa, Homo Sapiens
PPVRSTVCA

SEQ ID NO: 216922 - protein, 9 aa, Homo Sapiens
HKINHLCCL

SEQ ID NO: 216923 - protein, 9 aa, Homo Sapiens
TGICWLLGT

SEQ ID NO: 216924 - protein, 9 aa, Homo Sapiens
SLFNRGKWV

SEQ ID NO: 216925 - protein, 9 aa, Homo Sapiens
VARLCHDNI

SEQ ID NO: 216926 - protein, 9 aa, Homo Sapiens
EKFSGKEPN

SEQ ID NO: 216927 - protein, 9 aa, Homo Sapiens
NSSSTNSST

SEQ ID NO: 216928 - protein, 9 aa, Homo Sapiens
GHNSSGALS

SEQ ID NO: 216929 - protein, 9 aa, Homo Sapiens
SKNNMGAWR

SEQ ID NO: 216930 - protein, 9 aa, Homo Sapiens
GTAAGGQPS

SEQ ID NO: 216931 - protein, 9 aa, Homo Sapiens
AQQRPAQSV

SEQ ID NO: 216932 - protein, 9 aa, Homo Sapiens
LFIWTPWRK

SEQ ID NO: 216933 - protein, 9 aa, Homo Sapiens
MLSKVVHST

SEQ ID NO: 216934 - protein, 9 aa, Homo Sapiens
FPKAAWQFL

SEQ ID NO: 216935 - protein, 9 aa, Homo Sapiens
TLRGTSSPA

SEQ ID NO: 216936 - protein, 9 aa, Homo Sapiens
TQQETLTTV

SEQ ID NO: 216937 - protein, 9 aa, Homo Sapiens
TTQGNRDYI

SEQ ID NO: 216938 - protein, 9 aa, Homo Sapiens
IILKGSVQQ

SEQ ID NO: 216939 - protein, 9 aa, Homo Sapiens
IPKTSTHCP

SEQ ID NO: 216940 - protein, 9 aa, Homo Sapiens
LRAPALPGP

SEQ ID NO: 216941 - protein, 9 aa, Homo Sapiens
LILHEGSHT

SEQ ID NO: 216942 - protein, 9 aa, Homo Sapiens
SSWPAPTHL

SEQ ID NO: 216943 - protein, 9 aa, Homo Sapiens
ILSDFRAVL

SEQ ID NO: 216944 - protein, 9 aa, Homo Sapiens
EGEAEAEVN

SEQ ID NO: 216945 - protein, 9 aa, Homo Sapiens
HQVPPTWAS

SEQ ID NO: 216946 - protein, 9 aa, Homo Sapiens
MGLKSWISV

SEQ ID NO: 216947 - protein, 9 aa, Homo Sapiens
DYLKNKKEV

SEQ ID NO: 216948 - protein, 9 aa, Homo Sapiens
KEDLLYLRT

SEQ ID NO: 216949 - protein, 9 aa, Homo Sapiens
LTASENTSR

SEQ ID NO: 216950 - protein, 9 aa, Homo Sapiens
PVSLASALS

SEQ ID NO: 216951 - protein, 9 aa, Homo Sapiens
FDLVSRGFD

SEQ ID NO: 216952 - protein, 9 aa, Homo Sapiens
GVQMCVDAR

SEQ ID NO: 216953 - protein, 9 aa, Homo Sapiens
VEEEAVGRG

SEQ ID NO: 216954 - protein, 9 aa, Homo Sapiens
PRSSSQRYP

SEQ ID NO: 216955 - protein, 9 aa, Homo Sapiens
HGFSKNPKV

SEQ ID NO: 216956 - protein, 9 aa, Homo Sapiens
RTGRHETVH

SEQ ID NO: 216957 - protein, 9 aa, Homo Sapiens
IQGIVGAGL

SEQ ID NO: 216958 - protein, 9 aa, Homo Sapiens
PERIEESWN

SEQ ID NO: 216959 - protein, 9 aa, Homo Sapiens
AGLSTSPAA

SEQ ID NO: 216960 - protein, 9 aa, Homo Sapiens
SLTLPPPEY

SEQ ID NO: 216961 - protein, 9 aa, Homo Sapiens
LLSWASLAV

SEQ ID NO: 216962 - protein, 9 aa, Homo Sapiens
TKRVHLGPD

SEQ ID NO: 216963 - protein, 9 aa, Homo Sapiens
MPPTKDNLA

SEQ ID NO: 216964 - protein, 9 aa, Homo Sapiens
EAEELKPFL

SEQ ID NO: 216965 - protein, 9 aa, Homo Sapiens
LLCPFRGLR

SEQ ID NO: 216966 - protein, 9 aa, Homo Sapiens
QQQLHRVQE

SEQ ID NO: 216967 - protein, 9 aa, Homo Sapiens
PSVPSSTSS

SEQ ID NO: 216968 - protein, 9 aa, Homo Sapiens
SFWCSCDTG

SEQ ID NO: 216969 - protein, 9 aa, Homo Sapiens
DTEELWLVE

SEQ ID NO: 216970 - protein, 9 aa, Homo Sapiens
KELLGGFLG

SEQ ID NO: 216971 - protein, 9 aa, Homo Sapiens
RSGNPTRSS

SEQ ID NO: 216972 - protein, 9 aa, Homo Sapiens
SSGISYEEF

SEQ ID NO: 216973 - protein, 9 aa, Homo Sapiens
LLLVPCAHR

SEQ ID NO: 216974 - protein, 9 aa, Homo Sapiens
ASSSGGRTA

SEQ ID NO: 216975 - protein, 9 aa, Homo Sapiens
NVGHKSGSE

SEQ ID NO: 216976 - protein, 9 aa, Homo Sapiens
KTSLFRKTL

SEQ ID NO: 216977 - protein, 9 aa, Homo Sapiens
CSVSICTKV

SEQ ID NO: 216978 - protein, 9 aa, Homo Sapiens
FDCSINSVH

SEQ ID NO: 216979 - protein, 9 aa, Homo Sapiens
AASIPDCRG

SEQ ID NO: 216980 - protein, 9 aa, Homo Sapiens
HGLRCQRRD

SEQ ID NO: 216981 - protein, 9 aa, Homo Sapiens
KDLVFDLYE

SEQ ID NO: 216982 - protein, 9 aa, Homo Sapiens
PAAMTQMQG

SEQ ID NO: 216983 - protein, 9 aa, Homo Sapiens
VATRALQQN

SEQ ID NO: 216984 - protein, 9 aa, Homo Sapiens
GCPLSLWKR

SEQ ID NO: 216985 - protein, 9 aa, Homo Sapiens
PPGPQPGRS

SEQ ID NO: 216986 - protein, 9 aa, Homo Sapiens
GENTSLDLF

SEQ ID NO: 216987 - protein, 9 aa, Homo Sapiens
EAMEETGVV

SEQ ID NO: 216988 - protein, 9 aa, Homo Sapiens
ETSTCQTDG

SEQ ID NO: 216989 - protein, 9 aa, Homo Sapiens
TKSARESRA

SEQ ID NO: 216990 - protein, 9 aa, Homo Sapiens
RARCCRPAV

SEQ ID NO: 216991 - protein, 9 aa, Homo Sapiens
GIQFQNSHS

SEQ ID NO: 216992 - protein, 9 aa, Homo Sapiens
VQGQVHVFL

SEQ ID NO: 216993 - protein, 9 aa, Homo Sapiens
APEVLVAVA

SEQ ID NO: 216994 - protein, 9 aa, Homo Sapiens
EGHILIFTC

SEQ ID NO: 216995 - protein, 9 aa, Homo Sapiens
VCEGTRVAS

SEQ ID NO: 216996 - protein, 9 aa, Homo Sapiens
AGAVAVDLV

SEQ ID NO: 216997 - protein, 9 aa, Homo Sapiens
SSTNSSTGR

SEQ ID NO: 216998 - protein, 9 aa, Homo Sapiens
LEHWEEAIF

SEQ ID NO: 216999 - protein, 9 aa, Homo Sapiens
LPQRLFRMK

SEQ ID NO: 217000 - protein, 9 aa, Homo Sapiens
ANIITGAPC

SEQ ID NO: 217001 - protein, 9 aa, Homo Sapiens
PGVVTDLFP

SEQ ID NO: 217002 - protein, 9 aa, Homo Sapiens
PGCRSGRRQ

SEQ ID NO: 217003 - protein, 9 aa, Homo Sapiens
GQAVKAYDH

SEQ ID NO: 217004 - protein, 9 aa, Homo Sapiens
ACSITVSFV

SEQ ID NO: 217005 - protein, 9 aa, Homo Sapiens
APAVLLVVE

SEQ ID NO: 217006 - protein, 9 aa, Homo Sapiens
TFKKDRLSA

SEQ ID NO: 217007 - protein, 9 aa, Homo Sapiens
VGMPETYQV

SEQ ID NO: 217008 - protein, 9 aa, Homo Sapiens
GGEAGERSA

SEQ ID NO: 217009 - protein, 9 aa, Homo Sapiens
GPSPLVAPR

SEQ ID NO: 217010 - protein, 9 aa, Homo Sapiens
SMPRNGPWE

SEQ ID NO: 217011 - protein, 9 aa, Homo Sapiens
ASLQSPRVN

SEQ ID NO: 217012 - protein, 9 aa, Homo Sapiens
APEIFTRVT

SEQ ID NO: 217013 - protein, 9 aa, Homo Sapiens
CYNMRGSFW

SEQ ID NO: 217014 - protein, 9 aa, Homo Sapiens
HHPLAHQHR

SEQ ID NO: 217015 - protein, 9 aa, Homo Sapiens
DTFALASHQ

SEQ ID NO: 217016 - protein, 9 aa, Homo Sapiens
TRTSRSSPW

SEQ ID NO: 217017 - protein, 9 aa, Homo Sapiens
HRPDLEEAV

SEQ ID NO: 217018 - protein, 9 aa, Homo Sapiens
NARLARSSA

SEQ ID NO: 217019 - protein, 9 aa, Homo Sapiens
RKKSRLPHQ

SEQ ID NO: 217020 - protein, 9 aa, Homo Sapiens
CANRPCQRG

SEQ ID NO: 217021 - protein, 9 aa, Homo Sapiens
ETNEETSMQ

SEQ ID NO: 217022 - protein, 9 aa, Homo Sapiens
SSAARGRCG

SEQ ID NO: 217023 - protein, 9 aa, Homo Sapiens
AWKAGTGAQ

SEQ ID NO: 217024 - protein, 9 aa, Homo Sapiens
NALGQNDAD

SEQ ID NO: 217025 - protein, 9 aa, Homo Sapiens
GAVIRLCLC

SEQ ID NO: 217026 - protein, 9 aa, Homo Sapiens
PNSQVGTCI

SEQ ID NO: 217027 - protein, 9 aa, Homo Sapiens
GVSLLWVTE

SEQ ID NO: 217028 - protein, 9 aa, Homo Sapiens
NKSGSSSCK

SEQ ID NO: 217029 - protein, 9 aa, Homo Sapiens
GTPPGCRSG

SEQ ID NO: 217030 - protein, 9 aa, Homo Sapiens
VISIDRYTA

SEQ ID NO: 217031 - protein, 9 aa, Homo Sapiens
QHIDCYSCT

SEQ ID NO: 217032 - protein, 9 aa, Homo Sapiens
SSHNRGPHG

SEQ ID NO: 217033 - protein, 9 aa, Homo Sapiens
YHLSPHLNQ

SEQ ID NO: 217034 - protein, 9 aa, Homo Sapiens
RSTRTSATC

SEQ ID NO: 217035 - protein, 9 aa, Homo Sapiens
QNNTNVQMV

SEQ ID NO: 217036 - protein, 9 aa, Homo Sapiens
RPRCSSSSA

SEQ ID NO: 217037 - protein, 9 aa, Homo Sapiens
KLRACGNWR

SEQ ID NO: 217038 - protein, 9 aa, Homo Sapiens
DLSSPRPSQ

SEQ ID NO: 217039 - protein, 9 aa, Homo Sapiens
ARLCHDNIV

SEQ ID NO: 217040 - protein, 9 aa, Homo Sapiens
PQLTKFCND

SEQ ID NO: 217041 - protein, 9 aa, Homo Sapiens
RRSRATFSA

SEQ ID NO: 217042 - protein, 9 aa, Homo Sapiens
KVHQWVDSI

SEQ ID NO: 217043 - protein, 9 aa, Homo Sapiens
THTPPGVHR

SEQ ID NO: 217044 - protein, 9 aa, Homo Sapiens
LSFDLDDVI

SEQ ID NO: 217045 - protein, 9 aa, Homo Sapiens
SRGAWTNNY

SEQ ID NO: 217046 - protein, 9 aa, Homo Sapiens
PSRGHYHFR

SEQ ID NO: 217047 - protein, 9 aa, Homo Sapiens
GPLGHRGWR

SEQ ID NO: 217048 - protein, 9 aa, Homo Sapiens
HPKGREEHY

SEQ ID NO: 217049 - protein, 9 aa, Homo Sapiens
ARQPAKPPT

SEQ ID NO: 217050 - protein, 9 aa, Homo Sapiens
DLSLNFGRI

SEQ ID NO: 217051 - protein, 9 aa, Homo Sapiens
LLGSGLRLG

SEQ ID NO: 217052 - protein, 9 aa, Homo Sapiens
LTKFYFAWM

SEQ ID NO: 217053 - protein, 9 aa, Homo Sapiens
GPSARGAPS

SEQ ID NO: 217054 - protein, 9 aa, Homo Sapiens
FDLYEGQIT

SEQ ID NO: 217055 - protein, 9 aa, Homo Sapiens
LLLTTVRRK

SEQ ID NO: 217056 - protein, 9 aa, Homo Sapiens
VGCVGIEAS

SEQ ID NO: 217057 - protein, 9 aa, Homo Sapiens
ERLAELRKL

SEQ ID NO: 217058 - protein, 9 aa, Homo Sapiens
DVCLDLPGT

SEQ ID NO: 217059 - protein, 9 aa, Homo Sapiens
SCPSPPMRS

SEQ ID NO: 217060 - protein, 9 aa, Homo Sapiens
LCIRALGLA

SEQ ID NO: 217061 - protein, 9 aa, Homo Sapiens
ADLDEAVVL

SEQ ID NO: 217062 - protein, 9 aa, Homo Sapiens
AQEAVQEVA

SEQ ID NO: 217063 - protein, 9 aa, Homo Sapiens
VYFFLHYGH

SEQ ID NO: 217064 - protein, 9 aa, Homo Sapiens
ERRRCEEEM

SEQ ID NO: 217065 - protein, 9 aa, Homo Sapiens
WRRRIPAGR

SEQ ID NO: 217066 - protein, 9 aa, Homo Sapiens
REWSPYKRD

SEQ ID NO: 217067 - protein, 9 aa, Homo Sapiens
RALQAGGFP

SEQ ID NO: 217068 - protein, 9 aa, Homo Sapiens
YTTLPFVRV

SEQ ID NO: 217069 - protein, 9 aa, Homo Sapiens
YSWQCIECK

SEQ ID NO: 217070 - protein, 9 aa, Homo Sapiens
PAALVSWKQ

SEQ ID NO: 217071 - protein, 9 aa, Homo Sapiens
AWMDNIREL

SEQ ID NO: 217072 - protein, 9 aa, Homo Sapiens
GKSFSCVSL

SEQ ID NO: 217073 - protein, 9 aa, Homo Sapiens
LQSAAWQGN

SEQ ID NO: 217074 - protein, 9 aa, Homo Sapiens
APLLLPRRP

SEQ ID NO: 217075 - protein, 9 aa, Homo Sapiens
KVKVMGLNP

SEQ ID NO: 217076 - protein, 9 aa, Homo Sapiens
KAGFAGEDA

SEQ ID NO: 217077 - protein, 9 aa, Homo Sapiens
LCGMTTEKQ

SEQ ID NO: 217078 - protein, 9 aa, Homo Sapiens
KTSTHCPLT

SEQ ID NO: 217079 - protein, 9 aa, Homo Sapiens
ALIVIRYLS

SEQ ID NO: 217080 - protein, 9 aa, Homo Sapiens
SPDYCVHNE

SEQ ID NO: 217081 - protein, 9 aa, Homo Sapiens
SSALQAKSV

SEQ ID NO: 217082 - protein, 9 aa, Homo Sapiens
RVCCLRCCF

SEQ ID NO: 217083 - protein, 9 aa, Homo Sapiens
REHFVYVEP

SEQ ID NO: 217084 - protein, 9 aa, Homo Sapiens
GTGKTESTK

SEQ ID NO: 217085 - protein, 9 aa, Homo Sapiens
EVCMLFKDL

SEQ ID NO: 217086 - protein, 9 aa, Homo Sapiens
PSSRRATKA

SEQ ID NO: 217087 - protein, 9 aa, Homo Sapiens
SKIDVRQEY

SEQ ID NO: 217088 - protein, 9 aa, Homo Sapiens
FGKTSSCQL

SEQ ID NO: 217089 - protein, 9 aa, Homo Sapiens
ALACWLRPE

SEQ ID NO: 217090 - protein, 9 aa, Homo Sapiens
DFSLGGNIV

SEQ ID NO: 217091 - protein, 9 aa, Homo Sapiens
SPWPSPQQR

SEQ ID NO: 217092 - protein, 9 aa, Homo Sapiens
EQLKRPILF

SEQ ID NO: 217093 - protein, 9 aa, Homo Sapiens
PCSSQWSPA

SEQ ID NO: 217094 - protein, 9 aa, Homo Sapiens
NAEEKKSIS

SEQ ID NO: 217095 - protein, 9 aa, Homo Sapiens
QADIMLPSL

SEQ ID NO: 217096 - protein, 9 aa, Homo Sapiens
QAQVEWPQL

SEQ ID NO: 217097 - protein, 9 aa, Homo Sapiens
RQRRQERWQ

SEQ ID NO: 217098 - protein, 9 aa, Homo Sapiens
SSCWSPRPP

SEQ ID NO: 217099 - protein, 9 aa, Homo Sapiens
TFFAKLHHS

SEQ ID NO: 217100 - protein, 9 aa, Homo Sapiens
WPANDRPSM

SEQ ID NO: 217101 - protein, 9 aa, Homo Sapiens
SSSGRMCYE

SEQ ID NO: 217102 - protein, 9 aa, Homo Sapiens
IDLSKGRML

SEQ ID NO: 217103 - protein, 9 aa, Homo Sapiens
GYPDASYLG

SEQ ID NO: 217104 - protein, 9 aa, Homo Sapiens
VLYRGHAYP

SEQ ID NO: 217105 - protein, 9 aa, Homo Sapiens
RSLVHSAVD

SEQ ID NO: 217106 - protein, 9 aa, Homo Sapiens
DVVEAGEEA

SEQ ID NO: 217107 - protein, 9 aa, Homo Sapiens
QTSWTTSSV

SEQ ID NO: 217108 - protein, 9 aa, Homo Sapiens
EAWLLLLLS

SEQ ID NO: 217109 - protein, 9 aa, Homo Sapiens
HPKRGTGIG

SEQ ID NO: 217110 - protein, 9 aa, Homo Sapiens
CVLCVRCGQ

SEQ ID NO: 217111 - protein, 9 aa, Homo Sapiens
SPVTFIHGV

SEQ ID NO: 217112 - protein, 9 aa, Homo Sapiens
PQCPGLKVT

SEQ ID NO: 217113 - protein, 9 aa, Homo Sapiens
RLQLRLNPR

SEQ ID NO: 217114 - protein, 9 aa, Homo Sapiens
EKPFECNKY

SEQ ID NO: 217115 - protein, 9 aa, Homo Sapiens
TRFLNEHHG

SEQ ID NO: 217116 - protein, 9 aa, Homo Sapiens
GVLIMFSRA

SEQ ID NO: 217117 - protein, 9 aa, Homo Sapiens
WKKSQLLIL

SEQ ID NO: 217118 - protein, 9 aa, Homo Sapiens
LCPTPSAST

SEQ ID NO: 217119 - protein, 9 aa, Homo Sapiens
SINFVQDPN

SEQ ID NO: 217120 - protein, 9 aa, Homo Sapiens
LHCVASCND

SEQ ID NO: 217121 - protein, 9 aa, Homo Sapiens
REYQQRNIT

SEQ ID NO: 217122 - protein, 9 aa, Homo Sapiens
EVLKNIYRK

SEQ ID NO: 217123 - protein, 9 aa, Homo Sapiens
RARVCIVSL

SEQ ID NO: 217124 - protein, 9 aa, Homo Sapiens
GFTMLARLD

SEQ ID NO: 217125 - protein, 9 aa, Homo Sapiens
LAMSTHLHK

SEQ ID NO: 217126 - protein, 9 aa, Homo Sapiens
YLEWINKKH

SEQ ID NO: 217127 - protein, 9 aa, Homo Sapiens
FVTKCAFQA

SEQ ID NO: 217128 - protein, 9 aa, Homo Sapiens
PRPRRQPPH

SEQ ID NO: 217129 - protein, 9 aa, Homo Sapiens
SFTYLTTLT

SEQ ID NO: 217130 - protein, 9 aa, Homo Sapiens
TRRRRPPGR

SEQ ID NO: 217131 - protein, 9 aa, Homo Sapiens
VYGCQGYCS

SEQ ID NO: 217132 - protein, 9 aa, Homo Sapiens
SVISCFWSI

SEQ ID NO: 217133 - protein, 9 aa, Homo Sapiens
LCLLLSLYD

SEQ ID NO: 217134 - protein, 9 aa, Homo Sapiens
DELRTALTT

SEQ ID NO: 217135 - protein, 9 aa, Homo Sapiens
TTEQSHLLA

SEQ ID NO: 217136 - protein, 9 aa, Homo Sapiens
SPPPPAPSP

SEQ ID NO: 217137 - protein, 9 aa, Homo Sapiens
TNSSTGRNA

SEQ ID NO: 217138 - protein, 9 aa, Homo Sapiens
DHGVSLSIT

SEQ ID NO: 217139 - protein, 9 aa, Homo Sapiens
FLMIKKHRA

SEQ ID NO: 217140 - protein, 9 aa, Homo Sapiens
CSQRLWQSP

SEQ ID NO: 217141 - protein, 9 aa, Homo Sapiens
LLGSGSMGK

SEQ ID NO: 217142 - protein, 9 aa, Homo Sapiens
VSPVVAAVV

SEQ ID NO: 217143 - protein, 9 aa, Homo Sapiens
IQEEMMQDG

SEQ ID NO: 217144 - protein, 9 aa, Homo Sapiens
GGIFLWMKI

SEQ ID NO: 217145 - protein, 9 aa, Homo Sapiens
RGSSSRRVP

SEQ ID NO: 217146 - protein, 9 aa, Homo Sapiens
SGAGGPPSS

SEQ ID NO: 217147 - protein, 9 aa, Homo Sapiens
ILFVVDTGL

SEQ ID NO: 217148 - protein, 9 aa, Homo Sapiens
EGKLFPPPL

SEQ ID NO: 217149 - protein, 9 aa, Homo Sapiens
NPWLRQKPL

SEQ ID NO: 217150 - protein, 9 aa, Homo Sapiens
PANPQLLCQ

SEQ ID NO: 217151 - protein, 9 aa, Homo Sapiens
APGVHPGCQ

SEQ ID NO: 217152 - protein, 9 aa, Homo Sapiens
EEHGIGVCS

SEQ ID NO: 217153 - protein, 9 aa, Homo Sapiens
KEAQKKGRR

SEQ ID NO: 217154 - protein, 9 aa, Homo Sapiens
SSMRSRGES

SEQ ID NO: 217155 - protein, 9 aa, Homo Sapiens
WETECDRVR

SEQ ID NO: 217156 - protein, 9 aa, Homo Sapiens
VFSFCNKIQ

SEQ ID NO: 217157 - protein, 9 aa, Homo Sapiens
NYDAETKLN

SEQ ID NO: 217158 - protein, 9 aa, Homo Sapiens
FTIQDLVSG

SEQ ID NO: 217159 - protein, 9 aa, Homo Sapiens
LNLMRQLYH

SEQ ID NO: 217160 - protein, 9 aa, Homo Sapiens
SLQLEVQPS

SEQ ID NO: 217161 - protein, 9 aa, Homo Sapiens
SDELSFDLD

SEQ ID NO: 217162 - protein, 9 aa, Homo Sapiens
IRECSSTKA

SEQ ID NO: 217163 - protein, 9 aa, Homo Sapiens
KQGAQGVGS

SEQ ID NO: 217164 - protein, 9 aa, Homo Sapiens
SASNSSSRL

SEQ ID NO: 217165 - protein, 9 aa, Homo Sapiens
TERPGATRS

SEQ ID NO: 217166 - protein, 9 aa, Homo Sapiens
LRLWSWCGT

SEQ ID NO: 217167 - protein, 9 aa, Homo Sapiens
AGAHHCQYK

SEQ ID NO: 217168 - protein, 9 aa, Homo Sapiens
GSGPSRCRQ

SEQ ID NO: 217169 - protein, 9 aa, Homo Sapiens
IEIWERIGK

SEQ ID NO: 217170 - protein, 9 aa, Homo Sapiens
QTQPGEEGA

SEQ ID NO: 217171 - protein, 9 aa, Homo Sapiens
AVRKIVLLL

SEQ ID NO: 217172 - protein, 9 aa, Homo Sapiens
RCNKKIAMT

SEQ ID NO: 217173 - protein, 9 aa, Homo Sapiens
ECRSSDEDL

SEQ ID NO: 217174 - protein, 9 aa, Homo Sapiens
FATFPNEKQ

SEQ ID NO: 217175 - protein, 9 aa, Homo Sapiens
TKENLVDFI

SEQ ID NO: 217176 - protein, 9 aa, Homo Sapiens
IHKTFNLKM

SEQ ID NO: 217177 - protein, 9 aa, Homo Sapiens
ASINPNPLQ

SEQ ID NO: 217178 - protein, 9 aa, Homo Sapiens
MEKVTLKKV

SEQ ID NO: 217179 - protein, 9 aa, Homo Sapiens
RTQDGTTQG

SEQ ID NO: 217180 - protein, 9 aa, Homo Sapiens
ARRREEKWL

SEQ ID NO: 217181 - protein, 9 aa, Homo Sapiens
TDAQVSNGS

SEQ ID NO: 217182 - protein, 9 aa, Homo Sapiens
DQGSKAEDP

SEQ ID NO: 217183 - protein, 9 aa, Homo Sapiens
PSRKCSGPL

SEQ ID NO: 217184 - protein, 9 aa, Homo Sapiens
SQFYRPFYL

SEQ ID NO: 217185 - protein, 9 aa, Homo Sapiens
ALKHMLNFN

SEQ ID NO: 217186 - protein, 9 aa, Homo Sapiens
SPLRAYRTS

SEQ ID NO: 217187 - protein, 9 aa, Homo Sapiens
PIRECSSTK

SEQ ID NO: 217188 - protein, 9 aa, Homo Sapiens
DADINDQML

SEQ ID NO: 217189 - protein, 9 aa, Homo Sapiens
SHRVGPAQC

SEQ ID NO: 217190 - protein, 9 aa, Homo Sapiens
RLVECPVSA

SEQ ID NO: 217191 - protein, 9 aa, Homo Sapiens
CGFGGPGFG

SEQ ID NO: 217192 - protein, 9 aa, Homo Sapiens
ENGEIVCSI

SEQ ID NO: 217193 - protein, 9 aa, Homo Sapiens
SSPNRATQD

SEQ ID NO: 217194 - protein, 9 aa, Homo Sapiens
PEQSNDYCV

SEQ ID NO: 217195 - protein, 9 aa, Homo Sapiens
FILYKFLIV

SEQ ID NO: 217196 - protein, 9 aa, Homo Sapiens
KLNGQLMST

SEQ ID NO: 217197 - protein, 9 aa, Homo Sapiens
ELAASLTLG

SEQ ID NO: 217198 - protein, 9 aa, Homo Sapiens
GDEDFESLA

SEQ ID NO: 217199 - protein, 9 aa, Homo Sapiens
GTLGESGSR

SEQ ID NO: 217200 - protein, 9 aa, Homo Sapiens
RPGPPQAPP

SEQ ID NO: 217201 - protein, 9 aa, Homo Sapiens
MDGMSGSGH

SEQ ID NO: 217202 - protein, 9 aa, Homo Sapiens
SGDNSWQPG

SEQ ID NO: 217203 - protein, 9 aa, Homo Sapiens
RCSSSSAAR

SEQ ID NO: 217204 - protein, 9 aa, Homo Sapiens
LLIFVPDSV

SEQ ID NO: 217205 - protein, 9 aa, Homo Sapiens
KQCRRMGHR

SEQ ID NO: 217206 - protein, 9 aa, Homo Sapiens
DAVNVSLIF

SEQ ID NO: 217207 - protein, 9 aa, Homo Sapiens
RWAHFQKNL

SEQ ID NO: 217208 - protein, 9 aa, Homo Sapiens
WPAPTHLWW

SEQ ID NO: 217209 - protein, 9 aa, Homo Sapiens
NFDDCQDNK

SEQ ID NO: 217210 - protein, 9 aa, Homo Sapiens
TVMLKERLA

SEQ ID NO: 217211 - protein, 9 aa, Homo Sapiens
VNHLTEGSQ

SEQ ID NO: 217212 - protein, 9 aa, Homo Sapiens
INPSHHSRS

SEQ ID NO: 217213 - protein, 9 aa, Homo Sapiens
QEIKDWSKL

SEQ ID NO: 217214 - protein, 9 aa, Homo Sapiens
CDLVVENKE

SEQ ID NO: 217215 - protein, 9 aa, Homo Sapiens
LFIKEWHHI

SEQ ID NO: 217216 - protein, 9 aa, Homo Sapiens
LHAPVGFSA

SEQ ID NO: 217217 - protein, 9 aa, Homo Sapiens
RTAPAEVHK

SEQ ID NO: 217218 - protein, 9 aa, Homo Sapiens
ERQGNKSHP

SEQ ID NO: 217219 - protein, 9 aa, Homo Sapiens
FESFNGMMS

SEQ ID NO: 217220 - protein, 9 aa, Homo Sapiens
LEWCIGTVP

SEQ ID NO: 217221 - protein, 9 aa, Homo Sapiens
FHLDAHGQA

SEQ ID NO: 217222 - protein, 9 aa, Homo Sapiens
PAPGPSPLV

SEQ ID NO: 217223 - protein, 9 aa, Homo Sapiens
GRAPQDQHG

SEQ ID NO: 217224 - protein, 9 aa, Homo Sapiens
PGGRSSGRQ

SEQ ID NO: 217225 - protein, 9 aa, Homo Sapiens
EHGIGVCSG

SEQ ID NO: 217226 - protein, 9 aa, Homo Sapiens
DVMFSSDAG

SEQ ID NO: 217227 - protein, 9 aa, Homo Sapiens
LTGGEFHFI

SEQ ID NO: 217228 - protein, 9 aa, Homo Sapiens
GQSPIERKV

SEQ ID NO: 217229 - protein, 9 aa, Homo Sapiens
AGHYTHRQC

SEQ ID NO: 217230 - protein, 9 aa, Homo Sapiens
TCLPAVTTC

SEQ ID NO: 217231 - protein, 9 aa, Homo Sapiens
ITDSRRTVP

SEQ ID NO: 217232 - protein, 9 aa, Homo Sapiens
RLSFAHPRQ

SEQ ID NO: 217233 - protein, 9 aa, Homo Sapiens
PPGRGGSTP

SEQ ID NO: 217234 - protein, 9 aa, Homo Sapiens
APSTHTPSA

SEQ ID NO: 217235 - protein, 9 aa, Homo Sapiens
CQSCVNSIE

SEQ ID NO: 217236 - protein, 9 aa, Homo Sapiens
FALVDSGDK

SEQ ID NO: 217237 - protein, 9 aa, Homo Sapiens
SKVVHSTEQ

SEQ ID NO: 217238 - protein, 9 aa, Homo Sapiens
CPSDSGSYV

SEQ ID NO: 217239 - protein, 9 aa, Homo Sapiens
VVLLRKQNF

SEQ ID NO: 217240 - protein, 9 aa, Homo Sapiens
YLSLSLAST

SEQ ID NO: 217241 - protein, 9 aa, Homo Sapiens
GEPFSQPIK

SEQ ID NO: 217242 - protein, 9 aa, Homo Sapiens
QGRKRKKQT

SEQ ID NO: 217243 - protein, 9 aa, Homo Sapiens
DVKTKRNWT

SEQ ID NO: 217244 - protein, 9 aa, Homo Sapiens
QQALRQCQR

SEQ ID NO: 217245 - protein, 9 aa, Homo Sapiens
QLCAGPGPP

SEQ ID NO: 217246 - protein, 9 aa, Homo Sapiens
DLPGTFILY

SEQ ID NO: 217247 - protein, 9 aa, Homo Sapiens
AMTVIAGAH

SEQ ID NO: 217248 - protein, 9 aa, Homo Sapiens
GEYVKNFDQ

SEQ ID NO: 217249 - protein, 9 aa, Homo Sapiens
IVDASPSPF

SEQ ID NO: 217250 - protein, 9 aa, Homo Sapiens
TLTSQVSGT

SEQ ID NO: 217251 - protein, 9 aa, Homo Sapiens
TRGASTCPN

SEQ ID NO: 217252 - protein, 9 aa, Homo Sapiens
GRCGATSSR

SEQ ID NO: 217253 - protein, 9 aa, Homo Sapiens
ALLGLYPVL

SEQ ID NO: 217254 - protein, 9 aa, Homo Sapiens
SINKVNGLL

SEQ ID NO: 217255 - protein, 9 aa, Homo Sapiens
AERDRQMPS

SEQ ID NO: 217256 - protein, 9 aa, Homo Sapiens
YLKIMQLME

SEQ ID NO: 217257 - protein, 9 aa, Homo Sapiens
GVSTKYLNL

SEQ ID NO: 217258 - protein, 9 aa, Homo Sapiens
LDYFLFLQM

SEQ ID NO: 217259 - protein, 9 aa, Homo Sapiens
MADLDNIAD

SEQ ID NO: 217260 - protein, 9 aa, Homo Sapiens
SVKGYLFRW

SEQ ID NO: 217261 - protein, 9 aa, Homo Sapiens
EGPGGSVST

SEQ ID NO: 217262 - protein, 9 aa, Homo Sapiens
LKTKRYDIP

SEQ ID NO: 217263 - protein, 9 aa, Homo Sapiens
WINKKHHES

SEQ ID NO: 217264 - protein, 9 aa, Homo Sapiens
AAATTLTSA

SEQ ID NO: 217265 - protein, 9 aa, Homo Sapiens
IFIEEYLTG

SEQ ID NO: 217266 - protein, 9 aa, Homo Sapiens
CWTWMTWCG

SEQ ID NO: 217267 - protein, 9 aa, Homo Sapiens
KIKHSDNAE

SEQ ID NO: 217268 - protein, 9 aa, Homo Sapiens
PGLVAGVNI

SEQ ID NO: 217269 - protein, 9 aa, Homo Sapiens
THGLRCQRR

SEQ ID NO: 217270 - protein, 9 aa, Homo Sapiens
LQGSLLLPV

SEQ ID NO: 217271 - protein, 9 aa, Homo Sapiens
IARHAAKMA

SEQ ID NO: 217272 - protein, 9 aa, Homo Sapiens
DVCKVLPRN

SEQ ID NO: 217273 - protein, 9 aa, Homo Sapiens
VAGYDMVAR

SEQ ID NO: 217274 - protein, 9 aa, Homo Sapiens
GLDPNTMYS

SEQ ID NO: 217275 - protein, 9 aa, Homo Sapiens
ISHVENDYI

SEQ ID NO: 217276 - protein, 9 aa, Homo Sapiens
LMFQSSTLL

SEQ ID NO: 217277 - protein, 9 aa, Homo Sapiens
SMASLCWST

SEQ ID NO: 217278 - protein, 9 aa, Homo Sapiens
LCQRTERPG

SEQ ID NO: 217279 - protein, 9 aa, Homo Sapiens
GRNEPSRCQ

SEQ ID NO: 217280 - protein, 9 aa, Homo Sapiens
TRKRLLSYI

SEQ ID NO: 217281 - protein, 9 aa, Homo Sapiens
TDEKSLLEK

SEQ ID NO: 217282 - protein, 9 aa, Homo Sapiens
QSCVNSIEG

SEQ ID NO: 217283 - protein, 9 aa, Homo Sapiens
RGTVAYVRA

SEQ ID NO: 217284 - protein, 9 aa, Homo Sapiens
VRKIVLLLK

SEQ ID NO: 217285 - protein, 9 aa, Homo Sapiens
LLGERGLVA

SEQ ID NO: 217286 - protein, 9 aa, Homo Sapiens
APHPYSLQP

SEQ ID NO: 217287 - protein, 9 aa, Homo Sapiens
MRIHTGGKP

SEQ ID NO: 217288 - protein, 9 aa, Homo Sapiens
AQPLPARTL

SEQ ID NO: 217289 - protein, 9 aa, Homo Sapiens
LLDTTANRT

SEQ ID NO: 217290 - protein, 9 aa, Homo Sapiens
MAAPAGPRG

SEQ ID NO: 217291 - protein, 9 aa, Homo Sapiens
RCLRGKHAH

SEQ ID NO: 217292 - protein, 9 aa, Homo Sapiens
TRRVGGRKR

SEQ ID NO: 217293 - protein, 9 aa, Homo Sapiens
KDIPAHEVT

SEQ ID NO: 217294 - protein, 9 aa, Homo Sapiens
SIITGERNR

SEQ ID NO: 217295 - protein, 9 aa, Homo Sapiens
PRVPHWGPS

SEQ ID NO: 217296 - protein, 9 aa, Homo Sapiens
IQVILILRL

SEQ ID NO: 217297 - protein, 9 aa, Homo Sapiens
ISLHRYDEW

SEQ ID NO: 217298 - protein, 9 aa, Homo Sapiens
RRPRPPLGG

SEQ ID NO: 217299 - protein, 9 aa, Homo Sapiens
NHMEESKAL

SEQ ID NO: 217300 - protein, 9 aa, Homo Sapiens
LLIPGGRAN

SEQ ID NO: 217301 - protein, 9 aa, Homo Sapiens
EAEWKEEEE

SEQ ID NO: 217302 - protein, 9 aa, Homo Sapiens
SLCPAEDER

SEQ ID NO: 217303 - protein, 9 aa, Homo Sapiens
DRSPQAPLR

SEQ ID NO: 217304 - protein, 9 aa, Homo Sapiens
PHVGVTQRV

SEQ ID NO: 217305 - protein, 9 aa, Homo Sapiens
PSPPRGRGR

SEQ ID NO: 217306 - protein, 9 aa, Homo Sapiens
QVYIRADIG

SEQ ID NO: 217307 - protein, 9 aa, Homo Sapiens
QKLEAHRGD

SEQ ID NO: 217308 - protein, 9 aa, Homo Sapiens
KYWLLPIFQ

SEQ ID NO: 217309 - protein, 9 aa, Homo Sapiens
PPRESKNST

SEQ ID NO: 217310 - protein, 9 aa, Homo Sapiens
VICMTCCLL

SEQ ID NO: 217311 - protein, 9 aa, Homo Sapiens
AVNLATHNK

SEQ ID NO: 217312 - protein, 9 aa, Homo Sapiens
PPQHCYDAC

SEQ ID NO: 217313 - protein, 9 aa, Homo Sapiens
ERVLLKWTE

SEQ ID NO: 217314 - protein, 9 aa, Homo Sapiens
PEAQPGAEW

SEQ ID NO: 217315 - protein, 9 aa, Homo Sapiens
WGAAATTLT

SEQ ID NO: 217316 - protein, 9 aa, Homo Sapiens
QRVCCLRCC

SEQ ID NO: 217317 - protein, 9 aa, Homo Sapiens
SFLIYFFFF

SEQ ID NO: 217318 - protein, 9 aa, Homo Sapiens
EFTLERNLT

SEQ ID NO: 217319 - protein, 9 aa, Homo Sapiens
NSLKSSGIE

SEQ ID NO: 217320 - protein, 9 aa, Homo Sapiens
PKTTLPGLF

SEQ ID NO: 217321 - protein, 9 aa, Homo Sapiens
LYSQDYQCL

SEQ ID NO: 217322 - protein, 9 aa, Homo Sapiens
MQLRLNTGM

SEQ ID NO: 217323 - protein, 9 aa, Homo Sapiens
LSFALVDSG

SEQ ID NO: 217324 - protein, 9 aa, Homo Sapiens
QEDEDLPPG

SEQ ID NO: 217325 - protein, 9 aa, Homo Sapiens
SYLGNVLAE

SEQ ID NO: 217326 - protein, 9 aa, Homo Sapiens
YGCKNCGSA

SEQ ID NO: 217327 - protein, 9 aa, Homo Sapiens
LASALSPDC

SEQ ID NO: 217328 - protein, 9 aa, Homo Sapiens
PPEYSLFMF

SEQ ID NO: 217329 - protein, 9 aa, Homo Sapiens
LTGLPPQRP

SEQ ID NO: 217330 - protein, 9 aa, Homo Sapiens
LLVVILFVV

SEQ ID NO: 217331 - protein, 9 aa, Homo Sapiens
CPPELYTLM

SEQ ID NO: 217332 - protein, 9 aa, Homo Sapiens
LQLAHFQDR

SEQ ID NO: 217333 - protein, 9 aa, Homo Sapiens
SCLEEFRAT

SEQ ID NO: 217334 - protein, 9 aa, Homo Sapiens
TWIIPMGQT

SEQ ID NO: 217335 - protein, 9 aa, Homo Sapiens
VQSVLLLGV

SEQ ID NO: 217336 - protein, 9 aa, Homo Sapiens
AWDLEQMVT

SEQ ID NO: 217337 - protein, 9 aa, Homo Sapiens
AGAAPVCGA

SEQ ID NO: 217338 - protein, 9 aa, Homo Sapiens
GRELEGRDV

SEQ ID NO: 217339 - protein, 9 aa, Homo Sapiens
QLKLKDEVL

SEQ ID NO: 217340 - protein, 9 aa, Homo Sapiens
GTHQMRTAP

SEQ ID NO: 217341 - protein, 9 aa, Homo Sapiens
SYAVATASC

SEQ ID NO: 217342 - protein, 9 aa, Homo Sapiens
SGVSLLWVT

SEQ ID NO: 217343 - protein, 9 aa, Homo Sapiens
KRQKPLISL

SEQ ID NO: 217344 - protein, 9 aa, Homo Sapiens
LGKMLKVEQ

SEQ ID NO: 217345 - protein, 9 aa, Homo Sapiens
NKWDYMNTS

SEQ ID NO: 217346 - protein, 9 aa, Homo Sapiens
DVNCAIAHP

SEQ ID NO: 217347 - protein, 9 aa, Homo Sapiens
NTWIVTAAH

SEQ ID NO: 217348 - protein, 9 aa, Homo Sapiens
VSGMVESYT

SEQ ID NO: 217349 - protein, 9 aa, Homo Sapiens
ALTQVRYLE

SEQ ID NO: 217350 - protein, 9 aa, Homo Sapiens
HLFTIKQSM

SEQ ID NO: 217351 - protein, 9 aa, Homo Sapiens
FIVHKNRIS

SEQ ID NO: 217352 - protein, 9 aa, Homo Sapiens
AQSLPSLGF

SEQ ID NO: 217353 - protein, 9 aa, Homo Sapiens
FEELTSTRI

SEQ ID NO: 217354 - protein, 9 aa, Homo Sapiens
NVYPSVKPG

SEQ ID NO: 217355 - protein, 9 aa, Homo Sapiens
SRRSGCVWL

SEQ ID NO: 217356 - protein, 9 aa, Homo Sapiens
EKERKRLKE

SEQ ID NO: 217357 - protein, 9 aa, Homo Sapiens
GFSNLVRLM

SEQ ID NO: 217358 - protein, 9 aa, Homo Sapiens
VPMPVCVNG

SEQ ID NO: 217359 - protein, 9 aa, Homo Sapiens
WPEVLQDLR

SEQ ID NO: 217360 - protein, 9 aa, Homo Sapiens
RLGSRPAPA

SEQ ID NO: 217361 - protein, 9 aa, Homo Sapiens
TALTLVAGL

SEQ ID NO: 217362 - protein, 9 aa, Homo Sapiens
NQPLDDIIK

SEQ ID NO: 217363 - protein, 9 aa, Homo Sapiens
TSPAAVVMR

SEQ ID NO: 217364 - protein, 9 aa, Homo Sapiens
INRALGVLF

SEQ ID NO: 217365 - protein, 9 aa, Homo Sapiens
AGSALGGGA

SEQ ID NO: 217366 - protein, 9 aa, Homo Sapiens
LALLFLLST

SEQ ID NO: 217367 - protein, 9 aa, Homo Sapiens
AKSGSTASR

SEQ ID NO: 217368 - protein, 9 aa, Homo Sapiens
FKRRGSEGT

SEQ ID NO: 217369 - protein, 9 aa, Homo Sapiens
PLEDVWWGP

SEQ ID NO: 217370 - protein, 9 aa, Homo Sapiens
IGSQHLLFE

SEQ ID NO: 217371 - protein, 9 aa, Homo Sapiens
QTIIRLLVE

SEQ ID NO: 217372 - protein, 9 aa, Homo Sapiens
KTPTATWMG

SEQ ID NO: 217373 - protein, 9 aa, Homo Sapiens
CPEYSGPLL

SEQ ID NO: 217374 - protein, 9 aa, Homo Sapiens
GQGRGRGSS

SEQ ID NO: 217375 - protein, 9 aa, Homo Sapiens
GTSAQPLRP

SEQ ID NO: 217376 - protein, 9 aa, Homo Sapiens
TTVPRSSTP

SEQ ID NO: 217377 - protein, 9 aa, Homo Sapiens
GGPKRSARA

SEQ ID NO: 217378 - protein, 9 aa, Homo Sapiens
RLAPGGLRL

SEQ ID NO: 217379 - protein, 9 aa, Homo Sapiens
FPWQKKSLE

SEQ ID NO: 217380 - protein, 9 aa, Homo Sapiens
ASIPDCRGP

SEQ ID NO: 217381 - protein, 9 aa, Homo Sapiens
GMYRRPGQA

SEQ ID NO: 217382 - protein, 9 aa, Homo Sapiens
VVDKTLLVV

SEQ ID NO: 217383 - protein, 9 aa, Homo Sapiens
VLKVEHTSR

SEQ ID NO: 217384 - protein, 9 aa, Homo Sapiens
DDTALTLVA

SEQ ID NO: 217385 - protein, 9 aa, Homo Sapiens
LPLGLAAAS

SEQ ID NO: 217386 - protein, 9 aa, Homo Sapiens
NAPGVFRVA

SEQ ID NO: 217387 - protein, 9 aa, Homo Sapiens
IEAVEKYLT

SEQ ID NO: 217388 - protein, 9 aa, Homo Sapiens
GGHHGSVSL

SEQ ID NO: 217389 - protein, 9 aa, Homo Sapiens
RVNFIDSVG

SEQ ID NO: 217390 - protein, 9 aa, Homo Sapiens
YTNDRNILT

SEQ ID NO: 217391 - protein, 9 aa, Homo Sapiens
VRSFYLIIQ

SEQ ID NO: 217392 - protein, 9 aa, Homo Sapiens
PPGMPAVVL

SEQ ID NO: 217393 - protein, 9 aa, Homo Sapiens
SATPQGSNS

SEQ ID NO: 217394 - protein, 9 aa, Homo Sapiens
SEADEGVAD

SEQ ID NO: 217395 - protein, 9 aa, Homo Sapiens
TTVMLKERL

SEQ ID NO: 217396 - protein, 9 aa, Homo Sapiens
AFGATHQSQ

SEQ ID NO: 217397 - protein, 9 aa, Homo Sapiens
PKEEHHTEP

SEQ ID NO: 217398 - protein, 9 aa, Homo Sapiens
AATTLTSAA

SEQ ID NO: 217399 - protein, 9 aa, Homo Sapiens
PSLRAYPPL

SEQ ID NO: 217400 - protein, 9 aa, Homo Sapiens
FWPRQSAAD

SEQ ID NO: 217401 - protein, 9 aa, Homo Sapiens
HQSPGHLGL

SEQ ID NO: 217402 - protein, 9 aa, Homo Sapiens
FPMTCKPPL

SEQ ID NO: 217403 - protein, 9 aa, Homo Sapiens
AQVEWPQLL

SEQ ID NO: 217404 - protein, 9 aa, Homo Sapiens
TIHQLEGHL

SEQ ID NO: 217405 - protein, 9 aa, Homo Sapiens
GLWSWPPPS

SEQ ID NO: 217406 - protein, 9 aa, Homo Sapiens
SLMLMTTSN

SEQ ID NO: 217407 - protein, 9 aa, Homo Sapiens
GLAAASCSQ

SEQ ID NO: 217408 - protein, 9 aa, Homo Sapiens
TEPHTVLSH

SEQ ID NO: 217409 - protein, 9 aa, Homo Sapiens
GLSGHGEPL

SEQ ID NO: 217410 - protein, 9 aa, Homo Sapiens
PVGLRGFGL

SEQ ID NO: 217411 - protein, 9 aa, Homo Sapiens
PTCSFVQPC

SEQ ID NO: 217412 - protein, 9 aa, Homo Sapiens
EARVEESTQ

SEQ ID NO: 217413 - protein, 9 aa, Homo Sapiens
CNKKIAMTM

SEQ ID NO: 217414 - protein, 9 aa, Homo Sapiens
EDDEKMTGS

SEQ ID NO: 217415 - protein, 9 aa, Homo Sapiens
ASPTSTPGP

SEQ ID NO: 217416 - protein, 9 aa, Homo Sapiens
VHKNRISYN

SEQ ID NO: 217417 - protein, 9 aa, Homo Sapiens
MGLEVFRAH

SEQ ID NO: 217418 - protein, 9 aa, Homo Sapiens
MCPLNPAAQ

SEQ ID NO: 217419 - protein, 9 aa, Homo Sapiens
TINLDDCAN

SEQ ID NO: 217420 - protein, 9 aa, Homo Sapiens
LDLFQHAGQ

SEQ ID NO: 217421 - protein, 9 aa, Homo Sapiens
EKPDRRREL

SEQ ID NO: 217422 - protein, 9 aa, Homo Sapiens
RISRILRTS

SEQ ID NO: 217423 - protein, 9 aa, Homo Sapiens
SYSESKRIM

SEQ ID NO: 217424 - protein, 9 aa, Homo Sapiens
PWCLRRRSR

SEQ ID NO: 217425 - protein, 9 aa, Homo Sapiens
GLRSGPCEM

SEQ ID NO: 217426 - protein, 9 aa, Homo Sapiens
NGEPPHSAT

SEQ ID NO: 217427 - protein, 9 aa, Homo Sapiens
TPSMSKQNR

SEQ ID NO: 217428 - protein, 9 aa, Homo Sapiens
EVLKTKRYD

SEQ ID NO: 217429 - protein, 9 aa, Homo Sapiens
ATGPSVPSW

SEQ ID NO: 217430 - protein, 9 aa, Homo Sapiens
PWHLCMGLK

SEQ ID NO: 217431 - protein, 9 aa, Homo Sapiens
YRGLPLHLA

SEQ ID NO: 217432 - protein, 9 aa, Homo Sapiens
AGHGAGAWL

SEQ ID NO: 217433 - protein, 9 aa, Homo Sapiens
ETFLVLSDE

SEQ ID NO: 217434 - protein, 9 aa, Homo Sapiens
SLMAGQSQK

SEQ ID NO: 217435 - protein, 9 aa, Homo Sapiens
AISNSHYAL

SEQ ID NO: 217436 - protein, 9 aa, Homo Sapiens
DYVNGSVSF

SEQ ID NO: 217437 - protein, 9 aa, Homo Sapiens
CCLPVLRTP

SEQ ID NO: 217438 - protein, 9 aa, Homo Sapiens
FFSCIVCVA

SEQ ID NO: 217439 - protein, 9 aa, Homo Sapiens
RSSEEAHRA

SEQ ID NO: 217440 - protein, 9 aa, Homo Sapiens
RRMATDRRH

SEQ ID NO: 217441 - protein, 9 aa, Homo Sapiens
AKQFTILNS

SEQ ID NO: 217442 - protein, 9 aa, Homo Sapiens
IQKSWETEC

SEQ ID NO: 217443 - protein, 9 aa, Homo Sapiens
EEMEGIRGL

SEQ ID NO: 217444 - protein, 9 aa, Homo Sapiens
WAITSEECT

SEQ ID NO: 217445 - protein, 9 aa, Homo Sapiens
RKITMVVLS

SEQ ID NO: 217446 - protein, 9 aa, Homo Sapiens
LWLWCRPSW

SEQ ID NO: 217447 - protein, 9 aa, Homo Sapiens
HSLALLLTT

SEQ ID NO: 217448 - protein, 9 aa, Homo Sapiens
KECVKAFSS

SEQ ID NO: 217449 - protein, 9 aa, Homo Sapiens
SMKMNAKKA

SEQ ID NO: 217450 - protein, 9 aa, Homo Sapiens
SSVWSSAAT

SEQ ID NO: 217451 - protein, 9 aa, Homo Sapiens
AQAARIRAA

SEQ ID NO: 217452 - protein, 9 aa, Homo Sapiens
EHCDINFDD

SEQ ID NO: 217453 - protein, 9 aa, Homo Sapiens
IGFSKGCVL

SEQ ID NO: 217454 - protein, 9 aa, Homo Sapiens
KFCNDHVST

SEQ ID NO: 217455 - protein, 9 aa, Homo Sapiens
TPRRWQQQR

SEQ ID NO: 217456 - protein, 9 aa, Homo Sapiens
ILQSCWRPL

SEQ ID NO: 217457 - protein, 9 aa, Homo Sapiens
AELNVARLC

SEQ ID NO: 217458 - protein, 9 aa, Homo Sapiens
HIRQVHWDL

SEQ ID NO: 217459 - protein, 9 aa, Homo Sapiens
VRFYIAELT

SEQ ID NO: 217460 - protein, 9 aa, Homo Sapiens
HIPPEPPSR

SEQ ID NO: 217461 - protein, 9 aa, Homo Sapiens
TMSAHIKSV

SEQ ID NO: 217462 - protein, 9 aa, Homo Sapiens
VTLTFRALR

SEQ ID NO: 217463 - protein, 9 aa, Homo Sapiens
VPSGRPRRC

SEQ ID NO: 217464 - protein, 9 aa, Homo Sapiens
HLLQEPCLE

SEQ ID NO: 217465 - protein, 9 aa, Homo Sapiens
PYVSWTSAG

SEQ ID NO: 217466 - protein, 9 aa, Homo Sapiens
LFRAGKLEV

SEQ ID NO: 217467 - protein, 9 aa, Homo Sapiens
NSSRFPLGR

SEQ ID NO: 217468 - protein, 9 aa, Homo Sapiens
TAVGDVVNL

SEQ ID NO: 217469 - protein, 9 aa, Homo Sapiens
QNHHSFMES

SEQ ID NO: 217470 - protein, 9 aa, Homo Sapiens
SVKLRLNVD

SEQ ID NO: 217471 - protein, 9 aa, Homo Sapiens
LLHFGLPAL

SEQ ID NO: 217472 - protein, 9 aa, Homo Sapiens
NEYVSLDSP

SEQ ID NO: 217473 - protein, 9 aa, Homo Sapiens
GPVTVQTAQ

SEQ ID NO: 217474 - protein, 9 aa, Homo Sapiens
AAGVQEAER

SEQ ID NO: 217475 - protein, 9 aa, Homo Sapiens
GVSLLDPPE

SEQ ID NO: 217476 - protein, 9 aa, Homo Sapiens
QNLEHWEEA

SEQ ID NO: 217477 - protein, 9 aa, Homo Sapiens
PPAPSPCTP

SEQ ID NO: 217478 - protein, 9 aa, Homo Sapiens
TAPLACLHL

SEQ ID NO: 217479 - protein, 9 aa, Homo Sapiens
TSHWCPTQP

SEQ ID NO: 217480 - protein, 9 aa, Homo Sapiens
LGGLLGKSD

SEQ ID NO: 217481 - protein, 9 aa, Homo Sapiens
LKDRGWWIS

SEQ ID NO: 217482 - protein, 9 aa, Homo Sapiens
PSTKWWPST

SEQ ID NO: 217483 - protein, 9 aa, Homo Sapiens
NQAGGPELY

SEQ ID NO: 217484 - protein, 9 aa, Homo Sapiens
DAGHAGGRE

SEQ ID NO: 217485 - protein, 9 aa, Homo Sapiens
IGHLSILWG

SEQ ID NO: 217486 - protein, 9 aa, Homo Sapiens
LQQMCYPIW

SEQ ID NO: 217487 - protein, 9 aa, Homo Sapiens
PKALYPGGK

SEQ ID NO: 217488 - protein, 9 aa, Homo Sapiens
PAGGRGRHR

SEQ ID NO: 217489 - protein, 9 aa, Homo Sapiens
QLQQEIKDW

SEQ ID NO: 217490 - protein, 9 aa, Homo Sapiens
QSAPPIRRV

SEQ ID NO: 217491 - protein, 9 aa, Homo Sapiens
SLSVISCFW

SEQ ID NO: 217492 - protein, 9 aa, Homo Sapiens
YNSVDFSEV

SEQ ID NO: 217493 - protein, 9 aa, Homo Sapiens
EEPIDTSQY

SEQ ID NO: 217494 - protein, 9 aa, Homo Sapiens
QVEWPQLLQ

SEQ ID NO: 217495 - protein, 9 aa, Homo Sapiens
VVLPVLMNI

SEQ ID NO: 217496 - protein, 9 aa, Homo Sapiens
CKLRIIGIQ

SEQ ID NO: 217497 - protein, 9 aa, Homo Sapiens
HPSTLRRPA

SEQ ID NO: 217498 - protein, 9 aa, Homo Sapiens
QTNYDLLSA

SEQ ID NO: 217499 - protein, 9 aa, Homo Sapiens
VCESAIKQV

SEQ ID NO: 217500 - protein, 9 aa, Homo Sapiens
LLFSSASAE

SEQ ID NO: 217501 - protein, 9 aa, Homo Sapiens
PPPAPPAAL

SEQ ID NO: 217502 - protein, 9 aa, Homo Sapiens
QMRIRAKQR

SEQ ID NO: 217503 - protein, 9 aa, Homo Sapiens
WQDRLPLPR

SEQ ID NO: 217504 - protein, 9 aa, Homo Sapiens
HPHRSPPTS

SEQ ID NO: 217505 - protein, 9 aa, Homo Sapiens
RQTQSQRKM

SEQ ID NO: 217506 - protein, 9 aa, Homo Sapiens
RFLEQQTAA

SEQ ID NO: 217507 - protein, 9 aa, Homo Sapiens
TYNFRMTIL

SEQ ID NO: 217508 - protein, 9 aa, Homo Sapiens
RLVDGVTLL

SEQ ID NO: 217509 - protein, 9 aa, Homo Sapiens
VQQAPSNVS

SEQ ID NO: 217510 - protein, 9 aa, Homo Sapiens
AEVHKARSG

SEQ ID NO: 217511 - protein, 9 aa, Homo Sapiens
VNVKSAGEG

SEQ ID NO: 217512 - protein, 9 aa, Homo Sapiens
AKPPTRTSR

SEQ ID NO: 217513 - protein, 9 aa, Homo Sapiens
APASRGPST

SEQ ID NO: 217514 - protein, 9 aa, Homo Sapiens
YKEEKKCYI

SEQ ID NO: 217515 - protein, 9 aa, Homo Sapiens
IDEYKKTYM

SEQ ID NO: 217516 - protein, 9 aa, Homo Sapiens
SVDQYLGVP

SEQ ID NO: 217517 - protein, 9 aa, Homo Sapiens
GLFMVTMAV

SEQ ID NO: 217518 - protein, 9 aa, Homo Sapiens
IHMTFKEFF

SEQ ID NO: 217519 - protein, 9 aa, Homo Sapiens
KQCWRAFSQ

SEQ ID NO: 217520 - protein, 9 aa, Homo Sapiens
FLARSWNTM

SEQ ID NO: 217521 - protein, 9 aa, Homo Sapiens
MLNTEEACK

SEQ ID NO: 217522 - protein, 9 aa, Homo Sapiens
YVDGGFGMC

SEQ ID NO: 217523 - protein, 9 aa, Homo Sapiens
INFVQDPNN

SEQ ID NO: 217524 - protein, 9 aa, Homo Sapiens
LLVVARDHV

SEQ ID NO: 217525 - protein, 9 aa, Homo Sapiens
TPCIWQPVM

SEQ ID NO: 217526 - protein, 9 aa, Homo Sapiens
LINPLQQAA

SEQ ID NO: 217527 - protein, 9 aa, Homo Sapiens
TAHKPCAEV

SEQ ID NO: 217528 - protein, 9 aa, Homo Sapiens
GASNGLLCD

SEQ ID NO: 217529 - protein, 9 aa, Homo Sapiens
AKELHQARR

SEQ ID NO: 217530 - protein, 9 aa, Homo Sapiens
RGGPARSGN

SEQ ID NO: 217531 - protein, 9 aa, Homo Sapiens
QRIHTGEEP

SEQ ID NO: 217532 - protein, 9 aa, Homo Sapiens
WKCIGEDSV

SEQ ID NO: 217533 - protein, 9 aa, Homo Sapiens
SLEASGMPP

SEQ ID NO: 217534 - protein, 9 aa, Homo Sapiens
DPSEAWMQT

SEQ ID NO: 217535 - protein, 9 aa, Homo Sapiens
RREELLKKC

SEQ ID NO: 217536 - protein, 9 aa, Homo Sapiens
EFVIIDCRC

SEQ ID NO: 217537 - protein, 9 aa, Homo Sapiens
LEALEKIRT

SEQ ID NO: 217538 - protein, 9 aa, Homo Sapiens
VERTEEKDP

SEQ ID NO: 217539 - protein, 9 aa, Homo Sapiens
LWAWKAGTG

SEQ ID NO: 217540 - protein, 9 aa, Homo Sapiens
SGSRAAGPV

SEQ ID NO: 217541 - protein, 9 aa, Homo Sapiens
EKNQVVEML

SEQ ID NO: 217542 - protein, 9 aa, Homo Sapiens
QAETKEDLY

SEQ ID NO: 217543 - protein, 9 aa, Homo Sapiens
IGSLILLTS

SEQ ID NO: 217544 - protein, 9 aa, Homo Sapiens
KSLHQFQVE

SEQ ID NO: 217545 - protein, 9 aa, Homo Sapiens
KTSGPCSLP

SEQ ID NO: 217546 - protein, 9 aa, Homo Sapiens
AHQPGPEAA

SEQ ID NO: 217547 - protein, 9 aa, Homo Sapiens
GHGGVFGVA

SEQ ID NO: 217548 - protein, 9 aa, Homo Sapiens
ERYAKDYAD

SEQ ID NO: 217549 - protein, 9 aa, Homo Sapiens
SIWDMGLEV

SEQ ID NO: 217550 - protein, 9 aa, Homo Sapiens
TVICMTCCL

SEQ ID NO: 217551 - protein, 9 aa, Homo Sapiens
RLPKAQSGS

SEQ ID NO: 217552 - protein, 9 aa, Homo Sapiens
VIISKFFDD

SEQ ID NO: 217553 - protein, 9 aa, Homo Sapiens
SGRRQPPHW

SEQ ID NO: 217554 - protein, 9 aa, Homo Sapiens
TCFSEVQAL

SEQ ID NO: 217555 - protein, 9 aa, Homo Sapiens
EESATASQE

SEQ ID NO: 217556 - protein, 9 aa, Homo Sapiens
ELSSEVEDD

SEQ ID NO: 217557 - protein, 9 aa, Homo Sapiens
MPVGGQTSH

SEQ ID NO: 217558 - protein, 9 aa, Homo Sapiens
SEGGKYLTL

SEQ ID NO: 217559 - protein, 9 aa, Homo Sapiens
VHSYTRPMI

SEQ ID NO: 217560 - protein, 9 aa, Homo Sapiens
ANIFHSGCV

SEQ ID NO: 217561 - protein, 9 aa, Homo Sapiens
GCGWASMLA

SEQ ID NO: 217562 - protein, 9 aa, Homo Sapiens
VNSIEGKVR

SEQ ID NO: 217563 - protein, 9 aa, Homo Sapiens
NPQLLCQNP

SEQ ID NO: 217564 - protein, 9 aa, Homo Sapiens
QDISEGHQL

SEQ ID NO: 217565 - protein, 9 aa, Homo Sapiens
SSLSSSRTS

SEQ ID NO: 217566 - protein, 9 aa, Homo Sapiens
SPGSRRGVR

SEQ ID NO: 217567 - protein, 9 aa, Homo Sapiens
LVESVGWNE

SEQ ID NO: 217568 - protein, 9 aa, Homo Sapiens
RLTRERAAA

SEQ ID NO: 217569 - protein, 9 aa, Homo Sapiens
AVDMGARGL

SEQ ID NO: 217570 - protein, 9 aa, Homo Sapiens
GGELFSTYK

SEQ ID NO: 217571 - protein, 9 aa, Homo Sapiens
SYGDVDLEK

SEQ ID NO: 217572 - protein, 9 aa, Homo Sapiens
LARSSALAS

SEQ ID NO: 217573 - protein, 9 aa, Homo Sapiens
PPYCDDTHR

SEQ ID NO: 217574 - protein, 9 aa, Homo Sapiens
LLPRRPQPW

SEQ ID NO: 217575 - protein, 9 aa, Homo Sapiens
EGMLRIGSL

SEQ ID NO: 217576 - protein, 9 aa, Homo Sapiens
GARGLPHVT

SEQ ID NO: 217577 - protein, 9 aa, Homo Sapiens
KEGKLFPPP

SEQ ID NO: 217578 - protein, 9 aa, Homo Sapiens
EPHTVLSHE

SEQ ID NO: 217579 - protein, 9 aa, Homo Sapiens
LHSLVHGLT

SEQ ID NO: 217580 - protein, 9 aa, Homo Sapiens
HTVILDFTR

SEQ ID NO: 217581 - protein, 9 aa, Homo Sapiens
CKNNRCVPS

SEQ ID NO: 217582 - protein, 9 aa, Homo Sapiens
SVDARGGGP

SEQ ID NO: 217583 - protein, 9 aa, Homo Sapiens
QLHEGDFRV

SEQ ID NO: 217584 - protein, 9 aa, Homo Sapiens
SGRQCGPCG

SEQ ID NO: 217585 - protein, 9 aa, Homo Sapiens
LPSPVTCTH

SEQ ID NO: 217586 - protein, 9 aa, Homo Sapiens
LSNETATDD

SEQ ID NO: 217587 - protein, 9 aa, Homo Sapiens
WCRPSWKGK

SEQ ID NO: 217588 - protein, 9 aa, Homo Sapiens
TFGCRWFLP

SEQ ID NO: 217589 - protein, 9 aa, Homo Sapiens
WPTGRPAGA

SEQ ID NO: 217590 - protein, 9 aa, Homo Sapiens
KGQVTAHTG

SEQ ID NO: 217591 - protein, 9 aa, Homo Sapiens
GLLPCNLSL

SEQ ID NO: 217592 - protein, 9 aa, Homo Sapiens
RDSNGAIFS

SEQ ID NO: 217593 - protein, 9 aa, Homo Sapiens
VLNEDGVAG

SEQ ID NO: 217594 - protein, 9 aa, Homo Sapiens
EKTPKKKTP

SEQ ID NO: 217595 - protein, 9 aa, Homo Sapiens
MEAAACPLP

SEQ ID NO: 217596 - protein, 9 aa, Homo Sapiens
SQCRWLLCP

SEQ ID NO: 217597 - protein, 9 aa, Homo Sapiens
SLCWSTVAQ

SEQ ID NO: 217598 - protein, 9 aa, Homo Sapiens
HSLAGNDRH

SEQ ID NO: 217599 - protein, 9 aa, Homo Sapiens
RCDQHIDCY

SEQ ID NO: 217600 - protein, 9 aa, Homo Sapiens
ITNSCKNPS

SEQ ID NO: 217601 - protein, 9 aa, Homo Sapiens
GRALKKRRI

SEQ ID NO: 217602 - protein, 9 aa, Homo Sapiens
PLLGSCNGT

SEQ ID NO: 217603 - protein, 9 aa, Homo Sapiens
GASSGWAGP

SEQ ID NO: 217604 - protein, 9 aa, Homo Sapiens
RLPRAGGHR

SEQ ID NO: 217605 - protein, 9 aa, Homo Sapiens
YILVSTYRP

SEQ ID NO: 217606 - protein, 9 aa, Homo Sapiens
ATALLECPE

SEQ ID NO: 217607 - protein, 9 aa, Homo Sapiens
EDPAGCVCG

SEQ ID NO: 217608 - protein, 9 aa, Homo Sapiens
HCAAPACSP

SEQ ID NO: 217609 - protein, 9 aa, Homo Sapiens
KTFEKKGKK

SEQ ID NO: 217610 - protein, 9 aa, Homo Sapiens
GNDRHPVAL

SEQ ID NO: 217611 - protein, 9 aa, Homo Sapiens
KIIACLPLI

SEQ ID NO: 217612 - protein, 9 aa, Homo Sapiens
LLQEPCLEL

SEQ ID NO: 217613 - protein, 9 aa, Homo Sapiens
LCQNPEKLA

SEQ ID NO: 217614 - protein, 9 aa, Homo Sapiens
REAEWKEEE

SEQ ID NO: 217615 - protein, 9 aa, Homo Sapiens
LSKNEYVSL

SEQ ID NO: 217616 - protein, 9 aa, Homo Sapiens
GRGSCTGRA

SEQ ID NO: 217617 - protein, 9 aa, Homo Sapiens
QRRLKERED

SEQ ID NO: 217618 - protein, 9 aa, Homo Sapiens
EDVHSGPIG

SEQ ID NO: 217619 - protein, 9 aa, Homo Sapiens
LRLDHAAPA

SEQ ID NO: 217620 - protein, 9 aa, Homo Sapiens
SPLNQKIRS

SEQ ID NO: 217621 - protein, 9 aa, Homo Sapiens
TRKVICIVG

SEQ ID NO: 217622 - protein, 9 aa, Homo Sapiens
EPPGSYAVA

SEQ ID NO: 217623 - protein, 9 aa, Homo Sapiens
QLINPLQQA

SEQ ID NO: 217624 - protein, 9 aa, Homo Sapiens
VLEGLDALF

SEQ ID NO: 217625 - protein, 9 aa, Homo Sapiens
PPSPSSLLS

SEQ ID NO: 217626 - protein, 9 aa, Homo Sapiens
KCCTEMQLK

SEQ ID NO: 217627 - protein, 9 aa, Homo Sapiens
MTQQTYLQW

SEQ ID NO: 217628 - protein, 9 aa, Homo Sapiens
PLSTTPWTR

SEQ ID NO: 217629 - protein, 9 aa, Homo Sapiens
AHLRRYSYN

SEQ ID NO: 217630 - protein, 9 aa, Homo Sapiens
RGPAGRVPG

SEQ ID NO: 217631 - protein, 9 aa, Homo Sapiens
WPRQSAADI

SEQ ID NO: 217632 - protein, 9 aa, Homo Sapiens
EEAVAQVES

SEQ ID NO: 217633 - protein, 9 aa, Homo Sapiens
PFPHLLQEP

SEQ ID NO: 217634 - protein, 9 aa, Homo Sapiens
CEGTRVASI

SEQ ID NO: 217635 - protein, 9 aa, Homo Sapiens
LTTVHLEAT

SEQ ID NO: 217636 - protein, 9 aa, Homo Sapiens
SVSLIYWLL

SEQ ID NO: 217637 - protein, 9 aa, Homo Sapiens
PRGAGISGC

SEQ ID NO: 217638 - protein, 9 aa, Homo Sapiens
CMSICGPQG

SEQ ID NO: 217639 - protein, 9 aa, Homo Sapiens
KIKSGDEDF

SEQ ID NO: 217640 - protein, 9 aa, Homo Sapiens
RGLGVDVLD

SEQ ID NO: 217641 - protein, 9 aa, Homo Sapiens
PWMSPATIA

SEQ ID NO: 217642 - protein, 9 aa, Homo Sapiens
QDQHGDGLR

SEQ ID NO: 217643 - protein, 9 aa, Homo Sapiens
VVAEGHLEG

SEQ ID NO: 217644 - protein, 9 aa, Homo Sapiens
ELKKEQRVI

SEQ ID NO: 217645 - protein, 9 aa, Homo Sapiens
LLDACAGCR

SEQ ID NO: 217646 - protein, 9 aa, Homo Sapiens
PCTMLLPQG

SEQ ID NO: 217647 - protein, 9 aa, Homo Sapiens
SSQRYPEAA

SEQ ID NO: 217648 - protein, 9 aa, Homo Sapiens
LLFLLSTTW

SEQ ID NO: 217649 - protein, 9 aa, Homo Sapiens
SRLGGPKRS

SEQ ID NO: 217650 - protein, 9 aa, Homo Sapiens
DYLVRYVTE

SEQ ID NO: 217651 - protein, 9 aa, Homo Sapiens
LMQLQDAKE

SEQ ID NO: 217652 - protein, 9 aa, Homo Sapiens
AEGHGDQEL

SEQ ID NO: 217653 - protein, 9 aa, Homo Sapiens
RLAELRKLC

SEQ ID NO: 217654 - protein, 9 aa, Homo Sapiens
EEPYKCSEC

SEQ ID NO: 217655 - protein, 9 aa, Homo Sapiens
FVAVQNLEH

SEQ ID NO: 217656 - protein, 9 aa, Homo Sapiens
CLELLEVIF

SEQ ID NO: 217657 - protein, 9 aa, Homo Sapiens
LLELDHHFF

SEQ ID NO: 217658 - protein, 9 aa, Homo Sapiens
PPFPHLLQE

SEQ ID NO: 217659 - protein, 9 aa, Homo Sapiens
TLLGDPVLH

SEQ ID NO: 217660 - protein, 9 aa, Homo Sapiens
RLEHVAREI

SEQ ID NO: 217661 - protein, 9 aa, Homo Sapiens
CAATDREGF

SEQ ID NO: 217662 - protein, 9 aa, Homo Sapiens
TDYPTALLH

SEQ ID NO: 217663 - protein, 9 aa, Homo Sapiens
ILIFTCETS

SEQ ID NO: 217664 - protein, 9 aa, Homo Sapiens
RCRRPRCSG

SEQ ID NO: 217665 - protein, 9 aa, Homo Sapiens
VFSRKYNQK

SEQ ID NO: 217666 - protein, 9 aa, Homo Sapiens
AQGPSEKTN

SEQ ID NO: 217667 - protein, 9 aa, Homo Sapiens
ICFQETHLG

SEQ ID NO: 217668 - protein, 9 aa, Homo Sapiens
WKEEEERLR

SEQ ID NO: 217669 - protein, 9 aa, Homo Sapiens
AQRVCCLRC

SEQ ID NO: 217670 - protein, 9 aa, Homo Sapiens
LPPIVNPDP

SEQ ID NO: 217671 - protein, 9 aa, Homo Sapiens
RTPASCVRT

SEQ ID NO: 217672 - protein, 9 aa, Homo Sapiens
QLTRDWKAS

SEQ ID NO: 217673 - protein, 9 aa, Homo Sapiens
SVREKNSLR

SEQ ID NO: 217674 - protein, 9 aa, Homo Sapiens
APRRRKWGM

SEQ ID NO: 217675 - protein, 9 aa, Homo Sapiens
KDISKIFPG

SEQ ID NO: 217676 - protein, 9 aa, Homo Sapiens
TQDNPRTSC

SEQ ID NO: 217677 - protein, 9 aa, Homo Sapiens
RLAATTLAL

SEQ ID NO: 217678 - protein, 9 aa, Homo Sapiens
AVAQYLEET

SEQ ID NO: 217679 - protein, 9 aa, Homo Sapiens
AQMDDNNIQ

SEQ ID NO: 217680 - protein, 9 aa, Homo Sapiens
GPVFPPLIP

SEQ ID NO: 217681 - protein, 9 aa, Homo Sapiens
LSVELGSKP

SEQ ID NO: 217682 - protein, 9 aa, Homo Sapiens
PQGAVIRLC

SEQ ID NO: 217683 - protein, 9 aa, Homo Sapiens
EGETIMMRC

SEQ ID NO: 217684 - protein, 9 aa, Homo Sapiens
AQELTDRVG

SEQ ID NO: 217685 - protein, 9 aa, Homo Sapiens
CDKAFTRSS

SEQ ID NO: 217686 - protein, 9 aa, Homo Sapiens
RCRGLWSWP

SEQ ID NO: 217687 - protein, 9 aa, Homo Sapiens
VAPTVLQGP

SEQ ID NO: 217688 - protein, 9 aa, Homo Sapiens
QLPDRPPKE

SEQ ID NO: 217689 - protein, 9 aa, Homo Sapiens
VVLNEDGVA

SEQ ID NO: 217690 - protein, 9 aa, Homo Sapiens
PASDADSWG

SEQ ID NO: 217691 - protein, 9 aa, Homo Sapiens
KNQVVEMLG

SEQ ID NO: 217692 - protein, 9 aa, Homo Sapiens
YCRNSSKNK

SEQ ID NO: 217693 - protein, 9 aa, Homo Sapiens
KCNGQPIPF

SEQ ID NO: 217694 - protein, 9 aa, Homo Sapiens
HVHGSVDVV

SEQ ID NO: 217695 - protein, 9 aa, Homo Sapiens
PIMRKMQTL

SEQ ID NO: 217696 - protein, 9 aa, Homo Sapiens
VGRGPAGRV

SEQ ID NO: 217697 - protein, 9 aa, Homo Sapiens
NGPWETPSM

SEQ ID NO: 217698 - protein, 9 aa, Homo Sapiens
SDIDEYKKT

SEQ ID NO: 217699 - protein, 9 aa, Homo Sapiens
QVNAEEKKS

SEQ ID NO: 217700 - protein, 9 aa, Homo Sapiens
QMPSFGEFP

SEQ ID NO: 217701 - protein, 9 aa, Homo Sapiens
ARSWNTMQW

SEQ ID NO: 217702 - protein, 9 aa, Homo Sapiens
NQGDMMGTG

SEQ ID NO: 217703 - protein, 9 aa, Homo Sapiens
RVAAAGTWR

SEQ ID NO: 217704 - protein, 9 aa, Homo Sapiens
SVTIHSFSG

SEQ ID NO: 217705 - protein, 9 aa, Homo Sapiens
RPETRKRLL

SEQ ID NO: 217706 - protein, 9 aa, Homo Sapiens
FLESPNLPA

SEQ ID NO: 217707 - protein, 9 aa, Homo Sapiens
ELYGPSCRI

SEQ ID NO: 217708 - protein, 9 aa, Homo Sapiens
CPAEDERRR

SEQ ID NO: 217709 - protein, 9 aa, Homo Sapiens
VAGNFCFLR

SEQ ID NO: 217710 - protein, 9 aa, Homo Sapiens
EEYCRNSSK

SEQ ID NO: 217711 - protein, 9 aa, Homo Sapiens
SKLLEIFAL

SEQ ID NO: 217712 - protein, 9 aa, Homo Sapiens
GGLWAWKAG

SEQ ID NO: 217713 - protein, 9 aa, Homo Sapiens
DTPSVMQLR

SEQ ID NO: 217714 - protein, 9 aa, Homo Sapiens
LQNQLRVFL

SEQ ID NO: 217715 - protein, 9 aa, Homo Sapiens
LIKSSSTKS

SEQ ID NO: 217716 - protein, 9 aa, Homo Sapiens
RLAYLISAQ

SEQ ID NO: 217717 - protein, 9 aa, Homo Sapiens
WTPENSPKG

SEQ ID NO: 217718 - protein, 9 aa, Homo Sapiens
VMKMGMPEE

SEQ ID NO: 217719 - protein, 9 aa, Homo Sapiens
KFHKLQHEL

SEQ ID NO: 217720 - protein, 9 aa, Homo Sapiens
MVLAQLRLV

SEQ ID NO: 217721 - protein, 9 aa, Homo Sapiens
PCTFLKNLK

SEQ ID NO: 217722 - protein, 9 aa, Homo Sapiens
AGKLEVDSL

SEQ ID NO: 217723 - protein, 9 aa, Homo Sapiens
RTPRASSGC

SEQ ID NO: 217724 - protein, 9 aa, Homo Sapiens
LTTDWRKSH

SEQ ID NO: 217725 - protein, 9 aa, Homo Sapiens
HYRDELGAG

SEQ ID NO: 217726 - protein, 9 aa, Homo Sapiens
RVGVRWGAD

SEQ ID NO: 217727 - protein, 9 aa, Homo Sapiens
TVHSYMLAK

SEQ ID NO: 217728 - protein, 9 aa, Homo Sapiens
TSSLEASGM

SEQ ID NO: 217729 - protein, 9 aa, Homo Sapiens
SWRSRSTLS

SEQ ID NO: 217730 - protein, 9 aa, Homo Sapiens
EYCKSALLL

SEQ ID NO: 217731 - protein, 9 aa, Homo Sapiens
RTHHSFRVS

SEQ ID NO: 217732 - protein, 9 aa, Homo Sapiens
AEEVGVVAL

SEQ ID NO: 217733 - protein, 9 aa, Homo Sapiens
GHRRKEIWR

SEQ ID NO: 217734 - protein, 9 aa, Homo Sapiens
VAAAGTWRG

SEQ ID NO: 217735 - protein, 9 aa, Homo Sapiens
IRKYDAVNV

SEQ ID NO: 217736 - protein, 9 aa, Homo Sapiens
MYDHVIDFD

SEQ ID NO: 217737 - protein, 9 aa, Homo Sapiens
QLFTTHFLE

SEQ ID NO: 217738 - protein, 9 aa, Homo Sapiens
DLDRNTFRK

SEQ ID NO: 217739 - protein, 9 aa, Homo Sapiens
NVVSTKEVL

SEQ ID NO: 217740 - protein, 9 aa, Homo Sapiens
FIGQVTVLK

SEQ ID NO: 217741 - protein, 9 aa, Homo Sapiens
GERRRGCSG

SEQ ID NO: 217742 - protein, 9 aa, Homo Sapiens
PTSALALPH

SEQ ID NO: 217743 - protein, 9 aa, Homo Sapiens
PEGAVAHTQ

SEQ ID NO: 217744 - protein, 9 aa, Homo Sapiens
RKTPWVFIG

SEQ ID NO: 217745 - protein, 9 aa, Homo Sapiens
KQVLITEGP

SEQ ID NO: 217746 - protein, 9 aa, Homo Sapiens
HDVVEAGEE

SEQ ID NO: 217747 - protein, 9 aa, Homo Sapiens
ANVPLPPPQ

SEQ ID NO: 217748 - protein, 9 aa, Homo Sapiens
VCHNQVDPN

SEQ ID NO: 217749 - protein, 9 aa, Homo Sapiens
VFRAHIISD

SEQ ID NO: 217750 - protein, 9 aa, Homo Sapiens
SSARFMPCT

SEQ ID NO: 217751 - protein, 9 aa, Homo Sapiens
NRVTSVSSV

SEQ ID NO: 217752 - protein, 9 aa, Homo Sapiens
FCLANYVQR

SEQ ID NO: 217753 - protein, 9 aa, Homo Sapiens
NQNLSLMNR

SEQ ID NO: 217754 - protein, 9 aa, Homo Sapiens
GAAWGSLCT

SEQ ID NO: 217755 - protein, 9 aa, Homo Sapiens
VATVEAVLL

SEQ ID NO: 217756 - protein, 9 aa, Homo Sapiens
VSLVGVHSS

SEQ ID NO: 217757 - protein, 9 aa, Homo Sapiens
NLIEAGKEV

SEQ ID NO: 217758 - protein, 9 aa, Homo Sapiens
VCCGTSTIG

SEQ ID NO: 217759 - protein, 9 aa, Homo Sapiens
PPASHVCSL

SEQ ID NO: 217760 - protein, 9 aa, Homo Sapiens
PALPLLLGV

SEQ ID NO: 217761 - protein, 9 aa, Homo Sapiens
TGIGVHPHP

SEQ ID NO: 217762 - protein, 9 aa, Homo Sapiens
IPLPVGASL

SEQ ID NO: 217763 - protein, 9 aa, Homo Sapiens
IPLLYLNRA

SEQ ID NO: 217764 - protein, 9 aa, Homo Sapiens
INLYHLSPH

SEQ ID NO: 217765 - protein, 9 aa, Homo Sapiens
LCSVSICTK

SEQ ID NO: 217766 - protein, 9 aa, Homo Sapiens
VGCQELQRV

SEQ ID NO: 217767 - protein, 9 aa, Homo Sapiens
GLLPECFRH

SEQ ID NO: 217768 - protein, 9 aa, Homo Sapiens
GPPLKLLKN

SEQ ID NO: 217769 - protein, 9 aa, Homo Sapiens
IQVPREGHI

SEQ ID NO: 217770 - protein, 9 aa, Homo Sapiens
QPLRPLARR

SEQ ID NO: 217771 - protein, 9 aa, Homo Sapiens
KEKKLYLVH

SEQ ID NO: 217772 - protein, 9 aa, Homo Sapiens
PADSWDIII

SEQ ID NO: 217773 - protein, 9 aa, Homo Sapiens
TAAVGKARR

SEQ ID NO: 217774 - protein, 9 aa, Homo Sapiens
TSSRPLAHS

SEQ ID NO: 217775 - protein, 9 aa, Homo Sapiens
HFLLHNGKL

SEQ ID NO: 217776 - protein, 9 aa, Homo Sapiens
PARPLPPQS

SEQ ID NO: 217777 - protein, 9 aa, Homo Sapiens
TFKSVFTRS

SEQ ID NO: 217778 - protein, 9 aa, Homo Sapiens
PHQAGSPRY

SEQ ID NO: 217779 - protein, 9 aa, Homo Sapiens
NCGKSFSCV

SEQ ID NO: 217780 - protein, 9 aa, Homo Sapiens
LAPGASDHV

SEQ ID NO: 217781 - protein, 9 aa, Homo Sapiens
DGVAGQVPV

SEQ ID NO: 217782 - protein, 9 aa, Homo Sapiens
TVLPSKIDV

SEQ ID NO: 217783 - protein, 9 aa, Homo Sapiens
CLTKIYQLI

SEQ ID NO: 217784 - protein, 9 aa, Homo Sapiens
VHQWVDSIP

SEQ ID NO: 217785 - protein, 9 aa, Homo Sapiens
VRRPRATSD

SEQ ID NO: 217786 - protein, 9 aa, Homo Sapiens
RTASQHSNS

SEQ ID NO: 217787 - protein, 9 aa, Homo Sapiens
QVDPNGSRY

SEQ ID NO: 217788 - protein, 9 aa, Homo Sapiens
RAKLLLPVA

SEQ ID NO: 217789 - protein, 9 aa, Homo Sapiens
PSSSRTPRR

SEQ ID NO: 217790 - protein, 9 aa, Homo Sapiens
NTDHTQNSV

SEQ ID NO: 217791 - protein, 9 aa, Homo Sapiens
TSSSGRMCY

SEQ ID NO: 217792 - protein, 9 aa, Homo Sapiens
GSTASRASQ

SEQ ID NO: 217793 - protein, 9 aa, Homo Sapiens
PSKLGRTMT

SEQ ID NO: 217794 - protein, 9 aa, Homo Sapiens
WLCPTPSAS

SEQ ID NO: 217795 - protein, 9 aa, Homo Sapiens
SVRRQHCYP

SEQ ID NO: 217796 - protein, 9 aa, Homo Sapiens
NLTKLFLIF

SEQ ID NO: 217797 - protein, 9 aa, Homo Sapiens
PWETPSMSK

SEQ ID NO: 217798 - protein, 9 aa, Homo Sapiens
GSSSRIPRR

SEQ ID NO: 217799 - protein, 9 aa, Homo Sapiens
VVWPSVPSS

SEQ ID NO: 217800 - protein, 9 aa, Homo Sapiens
HQCNECGKL

SEQ ID NO: 217801 - protein, 9 aa, Homo Sapiens
LFSTFVELK

SEQ ID NO: 217802 - protein, 9 aa, Homo Sapiens
EEAPERGFP

SEQ ID NO: 217803 - protein, 9 aa, Homo Sapiens
SFIHMTFKE

SEQ ID NO: 217804 - protein, 9 aa, Homo Sapiens
PVCVNGASK

SEQ ID NO: 217805 - protein, 9 aa, Homo Sapiens
RKSRPHSET

SEQ ID NO: 217806 - protein, 9 aa, Homo Sapiens
SSPNNAGLE

SEQ ID NO: 217807 - protein, 9 aa, Homo Sapiens
FHMKCFLNL

SEQ ID NO: 217808 - protein, 9 aa, Homo Sapiens
FFCICGASV

SEQ ID NO: 217809 - protein, 9 aa, Homo Sapiens
CTGLDTWES

SEQ ID NO: 217810 - protein, 9 aa, Homo Sapiens
WTCGPSTPA

SEQ ID NO: 217811 - protein, 9 aa, Homo Sapiens
WQPGGRSSG

SEQ ID NO: 217812 - protein, 9 aa, Homo Sapiens
LYVEARHLE

SEQ ID NO: 217813 - protein, 9 aa, Homo Sapiens
LQERLDATR

SEQ ID NO: 217814 - protein, 9 aa, Homo Sapiens
RSKIPMKFK

SEQ ID NO: 217815 - protein, 9 aa, Homo Sapiens
GRYLTGGLW

SEQ ID NO: 217816 - protein, 9 aa, Homo Sapiens
VARHHENSS

SEQ ID NO: 217817 - protein, 9 aa, Homo Sapiens
RVFCWRSIN

SEQ ID NO: 217818 - protein, 9 aa, Homo Sapiens
DLLVNDNTD

SEQ ID NO: 217819 - protein, 9 aa, Homo Sapiens
PPANPQLLC

SEQ ID NO: 217820 - protein, 9 aa, Homo Sapiens
GWTPLHCVA

SEQ ID NO: 217821 - protein, 9 aa, Homo Sapiens
YRQYGVYRE

SEQ ID NO: 217822 - protein, 9 aa, Homo Sapiens
LWLVERDPQ

SEQ ID NO: 217823 - protein, 9 aa, Homo Sapiens
IQRTHMPSY

SEQ ID NO: 217824 - protein, 9 aa, Homo Sapiens
PCGCYVLHQ

SEQ ID NO: 217825 - protein, 9 aa, Homo Sapiens
GTLWWASGC

SEQ ID NO: 217826 - protein, 9 aa, Homo Sapiens
CTGRAPNCW

SEQ ID NO: 217827 - protein, 9 aa, Homo Sapiens
FILLVTLVM

SEQ ID NO: 217828 - protein, 9 aa, Homo Sapiens
EKSQIHSIP

SEQ ID NO: 217829 - protein, 9 aa, Homo Sapiens
LKPLSNETA

SEQ ID NO: 217830 - protein, 9 aa, Homo Sapiens
APVCGARGW

SEQ ID NO: 217831 - protein, 9 aa, Homo Sapiens
PACLERDLA

SEQ ID NO: 217832 - protein, 9 aa, Homo Sapiens
ASSGTSAQP

SEQ ID NO: 217833 - protein, 9 aa, Homo Sapiens
RPQPWKRGR

SEQ ID NO: 217834 - protein, 9 aa, Homo Sapiens
RRGVRSFYL

SEQ ID NO: 217835 - protein, 9 aa, Homo Sapiens
SRTPPRRVC

SEQ ID NO: 217836 - protein, 9 aa, Homo Sapiens
HNRVVPGCV

SEQ ID NO: 217837 - protein, 9 aa, Homo Sapiens
KKLKKDTSV

SEQ ID NO: 217838 - protein, 9 aa, Homo Sapiens
CISDGGQSV

SEQ ID NO: 217839 - protein, 9 aa, Homo Sapiens
SKNEYVSLD

SEQ ID NO: 217840 - protein, 9 aa, Homo Sapiens
PVSVYCLQT

SEQ ID NO: 217841 - protein, 9 aa, Homo Sapiens
SVPTPNHTP

SEQ ID NO: 217842 - protein, 9 aa, Homo Sapiens
MLSWGPQWP

SEQ ID NO: 217843 - protein, 9 aa, Homo Sapiens
AFKHKIKHS

SEQ ID NO: 217844 - protein, 9 aa, Homo Sapiens
GSCTGRAPN

SEQ ID NO: 217845 - protein, 9 aa, Homo Sapiens
PRTARGVTA

SEQ ID NO: 217846 - protein, 9 aa, Homo Sapiens
PPTIIKGKR

SEQ ID NO: 217847 - protein, 9 aa, Homo Sapiens
HSDNAELNC

SEQ ID NO: 217848 - protein, 9 aa, Homo Sapiens
TRGCLGNQF

SEQ ID NO: 217849 - protein, 9 aa, Homo Sapiens
GVFAINRAL

SEQ ID NO: 217850 - protein, 9 aa, Homo Sapiens
DTPWLCQST

SEQ ID NO: 217851 - protein, 9 aa, Homo Sapiens
CPAPHRSPP

SEQ ID NO: 217852 - protein, 9 aa, Homo Sapiens
LSDFRAVLV

SEQ ID NO: 217853 - protein, 9 aa, Homo Sapiens
TPDKGWGRG

SEQ ID NO: 217854 - protein, 9 aa, Homo Sapiens
RTSQNHSKC

SEQ ID NO: 217855 - protein, 9 aa, Homo Sapiens
PFLLLDTTA

SEQ ID NO: 217856 - protein, 9 aa, Homo Sapiens
ATGARWPPL

SEQ ID NO: 217857 - protein, 9 aa, Homo Sapiens
GAFLGLLMV

SEQ ID NO: 217858 - protein, 9 aa, Homo Sapiens
SQKPIHSWV

SEQ ID NO: 217859 - protein, 9 aa, Homo Sapiens
ASPPNTHPS

SEQ ID NO: 217860 - protein, 9 aa, Homo Sapiens
HWVFLATHD

SEQ ID NO: 217861 - protein, 9 aa, Homo Sapiens
KHLLDQGQC

SEQ ID NO: 217862 - protein, 9 aa, Homo Sapiens
GRSIGTAKL

SEQ ID NO: 217863 - protein, 9 aa, Homo Sapiens
GQFTVDHGM

SEQ ID NO: 217864 - protein, 9 aa, Homo Sapiens
TLGSLPLSS

SEQ ID NO: 217865 - protein, 9 aa, Homo Sapiens
SMVDLQDAH

SEQ ID NO: 217866 - protein, 9 aa, Homo Sapiens
SGKLTALIH

SEQ ID NO: 217867 - protein, 9 aa, Homo Sapiens
KWRRRIPAG

SEQ ID NO: 217868 - protein, 9 aa, Homo Sapiens
KRAIVRDNK

SEQ ID NO: 217869 - protein, 9 aa, Homo Sapiens
PSNRIRLHR

SEQ ID NO: 217870 - protein, 9 aa, Homo Sapiens
CSGPLQFKR

SEQ ID NO: 217871 - protein, 9 aa, Homo Sapiens
GINDFLVSQ

SEQ ID NO: 217872 - protein, 9 aa, Homo Sapiens
QRVQAEERE

SEQ ID NO: 217873 - protein, 9 aa, Homo Sapiens
NFVEEHMRS

SEQ ID NO: 217874 - protein, 9 aa, Homo Sapiens
LVPPQHCYD

SEQ ID NO: 217875 - protein, 9 aa, Homo Sapiens
PHPPPAAAG

SEQ ID NO: 217876 - protein, 9 aa, Homo Sapiens
GGQAPACLE

SEQ ID NO: 217877 - protein, 9 aa, Homo Sapiens
AEDHPRILQ

SEQ ID NO: 217878 - protein, 9 aa, Homo Sapiens
SHKLTLEFH

SEQ ID NO: 217879 - protein, 9 aa, Homo Sapiens
APMTSATGA

SEQ ID NO: 217880 - protein, 9 aa, Homo Sapiens
EYSLFMFPC

SEQ ID NO: 217881 - protein, 9 aa, Homo Sapiens
GTYNFRMTI

SEQ ID NO: 217882 - protein, 9 aa, Homo Sapiens
KIPLLYLNR

SEQ ID NO: 217883 - protein, 9 aa, Homo Sapiens
CNDHVSTAK

SEQ ID NO: 217884 - protein, 9 aa, Homo Sapiens
LMEHLKKLS

SEQ ID NO: 217885 - protein, 9 aa, Homo Sapiens
VCTNRLLSN

SEQ ID NO: 217886 - protein, 9 aa, Homo Sapiens
TYLTTLTDS

SEQ ID NO: 217887 - protein, 9 aa, Homo Sapiens
CQQQLPSIW

SEQ ID NO: 217888 - protein, 9 aa, Homo Sapiens
FFIPFLNSS

SEQ ID NO: 217889 - protein, 9 aa, Homo Sapiens
WHTLGHAIT

SEQ ID NO: 217890 - protein, 9 aa, Homo Sapiens
VAVASLPDR

SEQ ID NO: 217891 - protein, 9 aa, Homo Sapiens
LNVGAIVLA

SEQ ID NO: 217892 - protein, 9 aa, Homo Sapiens
FLGMVTGAG

SEQ ID NO: 217893 - protein, 9 aa, Homo Sapiens
HVIDFDENT

SEQ ID NO: 217894 - protein, 9 aa, Homo Sapiens
VVWVIGGGG

SEQ ID NO: 217895 - protein, 9 aa, Homo Sapiens
KEPIFQKQA

SEQ ID NO: 217896 - protein, 9 aa, Homo Sapiens
LEGIPAGSP

SEQ ID NO: 217897 - protein, 9 aa, Homo Sapiens
LYGPSCRIL

SEQ ID NO: 217898 - protein, 9 aa, Homo Sapiens
EKMTGSQDL

SEQ ID NO: 217899 - protein, 9 aa, Homo Sapiens
MVIGNRESG

SEQ ID NO: 217900 - protein, 9 aa, Homo Sapiens
RSARLAIEV

SEQ ID NO: 217901 - protein, 9 aa, Homo Sapiens
PNRATQDNP

SEQ ID NO: 217902 - protein, 9 aa, Homo Sapiens
PVTAKSKSA

SEQ ID NO: 217903 - protein, 9 aa, Homo Sapiens
GHPLALAFV

SEQ ID NO: 217904 - protein, 9 aa, Homo Sapiens
ALVPPQHCY

SEQ ID NO: 217905 - protein, 9 aa, Homo Sapiens
KNHRDSEYI

SEQ ID NO: 217906 - protein, 9 aa, Homo Sapiens
WCWLIRVAS

SEQ ID NO: 217907 - protein, 9 aa, Homo Sapiens
PVSMGIAWP

SEQ ID NO: 217908 - protein, 9 aa, Homo Sapiens
RPQLFSPYV

SEQ ID NO: 217909 - protein, 9 aa, Homo Sapiens
QDGWVAIYS

SEQ ID NO: 217910 - protein, 9 aa, Homo Sapiens
VLQAIIGSG

SEQ ID NO: 217911 - protein, 9 aa, Homo Sapiens
AKDELPHVG

SEQ ID NO: 217912 - protein, 9 aa, Homo Sapiens
QGIVGAGLS

SEQ ID NO: 217913 - protein, 9 aa, Homo Sapiens
QRNLLRLQS

SEQ ID NO: 217914 - protein, 9 aa, Homo Sapiens
CPLTAPLAC

SEQ ID NO: 217915 - protein, 9 aa, Homo Sapiens
TSRTSPPAG

SEQ ID NO: 217916 - protein, 9 aa, Homo Sapiens
ALSPHTVDH

SEQ ID NO: 217917 - protein, 9 aa, Homo Sapiens
PSPSSLLSP

SEQ ID NO: 217918 - protein, 9 aa, Homo Sapiens
YHKKTIQNE

SEQ ID NO: 217919 - protein, 9 aa, Homo Sapiens
HYEVFLGNR

SEQ ID NO: 217920 - protein, 9 aa, Homo Sapiens
DRSPLAIQD

SEQ ID NO: 217921 - protein, 9 aa, Homo Sapiens
CSRPFSSAP

SEQ ID NO: 217922 - protein, 9 aa, Homo Sapiens
RKSTPFTGS

SEQ ID NO: 217923 - protein, 9 aa, Homo Sapiens
LGLFEELLE

SEQ ID NO: 217924 - protein, 9 aa, Homo Sapiens
AITWLMWTA

SEQ ID NO: 217925 - protein, 9 aa, Homo Sapiens
SQMQSGMRN

SEQ ID NO: 217926 - protein, 9 aa, Homo Sapiens
SEDTSVQIW

SEQ ID NO: 217927 - protein, 9 aa, Homo Sapiens
KKCYINLWK

SEQ ID NO: 217928 - protein, 9 aa, Homo Sapiens
EQNPEPVNW

SEQ ID NO: 217929 - protein, 9 aa, Homo Sapiens
NVARLCHDN

SEQ ID NO: 217930 - protein, 9 aa, Homo Sapiens
LYEGQITAI

SEQ ID NO: 217931 - protein, 9 aa, Homo Sapiens
LNNKIPLLY

SEQ ID NO: 217932 - protein, 9 aa, Homo Sapiens
PSVKPGWLK

SEQ ID NO: 217933 - protein, 9 aa, Homo Sapiens
GLGRPPRSS

SEQ ID NO: 217934 - protein, 9 aa, Homo Sapiens
IPPASHVCS

SEQ ID NO: 217935 - protein, 9 aa, Homo Sapiens
ESPTIVQGH

SEQ ID NO: 217936 - protein, 9 aa, Homo Sapiens
AMATESSSS

SEQ ID NO: 217937 - protein, 9 aa, Homo Sapiens
TVEHTPIWR

SEQ ID NO: 217938 - protein, 9 aa, Homo Sapiens
AQDGARCPS

SEQ ID NO: 217939 - protein, 9 aa, Homo Sapiens
AECDNENHM

SEQ ID NO: 217940 - protein, 9 aa, Homo Sapiens
TIPGRSTPP

SEQ ID NO: 217941 - protein, 9 aa, Homo Sapiens
MALGPGRGY

SEQ ID NO: 217942 - protein, 9 aa, Homo Sapiens
RRTICSVSG

SEQ ID NO: 217943 - protein, 9 aa, Homo Sapiens
KSYLRELLE

SEQ ID NO: 217944 - protein, 9 aa, Homo Sapiens
PMSDLAEND

SEQ ID NO: 217945 - protein, 9 aa, Homo Sapiens
LTDHCNEVW

SEQ ID NO: 217946 - protein, 9 aa, Homo Sapiens
VVPDTAVLP

SEQ ID NO: 217947 - protein, 9 aa, Homo Sapiens
CTKCDKAFT

SEQ ID NO: 217948 - protein, 9 aa, Homo Sapiens
SLQPPPYHE

SEQ ID NO: 217949 - protein, 9 aa, Homo Sapiens
IQCCTADSQ

SEQ ID NO: 217950 - protein, 9 aa, Homo Sapiens
MKMKRWMRR

SEQ ID NO: 217951 - protein, 9 aa, Homo Sapiens
RTSQGCALL

SEQ ID NO: 217952 - protein, 9 aa, Homo Sapiens
SASMLSATS

SEQ ID NO: 217953 - protein, 9 aa, Homo Sapiens
DDSPESANG

SEQ ID NO: 217954 - protein, 9 aa, Homo Sapiens
SQPPSNRIR

SEQ ID NO: 217955 - protein, 9 aa, Homo Sapiens
SMRSRGESG

SEQ ID NO: 217956 - protein, 9 aa, Homo Sapiens
PKETFLVLS

SEQ ID NO: 217957 - protein, 9 aa, Homo Sapiens
EKKLSRRVC

SEQ ID NO: 217958 - protein, 9 aa, Homo Sapiens
HNLCTHDPT

SEQ ID NO: 217959 - protein, 9 aa, Homo Sapiens
KEPNAGHRT

SEQ ID NO: 217960 - protein, 9 aa, Homo Sapiens
KYIDNLEKN

SEQ ID NO: 217961 - protein, 9 aa, Homo Sapiens
TQRCLRGTP

SEQ ID NO: 217962 - protein, 9 aa, Homo Sapiens
LELYEEVKL

SEQ ID NO: 217963 - protein, 9 aa, Homo Sapiens
PGTFILYKF

SEQ ID NO: 217964 - protein, 9 aa, Homo Sapiens
WPARCDQAT

SEQ ID NO: 217965 - protein, 9 aa, Homo Sapiens
YSCAAGAGT

SEQ ID NO: 217966 - protein, 9 aa, Homo Sapiens
SEITSKGTS

SEQ ID NO: 217967 - protein, 9 aa, Homo Sapiens
IEYSEPWMG

SEQ ID NO: 217968 - protein, 9 aa, Homo Sapiens
LWALCDRDV

SEQ ID NO: 217969 - protein, 9 aa, Homo Sapiens
VDIYRELYA

SEQ ID NO: 217970 - protein, 9 aa, Homo Sapiens
TTGSCCWRG

SEQ ID NO: 217971 - protein, 9 aa, Homo Sapiens
IFFMTTKLP

SEQ ID NO: 217972 - protein, 9 aa, Homo Sapiens
ESNIALRSS

SEQ ID NO: 217973 - protein, 9 aa, Homo Sapiens
EKKVMSNSP

SEQ ID NO: 217974 - protein, 9 aa, Homo Sapiens
DLVSRGFDL

SEQ ID NO: 217975 - protein, 9 aa, Homo Sapiens
RLYILVSTY

SEQ ID NO: 217976 - protein, 9 aa, Homo Sapiens
NTTGCLRKR

SEQ ID NO: 217977 - protein, 9 aa, Homo Sapiens
LMKYCHIKH

SEQ ID NO: 217978 - protein, 9 aa, Homo Sapiens
TASSTRMGS

SEQ ID NO: 217979 - protein, 9 aa, Homo Sapiens
QQQQVSAHQ

SEQ ID NO: 217980 - protein, 9 aa, Homo Sapiens
QHSNSSGFA

SEQ ID NO: 217981 - protein, 9 aa, Homo Sapiens
SMLREWYAH

SEQ ID NO: 217982 - protein, 9 aa, Homo Sapiens
PLPNAIRLH

SEQ ID NO: 217983 - protein, 9 aa, Homo Sapiens
SVCNYYFCI

SEQ ID NO: 217984 - protein, 9 aa, Homo Sapiens
CVNGASKSK

SEQ ID NO: 217985 - protein, 9 aa, Homo Sapiens
TLMSDCWIY

SEQ ID NO: 217986 - protein, 9 aa, Homo Sapiens
QRTHPKGED

SEQ ID NO: 217987 - protein, 9 aa, Homo Sapiens
EDGPPFVEL

SEQ ID NO: 217988 - protein, 9 aa, Homo Sapiens
QNEANFFFQ

SEQ ID NO: 217989 - protein, 9 aa, Homo Sapiens
GLWRRGLGL

SEQ ID NO: 217990 - protein, 9 aa, Homo Sapiens
NTKSARESR

SEQ ID NO: 217991 - protein, 9 aa, Homo Sapiens
PWRKSGSGS

SEQ ID NO: 217992 - protein, 9 aa, Homo Sapiens
QRNWLTVLS

SEQ ID NO: 217993 - protein, 9 aa, Homo Sapiens
YAQRIPTGG

SEQ ID NO: 217994 - protein, 9 aa, Homo Sapiens
TGRHETVHG

SEQ ID NO: 217995 - protein, 9 aa, Homo Sapiens
EALCGMTTE

SEQ ID NO: 217996 - protein, 9 aa, Homo Sapiens
LLMQLQDAK

SEQ ID NO: 217997 - protein, 9 aa, Homo Sapiens
VAEELSGLK

SEQ ID NO: 217998 - protein, 9 aa, Homo Sapiens
GCGGKRNAY

SEQ ID NO: 217999 - protein, 9 aa, Homo Sapiens
RACCAPGGT

SEQ ID NO: 218000 - protein, 9 aa, Homo Sapiens
NHTPWPAQP

SEQ ID NO: 218001 - protein, 9 aa, Homo Sapiens
RLAKDLFYI

SEQ ID NO: 218002 - protein, 9 aa, Homo Sapiens
TRKNGGGLK

SEQ ID NO: 218003 - protein, 9 aa, Homo Sapiens
RNPNGTNPG

SEQ ID NO: 218004 - protein, 9 aa, Homo Sapiens
REMTIIITV

SEQ ID NO: 218005 - protein, 9 aa, Homo Sapiens
DAAKSVVRV

SEQ ID NO: 218006 - protein, 9 aa, Homo Sapiens
TVQTAQELK

SEQ ID NO: 218007 - protein, 9 aa, Homo Sapiens
HSWKTSGPC

SEQ ID NO: 218008 - protein, 9 aa, Homo Sapiens
VKVMGLNPK

SEQ ID NO: 218009 - protein, 9 aa, Homo Sapiens
HSRHCLCKA

SEQ ID NO: 218010 - protein, 9 aa, Homo Sapiens
GSGIGCGFG

SEQ ID NO: 218011 - protein, 9 aa, Homo Sapiens
WEYKMPGGL

SEQ ID NO: 218012 - protein, 9 aa, Homo Sapiens
GSLILLTSS

SEQ ID NO: 218013 - protein, 9 aa, Homo Sapiens
GVCSGNGCL

SEQ ID NO: 218014 - protein, 9 aa, Homo Sapiens
HPKGEDVHS

SEQ ID NO: 218015 - protein, 9 aa, Homo Sapiens
WKHFLSLPE

SEQ ID NO: 218016 - protein, 9 aa, Homo Sapiens
EPGKTSRGH

SEQ ID NO: 218017 - protein, 9 aa, Homo Sapiens
VLLQDTHFG

SEQ ID NO: 218018 - protein, 9 aa, Homo Sapiens
LPVLRTPQP

SEQ ID NO: 218019 - protein, 9 aa, Homo Sapiens
GQTLCSTIS

SEQ ID NO: 218020 - protein, 9 aa, Homo Sapiens
RVPGQAAKD

SEQ ID NO: 218021 - protein, 9 aa, Homo Sapiens
QVCNDVDEC

SEQ ID NO: 218022 - protein, 9 aa, Homo Sapiens
ADCSVEVDE

SEQ ID NO: 218023 - protein, 9 aa, Homo Sapiens
QRALLHSPV

SEQ ID NO: 218024 - protein, 9 aa, Homo Sapiens
PENSRYEVC

SEQ ID NO: 218025 - protein, 9 aa, Homo Sapiens
VLVNHHQQM

SEQ ID NO: 218026 - protein, 9 aa, Homo Sapiens
VEDPLLPGN

SEQ ID NO: 218027 - protein, 9 aa, Homo Sapiens
PAGAAPVCG

SEQ ID NO: 218028 - protein, 9 aa, Homo Sapiens
CPTPSASTH

SEQ ID NO: 218029 - protein, 9 aa, Homo Sapiens
RETRCLAEY

SEQ ID NO: 218030 - protein, 9 aa, Homo Sapiens
DPRAQTLCS

SEQ ID NO: 218031 - protein, 9 aa, Homo Sapiens
SPSMASLCW

SEQ ID NO: 218032 - protein, 9 aa, Homo Sapiens
TTAAGWIGT

SEQ ID NO: 218033 - protein, 9 aa, Homo Sapiens
GLKSWISVP

SEQ ID NO: 218034 - protein, 9 aa, Homo Sapiens
QRQVVLHHP

SEQ ID NO: 218035 - protein, 9 aa, Homo Sapiens
ASSGWAGPA

SEQ ID NO: 218036 - protein, 9 aa, Homo Sapiens
EDSKNIQDR

SEQ ID NO: 218037 - protein, 9 aa, Homo Sapiens
CGTSTIGLA

SEQ ID NO: 218038 - protein, 9 aa, Homo Sapiens
ETNGGTQIQ

SEQ ID NO: 218039 - protein, 9 aa, Homo Sapiens
DEDFESLAS

SEQ ID NO: 218040 - protein, 9 aa, Homo Sapiens
VGVLARPQN

SEQ ID NO: 218041 - protein, 9 aa, Homo Sapiens
STHLHKGDE

SEQ ID NO: 218042 - protein, 9 aa, Homo Sapiens
CVKAFSSSS

SEQ ID NO: 218043 - protein, 9 aa, Homo Sapiens
IHQKDTEGD

SEQ ID NO: 218044 - protein, 9 aa, Homo Sapiens
AFQILAKPE

SEQ ID NO: 218045 - protein, 9 aa, Homo Sapiens
SNGSWWAPS

SEQ ID NO: 218046 - protein, 9 aa, Homo Sapiens
SVQHGSCAL

SEQ ID NO: 218047 - protein, 9 aa, Homo Sapiens
VLGADGQRV

SEQ ID NO: 218048 - protein, 9 aa, Homo Sapiens
DDPDEEVQE

SEQ ID NO: 218049 - protein, 9 aa, Homo Sapiens
AWKHFLSLP

SEQ ID NO: 218050 - protein, 9 aa, Homo Sapiens
FDTIPLMMP

SEQ ID NO: 218051 - protein, 9 aa, Homo Sapiens
KEREEIARH

SEQ ID NO: 218052 - protein, 9 aa, Homo Sapiens
MTYRGERPY

SEQ ID NO: 218053 - protein, 9 aa, Homo Sapiens
LDQGQCPAG

SEQ ID NO: 218054 - protein, 9 aa, Homo Sapiens
CPREEWEMW

SEQ ID NO: 218055 - protein, 9 aa, Homo Sapiens
TPRLPVPAA

SEQ ID NO: 218056 - protein, 9 aa, Homo Sapiens
SCDSCVNSD

SEQ ID NO: 218057 - protein, 9 aa, Homo Sapiens
MGNERYNFP

SEQ ID NO: 218058 - protein, 9 aa, Homo Sapiens
VNKGKQKVL

SEQ ID NO: 218059 - protein, 9 aa, Homo Sapiens
QQTAALAAE

SEQ ID NO: 218060 - protein, 9 aa, Homo Sapiens
FLLFSSASA

SEQ ID NO: 218061 - protein, 9 aa, Homo Sapiens
LAPLQVTTT

SEQ ID NO: 218062 - protein, 9 aa, Homo Sapiens
QLRGQRPAR

SEQ ID NO: 218063 - protein, 9 aa, Homo Sapiens
MGLVTTPVN

SEQ ID NO: 218064 - protein, 9 aa, Homo Sapiens
QNDADINDQ

SEQ ID NO: 218065 - protein, 9 aa, Homo Sapiens
PEVRQSAAY

SEQ ID NO: 218066 - protein, 9 aa, Homo Sapiens
GVTLTFRAL

SEQ ID NO: 218067 - protein, 9 aa, Homo Sapiens
NGMVAVRTV

SEQ ID NO: 218068 - protein, 9 aa, Homo Sapiens
MLMTTSNEG

SEQ ID NO: 218069 - protein, 9 aa, Homo Sapiens
DLSKGRMLK

SEQ ID NO: 218070 - protein, 9 aa, Homo Sapiens
PSIRGVMIV

SEQ ID NO: 218071 - protein, 9 aa, Homo Sapiens
EAVGCQELQ

SEQ ID NO: 218072 - protein, 9 aa, Homo Sapiens
MALKKLLSE

SEQ ID NO: 218073 - protein, 9 aa, Homo Sapiens
RSKISGFDT

SEQ ID NO: 218074 - protein, 9 aa, Homo Sapiens
GAFKHYPIN

SEQ ID NO: 218075 - protein, 9 aa, Homo Sapiens
HHLVPLFIW

SEQ ID NO: 218076 - protein, 9 aa, Homo Sapiens
ASANIFHSG

SEQ ID NO: 218077 - protein, 9 aa, Homo Sapiens
RLWQSPCPA

SEQ ID NO: 218078 - protein, 9 aa, Homo Sapiens
PSFPKAAWQ

SEQ ID NO: 218079 - protein, 9 aa, Homo Sapiens
PSPVTCTHK

SEQ ID NO: 218080 - protein, 9 aa, Homo Sapiens
QAPPSCLRF

SEQ ID NO: 218081 - protein, 9 aa, Homo Sapiens
ELGTQQAGW

SEQ ID NO: 218082 - protein, 9 aa, Homo Sapiens
TQVRSSGSA

SEQ ID NO: 218083 - protein, 9 aa, Homo Sapiens
VEAGEEAQA

SEQ ID NO: 218084 - protein, 9 aa, Homo Sapiens
RKGQLHRAL

SEQ ID NO: 218085 - protein, 9 aa, Homo Sapiens
TVDASRGLR

SEQ ID NO: 218086 - protein, 9 aa, Homo Sapiens
KAPDGHPLW

SEQ ID NO: 218087 - protein, 9 aa, Homo Sapiens
GIVEALCGM

SEQ ID NO: 218088 - protein, 9 aa, Homo Sapiens
FVQDPNNNR

SEQ ID NO: 218089 - protein, 9 aa, Homo Sapiens
RLIKSSSTK

SEQ ID NO: 218090 - protein, 9 aa, Homo Sapiens
PHPHPMSSG

SEQ ID NO: 218091 - protein, 9 aa, Homo Sapiens
GDRSQHGPG

SEQ ID NO: 218092 - protein, 9 aa, Homo Sapiens
EGGKYLTLA

SEQ ID NO: 218093 - protein, 9 aa, Homo Sapiens
KNQVFPCAK

SEQ ID NO: 218094 - protein, 9 aa, Homo Sapiens
EKDVNIIET

SEQ ID NO: 218095 - protein, 9 aa, Homo Sapiens
PGLEKTGMA

SEQ ID NO: 218096 - protein, 9 aa, Homo Sapiens
VNRYTLNNG

SEQ ID NO: 218097 - protein, 9 aa, Homo Sapiens
HCTGARMGK

SEQ ID NO: 218098 - protein, 9 aa, Homo Sapiens
GWERAQKVV

SEQ ID NO: 218099 - protein, 9 aa, Homo Sapiens
TLLQTGEPF

SEQ ID NO: 218100 - protein, 9 aa, Homo Sapiens
QVPVDDWGA

SEQ ID NO: 218101 - protein, 9 aa, Homo Sapiens
GYSTLTRSS

SEQ ID NO: 218102 - protein, 9 aa, Homo Sapiens
ERFMMLYKK

SEQ ID NO: 218103 - protein, 9 aa, Homo Sapiens
WATPGHWGQ

SEQ ID NO: 218104 - protein, 9 aa, Homo Sapiens
DRYMVICYP

SEQ ID NO: 218105 - protein, 9 aa, Homo Sapiens
NSATIFGPN

SEQ ID NO: 218106 - protein, 9 aa, Homo Sapiens
YRLSKNEYV

SEQ ID NO: 218107 - protein, 9 aa, Homo Sapiens
TPVPAAPTS

SEQ ID NO: 218108 - protein, 9 aa, Homo Sapiens
DQTFKILYL

SEQ ID NO: 218109 - protein, 9 aa, Homo Sapiens
GCKNCGSAF

SEQ ID NO: 218110 - protein, 9 aa, Homo Sapiens
QKKTKCQEV

SEQ ID NO: 218111 - protein, 9 aa, Homo Sapiens
ICIREKGGE

SEQ ID NO: 218112 - protein, 9 aa, Homo Sapiens
GEAEAEVNV

SEQ ID NO: 218113 - protein, 9 aa, Homo Sapiens
EEEATRGCL

SEQ ID NO: 218114 - protein, 9 aa, Homo Sapiens
KIQKRSKKV

SEQ ID NO: 218115 - protein, 9 aa, Homo Sapiens
SQGGRILLQ

SEQ ID NO: 218116 - protein, 9 aa, Homo Sapiens
PGGLRLDHA

SEQ ID NO: 218117 - protein, 9 aa, Homo Sapiens
STISCPPLP

SEQ ID NO: 218118 - protein, 9 aa, Homo Sapiens
GPPTRAGPH

SEQ ID NO: 218119 - protein, 9 aa, Homo Sapiens
PPRPRLSGM

SEQ ID NO: 218120 - protein, 9 aa, Homo Sapiens
AGLEGVIMA

SEQ ID NO: 218121 - protein, 9 aa, Homo Sapiens
GVFLDYVNG

SEQ ID NO: 218122 - protein, 9 aa, Homo Sapiens
EGHLVRQDH

SEQ ID NO: 218123 - protein, 9 aa, Homo Sapiens
AYFEASVKL

SEQ ID NO: 218124 - protein, 9 aa, Homo Sapiens
EQSNDYCVV

SEQ ID NO: 218125 - protein, 9 aa, Homo Sapiens
GSQELGFTM

SEQ ID NO: 218126 - protein, 9 aa, Homo Sapiens
AISEELDNT

SEQ ID NO: 218127 - protein, 9 aa, Homo Sapiens
TEVLVNHHQ

SEQ ID NO: 218128 - protein, 9 aa, Homo Sapiens
VVVVFTEEE

SEQ ID NO: 218129 - protein, 9 aa, Homo Sapiens
DMVARESVQ

SEQ ID NO: 218130 - protein, 9 aa, Homo Sapiens
VLWILPLVV

SEQ ID NO: 218131 - protein, 9 aa, Homo Sapiens
REEAMLFTY

SEQ ID NO: 218132 - protein, 9 aa, Homo Sapiens
TSSPNRATQ

SEQ ID NO: 218133 - protein, 9 aa, Homo Sapiens
SQDYQCLMT

SEQ ID NO: 218134 - protein, 9 aa, Homo Sapiens
QWVDSIPDI

SEQ ID NO: 218135 - protein, 9 aa, Homo Sapiens
QCLVVLNQK

SEQ ID NO: 218136 - protein, 9 aa, Homo Sapiens
QGVGSSRLG

SEQ ID NO: 218137 - protein, 9 aa, Homo Sapiens
KQMTLSPLK

SEQ ID NO: 218138 - protein, 9 aa, Homo Sapiens
TSRQATAGG

SEQ ID NO: 218139 - protein, 9 aa, Homo Sapiens
VAAAEPFLL

SEQ ID NO: 218140 - protein, 9 aa, Homo Sapiens
VLLLGVPQT

SEQ ID NO: 218141 - protein, 9 aa, Homo Sapiens
LLSPCNASI

SEQ ID NO: 218142 - protein, 9 aa, Homo Sapiens
RHEVLVLDE

SEQ ID NO: 218143 - protein, 9 aa, Homo Sapiens
WAPLWTCLL

SEQ ID NO: 218144 - protein, 9 aa, Homo Sapiens
ARIRAARET

SEQ ID NO: 218145 - protein, 9 aa, Homo Sapiens
SSFCCCTQD

SEQ ID NO: 218146 - protein, 9 aa, Homo Sapiens
GCLPPEPGD

SEQ ID NO: 218147 - protein, 9 aa, Homo Sapiens
VAPRQTPGQ

SEQ ID NO: 218148 - protein, 9 aa, Homo Sapiens
FMVTMAVII

SEQ ID NO: 218149 - protein, 9 aa, Homo Sapiens
GKLSTWPSN

SEQ ID NO: 218150 - protein, 9 aa, Homo Sapiens
NEVGVDVNC

SEQ ID NO: 218151 - protein, 9 aa, Homo Sapiens
EGSHTGEKP

SEQ ID NO: 218152 - protein, 9 aa, Homo Sapiens
ILLTSSPVT

SEQ ID NO: 218153 - protein, 9 aa, Homo Sapiens
DPPELSQIP

SEQ ID NO: 218154 - protein, 9 aa, Homo Sapiens
SGHCLCRSG

SEQ ID NO: 218155 - protein, 9 aa, Homo Sapiens
NEPSRCQRA

SEQ ID NO: 218156 - protein, 9 aa, Homo Sapiens
GSCCWRGWP

SEQ ID NO: 218157 - protein, 9 aa, Homo Sapiens
VQLPLGLAA

SEQ ID NO: 218158 - protein, 9 aa, Homo Sapiens
PYTLTGGHH

SEQ ID NO: 218159 - protein, 9 aa, Homo Sapiens
TATARSLAH

SEQ ID NO: 218160 - protein, 9 aa, Homo Sapiens
DAEVWFNEK

SEQ ID NO: 218161 - protein, 9 aa, Homo Sapiens
LSYDSTLEV

SEQ ID NO: 218162 - protein, 9 aa, Homo Sapiens
VTLELGGRT

SEQ ID NO: 218163 - protein, 9 aa, Homo Sapiens
PRTPRASSG

SEQ ID NO: 218164 - protein, 9 aa, Homo Sapiens
NAVHAIVPN

SEQ ID NO: 218165 - protein, 9 aa, Homo Sapiens
LKDIIEKTS

SEQ ID NO: 218166 - protein, 9 aa, Homo Sapiens
WQFLLKWSF

SEQ ID NO: 218167 - protein, 9 aa, Homo Sapiens
SKTQTMSAH

SEQ ID NO: 218168 - protein, 9 aa, Homo Sapiens
PLSLWKRLK

SEQ ID NO: 218169 - protein, 9 aa, Homo Sapiens
VIHTSHNTL

SEQ ID NO: 218170 - protein, 9 aa, Homo Sapiens
GVVFPCQPS

SEQ ID NO: 218171 - protein, 9 aa, Homo Sapiens
HCLPSPPRG

SEQ ID NO: 218172 - protein, 9 aa, Homo Sapiens
DIEIWERIG

SEQ ID NO: 218173 - protein, 9 aa, Homo Sapiens
ATVPRHSSV

SEQ ID NO: 218174 - protein, 9 aa, Homo Sapiens
RSTLSLSGG

SEQ ID NO: 218175 - protein, 9 aa, Homo Sapiens
SVSGRGSCT

SEQ ID NO: 218176 - protein, 9 aa, Homo Sapiens
VGGPWATGP

SEQ ID NO: 218177 - protein, 9 aa, Homo Sapiens
AIEVLERAK

SEQ ID NO: 218178 - protein, 9 aa, Homo Sapiens
FKTEEYVAG

SEQ ID NO: 218179 - protein, 9 aa, Homo Sapiens
YECGGQRVS

SEQ ID NO: 218180 - protein, 9 aa, Homo Sapiens
AAPALPTST

SEQ ID NO: 218181 - protein, 9 aa, Homo Sapiens
PPPPTKKRG

SEQ ID NO: 218182 - protein, 9 aa, Homo Sapiens
FEAVAPFMT

SEQ ID NO: 218183 - protein, 9 aa, Homo Sapiens
RPIYPNHRE

SEQ ID NO: 218184 - protein, 9 aa, Homo Sapiens
KNWVYSHNG

SEQ ID NO: 218185 - protein, 9 aa, Homo Sapiens
EHLSHIGVE

SEQ ID NO: 218186 - protein, 9 aa, Homo Sapiens
NTPRLQVHC

SEQ ID NO: 218187 - protein, 9 aa, Homo Sapiens
GIGVHPHPH

SEQ ID NO: 218188 - protein, 9 aa, Homo Sapiens
RRCWTGAVC

SEQ ID NO: 218189 - protein, 9 aa, Homo Sapiens
RGAAPLSPL

SEQ ID NO: 218190 - protein, 9 aa, Homo Sapiens
ALVSWKQSQ

SEQ ID NO: 218191 - protein, 9 aa, Homo Sapiens
SMLSKVVHS

SEQ ID NO: 218192 - protein, 9 aa, Homo Sapiens
ASVSVLSLI

SEQ ID NO: 218193 - protein, 9 aa, Homo Sapiens
GTAKLRLVE

SEQ ID NO: 218194 - protein, 9 aa, Homo Sapiens
EINRMIQML

SEQ ID NO: 218195 - protein, 9 aa, Homo Sapiens
PQRPGWAPC

SEQ ID NO: 218196 - protein, 9 aa, Homo Sapiens
GPARSGNPT

SEQ ID NO: 218197 - protein, 9 aa, Homo Sapiens
DSVPHGADL

SEQ ID NO: 218198 - protein, 9 aa, Homo Sapiens
IFIPRSPLS

SEQ ID NO: 218199 - protein, 9 aa, Homo Sapiens
VIIFSLATE

SEQ ID NO: 218200 - protein, 9 aa, Homo Sapiens
RLWPHSKQP

SEQ ID NO: 218201 - protein, 9 aa, Homo Sapiens
FPYFEASDY

SEQ ID NO: 218202 - protein, 9 aa, Homo Sapiens
KCQKPVTAK

SEQ ID NO: 218203 - protein, 9 aa, Homo Sapiens
SCVSLLIQH

SEQ ID NO: 218204 - protein, 9 aa, Homo Sapiens
ISEGHQLLI

SEQ ID NO: 218205 - protein, 9 aa, Homo Sapiens
LMSHSHLRY

SEQ ID NO: 218206 - protein, 9 aa, Homo Sapiens
PGAPPCQSA

SEQ ID NO: 218207 - protein, 8 aa, Homo Sapiens
EWKLERTA

SEQ ID NO: 218208 - protein, 9 aa, Homo Sapiens
TTGCCSAAS

SEQ ID NO: 218209 - protein, 9 aa, Homo Sapiens
DYQCLMTVA

SEQ ID NO: 218210 - protein, 9 aa, Homo Sapiens
GPPSSSRTP

SEQ ID NO: 218211 - protein, 9 aa, Homo Sapiens
TTIYMLTHK

SEQ ID NO: 218212 - protein, 9 aa, Homo Sapiens
WERIGKDPA

SEQ ID NO: 218213 - protein, 9 aa, Homo Sapiens
MMSSGFSGS

SEQ ID NO: 218214 - protein, 9 aa, Homo Sapiens
APHCTNSHL

SEQ ID NO: 218215 - protein, 9 aa, Homo Sapiens
LLTTTCSRR

SEQ ID NO: 218216 - protein, 9 aa, Homo Sapiens
LPCTFLKNL

SEQ ID NO: 218217 - protein, 9 aa, Homo Sapiens
CHKHLMKRY

SEQ ID NO: 218218 - protein, 9 aa, Homo Sapiens
RKYNQKEFQ

SEQ ID NO: 218219 - protein, 9 aa, Homo Sapiens
EAPRYTVKS

SEQ ID NO: 218220 - protein, 9 aa, Homo Sapiens
GVPLIIGAV

SEQ ID NO: 218221 - protein, 9 aa, Homo Sapiens
EQQTAALAA

SEQ ID NO: 218222 - protein, 9 aa, Homo Sapiens
SSPLPPPLP

SEQ ID NO: 218223 - protein, 9 aa, Homo Sapiens
IAALLQTCL

SEQ ID NO: 218224 - protein, 9 aa, Homo Sapiens
DALFAQKVR

SEQ ID NO: 218225 - protein, 9 aa, Homo Sapiens
ERQERHIQV

SEQ ID NO: 218226 - protein, 9 aa, Homo Sapiens
NCQSYGKTF

SEQ ID NO: 218227 - protein, 9 aa, Homo Sapiens
HVHPRNGLH

SEQ ID NO: 218228 - protein, 9 aa, Homo Sapiens
SGCKVHQWV

SEQ ID NO: 218229 - protein, 9 aa, Homo Sapiens
APRRPRCSS

SEQ ID NO: 218230 - protein, 9 aa, Homo Sapiens
TEVCSVGPL

SEQ ID NO: 218231 - protein, 9 aa, Homo Sapiens
LLDPPETLN

SEQ ID NO: 218232 - protein, 9 aa, Homo Sapiens
DLILQQLNQ

SEQ ID NO: 218233 - protein, 9 aa, Homo Sapiens
LSSVAQTHQ

SEQ ID NO: 218234 - protein, 9 aa, Homo Sapiens
APKWRRRIP

SEQ ID NO: 218235 - protein, 9 aa, Homo Sapiens
LTLAVKNSK

SEQ ID NO: 218236 - protein, 9 aa, Homo Sapiens
EHGCQFMDN

SEQ ID NO: 218237 - protein, 9 aa, Homo Sapiens
LKLTLKMIL

SEQ ID NO: 218238 - protein, 9 aa, Homo Sapiens
DTETPLALT

SEQ ID NO: 218239 - protein, 9 aa, Homo Sapiens
SSRTTWGPA

SEQ ID NO: 218240 - protein, 9 aa, Homo Sapiens
ETTTEMISA

SEQ ID NO: 218241 - protein, 9 aa, Homo Sapiens
CQVKKSNTS

SEQ ID NO: 218242 - protein, 9 aa, Homo Sapiens
SPSTGDPAG

SEQ ID NO: 218243 - protein, 9 aa, Homo Sapiens
MMIGSQHLL

SEQ ID NO: 218244 - protein, 9 aa, Homo Sapiens
GTKSTPWQP

SEQ ID NO: 218245 - protein, 9 aa, Homo Sapiens
VPGASNGLL

SEQ ID NO: 218246 - protein, 9 aa, Homo Sapiens
LGYPVSTWS

SEQ ID NO: 218247 - protein, 9 aa, Homo Sapiens
NEDGVAGQV

SEQ ID NO: 218248 - protein, 9 aa, Homo Sapiens
SRRVPRGSC

SEQ ID NO: 218249 - protein, 9 aa, Homo Sapiens
YTVYSSSSA

SEQ ID NO: 218250 - protein, 9 aa, Homo Sapiens
QGHNSSGAL

SEQ ID NO: 218251 - protein, 9 aa, Homo Sapiens
APERGFPAW

SEQ ID NO: 218252 - protein, 9 aa, Homo Sapiens
GCVCGVAYR

SEQ ID NO: 218253 - protein, 9 aa, Homo Sapiens
NKKEVGFFQ

SEQ ID NO: 218254 - protein, 9 aa, Homo Sapiens
PATAHPNLL

SEQ ID NO: 218255 - protein, 9 aa, Homo Sapiens
GPPQGQARD

SEQ ID NO: 218256 - protein, 9 aa, Homo Sapiens
ILYLVILQT

SEQ ID NO: 218257 - protein, 9 aa, Homo Sapiens
RDWYQQQLH

SEQ ID NO: 218258 - protein, 9 aa, Homo Sapiens
VAAVVGIGV

SEQ ID NO: 218259 - protein, 9 aa, Homo Sapiens
HMYNLVSRI

SEQ ID NO: 218260 - protein, 9 aa, Homo Sapiens
CFLSALNLK

SEQ ID NO: 218261 - protein, 9 aa, Homo Sapiens
PEWGEQIVF

SEQ ID NO: 218262 - protein, 9 aa, Homo Sapiens
LVVEHVPAV

SEQ ID NO: 218263 - protein, 9 aa, Homo Sapiens
TASTSPPPP

SEQ ID NO: 218264 - protein, 9 aa, Homo Sapiens
SVDRCALDN

SEQ ID NO: 218265 - protein, 9 aa, Homo Sapiens
PRAQTLCSV

SEQ ID NO: 218266 - protein, 9 aa, Homo Sapiens
LPLITNNMV

SEQ ID NO: 218267 - protein, 9 aa, Homo Sapiens
DPNTMYSFL

SEQ ID NO: 218268 - protein, 9 aa, Homo Sapiens
ERLLFIIDS

SEQ ID NO: 218269 - protein, 9 aa, Homo Sapiens
RPRRKPRPL

SEQ ID NO: 218270 - protein, 9 aa, Homo Sapiens
ADDVKIFHG

SEQ ID NO: 218271 - protein, 9 aa, Homo Sapiens
FAPGTLYKP

SEQ ID NO: 218272 - protein, 9 aa, Homo Sapiens
GSLPLSSSQ

SEQ ID NO: 218273 - protein, 9 aa, Homo Sapiens
KKKSTKKIL

SEQ ID NO: 218274 - protein, 9 aa, Homo Sapiens
CEPEPSCLQ

SEQ ID NO: 218275 - protein, 9 aa, Homo Sapiens
SPCNASIMC

SEQ ID NO: 218276 - protein, 9 aa, Homo Sapiens
WLTVLSCWT

SEQ ID NO: 218277 - protein, 9 aa, Homo Sapiens
QQEPAAMTQ

SEQ ID NO: 218278 - protein, 9 aa, Homo Sapiens
CGTCPTAST

SEQ ID NO: 218279 - protein, 9 aa, Homo Sapiens
TFPSSVLTL

SEQ ID NO: 218280 - protein, 9 aa, Homo Sapiens
RLVLTDEKS

SEQ ID NO: 218281 - protein, 9 aa, Homo Sapiens
LDDVITDIE

SEQ ID NO: 218282 - protein, 9 aa, Homo Sapiens
CIQPLLDGT

SEQ ID NO: 218283 - protein, 9 aa, Homo Sapiens
LPASMRWRS

SEQ ID NO: 218284 - protein, 9 aa, Homo Sapiens
FTVNMSKVE

SEQ ID NO: 218285 - protein, 9 aa, Homo Sapiens
CIVCVAYAT

SEQ ID NO: 218286 - protein, 9 aa, Homo Sapiens
GPRLSQVAG

SEQ ID NO: 218287 - protein, 9 aa, Homo Sapiens
TALLNVPNI

SEQ ID NO: 218288 - protein, 9 aa, Homo Sapiens
QFERVLLKW

SEQ ID NO: 218289 - protein, 9 aa, Homo Sapiens
KHLRWIGRE

SEQ ID NO: 218290 - protein, 9 aa, Homo Sapiens
VFPLPFNMA

SEQ ID NO: 218291 - protein, 9 aa, Homo Sapiens
HPNLLLTAD

SEQ ID NO: 218292 - protein, 9 aa, Homo Sapiens
PALPTSTLR

SEQ ID NO: 218293 - protein, 9 aa, Homo Sapiens
LTGTTAAGW

SEQ ID NO: 218294 - protein, 9 aa, Homo Sapiens
EEDAVNDVQ

SEQ ID NO: 218295 - protein, 9 aa, Homo Sapiens
DENRRLQRT

SEQ ID NO: 218296 - protein, 9 aa, Homo Sapiens
PAPWAERDR

SEQ ID NO: 218297 - protein, 9 aa, Homo Sapiens
LPPCTALVE

SEQ ID NO: 218298 - protein, 9 aa, Homo Sapiens
VSTYNPQVI

SEQ ID NO: 218299 - protein, 9 aa, Homo Sapiens
HKSYRPLCA

SEQ ID NO: 218300 - protein, 9 aa, Homo Sapiens
SPASPSDCP

SEQ ID NO: 218301 - protein, 9 aa, Homo Sapiens
LLRGLFGVV

SEQ ID NO: 218302 - protein, 9 aa, Homo Sapiens
LGGPKRSAR

SEQ ID NO: 218303 - protein, 9 aa, Homo Sapiens
EDMDLDDWE

SEQ ID NO: 218304 - protein, 9 aa, Homo Sapiens
WRAQSAPRR

SEQ ID NO: 218305 - protein, 9 aa, Homo Sapiens
GGGIQRNLS

SEQ ID NO: 218306 - protein, 9 aa, Homo Sapiens
APSRGSRCL

SEQ ID NO: 218307 - protein, 9 aa, Homo Sapiens
CCTEMQLKD

SEQ ID NO: 218308 - protein, 9 aa, Homo Sapiens
RKTFSQSTK

SEQ ID NO: 218309 - protein, 9 aa, Homo Sapiens
APGSPYVSW

SEQ ID NO: 218310 - protein, 9 aa, Homo Sapiens
NMSKVETGL

SEQ ID NO: 218311 - protein, 9 aa, Homo Sapiens
AAPGMPRPH

SEQ ID NO: 218312 - protein, 9 aa, Homo Sapiens
KGACTADKP

SEQ ID NO: 218313 - protein, 9 aa, Homo Sapiens
LSLGYVASL

SEQ ID NO: 218314 - protein, 9 aa, Homo Sapiens
NQKIRSSSR

SEQ ID NO: 218315 - protein, 9 aa, Homo Sapiens
GSVGIIKKM

SEQ ID NO: 218316 - protein, 9 aa, Homo Sapiens
VVLCRVGAR

SEQ ID NO: 218317 - protein, 9 aa, Homo Sapiens
SRLSEAGRY

SEQ ID NO: 218318 - protein, 9 aa, Homo Sapiens
RYVYSTPLR

SEQ ID NO: 218319 - protein, 9 aa, Homo Sapiens
LSLYSVAVW

SEQ ID NO: 218320 - protein, 9 aa, Homo Sapiens
LHRQISLPL

SEQ ID NO: 218321 - protein, 9 aa, Homo Sapiens
QAPQLLPPA

SEQ ID NO: 218322 - protein, 9 aa, Homo Sapiens
VARTVICMT

SEQ ID NO: 218323 - protein, 9 aa, Homo Sapiens
INHLCCLVF

SEQ ID NO: 218324 - protein, 9 aa, Homo Sapiens
DGDGDKDGP

SEQ ID NO: 218325 - protein, 9 aa, Homo Sapiens
SVKGGAEIN

SEQ ID NO: 218326 - protein, 9 aa, Homo Sapiens
VCYQQVPWY

SEQ ID NO: 218327 - protein, 9 aa, Homo Sapiens
VEVPGSHLH

SEQ ID NO: 218328 - protein, 9 aa, Homo Sapiens
ELVIQYNKN

SEQ ID NO: 218329 - protein, 9 aa, Homo Sapiens
EELKKQMQH

SEQ ID NO: 218330 - protein, 9 aa, Homo Sapiens
TVIEHAVRA

SEQ ID NO: 218331 - protein, 9 aa, Homo Sapiens
QGAPWLWPA

SEQ ID NO: 218332 - protein, 9 aa, Homo Sapiens
MTLVTVQRS

SEQ ID NO: 218333 - protein, 9 aa, Homo Sapiens
GSCALATKD

SEQ ID NO: 218334 - protein, 9 aa, Homo Sapiens
EGHACECDV

SEQ ID NO: 218335 - protein, 9 aa, Homo Sapiens
DQVLHRLTV

SEQ ID NO: 218336 - protein, 9 aa, Homo Sapiens
NIIAWEYKM

SEQ ID NO: 218337 - protein, 9 aa, Homo Sapiens
TGWWTPWSP

SEQ ID NO: 218338 - protein, 9 aa, Homo Sapiens
GVEDFWEVD

SEQ ID NO: 218339 - protein, 9 aa, Homo Sapiens
KINHLCCLV

SEQ ID NO: 218340 - protein, 9 aa, Homo Sapiens
LSIQTQGSS

SEQ ID NO: 218341 - protein, 9 aa, Homo Sapiens
FQHAGQEKD

SEQ ID NO: 218342 - protein, 9 aa, Homo Sapiens
SLNQGIPGR

SEQ ID NO: 218343 - protein, 9 aa, Homo Sapiens
AHYEVFLGN

SEQ ID NO: 218344 - protein, 9 aa, Homo Sapiens
QPGEEGAAW

SEQ ID NO: 218345 - protein, 9 aa, Homo Sapiens
SSAHHLVPG

SEQ ID NO: 218346 - protein, 9 aa, Homo Sapiens
EEGSKPPNS

SEQ ID NO: 218347 - protein, 9 aa, Homo Sapiens
SAPAAAPPP

SEQ ID NO: 218348 - protein, 9 aa, Homo Sapiens
GFAGDDAPG

SEQ ID NO: 218349 - protein, 9 aa, Homo Sapiens
CDAGNEEIP

SEQ ID NO: 218350 - protein, 9 aa, Homo Sapiens
DYFLFLQML

SEQ ID NO: 218351 - protein, 9 aa, Homo Sapiens
ASCPAPHRS

SEQ ID NO: 218352 - protein, 9 aa, Homo Sapiens
HLTEGSQKC

SEQ ID NO: 218353 - protein, 9 aa, Homo Sapiens
RPTSQGERM

SEQ ID NO: 218354 - protein, 9 aa, Homo Sapiens
IWHNLSLNR

SEQ ID NO: 218355 - protein, 9 aa, Homo Sapiens
AQKKGRRSI

SEQ ID NO: 218356 - protein, 9 aa, Homo Sapiens
PTGLYCFPS

SEQ ID NO: 218357 - protein, 9 aa, Homo Sapiens
IMCPLNPAA

SEQ ID NO: 218358 - protein, 9 aa, Homo Sapiens
TVTAGQTQT

SEQ ID NO: 218359 - protein, 9 aa, Homo Sapiens
VNFVEEHMR

SEQ ID NO: 218360 - protein, 9 aa, Homo Sapiens
WLCQSTEPG

SEQ ID NO: 218361 - protein, 9 aa, Homo Sapiens
CQRMCQPLQ

SEQ ID NO: 218362 - protein, 9 aa, Homo Sapiens
SPTPTSALA

SEQ ID NO: 218363 - protein, 9 aa, Homo Sapiens
GVYGCQGYC

SEQ ID NO: 218364 - protein, 9 aa, Homo Sapiens
RPTTVRKAK

SEQ ID NO: 218365 - protein, 9 aa, Homo Sapiens
VAYHADDVK

SEQ ID NO: 218366 - protein, 9 aa, Homo Sapiens
CLINEHKRK

SEQ ID NO: 218367 - protein, 9 aa, Homo Sapiens
LSSPRPSQL

SEQ ID NO: 218368 - protein, 9 aa, Homo Sapiens
WWISNDRLG

SEQ ID NO: 218369 - protein, 9 aa, Homo Sapiens
VKTYSWQCI

SEQ ID NO: 218370 - protein, 9 aa, Homo Sapiens
AEPKVNQGN

SEQ ID NO: 218371 - protein, 9 aa, Homo Sapiens
LLDQGQCPA

SEQ ID NO: 218372 - protein, 9 aa, Homo Sapiens
ACLERDLAP

SEQ ID NO: 218373 - protein, 9 aa, Homo Sapiens
QLPTPPPGP

SEQ ID NO: 218374 - protein, 9 aa, Homo Sapiens
MPGSEIPPP

SEQ ID NO: 218375 - protein, 9 aa, Homo Sapiens
VEVQTEYVP

SEQ ID NO: 218376 - protein, 9 aa, Homo Sapiens
LKPPGRGGS

SEQ ID NO: 218377 - protein, 9 aa, Homo Sapiens
SHKSCKLRI

SEQ ID NO: 218378 - protein, 9 aa, Homo Sapiens
RVAYLISAR

SEQ ID NO: 218379 - protein, 9 aa, Homo Sapiens
FSRDGLSED

SEQ ID NO: 218380 - protein, 9 aa, Homo Sapiens
AGCRTQLVD

SEQ ID NO: 218381 - protein, 9 aa, Homo Sapiens
TFAATWPSS

SEQ ID NO: 218382 - protein, 9 aa, Homo Sapiens
PTHLPSAPA

SEQ ID NO: 218383 - protein, 9 aa, Homo Sapiens
MIDRSECDQ

SEQ ID NO: 218384 - protein, 9 aa, Homo Sapiens
TRERAAAAL

SEQ ID NO: 218385 - protein, 9 aa, Homo Sapiens
KINPSHHSR

SEQ ID NO: 218386 - protein, 9 aa, Homo Sapiens
PMCSEQTRL

SEQ ID NO: 218387 - protein, 9 aa, Homo Sapiens
EPSRCQRAI

SEQ ID NO: 218388 - protein, 9 aa, Homo Sapiens
GARGWGRRW

SEQ ID NO: 218389 - protein, 9 aa, Homo Sapiens
EKCARRLAK

SEQ ID NO: 218390 - protein, 9 aa, Homo Sapiens
PWAAAWGPA

SEQ ID NO: 218391 - protein, 9 aa, Homo Sapiens
CWLLCGTED

SEQ ID NO: 218392 - protein, 9 aa, Homo Sapiens
LLIVLCALA

SEQ ID NO: 218393 - protein, 9 aa, Homo Sapiens
LKSCTQRKT

SEQ ID NO: 218394 - protein, 9 aa, Homo Sapiens
GLLEVEVLQ

SEQ ID NO: 218395 - protein, 9 aa, Homo Sapiens
RVPVFGWVM

SEQ ID NO: 218396 - protein, 9 aa, Homo Sapiens
LEDYKKTTR

SEQ ID NO: 218397 - protein, 9 aa, Homo Sapiens
DDAPGLSSP

SEQ ID NO: 218398 - protein, 9 aa, Homo Sapiens
VAYFEASVK

SEQ ID NO: 218399 - protein, 9 aa, Homo Sapiens
WFVEGFPWQ

SEQ ID NO: 218400 - protein, 9 aa, Homo Sapiens
FVPMSLACS

SEQ ID NO: 218401 - protein, 9 aa, Homo Sapiens
PCWSLSEYT

SEQ ID NO: 218402 - protein, 9 aa, Homo Sapiens
LGPGRGYRA

SEQ ID NO: 218403 - protein, 9 aa, Homo Sapiens
GGQPSRDCS

SEQ ID NO: 218404 - protein, 9 aa, Homo Sapiens
WNEALGTES

SEQ ID NO: 218405 - protein, 9 aa, Homo Sapiens
KDKKENKKK

SEQ ID NO: 218406 - protein, 9 aa, Homo Sapiens
QIKKKPEEF

SEQ ID NO: 218407 - protein, 9 aa, Homo Sapiens
TSSAHSSDI

SEQ ID NO: 218408 - protein, 9 aa, Homo Sapiens
LSGKLTALI

SEQ ID NO: 218409 - protein, 9 aa, Homo Sapiens
PLLWLPCTT

SEQ ID NO: 218410 - protein, 9 aa, Homo Sapiens
DIPAHEVTG

SEQ ID NO: 218411 - protein, 9 aa, Homo Sapiens
EQLENGMVA

SEQ ID NO: 218412 - protein, 9 aa, Homo Sapiens
WAMGSRWAL

SEQ ID NO: 218413 - protein, 9 aa, Homo Sapiens
ALTYIVFVL

SEQ ID NO: 218414 - protein, 9 aa, Homo Sapiens
NRRKEGKLF

SEQ ID NO: 218415 - protein, 9 aa, Homo Sapiens
NRMIQMLRS

SEQ ID NO: 218416 - protein, 9 aa, Homo Sapiens
GMEPGADRE

SEQ ID NO: 218417 - protein, 9 aa, Homo Sapiens
SPSLRAYPP

SEQ ID NO: 218418 - protein, 9 aa, Homo Sapiens
GLKRSSSFS

SEQ ID NO: 218419 - protein, 9 aa, Homo Sapiens
GVFTFGLFA

SEQ ID NO: 218420 - protein, 9 aa, Homo Sapiens
PPLRRQTSI

SEQ ID NO: 218421 - protein, 9 aa, Homo Sapiens
ASVSHHYGS

SEQ ID NO: 218422 - protein, 9 aa, Homo Sapiens
ASSFVVDFN

SEQ ID NO: 218423 - protein, 9 aa, Homo Sapiens
CILDTTKLR

SEQ ID NO: 218424 - protein, 9 aa, Homo Sapiens
TEIREKGSA

SEQ ID NO: 218425 - protein, 9 aa, Homo Sapiens
GRKKSRLPH

SEQ ID NO: 218426 - protein, 9 aa, Homo Sapiens
SCALATKDM

SEQ ID NO: 218427 - protein, 9 aa, Homo Sapiens
HPLLKGVLG

SEQ ID NO: 218428 - protein, 9 aa, Homo Sapiens
HLSHIGVER

SEQ ID NO: 218429 - protein, 9 aa, Homo Sapiens
NLDRPPLQD

SEQ ID NO: 218430 - protein, 9 aa, Homo Sapiens
QNPPRPRLS

SEQ ID NO: 218431 - protein, 9 aa, Homo Sapiens
AERQERAVA

SEQ ID NO: 218432 - protein, 9 aa, Homo Sapiens
LNLCQRTER

SEQ ID NO: 218433 - protein, 9 aa, Homo Sapiens
RKARMEGQP

SEQ ID NO: 218434 - protein, 9 aa, Homo Sapiens
HQWVDSIPD

SEQ ID NO: 218435 - protein, 9 aa, Homo Sapiens
GRRSISLLR

SEQ ID NO: 218436 - protein, 9 aa, Homo Sapiens
PRCSSSSAA

SEQ ID NO: 218437 - protein, 9 aa, Homo Sapiens
VDMAITEHP

SEQ ID NO: 218438 - protein, 9 aa, Homo Sapiens
RRGEPVLLL

SEQ ID NO: 218439 - protein, 9 aa, Homo Sapiens
IALGKPLYR

SEQ ID NO: 218440 - protein, 9 aa, Homo Sapiens
YTHGLRCQR

SEQ ID NO: 218441 - protein, 9 aa, Homo Sapiens
RAGGHRPDL

SEQ ID NO: 218442 - protein, 9 aa, Homo Sapiens
PLIIGAVIL

SEQ ID NO: 218443 - protein, 9 aa, Homo Sapiens
ASAQSTAQA

SEQ ID NO: 218444 - protein, 9 aa, Homo Sapiens
GYTYCVWFV

SEQ ID NO: 218445 - protein, 9 aa, Homo Sapiens
QLRLVDGVT

SEQ ID NO: 218446 - protein, 9 aa, Homo Sapiens
LSSSNVCVI

SEQ ID NO: 218447 - protein, 9 aa, Homo Sapiens
GTTQGNRDY

SEQ ID NO: 218448 - protein, 9 aa, Homo Sapiens
LRHLDFKVV

SEQ ID NO: 218449 - protein, 9 aa, Homo Sapiens
SIRYSPLTT

SEQ ID NO: 218450 - protein, 9 aa, Homo Sapiens
QAPQVAMLP

SEQ ID NO: 218451 - protein, 9 aa, Homo Sapiens
LVRPREEDN

SEQ ID NO: 218452 - protein, 9 aa, Homo Sapiens
LKDQVGGTS

SEQ ID NO: 218453 - protein, 9 aa, Homo Sapiens
VAHTFLLMP

SEQ ID NO: 218454 - protein, 9 aa, Homo Sapiens
GQGSVLLWR

SEQ ID NO: 218455 - protein, 9 aa, Homo Sapiens
SAARGRCGT

SEQ ID NO: 218456 - protein, 9 aa, Homo Sapiens
RSGPCEMAE

SEQ ID NO: 218457 - protein, 9 aa, Homo Sapiens
KVCHGALTC

SEQ ID NO: 218458 - protein, 9 aa, Homo Sapiens
YSQKSIFEA

SEQ ID NO: 218459 - protein, 9 aa, Homo Sapiens
PLPFSTVRL

SEQ ID NO: 218460 - protein, 9 aa, Homo Sapiens
TVSSCTGLD

SEQ ID NO: 218461 - protein, 9 aa, Homo Sapiens
KKQELEKWL

SEQ ID NO: 218462 - protein, 9 aa, Homo Sapiens
FTSGTVIPS

SEQ ID NO: 218463 - protein, 9 aa, Homo Sapiens
PKTSTHCPL

SEQ ID NO: 218464 - protein, 9 aa, Homo Sapiens
FVVNGPASE

SEQ ID NO: 218465 - protein, 9 aa, Homo Sapiens
PDGTVDTIG

SEQ ID NO: 218466 - protein, 9 aa, Homo Sapiens
MFDCMNVLS

SEQ ID NO: 218467 - protein, 9 aa, Homo Sapiens
TLFEHLSHI

SEQ ID NO: 218468 - protein, 9 aa, Homo Sapiens
SRASQPSSS

SEQ ID NO: 218469 - protein, 9 aa, Homo Sapiens
AKKPFKQVL

SEQ ID NO: 218470 - protein, 9 aa, Homo Sapiens
SSWTPGRRG

SEQ ID NO: 218471 - protein, 9 aa, Homo Sapiens
ECVKAFSSS

SEQ ID NO: 218472 - protein, 9 aa, Homo Sapiens
LSRSSPKRD

SEQ ID NO: 218473 - protein, 9 aa, Homo Sapiens
YKIPLPVGA

SEQ ID NO: 218474 - protein, 9 aa, Homo Sapiens
MGVEEEEDD

SEQ ID NO: 218475 - protein, 9 aa, Homo Sapiens
AKSVVRVLF

SEQ ID NO: 218476 - protein, 9 aa, Homo Sapiens
LVKTWTQFR

SEQ ID NO: 218477 - protein, 9 aa, Homo Sapiens
KLQSSLKNW

SEQ ID NO: 218478 - protein, 9 aa, Homo Sapiens
DLRAPALPG

SEQ ID NO: 218479 - protein, 9 aa, Homo Sapiens
VLVEMYEES

SEQ ID NO: 218480 - protein, 9 aa, Homo Sapiens
IGPPLPPKW

SEQ ID NO: 218481 - protein, 9 aa, Homo Sapiens
EVRQSAAYG

SEQ ID NO: 218482 - protein, 9 aa, Homo Sapiens
RSSPGLPST

SEQ ID NO: 218483 - protein, 9 aa, Homo Sapiens
VISEPPEER

SEQ ID NO: 218484 - protein, 9 aa, Homo Sapiens
FELVIQYNK

SEQ ID NO: 218485 - protein, 9 aa, Homo Sapiens
NLATHNKNS

SEQ ID NO: 218486 - protein, 9 aa, Homo Sapiens
SDRFNFILT

SEQ ID NO: 218487 - protein, 9 aa, Homo Sapiens
RRRCEEEMR

SEQ ID NO: 218488 - protein, 9 aa, Homo Sapiens
NVPNIFKRH

SEQ ID NO: 218489 - protein, 9 aa, Homo Sapiens
HMLLCTALL

SEQ ID NO: 218490 - protein, 9 aa, Homo Sapiens
TSISVCGQV

SEQ ID NO: 218491 - protein, 9 aa, Homo Sapiens
RCCRPAVLL

SEQ ID NO: 218492 - protein, 9 aa, Homo Sapiens
GLGAQQAGW

SEQ ID NO: 218493 - protein, 9 aa, Homo Sapiens
VIRGQGSRV

SEQ ID NO: 218494 - protein, 9 aa, Homo Sapiens
WPSSVLIEQ

SEQ ID NO: 218495 - protein, 9 aa, Homo Sapiens
STCPNRSPH

SEQ ID NO: 218496 - protein, 9 aa, Homo Sapiens
SRFLQSQNL

SEQ ID NO: 218497 - protein, 9 aa, Homo Sapiens
SQCRVTKYC

SEQ ID NO: 218498 - protein, 9 aa, Homo Sapiens
PEQFIGQVT

SEQ ID NO: 218499 - protein, 9 aa, Homo Sapiens
SLGVRHTVI

SEQ ID NO: 218500 - protein, 9 aa, Homo Sapiens
HTFWVVFVL

SEQ ID NO: 218501 - protein, 9 aa, Homo Sapiens
SPRRPGSAW

SEQ ID NO: 218502 - protein, 9 aa, Homo Sapiens
LHQAGARLD

SEQ ID NO: 218503 - protein, 9 aa, Homo Sapiens
TDHQDYREV

SEQ ID NO: 218504 - protein, 9 aa, Homo Sapiens
MTVLPSKID

SEQ ID NO: 218505 - protein, 9 aa, Homo Sapiens
EHASGIGDR

SEQ ID NO: 218506 - protein, 9 aa, Homo Sapiens
HPYSLQPPP

SEQ ID NO: 218507 - protein, 9 aa, Homo Sapiens
GMVAVRTVV

SEQ ID NO: 218508 - protein, 9 aa, Homo Sapiens
AYPPLSVIT

SEQ ID NO: 218509 - protein, 9 aa, Homo Sapiens
PDAVVASSS

SEQ ID NO: 218510 - protein, 9 aa, Homo Sapiens
LELTCADTF

SEQ ID NO: 218511 - protein, 9 aa, Homo Sapiens
AVHAPRALS

SEQ ID NO: 218512 - protein, 9 aa, Homo Sapiens
YHSEEEEEE

SEQ ID NO: 218513 - protein, 9 aa, Homo Sapiens
SDRQSCPSP

SEQ ID NO: 218514 - protein, 9 aa, Homo Sapiens
LCYCETKHT

SEQ ID NO: 218515 - protein, 9 aa, Homo Sapiens
CVSRFWGLV

SEQ ID NO: 218516 - protein, 9 aa, Homo Sapiens
RVHCAAPAC

SEQ ID NO: 218517 - protein, 9 aa, Homo Sapiens
CKQNFWENL

SEQ ID NO: 218518 - protein, 9 aa, Homo Sapiens
VAAMEETEV

SEQ ID NO: 218519 - protein, 9 aa, Homo Sapiens
ACGNWRVPL

SEQ ID NO: 218520 - protein, 9 aa, Homo Sapiens
AYTSRMPKL

SEQ ID NO: 218521 - protein, 9 aa, Homo Sapiens
GWLCPTPSA

SEQ ID NO: 218522 - protein, 9 aa, Homo Sapiens
GAGVLAAGP

SEQ ID NO: 218523 - protein, 9 aa, Homo Sapiens
AGSSWTPGR

SEQ ID NO: 218524 - protein, 9 aa, Homo Sapiens
STRKNGGGL

SEQ ID NO: 218525 - protein, 9 aa, Homo Sapiens
NVTVNVRNS

SEQ ID NO: 218526 - protein, 9 aa, Homo Sapiens
LHSHLSWKL

SEQ ID NO: 218527 - protein, 9 aa, Homo Sapiens
TNDRNILTL

SEQ ID NO: 218528 - protein, 9 aa, Homo Sapiens
SPAPRRPRC

SEQ ID NO: 218529 - protein, 9 aa, Homo Sapiens
VQTAQELKT

SEQ ID NO: 218530 - protein, 9 aa, Homo Sapiens
RGRERRGTT

SEQ ID NO: 218531 - protein, 9 aa, Homo Sapiens
QLHRVQERQ

SEQ ID NO: 218532 - protein, 9 aa, Homo Sapiens
QIMHSCWHE

SEQ ID NO: 218533 - protein, 9 aa, Homo Sapiens
PRGRGRVWP

SEQ ID NO: 218534 - protein, 9 aa, Homo Sapiens
TVCQHNVRK

SEQ ID NO: 218535 - protein, 9 aa, Homo Sapiens
LHPRRRWPL

SEQ ID NO: 218536 - protein, 9 aa, Homo Sapiens
SPPGRTASA

SEQ ID NO: 218537 - protein, 9 aa, Homo Sapiens
YAKDYADSI

SEQ ID NO: 218538 - protein, 9 aa, Homo Sapiens
QQAQGGGQL

SEQ ID NO: 218539 - protein, 9 aa, Homo Sapiens
SLPSLGFPV

SEQ ID NO: 218540 - protein, 9 aa, Homo Sapiens
TPPPPPGWL

SEQ ID NO: 218541 - protein, 9 aa, Homo Sapiens
LGFTLLKLL

SEQ ID NO: 218542 - protein, 9 aa, Homo Sapiens
LPTASGVSL

SEQ ID NO: 218543 - protein, 9 aa, Homo Sapiens
FLSALNLKH

SEQ ID NO: 218544 - protein, 9 aa, Homo Sapiens
PIVNPDPLL

SEQ ID NO: 218545 - protein, 9 aa, Homo Sapiens
LAAGEAVQG

SEQ ID NO: 218546 - protein, 9 aa, Homo Sapiens
INKVNGLLK

SEQ ID NO: 218547 - protein, 9 aa, Homo Sapiens
ITLLEATPD

SEQ ID NO: 218548 - protein, 9 aa, Homo Sapiens
CLACRGATA

SEQ ID NO: 218549 - protein, 9 aa, Homo Sapiens
VCNYYFCIL

SEQ ID NO: 218550 - protein, 9 aa, Homo Sapiens
SEVSEDSPC

SEQ ID NO: 218551 - protein, 9 aa, Homo Sapiens
QMTLSPLKE

SEQ ID NO: 218552 - protein, 9 aa, Homo Sapiens
GEGTVAPTV

SEQ ID NO: 218553 - protein, 9 aa, Homo Sapiens
NEEMDRAQA

SEQ ID NO: 218554 - protein, 9 aa, Homo Sapiens
PRPRLSGML

SEQ ID NO: 218555 - protein, 9 aa, Homo Sapiens
EVDSLYLMQ

SEQ ID NO: 218556 - protein, 9 aa, Homo Sapiens
YFYTHGLRC

SEQ ID NO: 218557 - protein, 9 aa, Homo Sapiens
SLLWVTEDP

SEQ ID NO: 218558 - protein, 9 aa, Homo Sapiens
NGPASETAL

SEQ ID NO: 218559 - protein, 9 aa, Homo Sapiens
VRLQQSFPG

SEQ ID NO: 218560 - protein, 9 aa, Homo Sapiens
IEDIVCDGR

SEQ ID NO: 218561 - protein, 9 aa, Homo Sapiens
RDAGLTRRV

SEQ ID NO: 218562 - protein, 9 aa, Homo Sapiens
PRGRERRGT

SEQ ID NO: 218563 - protein, 9 aa, Homo Sapiens
PWAERDRQM

SEQ ID NO: 218564 - protein, 9 aa, Homo Sapiens
WLLCGTEDS

SEQ ID NO: 218565 - protein, 9 aa, Homo Sapiens
ELGAGSQES

SEQ ID NO: 218566 - protein, 9 aa, Homo Sapiens
RLMGPWHLC

SEQ ID NO: 218567 - protein, 9 aa, Homo Sapiens
TPDCYYNVT

SEQ ID NO: 218568 - protein, 9 aa, Homo Sapiens
ECKQCWRAF

SEQ ID NO: 218569 - protein, 9 aa, Homo Sapiens
VTELRQAPR

SEQ ID NO: 218570 - protein, 9 aa, Homo Sapiens
YECKQCWRA

SEQ ID NO: 218571 - protein, 9 aa, Homo Sapiens
AWQVFERWM

SEQ ID NO: 218572 - protein, 9 aa, Homo Sapiens
GGNKKFFGG

SEQ ID NO: 218573 - protein, 9 aa, Homo Sapiens
NRAENFTKT

SEQ ID NO: 218574 - protein, 9 aa, Homo Sapiens
EVSDTGGLT

SEQ ID NO: 218575 - protein, 9 aa, Homo Sapiens
QCIRVCICI

SEQ ID NO: 218576 - protein, 9 aa, Homo Sapiens
WKRLKDISK

SEQ ID NO: 218577 - protein, 9 aa, Homo Sapiens
KTTLPGLFV

SEQ ID NO: 218578 - protein, 9 aa, Homo Sapiens
TSGIRHLLL

SEQ ID NO: 218579 - protein, 9 aa, Homo Sapiens
GLCVVAHDV

SEQ ID NO: 218580 - protein, 9 aa, Homo Sapiens
WPVLDNAPR

SEQ ID NO: 218581 - protein, 9 aa, Homo Sapiens
VHKARSGKG

SEQ ID NO: 218582 - protein, 9 aa, Homo Sapiens
GHTLAGQTS

SEQ ID NO: 218583 - protein, 9 aa, Homo Sapiens
LDLLRGWGQ

SEQ ID NO: 218584 - protein, 9 aa, Homo Sapiens
DYPTALLHY

SEQ ID NO: 218585 - protein, 9 aa, Homo Sapiens
YKNTLWIEG

SEQ ID NO: 218586 - protein, 9 aa, Homo Sapiens
TTEEMLDAE

SEQ ID NO: 218587 - protein, 9 aa, Homo Sapiens
YSTLTRSSP

SEQ ID NO: 218588 - protein, 9 aa, Homo Sapiens
CSLPTASGV

SEQ ID NO: 218589 - protein, 9 aa, Homo Sapiens
LCVNLMRGW

SEQ ID NO: 218590 - protein, 9 aa, Homo Sapiens
MGPPLKLLK

SEQ ID NO: 218591 - protein, 9 aa, Homo Sapiens
NEHKRKLES

SEQ ID NO: 218592 - protein, 9 aa, Homo Sapiens
PLPSEILGS

SEQ ID NO: 218593 - protein, 9 aa, Homo Sapiens
TLWWASGCG

SEQ ID NO: 218594 - protein, 9 aa, Homo Sapiens
QSSPFLARS

SEQ ID NO: 218595 - protein, 9 aa, Homo Sapiens
QPGGRSSGR

SEQ ID NO: 218596 - protein, 9 aa, Homo Sapiens
MPRNGPWET

SEQ ID NO: 218597 - protein, 9 aa, Homo Sapiens
MASRSTRTS

SEQ ID NO: 218598 - protein, 9 aa, Homo Sapiens
PEIDKKSRT

SEQ ID NO: 218599 - protein, 9 aa, Homo Sapiens
TEEMLDAEL

SEQ ID NO: 218600 - protein, 9 aa, Homo Sapiens
TTSASMLSA

SEQ ID NO: 218601 - protein, 9 aa, Homo Sapiens
LDPPPPRPQ

SEQ ID NO: 218602 - protein, 9 aa, Homo Sapiens
VIIGPRGLG

SEQ ID NO: 218603 - protein, 9 aa, Homo Sapiens
PGPWAAAWG

SEQ ID NO: 218604 - protein, 9 aa, Homo Sapiens
YWPVLDNAP

SEQ ID NO: 218605 - protein, 9 aa, Homo Sapiens
YAMTGKQVT

SEQ ID NO: 218606 - protein, 9 aa, Homo Sapiens
RREQEEREQ

SEQ ID NO: 218607 - protein, 9 aa, Homo Sapiens
AEEAAASRL

SEQ ID NO: 218608 - protein, 9 aa, Homo Sapiens
GVLSVEISI

SEQ ID NO: 218609 - protein, 9 aa, Homo Sapiens
VHTDAQGRL

SEQ ID NO: 218610 - protein, 9 aa, Homo Sapiens
SRPHSETEE

SEQ ID NO: 218611 - protein, 9 aa, Homo Sapiens
LKKVWNLQG

SEQ ID NO: 218612 - protein, 9 aa, Homo Sapiens
EWKSQMQSG

SEQ ID NO: 218613 - protein, 9 aa, Homo Sapiens
KHTIQFVDW

SEQ ID NO: 218614 - protein, 9 aa, Homo Sapiens
IRADIGPVT

SEQ ID NO: 218615 - protein, 9 aa, Homo Sapiens
LRFHLDAHG

SEQ ID NO: 218616 - protein, 9 aa, Homo Sapiens
ARFVWGKLS

SEQ ID NO: 218617 - protein, 9 aa, Homo Sapiens
TTSQSQLSS

SEQ ID NO: 218618 - protein, 9 aa, Homo Sapiens
TKASVARQP

SEQ ID NO: 218619 - protein, 9 aa, Homo Sapiens
RETRSGRPG

SEQ ID NO: 218620 - protein, 9 aa, Homo Sapiens
LPDFNVIVP

SEQ ID NO: 218621 - protein, 9 aa, Homo Sapiens
LQDAGHAGG

SEQ ID NO: 218622 - protein, 9 aa, Homo Sapiens
LSELHYDKL

SEQ ID NO: 218623 - protein, 9 aa, Homo Sapiens
RLGVAPRVC

SEQ ID NO: 218624 - protein, 9 aa, Homo Sapiens
MPCTIWSFS

SEQ ID NO: 218625 - protein, 9 aa, Homo Sapiens
SSSNVCVIK

SEQ ID NO: 218626 - protein, 9 aa, Homo Sapiens
QREVWDTVV

SEQ ID NO: 218627 - protein, 9 aa, Homo Sapiens
PRCRTPQAP

SEQ ID NO: 218628 - protein, 9 aa, Homo Sapiens
RGQCNTTTG

SEQ ID NO: 218629 - protein, 9 aa, Homo Sapiens
LCVDQWLKC

SEQ ID NO: 218630 - protein, 9 aa, Homo Sapiens
WAPCGWPAL

SEQ ID NO: 218631 - protein, 9 aa, Homo Sapiens
LRTSGEPWD

SEQ ID NO: 218632 - protein, 9 aa, Homo Sapiens
CSYQFLVPI

SEQ ID NO: 218633 - protein, 9 aa, Homo Sapiens
VLLADPVAP

SEQ ID NO: 218634 - protein, 9 aa, Homo Sapiens
IIDCRCPYE

SEQ ID NO: 218635 - protein, 9 aa, Homo Sapiens
GTEDSRRSL

SEQ ID NO: 218636 - protein, 9 aa, Homo Sapiens
VSVIIFSLA

SEQ ID NO: 218637 - protein, 9 aa, Homo Sapiens
VHNESTGSL

SEQ ID NO: 218638 - protein, 9 aa, Homo Sapiens
DDTPCIWQP

SEQ ID NO: 218639 - protein, 9 aa, Homo Sapiens
LEPFLILRW

SEQ ID NO: 218640 - protein, 9 aa, Homo Sapiens
NSGHQVPPT

SEQ ID NO: 218641 - protein, 9 aa, Homo Sapiens
SATDSVADT

SEQ ID NO: 218642 - protein, 9 aa, Homo Sapiens
DRSQHGPGW

SEQ ID NO: 218643 - protein, 9 aa, Homo Sapiens
WIVTAAHCF

SEQ ID NO: 218644 - protein, 9 aa, Homo Sapiens
RGSKPVMES

SEQ ID NO: 218645 - protein, 9 aa, Homo Sapiens
DLRRGCYLT

SEQ ID NO: 218646 - protein, 9 aa, Homo Sapiens
EDPVLLKKK

SEQ ID NO: 218647 - protein, 9 aa, Homo Sapiens
GSSDPPTLT

SEQ ID NO: 218648 - protein, 9 aa, Homo Sapiens
QVFLVVFFC

SEQ ID NO: 218649 - protein, 9 aa, Homo Sapiens
AGLPREYQQ

SEQ ID NO: 218650 - protein, 9 aa, Homo Sapiens
ERIEESWND

SEQ ID NO: 218651 - protein, 9 aa, Homo Sapiens
AWSLPRLVG

SEQ ID NO: 218652 - protein, 9 aa, Homo Sapiens
PVIEELQNQ

SEQ ID NO: 218653 - protein, 9 aa, Homo Sapiens
LSHHRPSLF

SEQ ID NO: 218654 - protein, 9 aa, Homo Sapiens
GAPGARIPW

SEQ ID NO: 218655 - protein, 9 aa, Homo Sapiens
ECNKYGKSF

SEQ ID NO: 218656 - protein, 9 aa, Homo Sapiens
MTLSPLKEV

SEQ ID NO: 218657 - protein, 9 aa, Homo Sapiens
KSLWPGLRD

SEQ ID NO: 218658 - protein, 9 aa, Homo Sapiens
IQKIKSGDE

SEQ ID NO: 218659 - protein, 9 aa, Homo Sapiens
GVDSLSPVV

SEQ ID NO: 218660 - protein, 9 aa, Homo Sapiens
FAGDDAPGL

SEQ ID NO: 218661 - protein, 9 aa, Homo Sapiens
YPGQVCANN

SEQ ID NO: 218662 - protein, 9 aa, Homo Sapiens
QQQVSAHQE

SEQ ID NO: 218663 - protein, 9 aa, Homo Sapiens
QCRWLLCPF

SEQ ID NO: 218664 - protein, 9 aa, Homo Sapiens
LLQPPHSAM

SEQ ID NO: 218665 - protein, 9 aa, Homo Sapiens
WTQFRNYPR

SEQ ID NO: 218666 - protein, 9 aa, Homo Sapiens
RLQHQSLTY

SEQ ID NO: 218667 - protein, 9 aa, Homo Sapiens
AAGAAYAQG

SEQ ID NO: 218668 - protein, 9 aa, Homo Sapiens
PVAGDLTSL

SEQ ID NO: 218669 - protein, 9 aa, Homo Sapiens
CMNVLSVSP

SEQ ID NO: 218670 - protein, 9 aa, Homo Sapiens
LDLPVAGVY

SEQ ID NO: 218671 - protein, 9 aa, Homo Sapiens
LGQPWPPTC

SEQ ID NO: 218672 - protein, 9 aa, Homo Sapiens
EPERIEESW

SEQ ID NO: 218673 - protein, 9 aa, Homo Sapiens
FRWEELCEG

SEQ ID NO: 218674 - protein, 9 aa, Homo Sapiens
QSPIERKVI

SEQ ID NO: 218675 - protein, 9 aa, Homo Sapiens
EKDPCSPRE

SEQ ID NO: 218676 - protein, 9 aa, Homo Sapiens
YPWAGFPFA

SEQ ID NO: 218677 - protein, 9 aa, Homo Sapiens
PAGTATRNG

SEQ ID NO: 218678 - protein, 9 aa, Homo Sapiens
SGSGSGLNA

SEQ ID NO: 218679 - protein, 9 aa, Homo Sapiens
VHSEEEATR

SEQ ID NO: 218680 - protein, 9 aa, Homo Sapiens
ADDFSLKYE

SEQ ID NO: 218681 - protein, 9 aa, Homo Sapiens
WPSCKARTS

SEQ ID NO: 218682 - protein, 9 aa, Homo Sapiens
LCTGRGDPF

SEQ ID NO: 218683 - protein, 9 aa, Homo Sapiens
AFQQACYNF

SEQ ID NO: 218684 - protein, 9 aa, Homo Sapiens
GNRESGSKL

SEQ ID NO: 218685 - protein, 9 aa, Homo Sapiens
KHAHRKGGC

SEQ ID NO: 218686 - protein, 9 aa, Homo Sapiens
QAMATESSS

SEQ ID NO: 218687 - protein, 9 aa, Homo Sapiens
HLDDLSGLR

SEQ ID NO: 218688 - protein, 9 aa, Homo Sapiens
SMASLKKQY

SEQ ID NO: 218689 - protein, 9 aa, Homo Sapiens
VGLGASSCR

SEQ ID NO: 218690 - protein, 9 aa, Homo Sapiens
VEQVEFSEL

SEQ ID NO: 218691 - protein, 9 aa, Homo Sapiens
QQTYLQWPK

SEQ ID NO: 218692 - protein, 9 aa, Homo Sapiens
ERSDWARQT

SEQ ID NO: 218693 - protein, 9 aa, Homo Sapiens
PGGRARPRA

SEQ ID NO: 218694 - protein, 9 aa, Homo Sapiens
PWPSPQQRN

SEQ ID NO: 218695 - protein, 9 aa, Homo Sapiens
IGSGMGVLS

SEQ ID NO: 218696 - protein, 9 aa, Homo Sapiens
AIENIIAWE

SEQ ID NO: 218697 - protein, 9 aa, Homo Sapiens
LNTEEACKA

SEQ ID NO: 218698 - protein, 9 aa, Homo Sapiens
RHTVIEHAV

SEQ ID NO: 218699 - protein, 9 aa, Homo Sapiens
LFGLGIIGP

SEQ ID NO: 218700 - protein, 9 aa, Homo Sapiens
WAERDRQMP

SEQ ID NO: 218701 - protein, 9 aa, Homo Sapiens
ECGGQRVSW

SEQ ID NO: 218702 - protein, 9 aa, Homo Sapiens
ESAQFLLLL

SEQ ID NO: 218703 - protein, 9 aa, Homo Sapiens
CSDTPSVMQ

SEQ ID NO: 218704 - protein, 9 aa, Homo Sapiens
QGSSGCKVH

SEQ ID NO: 218705 - protein, 9 aa, Homo Sapiens
LCCLVFSRE

SEQ ID NO: 218706 - protein, 9 aa, Homo Sapiens
YVGVSADLK

SEQ ID NO: 218707 - protein, 9 aa, Homo Sapiens
FREDYKQAL

SEQ ID NO: 218708 - protein, 9 aa, Homo Sapiens
CRQRCGPRG

SEQ ID NO: 218709 - protein, 9 aa, Homo Sapiens
WNMGNAPLP

SEQ ID NO: 218710 - protein, 9 aa, Homo Sapiens
QDPKGKGHR

SEQ ID NO: 218711 - protein, 9 aa, Homo Sapiens
QMGYPKSTM

SEQ ID NO: 218712 - protein, 9 aa, Homo Sapiens
RKAKELHQA

SEQ ID NO: 218713 - protein, 9 aa, Homo Sapiens
PPGRCRTSR

SEQ ID NO: 218714 - protein, 9 aa, Homo Sapiens
EEIEEKTHN

SEQ ID NO: 218715 - protein, 9 aa, Homo Sapiens
SSSRTPRRQ

SEQ ID NO: 218716 - protein, 9 aa, Homo Sapiens
RKQHLLLSK

SEQ ID NO: 218717 - protein, 9 aa, Homo Sapiens
DSMARAEPL

SEQ ID NO: 218718 - protein, 9 aa, Homo Sapiens
LALGDLCVV

SEQ ID NO: 218719 - protein, 9 aa, Homo Sapiens
GGEQAQVTI

SEQ ID NO: 218720 - protein, 9 aa, Homo Sapiens
HKKDKKENK

SEQ ID NO: 218721 - protein, 9 aa, Homo Sapiens
ALRRRRRLL

SEQ ID NO: 218722 - protein, 9 aa, Homo Sapiens
VAAHKGKKN

SEQ ID NO: 218723 - protein, 9 aa, Homo Sapiens
KISGFDTET

SEQ ID NO: 218724 - protein, 9 aa, Homo Sapiens
TRAGPHAPC

SEQ ID NO: 218725 - protein, 9 aa, Homo Sapiens
GRTPASCVR

SEQ ID NO: 218726 - protein, 9 aa, Homo Sapiens
RGGGGRTPG

SEQ ID NO: 218727 - protein, 9 aa, Homo Sapiens
DTGGLTLRN

SEQ ID NO: 218728 - protein, 9 aa, Homo Sapiens
GQLEDLGKM

SEQ ID NO: 218729 - protein, 9 aa, Homo Sapiens
AGSAAGTLG

SEQ ID NO: 218730 - protein, 9 aa, Homo Sapiens
CDAPEAHVA

SEQ ID NO: 218731 - protein, 9 aa, Homo Sapiens
VFATIIGAF

SEQ ID NO: 218732 - protein, 9 aa, Homo Sapiens
PVQEGPGSG

SEQ ID NO: 218733 - protein, 9 aa, Homo Sapiens
TTTEQSHLL

SEQ ID NO: 218734 - protein, 9 aa, Homo Sapiens
VKAKFSGFE

SEQ ID NO: 218735 - protein, 9 aa, Homo Sapiens
LALSSRDRA

SEQ ID NO: 218736 - protein, 9 aa, Homo Sapiens
VYVLYKTLT

SEQ ID NO: 218737 - protein, 9 aa, Homo Sapiens
CIHVKHPHK

SEQ ID NO: 218738 - protein, 9 aa, Homo Sapiens
ARGALQNQL

SEQ ID NO: 218739 - protein, 9 aa, Homo Sapiens
PMSSGRISS

SEQ ID NO: 218740 - protein, 9 aa, Homo Sapiens
RRHHKHNLK

SEQ ID NO: 218741 - protein, 9 aa, Homo Sapiens
YDSWSPNSV

SEQ ID NO: 218742 - protein, 9 aa, Homo Sapiens
WTSALASCA

SEQ ID NO: 218743 - protein, 9 aa, Homo Sapiens
PSIRTPRGR

SEQ ID NO: 218744 - protein, 9 aa, Homo Sapiens
VATVETEVE

SEQ ID NO: 218745 - protein, 9 aa, Homo Sapiens
SFVGQISTL

SEQ ID NO: 218746 - protein, 9 aa, Homo Sapiens
PPPGRRRSH

SEQ ID NO: 218747 - protein, 9 aa, Homo Sapiens
KNEDLGHMY

SEQ ID NO: 218748 - protein, 9 aa, Homo Sapiens
NSLMAMDFS

SEQ ID NO: 218749 - protein, 9 aa, Homo Sapiens
GTSLYDLLG

SEQ ID NO: 218750 - protein, 9 aa, Homo Sapiens
PIVPRPALR

SEQ ID NO: 218751 - protein, 9 aa, Homo Sapiens
NMNQGDMMG

SEQ ID NO: 218752 - protein, 9 aa, Homo Sapiens
PWQKKSLEK

SEQ ID NO: 218753 - protein, 9 aa, Homo Sapiens
GRDVGAGAV

SEQ ID NO: 218754 - protein, 9 aa, Homo Sapiens
EKRKEVNGK

SEQ ID NO: 218755 - protein, 9 aa, Homo Sapiens
IEMVTAKRP

SEQ ID NO: 218756 - protein, 9 aa, Homo Sapiens
HRQISLPLR

SEQ ID NO: 218757 - protein, 9 aa, Homo Sapiens
FAAFQVVQT

SEQ ID NO: 218758 - protein, 9 aa, Homo Sapiens
CCLYECGGQ

SEQ ID NO: 218759 - protein, 9 aa, Homo Sapiens
TRTVSSPKQ

SEQ ID NO: 218760 - protein, 9 aa, Homo Sapiens
LHCLKQYSR

SEQ ID NO: 218761 - protein, 9 aa, Homo Sapiens
GTYTKGTFQ

SEQ ID NO: 218762 - protein, 9 aa, Homo Sapiens
SFTIQDLVS

SEQ ID NO: 218763 - protein, 9 aa, Homo Sapiens
RIIGIQFQN

SEQ ID NO: 218764 - protein, 9 aa, Homo Sapiens
GLGGAPGGG

SEQ ID NO: 218765 - protein, 9 aa, Homo Sapiens
NASIMCPLN

SEQ ID NO: 218766 - protein, 9 aa, Homo Sapiens
KNRQKVQKK

SEQ ID NO: 218767 - protein, 9 aa, Homo Sapiens
PQELGFSST

SEQ ID NO: 218768 - protein, 9 aa, Homo Sapiens
VFKAEFVSL

SEQ ID NO: 218769 - protein, 9 aa, Homo Sapiens
VPPYLGYHF

SEQ ID NO: 218770 - protein, 9 aa, Homo Sapiens
PMRKPRIPM

SEQ ID NO: 218771 - protein, 9 aa, Homo Sapiens
TQQTYLQWP

SEQ ID NO: 218772 - protein, 9 aa, Homo Sapiens
NRLVLLYLH

SEQ ID NO: 218773 - protein, 9 aa, Homo Sapiens
GTSSPARSP

SEQ ID NO: 218774 - protein, 9 aa, Homo Sapiens
VDLEKPTAI

SEQ ID NO: 218775 - protein, 9 aa, Homo Sapiens
ECAWNGSDG

SEQ ID NO: 218776 - protein, 9 aa, Homo Sapiens
LDRNTFRKL

SEQ ID NO: 218777 - protein, 9 aa, Homo Sapiens
RPSWKGKGA

SEQ ID NO: 218778 - protein, 9 aa, Homo Sapiens
SVLLPPPRL

SEQ ID NO: 218779 - protein, 9 aa, Homo Sapiens
LRLNPRRSC

SEQ ID NO: 218780 - protein, 9 aa, Homo Sapiens
SCAAGAGTF

SEQ ID NO: 218781 - protein, 9 aa, Homo Sapiens
FAKQLRVGN

SEQ ID NO: 218782 - protein, 9 aa, Homo Sapiens
HQTGQAPHL

SEQ ID NO: 218783 - protein, 9 aa, Homo Sapiens
PERGFPAWT

SEQ ID NO: 218784 - protein, 9 aa, Homo Sapiens
SRLECYTKN

SEQ ID NO: 218785 - protein, 9 aa, Homo Sapiens
PEPPSRKCS

SEQ ID NO: 218786 - protein, 9 aa, Homo Sapiens
RRLKEREDW

SEQ ID NO: 218787 - protein, 9 aa, Homo Sapiens
ITVGEDGRI

SEQ ID NO: 218788 - protein, 9 aa, Homo Sapiens
EGRDVGAGA

SEQ ID NO: 218789 - protein, 9 aa, Homo Sapiens
MRETRCLAE

SEQ ID NO: 218790 - protein, 9 aa, Homo Sapiens
ERTVFLRCI

SEQ ID NO: 218791 - protein, 9 aa, Homo Sapiens
KEKINAVHA

SEQ ID NO: 218792 - protein, 9 aa, Homo Sapiens
LFILPLLLS

SEQ ID NO: 218793 - protein, 9 aa, Homo Sapiens
SEVEDDEKM

SEQ ID NO: 218794 - protein, 9 aa, Homo Sapiens
CVACGRTVY

SEQ ID NO: 218795 - protein, 9 aa, Homo Sapiens
TRQMLTFYS

SEQ ID NO: 218796 - protein, 9 aa, Homo Sapiens
EIFTRVTEF

SEQ ID NO: 218797 - protein, 9 aa, Homo Sapiens
VLLQQDLDP

SEQ ID NO: 218798 - protein, 9 aa, Homo Sapiens
RLRLQGMGR

SEQ ID NO: 218799 - protein, 9 aa, Homo Sapiens
DGCYQYNTD

SEQ ID NO: 218800 - protein, 9 aa, Homo Sapiens
AGSPSTKWW

SEQ ID NO: 218801 - protein, 9 aa, Homo Sapiens
GGFLILGDL

SEQ ID NO: 218802 - protein, 9 aa, Homo Sapiens
DWRKSHLIF

SEQ ID NO: 218803 - protein, 9 aa, Homo Sapiens
ELQRVHLEE

SEQ ID NO: 218804 - protein, 9 aa, Homo Sapiens
CWLRPEDGG

SEQ ID NO: 218805 - protein, 9 aa, Homo Sapiens
WLLLLLSPL

SEQ ID NO: 218806 - protein, 9 aa, Homo Sapiens
LGRGSKPVM

SEQ ID NO: 218807 - protein, 9 aa, Homo Sapiens
QPGVFAINR

SEQ ID NO: 218808 - protein, 9 aa, Homo Sapiens
NWVYSHNGV

SEQ ID NO: 218809 - protein, 9 aa, Homo Sapiens
EPSRLGGPK

SEQ ID NO: 218810 - protein, 9 aa, Homo Sapiens
CSVSGRGSC

SEQ ID NO: 218811 - protein, 9 aa, Homo Sapiens
ETPSMSKQN

SEQ ID NO: 218812 - protein, 9 aa, Homo Sapiens
KSALLLVLY

SEQ ID NO: 218813 - protein, 9 aa, Homo Sapiens
RISSTHCTG

SEQ ID NO: 218814 - protein, 9 aa, Homo Sapiens
AVAPFMTNG

SEQ ID NO: 218815 - protein, 9 aa, Homo Sapiens
RWALSGSTP

SEQ ID NO: 218816 - protein, 9 aa, Homo Sapiens
DVIAKALVR

SEQ ID NO: 218817 - protein, 9 aa, Homo Sapiens
GPSEHWQMY

SEQ ID NO: 218818 - protein, 9 aa, Homo Sapiens
FIPLQCHRK

SEQ ID NO: 218819 - protein, 9 aa, Homo Sapiens
VVLGADGQR

SEQ ID NO: 218820 - protein, 9 aa, Homo Sapiens
KVVHSTEQG

SEQ ID NO: 218821 - protein, 9 aa, Homo Sapiens
FWNHMLLCT

SEQ ID NO: 218822 - protein, 9 aa, Homo Sapiens
EKIHPLLKG

SEQ ID NO: 218823 - protein, 9 aa, Homo Sapiens
NLKMTLLGQ

SEQ ID NO: 218824 - protein, 9 aa, Homo Sapiens
ASPAHSPTP

SEQ ID NO: 218825 - protein, 9 aa, Homo Sapiens
MTGKQVTRV

SEQ ID NO: 218826 - protein, 9 aa, Homo Sapiens
LRAVGTQIS

SEQ ID NO: 218827 - protein, 9 aa, Homo Sapiens
LLKDYDPMG

SEQ ID NO: 218828 - protein, 9 aa, Homo Sapiens
DVPVATDDP

SEQ ID NO: 218829 - protein, 9 aa, Homo Sapiens
WFTNCEDDI

SEQ ID NO: 218830 - protein, 9 aa, Homo Sapiens
RYPEAAAPA

SEQ ID NO: 218831 - protein, 9 aa, Homo Sapiens
LSWGPQWPA

SEQ ID NO: 218832 - protein, 9 aa, Homo Sapiens
PRASSGCGA

SEQ ID NO: 218833 - protein, 9 aa, Homo Sapiens
KDMAAFNEQ

SEQ ID NO: 218834 - protein, 9 aa, Homo Sapiens
DVQLLQDAG

SEQ ID NO: 218835 - protein, 9 aa, Homo Sapiens
LLRLGSRPA

SEQ ID NO: 218836 - protein, 9 aa, Homo Sapiens
GSLCTLCQV

SEQ ID NO: 218837 - protein, 9 aa, Homo Sapiens
VEDDEKMTG

SEQ ID NO: 218838 - protein, 9 aa, Homo Sapiens
GRSTPRLPV

SEQ ID NO: 218839 - protein, 9 aa, Homo Sapiens
TDAPEQFIG

SEQ ID NO: 218840 - protein, 9 aa, Homo Sapiens
GNCCSYSES

SEQ ID NO: 218841 - protein, 9 aa, Homo Sapiens
PPRPHASPT

SEQ ID NO: 218842 - protein, 9 aa, Homo Sapiens
LSKPQFPHL

SEQ ID NO: 218843 - protein, 9 aa, Homo Sapiens
LASPVLCSV

SEQ ID NO: 218844 - protein, 9 aa, Homo Sapiens
KTDPRAADT

SEQ ID NO: 218845 - protein, 9 aa, Homo Sapiens
GGCGRVCYL

SEQ ID NO: 218846 - protein, 9 aa, Homo Sapiens
YTKVWKMNW

SEQ ID NO: 218847 - protein, 9 aa, Homo Sapiens
EELTSTRID

SEQ ID NO: 218848 - protein, 9 aa, Homo Sapiens
LGNVAGAWQ

SEQ ID NO: 218849 - protein, 9 aa, Homo Sapiens
YSTPLRRQL

SEQ ID NO: 218850 - protein, 9 aa, Homo Sapiens
VTENPNYAL

SEQ ID NO: 218851 - protein, 9 aa, Homo Sapiens
SLRAYPPLS

SEQ ID NO: 218852 - protein, 9 aa, Homo Sapiens
RGVMIVLGA

SEQ ID NO: 218853 - protein, 9 aa, Homo Sapiens
HRRLVSYPR

SEQ ID NO: 218854 - protein, 9 aa, Homo Sapiens
CSHSLALLL

SEQ ID NO: 218855 - protein, 9 aa, Homo Sapiens
CWRGWPGGR

SEQ ID NO: 218856 - protein, 9 aa, Homo Sapiens
DQPHMLNHD

SEQ ID NO: 218857 - protein, 9 aa, Homo Sapiens
DQHIDCYSC

SEQ ID NO: 218858 - protein, 9 aa, Homo Sapiens
RKQMERQCL

SEQ ID NO: 218859 - protein, 9 aa, Homo Sapiens
GFLGNIVKS

SEQ ID NO: 218860 - protein, 9 aa, Homo Sapiens
RLAADDFSL

SEQ ID NO: 218861 - protein, 9 aa, Homo Sapiens
FAIENIIAW

SEQ ID NO: 218862 - protein, 9 aa, Homo Sapiens
ARCCRPAVL

SEQ ID NO: 218863 - protein, 9 aa, Homo Sapiens
SLEEELKKQ

SEQ ID NO: 218864 - protein, 9 aa, Homo Sapiens
PKRGTGIGV

SEQ ID NO: 218865 - protein, 9 aa, Homo Sapiens
GPEVPRKYW

SEQ ID NO: 218866 - protein, 9 aa, Homo Sapiens
MQNPDRPTH

SEQ ID NO: 218867 - protein, 9 aa, Homo Sapiens
GLYPSPSTG

SEQ ID NO: 218868 - protein, 9 aa, Homo Sapiens
LVLHFSLKG

SEQ ID NO: 218869 - protein, 9 aa, Homo Sapiens
ERIAALLQT

SEQ ID NO: 218870 - protein, 9 aa, Homo Sapiens
TPTPRRWQQ

SEQ ID NO: 218871 - protein, 9 aa, Homo Sapiens
AETSTCQTD

SEQ ID NO: 218872 - protein, 9 aa, Homo Sapiens
ATSQATTTT

SEQ ID NO: 218873 - protein, 9 aa, Homo Sapiens
WILKTWHHL

SEQ ID NO: 218874 - protein, 9 aa, Homo Sapiens
QDRLPLPRL

SEQ ID NO: 218875 - protein, 9 aa, Homo Sapiens
CTTSASMLS

SEQ ID NO: 218876 - protein, 9 aa, Homo Sapiens
QNQLRVFLS

SEQ ID NO: 218877 - protein, 9 aa, Homo Sapiens
PKFAIATLP

SEQ ID NO: 218878 - protein, 9 aa, Homo Sapiens
HRSHLHEIC

SEQ ID NO: 218879 - protein, 9 aa, Homo Sapiens
EKCAQCWPS

SEQ ID NO: 218880 - protein, 9 aa, Homo Sapiens
QPMRCLHLP

SEQ ID NO: 218881 - protein, 9 aa, Homo Sapiens
SGICFQETH

SEQ ID NO: 218882 - protein, 9 aa, Homo Sapiens
QLHESLHGQ

SEQ ID NO: 218883 - protein, 9 aa, Homo Sapiens
FFWAKSPLN

SEQ ID NO: 218884 - protein, 9 aa, Homo Sapiens
QTRSWRMTW

SEQ ID NO: 218885 - protein, 9 aa, Homo Sapiens
YKVKVMGLN

SEQ ID NO: 218886 - protein, 9 aa, Homo Sapiens
DQNPPRPRL

SEQ ID NO: 218887 - protein, 9 aa, Homo Sapiens
TPRSGQGSN

SEQ ID NO: 218888 - protein, 9 aa, Homo Sapiens
VDVEPCINI

SEQ ID NO: 218889 - protein, 9 aa, Homo Sapiens
WTVDASRGL

SEQ ID NO: 218890 - protein, 9 aa, Homo Sapiens
NRQPPHMRR

SEQ ID NO: 218891 - protein, 9 aa, Homo Sapiens
TEEQNPEPV

SEQ ID NO: 218892 - protein, 9 aa, Homo Sapiens
TSDSNPAGP

SEQ ID NO: 218893 - protein, 9 aa, Homo Sapiens
SLKKGLAIV

SEQ ID NO: 218894 - protein, 9 aa, Homo Sapiens
SGSIKRSCS

SEQ ID NO: 218895 - protein, 9 aa, Homo Sapiens
PRQDRPVCE

SEQ ID NO: 218896 - protein, 9 aa, Homo Sapiens
KYDHHKRGI

SEQ ID NO: 218897 - protein, 9 aa, Homo Sapiens
GGGCLPPEP

SEQ ID NO: 218898 - protein, 9 aa, Homo Sapiens
NRGKWVNLL

SEQ ID NO: 218899 - protein, 9 aa, Homo Sapiens
ADHIPPEPP

SEQ ID NO: 218900 - protein, 9 aa, Homo Sapiens
EAKKAYPSE

SEQ ID NO: 218901 - protein, 9 aa, Homo Sapiens
TCCLLQAFF

SEQ ID NO: 218902 - protein, 9 aa, Homo Sapiens
GLIKVQVAL

SEQ ID NO: 218903 - protein, 9 aa, Homo Sapiens
TTNTSLILA

SEQ ID NO: 218904 - protein, 9 aa, Homo Sapiens
TVIPSNEDM

SEQ ID NO: 218905 - protein, 9 aa, Homo Sapiens
ISVHVSACA

SEQ ID NO: 218906 - protein, 9 aa, Homo Sapiens
WSPTCPQPP

SEQ ID NO: 218907 - protein, 9 aa, Homo Sapiens
LKTLLGQLP

SEQ ID NO: 218908 - protein, 9 aa, Homo Sapiens
SENSLMAMD

SEQ ID NO: 218909 - protein, 9 aa, Homo Sapiens
FLLAEAMCV

SEQ ID NO: 218910 - protein, 9 aa, Homo Sapiens
RPGQSASSS

SEQ ID NO: 218911 - protein, 9 aa, Homo Sapiens
MARVTGVSG

SEQ ID NO: 218912 - protein, 9 aa, Homo Sapiens
SSSCKGCLW

SEQ ID NO: 218913 - protein, 9 aa, Homo Sapiens
YIHALCTLI

SEQ ID NO: 218914 - protein, 9 aa, Homo Sapiens
DIMLPSLRS

SEQ ID NO: 218915 - protein, 9 aa, Homo Sapiens
LPLDRTFLQ

SEQ ID NO: 218916 - protein, 9 aa, Homo Sapiens
STLRGTSSP

SEQ ID NO: 218917 - protein, 9 aa, Homo Sapiens
NTEDIAQRA

SEQ ID NO: 218918 - protein, 9 aa, Homo Sapiens
SHWCPTQPR

SEQ ID NO: 218919 - protein, 9 aa, Homo Sapiens
GIPVNHLTE

SEQ ID NO: 218920 - protein, 9 aa, Homo Sapiens
ASRRRAGGC

SEQ ID NO: 218921 - protein, 9 aa, Homo Sapiens
QKKSDSKNA

SEQ ID NO: 218922 - protein, 9 aa, Homo Sapiens
GGAWSMPRN

SEQ ID NO: 218923 - protein, 9 aa, Homo Sapiens
SLASTSTAP

SEQ ID NO: 218924 - protein, 9 aa, Homo Sapiens
KGVFGAGPG

SEQ ID NO: 218925 - protein, 9 aa, Homo Sapiens
GSPSTKWWP

SEQ ID NO: 218926 - protein, 9 aa, Homo Sapiens
LVVLHQAGA

SEQ ID NO: 218927 - protein, 9 aa, Homo Sapiens
FAGEDAPRA

SEQ ID NO: 218928 - protein, 9 aa, Homo Sapiens
ILYRSYCST

SEQ ID NO: 218929 - protein, 9 aa, Homo Sapiens
WVVTAGHCT

SEQ ID NO: 218930 - protein, 9 aa, Homo Sapiens
NLRGSSSTA

SEQ ID NO: 218931 - protein, 9 aa, Homo Sapiens
VTEDPAPWA

SEQ ID NO: 218932 - protein, 9 aa, Homo Sapiens
HPTLKDLTA

SEQ ID NO: 218933 - protein, 9 aa, Homo Sapiens
NRRDAEVWF

SEQ ID NO: 218934 - protein, 9 aa, Homo Sapiens
GPPPHGFNR

SEQ ID NO: 218935 - protein, 9 aa, Homo Sapiens
GASAPRGPG

SEQ ID NO: 218936 - protein, 9 aa, Homo Sapiens
NPPPRGRGG

SEQ ID NO: 218937 - protein, 9 aa, Homo Sapiens
LPPLASEAV

SEQ ID NO: 218938 - protein, 9 aa, Homo Sapiens
GFDTIPLMM

SEQ ID NO: 218939 - protein, 9 aa, Homo Sapiens
PQGRRKRRC

SEQ ID NO: 218940 - protein, 9 aa, Homo Sapiens
TRQALSEAR

SEQ ID NO: 218941 - protein, 9 aa, Homo Sapiens
RHCARQLAT

SEQ ID NO: 218942 - protein, 9 aa, Homo Sapiens
HGSVDVVKQ

SEQ ID NO: 218943 - protein, 9 aa, Homo Sapiens
WNHSLAIGG

SEQ ID NO: 218944 - protein, 9 aa, Homo Sapiens
FRHLALMFP

SEQ ID NO: 218945 - protein, 9 aa, Homo Sapiens
PLNPAAQDG

SEQ ID NO: 218946 - protein, 9 aa, Homo Sapiens
LLLVTQGLC

SEQ ID NO: 218947 - protein, 9 aa, Homo Sapiens
RKMKQRKNQ

SEQ ID NO: 218948 - protein, 9 aa, Homo Sapiens
IIEVNARLA

SEQ ID NO: 218949 - protein, 9 aa, Homo Sapiens
LPPQPGLPD

SEQ ID NO: 218950 - protein, 9 aa, Homo Sapiens
VDSFFVIFL

SEQ ID NO: 218951 - protein, 9 aa, Homo Sapiens
LAAASCSQT

SEQ ID NO: 218952 - protein, 9 aa, Homo Sapiens
WEELCEGPE

SEQ ID NO: 218953 - protein, 9 aa, Homo Sapiens
TGIPGGNPA

SEQ ID NO: 218954 - protein, 9 aa, Homo Sapiens
TCPNRSPHS

SEQ ID NO: 218955 - protein, 9 aa, Homo Sapiens
GPPRESKNS

SEQ ID NO: 218956 - protein, 9 aa, Homo Sapiens
LGAFLGLLM

SEQ ID NO: 218957 - protein, 9 aa, Homo Sapiens
GGRGRHRRR

SEQ ID NO: 218958 - protein, 9 aa, Homo Sapiens
PLHCVASCN

SEQ ID NO: 218959 - protein, 9 aa, Homo Sapiens
PSPRHKKVI

SEQ ID NO: 218960 - protein, 9 aa, Homo Sapiens
RWFLPWMAA

SEQ ID NO: 218961 - protein, 9 aa, Homo Sapiens
IRKLDLLGS

SEQ ID NO: 218962 - protein, 9 aa, Homo Sapiens
VLHRLTVGK

SEQ ID NO: 218963 - protein, 9 aa, Homo Sapiens
ETEVEAMEE

SEQ ID NO: 218964 - protein, 9 aa, Homo Sapiens
RTVIPKTST

SEQ ID NO: 218965 - protein, 9 aa, Homo Sapiens
PPPGPQPGR

SEQ ID NO: 218966 - protein, 9 aa, Homo Sapiens
FTRVNFIDS

SEQ ID NO: 218967 - protein, 9 aa, Homo Sapiens
AGPSGCGVP

SEQ ID NO: 218968 - protein, 9 aa, Homo Sapiens
WRVPLTPCS

SEQ ID NO: 218969 - protein, 9 aa, Homo Sapiens
EKHYHPSCV

SEQ ID NO: 218970 - protein, 9 aa, Homo Sapiens
LSSRDRAMK

SEQ ID NO: 218971 - protein, 9 aa, Homo Sapiens
TEDWQPTGT

SEQ ID NO: 218972 - protein, 9 aa, Homo Sapiens
PLVGSQHLF

SEQ ID NO: 218973 - protein, 9 aa, Homo Sapiens
ILDPPKSPH

SEQ ID NO: 218974 - protein, 9 aa, Homo Sapiens
RRRSRATFS

SEQ ID NO: 218975 - protein, 9 aa, Homo Sapiens
TDRDWETVS

SEQ ID NO: 218976 - protein, 9 aa, Homo Sapiens
LISLKKGLA

SEQ ID NO: 218977 - protein, 9 aa, Homo Sapiens
IGLSFLFCW

SEQ ID NO: 218978 - protein, 9 aa, Homo Sapiens
SLAVDGSAA

SEQ ID NO: 218979 - protein, 9 aa, Homo Sapiens
SGISYEEFQ

SEQ ID NO: 218980 - protein, 9 aa, Homo Sapiens
MSNSPQNGV

SEQ ID NO: 218981 - protein, 9 aa, Homo Sapiens
DILDRITTE

SEQ ID NO: 218982 - protein, 9 aa, Homo Sapiens
DVGGRGQSA

SEQ ID NO: 218983 - protein, 9 aa, Homo Sapiens
HPAHLRRYS

SEQ ID NO: 218984 - protein, 9 aa, Homo Sapiens
NDRHPVALR

SEQ ID NO: 218985 - protein, 9 aa, Homo Sapiens
FVMDGSFIC

SEQ ID NO: 218986 - protein, 9 aa, Homo Sapiens
TNRLLSNLT

SEQ ID NO: 218987 - protein, 9 aa, Homo Sapiens
CATIGWAWG

SEQ ID NO: 218988 - protein, 9 aa, Homo Sapiens
GSGGCQYLR

SEQ ID NO: 218989 - protein, 9 aa, Homo Sapiens
AITMALMGG

SEQ ID NO: 218990 - protein, 9 aa, Homo Sapiens
AKLLLPVAG

SEQ ID NO: 218991 - protein, 9 aa, Homo Sapiens
HDAHRKEIC

SEQ ID NO: 218992 - protein, 9 aa, Homo Sapiens
CGPSTPAMA

SEQ ID NO: 218993 - protein, 9 aa, Homo Sapiens
GTVAGYDMV

SEQ ID NO: 218994 - protein, 9 aa, Homo Sapiens
LKSYLRELL

SEQ ID NO: 218995 - protein, 9 aa, Homo Sapiens
KIPMKFKLL

SEQ ID NO: 218996 - protein, 9 aa, Homo Sapiens
DLEEAPERG

SEQ ID NO: 218997 - protein, 9 aa, Homo Sapiens
QQQLPSIWY

SEQ ID NO: 218998 - protein, 9 aa, Homo Sapiens
RDWVREWPS

SEQ ID NO: 218999 - protein, 9 aa, Homo Sapiens
RKRKKQTSI

SEQ ID NO: 219000 - protein, 9 aa, Homo Sapiens
HMSYAPRHV

SEQ ID NO: 219001 - protein, 9 aa, Homo Sapiens
EAMCVGHDQ

SEQ ID NO: 219002 - protein, 9 aa, Homo Sapiens
FMVIGNRES

SEQ ID NO: 219003 - protein, 9 aa, Homo Sapiens
PCNASIMCP

SEQ ID NO: 219004 - protein, 9 aa, Homo Sapiens
PSPPGAPPC

SEQ ID NO: 219005 - protein, 9 aa, Homo Sapiens
RTSLILHEG

SEQ ID NO: 219006 - protein, 9 aa, Homo Sapiens
PPHWLQARR

SEQ ID NO: 219007 - protein, 9 aa, Homo Sapiens
NQRRKYRLM

SEQ ID NO: 219008 - protein, 9 aa, Homo Sapiens
GYDMVARES

SEQ ID NO: 219009 - protein, 9 aa, Homo Sapiens
PPTQLMDSS

SEQ ID NO: 219010 - protein, 9 aa, Homo Sapiens
MLGMYRRPG

SEQ ID NO: 219011 - protein, 9 aa, Homo Sapiens
LPHQSPGHL

SEQ ID NO: 219012 - protein, 9 aa, Homo Sapiens
IFHQGISQV

SEQ ID NO: 219013 - protein, 9 aa, Homo Sapiens
KYHGVSLLD

SEQ ID NO: 219014 - protein, 9 aa, Homo Sapiens
YPDASYLGN

SEQ ID NO: 219015 - protein, 9 aa, Homo Sapiens
LLMVLAQLR

SEQ ID NO: 219016 - protein, 9 aa, Homo Sapiens
GASDHVTMP

SEQ ID NO: 219017 - protein, 9 aa, Homo Sapiens
KCQVSHGHP

SEQ ID NO: 219018 - protein, 9 aa, Homo Sapiens
TPQPSGLHL

SEQ ID NO: 219019 - protein, 9 aa, Homo Sapiens
SRQTQSQRK

SEQ ID NO: 219020 - protein, 9 aa, Homo Sapiens
HSTKRECLK

SEQ ID NO: 219021 - protein, 9 aa, Homo Sapiens
ASRKTWQRR

SEQ ID NO: 219022 - protein, 9 aa, Homo Sapiens
AYARVTGHA

SEQ ID NO: 219023 - protein, 9 aa, Homo Sapiens
VSVWRPHHG

SEQ ID NO: 219024 - protein, 9 aa, Homo Sapiens
TICSVSGRG

SEQ ID NO: 219025 - protein, 9 aa, Homo Sapiens
SDVSDSWPE

SEQ ID NO: 219026 - protein, 9 aa, Homo Sapiens
MSDTCSPGM

SEQ ID NO: 219027 - protein, 9 aa, Homo Sapiens
TASTTRCRR

SEQ ID NO: 219028 - protein, 9 aa, Homo Sapiens
GVHSSPNDQ

SEQ ID NO: 219029 - protein, 9 aa, Homo Sapiens
PKAGQSQPC

SEQ ID NO: 219030 - protein, 9 aa, Homo Sapiens
ATEFLSPQE

SEQ ID NO: 219031 - protein, 9 aa, Homo Sapiens
ELNVARLCH

SEQ ID NO: 219032 - protein, 9 aa, Homo Sapiens
MRINNNRLR

SEQ ID NO: 219033 - protein, 9 aa, Homo Sapiens
LFLLHQVLR

SEQ ID NO: 219034 - protein, 9 aa, Homo Sapiens
RRLPDFNVI

SEQ ID NO: 219035 - protein, 9 aa, Homo Sapiens
WQVVWVIGG

SEQ ID NO: 219036 - protein, 9 aa, Homo Sapiens
HKKVILQVR

SEQ ID NO: 219037 - protein, 9 aa, Homo Sapiens
STFVELKTV

SEQ ID NO: 219038 - protein, 9 aa, Homo Sapiens
DGMSGSGHC

SEQ ID NO: 219039 - protein, 9 aa, Homo Sapiens
QHQKQSEMP

SEQ ID NO: 219040 - protein, 9 aa, Homo Sapiens
LRLQSLLSL

SEQ ID NO: 219041 - protein, 9 aa, Homo Sapiens
NLTGIPGGN

SEQ ID NO: 219042 - protein, 9 aa, Homo Sapiens
IRTSMCQNL

SEQ ID NO: 219043 - protein, 9 aa, Homo Sapiens
GVADEEGEE

SEQ ID NO: 219044 - protein, 9 aa, Homo Sapiens
LVWTEVLVN

SEQ ID NO: 219045 - protein, 9 aa, Homo Sapiens
ISAQSLPSL

SEQ ID NO: 219046 - protein, 9 aa, Homo Sapiens
RCPQAAARR

SEQ ID NO: 219047 - protein, 9 aa, Homo Sapiens
TGTTSALTC

SEQ ID NO: 219048 - protein, 9 aa, Homo Sapiens
LDLLGSGLR

SEQ ID NO: 219049 - protein, 9 aa, Homo Sapiens
LICNLAAIT

SEQ ID NO: 219050 - protein, 9 aa, Homo Sapiens
YLKNKKEVG

SEQ ID NO: 219051 - protein, 9 aa, Homo Sapiens
ARPPAPRRG

SEQ ID NO: 219052 - protein, 9 aa, Homo Sapiens
IKDLSQILE

SEQ ID NO: 219053 - protein, 9 aa, Homo Sapiens
RARVHRCSR

SEQ ID NO: 219054 - protein, 9 aa, Homo Sapiens
TTINLGDLP

SEQ ID NO: 219055 - protein, 9 aa, Homo Sapiens
APSYPAGSP

SEQ ID NO: 219056 - protein, 9 aa, Homo Sapiens
DPVLSYGDV

SEQ ID NO: 219057 - protein, 9 aa, Homo Sapiens
TSRNCTAAL

SEQ ID NO: 219058 - protein, 9 aa, Homo Sapiens
ASQMHVEDP

SEQ ID NO: 219059 - protein, 9 aa, Homo Sapiens
NSPKGAHCS

SEQ ID NO: 219060 - protein, 9 aa, Homo Sapiens
AVQNLEHWE

SEQ ID NO: 219061 - protein, 9 aa, Homo Sapiens
DCYIHNSVI

SEQ ID NO: 219062 - protein, 9 aa, Homo Sapiens
FVELLLNFI

SEQ ID NO: 219063 - protein, 9 aa, Homo Sapiens
GARIPWKGH

SEQ ID NO: 219064 - protein, 9 aa, Homo Sapiens
VVNGPASET

SEQ ID NO: 219065 - protein, 9 aa, Homo Sapiens
GQEKDCWAA

SEQ ID NO: 219066 - protein, 9 aa, Homo Sapiens
RITPLSIQT

SEQ ID NO: 219067 - protein, 9 aa, Homo Sapiens
PGGKEETLA

SEQ ID NO: 219068 - protein, 9 aa, Homo Sapiens
APKNRHTIE

SEQ ID NO: 219069 - protein, 9 aa, Homo Sapiens
WTSRTSPPA

SEQ ID NO: 219070 - protein, 9 aa, Homo Sapiens
GGTAAGGQP

SEQ ID NO: 219071 - protein, 9 aa, Homo Sapiens
SQPERLLFI

SEQ ID NO: 219072 - protein, 9 aa, Homo Sapiens
LAMGLAQPA

SEQ ID NO: 219073 - protein, 9 aa, Homo Sapiens
EQLRGQRPA

SEQ ID NO: 219074 - protein, 9 aa, Homo Sapiens
KRCNPCCRL

SEQ ID NO: 219075 - protein, 9 aa, Homo Sapiens
TTVHLEATL

SEQ ID NO: 219076 - protein, 9 aa, Homo Sapiens
RMNEEMDRA

SEQ ID NO: 219077 - protein, 9 aa, Homo Sapiens
LGLYPVLCS

SEQ ID NO: 219078 - protein, 9 aa, Homo Sapiens
VAVQNLEHW

SEQ ID NO: 219079 - protein, 9 aa, Homo Sapiens
YPTALLHYL

SEQ ID NO: 219080 - protein, 9 aa, Homo Sapiens
LKVFSRDGL

SEQ ID NO: 219081 - protein, 9 aa, Homo Sapiens
GGLDDRSPQ

SEQ ID NO: 219082 - protein, 9 aa, Homo Sapiens
WDATILEYL

SEQ ID NO: 219083 - protein, 9 aa, Homo Sapiens
GIHHFFCDD

SEQ ID NO: 219084 - protein, 9 aa, Homo Sapiens
RHLALMFPM

SEQ ID NO: 219085 - protein, 9 aa, Homo Sapiens
EWKEEEERL

SEQ ID NO: 219086 - protein, 9 aa, Homo Sapiens
RSQHLPPLA

SEQ ID NO: 219087 - protein, 9 aa, Homo Sapiens
HGVVLHSIL

SEQ ID NO: 219088 - protein, 9 aa, Homo Sapiens
LRWRMNEEM

SEQ ID NO: 219089 - protein, 9 aa, Homo Sapiens
IVPRWMRVW

SEQ ID NO: 219090 - protein, 9 aa, Homo Sapiens
LLSQRIIRW

SEQ ID NO: 219091 - protein, 9 aa, Homo Sapiens
RSQQNHHSF

SEQ ID NO: 219092 - protein, 9 aa, Homo Sapiens
EVFRAHIIS

SEQ ID NO: 219093 - protein, 9 aa, Homo Sapiens
FTILNSKQF

SEQ ID NO: 219094 - protein, 9 aa, Homo Sapiens
EWKKSQLLI

SEQ ID NO: 219095 - protein, 9 aa, Homo Sapiens
EVFFNTTGC

SEQ ID NO: 219096 - protein, 9 aa, Homo Sapiens
LVMCLRNAH

SEQ ID NO: 219097 - protein, 9 aa, Homo Sapiens
SDVFQQWKC

SEQ ID NO: 219098 - protein, 9 aa, Homo Sapiens
EAGKEVEVS

SEQ ID NO: 219099 - protein, 9 aa, Homo Sapiens
APGARIPWK

SEQ ID NO: 219100 - protein, 9 aa, Homo Sapiens
AGWQPEEQL

SEQ ID NO: 219101 - protein, 9 aa, Homo Sapiens
KKTAPTPPR

SEQ ID NO: 219102 - protein, 9 aa, Homo Sapiens
DTELQSELL

SEQ ID NO: 219103 - protein, 9 aa, Homo Sapiens
LVHRRLAGS

SEQ ID NO: 219104 - protein, 9 aa, Homo Sapiens
LPKLLCRQM

SEQ ID NO: 219105 - protein, 9 aa, Homo Sapiens
TLLLVLQGR

SEQ ID NO: 219106 - protein, 9 aa, Homo Sapiens
YARVTGHAM

SEQ ID NO: 219107 - protein, 9 aa, Homo Sapiens
HRVGPAQCR

SEQ ID NO: 219108 - protein, 9 aa, Homo Sapiens
ILISGESGT

SEQ ID NO: 219109 - protein, 9 aa, Homo Sapiens
KERLAELRK

SEQ ID NO: 219110 - protein, 9 aa, Homo Sapiens
DNQVYVATT

SEQ ID NO: 219111 - protein, 9 aa, Homo Sapiens
IGPRGLGSQ

SEQ ID NO: 219112 - protein, 9 aa, Homo Sapiens
PPNSCVLRE

SEQ ID NO: 219113 - protein, 9 aa, Homo Sapiens
VSLGVRHTV

SEQ ID NO: 219114 - protein, 9 aa, Homo Sapiens
WKRKYSSQI

SEQ ID NO: 219115 - protein, 9 aa, Homo Sapiens
TIQPQATGL

SEQ ID NO: 219116 - protein, 9 aa, Homo Sapiens
NRLVRPREE

SEQ ID NO: 219117 - protein, 9 aa, Homo Sapiens
ADNANFNQG

SEQ ID NO: 219118 - protein, 9 aa, Homo Sapiens
LRCPLTAPL

SEQ ID NO: 219119 - protein, 9 aa, Homo Sapiens
QFSKVLIKL

SEQ ID NO: 219120 - protein, 9 aa, Homo Sapiens
KWTLSSVAQ

SEQ ID NO: 219121 - protein, 9 aa, Homo Sapiens
SSCRRPSSS

SEQ ID NO: 219122 - protein, 9 aa, Homo Sapiens
TRRARMFAR

SEQ ID NO: 219123 - protein, 9 aa, Homo Sapiens
TAISQTIIR

SEQ ID NO: 219124 - protein, 9 aa, Homo Sapiens
RLMQEQLQD

SEQ ID NO: 219125 - protein, 9 aa, Homo Sapiens
SAPFGASLD

SEQ ID NO: 219126 - protein, 9 aa, Homo Sapiens
INREGIPLD

SEQ ID NO: 219127 - protein, 9 aa, Homo Sapiens
PTAARPPSS

SEQ ID NO: 219128 - protein, 9 aa, Homo Sapiens
CGHGAEEGE

SEQ ID NO: 219129 - protein, 9 aa, Homo Sapiens
TCSVPPCLT

SEQ ID NO: 219130 - protein, 9 aa, Homo Sapiens
TGLYCFPSS

SEQ ID NO: 219131 - protein, 9 aa, Homo Sapiens
ERVTARAGA

SEQ ID NO: 219132 - protein, 9 aa, Homo Sapiens
SFVVDFNEP

SEQ ID NO: 219133 - protein, 9 aa, Homo Sapiens
FSPRGRERR

SEQ ID NO: 219134 - protein, 9 aa, Homo Sapiens
EKGGEQAQV

SEQ ID NO: 219135 - protein, 9 aa, Homo Sapiens
GNVKVVQLL

SEQ ID NO: 219136 - protein, 9 aa, Homo Sapiens
AVQQAQGGG

SEQ ID NO: 219137 - protein, 9 aa, Homo Sapiens
NDVDECNDG

SEQ ID NO: 219138 - protein, 9 aa, Homo Sapiens
QPPHWLQAR

SEQ ID NO: 219139 - protein, 9 aa, Homo Sapiens
HSPDEKSQI

SEQ ID NO: 219140 - protein, 9 aa, Homo Sapiens
SRPRTACIS

SEQ ID NO: 219141 - protein, 9 aa, Homo Sapiens
GLGKEANSG

SEQ ID NO: 219142 - protein, 9 aa, Homo Sapiens
AGRQAITSH

SEQ ID NO: 219143 - protein, 9 aa, Homo Sapiens
GIGCGFGGP

SEQ ID NO: 219144 - protein, 9 aa, Homo Sapiens
VRLMGPWHL

SEQ ID NO: 219145 - protein, 9 aa, Homo Sapiens
ECPISTQSF

SEQ ID NO: 219146 - protein, 9 aa, Homo Sapiens
RAGGCASCP

SEQ ID NO: 219147 - protein, 9 aa, Homo Sapiens
RGSSQAETE

SEQ ID NO: 219148 - protein, 9 aa, Homo Sapiens
LVWGPPDQG

SEQ ID NO: 219149 - protein, 9 aa, Homo Sapiens
QLVGDVVHP

SEQ ID NO: 219150 - protein, 9 aa, Homo Sapiens
PPCSQRLWQ

SEQ ID NO: 219151 - protein, 9 aa, Homo Sapiens
LECPVSTQS

SEQ ID NO: 219152 - protein, 9 aa, Homo Sapiens
QFTVDHGME

SEQ ID NO: 219153 - protein, 9 aa, Homo Sapiens
CLLRGLWQR

SEQ ID NO: 219154 - protein, 9 aa, Homo Sapiens
SRDCVAAAE

SEQ ID NO: 219155 - protein, 9 aa, Homo Sapiens
QPQATGLLK

SEQ ID NO: 219156 - protein, 9 aa, Homo Sapiens
RGRVWPSSR

SEQ ID NO: 219157 - protein, 9 aa, Homo Sapiens
CSQEQSVKT

SEQ ID NO: 219158 - protein, 9 aa, Homo Sapiens
KCSGPLQFK

SEQ ID NO: 219159 - protein, 9 aa, Homo Sapiens
SSRTSAGCA

SEQ ID NO: 219160 - protein, 9 aa, Homo Sapiens
NNSDTLELP

SEQ ID NO: 219161 - protein, 9 aa, Homo Sapiens
KSCTQRKTD

SEQ ID NO: 219162 - protein, 9 aa, Homo Sapiens
TVTLEKCGY

SEQ ID NO: 219163 - protein, 9 aa, Homo Sapiens
LEYDRDLSV

SEQ ID NO: 219164 - protein, 9 aa, Homo Sapiens
EAKLLVASI

SEQ ID NO: 219165 - protein, 9 aa, Homo Sapiens
LGHRGWRLP

SEQ ID NO: 219166 - protein, 9 aa, Homo Sapiens
NQTLQVIID

SEQ ID NO: 219167 - protein, 9 aa, Homo Sapiens
RWMRVWRSS

SEQ ID NO: 219168 - protein, 9 aa, Homo Sapiens
RCRTPQAPS

SEQ ID NO: 219169 - protein, 9 aa, Homo Sapiens
APGSQLPPL

SEQ ID NO: 219170 - protein, 9 aa, Homo Sapiens
RESGSKLLE

SEQ ID NO: 219171 - protein, 9 aa, Homo Sapiens
QSQPCVDVH

SEQ ID NO: 219172 - protein, 9 aa, Homo Sapiens
HASSGAKTF

SEQ ID NO: 219173 - protein, 9 aa, Homo Sapiens
RQSAAYGLG

SEQ ID NO: 219174 - protein, 9 aa, Homo Sapiens
PLLVVILFV

SEQ ID NO: 219175 - protein, 9 aa, Homo Sapiens
EERQYRCKD

SEQ ID NO: 219176 - protein, 9 aa, Homo Sapiens
DELPHVGVT

SEQ ID NO: 219177 - protein, 9 aa, Homo Sapiens
RLRLRLPRT

SEQ ID NO: 219178 - protein, 9 aa, Homo Sapiens
VRSVRRQHC

SEQ ID NO: 219179 - protein, 9 aa, Homo Sapiens
NSSDSLEGQ

SEQ ID NO: 219180 - protein, 9 aa, Homo Sapiens
RKSGSGSGL

SEQ ID NO: 219181 - protein, 9 aa, Homo Sapiens
GEPWDTERN

SEQ ID NO: 219182 - protein, 9 aa, Homo Sapiens
GLHVGLRSG

SEQ ID NO: 219183 - protein, 9 aa, Homo Sapiens
EQGLVVLTA

SEQ ID NO: 219184 - protein, 9 aa, Homo Sapiens
RLLGDLDRN

SEQ ID NO: 219185 - protein, 9 aa, Homo Sapiens
PAPHRSPPR

SEQ ID NO: 219186 - protein, 9 aa, Homo Sapiens
TYNRVPSAT

SEQ ID NO: 219187 - protein, 9 aa, Homo Sapiens
AVAPAVLLV

SEQ ID NO: 219188 - protein, 9 aa, Homo Sapiens
SGSKLLEIF

SEQ ID NO: 219189 - protein, 9 aa, Homo Sapiens
LVTLVMFAW

SEQ ID NO: 219190 - protein, 9 aa, Homo Sapiens
GFGFCLANY

SEQ ID NO: 219191 - protein, 9 aa, Homo Sapiens
LIHLSDFFS

SEQ ID NO: 219192 - protein, 9 aa, Homo Sapiens
GLLALSSSP

SEQ ID NO: 219193 - protein, 9 aa, Homo Sapiens
QLRWKPLLW

SEQ ID NO: 219194 - protein, 9 aa, Homo Sapiens
QHAGQEKDC

SEQ ID NO: 219195 - protein, 9 aa, Homo Sapiens
LTGRALLSK

SEQ ID NO: 219196 - protein, 9 aa, Homo Sapiens
QVFMVIGNR

SEQ ID NO: 219197 - protein, 9 aa, Homo Sapiens
KVSIQFERV

SEQ ID NO: 219198 - protein, 9 aa, Homo Sapiens
QPHMLNHDL

SEQ ID NO: 219199 - protein, 9 aa, Homo Sapiens
SEPPEERVT

SEQ ID NO: 219200 - protein, 9 aa, Homo Sapiens
SIPQPWSPT

SEQ ID NO: 219201 - protein, 9 aa, Homo Sapiens
RHCWWPTGR

SEQ ID NO: 219202 - protein, 9 aa, Homo Sapiens
VPHGADLDE

SEQ ID NO: 219203 - protein, 9 aa, Homo Sapiens
MKHRRDFIK

SEQ ID NO: 219204 - protein, 9 aa, Homo Sapiens
TNSVPTPNH

SEQ ID NO: 219205 - protein, 9 aa, Homo Sapiens
KIDSEIKKQ

SEQ ID NO: 219206 - protein, 9 aa, Homo Sapiens
NAWGIQKKT

SEQ ID NO: 219207 - protein, 9 aa, Homo Sapiens
LDALVATTI

SEQ ID NO: 219208 - protein, 9 aa, Homo Sapiens
VGTVISKKF

SEQ ID NO: 219209 - protein, 9 aa, Homo Sapiens
LDPDATQFI

SEQ ID NO: 219210 - protein, 9 aa, Homo Sapiens
PTNAPGVFR

SEQ ID NO: 219211 - protein, 9 aa, Homo Sapiens
KKSTKKILK

SEQ ID NO: 219212 - protein, 9 aa, Homo Sapiens
IITMDTAGM

SEQ ID NO: 219213 - protein, 9 aa, Homo Sapiens
VFSNAMCKL

SEQ ID NO: 219214 - protein, 9 aa, Homo Sapiens
PQSVLGRVF

SEQ ID NO: 219215 - protein, 9 aa, Homo Sapiens
YEAAGSALQ

SEQ ID NO: 219216 - protein, 9 aa, Homo Sapiens
FSTFVELKT

SEQ ID NO: 219217 - protein, 9 aa, Homo Sapiens
TPCSSQWSP

SEQ ID NO: 219218 - protein, 9 aa, Homo Sapiens
FTPPSGDMM

SEQ ID NO: 219219 - protein, 9 aa, Homo Sapiens
MTVFATIIG

SEQ ID NO: 219220 - protein, 9 aa, Homo Sapiens
PTSSSIQRA

SEQ ID NO: 219221 - protein, 9 aa, Homo Sapiens
HQPDVVVQQ

SEQ ID NO: 219222 - protein, 9 aa, Homo Sapiens
TIMMRCHSW

SEQ ID NO: 219223 - protein, 9 aa, Homo Sapiens
WGAAEELAS

SEQ ID NO: 219224 - protein, 9 aa, Homo Sapiens
AVGVVLSPW

SEQ ID NO: 219225 - protein, 9 aa, Homo Sapiens
GKKLVKISE

SEQ ID NO: 219226 - protein, 9 aa, Homo Sapiens
TPRASSGCG

SEQ ID NO: 219227 - protein, 9 aa, Homo Sapiens
VKTWMQGIS

SEQ ID NO: 219228 - protein, 9 aa, Homo Sapiens
LKIIACLPL

SEQ ID NO: 219229 - protein, 9 aa, Homo Sapiens
QLQPPLCST

SEQ ID NO: 219230 - protein, 9 aa, Homo Sapiens
GWVAIYSDF

SEQ ID NO: 219231 - protein, 9 aa, Homo Sapiens
ESGSRAAGP

SEQ ID NO: 219232 - protein, 9 aa, Homo Sapiens
GTIQRTHMP

SEQ ID NO: 219233 - protein, 9 aa, Homo Sapiens
GRGQSAKSG

SEQ ID NO: 219234 - protein, 9 aa, Homo Sapiens
TLLVVLLLG

SEQ ID NO: 219235 - protein, 9 aa, Homo Sapiens
LTCLPAVTT

SEQ ID NO: 219236 - protein, 9 aa, Homo Sapiens
YLLAYPQNP

SEQ ID NO: 219237 - protein, 9 aa, Homo Sapiens
KFLVANQIL

SEQ ID NO: 219238 - protein, 9 aa, Homo Sapiens
AFLLDHGVS

SEQ ID NO: 219239 - protein, 9 aa, Homo Sapiens
CQAWFTNCE

SEQ ID NO: 219240 - protein, 9 aa, Homo Sapiens
EGEKNQLTR

SEQ ID NO: 219241 - protein, 9 aa, Homo Sapiens
SGRASRKTW

SEQ ID NO: 219242 - protein, 9 aa, Homo Sapiens
TGCCSAASS

SEQ ID NO: 219243 - protein, 9 aa, Homo Sapiens
FTKTCRKPA

SEQ ID NO: 219244 - protein, 9 aa, Homo Sapiens
GQARAAQRK

SEQ ID NO: 219245 - protein, 9 aa, Homo Sapiens
GDTAPGGAA

SEQ ID NO: 219246 - protein, 9 aa, Homo Sapiens
LLSAQENIV

SEQ ID NO: 219247 - protein, 9 aa, Homo Sapiens
LPTLSTLQQ

SEQ ID NO: 219248 - protein, 9 aa, Homo Sapiens
HYAREWSPY

SEQ ID NO: 219249 - protein, 9 aa, Homo Sapiens
VTLDGQNWL

SEQ ID NO: 219250 - protein, 9 aa, Homo Sapiens
RHHKHNLKH

SEQ ID NO: 219251 - protein, 9 aa, Homo Sapiens
GMGTQQARE

SEQ ID NO: 219252 - protein, 9 aa, Homo Sapiens
RAWGSPSPW

SEQ ID NO: 219253 - protein, 9 aa, Homo Sapiens
RPTRSEPFW

SEQ ID NO: 219254 - protein, 9 aa, Homo Sapiens
YGGGHTLAG

SEQ ID NO: 219255 - protein, 9 aa, Homo Sapiens
TSTLRGTSS

SEQ ID NO: 219256 - protein, 9 aa, Homo Sapiens
AGKEVEVSQ

SEQ ID NO: 219257 - protein, 9 aa, Homo Sapiens
MFNLAYLYE

SEQ ID NO: 219258 - protein, 9 aa, Homo Sapiens
QALEAEQQA

SEQ ID NO: 219259 - protein, 9 aa, Homo Sapiens
EISILDVCL

SEQ ID NO: 219260 - protein, 9 aa, Homo Sapiens
YLTGGLWAW

SEQ ID NO: 219261 - protein, 9 aa, Homo Sapiens
MTFRLVVLC

SEQ ID NO: 219262 - protein, 9 aa, Homo Sapiens
AQYLEETFG

SEQ ID NO: 219263 - protein, 9 aa, Homo Sapiens
QLPSIWYEN

SEQ ID NO: 219264 - protein, 9 aa, Homo Sapiens
EGTKTVTKY

SEQ ID NO: 219265 - protein, 9 aa, Homo Sapiens
LRTRADAHN

SEQ ID NO: 219266 - protein, 9 aa, Homo Sapiens
ATPGVDLSC

SEQ ID NO: 219267 - protein, 9 aa, Homo Sapiens
ELQSELLSF

SEQ ID NO: 219268 - protein, 9 aa, Homo Sapiens
LIISTVAGG

SEQ ID NO: 219269 - protein, 9 aa, Homo Sapiens
PMPTGLRKA

SEQ ID NO: 219270 - protein, 9 aa, Homo Sapiens
YATICNPLL

SEQ ID NO: 219271 - protein, 9 aa, Homo Sapiens
CITDSRRTV

SEQ ID NO: 219272 - protein, 9 aa, Homo Sapiens
LFESFNGMM

SEQ ID NO: 219273 - protein, 9 aa, Homo Sapiens
WSWPMTIPG

SEQ ID NO: 219274 - protein, 9 aa, Homo Sapiens
VDLVHGALQ

SEQ ID NO: 219275 - protein, 9 aa, Homo Sapiens
QTEIPYVTV

SEQ ID NO: 219276 - protein, 9 aa, Homo Sapiens
LQPPPYHEL

SEQ ID NO: 219277 - protein, 9 aa, Homo Sapiens
AQPGAEWSF

SEQ ID NO: 219278 - protein, 9 aa, Homo Sapiens
SAASQRFPP

SEQ ID NO: 219279 - protein, 9 aa, Homo Sapiens
MGSLLMASW

SEQ ID NO: 219280 - protein, 9 aa, Homo Sapiens
YNMRGSFWC

SEQ ID NO: 219281 - protein, 9 aa, Homo Sapiens
TFWVVFVLL

SEQ ID NO: 219282 - protein, 9 aa, Homo Sapiens
DSLLAFGIV

SEQ ID NO: 219283 - protein, 9 aa, Homo Sapiens
LKKCSLYGK

SEQ ID NO: 219284 - protein, 9 aa, Homo Sapiens
YALARCAVP

SEQ ID NO: 219285 - protein, 9 aa, Homo Sapiens
KATAVGDVV

SEQ ID NO: 219286 - protein, 9 aa, Homo Sapiens
VDVGGRGQS

SEQ ID NO: 219287 - protein, 9 aa, Homo Sapiens
CAFGATHQS

SEQ ID NO: 219288 - protein, 9 aa, Homo Sapiens
GISYEEFQV

SEQ ID NO: 219289 - protein, 9 aa, Homo Sapiens
RCSFKVPPV

SEQ ID NO: 219290 - protein, 9 aa, Homo Sapiens
IYFFFFLLL

SEQ ID NO: 219291 - protein, 9 aa, Homo Sapiens
FFRKLSMDV

SEQ ID NO: 219292 - protein, 9 aa, Homo Sapiens
PQEESRDGE

SEQ ID NO: 219293 - protein, 9 aa, Homo Sapiens
WSLGVVFRL

SEQ ID NO: 219294 - protein, 9 aa, Homo Sapiens
MRIALGGCS

SEQ ID NO: 219295 - protein, 9 aa, Homo Sapiens
LVVLCRVGA

SEQ ID NO: 219296 - protein, 9 aa, Homo Sapiens
KSHIEDGDI

SEQ ID NO: 219297 - protein, 9 aa, Homo Sapiens
TVNVRNSEG

SEQ ID NO: 219298 - protein, 9 aa, Homo Sapiens
QDGARCPSC

SEQ ID NO: 219299 - protein, 9 aa, Homo Sapiens
VLEWCIGTV

SEQ ID NO: 219300 - protein, 9 aa, Homo Sapiens
QQEQLLMQL

SEQ ID NO: 219301 - protein, 9 aa, Homo Sapiens
IAPPGMPAV

SEQ ID NO: 219302 - protein, 9 aa, Homo Sapiens
LKEEAHEFG

SEQ ID NO: 219303 - protein, 9 aa, Homo Sapiens
ETDNPVIPA

SEQ ID NO: 219304 - protein, 9 aa, Homo Sapiens
GLHGDSSPL

SEQ ID NO: 219305 - protein, 9 aa, Homo Sapiens
EIIWKCIGE

SEQ ID NO: 219306 - protein, 9 aa, Homo Sapiens
LEIFALESA

SEQ ID NO: 219307 - protein, 9 aa, Homo Sapiens
KEQLQQEIK

SEQ ID NO: 219308 - protein, 9 aa, Homo Sapiens
SRGEGNHHH

SEQ ID NO: 219309 - protein, 9 aa, Homo Sapiens
PTRPRPTSQ

SEQ ID NO: 219310 - protein, 9 aa, Homo Sapiens
APQVAMLPK

SEQ ID NO: 219311 - protein, 9 aa, Homo Sapiens
NSHSEATQA

SEQ ID NO: 219312 - protein, 9 aa, Homo Sapiens
RDWETVSAA

SEQ ID NO: 219313 - protein, 9 aa, Homo Sapiens
FVVDFNEPL

SEQ ID NO: 219314 - protein, 9 aa, Homo Sapiens
ERCHLWGSY

SEQ ID NO: 219315 - protein, 9 aa, Homo Sapiens
DSKNAPHLQ

SEQ ID NO: 219316 - protein, 9 aa, Homo Sapiens
GWLPRLTRE

SEQ ID NO: 219317 - protein, 9 aa, Homo Sapiens
FCVTAPRHC

SEQ ID NO: 219318 - protein, 9 aa, Homo Sapiens
LGLHVHPRN

SEQ ID NO: 219319 - protein, 9 aa, Homo Sapiens
AGGAQAISY

SEQ ID NO: 219320 - protein, 9 aa, Homo Sapiens
SRTPRRQRS

SEQ ID NO: 219321 - protein, 9 aa, Homo Sapiens
DDPPGGRPR

SEQ ID NO: 219322 - protein, 9 aa, Homo Sapiens
MHTGEKPYA

SEQ ID NO: 219323 - protein, 9 aa, Homo Sapiens
GRHTAGLKL

SEQ ID NO: 219324 - protein, 9 aa, Homo Sapiens
GVETIWDIL

SEQ ID NO: 219325 - protein, 9 aa, Homo Sapiens
PQLPDRPPK

SEQ ID NO: 219326 - protein, 9 aa, Homo Sapiens
NQLRVFLSL

SEQ ID NO: 219327 - protein, 9 aa, Homo Sapiens
EATQQVLCV

SEQ ID NO: 219328 - protein, 9 aa, Homo Sapiens
NHPKRGTGI

SEQ ID NO: 219329 - protein, 9 aa, Homo Sapiens
RGAPGGRAR

SEQ ID NO: 219330 - protein, 9 aa, Homo Sapiens
CDYTLGKFA

SEQ ID NO: 219331 - protein, 9 aa, Homo Sapiens
SAAMMAITI

SEQ ID NO: 219332 - protein, 9 aa, Homo Sapiens
HGIGVCSGN

SEQ ID NO: 219333 - protein, 9 aa, Homo Sapiens
DVVKVGLVE

SEQ ID NO: 219334 - protein, 9 aa, Homo Sapiens
ARRWQAECF

SEQ ID NO: 219335 - protein, 9 aa, Homo Sapiens
RGLRLIKSS

SEQ ID NO: 219336 - protein, 9 aa, Homo Sapiens
YLCSSASSA

SEQ ID NO: 219337 - protein, 9 aa, Homo Sapiens
PTPPPGRRR

SEQ ID NO: 219338 - protein, 9 aa, Homo Sapiens
GPPTQLMDS

SEQ ID NO: 219339 - protein, 9 aa, Homo Sapiens
EIPPPAPAT

SEQ ID NO: 219340 - protein, 9 aa, Homo Sapiens
LRRASGTLL

SEQ ID NO: 219341 - protein, 9 aa, Homo Sapiens
LTVGKSHLL

SEQ ID NO: 219342 - protein, 9 aa, Homo Sapiens
LILQLVGDV

SEQ ID NO: 219343 - protein, 9 aa, Homo Sapiens
SRAAEPGYL

SEQ ID NO: 219344 - protein, 9 aa, Homo Sapiens
SGLQGCVQV

SEQ ID NO: 219345 - protein, 9 aa, Homo Sapiens
TQLVVVDFS

SEQ ID NO: 219346 - protein, 9 aa, Homo Sapiens
HAVRAPHAA

SEQ ID NO: 219347 - protein, 9 aa, Homo Sapiens
KFAPFFVPM

SEQ ID NO: 219348 - protein, 9 aa, Homo Sapiens
PLGCSGLPE

SEQ ID NO: 219349 - protein, 9 aa, Homo Sapiens
PNPSVTDAQ

SEQ ID NO: 219350 - protein, 9 aa, Homo Sapiens
YTARLAPGS

SEQ ID NO: 219351 - protein, 9 aa, Homo Sapiens
FLIQLKSVK

SEQ ID NO: 219352 - protein, 9 aa, Homo Sapiens
VVEELESYA

SEQ ID NO: 219353 - protein, 9 aa, Homo Sapiens
RPSHSPPSL

SEQ ID NO: 219354 - protein, 9 aa, Homo Sapiens
QERWQMKRL

SEQ ID NO: 219355 - protein, 9 aa, Homo Sapiens
SIATSQATT

SEQ ID NO: 219356 - protein, 9 aa, Homo Sapiens
IIGPRGLGS

SEQ ID NO: 219357 - protein, 9 aa, Homo Sapiens
FPHLLQEPC

SEQ ID NO: 219358 - protein, 9 aa, Homo Sapiens
EKSRSMLRE

SEQ ID NO: 219359 - protein, 9 aa, Homo Sapiens
LEAVREENV

SEQ ID NO: 219360 - protein, 9 aa, Homo Sapiens
SRLWPHSKQ

SEQ ID NO: 219361 - protein, 9 aa, Homo Sapiens
VFDLYEGQI

SEQ ID NO: 219362 - protein, 9 aa, Homo Sapiens
ALGPGRGYR

SEQ ID NO: 219363 - protein, 9 aa, Homo Sapiens
GPQWQVVWV

SEQ ID NO: 219364 - protein, 9 aa, Homo Sapiens
FKSDFNTGG

SEQ ID NO: 219365 - protein, 9 aa, Homo Sapiens
IGVCSGNGC

SEQ ID NO: 219366 - protein, 9 aa, Homo Sapiens
GIWEVMPRT

SEQ ID NO: 219367 - protein, 9 aa, Homo Sapiens
LVAASPTTA

SEQ ID NO: 219368 - protein, 9 aa, Homo Sapiens
LARPALLLQ

SEQ ID NO: 219369 - protein, 9 aa, Homo Sapiens
YNIQMYDHV

SEQ ID NO: 219370 - protein, 9 aa, Homo Sapiens
NPCPVGKQQ

SEQ ID NO: 219371 - protein, 9 aa, Homo Sapiens
NSKQFIKYY

SEQ ID NO: 219372 - protein, 9 aa, Homo Sapiens
SCPPPHRCC

SEQ ID NO: 219373 - protein, 9 aa, Homo Sapiens
NKVSILESL

SEQ ID NO: 219374 - protein, 9 aa, Homo Sapiens
PTKDNLAPS

SEQ ID NO: 219375 - protein, 9 aa, Homo Sapiens
EVQTEYVPL

SEQ ID NO: 219376 - protein, 9 aa, Homo Sapiens
PTALLHYLD

SEQ ID NO: 219377 - protein, 9 aa, Homo Sapiens
ANKLKKMCA

SEQ ID NO: 219378 - protein, 9 aa, Homo Sapiens
QTQSQRKMK

SEQ ID NO: 219379 - protein, 9 aa, Homo Sapiens
PGIIILAVE

SEQ ID NO: 219380 - protein, 9 aa, Homo Sapiens
ACDLRRGCY

SEQ ID NO: 219381 - protein, 9 aa, Homo Sapiens
WAASRRRAG

SEQ ID NO: 219382 - protein, 9 aa, Homo Sapiens
SPADWTREE

SEQ ID NO: 219383 - protein, 9 aa, Homo Sapiens
AIYSDFQTE

SEQ ID NO: 219384 - protein, 9 aa, Homo Sapiens
LGERGLVAT

SEQ ID NO: 219385 - protein, 9 aa, Homo Sapiens
LPECFRHAP

SEQ ID NO: 219386 - protein, 9 aa, Homo Sapiens
PPSNRIRLH

SEQ ID NO: 219387 - protein, 9 aa, Homo Sapiens
IVFAIWLAP

SEQ ID NO: 219388 - protein, 9 aa, Homo Sapiens
IRLHRLILP

SEQ ID NO: 219389 - protein, 9 aa, Homo Sapiens
DGDSLLAFG

SEQ ID NO: 219390 - protein, 9 aa, Homo Sapiens
EGVKSENKQ

SEQ ID NO: 219391 - protein, 9 aa, Homo Sapiens
SNAGIPQHH

SEQ ID NO: 219392 - protein, 9 aa, Homo Sapiens
SMRSDRLAV

SEQ ID NO: 219393 - protein, 9 aa, Homo Sapiens
PHQLEHSHQ

SEQ ID NO: 219394 - protein, 9 aa, Homo Sapiens
GRERRGTTL

SEQ ID NO: 219395 - protein, 9 aa, Homo Sapiens
AASCRPTRS

SEQ ID NO: 219396 - protein, 9 aa, Homo Sapiens
EEHMRSTLR

SEQ ID NO: 219397 - protein, 9 aa, Homo Sapiens
RWPPLTLQQ

SEQ ID NO: 219398 - protein, 9 aa, Homo Sapiens
DVNIIETKP

SEQ ID NO: 219399 - protein, 9 aa, Homo Sapiens
SLIYTVYSS

SEQ ID NO: 219400 - protein, 9 aa, Homo Sapiens
GNWRVPLTP

SEQ ID NO: 219401 - protein, 9 aa, Homo Sapiens
QSYGKTFSS

SEQ ID NO: 219402 - protein, 9 aa, Homo Sapiens
RYLLQAVGL

SEQ ID NO: 219403 - protein, 9 aa, Homo Sapiens
WSHRPPSSC

SEQ ID NO: 219404 - protein, 9 aa, Homo Sapiens
DLRTRADAH

SEQ ID NO: 219405 - protein, 9 aa, Homo Sapiens
DKQDSMHGW

SEQ ID NO: 219406 - protein, 9 aa, Homo Sapiens
HLLIAQELT

SEQ ID NO: 219407 - protein, 9 aa, Homo Sapiens
LHRALDVMA

SEQ ID NO: 219408 - protein, 9 aa, Homo Sapiens
LCVEDPLLP

SEQ ID NO: 219409 - protein, 9 aa, Homo Sapiens
EAVQGQVHV

SEQ ID NO: 219410 - protein, 9 aa, Homo Sapiens
ETKVLKPLS

SEQ ID NO: 219411 - protein, 9 aa, Homo Sapiens
VEMADYDLK

SEQ ID NO: 219412 - protein, 9 aa, Homo Sapiens
SALLLVLYT

SEQ ID NO: 219413 - protein, 9 aa, Homo Sapiens
WSWAMGSRW

SEQ ID NO: 219414 - protein, 9 aa, Homo Sapiens
GCTTGCCSA

SEQ ID NO: 219415 - protein, 9 aa, Homo Sapiens
MGGLEPGHK

SEQ ID NO: 219416 - protein, 9 aa, Homo Sapiens
DASSHGVGR

SEQ ID NO: 219417 - protein, 9 aa, Homo Sapiens
GVAVGSAVW

SEQ ID NO: 219418 - protein, 9 aa, Homo Sapiens
DHTVNENTF

SEQ ID NO: 219419 - protein, 9 aa, Homo Sapiens
DMTMVNVGM

SEQ ID NO: 219420 - protein, 9 aa, Homo Sapiens
CRPTRSEPF

SEQ ID NO: 219421 - protein, 9 aa, Homo Sapiens
RGSISSGIS

SEQ ID NO: 219422 - protein, 9 aa, Homo Sapiens
PGSHLHFIV

SEQ ID NO: 219423 - protein, 9 aa, Homo Sapiens
ELLQDLEKE

SEQ ID NO: 219424 - protein, 9 aa, Homo Sapiens
SAHIKSVDD

SEQ ID NO: 219425 - protein, 9 aa, Homo Sapiens
SSRLIVKWN

SEQ ID NO: 219426 - protein, 9 aa, Homo Sapiens
VLLSQRIIR

SEQ ID NO: 219427 - protein, 9 aa, Homo Sapiens
EGVENLRRM

SEQ ID NO: 219428 - protein, 9 aa, Homo Sapiens
FVRFVQGAP

SEQ ID NO: 219429 - protein, 9 aa, Homo Sapiens
ELSQIPASP

SEQ ID NO: 219430 - protein, 9 aa, Homo Sapiens
TTHSTSSAS

SEQ ID NO: 219431 - protein, 9 aa, Homo Sapiens
VDSLSPVVL

SEQ ID NO: 219432 - protein, 9 aa, Homo Sapiens
CRWFLPWMA

SEQ ID NO: 219433 - protein, 9 aa, Homo Sapiens
FLLACLTSG

SEQ ID NO: 219434 - protein, 9 aa, Homo Sapiens
AKQLRVGNG

SEQ ID NO: 219435 - protein, 9 aa, Homo Sapiens
FKEKSRSML

SEQ ID NO: 219436 - protein, 9 aa, Homo Sapiens
APQLLPPAT

SEQ ID NO: 219437 - protein, 9 aa, Homo Sapiens
KGKGASAPR

SEQ ID NO: 219438 - protein, 9 aa, Homo Sapiens
FSAPQGNCC

SEQ ID NO: 219439 - protein, 9 aa, Homo Sapiens
FTEGPPCIR

SEQ ID NO: 219440 - protein, 9 aa, Homo Sapiens
HCAGAACWC

SEQ ID NO: 219441 - protein, 9 aa, Homo Sapiens
RVLAVAPAV

SEQ ID NO: 219442 - protein, 9 aa, Homo Sapiens
PTFPSSVLT

SEQ ID NO: 219443 - protein, 9 aa, Homo Sapiens
VINRQRKES

SEQ ID NO: 219444 - protein, 9 aa, Homo Sapiens
MKKTINMLQ

SEQ ID NO: 219445 - protein, 9 aa, Homo Sapiens
LNLWALCDR

SEQ ID NO: 219446 - protein, 9 aa, Homo Sapiens
YVATTSPAR

SEQ ID NO: 219447 - protein, 9 aa, Homo Sapiens
SSVTTVPRS

SEQ ID NO: 219448 - protein, 9 aa, Homo Sapiens
LSASINPNP

SEQ ID NO: 219449 - protein, 9 aa, Homo Sapiens
RGAPSLLLL

SEQ ID NO: 219450 - protein, 9 aa, Homo Sapiens
RACWGPQRG

SEQ ID NO: 219451 - protein, 9 aa, Homo Sapiens
NSPEVRQSA

SEQ ID NO: 219452 - protein, 9 aa, Homo Sapiens
LRVAYLISA

SEQ ID NO: 219453 - protein, 9 aa, Homo Sapiens
GKRNAYLKE

SEQ ID NO: 219454 - protein, 9 aa, Homo Sapiens
HGGEEVLLE

SEQ ID NO: 219455 - protein, 9 aa, Homo Sapiens
VLHQAGARL

SEQ ID NO: 219456 - protein, 9 aa, Homo Sapiens
CKYTTPLTR

SEQ ID NO: 219457 - protein, 9 aa, Homo Sapiens
RGSPASPAS

SEQ ID NO: 219458 - protein, 9 aa, Homo Sapiens
GMSGSGHCL

SEQ ID NO: 219459 - protein, 9 aa, Homo Sapiens
PRRPQPWKR

SEQ ID NO: 219460 - protein, 9 aa, Homo Sapiens
GRGHPDGGG

SEQ ID NO: 219461 - protein, 9 aa, Homo Sapiens
KMAMTVIAG

SEQ ID NO: 219462 - protein, 9 aa, Homo Sapiens
TKLFLIFSH

SEQ ID NO: 219463 - protein, 9 aa, Homo Sapiens
PKRFTPDAM

SEQ ID NO: 219464 - protein, 9 aa, Homo Sapiens
FLVLHFSLK

SEQ ID NO: 219465 - protein, 9 aa, Homo Sapiens
SPVVLLRKQ

SEQ ID NO: 219466 - protein, 9 aa, Homo Sapiens
MAGPSASLH

SEQ ID NO: 219467 - protein, 9 aa, Homo Sapiens
TWHSTKREC

SEQ ID NO: 219468 - protein, 9 aa, Homo Sapiens
LSETGKRPF

SEQ ID NO: 219469 - protein, 9 aa, Homo Sapiens
QGIKAYHMM

SEQ ID NO: 219470 - protein, 9 aa, Homo Sapiens
DRHLIKMID

SEQ ID NO: 219471 - protein, 9 aa, Homo Sapiens
SLPRLVECP

SEQ ID NO: 219472 - protein, 9 aa, Homo Sapiens
RVTDFEVLS

SEQ ID NO: 219473 - protein, 9 aa, Homo Sapiens
MNIKGVDVG

SEQ ID NO: 219474 - protein, 9 aa, Homo Sapiens
DAELELKAE

SEQ ID NO: 219475 - protein, 9 aa, Homo Sapiens
QNPEPVNWE

SEQ ID NO: 219476 - protein, 9 aa, Homo Sapiens
LYSRAVRDL

SEQ ID NO: 219477 - protein, 9 aa, Homo Sapiens
STPRLPVPA

SEQ ID NO: 219478 - protein, 9 aa, Homo Sapiens
TLLEATPDT

SEQ ID NO: 219479 - protein, 9 aa, Homo Sapiens
ESPCGLSFN

SEQ ID NO: 219480 - protein, 9 aa, Homo Sapiens
PRSWPRPPC

SEQ ID NO: 219481 - protein, 9 aa, Homo Sapiens
KPHKRTRSG

SEQ ID NO: 219482 - protein, 9 aa, Homo Sapiens
GLHLHRQIS

SEQ ID NO: 219483 - protein, 9 aa, Homo Sapiens
APATQAPCM

SEQ ID NO: 219484 - protein, 9 aa, Homo Sapiens
AKLHHSRSF

SEQ ID NO: 219485 - protein, 9 aa, Homo Sapiens
KFSGKEPNS

SEQ ID NO: 219486 - protein, 9 aa, Homo Sapiens
PLSVITRQP

SEQ ID NO: 219487 - protein, 9 aa, Homo Sapiens
DPPTIIKGK

SEQ ID NO: 219488 - protein, 9 aa, Homo Sapiens
IVNPDPLLS

SEQ ID NO: 219489 - protein, 9 aa, Homo Sapiens
KLDPDATQF

SEQ ID NO: 219490 - protein, 9 aa, Homo Sapiens
GRTPGIIIL

SEQ ID NO: 219491 - protein, 9 aa, Homo Sapiens
WHVAHTFLL

SEQ ID NO: 219492 - protein, 9 aa, Homo Sapiens
VDFIKHNQL

SEQ ID NO: 219493 - protein, 9 aa, Homo Sapiens
LPGCPASPR

SEQ ID NO: 219494 - protein, 9 aa, Homo Sapiens
LHGQRLVFC

SEQ ID NO: 219495 - protein, 9 aa, Homo Sapiens
QGAVIRLCL

SEQ ID NO: 219496 - protein, 9 aa, Homo Sapiens
ISVTKELST

SEQ ID NO: 219497 - protein, 9 aa, Homo Sapiens
TTDWRKSHL

SEQ ID NO: 219498 - protein, 9 aa, Homo Sapiens
EVACESSTP

SEQ ID NO: 219499 - protein, 9 aa, Homo Sapiens
THPKGEDVH

SEQ ID NO: 219500 - protein, 9 aa, Homo Sapiens
AGPNSWRAW

SEQ ID NO: 219501 - protein, 9 aa, Homo Sapiens
CEEEMRRQQ

SEQ ID NO: 219502 - protein, 9 aa, Homo Sapiens
ESLKGNRAE

SEQ ID NO: 219503 - protein, 9 aa, Homo Sapiens
TEQGLVVLT

SEQ ID NO: 219504 - protein, 9 aa, Homo Sapiens
DFLKQMTLS

SEQ ID NO: 219505 - protein, 9 aa, Homo Sapiens
RGPAGPGKL

SEQ ID NO: 219506 - protein, 9 aa, Homo Sapiens
SVKAKFSGF

SEQ ID NO: 219507 - protein, 9 aa, Homo Sapiens
FRSGPWMMC

SEQ ID NO: 219508 - protein, 9 aa, Homo Sapiens
TWPSNRLVL

SEQ ID NO: 219509 - protein, 9 aa, Homo Sapiens
IQPQATGLL

SEQ ID NO: 219510 - protein, 9 aa, Homo Sapiens
GPQDLQVIK

SEQ ID NO: 219511 - protein, 9 aa, Homo Sapiens
QVPPTWASP

SEQ ID NO: 219512 - protein, 9 aa, Homo Sapiens
CICGASVSH

SEQ ID NO: 219513 - protein, 9 aa, Homo Sapiens
LCYILFLVL

SEQ ID NO: 219514 - protein, 9 aa, Homo Sapiens
AEWKEEEER

SEQ ID NO: 219515 - protein, 9 aa, Homo Sapiens
RKFDLRLYI

SEQ ID NO: 219516 - protein, 9 aa, Homo Sapiens
EAAACPLPP

SEQ ID NO: 219517 - protein, 9 aa, Homo Sapiens
SLPEGRHGH

SEQ ID NO: 219518 - protein, 9 aa, Homo Sapiens
ALHQLKHQH

SEQ ID NO: 219519 - protein, 9 aa, Homo Sapiens
SELSFPPAV

SEQ ID NO: 219520 - protein, 9 aa, Homo Sapiens
MRCSQCRVT

SEQ ID NO: 219521 - protein, 9 aa, Homo Sapiens
WLWKASTEV

SEQ ID NO: 219522 - protein, 9 aa, Homo Sapiens
DQSEASKRE

SEQ ID NO: 219523 - protein, 9 aa, Homo Sapiens
RRGCYLTVA

SEQ ID NO: 219524 - protein, 9 aa, Homo Sapiens
TLVLDVSSI

SEQ ID NO: 219525 - protein, 9 aa, Homo Sapiens
WGEQIVFNE

SEQ ID NO: 219526 - protein, 9 aa, Homo Sapiens
LYANIVLSG

SEQ ID NO: 219527 - protein, 9 aa, Homo Sapiens
VFGAGPGLS

SEQ ID NO: 219528 - protein, 9 aa, Homo Sapiens
SAPRWAPLW

SEQ ID NO: 219529 - protein, 9 aa, Homo Sapiens
ALTTGMRRG

SEQ ID NO: 219530 - protein, 9 aa, Homo Sapiens
CLPVLRTPQ

SEQ ID NO: 219531 - protein, 9 aa, Homo Sapiens
RPDLEEAVS

SEQ ID NO: 219532 - protein, 9 aa, Homo Sapiens
NSTVHSYML

SEQ ID NO: 219533 - protein, 9 aa, Homo Sapiens
RLDTEELWL

SEQ ID NO: 219534 - protein, 9 aa, Homo Sapiens
GHHGSVSLL

SEQ ID NO: 219535 - protein, 9 aa, Homo Sapiens
ADYLVRYVT

SEQ ID NO: 219536 - protein, 9 aa, Homo Sapiens
DGDNPEEIT

SEQ ID NO: 219537 - protein, 9 aa, Homo Sapiens
RRAVLETIK

SEQ ID NO: 219538 - protein, 9 aa, Homo Sapiens
VPPLQRGPA

SEQ ID NO: 219539 - protein, 9 aa, Homo Sapiens
ATHDGHPQL

SEQ ID NO: 219540 - protein, 9 aa, Homo Sapiens
TFLLACLTS

SEQ ID NO: 219541 - protein, 9 aa, Homo Sapiens
GPQWPAGPN

SEQ ID NO: 219542 - protein, 9 aa, Homo Sapiens
MPHARTEIS

SEQ ID NO: 219543 - protein, 9 aa, Homo Sapiens
HLDFKVVSL

SEQ ID NO: 219544 - protein, 9 aa, Homo Sapiens
TSATGARWP

SEQ ID NO: 219545 - protein, 9 aa, Homo Sapiens
RQATAGGRG

SEQ ID NO: 219546 - protein, 9 aa, Homo Sapiens
DSLYLMQKH

SEQ ID NO: 219547 - protein, 9 aa, Homo Sapiens
MWALSQEIT

SEQ ID NO: 219548 - protein, 9 aa, Homo Sapiens
SKGRMLKIL

SEQ ID NO: 219549 - protein, 9 aa, Homo Sapiens
PSPFTHRRL

SEQ ID NO: 219550 - protein, 9 aa, Homo Sapiens
EYFRVPVFG

SEQ ID NO: 219551 - protein, 9 aa, Homo Sapiens
EGNDLFRED

SEQ ID NO: 219552 - protein, 9 aa, Homo Sapiens
PNRSPHSWS

SEQ ID NO: 219553 - protein, 9 aa, Homo Sapiens
PHATHRDAY

SEQ ID NO: 219554 - protein, 9 aa, Homo Sapiens
NRYTLNNGN

SEQ ID NO: 219555 - protein, 9 aa, Homo Sapiens
DYKKTTRAY

SEQ ID NO: 219556 - protein, 9 aa, Homo Sapiens
LPRLTRERA

SEQ ID NO: 219557 - protein, 9 aa, Homo Sapiens
RREQLKRPI

SEQ ID NO: 219558 - protein, 9 aa, Homo Sapiens
LEEAPERGF

SEQ ID NO: 219559 - protein, 9 aa, Homo Sapiens
GNVAGAWQV

SEQ ID NO: 219560 - protein, 9 aa, Homo Sapiens
RCPYEYEGG

SEQ ID NO: 219561 - protein, 9 aa, Homo Sapiens
GCHKKTSQL

SEQ ID NO: 219562 - protein, 9 aa, Homo Sapiens
TIGWCWLIR

SEQ ID NO: 219563 - protein, 9 aa, Homo Sapiens
ASALLQPPH

SEQ ID NO: 219564 - protein, 9 aa, Homo Sapiens
MQKHTSSGS

SEQ ID NO: 219565 - protein, 9 aa, Homo Sapiens
LGESGSRAA

SEQ ID NO: 219566 - protein, 9 aa, Homo Sapiens
PSVQFSKVL

SEQ ID NO: 219567 - protein, 9 aa, Homo Sapiens
VVDFNEPLD

SEQ ID NO: 219568 - protein, 9 aa, Homo Sapiens
ITQSRDCVA

SEQ ID NO: 219569 - protein, 9 aa, Homo Sapiens
HKMAFDYYP

SEQ ID NO: 219570 - protein, 9 aa, Homo Sapiens
GVSLSITTK

SEQ ID NO: 219571 - protein, 9 aa, Homo Sapiens
PPTRTSRSS

SEQ ID NO: 219572 - protein, 9 aa, Homo Sapiens
SLCTLCQVD

SEQ ID NO: 219573 - protein, 9 aa, Homo Sapiens
LKFVENTWN

SEQ ID NO: 219574 - protein, 9 aa, Homo Sapiens
RTTAFCRPT

SEQ ID NO: 219575 - protein, 9 aa, Homo Sapiens
EELCQAWFT

SEQ ID NO: 219576 - protein, 9 aa, Homo Sapiens
GASYRQYGV

SEQ ID NO: 219577 - protein, 9 aa, Homo Sapiens
SSLSVMSSP

SEQ ID NO: 219578 - protein, 9 aa, Homo Sapiens
HRLTVGKSH

SEQ ID NO: 219579 - protein, 9 aa, Homo Sapiens
CPSPAVKGR

SEQ ID NO: 219580 - protein, 9 aa, Homo Sapiens
VSMPILGHS

SEQ ID NO: 219581 - protein, 9 aa, Homo Sapiens
AKRRNHFWE

SEQ ID NO: 219582 - protein, 9 aa, Homo Sapiens
GGAQAARIR

SEQ ID NO: 219583 - protein, 9 aa, Homo Sapiens
FKVPPVANH

SEQ ID NO: 219584 - protein, 9 aa, Homo Sapiens
TLYVEARHL

SEQ ID NO: 219585 - protein, 9 aa, Homo Sapiens
ARSLLRLEC

SEQ ID NO: 219586 - protein, 9 aa, Homo Sapiens
CPWRTAPSD

SEQ ID NO: 219587 - protein, 9 aa, Homo Sapiens
STRIDRLED

SEQ ID NO: 219588 - protein, 9 aa, Homo Sapiens
VHAPEGRGL

SEQ ID NO: 219589 - protein, 9 aa, Homo Sapiens
SCLQAVFEA

SEQ ID NO: 219590 - protein, 9 aa, Homo Sapiens
MLPSLRSRV

SEQ ID NO: 219591 - protein, 9 aa, Homo Sapiens
EVLGAFLGL

SEQ ID NO: 219592 - protein, 9 aa, Homo Sapiens
TNLTTIYML

SEQ ID NO: 219593 - protein, 9 aa, Homo Sapiens
GIRGLGVDV

SEQ ID NO: 219594 - protein, 9 aa, Homo Sapiens
GRILLQRNL

SEQ ID NO: 219595 - protein, 9 aa, Homo Sapiens
SHQLASGCF

SEQ ID NO: 219596 - protein, 9 aa, Homo Sapiens
MSMFGKLYL

SEQ ID NO: 219597 - protein, 9 aa, Homo Sapiens
GAGISGCSQ

SEQ ID NO: 219598 - protein, 9 aa, Homo Sapiens
KNLENFLSR

SEQ ID NO: 219599 - protein, 9 aa, Homo Sapiens
LCTLCQVDP

SEQ ID NO: 219600 - protein, 9 aa, Homo Sapiens
YQRMTVRDI

SEQ ID NO: 219601 - protein, 9 aa, Homo Sapiens
WMASRSTRT

SEQ ID NO: 219602 - protein, 9 aa, Homo Sapiens
VLEKENTII

SEQ ID NO: 219603 - protein, 9 aa, Homo Sapiens
GQVSCHTTC

SEQ ID NO: 219604 - protein, 9 aa, Homo Sapiens
VTVQTAQEL

SEQ ID NO: 219605 - protein, 9 aa, Homo Sapiens
LEQEIPFVF

SEQ ID NO: 219606 - protein, 9 aa, Homo Sapiens
NVHFLPRQF

SEQ ID NO: 219607 - protein, 9 aa, Homo Sapiens
NPSATRANP

SEQ ID NO: 219608 - protein, 9 aa, Homo Sapiens
SCCDAGNEE

SEQ ID NO: 219609 - protein, 9 aa, Homo Sapiens
ASAPRGPGM

SEQ ID NO: 219610 - protein, 9 aa, Homo Sapiens
CFAMGAATG

SEQ ID NO: 219611 - protein, 9 aa, Homo Sapiens
PMASERGPL

SEQ ID NO: 219612 - protein, 9 aa, Homo Sapiens
RFDSCLKYD

SEQ ID NO: 219613 - protein, 9 aa, Homo Sapiens
DWARQTFLL

SEQ ID NO: 219614 - protein, 9 aa, Homo Sapiens
RVSIIDDDI

SEQ ID NO: 219615 - protein, 9 aa, Homo Sapiens
CPLSLWKRL

SEQ ID NO: 219616 - protein, 9 aa, Homo Sapiens
HGSCALATK

SEQ ID NO: 219617 - protein, 9 aa, Homo Sapiens
IELKAKVFL

SEQ ID NO: 219618 - protein, 9 aa, Homo Sapiens
TAKSKSAES

SEQ ID NO: 219619 - protein, 9 aa, Homo Sapiens
QGSVLLWRL

SEQ ID NO: 219620 - protein, 9 aa, Homo Sapiens
WPSQVVLCI

SEQ ID NO: 219621 - protein, 9 aa, Homo Sapiens
REGIPLDIP

SEQ ID NO: 219622 - protein, 9 aa, Homo Sapiens
TTEEVHHKP

SEQ ID NO: 219623 - protein, 9 aa, Homo Sapiens
RGFGLRGLQ

SEQ ID NO: 219624 - protein, 9 aa, Homo Sapiens
WRSINSSLK

SEQ ID NO: 219625 - protein, 9 aa, Homo Sapiens
LQGSWASLQ

SEQ ID NO: 219626 - protein, 9 aa, Homo Sapiens
LKYDHHKRG

SEQ ID NO: 219627 - protein, 9 aa, Homo Sapiens
DLPQERYLL

SEQ ID NO: 219628 - protein, 9 aa, Homo Sapiens
AYHADDVKI

SEQ ID NO: 219629 - protein, 9 aa, Homo Sapiens
AGVPLIIGA

SEQ ID NO: 219630 - protein, 9 aa, Homo Sapiens
LSFLIYFFF

SEQ ID NO: 219631 - protein, 9 aa, Homo Sapiens
IQYNKNRQK

SEQ ID NO: 219632 - protein, 9 aa, Homo Sapiens
LWPEVLQDL

SEQ ID NO: 219633 - protein, 9 aa, Homo Sapiens
AMQLTFHKM

SEQ ID NO: 219634 - protein, 9 aa, Homo Sapiens
VFDCSINSV

SEQ ID NO: 219635 - protein, 9 aa, Homo Sapiens
EYIGRKKSR

SEQ ID NO: 219636 - protein, 9 aa, Homo Sapiens
RVSVIIFSL

SEQ ID NO: 219637 - protein, 9 aa, Homo Sapiens
DAVVASSSG

SEQ ID NO: 219638 - protein, 9 aa, Homo Sapiens
LTSSPVTFI

SEQ ID NO: 219639 - protein, 9 aa, Homo Sapiens
ALVKTWTQF

SEQ ID NO: 219640 - protein, 9 aa, Homo Sapiens
VGQISTLVL

SEQ ID NO: 219641 - protein, 9 aa, Homo Sapiens
LPSSLRPAL

SEQ ID NO: 219642 - protein, 9 aa, Homo Sapiens
THSTSSASG

SEQ ID NO: 219643 - protein, 9 aa, Homo Sapiens
PTQLMDSSA

SEQ ID NO: 219644 - protein, 9 aa, Homo Sapiens
RNWTEGCGS

SEQ ID NO: 219645 - protein, 9 aa, Homo Sapiens
FKEPILEIL

SEQ ID NO: 219646 - protein, 9 aa, Homo Sapiens
FLNEHHGGE

SEQ ID NO: 219647 - protein, 9 aa, Homo Sapiens
DISSHKPHK

SEQ ID NO: 219648 - protein, 9 aa, Homo Sapiens
SSPLPTFGC

SEQ ID NO: 219649 - protein, 9 aa, Homo Sapiens
IDRCYTGSH

SEQ ID NO: 219650 - protein, 9 aa, Homo Sapiens
KGAHCSWGL

SEQ ID NO: 219651 - protein, 9 aa, Homo Sapiens
PGGRRTICS

SEQ ID NO: 219652 - protein, 9 aa, Homo Sapiens
SPVPQLPDR

SEQ ID NO: 219653 - protein, 9 aa, Homo Sapiens
TGSQDLILQ

SEQ ID NO: 219654 - protein, 9 aa, Homo Sapiens
SPKGAHCSW

SEQ ID NO: 219655 - protein, 9 aa, Homo Sapiens
ACPLPPTRP

SEQ ID NO: 219656 - protein, 9 aa, Homo Sapiens
FVQGAPWLW

SEQ ID NO: 219657 - protein, 9 aa, Homo Sapiens
HLHKGDEGY

SEQ ID NO: 219658 - protein, 9 aa, Homo Sapiens
PSAPAAAPP

SEQ ID NO: 219659 - protein, 9 aa, Homo Sapiens
RTMAGPSAS

SEQ ID NO: 219660 - protein, 9 aa, Homo Sapiens
TEKKQCRKT

SEQ ID NO: 219661 - protein, 9 aa, Homo Sapiens
QKRFRHLAL

SEQ ID NO: 219662 - protein, 9 aa, Homo Sapiens
YDAVNVSLI

SEQ ID NO: 219663 - protein, 9 aa, Homo Sapiens
KGYLFRWAH

SEQ ID NO: 219664 - protein, 9 aa, Homo Sapiens
VPKSCRPWH

SEQ ID NO: 219665 - protein, 9 aa, Homo Sapiens
MGYPKSTMM

SEQ ID NO: 219666 - protein, 9 aa, Homo Sapiens
PAAVVMRPG

SEQ ID NO: 219667 - protein, 9 aa, Homo Sapiens
WPDREPPPR

SEQ ID NO: 219668 - protein, 9 aa, Homo Sapiens
WEPMWEHRQ

SEQ ID NO: 219669 - protein, 9 aa, Homo Sapiens
GPCWSLSEY

SEQ ID NO: 219670 - protein, 9 aa, Homo Sapiens
IATSQATTT

SEQ ID NO: 219671 - protein, 9 aa, Homo Sapiens
HPQLPTPPP

SEQ ID NO: 219672 - protein, 9 aa, Homo Sapiens
CTGRGDPFC

SEQ ID NO: 219673 - protein, 9 aa, Homo Sapiens
WILPLVVLG

SEQ ID NO: 219674 - protein, 9 aa, Homo Sapiens
RLPLPRLRL

SEQ ID NO: 219675 - protein, 9 aa, Homo Sapiens
LSLWSHRPP

SEQ ID NO: 219676 - protein, 9 aa, Homo Sapiens
LGLLKTHNC

SEQ ID NO: 219677 - protein, 9 aa, Homo Sapiens
NVKNVTKFL

SEQ ID NO: 219678 - protein, 9 aa, Homo Sapiens
QSPRVNCTL

SEQ ID NO: 219679 - protein, 9 aa, Homo Sapiens
LALRHRLSG

SEQ ID NO: 219680 - protein, 9 aa, Homo Sapiens
CSQTRPLWS

SEQ ID NO: 219681 - protein, 9 aa, Homo Sapiens
PGHWGQRDV

SEQ ID NO: 219682 - protein, 9 aa, Homo Sapiens
TECDRVRQK

SEQ ID NO: 219683 - protein, 9 aa, Homo Sapiens
LLTSGADAI

SEQ ID NO: 219684 - protein, 9 aa, Homo Sapiens
NEKVSTEPP

SEQ ID NO: 219685 - protein, 9 aa, Homo Sapiens
QYSHLQRTH

SEQ ID NO: 219686 - protein, 9 aa, Homo Sapiens
SPPRTARGV

SEQ ID NO: 219687 - protein, 9 aa, Homo Sapiens
GYTVLWILP

SEQ ID NO: 219688 - protein, 9 aa, Homo Sapiens
RGWGRRWSW

SEQ ID NO: 219689 - protein, 9 aa, Homo Sapiens
RFRMRMRVR

SEQ ID NO: 219690 - protein, 9 aa, Homo Sapiens
CPQAAARRV

SEQ ID NO: 219691 - protein, 9 aa, Homo Sapiens
AEPPKALEQ

SEQ ID NO: 219692 - protein, 9 aa, Homo Sapiens
GCTTSASML

SEQ ID NO: 219693 - protein, 9 aa, Homo Sapiens
FYFLRGLEA

SEQ ID NO: 219694 - protein, 9 aa, Homo Sapiens
RGHRRPRVH

SEQ ID NO: 219695 - protein, 9 aa, Homo Sapiens
ASAVSTAAS

SEQ ID NO: 219696 - protein, 9 aa, Homo Sapiens
ALQAKSVGV

SEQ ID NO: 219697 - protein, 9 aa, Homo Sapiens
THRRLPDFN

SEQ ID NO: 219698 - protein, 9 aa, Homo Sapiens
SRRTVPSGR

SEQ ID NO: 219699 - protein, 9 aa, Homo Sapiens
TPRLQVHCN

SEQ ID NO: 219700 - protein, 9 aa, Homo Sapiens
PLPPPQSSP

SEQ ID NO: 219701 - protein, 9 aa, Homo Sapiens
TAEGHGFKQ

SEQ ID NO: 219702 - protein, 9 aa, Homo Sapiens
QNPEKLALK

SEQ ID NO: 219703 - protein, 9 aa, Homo Sapiens
QNGVLDFFS

SEQ ID NO: 219704 - protein, 9 aa, Homo Sapiens
SSAWGSASC

SEQ ID NO: 219705 - protein, 9 aa, Homo Sapiens
AERGLGDVE

SEQ ID NO: 219706 - protein, 9 aa, Homo Sapiens
WSIPLVPLI

SEQ ID NO: 219707 - protein, 9 aa, Homo Sapiens
VVAAVVGIG

SEQ ID NO: 219708 - protein, 9 aa, Homo Sapiens
VQVPKFLSL

SEQ ID NO: 219709 - protein, 9 aa, Homo Sapiens
FFVLVNLEV

SEQ ID NO: 219710 - protein, 9 aa, Homo Sapiens
SFFVIFLES

SEQ ID NO: 219711 - protein, 9 aa, Homo Sapiens
PLDSSPLQL

SEQ ID NO: 219712 - protein, 9 aa, Homo Sapiens
GLLPVSYTA

SEQ ID NO: 219713 - protein, 9 aa, Homo Sapiens
RSRATFSAC

SEQ ID NO: 219714 - protein, 9 aa, Homo Sapiens
FNVIVPIVN

SEQ ID NO: 219715 - protein, 9 aa, Homo Sapiens
MTKNTSMWT

SEQ ID NO: 219716 - protein, 9 aa, Homo Sapiens
AQSAPRRSH

SEQ ID NO: 219717 - protein, 9 aa, Homo Sapiens
AQVESEVGR

SEQ ID NO: 219718 - protein, 9 aa, Homo Sapiens
LDDCANRPC

SEQ ID NO: 219719 - protein, 9 aa, Homo Sapiens
WVLQAIIGS

SEQ ID NO: 219720 - protein, 9 aa, Homo Sapiens
QELWLTPVI

SEQ ID NO: 219721 - protein, 9 aa, Homo Sapiens
GCRWFLPWM

SEQ ID NO: 219722 - protein, 9 aa, Homo Sapiens
WASLQSPRV

SEQ ID NO: 219723 - protein, 9 aa, Homo Sapiens
ALKQYACTV

SEQ ID NO: 219724 - protein, 9 aa, Homo Sapiens
LGLAAASCS

SEQ ID NO: 219725 - protein, 9 aa, Homo Sapiens
FEASDYKDF

SEQ ID NO: 219726 - protein, 9 aa, Homo Sapiens
SRRRAGGCA

SEQ ID NO: 219727 - protein, 9 aa, Homo Sapiens
QKDTEGDIV

SEQ ID NO: 219728 - protein, 9 aa, Homo Sapiens
SSESLPKET

SEQ ID NO: 219729 - protein, 9 aa, Homo Sapiens
SVLLGESMT

SEQ ID NO: 219730 - protein, 9 aa, Homo Sapiens
DVPMSDLAE

SEQ ID NO: 219731 - protein, 9 aa, Homo Sapiens
MICQYCKRL

SEQ ID NO: 219732 - protein, 9 aa, Homo Sapiens
ASLAVDGSA

SEQ ID NO: 219733 - protein, 9 aa, Homo Sapiens
PCSHSLALL

SEQ ID NO: 219734 - protein, 9 aa, Homo Sapiens
CSGRSRPTR

SEQ ID NO: 219735 - protein, 9 aa, Homo Sapiens
PASPASPSD

SEQ ID NO: 219736 - protein, 9 aa, Homo Sapiens
SAPPIRRVS

SEQ ID NO: 219737 - protein, 9 aa, Homo Sapiens
VIGRFLTGI

SEQ ID NO: 219738 - protein, 9 aa, Homo Sapiens
SQNHSKCIT

SEQ ID NO: 219739 - protein, 9 aa, Homo Sapiens
MATGLRKRG

SEQ ID NO: 219740 - protein, 9 aa, Homo Sapiens
FPCGPWTRN

SEQ ID NO: 219741 - protein, 9 aa, Homo Sapiens
MSQFYRPFY

SEQ ID NO: 219742 - protein, 9 aa, Homo Sapiens
FKRQGKLHR

SEQ ID NO: 219743 - protein, 9 aa, Homo Sapiens
QEDPPELSQ

SEQ ID NO: 219744 - protein, 9 aa, Homo Sapiens
TQMQGEESL

SEQ ID NO: 219745 - protein, 9 aa, Homo Sapiens
NGPQWQVVW

SEQ ID NO: 219746 - protein, 9 aa, Homo Sapiens
EKLREMTII

SEQ ID NO: 219747 - protein, 9 aa, Homo Sapiens
SSPADWTRE

SEQ ID NO: 219748 - protein, 9 aa, Homo Sapiens
PIGPPGHPG

SEQ ID NO: 219749 - protein, 9 aa, Homo Sapiens
VLKPLSVIM

SEQ ID NO: 219750 - protein, 9 aa, Homo Sapiens
SQWSPATGP

SEQ ID NO: 219751 - protein, 9 aa, Homo Sapiens
RRRELYKAH

SEQ ID NO: 219752 - protein, 9 aa, Homo Sapiens
VPQLPDRPP

SEQ ID NO: 219753 - protein, 9 aa, Homo Sapiens
QRKTDSIEK

SEQ ID NO: 219754 - protein, 9 aa, Homo Sapiens
DLGKMLKVE

SEQ ID NO: 219755 - protein, 9 aa, Homo Sapiens
QLRLNPRRS

SEQ ID NO: 219756 - protein, 9 aa, Homo Sapiens
QLHRALDVM

SEQ ID NO: 219757 - protein, 9 aa, Homo Sapiens
VEDPGPPRP

SEQ ID NO: 219758 - protein, 9 aa, Homo Sapiens
RPVCEGTRV

SEQ ID NO: 219759 - protein, 9 aa, Homo Sapiens
GTLYKPFGK

SEQ ID NO: 219760 - protein, 9 aa, Homo Sapiens
DLPSSLRPA

SEQ ID NO: 219761 - protein, 9 aa, Homo Sapiens
AMEETVVVA

SEQ ID NO: 219762 - protein, 9 aa, Homo Sapiens
KQDILSNSL

SEQ ID NO: 219763 - protein, 9 aa, Homo Sapiens
AGFAGEDAP

SEQ ID NO: 219764 - protein, 9 aa, Homo Sapiens
LYKHDDTAL

SEQ ID NO: 219765 - protein, 9 aa, Homo Sapiens
VKVVLGLLA

SEQ ID NO: 219766 - protein, 9 aa, Homo Sapiens
IEVLERAKR

SEQ ID NO: 219767 - protein, 9 aa, Homo Sapiens
RTWNPFRCK

SEQ ID NO: 219768 - protein, 9 aa, Homo Sapiens
WVIGGGGGG

SEQ ID NO: 219769 - protein, 9 aa, Homo Sapiens
VVLHSILNR

SEQ ID NO: 219770 - protein, 9 aa, Homo Sapiens
SGDKVVAEG

SEQ ID NO: 219771 - protein, 9 aa, Homo Sapiens
VLIMFSRAS

SEQ ID NO: 219772 - protein, 9 aa, Homo Sapiens
PTNAAATGS

SEQ ID NO: 219773 - protein, 9 aa, Homo Sapiens
PVAGVYKKV

SEQ ID NO: 219774 - protein, 9 aa, Homo Sapiens
AHFQDRGQF

SEQ ID NO: 219775 - protein, 9 aa, Homo Sapiens
ATPTPTPPP

SEQ ID NO: 219776 - protein, 9 aa, Homo Sapiens
MAHRVGVRH

SEQ ID NO: 219777 - protein, 9 aa, Homo Sapiens
GSSSRRVPR

SEQ ID NO: 219778 - protein, 9 aa, Homo Sapiens
MLIGYCPQQ

SEQ ID NO: 219779 - protein, 9 aa, Homo Sapiens
KPADSWDII

SEQ ID NO: 219780 - protein, 9 aa, Homo Sapiens
SPMASEVPY

SEQ ID NO: 219781 - protein, 9 aa, Homo Sapiens
IQAYILAHK

SEQ ID NO: 219782 - protein, 9 aa, Homo Sapiens
VSFTYSLSV

SEQ ID NO: 219783 - protein, 9 aa, Homo Sapiens
SSPFLARSW

SEQ ID NO: 219784 - protein, 9 aa, Homo Sapiens
EEEAVGRGP

SEQ ID NO: 219785 - protein, 9 aa, Homo Sapiens
TLLFTKTSL

SEQ ID NO: 219786 - protein, 9 aa, Homo Sapiens
IWMYVDAAW

SEQ ID NO: 219787 - protein, 9 aa, Homo Sapiens
VRDIEKSIC

SEQ ID NO: 219788 - protein, 9 aa, Homo Sapiens
SKIFPGKKS

SEQ ID NO: 219789 - protein, 9 aa, Homo Sapiens
SVLFRPCLC

SEQ ID NO: 219790 - protein, 9 aa, Homo Sapiens
SPTIVQGHY

SEQ ID NO: 219791 - protein, 9 aa, Homo Sapiens
SLHHTLKEI

SEQ ID NO: 219792 - protein, 9 aa, Homo Sapiens
MGSNRKFGD

SEQ ID NO: 219793 - protein, 9 aa, Homo Sapiens
GPPGTTPPR

SEQ ID NO: 219794 - protein, 9 aa, Homo Sapiens
ILVMLEIVT

SEQ ID NO: 219795 - protein, 9 aa, Homo Sapiens
DRGWWISND

SEQ ID NO: 219796 - protein, 9 aa, Homo Sapiens
QLLILDPPK

SEQ ID NO: 219797 - protein, 9 aa, Homo Sapiens
DAPSRCIWQ

SEQ ID NO: 219798 - protein, 9 aa, Homo Sapiens
CLPLITNNM

SEQ ID NO: 219799 - protein, 9 aa, Homo Sapiens
AAMTQMQGE

SEQ ID NO: 219800 - protein, 9 aa, Homo Sapiens
CNKIQGIVG

SEQ ID NO: 219801 - protein, 9 aa, Homo Sapiens
SFSGLVGLF

SEQ ID NO: 219802 - protein, 9 aa, Homo Sapiens
VVAFSEIMG

SEQ ID NO: 219803 - protein, 9 aa, Homo Sapiens
VTEADMAIT

SEQ ID NO: 219804 - protein, 9 aa, Homo Sapiens
FTYFETIND

SEQ ID NO: 219805 - protein, 9 aa, Homo Sapiens
RFVWGKLST

SEQ ID NO: 219806 - protein, 9 aa, Homo Sapiens
LSNSDFLVH

SEQ ID NO: 219807 - protein, 9 aa, Homo Sapiens
FRSPHRMRP

SEQ ID NO: 219808 - protein, 9 aa, Homo Sapiens
RALQTSTTR

SEQ ID NO: 219809 - protein, 9 aa, Homo Sapiens
DFSEVEWED

SEQ ID NO: 219810 - protein, 9 aa, Homo Sapiens
PFTGSPSQS

SEQ ID NO: 219811 - protein, 9 aa, Homo Sapiens
SRPLAHSVA

SEQ ID NO: 219812 - protein, 9 aa, Homo Sapiens
PWSCVTRGA

SEQ ID NO: 219813 - protein, 9 aa, Homo Sapiens
CGSGSPEDT

SEQ ID NO: 219814 - protein, 9 aa, Homo Sapiens
RTAHRAVAP

SEQ ID NO: 219815 - protein, 9 aa, Homo Sapiens
PPVFSYSWP

SEQ ID NO: 219816 - protein, 9 aa, Homo Sapiens
DQAVELVNT

SEQ ID NO: 219817 - protein, 9 aa, Homo Sapiens
VTMNEFEYP

SEQ ID NO: 219818 - protein, 9 aa, Homo Sapiens
VMRPGSPLF

SEQ ID NO: 219819 - protein, 9 aa, Homo Sapiens
CKHLRWIGR

SEQ ID NO: 219820 - protein, 9 aa, Homo Sapiens
PSLRSRVTV

SEQ ID NO: 219821 - protein, 9 aa, Homo Sapiens
HGSHHQGVG

SEQ ID NO: 219822 - protein, 9 aa, Homo Sapiens
GMMSTASVH

SEQ ID NO: 219823 - protein, 9 aa, Homo Sapiens
PGNWKSHLI

SEQ ID NO: 219824 - protein, 9 aa, Homo Sapiens
EVWEKLDPD

SEQ ID NO: 219825 - protein, 9 aa, Homo Sapiens
AEPPGSYAV

SEQ ID NO: 219826 - protein, 9 aa, Homo Sapiens
PATQAPCMM

SEQ ID NO: 219827 - protein, 9 aa, Homo Sapiens
LVKIIDWIL

SEQ ID NO: 219828 - protein, 9 aa, Homo Sapiens
LQIFTYEEG

SEQ ID NO: 219829 - protein, 9 aa, Homo Sapiens
MGLGGCRDH

SEQ ID NO: 219830 - protein, 9 aa, Homo Sapiens
PTATWMGSL

SEQ ID NO: 219831 - protein, 9 aa, Homo Sapiens
GRTTAVPRG

SEQ ID NO: 219832 - protein, 9 aa, Homo Sapiens
VRKGQLHRA

SEQ ID NO: 219833 - protein, 9 aa, Homo Sapiens
RGRGRVWPS

SEQ ID NO: 219834 - protein, 9 aa, Homo Sapiens
IVLLSQRII

SEQ ID NO: 219835 - protein, 9 aa, Homo Sapiens
AGRYASQQI

SEQ ID NO: 219836 - protein, 9 aa, Homo Sapiens
QPSSTWTRW

SEQ ID NO: 219837 - protein, 9 aa, Homo Sapiens
SAQSTAQAI

SEQ ID NO: 219838 - protein, 9 aa, Homo Sapiens
NALLLTTVR

SEQ ID NO: 219839 - protein, 9 aa, Homo Sapiens
IEHTQKELQ

SEQ ID NO: 219840 - protein, 9 aa, Homo Sapiens
LRLQGMGRA

SEQ ID NO: 219841 - protein, 9 aa, Homo Sapiens
NTGPPRESK

SEQ ID NO: 219842 - protein, 9 aa, Homo Sapiens
VSVKLHNRV

SEQ ID NO: 219843 - protein, 9 aa, Homo Sapiens
GAEWSFSTF

SEQ ID NO: 219844 - protein, 9 aa, Homo Sapiens
EAQCRGRPA

SEQ ID NO: 219845 - protein, 9 aa, Homo Sapiens
SAGSAAGTL

SEQ ID NO: 219846 - protein, 9 aa, Homo Sapiens
PHSRHCLCK

SEQ ID NO: 219847 - protein, 9 aa, Homo Sapiens
VDRIILKAN

SEQ ID NO: 219848 - protein, 9 aa, Homo Sapiens
LSPVVLLRK

SEQ ID NO: 219849 - protein, 9 aa, Homo Sapiens
RMRHKNIVR

SEQ ID NO: 219850 - protein, 9 aa, Homo Sapiens
FVDVWERSK

SEQ ID NO: 219851 - protein, 9 aa, Homo Sapiens
RGFLLHQPL

SEQ ID NO: 219852 - protein, 9 aa, Homo Sapiens
DEWNFFPGS

SEQ ID NO: 219853 - protein, 9 aa, Homo Sapiens
RSSGRQCGP

SEQ ID NO: 219854 - protein, 9 aa, Homo Sapiens
EFHFIILVA

SEQ ID NO: 219855 - protein, 9 aa, Homo Sapiens
GGCSSPLPT

SEQ ID NO: 219856 - protein, 9 aa, Homo Sapiens
GCSWTCSQT

SEQ ID NO: 219857 - protein, 9 aa, Homo Sapiens
RSPASPAHS

SEQ ID NO: 219858 - protein, 9 aa, Homo Sapiens
GLKLTGTHT

SEQ ID NO: 219859 - protein, 9 aa, Homo Sapiens
ILPESLELS

SEQ ID NO: 219860 - protein, 9 aa, Homo Sapiens
MGTLCYLGN

SEQ ID NO: 219861 - protein, 9 aa, Homo Sapiens
TPLRVQSVL

SEQ ID NO: 219862 - protein, 9 aa, Homo Sapiens
VIGLHGDSS

SEQ ID NO: 219863 - protein, 9 aa, Homo Sapiens
LGDLDRNTF

SEQ ID NO: 219864 - protein, 9 aa, Homo Sapiens
SPGVVTDLF

SEQ ID NO: 219865 - protein, 9 aa, Homo Sapiens
TGQAPHLGS

SEQ ID NO: 219866 - protein, 9 aa, Homo Sapiens
APPTKGACT

SEQ ID NO: 219867 - protein, 9 aa, Homo Sapiens
CVLNQLLFE

SEQ ID NO: 219868 - protein, 9 aa, Homo Sapiens
PPGITGICW

SEQ ID NO: 219869 - protein, 9 aa, Homo Sapiens
PTCYSRMWA

SEQ ID NO: 219870 - protein, 9 aa, Homo Sapiens
SHRSSSWPA

SEQ ID NO: 219871 - protein, 9 aa, Homo Sapiens
ETNGPDVNH

SEQ ID NO: 219872 - protein, 9 aa, Homo Sapiens
KQEIDPPTI

SEQ ID NO: 219873 - protein, 9 aa, Homo Sapiens
FFFFLLLEK

SEQ ID NO: 219874 - protein, 9 aa, Homo Sapiens
AMLFTYFET

SEQ ID NO: 219875 - protein, 9 aa, Homo Sapiens
WNPVMKMKR

SEQ ID NO: 219876 - protein, 9 aa, Homo Sapiens
GQEKCAQCW

SEQ ID NO: 219877 - protein, 9 aa, Homo Sapiens
LRCERVVEE

SEQ ID NO: 219878 - protein, 9 aa, Homo Sapiens
VRPRARVHR

SEQ ID NO: 219879 - protein, 9 aa, Homo Sapiens
KRQRRQERW

SEQ ID NO: 219880 - protein, 9 aa, Homo Sapiens
NALKAIITM

SEQ ID NO: 219881 - protein, 9 aa, Homo Sapiens
TPYKCSECG

SEQ ID NO: 219882 - protein, 9 aa, Homo Sapiens
TLTSAASSA

SEQ ID NO: 219883 - protein, 9 aa, Homo Sapiens
TLGESGSRA

SEQ ID NO: 219884 - protein, 9 aa, Homo Sapiens
SDHKINHLC

SEQ ID NO: 219885 - protein, 9 aa, Homo Sapiens
HAPRALSVL

SEQ ID NO: 219886 - protein, 9 aa, Homo Sapiens
CMVYVLYKT

SEQ ID NO: 219887 - protein, 9 aa, Homo Sapiens
QVADEQYQR

SEQ ID NO: 219888 - protein, 9 aa, Homo Sapiens
SHIGVERTI

SEQ ID NO: 219889 - protein, 9 aa, Homo Sapiens
RLRKSRPHS

SEQ ID NO: 219890 - protein, 9 aa, Homo Sapiens
EKKEKRREK

SEQ ID NO: 219891 - protein, 9 aa, Homo Sapiens
TASETLRCP

SEQ ID NO: 219892 - protein, 9 aa, Homo Sapiens
VLCSPRVPP

SEQ ID NO: 219893 - protein, 9 aa, Homo Sapiens
GHQLLIKAV

SEQ ID NO: 219894 - protein, 9 aa, Homo Sapiens
VVASSSGGR

SEQ ID NO: 219895 - protein, 9 aa, Homo Sapiens
SVAMQFLRV

SEQ ID NO: 219896 - protein, 9 aa, Homo Sapiens
VTSTSLTFK

SEQ ID NO: 219897 - protein, 9 aa, Homo Sapiens
EVSEDSPCE

SEQ ID NO: 219898 - protein, 9 aa, Homo Sapiens
SSFIGDGDI

SEQ ID NO: 219899 - protein, 9 aa, Homo Sapiens
WSLCPAEDE

SEQ ID NO: 219900 - protein, 9 aa, Homo Sapiens
VQHGSCALA

SEQ ID NO: 219901 - protein, 9 aa, Homo Sapiens
AEGHLEGLG

SEQ ID NO: 219902 - protein, 9 aa, Homo Sapiens
AAENYRTLF

SEQ ID NO: 219903 - protein, 9 aa, Homo Sapiens
GGRGHPDGG

SEQ ID NO: 219904 - protein, 9 aa, Homo Sapiens
KVNKGKQKV

SEQ ID NO: 219905 - protein, 9 aa, Homo Sapiens
RRREEKWLR

SEQ ID NO: 219906 - protein, 9 aa, Homo Sapiens
MTCPTAEPT

SEQ ID NO: 219907 - protein, 9 aa, Homo Sapiens
VRATLFATG

SEQ ID NO: 219908 - protein, 9 aa, Homo Sapiens
QFQNSHSLL

SEQ ID NO: 219909 - protein, 9 aa, Homo Sapiens
PSTHTPSAS

SEQ ID NO: 219910 - protein, 9 aa, Homo Sapiens
VLASLQVAL

SEQ ID NO: 219911 - protein, 9 aa, Homo Sapiens
TIQRVQAEE

SEQ ID NO: 219912 - protein, 9 aa, Homo Sapiens
LHISRGEGN

SEQ ID NO: 219913 - protein, 9 aa, Homo Sapiens
THRLYKVQP

SEQ ID NO: 219914 - protein, 9 aa, Homo Sapiens
IRLCLCCAD

SEQ ID NO: 219915 - protein, 9 aa, Homo Sapiens
RKIVLLLKP

SEQ ID NO: 219916 - protein, 9 aa, Homo Sapiens
GAVAHTQDV

SEQ ID NO: 219917 - protein, 9 aa, Homo Sapiens
TAATGPGCC

SEQ ID NO: 219918 - protein, 9 aa, Homo Sapiens
IIRFTGVFT

SEQ ID NO: 219919 - protein, 9 aa, Homo Sapiens
VSTKYLNLT

SEQ ID NO: 219920 - protein, 9 aa, Homo Sapiens
RLLFIIDSF

SEQ ID NO: 219921 - protein, 9 aa, Homo Sapiens
RRPRATSDS

SEQ ID NO: 219922 - protein, 9 aa, Homo Sapiens
WGKLSTWPS

SEQ ID NO: 219923 - protein, 9 aa, Homo Sapiens
LPACLALRR

SEQ ID NO: 219924 - protein, 9 aa, Homo Sapiens
LSLWKRLKV

SEQ ID NO: 219925 - protein, 9 aa, Homo Sapiens
SRPAPARAQ

SEQ ID NO: 219926 - protein, 9 aa, Homo Sapiens
RSPLAIQDS

SEQ ID NO: 219927 - protein, 9 aa, Homo Sapiens
AGCSWTCSQ

SEQ ID NO: 219928 - protein, 9 aa, Homo Sapiens
EYPKLLGKG

SEQ ID NO: 219929 - protein, 9 aa, Homo Sapiens
SKWDLPVFP

SEQ ID NO: 219930 - protein, 9 aa, Homo Sapiens
AAGLWTLLG

SEQ ID NO: 219931 - protein, 9 aa, Homo Sapiens
ELPLPPCTA

SEQ ID NO: 219932 - protein, 9 aa, Homo Sapiens
TPGHWGQRD

SEQ ID NO: 219933 - protein, 9 aa, Homo Sapiens
RQIQEEMMQ

SEQ ID NO: 219934 - protein, 9 aa, Homo Sapiens
SSHQSAPPI

SEQ ID NO: 219935 - protein, 9 aa, Homo Sapiens
GLAIVLLSQ

SEQ ID NO: 219936 - protein, 9 aa, Homo Sapiens
MWTSRTSPP

SEQ ID NO: 219937 - protein, 9 aa, Homo Sapiens
RPADHIPPE

SEQ ID NO: 219938 - protein, 9 aa, Homo Sapiens
RLWYKTFWN

SEQ ID NO: 219939 - protein, 9 aa, Homo Sapiens
YAMGGGSYR

SEQ ID NO: 219940 - protein, 9 aa, Homo Sapiens
LQSFRLLRV

SEQ ID NO: 219941 - protein, 9 aa, Homo Sapiens
PKGQVTAHT

SEQ ID NO: 219942 - protein, 9 aa, Homo Sapiens
LGSKPFTRQ

SEQ ID NO: 219943 - protein, 9 aa, Homo Sapiens
SEGTKTVTK

SEQ ID NO: 219944 - protein, 9 aa, Homo Sapiens
LPDAPTGFP

SEQ ID NO: 219945 - protein, 9 aa, Homo Sapiens
DIIIDPNLK

SEQ ID NO: 219946 - protein, 9 aa, Homo Sapiens
FERVLLKWT

SEQ ID NO: 219947 - protein, 9 aa, Homo Sapiens
RQMLTFYSA

SEQ ID NO: 219948 - protein, 9 aa, Homo Sapiens
RGKHAHRKG

SEQ ID NO: 219949 - protein, 9 aa, Homo Sapiens
LDHTNVVQA

SEQ ID NO: 219950 - protein, 9 aa, Homo Sapiens
GFDTETLGG

SEQ ID NO: 219951 - protein, 9 aa, Homo Sapiens
EELDNTLND

SEQ ID NO: 219952 - protein, 9 aa, Homo Sapiens
DGDKDGPAQ

SEQ ID NO: 219953 - protein, 9 aa, Homo Sapiens
TYSLSVISC

SEQ ID NO: 219954 - protein, 9 aa, Homo Sapiens
SRSSPWPSC

SEQ ID NO: 219955 - protein, 9 aa, Homo Sapiens
IKDWSKLHA

SEQ ID NO: 219956 - protein, 9 aa, Homo Sapiens
LQKYPQAAA

SEQ ID NO: 219957 - protein, 9 aa, Homo Sapiens
CGGQRVSWP

SEQ ID NO: 219958 - protein, 9 aa, Homo Sapiens
RSARAPRSW

SEQ ID NO: 219959 - protein, 9 aa, Homo Sapiens
VYSHNGVSL

SEQ ID NO: 219960 - protein, 9 aa, Homo Sapiens
STPVPAAPT

SEQ ID NO: 219961 - protein, 9 aa, Homo Sapiens
AHQNRVSVI

SEQ ID NO: 219962 - protein, 9 aa, Homo Sapiens
QVTFSPGLE

SEQ ID NO: 219963 - protein, 9 aa, Homo Sapiens
TVRQLVHAL

SEQ ID NO: 219964 - protein, 9 aa, Homo Sapiens
GLQGCVQVT

SEQ ID NO: 219965 - protein, 9 aa, Homo Sapiens
LEAFPLPRA

SEQ ID NO: 219966 - protein, 9 aa, Homo Sapiens
GRGLAAPGV

SEQ ID NO: 219967 - protein, 9 aa, Homo Sapiens
LHQLKHQHE

SEQ ID NO: 219968 - protein, 9 aa, Homo Sapiens
RDIGRSKEL

SEQ ID NO: 219969 - protein, 9 aa, Homo Sapiens
QAVGLHSLV

SEQ ID NO: 219970 - protein, 9 aa, Homo Sapiens
HQKQSEMPA

SEQ ID NO: 219971 - protein, 9 aa, Homo Sapiens
TAQLLLHGE

SEQ ID NO: 219972 - protein, 9 aa, Homo Sapiens
HAHGPSARG

SEQ ID NO: 219973 - protein, 9 aa, Homo Sapiens
EDMKNHRDS

SEQ ID NO: 219974 - protein, 9 aa, Homo Sapiens
PPPTRPRRK

SEQ ID NO: 219975 - protein, 9 aa, Homo Sapiens
LERLARPAL

SEQ ID NO: 219976 - protein, 9 aa, Homo Sapiens
SGPLDTGKS

SEQ ID NO: 219977 - protein, 9 aa, Homo Sapiens
FWAKSPLNQ

SEQ ID NO: 219978 - protein, 9 aa, Homo Sapiens
VRKITMVVL

SEQ ID NO: 219979 - protein, 9 aa, Homo Sapiens
QVPREGHIL

SEQ ID NO: 219980 - protein, 9 aa, Homo Sapiens
YQQQLHRVQ

SEQ ID NO: 219981 - protein, 9 aa, Homo Sapiens
HSIPQPWSP

SEQ ID NO: 219982 - protein, 9 aa, Homo Sapiens
NRCVPSRWQ

SEQ ID NO: 219983 - protein, 9 aa, Homo Sapiens
QYAKTDSYI

SEQ ID NO: 219984 - protein, 9 aa, Homo Sapiens
LTGIPGGNP

SEQ ID NO: 219985 - protein, 9 aa, Homo Sapiens
TATRNGPGL

SEQ ID NO: 219986 - protein, 9 aa, Homo Sapiens
LVGLGPPTC

SEQ ID NO: 219987 - protein, 9 aa, Homo Sapiens
STPLRRQLA

SEQ ID NO: 219988 - protein, 9 aa, Homo Sapiens
SPCRLRMLL

SEQ ID NO: 219989 - protein, 9 aa, Homo Sapiens
QVFSELSFP

SEQ ID NO: 219990 - protein, 9 aa, Homo Sapiens
KDLRTRADA

SEQ ID NO: 219991 - protein, 9 aa, Homo Sapiens
DNTDPAPLS

SEQ ID NO: 219992 - protein, 9 aa, Homo Sapiens
GDKGLKKMT

SEQ ID NO: 219993 - protein, 9 aa, Homo Sapiens
KQKVLKIQT

SEQ ID NO: 219994 - protein, 9 aa, Homo Sapiens
TCTWTCGPS

SEQ ID NO: 219995 - protein, 9 aa, Homo Sapiens
VHGLTLEVE

SEQ ID NO: 219996 - protein, 9 aa, Homo Sapiens
PVINRQRKE

SEQ ID NO: 219997 - protein, 9 aa, Homo Sapiens
SAPRATLQL

SEQ ID NO: 219998 - protein, 9 aa, Homo Sapiens
LQLLLHPHG

SEQ ID NO: 219999 - protein, 9 aa, Homo Sapiens
WDSPRKNQI

SEQ ID NO: 220000 - protein, 9 aa, Homo Sapiens
APGNKLELY

SEQ ID NO: 220001 - protein, 9 aa, Homo Sapiens
ILVKIHVKM

SEQ ID NO: 220002 - protein, 9 aa, Homo Sapiens
QAGARLDVR

SEQ ID NO: 220003 - protein, 9 aa, Homo Sapiens
CVSQVFLLF

SEQ ID NO: 220004 - protein, 9 aa, Homo Sapiens
LEMAEYEIK

SEQ ID NO: 220005 - protein, 9 aa, Homo Sapiens
MQWNNKKMA

SEQ ID NO: 220006 - protein, 9 aa, Homo Sapiens
LWILPLVVL

SEQ ID NO: 220007 - protein, 9 aa, Homo Sapiens
ERFNPGSSG

SEQ ID NO: 220008 - protein, 9 aa, Homo Sapiens
GVVGPRGQD

SEQ ID NO: 220009 - protein, 9 aa, Homo Sapiens
SNNDLQVAD

SEQ ID NO: 220010 - protein, 9 aa, Homo Sapiens
STAAPISSG

SEQ ID NO: 220011 - protein, 9 aa, Homo Sapiens
VHLEEHAVE

SEQ ID NO: 220012 - protein, 9 aa, Homo Sapiens
KISFFFRVG

SEQ ID NO: 220013 - protein, 9 aa, Homo Sapiens
DLQDAHTLD

SEQ ID NO: 220014 - protein, 9 aa, Homo Sapiens
RALSPELGI

SEQ ID NO: 220015 - protein, 9 aa, Homo Sapiens
ILVCETPCG

SEQ ID NO: 220016 - protein, 9 aa, Homo Sapiens
QNVTVNVRN

SEQ ID NO: 220017 - protein, 9 aa, Homo Sapiens
STCSKKKIE

SEQ ID NO: 220018 - protein, 9 aa, Homo Sapiens
ASERCHLWG

SEQ ID NO: 220019 - protein, 9 aa, Homo Sapiens
VSVIFLSVF

SEQ ID NO: 220020 - protein, 9 aa, Homo Sapiens
HTLQQALTA

SEQ ID NO: 220021 - protein, 9 aa, Homo Sapiens
KILYLVILQ

SEQ ID NO: 220022 - protein, 9 aa, Homo Sapiens
KKKLKLAPL

SEQ ID NO: 220023 - protein, 9 aa, Homo Sapiens
TSPYLNDDS

SEQ ID NO: 220024 - protein, 9 aa, Homo Sapiens
YVTVLDSAV

SEQ ID NO: 220025 - protein, 9 aa, Homo Sapiens
EPPHSATAT

SEQ ID NO: 220026 - protein, 9 aa, Homo Sapiens
GGTYNRVPS

SEQ ID NO: 220027 - protein, 9 aa, Homo Sapiens
KPQDATTNT

SEQ ID NO: 220028 - protein, 9 aa, Homo Sapiens
MAMDFSGQT

SEQ ID NO: 220029 - protein, 9 aa, Homo Sapiens
RSPSRRCPR

SEQ ID NO: 220030 - protein, 9 aa, Homo Sapiens
PTPRRWQQQ

SEQ ID NO: 220031 - protein, 9 aa, Homo Sapiens
WCGWLCPTP

SEQ ID NO: 220032 - protein, 9 aa, Homo Sapiens
ISERTHHSF

SEQ ID NO: 220033 - protein, 9 aa, Homo Sapiens
EHTPIWRPG

SEQ ID NO: 220034 - protein, 9 aa, Homo Sapiens
TGKSDPESV

SEQ ID NO: 220035 - protein, 9 aa, Homo Sapiens
SWTLFEHLS

SEQ ID NO: 220036 - protein, 9 aa, Homo Sapiens
GTCSVPPCL

SEQ ID NO: 220037 - protein, 9 aa, Homo Sapiens
DVKIFHGSG

SEQ ID NO: 220038 - protein, 9 aa, Homo Sapiens
MDNFQYVGV

SEQ ID NO: 220039 - protein, 9 aa, Homo Sapiens
VGATEETEV

SEQ ID NO: 220040 - protein, 9 aa, Homo Sapiens
WMYVDAAWG

SEQ ID NO: 220041 - protein, 9 aa, Homo Sapiens
KETKVLKPL

SEQ ID NO: 220042 - protein, 9 aa, Homo Sapiens
PGSHPLCST

SEQ ID NO: 220043 - protein, 9 aa, Homo Sapiens
AIIGSLIFH

SEQ ID NO: 220044 - protein, 9 aa, Homo Sapiens
LGYHFLGER

SEQ ID NO: 220045 - protein, 9 aa, Homo Sapiens
GPTSSSIQR

SEQ ID NO: 220046 - protein, 9 aa, Homo Sapiens
CLKFISAVL

SEQ ID NO: 220047 - protein, 9 aa, Homo Sapiens
QDSKLTTTS

SEQ ID NO: 220048 - protein, 9 aa, Homo Sapiens
GFIRFDKRS

SEQ ID NO: 220049 - protein, 9 aa, Homo Sapiens
GSVLLWRLR

SEQ ID NO: 220050 - protein, 9 aa, Homo Sapiens
EMADYDLKS

SEQ ID NO: 220051 - protein, 9 aa, Homo Sapiens
VTIGGIFLW

SEQ ID NO: 220052 - protein, 9 aa, Homo Sapiens
LRTSKELVS

SEQ ID NO: 220053 - protein, 9 aa, Homo Sapiens
PCRARVPGL

SEQ ID NO: 220054 - protein, 9 aa, Homo Sapiens
VIRYLSKLK

SEQ ID NO: 220055 - protein, 9 aa, Homo Sapiens
SPSPWCLRR

SEQ ID NO: 220056 - protein, 9 aa, Homo Sapiens
GRVLAVAPA

SEQ ID NO: 220057 - protein, 9 aa, Homo Sapiens
SIIQVILIL

SEQ ID NO: 220058 - protein, 9 aa, Homo Sapiens
ARLTLAGMG

SEQ ID NO: 220059 - protein, 9 aa, Homo Sapiens
QVSHGHPLA

SEQ ID NO: 220060 - protein, 9 aa, Homo Sapiens
LPGLFVKTM

SEQ ID NO: 220061 - protein, 9 aa, Homo Sapiens
KFISAVLAA

SEQ ID NO: 220062 - protein, 9 aa, Homo Sapiens
KQELEKWLL

SEQ ID NO: 220063 - protein, 9 aa, Homo Sapiens
KTGQKVNPG

SEQ ID NO: 220064 - protein, 9 aa, Homo Sapiens
DVPAVTSNF

SEQ ID NO: 220065 - protein, 9 aa, Homo Sapiens
LRCQRRDTT

SEQ ID NO: 220066 - protein, 9 aa, Homo Sapiens
CLLWKRKYS

SEQ ID NO: 220067 - protein, 9 aa, Homo Sapiens
SKCFEDYLE

SEQ ID NO: 220068 - protein, 9 aa, Homo Sapiens
PCINIGLRF

SEQ ID NO: 220069 - protein, 9 aa, Homo Sapiens
GRGRVWPSS

SEQ ID NO: 220070 - protein, 9 aa, Homo Sapiens
SHGHPLALA

SEQ ID NO: 220071 - protein, 9 aa, Homo Sapiens
RVELYGPSC

SEQ ID NO: 220072 - protein, 9 aa, Homo Sapiens
GQVPVDDWG

SEQ ID NO: 220073 - protein, 9 aa, Homo Sapiens
ITTIMVNND

SEQ ID NO: 220074 - protein, 9 aa, Homo Sapiens
TMLARLDSS

SEQ ID NO: 220075 - protein, 9 aa, Homo Sapiens
AGLVIFYFL

SEQ ID NO: 220076 - protein, 9 aa, Homo Sapiens
SLMIRKQIL

SEQ ID NO: 220077 - protein, 9 aa, Homo Sapiens
GLSADSMAR

SEQ ID NO: 220078 - protein, 9 aa, Homo Sapiens
MPIQISRQS

SEQ ID NO: 220079 - protein, 9 aa, Homo Sapiens
ESTMECQKP

SEQ ID NO: 220080 - protein, 9 aa, Homo Sapiens
GPSTPAMAS

SEQ ID NO: 220081 - protein, 9 aa, Homo Sapiens
QHSPSELFA

SEQ ID NO: 220082 - protein, 9 aa, Homo Sapiens
IVCVAYATE

SEQ ID NO: 220083 - protein, 9 aa, Homo Sapiens
RSPLRPGAP

SEQ ID NO: 220084 - protein, 9 aa, Homo Sapiens
AARPADHIP

SEQ ID NO: 220085 - protein, 9 aa, Homo Sapiens
REEDNAAIS

SEQ ID NO: 220086 - protein, 9 aa, Homo Sapiens
QCGPCGSGP

SEQ ID NO: 220087 - protein, 9 aa, Homo Sapiens
LAYLISAQS

SEQ ID NO: 220088 - protein, 9 aa, Homo Sapiens
PLRPLARRC

SEQ ID NO: 220089 - protein, 9 aa, Homo Sapiens
QGKLHRCGQ

SEQ ID NO: 220090 - protein, 9 aa, Homo Sapiens
CGWLCPTPS

SEQ ID NO: 220091 - protein, 9 aa, Homo Sapiens
RTAPSVWNA

SEQ ID NO: 220092 - protein, 9 aa, Homo Sapiens
EFPLVSLKE

SEQ ID NO: 220093 - protein, 9 aa, Homo Sapiens
VGLRSGPCE

SEQ ID NO: 220094 - protein, 9 aa, Homo Sapiens
TCPTASTTR

SEQ ID NO: 220095 - protein, 9 aa, Homo Sapiens
EEFRATPFI

SEQ ID NO: 220096 - protein, 9 aa, Homo Sapiens
LRRGCYLTV

SEQ ID NO: 220097 - protein, 9 aa, Homo Sapiens
HSKLEADKI

SEQ ID NO: 220098 - protein, 9 aa, Homo Sapiens
GYPKSTMME

SEQ ID NO: 220099 - protein, 9 aa, Homo Sapiens
ARSRGLGRP

SEQ ID NO: 220100 - protein, 9 aa, Homo Sapiens
LITSCDPLQ

SEQ ID NO: 220101 - protein, 9 aa, Homo Sapiens
HFTVNMSKV

SEQ ID NO: 220102 - protein, 9 aa, Homo Sapiens
KKDTSVNVK

SEQ ID NO: 220103 - protein, 9 aa, Homo Sapiens
PHPYSLQPP

SEQ ID NO: 220104 - protein, 9 aa, Homo Sapiens
EEHIRQVHW

SEQ ID NO: 220105 - protein, 9 aa, Homo Sapiens
CRGLWSWPP

SEQ ID NO: 220106 - protein, 9 aa, Homo Sapiens
PSRGFGRSL

SEQ ID NO: 220107 - protein, 9 aa, Homo Sapiens
TLMINLYHL

SEQ ID NO: 220108 - protein, 9 aa, Homo Sapiens
LNQGIPGRY

SEQ ID NO: 220109 - protein, 9 aa, Homo Sapiens
MRRRPGPPQ

SEQ ID NO: 220110 - protein, 9 aa, Homo Sapiens
GFTLLKLLV

SEQ ID NO: 220111 - protein, 9 aa, Homo Sapiens
QKNNGCFRS

SEQ ID NO: 220112 - protein, 9 aa, Homo Sapiens
LGLFLLHQV

SEQ ID NO: 220113 - protein, 9 aa, Homo Sapiens
LMRTWIIPM

SEQ ID NO: 220114 - protein, 9 aa, Homo Sapiens
HTRATHTKP

SEQ ID NO: 220115 - protein, 9 aa, Homo Sapiens
LFSSASAEL

SEQ ID NO: 220116 - protein, 9 aa, Homo Sapiens
LSHIGVERT

SEQ ID NO: 220117 - protein, 9 aa, Homo Sapiens
LGGKRSLGN

SEQ ID NO: 220118 - protein, 9 aa, Homo Sapiens
SRTSPPAGA

SEQ ID NO: 220119 - protein, 9 aa, Homo Sapiens
SLQSPRVNC

SEQ ID NO: 220120 - protein, 9 aa, Homo Sapiens
GSPGSRRGV

SEQ ID NO: 220121 - protein, 9 aa, Homo Sapiens
GEESSEREI

SEQ ID NO: 220122 - protein, 9 aa, Homo Sapiens
SPFGSSCLQ

SEQ ID NO: 220123 - protein, 9 aa, Homo Sapiens
HAAKMADEA

SEQ ID NO: 220124 - protein, 9 aa, Homo Sapiens
EQWLRLRLT

SEQ ID NO: 220125 - protein, 9 aa, Homo Sapiens
KPVTAKSKS

SEQ ID NO: 220126 - protein, 9 aa, Homo Sapiens
VQGHNSSGA

SEQ ID NO: 220127 - protein, 9 aa, Homo Sapiens
PRPTSQCHC

SEQ ID NO: 220128 - protein, 9 aa, Homo Sapiens
GKLEVDSLY

SEQ ID NO: 220129 - protein, 9 aa, Homo Sapiens
VHHKPKLCR

SEQ ID NO: 220130 - protein, 9 aa, Homo Sapiens
FFIQSNLQG

SEQ ID NO: 220131 - protein, 9 aa, Homo Sapiens
ATGWWTPWS

SEQ ID NO: 220132 - protein, 9 aa, Homo Sapiens
ENYRTLFQE

SEQ ID NO: 220133 - protein, 9 aa, Homo Sapiens
VGVTQRVPG

SEQ ID NO: 220134 - protein, 9 aa, Homo Sapiens
GVGFDGGTD

SEQ ID NO: 220135 - protein, 9 aa, Homo Sapiens
ESVGWNEAL

SEQ ID NO: 220136 - protein, 9 aa, Homo Sapiens
TNPSRGHYH

SEQ ID NO: 220137 - protein, 9 aa, Homo Sapiens
HTLDGEAGS

SEQ ID NO: 220138 - protein, 9 aa, Homo Sapiens
RLVVLCFLS

SEQ ID NO: 220139 - protein, 9 aa, Homo Sapiens
PNSVQKTSG

SEQ ID NO: 220140 - protein, 9 aa, Homo Sapiens
LECPEYSGP

SEQ ID NO: 220141 - protein, 9 aa, Homo Sapiens
EVDVIAKAL

SEQ ID NO: 220142 - protein, 9 aa, Homo Sapiens
TIVCHNQVD

SEQ ID NO: 220143 - protein, 9 aa, Homo Sapiens
HSEEEATRG

SEQ ID NO: 220144 - protein, 9 aa, Homo Sapiens
WHRDSAGPA

SEQ ID NO: 220145 - protein, 9 aa, Homo Sapiens
AVHAIVPNK

SEQ ID NO: 220146 - protein, 9 aa, Homo Sapiens
PAGPGKLRQ

SEQ ID NO: 220147 - protein, 9 aa, Homo Sapiens
LSGLPGSPG

SEQ ID NO: 220148 - protein, 9 aa, Homo Sapiens
NGIWEVMPR

SEQ ID NO: 220149 - protein, 9 aa, Homo Sapiens
IFWMRRLEE

SEQ ID NO: 220150 - protein, 9 aa, Homo Sapiens
KPNYNSVDF

SEQ ID NO: 220151 - protein, 9 aa, Homo Sapiens
TQCLVVLNQ

SEQ ID NO: 220152 - protein, 9 aa, Homo Sapiens
AGVQEAERR

SEQ ID NO: 220153 - protein, 9 aa, Homo Sapiens
KITPFPAEP

SEQ ID NO: 220154 - protein, 9 aa, Homo Sapiens
KNGKFYVGV

SEQ ID NO: 220155 - protein, 9 aa, Homo Sapiens
EADILSIML

SEQ ID NO: 220156 - protein, 9 aa, Homo Sapiens
LRLECPVST

SEQ ID NO: 220157 - protein, 9 aa, Homo Sapiens
WPPPSAQPR

SEQ ID NO: 220158 - protein, 9 aa, Homo Sapiens
HGAEEGEQG

SEQ ID NO: 220159 - protein, 9 aa, Homo Sapiens
NPEEITTIM

SEQ ID NO: 220160 - protein, 9 aa, Homo Sapiens
HSFSGLVGL

SEQ ID NO: 220161 - protein, 9 aa, Homo Sapiens
CPLPPCSLP

SEQ ID NO: 220162 - protein, 9 aa, Homo Sapiens
YRERGGGCL

SEQ ID NO: 220163 - protein, 9 aa, Homo Sapiens
LIIKTVMHK

SEQ ID NO: 220164 - protein, 9 aa, Homo Sapiens
KTMIFFTDI

SEQ ID NO: 220165 - protein, 9 aa, Homo Sapiens
RRITPLSIQ

SEQ ID NO: 220166 - protein, 9 aa, Homo Sapiens
HISRGEGNH

SEQ ID NO: 220167 - protein, 9 aa, Homo Sapiens
QNSKLWPEV

SEQ ID NO: 220168 - protein, 9 aa, Homo Sapiens
TEEVHHKPK

SEQ ID NO: 220169 - protein, 9 aa, Homo Sapiens
SEDQVLHRL

SEQ ID NO: 220170 - protein, 9 aa, Homo Sapiens
RLARPALLL

SEQ ID NO: 220171 - protein, 9 aa, Homo Sapiens
FTKTSLFRK

SEQ ID NO: 220172 - protein, 9 aa, Homo Sapiens
HTEIREKGS

SEQ ID NO: 220173 - protein, 9 aa, Homo Sapiens
TKLRQSLFN

SEQ ID NO: 220174 - protein, 9 aa, Homo Sapiens
AGVNIPCGD

SEQ ID NO: 220175 - protein, 9 aa, Homo Sapiens
RIRAARETR

SEQ ID NO: 220176 - protein, 9 aa, Homo Sapiens
QFQVENRRL

SEQ ID NO: 220177 - protein, 9 aa, Homo Sapiens
HTNVRFVKR

SEQ ID NO: 220178 - protein, 9 aa, Homo Sapiens
ASLDPIMRK

SEQ ID NO: 220179 - protein, 9 aa, Homo Sapiens
TWMQGISKK

SEQ ID NO: 220180 - protein, 9 aa, Homo Sapiens
SSPKRDMEK

SEQ ID NO: 220181 - protein, 9 aa, Homo Sapiens
MSGEGRMVQ

SEQ ID NO: 220182 - protein, 9 aa, Homo Sapiens
RLLVFRLVV

SEQ ID NO: 220183 - protein, 9 aa, Homo Sapiens
NLLLTADLR

SEQ ID NO: 220184 - protein, 9 aa, Homo Sapiens
GHLDSPTFH

SEQ ID NO: 220185 - protein, 9 aa, Homo Sapiens
RQSPIDLHS

SEQ ID NO: 220186 - protein, 9 aa, Homo Sapiens
LRTSQGCAL

SEQ ID NO: 220187 - protein, 9 aa, Homo Sapiens
VLSLIITAD

SEQ ID NO: 220188 - protein, 9 aa, Homo Sapiens
NAPRAAAFG

SEQ ID NO: 220189 - protein, 9 aa, Homo Sapiens
AAALKRHFT

SEQ ID NO: 220190 - protein, 9 aa, Homo Sapiens
LDHGEDVEH

SEQ ID NO: 220191 - protein, 9 aa, Homo Sapiens
ASTSPPPPA

SEQ ID NO: 220192 - protein, 9 aa, Homo Sapiens
YGGDRSRGA

SEQ ID NO: 220193 - protein, 9 aa, Homo Sapiens
KVRFLEQQT

SEQ ID NO: 220194 - protein, 9 aa, Homo Sapiens
CCSYSESKR

SEQ ID NO: 220195 - protein, 9 aa, Homo Sapiens
DQGQLNKFE

SEQ ID NO: 220196 - protein, 9 aa, Homo Sapiens
PTPTSALAL

SEQ ID NO: 220197 - protein, 9 aa, Homo Sapiens
LGCSGLPEL

SEQ ID NO: 220198 - protein, 9 aa, Homo Sapiens
NQVYVATTS

SEQ ID NO: 220199 - protein, 9 aa, Homo Sapiens
VLTTRPSRQ

SEQ ID NO: 220200 - protein, 9 aa, Homo Sapiens
DFFLCHFIL

SEQ ID NO: 220201 - protein, 9 aa, Homo Sapiens
PGFSAGGTA

SEQ ID NO: 220202 - protein, 9 aa, Homo Sapiens
SPRWTPRTW

SEQ ID NO: 220203 - protein, 9 aa, Homo Sapiens
QGLCPQCPG

SEQ ID NO: 220204 - protein, 9 aa, Homo Sapiens
CQRTERPGA

SEQ ID NO: 220205 - protein, 9 aa, Homo Sapiens
KKPFKQVLI

SEQ ID NO: 220206 - protein, 9 aa, Homo Sapiens
PGGRPSHPS

SEQ ID NO: 220207 - protein, 9 aa, Homo Sapiens
CIERGQAFI

SEQ ID NO: 220208 - protein, 9 aa, Homo Sapiens
QRPGWAPCG

SEQ ID NO: 220209 - protein, 9 aa, Homo Sapiens
NDKKRQKPL

SEQ ID NO: 220210 - protein, 9 aa, Homo Sapiens
THHSFRVSW

SEQ ID NO: 220211 - protein, 9 aa, Homo Sapiens
LPFSTVRLL

SEQ ID NO: 220212 - protein, 9 aa, Homo Sapiens
PRSWGCTTG

SEQ ID NO: 220213 - protein, 9 aa, Homo Sapiens
HESLHGQRL

SEQ ID NO: 220214 - protein, 9 aa, Homo Sapiens
MTGSQDLIL

SEQ ID NO: 220215 - protein, 9 aa, Homo Sapiens
RRVCENRRG

SEQ ID NO: 220216 - protein, 9 aa, Homo Sapiens
STLVLDVSS

SEQ ID NO: 220217 - protein, 9 aa, Homo Sapiens
RPGAPGLLP

SEQ ID NO: 220218 - protein, 9 aa, Homo Sapiens
LLDLLRGWG

SEQ ID NO: 220219 - protein, 9 aa, Homo Sapiens
DKIRSLEEQ

SEQ ID NO: 220220 - protein, 9 aa, Homo Sapiens
KSYRPLCAL

SEQ ID NO: 220221 - protein, 9 aa, Homo Sapiens
TDDPDEEVQ

SEQ ID NO: 220222 - protein, 9 aa, Homo Sapiens
PPTCSPQGR

SEQ ID NO: 220223 - protein, 9 aa, Homo Sapiens
AGYDMVARE

SEQ ID NO: 220224 - protein, 9 aa, Homo Sapiens
VSDSWPEQH

SEQ ID NO: 220225 - protein, 9 aa, Homo Sapiens
NSSTGRNAR

SEQ ID NO: 220226 - protein, 9 aa, Homo Sapiens
SWVLQAIIG

SEQ ID NO: 220227 - protein, 9 aa, Homo Sapiens
GGIQSLVNL

SEQ ID NO: 220228 - protein, 9 aa, Homo Sapiens
QVKKSNTSQ

SEQ ID NO: 220229 - protein, 9 aa, Homo Sapiens
LCRVGARPP

SEQ ID NO: 220230 - protein, 9 aa, Homo Sapiens
GGMSRTPPR

SEQ ID NO: 220231 - protein, 9 aa, Homo Sapiens
HWCPTQPRR

SEQ ID NO: 220232 - protein, 9 aa, Homo Sapiens
SDMGNLDDF

SEQ ID NO: 220233 - protein, 9 aa, Homo Sapiens
VDIACSEIF

SEQ ID NO: 220234 - protein, 9 aa, Homo Sapiens
CQTRSWRMT

SEQ ID NO: 220235 - protein, 9 aa, Homo Sapiens
FVLDIVSRL

SEQ ID NO: 220236 - protein, 9 aa, Homo Sapiens
IDGVKPPMP

SEQ ID NO: 220237 - protein, 9 aa, Homo Sapiens
HQLEGHLVR

SEQ ID NO: 220238 - protein, 9 aa, Homo Sapiens
LTGGHHGSV

SEQ ID NO: 220239 - protein, 9 aa, Homo Sapiens
STLAPASRG

SEQ ID NO: 220240 - protein, 9 aa, Homo Sapiens
LEQQTAALA

SEQ ID NO: 220241 - protein, 9 aa, Homo Sapiens
PIVNDIIRK

SEQ ID NO: 220242 - protein, 9 aa, Homo Sapiens
AAGPTSSPS

SEQ ID NO: 220243 - protein, 9 aa, Homo Sapiens
LRARAIEAQ

SEQ ID NO: 220244 - protein, 9 aa, Homo Sapiens
EPCSPNVHF

SEQ ID NO: 220245 - protein, 9 aa, Homo Sapiens
SWPRPPCSQ

SEQ ID NO: 220246 - protein, 9 aa, Homo Sapiens
IRVSIIDDD

SEQ ID NO: 220247 - protein, 9 aa, Homo Sapiens
MYKDKKRHE

SEQ ID NO: 220248 - protein, 9 aa, Homo Sapiens
NCCSYSESK

SEQ ID NO: 220249 - protein, 9 aa, Homo Sapiens
LPRRPQPWK

SEQ ID NO: 220250 - protein, 9 aa, Homo Sapiens
HPSPRWTPR

SEQ ID NO: 220251 - protein, 9 aa, Homo Sapiens
AWSMPRNGP

SEQ ID NO: 220252 - protein, 9 aa, Homo Sapiens
SSSLSVMSS

SEQ ID NO: 220253 - protein, 9 aa, Homo Sapiens
AQAPQLLPP

SEQ ID NO: 220254 - protein, 9 aa, Homo Sapiens
LSKKGNFQR

SEQ ID NO: 220255 - protein, 9 aa, Homo Sapiens
ELTDRVGEG

SEQ ID NO: 220256 - protein, 9 aa, Homo Sapiens
LAIGTHSAN

SEQ ID NO: 220257 - protein, 9 aa, Homo Sapiens
AAMEETEVG

SEQ ID NO: 220258 - protein, 9 aa, Homo Sapiens
DNGEPPHSA

SEQ ID NO: 220259 - protein, 9 aa, Homo Sapiens
FAGVPLIIG

SEQ ID NO: 220260 - protein, 9 aa, Homo Sapiens
IEEADILSI

SEQ ID NO: 220261 - protein, 9 aa, Homo Sapiens
DCWAATLFL

SEQ ID NO: 220262 - protein, 9 aa, Homo Sapiens
NLEDYKKTT

SEQ ID NO: 220263 - protein, 9 aa, Homo Sapiens
SVKLHNRVV

SEQ ID NO: 220264 - protein, 9 aa, Homo Sapiens
CNYYFCILD

SEQ ID NO: 220265 - protein, 9 aa, Homo Sapiens
PEDSNDSRC

SEQ ID NO: 220266 - protein, 9 aa, Homo Sapiens
AIEAQCYVV

SEQ ID NO: 220267 - protein, 9 aa, Homo Sapiens
RGGSTPAPW

SEQ ID NO: 220268 - protein, 9 aa, Homo Sapiens
MGSGFGFCL

SEQ ID NO: 220269 - protein, 9 aa, Homo Sapiens
DSEVSEDSP

SEQ ID NO: 220270 - protein, 9 aa, Homo Sapiens
LDATRQALS

SEQ ID NO: 220271 - protein, 9 aa, Homo Sapiens
PGLFVKTMV

SEQ ID NO: 220272 - protein, 9 aa, Homo Sapiens
REYLKAPED

SEQ ID NO: 220273 - protein, 9 aa, Homo Sapiens
GSSGWPNSR

SEQ ID NO: 220274 - protein, 9 aa, Homo Sapiens
VEPGGCGWA

SEQ ID NO: 220275 - protein, 9 aa, Homo Sapiens
RPTRGSSSR

SEQ ID NO: 220276 - protein, 9 aa, Homo Sapiens
AGGGIQRNL

SEQ ID NO: 220277 - protein, 9 aa, Homo Sapiens
LEAEQQALR

SEQ ID NO: 220278 - protein, 9 aa, Homo Sapiens
HTIQFVDWC

SEQ ID NO: 220279 - protein, 9 aa, Homo Sapiens
EGVLIMFSR

SEQ ID NO: 220280 - protein, 9 aa, Homo Sapiens
HLLPLRVTD

SEQ ID NO: 220281 - protein, 9 aa, Homo Sapiens
AGGTAAGGQ

SEQ ID NO: 220282 - protein, 9 aa, Homo Sapiens
MLKFVENTW

SEQ ID NO: 220283 - protein, 9 aa, Homo Sapiens
ARSGKGEAQ

SEQ ID NO: 220284 - protein, 9 aa, Homo Sapiens
VPEMKLPEV

SEQ ID NO: 220285 - protein, 9 aa, Homo Sapiens
AAYAQGTLQ

SEQ ID NO: 220286 - protein, 9 aa, Homo Sapiens
AAACPLPPT

SEQ ID NO: 220287 - protein, 9 aa, Homo Sapiens
RRVGGRKRG

SEQ ID NO: 220288 - protein, 9 aa, Homo Sapiens
SSGKKIAFH

SEQ ID NO: 220289 - protein, 9 aa, Homo Sapiens
RKSGTHQMR

SEQ ID NO: 220290 - protein, 9 aa, Homo Sapiens
PIQAYILAH

SEQ ID NO: 220291 - protein, 9 aa, Homo Sapiens
HYGHQAPQV

SEQ ID NO: 220292 - protein, 9 aa, Homo Sapiens
PLGHRGWRL

SEQ ID NO: 220293 - protein, 9 aa, Homo Sapiens
VEEHMRSTL

SEQ ID NO: 220294 - protein, 9 aa, Homo Sapiens
FNPDTELQS

SEQ ID NO: 220295 - protein, 9 aa, Homo Sapiens
SCPLALLIF

SEQ ID NO: 220296 - protein, 9 aa, Homo Sapiens
FLLIISTVA

SEQ ID NO: 220297 - protein, 9 aa, Homo Sapiens
LIFCASNGI

SEQ ID NO: 220298 - protein, 9 aa, Homo Sapiens
SPAWKHFLS

SEQ ID NO: 220299 - protein, 9 aa, Homo Sapiens
QEQLLMQLQ

SEQ ID NO: 220300 - protein, 9 aa, Homo Sapiens
GVLDYDKEK

SEQ ID NO: 220301 - protein, 9 aa, Homo Sapiens
PFLLAEAMC

SEQ ID NO: 220302 - protein, 9 aa, Homo Sapiens
WPISKQLYR

SEQ ID NO: 220303 - protein, 9 aa, Homo Sapiens
HQRKLRACG

SEQ ID NO: 220304 - protein, 9 aa, Homo Sapiens
PGGNPAYSF

SEQ ID NO: 220305 - protein, 9 aa, Homo Sapiens
TWIVTAAHC

SEQ ID NO: 220306 - protein, 9 aa, Homo Sapiens
QDAWQELGT

SEQ ID NO: 220307 - protein, 9 aa, Homo Sapiens
LPIDQVKIS

SEQ ID NO: 220308 - protein, 9 aa, Homo Sapiens
EETFGGWVC

SEQ ID NO: 220309 - protein, 9 aa, Homo Sapiens
RYRAKRRNH

SEQ ID NO: 220310 - protein, 9 aa, Homo Sapiens
SADSMARAE

SEQ ID NO: 220311 - protein, 9 aa, Homo Sapiens
RQVHWDLSG

SEQ ID NO: 220312 - protein, 9 aa, Homo Sapiens
LLLSLYDPW

SEQ ID NO: 220313 - protein, 9 aa, Homo Sapiens
LYHTPHAQA

SEQ ID NO: 220314 - protein, 9 aa, Homo Sapiens
SPAAVVMRP

SEQ ID NO: 220315 - protein, 9 aa, Homo Sapiens
SLPTASGVS

SEQ ID NO: 220316 - protein, 9 aa, Homo Sapiens
QPTNHVSAS

SEQ ID NO: 220317 - protein, 9 aa, Homo Sapiens
ALEQEQAAP

SEQ ID NO: 220318 - protein, 9 aa, Homo Sapiens
SELWKKSLN

SEQ ID NO: 220319 - protein, 9 aa, Homo Sapiens
VFSELSFPP

SEQ ID NO: 220320 - protein, 9 aa, Homo Sapiens
IPPPAPATQ

SEQ ID NO: 220321 - protein, 9 aa, Homo Sapiens
LEVEVKVVL

SEQ ID NO: 220322 - protein, 9 aa, Homo Sapiens
GCSWRSRST

SEQ ID NO: 220323 - protein, 9 aa, Homo Sapiens
VSFASGCVV

SEQ ID NO: 220324 - protein, 9 aa, Homo Sapiens
EKKDGEKTR

SEQ ID NO: 220325 - protein, 9 aa, Homo Sapiens
GGVGDLECA

SEQ ID NO: 220326 - protein, 9 aa, Homo Sapiens
SVTTVPRSS

SEQ ID NO: 220327 - protein, 9 aa, Homo Sapiens
GPLNTGGGP

SEQ ID NO: 220328 - protein, 9 aa, Homo Sapiens
GCLLRGLWQ

SEQ ID NO: 220329 - protein, 9 aa, Homo Sapiens
GLVVLTAYS

SEQ ID NO: 220330 - protein, 9 aa, Homo Sapiens
ALQTSTTRY

SEQ ID NO: 220331 - protein, 9 aa, Homo Sapiens
AGSEVDRII

SEQ ID NO: 220332 - protein, 9 aa, Homo Sapiens
DVGCVGIEA

SEQ ID NO: 220333 - protein, 9 aa, Homo Sapiens
GLKKMTLKA

SEQ ID NO: 220334 - protein, 9 aa, Homo Sapiens
APGASDHVT

SEQ ID NO: 220335 - protein, 9 aa, Homo Sapiens
RGTKSTPWQ

SEQ ID NO: 220336 - protein, 9 aa, Homo Sapiens
CRCLAQEDV

SEQ ID NO: 220337 - protein, 9 aa, Homo Sapiens
ISLDLPVAG

SEQ ID NO: 220338 - protein, 9 aa, Homo Sapiens
ECLDDAEKN

SEQ ID NO: 220339 - protein, 9 aa, Homo Sapiens
HRCCLPCLL

SEQ ID NO: 220340 - protein, 9 aa, Homo Sapiens
WTLLGDPVL

SEQ ID NO: 220341 - protein, 9 aa, Homo Sapiens
RESLIRRTR

SEQ ID NO: 220342 - protein, 9 aa, Homo Sapiens
CRGATAVFD

SEQ ID NO: 220343 - protein, 9 aa, Homo Sapiens
PGSSGWPNS

SEQ ID NO: 220344 - protein, 9 aa, Homo Sapiens
TLTWHSTKR

SEQ ID NO: 220345 - protein, 9 aa, Homo Sapiens
DATGSRGAW

SEQ ID NO: 220346 - protein, 9 aa, Homo Sapiens
NKYAKCFEN

SEQ ID NO: 220347 - protein, 9 aa, Homo Sapiens
LSYVGITLT

SEQ ID NO: 220348 - protein, 9 aa, Homo Sapiens
YMEMHYGHQ

SEQ ID NO: 220349 - protein, 9 aa, Homo Sapiens
VCFTKILSL

SEQ ID NO: 220350 - protein, 9 aa, Homo Sapiens
YNKNRQKVQ

SEQ ID NO: 220351 - protein, 9 aa, Homo Sapiens
EKFLSKKGN

SEQ ID NO: 220352 - protein, 9 aa, Homo Sapiens
ASGPIQAYI

SEQ ID NO: 220353 - protein, 9 aa, Homo Sapiens
SPSTLSSSP

SEQ ID NO: 220354 - protein, 9 aa, Homo Sapiens
AAFSNVGTV

SEQ ID NO: 220355 - protein, 9 aa, Homo Sapiens
NALFPPMEF

SEQ ID NO: 220356 - protein, 9 aa, Homo Sapiens
EGLCSLQHQ

SEQ ID NO: 220357 - protein, 9 aa, Homo Sapiens
EVVNILWSL

SEQ ID NO: 220358 - protein, 9 aa, Homo Sapiens
PDTTEEVHH

SEQ ID NO: 220359 - protein, 9 aa, Homo Sapiens
FWNHSLAIG

SEQ ID NO: 220360 - protein, 9 aa, Homo Sapiens
SAPQGNCCQ

SEQ ID NO: 220361 - protein, 9 aa, Homo Sapiens
LKCVCYQQV

SEQ ID NO: 220362 - protein, 9 aa, Homo Sapiens
DSFFVIFLE

SEQ ID NO: 220363 - protein, 9 aa, Homo Sapiens
NTSQVKAAG

SEQ ID NO: 220364 - protein, 9 aa, Homo Sapiens
LSQILEKMP

SEQ ID NO: 220365 - protein, 9 aa, Homo Sapiens
LQRGPAGPG

SEQ ID NO: 220366 - protein, 9 aa, Homo Sapiens
EPPEERVTA

SEQ ID NO: 220367 - protein, 9 aa, Homo Sapiens
EAHRGDAGP

SEQ ID NO: 220368 - protein, 9 aa, Homo Sapiens
RNHTNVRFV

SEQ ID NO: 220369 - protein, 9 aa, Homo Sapiens
GVFGVAEEL

SEQ ID NO: 220370 - protein, 9 aa, Homo Sapiens
ALLHFGLPA

SEQ ID NO: 220371 - protein, 9 aa, Homo Sapiens
RSEQNRSSE

SEQ ID NO: 220372 - protein, 9 aa, Homo Sapiens
VTTPVNPAP

SEQ ID NO: 220373 - protein, 9 aa, Homo Sapiens
EAGRYASQQ

SEQ ID NO: 220374 - protein, 9 aa, Homo Sapiens
EQLQDLHSH

SEQ ID NO: 220375 - protein, 9 aa, Homo Sapiens
RLVMCLRNA

SEQ ID NO: 220376 - protein, 9 aa, Homo Sapiens
PPPPSRPRS

SEQ ID NO: 220377 - protein, 9 aa, Homo Sapiens
QLKSVKGGA

SEQ ID NO: 220378 - protein, 9 aa, Homo Sapiens
RLLNLCQRT

SEQ ID NO: 220379 - protein, 9 aa, Homo Sapiens
RIVCFTKIL

SEQ ID NO: 220380 - protein, 9 aa, Homo Sapiens
AVIRLCLCC

SEQ ID NO: 220381 - protein, 9 aa, Homo Sapiens
AGTATRNGP

SEQ ID NO: 220382 - protein, 9 aa, Homo Sapiens
MTRRQDVLS

SEQ ID NO: 220383 - protein, 9 aa, Homo Sapiens
VANQILKDI

SEQ ID NO: 220384 - protein, 9 aa, Homo Sapiens
LPCLSWPAR

SEQ ID NO: 220385 - protein, 9 aa, Homo Sapiens
YDREKPMAY

SEQ ID NO: 220386 - protein, 9 aa, Homo Sapiens
ILKDQVGGT

SEQ ID NO: 220387 - protein, 9 aa, Homo Sapiens
GVLVAATAV

SEQ ID NO: 220388 - protein, 9 aa, Homo Sapiens
RGRHRRRGA

SEQ ID NO: 220389 - protein, 9 aa, Homo Sapiens
LSAASPAGT

SEQ ID NO: 220390 - protein, 9 aa, Homo Sapiens
TIGEKTDKY

SEQ ID NO: 220391 - protein, 9 aa, Homo Sapiens
EQIKKKPEE

SEQ ID NO: 220392 - protein, 9 aa, Homo Sapiens
RDTTHVQMG

SEQ ID NO: 220393 - protein, 9 aa, Homo Sapiens
FLEGFCSPR

SEQ ID NO: 220394 - protein, 9 aa, Homo Sapiens
ILKLTLKMI

SEQ ID NO: 220395 - protein, 9 aa, Homo Sapiens
SISWDPVNV

SEQ ID NO: 220396 - protein, 9 aa, Homo Sapiens
LKQALTTGM

SEQ ID NO: 220397 - protein, 9 aa, Homo Sapiens
SNRLVLLYL

SEQ ID NO: 220398 - protein, 9 aa, Homo Sapiens
LALSLGYVA

SEQ ID NO: 220399 - protein, 9 aa, Homo Sapiens
NSIWHNLSL

SEQ ID NO: 220400 - protein, 9 aa, Homo Sapiens
RWYRVPEVI

SEQ ID NO: 220401 - protein, 9 aa, Homo Sapiens
TSATPQGSN

SEQ ID NO: 220402 - protein, 9 aa, Homo Sapiens
IFLWMKIFR

SEQ ID NO: 220403 - protein, 9 aa, Homo Sapiens
QETNKQPPR

SEQ ID NO: 220404 - protein, 9 aa, Homo Sapiens
RCPRTPRAS

SEQ ID NO: 220405 - protein, 9 aa, Homo Sapiens
WGLTGIHLH

SEQ ID NO: 220406 - protein, 9 aa, Homo Sapiens
EAKVCMVYV

SEQ ID NO: 220407 - protein, 9 aa, Homo Sapiens
VKNFDQAVE

SEQ ID NO: 220408 - protein, 9 aa, Homo Sapiens
CIANSNPPV

SEQ ID NO: 220409 - protein, 9 aa, Homo Sapiens
FTSVQHGSC

SEQ ID NO: 220410 - protein, 9 aa, Homo Sapiens
DCRCPYEYE

SEQ ID NO: 220411 - protein, 9 aa, Homo Sapiens
RQTVALKHM

SEQ ID NO: 220412 - protein, 9 aa, Homo Sapiens
TAASIPDCR

SEQ ID NO: 220413 - protein, 9 aa, Homo Sapiens
PHARTEISV

SEQ ID NO: 220414 - protein, 9 aa, Homo Sapiens
EMTIIITVM

SEQ ID NO: 220415 - protein, 9 aa, Homo Sapiens
DAHTLDGEA

SEQ ID NO: 220416 - protein, 9 aa, Homo Sapiens
LPLSSSQVS

SEQ ID NO: 220417 - protein, 9 aa, Homo Sapiens
EDHPRILQA

SEQ ID NO: 220418 - protein, 9 aa, Homo Sapiens
PTASETLRC

SEQ ID NO: 220419 - protein, 9 aa, Homo Sapiens
TVAIIGSLI

SEQ ID NO: 220420 - protein, 9 aa, Homo Sapiens
HKGFGKDMT

SEQ ID NO: 220421 - protein, 9 aa, Homo Sapiens
YVRPQLFSP

SEQ ID NO: 220422 - protein, 9 aa, Homo Sapiens
WSELWKKSL

SEQ ID NO: 220423 - protein, 9 aa, Homo Sapiens
RCKDCDQLF

SEQ ID NO: 220424 - protein, 9 aa, Homo Sapiens
PTGVRGLGR

SEQ ID NO: 220425 - protein, 9 aa, Homo Sapiens
PSFDCGPFI

SEQ ID NO: 220426 - protein, 9 aa, Homo Sapiens
LSGLRVKGL

SEQ ID NO: 220427 - protein, 9 aa, Homo Sapiens
ISTQSFPSL

SEQ ID NO: 220428 - protein, 9 aa, Homo Sapiens
SGLRIHGPT

SEQ ID NO: 220429 - protein, 9 aa, Homo Sapiens
KDILLSPVL

SEQ ID NO: 220430 - protein, 9 aa, Homo Sapiens
GEDSVPHGA

SEQ ID NO: 220431 - protein, 9 aa, Homo Sapiens
FTLQNVGHK

SEQ ID NO: 220432 - protein, 9 aa, Homo Sapiens
SRTLGSLPL

SEQ ID NO: 220433 - protein, 9 aa, Homo Sapiens
TQAQEGLCS

SEQ ID NO: 220434 - protein, 9 aa, Homo Sapiens
QYGCKNCGS

SEQ ID NO: 220435 - protein, 9 aa, Homo Sapiens
EEVQVPKFL

SEQ ID NO: 220436 - protein, 9 aa, Homo Sapiens
PDGQSQPPS

SEQ ID NO: 220437 - protein, 9 aa, Homo Sapiens
CYTQQILTD

SEQ ID NO: 220438 - protein, 9 aa, Homo Sapiens
SRQPVRPSY

SEQ ID NO: 220439 - protein, 9 aa, Homo Sapiens
QLLILILAD

SEQ ID NO: 220440 - protein, 9 aa, Homo Sapiens
VKIIDWILK

SEQ ID NO: 220441 - protein, 9 aa, Homo Sapiens
GPARPLPPQ

SEQ ID NO: 220442 - protein, 9 aa, Homo Sapiens
THPSPLALP

SEQ ID NO: 220443 - protein, 9 aa, Homo Sapiens
VSLRAFLDQ

SEQ ID NO: 220444 - protein, 9 aa, Homo Sapiens
MQQNSADNA

SEQ ID NO: 220445 - protein, 9 aa, Homo Sapiens
GRISSTHCT

SEQ ID NO: 220446 - protein, 9 aa, Homo Sapiens
LPPQSRTTT

SEQ ID NO: 220447 - protein, 9 aa, Homo Sapiens
MTFKEFFAA

SEQ ID NO: 220448 - protein, 9 aa, Homo Sapiens
ELGVFAPDE

SEQ ID NO: 220449 - protein, 9 aa, Homo Sapiens
CPTAEPTAT

SEQ ID NO: 220450 - protein, 9 aa, Homo Sapiens
EPWDTERNL

SEQ ID NO: 220451 - protein, 9 aa, Homo Sapiens
SEIQLKAYF

SEQ ID NO: 220452 - protein, 9 aa, Homo Sapiens
GCQGTRRFR

SEQ ID NO: 220453 - protein, 9 aa, Homo Sapiens
SLPLRGFLL

SEQ ID NO: 220454 - protein, 9 aa, Homo Sapiens
KTFSQSTKQ

SEQ ID NO: 220455 - protein, 9 aa, Homo Sapiens
ALEAEQQAL

SEQ ID NO: 220456 - protein, 9 aa, Homo Sapiens
IDTFMGFIT

SEQ ID NO: 220457 - protein, 9 aa, Homo Sapiens
PLRLWSWCG

SEQ ID NO: 220458 - protein, 9 aa, Homo Sapiens
LPEGRHGHL

SEQ ID NO: 220459 - protein, 9 aa, Homo Sapiens
DVRSLSKKE

SEQ ID NO: 220460 - protein, 9 aa, Homo Sapiens
WQGNVKVVQ

SEQ ID NO: 220461 - protein, 9 aa, Homo Sapiens
SARGAPSLL

SEQ ID NO: 220462 - protein, 9 aa, Homo Sapiens
SKISGFDTE

SEQ ID NO: 220463 - protein, 9 aa, Homo Sapiens
TWSIITGER

SEQ ID NO: 220464 - protein, 9 aa, Homo Sapiens
WWSQPPPTR

SEQ ID NO: 220465 - protein, 9 aa, Homo Sapiens
LVKAGFAGE

SEQ ID NO: 220466 - protein, 9 aa, Homo Sapiens
SLPRLGCPV

SEQ ID NO: 220467 - protein, 9 aa, Homo Sapiens
RDQSEASKR

SEQ ID NO: 220468 - protein, 9 aa, Homo Sapiens
RLPACLALR

SEQ ID NO: 220469 - protein, 9 aa, Homo Sapiens
AERHPREYL

SEQ ID NO: 220470 - protein, 9 aa, Homo Sapiens
MINLYHLSP

SEQ ID NO: 220471 - protein, 9 aa, Homo Sapiens
LALCVSRFW

SEQ ID NO: 220472 - protein, 9 aa, Homo Sapiens
PLELQPPGD

SEQ ID NO: 220473 - protein, 9 aa, Homo Sapiens
RRWPLAPRK

SEQ ID NO: 220474 - protein, 9 aa, Homo Sapiens
SSCTGLDTW

SEQ ID NO: 220475 - protein, 9 aa, Homo Sapiens
LTYTKVWKM

SEQ ID NO: 220476 - protein, 9 aa, Homo Sapiens
SERVLTTRP

SEQ ID NO: 220477 - protein, 9 aa, Homo Sapiens
VRKCNGQPI

SEQ ID NO: 220478 - protein, 9 aa, Homo Sapiens
AAAGCSWTC

SEQ ID NO: 220479 - protein, 9 aa, Homo Sapiens
ETDHQDYRE

SEQ ID NO: 220480 - protein, 9 aa, Homo Sapiens
GLWAWKAGT

SEQ ID NO: 220481 - protein, 9 aa, Homo Sapiens
QIIWLKLTK

SEQ ID NO: 220482 - protein, 9 aa, Homo Sapiens
NLLRLQSLL

SEQ ID NO: 220483 - protein, 9 aa, Homo Sapiens
LLPPPPPCP

SEQ ID NO: 220484 - protein, 9 aa, Homo Sapiens
RSLLRVAYL

SEQ ID NO: 220485 - protein, 9 aa, Homo Sapiens
SEFPLVSLK

SEQ ID NO: 220486 - protein, 9 aa, Homo Sapiens
ELGFTMLAR

SEQ ID NO: 220487 - protein, 9 aa, Homo Sapiens
VTTVPRSST

SEQ ID NO: 220488 - protein, 9 aa, Homo Sapiens
SARSLPRPE

SEQ ID NO: 220489 - protein, 9 aa, Homo Sapiens
KDWEQAKDN

SEQ ID NO: 220490 - protein, 9 aa, Homo Sapiens
LTTVRRKKK

SEQ ID NO: 220491 - protein, 9 aa, Homo Sapiens
GKPLYRVST

SEQ ID NO: 220492 - protein, 9 aa, Homo Sapiens
IWERIGKDP

SEQ ID NO: 220493 - protein, 9 aa, Homo Sapiens
QQRFHLVPS

SEQ ID NO: 220494 - protein, 9 aa, Homo Sapiens
VPDTAVLPS

SEQ ID NO: 220495 - protein, 9 aa, Homo Sapiens
ESKTGQKVN

SEQ ID NO: 220496 - protein, 9 aa, Homo Sapiens
WALSGSTPT

SEQ ID NO: 220497 - protein, 9 aa, Homo Sapiens
PQGQARDLR

SEQ ID NO: 220498 - protein, 9 aa, Homo Sapiens
SLYDPWMPS

SEQ ID NO: 220499 - protein, 9 aa, Homo Sapiens
SASLHPASG

SEQ ID NO: 220500 - protein, 9 aa, Homo Sapiens
AGPGPPTRA

SEQ ID NO: 220501 - protein, 9 aa, Homo Sapiens
AATASTSPP

SEQ ID NO: 220502 - protein, 9 aa, Homo Sapiens
HEGPGGSVS

SEQ ID NO: 220503 - protein, 9 aa, Homo Sapiens
GCPVSARSL

SEQ ID NO: 220504 - protein, 9 aa, Homo Sapiens
YLEETFGGW

SEQ ID NO: 220505 - protein, 9 aa, Homo Sapiens
VHGSVDVVK

SEQ ID NO: 220506 - protein, 9 aa, Homo Sapiens
AQIFLEGFC

SEQ ID NO: 220507 - protein, 9 aa, Homo Sapiens
VKPSDMGNL

SEQ ID NO: 220508 - protein, 9 aa, Homo Sapiens
HVLLGERGL

SEQ ID NO: 220509 - protein, 9 aa, Homo Sapiens
TPLSIQTQG

SEQ ID NO: 220510 - protein, 9 aa, Homo Sapiens
CPTASTTRC

SEQ ID NO: 220511 - protein, 9 aa, Homo Sapiens
EPLAEDHPR

SEQ ID NO: 220512 - protein, 9 aa, Homo Sapiens
RLRSSGKKI

SEQ ID NO: 220513 - protein, 9 aa, Homo Sapiens
RPGEAGPGL

SEQ ID NO: 220514 - protein, 9 aa, Homo Sapiens
HILRHEVLV

SEQ ID NO: 220515 - protein, 9 aa, Homo Sapiens
DRQIGKILK

SEQ ID NO: 220516 - protein, 9 aa, Homo Sapiens
FLEQQTAAL

SEQ ID NO: 220517 - protein, 9 aa, Homo Sapiens
ATRSLVRRN

SEQ ID NO: 220518 - protein, 9 aa, Homo Sapiens
NSHPSPRWT

SEQ ID NO: 220519 - protein, 9 aa, Homo Sapiens
GALSVPLSC

SEQ ID NO: 220520 - protein, 9 aa, Homo Sapiens
KNGDNKTNQ

SEQ ID NO: 220521 - protein, 9 aa, Homo Sapiens
TLTLSGMFL

SEQ ID NO: 220522 - protein, 9 aa, Homo Sapiens
QLLQGSLLL

SEQ ID NO: 220523 - protein, 9 aa, Homo Sapiens
SSPRPSQLC

SEQ ID NO: 220524 - protein, 9 aa, Homo Sapiens
TGVSTYNPQ

SEQ ID NO: 220525 - protein, 9 aa, Homo Sapiens
VNPDPLLSC

SEQ ID NO: 220526 - protein, 9 aa, Homo Sapiens
FGATHQSQG

SEQ ID NO: 220527 - protein, 9 aa, Homo Sapiens
LELKKEQRV

SEQ ID NO: 220528 - protein, 9 aa, Homo Sapiens
TSWGTLWWA

SEQ ID NO: 220529 - protein, 9 aa, Homo Sapiens
GNNKLQVSA

SEQ ID NO: 220530 - protein, 9 aa, Homo Sapiens
LAASLTLGL

SEQ ID NO: 220531 - protein, 9 aa, Homo Sapiens
LALLLTTTC

SEQ ID NO: 220532 - protein, 9 aa, Homo Sapiens
TPGAEGWWQ

SEQ ID NO: 220533 - protein, 9 aa, Homo Sapiens
YANCTWSII

SEQ ID NO: 220534 - protein, 9 aa, Homo Sapiens
MKGLLTKVN

SEQ ID NO: 220535 - protein, 9 aa, Homo Sapiens
LSVEISILD

SEQ ID NO: 220536 - protein, 9 aa, Homo Sapiens
FPVLSTSSF

SEQ ID NO: 220537 - protein, 9 aa, Homo Sapiens
RRSHCLTWA

SEQ ID NO: 220538 - protein, 9 aa, Homo Sapiens
FYTLRVQAR

SEQ ID NO: 220539 - protein, 9 aa, Homo Sapiens
LAVLHTERG

SEQ ID NO: 220540 - protein, 9 aa, Homo Sapiens
AVVDKTLLV

SEQ ID NO: 220541 - protein, 9 aa, Homo Sapiens
LQLHESLHG

SEQ ID NO: 220542 - protein, 9 aa, Homo Sapiens
DMAAFNEQP

SEQ ID NO: 220543 - protein, 9 aa, Homo Sapiens
VMERYAKDY

SEQ ID NO: 220544 - protein, 9 aa, Homo Sapiens
QNAEAVHFS

SEQ ID NO: 220545 - protein, 9 aa, Homo Sapiens
RGILYAAPS

SEQ ID NO: 220546 - protein, 9 aa, Homo Sapiens
RLSSLQAET

SEQ ID NO: 220547 - protein, 9 aa, Homo Sapiens
QAEGRPQNM

SEQ ID NO: 220548 - protein, 9 aa, Homo Sapiens
TQQAGWQGL

SEQ ID NO: 220549 - protein, 9 aa, Homo Sapiens
FCVIDTIVR

SEQ ID NO: 220550 - protein, 9 aa, Homo Sapiens
YALELTLPN

SEQ ID NO: 220551 - protein, 9 aa, Homo Sapiens
EKSFLFFIP

SEQ ID NO: 220552 - protein, 9 aa, Homo Sapiens
QPGRSPLRP

SEQ ID NO: 220553 - protein, 9 aa, Homo Sapiens
SQIILKGSV

SEQ ID NO: 220554 - protein, 9 aa, Homo Sapiens
PMPVCVNGA

SEQ ID NO: 220555 - protein, 9 aa, Homo Sapiens
SVPHGADLD

SEQ ID NO: 220556 - protein, 9 aa, Homo Sapiens
KNCGSAFCS

SEQ ID NO: 220557 - protein, 9 aa, Homo Sapiens
VKRLSGVIH

SEQ ID NO: 220558 - protein, 9 aa, Homo Sapiens
ETRSGRPGW

SEQ ID NO: 220559 - protein, 9 aa, Homo Sapiens
RVQAEEREQ

SEQ ID NO: 220560 - protein, 9 aa, Homo Sapiens
STPWQPTRP

SEQ ID NO: 220561 - protein, 9 aa, Homo Sapiens
LGHEGPGGS

SEQ ID NO: 220562 - protein, 9 aa, Homo Sapiens
CPTQPRRVA

SEQ ID NO: 220563 - protein, 9 aa, Homo Sapiens
RQISHTSKS

SEQ ID NO: 220564 - protein, 9 aa, Homo Sapiens
VSALQEALE

SEQ ID NO: 220565 - protein, 9 aa, Homo Sapiens
NVGTVISKK

SEQ ID NO: 220566 - protein, 9 aa, Homo Sapiens
PQAPPSGSR

SEQ ID NO: 220567 - protein, 9 aa, Homo Sapiens
DCANRPCQR

SEQ ID NO: 220568 - protein, 9 aa, Homo Sapiens
SSAIPLPLP

SEQ ID NO: 220569 - protein, 9 aa, Homo Sapiens
NLTASENTS

SEQ ID NO: 220570 - protein, 9 aa, Homo Sapiens
KSCKLRIIG

SEQ ID NO: 220571 - protein, 9 aa, Homo Sapiens
ISKQILSDF

SEQ ID NO: 220572 - protein, 9 aa, Homo Sapiens
RVCYLKKAF

SEQ ID NO: 220573 - protein, 9 aa, Homo Sapiens
GTRMGTLCY

SEQ ID NO: 220574 - protein, 9 aa, Homo Sapiens
PATEFLSPQ

SEQ ID NO: 220575 - protein, 9 aa, Homo Sapiens
ECGKNKQVV

SEQ ID NO: 220576 - protein, 9 aa, Homo Sapiens
IVSLGVRHT

SEQ ID NO: 220577 - protein, 9 aa, Homo Sapiens
NMDNLGKET

SEQ ID NO: 220578 - protein, 9 aa, Homo Sapiens
PSVTIHSFS

SEQ ID NO: 220579 - protein, 9 aa, Homo Sapiens
RGLKRSSSF

SEQ ID NO: 220580 - protein, 9 aa, Homo Sapiens
VMKMKRWMR

SEQ ID NO: 220581 - protein, 9 aa, Homo Sapiens
LLYSQDYQC

SEQ ID NO: 220582 - protein, 9 aa, Homo Sapiens
MRKPRIPME

SEQ ID NO: 220583 - protein, 9 aa, Homo Sapiens
LHGFSKNPK

SEQ ID NO: 220584 - protein, 9 aa, Homo Sapiens
SAPRRSHCL

SEQ ID NO: 220585 - protein, 9 aa, Homo Sapiens
ISKIFPGKK

SEQ ID NO: 220586 - protein, 9 aa, Homo Sapiens
IVSQINHPA

SEQ ID NO: 220587 - protein, 9 aa, Homo Sapiens
EVLVEMYEE

SEQ ID NO: 220588 - protein, 9 aa, Homo Sapiens
DAVDNKKTH

SEQ ID NO: 220589 - protein, 9 aa, Homo Sapiens
TLAPASRGP

SEQ ID NO: 220590 - protein, 9 aa, Homo Sapiens
FLIMLLVYR

SEQ ID NO: 220591 - protein, 9 aa, Homo Sapiens
EPASQMHVE

SEQ ID NO: 220592 - protein, 9 aa, Homo Sapiens
YVYTTLPFV

SEQ ID NO: 220593 - protein, 9 aa, Homo Sapiens
CTAALCRKD

SEQ ID NO: 220594 - protein, 9 aa, Homo Sapiens
VQEKTPKKK

SEQ ID NO: 220595 - protein, 9 aa, Homo Sapiens
RYDIPAMYN

SEQ ID NO: 220596 - protein, 9 aa, Homo Sapiens
DLPRELSPW

SEQ ID NO: 220597 - protein, 9 aa, Homo Sapiens
PGNPSKEAS

SEQ ID NO: 220598 - protein, 9 aa, Homo Sapiens
HGFNRQPPH

SEQ ID NO: 220599 - protein, 9 aa, Homo Sapiens
TFEQGIKAY

SEQ ID NO: 220600 - protein, 9 aa, Homo Sapiens
DILSNSLTT

SEQ ID NO: 220601 - protein, 9 aa, Homo Sapiens
RLQSLLSLY

SEQ ID NO: 220602 - protein, 9 aa, Homo Sapiens
QEPCLELLE

SEQ ID NO: 220603 - protein, 9 aa, Homo Sapiens
CSRARLALL

SEQ ID NO: 220604 - protein, 9 aa, Homo Sapiens
KVICIVGKS

SEQ ID NO: 220605 - protein, 9 aa, Homo Sapiens
KTYSWQCIE

SEQ ID NO: 220606 - protein, 9 aa, Homo Sapiens
SHPLCSTMW

SEQ ID NO: 220607 - protein, 9 aa, Homo Sapiens
FGLIPRLPT

SEQ ID NO: 220608 - protein, 9 aa, Homo Sapiens
YLLDYFLQE

SEQ ID NO: 220609 - protein, 9 aa, Homo Sapiens
KRFTPDAMP

SEQ ID NO: 220610 - protein, 9 aa, Homo Sapiens
AHARARASY

SEQ ID NO: 220611 - protein, 9 aa, Homo Sapiens
EESWNDEAR

SEQ ID NO: 220612 - protein, 9 aa, Homo Sapiens
FKENDGSLK

SEQ ID NO: 220613 - protein, 9 aa, Homo Sapiens
EVSCCDAGN

SEQ ID NO: 220614 - protein, 9 aa, Homo Sapiens
HGPTHIGKK

SEQ ID NO: 220615 - protein, 9 aa, Homo Sapiens
DSDSELEQM

SEQ ID NO: 220616 - protein, 9 aa, Homo Sapiens
GRRTICSVS

SEQ ID NO: 220617 - protein, 9 aa, Homo Sapiens
DHHVSIVRE

SEQ ID NO: 220618 - protein, 9 aa, Homo Sapiens
QAAKDELPH

SEQ ID NO: 220619 - protein, 9 aa, Homo Sapiens
WPGLRDWLS

SEQ ID NO: 220620 - protein, 9 aa, Homo Sapiens
PSGSRAEPQ

SEQ ID NO: 220621 - protein, 9 aa, Homo Sapiens
RRKAKELHQ

SEQ ID NO: 220622 - protein, 9 aa, Homo Sapiens
LTWHSTKRE

SEQ ID NO: 220623 - protein, 9 aa, Homo Sapiens
LKALMTQQT

SEQ ID NO: 220624 - protein, 9 aa, Homo Sapiens
CSWTCSQTR

SEQ ID NO: 220625 - protein, 9 aa, Homo Sapiens
APWAERDRQ

SEQ ID NO: 220626 - protein, 9 aa, Homo Sapiens
SPQAPLRLW

SEQ ID NO: 220627 - protein, 9 aa, Homo Sapiens
QRDIEQHNA

SEQ ID NO: 220628 - protein, 9 aa, Homo Sapiens
PGCSWRSRS

SEQ ID NO: 220629 - protein, 9 aa, Homo Sapiens
IASWELWVE

SEQ ID NO: 220630 - protein, 9 aa, Homo Sapiens
YRGERPYKC

SEQ ID NO: 220631 - protein, 9 aa, Homo Sapiens
NSYRMDQTF

SEQ ID NO: 220632 - protein, 9 aa, Homo Sapiens
HTKPCGLPP

SEQ ID NO: 220633 - protein, 9 aa, Homo Sapiens
KTAPTPPRR

SEQ ID NO: 220634 - protein, 9 aa, Homo Sapiens
AVHSYTRPM

SEQ ID NO: 220635 - protein, 9 aa, Homo Sapiens
ALPGPPTQL

SEQ ID NO: 220636 - protein, 9 aa, Homo Sapiens
WIEMVGDMT

SEQ ID NO: 220637 - protein, 9 aa, Homo Sapiens
KPPSPDIQC

SEQ ID NO: 220638 - protein, 9 aa, Homo Sapiens
FRCSYQFLV

SEQ ID NO: 220639 - protein, 9 aa, Homo Sapiens
SSRTLGLHV

SEQ ID NO: 220640 - protein, 9 aa, Homo Sapiens
PSWRAQSAP

SEQ ID NO: 220641 - protein, 9 aa, Homo Sapiens
KDPHTRATH

SEQ ID NO: 220642 - protein, 9 aa, Homo Sapiens
KLTYTKVWK

SEQ ID NO: 220643 - protein, 9 aa, Homo Sapiens
SEYTRTCGP

SEQ ID NO: 220644 - protein, 9 aa, Homo Sapiens
QRVHCAAPA

SEQ ID NO: 220645 - protein, 9 aa, Homo Sapiens
SPRYQGAAV

SEQ ID NO: 220646 - protein, 9 aa, Homo Sapiens
TMALMGGIG

SEQ ID NO: 220647 - protein, 9 aa, Homo Sapiens
KGNRAENFT

SEQ ID NO: 220648 - protein, 9 aa, Homo Sapiens
GCPHTTPDK

SEQ ID NO: 220649 - protein, 9 aa, Homo Sapiens
IQMLRSEID

SEQ ID NO: 220650 - protein, 9 aa, Homo Sapiens
DMDLWVPVR

SEQ ID NO: 220651 - protein, 9 aa, Homo Sapiens
AEVSQRALL

SEQ ID NO: 220652 - protein, 9 aa, Homo Sapiens
SVWRPHHGK

SEQ ID NO: 220653 - protein, 9 aa, Homo Sapiens
VILKSCTQR

SEQ ID NO: 220654 - protein, 9 aa, Homo Sapiens
QEPSRLGGP

SEQ ID NO: 220655 - protein, 9 aa, Homo Sapiens
LAVRKIVLL

SEQ ID NO: 220656 - protein, 9 aa, Homo Sapiens
QSCWRPLAQ

SEQ ID NO: 220657 - protein, 9 aa, Homo Sapiens
RPQLLPPRS

SEQ ID NO: 220658 - protein, 9 aa, Homo Sapiens
QPQSVLGRV

SEQ ID NO: 220659 - protein, 9 aa, Homo Sapiens
IKKKANLNT

SEQ ID NO: 220660 - protein, 9 aa, Homo Sapiens
SQTIIRLLV

SEQ ID NO: 220661 - protein, 9 aa, Homo Sapiens
AMEAKWEEE

SEQ ID NO: 220662 - protein, 9 aa, Homo Sapiens
WGRPRGGPA

SEQ ID NO: 220663 - protein, 9 aa, Homo Sapiens
FPASAVSTA

SEQ ID NO: 220664 - protein, 9 aa, Homo Sapiens
YSRAVRDLK

SEQ ID NO: 220665 - protein, 9 aa, Homo Sapiens
DNSWQPGGR

SEQ ID NO: 220666 - protein, 9 aa, Homo Sapiens
HNRGPHGRS

SEQ ID NO: 220667 - protein, 9 aa, Homo Sapiens
MSVADSYDP

SEQ ID NO: 220668 - protein, 9 aa, Homo Sapiens
GGGGGGCCC

SEQ ID NO: 220669 - protein, 9 aa, Homo Sapiens
VKGLWRRGL

SEQ ID NO: 220670 - protein, 9 aa, Homo Sapiens
TMTHEHLAM

SEQ ID NO: 220671 - protein, 9 aa, Homo Sapiens
SADGASEII

SEQ ID NO: 220672 - protein, 9 aa, Homo Sapiens
PEAKLLVAS

SEQ ID NO: 220673 - protein, 9 aa, Homo Sapiens
WIPQSAGTT

SEQ ID NO: 220674 - protein, 9 aa, Homo Sapiens
DGTKNMLEM

SEQ ID NO: 220675 - protein, 9 aa, Homo Sapiens
FNPGSSGWP

SEQ ID NO: 220676 - protein, 9 aa, Homo Sapiens
DELGAGSQE

SEQ ID NO: 220677 - protein, 9 aa, Homo Sapiens
RPRMIGCGA

SEQ ID NO: 220678 - protein, 9 aa, Homo Sapiens
DVLPELLGG

SEQ ID NO: 220679 - protein, 9 aa, Homo Sapiens
HPHGKRCNP

SEQ ID NO: 220680 - protein, 9 aa, Homo Sapiens
VKVEDMSQF

SEQ ID NO: 220681 - protein, 9 aa, Homo Sapiens
RVQVHGLGL

SEQ ID NO: 220682 - protein, 9 aa, Homo Sapiens
HVPEHRCLP

SEQ ID NO: 220683 - protein, 9 aa, Homo Sapiens
WARVGPLVH

SEQ ID NO: 220684 - protein, 9 aa, Homo Sapiens
RTATARSLA

SEQ ID NO: 220685 - protein, 9 aa, Homo Sapiens
PRESKNSTA

SEQ ID NO: 220686 - protein, 9 aa, Homo Sapiens
ISEPPEERV

SEQ ID NO: 220687 - protein, 9 aa, Homo Sapiens
LGRGAAPLS

SEQ ID NO: 220688 - protein, 9 aa, Homo Sapiens
MKRMCKQKR

SEQ ID NO: 220689 - protein, 9 aa, Homo Sapiens
LEHGCQFMD

SEQ ID NO: 220690 - protein, 9 aa, Homo Sapiens
GIPGGNPAY

SEQ ID NO: 220691 - protein, 9 aa, Homo Sapiens
FRRERIQML

SEQ ID NO: 220692 - protein, 9 aa, Homo Sapiens
ASSTTSISV

SEQ ID NO: 220693 - protein, 9 aa, Homo Sapiens
DLWVPVRQS

SEQ ID NO: 220694 - protein, 9 aa, Homo Sapiens
FYIVLDYFL

SEQ ID NO: 220695 - protein, 9 aa, Homo Sapiens
KEEMKKTTS

SEQ ID NO: 220696 - protein, 9 aa, Homo Sapiens
CRTPQAPSP

SEQ ID NO: 220697 - protein, 9 aa, Homo Sapiens
HHGSVSLLR

SEQ ID NO: 220698 - protein, 9 aa, Homo Sapiens
GGAEKEPIF

SEQ ID NO: 220699 - protein, 9 aa, Homo Sapiens
YDHHKRGIL

SEQ ID NO: 220700 - protein, 9 aa, Homo Sapiens
ALQQNRGPV

SEQ ID NO: 220701 - protein, 9 aa, Homo Sapiens
TSMWTSRTS

SEQ ID NO: 220702 - protein, 9 aa, Homo Sapiens
VEHVLLGER

SEQ ID NO: 220703 - protein, 9 aa, Homo Sapiens
RCASCGTCP

SEQ ID NO: 220704 - protein, 9 aa, Homo Sapiens
PPSLGSQPI

SEQ ID NO: 220705 - protein, 9 aa, Homo Sapiens
ILYKFLIVI

SEQ ID NO: 220706 - protein, 9 aa, Homo Sapiens
GGETKREAR

SEQ ID NO: 220707 - protein, 9 aa, Homo Sapiens
SYYDYIWDA

SEQ ID NO: 220708 - protein, 9 aa, Homo Sapiens
GLRLDHAAP

SEQ ID NO: 220709 - protein, 9 aa, Homo Sapiens
KVMGLNPKT

SEQ ID NO: 220710 - protein, 9 aa, Homo Sapiens
VLSVEISIL

SEQ ID NO: 220711 - protein, 9 aa, Homo Sapiens
RRCEEEMRR

SEQ ID NO: 220712 - protein, 9 aa, Homo Sapiens
PGEEGAAWA

SEQ ID NO: 220713 - protein, 9 aa, Homo Sapiens
LAPGGLRLD

SEQ ID NO: 220714 - protein, 9 aa, Homo Sapiens
PSQLCSQGL

SEQ ID NO: 220715 - protein, 9 aa, Homo Sapiens
AGSVGVLAR

SEQ ID NO: 220716 - protein, 9 aa, Homo Sapiens
QNRSSEEAH

SEQ ID NO: 220717 - protein, 9 aa, Homo Sapiens
PVVLLRKQN

SEQ ID NO: 220718 - protein, 9 aa, Homo Sapiens
SWSWPMTIP

SEQ ID NO: 220719 - protein, 9 aa, Homo Sapiens
ARISVCACV

SEQ ID NO: 220720 - protein, 9 aa, Homo Sapiens
KKISVLSFE

SEQ ID NO: 220721 - protein, 9 aa, Homo Sapiens
TISCPPLPC

SEQ ID NO: 220722 - protein, 9 aa, Homo Sapiens
NAHSIPQPW

SEQ ID NO: 220723 - protein, 9 aa, Homo Sapiens
TVRKAKFCI

SEQ ID NO: 220724 - protein, 9 aa, Homo Sapiens
EPIDTSQYS

SEQ ID NO: 220725 - protein, 9 aa, Homo Sapiens
HLLLRRGQL

SEQ ID NO: 220726 - protein, 9 aa, Homo Sapiens
LDDRSPQAP

SEQ ID NO: 220727 - protein, 9 aa, Homo Sapiens
LTAITGSFQ

SEQ ID NO: 220728 - protein, 9 aa, Homo Sapiens
AVGRGPAGR

SEQ ID NO: 220729 - protein, 9 aa, Homo Sapiens
PYNTDHTQN

SEQ ID NO: 220730 - protein, 9 aa, Homo Sapiens
WMRRLEERW

SEQ ID NO: 220731 - protein, 9 aa, Homo Sapiens
TDPRAADTA

SEQ ID NO: 220732 - protein, 9 aa, Homo Sapiens
FWEVDPIFG

SEQ ID NO: 220733 - protein, 9 aa, Homo Sapiens
ASPAGTATR

SEQ ID NO: 220734 - protein, 9 aa, Homo Sapiens
FVVDTGLFI

SEQ ID NO: 220735 - protein, 9 aa, Homo Sapiens
RTICSVSGR

SEQ ID NO: 220736 - protein, 9 aa, Homo Sapiens
VLITEGPYV

SEQ ID NO: 220737 - protein, 9 aa, Homo Sapiens
DPGVPIGLD

SEQ ID NO: 220738 - protein, 9 aa, Homo Sapiens
LALPASMRW

SEQ ID NO: 220739 - protein, 9 aa, Homo Sapiens
LRKSHTLQQ

SEQ ID NO: 220740 - protein, 9 aa, Homo Sapiens
RERTANEKI

SEQ ID NO: 220741 - protein, 9 aa, Homo Sapiens
LEGYSRSVC

SEQ ID NO: 220742 - protein, 9 aa, Homo Sapiens
AMQFLRVTK

SEQ ID NO: 220743 - protein, 9 aa, Homo Sapiens
LSLASTSKC

SEQ ID NO: 220744 - protein, 9 aa, Homo Sapiens
VYREQPLPA

SEQ ID NO: 220745 - protein, 9 aa, Homo Sapiens
AQLRLVDGV

SEQ ID NO: 220746 - protein, 9 aa, Homo Sapiens
GGFVIGRFL

SEQ ID NO: 220747 - protein, 9 aa, Homo Sapiens
GPLDTGKSD

SEQ ID NO: 220748 - protein, 9 aa, Homo Sapiens
QGNVKVVQL

SEQ ID NO: 220749 - protein, 9 aa, Homo Sapiens
DEEHCLKFI

SEQ ID NO: 220750 - protein, 9 aa, Homo Sapiens
GSHPLCSTM

SEQ ID NO: 220751 - protein, 9 aa, Homo Sapiens
QPSSSVWSS

SEQ ID NO: 220752 - protein, 9 aa, Homo Sapiens
LDHHFFLQI

SEQ ID NO: 220753 - protein, 9 aa, Homo Sapiens
AVATASCGT

SEQ ID NO: 220754 - protein, 9 aa, Homo Sapiens
LEVLGAFLG

SEQ ID NO: 220755 - protein, 9 aa, Homo Sapiens
SHLIVSVWR

SEQ ID NO: 220756 - protein, 9 aa, Homo Sapiens
PQWPAGPNS

SEQ ID NO: 220757 - protein, 9 aa, Homo Sapiens
GSGRSTPRL

SEQ ID NO: 220758 - protein, 9 aa, Homo Sapiens
EFWPRQSAA

SEQ ID NO: 220759 - protein, 9 aa, Homo Sapiens
ANVGATSGL

SEQ ID NO: 220760 - protein, 9 aa, Homo Sapiens
VAHDVVEAG

SEQ ID NO: 220761 - protein, 9 aa, Homo Sapiens
PQSRWLSPG

SEQ ID NO: 220762 - protein, 9 aa, Homo Sapiens
ECQKPEPLW

SEQ ID NO: 220763 - protein, 9 aa, Homo Sapiens
PSSPSMASL

SEQ ID NO: 220764 - protein, 9 aa, Homo Sapiens
MDDLVTLDG

SEQ ID NO: 220765 - protein, 9 aa, Homo Sapiens
FIGDGDIFK

SEQ ID NO: 220766 - protein, 9 aa, Homo Sapiens
SRLEHVARE

SEQ ID NO: 220767 - protein, 9 aa, Homo Sapiens
QLLLHGEAT

SEQ ID NO: 220768 - protein, 9 aa, Homo Sapiens
ITLREFMKH

SEQ ID NO: 220769 - protein, 9 aa, Homo Sapiens
PQPPHVPRW

SEQ ID NO: 220770 - protein, 9 aa, Homo Sapiens
PGVFRVASR

SEQ ID NO: 220771 - protein, 9 aa, Homo Sapiens
EKNSGSQSG

SEQ ID NO: 220772 - protein, 9 aa, Homo Sapiens
VMFSSDAGD

SEQ ID NO: 220773 - protein, 9 aa, Homo Sapiens
WPMTIPGRS

SEQ ID NO: 220774 - protein, 9 aa, Homo Sapiens
PYVTVLDSA

SEQ ID NO: 220775 - protein, 9 aa, Homo Sapiens
MCKQKRREG

SEQ ID NO: 220776 - protein, 9 aa, Homo Sapiens
WLAAERSHD

SEQ ID NO: 220777 - protein, 9 aa, Homo Sapiens
APKSSFIGD

SEQ ID NO: 220778 - protein, 9 aa, Homo Sapiens
STAAGLWTL

SEQ ID NO: 220779 - protein, 9 aa, Homo Sapiens
LYCLSSYIK

SEQ ID NO: 220780 - protein, 9 aa, Homo Sapiens
DGFGNMASS

SEQ ID NO: 220781 - protein, 9 aa, Homo Sapiens
LQPPGDCPR

SEQ ID NO: 220782 - protein, 9 aa, Homo Sapiens
TWTSALASC

SEQ ID NO: 220783 - protein, 9 aa, Homo Sapiens
NTEVCSVGP

SEQ ID NO: 220784 - protein, 9 aa, Homo Sapiens
TEHVPLGNL

SEQ ID NO: 220785 - protein, 9 aa, Homo Sapiens
GQSQPPSNR

SEQ ID NO: 220786 - protein, 9 aa, Homo Sapiens
GRGPAGRVP

SEQ ID NO: 220787 - protein, 9 aa, Homo Sapiens
VVGKMRVPS

SEQ ID NO: 220788 - protein, 9 aa, Homo Sapiens
TSLDLFQHA

SEQ ID NO: 220789 - protein, 9 aa, Homo Sapiens
EEVGVVALQ

SEQ ID NO: 220790 - protein, 9 aa, Homo Sapiens
DRNTFRKLL

SEQ ID NO: 220791 - protein, 9 aa, Homo Sapiens
HTPPGVHRR

SEQ ID NO: 220792 - protein, 9 aa, Homo Sapiens
ARVEESTQV

SEQ ID NO: 220793 - protein, 9 aa, Homo Sapiens
TRVSSLPRS

SEQ ID NO: 220794 - protein, 9 aa, Homo Sapiens
TSLYDLLGM

SEQ ID NO: 220795 - protein, 9 aa, Homo Sapiens
LRQSPIDLH

SEQ ID NO: 220796 - protein, 9 aa, Homo Sapiens
RAAPLLLPR

SEQ ID NO: 220797 - protein, 9 aa, Homo Sapiens
REKSVREKN

SEQ ID NO: 220798 - protein, 9 aa, Homo Sapiens
KSDSKNAPH

SEQ ID NO: 220799 - protein, 9 aa, Homo Sapiens
PPTKKRGKS

SEQ ID NO: 220800 - protein, 9 aa, Homo Sapiens
AHDAHRKEI

SEQ ID NO: 220801 - protein, 9 aa, Homo Sapiens
RKATAVGDV

SEQ ID NO: 220802 - protein, 9 aa, Homo Sapiens
PQSPCRLRM

SEQ ID NO: 220803 - protein, 9 aa, Homo Sapiens
DFLQRLVES

SEQ ID NO: 220804 - protein, 9 aa, Homo Sapiens
AQVLSRSSP

SEQ ID NO: 220805 - protein, 9 aa, Homo Sapiens
ILVSMTVCV

SEQ ID NO: 220806 - protein, 9 aa, Homo Sapiens
SPPSPSSLL

SEQ ID NO: 220807 - protein, 9 aa, Homo Sapiens
SGQGSNRGS

SEQ ID NO: 220808 - protein, 9 aa, Homo Sapiens
SEFLKTLKN

SEQ ID NO: 220809 - protein, 9 aa, Homo Sapiens
EDVEHVLLG

SEQ ID NO: 220810 - protein, 9 aa, Homo Sapiens
NGTMADLDN

SEQ ID NO: 220811 - protein, 9 aa, Homo Sapiens
NAWNGFSNL

SEQ ID NO: 220812 - protein, 9 aa, Homo Sapiens
QTAISQTII

SEQ ID NO: 220813 - protein, 9 aa, Homo Sapiens
PKGAHCSWG

SEQ ID NO: 220814 - protein, 9 aa, Homo Sapiens
GDVMEIRKE

SEQ ID NO: 220815 - protein, 9 aa, Homo Sapiens
EVEPGCGGK

SEQ ID NO: 220816 - protein, 9 aa, Homo Sapiens
MLQACQGRI

SEQ ID NO: 220817 - protein, 9 aa, Homo Sapiens
CYLGNRLRL

SEQ ID NO: 220818 - protein, 9 aa, Homo Sapiens
QRAEPQQQR

SEQ ID NO: 220819 - protein, 9 aa, Homo Sapiens
TQHQINGRV

SEQ ID NO: 220820 - protein, 9 aa, Homo Sapiens
EKSRDTNRH

SEQ ID NO: 220821 - protein, 9 aa, Homo Sapiens
PQPGLPDER

SEQ ID NO: 220822 - protein, 9 aa, Homo Sapiens
ATTLTSAAS

SEQ ID NO: 220823 - protein, 9 aa, Homo Sapiens
FFPASAVST

SEQ ID NO: 220824 - protein, 9 aa, Homo Sapiens
ISKAPEAAV

SEQ ID NO: 220825 - protein, 9 aa, Homo Sapiens
SRLIVKWNP

SEQ ID NO: 220826 - protein, 9 aa, Homo Sapiens
ALRAKLLLP

SEQ ID NO: 220827 - protein, 9 aa, Homo Sapiens
KIVLLLKPD

SEQ ID NO: 220828 - protein, 9 aa, Homo Sapiens
LRLPFVAQT

SEQ ID NO: 220829 - protein, 9 aa, Homo Sapiens
QAGWQGLGA

SEQ ID NO: 220830 - protein, 9 aa, Homo Sapiens
ILEKQRLLL

SEQ ID NO: 220831 - protein, 9 aa, Homo Sapiens
DALIKCVQV

SEQ ID NO: 220832 - protein, 9 aa, Homo Sapiens
DKVDHTVNE

SEQ ID NO: 220833 - protein, 9 aa, Homo Sapiens
THMPSYEDR

SEQ ID NO: 220834 - protein, 9 aa, Homo Sapiens
PKNRHTIEV

SEQ ID NO: 220835 - protein, 9 aa, Homo Sapiens
AEAITWLMW

SEQ ID NO: 220836 - protein, 9 aa, Homo Sapiens
MAYDRYATI

SEQ ID NO: 220837 - protein, 9 aa, Homo Sapiens
QEALLHFGL

SEQ ID NO: 220838 - protein, 9 aa, Homo Sapiens
PSALPCAQP

SEQ ID NO: 220839 - protein, 9 aa, Homo Sapiens
SDWARQTFL

SEQ ID NO: 220840 - protein, 9 aa, Homo Sapiens
APGGLRLDH

SEQ ID NO: 220841 - protein, 9 aa, Homo Sapiens
RLTAQLLLH

SEQ ID NO: 220842 - protein, 9 aa, Homo Sapiens
PGPPWPTHL

SEQ ID NO: 220843 - protein, 9 aa, Homo Sapiens
NHLTEGSQK

SEQ ID NO: 220844 - protein, 9 aa, Homo Sapiens
LASGVLPQS

SEQ ID NO: 220845 - protein, 9 aa, Homo Sapiens
KENKKKKKE

SEQ ID NO: 220846 - protein, 9 aa, Homo Sapiens
PTRAGPHAP

SEQ ID NO: 220847 - protein, 9 aa, Homo Sapiens
KKGAPGPCW

SEQ ID NO: 220848 - protein, 9 aa, Homo Sapiens
WDLPVFPLP

SEQ ID NO: 220849 - protein, 9 aa, Homo Sapiens
ECRDLVDAA

SEQ ID NO: 220850 - protein, 9 aa, Homo Sapiens
TPEEVLKNI

SEQ ID NO: 220851 - protein, 9 aa, Homo Sapiens
GPLPGCPAS

SEQ ID NO: 220852 - protein, 9 aa, Homo Sapiens
EGTKVSAHV

SEQ ID NO: 220853 - protein, 9 aa, Homo Sapiens
LAGLLPVSY

SEQ ID NO: 220854 - protein, 9 aa, Homo Sapiens
KKVILNVHS

SEQ ID NO: 220855 - protein, 9 aa, Homo Sapiens
DPEIDKKSR

SEQ ID NO: 220856 - protein, 9 aa, Homo Sapiens
ILQQLNQRL

SEQ ID NO: 220857 - protein, 9 aa, Homo Sapiens
AMVFQWLHS

SEQ ID NO: 220858 - protein, 9 aa, Homo Sapiens
GCVVLPVLM

SEQ ID NO: 220859 - protein, 9 aa, Homo Sapiens
EASGMPPSS

SEQ ID NO: 220860 - protein, 9 aa, Homo Sapiens
RALLSVELG

SEQ ID NO: 220861 - protein, 9 aa, Homo Sapiens
RLCLCCADR

SEQ ID NO: 220862 - protein, 9 aa, Homo Sapiens
HVFLEYDRD

SEQ ID NO: 220863 - protein, 9 aa, Homo Sapiens
NRTLLVVAR

SEQ ID NO: 220864 - protein, 9 aa, Homo Sapiens
EGGLRRASG

SEQ ID NO: 220865 - protein, 9 aa, Homo Sapiens
AILRGNHES

SEQ ID NO: 220866 - protein, 9 aa, Homo Sapiens
RFPYFEASD

SEQ ID NO: 220867 - protein, 9 aa, Homo Sapiens
SLVGVHSSP

SEQ ID NO: 220868 - protein, 9 aa, Homo Sapiens
TWASPPNTH

SEQ ID NO: 220869 - protein, 9 aa, Homo Sapiens
GVMIVLGAG

SEQ ID NO: 220870 - protein, 9 aa, Homo Sapiens
SPKRPKILK

SEQ ID NO: 220871 - protein, 9 aa, Homo Sapiens
GDDTPCIWQ

SEQ ID NO: 220872 - protein, 9 aa, Homo Sapiens
CKECVKAFS

SEQ ID NO: 220873 - protein, 9 aa, Homo Sapiens
VVPESKLQI

SEQ ID NO: 220874 - protein, 9 aa, Homo Sapiens
LQVIKDSKE

SEQ ID NO: 220875 - protein, 9 aa, Homo Sapiens
DPPKSPHSW

SEQ ID NO: 220876 - protein, 9 aa, Homo Sapiens
AAVGKARRR

SEQ ID NO: 220877 - protein, 9 aa, Homo Sapiens
ALIHLSDFF

SEQ ID NO: 220878 - protein, 9 aa, Homo Sapiens
DNTPTFPSS

SEQ ID NO: 220879 - protein, 9 aa, Homo Sapiens
MPSYEDRVC

SEQ ID NO: 220880 - protein, 9 aa, Homo Sapiens
LEQEQAAPG

SEQ ID NO: 220881 - protein, 9 aa, Homo Sapiens
GFWFVEGFP

SEQ ID NO: 220882 - protein, 9 aa, Homo Sapiens
VPIVNDIIR

SEQ ID NO: 220883 - protein, 9 aa, Homo Sapiens
AYRTSSATS

SEQ ID NO: 220884 - protein, 9 aa, Homo Sapiens
GGCASCPSP

SEQ ID NO: 220885 - protein, 9 aa, Homo Sapiens
LPHVTWSSA

SEQ ID NO: 220886 - protein, 9 aa, Homo Sapiens
FHVFLEYDR

SEQ ID NO: 220887 - protein, 9 aa, Homo Sapiens
PNYANCTWS

SEQ ID NO: 220888 - protein, 9 aa, Homo Sapiens
SATASQESS

SEQ ID NO: 220889 - protein, 9 aa, Homo Sapiens
PLDTGKSDP

SEQ ID NO: 220890 - protein, 9 aa, Homo Sapiens
SSSLTPLTT

SEQ ID NO: 220891 - protein, 9 aa, Homo Sapiens
LLHHILRHE

SEQ ID NO: 220892 - protein, 9 aa, Homo Sapiens
CRPWHSNSP

SEQ ID NO: 220893 - protein, 9 aa, Homo Sapiens
TTSPARDDK

SEQ ID NO: 220894 - protein, 9 aa, Homo Sapiens
IERGQAFIQ

SEQ ID NO: 220895 - protein, 9 aa, Homo Sapiens
TGSRGAWTN

SEQ ID NO: 220896 - protein, 9 aa, Homo Sapiens
NSSAIPLPL

SEQ ID NO: 220897 - protein, 9 aa, Homo Sapiens
TKRECLKSN

SEQ ID NO: 220898 - protein, 9 aa, Homo Sapiens
GSQLPPLSS

SEQ ID NO: 220899 - protein, 9 aa, Homo Sapiens
TRSGRPGWG

SEQ ID NO: 220900 - protein, 9 aa, Homo Sapiens
VAMLPKLLC

SEQ ID NO: 220901 - protein, 9 aa, Homo Sapiens
QSRDCVAAA

SEQ ID NO: 220902 - protein, 9 aa, Homo Sapiens
PSRWQCDYD

SEQ ID NO: 220903 - protein, 9 aa, Homo Sapiens
RGNKDLRTR

SEQ ID NO: 220904 - protein, 9 aa, Homo Sapiens
PSRCIWQLG

SEQ ID NO: 220905 - protein, 9 aa, Homo Sapiens
NRIQCCTAD

SEQ ID NO: 220906 - protein, 9 aa, Homo Sapiens
NLMRQLYHE

SEQ ID NO: 220907 - protein, 9 aa, Homo Sapiens
VGVDVNCAI

SEQ ID NO: 220908 - protein, 9 aa, Homo Sapiens
VEQATQVRS

SEQ ID NO: 220909 - protein, 9 aa, Homo Sapiens
KGEVVPLHQ

SEQ ID NO: 220910 - protein, 9 aa, Homo Sapiens
QQVTLAAWN

SEQ ID NO: 220911 - protein, 9 aa, Homo Sapiens
CAHDAHRKE

SEQ ID NO: 220912 - protein, 9 aa, Homo Sapiens
HLCMGLKSW

SEQ ID NO: 220913 - protein, 9 aa, Homo Sapiens
NSVPTPNHT

SEQ ID NO: 220914 - protein, 9 aa, Homo Sapiens
RGQEKCAQC

SEQ ID NO: 220915 - protein, 9 aa, Homo Sapiens
PTIQRVQAE

SEQ ID NO: 220916 - protein, 9 aa, Homo Sapiens
RCIANSNPP

SEQ ID NO: 220917 - protein, 9 aa, Homo Sapiens
RIILKANET

SEQ ID NO: 220918 - protein, 9 aa, Homo Sapiens
APHAAHPAD

SEQ ID NO: 220919 - protein, 9 aa, Homo Sapiens
PPLSVITRQ

SEQ ID NO: 220920 - protein, 9 aa, Homo Sapiens
ILFFINALI

SEQ ID NO: 220921 - protein, 9 aa, Homo Sapiens
CVRTLTWTW

SEQ ID NO: 220922 - protein, 9 aa, Homo Sapiens
KRLSGVIHT

SEQ ID NO: 220923 - protein, 9 aa, Homo Sapiens
GPGFSAGGT

SEQ ID NO: 220924 - protein, 9 aa, Homo Sapiens
QSFVDVWER

SEQ ID NO: 220925 - protein, 9 aa, Homo Sapiens
ALASHQKAA

SEQ ID NO: 220926 - protein, 9 aa, Homo Sapiens
HKNRISYNW

SEQ ID NO: 220927 - protein, 9 aa, Homo Sapiens
CGQVSCHTT

SEQ ID NO: 220928 - protein, 9 aa, Homo Sapiens
LQQRHPQGP

SEQ ID NO: 220929 - protein, 9 aa, Homo Sapiens
SSPTPGRAA

SEQ ID NO: 220930 - protein, 9 aa, Homo Sapiens
GLRRASGTL

SEQ ID NO: 220931 - protein, 9 aa, Homo Sapiens
LIIQVPREG

SEQ ID NO: 220932 - protein, 9 aa, Homo Sapiens
RDETRRARM

SEQ ID NO: 220933 - protein, 9 aa, Homo Sapiens
KDPCSPRER

SEQ ID NO: 220934 - protein, 9 aa, Homo Sapiens
QSEASKREL

SEQ ID NO: 220935 - protein, 9 aa, Homo Sapiens
LAVESQKPI

SEQ ID NO: 220936 - protein, 9 aa, Homo Sapiens
TFKDVVVVF

SEQ ID NO: 220937 - protein, 9 aa, Homo Sapiens
MHLTEHQRM

SEQ ID NO: 220938 - protein, 9 aa, Homo Sapiens
KETFLVLSD

SEQ ID NO: 220939 - protein, 9 aa, Homo Sapiens
HYGHHLVQR

SEQ ID NO: 220940 - protein, 9 aa, Homo Sapiens
REVMERYAK

SEQ ID NO: 220941 - protein, 9 aa, Homo Sapiens
SCPAPHRSP

SEQ ID NO: 220942 - protein, 9 aa, Homo Sapiens
PVTNPVYEA

SEQ ID NO: 220943 - protein, 9 aa, Homo Sapiens
SGFGFCLAN

SEQ ID NO: 220944 - protein, 9 aa, Homo Sapiens
PSEHWQMYW

SEQ ID NO: 220945 - protein, 9 aa, Homo Sapiens
ATEVVNILW

SEQ ID NO: 220946 - protein, 9 aa, Homo Sapiens
LACRGATAV

SEQ ID NO: 220947 - protein, 9 aa, Homo Sapiens
VPRGPYGPW

SEQ ID NO: 220948 - protein, 9 aa, Homo Sapiens
GQTQPGEEG

SEQ ID NO: 220949 - protein, 9 aa, Homo Sapiens
EPNSKDNSV

SEQ ID NO: 220950 - protein, 9 aa, Homo Sapiens
SVSSVKLVW

SEQ ID NO: 220951 - protein, 9 aa, Homo Sapiens
MELKERFMM

SEQ ID NO: 220952 - protein, 9 aa, Homo Sapiens
MESVFDCSI

SEQ ID NO: 220953 - protein, 9 aa, Homo Sapiens
VARQPPGCS

SEQ ID NO: 220954 - protein, 9 aa, Homo Sapiens
GHGSHHQGV

SEQ ID NO: 220955 - protein, 9 aa, Homo Sapiens
VSCCDAGNE

SEQ ID NO: 220956 - protein, 9 aa, Homo Sapiens
YVRVSVKLH

SEQ ID NO: 220957 - protein, 9 aa, Homo Sapiens
KSFLFFIPF

SEQ ID NO: 220958 - protein, 9 aa, Homo Sapiens
FYGMGFGVY

SEQ ID NO: 220959 - protein, 9 aa, Homo Sapiens
AHEFIPFRF

SEQ ID NO: 220960 - protein, 9 aa, Homo Sapiens
VECPVSAWS

SEQ ID NO: 220961 - protein, 9 aa, Homo Sapiens
MLRHFHTPH

SEQ ID NO: 220962 - protein, 9 aa, Homo Sapiens
DVFVVNGPA

SEQ ID NO: 220963 - protein, 9 aa, Homo Sapiens
TKGGNKKFF

SEQ ID NO: 220964 - protein, 9 aa, Homo Sapiens
RDELGAGSQ

SEQ ID NO: 220965 - protein, 9 aa, Homo Sapiens
GDCPRTMAG

SEQ ID NO: 220966 - protein, 9 aa, Homo Sapiens
AAHPADASS

SEQ ID NO: 220967 - protein, 9 aa, Homo Sapiens
SSGRISSTH

SEQ ID NO: 220968 - protein, 9 aa, Homo Sapiens
SQRSWMVLV

SEQ ID NO: 220969 - protein, 9 aa, Homo Sapiens
IPMGQTQPG

SEQ ID NO: 220970 - protein, 9 aa, Homo Sapiens
AGAGLHVHG

SEQ ID NO: 220971 - protein, 9 aa, Homo Sapiens
AHGPSARGA

SEQ ID NO: 220972 - protein, 9 aa, Homo Sapiens
VVAVQGPIH

SEQ ID NO: 220973 - protein, 9 aa, Homo Sapiens
EKRRCYSRG

SEQ ID NO: 220974 - protein, 9 aa, Homo Sapiens
FLICNLAAI

SEQ ID NO: 220975 - protein, 9 aa, Homo Sapiens
PELHLKHIC

SEQ ID NO: 220976 - protein, 9 aa, Homo Sapiens
RKSHTLQQA

SEQ ID NO: 220977 - protein, 9 aa, Homo Sapiens
SAHHLVPGP

SEQ ID NO: 220978 - protein, 9 aa, Homo Sapiens
KRLKDISKI

SEQ ID NO: 220979 - protein, 9 aa, Homo Sapiens
GGHTHTPLP

SEQ ID NO: 220980 - protein, 9 aa, Homo Sapiens
QTAQELKTL

SEQ ID NO: 220981 - protein, 9 aa, Homo Sapiens
WECKHLRWI

SEQ ID NO: 220982 - protein, 9 aa, Homo Sapiens
EPSCLQAVF

SEQ ID NO: 220983 - protein, 9 aa, Homo Sapiens
PEVLVAVAS

SEQ ID NO: 220984 - protein, 9 aa, Homo Sapiens
RSWPRPPCS

SEQ ID NO: 220985 - protein, 9 aa, Homo Sapiens
LDDLSGLRV

SEQ ID NO: 220986 - protein, 9 aa, Homo Sapiens
RPCAHDAHR

SEQ ID NO: 220987 - protein, 9 aa, Homo Sapiens
RKWGMTSWG

SEQ ID NO: 220988 - protein, 9 aa, Homo Sapiens
PQDLQVIKD

SEQ ID NO: 220989 - protein, 9 aa, Homo Sapiens
AASPAGTAT

SEQ ID NO: 220990 - protein, 9 aa, Homo Sapiens
KISERYVPV

SEQ ID NO: 220991 - protein, 9 aa, Homo Sapiens
RSHYMEVCE

SEQ ID NO: 220992 - protein, 9 aa, Homo Sapiens
SLLRSHQRK

SEQ ID NO: 220993 - protein, 9 aa, Homo Sapiens
LHHILRHEV

SEQ ID NO: 220994 - protein, 9 aa, Homo Sapiens
EKKQCRKTT

SEQ ID NO: 220995 - protein, 9 aa, Homo Sapiens
QSQPPSNRI

SEQ ID NO: 220996 - protein, 9 aa, Homo Sapiens
LYLLDYFLQ

SEQ ID NO: 220997 - protein, 9 aa, Homo Sapiens
RELYKAHEW

SEQ ID NO: 220998 - protein, 9 aa, Homo Sapiens
ELKRSKNLE

SEQ ID NO: 220999 - protein, 9 aa, Homo Sapiens
LSSFRSRNP

SEQ ID NO: 221000 - protein, 9 aa, Homo Sapiens
VSSLPRSPP

SEQ ID NO: 221001 - protein, 9 aa, Homo Sapiens
EGLVIGLHG

SEQ ID NO: 221002 - protein, 9 aa, Homo Sapiens
WMMCTASFA

SEQ ID NO: 221003 - protein, 9 aa, Homo Sapiens
WRCRGLWSW

SEQ ID NO: 221004 - protein, 9 aa, Homo Sapiens
PQQQRRAPA

SEQ ID NO: 221005 - protein, 9 aa, Homo Sapiens
TAEPTATPA

SEQ ID NO: 221006 - protein, 9 aa, Homo Sapiens
CAAGMTLAA

SEQ ID NO: 221007 - protein, 9 aa, Homo Sapiens
RCEPEPSCL

SEQ ID NO: 221008 - protein, 9 aa, Homo Sapiens
RTSASRSAA

SEQ ID NO: 221009 - protein, 9 aa, Homo Sapiens
CWPSDGLVS

SEQ ID NO: 221010 - protein, 9 aa, Homo Sapiens
QKYPQAAAV

SEQ ID NO: 221011 - protein, 9 aa, Homo Sapiens
PRLSQVAGA

SEQ ID NO: 221012 - protein, 9 aa, Homo Sapiens
RPTQRCLRG

SEQ ID NO: 221013 - protein, 9 aa, Homo Sapiens
NHSLAIGGT

SEQ ID NO: 221014 - protein, 9 aa, Homo Sapiens
GAEVPQGAV

SEQ ID NO: 221015 - protein, 9 aa, Homo Sapiens
QQLIEDIVC

SEQ ID NO: 221016 - protein, 9 aa, Homo Sapiens
IGPVTSILP

SEQ ID NO: 221017 - protein, 9 aa, Homo Sapiens
SARSLQRLA

SEQ ID NO: 221018 - protein, 9 aa, Homo Sapiens
FGIVQGSLQ

SEQ ID NO: 221019 - protein, 9 aa, Homo Sapiens
KRCNKKIAM

SEQ ID NO: 221020 - protein, 9 aa, Homo Sapiens
AMRVSALQE

SEQ ID NO: 221021 - protein, 9 aa, Homo Sapiens
GGHDSPGCV

SEQ ID NO: 221022 - protein, 9 aa, Homo Sapiens
CRNPDRELW

SEQ ID NO: 221023 - protein, 9 aa, Homo Sapiens
QRTDIFGVE

SEQ ID NO: 221024 - protein, 9 aa, Homo Sapiens
AQALEAEQQ

SEQ ID NO: 221025 - protein, 9 aa, Homo Sapiens
REETGVSTY

SEQ ID NO: 221026 - protein, 9 aa, Homo Sapiens
VWFNEKSAS

SEQ ID NO: 221027 - protein, 9 aa, Homo Sapiens
EFEYPKLLG

SEQ ID NO: 221028 - protein, 9 aa, Homo Sapiens
VAVQGPIHL

SEQ ID NO: 221029 - protein, 9 aa, Homo Sapiens
MFPCGPWTR

SEQ ID NO: 221030 - protein, 9 aa, Homo Sapiens
LHFFSGFSF

SEQ ID NO: 221031 - protein, 9 aa, Homo Sapiens
GFSKGCVLN

SEQ ID NO: 221032 - protein, 9 aa, Homo Sapiens
WYRVPEVIL

SEQ ID NO: 221033 - protein, 9 aa, Homo Sapiens
SLRAFLDQP

SEQ ID NO: 221034 - protein, 9 aa, Homo Sapiens
CQKKFWKTL

SEQ ID NO: 221035 - protein, 9 aa, Homo Sapiens
ITSCDPLQI

SEQ ID NO: 221036 - protein, 9 aa, Homo Sapiens
RSPHSWSWP

SEQ ID NO: 221037 - protein, 9 aa, Homo Sapiens
NYASLHHTL

SEQ ID NO: 221038 - protein, 9 aa, Homo Sapiens
PEGRHGHLD

SEQ ID NO: 221039 - protein, 9 aa, Homo Sapiens
PIHLLVDLI

SEQ ID NO: 221040 - protein, 9 aa, Homo Sapiens
RAMLSVELG

SEQ ID NO: 221041 - protein, 9 aa, Homo Sapiens
IYQIMHSCW

SEQ ID NO: 221042 - protein, 9 aa, Homo Sapiens
SGGKGFPIN

SEQ ID NO: 221043 - protein, 9 aa, Homo Sapiens
EEADILSIM

SEQ ID NO: 221044 - protein, 9 aa, Homo Sapiens
EVIFHQGIS

SEQ ID NO: 221045 - protein, 9 aa, Homo Sapiens
TSKELVSRH

SEQ ID NO: 221046 - protein, 9 aa, Homo Sapiens
HNESTGSLG

SEQ ID NO: 221047 - protein, 9 aa, Homo Sapiens
LSGHGEPLP

SEQ ID NO: 221048 - protein, 9 aa, Homo Sapiens
LLKTHNCYH

SEQ ID NO: 221049 - protein, 9 aa, Homo Sapiens
PRLECPISA

SEQ ID NO: 221050 - protein, 9 aa, Homo Sapiens
LTMSSTMYN

SEQ ID NO: 221051 - protein, 9 aa, Homo Sapiens
PQTTVTAGQ

SEQ ID NO: 221052 - protein, 9 aa, Homo Sapiens
ATIKTKHTI

SEQ ID NO: 221053 - protein, 9 aa, Homo Sapiens
CRKRQKRCM

SEQ ID NO: 221054 - protein, 9 aa, Homo Sapiens
DLATREKVV

SEQ ID NO: 221055 - protein, 9 aa, Homo Sapiens
PDRLWGSHL

SEQ ID NO: 221056 - protein, 9 aa, Homo Sapiens
SLLKDYDPM

SEQ ID NO: 221057 - protein, 9 aa, Homo Sapiens
VTGHAMAAM

SEQ ID NO: 221058 - protein, 9 aa, Homo Sapiens
ICKTWAQLE

SEQ ID NO: 221059 - protein, 9 aa, Homo Sapiens
KLEATDRYH

SEQ ID NO: 221060 - protein, 9 aa, Homo Sapiens
KINAVHAIV

SEQ ID NO: 221061 - protein, 9 aa, Homo Sapiens
ASEITSKGT

SEQ ID NO: 221062 - protein, 9 aa, Homo Sapiens
ANFYCDIPP

SEQ ID NO: 221063 - protein, 9 aa, Homo Sapiens
VRPIFLRLL

SEQ ID NO: 221064 - protein, 9 aa, Homo Sapiens
PLVAPRQTP

SEQ ID NO: 221065 - protein, 9 aa, Homo Sapiens
KLSRRVCEN

SEQ ID NO: 221066 - protein, 9 aa, Homo Sapiens
RQEEMLNTE

SEQ ID NO: 221067 - protein, 9 aa, Homo Sapiens
IGARIHALP

SEQ ID NO: 221068 - protein, 9 aa, Homo Sapiens
TCGPWARNP

SEQ ID NO: 221069 - protein, 9 aa, Homo Sapiens
ARLVLTDEK

SEQ ID NO: 221070 - protein, 9 aa, Homo Sapiens
HPREYLKAP

SEQ ID NO: 221071 - protein, 9 aa, Homo Sapiens
GCVPFCGWR

SEQ ID NO: 221072 - protein, 9 aa, Homo Sapiens
SSVMSHRSS

SEQ ID NO: 221073 - protein, 9 aa, Homo Sapiens
AMFNLAYLY

SEQ ID NO: 221074 - protein, 9 aa, Homo Sapiens
QEWGCLCGR

SEQ ID NO: 221075 - protein, 9 aa, Homo Sapiens
VLKDRGWWI

SEQ ID NO: 221076 - protein, 9 aa, Homo Sapiens
PEEKCARRL

SEQ ID NO: 221077 - protein, 9 aa, Homo Sapiens
YDRYATICN

SEQ ID NO: 221078 - protein, 9 aa, Homo Sapiens
QRVILDCER

SEQ ID NO: 221079 - protein, 9 aa, Homo Sapiens
IFKEPILEI

SEQ ID NO: 221080 - protein, 9 aa, Homo Sapiens
MRRKAKELH

SEQ ID NO: 221081 - protein, 9 aa, Homo Sapiens
LHFGLPALE

SEQ ID NO: 221082 - protein, 9 aa, Homo Sapiens
PWKRGRTAP

SEQ ID NO: 221083 - protein, 9 aa, Homo Sapiens
LYDPWMPSS

SEQ ID NO: 221084 - protein, 9 aa, Homo Sapiens
CLAQEDVMF

SEQ ID NO: 221085 - protein, 9 aa, Homo Sapiens
TTGCLRKRL

SEQ ID NO: 221086 - protein, 9 aa, Homo Sapiens
TPSASREWI

SEQ ID NO: 221087 - protein, 9 aa, Homo Sapiens
IIQFLDRQL

SEQ ID NO: 221088 - protein, 9 aa, Homo Sapiens
LSSLPDKKR

SEQ ID NO: 221089 - protein, 9 aa, Homo Sapiens
LKVNDLYWH

SEQ ID NO: 221090 - protein, 9 aa, Homo Sapiens
IGGVQPQSV

SEQ ID NO: 221091 - protein, 9 aa, Homo Sapiens
SWISVPCPN

SEQ ID NO: 221092 - protein, 9 aa, Homo Sapiens
KEKRREKKR

SEQ ID NO: 221093 - protein, 9 aa, Homo Sapiens
DLECAARRQ

SEQ ID NO: 221094 - protein, 9 aa, Homo Sapiens
QHNCQSYGK

SEQ ID NO: 221095 - protein, 9 aa, Homo Sapiens
KICRGAQNM

SEQ ID NO: 221096 - protein, 9 aa, Homo Sapiens
LIQLKSVKG

SEQ ID NO: 221097 - protein, 9 aa, Homo Sapiens
SPPPSPPSP

SEQ ID NO: 221098 - protein, 9 aa, Homo Sapiens
GPAQCRPAW

SEQ ID NO: 221099 - protein, 9 aa, Homo Sapiens
ANRPCQRGA

SEQ ID NO: 221100 - protein, 9 aa, Homo Sapiens
WPSPQQRNW

SEQ ID NO: 221101 - protein, 9 aa, Homo Sapiens
HGDQELWSE

SEQ ID NO: 221102 - protein, 9 aa, Homo Sapiens
QAGWQPEEQ

SEQ ID NO: 221103 - protein, 9 aa, Homo Sapiens
SALPCAQPT

SEQ ID NO: 221104 - protein, 9 aa, Homo Sapiens
WTPTLPKKL

SEQ ID NO: 221105 - protein, 9 aa, Homo Sapiens
RQEEERRRC

SEQ ID NO: 221106 - protein, 9 aa, Homo Sapiens
LRACWGPQR

SEQ ID NO: 221107 - protein, 9 aa, Homo Sapiens
QGPIHLLVD

SEQ ID NO: 221108 - protein, 9 aa, Homo Sapiens
QDAHTLDGE

SEQ ID NO: 221109 - protein, 9 aa, Homo Sapiens
LQEMLGMYR

SEQ ID NO: 221110 - protein, 9 aa, Homo Sapiens
YPSVKPGWL

SEQ ID NO: 221111 - protein, 9 aa, Homo Sapiens
DDDLNLWAL

SEQ ID NO: 221112 - protein, 9 aa, Homo Sapiens
STPGPWAAA

SEQ ID NO: 221113 - protein, 9 aa, Homo Sapiens
GNFAMRVSA

SEQ ID NO: 221114 - protein, 9 aa, Homo Sapiens
VMQLRLNTG

SEQ ID NO: 221115 - protein, 9 aa, Homo Sapiens
VSGRGSCTG

SEQ ID NO: 221116 - protein, 9 aa, Homo Sapiens
PPPQSSPFL

SEQ ID NO: 221117 - protein, 9 aa, Homo Sapiens
SGSRKATAV

SEQ ID NO: 221118 - protein, 9 aa, Homo Sapiens
PGETGLLPE

SEQ ID NO: 221119 - protein, 9 aa, Homo Sapiens
RKCSGPLQF

SEQ ID NO: 221120 - protein, 9 aa, Homo Sapiens
LQTSSSGLQ

SEQ ID NO: 221121 - protein, 9 aa, Homo Sapiens
NQKKVLKVE

SEQ ID NO: 221122 - protein, 9 aa, Homo Sapiens
GSKPVMESY

SEQ ID NO: 221123 - protein, 9 aa, Homo Sapiens
AGWQGLGAQ

SEQ ID NO: 221124 - protein, 9 aa, Homo Sapiens
VGEGGLRRA

SEQ ID NO: 221125 - protein, 9 aa, Homo Sapiens
ATTSPARDD

SEQ ID NO: 221126 - protein, 9 aa, Homo Sapiens
NRSSEEAHR

SEQ ID NO: 221127 - protein, 9 aa, Homo Sapiens
KLKPLSNET

SEQ ID NO: 221128 - protein, 9 aa, Homo Sapiens
FTFAATWPS

SEQ ID NO: 221129 - protein, 9 aa, Homo Sapiens
TLMISIYNR

SEQ ID NO: 221130 - protein, 9 aa, Homo Sapiens
HAARPADHI

SEQ ID NO: 221131 - protein, 9 aa, Homo Sapiens
ATTVMLKER

SEQ ID NO: 221132 - protein, 9 aa, Homo Sapiens
TMCSRARLA

SEQ ID NO: 221133 - protein, 9 aa, Homo Sapiens
RVPPLQRGP

SEQ ID NO: 221134 - protein, 9 aa, Homo Sapiens
CALPAAAWS

SEQ ID NO: 221135 - protein, 9 aa, Homo Sapiens
SHRKRNQPK

SEQ ID NO: 221136 - protein, 9 aa, Homo Sapiens
QAKDNKAQD

SEQ ID NO: 221137 - protein, 9 aa, Homo Sapiens
KMRNLHFHI

SEQ ID NO: 221138 - protein, 9 aa, Homo Sapiens
SAMGPGSHP

SEQ ID NO: 221139 - protein, 9 aa, Homo Sapiens
CSSTKASVA

SEQ ID NO: 221140 - protein, 9 aa, Homo Sapiens
RPPRSSPPS

SEQ ID NO: 221141 - protein, 9 aa, Homo Sapiens
EWNFFPGSG

SEQ ID NO: 221142 - protein, 9 aa, Homo Sapiens
RSPAPRRPR

SEQ ID NO: 221143 - protein, 9 aa, Homo Sapiens
GVDVLDHGE

SEQ ID NO: 221144 - protein, 9 aa, Homo Sapiens
RLKLNTEVC

SEQ ID NO: 221145 - protein, 9 aa, Homo Sapiens
PSNRLVLLY

SEQ ID NO: 221146 - protein, 9 aa, Homo Sapiens
RVKGLWRRG

SEQ ID NO: 221147 - protein, 9 aa, Homo Sapiens
AAWQFLLKW

SEQ ID NO: 221148 - protein, 9 aa, Homo Sapiens
EESSEREIL

SEQ ID NO: 221149 - protein, 9 aa, Homo Sapiens
NLEHWEEAI

SEQ ID NO: 221150 - protein, 9 aa, Homo Sapiens
EAAENYRTL

SEQ ID NO: 221151 - protein, 9 aa, Homo Sapiens
THNKNSNKS

SEQ ID NO: 221152 - protein, 9 aa, Homo Sapiens
PTPSSPLPP

SEQ ID NO: 221153 - protein, 9 aa, Homo Sapiens
CYIHNSVIR

SEQ ID NO: 221154 - protein, 9 aa, Homo Sapiens
TSTCQTDGT

SEQ ID NO: 221155 - protein, 9 aa, Homo Sapiens
RFMPCTIWS

SEQ ID NO: 221156 - protein, 9 aa, Homo Sapiens
RHLIKMIDL

SEQ ID NO: 221157 - protein, 9 aa, Homo Sapiens
KLEMGLKDL

SEQ ID NO: 221158 - protein, 9 aa, Homo Sapiens
TPLVAIMIT

SEQ ID NO: 221159 - protein, 9 aa, Homo Sapiens
LEGFCSPRQ

SEQ ID NO: 221160 - protein, 9 aa, Homo Sapiens
NVRKDCLDR

SEQ ID NO: 221161 - protein, 9 aa, Homo Sapiens
KPGWLKATY

SEQ ID NO: 221162 - protein, 9 aa, Homo Sapiens
THTVTSSKA

SEQ ID NO: 221163 - protein, 9 aa, Homo Sapiens
FNEYQRMTV

SEQ ID NO: 221164 - protein, 9 aa, Homo Sapiens
GLASHEEHW

SEQ ID NO: 221165 - protein, 9 aa, Homo Sapiens
HSTEQGTLF

SEQ ID NO: 221166 - protein, 9 aa, Homo Sapiens
STQNNTNVQ

SEQ ID NO: 221167 - protein, 9 aa, Homo Sapiens
SVAQTHQLR

SEQ ID NO: 221168 - protein, 9 aa, Homo Sapiens
KELPLYVRP

SEQ ID NO: 221169 - protein, 9 aa, Homo Sapiens
GFLGMVTGA

SEQ ID NO: 221170 - protein, 9 aa, Homo Sapiens
TFSQSTKQI

SEQ ID NO: 221171 - protein, 9 aa, Homo Sapiens
YQLQVFMVI

SEQ ID NO: 221172 - protein, 9 aa, Homo Sapiens
RPGWGCVPF

SEQ ID NO: 221173 - protein, 9 aa, Homo Sapiens
AGREHFVYV

SEQ ID NO: 221174 - protein, 9 aa, Homo Sapiens
HQMTYRGER

SEQ ID NO: 221175 - protein, 9 aa, Homo Sapiens
TNTSLILAA

SEQ ID NO: 221176 - protein, 9 aa, Homo Sapiens
VCVIKDKQT

SEQ ID NO: 221177 - protein, 9 aa, Homo Sapiens
VREEAMLFT

SEQ ID NO: 221178 - protein, 9 aa, Homo Sapiens
ITSEECTKH

SEQ ID NO: 221179 - protein, 9 aa, Homo Sapiens
MLDMDDLVT

SEQ ID NO: 221180 - protein, 9 aa, Homo Sapiens
LAFKHKIKH

SEQ ID NO: 221181 - protein, 9 aa, Homo Sapiens
EWSFSTFGK

SEQ ID NO: 221182 - protein, 9 aa, Homo Sapiens
GSALGGGAP

SEQ ID NO: 221183 - protein, 9 aa, Homo Sapiens
LEDLGKMLK

SEQ ID NO: 221184 - protein, 9 aa, Homo Sapiens
GQELWLTPV

SEQ ID NO: 221185 - protein, 9 aa, Homo Sapiens
LALSSSPSA

SEQ ID NO: 221186 - protein, 9 aa, Homo Sapiens
FAMRVSALQ

SEQ ID NO: 221187 - protein, 9 aa, Homo Sapiens
FLHYGHHLV

SEQ ID NO: 221188 - protein, 9 aa, Homo Sapiens
GRSKELTIR

SEQ ID NO: 221189 - protein, 9 aa, Homo Sapiens
ITMDTAGMI

SEQ ID NO: 221190 - protein, 9 aa, Homo Sapiens
TLQQALTAA

SEQ ID NO: 221191 - protein, 9 aa, Homo Sapiens
AGPVSCRST

SEQ ID NO: 221192 - protein, 9 aa, Homo Sapiens
VLDHGEDVE

SEQ ID NO: 221193 - protein, 9 aa, Homo Sapiens
SSGAKTFKK

SEQ ID NO: 221194 - protein, 9 aa, Homo Sapiens
LTKVNMDIP

SEQ ID NO: 221195 - protein, 9 aa, Homo Sapiens
RLRACRAGG

SEQ ID NO: 221196 - protein, 9 aa, Homo Sapiens
EPASSFVVD

SEQ ID NO: 221197 - protein, 9 aa, Homo Sapiens
ITKRAEAIT

SEQ ID NO: 221198 - protein, 9 aa, Homo Sapiens
GVFAPDELR

SEQ ID NO: 221199 - protein, 9 aa, Homo Sapiens
LNSATIFGP

SEQ ID NO: 221200 - protein, 9 aa, Homo Sapiens
VIEHAVRAP

SEQ ID NO: 221201 - protein, 9 aa, Homo Sapiens
GLGVDVLDH

SEQ ID NO: 221202 - protein, 9 aa, Homo Sapiens
AGPGKLRQD

SEQ ID NO: 221203 - protein, 9 aa, Homo Sapiens
LMLMTTSNE

SEQ ID NO: 221204 - protein, 9 aa, Homo Sapiens
SCRRPSSSA

SEQ ID NO: 221205 - protein, 9 aa, Homo Sapiens
DHVDMSLSC

SEQ ID NO: 221206 - protein, 9 aa, Homo Sapiens
HPRQLRWKP

SEQ ID NO: 221207 - protein, 9 aa, Homo Sapiens
GKTSRGHPR

SEQ ID NO: 221208 - protein, 9 aa, Homo Sapiens
AGSALQIAT

SEQ ID NO: 221209 - protein, 9 aa, Homo Sapiens
SGEPWDTER

SEQ ID NO: 221210 - protein, 9 aa, Homo Sapiens
KVNQGNAGV

SEQ ID NO: 221211 - protein, 9 aa, Homo Sapiens
VCRPGRLGV

SEQ ID NO: 221212 - protein, 9 aa, Homo Sapiens
SEECSLEAV

SEQ ID NO: 221213 - protein, 9 aa, Homo Sapiens
AAGSALQIA

SEQ ID NO: 221214 - protein, 9 aa, Homo Sapiens
ARGVVGPRG

SEQ ID NO: 221215 - protein, 9 aa, Homo Sapiens
PSLVAASPT

SEQ ID NO: 221216 - protein, 9 aa, Homo Sapiens
SFRSRNPEE

SEQ ID NO: 221217 - protein, 9 aa, Homo Sapiens
FLLTTTEQS

SEQ ID NO: 221218 - protein, 9 aa, Homo Sapiens
KNGIWEVMP

SEQ ID NO: 221219 - protein, 9 aa, Homo Sapiens
RGAETVHYI

SEQ ID NO: 221220 - protein, 9 aa, Homo Sapiens
KKLEMGLKD

SEQ ID NO: 221221 - protein, 9 aa, Homo Sapiens
PQGSSGCKV

SEQ ID NO: 221222 - protein, 9 aa, Homo Sapiens
DPPGGRPRR

SEQ ID NO: 221223 - protein, 9 aa, Homo Sapiens
SRKATAVGD

SEQ ID NO: 221224 - protein, 9 aa, Homo Sapiens
AEDERRRAT

SEQ ID NO: 221225 - protein, 9 aa, Homo Sapiens
LALWPISKQ

SEQ ID NO: 221226 - protein, 9 aa, Homo Sapiens
VAYLISARS

SEQ ID NO: 221227 - protein, 9 aa, Homo Sapiens
GADCSVEVD

SEQ ID NO: 221228 - protein, 9 aa, Homo Sapiens
SIPCLGLKK

SEQ ID NO: 221229 - protein, 9 aa, Homo Sapiens
YSIDSLIDT

SEQ ID NO: 221230 - protein, 9 aa, Homo Sapiens
MADLPRELS

SEQ ID NO: 221231 - protein, 9 aa, Homo Sapiens
ISLMIEYSE

SEQ ID NO: 221232 - protein, 9 aa, Homo Sapiens
NQIMKRMCK

SEQ ID NO: 221233 - protein, 9 aa, Homo Sapiens
LQEPCLELL

SEQ ID NO: 221234 - protein, 9 aa, Homo Sapiens
VEMYEESVP

SEQ ID NO: 221235 - protein, 9 aa, Homo Sapiens
HTPWPAQPQ

SEQ ID NO: 221236 - protein, 9 aa, Homo Sapiens
WHHIFYQDK

SEQ ID NO: 221237 - protein, 9 aa, Homo Sapiens
KCGGIQSLV

SEQ ID NO: 221238 - protein, 9 aa, Homo Sapiens
YTQQILTDH

SEQ ID NO: 221239 - protein, 9 aa, Homo Sapiens
RHAAKMADE

SEQ ID NO: 221240 - protein, 9 aa, Homo Sapiens
TTWGPARPL

SEQ ID NO: 221241 - protein, 9 aa, Homo Sapiens
YIRADIGPV

SEQ ID NO: 221242 - protein, 9 aa, Homo Sapiens
GAMQLTFHK

SEQ ID NO: 221243 - protein, 9 aa, Homo Sapiens
QSFPSLGYP

SEQ ID NO: 221244 - protein, 9 aa, Homo Sapiens
ETIMMRCHS

SEQ ID NO: 221245 - protein, 9 aa, Homo Sapiens
QVLRKLKQM

SEQ ID NO: 221246 - protein, 9 aa, Homo Sapiens
GLPHVTWSS

SEQ ID NO: 221247 - protein, 9 aa, Homo Sapiens
TEPPVTNPV

SEQ ID NO: 221248 - protein, 9 aa, Homo Sapiens
SFPFQEKRI

SEQ ID NO: 221249 - protein, 9 aa, Homo Sapiens
PCPAPGPSP

SEQ ID NO: 221250 - protein, 9 aa, Homo Sapiens
LRQEAEQLW

SEQ ID NO: 221251 - protein, 9 aa, Homo Sapiens
PPQSPPRTA

SEQ ID NO: 221252 - protein, 9 aa, Homo Sapiens
VRQSAAYGL

SEQ ID NO: 221253 - protein, 9 aa, Homo Sapiens
IGCGAILVA

SEQ ID NO: 221254 - protein, 9 aa, Homo Sapiens
CVNSDYETD

SEQ ID NO: 221255 - protein, 9 aa, Homo Sapiens
NVTLLPAAW

SEQ ID NO: 221256 - protein, 9 aa, Homo Sapiens
SKTFEKKGK

SEQ ID NO: 221257 - protein, 9 aa, Homo Sapiens
PQFPHLNPN

SEQ ID NO: 221258 - protein, 9 aa, Homo Sapiens
KFESLELCR

SEQ ID NO: 221259 - protein, 9 aa, Homo Sapiens
MDSVRSGLF

SEQ ID NO: 221260 - protein, 9 aa, Homo Sapiens
PRRPSHSPP

SEQ ID NO: 221261 - protein, 9 aa, Homo Sapiens
RVPEVILNW

SEQ ID NO: 221262 - protein, 9 aa, Homo Sapiens
ITLTLSGMF

SEQ ID NO: 221263 - protein, 9 aa, Homo Sapiens
DSLIDTFMG

SEQ ID NO: 221264 - protein, 9 aa, Homo Sapiens
LWVPVRQST

SEQ ID NO: 221265 - protein, 9 aa, Homo Sapiens
SNDYCVVVF

SEQ ID NO: 221266 - protein, 9 aa, Homo Sapiens
PAFSVGLGA

SEQ ID NO: 221267 - protein, 9 aa, Homo Sapiens
AACPLPPTR

SEQ ID NO: 221268 - protein, 9 aa, Homo Sapiens
QYFNTPRLQ

SEQ ID NO: 221269 - protein, 9 aa, Homo Sapiens
LPVAGVYKK

SEQ ID NO: 221270 - protein, 9 aa, Homo Sapiens
SLEGVVFPC

SEQ ID NO: 221271 - protein, 9 aa, Homo Sapiens
NNGCFRSSG

SEQ ID NO: 221272 - protein, 9 aa, Homo Sapiens
TIYMLTHKS

SEQ ID NO: 221273 - protein, 9 aa, Homo Sapiens
FLIYFFFFL

SEQ ID NO: 221274 - protein, 9 aa, Homo Sapiens
GRGDPFCRL

SEQ ID NO: 221275 - protein, 9 aa, Homo Sapiens
IHTSHNTLE

SEQ ID NO: 221276 - protein, 9 aa, Homo Sapiens
KLKALMTQQ

SEQ ID NO: 221277 - protein, 9 aa, Homo Sapiens
GDLCVVLLN

SEQ ID NO: 221278 - protein, 9 aa, Homo Sapiens
AKPADSWDI

SEQ ID NO: 221279 - protein, 9 aa, Homo Sapiens
VRHTVIEHA

SEQ ID NO: 221280 - protein, 9 aa, Homo Sapiens
KIVDMYKDK

SEQ ID NO: 221281 - protein, 9 aa, Homo Sapiens
PNHTPWPAQ

SEQ ID NO: 221282 - protein, 9 aa, Homo Sapiens
NRRTKWKKR

SEQ ID NO: 221283 - protein, 9 aa, Homo Sapiens
VWEKLDPDA

SEQ ID NO: 221284 - protein, 9 aa, Homo Sapiens
GLSGLPGSP

SEQ ID NO: 221285 - protein, 9 aa, Homo Sapiens
IVNFVEEHM

SEQ ID NO: 221286 - protein, 9 aa, Homo Sapiens
GCYLTVACI

SEQ ID NO: 221287 - protein, 9 aa, Homo Sapiens
PRYQGAAVA

SEQ ID NO: 221288 - protein, 9 aa, Homo Sapiens
HLWLSHRLR

SEQ ID NO: 221289 - protein, 9 aa, Homo Sapiens
WQLLGLLPE

SEQ ID NO: 221290 - protein, 9 aa, Homo Sapiens
HSVDARGGG

SEQ ID NO: 221291 - protein, 9 aa, Homo Sapiens
HFLMIKKHR

SEQ ID NO: 221292 - protein, 9 aa, Homo Sapiens
SSPLQLLLH

SEQ ID NO: 221293 - protein, 9 aa, Homo Sapiens
GGRELEGRD

SEQ ID NO: 221294 - protein, 9 aa, Homo Sapiens
GKLFPPPLS

SEQ ID NO: 221295 - protein, 9 aa, Homo Sapiens
SVTKELSTT

SEQ ID NO: 221296 - protein, 9 aa, Homo Sapiens
LRYPPQSPC

SEQ ID NO: 221297 - protein, 9 aa, Homo Sapiens
TKLNDVLLI

SEQ ID NO: 221298 - protein, 9 aa, Homo Sapiens
APSRSTCPP

SEQ ID NO: 221299 - protein, 9 aa, Homo Sapiens
TGVRGLGRH

SEQ ID NO: 221300 - protein, 9 aa, Homo Sapiens
TGPPRESKN

SEQ ID NO: 221301 - protein, 9 aa, Homo Sapiens
GATSSRPLA

SEQ ID NO: 221302 - protein, 9 aa, Homo Sapiens
SAPSLVAAS

SEQ ID NO: 221303 - protein, 9 aa, Homo Sapiens
GWPLYWKGG

SEQ ID NO: 221304 - protein, 9 aa, Homo Sapiens
QERVRIEKA

SEQ ID NO: 221305 - protein, 9 aa, Homo Sapiens
IWTPWRKSG

SEQ ID NO: 221306 - protein, 9 aa, Homo Sapiens
SPDRLWGSH

SEQ ID NO: 221307 - protein, 9 aa, Homo Sapiens
AHQHRLLLV

SEQ ID NO: 221308 - protein, 9 aa, Homo Sapiens
GLRARSRGL

SEQ ID NO: 221309 - protein, 9 aa, Homo Sapiens
SMWTSRTSP

SEQ ID NO: 221310 - protein, 9 aa, Homo Sapiens
WPPTAARPP

SEQ ID NO: 221311 - protein, 9 aa, Homo Sapiens
PSSLEEEGV

SEQ ID NO: 221312 - protein, 9 aa, Homo Sapiens
GGFLGNIVK

SEQ ID NO: 221313 - protein, 9 aa, Homo Sapiens
ECGKVLINN

SEQ ID NO: 221314 - protein, 9 aa, Homo Sapiens
GMPPSSPSM

SEQ ID NO: 221315 - protein, 9 aa, Homo Sapiens
TLCSTISCP

SEQ ID NO: 221316 - protein, 9 aa, Homo Sapiens
NVRFVKRLS

SEQ ID NO: 221317 - protein, 9 aa, Homo Sapiens
NQSKEVTEN

SEQ ID NO: 221318 - protein, 9 aa, Homo Sapiens
ISVCGQVLA

SEQ ID NO: 221319 - protein, 9 aa, Homo Sapiens
LRPTDYLSW

SEQ ID NO: 221320 - protein, 9 aa, Homo Sapiens
GEAGERSAE

SEQ ID NO: 221321 - protein, 9 aa, Homo Sapiens
KQCRKTTAT

SEQ ID NO: 221322 - protein, 9 aa, Homo Sapiens
WKTPTATWM

SEQ ID NO: 221323 - protein, 9 aa, Homo Sapiens
SLAVRKIVL

SEQ ID NO: 221324 - protein, 9 aa, Homo Sapiens
VSQRALLHS

SEQ ID NO: 221325 - protein, 9 aa, Homo Sapiens
YRTLFQEIL

SEQ ID NO: 221326 - protein, 9 aa, Homo Sapiens
VHSKLEADK

SEQ ID NO: 221327 - protein, 9 aa, Homo Sapiens
GGFEDEDKK

SEQ ID NO: 221328 - protein, 9 aa, Homo Sapiens
PQNMSVADS

SEQ ID NO: 221329 - protein, 9 aa, Homo Sapiens
NIITGAPCL

SEQ ID NO: 221330 - protein, 9 aa, Homo Sapiens
VSLTTDWRK

SEQ ID NO: 221331 - protein, 9 aa, Homo Sapiens
GIFPESLVR

SEQ ID NO: 221332 - protein, 9 aa, Homo Sapiens
GLLGKSDVS

SEQ ID NO: 221333 - protein, 9 aa, Homo Sapiens
RQMLPTLST

SEQ ID NO: 221334 - protein, 9 aa, Homo Sapiens
FCASNGIHH

SEQ ID NO: 221335 - protein, 9 aa, Homo Sapiens
IQPLLDGTN

SEQ ID NO: 221336 - protein, 9 aa, Homo Sapiens
YAISEGFLK

SEQ ID NO: 221337 - protein, 9 aa, Homo Sapiens
RMQKPPSPD

SEQ ID NO: 221338 - protein, 9 aa, Homo Sapiens
VKDNGEPPH

SEQ ID NO: 221339 - protein, 9 aa, Homo Sapiens
DWYQQQLHR

SEQ ID NO: 221340 - protein, 9 aa, Homo Sapiens
AASTGMWTL

SEQ ID NO: 221341 - protein, 9 aa, Homo Sapiens
VVEAGEEAQ

SEQ ID NO: 221342 - protein, 9 aa, Homo Sapiens
YQSHRVGPA

SEQ ID NO: 221343 - protein, 9 aa, Homo Sapiens
MRVWRSSEC

SEQ ID NO: 221344 - protein, 9 aa, Homo Sapiens
SQPDVPAVT

SEQ ID NO: 221345 - protein, 9 aa, Homo Sapiens
MSCPRPFWL

SEQ ID NO: 221346 - protein, 9 aa, Homo Sapiens
VGGQVGHGV

SEQ ID NO: 221347 - protein, 9 aa, Homo Sapiens
CNPCCRLTW

SEQ ID NO: 221348 - protein, 9 aa, Homo Sapiens
ARIPWKGHN

SEQ ID NO: 221349 - protein, 9 aa, Homo Sapiens
EYCRNSSKN

SEQ ID NO: 221350 - protein, 9 aa, Homo Sapiens
NRGDDTPCI

SEQ ID NO: 221351 - protein, 9 aa, Homo Sapiens
GMVTGAGAT

SEQ ID NO: 221352 - protein, 9 aa, Homo Sapiens
LRCIANSNP

SEQ ID NO: 221353 - protein, 9 aa, Homo Sapiens
YVTSDDELI

SEQ ID NO: 221354 - protein, 9 aa, Homo Sapiens
FGGKQEDVY

SEQ ID NO: 221355 - protein, 9 aa, Homo Sapiens
GSYRKLFES

SEQ ID NO: 221356 - protein, 9 aa, Homo Sapiens
MDHKPLVLQ

SEQ ID NO: 221357 - protein, 9 aa, Homo Sapiens
STHCPLTTP

SEQ ID NO: 221358 - protein, 9 aa, Homo Sapiens
RCESAAWTR

SEQ ID NO: 221359 - protein, 9 aa, Homo Sapiens
VVEMLGHKY

SEQ ID NO: 221360 - protein, 9 aa, Homo Sapiens
CTLIKPFLK

SEQ ID NO: 221361 - protein, 9 aa, Homo Sapiens
LWPGLRDWL

SEQ ID NO: 221362 - protein, 9 aa, Homo Sapiens
ASRAVEGML

SEQ ID NO: 221363 - protein, 9 aa, Homo Sapiens
GPELYQRAI

SEQ ID NO: 221364 - protein, 9 aa, Homo Sapiens
NTLDRYGRT

SEQ ID NO: 221365 - protein, 9 aa, Homo Sapiens
CGGWLRRHM

SEQ ID NO: 221366 - protein, 9 aa, Homo Sapiens
KVMSNSPQN

SEQ ID NO: 221367 - protein, 9 aa, Homo Sapiens
IFCASNGIH

SEQ ID NO: 221368 - protein, 9 aa, Homo Sapiens
GSISSGISY

SEQ ID NO: 221369 - protein, 9 aa, Homo Sapiens
YSESKRIMR

SEQ ID NO: 221370 - protein, 9 aa, Homo Sapiens
TFLCQEKYQ

SEQ ID NO: 221371 - protein, 9 aa, Homo Sapiens
NSWAIGVLW

SEQ ID NO: 221372 - protein, 9 aa, Homo Sapiens
VKESQRMSG

SEQ ID NO: 221373 - protein, 9 aa, Homo Sapiens
RNCTAALCR

SEQ ID NO: 221374 - protein, 9 aa, Homo Sapiens
SATAATGPG

SEQ ID NO: 221375 - protein, 9 aa, Homo Sapiens
SWTEKKQCR

SEQ ID NO: 221376 - protein, 9 aa, Homo Sapiens
LDVCCGTST

SEQ ID NO: 221377 - protein, 9 aa, Homo Sapiens
EKEAQKKGR

SEQ ID NO: 221378 - protein, 9 aa, Homo Sapiens
SKPQFPHLN

SEQ ID NO: 221379 - protein, 9 aa, Homo Sapiens
YLISAQSLL

SEQ ID NO: 221380 - protein, 9 aa, Homo Sapiens
TGTRRRRPP

SEQ ID NO: 221381 - protein, 9 aa, Homo Sapiens
APPIAPPGM

SEQ ID NO: 221382 - protein, 9 aa, Homo Sapiens
CSTAATAST

SEQ ID NO: 221383 - protein, 9 aa, Homo Sapiens
LQCQSLALP

SEQ ID NO: 221384 - protein, 9 aa, Homo Sapiens
PVLSTSSFC

SEQ ID NO: 221385 - protein, 9 aa, Homo Sapiens
AWQGNVKVV

SEQ ID NO: 221386 - protein, 9 aa, Homo Sapiens
RLTLAGMGT

SEQ ID NO: 221387 - protein, 9 aa, Homo Sapiens
RSFYLIIQV

SEQ ID NO: 221388 - protein, 9 aa, Homo Sapiens
FLGIFSGCF

SEQ ID NO: 221389 - protein, 9 aa, Homo Sapiens
LRTASQHSN

SEQ ID NO: 221390 - protein, 9 aa, Homo Sapiens
GNPTRSSRL

SEQ ID NO: 221391 - protein, 9 aa, Homo Sapiens
LNLTASENT

SEQ ID NO: 221392 - protein, 9 aa, Homo Sapiens
DGEEWKKSQ

SEQ ID NO: 221393 - protein, 9 aa, Homo Sapiens
VRDLKKKLL

SEQ ID NO: 221394 - protein, 9 aa, Homo Sapiens
TMCPAPWWS

SEQ ID NO: 221395 - protein, 9 aa, Homo Sapiens
CGSGPSRCR

SEQ ID NO: 221396 - protein, 9 aa, Homo Sapiens
QDTFALASH

SEQ ID NO: 221397 - protein, 9 aa, Homo Sapiens
GQSQPCVDV

SEQ ID NO: 221398 - protein, 9 aa, Homo Sapiens
SYGRRRSRA

SEQ ID NO: 221399 - protein, 9 aa, Homo Sapiens
TGQDVGRSC

SEQ ID NO: 221400 - protein, 9 aa, Homo Sapiens
LHYAISEGF

SEQ ID NO: 221401 - protein, 9 aa, Homo Sapiens
NQVDPNGSR

SEQ ID NO: 221402 - protein, 9 aa, Homo Sapiens
GPRGLGSQR

SEQ ID NO: 221403 - protein, 9 aa, Homo Sapiens
GTGAQRVCC

SEQ ID NO: 221404 - protein, 9 aa, Homo Sapiens
VFQWLHSTA

SEQ ID NO: 221405 - protein, 9 aa, Homo Sapiens
ILVSTYRPL

SEQ ID NO: 221406 - protein, 9 aa, Homo Sapiens
SSDEDLIKV

SEQ ID NO: 221407 - protein, 9 aa, Homo Sapiens
RRHCWWPTG

SEQ ID NO: 221408 - protein, 9 aa, Homo Sapiens
RRARMFARH

SEQ ID NO: 221409 - protein, 9 aa, Homo Sapiens
ALAFSAPQG

SEQ ID NO: 221410 - protein, 9 aa, Homo Sapiens
KHYHPSCVL

SEQ ID NO: 221411 - protein, 9 aa, Homo Sapiens
TPTSALALP

SEQ ID NO: 221412 - protein, 9 aa, Homo Sapiens
WGQHTGQPQ

SEQ ID NO: 221413 - protein, 9 aa, Homo Sapiens
VLQSFRLLR

SEQ ID NO: 221414 - protein, 9 aa, Homo Sapiens
GSIASWELW

SEQ ID NO: 221415 - protein, 9 aa, Homo Sapiens
WRRWCWRCP

SEQ ID NO: 221416 - protein, 9 aa, Homo Sapiens
CLAREKQMR

SEQ ID NO: 221417 - protein, 9 aa, Homo Sapiens
LWAALATRV

SEQ ID NO: 221418 - protein, 9 aa, Homo Sapiens
SLDVKPMRK

SEQ ID NO: 221419 - protein, 9 aa, Homo Sapiens
AAVKTYSWQ

SEQ ID NO: 221420 - protein, 9 aa, Homo Sapiens
EVHFVFSRL

SEQ ID NO: 221421 - protein, 9 aa, Homo Sapiens
RIYKNLHIL

SEQ ID NO: 221422 - protein, 9 aa, Homo Sapiens
GKTSSAHSS

SEQ ID NO: 221423 - protein, 9 aa, Homo Sapiens
ILTEKTITV

SEQ ID NO: 221424 - protein, 9 aa, Homo Sapiens
VIDTIVRIA

SEQ ID NO: 221425 - protein, 9 aa, Homo Sapiens
VLESWGQRP

SEQ ID NO: 221426 - protein, 9 aa, Homo Sapiens
DASARRREI

SEQ ID NO: 221427 - protein, 9 aa, Homo Sapiens
TWNMGNAPL

SEQ ID NO: 221428 - protein, 9 aa, Homo Sapiens
RKLSMDVNL

SEQ ID NO: 221429 - protein, 9 aa, Homo Sapiens
SSEIQLKAY

SEQ ID NO: 221430 - protein, 9 aa, Homo Sapiens
VPGNPSKEA

SEQ ID NO: 221431 - protein, 9 aa, Homo Sapiens
WDLSGSRFG

SEQ ID NO: 221432 - protein, 9 aa, Homo Sapiens
VARDHVFSF

SEQ ID NO: 221433 - protein, 9 aa, Homo Sapiens
GLLCDPGVP

SEQ ID NO: 221434 - protein, 9 aa, Homo Sapiens
ERNLTSVMS

SEQ ID NO: 221435 - protein, 9 aa, Homo Sapiens
MAAVKTYSW

SEQ ID NO: 221436 - protein, 9 aa, Homo Sapiens
LLPPPRLAP

SEQ ID NO: 221437 - protein, 9 aa, Homo Sapiens
VLELTCADT

SEQ ID NO: 221438 - protein, 9 aa, Homo Sapiens
YKTFWNHML

SEQ ID NO: 221439 - protein, 9 aa, Homo Sapiens
YLYAMTGKQ

SEQ ID NO: 221440 - protein, 9 aa, Homo Sapiens
IDSLIDTFM

SEQ ID NO: 221441 - protein, 9 aa, Homo Sapiens
PLIDFCDAP

SEQ ID NO: 221442 - protein, 9 aa, Homo Sapiens
ALALPHLPV

SEQ ID NO: 221443 - protein, 9 aa, Homo Sapiens
TLYKHDDTA

SEQ ID NO: 221444 - protein, 9 aa, Homo Sapiens
DGPPFVELL

SEQ ID NO: 221445 - protein, 9 aa, Homo Sapiens
YTRTCGPWA

SEQ ID NO: 221446 - protein, 9 aa, Homo Sapiens
QLSEMKSHI

SEQ ID NO: 221447 - protein, 9 aa, Homo Sapiens
YCLTKIYQL

SEQ ID NO: 221448 - protein, 9 aa, Homo Sapiens
VVDTGLFIS

SEQ ID NO: 221449 - protein, 9 aa, Homo Sapiens
EVHKARSGK

SEQ ID NO: 221450 - protein, 9 aa, Homo Sapiens
LLPPPPLLG

SEQ ID NO: 221451 - protein, 9 aa, Homo Sapiens
SHSPPSLAL

SEQ ID NO: 221452 - protein, 9 aa, Homo Sapiens
TLNRTLLVV

SEQ ID NO: 221453 - protein, 9 aa, Homo Sapiens
TRNPRQPAT

SEQ ID NO: 221454 - protein, 9 aa, Homo Sapiens
ADMAITMAL

SEQ ID NO: 221455 - protein, 9 aa, Homo Sapiens
FVELKTVRL

SEQ ID NO: 221456 - protein, 9 aa, Homo Sapiens
ESGSKLLEI

SEQ ID NO: 221457 - protein, 9 aa, Homo Sapiens
PAEDERRRA

SEQ ID NO: 221458 - protein, 9 aa, Homo Sapiens
NIVGIPSAF

SEQ ID NO: 221459 - protein, 9 aa, Homo Sapiens
GLLPSPPLP

SEQ ID NO: 221460 - protein, 9 aa, Homo Sapiens
LEEEGVLIM

SEQ ID NO: 221461 - protein, 9 aa, Homo Sapiens
LPRLGCPVS

SEQ ID NO: 221462 - protein, 9 aa, Homo Sapiens
LNPAAQDGA

SEQ ID NO: 221463 - protein, 9 aa, Homo Sapiens
APAEVHKAR

SEQ ID NO: 221464 - protein, 9 aa, Homo Sapiens
ALLDAEPPY

SEQ ID NO: 221465 - protein, 9 aa, Homo Sapiens
MLAKLYEAD

SEQ ID NO: 221466 - protein, 9 aa, Homo Sapiens
AEIFHSVDA

SEQ ID NO: 221467 - protein, 9 aa, Homo Sapiens
GLKVTLTQG

SEQ ID NO: 221468 - protein, 9 aa, Homo Sapiens
DQWLKCQDS

SEQ ID NO: 221469 - protein, 9 aa, Homo Sapiens
VYGNGYSNA

SEQ ID NO: 221470 - protein, 9 aa, Homo Sapiens
LDLSLNFGR

SEQ ID NO: 221471 - protein, 9 aa, Homo Sapiens
KPISKAPEA

SEQ ID NO: 221472 - protein, 9 aa, Homo Sapiens
PSVWNASRP

SEQ ID NO: 221473 - protein, 9 aa, Homo Sapiens
FGYRCALPN

SEQ ID NO: 221474 - protein, 9 aa, Homo Sapiens
NNISINKVN

SEQ ID NO: 221475 - protein, 9 aa, Homo Sapiens
QGCVQVTFS

SEQ ID NO: 221476 - protein, 9 aa, Homo Sapiens
LCEGPEHLT

SEQ ID NO: 221477 - protein, 9 aa, Homo Sapiens
SQRFPPPLM

SEQ ID NO: 221478 - protein, 9 aa, Homo Sapiens
IGCGFGGPG

SEQ ID NO: 221479 - protein, 9 aa, Homo Sapiens
RPREEDNAA

SEQ ID NO: 221480 - protein, 9 aa, Homo Sapiens
ERSWAASRR

SEQ ID NO: 221481 - protein, 9 aa, Homo Sapiens
GCVLNQLLF

SEQ ID NO: 221482 - protein, 9 aa, Homo Sapiens
DPDAVVASS

SEQ ID NO: 221483 - protein, 9 aa, Homo Sapiens
DQEVCMLFK

SEQ ID NO: 221484 - protein, 9 aa, Homo Sapiens
GEDAPRAVF

SEQ ID NO: 221485 - protein, 9 aa, Homo Sapiens
PAAPTSACS

SEQ ID NO: 221486 - protein, 9 aa, Homo Sapiens
SPPVRSTVC

SEQ ID NO: 221487 - protein, 9 aa, Homo Sapiens
CANNSDTLE

SEQ ID NO: 221488 - protein, 9 aa, Homo Sapiens
KVLIKLPDN

SEQ ID NO: 221489 - protein, 9 aa, Homo Sapiens
LKKLKTFHM

SEQ ID NO: 221490 - protein, 9 aa, Homo Sapiens
GFEELTSTR

SEQ ID NO: 221491 - protein, 9 aa, Homo Sapiens
PPHRCCLPC

SEQ ID NO: 221492 - protein, 9 aa, Homo Sapiens
LLGESMTSP

SEQ ID NO: 221493 - protein, 9 aa, Homo Sapiens
TLREFMKHR

SEQ ID NO: 221494 - protein, 9 aa, Homo Sapiens
QNPWLRQKP

SEQ ID NO: 221495 - protein, 9 aa, Homo Sapiens
KGVDVGLYI

SEQ ID NO: 221496 - protein, 9 aa, Homo Sapiens
ELGIKAGPR

SEQ ID NO: 221497 - protein, 9 aa, Homo Sapiens
RGPRLSQVA

SEQ ID NO: 221498 - protein, 9 aa, Homo Sapiens
ACWLRPEDG

SEQ ID NO: 221499 - protein, 9 aa, Homo Sapiens
VSTRSLLRV

SEQ ID NO: 221500 - protein, 9 aa, Homo Sapiens
WTEGCGSPK

SEQ ID NO: 221501 - protein, 9 aa, Homo Sapiens
IGKILKVNM

SEQ ID NO: 221502 - protein, 9 aa, Homo Sapiens
RWSWAMGSR

SEQ ID NO: 221503 - protein, 9 aa, Homo Sapiens
MECQKPEPL

SEQ ID NO: 221504 - protein, 9 aa, Homo Sapiens
RGDPFCRLF

SEQ ID NO: 221505 - protein, 9 aa, Homo Sapiens
HGVSLLDPP

SEQ ID NO: 221506 - protein, 9 aa, Homo Sapiens
LSVSIDPRT

SEQ ID NO: 221507 - protein, 9 aa, Homo Sapiens
PVLDNAPRA

SEQ ID NO: 221508 - protein, 9 aa, Homo Sapiens
PETRKRLLS

SEQ ID NO: 221509 - protein, 9 aa, Homo Sapiens
KIHPLLKGV

SEQ ID NO: 221510 - protein, 9 aa, Homo Sapiens
QATQVRSSG

SEQ ID NO: 221511 - protein, 9 aa, Homo Sapiens
AGLVHGYRG

SEQ ID NO: 221512 - protein, 9 aa, Homo Sapiens
CKTWAQLEW

SEQ ID NO: 221513 - protein, 9 aa, Homo Sapiens
NPGPQDTVE

SEQ ID NO: 221514 - protein, 9 aa, Homo Sapiens
INTLPPIVN

SEQ ID NO: 221515 - protein, 9 aa, Homo Sapiens
YTLRIMSRG

SEQ ID NO: 221516 - protein, 9 aa, Homo Sapiens
GEEGAAWAP

SEQ ID NO: 221517 - protein, 9 aa, Homo Sapiens
SVFHTGWIS

SEQ ID NO: 221518 - protein, 9 aa, Homo Sapiens
CGRVCYLKK

SEQ ID NO: 221519 - protein, 9 aa, Homo Sapiens
VKDDKIRSL

SEQ ID NO: 221520 - protein, 9 aa, Homo Sapiens
PLLLPRRPQ

SEQ ID NO: 221521 - protein, 9 aa, Homo Sapiens
FVEEHMRST

SEQ ID NO: 221522 - protein, 9 aa, Homo Sapiens
NSPPPSPPS

SEQ ID NO: 221523 - protein, 9 aa, Homo Sapiens
TGNRLVRPR

SEQ ID NO: 221524 - protein, 9 aa, Homo Sapiens
DVEQLVKCS

SEQ ID NO: 221525 - protein, 9 aa, Homo Sapiens
IRYRVVALK

SEQ ID NO: 221526 - protein, 9 aa, Homo Sapiens
RRGQLGAEV

SEQ ID NO: 221527 - protein, 9 aa, Homo Sapiens
TELQSELLS

SEQ ID NO: 221528 - protein, 9 aa, Homo Sapiens
HPGCQGTRR

SEQ ID NO: 221529 - protein, 9 aa, Homo Sapiens
NHRDSEYIF

SEQ ID NO: 221530 - protein, 9 aa, Homo Sapiens
EGVVFPCQP

SEQ ID NO: 221531 - protein, 9 aa, Homo Sapiens
LIPLLGDQL

SEQ ID NO: 221532 - protein, 9 aa, Homo Sapiens
YGYTYCVWF

SEQ ID NO: 221533 - protein, 9 aa, Homo Sapiens
LMGLGGCRD

SEQ ID NO: 221534 - protein, 9 aa, Homo Sapiens
GSHHQGVGS

SEQ ID NO: 221535 - protein, 9 aa, Homo Sapiens
MRNLHFHIL

SEQ ID NO: 221536 - protein, 9 aa, Homo Sapiens
KPPMPTGLR

SEQ ID NO: 221537 - protein, 9 aa, Homo Sapiens
SRKSTPFTG

SEQ ID NO: 221538 - protein, 9 aa, Homo Sapiens
TTSNEGSKA

SEQ ID NO: 221539 - protein, 9 aa, Homo Sapiens
AITMDERVW

SEQ ID NO: 221540 - protein, 9 aa, Homo Sapiens
VLQGRPELS

SEQ ID NO: 221541 - protein, 9 aa, Homo Sapiens
KESPCGLSF

SEQ ID NO: 221542 - protein, 9 aa, Homo Sapiens
KPIHSWVLQ

SEQ ID NO: 221543 - protein, 9 aa, Homo Sapiens
PDLGTQCLV

SEQ ID NO: 221544 - protein, 9 aa, Homo Sapiens
TARLWYKTF

SEQ ID NO: 221545 - protein, 9 aa, Homo Sapiens
RRMFPPSRC

SEQ ID NO: 221546 - protein, 9 aa, Homo Sapiens
PFVELLLNF

SEQ ID NO: 221547 - protein, 9 aa, Homo Sapiens
LAIALHLRR

SEQ ID NO: 221548 - protein, 9 aa, Homo Sapiens
RLKVFSRDG

SEQ ID NO: 221549 - protein, 9 aa, Homo Sapiens
LVPLFIWTP

SEQ ID NO: 221550 - protein, 9 aa, Homo Sapiens
TLFYGMGFG

SEQ ID NO: 221551 - protein, 9 aa, Homo Sapiens
QRIHTGETP

SEQ ID NO: 221552 - protein, 9 aa, Homo Sapiens
FAHPRQLRW

SEQ ID NO: 221553 - protein, 9 aa, Homo Sapiens
GKQNSKLWP

SEQ ID NO: 221554 - protein, 9 aa, Homo Sapiens
CNECGKVLI

SEQ ID NO: 221555 - protein, 9 aa, Homo Sapiens
KRAEAITWL

SEQ ID NO: 221556 - protein, 9 aa, Homo Sapiens
NDRNGDFSE

SEQ ID NO: 221557 - protein, 9 aa, Homo Sapiens
PSRGSRCLY

SEQ ID NO: 221558 - protein, 9 aa, Homo Sapiens
PRSQHLPPL

SEQ ID NO: 221559 - protein, 9 aa, Homo Sapiens
LGSQPIYRS

SEQ ID NO: 221560 - protein, 9 aa, Homo Sapiens
WNDEARVEG

SEQ ID NO: 221561 - protein, 9 aa, Homo Sapiens
TFMGFITPA

SEQ ID NO: 221562 - protein, 9 aa, Homo Sapiens
PHHLVPLFI

SEQ ID NO: 221563 - protein, 9 aa, Homo Sapiens
KTGMAVNKP

SEQ ID NO: 221564 - protein, 9 aa, Homo Sapiens
MFQSSTLLF

SEQ ID NO: 221565 - protein, 9 aa, Homo Sapiens
GNFQRTTCH

SEQ ID NO: 221566 - protein, 9 aa, Homo Sapiens
RAFLDQPHM

SEQ ID NO: 221567 - protein, 9 aa, Homo Sapiens
MGFGVYLSS

SEQ ID NO: 221568 - protein, 9 aa, Homo Sapiens
DQLVGGQVG

SEQ ID NO: 221569 - protein, 9 aa, Homo Sapiens
SEDVIISKF

SEQ ID NO: 221570 - protein, 9 aa, Homo Sapiens
QMDDNNIQM

SEQ ID NO: 221571 - protein, 9 aa, Homo Sapiens
SRTGRPPKT

SEQ ID NO: 221572 - protein, 9 aa, Homo Sapiens
NSADNANFN

SEQ ID NO: 221573 - protein, 9 aa, Homo Sapiens
RLILPMKIP

SEQ ID NO: 221574 - protein, 9 aa, Homo Sapiens
CYSRMWALS

SEQ ID NO: 221575 - protein, 9 aa, Homo Sapiens
LMWTATECW

SEQ ID NO: 221576 - protein, 9 aa, Homo Sapiens
LTPLTTQSW

SEQ ID NO: 221577 - protein, 9 aa, Homo Sapiens
LTLPPTNAA

SEQ ID NO: 221578 - protein, 9 aa, Homo Sapiens
GANTTLCQG

SEQ ID NO: 221579 - protein, 9 aa, Homo Sapiens
GSWNYRQPV

SEQ ID NO: 221580 - protein, 9 aa, Homo Sapiens
SGIGCGFGG

SEQ ID NO: 221581 - protein, 9 aa, Homo Sapiens
NLFHLLLSH

SEQ ID NO: 221582 - protein, 9 aa, Homo Sapiens
NCQQQLPSI

SEQ ID NO: 221583 - protein, 9 aa, Homo Sapiens
CLKTSCFKL

SEQ ID NO: 221584 - protein, 9 aa, Homo Sapiens
AWRRWCWRC

SEQ ID NO: 221585 - protein, 9 aa, Homo Sapiens
LPPPQSSPF

SEQ ID NO: 221586 - protein, 9 aa, Homo Sapiens
VDMSLSCTL

SEQ ID NO: 221587 - protein, 9 aa, Homo Sapiens
KSTMMEKRK

SEQ ID NO: 221588 - protein, 9 aa, Homo Sapiens
AHKGKKNAP

SEQ ID NO: 221589 - protein, 9 aa, Homo Sapiens
RLECPISAR

SEQ ID NO: 221590 - protein, 9 aa, Homo Sapiens
PPWPTHLPS

SEQ ID NO: 221591 - protein, 9 aa, Homo Sapiens
LEAHRGDAG

SEQ ID NO: 221592 - protein, 9 aa, Homo Sapiens
FYLIIQVPR

SEQ ID NO: 221593 - protein, 9 aa, Homo Sapiens
IHDILDRIT

SEQ ID NO: 221594 - protein, 9 aa, Homo Sapiens
VTIHSFSGL

SEQ ID NO: 221595 - protein, 9 aa, Homo Sapiens
KAKFCIFSS

SEQ ID NO: 221596 - protein, 9 aa, Homo Sapiens
YSHLQRTHP

SEQ ID NO: 221597 - protein, 9 aa, Homo Sapiens
APGEPGLSG

SEQ ID NO: 221598 - protein, 9 aa, Homo Sapiens
GRRSGGRMR

SEQ ID NO: 221599 - protein, 9 aa, Homo Sapiens
YREVCQQGG

SEQ ID NO: 221600 - protein, 9 aa, Homo Sapiens
TSALALPHL

SEQ ID NO: 221601 - protein, 9 aa, Homo Sapiens
RQGTVAGYD

SEQ ID NO: 221602 - protein, 9 aa, Homo Sapiens
SCNGTQVPQ

SEQ ID NO: 221603 - protein, 9 aa, Homo Sapiens
EQTVDVEPC

SEQ ID NO: 221604 - protein, 9 aa, Homo Sapiens
RIELKAKVF

SEQ ID NO: 221605 - protein, 9 aa, Homo Sapiens
RPRPTSQCH

SEQ ID NO: 221606 - protein, 9 aa, Homo Sapiens
GAPRALQAG

SEQ ID NO: 221607 - protein, 9 aa, Homo Sapiens
LSITKIHQS

SEQ ID NO: 221608 - protein, 9 aa, Homo Sapiens
AGHCTSSSR

SEQ ID NO: 221609 - protein, 9 aa, Homo Sapiens
GVLDFFSRS

SEQ ID NO: 221610 - protein, 9 aa, Homo Sapiens
LRSGPCEMA

SEQ ID NO: 221611 - protein, 9 aa, Homo Sapiens
ITGAPCLAH

SEQ ID NO: 221612 - protein, 9 aa, Homo Sapiens
RIHALPDDL

SEQ ID NO: 221613 - protein, 9 aa, Homo Sapiens
QGISKKLTE

SEQ ID NO: 221614 - protein, 9 aa, Homo Sapiens
PCCRGSSKN

SEQ ID NO: 221615 - protein, 9 aa, Homo Sapiens
QVKKQSQLY

SEQ ID NO: 221616 - protein, 9 aa, Homo Sapiens
SAIPLPLPG

SEQ ID NO: 221617 - protein, 9 aa, Homo Sapiens
TLRACANSW

SEQ ID NO: 221618 - protein, 9 aa, Homo Sapiens
KVYTLQPLD

SEQ ID NO: 221619 - protein, 9 aa, Homo Sapiens
VHFVFSRLP

SEQ ID NO: 221620 - protein, 9 aa, Homo Sapiens
WRAFSQRSS

SEQ ID NO: 221621 - protein, 9 aa, Homo Sapiens
HFHTPHPTG

SEQ ID NO: 221622 - protein, 9 aa, Homo Sapiens
LAPQAHPGF

SEQ ID NO: 221623 - protein, 9 aa, Homo Sapiens
GSCPREEWE

SEQ ID NO: 221624 - protein, 9 aa, Homo Sapiens
EAESNIALR

SEQ ID NO: 221625 - protein, 9 aa, Homo Sapiens
DGTPPGCRS

SEQ ID NO: 221626 - protein, 9 aa, Homo Sapiens
LGIGFTLCR

SEQ ID NO: 221627 - protein, 9 aa, Homo Sapiens
CTALLNVPN

SEQ ID NO: 221628 - protein, 9 aa, Homo Sapiens
SHEPGSSSV

SEQ ID NO: 221629 - protein, 9 aa, Homo Sapiens
PSVTDAQVS

SEQ ID NO: 221630 - protein, 9 aa, Homo Sapiens
LASCARPAP

SEQ ID NO: 221631 - protein, 9 aa, Homo Sapiens
SVGVLARPQ

SEQ ID NO: 221632 - protein, 9 aa, Homo Sapiens
FASPRVVAA

SEQ ID NO: 221633 - protein, 9 aa, Homo Sapiens
SDTIYQIMH

SEQ ID NO: 221634 - protein, 9 aa, Homo Sapiens
FRLVVLCRV

SEQ ID NO: 221635 - protein, 9 aa, Homo Sapiens
VIGGVQPQS

SEQ ID NO: 221636 - protein, 9 aa, Homo Sapiens
LELDHHFFL

SEQ ID NO: 221637 - protein, 9 aa, Homo Sapiens
GKETNSGYS

SEQ ID NO: 221638 - protein, 9 aa, Homo Sapiens
RLPFVAQTS

SEQ ID NO: 221639 - protein, 9 aa, Homo Sapiens
DRSRGAMEE

SEQ ID NO: 221640 - protein, 9 aa, Homo Sapiens
ISRWDSPRK

SEQ ID NO: 221641 - protein, 9 aa, Homo Sapiens
PVGFLLIIS

SEQ ID NO: 221642 - protein, 9 aa, Homo Sapiens
LGQLHPRRR

SEQ ID NO: 221643 - protein, 9 aa, Homo Sapiens
ILQLVGDVV

SEQ ID NO: 221644 - protein, 9 aa, Homo Sapiens
TGIHLHSYQ

SEQ ID NO: 221645 - protein, 9 aa, Homo Sapiens
QCPPDGCYQ

SEQ ID NO: 221646 - protein, 9 aa, Homo Sapiens
TKKTQLLLF

SEQ ID NO: 221647 - protein, 9 aa, Homo Sapiens
NPYRMWPRG

SEQ ID NO: 221648 - protein, 9 aa, Homo Sapiens
SHAHGPSAR

SEQ ID NO: 221649 - protein, 9 aa, Homo Sapiens
PMPQLDPGS

SEQ ID NO: 221650 - protein, 9 aa, Homo Sapiens
TVAQTPSPV

SEQ ID NO: 221651 - protein, 9 aa, Homo Sapiens
TSLTGTTAA

SEQ ID NO: 221652 - protein, 9 aa, Homo Sapiens
PDVNHEYST

SEQ ID NO: 221653 - protein, 9 aa, Homo Sapiens
HIKSIAAAL

SEQ ID NO: 221654 - protein, 9 aa, Homo Sapiens
QSTEPGDEE

SEQ ID NO: 221655 - protein, 9 aa, Homo Sapiens
TSPYGGGHT

SEQ ID NO: 221656 - protein, 9 aa, Homo Sapiens
WRPLAQRPS

SEQ ID NO: 221657 - protein, 9 aa, Homo Sapiens
VREWPSQVV

SEQ ID NO: 221658 - protein, 9 aa, Homo Sapiens
AATLFLCKD

SEQ ID NO: 221659 - protein, 9 aa, Homo Sapiens
QFTPDREEW

SEQ ID NO: 221660 - protein, 9 aa, Homo Sapiens
TSLLKEEAH

SEQ ID NO: 221661 - protein, 9 aa, Homo Sapiens
NPNALFPPM

SEQ ID NO: 221662 - protein, 9 aa, Homo Sapiens
AQTGCMSIC

SEQ ID NO: 221663 - protein, 9 aa, Homo Sapiens
RSSRLRSWR

SEQ ID NO: 221664 - protein, 9 aa, Homo Sapiens
RTLEGCISV

SEQ ID NO: 221665 - protein, 9 aa, Homo Sapiens
GGCLPPEPG

SEQ ID NO: 221666 - protein, 9 aa, Homo Sapiens
AEKEPIFQK

SEQ ID NO: 221667 - protein, 9 aa, Homo Sapiens
TLSELHYDK

SEQ ID NO: 221668 - protein, 9 aa, Homo Sapiens
ATREKVVLV

SEQ ID NO: 221669 - protein, 9 aa, Homo Sapiens
ATGSSSSLS

SEQ ID NO: 221670 - protein, 9 aa, Homo Sapiens
IDIMATEMA

SEQ ID NO: 221671 - protein, 9 aa, Homo Sapiens
STQNVTVNV

SEQ ID NO: 221672 - protein, 9 aa, Homo Sapiens
TTEMISATD

SEQ ID NO: 221673 - protein, 9 aa, Homo Sapiens
DSKQAQLIV

SEQ ID NO: 221674 - protein, 9 aa, Homo Sapiens
ESATASQES

SEQ ID NO: 221675 - protein, 9 aa, Homo Sapiens
LHVGLRSGP

SEQ ID NO: 221676 - protein, 9 aa, Homo Sapiens
AEVWFNEKS

SEQ ID NO: 221677 - protein, 9 aa, Homo Sapiens
HKRKLESID

SEQ ID NO: 221678 - protein, 9 aa, Homo Sapiens
QSKGKIKEL

SEQ ID NO: 221679 - protein, 9 aa, Homo Sapiens
STHTSRNCT

SEQ ID NO: 221680 - protein, 9 aa, Homo Sapiens
EQSVDRSVH

SEQ ID NO: 221681 - protein, 9 aa, Homo Sapiens
VVPVSMGIA

SEQ ID NO: 221682 - protein, 9 aa, Homo Sapiens
DLKKKLLPW

SEQ ID NO: 221683 - protein, 9 aa, Homo Sapiens
LSSLSGILR

SEQ ID NO: 221684 - protein, 9 aa, Homo Sapiens
FAGLEGVIM

SEQ ID NO: 221685 - protein, 9 aa, Homo Sapiens
VPRSSTPSR

SEQ ID NO: 221686 - protein, 9 aa, Homo Sapiens
ENEDQEVCM

SEQ ID NO: 221687 - protein, 9 aa, Homo Sapiens
SAAGTLGES

SEQ ID NO: 221688 - protein, 9 aa, Homo Sapiens
SALSPDCRR

SEQ ID NO: 221689 - protein, 9 aa, Homo Sapiens
IIACLPLIT

SEQ ID NO: 221690 - protein, 9 aa, Homo Sapiens
GNIRKQKEK

SEQ ID NO: 221691 - protein, 9 aa, Homo Sapiens
SEREKSVRE

SEQ ID NO: 221692 - protein, 9 aa, Homo Sapiens
CPPGITGIC

SEQ ID NO: 221693 - protein, 9 aa, Homo Sapiens
VYVEPRELL

SEQ ID NO: 221694 - protein, 9 aa, Homo Sapiens
TRTSATCTW

SEQ ID NO: 221695 - protein, 9 aa, Homo Sapiens
GYNKGYKGL

SEQ ID NO: 221696 - protein, 9 aa, Homo Sapiens
ASSLSSSRT

SEQ ID NO: 221697 - protein, 9 aa, Homo Sapiens
APRKAPHCT

SEQ ID NO: 221698 - protein, 9 aa, Homo Sapiens
RGQLGAEVP

SEQ ID NO: 221699 - protein, 9 aa, Homo Sapiens
IGTAKLRLV

SEQ ID NO: 221700 - protein, 9 aa, Homo Sapiens
LMIEYSEPW

SEQ ID NO: 221701 - protein, 9 aa, Homo Sapiens
LGRPPRSSP

SEQ ID NO: 221702 - protein, 9 aa, Homo Sapiens
GDLLLNCCV

SEQ ID NO: 221703 - protein, 9 aa, Homo Sapiens
IDLYHSEEE

SEQ ID NO: 221704 - protein, 9 aa, Homo Sapiens
IHALPDDLV

SEQ ID NO: 221705 - protein, 9 aa, Homo Sapiens
DGEDMDLDD

SEQ ID NO: 221706 - protein, 9 aa, Homo Sapiens
VDAAKNYLL

SEQ ID NO: 221707 - protein, 9 aa, Homo Sapiens
AKWEEETTT

SEQ ID NO: 221708 - protein, 9 aa, Homo Sapiens
HTGGQERQG

SEQ ID NO: 221709 - protein, 9 aa, Homo Sapiens
KIEKASAQS

SEQ ID NO: 221710 - protein, 9 aa, Homo Sapiens
SAASAPSLV

SEQ ID NO: 221711 - protein, 9 aa, Homo Sapiens
NWDYRGLPL

SEQ ID NO: 221712 - protein, 9 aa, Homo Sapiens
GAAAAAAQC

SEQ ID NO: 221713 - protein, 9 aa, Homo Sapiens
WTRANARTR

SEQ ID NO: 221714 - protein, 9 aa, Homo Sapiens
LPCNLSLEV

SEQ ID NO: 221715 - protein, 9 aa, Homo Sapiens
ILERNHTNV

SEQ ID NO: 221716 - protein, 9 aa, Homo Sapiens
RSSSQRYPE

SEQ ID NO: 221717 - protein, 9 aa, Homo Sapiens
VQEGPGSGS

SEQ ID NO: 221718 - protein, 9 aa, Homo Sapiens
RFEPGKTSR

SEQ ID NO: 221719 - protein, 9 aa, Homo Sapiens
VASCPAPHR

SEQ ID NO: 221720 - protein, 9 aa, Homo Sapiens
PLSCPPPHR

SEQ ID NO: 221721 - protein, 9 aa, Homo Sapiens
GKGHGDVCK

SEQ ID NO: 221722 - protein, 9 aa, Homo Sapiens
VQPQSVLGR

SEQ ID NO: 221723 - protein, 9 aa, Homo Sapiens
GFFIQSNLQ

SEQ ID NO: 221724 - protein, 9 aa, Homo Sapiens
SAASPAGTA

SEQ ID NO: 221725 - protein, 9 aa, Homo Sapiens
IFLEGFCSP

SEQ ID NO: 221726 - protein, 9 aa, Homo Sapiens
HLSDFFSAQ

SEQ ID NO: 221727 - protein, 9 aa, Homo Sapiens
SLHPDGTKN

SEQ ID NO: 221728 - protein, 9 aa, Homo Sapiens
DRRRELYKA

SEQ ID NO: 221729 - protein, 9 aa, Homo Sapiens
ELSFDLDDV

SEQ ID NO: 221730 - protein, 9 aa, Homo Sapiens
RHTAGLKLT

SEQ ID NO: 221731 - protein, 9 aa, Homo Sapiens
AVTSNFQSL

SEQ ID NO: 221732 - protein, 9 aa, Homo Sapiens
STWPSNRLV

SEQ ID NO: 221733 - protein, 9 aa, Homo Sapiens
DYCVHNEST

SEQ ID NO: 221734 - protein, 9 aa, Homo Sapiens
DWVREWPSQ

SEQ ID NO: 221735 - protein, 9 aa, Homo Sapiens
ISGCSQEQS

SEQ ID NO: 221736 - protein, 9 aa, Homo Sapiens
RELFSTFVE

SEQ ID NO: 221737 - protein, 9 aa, Homo Sapiens
SFAAFQVVQ

SEQ ID NO: 221738 - protein, 9 aa, Homo Sapiens
QTSIEVSVK

SEQ ID NO: 221739 - protein, 9 aa, Homo Sapiens
SAITKRAEA

SEQ ID NO: 221740 - protein, 9 aa, Homo Sapiens
SFIHVHTPL

SEQ ID NO: 221741 - protein, 9 aa, Homo Sapiens
PRGLGSQRL

SEQ ID NO: 221742 - protein, 9 aa, Homo Sapiens
ASTSTAPTT

SEQ ID NO: 221743 - protein, 9 aa, Homo Sapiens
PKDIPAHEV

SEQ ID NO: 221744 - protein, 9 aa, Homo Sapiens
SLGDDPPGG

SEQ ID NO: 221745 - protein, 9 aa, Homo Sapiens
KRSKNLENF

SEQ ID NO: 221746 - protein, 9 aa, Homo Sapiens
GGRSSGRQC

SEQ ID NO: 221747 - protein, 9 aa, Homo Sapiens
RAQRRCQPH

SEQ ID NO: 221748 - protein, 9 aa, Homo Sapiens
LALCPSAPA

SEQ ID NO: 221749 - protein, 9 aa, Homo Sapiens
IPAGSPSTK

SEQ ID NO: 221750 - protein, 9 aa, Homo Sapiens
PAHARARAS

SEQ ID NO: 221751 - protein, 9 aa, Homo Sapiens
RRQEEMLNT

SEQ ID NO: 221752 - protein, 9 aa, Homo Sapiens
VLPVLMNIK

SEQ ID NO: 221753 - protein, 9 aa, Homo Sapiens
ILFLVLHFS

SEQ ID NO: 221754 - protein, 9 aa, Homo Sapiens
GASTCPNRS

SEQ ID NO: 221755 - protein, 9 aa, Homo Sapiens
SSSRTSAGC

SEQ ID NO: 221756 - protein, 9 aa, Homo Sapiens
DQIPKFAIA

SEQ ID NO: 221757 - protein, 9 aa, Homo Sapiens
GRRGSRRRP

SEQ ID NO: 221758 - protein, 9 aa, Homo Sapiens
TLSCPPRSS

SEQ ID NO: 221759 - protein, 9 aa, Homo Sapiens
WFLPWMAAC

SEQ ID NO: 221760 - protein, 9 aa, Homo Sapiens
SCWTPTPCS

SEQ ID NO: 221761 - protein, 9 aa, Homo Sapiens
TPSPRHKKV

SEQ ID NO: 221762 - protein, 9 aa, Homo Sapiens
VLSNSDFLV

SEQ ID NO: 221763 - protein, 9 aa, Homo Sapiens
EEMLNTEEA

SEQ ID NO: 221764 - protein, 9 aa, Homo Sapiens
SPNLPAWTL

SEQ ID NO: 221765 - protein, 9 aa, Homo Sapiens
VKFWTLTGR

SEQ ID NO: 221766 - protein, 9 aa, Homo Sapiens
DILNGGSSK

SEQ ID NO: 221767 - protein, 9 aa, Homo Sapiens
KCNECGKVL

SEQ ID NO: 221768 - protein, 9 aa, Homo Sapiens
LPTPPPGPQ

SEQ ID NO: 221769 - protein, 9 aa, Homo Sapiens
HHQQMGYPK

SEQ ID NO: 221770 - protein, 9 aa, Homo Sapiens
LGDQLVGGQ

SEQ ID NO: 221771 - protein, 9 aa, Homo Sapiens
WSPLSTTPW

SEQ ID NO: 221772 - protein, 9 aa, Homo Sapiens
KESFAPGTL

SEQ ID NO: 221773 - protein, 9 aa, Homo Sapiens
YDRDLSVRR

SEQ ID NO: 221774 - protein, 9 aa, Homo Sapiens
EEEEEEVVD

SEQ ID NO: 221775 - protein, 9 aa, Homo Sapiens
VLRTPQPSG

SEQ ID NO: 221776 - protein, 9 aa, Homo Sapiens
HVDQHEVRY

SEQ ID NO: 221777 - protein, 9 aa, Homo Sapiens
KKTIQNEAN

SEQ ID NO: 221778 - protein, 9 aa, Homo Sapiens
CLSWPARCD

SEQ ID NO: 221779 - protein, 9 aa, Homo Sapiens
VFLDYVNGS

SEQ ID NO: 221780 - protein, 9 aa, Homo Sapiens
VVDSFFVIF

SEQ ID NO: 221781 - protein, 9 aa, Homo Sapiens
PRILQASVA

SEQ ID NO: 221782 - protein, 9 aa, Homo Sapiens
SSFRSRNPE

SEQ ID NO: 221783 - protein, 9 aa, Homo Sapiens
NFQRTTCHS

SEQ ID NO: 221784 - protein, 9 aa, Homo Sapiens
AWQFLLKWS

SEQ ID NO: 221785 - protein, 9 aa, Homo Sapiens
LAQALEAEQ

SEQ ID NO: 221786 - protein, 9 aa, Homo Sapiens
FISAVLAAQ

SEQ ID NO: 221787 - protein, 9 aa, Homo Sapiens
EEEGVLIMF

SEQ ID NO: 221788 - protein, 9 aa, Homo Sapiens
TFRLVVLCF

SEQ ID NO: 221789 - protein, 9 aa, Homo Sapiens
KIFKEPILE

SEQ ID NO: 221790 - protein, 9 aa, Homo Sapiens
AQRAEPQQQ

SEQ ID NO: 221791 - protein, 9 aa, Homo Sapiens
STSPAAVVM

SEQ ID NO: 221792 - protein, 9 aa, Homo Sapiens
SIRGVMIVL

SEQ ID NO: 221793 - protein, 9 aa, Homo Sapiens
RRSGCVWLL

SEQ ID NO: 221794 - protein, 9 aa, Homo Sapiens
GCSGLPELF

SEQ ID NO: 221795 - protein, 9 aa, Homo Sapiens
PHSFLVKSK

SEQ ID NO: 221796 - protein, 9 aa, Homo Sapiens
ASQHSNSSG

SEQ ID NO: 221797 - protein, 9 aa, Homo Sapiens
ENTWNPVMK

SEQ ID NO: 221798 - protein, 9 aa, Homo Sapiens
KRRITPLSI

SEQ ID NO: 221799 - protein, 9 aa, Homo Sapiens
WLPRLTRER

SEQ ID NO: 221800 - protein, 9 aa, Homo Sapiens
RARRGEPVL

SEQ ID NO: 221801 - protein, 9 aa, Homo Sapiens
SHSFRTASV

SEQ ID NO: 221802 - protein, 9 aa, Homo Sapiens
SRVGVRWGA

SEQ ID NO: 221803 - protein, 9 aa, Homo Sapiens
VKSVFVDFL

SEQ ID NO: 221804 - protein, 9 aa, Homo Sapiens
ECYTKNEKT

SEQ ID NO: 221805 - protein, 9 aa, Homo Sapiens
RSPHRMRPL

SEQ ID NO: 221806 - protein, 9 aa, Homo Sapiens
LPEGVGPRD

SEQ ID NO: 221807 - protein, 9 aa, Homo Sapiens
NKPYIYRPT

SEQ ID NO: 221808 - protein, 9 aa, Homo Sapiens
LKHVLAHQP

SEQ ID NO: 221809 - protein, 9 aa, Homo Sapiens
SSEREILPE

SEQ ID NO: 221810 - protein, 9 aa, Homo Sapiens
PSATRANPG

SEQ ID NO: 221811 - protein, 9 aa, Homo Sapiens
TLVDIYREL

SEQ ID NO: 221812 - protein, 9 aa, Homo Sapiens
TVVGLLEVE

SEQ ID NO: 221813 - protein, 9 aa, Homo Sapiens
ALSKLNVEV

SEQ ID NO: 221814 - protein, 9 aa, Homo Sapiens
SLNSATIFG

SEQ ID NO: 221815 - protein, 9 aa, Homo Sapiens
SGSRAEPQA

SEQ ID NO: 221816 - protein, 9 aa, Homo Sapiens
LDTEELWLV

SEQ ID NO: 221817 - protein, 9 aa, Homo Sapiens
ASRSAASAP

SEQ ID NO: 221818 - protein, 9 aa, Homo Sapiens
KELAASLTL

SEQ ID NO: 221819 - protein, 9 aa, Homo Sapiens
TRGSSSRRV

SEQ ID NO: 221820 - protein, 9 aa, Homo Sapiens
SGIGDRSQH

SEQ ID NO: 221821 - protein, 9 aa, Homo Sapiens
LSLSGGAWS

SEQ ID NO: 221822 - protein, 9 aa, Homo Sapiens
SSPPLWAAL

SEQ ID NO: 221823 - protein, 9 aa, Homo Sapiens
VGFLLIIST

SEQ ID NO: 221824 - protein, 9 aa, Homo Sapiens
YICIERGQA

SEQ ID NO: 221825 - protein, 9 aa, Homo Sapiens
LLGLLKTHN

SEQ ID NO: 221826 - protein, 9 aa, Homo Sapiens
WYIHALCTL

SEQ ID NO: 221827 - protein, 9 aa, Homo Sapiens
KKYKIWMYV

SEQ ID NO: 221828 - protein, 9 aa, Homo Sapiens
VIPSNEDMQ

SEQ ID NO: 221829 - protein, 9 aa, Homo Sapiens
LLADPVAPT

SEQ ID NO: 221830 - protein, 9 aa, Homo Sapiens
TTPPRAEVS

SEQ ID NO: 221831 - protein, 9 aa, Homo Sapiens
KKTHPCTML

SEQ ID NO: 221832 - protein, 9 aa, Homo Sapiens
VKDRSADQA

SEQ ID NO: 221833 - protein, 9 aa, Homo Sapiens
PGGSVSTSQ

SEQ ID NO: 221834 - protein, 9 aa, Homo Sapiens
VVHTQLINP

SEQ ID NO: 221835 - protein, 9 aa, Homo Sapiens
VACGRTVYH

SEQ ID NO: 221836 - protein, 9 aa, Homo Sapiens
CAQPTVSTG

SEQ ID NO: 221837 - protein, 9 aa, Homo Sapiens
SVSIDPRTA

SEQ ID NO: 221838 - protein, 9 aa, Homo Sapiens
LACWLRPED

SEQ ID NO: 221839 - protein, 9 aa, Homo Sapiens
DKKVRRQWE

SEQ ID NO: 221840 - protein, 9 aa, Homo Sapiens
WGAAGVQEA

SEQ ID NO: 221841 - protein, 9 aa, Homo Sapiens
LVPMPVCVN

SEQ ID NO: 221842 - protein, 9 aa, Homo Sapiens
LALPHLPVA

SEQ ID NO: 221843 - protein, 9 aa, Homo Sapiens
APQDQHGDG

SEQ ID NO: 221844 - protein, 9 aa, Homo Sapiens
AGGRELEGR

SEQ ID NO: 221845 - protein, 9 aa, Homo Sapiens
VFPMTCKPP

SEQ ID NO: 221846 - protein, 9 aa, Homo Sapiens
IKHSDNAEL

SEQ ID NO: 221847 - protein, 9 aa, Homo Sapiens
IQKRSKKVS

SEQ ID NO: 221848 - protein, 9 aa, Homo Sapiens
SVTDAQVSN

SEQ ID NO: 221849 - protein, 9 aa, Homo Sapiens
CLVVLNQKF

SEQ ID NO: 221850 - protein, 9 aa, Homo Sapiens
TSVTSTSPR

SEQ ID NO: 221851 - protein, 9 aa, Homo Sapiens
CRDETRRAR

SEQ ID NO: 221852 - protein, 9 aa, Homo Sapiens
NPDPLLSCD

SEQ ID NO: 221853 - protein, 9 aa, Homo Sapiens
LVSYPRRSQ

SEQ ID NO: 221854 - protein, 9 aa, Homo Sapiens
ALKKLLSEE

SEQ ID NO: 221855 - protein, 9 aa, Homo Sapiens
DSRRTVPSG

SEQ ID NO: 221856 - protein, 9 aa, Homo Sapiens
PFLARSWNT

SEQ ID NO: 221857 - protein, 9 aa, Homo Sapiens
SQMHVEDPG

SEQ ID NO: 221858 - protein, 9 aa, Homo Sapiens
RKPHGVKRR

SEQ ID NO: 221859 - protein, 9 aa, Homo Sapiens
IRHLLLRRG

SEQ ID NO: 221860 - protein, 9 aa, Homo Sapiens
GTGIGVHPH

SEQ ID NO: 221861 - protein, 9 aa, Homo Sapiens
QLNKFESLE

SEQ ID NO: 221862 - protein, 9 aa, Homo Sapiens
IRWPSATTA

SEQ ID NO: 221863 - protein, 9 aa, Homo Sapiens
TVILYRSYC

SEQ ID NO: 221864 - protein, 9 aa, Homo Sapiens
MVFQSKDVP

SEQ ID NO: 221865 - protein, 9 aa, Homo Sapiens
GERSAEPPP

SEQ ID NO: 221866 - protein, 9 aa, Homo Sapiens
CKMYHPRAF

SEQ ID NO: 221867 - protein, 9 aa, Homo Sapiens
EVPRKYWEC

SEQ ID NO: 221868 - protein, 9 aa, Homo Sapiens
RAAAALRAV

SEQ ID NO: 221869 - protein, 9 aa, Homo Sapiens
WKIIKKKRS

SEQ ID NO: 221870 - protein, 9 aa, Homo Sapiens
WMQGISKKL

SEQ ID NO: 221871 - protein, 9 aa, Homo Sapiens
QNHSKCITE

SEQ ID NO: 221872 - protein, 9 aa, Homo Sapiens
MATESSSSV

SEQ ID NO: 221873 - protein, 9 aa, Homo Sapiens
APRTTAFCR

SEQ ID NO: 221874 - protein, 9 aa, Homo Sapiens
SRGSVQRYS

SEQ ID NO: 221875 - protein, 9 aa, Homo Sapiens
PVNPAPTTP

SEQ ID NO: 221876 - protein, 9 aa, Homo Sapiens
PRKYWECKH

SEQ ID NO: 221877 - protein, 9 aa, Homo Sapiens
LSCDSCVNS

SEQ ID NO: 221878 - protein, 9 aa, Homo Sapiens
CQAQDTAQR

SEQ ID NO: 221879 - protein, 9 aa, Homo Sapiens
NSHLDPPPP

SEQ ID NO: 221880 - protein, 9 aa, Homo Sapiens
PPPPLLGDQ

SEQ ID NO: 221881 - protein, 9 aa, Homo Sapiens
FILTSTNSD

SEQ ID NO: 221882 - protein, 9 aa, Homo Sapiens
GSFWCSCDT

SEQ ID NO: 221883 - protein, 9 aa, Homo Sapiens
PLPSIRGVM

SEQ ID NO: 221884 - protein, 9 aa, Homo Sapiens
RRRPESCHD

SEQ ID NO: 221885 - protein, 9 aa, Homo Sapiens
DQEEQLKLK

SEQ ID NO: 221886 - protein, 9 aa, Homo Sapiens
QQVSAHQEA

SEQ ID NO: 221887 - protein, 9 aa, Homo Sapiens
VPEHRCLPI

SEQ ID NO: 221888 - protein, 9 aa, Homo Sapiens
SGTSAQPLR

SEQ ID NO: 221889 - protein, 9 aa, Homo Sapiens
PVCEGTRVA

SEQ ID NO: 221890 - protein, 9 aa, Homo Sapiens
GSRGAETVH

SEQ ID NO: 221891 - protein, 9 aa, Homo Sapiens
PVMKMKRWM

SEQ ID NO: 221892 - protein, 9 aa, Homo Sapiens
NMLKFVENT

SEQ ID NO: 221893 - protein, 9 aa, Homo Sapiens
LSLQCQSLA

SEQ ID NO: 221894 - protein, 9 aa, Homo Sapiens
LAICKMYHP

SEQ ID NO: 221895 - protein, 9 aa, Homo Sapiens
ETVVVAVAT

SEQ ID NO: 221896 - protein, 9 aa, Homo Sapiens
RTARGVTAR

SEQ ID NO: 221897 - protein, 9 aa, Homo Sapiens
GVEAVITLL

SEQ ID NO: 221898 - protein, 9 aa, Homo Sapiens
EMALGPGRG

SEQ ID NO: 221899 - protein, 9 aa, Homo Sapiens
WACIAAAIT

SEQ ID NO: 221900 - protein, 9 aa, Homo Sapiens
RRRPPGRCR

SEQ ID NO: 221901 - protein, 9 aa, Homo Sapiens
GAEGWWQLL

SEQ ID NO: 221902 - protein, 9 aa, Homo Sapiens
WRSRHTICV

SEQ ID NO: 221903 - protein, 9 aa, Homo Sapiens
FQEKRIHFP

SEQ ID NO: 221904 - protein, 9 aa, Homo Sapiens
FLMVGIGLS

SEQ ID NO: 221905 - protein, 9 aa, Homo Sapiens
RWEELCEGP

SEQ ID NO: 221906 - protein, 9 aa, Homo Sapiens
EIIPQGVVM

SEQ ID NO: 221907 - protein, 9 aa, Homo Sapiens
SCVRTLTWT

SEQ ID NO: 221908 - protein, 9 aa, Homo Sapiens
TYEIIPQGV

SEQ ID NO: 221909 - protein, 9 aa, Homo Sapiens
LMINLYHLS

SEQ ID NO: 221910 - protein, 9 aa, Homo Sapiens
DNFQYVGVS

SEQ ID NO: 221911 - protein, 9 aa, Homo Sapiens
LISSPNNAG

SEQ ID NO: 221912 - protein, 9 aa, Homo Sapiens
SGCFAMGAA

SEQ ID NO: 221913 - protein, 9 aa, Homo Sapiens
PLPQAQVEW

SEQ ID NO: 221914 - protein, 9 aa, Homo Sapiens
AASCSQTVT

SEQ ID NO: 221915 - protein, 9 aa, Homo Sapiens
PWCLSCSLT

SEQ ID NO: 221916 - protein, 9 aa, Homo Sapiens
PVSCRSTSS

SEQ ID NO: 221917 - protein, 9 aa, Homo Sapiens
TPLRRQLAS

SEQ ID NO: 221918 - protein, 9 aa, Homo Sapiens
CCDAGNEEI

SEQ ID NO: 221919 - protein, 9 aa, Homo Sapiens
GCIIVADSR

SEQ ID NO: 221920 - protein, 9 aa, Homo Sapiens
APVSQHPGS

SEQ ID NO: 221921 - protein, 9 aa, Homo Sapiens
QSPCRLRML

SEQ ID NO: 221922 - protein, 9 aa, Homo Sapiens
AVILAIALH

SEQ ID NO: 221923 - protein, 9 aa, Homo Sapiens
GRRNPPPRG

SEQ ID NO: 221924 - protein, 9 aa, Homo Sapiens
DFHPEENAR

SEQ ID NO: 221925 - protein, 9 aa, Homo Sapiens
MSYAPRHVT

SEQ ID NO: 221926 - protein, 9 aa, Homo Sapiens
SVPCPNLLP

SEQ ID NO: 221927 - protein, 9 aa, Homo Sapiens
HDFHPEENA

SEQ ID NO: 221928 - protein, 9 aa, Homo Sapiens
GIDRRSLAP

SEQ ID NO: 221929 - protein, 9 aa, Homo Sapiens
LQDLCWELH

SEQ ID NO: 221930 - protein, 9 aa, Homo Sapiens
YRVVALKQA

SEQ ID NO: 221931 - protein, 9 aa, Homo Sapiens
RHMIPETNS

SEQ ID NO: 221932 - protein, 9 aa, Homo Sapiens
FQYVGVSAD

SEQ ID NO: 221933 - protein, 9 aa, Homo Sapiens
ALGEVIRGQ

SEQ ID NO: 221934 - protein, 9 aa, Homo Sapiens
EATQAEAAA

SEQ ID NO: 221935 - protein, 9 aa, Homo Sapiens
QVYVATTSP

SEQ ID NO: 221936 - protein, 9 aa, Homo Sapiens
EKLDPDATQ

SEQ ID NO: 221937 - protein, 9 aa, Homo Sapiens
GGRARPRAR

SEQ ID NO: 221938 - protein, 9 aa, Homo Sapiens
QWSPATGPT

SEQ ID NO: 221939 - protein, 9 aa, Homo Sapiens
SALAFSAPQ

SEQ ID NO: 221940 - protein, 9 aa, Homo Sapiens
TRPLWSRLS

SEQ ID NO: 221941 - protein, 9 aa, Homo Sapiens
GRGAPRHPH

SEQ ID NO: 221942 - protein, 9 aa, Homo Sapiens
ISNSHYALE

SEQ ID NO: 221943 - protein, 9 aa, Homo Sapiens
QKEKITKIL

SEQ ID NO: 221944 - protein, 9 aa, Homo Sapiens
MHSCWHELP

SEQ ID NO: 221945 - protein, 9 aa, Homo Sapiens
IVQGHYREF

SEQ ID NO: 221946 - protein, 9 aa, Homo Sapiens
PASASGDNS

SEQ ID NO: 221947 - protein, 9 aa, Homo Sapiens
LLLLIVLCA

SEQ ID NO: 221948 - protein, 9 aa, Homo Sapiens
FTYLTTLTD

SEQ ID NO: 221949 - protein, 9 aa, Homo Sapiens
WSTVAQTPS

SEQ ID NO: 221950 - protein, 9 aa, Homo Sapiens
DHPRILQAS

SEQ ID NO: 221951 - protein, 9 aa, Homo Sapiens
ASLNDCHEE

SEQ ID NO: 221952 - protein, 9 aa, Homo Sapiens
MAITMALMG

SEQ ID NO: 221953 - protein, 9 aa, Homo Sapiens
LLVVEHVPA

SEQ ID NO: 221954 - protein, 9 aa, Homo Sapiens
NKALFIKEW

SEQ ID NO: 221955 - protein, 9 aa, Homo Sapiens
VLFRPCLCL

SEQ ID NO: 221956 - protein, 9 aa, Homo Sapiens
TGMAVNKPA

SEQ ID NO: 221957 - protein, 9 aa, Homo Sapiens
GQNDADIND

SEQ ID NO: 221958 - protein, 9 aa, Homo Sapiens
NTNVQMVDS

SEQ ID NO: 221959 - protein, 9 aa, Homo Sapiens
LWGSHLTFN

SEQ ID NO: 221960 - protein, 9 aa, Homo Sapiens
VQFGEVELS

SEQ ID NO: 221961 - protein, 9 aa, Homo Sapiens
GSVDQYLGV

SEQ ID NO: 221962 - protein, 9 aa, Homo Sapiens
QTVALKHML

SEQ ID NO: 221963 - protein, 9 aa, Homo Sapiens
RLTHSCSRP

SEQ ID NO: 221964 - protein, 9 aa, Homo Sapiens
SDSLQLEVQ

SEQ ID NO: 221965 - protein, 9 aa, Homo Sapiens
AWDIRDYVL

SEQ ID NO: 221966 - protein, 9 aa, Homo Sapiens
QAIIGSGMG

SEQ ID NO: 221967 - protein, 9 aa, Homo Sapiens
DVMEIRKET

SEQ ID NO: 221968 - protein, 9 aa, Homo Sapiens
VVLCFLSAL

SEQ ID NO: 221969 - protein, 9 aa, Homo Sapiens
HYREFCQCD

SEQ ID NO: 221970 - protein, 9 aa, Homo Sapiens
RANARTRAW

SEQ ID NO: 221971 - protein, 9 aa, Homo Sapiens
TRPRPTSQC

SEQ ID NO: 221972 - protein, 9 aa, Homo Sapiens
FAPDELRTA

SEQ ID NO: 221973 - protein, 9 aa, Homo Sapiens
PHVTWSSAL

SEQ ID NO: 221974 - protein, 9 aa, Homo Sapiens
SLSVTLVDI

SEQ ID NO: 221975 - protein, 9 aa, Homo Sapiens
SALDCFSFQ

SEQ ID NO: 221976 - protein, 9 aa, Homo Sapiens
NQILKDIGE

SEQ ID NO: 221977 - protein, 9 aa, Homo Sapiens
RMTVRDIEK

SEQ ID NO: 221978 - protein, 9 aa, Homo Sapiens
KRREKKRHC

SEQ ID NO: 221979 - protein, 9 aa, Homo Sapiens
SGALSIRET

SEQ ID NO: 221980 - protein, 9 aa, Homo Sapiens
VAQVESEVG

SEQ ID NO: 221981 - protein, 9 aa, Homo Sapiens
HFIVEGSPG

SEQ ID NO: 221982 - protein, 9 aa, Homo Sapiens
RGHPRTGRH

SEQ ID NO: 221983 - protein, 9 aa, Homo Sapiens
PQNGPQWQV

SEQ ID NO: 221984 - protein, 9 aa, Homo Sapiens
ISTLVLDVS

SEQ ID NO: 221985 - protein, 9 aa, Homo Sapiens
TLKALVKTW

SEQ ID NO: 221986 - protein, 9 aa, Homo Sapiens
EGHLEGLGP

SEQ ID NO: 221987 - protein, 9 aa, Homo Sapiens
LKALVKTWT

SEQ ID NO: 221988 - protein, 9 aa, Homo Sapiens
LKLILVMLE

SEQ ID NO: 221989 - protein, 9 aa, Homo Sapiens
STPPSRPRT

SEQ ID NO: 221990 - protein, 9 aa, Homo Sapiens
REGINIFWM

SEQ ID NO: 221991 - protein, 9 aa, Homo Sapiens
GELSSEVED

SEQ ID NO: 221992 - protein, 9 aa, Homo Sapiens
MTNGPLTFH

SEQ ID NO: 221993 - protein, 9 aa, Homo Sapiens
KTRVSSLPR

SEQ ID NO: 221994 - protein, 9 aa, Homo Sapiens
TTPWTRANA

SEQ ID NO: 221995 - protein, 9 aa, Homo Sapiens
RGCTTSASM

SEQ ID NO: 221996 - protein, 9 aa, Homo Sapiens
RQSAADILS

SEQ ID NO: 221997 - protein, 9 aa, Homo Sapiens
TGLLIENIC

SEQ ID NO: 221998 - protein, 9 aa, Homo Sapiens
LGFCIHVKH

SEQ ID NO: 221999 - protein, 9 aa, Homo Sapiens
GPAGWARQA

SEQ ID NO: 222000 - protein, 9 aa, Homo Sapiens
LKSLHQFQV

SEQ ID NO: 222001 - protein, 9 aa, Homo Sapiens
QTLSLMIRK

SEQ ID NO: 222002 - protein, 9 aa, Homo Sapiens
PRRRKWGMT

SEQ ID NO: 222003 - protein, 9 aa, Homo Sapiens
HGEDVEHVL

SEQ ID NO: 222004 - protein, 9 aa, Homo Sapiens
EPILEILDE

SEQ ID NO: 222005 - protein, 9 aa, Homo Sapiens
CQCRCITDS

SEQ ID NO: 222006 - protein, 9 aa, Homo Sapiens
LQTGEPFSQ

SEQ ID NO: 222007 - protein, 9 aa, Homo Sapiens
CKCLLWKRK

SEQ ID NO: 222008 - protein, 9 aa, Homo Sapiens
LPALLGFRL

SEQ ID NO: 222009 - protein, 9 aa, Homo Sapiens
DKKENKKKK

SEQ ID NO: 222010 - protein, 9 aa, Homo Sapiens
LGAGVLAAG

SEQ ID NO: 222011 - protein, 9 aa, Homo Sapiens
KRQKRCMRH

SEQ ID NO: 222012 - protein, 9 aa, Homo Sapiens
AAWGSLCTL

SEQ ID NO: 222013 - protein, 9 aa, Homo Sapiens
FSFIHVHTP

SEQ ID NO: 222014 - protein, 9 aa, Homo Sapiens
EISVGTYES

SEQ ID NO: 222015 - protein, 9 aa, Homo Sapiens
DKNEDLGHM

SEQ ID NO: 222016 - protein, 9 aa, Homo Sapiens
ISFFFRVGR

SEQ ID NO: 222017 - protein, 9 aa, Homo Sapiens
EQNRRDAEV

SEQ ID NO: 222018 - protein, 9 aa, Homo Sapiens
YFEASDYKD

SEQ ID NO: 222019 - protein, 9 aa, Homo Sapiens
QEQVFSELS

SEQ ID NO: 222020 - protein, 9 aa, Homo Sapiens
RLCHDNIVR

SEQ ID NO: 222021 - protein, 9 aa, Homo Sapiens
SEKVVPVSM

SEQ ID NO: 222022 - protein, 9 aa, Homo Sapiens
PLAPRKAPH

SEQ ID NO: 222023 - protein, 9 aa, Homo Sapiens
ARRWALAQA

SEQ ID NO: 222024 - protein, 9 aa, Homo Sapiens
EHAVEEEAV

SEQ ID NO: 222025 - protein, 9 aa, Homo Sapiens
KREARVEES

SEQ ID NO: 222026 - protein, 9 aa, Homo Sapiens
APAGGRGRH

SEQ ID NO: 222027 - protein, 9 aa, Homo Sapiens
YCLQTPRGL

SEQ ID NO: 222028 - protein, 9 aa, Homo Sapiens
PPASSGTSA

SEQ ID NO: 222029 - protein, 9 aa, Homo Sapiens
FLMGGMSRT

SEQ ID NO: 222030 - protein, 9 aa, Homo Sapiens
AHNHPKRGT

SEQ ID NO: 222031 - protein, 9 aa, Homo Sapiens
PGRRGGTCA

SEQ ID NO: 222032 - protein, 9 aa, Homo Sapiens
TCSKKKIEK

SEQ ID NO: 222033 - protein, 9 aa, Homo Sapiens
LTSAASSAG

SEQ ID NO: 222034 - protein, 9 aa, Homo Sapiens
LPPPRLAPG

SEQ ID NO: 222035 - protein, 9 aa, Homo Sapiens
PAEVHKARS

SEQ ID NO: 222036 - protein, 9 aa, Homo Sapiens
SSLEASGMP

SEQ ID NO: 222037 - protein, 9 aa, Homo Sapiens
HHSKVQGEQ

SEQ ID NO: 222038 - protein, 9 aa, Homo Sapiens
ADEQYQRLM

SEQ ID NO: 222039 - protein, 9 aa, Homo Sapiens
PKLTLDESC

SEQ ID NO: 222040 - protein, 9 aa, Homo Sapiens
LNRTLLVVA

SEQ ID NO: 222041 - protein, 9 aa, Homo Sapiens
RYCTAFTRE

SEQ ID NO: 222042 - protein, 9 aa, Homo Sapiens
VTSHSFRTA

SEQ ID NO: 222043 - protein, 9 aa, Homo Sapiens
AAQMFLFSE

SEQ ID NO: 222044 - protein, 9 aa, Homo Sapiens
APASALLQP

SEQ ID NO: 222045 - protein, 9 aa, Homo Sapiens
ERGLVATVE

SEQ ID NO: 222046 - protein, 9 aa, Homo Sapiens
TEAKKAYPS

SEQ ID NO: 222047 - protein, 9 aa, Homo Sapiens
HYSQKSIFE

SEQ ID NO: 222048 - protein, 9 aa, Homo Sapiens
IFEKFSGKE

SEQ ID NO: 222049 - protein, 9 aa, Homo Sapiens
SVSENSLMA

SEQ ID NO: 222050 - protein, 9 aa, Homo Sapiens
LLRLAYLIS

SEQ ID NO: 222051 - protein, 9 aa, Homo Sapiens
HRPRMIGCG

SEQ ID NO: 222052 - protein, 9 aa, Homo Sapiens
SRCSSCWTP

SEQ ID NO: 222053 - protein, 9 aa, Homo Sapiens
LLVASIARA

SEQ ID NO: 222054 - protein, 9 aa, Homo Sapiens
KPFKQVLIT

SEQ ID NO: 222055 - protein, 9 aa, Homo Sapiens
CRYWGRSGT

SEQ ID NO: 222056 - protein, 9 aa, Homo Sapiens
ELLGLLKTH

SEQ ID NO: 222057 - protein, 9 aa, Homo Sapiens
LHSPVPRLP

SEQ ID NO: 222058 - protein, 9 aa, Homo Sapiens
LSEMKSHIE

SEQ ID NO: 222059 - protein, 9 aa, Homo Sapiens
QRDLPQERY

SEQ ID NO: 222060 - protein, 9 aa, Homo Sapiens
RPGATRSLV

SEQ ID NO: 222061 - protein, 9 aa, Homo Sapiens
GSNCQTAIC

SEQ ID NO: 222062 - protein, 9 aa, Homo Sapiens
GPCGSGPSR

SEQ ID NO: 222063 - protein, 9 aa, Homo Sapiens
VSAASSLAS

SEQ ID NO: 222064 - protein, 9 aa, Homo Sapiens
RDHHVSIVR

SEQ ID NO: 222065 - protein, 9 aa, Homo Sapiens
FSRSHLDFS

SEQ ID NO: 222066 - protein, 9 aa, Homo Sapiens
ALPCAQPTV

SEQ ID NO: 222067 - protein, 9 aa, Homo Sapiens
GLRLGPSEH

SEQ ID NO: 222068 - protein, 9 aa, Homo Sapiens
WRCPWRTAP

SEQ ID NO: 222069 - protein, 9 aa, Homo Sapiens
PCDQLHICD

SEQ ID NO: 222070 - protein, 9 aa, Homo Sapiens
GKDMTLYSL

SEQ ID NO: 222071 - protein, 9 aa, Homo Sapiens
SPLQLLLHP

SEQ ID NO: 222072 - protein, 9 aa, Homo Sapiens
RLEERWENK

SEQ ID NO: 222073 - protein, 9 aa, Homo Sapiens
SRSVCSRSG

SEQ ID NO: 222074 - protein, 9 aa, Homo Sapiens
TANRAMSRQ

SEQ ID NO: 222075 - protein, 9 aa, Homo Sapiens
STHVLTPKT

SEQ ID NO: 222076 - protein, 9 aa, Homo Sapiens
VPKFLSLSA

SEQ ID NO: 222077 - protein, 9 aa, Homo Sapiens
APNESPKDI

SEQ ID NO: 222078 - protein, 9 aa, Homo Sapiens
GLFLLHQVL

SEQ ID NO: 222079 - protein, 9 aa, Homo Sapiens
PVRLQKYPQ

SEQ ID NO: 222080 - protein, 9 aa, Homo Sapiens
QNSADNANF

SEQ ID NO: 222081 - protein, 9 aa, Homo Sapiens
FRSRNPEEG

SEQ ID NO: 222082 - protein, 9 aa, Homo Sapiens
NKNRQKVQK

SEQ ID NO: 222083 - protein, 9 aa, Homo Sapiens
SNGIHHFFC

SEQ ID NO: 222084 - protein, 9 aa, Homo Sapiens
IKMTVFATI

SEQ ID NO: 222085 - protein, 9 aa, Homo Sapiens
ASMLSATST

SEQ ID NO: 222086 - protein, 9 aa, Homo Sapiens
ALLSVELGS

SEQ ID NO: 222087 - protein, 9 aa, Homo Sapiens
KEAYYQTLN

SEQ ID NO: 222088 - protein, 9 aa, Homo Sapiens
GGTSFYDSW

SEQ ID NO: 222089 - protein, 9 aa, Homo Sapiens
THQMRTAPS

SEQ ID NO: 222090 - protein, 9 aa, Homo Sapiens
SGPTCENKT

SEQ ID NO: 222091 - protein, 9 aa, Homo Sapiens
LDPPETLNL

SEQ ID NO: 222092 - protein, 9 aa, Homo Sapiens
RTSRSSPWP

SEQ ID NO: 222093 - protein, 9 aa, Homo Sapiens
RLECPISAQ

SEQ ID NO: 222094 - protein, 9 aa, Homo Sapiens
VHRHVDQHE

SEQ ID NO: 222095 - protein, 9 aa, Homo Sapiens
QWPAGPNSW

SEQ ID NO: 222096 - protein, 9 aa, Homo Sapiens
LIRHQMTYR

SEQ ID NO: 222097 - protein, 9 aa, Homo Sapiens
SVLLWRLRG

SEQ ID NO: 222098 - protein, 9 aa, Homo Sapiens
DHRTSQNHS

SEQ ID NO: 222099 - protein, 9 aa, Homo Sapiens
RKVGEGGLR

SEQ ID NO: 222100 - protein, 9 aa, Homo Sapiens
PMLRPLPPQ

SEQ ID NO: 222101 - protein, 9 aa, Homo Sapiens
QPWPPTCSP

SEQ ID NO: 222102 - protein, 9 aa, Homo Sapiens
LLSPLDSSP

SEQ ID NO: 222103 - protein, 9 aa, Homo Sapiens
TNTVLYRGH

SEQ ID NO: 222104 - protein, 9 aa, Homo Sapiens
CNLAAITMD

SEQ ID NO: 222105 - protein, 9 aa, Homo Sapiens
PEPGDPDAV

SEQ ID NO: 222106 - protein, 9 aa, Homo Sapiens
GEFILERNH

SEQ ID NO: 222107 - protein, 9 aa, Homo Sapiens
TLYKPFGKE

SEQ ID NO: 222108 - protein, 9 aa, Homo Sapiens
ASRASQPSS

SEQ ID NO: 222109 - protein, 9 aa, Homo Sapiens
YNGSCPREE

SEQ ID NO: 222110 - protein, 9 aa, Homo Sapiens
KLRQSLFNR

SEQ ID NO: 222111 - protein, 9 aa, Homo Sapiens
PPTRPRPTS

SEQ ID NO: 222112 - protein, 9 aa, Homo Sapiens
IVPRPALRP

SEQ ID NO: 222113 - protein, 9 aa, Homo Sapiens
TRSLLRVAY

SEQ ID NO: 222114 - protein, 9 aa, Homo Sapiens
KNQNLSLMN

SEQ ID NO: 222115 - protein, 9 aa, Homo Sapiens
SSCQLSIDA

SEQ ID NO: 222116 - protein, 9 aa, Homo Sapiens
VGIVEALCG

SEQ ID NO: 222117 - protein, 9 aa, Homo Sapiens
CYCETKHTE

SEQ ID NO: 222118 - protein, 9 aa, Homo Sapiens
GFSAGGTAA

SEQ ID NO: 222119 - protein, 9 aa, Homo Sapiens
ISAQSLLRL

SEQ ID NO: 222120 - protein, 9 aa, Homo Sapiens
TSTTTVEHT

SEQ ID NO: 222121 - protein, 9 aa, Homo Sapiens
RSSTTPPAS

SEQ ID NO: 222122 - protein, 9 aa, Homo Sapiens
SCRPTRSEP

SEQ ID NO: 222123 - protein, 9 aa, Homo Sapiens
GTQCLVVLN

SEQ ID NO: 222124 - protein, 9 aa, Homo Sapiens
LHLDDLSGL

SEQ ID NO: 222125 - protein, 9 aa, Homo Sapiens
CQLCYCETK

SEQ ID NO: 222126 - protein, 9 aa, Homo Sapiens
FLAERNEED

SEQ ID NO: 222127 - protein, 9 aa, Homo Sapiens
VTGVSGLSA

SEQ ID NO: 222128 - protein, 9 aa, Homo Sapiens
QVHWDLSGS

SEQ ID NO: 222129 - protein, 9 aa, Homo Sapiens
SLKQVQLEW

SEQ ID NO: 222130 - protein, 9 aa, Homo Sapiens
LLGGFLGNI

SEQ ID NO: 222131 - protein, 9 aa, Homo Sapiens
RQGNKSHPP

SEQ ID NO: 222132 - protein, 9 aa, Homo Sapiens
GDSLLAFGI

SEQ ID NO: 222133 - protein, 9 aa, Homo Sapiens
ANPQLLCQN

SEQ ID NO: 222134 - protein, 9 aa, Homo Sapiens
MIDQLMSHS

SEQ ID NO: 222135 - protein, 9 aa, Homo Sapiens
FSGCFAMGA

SEQ ID NO: 222136 - protein, 9 aa, Homo Sapiens
QGQARDLRC

SEQ ID NO: 222137 - protein, 9 aa, Homo Sapiens
NGMRFQLAL

SEQ ID NO: 222138 - protein, 9 aa, Homo Sapiens
ARALRIVCF

SEQ ID NO: 222139 - protein, 9 aa, Homo Sapiens
PDMDLWVPV

SEQ ID NO: 222140 - protein, 9 aa, Homo Sapiens
AIITMDTAG

SEQ ID NO: 222141 - protein, 9 aa, Homo Sapiens
GLGPPTCSF

SEQ ID NO: 222142 - protein, 9 aa, Homo Sapiens
TAARPPSSR

SEQ ID NO: 222143 - protein, 9 aa, Homo Sapiens
NPEVSREDQ

SEQ ID NO: 222144 - protein, 9 aa, Homo Sapiens
ICGPQGPLP

SEQ ID NO: 222145 - protein, 9 aa, Homo Sapiens
HQRIHTGET

SEQ ID NO: 222146 - protein, 9 aa, Homo Sapiens
FWCSCDTGY

SEQ ID NO: 222147 - protein, 9 aa, Homo Sapiens
TQDVISDLL

SEQ ID NO: 222148 - protein, 9 aa, Homo Sapiens
HPGSSRTTW

SEQ ID NO: 222149 - protein, 9 aa, Homo Sapiens
RRLEERWEN

SEQ ID NO: 222150 - protein, 9 aa, Homo Sapiens
GCRSGRRQP

SEQ ID NO: 222151 - protein, 9 aa, Homo Sapiens
KPDRQLITQ

SEQ ID NO: 222152 - protein, 9 aa, Homo Sapiens
PPGPQDLQV

SEQ ID NO: 222153 - protein, 9 aa, Homo Sapiens
DEIRYRVVA

SEQ ID NO: 222154 - protein, 9 aa, Homo Sapiens
WTLFEHLSH

SEQ ID NO: 222155 - protein, 9 aa, Homo Sapiens
RTVRCIQPL

SEQ ID NO: 222156 - protein, 9 aa, Homo Sapiens
HPRRRWPLA

SEQ ID NO: 222157 - protein, 9 aa, Homo Sapiens
ATVEAVLLQ

SEQ ID NO: 222158 - protein, 9 aa, Homo Sapiens
TRTTEEMLD

SEQ ID NO: 222159 - protein, 9 aa, Homo Sapiens
PTGSCCTPT

SEQ ID NO: 222160 - protein, 9 aa, Homo Sapiens
GNKLELYEE

SEQ ID NO: 222161 - protein, 9 aa, Homo Sapiens
PRRHCWWPT

SEQ ID NO: 222162 - protein, 9 aa, Homo Sapiens
VTAHTGGQE

SEQ ID NO: 222163 - protein, 9 aa, Homo Sapiens
LCTLIKPFL

SEQ ID NO: 222164 - protein, 9 aa, Homo Sapiens
RGQGLFILP

SEQ ID NO: 222165 - protein, 9 aa, Homo Sapiens
GVTLLLVLQ

SEQ ID NO: 222166 - protein, 9 aa, Homo Sapiens
VTPQHGCVV

SEQ ID NO: 222167 - protein, 9 aa, Homo Sapiens
MNEFEYPKL

SEQ ID NO: 222168 - protein, 9 aa, Homo Sapiens
YCVHNESTG

SEQ ID NO: 222169 - protein, 9 aa, Homo Sapiens
CDPLQIFTY

SEQ ID NO: 222170 - protein, 9 aa, Homo Sapiens
YLLLAFGLP

SEQ ID NO: 222171 - protein, 9 aa, Homo Sapiens
NKKFFGGKQ

SEQ ID NO: 222172 - protein, 9 aa, Homo Sapiens
QSLVNLLVG

SEQ ID NO: 222173 - protein, 9 aa, Homo Sapiens
LDHAAPAAF

SEQ ID NO: 222174 - protein, 9 aa, Homo Sapiens
LPPRAPHPP

SEQ ID NO: 222175 - protein, 9 aa, Homo Sapiens
SMSKQNRGL

SEQ ID NO: 222176 - protein, 9 aa, Homo Sapiens
VILFVVDTG

SEQ ID NO: 222177 - protein, 9 aa, Homo Sapiens
GLVIGLHGD

SEQ ID NO: 222178 - protein, 9 aa, Homo Sapiens
QSAAWQGNV

SEQ ID NO: 222179 - protein, 9 aa, Homo Sapiens
LTGIHLHSY

SEQ ID NO: 222180 - protein, 9 aa, Homo Sapiens
TRALQQNRG

SEQ ID NO: 222181 - protein, 9 aa, Homo Sapiens
GQKQWIAIA

SEQ ID NO: 222182 - protein, 9 aa, Homo Sapiens
SSKNNMGAW

SEQ ID NO: 222183 - protein, 9 aa, Homo Sapiens
SPVLALSFC

SEQ ID NO: 222184 - protein, 9 aa, Homo Sapiens
DRRSLAPPE

SEQ ID NO: 222185 - protein, 9 aa, Homo Sapiens
GKPYKCKEC

SEQ ID NO: 222186 - protein, 9 aa, Homo Sapiens
SCVTRGAST

SEQ ID NO: 222187 - protein, 9 aa, Homo Sapiens
DSWGSGAAA

SEQ ID NO: 222188 - protein, 9 aa, Homo Sapiens
PAGSEVDRI

SEQ ID NO: 222189 - protein, 9 aa, Homo Sapiens
HPQGPCPPP

SEQ ID NO: 222190 - protein, 9 aa, Homo Sapiens
GCSVHFPFT

SEQ ID NO: 222191 - protein, 9 aa, Homo Sapiens
RVDIACSEI

SEQ ID NO: 222192 - protein, 9 aa, Homo Sapiens
FDMVSRAAE

SEQ ID NO: 222193 - protein, 9 aa, Homo Sapiens
KPPGRGGST

SEQ ID NO: 222194 - protein, 9 aa, Homo Sapiens
TLGGPEVPR

SEQ ID NO: 222195 - protein, 9 aa, Homo Sapiens
ATRNGPGLV

SEQ ID NO: 222196 - protein, 9 aa, Homo Sapiens
FWENLALIM

SEQ ID NO: 222197 - protein, 9 aa, Homo Sapiens
TWLSQMQKN

SEQ ID NO: 222198 - protein, 9 aa, Homo Sapiens
YGHQAPQVA

SEQ ID NO: 222199 - protein, 9 aa, Homo Sapiens
LLALSSSPS

SEQ ID NO: 222200 - protein, 9 aa, Homo Sapiens
GAGLVIFYF

SEQ ID NO: 222201 - protein, 9 aa, Homo Sapiens
AAPTSACSP

SEQ ID NO: 222202 - protein, 9 aa, Homo Sapiens
LGKPLYRVS

SEQ ID NO: 222203 - protein, 9 aa, Homo Sapiens
LKKQMQHVH

SEQ ID NO: 222204 - protein, 9 aa, Homo Sapiens
DRFNFILTS

SEQ ID NO: 222205 - protein, 9 aa, Homo Sapiens
GNKDLRTRA

SEQ ID NO: 222206 - protein, 9 aa, Homo Sapiens
DKNLHGFSK

SEQ ID NO: 222207 - protein, 9 aa, Homo Sapiens
HAQAPQLLP

SEQ ID NO: 222208 - protein, 9 aa, Homo Sapiens
NPAPTTPVT

SEQ ID NO: 222209 - protein, 9 aa, Homo Sapiens
QRSENYREA

SEQ ID NO: 222210 - protein, 9 aa, Homo Sapiens
NSLMAGQSQ

SEQ ID NO: 222211 - protein, 9 aa, Homo Sapiens
LPLRGFLLH

SEQ ID NO: 222212 - protein, 9 aa, Homo Sapiens
DIACSEIFM

SEQ ID NO: 222213 - protein, 9 aa, Homo Sapiens
CIKQELMVF

SEQ ID NO: 222214 - protein, 9 aa, Homo Sapiens
HSCSRPFSS

SEQ ID NO: 222215 - protein, 9 aa, Homo Sapiens
AVEGMLRIG

SEQ ID NO: 222216 - protein, 9 aa, Homo Sapiens
TKELSTTTR

SEQ ID NO: 222217 - protein, 9 aa, Homo Sapiens
VCAMDSLRP

SEQ ID NO: 222218 - protein, 9 aa, Homo Sapiens
PSGPTCENK

SEQ ID NO: 222219 - protein, 9 aa, Homo Sapiens
DSVLFRPCL

SEQ ID NO: 222220 - protein, 9 aa, Homo Sapiens
LVTRKTPWV

SEQ ID NO: 222221 - protein, 9 aa, Homo Sapiens
TSLTHRSHL

SEQ ID NO: 222222 - protein, 9 aa, Homo Sapiens
IPDILQEFV

SEQ ID NO: 222223 - protein, 9 aa, Homo Sapiens
HTPHPTGVR

SEQ ID NO: 222224 - protein, 9 aa, Homo Sapiens
THRQCCCDR

SEQ ID NO: 222225 - protein, 9 aa, Homo Sapiens
GPFLSTELG

SEQ ID NO: 222226 - protein, 9 aa, Homo Sapiens
WAIGVLWAI

SEQ ID NO: 222227 - protein, 9 aa, Homo Sapiens
VREKNSLRS

SEQ ID NO: 222228 - protein, 9 aa, Homo Sapiens
SQRKMKQRK

SEQ ID NO: 222229 - protein, 9 aa, Homo Sapiens
DVDECNDGN

SEQ ID NO: 222230 - protein, 9 aa, Homo Sapiens
FNGMMSTAS

SEQ ID NO: 222231 - protein, 9 aa, Homo Sapiens
WKRGRTAPA

SEQ ID NO: 222232 - protein, 9 aa, Homo Sapiens
MVGIGLSFL

SEQ ID NO: 222233 - protein, 9 aa, Homo Sapiens
KNFDQAVEL

SEQ ID NO: 222234 - protein, 9 aa, Homo Sapiens
GTWAWRAAS

SEQ ID NO: 222235 - protein, 9 aa, Homo Sapiens
HMKCFLNLS

SEQ ID NO: 222236 - protein, 9 aa, Homo Sapiens
LAPATPPFG

SEQ ID NO: 222237 - protein, 9 aa, Homo Sapiens
VFPEHQQHE

SEQ ID NO: 222238 - protein, 9 aa, Homo Sapiens
YDKLHVDPE

SEQ ID NO: 222239 - protein, 9 aa, Homo Sapiens
VSLDSPTNG

SEQ ID NO: 222240 - protein, 9 aa, Homo Sapiens
AGRGAPRHP

SEQ ID NO: 222241 - protein, 9 aa, Homo Sapiens
EVTSWTVDA

SEQ ID NO: 222242 - protein, 9 aa, Homo Sapiens
RCHEAESNI

SEQ ID NO: 222243 - protein, 9 aa, Homo Sapiens
RRGSRRRPR

SEQ ID NO: 222244 - protein, 9 aa, Homo Sapiens
LAIVLLSQR

SEQ ID NO: 222245 - protein, 9 aa, Homo Sapiens
KCVACGRTV

SEQ ID NO: 222246 - protein, 9 aa, Homo Sapiens
IFHSVDARG

SEQ ID NO: 222247 - protein, 9 aa, Homo Sapiens
RHPREYLKA

SEQ ID NO: 222248 - protein, 9 aa, Homo Sapiens
GRLNVMSQN

SEQ ID NO: 222249 - protein, 9 aa, Homo Sapiens
YLSASINPN

SEQ ID NO: 222250 - protein, 9 aa, Homo Sapiens
QCRRMGHRV

SEQ ID NO: 222251 - protein, 9 aa, Homo Sapiens
GAAAGVQFG

SEQ ID NO: 222252 - protein, 9 aa, Homo Sapiens
AFSNVGTVI

SEQ ID NO: 222253 - protein, 9 aa, Homo Sapiens
LRPLPPQPG

SEQ ID NO: 222254 - protein, 9 aa, Homo Sapiens
ERIGKDPAP

SEQ ID NO: 222255 - protein, 9 aa, Homo Sapiens
YPSCGGLRQ

SEQ ID NO: 222256 - protein, 9 aa, Homo Sapiens
GIIPTLHYA

SEQ ID NO: 222257 - protein, 9 aa, Homo Sapiens
AGVLAAGPT

SEQ ID NO: 222258 - protein, 9 aa, Homo Sapiens
WMRRVPRLR

SEQ ID NO: 222259 - protein, 9 aa, Homo Sapiens
WNASRPPQA

SEQ ID NO: 222260 - protein, 9 aa, Homo Sapiens
QLLQQMCYP

SEQ ID NO: 222261 - protein, 9 aa, Homo Sapiens
RPQNGPQWQ

SEQ ID NO: 222262 - protein, 9 aa, Homo Sapiens
KLCQCRCIT

SEQ ID NO: 222263 - protein, 9 aa, Homo Sapiens
IAEKNHARV

SEQ ID NO: 222264 - protein, 9 aa, Homo Sapiens
HRRPRVHAP

SEQ ID NO: 222265 - protein, 9 aa, Homo Sapiens
ENICKKFSN

SEQ ID NO: 222266 - protein, 9 aa, Homo Sapiens
DVTLMISIY

SEQ ID NO: 222267 - protein, 9 aa, Homo Sapiens
DKAPKSSFI

SEQ ID NO: 222268 - protein, 9 aa, Homo Sapiens
SSSPSALPC

SEQ ID NO: 222269 - protein, 9 aa, Homo Sapiens
TPASSTAAP

SEQ ID NO: 222270 - protein, 9 aa, Homo Sapiens
SASREWIRA

SEQ ID NO: 222271 - protein, 9 aa, Homo Sapiens
HQPGPEAAE

SEQ ID NO: 222272 - protein, 9 aa, Homo Sapiens
VRITNSCKN

SEQ ID NO: 222273 - protein, 9 aa, Homo Sapiens
REKGSAYGG

SEQ ID NO: 222274 - protein, 9 aa, Homo Sapiens
LGGRTPASC

SEQ ID NO: 222275 - protein, 9 aa, Homo Sapiens
PRTWQDRLP

SEQ ID NO: 222276 - protein, 9 aa, Homo Sapiens
LFLQMLPCL

SEQ ID NO: 222277 - protein, 9 aa, Homo Sapiens
QRQIQEWGC

SEQ ID NO: 222278 - protein, 9 aa, Homo Sapiens
RLKGRNSHP

SEQ ID NO: 222279 - protein, 9 aa, Homo Sapiens
PGMPNSLNQ

SEQ ID NO: 222280 - protein, 9 aa, Homo Sapiens
LIVEQKVHS

SEQ ID NO: 222281 - protein, 9 aa, Homo Sapiens
ITECVRTAL

SEQ ID NO: 222282 - protein, 9 aa, Homo Sapiens
CQDSKQAQL

SEQ ID NO: 222283 - protein, 9 aa, Homo Sapiens
REYCKSALL

SEQ ID NO: 222284 - protein, 9 aa, Homo Sapiens
HLGLFLLHQ

SEQ ID NO: 222285 - protein, 9 aa, Homo Sapiens
AEWSFSTFG

SEQ ID NO: 222286 - protein, 9 aa, Homo Sapiens
HQSQGLGQP

SEQ ID NO: 222287 - protein, 9 aa, Homo Sapiens
QCPGLKVTL

SEQ ID NO: 222288 - protein, 9 aa, Homo Sapiens
MEEESKTGQ

SEQ ID NO: 222289 - protein, 9 aa, Homo Sapiens
LNVARLCHD

SEQ ID NO: 222290 - protein, 9 aa, Homo Sapiens
EGRHGHLDS

SEQ ID NO: 222291 - protein, 9 aa, Homo Sapiens
LKKEQRVIL

SEQ ID NO: 222292 - protein, 9 aa, Homo Sapiens
PNNAGLEDF

SEQ ID NO: 222293 - protein, 9 aa, Homo Sapiens
KTTSPKGEV

SEQ ID NO: 222294 - protein, 9 aa, Homo Sapiens
GWLSKILRN

SEQ ID NO: 222295 - protein, 9 aa, Homo Sapiens
PGASDHVTM

SEQ ID NO: 222296 - protein, 9 aa, Homo Sapiens
KCTQMYHYS

SEQ ID NO: 222297 - protein, 9 aa, Homo Sapiens
TWPSSVLIE

SEQ ID NO: 222298 - protein, 9 aa, Homo Sapiens
MVICYPLHY

SEQ ID NO: 222299 - protein, 9 aa, Homo Sapiens
RATHTKPCG

SEQ ID NO: 222300 - protein, 9 aa, Homo Sapiens
PFGSSCLQT

SEQ ID NO: 222301 - protein, 9 aa, Homo Sapiens
CYINLWKII

SEQ ID NO: 222302 - protein, 9 aa, Homo Sapiens
THSANIQQA

SEQ ID NO: 222303 - protein, 9 aa, Homo Sapiens
PKSCRPWHS

SEQ ID NO: 222304 - protein, 9 aa, Homo Sapiens
CRCITDSRR

SEQ ID NO: 222305 - protein, 9 aa, Homo Sapiens
TLPGLFVKT

SEQ ID NO: 222306 - protein, 9 aa, Homo Sapiens
SLQTSSSGL

SEQ ID NO: 222307 - protein, 9 aa, Homo Sapiens
YCVVVFGAG

SEQ ID NO: 222308 - protein, 9 aa, Homo Sapiens
RGPPFPHLL

SEQ ID NO: 222309 - protein, 9 aa, Homo Sapiens
LGVFAPDEL

SEQ ID NO: 222310 - protein, 9 aa, Homo Sapiens
CRVGARPPA

SEQ ID NO: 222311 - protein, 9 aa, Homo Sapiens
VLGLLADVL

SEQ ID NO: 222312 - protein, 9 aa, Homo Sapiens
ALKAIITMD

SEQ ID NO: 222313 - protein, 9 aa, Homo Sapiens
PDAPSRCIW

SEQ ID NO: 222314 - protein, 9 aa, Homo Sapiens
SHHRPSLFH

SEQ ID NO: 222315 - protein, 9 aa, Homo Sapiens
TMNEFEYPK

SEQ ID NO: 222316 - protein, 9 aa, Homo Sapiens
EKENTIILQ

SEQ ID NO: 222317 - protein, 9 aa, Homo Sapiens
LTLKMILTL

SEQ ID NO: 222318 - protein, 9 aa, Homo Sapiens
VPRLRKFYK

SEQ ID NO: 222319 - protein, 9 aa, Homo Sapiens
GKGLLKKRN

SEQ ID NO: 222320 - protein, 9 aa, Homo Sapiens
RLHIVELAQ

SEQ ID NO: 222321 - protein, 9 aa, Homo Sapiens
LCHYSQKSI

SEQ ID NO: 222322 - protein, 9 aa, Homo Sapiens
LLWVTEDPA

SEQ ID NO: 222323 - protein, 9 aa, Homo Sapiens
SLAPPETYQ

SEQ ID NO: 222324 - protein, 9 aa, Homo Sapiens
RIMRDLRSC

SEQ ID NO: 222325 - protein, 9 aa, Homo Sapiens
KKIEKASAQ

SEQ ID NO: 222326 - protein, 9 aa, Homo Sapiens
KSRLPHQSP

SEQ ID NO: 222327 - protein, 9 aa, Homo Sapiens
VITLLEATP

SEQ ID NO: 222328 - protein, 9 aa, Homo Sapiens
IHSWVLQAI

SEQ ID NO: 222329 - protein, 9 aa, Homo Sapiens
MKISERYVP

SEQ ID NO: 222330 - protein, 9 aa, Homo Sapiens
GHYREFCQC

SEQ ID NO: 222331 - protein, 9 aa, Homo Sapiens
LQVIIDFIL

SEQ ID NO: 222332 - protein, 9 aa, Homo Sapiens
FTPVCTNRL

SEQ ID NO: 222333 - protein, 9 aa, Homo Sapiens
CRKTTATLC

SEQ ID NO: 222334 - protein, 9 aa, Homo Sapiens
MRFQLALCV

SEQ ID NO: 222335 - protein, 9 aa, Homo Sapiens
QNLNCIALC

SEQ ID NO: 222336 - protein, 9 aa, Homo Sapiens
LKKRNGMRF

SEQ ID NO: 222337 - protein, 9 aa, Homo Sapiens
NHVSASRAV

SEQ ID NO: 222338 - protein, 9 aa, Homo Sapiens
TPPSGDMMS

SEQ ID NO: 222339 - protein, 9 aa, Homo Sapiens
VVLSPWCLS

SEQ ID NO: 222340 - protein, 9 aa, Homo Sapiens
GPEVSDTGG

SEQ ID NO: 222341 - protein, 9 aa, Homo Sapiens
EEDKKVRRQ

SEQ ID NO: 222342 - protein, 9 aa, Homo Sapiens
MEPGADREE

SEQ ID NO: 222343 - protein, 9 aa, Homo Sapiens
EKVVPVSMG

SEQ ID NO: 222344 - protein, 9 aa, Homo Sapiens
GKSLWPGLR

SEQ ID NO: 222345 - protein, 9 aa, Homo Sapiens
IKKMKKRIM

SEQ ID NO: 222346 - protein, 9 aa, Homo Sapiens
VPDSVLFRP

SEQ ID NO: 222347 - protein, 9 aa, Homo Sapiens
HTDAQGRLV

SEQ ID NO: 222348 - protein, 9 aa, Homo Sapiens
EETVVVAVA

SEQ ID NO: 222349 - protein, 9 aa, Homo Sapiens
PAWTLTSLK

SEQ ID NO: 222350 - protein, 9 aa, Homo Sapiens
GLGRHHPSQ

SEQ ID NO: 222351 - protein, 9 aa, Homo Sapiens
ASMASLKKQ

SEQ ID NO: 222352 - protein, 9 aa, Homo Sapiens
MEKKLSRRV

SEQ ID NO: 222353 - protein, 9 aa, Homo Sapiens
DPPTLTSQV

SEQ ID NO: 222354 - protein, 9 aa, Homo Sapiens
VKSENKQRK

SEQ ID NO: 222355 - protein, 9 aa, Homo Sapiens
PFKQVLITE

SEQ ID NO: 222356 - protein, 9 aa, Homo Sapiens
VLKNIYRKS

SEQ ID NO: 222357 - protein, 9 aa, Homo Sapiens
RAVPKLGVA

SEQ ID NO: 222358 - protein, 9 aa, Homo Sapiens
LLPCNLSLE

SEQ ID NO: 222359 - protein, 9 aa, Homo Sapiens
KDNGEPPHS

SEQ ID NO: 222360 - protein, 9 aa, Homo Sapiens
LRPETRKRL

SEQ ID NO: 222361 - protein, 9 aa, Homo Sapiens
DLRLYILVS

SEQ ID NO: 222362 - protein, 9 aa, Homo Sapiens
LPRSLASTS

SEQ ID NO: 222363 - protein, 9 aa, Homo Sapiens
SHPSPRWTP

SEQ ID NO: 222364 - protein, 9 aa, Homo Sapiens
RPSMLCVED

SEQ ID NO: 222365 - protein, 9 aa, Homo Sapiens
TVLESWGQR

SEQ ID NO: 222366 - protein, 9 aa, Homo Sapiens
SHCGHGAEE

SEQ ID NO: 222367 - protein, 9 aa, Homo Sapiens
HLIVSVWRP

SEQ ID NO: 222368 - protein, 9 aa, Homo Sapiens
IPQSAGTTS

SEQ ID NO: 222369 - protein, 9 aa, Homo Sapiens
VFKSDFNTG

SEQ ID NO: 222370 - protein, 9 aa, Homo Sapiens
WGRRWSWAM

SEQ ID NO: 222371 - protein, 9 aa, Homo Sapiens
GVTLDGPAD

SEQ ID NO: 222372 - protein, 9 aa, Homo Sapiens
RSSPWPSCK

SEQ ID NO: 222373 - protein, 9 aa, Homo Sapiens
KKAAANFRR

SEQ ID NO: 222374 - protein, 9 aa, Homo Sapiens
SPGHLGLFL

SEQ ID NO: 222375 - protein, 9 aa, Homo Sapiens
PIAPPGMPA

SEQ ID NO: 222376 - protein, 9 aa, Homo Sapiens
LKMILTLMY

SEQ ID NO: 222377 - protein, 9 aa, Homo Sapiens
LERNHTNVR

SEQ ID NO: 222378 - protein, 9 aa, Homo Sapiens
NSSGALSIR

SEQ ID NO: 222379 - protein, 9 aa, Homo Sapiens
RRAGGCASC

SEQ ID NO: 222380 - protein, 9 aa, Homo Sapiens
GLVATRALQ

SEQ ID NO: 222381 - protein, 9 aa, Homo Sapiens
RPSRQLVGR

SEQ ID NO: 222382 - protein, 9 aa, Homo Sapiens
LRATVPRHS

SEQ ID NO: 222383 - protein, 9 aa, Homo Sapiens
TMECQKPEP

SEQ ID NO: 222384 - protein, 9 aa, Homo Sapiens
GHRGWRLPK

SEQ ID NO: 222385 - protein, 9 aa, Homo Sapiens
ELGGRTPAS

SEQ ID NO: 222386 - protein, 9 aa, Homo Sapiens
LPWGRPRGG

SEQ ID NO: 222387 - protein, 9 aa, Homo Sapiens
VAASPTTAA

SEQ ID NO: 222388 - protein, 9 aa, Homo Sapiens
AGQQEQLLM

SEQ ID NO: 222389 - protein, 9 aa, Homo Sapiens
SVKDHRTSQ

SEQ ID NO: 222390 - protein, 9 aa, Homo Sapiens
ACAGIPGWT

SEQ ID NO: 222391 - protein, 9 aa, Homo Sapiens
GPDVNHEYS

SEQ ID NO: 222392 - protein, 9 aa, Homo Sapiens
KKLSRRVCE

SEQ ID NO: 222393 - protein, 9 aa, Homo Sapiens
QGPSSTFLL

SEQ ID NO: 222394 - protein, 9 aa, Homo Sapiens
YRMDQTFKI

SEQ ID NO: 222395 - protein, 9 aa, Homo Sapiens
RKYWECKHL

SEQ ID NO: 222396 - protein, 9 aa, Homo Sapiens
VGRRNPPPR

SEQ ID NO: 222397 - protein, 9 aa, Homo Sapiens
RLGGPKRSA

SEQ ID NO: 222398 - protein, 9 aa, Homo Sapiens
SNSDFLVHF

SEQ ID NO: 222399 - protein, 9 aa, Homo Sapiens
LQLRLNPRR

SEQ ID NO: 222400 - protein, 9 aa, Homo Sapiens
KSTPFTGSP

SEQ ID NO: 222401 - protein, 9 aa, Homo Sapiens
FDLDDVITD

SEQ ID NO: 222402 - protein, 9 aa, Homo Sapiens
IHLSDFFSA

SEQ ID NO: 222403 - protein, 9 aa, Homo Sapiens
GKSYLALGD

SEQ ID NO: 222404 - protein, 9 aa, Homo Sapiens
YLALGDLCV

SEQ ID NO: 222405 - protein, 9 aa, Homo Sapiens
IVDMYKDKK

SEQ ID NO: 222406 - protein, 9 aa, Homo Sapiens
VCKVLPRNI

SEQ ID NO: 222407 - protein, 9 aa, Homo Sapiens
QRKSQSWCL

SEQ ID NO: 222408 - protein, 9 aa, Homo Sapiens
PPELYTLMS

SEQ ID NO: 222409 - protein, 9 aa, Homo Sapiens
ALQNQLRVF

SEQ ID NO: 222410 - protein, 9 aa, Homo Sapiens
EQPIIFALS

SEQ ID NO: 222411 - protein, 9 aa, Homo Sapiens
PLWSRLSLL

SEQ ID NO: 222412 - protein, 9 aa, Homo Sapiens
TSATCTWTS

SEQ ID NO: 222413 - protein, 9 aa, Homo Sapiens
RPHASPTST

SEQ ID NO: 222414 - protein, 9 aa, Homo Sapiens
PPTSCPPLL

SEQ ID NO: 222415 - protein, 9 aa, Homo Sapiens
ACNMNIKGV

SEQ ID NO: 222416 - protein, 9 aa, Homo Sapiens
FSEIMGMVW

SEQ ID NO: 222417 - protein, 9 aa, Homo Sapiens
EDSRTGLPR

SEQ ID NO: 222418 - protein, 9 aa, Homo Sapiens
SSKRQTNGC

SEQ ID NO: 222419 - protein, 9 aa, Homo Sapiens
ASVSFTYSL

SEQ ID NO: 222420 - protein, 9 aa, Homo Sapiens
PEEGSKPPN

SEQ ID NO: 222421 - protein, 9 aa, Homo Sapiens
RALSVLLPP

SEQ ID NO: 222422 - protein, 9 aa, Homo Sapiens
VPLISLMIE

SEQ ID NO: 222423 - protein, 9 aa, Homo Sapiens
VSAPNLTPI

SEQ ID NO: 222424 - protein, 9 aa, Homo Sapiens
LSPHLNQIM

SEQ ID NO: 222425 - protein, 9 aa, Homo Sapiens
GLTGIHLHS

SEQ ID NO: 222426 - protein, 9 aa, Homo Sapiens
AGVYKKVWC

SEQ ID NO: 222427 - protein, 9 aa, Homo Sapiens
EYVKNFDQA

SEQ ID NO: 222428 - protein, 9 aa, Homo Sapiens
ELLLNFIWF

SEQ ID NO: 222429 - protein, 9 aa, Homo Sapiens
KDLSQILEK

SEQ ID NO: 222430 - protein, 9 aa, Homo Sapiens
RSISLLRSH

SEQ ID NO: 222431 - protein, 9 aa, Homo Sapiens
ATVSHCGHG

SEQ ID NO: 222432 - protein, 9 aa, Homo Sapiens
LHMSYAPRH

SEQ ID NO: 222433 - protein, 9 aa, Homo Sapiens
GYRCALPNR

SEQ ID NO: 222434 - protein, 9 aa, Homo Sapiens
FLCQEKYQL

SEQ ID NO: 222435 - protein, 9 aa, Homo Sapiens
VYIRADIGP

SEQ ID NO: 222436 - protein, 9 aa, Homo Sapiens
HLIKMIDLS

SEQ ID NO: 222437 - protein, 9 aa, Homo Sapiens
ASLKKQYPK

SEQ ID NO: 222438 - protein, 9 aa, Homo Sapiens
LSKGRMLKI

SEQ ID NO: 222439 - protein, 9 aa, Homo Sapiens
RSWSSGGKL

SEQ ID NO: 222440 - protein, 9 aa, Homo Sapiens
QGVGSGGVC

SEQ ID NO: 222441 - protein, 9 aa, Homo Sapiens
SCIVCVAYA

SEQ ID NO: 222442 - protein, 9 aa, Homo Sapiens
LSPELGIKA

SEQ ID NO: 222443 - protein, 9 aa, Homo Sapiens
VVARDHVFS

SEQ ID NO: 222444 - protein, 9 aa, Homo Sapiens
WEVMPRTLE

SEQ ID NO: 222445 - protein, 9 aa, Homo Sapiens
EDVMFSSDA

SEQ ID NO: 222446 - protein, 9 aa, Homo Sapiens
RSDWARQTF

SEQ ID NO: 222447 - protein, 9 aa, Homo Sapiens
MDDNNIQMK

SEQ ID NO: 222448 - protein, 9 aa, Homo Sapiens
QLTKFCNDH

SEQ ID NO: 222449 - protein, 9 aa, Homo Sapiens
LHYDKLHVD

SEQ ID NO: 222450 - protein, 9 aa, Homo Sapiens
SFAPGTLYK

SEQ ID NO: 222451 - protein, 9 aa, Homo Sapiens
RNLGCSPML

SEQ ID NO: 222452 - protein, 9 aa, Homo Sapiens
VQEAERRQD

SEQ ID NO: 222453 - protein, 9 aa, Homo Sapiens
NFLNPPGGG

SEQ ID NO: 222454 - protein, 9 aa, Homo Sapiens
YDKVDRERA

SEQ ID NO: 222455 - protein, 9 aa, Homo Sapiens
RLAPGSPYV

SEQ ID NO: 222456 - protein, 9 aa, Homo Sapiens
LPGLHVGLR

SEQ ID NO: 222457 - protein, 9 aa, Homo Sapiens
VCQRMCQPL

SEQ ID NO: 222458 - protein, 9 aa, Homo Sapiens
KASVARQPP

SEQ ID NO: 222459 - protein, 9 aa, Homo Sapiens
IDTIVRIAS

SEQ ID NO: 222460 - protein, 9 aa, Homo Sapiens
ETVHYIGSR

SEQ ID NO: 222461 - protein, 9 aa, Homo Sapiens
KVLINNQTL

SEQ ID NO: 222462 - protein, 9 aa, Homo Sapiens
LEKTGMAVN

SEQ ID NO: 222463 - protein, 9 aa, Homo Sapiens
EDPGAAAGV

SEQ ID NO: 222464 - protein, 9 aa, Homo Sapiens
GAQAARIRA

SEQ ID NO: 222465 - protein, 9 aa, Homo Sapiens
IKSGDEDFE

SEQ ID NO: 222466 - protein, 9 aa, Homo Sapiens
GVTSQAMAT

SEQ ID NO: 222467 - protein, 9 aa, Homo Sapiens
GLLADVLPE

SEQ ID NO: 222468 - protein, 9 aa, Homo Sapiens
NRGGGDANL

SEQ ID NO: 222469 - protein, 9 aa, Homo Sapiens
VSRCSSCWT

SEQ ID NO: 222470 - protein, 9 aa, Homo Sapiens
PGGGGSPRS

SEQ ID NO: 222471 - protein, 9 aa, Homo Sapiens
CSKKKIEKA

SEQ ID NO: 222472 - protein, 9 aa, Homo Sapiens
ATPVGRFTA

SEQ ID NO: 222473 - protein, 9 aa, Homo Sapiens
QPWKRGRTA

SEQ ID NO: 222474 - protein, 9 aa, Homo Sapiens
RPGSAWRPP

SEQ ID NO: 222475 - protein, 9 aa, Homo Sapiens
SSGSALAFS

SEQ ID NO: 222476 - protein, 9 aa, Homo Sapiens
GSALAFSAP

SEQ ID NO: 222477 - protein, 9 aa, Homo Sapiens
LIDDDNPPC

SEQ ID NO: 222478 - protein, 9 aa, Homo Sapiens
DSMHGWTAL

SEQ ID NO: 222479 - protein, 9 aa, Homo Sapiens
SHLDFSPYW

SEQ ID NO: 222480 - protein, 9 aa, Homo Sapiens
HLPPLASEA

SEQ ID NO: 222481 - protein, 9 aa, Homo Sapiens
KVFLPSNGE

SEQ ID NO: 222482 - protein, 9 aa, Homo Sapiens
PSHPSTLRR

SEQ ID NO: 222483 - protein, 9 aa, Homo Sapiens
FSRLPGNCC

SEQ ID NO: 222484 - protein, 9 aa, Homo Sapiens
CLCCADRGA

SEQ ID NO: 222485 - protein, 9 aa, Homo Sapiens
KPEEDSESI

SEQ ID NO: 222486 - protein, 9 aa, Homo Sapiens
LTLDESCDL

SEQ ID NO: 222487 - protein, 9 aa, Homo Sapiens
RWKALIVIR

SEQ ID NO: 222488 - protein, 9 aa, Homo Sapiens
LSTLQQRHP

SEQ ID NO: 222489 - protein, 9 aa, Homo Sapiens
AEDPVLLKK

SEQ ID NO: 222490 - protein, 9 aa, Homo Sapiens
ITIMKVHRI

SEQ ID NO: 222491 - protein, 9 aa, Homo Sapiens
CSRRPLPWT

SEQ ID NO: 222492 - protein, 9 aa, Homo Sapiens
VRQLVHALA

SEQ ID NO: 222493 - protein, 9 aa, Homo Sapiens
NTLNDITSL

SEQ ID NO: 222494 - protein, 9 aa, Homo Sapiens
EDKVHVWQL

SEQ ID NO: 222495 - protein, 9 aa, Homo Sapiens
KDLYANIVL

SEQ ID NO: 222496 - protein, 9 aa, Homo Sapiens
KCQLCYCET

SEQ ID NO: 222497 - protein, 9 aa, Homo Sapiens
GSERVLTTR

SEQ ID NO: 222498 - protein, 9 aa, Homo Sapiens
ATECWIFIP

SEQ ID NO: 222499 - protein, 9 aa, Homo Sapiens
QLITQVMLY

SEQ ID NO: 222500 - protein, 9 aa, Homo Sapiens
PPLGGDTAP

SEQ ID NO: 222501 - protein, 9 aa, Homo Sapiens
PTPNHTPWP

SEQ ID NO: 222502 - protein, 9 aa, Homo Sapiens
PRQTPGQAR

SEQ ID NO: 222503 - protein, 9 aa, Homo Sapiens
EDGEDMDLD

SEQ ID NO: 222504 - protein, 9 aa, Homo Sapiens
VVVFTEEEL

SEQ ID NO: 222505 - protein, 9 aa, Homo Sapiens
SKVLPDAPT

SEQ ID NO: 222506 - protein, 9 aa, Homo Sapiens
PSVMQLRLN

SEQ ID NO: 222507 - protein, 9 aa, Homo Sapiens
VEYIGRKKS

SEQ ID NO: 222508 - protein, 9 aa, Homo Sapiens
RTLFQEILN

SEQ ID NO: 222509 - protein, 9 aa, Homo Sapiens
IDPTIQRVQ

SEQ ID NO: 222510 - protein, 9 aa, Homo Sapiens
LLRLQSLLS

SEQ ID NO: 222511 - protein, 9 aa, Homo Sapiens
YLNDDSPES

SEQ ID NO: 222512 - protein, 9 aa, Homo Sapiens
KNDRNGDFS

SEQ ID NO: 222513 - protein, 9 aa, Homo Sapiens
KGKGHRRKE

SEQ ID NO: 222514 - protein, 9 aa, Homo Sapiens
QELKTLLGQ

SEQ ID NO: 222515 - protein, 9 aa, Homo Sapiens
YDYIWDATI

SEQ ID NO: 222516 - protein, 9 aa, Homo Sapiens
RTERPGATR

SEQ ID NO: 222517 - protein, 9 aa, Homo Sapiens
LHTERGIRQ

SEQ ID NO: 222518 - protein, 9 aa, Homo Sapiens
SNNPVIEEL

SEQ ID NO: 222519 - protein, 9 aa, Homo Sapiens
SCKGCLWAL

SEQ ID NO: 222520 - protein, 9 aa, Homo Sapiens
DTSVQIWEI

SEQ ID NO: 222521 - protein, 9 aa, Homo Sapiens
QSLYSPADP

SEQ ID NO: 222522 - protein, 9 aa, Homo Sapiens
FIVEGSPGS

SEQ ID NO: 222523 - protein, 9 aa, Homo Sapiens
KEKEAQKKG

SEQ ID NO: 222524 - protein, 9 aa, Homo Sapiens
QLTFHKMAF

SEQ ID NO: 222525 - protein, 9 aa, Homo Sapiens
AQEGLCSLQ

SEQ ID NO: 222526 - protein, 9 aa, Homo Sapiens
CCFSPLKKV

SEQ ID NO: 222527 - protein, 9 aa, Homo Sapiens
LTGGLWAWK

SEQ ID NO: 222528 - protein, 9 aa, Homo Sapiens
FLLHNGKLF

SEQ ID NO: 222529 - protein, 9 aa, Homo Sapiens
SCWSPRPPG

SEQ ID NO: 222530 - protein, 9 aa, Homo Sapiens
SNETATDDT

SEQ ID NO: 222531 - protein, 9 aa, Homo Sapiens
EIARHAAKM

SEQ ID NO: 222532 - protein, 9 aa, Homo Sapiens
TQQILTDHC

SEQ ID NO: 222533 - protein, 9 aa, Homo Sapiens
QMYWLLFRQ

SEQ ID NO: 222534 - protein, 9 aa, Homo Sapiens
HGKRCNPCC

SEQ ID NO: 222535 - protein, 9 aa, Homo Sapiens
RAPGSQLPP

SEQ ID NO: 222536 - protein, 9 aa, Homo Sapiens
FHKLQHELE

SEQ ID NO: 222537 - protein, 9 aa, Homo Sapiens
ARVHRCSRL

SEQ ID NO: 222538 - protein, 9 aa, Homo Sapiens
CSASVSFTY

SEQ ID NO: 222539 - protein, 9 aa, Homo Sapiens
DSHGVETIW

SEQ ID NO: 222540 - protein, 9 aa, Homo Sapiens
DVSMPILGH

SEQ ID NO: 222541 - protein, 9 aa, Homo Sapiens
MYLWPQLGN

SEQ ID NO: 222542 - protein, 9 aa, Homo Sapiens
ETEVGATEE

SEQ ID NO: 222543 - protein, 9 aa, Homo Sapiens
ERESLIRRT

SEQ ID NO: 222544 - protein, 9 aa, Homo Sapiens
FDNTEDIAQ

SEQ ID NO: 222545 - protein, 9 aa, Homo Sapiens
DTCSPGMQR

SEQ ID NO: 222546 - protein, 9 aa, Homo Sapiens
VACLINEHK

SEQ ID NO: 222547 - protein, 9 aa, Homo Sapiens
HLTFNHDGS

SEQ ID NO: 222548 - protein, 9 aa, Homo Sapiens
TRANARTRA

SEQ ID NO: 222549 - protein, 9 aa, Homo Sapiens
VDSGDKVVA

SEQ ID NO: 222550 - protein, 9 aa, Homo Sapiens
NHREREAMI

SEQ ID NO: 222551 - protein, 9 aa, Homo Sapiens
KVVPVSMGI

SEQ ID NO: 222552 - protein, 9 aa, Homo Sapiens
CRAYEAAGS

SEQ ID NO: 222553 - protein, 9 aa, Homo Sapiens
ATRQALSEA

SEQ ID NO: 222554 - protein, 9 aa, Homo Sapiens
AGSPRYQGA

SEQ ID NO: 222555 - protein, 9 aa, Homo Sapiens
MIGAFKHYP

SEQ ID NO: 222556 - protein, 9 aa, Homo Sapiens
PLSCPLALL

SEQ ID NO: 222557 - protein, 9 aa, Homo Sapiens
QWQVVWVIG

SEQ ID NO: 222558 - protein, 9 aa, Homo Sapiens
ASCFSNGSW

SEQ ID NO: 222559 - protein, 9 aa, Homo Sapiens
GGTYTKGTF

SEQ ID NO: 222560 - protein, 9 aa, Homo Sapiens
KKNLGKVFL

SEQ ID NO: 222561 - protein, 9 aa, Homo Sapiens
ALPTSTLRG

SEQ ID NO: 222562 - protein, 9 aa, Homo Sapiens
EPVNWEDRP

SEQ ID NO: 222563 - protein, 9 aa, Homo Sapiens
VVRVLFIRE

SEQ ID NO: 222564 - protein, 9 aa, Homo Sapiens
DDIIKCEQN

SEQ ID NO: 222565 - protein, 9 aa, Homo Sapiens
GYSRSVCSR

SEQ ID NO: 222566 - protein, 9 aa, Homo Sapiens
APATPPFGL

SEQ ID NO: 222567 - protein, 9 aa, Homo Sapiens
KRRCYSRGS

SEQ ID NO: 222568 - protein, 9 aa, Homo Sapiens
VLQEMLGMY

SEQ ID NO: 222569 - protein, 9 aa, Homo Sapiens
ERLMQEQLQ

SEQ ID NO: 222570 - protein, 9 aa, Homo Sapiens
RSYCSTRQT

SEQ ID NO: 222571 - protein, 9 aa, Homo Sapiens
LKEREDWGI

SEQ ID NO: 222572 - protein, 9 aa, Homo Sapiens
IDNLEKNSG

SEQ ID NO: 222573 - protein, 9 aa, Homo Sapiens
ARSGNPTRS

SEQ ID NO: 222574 - protein, 9 aa, Homo Sapiens
LEKWLLDVN

SEQ ID NO: 222575 - protein, 9 aa, Homo Sapiens
LNGGSSKRQ

SEQ ID NO: 222576 - protein, 9 aa, Homo Sapiens
EGSFLTPGM

SEQ ID NO: 222577 - protein, 9 aa, Homo Sapiens
LGLALCPSA

SEQ ID NO: 222578 - protein, 9 aa, Homo Sapiens
KTIQNEANF

SEQ ID NO: 222579 - protein, 9 aa, Homo Sapiens
VGGQTSHWC

SEQ ID NO: 222580 - protein, 9 aa, Homo Sapiens
RRSRVPRCR

SEQ ID NO: 222581 - protein, 9 aa, Homo Sapiens
SRLPGNCCS

SEQ ID NO: 222582 - protein, 9 aa, Homo Sapiens
RGRGGRGAH

SEQ ID NO: 222583 - protein, 9 aa, Homo Sapiens
AGIYVRPQL

SEQ ID NO: 222584 - protein, 9 aa, Homo Sapiens
APDGHPLWL

SEQ ID NO: 222585 - protein, 9 aa, Homo Sapiens
SASSSAHHL

SEQ ID NO: 222586 - protein, 9 aa, Homo Sapiens
DKGWQNSIW

SEQ ID NO: 222587 - protein, 9 aa, Homo Sapiens
HFHILTWPS

SEQ ID NO: 222588 - protein, 9 aa, Homo Sapiens
CRPAWTAAG

SEQ ID NO: 222589 - protein, 9 aa, Homo Sapiens
HEGDFRVPP

SEQ ID NO: 222590 - protein, 9 aa, Homo Sapiens
DASPSPFTH

SEQ ID NO: 222591 - protein, 9 aa, Homo Sapiens
RKLRACGNW

SEQ ID NO: 222592 - protein, 9 aa, Homo Sapiens
CHRKSDFCW

SEQ ID NO: 222593 - protein, 9 aa, Homo Sapiens
NWKSHLIVS

SEQ ID NO: 222594 - protein, 9 aa, Homo Sapiens
KALMTQQTY

SEQ ID NO: 222595 - protein, 9 aa, Homo Sapiens
VIKKHELLS

SEQ ID NO: 222596 - protein, 9 aa, Homo Sapiens
ALSYVGITL

SEQ ID NO: 222597 - protein, 9 aa, Homo Sapiens
APPSCLRFV

SEQ ID NO: 222598 - protein, 9 aa, Homo Sapiens
KMKRWMRRV

SEQ ID NO: 222599 - protein, 9 aa, Homo Sapiens
HPPPAAAGC

SEQ ID NO: 222600 - protein, 9 aa, Homo Sapiens
NILNVGAIV

SEQ ID NO: 222601 - protein, 9 aa, Homo Sapiens
SKKERKVTL

SEQ ID NO: 222602 - protein, 9 aa, Homo Sapiens
RGWWISNDR

SEQ ID NO: 222603 - protein, 9 aa, Homo Sapiens
PGSRRGVRS

SEQ ID NO: 222604 - protein, 9 aa, Homo Sapiens
TQSLPRLGC

SEQ ID NO: 222605 - protein, 9 aa, Homo Sapiens
WPPCAATDR

SEQ ID NO: 222606 - protein, 9 aa, Homo Sapiens
LPQEESRDG

SEQ ID NO: 222607 - protein, 9 aa, Homo Sapiens
VSTTATTHT

SEQ ID NO: 222608 - protein, 9 aa, Homo Sapiens
TSHMHLKCK

SEQ ID NO: 222609 - protein, 9 aa, Homo Sapiens
DMDEVYTIP

SEQ ID NO: 222610 - protein, 9 aa, Homo Sapiens
LAKQGAQGV

SEQ ID NO: 222611 - protein, 9 aa, Homo Sapiens
LVGLFRAGK

SEQ ID NO: 222612 - protein, 9 aa, Homo Sapiens
VMEIRKETA

SEQ ID NO: 222613 - protein, 9 aa, Homo Sapiens
CSQCRVTKY

SEQ ID NO: 222614 - protein, 9 aa, Homo Sapiens
EDTSVQIWE

SEQ ID NO: 222615 - protein, 9 aa, Homo Sapiens
SWDPVNVHD

SEQ ID NO: 222616 - protein, 9 aa, Homo Sapiens
ALSSSPSAL

SEQ ID NO: 222617 - protein, 9 aa, Homo Sapiens
SVLREPAFL

SEQ ID NO: 222618 - protein, 9 aa, Homo Sapiens
IMMRCHSWK

SEQ ID NO: 222619 - protein, 9 aa, Homo Sapiens
ASCGTCPTA

SEQ ID NO: 222620 - protein, 9 aa, Homo Sapiens
DHHKRGILW

SEQ ID NO: 222621 - protein, 9 aa, Homo Sapiens
CGPGFSAGG

SEQ ID NO: 222622 - protein, 9 aa, Homo Sapiens
RRLRACRAG

SEQ ID NO: 222623 - protein, 9 aa, Homo Sapiens
KARSGKGEA

SEQ ID NO: 222624 - protein, 9 aa, Homo Sapiens
MDCLDHTNV

SEQ ID NO: 222625 - protein, 9 aa, Homo Sapiens
AQEDVMFSS

SEQ ID NO: 222626 - protein, 9 aa, Homo Sapiens
AEPQATRRD

SEQ ID NO: 222627 - protein, 9 aa, Homo Sapiens
INPLQQAAE

SEQ ID NO: 222628 - protein, 9 aa, Homo Sapiens
FWMASRSTR

SEQ ID NO: 222629 - protein, 9 aa, Homo Sapiens
VGFSAGEVH

SEQ ID NO: 222630 - protein, 9 aa, Homo Sapiens
VNPAPTTPV

SEQ ID NO: 222631 - protein, 9 aa, Homo Sapiens
PLSNETATD

SEQ ID NO: 222632 - protein, 9 aa, Homo Sapiens
AGRRSGGRM

SEQ ID NO: 222633 - protein, 9 aa, Homo Sapiens
FGQAVKAYD

SEQ ID NO: 222634 - protein, 9 aa, Homo Sapiens
TWNPVMKMK

SEQ ID NO: 222635 - protein, 9 aa, Homo Sapiens
MCPPGITGI

SEQ ID NO: 222636 - protein, 9 aa, Homo Sapiens
HPLWLWKAS

SEQ ID NO: 222637 - protein, 9 aa, Homo Sapiens
YANIVLSGS

SEQ ID NO: 222638 - protein, 9 aa, Homo Sapiens
EGQPMRCLH

SEQ ID NO: 222639 - protein, 9 aa, Homo Sapiens
DEYKKTYME

SEQ ID NO: 222640 - protein, 9 aa, Homo Sapiens
QLNQRLQHQ

SEQ ID NO: 222641 - protein, 9 aa, Homo Sapiens
AAWAPGAPG

SEQ ID NO: 222642 - protein, 9 aa, Homo Sapiens
DQVRRYCTA

SEQ ID NO: 222643 - protein, 9 aa, Homo Sapiens
PSEILGSVD

SEQ ID NO: 222644 - protein, 9 aa, Homo Sapiens
CIREKGGEQ

SEQ ID NO: 222645 - protein, 9 aa, Homo Sapiens
GCCSAASST

SEQ ID NO: 222646 - protein, 9 aa, Homo Sapiens
TTPPASSGT

SEQ ID NO: 222647 - protein, 9 aa, Homo Sapiens
SSRRVPRGS

SEQ ID NO: 222648 - protein, 9 aa, Homo Sapiens
VSREDQQQQ

SEQ ID NO: 222649 - protein, 9 aa, Homo Sapiens
NTLPPIVNP

SEQ ID NO: 222650 - protein, 9 aa, Homo Sapiens
SVAKPLVGS

SEQ ID NO: 222651 - protein, 9 aa, Homo Sapiens
GAVCGPGFS

SEQ ID NO: 222652 - protein, 9 aa, Homo Sapiens
VEALCGMTT

SEQ ID NO: 222653 - protein, 9 aa, Homo Sapiens
LPLHLANFL

SEQ ID NO: 222654 - protein, 9 aa, Homo Sapiens
SCSRPFSSA

SEQ ID NO: 222655 - protein, 9 aa, Homo Sapiens
RLNVMSQNP

SEQ ID NO: 222656 - protein, 9 aa, Homo Sapiens
HRLLLVTQG

SEQ ID NO: 222657 - protein, 9 aa, Homo Sapiens
APGPSPLVA

SEQ ID NO: 222658 - protein, 9 aa, Homo Sapiens
CERVVEELE

SEQ ID NO: 222659 - protein, 9 aa, Homo Sapiens
LPDLRSMRI

SEQ ID NO: 222660 - protein, 9 aa, Homo Sapiens
QDTNLQQLV

SEQ ID NO: 222661 - protein, 9 aa, Homo Sapiens
QRKMKQRKN

SEQ ID NO: 222662 - protein, 9 aa, Homo Sapiens
DMTLYSLLR

SEQ ID NO: 222663 - protein, 9 aa, Homo Sapiens
PPRLLNLCQ

SEQ ID NO: 222664 - protein, 9 aa, Homo Sapiens
MPETYQVRL

SEQ ID NO: 222665 - protein, 9 aa, Homo Sapiens
QAQLIVEQK

SEQ ID NO: 222666 - protein, 9 aa, Homo Sapiens
SNILKSARK

SEQ ID NO: 222667 - protein, 9 aa, Homo Sapiens
VPPSTMCPA

SEQ ID NO: 222668 - protein, 9 aa, Homo Sapiens
GDDPPGGRP

SEQ ID NO: 222669 - protein, 9 aa, Homo Sapiens
HLHRQISLP

SEQ ID NO: 222670 - protein, 9 aa, Homo Sapiens
GLVGLFRAG

SEQ ID NO: 222671 - protein, 9 aa, Homo Sapiens
QFGEVELSR

SEQ ID NO: 222672 - protein, 9 aa, Homo Sapiens
STWHVAHTF

SEQ ID NO: 222673 - protein, 9 aa, Homo Sapiens
PVETNGPDV

SEQ ID NO: 222674 - protein, 9 aa, Homo Sapiens
RCALPNRPG

SEQ ID NO: 222675 - protein, 9 aa, Homo Sapiens
LDQPHMLNH

SEQ ID NO: 222676 - protein, 9 aa, Homo Sapiens
VGLVGLGPP

SEQ ID NO: 222677 - protein, 9 aa, Homo Sapiens
AGPGLRARS

SEQ ID NO: 222678 - protein, 9 aa, Homo Sapiens
MGIPAATNS

SEQ ID NO: 222679 - protein, 9 aa, Homo Sapiens
SSVKLVWTE

SEQ ID NO: 222680 - protein, 9 aa, Homo Sapiens
LPLEDVWWG

SEQ ID NO: 222681 - protein, 9 aa, Homo Sapiens
TTARLWYKT

SEQ ID NO: 222682 - protein, 9 aa, Homo Sapiens
LECPISARS

SEQ ID NO: 222683 - protein, 9 aa, Homo Sapiens
QSQAQMYLW

SEQ ID NO: 222684 - protein, 9 aa, Homo Sapiens
PLSRQPVRP

SEQ ID NO: 222685 - protein, 9 aa, Homo Sapiens
AWNGFSNLV

SEQ ID NO: 222686 - protein, 9 aa, Homo Sapiens
ACWGPQRGQ

SEQ ID NO: 222687 - protein, 9 aa, Homo Sapiens
SITKIHQSV

SEQ ID NO: 222688 - protein, 9 aa, Homo Sapiens
AQPLRPLAR

SEQ ID NO: 222689 - protein, 9 aa, Homo Sapiens
PIGHLSILW

SEQ ID NO: 222690 - protein, 9 aa, Homo Sapiens
NLLLELDHH

SEQ ID NO: 222691 - protein, 9 aa, Homo Sapiens
DAVNDVQLL

SEQ ID NO: 222692 - protein, 9 aa, Homo Sapiens
CLTSGTLSA

SEQ ID NO: 222693 - protein, 9 aa, Homo Sapiens
GVLEWCIGT

SEQ ID NO: 222694 - protein, 9 aa, Homo Sapiens
DGSTLRTLH

SEQ ID NO: 222695 - protein, 9 aa, Homo Sapiens
RGRRGSRRR

SEQ ID NO: 222696 - protein, 9 aa, Homo Sapiens
RQLATRAPC

SEQ ID NO: 222697 - protein, 9 aa, Homo Sapiens
PRGMAFVPF

SEQ ID NO: 222698 - protein, 9 aa, Homo Sapiens
PRHSSVLAT

SEQ ID NO: 222699 - protein, 9 aa, Homo Sapiens
LHRLTVGKS

SEQ ID NO: 222700 - protein, 9 aa, Homo Sapiens
APGPCWSLS

SEQ ID NO: 222701 - protein, 9 aa, Homo Sapiens
SSYHQYGGT

SEQ ID NO: 222702 - protein, 9 aa, Homo Sapiens
WVDSIPDIL

SEQ ID NO: 222703 - protein, 9 aa, Homo Sapiens
QTLNLMRQL

SEQ ID NO: 222704 - protein, 9 aa, Homo Sapiens
TWMGSLLMA

SEQ ID NO: 222705 - protein, 9 aa, Homo Sapiens
KIRSSSRPG

SEQ ID NO: 222706 - protein, 9 aa, Homo Sapiens
AARLGRTQH

SEQ ID NO: 222707 - protein, 9 aa, Homo Sapiens
SLLAPKTTL

SEQ ID NO: 222708 - protein, 9 aa, Homo Sapiens
VISCFWSIP

SEQ ID NO: 222709 - protein, 9 aa, Homo Sapiens
LCQEKYQLQ

SEQ ID NO: 222710 - protein, 9 aa, Homo Sapiens
HSYMLAKLY

SEQ ID NO: 222711 - protein, 9 aa, Homo Sapiens
TLLVRYWHY

SEQ ID NO: 222712 - protein, 9 aa, Homo Sapiens
ASFTYLTTL

SEQ ID NO: 222713 - protein, 9 aa, Homo Sapiens
YAAPSSAPF

SEQ ID NO: 222714 - protein, 9 aa, Homo Sapiens
IQRNLSASV

SEQ ID NO: 222715 - protein, 9 aa, Homo Sapiens
QYRCKDCDQ

SEQ ID NO: 222716 - protein, 9 aa, Homo Sapiens
QHGCVVPES

SEQ ID NO: 222717 - protein, 9 aa, Homo Sapiens
PAVLLVVEH

SEQ ID NO: 222718 - protein, 9 aa, Homo Sapiens
MEAKWEEET

SEQ ID NO: 222719 - protein, 9 aa, Homo Sapiens
RALPMTCPT

SEQ ID NO: 222720 - protein, 9 aa, Homo Sapiens
TRHCARQLA

SEQ ID NO: 222721 - protein, 9 aa, Homo Sapiens
QHLFTIKQS

SEQ ID NO: 222722 - protein, 9 aa, Homo Sapiens
VALHLDDLS

SEQ ID NO: 222723 - protein, 9 aa, Homo Sapiens
LKIMQLMEK

SEQ ID NO: 222724 - protein, 9 aa, Homo Sapiens
PRRCWTGAV

SEQ ID NO: 222725 - protein, 9 aa, Homo Sapiens
SFGQAVKAY

SEQ ID NO: 222726 - protein, 9 aa, Homo Sapiens
PPLIPLLGD

SEQ ID NO: 222727 - protein, 9 aa, Homo Sapiens
PPSRCESAA

SEQ ID NO: 222728 - protein, 9 aa, Homo Sapiens
IIETKPSNF

SEQ ID NO: 222729 - protein, 9 aa, Homo Sapiens
ALEQEIPFV

SEQ ID NO: 222730 - protein, 9 aa, Homo Sapiens
QSLMLMTTS

SEQ ID NO: 222731 - protein, 9 aa, Homo Sapiens
WSGLRIHGP

SEQ ID NO: 222732 - protein, 9 aa, Homo Sapiens
PVRQSTSQP

SEQ ID NO: 222733 - protein, 9 aa, Homo Sapiens
LGGCPLSLW

SEQ ID NO: 222734 - protein, 9 aa, Homo Sapiens
TEGPPCIRT

SEQ ID NO: 222735 - protein, 9 aa, Homo Sapiens
LVLTDEKSL

SEQ ID NO: 222736 - protein, 9 aa, Homo Sapiens
QNPDRPTHL

SEQ ID NO: 222737 - protein, 9 aa, Homo Sapiens
NLPAWTLTS

SEQ ID NO: 222738 - protein, 9 aa, Homo Sapiens
AHHPLAHQH

SEQ ID NO: 222739 - protein, 9 aa, Homo Sapiens
GCVVPESKL

SEQ ID NO: 222740 - protein, 9 aa, Homo Sapiens
PSASLHPAS

SEQ ID NO: 222741 - protein, 9 aa, Homo Sapiens
RQDRVQVHG

SEQ ID NO: 222742 - protein, 9 aa, Homo Sapiens
MELKHVLAH

SEQ ID NO: 222743 - protein, 9 aa, Homo Sapiens
PKTLTWHST

SEQ ID NO: 222744 - protein, 9 aa, Homo Sapiens
TTPGAEGWW

SEQ ID NO: 222745 - protein, 9 aa, Homo Sapiens
NHMLLCTAL

SEQ ID NO: 222746 - protein, 9 aa, Homo Sapiens
TSWIEMVGD

SEQ ID NO: 222747 - protein, 9 aa, Homo Sapiens
LEEAVSGSG

SEQ ID NO: 222748 - protein, 9 aa, Homo Sapiens
PYFEASDYK

SEQ ID NO: 222749 - protein, 9 aa, Homo Sapiens
FEYPKLLGK

SEQ ID NO: 222750 - protein, 9 aa, Homo Sapiens
LHICDASQG

SEQ ID NO: 222751 - protein, 9 aa, Homo Sapiens
IPTLHYAIS

SEQ ID NO: 222752 - protein, 9 aa, Homo Sapiens
ITTEAGQLA

SEQ ID NO: 222753 - protein, 9 aa, Homo Sapiens
TGARWPPLT

SEQ ID NO: 222754 - protein, 9 aa, Homo Sapiens
GFEDEDKKV

SEQ ID NO: 222755 - protein, 9 aa, Homo Sapiens
ALLLQPRRG

SEQ ID NO: 222756 - protein, 9 aa, Homo Sapiens
NIGCRFPYF

SEQ ID NO: 222757 - protein, 9 aa, Homo Sapiens
RVHTGEKPC

SEQ ID NO: 222758 - protein, 9 aa, Homo Sapiens
HGMEPGADR

SEQ ID NO: 222759 - protein, 9 aa, Homo Sapiens
SPHSWKTSG

SEQ ID NO: 222760 - protein, 9 aa, Homo Sapiens
LTSTRIDRL

SEQ ID NO: 222761 - protein, 9 aa, Homo Sapiens
TQSFPSLGY

SEQ ID NO: 222762 - protein, 9 aa, Homo Sapiens
VTTVLESWG

SEQ ID NO: 222763 - protein, 9 aa, Homo Sapiens
GTVAYVRAT

SEQ ID NO: 222764 - protein, 9 aa, Homo Sapiens
RVFSFCNKI

SEQ ID NO: 222765 - protein, 9 aa, Homo Sapiens
EAWMQTNYD

SEQ ID NO: 222766 - protein, 9 aa, Homo Sapiens
GGGLGGKRS

SEQ ID NO: 222767 - protein, 9 aa, Homo Sapiens
YRDELGAGS

SEQ ID NO: 222768 - protein, 9 aa, Homo Sapiens
TLVVLHQAG

SEQ ID NO: 222769 - protein, 9 aa, Homo Sapiens
HSFRTASVS

SEQ ID NO: 222770 - protein, 9 aa, Homo Sapiens
VEGLLPCNL

SEQ ID NO: 222771 - protein, 9 aa, Homo Sapiens
LVFNPDTEL

SEQ ID NO: 222772 - protein, 9 aa, Homo Sapiens
EDDDDDDDN

SEQ ID NO: 222773 - protein, 9 aa, Homo Sapiens
SGLFGQVFR

SEQ ID NO: 222774 - protein, 9 aa, Homo Sapiens
ETQEHLEAA

SEQ ID NO: 222775 - protein, 9 aa, Homo Sapiens
LGKFASSQK

SEQ ID NO: 222776 - protein, 9 aa, Homo Sapiens
LAPPETYQQ

SEQ ID NO: 222777 - protein, 9 aa, Homo Sapiens
PSSAPFGAS

SEQ ID NO: 222778 - protein, 9 aa, Homo Sapiens
NDRPSMRSD

SEQ ID NO: 222779 - protein, 9 aa, Homo Sapiens
PRLQVHCND

SEQ ID NO: 222780 - protein, 9 aa, Homo Sapiens
RPLPPQSRT

SEQ ID NO: 222781 - protein, 9 aa, Homo Sapiens
KDRQIGKIL

SEQ ID NO: 222782 - protein, 9 aa, Homo Sapiens
RQDLRAPAL

SEQ ID NO: 222783 - protein, 9 aa, Homo Sapiens
GSEIPPPAP

SEQ ID NO: 222784 - protein, 9 aa, Homo Sapiens
ASTCPNRSP

SEQ ID NO: 222785 - protein, 9 aa, Homo Sapiens
RIPRRTHLC

SEQ ID NO: 222786 - protein, 9 aa, Homo Sapiens
SCPPRSSTS

SEQ ID NO: 222787 - protein, 9 aa, Homo Sapiens
QTKVKSVFV

SEQ ID NO: 222788 - protein, 9 aa, Homo Sapiens
HTVIEHAVR

SEQ ID NO: 222789 - protein, 9 aa, Homo Sapiens
LVSRHLCEL

SEQ ID NO: 222790 - protein, 9 aa, Homo Sapiens
RDCSWRGQC

SEQ ID NO: 222791 - protein, 9 aa, Homo Sapiens
VDVIAKALV

SEQ ID NO: 222792 - protein, 9 aa, Homo Sapiens
HSAMGPGSH

SEQ ID NO: 222793 - protein, 9 aa, Homo Sapiens
TAPTPPRRS

SEQ ID NO: 222794 - protein, 9 aa, Homo Sapiens
CPPPVTPLR

SEQ ID NO: 222795 - protein, 9 aa, Homo Sapiens
MDVPMSDLA

SEQ ID NO: 222796 - protein, 9 aa, Homo Sapiens
KTAEGHGFK

SEQ ID NO: 222797 - protein, 9 aa, Homo Sapiens
GITGICWLL

SEQ ID NO: 222798 - protein, 9 aa, Homo Sapiens
VQVTFSPGL

SEQ ID NO: 222799 - protein, 9 aa, Homo Sapiens
VLEGIPAGS

SEQ ID NO: 222800 - protein, 9 aa, Homo Sapiens
SGESGTGKT

SEQ ID NO: 222801 - protein, 9 aa, Homo Sapiens
PVISRWDSP

SEQ ID NO: 222802 - protein, 9 aa, Homo Sapiens
LYRNPNGTN

SEQ ID NO: 222803 - protein, 9 aa, Homo Sapiens
RNRIQCCTA

SEQ ID NO: 222804 - protein, 9 aa, Homo Sapiens
SHPPEAKLL

SEQ ID NO: 222805 - protein, 9 aa, Homo Sapiens
QHVLGAGVV

SEQ ID NO: 222806 - protein, 9 aa, Homo Sapiens
TPSPVSGSW

SEQ ID NO: 222807 - protein, 9 aa, Homo Sapiens
VEAVLLQQD

SEQ ID NO: 222808 - protein, 9 aa, Homo Sapiens
GWWQLLGLL

SEQ ID NO: 222809 - protein, 9 aa, Homo Sapiens
GPPFPHLLQ

SEQ ID NO: 222810 - protein, 9 aa, Homo Sapiens
RHTFWVVFV

SEQ ID NO: 222811 - protein, 9 aa, Homo Sapiens
LPSPPVRST

SEQ ID NO: 222812 - protein, 9 aa, Homo Sapiens
LCCADRGAL

SEQ ID NO: 222813 - protein, 9 aa, Homo Sapiens
SGPIGHLSI

SEQ ID NO: 222814 - protein, 9 aa, Homo Sapiens
SVSFTYSLS

SEQ ID NO: 222815 - protein, 9 aa, Homo Sapiens
EDVIISKFF

SEQ ID NO: 222816 - protein, 9 aa, Homo Sapiens
RLVVLCRVG

SEQ ID NO: 222817 - protein, 9 aa, Homo Sapiens
APRHCLWLW

SEQ ID NO: 222818 - protein, 9 aa, Homo Sapiens
ACLHLPSPP

SEQ ID NO: 222819 - protein, 9 aa, Homo Sapiens
VPRWRCRGL

SEQ ID NO: 222820 - protein, 9 aa, Homo Sapiens
HYPINMDFK

SEQ ID NO: 222821 - protein, 9 aa, Homo Sapiens
KNTSMWTSR

SEQ ID NO: 222822 - protein, 9 aa, Homo Sapiens
AARIRAARE

SEQ ID NO: 222823 - protein, 9 aa, Homo Sapiens
EECTKHDRQ

SEQ ID NO: 222824 - protein, 9 aa, Homo Sapiens
TLSSSPNNL

SEQ ID NO: 222825 - protein, 9 aa, Homo Sapiens
CSWGLPRLM

SEQ ID NO: 222826 - protein, 9 aa, Homo Sapiens
ASRLPRMPG

SEQ ID NO: 222827 - protein, 9 aa, Homo Sapiens
CQVSHGHPL

SEQ ID NO: 222828 - protein, 9 aa, Homo Sapiens
TPWSPLSTT

SEQ ID NO: 222829 - protein, 9 aa, Homo Sapiens
CWELHAKVE

SEQ ID NO: 222830 - protein, 9 aa, Homo Sapiens
PRSGQGSNR

SEQ ID NO: 222831 - protein, 9 aa, Homo Sapiens
GAPRSWGCT

SEQ ID NO: 222832 - protein, 9 aa, Homo Sapiens
LKRNVKVSH

SEQ ID NO: 222833 - protein, 9 aa, Homo Sapiens
ARRGEPVLL

SEQ ID NO: 222834 - protein, 9 aa, Homo Sapiens
IVTAAHCFQ

SEQ ID NO: 222835 - protein, 9 aa, Homo Sapiens
IWKCIGEDS

SEQ ID NO: 222836 - protein, 9 aa, Homo Sapiens
KMVDVGGRG

SEQ ID NO: 222837 - protein, 9 aa, Homo Sapiens
LPAVLEKEN

SEQ ID NO: 222838 - protein, 9 aa, Homo Sapiens
MYEESVPVS

SEQ ID NO: 222839 - protein, 9 aa, Homo Sapiens
EEEERLRLE

SEQ ID NO: 222840 - protein, 9 aa, Homo Sapiens
LGRTMTHEH

SEQ ID NO: 222841 - protein, 9 aa, Homo Sapiens
VEFSELNLV

SEQ ID NO: 222842 - protein, 9 aa, Homo Sapiens
FGKLYLLLA

SEQ ID NO: 222843 - protein, 9 aa, Homo Sapiens
TENPNYALK

SEQ ID NO: 222844 - protein, 9 aa, Homo Sapiens
SLLFGDVAS

SEQ ID NO: 222845 - protein, 9 aa, Homo Sapiens
VPVATDDPD

SEQ ID NO: 222846 - protein, 9 aa, Homo Sapiens
ELPRERKRL

SEQ ID NO: 222847 - protein, 9 aa, Homo Sapiens
CHDNIVRVV

SEQ ID NO: 222848 - protein, 9 aa, Homo Sapiens
LCVVRQVTH

SEQ ID NO: 222849 - protein, 9 aa, Homo Sapiens
GGPAGWARQ

SEQ ID NO: 222850 - protein, 9 aa, Homo Sapiens
NVLSVSPGQ

SEQ ID NO: 222851 - protein, 9 aa, Homo Sapiens
GQLHPRRRW

SEQ ID NO: 222852 - protein, 9 aa, Homo Sapiens
LESGERGVL

SEQ ID NO: 222853 - protein, 9 aa, Homo Sapiens
DRQMPSFGE

SEQ ID NO: 222854 - protein, 9 aa, Homo Sapiens
LVMLEIVTE

SEQ ID NO: 222855 - protein, 9 aa, Homo Sapiens
AVRAPHAAH

SEQ ID NO: 222856 - protein, 9 aa, Homo Sapiens
SLDPIMRKM

SEQ ID NO: 222857 - protein, 9 aa, Homo Sapiens
QELTDRVGE

SEQ ID NO: 222858 - protein, 9 aa, Homo Sapiens
RRSCPTLRA

SEQ ID NO: 222859 - protein, 9 aa, Homo Sapiens
APDELRTAL

SEQ ID NO: 222860 - protein, 9 aa, Homo Sapiens
APSALVLLA

SEQ ID NO: 222861 - protein, 9 aa, Homo Sapiens
RQLITQVML

SEQ ID NO: 222862 - protein, 9 aa, Homo Sapiens
RLWGSHLTF

SEQ ID NO: 222863 - protein, 9 aa, Homo Sapiens
RKVICIVGK

SEQ ID NO: 222864 - protein, 9 aa, Homo Sapiens
PGPRLRTAT

SEQ ID NO: 222865 - protein, 9 aa, Homo Sapiens
LTTQSWIPQ

SEQ ID NO: 222866 - protein, 9 aa, Homo Sapiens
ALLQPPHSA

SEQ ID NO: 222867 - protein, 9 aa, Homo Sapiens
SNSSAIPLP

SEQ ID NO: 222868 - protein, 9 aa, Homo Sapiens
TMADLDNIA

SEQ ID NO: 222869 - protein, 9 aa, Homo Sapiens
NTTTGSCCW

SEQ ID NO: 222870 - protein, 9 aa, Homo Sapiens
VLSSFRSRN

SEQ ID NO: 222871 - protein, 9 aa, Homo Sapiens
PQPWKRGRT

SEQ ID NO: 222872 - protein, 9 aa, Homo Sapiens
MVTAKRPWH

SEQ ID NO: 222873 - protein, 9 aa, Homo Sapiens
GSHTGEKPY

SEQ ID NO: 222874 - protein, 9 aa, Homo Sapiens
RLLSNLTEI

SEQ ID NO: 222875 - protein, 9 aa, Homo Sapiens
PWSPLSTTP

SEQ ID NO: 222876 - protein, 9 aa, Homo Sapiens
WATGPSVPS

SEQ ID NO: 222877 - protein, 9 aa, Homo Sapiens
TAVLLPCTF

SEQ ID NO: 222878 - protein, 9 aa, Homo Sapiens
SPHLNQIMK

SEQ ID NO: 222879 - protein, 9 aa, Homo Sapiens
NTEEACKAI

SEQ ID NO: 222880 - protein, 9 aa, Homo Sapiens
LCQSTEPGD

SEQ ID NO: 222881 - protein, 9 aa, Homo Sapiens
EQSLYSPAD

SEQ ID NO: 222882 - protein, 9 aa, Homo Sapiens
YIQKIKSGD

SEQ ID NO: 222883 - protein, 9 aa, Homo Sapiens
SRISFSQHA

SEQ ID NO: 222884 - protein, 9 aa, Homo Sapiens
MGGMSRTPP

SEQ ID NO: 222885 - protein, 9 aa, Homo Sapiens
ARGLKRSSS

SEQ ID NO: 222886 - protein, 9 aa, Homo Sapiens
SSCLQTSNN

SEQ ID NO: 222887 - protein, 9 aa, Homo Sapiens
TQGPSSTFL

SEQ ID NO: 222888 - protein, 9 aa, Homo Sapiens
GARPPAPRR

SEQ ID NO: 222889 - protein, 9 aa, Homo Sapiens
NEQPIIFAL

SEQ ID NO: 222890 - protein, 9 aa, Homo Sapiens
SQTRPLWSR

SEQ ID NO: 222891 - protein, 9 aa, Homo Sapiens
ALQLHESLH

SEQ ID NO: 222892 - protein, 9 aa, Homo Sapiens
RGTGIGVHP

SEQ ID NO: 222893 - protein, 9 aa, Homo Sapiens
SETGKRPFI

SEQ ID NO: 222894 - protein, 9 aa, Homo Sapiens
MGNLDDFAE

SEQ ID NO: 222895 - protein, 9 aa, Homo Sapiens
LTHRSHLHE

SEQ ID NO: 222896 - protein, 9 aa, Homo Sapiens
CYILFLVLH

SEQ ID NO: 222897 - protein, 9 aa, Homo Sapiens
PAPASPGTH

SEQ ID NO: 222898 - protein, 9 aa, Homo Sapiens
HVPRWRCRG

SEQ ID NO: 222899 - protein, 9 aa, Homo Sapiens
SFVQPCTCP

SEQ ID NO: 222900 - protein, 9 aa, Homo Sapiens
LTPGMPDPS

SEQ ID NO: 222901 - protein, 9 aa, Homo Sapiens
QGHYREFCQ

SEQ ID NO: 222902 - protein, 9 aa, Homo Sapiens
PISTQSFPS

SEQ ID NO: 222903 - protein, 9 aa, Homo Sapiens
QQQQQQVSA

SEQ ID NO: 222904 - protein, 9 aa, Homo Sapiens
TLYSLLRAK

SEQ ID NO: 222905 - protein, 9 aa, Homo Sapiens
SFDCGPFIG

SEQ ID NO: 222906 - protein, 9 aa, Homo Sapiens
WCLSCSLTA

SEQ ID NO: 222907 - protein, 9 aa, Homo Sapiens
FLPWMAACA

SEQ ID NO: 222908 - protein, 9 aa, Homo Sapiens
SSSSHNRGP

SEQ ID NO: 222909 - protein, 9 aa, Homo Sapiens
CARQLATRA

SEQ ID NO: 222910 - protein, 9 aa, Homo Sapiens
KSGSSSCKG

SEQ ID NO: 222911 - protein, 9 aa, Homo Sapiens
PHVPRWRCR

SEQ ID NO: 222912 - protein, 9 aa, Homo Sapiens
ALELTLPNI

SEQ ID NO: 222913 - protein, 9 aa, Homo Sapiens
PFVAQTSWT

SEQ ID NO: 222914 - protein, 9 aa, Homo Sapiens
NNPYRMWPR

SEQ ID NO: 222915 - protein, 9 aa, Homo Sapiens
DNTEDIAQR

SEQ ID NO: 222916 - protein, 9 aa, Homo Sapiens
GFEGHACEC

SEQ ID NO: 222917 - protein, 9 aa, Homo Sapiens
RAVEGMLRI

SEQ ID NO: 222918 - protein, 9 aa, Homo Sapiens
KLTLDESCD

SEQ ID NO: 222919 - protein, 9 aa, Homo Sapiens
LNPNRTYLL

SEQ ID NO: 222920 - protein, 9 aa, Homo Sapiens
LRSHQRKLR

SEQ ID NO: 222921 - protein, 9 aa, Homo Sapiens
EKSRWSGSH

SEQ ID NO: 222922 - protein, 9 aa, Homo Sapiens
MVYVLYKTL

SEQ ID NO: 222923 - protein, 9 aa, Homo Sapiens
RAEPQQQRR

SEQ ID NO: 222924 - protein, 9 aa, Homo Sapiens
IGKGSFGQA

SEQ ID NO: 222925 - protein, 9 aa, Homo Sapiens
CTASGSWNY

SEQ ID NO: 222926 - protein, 9 aa, Homo Sapiens
SGKGEAQCR

SEQ ID NO: 222927 - protein, 9 aa, Homo Sapiens
GLYCFPSSD

SEQ ID NO: 222928 - protein, 9 aa, Homo Sapiens
PAAAGCSWT

SEQ ID NO: 222929 - protein, 9 aa, Homo Sapiens
EKPCKCHEC

SEQ ID NO: 222930 - protein, 9 aa, Homo Sapiens
EMVGDMTMV

SEQ ID NO: 222931 - protein, 9 aa, Homo Sapiens
SHGVGRVLA

SEQ ID NO: 222932 - protein, 9 aa, Homo Sapiens
GGSVSTSQP

SEQ ID NO: 222933 - protein, 9 aa, Homo Sapiens
CPISARSLQ

SEQ ID NO: 222934 - protein, 9 aa, Homo Sapiens
HGVKRRHHK

SEQ ID NO: 222935 - protein, 9 aa, Homo Sapiens
KLDLSLNFG

SEQ ID NO: 222936 - protein, 9 aa, Homo Sapiens
EEEPPRLLN

SEQ ID NO: 222937 - protein, 9 aa, Homo Sapiens
TASQHSNSS

SEQ ID NO: 222938 - protein, 9 aa, Homo Sapiens
TSFGYRCAL

SEQ ID NO: 222939 - protein, 9 aa, Homo Sapiens
DQLMSHSHL

SEQ ID NO: 222940 - protein, 9 aa, Homo Sapiens
ANFRRCCWY

SEQ ID NO: 222941 - protein, 9 aa, Homo Sapiens
LHSCDPPSS

SEQ ID NO: 222942 - protein, 9 aa, Homo Sapiens
SHSEATQAE

SEQ ID NO: 222943 - protein, 9 aa, Homo Sapiens
GSLKSNILK

SEQ ID NO: 222944 - protein, 9 aa, Homo Sapiens
LQSQNLNCI

SEQ ID NO: 222945 - protein, 9 aa, Homo Sapiens
LAHQHRLLL

SEQ ID NO: 222946 - protein, 9 aa, Homo Sapiens
NCEQLRGQR

SEQ ID NO: 222947 - protein, 9 aa, Homo Sapiens
PPGWLPRLT

SEQ ID NO: 222948 - protein, 9 aa, Homo Sapiens
PRLGCPVST

SEQ ID NO: 222949 - protein, 9 aa, Homo Sapiens
LSALQDLCW

SEQ ID NO: 222950 - protein, 9 aa, Homo Sapiens
ISERYVPVF

SEQ ID NO: 222951 - protein, 9 aa, Homo Sapiens
MEMHYGHQA

SEQ ID NO: 222952 - protein, 9 aa, Homo Sapiens
TQSRDCVAA

SEQ ID NO: 222953 - protein, 9 aa, Homo Sapiens
RARASYSPA

SEQ ID NO: 222954 - protein, 9 aa, Homo Sapiens
QSLFNRGKW

SEQ ID NO: 222955 - protein, 9 aa, Homo Sapiens
PRGRAPQDQ

SEQ ID NO: 222956 - protein, 9 aa, Homo Sapiens
SARSLLRLE

SEQ ID NO: 222957 - protein, 9 aa, Homo Sapiens
SPERRCRYW

SEQ ID NO: 222958 - protein, 9 aa, Homo Sapiens
RYATICNPL

SEQ ID NO: 222959 - protein, 9 aa, Homo Sapiens
TTARNLLTS

SEQ ID NO: 222960 - protein, 9 aa, Homo Sapiens
DDQRSENYR

SEQ ID NO: 222961 - protein, 9 aa, Homo Sapiens
RLPTGLYCF

SEQ ID NO: 222962 - protein, 9 aa, Homo Sapiens
LAAITMDER

SEQ ID NO: 222963 - protein, 9 aa, Homo Sapiens
DLVFDLYEG

SEQ ID NO: 222964 - protein, 9 aa, Homo Sapiens
SRVWPSTTT

SEQ ID NO: 222965 - protein, 9 aa, Homo Sapiens
PKSTMMEKR

SEQ ID NO: 222966 - protein, 9 aa, Homo Sapiens
TGEEPYKCS

SEQ ID NO: 222967 - protein, 9 aa, Homo Sapiens
NNPPGNWKS

SEQ ID NO: 222968 - protein, 9 aa, Homo Sapiens
YAQGTLQGI

SEQ ID NO: 222969 - protein, 9 aa, Homo Sapiens
LQRDIEQHN

SEQ ID NO: 222970 - protein, 9 aa, Homo Sapiens
EAITWLMWT

SEQ ID NO: 222971 - protein, 9 aa, Homo Sapiens
ATGLLKPKI

SEQ ID NO: 222972 - protein, 9 aa, Homo Sapiens
DTEEQNPEP

SEQ ID NO: 222973 - protein, 9 aa, Homo Sapiens
GRQAITSHM

SEQ ID NO: 222974 - protein, 9 aa, Homo Sapiens
FQYSHLQRT

SEQ ID NO: 222975 - protein, 9 aa, Homo Sapiens
QPERLLFII

SEQ ID NO: 222976 - protein, 9 aa, Homo Sapiens
QQRPAQSVN

SEQ ID NO: 222977 - protein, 9 aa, Homo Sapiens
PQSMPPPPS

SEQ ID NO: 222978 - protein, 9 aa, Homo Sapiens
KPALLEPFL

SEQ ID NO: 222979 - protein, 9 aa, Homo Sapiens
ADSWDIIID

SEQ ID NO: 222980 - protein, 9 aa, Homo Sapiens
RRRRLLVFR

SEQ ID NO: 222981 - protein, 9 aa, Homo Sapiens
RHRRRGAPG

SEQ ID NO: 222982 - protein, 9 aa, Homo Sapiens
LIVFAIWLA

SEQ ID NO: 222983 - protein, 9 aa, Homo Sapiens
KIQGIVGAG

SEQ ID NO: 222984 - protein, 9 aa, Homo Sapiens
PVSGSWCGT

SEQ ID NO: 222985 - protein, 9 aa, Homo Sapiens
HSCDPPSSM

SEQ ID NO: 222986 - protein, 9 aa, Homo Sapiens
AGAWQVFER

SEQ ID NO: 222987 - protein, 9 aa, Homo Sapiens
APVRALPMT

SEQ ID NO: 222988 - protein, 9 aa, Homo Sapiens
FKEFFAAMY

SEQ ID NO: 222989 - protein, 9 aa, Homo Sapiens
CSALSKLNV

SEQ ID NO: 222990 - protein, 9 aa, Homo Sapiens
KYKDCDPQG

SEQ ID NO: 222991 - protein, 9 aa, Homo Sapiens
NTSLILAAA

SEQ ID NO: 222992 - protein, 9 aa, Homo Sapiens
VNYSDHMID

SEQ ID NO: 222993 - protein, 9 aa, Homo Sapiens
GADGQRVLQ

SEQ ID NO: 222994 - protein, 9 aa, Homo Sapiens
KLELYEEVK

SEQ ID NO: 222995 - protein, 9 aa, Homo Sapiens
PSPDYCVHN

SEQ ID NO: 222996 - protein, 9 aa, Homo Sapiens
GYCSFKCLN

SEQ ID NO: 222997 - protein, 9 aa, Homo Sapiens
HSHLSWKLG

SEQ ID NO: 222998 - protein, 9 aa, Homo Sapiens
AAMMAITIM

SEQ ID NO: 222999 - protein, 9 aa, Homo Sapiens
LHKSMWKDR

SEQ ID NO: 223000 - protein, 9 aa, Homo Sapiens
PGSEIPPPA

SEQ ID NO: 223001 - protein, 9 aa, Homo Sapiens
LLLTTTCSR

SEQ ID NO: 223002 - protein, 9 aa, Homo Sapiens
LVRLMGPWH

SEQ ID NO: 223003 - protein, 9 aa, Homo Sapiens
DPNSQVGTC

SEQ ID NO: 223004 - protein, 9 aa, Homo Sapiens
EGTIQRTHM

SEQ ID NO: 223005 - protein, 9 aa, Homo Sapiens
GGGNKCVAC

SEQ ID NO: 223006 - protein, 9 aa, Homo Sapiens
KILRNNPYR

SEQ ID NO: 223007 - protein, 9 aa, Homo Sapiens
MTIPGRSTP

SEQ ID NO: 223008 - protein, 9 aa, Homo Sapiens
FSTAHKPCA

SEQ ID NO: 223009 - protein, 9 aa, Homo Sapiens
SASRAVEGM

SEQ ID NO: 223010 - protein, 9 aa, Homo Sapiens
PSWKGKGAS

SEQ ID NO: 223011 - protein, 9 aa, Homo Sapiens
QHLPPLASE

SEQ ID NO: 223012 - protein, 9 aa, Homo Sapiens
RLWSWCGTS

SEQ ID NO: 223013 - protein, 9 aa, Homo Sapiens
LFEELLEAA

SEQ ID NO: 223014 - protein, 9 aa, Homo Sapiens
IRSSSRPGG

SEQ ID NO: 223015 - protein, 9 aa, Homo Sapiens
SKKKIEKAS

SEQ ID NO: 223016 - protein, 9 aa, Homo Sapiens
NPVIEELQN

SEQ ID NO: 223017 - protein, 9 aa, Homo Sapiens
PPRALQTST

SEQ ID NO: 223018 - protein, 9 aa, Homo Sapiens
GSQDLILQQ

SEQ ID NO: 223019 - protein, 9 aa, Homo Sapiens
PCLSWPARC

SEQ ID NO: 223020 - protein, 9 aa, Homo Sapiens
DLNDQDRRI

SEQ ID NO: 223021 - protein, 9 aa, Homo Sapiens
GERGVLQWD

SEQ ID NO: 223022 - protein, 9 aa, Homo Sapiens
PCPVGKQQM

SEQ ID NO: 223023 - protein, 9 aa, Homo Sapiens
PSRCQRAIP

SEQ ID NO: 223024 - protein, 9 aa, Homo Sapiens
WMRVWRSSE

SEQ ID NO: 223025 - protein, 9 aa, Homo Sapiens
RQSCPSPAV

SEQ ID NO: 223026 - protein, 9 aa, Homo Sapiens
CADRGALSV

SEQ ID NO: 223027 - protein, 9 aa, Homo Sapiens
RSTPRLPVP

SEQ ID NO: 223028 - protein, 9 aa, Homo Sapiens
IPRQLPQMS

SEQ ID NO: 223029 - protein, 9 aa, Homo Sapiens
GKSSEREAY

SEQ ID NO: 223030 - protein, 9 aa, Homo Sapiens
ETIWDILPD

SEQ ID NO: 223031 - protein, 9 aa, Homo Sapiens
RPRFCAFGA

SEQ ID NO: 223032 - protein, 9 aa, Homo Sapiens
EEREQQLRR

SEQ ID NO: 223033 - protein, 9 aa, Homo Sapiens
SWASLAVDG

SEQ ID NO: 223034 - protein, 9 aa, Homo Sapiens
AFRWEELCE

SEQ ID NO: 223035 - protein, 9 aa, Homo Sapiens
KKKLEKKQD

SEQ ID NO: 223036 - protein, 9 aa, Homo Sapiens
DIEAIFQSM

SEQ ID NO: 223037 - protein, 9 aa, Homo Sapiens
PAGSPSTKW

SEQ ID NO: 223038 - protein, 9 aa, Homo Sapiens
IQDLVSGSV

SEQ ID NO: 223039 - protein, 9 aa, Homo Sapiens
RYRVVALKQ

SEQ ID NO: 223040 - protein, 9 aa, Homo Sapiens
LLLYHTPHA

SEQ ID NO: 223041 - protein, 9 aa, Homo Sapiens
SGGSGGCQY

SEQ ID NO: 223042 - protein, 9 aa, Homo Sapiens
SPPRLECPI

SEQ ID NO: 223043 - protein, 9 aa, Homo Sapiens
YGPSCRILD

SEQ ID NO: 223044 - protein, 9 aa, Homo Sapiens
RQRMEAAAC

SEQ ID NO: 223045 - protein, 9 aa, Homo Sapiens
CSTRQTSMQ

SEQ ID NO: 223046 - protein, 9 aa, Homo Sapiens
VDCGNTEVP

SEQ ID NO: 223047 - protein, 9 aa, Homo Sapiens
IIQVPREGH

SEQ ID NO: 223048 - protein, 9 aa, Homo Sapiens
PGPLGELVW

SEQ ID NO: 223049 - protein, 9 aa, Homo Sapiens
MRRLEERWE

SEQ ID NO: 223050 - protein, 9 aa, Homo Sapiens
HIDCYSCTA

SEQ ID NO: 223051 - protein, 9 aa, Homo Sapiens
LLWKRKYSS

SEQ ID NO: 223052 - protein, 9 aa, Homo Sapiens
VNNISINKV

SEQ ID NO: 223053 - protein, 9 aa, Homo Sapiens
ALFPPMEFP

SEQ ID NO: 223054 - protein, 9 aa, Homo Sapiens
PSRPRTACI

SEQ ID NO: 223055 - protein, 9 aa, Homo Sapiens
VAAWPSRRA

SEQ ID NO: 223056 - protein, 9 aa, Homo Sapiens
AGERSAEPP

SEQ ID NO: 223057 - protein, 9 aa, Homo Sapiens
RLPRMPGPP

SEQ ID NO: 223058 - protein, 9 aa, Homo Sapiens
KGAPGPCWS

SEQ ID NO: 223059 - protein, 9 aa, Homo Sapiens
PSYKVKVMG

SEQ ID NO: 223060 - protein, 9 aa, Homo Sapiens
NQGNAGVKR

SEQ ID NO: 223061 - protein, 9 aa, Homo Sapiens
LVDGVTLLL

SEQ ID NO: 223062 - protein, 9 aa, Homo Sapiens
ASPASPSDC

SEQ ID NO: 223063 - protein, 9 aa, Homo Sapiens
HSRSFSDLP

SEQ ID NO: 223064 - protein, 9 aa, Homo Sapiens
GSPMCSEQT

SEQ ID NO: 223065 - protein, 9 aa, Homo Sapiens
HLHSYQLEG

SEQ ID NO: 223066 - protein, 9 aa, Homo Sapiens
SVCSRSGER

SEQ ID NO: 223067 - protein, 9 aa, Homo Sapiens
PGCVYAATP

SEQ ID NO: 223068 - protein, 9 aa, Homo Sapiens
CTNSHLDPP

SEQ ID NO: 223069 - protein, 9 aa, Homo Sapiens
QVHHMLHLQ

SEQ ID NO: 223070 - protein, 9 aa, Homo Sapiens
KKQCRRMGH

SEQ ID NO: 223071 - protein, 9 aa, Homo Sapiens
DPRAADTAV

SEQ ID NO: 223072 - protein, 9 aa, Homo Sapiens
LSGVIHTSH

SEQ ID NO: 223073 - protein, 9 aa, Homo Sapiens
SEQNRSSEE

SEQ ID NO: 223074 - protein, 9 aa, Homo Sapiens
ENHMEESKA

SEQ ID NO: 223075 - protein, 9 aa, Homo Sapiens
KALVKTWTQ

SEQ ID NO: 223076 - protein, 9 aa, Homo Sapiens
PNHREREAM

SEQ ID NO: 223077 - protein, 9 aa, Homo Sapiens
AVEPGGCGW

SEQ ID NO: 223078 - protein, 9 aa, Homo Sapiens
RSGVLEWCI

SEQ ID NO: 223079 - protein, 9 aa, Homo Sapiens
YKDKKRHEM

SEQ ID NO: 223080 - protein, 9 aa, Homo Sapiens
DPGAAAGVQ

SEQ ID NO: 223081 - protein, 9 aa, Homo Sapiens
FYEVWEKLD

SEQ ID NO: 223082 - protein, 9 aa, Homo Sapiens
IEAQCYVVA

SEQ ID NO: 223083 - protein, 9 aa, Homo Sapiens
NMIPQMARV

SEQ ID NO: 223084 - protein, 9 aa, Homo Sapiens
WSSGGKLCQ

SEQ ID NO: 223085 - protein, 9 aa, Homo Sapiens
HLGVVFPEH

SEQ ID NO: 223086 - protein, 9 aa, Homo Sapiens
EALGKEVAC

SEQ ID NO: 223087 - protein, 9 aa, Homo Sapiens
LRLGPSEHW

SEQ ID NO: 223088 - protein, 9 aa, Homo Sapiens
GAGGPPSSS

SEQ ID NO: 223089 - protein, 9 aa, Homo Sapiens
GRPELSFAL

SEQ ID NO: 223090 - protein, 9 aa, Homo Sapiens
MKTAEGHGF

SEQ ID NO: 223091 - protein, 9 aa, Homo Sapiens
QRWIQNWSL

SEQ ID NO: 223092 - protein, 9 aa, Homo Sapiens
ARETRSGRP

SEQ ID NO: 223093 - protein, 9 aa, Homo Sapiens
EMMQDGTWR

SEQ ID NO: 223094 - protein, 9 aa, Homo Sapiens
PPRAPHPPP

SEQ ID NO: 223095 - protein, 9 aa, Homo Sapiens
PLSSLGTRM

SEQ ID NO: 223096 - protein, 9 aa, Homo Sapiens
VEWPQLLQG

SEQ ID NO: 223097 - protein, 9 aa, Homo Sapiens
ELLGGFLGN

SEQ ID NO: 223098 - protein, 9 aa, Homo Sapiens
SRSSPKRDM

SEQ ID NO: 223099 - protein, 9 aa, Homo Sapiens
PISARSLQR

SEQ ID NO: 223100 - protein, 9 aa, Homo Sapiens
WHNLSLNRY

SEQ ID NO: 223101 - protein, 9 aa, Homo Sapiens
EEWKKSQLL

SEQ ID NO: 223102 - protein, 9 aa, Homo Sapiens
ETYQVRLQQ

SEQ ID NO: 223103 - protein, 9 aa, Homo Sapiens
SRKGSRTGV

SEQ ID NO: 223104 - protein, 9 aa, Homo Sapiens
DGWVAIYSD

SEQ ID NO: 223105 - protein, 9 aa, Homo Sapiens
AGEEAQAGA

SEQ ID NO: 223106 - protein, 9 aa, Homo Sapiens
RGQAFIQKT

SEQ ID NO: 223107 - protein, 9 aa, Homo Sapiens
CLACRKRQK

SEQ ID NO: 223108 - protein, 9 aa, Homo Sapiens
SFCNKIQGI

SEQ ID NO: 223109 - protein, 9 aa, Homo Sapiens
PHPMSSGRI

SEQ ID NO: 223110 - protein, 9 aa, Homo Sapiens
HMTFKEFFA

SEQ ID NO: 223111 - protein, 9 aa, Homo Sapiens
DAIQILLVF

SEQ ID NO: 223112 - protein, 9 aa, Homo Sapiens
NETATDDTG

SEQ ID NO: 223113 - protein, 9 aa, Homo Sapiens
ADYFLRPLH

SEQ ID NO: 223114 - protein, 9 aa, Homo Sapiens
CCGTSTIGL

SEQ ID NO: 223115 - protein, 9 aa, Homo Sapiens
RRLQRTLAR

SEQ ID NO: 223116 - protein, 9 aa, Homo Sapiens
QRHPQGPCP

SEQ ID NO: 223117 - protein, 9 aa, Homo Sapiens
VALGSPQSR

SEQ ID NO: 223118 - protein, 9 aa, Homo Sapiens
AMEETGVVA

SEQ ID NO: 223119 - protein, 9 aa, Homo Sapiens
LHVDASCGY

SEQ ID NO: 223120 - protein, 9 aa, Homo Sapiens
LGNIVKSAD

SEQ ID NO: 223121 - protein, 9 aa, Homo Sapiens
TNGPLTFHP

SEQ ID NO: 223122 - protein, 9 aa, Homo Sapiens
SLHRYDEWN

SEQ ID NO: 223123 - protein, 9 aa, Homo Sapiens
VELGPEKLL

SEQ ID NO: 223124 - protein, 9 aa, Homo Sapiens
GPWAAAWGP

SEQ ID NO: 223125 - protein, 9 aa, Homo Sapiens
GGGRTPGII

SEQ ID NO: 223126 - protein, 9 aa, Homo Sapiens
GNGYSNAGI

SEQ ID NO: 223127 - protein, 9 aa, Homo Sapiens
MLYSRAVRD

SEQ ID NO: 223128 - protein, 9 aa, Homo Sapiens
QQRHPQGPC

SEQ ID NO: 223129 - protein, 9 aa, Homo Sapiens
GMVESYTAS

SEQ ID NO: 223130 - protein, 9 aa, Homo Sapiens
AICKMYHPR

SEQ ID NO: 223131 - protein, 9 aa, Homo Sapiens
LRDMFPCGP

SEQ ID NO: 223132 - protein, 9 aa, Homo Sapiens
ELAMSTHLH

SEQ ID NO: 223133 - protein, 9 aa, Homo Sapiens
EVSLTTDWR

SEQ ID NO: 223134 - protein, 9 aa, Homo Sapiens
TSSCQLSID

SEQ ID NO: 223135 - protein, 9 aa, Homo Sapiens
SRMWALSQE

SEQ ID NO: 223136 - protein, 9 aa, Homo Sapiens
MWAITSEEC

SEQ ID NO: 223137 - protein, 9 aa, Homo Sapiens
FCAFGATHQ

SEQ ID NO: 223138 - protein, 9 aa, Homo Sapiens
RRGCAWYLC

SEQ ID NO: 223139 - protein, 9 aa, Homo Sapiens
SLHPASGRA

SEQ ID NO: 223140 - protein, 9 aa, Homo Sapiens
MLRYLKIMQ

SEQ ID NO: 223141 - protein, 9 aa, Homo Sapiens
RKRQKRCMR

SEQ ID NO: 223142 - protein, 9 aa, Homo Sapiens
LPMKIPRQL

SEQ ID NO: 223143 - protein, 9 aa, Homo Sapiens
MDGSFICSQ

SEQ ID NO: 223144 - protein, 9 aa, Homo Sapiens
CANSWSTWL

SEQ ID NO: 223145 - protein, 9 aa, Homo Sapiens
GLFGQVFRP

SEQ ID NO: 223146 - protein, 9 aa, Homo Sapiens
GLRQSPIDL

SEQ ID NO: 223147 - protein, 9 aa, Homo Sapiens
VEEIFIEEY

SEQ ID NO: 223148 - protein, 9 aa, Homo Sapiens
EYVAGNFCF

SEQ ID NO: 223149 - protein, 9 aa, Homo Sapiens
PRLHPQLPT

SEQ ID NO: 223150 - protein, 9 aa, Homo Sapiens
DRSVHSGSH

SEQ ID NO: 223151 - protein, 9 aa, Homo Sapiens
ASQRFPPPL

SEQ ID NO: 223152 - protein, 9 aa, Homo Sapiens
PLQLLLHPH

SEQ ID NO: 223153 - protein, 9 aa, Homo Sapiens
DLFYIVLDY

SEQ ID NO: 223154 - protein, 9 aa, Homo Sapiens
ITSKGTSLY

SEQ ID NO: 223155 - protein, 9 aa, Homo Sapiens
PLTQLVVVD

SEQ ID NO: 223156 - protein, 9 aa, Homo Sapiens
GPPRALQTS

SEQ ID NO: 223157 - protein, 9 aa, Homo Sapiens
HNSVIRARL

SEQ ID NO: 223158 - protein, 9 aa, Homo Sapiens
RELWPWCFT

SEQ ID NO: 223159 - protein, 9 aa, Homo Sapiens
PFLMGIPAA

SEQ ID NO: 223160 - protein, 9 aa, Homo Sapiens
KKMAMTVIA

SEQ ID NO: 223161 - protein, 9 aa, Homo Sapiens
FSCIVCVAY

SEQ ID NO: 223162 - protein, 9 aa, Homo Sapiens
VGKSHLLEF

SEQ ID NO: 223163 - protein, 9 aa, Homo Sapiens
ASYSPAHAR

SEQ ID NO: 223164 - protein, 9 aa, Homo Sapiens
ENTSLDLFQ

SEQ ID NO: 223165 - protein, 9 aa, Homo Sapiens
ARHLEFRKH

SEQ ID NO: 223166 - protein, 9 aa, Homo Sapiens
PSKIDVRQE

SEQ ID NO: 223167 - protein, 9 aa, Homo Sapiens
EPPPREAIF

SEQ ID NO: 223168 - protein, 9 aa, Homo Sapiens
RFYTARLAP

SEQ ID NO: 223169 - protein, 9 aa, Homo Sapiens
SSSSSSTRH

SEQ ID NO: 223170 - protein, 9 aa, Homo Sapiens
HTIEVNRCR

SEQ ID NO: 223171 - protein, 9 aa, Homo Sapiens
PLFKIVDAS

SEQ ID NO: 223172 - protein, 9 aa, Homo Sapiens
VIMAVLDEF

SEQ ID NO: 223173 - protein, 9 aa, Homo Sapiens
QEFTPPSGD

SEQ ID NO: 223174 - protein, 9 aa, Homo Sapiens
KLQVSAPNL

SEQ ID NO: 223175 - protein, 9 aa, Homo Sapiens
QVFLLFSSA

SEQ ID NO: 223176 - protein, 9 aa, Homo Sapiens
FGSSCLQTS

SEQ ID NO: 223177 - protein, 9 aa, Homo Sapiens
HAGQEKDCW

SEQ ID NO: 223178 - protein, 9 aa, Homo Sapiens
QVQLEWDEY

SEQ ID NO: 223179 - protein, 9 aa, Homo Sapiens
LFFSFIHVH

SEQ ID NO: 223180 - protein, 9 aa, Homo Sapiens
NAEAVHFSA

SEQ ID NO: 223181 - protein, 9 aa, Homo Sapiens
MVESYTASS

SEQ ID NO: 223182 - protein, 9 aa, Homo Sapiens
TNAAATGSS

SEQ ID NO: 223183 - protein, 9 aa, Homo Sapiens
LLERLARPA

SEQ ID NO: 223184 - protein, 9 aa, Homo Sapiens
AALLQTCLH

SEQ ID NO: 223185 - protein, 9 aa, Homo Sapiens
KSQIHSIPC

SEQ ID NO: 223186 - protein, 9 aa, Homo Sapiens
SGRISSTHC

SEQ ID NO: 223187 - protein, 9 aa, Homo Sapiens
TMSSTMYNP

SEQ ID NO: 223188 - protein, 9 aa, Homo Sapiens
YNVIAMALE

SEQ ID NO: 223189 - protein, 9 aa, Homo Sapiens
GTLRKSHTL

SEQ ID NO: 223190 - protein, 9 aa, Homo Sapiens
SLHQFQVEN

SEQ ID NO: 223191 - protein, 9 aa, Homo Sapiens
KLRWRMNEE

SEQ ID NO: 223192 - protein, 9 aa, Homo Sapiens
ISGFDTETL

SEQ ID NO: 223193 - protein, 9 aa, Homo Sapiens
LLEPFLILR

SEQ ID NO: 223194 - protein, 9 aa, Homo Sapiens
VMCLRNAHS

SEQ ID NO: 223195 - protein, 9 aa, Homo Sapiens
RGPIFTTVR

SEQ ID NO: 223196 - protein, 9 aa, Homo Sapiens
PEEDSESIS

SEQ ID NO: 223197 - protein, 9 aa, Homo Sapiens
ENSPKGAHC

SEQ ID NO: 223198 - protein, 9 aa, Homo Sapiens
KCQDSKQAQ

SEQ ID NO: 223199 - protein, 9 aa, Homo Sapiens
HLRWIGREK

SEQ ID NO: 223200 - protein, 9 aa, Homo Sapiens
QIFTYEEGL

SEQ ID NO: 223201 - protein, 9 aa, Homo Sapiens
VSAHVCTGE

SEQ ID NO: 223202 - protein, 9 aa, Homo Sapiens
APEAPVQEG

SEQ ID NO: 223203 - protein, 9 aa, Homo Sapiens
LAQEDVMFS

SEQ ID NO: 223204 - protein, 9 aa, Homo Sapiens
EDWQPTGTQ

SEQ ID NO: 223205 - protein, 9 aa, Homo Sapiens
INGKGLLKK

SEQ ID NO: 223206 - protein, 9 aa, Homo Sapiens
PASPSDCPP

SEQ ID NO: 223207 - protein, 9 aa, Homo Sapiens
AKKAAANFR

SEQ ID NO: 223208 - protein, 9 aa, Homo Sapiens
PMDHKPLVL

SEQ ID NO: 223209 - protein, 9 aa, Homo Sapiens
SHNSVKAKF

SEQ ID NO: 223210 - protein, 9 aa, Homo Sapiens
MLRPLPPQP

SEQ ID NO: 223211 - protein, 9 aa, Homo Sapiens
GGPARSGNP

SEQ ID NO: 223212 - protein, 9 aa, Homo Sapiens
LARRCGSAT

SEQ ID NO: 223213 - protein, 9 aa, Homo Sapiens
QEGCIIVAD

SEQ ID NO: 223214 - protein, 9 aa, Homo Sapiens
TEELWLVER

SEQ ID NO: 223215 - protein, 9 aa, Homo Sapiens
TSAGSAAGT

SEQ ID NO: 223216 - protein, 9 aa, Homo Sapiens
RDDDLNLWA

SEQ ID NO: 223217 - protein, 9 aa, Homo Sapiens
LDMDDLVTL

SEQ ID NO: 223218 - protein, 9 aa, Homo Sapiens
TGTQQDAWQ

SEQ ID NO: 223219 - protein, 9 aa, Homo Sapiens
GAQEAVQEV

SEQ ID NO: 223220 - protein, 9 aa, Homo Sapiens
LAYPQNPWL

SEQ ID NO: 223221 - protein, 9 aa, Homo Sapiens
PDGHPLWLW

SEQ ID NO: 223222 - protein, 9 aa, Homo Sapiens
KTKHTIQFV

SEQ ID NO: 223223 - protein, 9 aa, Homo Sapiens
PFSSAPLKK

SEQ ID NO: 223224 - protein, 9 aa, Homo Sapiens
LEWINKKHH

SEQ ID NO: 223225 - protein, 9 aa, Homo Sapiens
EAVQEVADG

SEQ ID NO: 223226 - protein, 9 aa, Homo Sapiens
DRFSMDVPM

SEQ ID NO: 223227 - protein, 9 aa, Homo Sapiens
VKTMVCCLK

SEQ ID NO: 223228 - protein, 9 aa, Homo Sapiens
VEDMSQFYR

SEQ ID NO: 223229 - protein, 9 aa, Homo Sapiens
TASFAAFQV

SEQ ID NO: 223230 - protein, 9 aa, Homo Sapiens
CNNPEIITV

SEQ ID NO: 223231 - protein, 9 aa, Homo Sapiens
DRDLSVRRK

SEQ ID NO: 223232 - protein, 9 aa, Homo Sapiens
QALMMMKFA

SEQ ID NO: 223233 - protein, 9 aa, Homo Sapiens
EVGVDVNCA

SEQ ID NO: 223234 - protein, 9 aa, Homo Sapiens
RPSLFHRRR

SEQ ID NO: 223235 - protein, 9 aa, Homo Sapiens
VFLICNLAA

SEQ ID NO: 223236 - protein, 9 aa, Homo Sapiens
RTLGLHVHP

SEQ ID NO: 223237 - protein, 9 aa, Homo Sapiens
FTPDREEWE

SEQ ID NO: 223238 - protein, 9 aa, Homo Sapiens
LMEKLCHYS

SEQ ID NO: 223239 - protein, 9 aa, Homo Sapiens
PAVLELTCA

SEQ ID NO: 223240 - protein, 9 aa, Homo Sapiens
AGVQFGEVE

SEQ ID NO: 223241 - protein, 9 aa, Homo Sapiens
GGKESEVTM

SEQ ID NO: 223242 - protein, 9 aa, Homo Sapiens
IIGIQFQNS

SEQ ID NO: 223243 - protein, 9 aa, Homo Sapiens
KLLVHWVTY

SEQ ID NO: 223244 - protein, 9 aa, Homo Sapiens
LMTQQTYLQ

SEQ ID NO: 223245 - protein, 9 aa, Homo Sapiens
LPRSSSQRY

SEQ ID NO: 223246 - protein, 9 aa, Homo Sapiens
RSGPWMMCT

SEQ ID NO: 223247 - protein, 9 aa, Homo Sapiens
LRRSHRKRN

SEQ ID NO: 223248 - protein, 9 aa, Homo Sapiens
IIWLKLTKF

SEQ ID NO: 223249 - protein, 9 aa, Homo Sapiens
GRGGGGRTP

SEQ ID NO: 223250 - protein, 9 aa, Homo Sapiens
VIIPTIGWC

SEQ ID NO: 223251 - protein, 9 aa, Homo Sapiens
EIFIEEYLT

SEQ ID NO: 223252 - protein, 9 aa, Homo Sapiens
TLLSGDYHP

SEQ ID NO: 223253 - protein, 9 aa, Homo Sapiens
FGVAEELSG

SEQ ID NO: 223254 - protein, 9 aa, Homo Sapiens
YWLLPIFQV

SEQ ID NO: 223255 - protein, 9 aa, Homo Sapiens
HTPLPFSTV

SEQ ID NO: 223256 - protein, 9 aa, Homo Sapiens
VGSSRLGRP

SEQ ID NO: 223257 - protein, 9 aa, Homo Sapiens
EDQVLHRLT

SEQ ID NO: 223258 - protein, 9 aa, Homo Sapiens
KSQLLILIL

SEQ ID NO: 223259 - protein, 9 aa, Homo Sapiens
SETSSIPQK

SEQ ID NO: 223260 - protein, 9 aa, Homo Sapiens
RTLARLRAV

SEQ ID NO: 223261 - protein, 9 aa, Homo Sapiens
TKNTSMWTS

SEQ ID NO: 223262 - protein, 9 aa, Homo Sapiens
ILGHSLLFC

SEQ ID NO: 223263 - protein, 9 aa, Homo Sapiens
KLRIIGIQF

SEQ ID NO: 223264 - protein, 9 aa, Homo Sapiens
VGAGELSSE

SEQ ID NO: 223265 - protein, 9 aa, Homo Sapiens
RSLASTSTA

SEQ ID NO: 223266 - protein, 9 aa, Homo Sapiens
LKNGKFYVG

SEQ ID NO: 223267 - protein, 9 aa, Homo Sapiens
AQTSWTTSS

SEQ ID NO: 223268 - protein, 9 aa, Homo Sapiens
SCPSPAVKG

SEQ ID NO: 223269 - protein, 9 aa, Homo Sapiens
SGERGVLQW

SEQ ID NO: 223270 - protein, 9 aa, Homo Sapiens
SFPSLGYPV

SEQ ID NO: 223271 - protein, 9 aa, Homo Sapiens
ERIELKAKV

SEQ ID NO: 223272 - protein, 9 aa, Homo Sapiens
NPEKLALKE

SEQ ID NO: 223273 - protein, 9 aa, Homo Sapiens
PLITNNMVG

SEQ ID NO: 223274 - protein, 9 aa, Homo Sapiens
KIWMYVDAA

SEQ ID NO: 223275 - protein, 9 aa, Homo Sapiens
AMGGGSYRK

SEQ ID NO: 223276 - protein, 9 aa, Homo Sapiens
ILPIDQVKI

SEQ ID NO: 223277 - protein, 9 aa, Homo Sapiens
MSTASVHTL

SEQ ID NO: 223278 - protein, 9 aa, Homo Sapiens
RSSRRQRME

SEQ ID NO: 223279 - protein, 9 aa, Homo Sapiens
IYTVYSSSS

SEQ ID NO: 223280 - protein, 9 aa, Homo Sapiens
ARVCIVSLG

SEQ ID NO: 223281 - protein, 9 aa, Homo Sapiens
SARVPPSTM

SEQ ID NO: 223282 - protein, 9 aa, Homo Sapiens
CRTSRQATA

SEQ ID NO: 223283 - protein, 9 aa, Homo Sapiens
NNNMEKVTL

SEQ ID NO: 223284 - protein, 9 aa, Homo Sapiens
NMRGSFWCS

SEQ ID NO: 223285 - protein, 9 aa, Homo Sapiens
GTVAIRGLF

SEQ ID NO: 223286 - protein, 9 aa, Homo Sapiens
EAHEFGNQT

SEQ ID NO: 223287 - protein, 9 aa, Homo Sapiens
HCYDACVFD

SEQ ID NO: 223288 - protein, 9 aa, Homo Sapiens
ETLPLEDVW

SEQ ID NO: 223289 - protein, 9 aa, Homo Sapiens
LVIWEPMWE

SEQ ID NO: 223290 - protein, 9 aa, Homo Sapiens
KESFQENED

SEQ ID NO: 223291 - protein, 9 aa, Homo Sapiens
KEFFAAMYY

SEQ ID NO: 223292 - protein, 9 aa, Homo Sapiens
GHGAEEGEQ

SEQ ID NO: 223293 - protein, 9 aa, Homo Sapiens
VGIGLSFLF

SEQ ID NO: 223294 - protein, 9 aa, Homo Sapiens
KKQTSIEVS

SEQ ID NO: 223295 - protein, 9 aa, Homo Sapiens
RLKEREDWG

SEQ ID NO: 223296 - protein, 9 aa, Homo Sapiens
DDLSGLRVK

SEQ ID NO: 223297 - protein, 9 aa, Homo Sapiens
QSMPPPPSR

SEQ ID NO: 223298 - protein, 9 aa, Homo Sapiens
LLLHPHGKR

SEQ ID NO: 223299 - protein, 9 aa, Homo Sapiens
SFYHKKTIQ

SEQ ID NO: 223300 - protein, 9 aa, Homo Sapiens
GFCLANYVQ

SEQ ID NO: 223301 - protein, 9 aa, Homo Sapiens
TEVQFDLVS

SEQ ID NO: 223302 - protein, 9 aa, Homo Sapiens
LGAEVPQGA

SEQ ID NO: 223303 - protein, 9 aa, Homo Sapiens
PSCVLCVRC

SEQ ID NO: 223304 - protein, 9 aa, Homo Sapiens
STSSFCCCT

SEQ ID NO: 223305 - protein, 9 aa, Homo Sapiens
ENDIKVLGC

SEQ ID NO: 223306 - protein, 9 aa, Homo Sapiens
RFMMLYKKK

SEQ ID NO: 223307 - protein, 9 aa, Homo Sapiens
GPSEKTNCT

SEQ ID NO: 223308 - protein, 9 aa, Homo Sapiens
KEDKEKETF

SEQ ID NO: 223309 - protein, 9 aa, Homo Sapiens
SPTHMLTAI

SEQ ID NO: 223310 - protein, 9 aa, Homo Sapiens
VLQEGEAEA

SEQ ID NO: 223311 - protein, 9 aa, Homo Sapiens
PALRPTDYL

SEQ ID NO: 223312 - protein, 9 aa, Homo Sapiens
EVWDTVVAR

SEQ ID NO: 223313 - protein, 9 aa, Homo Sapiens
PGPQPGRSP

SEQ ID NO: 223314 - protein, 9 aa, Homo Sapiens
LYPGGKEET

SEQ ID NO: 223315 - protein, 9 aa, Homo Sapiens
GQSASSSPT

SEQ ID NO: 223316 - protein, 9 aa, Homo Sapiens
VRSLSKKER

SEQ ID NO: 223317 - protein, 9 aa, Homo Sapiens
ERKVTLMIN

SEQ ID NO: 223318 - protein, 9 aa, Homo Sapiens
LEGSTVMRE

SEQ ID NO: 223319 - protein, 9 aa, Homo Sapiens
VPCAHRNCL

SEQ ID NO: 223320 - protein, 9 aa, Homo Sapiens
TRRQDVLSN

SEQ ID NO: 223321 - protein, 9 aa, Homo Sapiens
RVTPLGTGQ

SEQ ID NO: 223322 - protein, 9 aa, Homo Sapiens
RSEPFWMAS

SEQ ID NO: 223323 - protein, 9 aa, Homo Sapiens
KMQTLMRTW

SEQ ID NO: 223324 - protein, 9 aa, Homo Sapiens
KRVLALGAG

SEQ ID NO: 223325 - protein, 9 aa, Homo Sapiens
HEQSVDRSV

SEQ ID NO: 223326 - protein, 9 aa, Homo Sapiens
PGPPTRAGP

SEQ ID NO: 223327 - protein, 9 aa, Homo Sapiens
CIVGKSLWP

SEQ ID NO: 223328 - protein, 9 aa, Homo Sapiens
LFLIFSHML

SEQ ID NO: 223329 - protein, 9 aa, Homo Sapiens
EKNSPFGSS

SEQ ID NO: 223330 - protein, 9 aa, Homo Sapiens
CRPSWKGKG

SEQ ID NO: 223331 - protein, 9 aa, Homo Sapiens
QGQTLCSTI

SEQ ID NO: 223332 - protein, 9 aa, Homo Sapiens
PSRSTCPPT

SEQ ID NO: 223333 - protein, 9 aa, Homo Sapiens
LLADVLPEL

SEQ ID NO: 223334 - protein, 9 aa, Homo Sapiens
AIVRDNKDG

SEQ ID NO: 223335 - protein, 9 aa, Homo Sapiens
VKNIHQKDT

SEQ ID NO: 223336 - protein, 9 aa, Homo Sapiens
QGLGQPWPP

SEQ ID NO: 223337 - protein, 9 aa, Homo Sapiens
EVVDLACTP

SEQ ID NO: 223338 - protein, 9 aa, Homo Sapiens
MGTQQAREP

SEQ ID NO: 223339 - protein, 9 aa, Homo Sapiens
EELPLPPCT

SEQ ID NO: 223340 - protein, 9 aa, Homo Sapiens
TTSSVMSHR

SEQ ID NO: 223341 - protein, 9 aa, Homo Sapiens
GKESEVTMG

SEQ ID NO: 223342 - protein, 9 aa, Homo Sapiens
FFRSPHRMR

SEQ ID NO: 223343 - protein, 9 aa, Homo Sapiens
GLVAGVNIP

SEQ ID NO: 223344 - protein, 9 aa, Homo Sapiens
APVDAGGHP

SEQ ID NO: 223345 - protein, 9 aa, Homo Sapiens
FLESVFKAE

SEQ ID NO: 223346 - protein, 9 aa, Homo Sapiens
SPQGRRKRR

SEQ ID NO: 223347 - protein, 9 aa, Homo Sapiens
NDNTDPAPL

SEQ ID NO: 223348 - protein, 9 aa, Homo Sapiens
VEKDRQIGK

SEQ ID NO: 223349 - protein, 9 aa, Homo Sapiens
YDRYMVICY

SEQ ID NO: 223350 - protein, 9 aa, Homo Sapiens
QELGFTMLA

SEQ ID NO: 223351 - protein, 9 aa, Homo Sapiens
PCPRSKSQR

SEQ ID NO: 223352 - protein, 9 aa, Homo Sapiens
SATGAPGMD

SEQ ID NO: 223353 - protein, 9 aa, Homo Sapiens
IRALGLAPQ

SEQ ID NO: 223354 - protein, 9 aa, Homo Sapiens
KGSVQQAPS

SEQ ID NO: 223355 - protein, 9 aa, Homo Sapiens
EPFWMASRS

SEQ ID NO: 223356 - protein, 9 aa, Homo Sapiens
PHRCCLPCL

SEQ ID NO: 223357 - protein, 9 aa, Homo Sapiens
LPRLVGCPV

SEQ ID NO: 223358 - protein, 9 aa, Homo Sapiens
LMSGVEQAT

SEQ ID NO: 223359 - protein, 9 aa, Homo Sapiens
HAAPAAFGV

SEQ ID NO: 223360 - protein, 9 aa, Homo Sapiens
APRRSHCLT

SEQ ID NO: 223361 - protein, 9 aa, Homo Sapiens
HMLTAITGS

SEQ ID NO: 223362 - protein, 9 aa, Homo Sapiens
VWTEVLVNH

SEQ ID NO: 223363 - protein, 9 aa, Homo Sapiens
NILKSARKF

SEQ ID NO: 223364 - protein, 9 aa, Homo Sapiens
SGRGSCTGR

SEQ ID NO: 223365 - protein, 9 aa, Homo Sapiens
MSVAKPLVG

SEQ ID NO: 223366 - protein, 9 aa, Homo Sapiens
EEAVGRGPA

SEQ ID NO: 223367 - protein, 9 aa, Homo Sapiens
QARRWPRAL

SEQ ID NO: 223368 - protein, 9 aa, Homo Sapiens
PSRCESAAW

SEQ ID NO: 223369 - protein, 9 aa, Homo Sapiens
CLGNQFYVL

SEQ ID NO: 223370 - protein, 9 aa, Homo Sapiens
LITQVMLYS

SEQ ID NO: 223371 - protein, 9 aa, Homo Sapiens
AAQAAQQRF

SEQ ID NO: 223372 - protein, 9 aa, Homo Sapiens
IPGGRANVG

SEQ ID NO: 223373 - protein, 9 aa, Homo Sapiens
RPWMSPATI

SEQ ID NO: 223374 - protein, 9 aa, Homo Sapiens
HHCQYKLTY

SEQ ID NO: 223375 - protein, 9 aa, Homo Sapiens
ARPSRLEHV

SEQ ID NO: 223376 - protein, 9 aa, Homo Sapiens
ALKRHFTVN

SEQ ID NO: 223377 - protein, 9 aa, Homo Sapiens
LESVFKAEF

SEQ ID NO: 223378 - protein, 9 aa, Homo Sapiens
GPGSHPLCS

SEQ ID NO: 223379 - protein, 9 aa, Homo Sapiens
AGAAYAQGT

SEQ ID NO: 223380 - protein, 9 aa, Homo Sapiens
HRPPSSCWS

SEQ ID NO: 223381 - protein, 9 aa, Homo Sapiens
KNIYRKSGT

SEQ ID NO: 223382 - protein, 9 aa, Homo Sapiens
LPRAGGHRP

SEQ ID NO: 223383 - protein, 9 aa, Homo Sapiens
GPTCENKTY

SEQ ID NO: 223384 - protein, 9 aa, Homo Sapiens
QGLFILPLL

SEQ ID NO: 223385 - protein, 9 aa, Homo Sapiens
VCGARGWGR

SEQ ID NO: 223386 - protein, 9 aa, Homo Sapiens
QNHGSSSNP

SEQ ID NO: 223387 - protein, 9 aa, Homo Sapiens
MYEEFLNKV

SEQ ID NO: 223388 - protein, 9 aa, Homo Sapiens
DLPEGEKNQ

SEQ ID NO: 223389 - protein, 9 aa, Homo Sapiens
VHSGPIGHL

SEQ ID NO: 223390 - protein, 9 aa, Homo Sapiens
AHTLDGEAG

SEQ ID NO: 223391 - protein, 9 aa, Homo Sapiens
TLTTVHLEA

SEQ ID NO: 223392 - protein, 9 aa, Homo Sapiens
TLALWPISK

SEQ ID NO: 223393 - protein, 9 aa, Homo Sapiens
RIAILRGNH

SEQ ID NO: 223394 - protein, 9 aa, Homo Sapiens
IRSLEEQLQ

SEQ ID NO: 223395 - protein, 9 aa, Homo Sapiens
TQSWIPQSA

SEQ ID NO: 223396 - protein, 9 aa, Homo Sapiens
ESAGYTVLW

SEQ ID NO: 223397 - protein, 9 aa, Homo Sapiens
TTPDIEIWE

SEQ ID NO: 223398 - protein, 9 aa, Homo Sapiens
RFLNEHHGG

SEQ ID NO: 223399 - protein, 9 aa, Homo Sapiens
GRNSHPSPR

SEQ ID NO: 223400 - protein, 9 aa, Homo Sapiens
TLKLILVML

SEQ ID NO: 223401 - protein, 9 aa, Homo Sapiens
SPSSTPPSR

SEQ ID NO: 223402 - protein, 9 aa, Homo Sapiens
QRVSPEPPR

SEQ ID NO: 223403 - protein, 9 aa, Homo Sapiens
NDQDRRIVL

SEQ ID NO: 223404 - protein, 9 aa, Homo Sapiens
STWSLPRLV

SEQ ID NO: 223405 - protein, 9 aa, Homo Sapiens
GSRVGVRWG

SEQ ID NO: 223406 - protein, 9 aa, Homo Sapiens
SGTLSASSS

SEQ ID NO: 223407 - protein, 9 aa, Homo Sapiens
ELHLKHICK

SEQ ID NO: 223408 - protein, 9 aa, Homo Sapiens
VSRFWGLVT

SEQ ID NO: 223409 - protein, 9 aa, Homo Sapiens
CYNFIRSMA

SEQ ID NO: 223410 - protein, 9 aa, Homo Sapiens
ELLATSAVE

SEQ ID NO: 223411 - protein, 9 aa, Homo Sapiens
LQTCLHAAW

SEQ ID NO: 223412 - protein, 9 aa, Homo Sapiens
GELVSVDRC

SEQ ID NO: 223413 - protein, 9 aa, Homo Sapiens
DRLWGSHLT

SEQ ID NO: 223414 - protein, 9 aa, Homo Sapiens
AVSGSGGRG

SEQ ID NO: 223415 - protein, 9 aa, Homo Sapiens
LQEFTPPSG

SEQ ID NO: 223416 - protein, 9 aa, Homo Sapiens
CENKTYSVP

SEQ ID NO: 223417 - protein, 9 aa, Homo Sapiens
TGRALLSKK

SEQ ID NO: 223418 - protein, 9 aa, Homo Sapiens
LRNRIQCCT

SEQ ID NO: 223419 - protein, 9 aa, Homo Sapiens
RGWSSKHNR

SEQ ID NO: 223420 - protein, 9 aa, Homo Sapiens
VFSYSWPRV

SEQ ID NO: 223421 - protein, 9 aa, Homo Sapiens
RRFRMRMRV

SEQ ID NO: 223422 - protein, 9 aa, Homo Sapiens
GSHLTFNHD

SEQ ID NO: 223423 - protein, 9 aa, Homo Sapiens
SQHLFTIKQ

SEQ ID NO: 223424 - protein, 9 aa, Homo Sapiens
EQFIGQVTV

SEQ ID NO: 223425 - protein, 9 aa, Homo Sapiens
SSSRRVPRG

SEQ ID NO: 223426 - protein, 9 aa, Homo Sapiens
HFILFFINA

SEQ ID NO: 223427 - protein, 9 aa, Homo Sapiens
QDLDPCFQR

SEQ ID NO: 223428 - protein, 9 aa, Homo Sapiens
CMGLKSWIS

SEQ ID NO: 223429 - protein, 9 aa, Homo Sapiens
PPLKAPVRA

SEQ ID NO: 223430 - protein, 9 aa, Homo Sapiens
TPTASETLR

SEQ ID NO: 223431 - protein, 9 aa, Homo Sapiens
DIPRESGVH

SEQ ID NO: 223432 - protein, 9 aa, Homo Sapiens
PRSPPRLEC

SEQ ID NO: 223433 - protein, 9 aa, Homo Sapiens
IKGVDVGLY

SEQ ID NO: 223434 - protein, 9 aa, Homo Sapiens
SVEDAPSEE

SEQ ID NO: 223435 - protein, 9 aa, Homo Sapiens
FSATDSVAD

SEQ ID NO: 223436 - protein, 9 aa, Homo Sapiens
CYQQVPWYP

SEQ ID NO: 223437 - protein, 9 aa, Homo Sapiens
SQTPSRGFG

SEQ ID NO: 223438 - protein, 9 aa, Homo Sapiens
TPHPTGVRG

SEQ ID NO: 223439 - protein, 9 aa, Homo Sapiens
EEVLKNIYR

SEQ ID NO: 223440 - protein, 9 aa, Homo Sapiens
RISYNWYAT

SEQ ID NO: 223441 - protein, 9 aa, Homo Sapiens
VEQPPSPLG

SEQ ID NO: 223442 - protein, 9 aa, Homo Sapiens
VTLLPAAWR

SEQ ID NO: 223443 - protein, 9 aa, Homo Sapiens
VPVSMGIAW

SEQ ID NO: 223444 - protein, 9 aa, Homo Sapiens
HARVLGGLP

SEQ ID NO: 223445 - protein, 9 aa, Homo Sapiens
APSPAFSVG

SEQ ID NO: 223446 - protein, 9 aa, Homo Sapiens
PNLPAWTLT

SEQ ID NO: 223447 - protein, 9 aa, Homo Sapiens
ERTANEKIT

SEQ ID NO: 223448 - protein, 9 aa, Homo Sapiens
HPRAFIFSD

SEQ ID NO: 223449 - protein, 9 aa, Homo Sapiens
SIASWELWV

SEQ ID NO: 223450 - protein, 9 aa, Homo Sapiens
NLHGFSKNP

SEQ ID NO: 223451 - protein, 9 aa, Homo Sapiens
QGYCSFKCL

SEQ ID NO: 223452 - protein, 9 aa, Homo Sapiens
IMAVLDEFP

SEQ ID NO: 223453 - protein, 9 aa, Homo Sapiens
DTHRSERVQ

SEQ ID NO: 223454 - protein, 9 aa, Homo Sapiens
PCSPNVHFL

SEQ ID NO: 223455 - protein, 9 aa, Homo Sapiens
LKHQHEEGA

SEQ ID NO: 223456 - protein, 9 aa, Homo Sapiens
WTREEVVTP

SEQ ID NO: 223457 - protein, 9 aa, Homo Sapiens
SWSSGGKLC

SEQ ID NO: 223458 - protein, 9 aa, Homo Sapiens
PDCRGPNGV

SEQ ID NO: 223459 - protein, 9 aa, Homo Sapiens
PLARRCGSA

SEQ ID NO: 223460 - protein, 9 aa, Homo Sapiens
RRPPGRCRT

SEQ ID NO: 223461 - protein, 9 aa, Homo Sapiens
VHLGPDCLP

SEQ ID NO: 223462 - protein, 9 aa, Homo Sapiens
RRRERSWAA

SEQ ID NO: 223463 - protein, 9 aa, Homo Sapiens
KDPNSQVGT

SEQ ID NO: 223464 - protein, 9 aa, Homo Sapiens
LRNNPYRMW

SEQ ID NO: 223465 - protein, 9 aa, Homo Sapiens
LRAYPPLSV

SEQ ID NO: 223466 - protein, 9 aa, Homo Sapiens
KKHELLSST

SEQ ID NO: 223467 - protein, 9 aa, Homo Sapiens
GGVCRPGRL

SEQ ID NO: 223468 - protein, 9 aa, Homo Sapiens
CNTTTGSCC

SEQ ID NO: 223469 - protein, 9 aa, Homo Sapiens
SEECTKHDR

SEQ ID NO: 223470 - protein, 9 aa, Homo Sapiens
ASQESSSPT

SEQ ID NO: 223471 - protein, 9 aa, Homo Sapiens
NDPFLMGIP

SEQ ID NO: 223472 - protein, 9 aa, Homo Sapiens
PHGADLDEA

SEQ ID NO: 223473 - protein, 9 aa, Homo Sapiens
DYDKEKKLY

SEQ ID NO: 223474 - protein, 9 aa, Homo Sapiens
PSMSKQNRG

SEQ ID NO: 223475 - protein, 9 aa, Homo Sapiens
LSTWPSNRL

SEQ ID NO: 223476 - protein, 9 aa, Homo Sapiens
YSLQPPPYH

SEQ ID NO: 223477 - protein, 9 aa, Homo Sapiens
MEDSESVQR

SEQ ID NO: 223478 - protein, 9 aa, Homo Sapiens
RRKKKETEM

SEQ ID NO: 223479 - protein, 9 aa, Homo Sapiens
EDSSEIQLK

SEQ ID NO: 223480 - protein, 9 aa, Homo Sapiens
LGRTQHQIN

SEQ ID NO: 223481 - protein, 9 aa, Homo Sapiens
PPPAAAGCS

SEQ ID NO: 223482 - protein, 9 aa, Homo Sapiens
EVSREDQQQ

SEQ ID NO: 223483 - protein, 9 aa, Homo Sapiens
DMGLEVFRA

SEQ ID NO: 223484 - protein, 9 aa, Homo Sapiens
NRVDIACSE

SEQ ID NO: 223485 - protein, 9 aa, Homo Sapiens
SGTPDCYYN

SEQ ID NO: 223486 - protein, 9 aa, Homo Sapiens
PGFEGADCS

SEQ ID NO: 223487 - protein, 9 aa, Homo Sapiens
KSRPHSETE

SEQ ID NO: 223488 - protein, 9 aa, Homo Sapiens
LYGFHAHEF

SEQ ID NO: 223489 - protein, 9 aa, Homo Sapiens
SDFFSAQPT

SEQ ID NO: 223490 - protein, 9 aa, Homo Sapiens
GPGSGYPWA

SEQ ID NO: 223491 - protein, 9 aa, Homo Sapiens
RSHQRKLRA

SEQ ID NO: 223492 - protein, 9 aa, Homo Sapiens
PCTIWSFSH

SEQ ID NO: 223493 - protein, 9 aa, Homo Sapiens
SPVTCTHKE

SEQ ID NO: 223494 - protein, 9 aa, Homo Sapiens
PVCGQVSCH

SEQ ID NO: 223495 - protein, 9 aa, Homo Sapiens
RYAKDYADS

SEQ ID NO: 223496 - protein, 9 aa, Homo Sapiens
CKMSDTCSP

SEQ ID NO: 223497 - protein, 9 aa, Homo Sapiens
QGAVPCQDL

SEQ ID NO: 223498 - protein, 9 aa, Homo Sapiens
RAEGMTSLM

SEQ ID NO: 223499 - protein, 9 aa, Homo Sapiens
TIIRLLVED

SEQ ID NO: 223500 - protein, 9 aa, Homo Sapiens
VPAVTSNFQ

SEQ ID NO: 223501 - protein, 9 aa, Homo Sapiens
CPAPGPSPL

SEQ ID NO: 223502 - protein, 9 aa, Homo Sapiens
LQPRALACW

SEQ ID NO: 223503 - protein, 9 aa, Homo Sapiens
ILDRITTEA

SEQ ID NO: 223504 - protein, 9 aa, Homo Sapiens
HFLPRQFGL

SEQ ID NO: 223505 - protein, 9 aa, Homo Sapiens
HSLAIGGTG

SEQ ID NO: 223506 - protein, 9 aa, Homo Sapiens
APFMTNGPL

SEQ ID NO: 223507 - protein, 9 aa, Homo Sapiens
VAGAVQQAQ

SEQ ID NO: 223508 - protein, 9 aa, Homo Sapiens
VEVACVAVH

SEQ ID NO: 223509 - protein, 9 aa, Homo Sapiens
PGPSPLVAP

SEQ ID NO: 223510 - protein, 9 aa, Homo Sapiens
TVNENTFLW

SEQ ID NO: 223511 - protein, 9 aa, Homo Sapiens
QSFRLLRVF

SEQ ID NO: 223512 - protein, 9 aa, Homo Sapiens
SARPSRLEH

SEQ ID NO: 223513 - protein, 9 aa, Homo Sapiens
NLLTSGADA

SEQ ID NO: 223514 - protein, 9 aa, Homo Sapiens
PIDQVKISH

SEQ ID NO: 223515 - protein, 9 aa, Homo Sapiens
YQGLCPQCP

SEQ ID NO: 223516 - protein, 9 aa, Homo Sapiens
KDCWAATLF

SEQ ID NO: 223517 - protein, 9 aa, Homo Sapiens
FPRGMAFVP

SEQ ID NO: 223518 - protein, 9 aa, Homo Sapiens
LSEAGRYAS

SEQ ID NO: 223519 - protein, 9 aa, Homo Sapiens
GGVQPQSVL

SEQ ID NO: 223520 - protein, 9 aa, Homo Sapiens
VSVLSLIIT

SEQ ID NO: 223521 - protein, 9 aa, Homo Sapiens
ALTFKLNIF

SEQ ID NO: 223522 - protein, 9 aa, Homo Sapiens
ESRISFSQH

SEQ ID NO: 223523 - protein, 9 aa, Homo Sapiens
LKPKISQNM

SEQ ID NO: 223524 - protein, 9 aa, Homo Sapiens
THLLPLRVT

SEQ ID NO: 223525 - protein, 9 aa, Homo Sapiens
EDYKKTTRA

SEQ ID NO: 223526 - protein, 9 aa, Homo Sapiens
DMVFSRKYN

SEQ ID NO: 223527 - protein, 9 aa, Homo Sapiens
CGASVSHHY

SEQ ID NO: 223528 - protein, 9 aa, Homo Sapiens
RLDHAAPAA

SEQ ID NO: 223529 - protein, 9 aa, Homo Sapiens
SKSPVISRW

SEQ ID NO: 223530 - protein, 9 aa, Homo Sapiens
LLSSTREDL

SEQ ID NO: 223531 - protein, 9 aa, Homo Sapiens
SSTKASVAR

SEQ ID NO: 223532 - protein, 9 aa, Homo Sapiens
QVVQTMLRY

SEQ ID NO: 223533 - protein, 9 aa, Homo Sapiens
LTEKTITVL

SEQ ID NO: 223534 - protein, 9 aa, Homo Sapiens
SISSGISYE

SEQ ID NO: 223535 - protein, 9 aa, Homo Sapiens
FEQILQERI

SEQ ID NO: 223536 - protein, 9 aa, Homo Sapiens
RHPHRSPPT

SEQ ID NO: 223537 - protein, 9 aa, Homo Sapiens
SPHRMRPLV

SEQ ID NO: 223538 - protein, 9 aa, Homo Sapiens
RSKNLENFL

SEQ ID NO: 223539 - protein, 9 aa, Homo Sapiens
WPSTTTLSC

SEQ ID NO: 223540 - protein, 9 aa, Homo Sapiens
SCVHFLLHN

SEQ ID NO: 223541 - protein, 9 aa, Homo Sapiens
LRKARMEGQ

SEQ ID NO: 223542 - protein, 9 aa, Homo Sapiens
ITLCIVFPM

SEQ ID NO: 223543 - protein, 9 aa, Homo Sapiens
AGISGCSQE

SEQ ID NO: 223544 - protein, 9 aa, Homo Sapiens
EFASPRVVA

SEQ ID NO: 223545 - protein, 9 aa, Homo Sapiens
ILADMSIKM

SEQ ID NO: 223546 - protein, 9 aa, Homo Sapiens
TGGEFHFII

SEQ ID NO: 223547 - protein, 9 aa, Homo Sapiens
ELYTLMSDC

SEQ ID NO: 223548 - protein, 9 aa, Homo Sapiens
SPMCSEQTR

SEQ ID NO: 223549 - protein, 9 aa, Homo Sapiens
VDASCGYLD

SEQ ID NO: 223550 - protein, 9 aa, Homo Sapiens
PIRHHNSLP

SEQ ID NO: 223551 - protein, 9 aa, Homo Sapiens
TTLPGLFVK

SEQ ID NO: 223552 - protein, 9 aa, Homo Sapiens
MMAITIMKV

SEQ ID NO: 223553 - protein, 9 aa, Homo Sapiens
DETRRARMF

SEQ ID NO: 223554 - protein, 9 aa, Homo Sapiens
LPNAIRLHI

SEQ ID NO: 223555 - protein, 9 aa, Homo Sapiens
PSMASLCWS

SEQ ID NO: 223556 - protein, 9 aa, Homo Sapiens
LVECPVSAW

SEQ ID NO: 223557 - protein, 9 aa, Homo Sapiens
VPEVILNWM

SEQ ID NO: 223558 - protein, 9 aa, Homo Sapiens
KQIVRKITM

SEQ ID NO: 223559 - protein, 9 aa, Homo Sapiens
LPQERYLLQ

SEQ ID NO: 223560 - protein, 9 aa, Homo Sapiens
VGSQHLFTI

SEQ ID NO: 223561 - protein, 9 aa, Homo Sapiens
ASFAAFQVV

SEQ ID NO: 223562 - protein, 9 aa, Homo Sapiens
DRVKCFEKN

SEQ ID NO: 223563 - protein, 9 aa, Homo Sapiens
LSKKISFFF

SEQ ID NO: 223564 - protein, 9 aa, Homo Sapiens
TFEKKGKKM

SEQ ID NO: 223565 - protein, 9 aa, Homo Sapiens
FTLLKLLVH

SEQ ID NO: 223566 - protein, 9 aa, Homo Sapiens
VHSGSHHSH

SEQ ID NO: 223567 - protein, 9 aa, Homo Sapiens
VLDIVSRLM

SEQ ID NO: 223568 - protein, 9 aa, Homo Sapiens
SGTGKTEST

SEQ ID NO: 223569 - protein, 9 aa, Homo Sapiens
PPCQSAECQ

SEQ ID NO: 223570 - protein, 9 aa, Homo Sapiens
VEVKVVLGL

SEQ ID NO: 223571 - protein, 9 aa, Homo Sapiens
YMLTHKSFI

SEQ ID NO: 223572 - protein, 9 aa, Homo Sapiens
IIQQPQTTV

SEQ ID NO: 223573 - protein, 9 aa, Homo Sapiens
MVDLQDAHT

SEQ ID NO: 223574 - protein, 9 aa, Homo Sapiens
EPFSQPIKF

SEQ ID NO: 223575 - protein, 9 aa, Homo Sapiens
GSQHLLFEA

SEQ ID NO: 223576 - protein, 9 aa, Homo Sapiens
GGQLAAGEA

SEQ ID NO: 223577 - protein, 9 aa, Homo Sapiens
EKKQDPKGK

SEQ ID NO: 223578 - protein, 9 aa, Homo Sapiens
GQPDEQGLQ

SEQ ID NO: 223579 - protein, 9 aa, Homo Sapiens
GDLDRNTFR

SEQ ID NO: 223580 - protein, 9 aa, Homo Sapiens
MTVRDIEKS

SEQ ID NO: 223581 - protein, 9 aa, Homo Sapiens
SQDLILQQL

SEQ ID NO: 223582 - protein, 9 aa, Homo Sapiens
RHKKVILQV

SEQ ID NO: 223583 - protein, 9 aa, Homo Sapiens
DHAAPAAFG

SEQ ID NO: 223584 - protein, 9 aa, Homo Sapiens
MGLAIGTHS

SEQ ID NO: 223585 - protein, 9 aa, Homo Sapiens
STASRASQP

SEQ ID NO: 223586 - protein, 9 aa, Homo Sapiens
PHPKRFTPD

SEQ ID NO: 223587 - protein, 9 aa, Homo Sapiens
LRGSSSTAK

SEQ ID NO: 223588 - protein, 9 aa, Homo Sapiens
DREKPMAYT

SEQ ID NO: 223589 - protein, 9 aa, Homo Sapiens
PPGRTASAT

SEQ ID NO: 223590 - protein, 9 aa, Homo Sapiens
VAQTPSPVS

SEQ ID NO: 223591 - protein, 9 aa, Homo Sapiens
CAIAHPYSQ

SEQ ID NO: 223592 - protein, 9 aa, Homo Sapiens
LYLFKLPAL

SEQ ID NO: 223593 - protein, 9 aa, Homo Sapiens
AEKNHARVL

SEQ ID NO: 223594 - protein, 9 aa, Homo Sapiens
RTSPPAGAV

SEQ ID NO: 223595 - protein, 9 aa, Homo Sapiens
NLSELQDTN

SEQ ID NO: 223596 - protein, 9 aa, Homo Sapiens
ETSSIPQKD

SEQ ID NO: 223597 - protein, 9 aa, Homo Sapiens
ICSPRGPVF

SEQ ID NO: 223598 - protein, 9 aa, Homo Sapiens
LQSPRVNCT

SEQ ID NO: 223599 - protein, 9 aa, Homo Sapiens
FMKHRRDFI

SEQ ID NO: 223600 - protein, 9 aa, Homo Sapiens
PRRSCPTLR

SEQ ID NO: 223601 - protein, 9 aa, Homo Sapiens
DSNDSRCGS

SEQ ID NO: 223602 - protein, 9 aa, Homo Sapiens
SGTLLSGDY

SEQ ID NO: 223603 - protein, 9 aa, Homo Sapiens
SFIRKYDAV

SEQ ID NO: 223604 - protein, 9 aa, Homo Sapiens
QPPHVPRWR

SEQ ID NO: 223605 - protein, 9 aa, Homo Sapiens
LDNTLNDIT

SEQ ID NO: 223606 - protein, 9 aa, Homo Sapiens
KLEVDSLYL

SEQ ID NO: 223607 - protein, 9 aa, Homo Sapiens
EFVQLHEGD

SEQ ID NO: 223608 - protein, 9 aa, Homo Sapiens
YKEWKSQMQ

SEQ ID NO: 223609 - protein, 9 aa, Homo Sapiens
QVLHRLTVG

SEQ ID NO: 223610 - protein, 9 aa, Homo Sapiens
RLKDISKIF

SEQ ID NO: 223611 - protein, 9 aa, Homo Sapiens
GLLTKVNMD

SEQ ID NO: 223612 - protein, 9 aa, Homo Sapiens
AHTGGQERQ

SEQ ID NO: 223613 - protein, 9 aa, Homo Sapiens
RAEVSQRAL

SEQ ID NO: 223614 - protein, 9 aa, Homo Sapiens
LLRALCMLK

SEQ ID NO: 223615 - protein, 9 aa, Homo Sapiens
AQLLLHGEA

SEQ ID NO: 223616 - protein, 9 aa, Homo Sapiens
GQDLPNNMI

SEQ ID NO: 223617 - protein, 9 aa, Homo Sapiens
VSAASATGA

SEQ ID NO: 223618 - protein, 9 aa, Homo Sapiens
LTKLFLIFS

SEQ ID NO: 223619 - protein, 9 aa, Homo Sapiens
AVDLVHGAL

SEQ ID NO: 223620 - protein, 9 aa, Homo Sapiens
PIRTSMCQN

SEQ ID NO: 223621 - protein, 9 aa, Homo Sapiens
ILTLPPTNA

SEQ ID NO: 223622 - protein, 9 aa, Homo Sapiens
ILHSPDEKS

SEQ ID NO: 223623 - protein, 9 aa, Homo Sapiens
IDELTALLQ

SEQ ID NO: 223624 - protein, 9 aa, Homo Sapiens
LGGCSSPLP

SEQ ID NO: 223625 - protein, 9 aa, Homo Sapiens
KRREQWLRL

SEQ ID NO: 223626 - protein, 9 aa, Homo Sapiens
SIPSMILPD

SEQ ID NO: 223627 - protein, 9 aa, Homo Sapiens
LTSLTHRSH

SEQ ID NO: 223628 - protein, 9 aa, Homo Sapiens
LGQDLPNNM

SEQ ID NO: 223629 - protein, 9 aa, Homo Sapiens
SSGWAGPAA

SEQ ID NO: 223630 - protein, 9 aa, Homo Sapiens
CPTLRACAN

SEQ ID NO: 223631 - protein, 9 aa, Homo Sapiens
SYHQYGGTY

SEQ ID NO: 223632 - protein, 9 aa, Homo Sapiens
WISVPCPNL

SEQ ID NO: 223633 - protein, 9 aa, Homo Sapiens
PEVSREDQQ

SEQ ID NO: 223634 - protein, 9 aa, Homo Sapiens
SASTHTSRN

SEQ ID NO: 223635 - protein, 9 aa, Homo Sapiens
PRAPGSQLP

SEQ ID NO: 223636 - protein, 9 aa, Homo Sapiens
LGAAWGSLC

SEQ ID NO: 223637 - protein, 9 aa, Homo Sapiens
TEQSHLLAA

SEQ ID NO: 223638 - protein, 9 aa, Homo Sapiens
RCIWQLGRP

SEQ ID NO: 223639 - protein, 9 aa, Homo Sapiens
EERRRCEEE

SEQ ID NO: 223640 - protein, 9 aa, Homo Sapiens
MHGRGNARS

SEQ ID NO: 223641 - protein, 9 aa, Homo Sapiens
FPSYKVKVM

SEQ ID NO: 223642 - protein, 9 aa, Homo Sapiens
ATAHPNLLL

SEQ ID NO: 223643 - protein, 9 aa, Homo Sapiens
DFTRVNFID

SEQ ID NO: 223644 - protein, 9 aa, Homo Sapiens
RFHLVPSIN

SEQ ID NO: 223645 - protein, 9 aa, Homo Sapiens
QMRTAPSVW

SEQ ID NO: 223646 - protein, 9 aa, Homo Sapiens
SQINHPAHL

SEQ ID NO: 223647 - protein, 9 aa, Homo Sapiens
PKGEDVHSG

SEQ ID NO: 223648 - protein, 9 aa, Homo Sapiens
FAIWLAPSL

SEQ ID NO: 223649 - protein, 9 aa, Homo Sapiens
MRWRSSRRQ

SEQ ID NO: 223650 - protein, 9 aa, Homo Sapiens
EGSKPPNSC

SEQ ID NO: 223651 - protein, 9 aa, Homo Sapiens
VDGGFGMCK

SEQ ID NO: 223652 - protein, 9 aa, Homo Sapiens
AKDLFYIVL

SEQ ID NO: 223653 - protein, 9 aa, Homo Sapiens
VAIIGSLIF

SEQ ID NO: 223654 - protein, 9 aa, Homo Sapiens
EACDPHSRH

SEQ ID NO: 223655 - protein, 9 aa, Homo Sapiens
GSAASQRFP

SEQ ID NO: 223656 - protein, 9 aa, Homo Sapiens
QNGPQWQVV

SEQ ID NO: 223657 - protein, 9 aa, Homo Sapiens
QQDAWQELG

SEQ ID NO: 223658 - protein, 9 aa, Homo Sapiens
FVLVNLEVT

SEQ ID NO: 223659 - protein, 9 aa, Homo Sapiens
ASQANHVKD

SEQ ID NO: 223660 - protein, 9 aa, Homo Sapiens
MPHSFLVKS

SEQ ID NO: 223661 - protein, 9 aa, Homo Sapiens
PPRGRGRRG

SEQ ID NO: 223662 - protein, 9 aa, Homo Sapiens
APCRARVPG

SEQ ID NO: 223663 - protein, 9 aa, Homo Sapiens
HIKSPKRPK

SEQ ID NO: 223664 - protein, 9 aa, Homo Sapiens
PGSQLPPLS

SEQ ID NO: 223665 - protein, 9 aa, Homo Sapiens
KENGPFLST

SEQ ID NO: 223666 - protein, 9 aa, Homo Sapiens
THTPLPFST

SEQ ID NO: 223667 - protein, 9 aa, Homo Sapiens
LEVDSLYLM

SEQ ID NO: 223668 - protein, 9 aa, Homo Sapiens
PPTLTSQVS

SEQ ID NO: 223669 - protein, 9 aa, Homo Sapiens
VSIIDDDIF

SEQ ID NO: 223670 - protein, 9 aa, Homo Sapiens
GIIILAVES

SEQ ID NO: 223671 - protein, 9 aa, Homo Sapiens
LAARLEEEC

SEQ ID NO: 223672 - protein, 9 aa, Homo Sapiens
QEEREQQLR

SEQ ID NO: 223673 - protein, 9 aa, Homo Sapiens
SFALVDSGD

SEQ ID NO: 223674 - protein, 9 aa, Homo Sapiens
WGQRPAPRT

SEQ ID NO: 223675 - protein, 9 aa, Homo Sapiens
DPMPIQISR

SEQ ID NO: 223676 - protein, 9 aa, Homo Sapiens
GGKPYKCKE

SEQ ID NO: 223677 - protein, 9 aa, Homo Sapiens
KGNFQRTTC

SEQ ID NO: 223678 - protein, 9 aa, Homo Sapiens
GLSLEVARH

SEQ ID NO: 223679 - protein, 9 aa, Homo Sapiens
KVGEGGLRR

SEQ ID NO: 223680 - protein, 9 aa, Homo Sapiens
AWRTRCASC

SEQ ID NO: 223681 - protein, 9 aa, Homo Sapiens
LPQAQVEWP

SEQ ID NO: 223682 - protein, 9 aa, Homo Sapiens
EKTMIFFTD

SEQ ID NO: 223683 - protein, 9 aa, Homo Sapiens
HQAPQVAML

SEQ ID NO: 223684 - protein, 9 aa, Homo Sapiens
SAHVCTGEH

SEQ ID NO: 223685 - protein, 9 aa, Homo Sapiens
WEQLENGMV

SEQ ID NO: 223686 - protein, 9 aa, Homo Sapiens
QMKTAEGHG

SEQ ID NO: 223687 - protein, 9 aa, Homo Sapiens
KLEPASSFV

SEQ ID NO: 223688 - protein, 9 aa, Homo Sapiens
SIALTQVRY

SEQ ID NO: 223689 - protein, 9 aa, Homo Sapiens
TQKEIRVSI

SEQ ID NO: 223690 - protein, 9 aa, Homo Sapiens
WCGTWTAWM

SEQ ID NO: 223691 - protein, 9 aa, Homo Sapiens
RLASVLREP

SEQ ID NO: 223692 - protein, 9 aa, Homo Sapiens
ALLDACAGC

SEQ ID NO: 223693 - protein, 9 aa, Homo Sapiens
CVVPESKLQ

SEQ ID NO: 223694 - protein, 9 aa, Homo Sapiens
LPSAWDIRD

SEQ ID NO: 223695 - protein, 9 aa, Homo Sapiens
WLTMSSTMY

SEQ ID NO: 223696 - protein, 9 aa, Homo Sapiens
PRAGGFVIG

SEQ ID NO: 223697 - protein, 9 aa, Homo Sapiens
TSPYNTDHT

SEQ ID NO: 223698 - protein, 9 aa, Homo Sapiens
GEHCDINFD

SEQ ID NO: 223699 - protein, 9 aa, Homo Sapiens
CKKFSNPFR

SEQ ID NO: 223700 - protein, 9 aa, Homo Sapiens
GASEIIWKC

SEQ ID NO: 223701 - protein, 9 aa, Homo Sapiens
AADMDEVYT

SEQ ID NO: 223702 - protein, 9 aa, Homo Sapiens
LLHFFSGFS

SEQ ID NO: 223703 - protein, 9 aa, Homo Sapiens
DLYANIVLS

SEQ ID NO: 223704 - protein, 9 aa, Homo Sapiens
RQGKLHRCG

SEQ ID NO: 223705 - protein, 9 aa, Homo Sapiens
LLSLLLAAV

SEQ ID NO: 223706 - protein, 9 aa, Homo Sapiens
LPVGFLLII

SEQ ID NO: 223707 - protein, 9 aa, Homo Sapiens
NRLRLQGMG

SEQ ID NO: 223708 - protein, 9 aa, Homo Sapiens
PSPASDADS

SEQ ID NO: 223709 - protein, 9 aa, Homo Sapiens
MRSDRLAVG

SEQ ID NO: 223710 - protein, 9 aa, Homo Sapiens
RASRKTWQR

SEQ ID NO: 223711 - protein, 9 aa, Homo Sapiens
GAHHCQYKL

SEQ ID NO: 223712 - protein, 9 aa, Homo Sapiens
TPGIIILAV

SEQ ID NO: 223713 - protein, 9 aa, Homo Sapiens
VRCIQPLLD

SEQ ID NO: 223714 - protein, 9 aa, Homo Sapiens
SSTAAPISS

SEQ ID NO: 223715 - protein, 9 aa, Homo Sapiens
TKTSLFRKT

SEQ ID NO: 223716 - protein, 9 aa, Homo Sapiens
QRSSTTPPA

SEQ ID NO: 223717 - protein, 9 aa, Homo Sapiens
CLECKQNFW

SEQ ID NO: 223718 - protein, 9 aa, Homo Sapiens
HWLQARRWP

SEQ ID NO: 223719 - protein, 9 aa, Homo Sapiens
RHNQTLSLM

SEQ ID NO: 223720 - protein, 9 aa, Homo Sapiens
LGRVFSFCN

SEQ ID NO: 223721 - protein, 9 aa, Homo Sapiens
ENIVGIPSA

SEQ ID NO: 223722 - protein, 9 aa, Homo Sapiens
DGTVDTIGE

SEQ ID NO: 223723 - protein, 9 aa, Homo Sapiens
NPVMKMKRW

SEQ ID NO: 223724 - protein, 9 aa, Homo Sapiens
GPGLVATRA

SEQ ID NO: 223725 - protein, 9 aa, Homo Sapiens
GASEADEGV

SEQ ID NO: 223726 - protein, 9 aa, Homo Sapiens
LADVLPELL

SEQ ID NO: 223727 - protein, 9 aa, Homo Sapiens
PDLRSMRIN

SEQ ID NO: 223728 - protein, 9 aa, Homo Sapiens
TLRPRSHYM

SEQ ID NO: 223729 - protein, 9 aa, Homo Sapiens
KSGDEDFES

SEQ ID NO: 223730 - protein, 9 aa, Homo Sapiens
RSSSFSKFL

SEQ ID NO: 223731 - protein, 9 aa, Homo Sapiens
HLSLIYTVY

SEQ ID NO: 223732 - protein, 9 aa, Homo Sapiens
MCPAPWWSQ

SEQ ID NO: 223733 - protein, 9 aa, Homo Sapiens
PPAPATQAP

SEQ ID NO: 223734 - protein, 9 aa, Homo Sapiens
KVLQEMLGM

SEQ ID NO: 223735 - protein, 9 aa, Homo Sapiens
LLDHGVSLS

SEQ ID NO: 223736 - protein, 9 aa, Homo Sapiens
PTRSEPFWM

SEQ ID NO: 223737 - protein, 9 aa, Homo Sapiens
VAVDLVHGA

SEQ ID NO: 223738 - protein, 9 aa, Homo Sapiens
RGATAVFDM

SEQ ID NO: 223739 - protein, 9 aa, Homo Sapiens
APTAPASAL

SEQ ID NO: 223740 - protein, 9 aa, Homo Sapiens
SVDVVKQVQ

SEQ ID NO: 223741 - protein, 9 aa, Homo Sapiens
SVHFPFTFS

SEQ ID NO: 223742 - protein, 9 aa, Homo Sapiens
KLKRKIQKR

SEQ ID NO: 223743 - protein, 9 aa, Homo Sapiens
SKGCVLNQL

SEQ ID NO: 223744 - protein, 9 aa, Homo Sapiens
VGSAASQRF

SEQ ID NO: 223745 - protein, 9 aa, Homo Sapiens
LVATVEAVL

SEQ ID NO: 223746 - protein, 9 aa, Homo Sapiens
LSYGDVDLE

SEQ ID NO: 223747 - protein, 9 aa, Homo Sapiens
RPLPPPPSW

SEQ ID NO: 223748 - protein, 9 aa, Homo Sapiens
EAVAQVESE

SEQ ID NO: 223749 - protein, 9 aa, Homo Sapiens
TQQVLCVVR

SEQ ID NO: 223750 - protein, 9 aa, Homo Sapiens
GEAVQGQVH

SEQ ID NO: 223751 - protein, 9 aa, Homo Sapiens
SFPLSCPPP

SEQ ID NO: 223752 - protein, 9 aa, Homo Sapiens
QDLHSHFSD

SEQ ID NO: 223753 - protein, 9 aa, Homo Sapiens
DVVGSALDC

SEQ ID NO: 223754 - protein, 9 aa, Homo Sapiens
TTLTDSNIV

SEQ ID NO: 223755 - protein, 9 aa, Homo Sapiens
VRLASVLRE

SEQ ID NO: 223756 - protein, 9 aa, Homo Sapiens
WDTVVARGA

SEQ ID NO: 223757 - protein, 9 aa, Homo Sapiens
PRWAPLWTC

SEQ ID NO: 223758 - protein, 9 aa, Homo Sapiens
LQLVGDVVH

SEQ ID NO: 223759 - protein, 9 aa, Homo Sapiens
LHPDGTVDT

SEQ ID NO: 223760 - protein, 9 aa, Homo Sapiens
DVKCDYTLG

SEQ ID NO: 223761 - protein, 9 aa, Homo Sapiens
SDEDLIKVS

SEQ ID NO: 223762 - protein, 9 aa, Homo Sapiens
GGLGGKRSL

SEQ ID NO: 223763 - protein, 9 aa, Homo Sapiens
PKGEVVPLH

SEQ ID NO: 223764 - protein, 9 aa, Homo Sapiens
TMDSVRSGL

SEQ ID NO: 223765 - protein, 9 aa, Homo Sapiens
RPDRDHHVS

SEQ ID NO: 223766 - protein, 9 aa, Homo Sapiens
GDQIPKFAI

SEQ ID NO: 223767 - protein, 9 aa, Homo Sapiens
DKSPTHMLT

SEQ ID NO: 223768 - protein, 9 aa, Homo Sapiens
SYDSTLEVL

SEQ ID NO: 223769 - protein, 9 aa, Homo Sapiens
LLQQDLDPC

SEQ ID NO: 223770 - protein, 9 aa, Homo Sapiens
CVVVFGAGG

SEQ ID NO: 223771 - protein, 9 aa, Homo Sapiens
YFAGVPLII

SEQ ID NO: 223772 - protein, 9 aa, Homo Sapiens
YTLLVQLRP

SEQ ID NO: 223773 - protein, 9 aa, Homo Sapiens
PRVHAPEGR

SEQ ID NO: 223774 - protein, 9 aa, Homo Sapiens
STRTSATCT

SEQ ID NO: 223775 - protein, 9 aa, Homo Sapiens
VQAEEREQI

SEQ ID NO: 223776 - protein, 9 aa, Homo Sapiens
DESCDLVVE

SEQ ID NO: 223777 - protein, 9 aa, Homo Sapiens
QVPWYPTVL

SEQ ID NO: 223778 - protein, 9 aa, Homo Sapiens
VSGLSAASP

SEQ ID NO: 223779 - protein, 9 aa, Homo Sapiens
PAPWAGHLL

SEQ ID NO: 223780 - protein, 9 aa, Homo Sapiens
NTVLYRGHA

SEQ ID NO: 223781 - protein, 9 aa, Homo Sapiens
NQVFPCAKG

SEQ ID NO: 223782 - protein, 9 aa, Homo Sapiens
NPPGGGTIQ

SEQ ID NO: 223783 - protein, 9 aa, Homo Sapiens
CYSAPRWAP

SEQ ID NO: 223784 - protein, 9 aa, Homo Sapiens
EAEQLWNQI

SEQ ID NO: 223785 - protein, 9 aa, Homo Sapiens
LVFGALIFG

SEQ ID NO: 223786 - protein, 9 aa, Homo Sapiens
QFPMVPGET

SEQ ID NO: 223787 - protein, 9 aa, Homo Sapiens
DSCVNSDYE

SEQ ID NO: 223788 - protein, 9 aa, Homo Sapiens
MMVAAAVPP

SEQ ID NO: 223789 - protein, 9 aa, Homo Sapiens
GSVSTSQPV

SEQ ID NO: 223790 - protein, 9 aa, Homo Sapiens
PTLRACANS

SEQ ID NO: 223791 - protein, 9 aa, Homo Sapiens
LGQELWLTP

SEQ ID NO: 223792 - protein, 9 aa, Homo Sapiens
GDEDFQSDG

SEQ ID NO: 223793 - protein, 9 aa, Homo Sapiens
AARLEEECG

SEQ ID NO: 223794 - protein, 9 aa, Homo Sapiens
KPFECNKYG

SEQ ID NO: 223795 - protein, 9 aa, Homo Sapiens
LDPKTDPRA

SEQ ID NO: 223796 - protein, 9 aa, Homo Sapiens
IEKASAQST

SEQ ID NO: 223797 - protein, 9 aa, Homo Sapiens
RVPPSTMCP

SEQ ID NO: 223798 - protein, 9 aa, Homo Sapiens
QVTLAAWNE

SEQ ID NO: 223799 - protein, 9 aa, Homo Sapiens
AGTTSPWPS

SEQ ID NO: 223800 - protein, 9 aa, Homo Sapiens
DDDNPPCLL

SEQ ID NO: 223801 - protein, 9 aa, Homo Sapiens
KKGRRSISL

SEQ ID NO: 223802 - protein, 9 aa, Homo Sapiens
GKRCNPCCR

SEQ ID NO: 223803 - protein, 9 aa, Homo Sapiens
STKRECLKS

SEQ ID NO: 223804 - protein, 9 aa, Homo Sapiens
RICPLPPCS

SEQ ID NO: 223805 - protein, 9 aa, Homo Sapiens
IISKFFDDP

SEQ ID NO: 223806 - protein, 9 aa, Homo Sapiens
WKAGTGAQR

SEQ ID NO: 223807 - protein, 9 aa, Homo Sapiens
GRCRTSRQA

SEQ ID NO: 223808 - protein, 9 aa, Homo Sapiens
QPVRPSYRQ

SEQ ID NO: 223809 - protein, 9 aa, Homo Sapiens
LYPVLCSPR

SEQ ID NO: 223810 - protein, 9 aa, Homo Sapiens
RSTVCAMDS

SEQ ID NO: 223811 - protein, 9 aa, Homo Sapiens
SEQLGVDGD

SEQ ID NO: 223812 - protein, 9 aa, Homo Sapiens
VSTAASMKM

SEQ ID NO: 223813 - protein, 9 aa, Homo Sapiens
TVLWLLTAN

SEQ ID NO: 223814 - protein, 9 aa, Homo Sapiens
PRCSGWRVA

SEQ ID NO: 223815 - protein, 9 aa, Homo Sapiens
SVFVDFLIG

SEQ ID NO: 223816 - protein, 9 aa, Homo Sapiens
STLAFQQAC

SEQ ID NO: 223817 - protein, 9 aa, Homo Sapiens
LAAPISLHM

SEQ ID NO: 223818 - protein, 9 aa, Homo Sapiens
HLHFIVEGS

SEQ ID NO: 223819 - protein, 9 aa, Homo Sapiens
GEKEEDKKV

SEQ ID NO: 223820 - protein, 9 aa, Homo Sapiens
FNGALEKGR

SEQ ID NO: 223821 - protein, 9 aa, Homo Sapiens
VDVGLYIPD

SEQ ID NO: 223822 - protein, 9 aa, Homo Sapiens
QARAAQRKS

SEQ ID NO: 223823 - protein, 9 aa, Homo Sapiens
PGNNKLQVS

SEQ ID NO: 223824 - protein, 9 aa, Homo Sapiens
AAERSHDQR

SEQ ID NO: 223825 - protein, 9 aa, Homo Sapiens
TVLQGPSPG

SEQ ID NO: 223826 - protein, 9 aa, Homo Sapiens
SLLRLAYLI

SEQ ID NO: 223827 - protein, 9 aa, Homo Sapiens
RFHKDILLS

SEQ ID NO: 223828 - protein, 9 aa, Homo Sapiens
VILQTGAPG

SEQ ID NO: 223829 - protein, 9 aa, Homo Sapiens
CRRMGHRVL

SEQ ID NO: 223830 - protein, 9 aa, Homo Sapiens
HQHEEGAGR

SEQ ID NO: 223831 - protein, 9 aa, Homo Sapiens
RAKRRNHFW

SEQ ID NO: 223832 - protein, 9 aa, Homo Sapiens
SVIFLSVFK

SEQ ID NO: 223833 - protein, 9 aa, Homo Sapiens
GPTSSPSST

SEQ ID NO: 223834 - protein, 9 aa, Homo Sapiens
LTQLVVVDF

SEQ ID NO: 223835 - protein, 9 aa, Homo Sapiens
LKRSSSFSK

SEQ ID NO: 223836 - protein, 9 aa, Homo Sapiens
PHLPVASCP

SEQ ID NO: 223837 - protein, 9 aa, Homo Sapiens
APPVAEEAA

SEQ ID NO: 223838 - protein, 9 aa, Homo Sapiens
AMAYDRYAT

SEQ ID NO: 223839 - protein, 9 aa, Homo Sapiens
YPLLLLLLI

SEQ ID NO: 223840 - protein, 9 aa, Homo Sapiens
AGGCASCPS

SEQ ID NO: 223841 - protein, 9 aa, Homo Sapiens
MRPGSPLFK

SEQ ID NO: 223842 - protein, 9 aa, Homo Sapiens
WYGLEHGQS

SEQ ID NO: 223843 - protein, 9 aa, Homo Sapiens
GMCKYTTPL

SEQ ID NO: 223844 - protein, 9 aa, Homo Sapiens
GIPGWTNRP

SEQ ID NO: 223845 - protein, 9 aa, Homo Sapiens
GRVFCWRSI

SEQ ID NO: 223846 - protein, 9 aa, Homo Sapiens
CMTCCLLQA

SEQ ID NO: 223847 - protein, 9 aa, Homo Sapiens
TRANPGPQD

SEQ ID NO: 223848 - protein, 9 aa, Homo Sapiens
LLWLPCTTG

SEQ ID NO: 223849 - protein, 9 aa, Homo Sapiens
AEGHGFKQE

SEQ ID NO: 223850 - protein, 9 aa, Homo Sapiens
VPIRECSST

SEQ ID NO: 223851 - protein, 9 aa, Homo Sapiens
GAACWCLEC

SEQ ID NO: 223852 - protein, 9 aa, Homo Sapiens
QPDVVVQQR

SEQ ID NO: 223853 - protein, 9 aa, Homo Sapiens
RVCIVSLGV

SEQ ID NO: 223854 - protein, 9 aa, Homo Sapiens
NCWHRDSAG

SEQ ID NO: 223855 - protein, 9 aa, Homo Sapiens
HGYRGSRHV

SEQ ID NO: 223856 - protein, 9 aa, Homo Sapiens
PNTMYSFLL

SEQ ID NO: 223857 - protein, 9 aa, Homo Sapiens
EDQNPPRPR

SEQ ID NO: 223858 - protein, 9 aa, Homo Sapiens
IWQLGRPAS

SEQ ID NO: 223859 - protein, 9 aa, Homo Sapiens
HDSPGCVIC

SEQ ID NO: 223860 - protein, 9 aa, Homo Sapiens
PEVSDTGGL

SEQ ID NO: 223861 - protein, 9 aa, Homo Sapiens
LRRRSRKAS

SEQ ID NO: 223862 - protein, 9 aa, Homo Sapiens
CRILDNSTK

SEQ ID NO: 223863 - protein, 9 aa, Homo Sapiens
LKKDTSVNV

SEQ ID NO: 223864 - protein, 9 aa, Homo Sapiens
LSTSPAAVV

SEQ ID NO: 223865 - protein, 9 aa, Homo Sapiens
EREQQLRRE

SEQ ID NO: 223866 - protein, 9 aa, Homo Sapiens
KCSLYGKKL

SEQ ID NO: 223867 - protein, 9 aa, Homo Sapiens
GVGVLGAHH

SEQ ID NO: 223868 - protein, 9 aa, Homo Sapiens
DSPGCVICS

SEQ ID NO: 223869 - protein, 9 aa, Homo Sapiens
LKTWHHLNS

SEQ ID NO: 223870 - protein, 9 aa, Homo Sapiens
SISVCGQVL

SEQ ID NO: 223871 - protein, 9 aa, Homo Sapiens
SLVRFYIAE

SEQ ID NO: 223872 - protein, 9 aa, Homo Sapiens
FSNLVRLMG

SEQ ID NO: 223873 - protein, 9 aa, Homo Sapiens
TGDPAGGGC

SEQ ID NO: 223874 - protein, 9 aa, Homo Sapiens
NEVSCCDAG

SEQ ID NO: 223875 - protein, 9 aa, Homo Sapiens
PSAQPRRHC

SEQ ID NO: 223876 - protein, 9 aa, Homo Sapiens
APTPKAGQS

SEQ ID NO: 223877 - protein, 9 aa, Homo Sapiens
SWPRVPHWG

SEQ ID NO: 223878 - protein, 9 aa, Homo Sapiens
LLEVEVLQE

SEQ ID NO: 223879 - protein, 9 aa, Homo Sapiens
TTRPSRQLV

SEQ ID NO: 223880 - protein, 9 aa, Homo Sapiens
ASIMCPLNP

SEQ ID NO: 223881 - protein, 9 aa, Homo Sapiens
STLLFTKTS

SEQ ID NO: 223882 - protein, 9 aa, Homo Sapiens
PPRRSSSFR

SEQ ID NO: 223883 - protein, 9 aa, Homo Sapiens
FIHVHTPLP

SEQ ID NO: 223884 - protein, 9 aa, Homo Sapiens
NKSHPPEAK

SEQ ID NO: 223885 - protein, 9 aa, Homo Sapiens
RRSISLLRS

SEQ ID NO: 223886 - protein, 9 aa, Homo Sapiens
TSLILHEGS

SEQ ID NO: 223887 - protein, 9 aa, Homo Sapiens
VTFIHGVVL

SEQ ID NO: 223888 - protein, 9 aa, Homo Sapiens
TKCAFQAPP

SEQ ID NO: 223889 - protein, 9 aa, Homo Sapiens
EVELSRKVT

SEQ ID NO: 223890 - protein, 9 aa, Homo Sapiens
HLTEHQRMH

SEQ ID NO: 223891 - protein, 9 aa, Homo Sapiens
NKIQGIVGA

SEQ ID NO: 223892 - protein, 9 aa, Homo Sapiens
WAWRAASCR

SEQ ID NO: 223893 - protein, 9 aa, Homo Sapiens
ESPKDIPAH

SEQ ID NO: 223894 - protein, 9 aa, Homo Sapiens
IRHPSLGGC

SEQ ID NO: 223895 - protein, 9 aa, Homo Sapiens
VDLQDAHTL

SEQ ID NO: 223896 - protein, 9 aa, Homo Sapiens
DDWGAAGVQ

SEQ ID NO: 223897 - protein, 9 aa, Homo Sapiens
KTKRYDIPA

SEQ ID NO: 223898 - protein, 9 aa, Homo Sapiens
TVLYRGHAY

SEQ ID NO: 223899 - protein, 9 aa, Homo Sapiens
HVEDPGPPR

SEQ ID NO: 223900 - protein, 9 aa, Homo Sapiens
SHDQRHWRP

SEQ ID NO: 223901 - protein, 9 aa, Homo Sapiens
IAPSRGSRC

SEQ ID NO: 223902 - protein, 9 aa, Homo Sapiens
NVRNSEGEV

SEQ ID NO: 223903 - protein, 9 aa, Homo Sapiens
AGGRGRHRR

SEQ ID NO: 223904 - protein, 9 aa, Homo Sapiens
RSSGKKIAF

SEQ ID NO: 223905 - protein, 9 aa, Homo Sapiens
LDWLLRFTK

SEQ ID NO: 223906 - protein, 9 aa, Homo Sapiens
EWGCLCGRC

SEQ ID NO: 223907 - protein, 9 aa, Homo Sapiens
AVVLNEDGV

SEQ ID NO: 223908 - protein, 9 aa, Homo Sapiens
RMAGRTTAV

SEQ ID NO: 223909 - protein, 9 aa, Homo Sapiens
LWSHRPPSS

SEQ ID NO: 223910 - protein, 9 aa, Homo Sapiens
KISVLSFET

SEQ ID NO: 223911 - protein, 9 aa, Homo Sapiens
GYRPSMLCV

SEQ ID NO: 223912 - protein, 9 aa, Homo Sapiens
EYLKAPEDS

SEQ ID NO: 223913 - protein, 9 aa, Homo Sapiens
EGVADEEGE

SEQ ID NO: 223914 - protein, 9 aa, Homo Sapiens
HCLWLWCRP

SEQ ID NO: 223915 - protein, 9 aa, Homo Sapiens
KGASAPRGP

SEQ ID NO: 223916 - protein, 9 aa, Homo Sapiens
CMDCLDHTN

SEQ ID NO: 223917 - protein, 9 aa, Homo Sapiens
LACLTSGTL

SEQ ID NO: 223918 - protein, 9 aa, Homo Sapiens
GYKIPLPVG

SEQ ID NO: 223919 - protein, 9 aa, Homo Sapiens
EVEVKVVLG

SEQ ID NO: 223920 - protein, 9 aa, Homo Sapiens
EAVAPFMTN

SEQ ID NO: 223921 - protein, 9 aa, Homo Sapiens
VPLIIGAVI

SEQ ID NO: 223922 - protein, 9 aa, Homo Sapiens
TCFKRQGKL

SEQ ID NO: 223923 - protein, 9 aa, Homo Sapiens
RAARETRSG

SEQ ID NO: 223924 - protein, 9 aa, Homo Sapiens
MIPPQDASA

SEQ ID NO: 223925 - protein, 9 aa, Homo Sapiens
VVGPRGQDP

SEQ ID NO: 223926 - protein, 9 aa, Homo Sapiens
VAGDLTSLG

SEQ ID NO: 223927 - protein, 9 aa, Homo Sapiens
LKKLLSEEP

SEQ ID NO: 223928 - protein, 9 aa, Homo Sapiens
AGLWTLLGD

SEQ ID NO: 223929 - protein, 9 aa, Homo Sapiens
CEGPEHLTG

SEQ ID NO: 223930 - protein, 9 aa, Homo Sapiens
SKLTTTSST

SEQ ID NO: 223931 - protein, 9 aa, Homo Sapiens
HRQCCCDRG

SEQ ID NO: 223932 - protein, 9 aa, Homo Sapiens
EKRREKKRH

SEQ ID NO: 223933 - protein, 9 aa, Homo Sapiens
HTQAQEGLC

SEQ ID NO: 223934 - protein, 9 aa, Homo Sapiens
PHAPCRARV

SEQ ID NO: 223935 - protein, 9 aa, Homo Sapiens
WMTWCGWLC

SEQ ID NO: 223936 - protein, 9 aa, Homo Sapiens
VFILLVTLV

SEQ ID NO: 223937 - protein, 9 aa, Homo Sapiens
EEAQAGAGL

SEQ ID NO: 223938 - protein, 9 aa, Homo Sapiens
VDIEAIFQS

SEQ ID NO: 223939 - protein, 9 aa, Homo Sapiens
RSSSWPAPT

SEQ ID NO: 223940 - protein, 9 aa, Homo Sapiens
LSADSMARA

SEQ ID NO: 223941 - protein, 9 aa, Homo Sapiens
RIASIAVVS

SEQ ID NO: 223942 - protein, 9 aa, Homo Sapiens
TRCEPEPSC

SEQ ID NO: 223943 - protein, 9 aa, Homo Sapiens
LHLHRQISL

SEQ ID NO: 223944 - protein, 9 aa, Homo Sapiens
LCKMSDTCS

SEQ ID NO: 223945 - protein, 9 aa, Homo Sapiens
LFRWAHFQK

SEQ ID NO: 223946 - protein, 9 aa, Homo Sapiens
GWQNSIWHN

SEQ ID NO: 223947 - protein, 9 aa, Homo Sapiens
CAQCWPSDG

SEQ ID NO: 223948 - protein, 9 aa, Homo Sapiens
LLFEAWLLL

SEQ ID NO: 223949 - protein, 9 aa, Homo Sapiens
TYTKVWKMN

SEQ ID NO: 223950 - protein, 9 aa, Homo Sapiens
NSPCPRSKS

SEQ ID NO: 223951 - protein, 9 aa, Homo Sapiens
AEAEVNVVS

SEQ ID NO: 223952 - protein, 9 aa, Homo Sapiens
APRWAPLWT

SEQ ID NO: 223953 - protein, 9 aa, Homo Sapiens
ESQRMSGEG

SEQ ID NO: 223954 - protein, 9 aa, Homo Sapiens
IPRRTHLCS

SEQ ID NO: 223955 - protein, 9 aa, Homo Sapiens
LLTSSPVTF

SEQ ID NO: 223956 - protein, 9 aa, Homo Sapiens
QKTFYTLRV

SEQ ID NO: 223957 - protein, 9 aa, Homo Sapiens
GKTSSCQLS

SEQ ID NO: 223958 - protein, 9 aa, Homo Sapiens
IQISRQSSV

SEQ ID NO: 223959 - protein, 9 aa, Homo Sapiens
EVLVLDEAV

SEQ ID NO: 223960 - protein, 9 aa, Homo Sapiens
SQIHSIPCL

SEQ ID NO: 223961 - protein, 9 aa, Homo Sapiens
TVAIRGLFS

SEQ ID NO: 223962 - protein, 9 aa, Homo Sapiens
HHQGVGSSR

SEQ ID NO: 223963 - protein, 9 aa, Homo Sapiens
VNVVGSSGI

SEQ ID NO: 223964 - protein, 9 aa, Homo Sapiens
SEGHQLLIK

SEQ ID NO: 223965 - protein, 9 aa, Homo Sapiens
QPSRDCSWR

SEQ ID NO: 223966 - protein, 9 aa, Homo Sapiens
SPNSVQKTS

SEQ ID NO: 223967 - protein, 9 aa, Homo Sapiens
TIVCPDCEV

SEQ ID NO: 223968 - protein, 9 aa, Homo Sapiens
QLMEKLCHY

SEQ ID NO: 223969 - protein, 9 aa, Homo Sapiens
LCCATIGWA

SEQ ID NO: 223970 - protein, 9 aa, Homo Sapiens
LAGLPREYQ

SEQ ID NO: 223971 - protein, 9 aa, Homo Sapiens
TPTPTPPPG

SEQ ID NO: 223972 - protein, 9 aa, Homo Sapiens
IKQELMVFQ

SEQ ID NO: 223973 - protein, 9 aa, Homo Sapiens
PLPPQSRTT

SEQ ID NO: 223974 - protein, 9 aa, Homo Sapiens
DDNNIQMKK

SEQ ID NO: 223975 - protein, 9 aa, Homo Sapiens
LNVEVACVA

SEQ ID NO: 223976 - protein, 9 aa, Homo Sapiens
GPCSLPLDR

SEQ ID NO: 223977 - protein, 9 aa, Homo Sapiens
RSLPRPERP

SEQ ID NO: 223978 - protein, 9 aa, Homo Sapiens
RRSLAPPET

SEQ ID NO: 223979 - protein, 9 aa, Homo Sapiens
DKSRLECYT

SEQ ID NO: 223980 - protein, 9 aa, Homo Sapiens
WTWQWSVPI

SEQ ID NO: 223981 - protein, 9 aa, Homo Sapiens
DYCVVVFGA

SEQ ID NO: 223982 - protein, 9 aa, Homo Sapiens
LLSNLTEIH

SEQ ID NO: 223983 - protein, 9 aa, Homo Sapiens
RNPPPRGRG

SEQ ID NO: 223984 - protein, 9 aa, Homo Sapiens
MPNSLNQGI

SEQ ID NO: 223985 - protein, 9 aa, Homo Sapiens
AACDLRRGC

SEQ ID NO: 223986 - protein, 9 aa, Homo Sapiens
REEELPRER

SEQ ID NO: 223987 - protein, 9 aa, Homo Sapiens
LTLMYILEK

SEQ ID NO: 223988 - protein, 9 aa, Homo Sapiens
LQIKLYNPP

SEQ ID NO: 223989 - protein, 9 aa, Homo Sapiens
TLGLHVHPR

SEQ ID NO: 223990 - protein, 9 aa, Homo Sapiens
KEVACESST

SEQ ID NO: 223991 - protein, 9 aa, Homo Sapiens
SQQCLRMGN

SEQ ID NO: 223992 - protein, 9 aa, Homo Sapiens
SAVPPHVKR

SEQ ID NO: 223993 - protein, 9 aa, Homo Sapiens
ELTNLLRHL

SEQ ID NO: 223994 - protein, 9 aa, Homo Sapiens
QATRARSLR

SEQ ID NO: 223995 - protein, 9 aa, Homo Sapiens
GRYVYSTPL

SEQ ID NO: 223996 - protein, 9 aa, Homo Sapiens
KKLVKISEI

SEQ ID NO: 223997 - protein, 9 aa, Homo Sapiens
RNSYRMDQT

SEQ ID NO: 223998 - protein, 9 aa, Homo Sapiens
RRGRLPACL

SEQ ID NO: 223999 - protein, 9 aa, Homo Sapiens
LVSWKQSQQ

SEQ ID NO: 224000 - protein, 9 aa, Homo Sapiens
AMTMDQYPF

SEQ ID NO: 224001 - protein, 9 aa, Homo Sapiens
SINSSLKQC

SEQ ID NO: 224002 - protein, 9 aa, Homo Sapiens
SSLKQLAEQ

SEQ ID NO: 224003 - protein, 9 aa, Homo Sapiens
PWLCQSTEP

SEQ ID NO: 224004 - protein, 9 aa, Homo Sapiens
FQLALCVSR

SEQ ID NO: 224005 - protein, 9 aa, Homo Sapiens
SIMLSEDNN

SEQ ID NO: 224006 - protein, 9 aa, Homo Sapiens
VFAPDELRT

SEQ ID NO: 224007 - protein, 9 aa, Homo Sapiens
GVRGLGRHH

SEQ ID NO: 224008 - protein, 9 aa, Homo Sapiens
VGAGLSTSP

SEQ ID NO: 224009 - protein, 9 aa, Homo Sapiens
GYRGSRHVG

SEQ ID NO: 224010 - protein, 9 aa, Homo Sapiens
NGNLGRIVT

SEQ ID NO: 224011 - protein, 9 aa, Homo Sapiens
WQMYWLLFR

SEQ ID NO: 224012 - protein, 9 aa, Homo Sapiens
ECALYFKHL

SEQ ID NO: 224013 - protein, 9 aa, Homo Sapiens
PISKAPEAA

SEQ ID NO: 224014 - protein, 9 aa, Homo Sapiens
GGLRLDHAA

SEQ ID NO: 224015 - protein, 9 aa, Homo Sapiens
PFLSTELGF

SEQ ID NO: 224016 - protein, 9 aa, Homo Sapiens
HHPVQHQPD

SEQ ID NO: 224017 - protein, 9 aa, Homo Sapiens
RSHCLTWAS

SEQ ID NO: 224018 - protein, 9 aa, Homo Sapiens
LSRQPVRPS

SEQ ID NO: 224019 - protein, 9 aa, Homo Sapiens
VRTWIGNQR

SEQ ID NO: 224020 - protein, 9 aa, Homo Sapiens
YGFHAHEFI

SEQ ID NO: 224021 - protein, 9 aa, Homo Sapiens
VSCRSTSSS

SEQ ID NO: 224022 - protein, 9 aa, Homo Sapiens
DGSEKVVPV

SEQ ID NO: 224023 - protein, 9 aa, Homo Sapiens
CSSASSAWG

SEQ ID NO: 224024 - protein, 9 aa, Homo Sapiens
SSHGVGRVL

SEQ ID NO: 224025 - protein, 9 aa, Homo Sapiens
DYFYTHGLR

SEQ ID NO: 224026 - protein, 9 aa, Homo Sapiens
ATRAPCTSV

SEQ ID NO: 224027 - protein, 9 aa, Homo Sapiens
AKFHKLQHE

SEQ ID NO: 224028 - protein, 9 aa, Homo Sapiens
GLRDWLSKK

SEQ ID NO: 224029 - protein, 9 aa, Homo Sapiens
VEAVITLLE

SEQ ID NO: 224030 - protein, 9 aa, Homo Sapiens
VQFSKVLIK

SEQ ID NO: 224031 - protein, 9 aa, Homo Sapiens
GPGLSGHGE

SEQ ID NO: 224032 - protein, 9 aa, Homo Sapiens
LCPSAPAMV

SEQ ID NO: 224033 - protein, 9 aa, Homo Sapiens
SGSGLNAWN

SEQ ID NO: 224034 - protein, 9 aa, Homo Sapiens
RVHLGPDCL

SEQ ID NO: 224035 - protein, 9 aa, Homo Sapiens
RLEALEKIR

SEQ ID NO: 224036 - protein, 9 aa, Homo Sapiens
FSRKSTPFT

SEQ ID NO: 224037 - protein, 9 aa, Homo Sapiens
AQRRCQPHQ

SEQ ID NO: 224038 - protein, 9 aa, Homo Sapiens
SGAKTFKKD

SEQ ID NO: 224039 - protein, 9 aa, Homo Sapiens
FLVSVIFLS

SEQ ID NO: 224040 - protein, 9 aa, Homo Sapiens
KQLEMAEYE

SEQ ID NO: 224041 - protein, 9 aa, Homo Sapiens
GDVASLKSF

SEQ ID NO: 224042 - protein, 9 aa, Homo Sapiens
TPQHGCVVP

SEQ ID NO: 224043 - protein, 9 aa, Homo Sapiens
DRQSCPSPA

SEQ ID NO: 224044 - protein, 9 aa, Homo Sapiens
PVNWEDRPS

SEQ ID NO: 224045 - protein, 9 aa, Homo Sapiens
GEPGLSGLP

SEQ ID NO: 224046 - protein, 9 aa, Homo Sapiens
SAVSTAASM

SEQ ID NO: 224047 - protein, 9 aa, Homo Sapiens
HTEPSSESL

SEQ ID NO: 224048 - protein, 9 aa, Homo Sapiens
SLTFKSVFT

SEQ ID NO: 224049 - protein, 9 aa, Homo Sapiens
TKCDKAFTR

SEQ ID NO: 224050 - protein, 9 aa, Homo Sapiens
RSGRPGWGA

SEQ ID NO: 224051 - protein, 9 aa, Homo Sapiens
PQATRARSL

SEQ ID NO: 224052 - protein, 9 aa, Homo Sapiens
IPPQDASAR

SEQ ID NO: 224053 - protein, 9 aa, Homo Sapiens
GTVISKKFG

SEQ ID NO: 224054 - protein, 9 aa, Homo Sapiens
LPRMPGPPW

SEQ ID NO: 224055 - protein, 9 aa, Homo Sapiens
ERREQLKRP

SEQ ID NO: 224056 - protein, 9 aa, Homo Sapiens
WHSTKRECL

SEQ ID NO: 224057 - protein, 9 aa, Homo Sapiens
RSRVPRCRT

SEQ ID NO: 224058 - protein, 9 aa, Homo Sapiens
VLQEAQRQV

SEQ ID NO: 224059 - protein, 9 aa, Homo Sapiens
GPPFVELLL

SEQ ID NO: 224060 - protein, 9 aa, Homo Sapiens
SQPSSSVWS

SEQ ID NO: 224061 - protein, 9 aa, Homo Sapiens
TKWKKRKKT

SEQ ID NO: 224062 - protein, 9 aa, Homo Sapiens
AQPTVSTGG

SEQ ID NO: 224063 - protein, 9 aa, Homo Sapiens
GGAPGGGGS

SEQ ID NO: 224064 - protein, 9 aa, Homo Sapiens
LTGESDTPQ

SEQ ID NO: 224065 - protein, 9 aa, Homo Sapiens
DDNYASLHH

SEQ ID NO: 224066 - protein, 9 aa, Homo Sapiens
KEGCHKKTS

SEQ ID NO: 224067 - protein, 9 aa, Homo Sapiens
GVRHTVIEH

SEQ ID NO: 224068 - protein, 9 aa, Homo Sapiens
RGEPVLLLL

SEQ ID NO: 224069 - protein, 9 aa, Homo Sapiens
ALVDSGDKV

SEQ ID NO: 224070 - protein, 9 aa, Homo Sapiens
ASGIGDRSQ

SEQ ID NO: 224071 - protein, 9 aa, Homo Sapiens
SGQRRRRRN

SEQ ID NO: 224072 - protein, 9 aa, Homo Sapiens
GSVQQAPSN

SEQ ID NO: 224073 - protein, 9 aa, Homo Sapiens
TIMKVHRIY

SEQ ID NO: 224074 - protein, 9 aa, Homo Sapiens
DGTMEDSES

SEQ ID NO: 224075 - protein, 9 aa, Homo Sapiens
DPGGRPSHP

SEQ ID NO: 224076 - protein, 9 aa, Homo Sapiens
AGRVPGQAA

SEQ ID NO: 224077 - protein, 9 aa, Homo Sapiens
IPGRSTPPR

SEQ ID NO: 224078 - protein, 9 aa, Homo Sapiens
SGVIHTSHN

SEQ ID NO: 224079 - protein, 9 aa, Homo Sapiens
VAPTPVNPC

SEQ ID NO: 224080 - protein, 9 aa, Homo Sapiens
AASSPPGRT

SEQ ID NO: 224081 - protein, 9 aa, Homo Sapiens
RCGSATGWW

SEQ ID NO: 224082 - protein, 9 aa, Homo Sapiens
GVAEELSGL

SEQ ID NO: 224083 - protein, 9 aa, Homo Sapiens
CYLKKAFNL

SEQ ID NO: 224084 - protein, 9 aa, Homo Sapiens
PPTRAGPHA

SEQ ID NO: 224085 - protein, 9 aa, Homo Sapiens
CDNENHMEE

SEQ ID NO: 224086 - protein, 9 aa, Homo Sapiens
WAWGHPCEM

SEQ ID NO: 224087 - protein, 9 aa, Homo Sapiens
FWSIPLVPL

SEQ ID NO: 224088 - protein, 9 aa, Homo Sapiens
RPWHSNSPC

SEQ ID NO: 224089 - protein, 9 aa, Homo Sapiens
RDIKAFQVL

SEQ ID NO: 224090 - protein, 9 aa, Homo Sapiens
IAAALKRHF

SEQ ID NO: 224091 - protein, 9 aa, Homo Sapiens
LLGGLLGKS

SEQ ID NO: 224092 - protein, 9 aa, Homo Sapiens
IASQVSGMV

SEQ ID NO: 224093 - protein, 9 aa, Homo Sapiens
TTVRRKKKE

SEQ ID NO: 224094 - protein, 9 aa, Homo Sapiens
SRSTLSLSG

SEQ ID NO: 224095 - protein, 9 aa, Homo Sapiens
PTFGCRWFL

SEQ ID NO: 224096 - protein, 9 aa, Homo Sapiens
GSPSPWCLR

SEQ ID NO: 224097 - protein, 9 aa, Homo Sapiens
SVVSESLLV

SEQ ID NO: 224098 - protein, 9 aa, Homo Sapiens
EFLSITKIH

SEQ ID NO: 224099 - protein, 9 aa, Homo Sapiens
VNSTVHSYM

SEQ ID NO: 224100 - protein, 9 aa, Homo Sapiens
LALGEVIRG

SEQ ID NO: 224101 - protein, 9 aa, Homo Sapiens
TKEGCHKKT

SEQ ID NO: 224102 - protein, 9 aa, Homo Sapiens
ELWLTPVIP

SEQ ID NO: 224103 - protein, 9 aa, Homo Sapiens
KEPKSVFHT

SEQ ID NO: 224104 - protein, 9 aa, Homo Sapiens
CPHTTPDKG

SEQ ID NO: 224105 - protein, 9 aa, Homo Sapiens
YIHNSVIRA

SEQ ID NO: 224106 - protein, 9 aa, Homo Sapiens
SPVSGSWCG

SEQ ID NO: 224107 - protein, 9 aa, Homo Sapiens
TEADMAITM

SEQ ID NO: 224108 - protein, 9 aa, Homo Sapiens
EELGEQECQ

SEQ ID NO: 224109 - protein, 9 aa, Homo Sapiens
GRGRHRRRG

SEQ ID NO: 224110 - protein, 9 aa, Homo Sapiens
RESKNSTAV

SEQ ID NO: 224111 - protein, 9 aa, Homo Sapiens
DPNSLSNLG

SEQ ID NO: 224112 - protein, 9 aa, Homo Sapiens
LNTLDRYGR

SEQ ID NO: 224113 - protein, 9 aa, Homo Sapiens
PILEDSSEI

SEQ ID NO: 224114 - protein, 9 aa, Homo Sapiens
IRLHIVELA

SEQ ID NO: 224115 - protein, 9 aa, Homo Sapiens
SPLSDSILT

SEQ ID NO: 224116 - protein, 9 aa, Homo Sapiens
SRPRSPASP

SEQ ID NO: 224117 - protein, 9 aa, Homo Sapiens
DNPEEITTI

SEQ ID NO: 224118 - protein, 9 aa, Homo Sapiens
VNHEYSTSS

SEQ ID NO: 224119 - protein, 9 aa, Homo Sapiens
HVAYFEASV

SEQ ID NO: 224120 - protein, 9 aa, Homo Sapiens
RPPKTASST

SEQ ID NO: 224121 - protein, 9 aa, Homo Sapiens
PQHGCVVPE

SEQ ID NO: 224122 - protein, 9 aa, Homo Sapiens
CSSPLPTFG

SEQ ID NO: 224123 - protein, 9 aa, Homo Sapiens
IISKELRPV

SEQ ID NO: 224124 - protein, 9 aa, Homo Sapiens
VCSRSGERW

SEQ ID NO: 224125 - protein, 9 aa, Homo Sapiens
VYLAIMWLT

SEQ ID NO: 224126 - protein, 9 aa, Homo Sapiens
CKLAAAILG

SEQ ID NO: 224127 - protein, 9 aa, Homo Sapiens
RQCLAREKQ

SEQ ID NO: 224128 - protein, 9 aa, Homo Sapiens
GHRTIAECE

SEQ ID NO: 224129 - protein, 9 aa, Homo Sapiens
VTAKSKSAE

SEQ ID NO: 224130 - protein, 9 aa, Homo Sapiens
MGMVWKRLN

SEQ ID NO: 224131 - protein, 9 aa, Homo Sapiens
GLVVLLGLF

SEQ ID NO: 224132 - protein, 9 aa, Homo Sapiens
QRHLGVVFP

SEQ ID NO: 224133 - protein, 9 aa, Homo Sapiens
KWEEETTTE

SEQ ID NO: 224134 - protein, 9 aa, Homo Sapiens
LNPPGGGTI

SEQ ID NO: 224135 - protein, 9 aa, Homo Sapiens
KRRHHKHNL

SEQ ID NO: 224136 - protein, 9 aa, Homo Sapiens
ADLPRELSP

SEQ ID NO: 224137 - protein, 9 aa, Homo Sapiens
KYKIWMYVD

SEQ ID NO: 224138 - protein, 9 aa, Homo Sapiens
LRPVMDKWI

SEQ ID NO: 224139 - protein, 9 aa, Homo Sapiens
SPADPRLHP

SEQ ID NO: 224140 - protein, 9 aa, Homo Sapiens
FSLKYENEV

SEQ ID NO: 224141 - protein, 9 aa, Homo Sapiens
QPGLPDERL

SEQ ID NO: 224142 - protein, 9 aa, Homo Sapiens
VATTSPARD

SEQ ID NO: 224143 - protein, 9 aa, Homo Sapiens
LPPPPLLGD

SEQ ID NO: 224144 - protein, 9 aa, Homo Sapiens
SNVNLAKFH

SEQ ID NO: 224145 - protein, 9 aa, Homo Sapiens
PYVPRSWSS

SEQ ID NO: 224146 - protein, 9 aa, Homo Sapiens
DFFSAQPTN

SEQ ID NO: 224147 - protein, 9 aa, Homo Sapiens
QRRRRRNST

SEQ ID NO: 224148 - protein, 9 aa, Homo Sapiens
WGGSQCRWL

SEQ ID NO: 224149 - protein, 9 aa, Homo Sapiens
LRNAHSIPQ

SEQ ID NO: 224150 - protein, 9 aa, Homo Sapiens
HPSPSTGDP

SEQ ID NO: 224151 - protein, 9 aa, Homo Sapiens
QDLELKKEQ

SEQ ID NO: 224152 - protein, 9 aa, Homo Sapiens
HFKEVQSGG

SEQ ID NO: 224153 - protein, 9 aa, Homo Sapiens
GKRPFIDEA

SEQ ID NO: 224154 - protein, 9 aa, Homo Sapiens
TMLRYLKIM

SEQ ID NO: 224155 - protein, 9 aa, Homo Sapiens
VCCLKTSCF

SEQ ID NO: 224156 - protein, 9 aa, Homo Sapiens
RNLLRLQSL

SEQ ID NO: 224157 - protein, 9 aa, Homo Sapiens
RNLLTSGAD

SEQ ID NO: 224158 - protein, 9 aa, Homo Sapiens
SHHQGVGSS

SEQ ID NO: 224159 - protein, 9 aa, Homo Sapiens
GHLLGQLHP

SEQ ID NO: 224160 - protein, 9 aa, Homo Sapiens
GAQAISYVG

SEQ ID NO: 224161 - protein, 9 aa, Homo Sapiens
AASATGAPG

SEQ ID NO: 224162 - protein, 9 aa, Homo Sapiens
SRATFSACS

SEQ ID NO: 224163 - protein, 9 aa, Homo Sapiens
TEEYVAGNF

SEQ ID NO: 224164 - protein, 9 aa, Homo Sapiens
LNLCVISID

SEQ ID NO: 224165 - protein, 9 aa, Homo Sapiens
CQLSIDASL

SEQ ID NO: 224166 - protein, 9 aa, Homo Sapiens
RWEPEENIL

SEQ ID NO: 224167 - protein, 9 aa, Homo Sapiens
NIQDRVNSD

SEQ ID NO: 224168 - protein, 9 aa, Homo Sapiens
HTPHAQAPQ

SEQ ID NO: 224169 - protein, 9 aa, Homo Sapiens
LGQALEVLG

SEQ ID NO: 224170 - protein, 9 aa, Homo Sapiens
NSCSEEELN

SEQ ID NO: 224171 - protein, 9 aa, Homo Sapiens
ASWELWVEG

SEQ ID NO: 224172 - protein, 9 aa, Homo Sapiens
HRKRNQPKK

SEQ ID NO: 224173 - protein, 9 aa, Homo Sapiens
APGLLPSPP

SEQ ID NO: 224174 - protein, 9 aa, Homo Sapiens
PLAQRPSAS

SEQ ID NO: 224175 - protein, 9 aa, Homo Sapiens
GIIKKMKKR

SEQ ID NO: 224176 - protein, 9 aa, Homo Sapiens
AATDAHYEV

SEQ ID NO: 224177 - protein, 9 aa, Homo Sapiens
PLFIWTPWR

SEQ ID NO: 224178 - protein, 9 aa, Homo Sapiens
PDDLTLISR

SEQ ID NO: 224179 - protein, 9 aa, Homo Sapiens
QYLEETFGG

SEQ ID NO: 224180 - protein, 9 aa, Homo Sapiens
HALVPPQHC

SEQ ID NO: 224181 - protein, 9 aa, Homo Sapiens
DAGPGDAES

SEQ ID NO: 224182 - protein, 9 aa, Homo Sapiens
RSENYREAL

SEQ ID NO: 224183 - protein, 9 aa, Homo Sapiens
ARTLARLRA

SEQ ID NO: 224184 - protein, 9 aa, Homo Sapiens
RGLGDVEQL

SEQ ID NO: 224185 - protein, 9 aa, Homo Sapiens
CIVFPMTCK

SEQ ID NO: 224186 - protein, 9 aa, Homo Sapiens
PSSTFLLAC

SEQ ID NO: 224187 - protein, 9 aa, Homo Sapiens
MERSDWARQ

SEQ ID NO: 224188 - protein, 9 aa, Homo Sapiens
LSCPLALLI

SEQ ID NO: 224189 - protein, 9 aa, Homo Sapiens
ACLPLITNN

SEQ ID NO: 224190 - protein, 9 aa, Homo Sapiens
VVGSALDCF

SEQ ID NO: 224191 - protein, 9 aa, Homo Sapiens
RVSALQEAL

SEQ ID NO: 224192 - protein, 9 aa, Homo Sapiens
THMRIHTGG

SEQ ID NO: 224193 - protein, 9 aa, Homo Sapiens
GTCWLLCGT

SEQ ID NO: 224194 - protein, 9 aa, Homo Sapiens
IAPGEPGLS

SEQ ID NO: 224195 - protein, 9 aa, Homo Sapiens
KISQNMIPQ

SEQ ID NO: 224196 - protein, 9 aa, Homo Sapiens
LECKQNFWE

SEQ ID NO: 224197 - protein, 9 aa, Homo Sapiens
QQCLRMGNE

SEQ ID NO: 224198 - protein, 9 aa, Homo Sapiens
EQECQAEVQ

SEQ ID NO: 224199 - protein, 9 aa, Homo Sapiens
SPYLNDDSP

SEQ ID NO: 224200 - protein, 9 aa, Homo Sapiens
VHSIIQVIL

SEQ ID NO: 224201 - protein, 9 aa, Homo Sapiens
HAPPPRMAA

SEQ ID NO: 224202 - protein, 9 aa, Homo Sapiens
PPELSQIPA

SEQ ID NO: 224203 - protein, 9 aa, Homo Sapiens
SESASPSTL

SEQ ID NO: 224204 - protein, 9 aa, Homo Sapiens
SAAWQGNVK

SEQ ID NO: 224205 - protein, 9 aa, Homo Sapiens
MERQCLARE

SEQ ID NO: 224206 - protein, 9 aa, Homo Sapiens
LGTGQDVGR

SEQ ID NO: 224207 - protein, 9 aa, Homo Sapiens
AAPLPPRAP

SEQ ID NO: 224208 - protein, 9 aa, Homo Sapiens
KSQGGRILL

SEQ ID NO: 224209 - protein, 9 aa, Homo Sapiens
STSPPPPAP

SEQ ID NO: 224210 - protein, 9 aa, Homo Sapiens
SDPPTLTSQ

SEQ ID NO: 224211 - protein, 9 aa, Homo Sapiens
VNGGELFST

SEQ ID NO: 224212 - protein, 9 aa, Homo Sapiens
VVFPCQPSR

SEQ ID NO: 224213 - protein, 9 aa, Homo Sapiens
CKDCDQLFE

SEQ ID NO: 224214 - protein, 9 aa, Homo Sapiens
VSAWSLPRL

SEQ ID NO: 224215 - protein, 9 aa, Homo Sapiens
MDTYSGPPQ

SEQ ID NO: 224216 - protein, 9 aa, Homo Sapiens
WMDNIRELC

SEQ ID NO: 224217 - protein, 9 aa, Homo Sapiens
CTPTPRRWQ

SEQ ID NO: 224218 - protein, 9 aa, Homo Sapiens
VQCCLYECG

SEQ ID NO: 224219 - protein, 9 aa, Homo Sapiens
PPSSPSMAS

SEQ ID NO: 224220 - protein, 9 aa, Homo Sapiens
AAPAAFGVL

SEQ ID NO: 224221 - protein, 9 aa, Homo Sapiens
EKITPFPAE

SEQ ID NO: 224222 - protein, 9 aa, Homo Sapiens
GQALEVLGA

SEQ ID NO: 224223 - protein, 9 aa, Homo Sapiens
NWLTVLSCW

SEQ ID NO: 224224 - protein, 9 aa, Homo Sapiens
GSSRTTWGP

SEQ ID NO: 224225 - protein, 9 aa, Homo Sapiens
SRTTWGPAR

SEQ ID NO: 224226 - protein, 9 aa, Homo Sapiens
SLQVALHLD

SEQ ID NO: 224227 - protein, 9 aa, Homo Sapiens
WALSQEITR

SEQ ID NO: 224228 - protein, 9 aa, Homo Sapiens
EKLDLSKLT

SEQ ID NO: 224229 - protein, 9 aa, Homo Sapiens
VMRETRCLA

SEQ ID NO: 224230 - protein, 9 aa, Homo Sapiens
PNAIRLHIV

SEQ ID NO: 224231 - protein, 9 aa, Homo Sapiens
GPPWPTHLP

SEQ ID NO: 224232 - protein, 9 aa, Homo Sapiens
LGELVWGPP

SEQ ID NO: 224233 - protein, 9 aa, Homo Sapiens
TRSWRMTWS

SEQ ID NO: 224234 - protein, 9 aa, Homo Sapiens
ICKMYHPRA

SEQ ID NO: 224235 - protein, 9 aa, Homo Sapiens
ILKSARKFT

SEQ ID NO: 224236 - protein, 9 aa, Homo Sapiens
TPSASTHTS

SEQ ID NO: 224237 - protein, 9 aa, Homo Sapiens
RLECPISTQ

SEQ ID NO: 224238 - protein, 9 aa, Homo Sapiens
TPQIEAEKK

SEQ ID NO: 224239 - protein, 9 aa, Homo Sapiens
NRESGSKLL

SEQ ID NO: 224240 - protein, 9 aa, Homo Sapiens
TSCFKLDLS

SEQ ID NO: 224241 - protein, 9 aa, Homo Sapiens
AHSVASTLA

SEQ ID NO: 224242 - protein, 9 aa, Homo Sapiens
YRTWNPFRC

SEQ ID NO: 224243 - protein, 9 aa, Homo Sapiens
RASYSPAHA

SEQ ID NO: 224244 - protein, 9 aa, Homo Sapiens
VDRERARQG

SEQ ID NO: 224245 - protein, 9 aa, Homo Sapiens
MTSLNSATI

SEQ ID NO: 224246 - protein, 9 aa, Homo Sapiens
RRTVPSGRP

SEQ ID NO: 224247 - protein, 9 aa, Homo Sapiens
SWTVDASRG

SEQ ID NO: 224248 - protein, 9 aa, Homo Sapiens
FQSDGDSFN

SEQ ID NO: 224249 - protein, 9 aa, Homo Sapiens
PDILQEFVQ

SEQ ID NO: 224250 - protein, 9 aa, Homo Sapiens
RSRHTICVK

SEQ ID NO: 224251 - protein, 9 aa, Homo Sapiens
VYSREEELP

SEQ ID NO: 224252 - protein, 9 aa, Homo Sapiens
RPRARVHRC

SEQ ID NO: 224253 - protein, 9 aa, Homo Sapiens
QQRRAPAGG

SEQ ID NO: 224254 - protein, 9 aa, Homo Sapiens
HTGWAHSGV

SEQ ID NO: 224255 - protein, 9 aa, Homo Sapiens
HSETEEMGD

SEQ ID NO: 224256 - protein, 9 aa, Homo Sapiens
CPLNPAAQD

SEQ ID NO: 224257 - protein, 9 aa, Homo Sapiens
LGVDVLDHG

SEQ ID NO: 224258 - protein, 9 aa, Homo Sapiens
LDFTRVNFI

SEQ ID NO: 224259 - protein, 9 aa, Homo Sapiens
LPLPRLRLF

SEQ ID NO: 224260 - protein, 9 aa, Homo Sapiens
SEVDRIILK

SEQ ID NO: 224261 - protein, 9 aa, Homo Sapiens
LKNKKEVGF

SEQ ID NO: 224262 - protein, 9 aa, Homo Sapiens
KFYKEEKKC

SEQ ID NO: 224263 - protein, 9 aa, Homo Sapiens
SRVDATTVT

SEQ ID NO: 224264 - protein, 9 aa, Homo Sapiens
KDVVVVFTE

SEQ ID NO: 224265 - protein, 9 aa, Homo Sapiens
QSTIVCHNQ

SEQ ID NO: 224266 - protein, 9 aa, Homo Sapiens
EHVLLGERG

SEQ ID NO: 224267 - protein, 9 aa, Homo Sapiens
KEPILEILD

SEQ ID NO: 224268 - protein, 9 aa, Homo Sapiens
DNLAPSYPA

SEQ ID NO: 224269 - protein, 9 aa, Homo Sapiens
TYRGERPYK

SEQ ID NO: 224270 - protein, 9 aa, Homo Sapiens
DASYLGNVL

SEQ ID NO: 224271 - protein, 9 aa, Homo Sapiens
RHQMTYRGE

SEQ ID NO: 224272 - protein, 9 aa, Homo Sapiens
RRLPQEESR

SEQ ID NO: 224273 - protein, 9 aa, Homo Sapiens
LSTTPWTRA

SEQ ID NO: 224274 - protein, 9 aa, Homo Sapiens
QVVLHHPVQ

SEQ ID NO: 224275 - protein, 9 aa, Homo Sapiens
TLHYAISEG

SEQ ID NO: 224276 - protein, 9 aa, Homo Sapiens
FYTNDRNIL

SEQ ID NO: 224277 - protein, 9 aa, Homo Sapiens
GDQELWSEK

SEQ ID NO: 224278 - protein, 9 aa, Homo Sapiens
LPWMAACAG

SEQ ID NO: 224279 - protein, 9 aa, Homo Sapiens
DDRSPQAPL

SEQ ID NO: 224280 - protein, 9 aa, Homo Sapiens
AKKAYPSEK

SEQ ID NO: 224281 - protein, 9 aa, Homo Sapiens
FRSSQTTHR

SEQ ID NO: 224282 - protein, 9 aa, Homo Sapiens
TFSACSTAK

SEQ ID NO: 224283 - protein, 9 aa, Homo Sapiens
CFQERVRIE

SEQ ID NO: 224284 - protein, 9 aa, Homo Sapiens
YVASLEASV

SEQ ID NO: 224285 - protein, 9 aa, Homo Sapiens
NLWALCDRD

SEQ ID NO: 224286 - protein, 9 aa, Homo Sapiens
QFYRPFYLQ

SEQ ID NO: 224287 - protein, 9 aa, Homo Sapiens
SNGLLCDPG

SEQ ID NO: 224288 - protein, 9 aa, Homo Sapiens
VSYTAPIMS

SEQ ID NO: 224289 - protein, 9 aa, Homo Sapiens
TQMYHYSCA

SEQ ID NO: 224290 - protein, 9 aa, Homo Sapiens
TVTSGKVCH

SEQ ID NO: 224291 - protein, 9 aa, Homo Sapiens
RLLRALCML

SEQ ID NO: 224292 - protein, 9 aa, Homo Sapiens
LELVFALRA

SEQ ID NO: 224293 - protein, 9 aa, Homo Sapiens
HASPTSTPG

SEQ ID NO: 224294 - protein, 9 aa, Homo Sapiens
QRKNQVFPC

SEQ ID NO: 224295 - protein, 9 aa, Homo Sapiens
TSVEDAPSE

SEQ ID NO: 224296 - protein, 9 aa, Homo Sapiens
NYYFCILDT

SEQ ID NO: 224297 - protein, 9 aa, Homo Sapiens
GLVGLGPPT

SEQ ID NO: 224298 - protein, 9 aa, Homo Sapiens
KGQLHRALD

SEQ ID NO: 224299 - protein, 9 aa, Homo Sapiens
AGHAGGREL

SEQ ID NO: 224300 - protein, 9 aa, Homo Sapiens
CLALRRRRR

SEQ ID NO: 224301 - protein, 9 aa, Homo Sapiens
DWEQAKDNK

SEQ ID NO: 224302 - protein, 9 aa, Homo Sapiens
VASLKSFDS

SEQ ID NO: 224303 - protein, 9 aa, Homo Sapiens
LRFYTARLA

SEQ ID NO: 224304 - protein, 9 aa, Homo Sapiens
VVVQQRHLG

SEQ ID NO: 224305 - protein, 9 aa, Homo Sapiens
TERGIRQWA

SEQ ID NO: 224306 - protein, 9 aa, Homo Sapiens
EHFVYVEPR

SEQ ID NO: 224307 - protein, 9 aa, Homo Sapiens
ARTEISVGT

SEQ ID NO: 224308 - protein, 9 aa, Homo Sapiens
DLFQHAGQE

SEQ ID NO: 224309 - protein, 9 aa, Homo Sapiens
YQQVPWYPT

SEQ ID NO: 224310 - protein, 9 aa, Homo Sapiens
DWQPTGTQQ

SEQ ID NO: 224311 - protein, 9 aa, Homo Sapiens
GVAPSSPTH

SEQ ID NO: 224312 - protein, 9 aa, Homo Sapiens
EEMKKTTSQ

SEQ ID NO: 224313 - protein, 9 aa, Homo Sapiens
QLHICDASQ

SEQ ID NO: 224314 - protein, 9 aa, Homo Sapiens
ELMVFQSKD

SEQ ID NO: 224315 - protein, 9 aa, Homo Sapiens
LREMTIIIT

SEQ ID NO: 224316 - protein, 9 aa, Homo Sapiens
ADWTREEVV

SEQ ID NO: 224317 - protein, 9 aa, Homo Sapiens
LLLIVLCAL

SEQ ID NO: 224318 - protein, 9 aa, Homo Sapiens
EQVEFSELN

SEQ ID NO: 224319 - protein, 9 aa, Homo Sapiens
EPMWEHRQP

SEQ ID NO: 224320 - protein, 9 aa, Homo Sapiens
PSTCSKKKI

SEQ ID NO: 224321 - protein, 9 aa, Homo Sapiens
RWRSSRRQR

SEQ ID NO: 224322 - protein, 9 aa, Homo Sapiens
IRAKQRAEG

SEQ ID NO: 224323 - protein, 9 aa, Homo Sapiens
EMGLKDLEA

SEQ ID NO: 224324 - protein, 9 aa, Homo Sapiens
LPTFGCRWF

SEQ ID NO: 224325 - protein, 9 aa, Homo Sapiens
AAGWIGTGA

SEQ ID NO: 224326 - protein, 9 aa, Homo Sapiens
PRSHYMEVC

SEQ ID NO: 224327 - protein, 9 aa, Homo Sapiens
PPRPQLLPP

SEQ ID NO: 224328 - protein, 9 aa, Homo Sapiens
CAMDSLRPV

SEQ ID NO: 224329 - protein, 9 aa, Homo Sapiens
KRWMRRVPR

SEQ ID NO: 224330 - protein, 9 aa, Homo Sapiens
PKRDMEKVE

SEQ ID NO: 224331 - protein, 9 aa, Homo Sapiens
LLEAFPLPR

SEQ ID NO: 224332 - protein, 9 aa, Homo Sapiens
WIQNWSLLK

SEQ ID NO: 224333 - protein, 9 aa, Homo Sapiens
QEVRDDNHP

SEQ ID NO: 224334 - protein, 9 aa, Homo Sapiens
QENIVGIPS

SEQ ID NO: 224335 - protein, 9 aa, Homo Sapiens
SCLKYDHHK

SEQ ID NO: 224336 - protein, 9 aa, Homo Sapiens
MMCTASFAA

SEQ ID NO: 224337 - protein, 9 aa, Homo Sapiens
RNLHFHILT

SEQ ID NO: 224338 - protein, 9 aa, Homo Sapiens
AAALRAVGT

SEQ ID NO: 224339 - protein, 9 aa, Homo Sapiens
AAFLLDHGV

SEQ ID NO: 224340 - protein, 9 aa, Homo Sapiens
SHVCSLKPK

SEQ ID NO: 224341 - protein, 9 aa, Homo Sapiens
GHRRPRVHA

SEQ ID NO: 224342 - protein, 9 aa, Homo Sapiens
PGFWFVEGF

SEQ ID NO: 224343 - protein, 9 aa, Homo Sapiens
DCTFDHMGH

SEQ ID NO: 224344 - protein, 9 aa, Homo Sapiens
IQDILNGGS

SEQ ID NO: 224345 - protein, 9 aa, Homo Sapiens
YGNGYSNAG

SEQ ID NO: 224346 - protein, 9 aa, Homo Sapiens
KVTLTQGPS

SEQ ID NO: 224347 - protein, 9 aa, Homo Sapiens
LWIEGANNT

SEQ ID NO: 224348 - protein, 9 aa, Homo Sapiens
LLRVAYLIS

SEQ ID NO: 224349 - protein, 9 aa, Homo Sapiens
VCICISVHV

SEQ ID NO: 224350 - protein, 9 aa, Homo Sapiens
RYLKIMQLM

SEQ ID NO: 224351 - protein, 9 aa, Homo Sapiens
EILPESLEL

SEQ ID NO: 224352 - protein, 9 aa, Homo Sapiens
AATVSHCGH

SEQ ID NO: 224353 - protein, 9 aa, Homo Sapiens
GSGGRGHPD

SEQ ID NO: 224354 - protein, 9 aa, Homo Sapiens
AQRIPTGGD

SEQ ID NO: 224355 - protein, 9 aa, Homo Sapiens
LPKDYTTDN

SEQ ID NO: 224356 - protein, 9 aa, Homo Sapiens
GNAPLPRRS

SEQ ID NO: 224357 - protein, 9 aa, Homo Sapiens
ASNGIHHFF

SEQ ID NO: 224358 - protein, 9 aa, Homo Sapiens
SGRYVYSTP

SEQ ID NO: 224359 - protein, 9 aa, Homo Sapiens
GPTGSCCTP

SEQ ID NO: 224360 - protein, 9 aa, Homo Sapiens
RALHQLKHQ

SEQ ID NO: 224361 - protein, 9 aa, Homo Sapiens
MSSPSWRAQ

SEQ ID NO: 224362 - protein, 9 aa, Homo Sapiens
GVNIPCGDD

SEQ ID NO: 224363 - protein, 9 aa, Homo Sapiens
GEPPHSATA

SEQ ID NO: 224364 - protein, 9 aa, Homo Sapiens
QVPKFLSLS

SEQ ID NO: 224365 - protein, 9 aa, Homo Sapiens
GCYQYNTDV

SEQ ID NO: 224366 - protein, 9 aa, Homo Sapiens
KSRLPEWGE

SEQ ID NO: 224367 - protein, 9 aa, Homo Sapiens
SNLVRLMGP

SEQ ID NO: 224368 - protein, 9 aa, Homo Sapiens
KFARSKIPM

SEQ ID NO: 224369 - protein, 9 aa, Homo Sapiens
MGEKLDLSK

SEQ ID NO: 224370 - protein, 9 aa, Homo Sapiens
VGAIVLANL

SEQ ID NO: 224371 - protein, 9 aa, Homo Sapiens
VVSESLLVQ

SEQ ID NO: 224372 - protein, 9 aa, Homo Sapiens
LHHSRSFSD

SEQ ID NO: 224373 - protein, 9 aa, Homo Sapiens
YHTPHAQAP

SEQ ID NO: 224374 - protein, 9 aa, Homo Sapiens
RLGPSEHWQ

SEQ ID NO: 224375 - protein, 9 aa, Homo Sapiens
FVKTMVCCL

SEQ ID NO: 224376 - protein, 9 aa, Homo Sapiens
HTLGGPEVP

SEQ ID NO: 224377 - protein, 9 aa, Homo Sapiens
RTMTHEHLA

SEQ ID NO: 224378 - protein, 9 aa, Homo Sapiens
LTHSCSRPF

SEQ ID NO: 224379 - protein, 9 aa, Homo Sapiens
DVWWGPGTR

SEQ ID NO: 224380 - protein, 9 aa, Homo Sapiens
SVIIFSLAT

SEQ ID NO: 224381 - protein, 9 aa, Homo Sapiens
GICWLLGTR

SEQ ID NO: 224382 - protein, 9 aa, Homo Sapiens
REGTYNFRM

SEQ ID NO: 224383 - protein, 9 aa, Homo Sapiens
EGFCSPRQV

SEQ ID NO: 224384 - protein, 9 aa, Homo Sapiens
SQHSNSSGF

SEQ ID NO: 224385 - protein, 9 aa, Homo Sapiens
FIGKNRMFE

SEQ ID NO: 224386 - protein, 9 aa, Homo Sapiens
SSGTSAQPL

SEQ ID NO: 224387 - protein, 9 aa, Homo Sapiens
GCVGIEASL

SEQ ID NO: 224388 - protein, 9 aa, Homo Sapiens
DSKLTTTSS

SEQ ID NO: 224389 - protein, 9 aa, Homo Sapiens
ASNGLLCDP

SEQ ID NO: 224390 - protein, 9 aa, Homo Sapiens
GEDVEHVLL

SEQ ID NO: 224391 - protein, 9 aa, Homo Sapiens
IPQMARVTG

SEQ ID NO: 224392 - protein, 9 aa, Homo Sapiens
LPLPPCTAL

SEQ ID NO: 224393 - protein, 9 aa, Homo Sapiens
SAQPLRPLA

SEQ ID NO: 224394 - protein, 9 aa, Homo Sapiens
PDLEEAVSG

SEQ ID NO: 224395 - protein, 9 aa, Homo Sapiens
KQNFWENLA

SEQ ID NO: 224396 - protein, 9 aa, Homo Sapiens
SGLAGGAQA

SEQ ID NO: 224397 - protein, 9 aa, Homo Sapiens
NENHMEESK

SEQ ID NO: 224398 - protein, 9 aa, Homo Sapiens
ECPVSAWSL

SEQ ID NO: 224399 - protein, 9 aa, Homo Sapiens
SYSINFVQD

SEQ ID NO: 224400 - protein, 9 aa, Homo Sapiens
QAGSPRYQG

SEQ ID NO: 224401 - protein, 9 aa, Homo Sapiens
VLCFLSALN

SEQ ID NO: 224402 - protein, 9 aa, Homo Sapiens
AHPADASSH

SEQ ID NO: 224403 - protein, 9 aa, Homo Sapiens
RCLMGLGGC

SEQ ID NO: 224404 - protein, 9 aa, Homo Sapiens
HTQNSVTAP

SEQ ID NO: 224405 - protein, 9 aa, Homo Sapiens
IDFILERNL

SEQ ID NO: 224406 - protein, 9 aa, Homo Sapiens
MLSGLAGGA

SEQ ID NO: 224407 - protein, 9 aa, Homo Sapiens
DSLQLEVQP

SEQ ID NO: 224408 - protein, 9 aa, Homo Sapiens
HNHPKRGTG

SEQ ID NO: 224409 - protein, 9 aa, Homo Sapiens
PVTVQTAQE

SEQ ID NO: 224410 - protein, 9 aa, Homo Sapiens
VRKDCLDRS

SEQ ID NO: 224411 - protein, 9 aa, Homo Sapiens
VLLPCTFLK

SEQ ID NO: 224412 - protein, 9 aa, Homo Sapiens
LKSWISVPC

SEQ ID NO: 224413 - protein, 9 aa, Homo Sapiens
EAAASRLPR

SEQ ID NO: 224414 - protein, 9 aa, Homo Sapiens
PQPWSPTCP

SEQ ID NO: 224415 - protein, 9 aa, Homo Sapiens
EPGCGGKRN

SEQ ID NO: 224416 - protein, 9 aa, Homo Sapiens
GLLCYILFL

SEQ ID NO: 224417 - protein, 9 aa, Homo Sapiens
NVVICITFY

SEQ ID NO: 224418 - protein, 9 aa, Homo Sapiens
PEVKLPEVK

SEQ ID NO: 224419 - protein, 9 aa, Homo Sapiens
ALPLLLGVT

SEQ ID NO: 224420 - protein, 9 aa, Homo Sapiens
PCQPSRGRY

SEQ ID NO: 224421 - protein, 9 aa, Homo Sapiens
SVTSTSPRR

SEQ ID NO: 224422 - protein, 9 aa, Homo Sapiens
FYSCAAGMT

SEQ ID NO: 224423 - protein, 9 aa, Homo Sapiens
HAGGRELEG

SEQ ID NO: 224424 - protein, 9 aa, Homo Sapiens
AQRQVVLHH

SEQ ID NO: 224425 - protein, 9 aa, Homo Sapiens
AICDPDCKN

SEQ ID NO: 224426 - protein, 9 aa, Homo Sapiens
LKQMTLSPL

SEQ ID NO: 224427 - protein, 9 aa, Homo Sapiens
LTQVRYLEK

SEQ ID NO: 224428 - protein, 9 aa, Homo Sapiens
HGWTPLHCV

SEQ ID NO: 224429 - protein, 9 aa, Homo Sapiens
ELVSRHLCE

SEQ ID NO: 224430 - protein, 9 aa, Homo Sapiens
NANFNQGLC

SEQ ID NO: 224431 - protein, 9 aa, Homo Sapiens
IATIKTKHT

SEQ ID NO: 224432 - protein, 9 aa, Homo Sapiens
LYEHGLGIT

SEQ ID NO: 224433 - protein, 9 aa, Homo Sapiens
PRGWPLYWK

SEQ ID NO: 224434 - protein, 9 aa, Homo Sapiens
MPHHSLKMR

SEQ ID NO: 224435 - protein, 9 aa, Homo Sapiens
FDCGPFIGK

SEQ ID NO: 224436 - protein, 9 aa, Homo Sapiens
SRPIKLHKS

SEQ ID NO: 224437 - protein, 9 aa, Homo Sapiens
SSNNFTKKT

SEQ ID NO: 224438 - protein, 9 aa, Homo Sapiens
CGKVLINNQ

SEQ ID NO: 224439 - protein, 9 aa, Homo Sapiens
MLARLDSSS

SEQ ID NO: 224440 - protein, 9 aa, Homo Sapiens
TSWTTSSVM

SEQ ID NO: 224441 - protein, 9 aa, Homo Sapiens
VGDVVHPQF

SEQ ID NO: 224442 - protein, 9 aa, Homo Sapiens
SQEMCPPGI

SEQ ID NO: 224443 - protein, 9 aa, Homo Sapiens
PVPQKRFRH

SEQ ID NO: 224444 - protein, 9 aa, Homo Sapiens
VFALRAKLL

SEQ ID NO: 224445 - protein, 9 aa, Homo Sapiens
EHCLKFISA

SEQ ID NO: 224446 - protein, 9 aa, Homo Sapiens
RTSRQATAG

SEQ ID NO: 224447 - protein, 9 aa, Homo Sapiens
TSSFCCCTQ

SEQ ID NO: 224448 - protein, 9 aa, Homo Sapiens
PQAPLRLWS

SEQ ID NO: 224449 - protein, 9 aa, Homo Sapiens
VSWWPRESG

SEQ ID NO: 224450 - protein, 9 aa, Homo Sapiens
NPNPLQPHF

SEQ ID NO: 224451 - protein, 9 aa, Homo Sapiens
CVCGVAYRL

SEQ ID NO: 224452 - protein, 9 aa, Homo Sapiens
RCHWCKYHN

SEQ ID NO: 224453 - protein, 9 aa, Homo Sapiens
RPPGASSGW

SEQ ID NO: 224454 - protein, 9 aa, Homo Sapiens
GRPPKTASS

SEQ ID NO: 224455 - protein, 9 aa, Homo Sapiens
MGSRWALSG

SEQ ID NO: 224456 - protein, 9 aa, Homo Sapiens
SSCKGCLWA

SEQ ID NO: 224457 - protein, 9 aa, Homo Sapiens
VATDDPDEE

SEQ ID NO: 224458 - protein, 9 aa, Homo Sapiens
RRRAGGCAS

SEQ ID NO: 224459 - protein, 9 aa, Homo Sapiens
GAAATTLTS

SEQ ID NO: 224460 - protein, 9 aa, Homo Sapiens
RSVRRQHCY

SEQ ID NO: 224461 - protein, 9 aa, Homo Sapiens
IGQLQPPLC

SEQ ID NO: 224462 - protein, 9 aa, Homo Sapiens
ERSAEPPPS

SEQ ID NO: 224463 - protein, 9 aa, Homo Sapiens
DPRRPSHSP

SEQ ID NO: 224464 - protein, 9 aa, Homo Sapiens
GEQIVFNEN

SEQ ID NO: 224465 - protein, 9 aa, Homo Sapiens
VEGLSVLQS

SEQ ID NO: 224466 - protein, 9 aa, Homo Sapiens
VALKHMLNF

SEQ ID NO: 224467 - protein, 9 aa, Homo Sapiens
MGIFPESLV

SEQ ID NO: 224468 - protein, 9 aa, Homo Sapiens
QCNECGKLS

SEQ ID NO: 224469 - protein, 9 aa, Homo Sapiens
GYSNAGIPQ

SEQ ID NO: 224470 - protein, 9 aa, Homo Sapiens
PARWWMSAA

SEQ ID NO: 224471 - protein, 9 aa, Homo Sapiens
LCTLALWPI

SEQ ID NO: 224472 - protein, 9 aa, Homo Sapiens
LDFSPYWMK

SEQ ID NO: 224473 - protein, 9 aa, Homo Sapiens
LTLAGMGTQ

SEQ ID NO: 224474 - protein, 9 aa, Homo Sapiens
GCISVKDHR

SEQ ID NO: 224475 - protein, 9 aa, Homo Sapiens
ELEQMSIGH

SEQ ID NO: 224476 - protein, 9 aa, Homo Sapiens
QSNDYCVVV

SEQ ID NO: 224477 - protein, 9 aa, Homo Sapiens
SSRPLAHSV

SEQ ID NO: 224478 - protein, 9 aa, Homo Sapiens
KKKEDKEKE

SEQ ID NO: 224479 - protein, 9 aa, Homo Sapiens
PLPTFGCRW

SEQ ID NO: 224480 - protein, 9 aa, Homo Sapiens
ALLEAVDCG

SEQ ID NO: 224481 - protein, 9 aa, Homo Sapiens
APEGRGLAA

SEQ ID NO: 224482 - protein, 9 aa, Homo Sapiens
EAQPGAEWS

SEQ ID NO: 224483 - protein, 9 aa, Homo Sapiens
FRVPVFGWV

SEQ ID NO: 224484 - protein, 9 aa, Homo Sapiens
FLLHQVLRK

SEQ ID NO: 224485 - protein, 9 aa, Homo Sapiens
SILDVCLDL

SEQ ID NO: 224486 - protein, 9 aa, Homo Sapiens
GFLLHQPLP

SEQ ID NO: 224487 - protein, 9 aa, Homo Sapiens
CLKQYSRDE

SEQ ID NO: 224488 - protein, 9 aa, Homo Sapiens
IMRDLRSCV

SEQ ID NO: 224489 - protein, 9 aa, Homo Sapiens
NQQEKKLGG

SEQ ID NO: 224490 - protein, 9 aa, Homo Sapiens
EDAPRAVFP

SEQ ID NO: 224491 - protein, 9 aa, Homo Sapiens
EASERCHLW

SEQ ID NO: 224492 - protein, 9 aa, Homo Sapiens
PIRWKALIV

SEQ ID NO: 224493 - protein, 9 aa, Homo Sapiens
KEVHFVFSR

SEQ ID NO: 224494 - protein, 9 aa, Homo Sapiens
RKEVNGKSS

SEQ ID NO: 224495 - protein, 9 aa, Homo Sapiens
GADQVRRYC

SEQ ID NO: 224496 - protein, 9 aa, Homo Sapiens
PNYNSVDFS

SEQ ID NO: 224497 - protein, 9 aa, Homo Sapiens
GCQFMDNMS

SEQ ID NO: 224498 - protein, 9 aa, Homo Sapiens
YPTNAPGVF

SEQ ID NO: 224499 - protein, 9 aa, Homo Sapiens
ETRKRLLSY

SEQ ID NO: 224500 - protein, 9 aa, Homo Sapiens
RYRLAGLPR

SEQ ID NO: 224501 - protein, 9 aa, Homo Sapiens
KKFFGGKQE

SEQ ID NO: 224502 - protein, 9 aa, Homo Sapiens
LTITHTVAL

SEQ ID NO: 224503 - protein, 9 aa, Homo Sapiens
KKRNGMRFQ

SEQ ID NO: 224504 - protein, 9 aa, Homo Sapiens
HKPLVLQHC

SEQ ID NO: 224505 - protein, 9 aa, Homo Sapiens
NIYRKSGTH

SEQ ID NO: 224506 - protein, 9 aa, Homo Sapiens
DFRAVLVVL

SEQ ID NO: 224507 - protein, 9 aa, Homo Sapiens
HLKHICKTW

SEQ ID NO: 224508 - protein, 9 aa, Homo Sapiens
SYRTQDGTT

SEQ ID NO: 224509 - protein, 9 aa, Homo Sapiens
MNFKWSELW

SEQ ID NO: 224510 - protein, 9 aa, Homo Sapiens
KWDYMNTSV

SEQ ID NO: 224511 - protein, 9 aa, Homo Sapiens
IRTPRGRAP

SEQ ID NO: 224512 - protein, 9 aa, Homo Sapiens
RTWIIPMGQ

SEQ ID NO: 224513 - protein, 9 aa, Homo Sapiens
KVEQVEFSE

SEQ ID NO: 224514 - protein, 9 aa, Homo Sapiens
RSPRAPGSQ

SEQ ID NO: 224515 - protein, 9 aa, Homo Sapiens
FVAQTSWTT

SEQ ID NO: 224516 - protein, 9 aa, Homo Sapiens
NRALGVLFL

SEQ ID NO: 224517 - protein, 9 aa, Homo Sapiens
ASCPSPPMR

SEQ ID NO: 224518 - protein, 9 aa, Homo Sapiens
TWASSATAA

SEQ ID NO: 224519 - protein, 9 aa, Homo Sapiens
SGHQVPPTW

SEQ ID NO: 224520 - protein, 9 aa, Homo Sapiens
APPIRRVSP

SEQ ID NO: 224521 - protein, 9 aa, Homo Sapiens
RIPAGRRSG

SEQ ID NO: 224522 - protein, 9 aa, Homo Sapiens
LQCHRKSDF

SEQ ID NO: 224523 - protein, 9 aa, Homo Sapiens
ALQDLCWEL

SEQ ID NO: 224524 - protein, 9 aa, Homo Sapiens
NSSSRLIVK

SEQ ID NO: 224525 - protein, 9 aa, Homo Sapiens
KAKELHQAR

SEQ ID NO: 224526 - protein, 9 aa, Homo Sapiens
KHDDTALTL

SEQ ID NO: 224527 - protein, 9 aa, Homo Sapiens
DNNIQMKKD

SEQ ID NO: 224528 - protein, 9 aa, Homo Sapiens
HPSLGGCPL

SEQ ID NO: 224529 - protein, 9 aa, Homo Sapiens
KMTLLGQEL

SEQ ID NO: 224530 - protein, 9 aa, Homo Sapiens
SCFKLDLSL

SEQ ID NO: 224531 - protein, 9 aa, Homo Sapiens
ATPAAVVAI

SEQ ID NO: 224532 - protein, 9 aa, Homo Sapiens
EYKKTYMEM

SEQ ID NO: 224533 - protein, 9 aa, Homo Sapiens
VASLEASVQ

SEQ ID NO: 224534 - protein, 9 aa, Homo Sapiens
GALSIRETP

SEQ ID NO: 224535 - protein, 9 aa, Homo Sapiens
LKMRNLHFH

SEQ ID NO: 224536 - protein, 9 aa, Homo Sapiens
RRTKWKKRK

SEQ ID NO: 224537 - protein, 9 aa, Homo Sapiens
VIWEPMWEH

SEQ ID NO: 224538 - protein, 9 aa, Homo Sapiens
VVMRPGSPL

SEQ ID NO: 224539 - protein, 9 aa, Homo Sapiens
EKITKILSD

SEQ ID NO: 224540 - protein, 9 aa, Homo Sapiens
QKSIFEALW

SEQ ID NO: 224541 - protein, 9 aa, Homo Sapiens
WVPVRQSTS

SEQ ID NO: 224542 - protein, 9 aa, Homo Sapiens
AHWVFLATH

SEQ ID NO: 224543 - protein, 9 aa, Homo Sapiens
SDSEVSEDS

SEQ ID NO: 224544 - protein, 9 aa, Homo Sapiens
ALVTIGGIF

SEQ ID NO: 224545 - protein, 9 aa, Homo Sapiens
ALLLTTVRR

SEQ ID NO: 224546 - protein, 9 aa, Homo Sapiens
TLCYLGNRL

SEQ ID NO: 224547 - protein, 9 aa, Homo Sapiens
LLAYPQNPW

SEQ ID NO: 224548 - protein, 9 aa, Homo Sapiens
PEKKVMSNS

SEQ ID NO: 224549 - protein, 9 aa, Homo Sapiens
PRPHASPTS

SEQ ID NO: 224550 - protein, 9 aa, Homo Sapiens
HKINPSHHS

SEQ ID NO: 224551 - protein, 9 aa, Homo Sapiens
GLVIFYFLR

SEQ ID NO: 224552 - protein, 9 aa, Homo Sapiens
GPAATSSLE

SEQ ID NO: 224553 - protein, 9 aa, Homo Sapiens
NTNPSRGHY

SEQ ID NO: 224554 - protein, 9 aa, Homo Sapiens
ALRAVGTQI

SEQ ID NO: 224555 - protein, 9 aa, Homo Sapiens
LNLFHLLLS

SEQ ID NO: 224556 - protein, 9 aa, Homo Sapiens
TLQNVGHKS

SEQ ID NO: 224557 - protein, 9 aa, Homo Sapiens
KLEKKQDPK

SEQ ID NO: 224558 - protein, 9 aa, Homo Sapiens
SKAEDPVLL

SEQ ID NO: 224559 - protein, 9 aa, Homo Sapiens
IPQKDLKIP

SEQ ID NO: 224560 - protein, 9 aa, Homo Sapiens
ENSRYEVCG

SEQ ID NO: 224561 - protein, 9 aa, Homo Sapiens
GLIPRLPTG

SEQ ID NO: 224562 - protein, 9 aa, Homo Sapiens
TNYVRNSWA

SEQ ID NO: 224563 - protein, 9 aa, Homo Sapiens
NRHTIEVNR

SEQ ID NO: 224564 - protein, 9 aa, Homo Sapiens
LLAFGIVQG

SEQ ID NO: 224565 - protein, 9 aa, Homo Sapiens
EPTATPAAV

SEQ ID NO: 224566 - protein, 9 aa, Homo Sapiens
SWPPPSAQP

SEQ ID NO: 224567 - protein, 9 aa, Homo Sapiens
AFQAPPSCL

SEQ ID NO: 224568 - protein, 9 aa, Homo Sapiens
DRGALSVPL

SEQ ID NO: 224569 - protein, 9 aa, Homo Sapiens
LLSETGKRP

SEQ ID NO: 224570 - protein, 9 aa, Homo Sapiens
PLRDMFPCG

SEQ ID NO: 224571 - protein, 9 aa, Homo Sapiens
YVKDDKIRS

SEQ ID NO: 224572 - protein, 9 aa, Homo Sapiens
EMAEYEIKK

SEQ ID NO: 224573 - protein, 9 aa, Homo Sapiens
NRGLRLIKS

SEQ ID NO: 224574 - protein, 9 aa, Homo Sapiens
NQPITLTVE

SEQ ID NO: 224575 - protein, 9 aa, Homo Sapiens
KAKFSGFEA

SEQ ID NO: 224576 - protein, 9 aa, Homo Sapiens
GASSCRRPS

SEQ ID NO: 224577 - protein, 9 aa, Homo Sapiens
QPLDDIIKC

SEQ ID NO: 224578 - protein, 9 aa, Homo Sapiens
LFVKTMVCC

SEQ ID NO: 224579 - protein, 9 aa, Homo Sapiens
NHPKGREEH

SEQ ID NO: 224580 - protein, 9 aa, Homo Sapiens
ITCPENSRY

SEQ ID NO: 224581 - protein, 9 aa, Homo Sapiens
YLMQKHTSS

SEQ ID NO: 224582 - protein, 9 aa, Homo Sapiens
EQLVKCSHE

SEQ ID NO: 224583 - protein, 9 aa, Homo Sapiens
SSLSGILRK

SEQ ID NO: 224584 - protein, 9 aa, Homo Sapiens
VQMGQAENL

SEQ ID NO: 224585 - protein, 9 aa, Homo Sapiens
PHSKCFEDY

SEQ ID NO: 224586 - protein, 9 aa, Homo Sapiens
VKGYLFRWA

SEQ ID NO: 224587 - protein, 9 aa, Homo Sapiens
IQLFTTHFL

SEQ ID NO: 224588 - protein, 9 aa, Homo Sapiens
IDNFNQQEK

SEQ ID NO: 224589 - protein, 9 aa, Homo Sapiens
DNLIEAGKE

SEQ ID NO: 224590 - protein, 9 aa, Homo Sapiens
QDASARRRE

SEQ ID NO: 224591 - protein, 9 aa, Homo Sapiens
SRPGFSPRG

SEQ ID NO: 224592 - protein, 9 aa, Homo Sapiens
QATGLLKPK

SEQ ID NO: 224593 - protein, 9 aa, Homo Sapiens
LPRLMSGVE

SEQ ID NO: 224594 - protein, 9 aa, Homo Sapiens
TLTDSNIVA

SEQ ID NO: 224595 - protein, 9 aa, Homo Sapiens
APRHPHRSP

SEQ ID NO: 224596 - protein, 9 aa, Homo Sapiens
AANFRRCCW

SEQ ID NO: 224597 - protein, 9 aa, Homo Sapiens
LLGDQLVGG

SEQ ID NO: 224598 - protein, 9 aa, Homo Sapiens
WDYMNTSVQ

SEQ ID NO: 224599 - protein, 9 aa, Homo Sapiens
REWPSQVVL

SEQ ID NO: 224600 - protein, 9 aa, Homo Sapiens
QHQPDVVVQ

SEQ ID NO: 224601 - protein, 9 aa, Homo Sapiens
RGWGQHTGQ

SEQ ID NO: 224602 - protein, 9 aa, Homo Sapiens
DPCFQRDLP

SEQ ID NO: 224603 - protein, 9 aa, Homo Sapiens
VFLVVFFCI

SEQ ID NO: 224604 - protein, 9 aa, Homo Sapiens
GLPREYQQR

SEQ ID NO: 224605 - protein, 9 aa, Homo Sapiens
EVLVAVASL

SEQ ID NO: 224606 - protein, 9 aa, Homo Sapiens
ISVGTYESH

SEQ ID NO: 224607 - protein, 9 aa, Homo Sapiens
TSFYDSWSP

SEQ ID NO: 224608 - protein, 9 aa, Homo Sapiens
TNCEDDITC

SEQ ID NO: 224609 - protein, 9 aa, Homo Sapiens
ACWCLECAL

SEQ ID NO: 224610 - protein, 9 aa, Homo Sapiens
LDRPPLQDH

SEQ ID NO: 224611 - protein, 9 aa, Homo Sapiens
GTMADLDNI

SEQ ID NO: 224612 - protein, 9 aa, Homo Sapiens
YPKLLGKGT

SEQ ID NO: 224613 - protein, 9 aa, Homo Sapiens
ATSSRPLAH

SEQ ID NO: 224614 - protein, 9 aa, Homo Sapiens
SQDSKLTTT

SEQ ID NO: 224615 - protein, 9 aa, Homo Sapiens
PGCPASPRT

SEQ ID NO: 224616 - protein, 9 aa, Homo Sapiens
YHQYGGTYN

SEQ ID NO: 224617 - protein, 9 aa, Homo Sapiens
RLSGVIHTS

SEQ ID NO: 224618 - protein, 9 aa, Homo Sapiens
KKEQRVILD

SEQ ID NO: 224619 - protein, 9 aa, Homo Sapiens
RVSWWPRES

SEQ ID NO: 224620 - protein, 9 aa, Homo Sapiens
VGPAQCRPA

SEQ ID NO: 224621 - protein, 9 aa, Homo Sapiens
SNPSLITRQ

SEQ ID NO: 224622 - protein, 9 aa, Homo Sapiens
VPESKLQIL

SEQ ID NO: 224623 - protein, 9 aa, Homo Sapiens
TSTIGLALA

SEQ ID NO: 224624 - protein, 9 aa, Homo Sapiens
RYLTGGLWA

SEQ ID NO: 224625 - protein, 9 aa, Homo Sapiens
SHPSTLRRP

SEQ ID NO: 224626 - protein, 9 aa, Homo Sapiens
IEDGDIAGA

SEQ ID NO: 224627 - protein, 9 aa, Homo Sapiens
LNKFESLEL

SEQ ID NO: 224628 - protein, 9 aa, Homo Sapiens
TKDNLAPSY

SEQ ID NO: 224629 - protein, 9 aa, Homo Sapiens
VFHTGWIST

SEQ ID NO: 224630 - protein, 9 aa, Homo Sapiens
MIGCGAILV

SEQ ID NO: 224631 - protein, 9 aa, Homo Sapiens
SCVNSDYET

SEQ ID NO: 224632 - protein, 9 aa, Homo Sapiens
ICGASVSHH

SEQ ID NO: 224633 - protein, 9 aa, Homo Sapiens
HGLLGQALE

SEQ ID NO: 224634 - protein, 9 aa, Homo Sapiens
GEEKELMEH

SEQ ID NO: 224635 - protein, 9 aa, Homo Sapiens
FGEVELSRK

SEQ ID NO: 224636 - protein, 9 aa, Homo Sapiens
VSIQFERVL

SEQ ID NO: 224637 - protein, 9 aa, Homo Sapiens
DDCANRPCQ

SEQ ID NO: 224638 - protein, 9 aa, Homo Sapiens
FWVECQSKG

SEQ ID NO: 224639 - protein, 9 aa, Homo Sapiens
DFSKELKKL

SEQ ID NO: 224640 - protein, 9 aa, Homo Sapiens
LGHMYNLVS

SEQ ID NO: 224641 - protein, 9 aa, Homo Sapiens
LLVVAVQGP

SEQ ID NO: 224642 - protein, 9 aa, Homo Sapiens
REIDDFLKQ

SEQ ID NO: 224643 - protein, 9 aa, Homo Sapiens
RLARSSALA

SEQ ID NO: 224644 - protein, 9 aa, Homo Sapiens
CGPWARNPT

SEQ ID NO: 224645 - protein, 9 aa, Homo Sapiens
RRNLTKLFL

SEQ ID NO: 224646 - protein, 9 aa, Homo Sapiens
SPQSRWLSP

SEQ ID NO: 224647 - protein, 9 aa, Homo Sapiens
VMSNSPQNG

SEQ ID NO: 224648 - protein, 9 aa, Homo Sapiens
PRHPHRSPP

SEQ ID NO: 224649 - protein, 9 aa, Homo Sapiens
PEIITVGED

SEQ ID NO: 224650 - protein, 9 aa, Homo Sapiens
DLPVAGVYK

SEQ ID NO: 224651 - protein, 9 aa, Homo Sapiens
KEPNSKDNS

SEQ ID NO: 224652 - protein, 9 aa, Homo Sapiens
YSLFMFPCG

SEQ ID NO: 224653 - protein, 9 aa, Homo Sapiens
RVTKYCSAK

SEQ ID NO: 224654 - protein, 9 aa, Homo Sapiens
CMTTNQKKV

SEQ ID NO: 224655 - protein, 9 aa, Homo Sapiens
KYLNLTASE

SEQ ID NO: 224656 - protein, 9 aa, Homo Sapiens
LKQMLNNKL

SEQ ID NO: 224657 - protein, 9 aa, Homo Sapiens
SHLVQHRHI

SEQ ID NO: 224658 - protein, 9 aa, Homo Sapiens
LLVHWVTYI

SEQ ID NO: 224659 - protein, 9 aa, Homo Sapiens
NPLQPHFKE

SEQ ID NO: 224660 - protein, 9 aa, Homo Sapiens
WRAWGSPSP

SEQ ID NO: 224661 - protein, 9 aa, Homo Sapiens
WVGAQEAVQ

SEQ ID NO: 224662 - protein, 9 aa, Homo Sapiens
GDAGPGDAE

SEQ ID NO: 224663 - protein, 9 aa, Homo Sapiens
SRPPQATRA

SEQ ID NO: 224664 - protein, 9 aa, Homo Sapiens
LPTSTLRGT

SEQ ID NO: 224665 - protein, 9 aa, Homo Sapiens
RVDATTVTD

SEQ ID NO: 224666 - protein, 9 aa, Homo Sapiens
KYGKSFRLK

SEQ ID NO: 224667 - protein, 9 aa, Homo Sapiens
QGGRILLQR

SEQ ID NO: 224668 - protein, 9 aa, Homo Sapiens
GLTLEVEVK

SEQ ID NO: 224669 - protein, 9 aa, Homo Sapiens
DLTSLGLHG

SEQ ID NO: 224670 - protein, 9 aa, Homo Sapiens
LFSQDSKLT

SEQ ID NO: 224671 - protein, 9 aa, Homo Sapiens
NPNGTNPGV

SEQ ID NO: 224672 - protein, 9 aa, Homo Sapiens
FFFRVGRGG

SEQ ID NO: 224673 - protein, 9 aa, Homo Sapiens
PPLQRGPAG

SEQ ID NO: 224674 - protein, 9 aa, Homo Sapiens
GGGTYTKGT

SEQ ID NO: 224675 - protein, 9 aa, Homo Sapiens
PTKGACTAD

SEQ ID NO: 224676 - protein, 9 aa, Homo Sapiens
FSACSTAKA

SEQ ID NO: 224677 - protein, 9 aa, Homo Sapiens
PQDATTNTS

SEQ ID NO: 224678 - protein, 9 aa, Homo Sapiens
VFKENDGSL

SEQ ID NO: 224679 - protein, 9 aa, Homo Sapiens
ETGVVAAME

SEQ ID NO: 224680 - protein, 9 aa, Homo Sapiens
LLSVELGSK

SEQ ID NO: 224681 - protein, 9 aa, Homo Sapiens
KNLHGFSKN

SEQ ID NO: 224682 - protein, 9 aa, Homo Sapiens
LQGHGLLGQ

SEQ ID NO: 224683 - protein, 9 aa, Homo Sapiens
VVLHHPVQH

SEQ ID NO: 224684 - protein, 9 aa, Homo Sapiens
CKKQCRRMG

SEQ ID NO: 224685 - protein, 9 aa, Homo Sapiens
TTGMRRGLL

SEQ ID NO: 224686 - protein, 9 aa, Homo Sapiens
QNVDFVDLK

SEQ ID NO: 224687 - protein, 9 aa, Homo Sapiens
DGQRVLQEA

SEQ ID NO: 224688 - protein, 9 aa, Homo Sapiens
TSEGGKYLT

SEQ ID NO: 224689 - protein, 9 aa, Homo Sapiens
HQLLIKAVN

SEQ ID NO: 224690 - protein, 9 aa, Homo Sapiens
VGSSSRIPR

SEQ ID NO: 224691 - protein, 9 aa, Homo Sapiens
RPGGAEKEP

SEQ ID NO: 224692 - protein, 9 aa, Homo Sapiens
RTSVEDAPS

SEQ ID NO: 224693 - protein, 9 aa, Homo Sapiens
ECDRVRQKL

SEQ ID NO: 224694 - protein, 9 aa, Homo Sapiens
QISLPLRGF

SEQ ID NO: 224695 - protein, 9 aa, Homo Sapiens
DRIILKANE

SEQ ID NO: 224696 - protein, 9 aa, Homo Sapiens
SHNGVSLHE

SEQ ID NO: 224697 - protein, 9 aa, Homo Sapiens
DVGAGAVAV

SEQ ID NO: 224698 - protein, 9 aa, Homo Sapiens
YMQQNSADN

SEQ ID NO: 224699 - protein, 9 aa, Homo Sapiens
VDDQRSENY

SEQ ID NO: 224700 - protein, 9 aa, Homo Sapiens
SADLSCDSC

SEQ ID NO: 224701 - protein, 9 aa, Homo Sapiens
LLGQLHPRR

SEQ ID NO: 224702 - protein, 9 aa, Homo Sapiens
RWPRALRAR

SEQ ID NO: 224703 - protein, 9 aa, Homo Sapiens
MRIRAKQRA

SEQ ID NO: 224704 - protein, 9 aa, Homo Sapiens
YVKTWMQGI

SEQ ID NO: 224705 - protein, 9 aa, Homo Sapiens
RRMGHRVLG

SEQ ID NO: 224706 - protein, 9 aa, Homo Sapiens
TAKLRLVEF

SEQ ID NO: 224707 - protein, 9 aa, Homo Sapiens
LHSPDEKSQ

SEQ ID NO: 224708 - protein, 9 aa, Homo Sapiens
VAPFMTNGP

SEQ ID NO: 224709 - protein, 9 aa, Homo Sapiens
STAHKPCAE

SEQ ID NO: 224710 - protein, 9 aa, Homo Sapiens
PVSHSCTTH

SEQ ID NO: 224711 - protein, 9 aa, Homo Sapiens
RKMTFRLVV

SEQ ID NO: 224712 - protein, 9 aa, Homo Sapiens
GSGGVCQRM

SEQ ID NO: 224713 - protein, 9 aa, Homo Sapiens
QILTDHCNE

SEQ ID NO: 224714 - protein, 9 aa, Homo Sapiens
VFRLVVLCR

SEQ ID NO: 224715 - protein, 9 aa, Homo Sapiens
TNPVYEALL

SEQ ID NO: 224716 - protein, 9 aa, Homo Sapiens
EDLGKMLKV

SEQ ID NO: 224717 - protein, 9 aa, Homo Sapiens
SKILRNNPY

SEQ ID NO: 224718 - protein, 9 aa, Homo Sapiens
ARAAQRKSQ

SEQ ID NO: 224719 - protein, 9 aa, Homo Sapiens
IVRKITMVV

SEQ ID NO: 224720 - protein, 9 aa, Homo Sapiens
EQGIKAYHM

SEQ ID NO: 224721 - protein, 9 aa, Homo Sapiens
PQATRRDAG

SEQ ID NO: 224722 - protein, 9 aa, Homo Sapiens
PQKRFRHLA

SEQ ID NO: 224723 - protein, 9 aa, Homo Sapiens
SDSKNAPHL

SEQ ID NO: 224724 - protein, 9 aa, Homo Sapiens
ARSPAPRRP

SEQ ID NO: 224725 - protein, 9 aa, Homo Sapiens
APRPWMSPA

SEQ ID NO: 224726 - protein, 9 aa, Homo Sapiens
GVDVNCAIA

SEQ ID NO: 224727 - protein, 9 aa, Homo Sapiens
REEIARHAA

SEQ ID NO: 224728 - protein, 9 aa, Homo Sapiens
RRRPGPPQA

SEQ ID NO: 224729 - protein, 9 aa, Homo Sapiens
AIMITRLVV

SEQ ID NO: 224730 - protein, 9 aa, Homo Sapiens
YDAETKLND

SEQ ID NO: 224731 - protein, 9 aa, Homo Sapiens
SCPRPFWLR

SEQ ID NO: 224732 - protein, 9 aa, Homo Sapiens
LGDLCVVLL

SEQ ID NO: 224733 - protein, 9 aa, Homo Sapiens
HLPSPPVRS

SEQ ID NO: 224734 - protein, 9 aa, Homo Sapiens
EYVPLLNSL

SEQ ID NO: 224735 - protein, 9 aa, Homo Sapiens
SPDLGTQCL

SEQ ID NO: 224736 - protein, 9 aa, Homo Sapiens
GSQSGTKMK

SEQ ID NO: 224737 - protein, 9 aa, Homo Sapiens
ATASTSPPP

SEQ ID NO: 224738 - protein, 9 aa, Homo Sapiens
IVIGGVQPQ

SEQ ID NO: 224739 - protein, 9 aa, Homo Sapiens
RYVTENRDD

SEQ ID NO: 224740 - protein, 9 aa, Homo Sapiens
PPIRRVSPG

SEQ ID NO: 224741 - protein, 9 aa, Homo Sapiens
ALQEYQGAV

SEQ ID NO: 224742 - protein, 9 aa, Homo Sapiens
EWDEYAKHI

SEQ ID NO: 224743 - protein, 9 aa, Homo Sapiens
MDAVEPGGC

SEQ ID NO: 224744 - protein, 9 aa, Homo Sapiens
EVCSVGPLS

SEQ ID NO: 224745 - protein, 9 aa, Homo Sapiens
IQMYDHVID

SEQ ID NO: 224746 - protein, 9 aa, Homo Sapiens
GVRSFYLII

SEQ ID NO: 224747 - protein, 9 aa, Homo Sapiens
QELQRVHLE

SEQ ID NO: 224748 - protein, 9 aa, Homo Sapiens
GDVEQLVKC

SEQ ID NO: 224749 - protein, 9 aa, Homo Sapiens
EALGTESST

SEQ ID NO: 224750 - protein, 9 aa, Homo Sapiens
LRLIKSSST

SEQ ID NO: 224751 - protein, 9 aa, Homo Sapiens
WVFLATHDG

SEQ ID NO: 224752 - protein, 9 aa, Homo Sapiens
PELYTLMSD

SEQ ID NO: 224753 - protein, 9 aa, Homo Sapiens
AVLLPCTFL

SEQ ID NO: 224754 - protein, 9 aa, Homo Sapiens
QQNSADNAN

SEQ ID NO: 224755 - protein, 9 aa, Homo Sapiens
TAVFDMSYF

SEQ ID NO: 224756 - protein, 9 aa, Homo Sapiens
GVLGYKIDH

SEQ ID NO: 224757 - protein, 9 aa, Homo Sapiens
QHRLLLVTQ

SEQ ID NO: 224758 - protein, 9 aa, Homo Sapiens
LQARRWPRA

SEQ ID NO: 224759 - protein, 9 aa, Homo Sapiens
EDAVNDVQL

SEQ ID NO: 224760 - protein, 9 aa, Homo Sapiens
TDSVADTAQ

SEQ ID NO: 224761 - protein, 9 aa, Homo Sapiens
EEPPRLLNL

SEQ ID NO: 224762 - protein, 9 aa, Homo Sapiens
TTVLESWGQ

SEQ ID NO: 224763 - protein, 9 aa, Homo Sapiens
PHSAMGPGS

SEQ ID NO: 224764 - protein, 9 aa, Homo Sapiens
ALRHRLSGQ

SEQ ID NO: 224765 - protein, 9 aa, Homo Sapiens
DFWEVDPIF

SEQ ID NO: 224766 - protein, 9 aa, Homo Sapiens
TTIMVNNDF

SEQ ID NO: 224767 - protein, 9 aa, Homo Sapiens
SRSHLDFSP

SEQ ID NO: 224768 - protein, 9 aa, Homo Sapiens
WLRRLERRR

SEQ ID NO: 224769 - protein, 9 aa, Homo Sapiens
IPTEKLREM

SEQ ID NO: 224770 - protein, 9 aa, Homo Sapiens
QAPSPAFSV

SEQ ID NO: 224771 - protein, 9 aa, Homo Sapiens
CWSPRPPGA

SEQ ID NO: 224772 - protein, 9 aa, Homo Sapiens
TPLGTGQDV

SEQ ID NO: 224773 - protein, 9 aa, Homo Sapiens
TTCTWTCGP

SEQ ID NO: 224774 - protein, 9 aa, Homo Sapiens
VCETPCGCY

SEQ ID NO: 224775 - protein, 9 aa, Homo Sapiens
ERLKGLGKE

SEQ ID NO: 224776 - protein, 9 aa, Homo Sapiens
RGSVQRYSN

SEQ ID NO: 224777 - protein, 9 aa, Homo Sapiens
AMSTHLHKG

SEQ ID NO: 224778 - protein, 9 aa, Homo Sapiens
PLGRVSWWP

SEQ ID NO: 224779 - protein, 9 aa, Homo Sapiens
ESAIKQVVN

SEQ ID NO: 224780 - protein, 9 aa, Homo Sapiens
CASCPSPPM

SEQ ID NO: 224781 - protein, 9 aa, Homo Sapiens
SKPTTPEKQ

SEQ ID NO: 224782 - protein, 9 aa, Homo Sapiens
LSRKVTELR

SEQ ID NO: 224783 - protein, 9 aa, Homo Sapiens
HAESGKVYT

SEQ ID NO: 224784 - protein, 9 aa, Homo Sapiens
TPPPGPQPG

SEQ ID NO: 224785 - protein, 9 aa, Homo Sapiens
VPGETGLLP

SEQ ID NO: 224786 - protein, 9 aa, Homo Sapiens
RFWGLVTDA

SEQ ID NO: 224787 - protein, 9 aa, Homo Sapiens
HQRVHCAAP

SEQ ID NO: 224788 - protein, 9 aa, Homo Sapiens
AFVLFRCSY

SEQ ID NO: 224789 - protein, 9 aa, Homo Sapiens
TLLGQLPPK

SEQ ID NO: 224790 - protein, 9 aa, Homo Sapiens
FRCHWCKYH

SEQ ID NO: 224791 - protein, 9 aa, Homo Sapiens
IVPSHKLTL

SEQ ID NO: 224792 - protein, 9 aa, Homo Sapiens
AQRQECNLQ

SEQ ID NO: 224793 - protein, 9 aa, Homo Sapiens
TGQPQGSSG

SEQ ID NO: 224794 - protein, 9 aa, Homo Sapiens
LVLLGSGSM

SEQ ID NO: 224795 - protein, 9 aa, Homo Sapiens
VTLYKHDDT

SEQ ID NO: 224796 - protein, 9 aa, Homo Sapiens
SLQAETKED

SEQ ID NO: 224797 - protein, 9 aa, Homo Sapiens
HDTALAHRA

SEQ ID NO: 224798 - protein, 9 aa, Homo Sapiens
SSRRQRMEA

SEQ ID NO: 224799 - protein, 9 aa, Homo Sapiens
WPGGRRTIC

SEQ ID NO: 224800 - protein, 9 aa, Homo Sapiens
TTIVCPDCE

SEQ ID NO: 224801 - protein, 9 aa, Homo Sapiens
ALCMLKLGR

SEQ ID NO: 224802 - protein, 9 aa, Homo Sapiens
GLAIGTHSA

SEQ ID NO: 224803 - protein, 9 aa, Homo Sapiens
STFLLACLT

SEQ ID NO: 224804 - protein, 9 aa, Homo Sapiens
SYMLAKLYE

SEQ ID NO: 224805 - protein, 9 aa, Homo Sapiens
LSDFFSAQP

SEQ ID NO: 224806 - protein, 9 aa, Homo Sapiens
DFVDLKNGK

SEQ ID NO: 224807 - protein, 9 aa, Homo Sapiens
TVGKSHLLE

SEQ ID NO: 224808 - protein, 9 aa, Homo Sapiens
NNIQMKKDL

SEQ ID NO: 224809 - protein, 9 aa, Homo Sapiens
KNQLTRDWK

SEQ ID NO: 224810 - protein, 9 aa, Homo Sapiens
PSFKQFLVV

SEQ ID NO: 224811 - protein, 9 aa, Homo Sapiens
VWRSSECMK

SEQ ID NO: 224812 - protein, 9 aa, Homo Sapiens
PTKKRGKSQ

SEQ ID NO: 224813 - protein, 9 aa, Homo Sapiens
RIIRWPSAT

SEQ ID NO: 224814 - protein, 9 aa, Homo Sapiens
PCQAQDTAQ

SEQ ID NO: 224815 - protein, 9 aa, Homo Sapiens
LLLRRGQLG

SEQ ID NO: 224816 - protein, 9 aa, Homo Sapiens
ARAIEAQCY

SEQ ID NO: 224817 - protein, 9 aa, Homo Sapiens
AATSSLEAS

SEQ ID NO: 224818 - protein, 9 aa, Homo Sapiens
QMYDHVIDF

SEQ ID NO: 224819 - protein, 9 aa, Homo Sapiens
TLNPPGCAL

SEQ ID NO: 224820 - protein, 9 aa, Homo Sapiens
EVFKENDGS

SEQ ID NO: 224821 - protein, 9 aa, Homo Sapiens
PRLPRAGGH

SEQ ID NO: 224822 - protein, 9 aa, Homo Sapiens
QVIIDFILE

SEQ ID NO: 224823 - protein, 9 aa, Homo Sapiens
KVKSVFVDF

SEQ ID NO: 224824 - protein, 9 aa, Homo Sapiens
GHGVWVGAQ

SEQ ID NO: 224825 - protein, 9 aa, Homo Sapiens
LPFVAQTSW

SEQ ID NO: 224826 - protein, 9 aa, Homo Sapiens
RGLAAPGVH

SEQ ID NO: 224827 - protein, 9 aa, Homo Sapiens
QLLLHPHGK

SEQ ID NO: 224828 - protein, 9 aa, Homo Sapiens
SLITRQMLT

SEQ ID NO: 224829 - protein, 9 aa, Homo Sapiens
PSEKTNCTC

SEQ ID NO: 224830 - protein, 9 aa, Homo Sapiens
CINIGLRFQ

SEQ ID NO: 224831 - protein, 9 aa, Homo Sapiens
RSSTPSRLA

SEQ ID NO: 224832 - protein, 9 aa, Homo Sapiens
RQIQEWGCL

SEQ ID NO: 224833 - protein, 9 aa, Homo Sapiens
PHTVDHCHS

SEQ ID NO: 224834 - protein, 9 aa, Homo Sapiens
SCAAGMTLA

SEQ ID NO: 224835 - protein, 9 aa, Homo Sapiens
REQEEREQQ

SEQ ID NO: 224836 - protein, 9 aa, Homo Sapiens
GSSCLQTSN

SEQ ID NO: 224837 - protein, 9 aa, Homo Sapiens
FLSLSADGA

SEQ ID NO: 224838 - protein, 9 aa, Homo Sapiens
LKRHFTVNM

SEQ ID NO: 224839 - protein, 9 aa, Homo Sapiens
WGTLWWASG

SEQ ID NO: 224840 - protein, 9 aa, Homo Sapiens
LYHLSPHLN

SEQ ID NO: 224841 - protein, 9 aa, Homo Sapiens
KKMTLKALV

SEQ ID NO: 224842 - protein, 9 aa, Homo Sapiens
QRTTCHSIL

SEQ ID NO: 224843 - protein, 9 aa, Homo Sapiens
VQNLEHWEE

SEQ ID NO: 224844 - protein, 9 aa, Homo Sapiens
LHAVAASTG

SEQ ID NO: 224845 - protein, 9 aa, Homo Sapiens
PGLKVTLTQ

SEQ ID NO: 224846 - protein, 9 aa, Homo Sapiens
APLSPLGLA

SEQ ID NO: 224847 - protein, 9 aa, Homo Sapiens
PMRCLHLPP

SEQ ID NO: 224848 - protein, 9 aa, Homo Sapiens
NPSRGHYHF

SEQ ID NO: 224849 - protein, 9 aa, Homo Sapiens
ALEHGCQFM

SEQ ID NO: 224850 - protein, 9 aa, Homo Sapiens
DMYKDKKRH

SEQ ID NO: 224851 - protein, 9 aa, Homo Sapiens
DHMIDRSEC

SEQ ID NO: 224852 - protein, 9 aa, Homo Sapiens
PTASGVSLL

SEQ ID NO: 224853 - protein, 9 aa, Homo Sapiens
EDMSQFYRP

SEQ ID NO: 224854 - protein, 9 aa, Homo Sapiens
HQSAPPIRR

SEQ ID NO: 224855 - protein, 9 aa, Homo Sapiens
CDVNECFQD

SEQ ID NO: 224856 - protein, 9 aa, Homo Sapiens
CPPRSSTSC

SEQ ID NO: 224857 - protein, 9 aa, Homo Sapiens
WLVERDPQG

SEQ ID NO: 224858 - protein, 9 aa, Homo Sapiens
LAVDGSAAV

SEQ ID NO: 224859 - protein, 9 aa, Homo Sapiens
VKRRHHKHN

SEQ ID NO: 224860 - protein, 9 aa, Homo Sapiens
ALVLLAPAT

SEQ ID NO: 224861 - protein, 9 aa, Homo Sapiens
VLYKTLTPI

SEQ ID NO: 224862 - protein, 9 aa, Homo Sapiens
VVICITFYY

SEQ ID NO: 224863 - protein, 9 aa, Homo Sapiens
RLMSGVEQA

SEQ ID NO: 224864 - protein, 9 aa, Homo Sapiens
KSARESRAG

SEQ ID NO: 224865 - protein, 9 aa, Homo Sapiens
CLEEFRATP

SEQ ID NO: 224866 - protein, 9 aa, Homo Sapiens
DPIMRKMQT

SEQ ID NO: 224867 - protein, 9 aa, Homo Sapiens
MLTAITGSF

SEQ ID NO: 224868 - protein, 9 aa, Homo Sapiens
APDCYIHNS

SEQ ID NO: 224869 - protein, 9 aa, Homo Sapiens
RTSMCQNLG

SEQ ID NO: 224870 - protein, 9 aa, Homo Sapiens
ELLEVIFHQ

SEQ ID NO: 224871 - protein, 9 aa, Homo Sapiens
SRFPLGRVS

SEQ ID NO: 224872 - protein, 9 aa, Homo Sapiens
VLTAYSLQP

SEQ ID NO: 224873 - protein, 9 aa, Homo Sapiens
PTQPRRVAS

SEQ ID NO: 224874 - protein, 9 aa, Homo Sapiens
GGRTAAVGK

SEQ ID NO: 224875 - protein, 9 aa, Homo Sapiens
PMTCPTAEP

SEQ ID NO: 224876 - protein, 9 aa, Homo Sapiens
VELLLNFIW

SEQ ID NO: 224877 - protein, 9 aa, Homo Sapiens
DAGLTRRVG

SEQ ID NO: 224878 - protein, 9 aa, Homo Sapiens
DVPGNPSKE

SEQ ID NO: 224879 - protein, 9 aa, Homo Sapiens
RRYWLDLKS

SEQ ID NO: 224880 - protein, 9 aa, Homo Sapiens
LRPRSHYME

SEQ ID NO: 224881 - protein, 9 aa, Homo Sapiens
AAKCQKPVT

SEQ ID NO: 224882 - protein, 9 aa, Homo Sapiens
FVHSIIQVI

SEQ ID NO: 224883 - protein, 9 aa, Homo Sapiens
LAAERSHDQ

SEQ ID NO: 224884 - protein, 9 aa, Homo Sapiens
LNNGNLGRI

SEQ ID NO: 224885 - protein, 9 aa, Homo Sapiens
SPLAIQDSE

SEQ ID NO: 224886 - protein, 9 aa, Homo Sapiens
EVQEGHGSH

SEQ ID NO: 224887 - protein, 9 aa, Homo Sapiens
KTEEYVAGN

SEQ ID NO: 224888 - protein, 9 aa, Homo Sapiens
GEVTKENLV

SEQ ID NO: 224889 - protein, 9 aa, Homo Sapiens
LILDPPKSP

SEQ ID NO: 224890 - protein, 9 aa, Homo Sapiens
YAKTDSYII

SEQ ID NO: 224891 - protein, 9 aa, Homo Sapiens
GDLAGHYTH

SEQ ID NO: 224892 - protein, 9 aa, Homo Sapiens
LPYEDKVHV

SEQ ID NO: 224893 - protein, 9 aa, Homo Sapiens
LRACANSWS

SEQ ID NO: 224894 - protein, 9 aa, Homo Sapiens
SIIDDDIFE

SEQ ID NO: 224895 - protein, 9 aa, Homo Sapiens
GHSLLFCGK

SEQ ID NO: 224896 - protein, 9 aa, Homo Sapiens
PSSRTGRPP

SEQ ID NO: 224897 - protein, 9 aa, Homo Sapiens
SMRINNNRL

SEQ ID NO: 224898 - protein, 9 aa, Homo Sapiens
RYMVICYPL

SEQ ID NO: 224899 - protein, 9 aa, Homo Sapiens
LASLQVALH

SEQ ID NO: 224900 - protein, 9 aa, Homo Sapiens
PRLVECPVS

SEQ ID NO: 224901 - protein, 9 aa, Homo Sapiens
KYDAVNVSL

SEQ ID NO: 224902 - protein, 9 aa, Homo Sapiens
EAERRQDLR

SEQ ID NO: 224903 - protein, 9 aa, Homo Sapiens
NEAGRQAIT

SEQ ID NO: 224904 - protein, 9 aa, Homo Sapiens
DFCVTAPRH

SEQ ID NO: 224905 - protein, 9 aa, Homo Sapiens
GSSWTPGRR

SEQ ID NO: 224906 - protein, 9 aa, Homo Sapiens
CAWDLEQMV

SEQ ID NO: 224907 - protein, 9 aa, Homo Sapiens
QVHCNDFLI

SEQ ID NO: 224908 - protein, 9 aa, Homo Sapiens
PQGVEEIRQ

SEQ ID NO: 224909 - protein, 9 aa, Homo Sapiens
VRNSEGEVT

SEQ ID NO: 224910 - protein, 9 aa, Homo Sapiens
GLSVSIDPR

SEQ ID NO: 224911 - protein, 9 aa, Homo Sapiens
HPVQHQPDV

SEQ ID NO: 224912 - protein, 9 aa, Homo Sapiens
RGWPLYWKG

SEQ ID NO: 224913 - protein, 9 aa, Homo Sapiens
TECWIFIPR

SEQ ID NO: 224914 - protein, 9 aa, Homo Sapiens
NSEFPLVSL

SEQ ID NO: 224915 - protein, 9 aa, Homo Sapiens
EVRDDNHPK

SEQ ID NO: 224916 - protein, 9 aa, Homo Sapiens
LGTNSLKSS

SEQ ID NO: 224917 - protein, 9 aa, Homo Sapiens
VMDHLQSFI

SEQ ID NO: 224918 - protein, 9 aa, Homo Sapiens
RIMEEESKT

SEQ ID NO: 224919 - protein, 9 aa, Homo Sapiens
RCSYQFLVP

SEQ ID NO: 224920 - protein, 9 aa, Homo Sapiens
TSVQIWEIP

SEQ ID NO: 224921 - protein, 9 aa, Homo Sapiens
TDRYHMPKE

SEQ ID NO: 224922 - protein, 9 aa, Homo Sapiens
VILDFTRVN

SEQ ID NO: 224923 - protein, 9 aa, Homo Sapiens
GKEVEVSQS

SEQ ID NO: 224924 - protein, 9 aa, Homo Sapiens
GMTCQSCVN

SEQ ID NO: 224925 - protein, 9 aa, Homo Sapiens
AKPECNIFS

SEQ ID NO: 224926 - protein, 9 aa, Homo Sapiens
PACLALRRR

SEQ ID NO: 224927 - protein, 9 aa, Homo Sapiens
IWNIEEYCR

SEQ ID NO: 224928 - protein, 9 aa, Homo Sapiens
ELWLVERDP

SEQ ID NO: 224929 - protein, 9 aa, Homo Sapiens
FASLNDCHE

SEQ ID NO: 224930 - protein, 9 aa, Homo Sapiens
LCALTFKLN

SEQ ID NO: 224931 - protein, 9 aa, Homo Sapiens
AGPGLSGHG

SEQ ID NO: 224932 - protein, 9 aa, Homo Sapiens
RSARVPPST

SEQ ID NO: 224933 - protein, 9 aa, Homo Sapiens
KAAWQFLLK

SEQ ID NO: 224934 - protein, 9 aa, Homo Sapiens
RSLAPPETY

SEQ ID NO: 224935 - protein, 9 aa, Homo Sapiens
TIPLMMPLD

SEQ ID NO: 224936 - protein, 9 aa, Homo Sapiens
ASGVLPQSY

SEQ ID NO: 224937 - protein, 9 aa, Homo Sapiens
FSSPPSVTI

SEQ ID NO: 224938 - protein, 9 aa, Homo Sapiens
LCVSRFWGL

SEQ ID NO: 224939 - protein, 9 aa, Homo Sapiens
SSSAARGRC

SEQ ID NO: 224940 - protein, 9 aa, Homo Sapiens
GSRAAGPVS

SEQ ID NO: 224941 - protein, 9 aa, Homo Sapiens
LGFTMLARL

SEQ ID NO: 224942 - protein, 9 aa, Homo Sapiens
LYILVSTYR

SEQ ID NO: 224943 - protein, 9 aa, Homo Sapiens
WEVDPIFGT

SEQ ID NO: 224944 - protein, 9 aa, Homo Sapiens
CICISVHVS

SEQ ID NO: 224945 - protein, 9 aa, Homo Sapiens
HIKHAWART

SEQ ID NO: 224946 - protein, 9 aa, Homo Sapiens
PLTAPLACL

SEQ ID NO: 224947 - protein, 9 aa, Homo Sapiens
FGAGPGLSG

SEQ ID NO: 224948 - protein, 9 aa, Homo Sapiens
PPPPPCPAH

SEQ ID NO: 224949 - protein, 9 aa, Homo Sapiens
LIAQELTDR

SEQ ID NO: 224950 - protein, 9 aa, Homo Sapiens
DWGAAGVQE

SEQ ID NO: 224951 - protein, 9 aa, Homo Sapiens
EAGRQAITS

SEQ ID NO: 224952 - protein, 9 aa, Homo Sapiens
DTAQRQECN

SEQ ID NO: 224953 - protein, 9 aa, Homo Sapiens
FFSRSHLDF

SEQ ID NO: 224954 - protein, 9 aa, Homo Sapiens
CVEDPLLPG

SEQ ID NO: 224955 - protein, 9 aa, Homo Sapiens
AWGSLCTLC

SEQ ID NO: 224956 - protein, 9 aa, Homo Sapiens
RSPQAPLRL

SEQ ID NO: 224957 - protein, 9 aa, Homo Sapiens
VQQAQGGGQ

SEQ ID NO: 224958 - protein, 9 aa, Homo Sapiens
SFSHAPPVA

SEQ ID NO: 224959 - protein, 9 aa, Homo Sapiens
LAECDNENH

SEQ ID NO: 224960 - protein, 9 aa, Homo Sapiens
SLGRGAAPL

SEQ ID NO: 224961 - protein, 9 aa, Homo Sapiens
PLLGDQLVG

SEQ ID NO: 224962 - protein, 9 aa, Homo Sapiens
SQGLGQPWP

SEQ ID NO: 224963 - protein, 9 aa, Homo Sapiens
MPLDVNQLQ

SEQ ID NO: 224964 - protein, 9 aa, Homo Sapiens
SCPTLRACA

SEQ ID NO: 224965 - protein, 9 aa, Homo Sapiens
VQPCTCPPV

SEQ ID NO: 224966 - protein, 9 aa, Homo Sapiens
VAYVRATLF

SEQ ID NO: 224967 - protein, 9 aa, Homo Sapiens
CVSLLIQHL

SEQ ID NO: 224968 - protein, 9 aa, Homo Sapiens
DLPVFPLPF

SEQ ID NO: 224969 - protein, 9 aa, Homo Sapiens
IRVTPLGTG

SEQ ID NO: 224970 - protein, 9 aa, Homo Sapiens
PARSPAPRR

SEQ ID NO: 224971 - protein, 9 aa, Homo Sapiens
PPPVTPLRV

SEQ ID NO: 224972 - protein, 9 aa, Homo Sapiens
QSAAYGLGV

SEQ ID NO: 224973 - protein, 9 aa, Homo Sapiens
KIAMTMDQY

SEQ ID NO: 224974 - protein, 9 aa, Homo Sapiens
SATGWWTPW

SEQ ID NO: 224975 - protein, 9 aa, Homo Sapiens
KLDLLGSGL

SEQ ID NO: 224976 - protein, 9 aa, Homo Sapiens
PPPSSPVPQ

SEQ ID NO: 224977 - protein, 9 aa, Homo Sapiens
KQVCNDVDE

SEQ ID NO: 224978 - protein, 9 aa, Homo Sapiens
EKAAKWKTP

SEQ ID NO: 224979 - protein, 9 aa, Homo Sapiens
MSHRSSSWP

SEQ ID NO: 224980 - protein, 9 aa, Homo Sapiens
DLRGKKTAV

SEQ ID NO: 224981 - protein, 9 aa, Homo Sapiens
DMAITEHPE

SEQ ID NO: 224982 - protein, 9 aa, Homo Sapiens
TRMGTLCYL

SEQ ID NO: 224983 - protein, 9 aa, Homo Sapiens
GAHHPLAHQ

SEQ ID NO: 224984 - protein, 9 aa, Homo Sapiens
RLPQEESRD

SEQ ID NO: 224985 - protein, 9 aa, Homo Sapiens
PDELRTALT

SEQ ID NO: 224986 - protein, 9 aa, Homo Sapiens
YCSTRQTSM

SEQ ID NO: 224987 - protein, 9 aa, Homo Sapiens
LDAEPPYSI

SEQ ID NO: 224988 - protein, 9 aa, Homo Sapiens
AVVWPSVPS

SEQ ID NO: 224989 - protein, 9 aa, Homo Sapiens
YWRWLRKQN

SEQ ID NO: 224990 - protein, 9 aa, Homo Sapiens
YRLSFAHPR

SEQ ID NO: 224991 - protein, 9 aa, Homo Sapiens
LADMSIKMK

SEQ ID NO: 224992 - protein, 9 aa, Homo Sapiens
PGGAATWRC

SEQ ID NO: 224993 - protein, 9 aa, Homo Sapiens
LIVSVWRPH

SEQ ID NO: 224994 - protein, 9 aa, Homo Sapiens
CTWTCGPST

SEQ ID NO: 224995 - protein, 9 aa, Homo Sapiens
SKHNRWEPE

SEQ ID NO: 224996 - protein, 9 aa, Homo Sapiens
NTLLQTGEP

SEQ ID NO: 224997 - protein, 9 aa, Homo Sapiens
LESWGQRPA

SEQ ID NO: 224998 - protein, 9 aa, Homo Sapiens
DRVQVHGLG

SEQ ID NO: 224999 - protein, 9 aa, Homo Sapiens
TEDKKNGIW

SEQ ID NO: 225000 - protein, 9 aa, Homo Sapiens
ELQPPGDCP

SEQ ID NO: 225001 - protein, 9 aa, Homo Sapiens
CAWYLCSSA

SEQ ID NO: 225002 - protein, 9 aa, Homo Sapiens
EEITTIMVN

SEQ ID NO: 225003 - protein, 9 aa, Homo Sapiens
GLRLIKSSS

SEQ ID NO: 225004 - protein, 9 aa, Homo Sapiens
GVFGAGPGL

SEQ ID NO: 225005 - protein, 9 aa, Homo Sapiens
FFRVGRGGG

SEQ ID NO: 225006 - protein, 9 aa, Homo Sapiens
SREDQQQQH

SEQ ID NO: 225007 - protein, 9 aa, Homo Sapiens
EQQALRQCQ

SEQ ID NO: 225008 - protein, 9 aa, Homo Sapiens
LGDDPPGGR

SEQ ID NO: 225009 - protein, 9 aa, Homo Sapiens
QPIVPRPAL

SEQ ID NO: 225010 - protein, 9 aa, Homo Sapiens
QYGVYREQP

SEQ ID NO: 225011 - protein, 9 aa, Homo Sapiens
VLSHEPGSS

SEQ ID NO: 225012 - protein, 9 aa, Homo Sapiens
RSRNPEEGG

SEQ ID NO: 225013 - protein, 9 aa, Homo Sapiens
EAMLFTYFE

SEQ ID NO: 225014 - protein, 9 aa, Homo Sapiens
HSKCITECV

SEQ ID NO: 225015 - protein, 9 aa, Homo Sapiens
FLDGVGVLG

SEQ ID NO: 225016 - protein, 9 aa, Homo Sapiens
CCAPGGTVW

SEQ ID NO: 225017 - protein, 9 aa, Homo Sapiens
NFWENLALI

SEQ ID NO: 225018 - protein, 9 aa, Homo Sapiens
ASTLAPASR

SEQ ID NO: 225019 - protein, 9 aa, Homo Sapiens
FICSQTGKK

SEQ ID NO: 225020 - protein, 9 aa, Homo Sapiens
CPRTPRASS

SEQ ID NO: 225021 - protein, 9 aa, Homo Sapiens
IPLQCHRKS

SEQ ID NO: 225022 - protein, 9 aa, Homo Sapiens
GRRRSRATF

SEQ ID NO: 225023 - protein, 9 aa, Homo Sapiens
EEMMQDGTW

SEQ ID NO: 225024 - protein, 9 aa, Homo Sapiens
TVPSGRPRR

SEQ ID NO: 225025 - protein, 9 aa, Homo Sapiens
VPGSHLHFI

SEQ ID NO: 225026 - protein, 9 aa, Homo Sapiens
HVPLGNLSP

SEQ ID NO: 225027 - protein, 9 aa, Homo Sapiens
RLPEWGEQI

SEQ ID NO: 225028 - protein, 9 aa, Homo Sapiens
VGKMRVPSQ

SEQ ID NO: 225029 - protein, 9 aa, Homo Sapiens
GGGTVVGLL

SEQ ID NO: 225030 - protein, 9 aa, Homo Sapiens
HFIILVARI

SEQ ID NO: 225031 - protein, 9 aa, Homo Sapiens
IWEVMPRTL

SEQ ID NO: 225032 - protein, 9 aa, Homo Sapiens
RGLVATVEA

SEQ ID NO: 225033 - protein, 9 aa, Homo Sapiens
MMDRIKLDW

SEQ ID NO: 225034 - protein, 9 aa, Homo Sapiens
SKICRGAQN

SEQ ID NO: 225035 - protein, 9 aa, Homo Sapiens
CLQAVFEAL

SEQ ID NO: 225036 - protein, 9 aa, Homo Sapiens
CGWPALPRA

SEQ ID NO: 225037 - protein, 9 aa, Homo Sapiens
PGEAGPGLR

SEQ ID NO: 225038 - protein, 9 aa, Homo Sapiens
VTVLDSAVY

SEQ ID NO: 225039 - protein, 9 aa, Homo Sapiens
LMIKKHRAA

SEQ ID NO: 225040 - protein, 9 aa, Homo Sapiens
LLLNFIWFL

SEQ ID NO: 225041 - protein, 9 aa, Homo Sapiens
GVKSENKQR

SEQ ID NO: 225042 - protein, 9 aa, Homo Sapiens
QTMLRYLKI

SEQ ID NO: 225043 - protein, 9 aa, Homo Sapiens
ILLVTLVMF

SEQ ID NO: 225044 - protein, 9 aa, Homo Sapiens
PLHVDASCG

SEQ ID NO: 225045 - protein, 9 aa, Homo Sapiens
DLKSAGASI

SEQ ID NO: 225046 - protein, 9 aa, Homo Sapiens
SVFDCSINS

SEQ ID NO: 225047 - protein, 9 aa, Homo Sapiens
QLWNQIQDA

SEQ ID NO: 225048 - protein, 9 aa, Homo Sapiens
CRRYWLDLK

SEQ ID NO: 225049 - protein, 9 aa, Homo Sapiens
AAEPPGSYA

SEQ ID NO: 225050 - protein, 9 aa, Homo Sapiens
DVVKQVQGL

SEQ ID NO: 225051 - protein, 9 aa, Homo Sapiens
RRELYKAHE

SEQ ID NO: 225052 - protein, 9 aa, Homo Sapiens
QRLAYLISA

SEQ ID NO: 225053 - protein, 9 aa, Homo Sapiens
IITVGEDGR

SEQ ID NO: 225054 - protein, 9 aa, Homo Sapiens
FVIFLESPN

SEQ ID NO: 225055 - protein, 9 aa, Homo Sapiens
SVCGQVLAG

SEQ ID NO: 225056 - protein, 9 aa, Homo Sapiens
PELGIKAGP

SEQ ID NO: 225057 - protein, 9 aa, Homo Sapiens
YRLRKSRPH

SEQ ID NO: 225058 - protein, 9 aa, Homo Sapiens
GPGRGYRAL

SEQ ID NO: 225059 - protein, 9 aa, Homo Sapiens
ILAKPECNI

SEQ ID NO: 225060 - protein, 9 aa, Homo Sapiens
HRALQHHSK

SEQ ID NO: 225061 - protein, 9 aa, Homo Sapiens
EAGEEAQAG

SEQ ID NO: 225062 - protein, 9 aa, Homo Sapiens
PGRTASATT

SEQ ID NO: 225063 - protein, 9 aa, Homo Sapiens
TCYSRMWAL

SEQ ID NO: 225064 - protein, 9 aa, Homo Sapiens
EPPRLLNLC

SEQ ID NO: 225065 - protein, 9 aa, Homo Sapiens
IPGWTNRPR

SEQ ID NO: 225066 - protein, 9 aa, Homo Sapiens
STGRNARNC

SEQ ID NO: 225067 - protein, 9 aa, Homo Sapiens
GPRGWPLYW

SEQ ID NO: 225068 - protein, 9 aa, Homo Sapiens
LVGCPVSAR

SEQ ID NO: 225069 - protein, 9 aa, Homo Sapiens
DFCDAPEAH

SEQ ID NO: 225070 - protein, 9 aa, Homo Sapiens
VGSAVWHTL

SEQ ID NO: 225071 - protein, 9 aa, Homo Sapiens
TWAWRAASC

SEQ ID NO: 225072 - protein, 9 aa, Homo Sapiens
FGAGSGIGC

SEQ ID NO: 225073 - protein, 9 aa, Homo Sapiens
PCQDLGIGQ

SEQ ID NO: 225074 - protein, 9 aa, Homo Sapiens
SVQRATALI

SEQ ID NO: 225075 - protein, 9 aa, Homo Sapiens
TECVRTALN

SEQ ID NO: 225076 - protein, 9 aa, Homo Sapiens
LNGQLMSTE

SEQ ID NO: 225077 - protein, 9 aa, Homo Sapiens
MKFKLLGDD

SEQ ID NO: 225078 - protein, 9 aa, Homo Sapiens
AAGCSWTCS

SEQ ID NO: 225079 - protein, 9 aa, Homo Sapiens
PPTCSFVQP

SEQ ID NO: 225080 - protein, 9 aa, Homo Sapiens
RAPCTSVTS

SEQ ID NO: 225081 - protein, 9 aa, Homo Sapiens
FKAEFVSLL

SEQ ID NO: 225082 - protein, 9 aa, Homo Sapiens
EKWLRRLER

SEQ ID NO: 225083 - protein, 9 aa, Homo Sapiens
TASRASQPS

SEQ ID NO: 225084 - protein, 9 aa, Homo Sapiens
MAAFNEQPI

SEQ ID NO: 225085 - protein, 9 aa, Homo Sapiens
KYAKCFENK

SEQ ID NO: 225086 - protein, 9 aa, Homo Sapiens
PLDRTFLQC

SEQ ID NO: 225087 - protein, 9 aa, Homo Sapiens
TVFLRCIAN

SEQ ID NO: 225088 - protein, 9 aa, Homo Sapiens
FVNGGELFS

SEQ ID NO: 225089 - protein, 9 aa, Homo Sapiens
APEAHVAVG

SEQ ID NO: 225090 - protein, 9 aa, Homo Sapiens
VWNASRPPQ

SEQ ID NO: 225091 - protein, 9 aa, Homo Sapiens
RGPAQRAEP

SEQ ID NO: 225092 - protein, 9 aa, Homo Sapiens
DEAVGCQEL

SEQ ID NO: 225093 - protein, 9 aa, Homo Sapiens
TLLDDIKML

SEQ ID NO: 225094 - protein, 9 aa, Homo Sapiens
TDNPVIPAD

SEQ ID NO: 225095 - protein, 9 aa, Homo Sapiens
IKEWHHIFY

SEQ ID NO: 225096 - protein, 9 aa, Homo Sapiens
GSGFGFCLA

SEQ ID NO: 225097 - protein, 9 aa, Homo Sapiens
EKTGMAVNK

SEQ ID NO: 225098 - protein, 9 aa, Homo Sapiens
HSATATLQV

SEQ ID NO: 225099 - protein, 9 aa, Homo Sapiens
LLQDLEKER

SEQ ID NO: 225100 - protein, 9 aa, Homo Sapiens
RVTARAGAS

SEQ ID NO: 225101 - protein, 9 aa, Homo Sapiens
KEKKEKRRE

SEQ ID NO: 225102 - protein, 9 aa, Homo Sapiens
CSEQTRLDL

SEQ ID NO: 225103 - protein, 9 aa, Homo Sapiens
LLIENICPS

SEQ ID NO: 225104 - protein, 9 aa, Homo Sapiens
AHEFGNQTL

SEQ ID NO: 225105 - protein, 9 aa, Homo Sapiens
KTKRNWTEG

SEQ ID NO: 225106 - protein, 9 aa, Homo Sapiens
SPVPRLPRA

SEQ ID NO: 225107 - protein, 9 aa, Homo Sapiens
FLAVGGPWA

SEQ ID NO: 225108 - protein, 9 aa, Homo Sapiens
THLPSAPAA

SEQ ID NO: 225109 - protein, 9 aa, Homo Sapiens
EPQQQRRAP

SEQ ID NO: 225110 - protein, 9 aa, Homo Sapiens
NLGKVFLPS

SEQ ID NO: 225111 - protein, 9 aa, Homo Sapiens
FSFFPASAV

SEQ ID NO: 225112 - protein, 9 aa, Homo Sapiens
DEQVHRHVD

SEQ ID NO: 225113 - protein, 9 aa, Homo Sapiens
THTKPCGLP

SEQ ID NO: 225114 - protein, 9 aa, Homo Sapiens
AVDCGNTEV

SEQ ID NO: 225115 - protein, 9 aa, Homo Sapiens
PAPPAALVS

SEQ ID NO: 225116 - protein, 9 aa, Homo Sapiens
RKGLSEDVI

SEQ ID NO: 225117 - protein, 9 aa, Homo Sapiens
QWKCCTEMQ

SEQ ID NO: 225118 - protein, 9 aa, Homo Sapiens
GPQRGQGLF

SEQ ID NO: 225119 - protein, 9 aa, Homo Sapiens
NPEEGGGPG

SEQ ID NO: 225120 - protein, 9 aa, Homo Sapiens
NLTTIYMLT

SEQ ID NO: 225121 - protein, 9 aa, Homo Sapiens
ACKRREQWL

SEQ ID NO: 225122 - protein, 9 aa, Homo Sapiens
TCIVNSENK

SEQ ID NO: 225123 - protein, 9 aa, Homo Sapiens
PAPTHLWWS

SEQ ID NO: 225124 - protein, 9 aa, Homo Sapiens
PRQLPQMSK

SEQ ID NO: 225125 - protein, 9 aa, Homo Sapiens
SCPPLLEAF

SEQ ID NO: 225126 - protein, 9 aa, Homo Sapiens
MSSGRISST

SEQ ID NO: 225127 - protein, 9 aa, Homo Sapiens
GSPQSRWLS

SEQ ID NO: 225128 - protein, 9 aa, Homo Sapiens
TSQSQLSSE

SEQ ID NO: 225129 - protein, 9 aa, Homo Sapiens
MFYEVWEKL

SEQ ID NO: 225130 - protein, 9 aa, Homo Sapiens
VIFLSVFKE

SEQ ID NO: 225131 - protein, 9 aa, Homo Sapiens
VLGAFLGLL

SEQ ID NO: 225132 - protein, 9 aa, Homo Sapiens
EITCPENSR

SEQ ID NO: 225133 - protein, 9 aa, Homo Sapiens
CHEEKIRKV

SEQ ID NO: 225134 - protein, 9 aa, Homo Sapiens
GCMSICGPQ

SEQ ID NO: 225135 - protein, 9 aa, Homo Sapiens
EMLNTEEAC

SEQ ID NO: 225136 - protein, 9 aa, Homo Sapiens
CESAIKQVV

SEQ ID NO: 225137 - protein, 9 aa, Homo Sapiens
MVPGETGLL

SEQ ID NO: 225138 - protein, 9 aa, Homo Sapiens
NQRLQHQSL

SEQ ID NO: 225139 - protein, 9 aa, Homo Sapiens
LRGKHAHRK

SEQ ID NO: 225140 - protein, 9 aa, Homo Sapiens
GALQGHGLL

SEQ ID NO: 225141 - protein, 9 aa, Homo Sapiens
TTTRMVLDS

SEQ ID NO: 225142 - protein, 9 aa, Homo Sapiens
RMIQMLRSE

SEQ ID NO: 225143 - protein, 9 aa, Homo Sapiens
GGGHTLAGQ

SEQ ID NO: 225144 - protein, 9 aa, Homo Sapiens
QTAICDPDC

SEQ ID NO: 225145 - protein, 9 aa, Homo Sapiens
GFPWQKKSL

SEQ ID NO: 225146 - protein, 9 aa, Homo Sapiens
KFLSKKGNF

SEQ ID NO: 225147 - protein, 9 aa, Homo Sapiens
LRRQTSIRY

SEQ ID NO: 225148 - protein, 9 aa, Homo Sapiens
CKGCLWALN

SEQ ID NO: 225149 - protein, 9 aa, Homo Sapiens
MERESLIRR

SEQ ID NO: 225150 - protein, 9 aa, Homo Sapiens
LQDLEKERK

SEQ ID NO: 225151 - protein, 9 aa, Homo Sapiens
DDEKMTGSQ

SEQ ID NO: 225152 - protein, 9 aa, Homo Sapiens
HLKKLSVPT

SEQ ID NO: 225153 - protein, 9 aa, Homo Sapiens
YGHHLVQRQ

SEQ ID NO: 225154 - protein, 9 aa, Homo Sapiens
NECGKVLIN

SEQ ID NO: 225155 - protein, 9 aa, Homo Sapiens
SKPVMESYT

SEQ ID NO: 225156 - protein, 9 aa, Homo Sapiens
QSGTKMKAT

SEQ ID NO: 225157 - protein, 9 aa, Homo Sapiens
QMERQCLAR

SEQ ID NO: 225158 - protein, 9 aa, Homo Sapiens
LHNWIDMKQ

SEQ ID NO: 225159 - protein, 9 aa, Homo Sapiens
DFFSRSHLD

SEQ ID NO: 225160 - protein, 9 aa, Homo Sapiens
PQLPTPPPG

SEQ ID NO: 225161 - protein, 9 aa, Homo Sapiens
LILVMLEIV

SEQ ID NO: 225162 - protein, 9 aa, Homo Sapiens
QEESRDGES

SEQ ID NO: 225163 - protein, 9 aa, Homo Sapiens
SERCHLWGS

SEQ ID NO: 225164 - protein, 9 aa, Homo Sapiens
TLSLMIRKQ

SEQ ID NO: 225165 - protein, 9 aa, Homo Sapiens
PPPANPQLL

SEQ ID NO: 225166 - protein, 9 aa, Homo Sapiens
RVTGHAMAA

SEQ ID NO: 225167 - protein, 9 aa, Homo Sapiens
FQVENRRLE

SEQ ID NO: 225168 - protein, 9 aa, Homo Sapiens
LCSTSAGKR

SEQ ID NO: 225169 - protein, 9 aa, Homo Sapiens
LSPLDSSPL

SEQ ID NO: 225170 - protein, 9 aa, Homo Sapiens
KAEPPKALE

SEQ ID NO: 225171 - protein, 9 aa, Homo Sapiens
PCGLSFNKG

SEQ ID NO: 225172 - protein, 9 aa, Homo Sapiens
PPAGAVVWP

SEQ ID NO: 225173 - protein, 9 aa, Homo Sapiens
NLQQLVSQR

SEQ ID NO: 225174 - protein, 9 aa, Homo Sapiens
ERGLGDVEQ

SEQ ID NO: 225175 - protein, 9 aa, Homo Sapiens
QKPPSPDIQ

SEQ ID NO: 225176 - protein, 9 aa, Homo Sapiens
LQEYQGAVP

SEQ ID NO: 225177 - protein, 9 aa, Homo Sapiens
FTNTVLYRG

SEQ ID NO: 225178 - protein, 9 aa, Homo Sapiens
EDPPELSQI

SEQ ID NO: 225179 - protein, 9 aa, Homo Sapiens
KDIGEFILE

SEQ ID NO: 225180 - protein, 9 aa, Homo Sapiens
VSADLKGGF

SEQ ID NO: 225181 - protein, 9 aa, Homo Sapiens
DAPEAHVAV

SEQ ID NO: 225182 - protein, 9 aa, Homo Sapiens
VTRWYRVPE

SEQ ID NO: 225183 - protein, 9 aa, Homo Sapiens
KLRCERVVE

SEQ ID NO: 225184 - protein, 9 aa, Homo Sapiens
YSPSDRQSC

SEQ ID NO: 225185 - protein, 9 aa, Homo Sapiens
HALCTLIKP

SEQ ID NO: 225186 - protein, 9 aa, Homo Sapiens
VKLHNRVVP

SEQ ID NO: 225187 - protein, 9 aa, Homo Sapiens
MRCLHLPPS

SEQ ID NO: 225188 - protein, 9 aa, Homo Sapiens
PPPPGWLPR

SEQ ID NO: 225189 - protein, 9 aa, Homo Sapiens
RPPSSCWSP

SEQ ID NO: 225190 - protein, 9 aa, Homo Sapiens
QSEMPARLV

SEQ ID NO: 225191 - protein, 9 aa, Homo Sapiens
MTTKLPLPA

SEQ ID NO: 225192 - protein, 9 aa, Homo Sapiens
VSENSLMAM

SEQ ID NO: 225193 - protein, 9 aa, Homo Sapiens
QKSWETECD

SEQ ID NO: 225194 - protein, 9 aa, Homo Sapiens
VHPRNGLHH

SEQ ID NO: 225195 - protein, 9 aa, Homo Sapiens
GLVIWEPMW

SEQ ID NO: 225196 - protein, 9 aa, Homo Sapiens
LPMASERGP

SEQ ID NO: 225197 - protein, 9 aa, Homo Sapiens
PWQPTRPFQ

SEQ ID NO: 225198 - protein, 9 aa, Homo Sapiens
TYSWQCIEC

SEQ ID NO: 225199 - protein, 9 aa, Homo Sapiens
NAAATGSSS

SEQ ID NO: 225200 - protein, 9 aa, Homo Sapiens
VWHTLGHAI

SEQ ID NO: 225201 - protein, 9 aa, Homo Sapiens
EGAVAHTQD

SEQ ID NO: 225202 - protein, 9 aa, Homo Sapiens
GQPIPFQQP

SEQ ID NO: 225203 - protein, 9 aa, Homo Sapiens
EGAAEPPGS

SEQ ID NO: 225204 - protein, 9 aa, Homo Sapiens
QVLSRSSPK

SEQ ID NO: 225205 - protein, 9 aa, Homo Sapiens
AHKPCAEVI

SEQ ID NO: 225206 - protein, 9 aa, Homo Sapiens
GNKKFFGGK

SEQ ID NO: 225207 - protein, 9 aa, Homo Sapiens
RARLALLVY

SEQ ID NO: 225208 - protein, 9 aa, Homo Sapiens
NIEEYCRNS

SEQ ID NO: 225209 - protein, 9 aa, Homo Sapiens
KVNGLLKVA

SEQ ID NO: 225210 - protein, 9 aa, Homo Sapiens
DLDNIADNP

SEQ ID NO: 225211 - protein, 9 aa, Homo Sapiens
VARIPLPQR

SEQ ID NO: 225212 - protein, 9 aa, Homo Sapiens
PLALPASMR

SEQ ID NO: 225213 - protein, 9 aa, Homo Sapiens
ILILRLPFC

SEQ ID NO: 225214 - protein, 9 aa, Homo Sapiens
IPDCRGPNG

SEQ ID NO: 225215 - protein, 9 aa, Homo Sapiens
EDLIKVSDR

SEQ ID NO: 225216 - protein, 9 aa, Homo Sapiens
GAEEVGVVA

SEQ ID NO: 225217 - protein, 9 aa, Homo Sapiens
RCITDSRRT

SEQ ID NO: 225218 - protein, 9 aa, Homo Sapiens
KTLLDDIKM

SEQ ID NO: 225219 - protein, 9 aa, Homo Sapiens
CPAPWWSQP

SEQ ID NO: 225220 - protein, 9 aa, Homo Sapiens
ELSRKVTEL

SEQ ID NO: 225221 - protein, 9 aa, Homo Sapiens
ALCVSRFWG

SEQ ID NO: 225222 - protein, 9 aa, Homo Sapiens
HSANIQQAR

SEQ ID NO: 225223 - protein, 9 aa, Homo Sapiens
DCLDHTNVV

SEQ ID NO: 225224 - protein, 9 aa, Homo Sapiens
GAVPCQDLG

SEQ ID NO: 225225 - protein, 9 aa, Homo Sapiens
FSAITKRAE

SEQ ID NO: 225226 - protein, 9 aa, Homo Sapiens
LCQGPLGFF

SEQ ID NO: 225227 - protein, 9 aa, Homo Sapiens
AWRAASCRP

SEQ ID NO: 225228 - protein, 9 aa, Homo Sapiens
ARNPTSLTG

SEQ ID NO: 225229 - protein, 9 aa, Homo Sapiens
PNVGVTLDG

SEQ ID NO: 225230 - protein, 9 aa, Homo Sapiens
IENICPSDS

SEQ ID NO: 225231 - protein, 9 aa, Homo Sapiens
RKEGKLFPP

SEQ ID NO: 225232 - protein, 9 aa, Homo Sapiens
YSRMWALSQ

SEQ ID NO: 225233 - protein, 9 aa, Homo Sapiens
REKGGEQAQ

SEQ ID NO: 225234 - protein, 9 aa, Homo Sapiens
LADPVAPTP

SEQ ID NO: 225235 - protein, 9 aa, Homo Sapiens
RHPFLLLDT

SEQ ID NO: 225236 - protein, 9 aa, Homo Sapiens
RVNSDLEVA

SEQ ID NO: 225237 - protein, 9 aa, Homo Sapiens
FWILVSMTV

SEQ ID NO: 225238 - protein, 9 aa, Homo Sapiens
VREENVPKD

SEQ ID NO: 225239 - protein, 9 aa, Homo Sapiens
FKEVQSGGL

SEQ ID NO: 225240 - protein, 9 aa, Homo Sapiens
IPPEPPSRK

SEQ ID NO: 225241 - protein, 9 aa, Homo Sapiens
QSVVSESLL

SEQ ID NO: 225242 - protein, 9 aa, Homo Sapiens
GRASRKTWQ

SEQ ID NO: 225243 - protein, 9 aa, Homo Sapiens
PFGASLDPI

SEQ ID NO: 225244 - protein, 9 aa, Homo Sapiens
ERSYICIER

SEQ ID NO: 225245 - protein, 9 aa, Homo Sapiens
RHIQVTLRK

SEQ ID NO: 225246 - protein, 9 aa, Homo Sapiens
QPPPTRPRR

SEQ ID NO: 225247 - protein, 9 aa, Homo Sapiens
SRSTRTSAT

SEQ ID NO: 225248 - protein, 9 aa, Homo Sapiens
GKNWVYSHN

SEQ ID NO: 225249 - protein, 9 aa, Homo Sapiens
AVAFQILAK

SEQ ID NO: 225250 - protein, 9 aa, Homo Sapiens
MKYCHIKHA

SEQ ID NO: 225251 - protein, 9 aa, Homo Sapiens
TTSPKGEVV

SEQ ID NO: 225252 - protein, 9 aa, Homo Sapiens
VYCLQTPRG

SEQ ID NO: 225253 - protein, 9 aa, Homo Sapiens
LLGVTLTFR

SEQ ID NO: 225254 - protein, 9 aa, Homo Sapiens
RERRGTTLR

SEQ ID NO: 225255 - protein, 9 aa, Homo Sapiens
DNLEKNSGS

SEQ ID NO: 225256 - protein, 9 aa, Homo Sapiens
RSWGCTTGC

SEQ ID NO: 225257 - protein, 9 aa, Homo Sapiens
RSIGTAKLR

SEQ ID NO: 225258 - protein, 9 aa, Homo Sapiens
GVQEAERRQ

SEQ ID NO: 225259 - protein, 9 aa, Homo Sapiens
ELLGGHDSP

SEQ ID NO: 225260 - protein, 9 aa, Homo Sapiens
LLILDPPKS

SEQ ID NO: 225261 - protein, 9 aa, Homo Sapiens
QDGTTQGNR

SEQ ID NO: 225262 - protein, 9 aa, Homo Sapiens
MVGAGELSS

SEQ ID NO: 225263 - protein, 9 aa, Homo Sapiens
TLEVLRGIA

SEQ ID NO: 225264 - protein, 9 aa, Homo Sapiens
LYVRPIFLR

SEQ ID NO: 225265 - protein, 9 aa, Homo Sapiens
WHLCMGLKS

SEQ ID NO: 225266 - protein, 9 aa, Homo Sapiens
PSTMCPAPW

SEQ ID NO: 225267 - protein, 9 aa, Homo Sapiens
AARETRSGR

SEQ ID NO: 225268 - protein, 9 aa, Homo Sapiens
PLGNLSPGV

SEQ ID NO: 225269 - protein, 9 aa, Homo Sapiens
HKIKHSDNA

SEQ ID NO: 225270 - protein, 9 aa, Homo Sapiens
GWPGGRRTI

SEQ ID NO: 225271 - protein, 9 aa, Homo Sapiens
RSEAEEAIK

SEQ ID NO: 225272 - protein, 9 aa, Homo Sapiens
LAEAMCVGH

SEQ ID NO: 225273 - protein, 9 aa, Homo Sapiens
STRHCARQL

SEQ ID NO: 225274 - protein, 9 aa, Homo Sapiens
LHPQLPTPP

SEQ ID NO: 225275 - protein, 9 aa, Homo Sapiens
LLRHLDFKV

SEQ ID NO: 225276 - protein, 9 aa, Homo Sapiens
QWIAIARAL

SEQ ID NO: 225277 - protein, 9 aa, Homo Sapiens
VNDNTDPAP

SEQ ID NO: 225278 - protein, 9 aa, Homo Sapiens
LYHSEEEEE

SEQ ID NO: 225279 - protein, 9 aa, Homo Sapiens
TSGADAIER

SEQ ID NO: 225280 - protein, 9 aa, Homo Sapiens
SQRMSGEGR

SEQ ID NO: 225281 - protein, 9 aa, Homo Sapiens
PRARRGEPV

SEQ ID NO: 225282 - protein, 9 aa, Homo Sapiens
MTHEHLAMT

SEQ ID NO: 225283 - protein, 9 aa, Homo Sapiens
INRMIQMLR

SEQ ID NO: 225284 - protein, 9 aa, Homo Sapiens
SHQRKLRAC

SEQ ID NO: 225285 - protein, 9 aa, Homo Sapiens
LFEAWLLLL

SEQ ID NO: 225286 - protein, 9 aa, Homo Sapiens
LGLLADVLP

SEQ ID NO: 225287 - protein, 9 aa, Homo Sapiens
GDNKTNQPI

SEQ ID NO: 225288 - protein, 9 aa, Homo Sapiens
MKETTKRVH

SEQ ID NO: 225289 - protein, 9 aa, Homo Sapiens
DPSLSVTLV

SEQ ID NO: 225290 - protein, 9 aa, Homo Sapiens
TAPSVWNAS

SEQ ID NO: 225291 - protein, 9 aa, Homo Sapiens
GDMMGTGPP

SEQ ID NO: 225292 - protein, 9 aa, Homo Sapiens
LYGKKLVKI

SEQ ID NO: 225293 - protein, 9 aa, Homo Sapiens
LLGKSDVSD

SEQ ID NO: 225294 - protein, 9 aa, Homo Sapiens
VFLLFSSAS

SEQ ID NO: 225295 - protein, 9 aa, Homo Sapiens
ESKDWEQAK

SEQ ID NO: 225296 - protein, 9 aa, Homo Sapiens
VDVNCAIAH

SEQ ID NO: 225297 - protein, 9 aa, Homo Sapiens
ANTTLCQGP

SEQ ID NO: 225298 - protein, 9 aa, Homo Sapiens
SRGLGRPPR

SEQ ID NO: 225299 - protein, 9 aa, Homo Sapiens
PGNKLELYE

SEQ ID NO: 225300 - protein, 9 aa, Homo Sapiens
RVGNGLLMT

SEQ ID NO: 225301 - protein, 9 aa, Homo Sapiens
VAHMDERRE

SEQ ID NO: 225302 - protein, 9 aa, Homo Sapiens
PTLRPRSHY

SEQ ID NO: 225303 - protein, 9 aa, Homo Sapiens
VDLNDQDRR

SEQ ID NO: 225304 - protein, 9 aa, Homo Sapiens
QSLPSLGFP

SEQ ID NO: 225305 - protein, 9 aa, Homo Sapiens
VECQSKGKI

SEQ ID NO: 225306 - protein, 9 aa, Homo Sapiens
RVGRGGGGR

SEQ ID NO: 225307 - protein, 9 aa, Homo Sapiens
NDFLVSQHP

SEQ ID NO: 225308 - protein, 9 aa, Homo Sapiens
CGAILVALA

SEQ ID NO: 225309 - protein, 9 aa, Homo Sapiens
EYQRMTVRD

SEQ ID NO: 225310 - protein, 9 aa, Homo Sapiens
PCSQRLWQS

SEQ ID NO: 225311 - protein, 9 aa, Homo Sapiens
AGELSSEVE

SEQ ID NO: 225312 - protein, 9 aa, Homo Sapiens
PALPGPGVH

SEQ ID NO: 225313 - protein, 9 aa, Homo Sapiens
LRQDRVQVH

SEQ ID NO: 225314 - protein, 9 aa, Homo Sapiens
HCSWGLPRL

SEQ ID NO: 225315 - protein, 9 aa, Homo Sapiens
PLQRGPAGP

SEQ ID NO: 225316 - protein, 9 aa, Homo Sapiens
EGRPQNMSV

SEQ ID NO: 225317 - protein, 9 aa, Homo Sapiens
NLAQIFLEG

SEQ ID NO: 225318 - protein, 9 aa, Homo Sapiens
SASVSFTYS

SEQ ID NO: 225319 - protein, 9 aa, Homo Sapiens
MSHSHLRYK

SEQ ID NO: 225320 - protein, 9 aa, Homo Sapiens
CPPDGCYQY

SEQ ID NO: 225321 - protein, 9 aa, Homo Sapiens
VPLPPPQSS

SEQ ID NO: 225322 - protein, 9 aa, Homo Sapiens
AYTLLVQLR

SEQ ID NO: 225323 - protein, 9 aa, Homo Sapiens
KGLLTKVNM

SEQ ID NO: 225324 - protein, 9 aa, Homo Sapiens
CCLRPVCGQ

SEQ ID NO: 225325 - protein, 9 aa, Homo Sapiens
ICRGAQNME

SEQ ID NO: 225326 - protein, 9 aa, Homo Sapiens
HQNHGSSSN

SEQ ID NO: 225327 - protein, 9 aa, Homo Sapiens
RLGRALKKR

SEQ ID NO: 225328 - protein, 9 aa, Homo Sapiens
TEGSQKCVA

SEQ ID NO: 225329 - protein, 9 aa, Homo Sapiens
FAIFLIMLL

SEQ ID NO: 225330 - protein, 9 aa, Homo Sapiens
QRTERPGAT

SEQ ID NO: 225331 - protein, 9 aa, Homo Sapiens
LKLAPLQVT

SEQ ID NO: 225332 - protein, 9 aa, Homo Sapiens
STVAQTPSP

SEQ ID NO: 225333 - protein, 9 aa, Homo Sapiens
QGTVAGYDM

SEQ ID NO: 225334 - protein, 9 aa, Homo Sapiens
FALRAKLLL

SEQ ID NO: 225335 - protein, 9 aa, Homo Sapiens
FIHMTFKEF

SEQ ID NO: 225336 - protein, 9 aa, Homo Sapiens
LLPPAPKWR

SEQ ID NO: 225337 - protein, 9 aa, Homo Sapiens
ARLAADDFS

SEQ ID NO: 225338 - protein, 9 aa, Homo Sapiens
AIRLHIVEL

SEQ ID NO: 225339 - protein, 9 aa, Homo Sapiens
GMLKSLHQF

SEQ ID NO: 225340 - protein, 9 aa, Homo Sapiens
GVVAAMEET

SEQ ID NO: 225341 - protein, 9 aa, Homo Sapiens
KMTLKALVK

SEQ ID NO: 225342 - protein, 9 aa, Homo Sapiens
SSTPSRLAL

SEQ ID NO: 225343 - protein, 9 aa, Homo Sapiens
VPVFGWVMF

SEQ ID NO: 225344 - protein, 9 aa, Homo Sapiens
ILSPMASEV

SEQ ID NO: 225345 - protein, 9 aa, Homo Sapiens
GHLGLFLLH

SEQ ID NO: 225346 - protein, 9 aa, Homo Sapiens
FAKLHHSRS

SEQ ID NO: 225347 - protein, 9 aa, Homo Sapiens
NSPGRGGGG

SEQ ID NO: 225348 - protein, 9 aa, Homo Sapiens
CPQCPGLKV

SEQ ID NO: 225349 - protein, 9 aa, Homo Sapiens
KTFKKDRLS

SEQ ID NO: 225350 - protein, 9 aa, Homo Sapiens
YPSEKSNKK

SEQ ID NO: 225351 - protein, 9 aa, Homo Sapiens
FRAGKLEVD

SEQ ID NO: 225352 - protein, 9 aa, Homo Sapiens
ARSLPRPER

SEQ ID NO: 225353 - protein, 9 aa, Homo Sapiens
PRRQRSSTT

SEQ ID NO: 225354 - protein, 9 aa, Homo Sapiens
SPEDRVKCF

SEQ ID NO: 225355 - protein, 9 aa, Homo Sapiens
PIPKEEHHT

SEQ ID NO: 225356 - protein, 9 aa, Homo Sapiens
LVIGLHGDS

SEQ ID NO: 225357 - protein, 9 aa, Homo Sapiens
LNSLDVKPM

SEQ ID NO: 225358 - protein, 9 aa, Homo Sapiens
TVDHGMEPG

SEQ ID NO: 225359 - protein, 9 aa, Homo Sapiens
NDIKVLGCP

SEQ ID NO: 225360 - protein, 9 aa, Homo Sapiens
IKLHKSMWK

SEQ ID NO: 225361 - protein, 9 aa, Homo Sapiens
GGQERQGNK

SEQ ID NO: 225362 - protein, 9 aa, Homo Sapiens
HPPEAKLLV

SEQ ID NO: 225363 - protein, 9 aa, Homo Sapiens
EITSKGTSL

SEQ ID NO: 225364 - protein, 9 aa, Homo Sapiens
FMPCTIWSF

SEQ ID NO: 225365 - protein, 9 aa, Homo Sapiens
IRGQGSRVE

SEQ ID NO: 225366 - protein, 9 aa, Homo Sapiens
FWMAMFQQK

SEQ ID NO: 225367 - protein, 9 aa, Homo Sapiens
EAVREENVP

SEQ ID NO: 225368 - protein, 9 aa, Homo Sapiens
MMRRRRRDG

SEQ ID NO: 225369 - protein, 9 aa, Homo Sapiens
KFVENTWNP

SEQ ID NO: 225370 - protein, 9 aa, Homo Sapiens
PRPWMSPAT

SEQ ID NO: 225371 - protein, 9 aa, Homo Sapiens
KSHLLEFQT

SEQ ID NO: 225372 - protein, 9 aa, Homo Sapiens
PLLLLLLIV

SEQ ID NO: 225373 - protein, 9 aa, Homo Sapiens
LFPPMEFPA

SEQ ID NO: 225374 - protein, 9 aa, Homo Sapiens
HLWGSYTLR

SEQ ID NO: 225375 - protein, 9 aa, Homo Sapiens
SESLPKETF

SEQ ID NO: 225376 - protein, 9 aa, Homo Sapiens
RKLFESVEC

SEQ ID NO: 225377 - protein, 9 aa, Homo Sapiens
KTINMLQIE

SEQ ID NO: 225378 - protein, 9 aa, Homo Sapiens
VLQERLDAT

SEQ ID NO: 225379 - protein, 9 aa, Homo Sapiens
VSEGTKTVT

SEQ ID NO: 225380 - protein, 9 aa, Homo Sapiens
LMQEQLQDL

SEQ ID NO: 225381 - protein, 9 aa, Homo Sapiens
HHPSQLCAG

SEQ ID NO: 225382 - protein, 9 aa, Homo Sapiens
TLAVLHTER

SEQ ID NO: 225383 - protein, 9 aa, Homo Sapiens
WLSHRLRLR

SEQ ID NO: 225384 - protein, 9 aa, Homo Sapiens
ATHNKNSNK

SEQ ID NO: 225385 - protein, 9 aa, Homo Sapiens
RRERSWAAS

SEQ ID NO: 225386 - protein, 9 aa, Homo Sapiens
KLRPETRKR

SEQ ID NO: 225387 - protein, 9 aa, Homo Sapiens
LEEFRATPF

SEQ ID NO: 225388 - protein, 9 aa, Homo Sapiens
CGVAYRLPV

SEQ ID NO: 225389 - protein, 9 aa, Homo Sapiens
GYPNMNQGD

SEQ ID NO: 225390 - protein, 9 aa, Homo Sapiens
STAKGPPPP

SEQ ID NO: 225391 - protein, 9 aa, Homo Sapiens
GPSRCRQRC

SEQ ID NO: 225392 - protein, 9 aa, Homo Sapiens
LHLRRSLSP

SEQ ID NO: 225393 - protein, 9 aa, Homo Sapiens
LIEAGKEVE

SEQ ID NO: 225394 - protein, 9 aa, Homo Sapiens
QIHSIPCLG

SEQ ID NO: 225395 - protein, 9 aa, Homo Sapiens
ERVLTTRPS

SEQ ID NO: 225396 - protein, 9 aa, Homo Sapiens
LEKNSGSQS

SEQ ID NO: 225397 - protein, 9 aa, Homo Sapiens
VVGSSGICF

SEQ ID NO: 225398 - protein, 9 aa, Homo Sapiens
HFVYVEPRE

SEQ ID NO: 225399 - protein, 9 aa, Homo Sapiens
TAAGAAYAQ

SEQ ID NO: 225400 - protein, 9 aa, Homo Sapiens
FPMPQLDPG

SEQ ID NO: 225401 - protein, 9 aa, Homo Sapiens
KRNWTEGCG

SEQ ID NO: 225402 - protein, 9 aa, Homo Sapiens
MQLMEKLCH

SEQ ID NO: 225403 - protein, 9 aa, Homo Sapiens
QIGKILKVN

SEQ ID NO: 225404 - protein, 9 aa, Homo Sapiens
PQQRNWLTV

SEQ ID NO: 225405 - protein, 9 aa, Homo Sapiens
QSVLLLGVP

SEQ ID NO: 225406 - protein, 9 aa, Homo Sapiens
APVGLRGFG

SEQ ID NO: 225407 - protein, 9 aa, Homo Sapiens
SPSDRQSCP

SEQ ID NO: 225408 - protein, 9 aa, Homo Sapiens
IACLPLITN

SEQ ID NO: 225409 - protein, 9 aa, Homo Sapiens
KVLPDAPTG

SEQ ID NO: 225410 - protein, 9 aa, Homo Sapiens
LGVRHTVIE

SEQ ID NO: 225411 - protein, 9 aa, Homo Sapiens
YCKKQCRRM

SEQ ID NO: 225412 - protein, 9 aa, Homo Sapiens
GAETVHYIG

SEQ ID NO: 225413 - protein, 9 aa, Homo Sapiens
RFSATDSVA

SEQ ID NO: 225414 - protein, 9 aa, Homo Sapiens
PNTHPSPLA

SEQ ID NO: 225415 - protein, 9 aa, Homo Sapiens
KHKIKHSDN

SEQ ID NO: 225416 - protein, 9 aa, Homo Sapiens
TMMEKRKMT

SEQ ID NO: 225417 - protein, 9 aa, Homo Sapiens
FLRPLHSHL

SEQ ID NO: 225418 - protein, 9 aa, Homo Sapiens
NVMSQNPYN

SEQ ID NO: 225419 - protein, 9 aa, Homo Sapiens
RREGVKSEN

SEQ ID NO: 225420 - protein, 9 aa, Homo Sapiens
QRGPAGPGK

SEQ ID NO: 225421 - protein, 9 aa, Homo Sapiens
GTSRRSGCV

SEQ ID NO: 225422 - protein, 9 aa, Homo Sapiens
GVVTDLFPV

SEQ ID NO: 225423 - protein, 9 aa, Homo Sapiens
QLGAEVPQG

SEQ ID NO: 225424 - protein, 9 aa, Homo Sapiens
AETKLNDVL

SEQ ID NO: 225425 - protein, 9 aa, Homo Sapiens
RRPSHSPPS

SEQ ID NO: 225426 - protein, 9 aa, Homo Sapiens
CLRPVCGQV

SEQ ID NO: 225427 - protein, 9 aa, Homo Sapiens
EPSGPTCEN

SEQ ID NO: 225428 - protein, 9 aa, Homo Sapiens
AVAVDLVHG

SEQ ID NO: 225429 - protein, 9 aa, Homo Sapiens
DSQWPPCAA

SEQ ID NO: 225430 - protein, 9 aa, Homo Sapiens
RPIRHHNSL

SEQ ID NO: 225431 - protein, 9 aa, Homo Sapiens
KKRDLLGPL

SEQ ID NO: 225432 - protein, 9 aa, Homo Sapiens
IGDGDIFKK

SEQ ID NO: 225433 - protein, 9 aa, Homo Sapiens
RSWRMTWST

SEQ ID NO: 225434 - protein, 9 aa, Homo Sapiens
PMGQTQPGE

SEQ ID NO: 225435 - protein, 9 aa, Homo Sapiens
RRPRCSSSS

SEQ ID NO: 225436 - protein, 9 aa, Homo Sapiens
IEGANNTGN

SEQ ID NO: 225437 - protein, 9 aa, Homo Sapiens
SNCQTAICD

SEQ ID NO: 225438 - protein, 9 aa, Homo Sapiens
AFPLPRASL

SEQ ID NO: 225439 - protein, 9 aa, Homo Sapiens
PRRKPRPLP

SEQ ID NO: 225440 - protein, 9 aa, Homo Sapiens
ERSETSSIP

SEQ ID NO: 225441 - protein, 9 aa, Homo Sapiens
NRGSGSRPG

SEQ ID NO: 225442 - protein, 9 aa, Homo Sapiens
CLPPEPGDP

SEQ ID NO: 225443 - protein, 9 aa, Homo Sapiens
SPLRDMFPC

SEQ ID NO: 225444 - protein, 9 aa, Homo Sapiens
LCSLQHQEK

SEQ ID NO: 225445 - protein, 9 aa, Homo Sapiens
LTTTEQSHL

SEQ ID NO: 225446 - protein, 9 aa, Homo Sapiens
HARARASYS

SEQ ID NO: 225447 - protein, 9 aa, Homo Sapiens
CALATKDMR

SEQ ID NO: 225448 - protein, 9 aa, Homo Sapiens
LFNRGKWVN

SEQ ID NO: 225449 - protein, 9 aa, Homo Sapiens
PQSPPRTAR

SEQ ID NO: 225450 - protein, 9 aa, Homo Sapiens
ARKKLEMGL

SEQ ID NO: 225451 - protein, 9 aa, Homo Sapiens
AGPHAPCRA

SEQ ID NO: 225452 - protein, 9 aa, Homo Sapiens
IPMKFKLLG

SEQ ID NO: 225453 - protein, 9 aa, Homo Sapiens
CETKHTEEL

SEQ ID NO: 225454 - protein, 9 aa, Homo Sapiens
LIKCVQVSQ

SEQ ID NO: 225455 - protein, 9 aa, Homo Sapiens
HSFRVSWTP

SEQ ID NO: 225456 - protein, 9 aa, Homo Sapiens
QATAGGRGC

SEQ ID NO: 225457 - protein, 9 aa, Homo Sapiens
DFCPMDHKP

SEQ ID NO: 225458 - protein, 9 aa, Homo Sapiens
TSQESTMEC

SEQ ID NO: 225459 - protein, 9 aa, Homo Sapiens
FYKEEKKCY

SEQ ID NO: 225460 - protein, 9 aa, Homo Sapiens
WASSATAAT

SEQ ID NO: 225461 - protein, 9 aa, Homo Sapiens
KTLTWHSTK

SEQ ID NO: 225462 - protein, 9 aa, Homo Sapiens
RRRSRKASG

SEQ ID NO: 225463 - protein, 9 aa, Homo Sapiens
DLARGLKRS

SEQ ID NO: 225464 - protein, 9 aa, Homo Sapiens
FLTEDKKNG

SEQ ID NO: 225465 - protein, 9 aa, Homo Sapiens
SEALGKEVA

SEQ ID NO: 225466 - protein, 9 aa, Homo Sapiens
RVASRVWPS

SEQ ID NO: 225467 - protein, 9 aa, Homo Sapiens
IGKNRMFEV

SEQ ID NO: 225468 - protein, 9 aa, Homo Sapiens
AQENIVGIP

SEQ ID NO: 225469 - protein, 9 aa, Homo Sapiens
PSPCTPRAA

SEQ ID NO: 225470 - protein, 9 aa, Homo Sapiens
PLCSTMWSA

SEQ ID NO: 225471 - protein, 9 aa, Homo Sapiens
ALESAQFLL

SEQ ID NO: 225472 - protein, 9 aa, Homo Sapiens
YRQPVDSTS

SEQ ID NO: 225473 - protein, 9 aa, Homo Sapiens
HYHFRAPSR

SEQ ID NO: 225474 - protein, 9 aa, Homo Sapiens
WSIITGERN

SEQ ID NO: 225475 - protein, 9 aa, Homo Sapiens
PYECKECVK

SEQ ID NO: 225476 - protein, 9 aa, Homo Sapiens
VLLWRLRGG

SEQ ID NO: 225477 - protein, 9 aa, Homo Sapiens
TLSLSGGAW

SEQ ID NO: 225478 - protein, 9 aa, Homo Sapiens
EARGALQNQ

SEQ ID NO: 225479 - protein, 9 aa, Homo Sapiens
TIWDILPDT

SEQ ID NO: 225480 - protein, 9 aa, Homo Sapiens
ERVVEELES

SEQ ID NO: 225481 - protein, 9 aa, Homo Sapiens
LTTTSSTGT

SEQ ID NO: 225482 - protein, 9 aa, Homo Sapiens
LCMSLQEKL

SEQ ID NO: 225483 - protein, 9 aa, Homo Sapiens
SRWQCDYDN

SEQ ID NO: 225484 - protein, 9 aa, Homo Sapiens
NHHQQMGYP

SEQ ID NO: 225485 - protein, 9 aa, Homo Sapiens
ECWIFIPRS

SEQ ID NO: 225486 - protein, 9 aa, Homo Sapiens
SAFCSGCLS

SEQ ID NO: 225487 - protein, 9 aa, Homo Sapiens
LLLELDHHF

SEQ ID NO: 225488 - protein, 9 aa, Homo Sapiens
PRPPGASSG

SEQ ID NO: 225489 - protein, 9 aa, Homo Sapiens
ASLTLGLEL

SEQ ID NO: 225490 - protein, 9 aa, Homo Sapiens
AFLGLLMVL

SEQ ID NO: 225491 - protein, 9 aa, Homo Sapiens
EEHWGAAEE

SEQ ID NO: 225492 - protein, 9 aa, Homo Sapiens
PNALFPPME

SEQ ID NO: 225493 - protein, 9 aa, Homo Sapiens
LAAGPTSSP

SEQ ID NO: 225494 - protein, 9 aa, Homo Sapiens
LAPSYPAGS

SEQ ID NO: 225495 - protein, 9 aa, Homo Sapiens
PKLGVAPSS

SEQ ID NO: 225496 - protein, 9 aa, Homo Sapiens
MNANHVFFL

SEQ ID NO: 225497 - protein, 9 aa, Homo Sapiens
GCALPAAAW

SEQ ID NO: 225498 - protein, 9 aa, Homo Sapiens
VTLTQGPSS

SEQ ID NO: 225499 - protein, 9 aa, Homo Sapiens
VPTPLVAIM

SEQ ID NO: 225500 - protein, 9 aa, Homo Sapiens
RSGQGSNRG

SEQ ID NO: 225501 - protein, 9 aa, Homo Sapiens
GETGLLPEC

SEQ ID NO: 225502 - protein, 9 aa, Homo Sapiens
ELFSTFVEL

SEQ ID NO: 225503 - protein, 9 aa, Homo Sapiens
APGGRARPR

SEQ ID NO: 225504 - protein, 9 aa, Homo Sapiens
AVAQVESEV

SEQ ID NO: 225505 - protein, 9 aa, Homo Sapiens
TAATASTSP

SEQ ID NO: 225506 - protein, 9 aa, Homo Sapiens
LRPVCGQVS

SEQ ID NO: 225507 - protein, 9 aa, Homo Sapiens
SKELRPVMD

SEQ ID NO: 225508 - protein, 9 aa, Homo Sapiens
YDSTLEVLR

SEQ ID NO: 225509 - protein, 9 aa, Homo Sapiens
LNQIMKRMC

SEQ ID NO: 225510 - protein, 9 aa, Homo Sapiens
YGVYREQPL

SEQ ID NO: 225511 - protein, 9 aa, Homo Sapiens
HCARQLATR

SEQ ID NO: 225512 - protein, 9 aa, Homo Sapiens
GWGCVPFCG

SEQ ID NO: 225513 - protein, 9 aa, Homo Sapiens
AHRGDAGPG

SEQ ID NO: 225514 - protein, 9 aa, Homo Sapiens
WDEYAKHIK

SEQ ID NO: 225515 - protein, 9 aa, Homo Sapiens
FKHKIKHSD

SEQ ID NO: 225516 - protein, 9 aa, Homo Sapiens
DEFLMGGMS

SEQ ID NO: 225517 - protein, 9 aa, Homo Sapiens
AITVVGVLI

SEQ ID NO: 225518 - protein, 9 aa, Homo Sapiens
WSKIYSCHC

SEQ ID NO: 225519 - protein, 9 aa, Homo Sapiens
GGGDANLDR

SEQ ID NO: 225520 - protein, 9 aa, Homo Sapiens
CFQDGRLGK

SEQ ID NO: 225521 - protein, 9 aa, Homo Sapiens
STSSSLTPL

SEQ ID NO: 225522 - protein, 9 aa, Homo Sapiens
EPGPPGPQD

SEQ ID NO: 225523 - protein, 9 aa, Homo Sapiens
HGHLDSPTF

SEQ ID NO: 225524 - protein, 9 aa, Homo Sapiens
GSDGVIMTG

SEQ ID NO: 225525 - protein, 9 aa, Homo Sapiens
LCHFILFFI

SEQ ID NO: 225526 - protein, 9 aa, Homo Sapiens
YSPLRAYRT

SEQ ID NO: 225527 - protein, 9 aa, Homo Sapiens
SWQCIECKC

SEQ ID NO: 225528 - protein, 9 aa, Homo Sapiens
LKGSVQQAP

SEQ ID NO: 225529 - protein, 9 aa, Homo Sapiens
SGSALAFSA

SEQ ID NO: 225530 - protein, 9 aa, Homo Sapiens
SGMVESYTA

SEQ ID NO: 225531 - protein, 9 aa, Homo Sapiens
PCRLRMLLV

SEQ ID NO: 225532 - protein, 9 aa, Homo Sapiens
PVLLKKKLE

SEQ ID NO: 225533 - protein, 9 aa, Homo Sapiens
KNDPFLMGI

SEQ ID NO: 225534 - protein, 9 aa, Homo Sapiens
HSWSWPMTI

SEQ ID NO: 225535 - protein, 9 aa, Homo Sapiens
DNKHPMYRS

SEQ ID NO: 225536 - protein, 9 aa, Homo Sapiens
PGGCGWASM

SEQ ID NO: 225537 - protein, 9 aa, Homo Sapiens
TSSSLTPLT

SEQ ID NO: 225538 - protein, 9 aa, Homo Sapiens
EGSPGSRRG

SEQ ID NO: 225539 - protein, 9 aa, Homo Sapiens
RQANIITGA

SEQ ID NO: 225540 - protein, 9 aa, Homo Sapiens
PPSPASDAD

SEQ ID NO: 225541 - protein, 9 aa, Homo Sapiens
QCLAREKQM

SEQ ID NO: 225542 - protein, 9 aa, Homo Sapiens
MLCVEDPLL

SEQ ID NO: 225543 - protein, 9 aa, Homo Sapiens
QQAGWQPEE

SEQ ID NO: 225544 - protein, 9 aa, Homo Sapiens
VTEPPVTNP

SEQ ID NO: 225545 - protein, 9 aa, Homo Sapiens
FTLERNLTS

SEQ ID NO: 225546 - protein, 9 aa, Homo Sapiens
FSPLKKVWN

SEQ ID NO: 225547 - protein, 9 aa, Homo Sapiens
ASDADSWGS

SEQ ID NO: 225548 - protein, 9 aa, Homo Sapiens
YLEQKYVQL

SEQ ID NO: 225549 - protein, 9 aa, Homo Sapiens
RAVGTQISI

SEQ ID NO: 225550 - protein, 9 aa, Homo Sapiens
GLWTLLGDP

SEQ ID NO: 225551 - protein, 9 aa, Homo Sapiens
RRLAATTLA

SEQ ID NO: 225552 - protein, 9 aa, Homo Sapiens
FSGLVGLFR

SEQ ID NO: 225553 - protein, 9 aa, Homo Sapiens
YTRPMICQY

SEQ ID NO: 225554 - protein, 9 aa, Homo Sapiens
LLALAMGLA

SEQ ID NO: 225555 - protein, 9 aa, Homo Sapiens
IETKPSNFR

SEQ ID NO: 225556 - protein, 9 aa, Homo Sapiens
ADLSCDSCV

SEQ ID NO: 225557 - protein, 9 aa, Homo Sapiens
YTLGKFASS

SEQ ID NO: 225558 - protein, 9 aa, Homo Sapiens
HHFFLQIIW

SEQ ID NO: 225559 - protein, 9 aa, Homo Sapiens
LRRGQLGAE

SEQ ID NO: 225560 - protein, 9 aa, Homo Sapiens
HRRDFIKEK

SEQ ID NO: 225561 - protein, 9 aa, Homo Sapiens
ADQSFTIQD

SEQ ID NO: 225562 - protein, 9 aa, Homo Sapiens
NSDTLELPD

SEQ ID NO: 225563 - protein, 9 aa, Homo Sapiens
PSLGFPVSA

SEQ ID NO: 225564 - protein, 9 aa, Homo Sapiens
SGGRMRGTK

SEQ ID NO: 225565 - protein, 9 aa, Homo Sapiens
VVGLLEVEV

SEQ ID NO: 225566 - protein, 9 aa, Homo Sapiens
FNQQEKKLG

SEQ ID NO: 225567 - protein, 9 aa, Homo Sapiens
HIQSAQSQH

SEQ ID NO: 225568 - protein, 9 aa, Homo Sapiens
QWKRPMGLS

SEQ ID NO: 225569 - protein, 9 aa, Homo Sapiens
LEATDRYHM

SEQ ID NO: 225570 - protein, 9 aa, Homo Sapiens
KQFTILNSK

SEQ ID NO: 225571 - protein, 9 aa, Homo Sapiens
CRGPNGVWT

SEQ ID NO: 225572 - protein, 9 aa, Homo Sapiens
STRSLLRVA

SEQ ID NO: 225573 - protein, 9 aa, Homo Sapiens
TFALASHQK

SEQ ID NO: 225574 - protein, 9 aa, Homo Sapiens
CDRHLIKMI

SEQ ID NO: 225575 - protein, 9 aa, Homo Sapiens
AATPVGRFT

SEQ ID NO: 225576 - protein, 9 aa, Homo Sapiens
CNQPLDDII

SEQ ID NO: 225577 - protein, 9 aa, Homo Sapiens
FIILVARIP

SEQ ID NO: 225578 - protein, 9 aa, Homo Sapiens
RAMSRQTQS

SEQ ID NO: 225579 - protein, 9 aa, Homo Sapiens
LSVISCFWS

SEQ ID NO: 225580 - protein, 9 aa, Homo Sapiens
SQRYPEAAA

SEQ ID NO: 225581 - protein, 9 aa, Homo Sapiens
SWKRLKDIS

SEQ ID NO: 225582 - protein, 9 aa, Homo Sapiens
VLLRKQNFQ

SEQ ID NO: 225583 - protein, 9 aa, Homo Sapiens
QWLHSTAYM

SEQ ID NO: 225584 - protein, 9 aa, Homo Sapiens
ERHIQVTLR

SEQ ID NO: 225585 - protein, 9 aa, Homo Sapiens
GIFSGCFAM

SEQ ID NO: 225586 - protein, 9 aa, Homo Sapiens
QRRAPAGGR

SEQ ID NO: 225587 - protein, 9 aa, Homo Sapiens
QGNCCQTRS

SEQ ID NO: 225588 - protein, 9 aa, Homo Sapiens
QSHLLAAQH

SEQ ID NO: 225589 - protein, 9 aa, Homo Sapiens
AKNDPFLMG

SEQ ID NO: 225590 - protein, 9 aa, Homo Sapiens
CALTFKLNI

SEQ ID NO: 225591 - protein, 9 aa, Homo Sapiens
VRVLFIREK

SEQ ID NO: 225592 - protein, 9 aa, Homo Sapiens
AWGIQKKTK

SEQ ID NO: 225593 - protein, 9 aa, Homo Sapiens
SSSPTPGRA

SEQ ID NO: 225594 - protein, 9 aa, Homo Sapiens
AHPRQLRWK

SEQ ID NO: 225595 - protein, 9 aa, Homo Sapiens
SPRVVAAYQ

SEQ ID NO: 225596 - protein, 9 aa, Homo Sapiens
RFTEGPPCI

SEQ ID NO: 225597 - protein, 9 aa, Homo Sapiens
TTLTSAASS

SEQ ID NO: 225598 - protein, 9 aa, Homo Sapiens
LQVFMVIGN

SEQ ID NO: 225599 - protein, 9 aa, Homo Sapiens
DLSQILEKM

SEQ ID NO: 225600 - protein, 9 aa, Homo Sapiens
TSGTLSASS

SEQ ID NO: 225601 - protein, 9 aa, Homo Sapiens
RGSSKNNMG

SEQ ID NO: 225602 - protein, 9 aa, Homo Sapiens
PFWMASRST

SEQ ID NO: 225603 - protein, 9 aa, Homo Sapiens
ATGLRKRGR

SEQ ID NO: 225604 - protein, 9 aa, Homo Sapiens
AEQLWNQIQ

SEQ ID NO: 225605 - protein, 9 aa, Homo Sapiens
VGVKTSRFA

SEQ ID NO: 225606 - protein, 9 aa, Homo Sapiens
EVLQEGEAE

SEQ ID NO: 225607 - protein, 9 aa, Homo Sapiens
GLEHGQSPI

SEQ ID NO: 225608 - protein, 9 aa, Homo Sapiens
SKQILSDFR

SEQ ID NO: 225609 - protein, 9 aa, Homo Sapiens
SLLRLECPV

SEQ ID NO: 225610 - protein, 9 aa, Homo Sapiens
LSGGKGFPI

SEQ ID NO: 225611 - protein, 9 aa, Homo Sapiens
SMPPPPSRP

SEQ ID NO: 225612 - protein, 9 aa, Homo Sapiens
GIVGAGLST

SEQ ID NO: 225613 - protein, 9 aa, Homo Sapiens
NIQMYDHVI

SEQ ID NO: 225614 - protein, 9 aa, Homo Sapiens
RCYSRGSVQ

SEQ ID NO: 225615 - protein, 9 aa, Homo Sapiens
KWQEEEGLR

SEQ ID NO: 225616 - protein, 9 aa, Homo Sapiens
TLEVEVKVV

SEQ ID NO: 225617 - protein, 9 aa, Homo Sapiens
FRVPPLQRG

SEQ ID NO: 225618 - protein, 9 aa, Homo Sapiens
SRAAGPVSC

SEQ ID NO: 225619 - protein, 9 aa, Homo Sapiens
QEKYQLQVF

SEQ ID NO: 225620 - protein, 9 aa, Homo Sapiens
VVQTMLRYL

SEQ ID NO: 225621 - protein, 9 aa, Homo Sapiens
TRTCGPWAR

SEQ ID NO: 225622 - protein, 9 aa, Homo Sapiens
VTSGKVCHG

SEQ ID NO: 225623 - protein, 9 aa, Homo Sapiens
SLLRLECPI

SEQ ID NO: 225624 - protein, 9 aa, Homo Sapiens
NKKKSTKKI

SEQ ID NO: 225625 - protein, 9 aa, Homo Sapiens
LQQEIKDWS

SEQ ID NO: 225626 - protein, 9 aa, Homo Sapiens
WGKGHGDVC

SEQ ID NO: 225627 - protein, 9 aa, Homo Sapiens
KQDSMHGWT

SEQ ID NO: 225628 - protein, 9 aa, Homo Sapiens
RTWQDRLPL

SEQ ID NO: 225629 - protein, 9 aa, Homo Sapiens
FLSPQELGF

SEQ ID NO: 225630 - protein, 9 aa, Homo Sapiens
LRLKPRTSV

SEQ ID NO: 225631 - protein, 9 aa, Homo Sapiens
VPAVHAPRA

SEQ ID NO: 225632 - protein, 9 aa, Homo Sapiens
LYLLLAFGL

SEQ ID NO: 225633 - protein, 9 aa, Homo Sapiens
QELMVFQSK

SEQ ID NO: 225634 - protein, 9 aa, Homo Sapiens
QYQSHRVGP

SEQ ID NO: 225635 - protein, 9 aa, Homo Sapiens
PEAPVQEGP

SEQ ID NO: 225636 - protein, 9 aa, Homo Sapiens
EHPHQLEHS

SEQ ID NO: 225637 - protein, 9 aa, Homo Sapiens
EYSCIALGK

SEQ ID NO: 225638 - protein, 9 aa, Homo Sapiens
PKQSLMLMT

SEQ ID NO: 225639 - protein, 9 aa, Homo Sapiens
KKANLNTLD

SEQ ID NO: 225640 - protein, 9 aa, Homo Sapiens
SVPIRECSS

SEQ ID NO: 225641 - protein, 9 aa, Homo Sapiens
KQTEIPYVT

SEQ ID NO: 225642 - protein, 9 aa, Homo Sapiens
VEQNGTMVG

SEQ ID NO: 225643 - protein, 9 aa, Homo Sapiens
VLDVCCGTS

SEQ ID NO: 225644 - protein, 9 aa, Homo Sapiens
PQDQHGDGL

SEQ ID NO: 225645 - protein, 9 aa, Homo Sapiens
RNLTKLFLI

SEQ ID NO: 225646 - protein, 9 aa, Homo Sapiens
TSGPCSLPL

SEQ ID NO: 225647 - protein, 9 aa, Homo Sapiens
ALFIKEWHH

SEQ ID NO: 225648 - protein, 9 aa, Homo Sapiens
FQAPPSCLR

SEQ ID NO: 225649 - protein, 9 aa, Homo Sapiens
PLQVTTTLK

SEQ ID NO: 225650 - protein, 9 aa, Homo Sapiens
REQWLRLRL

SEQ ID NO: 225651 - protein, 9 aa, Homo Sapiens
LAIEVLERA

SEQ ID NO: 225652 - protein, 9 aa, Homo Sapiens
DDRSPLAIQ

SEQ ID NO: 225653 - protein, 9 aa, Homo Sapiens
FFSAQPTNH

SEQ ID NO: 225654 - protein, 9 aa, Homo Sapiens
LSLYDPWMP

SEQ ID NO: 225655 - protein, 9 aa, Homo Sapiens
LMVLAQLRL

SEQ ID NO: 225656 - protein, 9 aa, Homo Sapiens
LEKGRLHEW

SEQ ID NO: 225657 - protein, 9 aa, Homo Sapiens
TARLAPGSP

SEQ ID NO: 225658 - protein, 9 aa, Homo Sapiens
CKRREQWLR

SEQ ID NO: 225659 - protein, 9 aa, Homo Sapiens
VVCNNPEII

SEQ ID NO: 225660 - protein, 9 aa, Homo Sapiens
PAIFFMTTK

SEQ ID NO: 225661 - protein, 9 aa, Homo Sapiens
EAEQQALRQ

SEQ ID NO: 225662 - protein, 9 aa, Homo Sapiens
ASYGRRRSR

SEQ ID NO: 225663 - protein, 9 aa, Homo Sapiens
GRMLKILDW

SEQ ID NO: 225664 - protein, 9 aa, Homo Sapiens
DLIKVSDRC

SEQ ID NO: 225665 - protein, 9 aa, Homo Sapiens
VSTKEVLMK

SEQ ID NO: 225666 - protein, 9 aa, Homo Sapiens
VASSSGGRT

SEQ ID NO: 225667 - protein, 9 aa, Homo Sapiens
SALTCLPAV

SEQ ID NO: 225668 - protein, 9 aa, Homo Sapiens
SPCGLSFNK

SEQ ID NO: 225669 - protein, 9 aa, Homo Sapiens
SSIQRACCA

SEQ ID NO: 225670 - protein, 9 aa, Homo Sapiens
VLHTERGIR

SEQ ID NO: 225671 - protein, 9 aa, Homo Sapiens
RWMRRVPRL

SEQ ID NO: 225672 - protein, 9 aa, Homo Sapiens
ETIHQLEGH

SEQ ID NO: 225673 - protein, 9 aa, Homo Sapiens
WGSPSPWCL

SEQ ID NO: 225674 - protein, 9 aa, Homo Sapiens
RVTLELGGR

SEQ ID NO: 225675 - protein, 9 aa, Homo Sapiens
PTPGRAASA

SEQ ID NO: 225676 - protein, 9 aa, Homo Sapiens
SASQANHVK

SEQ ID NO: 225677 - protein, 9 aa, Homo Sapiens
RDEGFMTQN

SEQ ID NO: 225678 - protein, 9 aa, Homo Sapiens
GAIVLANLC

SEQ ID NO: 225679 - protein, 9 aa, Homo Sapiens
HGQSPIERK

SEQ ID NO: 225680 - protein, 9 aa, Homo Sapiens
LPDPSVKLR

SEQ ID NO: 225681 - protein, 9 aa, Homo Sapiens
SLKSSGIEN

SEQ ID NO: 225682 - protein, 9 aa, Homo Sapiens
HGVWVGAQE

SEQ ID NO: 225683 - protein, 9 aa, Homo Sapiens
QVSCHTTCY

SEQ ID NO: 225684 - protein, 9 aa, Homo Sapiens
HHSFRVSWT

SEQ ID NO: 225685 - protein, 9 aa, Homo Sapiens
AVRFEPGKT

SEQ ID NO: 225686 - protein, 9 aa, Homo Sapiens
KAPHCTNSH

SEQ ID NO: 225687 - protein, 9 aa, Homo Sapiens
ELVFALRAK

SEQ ID NO: 225688 - protein, 9 aa, Homo Sapiens
YVGEHCDIN

SEQ ID NO: 225689 - protein, 9 aa, Homo Sapiens
LEEHAVEEE

SEQ ID NO: 225690 - protein, 9 aa, Homo Sapiens
VEISILDVC

SEQ ID NO: 225691 - protein, 9 aa, Homo Sapiens
QDLEKERKR

SEQ ID NO: 225692 - protein, 9 aa, Homo Sapiens
YWHYFRLLV

SEQ ID NO: 225693 - protein, 9 aa, Homo Sapiens
GQREGTYNF

SEQ ID NO: 225694 - protein, 9 aa, Homo Sapiens
WNQIQDARK

SEQ ID NO: 225695 - protein, 9 aa, Homo Sapiens
SPPQRRPGQ

SEQ ID NO: 225696 - protein, 9 aa, Homo Sapiens
QRRPGQSAS

SEQ ID NO: 225697 - protein, 9 aa, Homo Sapiens
VNAEEKKSI

SEQ ID NO: 225698 - protein, 9 aa, Homo Sapiens
GVGRVLAVA

SEQ ID NO: 225699 - protein, 9 aa, Homo Sapiens
GICFQETHL

SEQ ID NO: 225700 - protein, 9 aa, Homo Sapiens
PLTTVEDLY

SEQ ID NO: 225701 - protein, 9 aa, Homo Sapiens
TVRSVRRQH

SEQ ID NO: 225702 - protein, 9 aa, Homo Sapiens
WTLTGRALL

SEQ ID NO: 225703 - protein, 9 aa, Homo Sapiens
CLECALYFK

SEQ ID NO: 225704 - protein, 9 aa, Homo Sapiens
TCENKTYSV

SEQ ID NO: 225705 - protein, 9 aa, Homo Sapiens
VQGHYREFC

SEQ ID NO: 225706 - protein, 9 aa, Homo Sapiens
TKFYFAWMM

SEQ ID NO: 225707 - protein, 9 aa, Homo Sapiens
TTLSCPPRS

SEQ ID NO: 225708 - protein, 9 aa, Homo Sapiens
SRKCSGPLQ

SEQ ID NO: 225709 - protein, 9 aa, Homo Sapiens
PQPGRSPLR

SEQ ID NO: 225710 - protein, 9 aa, Homo Sapiens
KTSSAHSSD

SEQ ID NO: 225711 - protein, 9 aa, Homo Sapiens
KDGPAQQLS

SEQ ID NO: 225712 - protein, 9 aa, Homo Sapiens
APFGASLDP

SEQ ID NO: 225713 - protein, 9 aa, Homo Sapiens
PPLKLLKNQ

SEQ ID NO: 225714 - protein, 9 aa, Homo Sapiens
SPLDSSPLQ

SEQ ID NO: 225715 - protein, 9 aa, Homo Sapiens
GDFRVPPLQ

SEQ ID NO: 225716 - protein, 9 aa, Homo Sapiens
KGLRRLAAT

SEQ ID NO: 225717 - protein, 9 aa, Homo Sapiens
ASCLALRHR

SEQ ID NO: 225718 - protein, 9 aa, Homo Sapiens
PKLLCRQML

SEQ ID NO: 225719 - protein, 9 aa, Homo Sapiens
CGPQGPLPG

SEQ ID NO: 225720 - protein, 9 aa, Homo Sapiens
FRAQLGPAF

SEQ ID NO: 225721 - protein, 9 aa, Homo Sapiens
DSVADTAQR

SEQ ID NO: 225722 - protein, 9 aa, Homo Sapiens
GVVVPDTAV

SEQ ID NO: 225723 - protein, 9 aa, Homo Sapiens
CAWNGSDGV

SEQ ID NO: 225724 - protein, 9 aa, Homo Sapiens
SPRPSQLCS

SEQ ID NO: 225725 - protein, 9 aa, Homo Sapiens
NDLFREDYK

SEQ ID NO: 225726 - protein, 9 aa, Homo Sapiens
AMTGKQVTR

SEQ ID NO: 225727 - protein, 9 aa, Homo Sapiens
YEDMKNHRD

SEQ ID NO: 225728 - protein, 9 aa, Homo Sapiens
TVSAASSLA

SEQ ID NO: 225729 - protein, 9 aa, Homo Sapiens
TQVRYLEKE

SEQ ID NO: 225730 - protein, 9 aa, Homo Sapiens
RPVCGQVSC

SEQ ID NO: 225731 - protein, 9 aa, Homo Sapiens
PRPPLGGDT

SEQ ID NO: 225732 - protein, 9 aa, Homo Sapiens
LLKGVLGYK

SEQ ID NO: 225733 - protein, 9 aa, Homo Sapiens
GKWTLSSVA

SEQ ID NO: 225734 - protein, 9 aa, Homo Sapiens
GAETSTCQT

SEQ ID NO: 225735 - protein, 9 aa, Homo Sapiens
KVEDMSQFY

SEQ ID NO: 225736 - protein, 9 aa, Homo Sapiens
PRSLASTST

SEQ ID NO: 225737 - protein, 9 aa, Homo Sapiens
SCFWSIPLV

SEQ ID NO: 225738 - protein, 9 aa, Homo Sapiens
QHALDVVDM

SEQ ID NO: 225739 - protein, 9 aa, Homo Sapiens
QTPRGLEMY

SEQ ID NO: 225740 - protein, 9 aa, Homo Sapiens
KLTLKMILT

SEQ ID NO: 225741 - protein, 9 aa, Homo Sapiens
GQEFWPRQS

SEQ ID NO: 225742 - protein, 9 aa, Homo Sapiens
PPGDCPRTM

SEQ ID NO: 225743 - protein, 9 aa, Homo Sapiens
CVASCNDTV

SEQ ID NO: 225744 - protein, 9 aa, Homo Sapiens
VIAGAHHCQ

SEQ ID NO: 225745 - protein, 9 aa, Homo Sapiens
PPQRRPGQS

SEQ ID NO: 225746 - protein, 9 aa, Homo Sapiens
ATTNTSLIL

SEQ ID NO: 225747 - protein, 9 aa, Homo Sapiens
GEELGEQEC

SEQ ID NO: 225748 - protein, 9 aa, Homo Sapiens
NGPFLSTEL

SEQ ID NO: 225749 - protein, 9 aa, Homo Sapiens
LQAIIGSGM

SEQ ID NO: 225750 - protein, 9 aa, Homo Sapiens
SPSPFTHRR

SEQ ID NO: 225751 - protein, 9 aa, Homo Sapiens
RQPPHWLQA

SEQ ID NO: 225752 - protein, 9 aa, Homo Sapiens
RVVKDLRGK

SEQ ID NO: 225753 - protein, 9 aa, Homo Sapiens
NMLQIEFKC

SEQ ID NO: 225754 - protein, 9 aa, Homo Sapiens
NATALLECP

SEQ ID NO: 225755 - protein, 9 aa, Homo Sapiens
SSRDRAMKE

SEQ ID NO: 225756 - protein, 9 aa, Homo Sapiens
TSVLLGESM

SEQ ID NO: 225757 - protein, 9 aa, Homo Sapiens
VEPGCGGKR

SEQ ID NO: 225758 - protein, 9 aa, Homo Sapiens
TPKAGQSQP

SEQ ID NO: 225759 - protein, 9 aa, Homo Sapiens
GSRRGCAWY

SEQ ID NO: 225760 - protein, 9 aa, Homo Sapiens
APSSAPFGA

SEQ ID NO: 225761 - protein, 9 aa, Homo Sapiens
QNRGPVTVQ

SEQ ID NO: 225762 - protein, 9 aa, Homo Sapiens
LGIFSGCFA

SEQ ID NO: 225763 - protein, 9 aa, Homo Sapiens
VLSTSSFCC

SEQ ID NO: 225764 - protein, 9 aa, Homo Sapiens
WRPHHGKAM

SEQ ID NO: 225765 - protein, 9 aa, Homo Sapiens
YSWPRVPHW

SEQ ID NO: 225766 - protein, 9 aa, Homo Sapiens
LRSWRTNSS

SEQ ID NO: 225767 - protein, 9 aa, Homo Sapiens
KKMMIGSQH

SEQ ID NO: 225768 - protein, 9 aa, Homo Sapiens
APVGFSAGE

SEQ ID NO: 225769 - protein, 9 aa, Homo Sapiens
SCCWRGWPG

SEQ ID NO: 225770 - protein, 9 aa, Homo Sapiens
PLQFKRRGS

SEQ ID NO: 225771 - protein, 9 aa, Homo Sapiens
LRLFPNCSA

SEQ ID NO: 225772 - protein, 9 aa, Homo Sapiens
RRQDVLSNS

SEQ ID NO: 225773 - protein, 9 aa, Homo Sapiens
VTREVLVEM

SEQ ID NO: 225774 - protein, 9 aa, Homo Sapiens
GGSTPAPWA

SEQ ID NO: 225775 - protein, 9 aa, Homo Sapiens
HKSMWKDRN

SEQ ID NO: 225776 - protein, 9 aa, Homo Sapiens
PAMTVLPSK

SEQ ID NO: 225777 - protein, 9 aa, Homo Sapiens
QHNAGVESV

SEQ ID NO: 225778 - protein, 9 aa, Homo Sapiens
SSSSSSSTR

SEQ ID NO: 225779 - protein, 9 aa, Homo Sapiens
DKKRDLLGP

SEQ ID NO: 225780 - protein, 9 aa, Homo Sapiens
ICISVHVSA

SEQ ID NO: 225781 - protein, 9 aa, Homo Sapiens
IKKKPEEFS

SEQ ID NO: 225782 - protein, 9 aa, Homo Sapiens
SRTSAGCAS

SEQ ID NO: 225783 - protein, 9 aa, Homo Sapiens
GQEAADMDE

SEQ ID NO: 225784 - protein, 9 aa, Homo Sapiens
PLDHQDVGV

SEQ ID NO: 225785 - protein, 9 aa, Homo Sapiens
PHSWKTSGP

SEQ ID NO: 225786 - protein, 9 aa, Homo Sapiens
WTEVLVNHH

SEQ ID NO: 225787 - protein, 9 aa, Homo Sapiens
SSSTRHCAR

SEQ ID NO: 225788 - protein, 9 aa, Homo Sapiens
PVSTQSLPR

SEQ ID NO: 225789 - protein, 9 aa, Homo Sapiens
AGVSLVGVH

SEQ ID NO: 225790 - protein, 9 aa, Homo Sapiens
VAKPLVGSQ

SEQ ID NO: 225791 - protein, 9 aa, Homo Sapiens
WHYFRLLVR

SEQ ID NO: 225792 - protein, 9 aa, Homo Sapiens
ISVPCPNLL

SEQ ID NO: 225793 - protein, 9 aa, Homo Sapiens
FNRQPPHMR

SEQ ID NO: 225794 - protein, 9 aa, Homo Sapiens
EKQDILSNS

SEQ ID NO: 225795 - protein, 9 aa, Homo Sapiens
LYECGGQRV

SEQ ID NO: 225796 - protein, 9 aa, Homo Sapiens
TGGHTHTPL

SEQ ID NO: 225797 - protein, 9 aa, Homo Sapiens
EAADMDEVY

SEQ ID NO: 225798 - protein, 9 aa, Homo Sapiens
IVCSIPRNL

SEQ ID NO: 225799 - protein, 9 aa, Homo Sapiens
GKQVTRVPV

SEQ ID NO: 225800 - protein, 9 aa, Homo Sapiens
VRVVKDLRG

SEQ ID NO: 225801 - protein, 9 aa, Homo Sapiens
NQTLSLMIR

SEQ ID NO: 225802 - protein, 9 aa, Homo Sapiens
LTVLSCWTW

SEQ ID NO: 225803 - protein, 9 aa, Homo Sapiens
GGPDWHWGA

SEQ ID NO: 225804 - protein, 9 aa, Homo Sapiens
PANDRPSMR

SEQ ID NO: 225805 - protein, 9 aa, Homo Sapiens
SSPPGRTAS

SEQ ID NO: 225806 - protein, 9 aa, Homo Sapiens
VNGKSSERE

SEQ ID NO: 225807 - protein, 9 aa, Homo Sapiens
LAAEPKVNQ

SEQ ID NO: 225808 - protein, 9 aa, Homo Sapiens
KASANIFHS

SEQ ID NO: 225809 - protein, 9 aa, Homo Sapiens
SVPLSCPLA

SEQ ID NO: 225810 - protein, 9 aa, Homo Sapiens
TAPASALLQ

SEQ ID NO: 225811 - protein, 9 aa, Homo Sapiens
QSRWLSPGD

SEQ ID NO: 225812 - protein, 9 aa, Homo Sapiens
GLEGVIMAV

SEQ ID NO: 225813 - protein, 9 aa, Homo Sapiens
MQPSSTWTR

SEQ ID NO: 225814 - protein, 9 aa, Homo Sapiens
SKKGNFQRT

SEQ ID NO: 225815 - protein, 9 aa, Homo Sapiens
EIWERIGKD

SEQ ID NO: 225816 - protein, 9 aa, Homo Sapiens
KRPILFLRL

SEQ ID NO: 225817 - protein, 9 aa, Homo Sapiens
SWWAPSRST

SEQ ID NO: 225818 - protein, 9 aa, Homo Sapiens
LEGCISVKD

SEQ ID NO: 225819 - protein, 9 aa, Homo Sapiens
GHGFKQEYE

SEQ ID NO: 225820 - protein, 9 aa, Homo Sapiens
WVFSNAMCK

SEQ ID NO: 225821 - protein, 9 aa, Homo Sapiens
GESDTPQIE

SEQ ID NO: 225822 - protein, 9 aa, Homo Sapiens
EPYEDFWIL

SEQ ID NO: 225823 - protein, 9 aa, Homo Sapiens
ILTWPSWMT

SEQ ID NO: 225824 - protein, 9 aa, Homo Sapiens
HILIFTCET

SEQ ID NO: 225825 - protein, 9 aa, Homo Sapiens
NLVDFIKHN

SEQ ID NO: 225826 - protein, 9 aa, Homo Sapiens
PAGCVCGVA

SEQ ID NO: 225827 - protein, 9 aa, Homo Sapiens
SHTLQQALT

SEQ ID NO: 225828 - protein, 9 aa, Homo Sapiens
EGTVAPTVL

SEQ ID NO: 225829 - protein, 9 aa, Homo Sapiens
YSAPRWAPL

SEQ ID NO: 225830 - protein, 9 aa, Homo Sapiens
WPSVPSSTS

SEQ ID NO: 225831 - protein, 9 aa, Homo Sapiens
SVNVKSAGE

SEQ ID NO: 225832 - protein, 9 aa, Homo Sapiens
PFIDVVKVG

SEQ ID NO: 225833 - protein, 9 aa, Homo Sapiens
PVSTRSLLR

SEQ ID NO: 225834 - protein, 9 aa, Homo Sapiens
GWCWLIRVA

SEQ ID NO: 225835 - protein, 9 aa, Homo Sapiens
PFRCKLAAA

SEQ ID NO: 225836 - protein, 9 aa, Homo Sapiens
GNPAYSFHV

SEQ ID NO: 225837 - protein, 9 aa, Homo Sapiens
FFSGFSFFP

SEQ ID NO: 225838 - protein, 9 aa, Homo Sapiens
RRPGQSASS

SEQ ID NO: 225839 - protein, 9 aa, Homo Sapiens
RRCLHDTAL

SEQ ID NO: 225840 - protein, 9 aa, Homo Sapiens
EAEETNGGT

SEQ ID NO: 225841 - protein, 9 aa, Homo Sapiens
ACILTLPPT

SEQ ID NO: 225842 - protein, 9 aa, Homo Sapiens
HQHALDVVD

SEQ ID NO: 225843 - protein, 9 aa, Homo Sapiens
QLLMQLQDA

SEQ ID NO: 225844 - protein, 9 aa, Homo Sapiens
LSKVVHSTE

SEQ ID NO: 225845 - protein, 9 aa, Homo Sapiens
RGSRRRPRP

SEQ ID NO: 225846 - protein, 9 aa, Homo Sapiens
NSRYEVCGP

SEQ ID NO: 225847 - protein, 9 aa, Homo Sapiens
VTSQIDAQQ

SEQ ID NO: 225848 - protein, 9 aa, Homo Sapiens
CVICSPRGP

SEQ ID NO: 225849 - protein, 9 aa, Homo Sapiens
SHLLEFQTP

SEQ ID NO: 225850 - protein, 9 aa, Homo Sapiens
FHTGWISTS

SEQ ID NO: 225851 - protein, 9 aa, Homo Sapiens
HTAGLKLTG

SEQ ID NO: 225852 - protein, 9 aa, Homo Sapiens
QVAGASPLS

SEQ ID NO: 225853 - protein, 9 aa, Homo Sapiens
QQLAYARVT

SEQ ID NO: 225854 - protein, 9 aa, Homo Sapiens
QTTVTAGQT

SEQ ID NO: 225855 - protein, 9 aa, Homo Sapiens
RCSGWRVAA

SEQ ID NO: 225856 - protein, 9 aa, Homo Sapiens
PTGVTSQAM

SEQ ID NO: 225857 - protein, 9 aa, Homo Sapiens
KKVSTRKNG

SEQ ID NO: 225858 - protein, 9 aa, Homo Sapiens
WVRKGQLHR

SEQ ID NO: 225859 - protein, 9 aa, Homo Sapiens
CSVHFPFTF

SEQ ID NO: 225860 - protein, 9 aa, Homo Sapiens
IEELQNQPV

SEQ ID NO: 225861 - protein, 9 aa, Homo Sapiens
CGPRGWPLY

SEQ ID NO: 225862 - protein, 9 aa, Homo Sapiens
TPRGRAPQD

SEQ ID NO: 225863 - protein, 9 aa, Homo Sapiens
STELGFTLL

SEQ ID NO: 225864 - protein, 9 aa, Homo Sapiens
LASTSTAPT

SEQ ID NO: 225865 - protein, 9 aa, Homo Sapiens
VFSRDGLSE

SEQ ID NO: 225866 - protein, 9 aa, Homo Sapiens
SSRLGRPLG

SEQ ID NO: 225867 - protein, 9 aa, Homo Sapiens
LHQFQVENR

SEQ ID NO: 225868 - protein, 9 aa, Homo Sapiens
SLGTTTHTP

SEQ ID NO: 225869 - protein, 9 aa, Homo Sapiens
WRMNEEMDR

SEQ ID NO: 225870 - protein, 9 aa, Homo Sapiens
LHESLHGQR

SEQ ID NO: 225871 - protein, 9 aa, Homo Sapiens
PGGAEKEPI

SEQ ID NO: 225872 - protein, 9 aa, Homo Sapiens
ATEKSRWSG

SEQ ID NO: 225873 - protein, 9 aa, Homo Sapiens
RFNFILTST

SEQ ID NO: 225874 - protein, 9 aa, Homo Sapiens
KESNKGNEH

SEQ ID NO: 225875 - protein, 9 aa, Homo Sapiens
WKSHLIVSV

SEQ ID NO: 225876 - protein, 9 aa, Homo Sapiens
LGNLSPGVV

SEQ ID NO: 225877 - protein, 9 aa, Homo Sapiens
FTGSPSQSS

SEQ ID NO: 225878 - protein, 9 aa, Homo Sapiens
AEPTATPAA

SEQ ID NO: 225879 - protein, 9 aa, Homo Sapiens
EVGATEETE

SEQ ID NO: 225880 - protein, 9 aa, Homo Sapiens
VVAVATVET

SEQ ID NO: 225881 - protein, 9 aa, Homo Sapiens
QGNAGVKRS

SEQ ID NO: 225882 - protein, 9 aa, Homo Sapiens
LTSLGLHGL

SEQ ID NO: 225883 - protein, 9 aa, Homo Sapiens
RPALLLQPR

SEQ ID NO: 225884 - protein, 9 aa, Homo Sapiens
GYRERGGGC

SEQ ID NO: 225885 - protein, 9 aa, Homo Sapiens
QAVKAYDHQ

SEQ ID NO: 225886 - protein, 9 aa, Homo Sapiens
MASERGPLD

SEQ ID NO: 225887 - protein, 9 aa, Homo Sapiens
SEHWQMYWL

SEQ ID NO: 225888 - protein, 9 aa, Homo Sapiens
KAAKWKTPT

SEQ ID NO: 225889 - protein, 9 aa, Homo Sapiens
MTMCSRARL

SEQ ID NO: 225890 - protein, 9 aa, Homo Sapiens
ELALSLGYV

SEQ ID NO: 225891 - protein, 9 aa, Homo Sapiens
PGASNGLLC

SEQ ID NO: 225892 - protein, 9 aa, Homo Sapiens
RRRLLVFRL

SEQ ID NO: 225893 - protein, 9 aa, Homo Sapiens
SQNLNCIAL

SEQ ID NO: 225894 - protein, 9 aa, Homo Sapiens
MTLYSLLRA

SEQ ID NO: 225895 - protein, 9 aa, Homo Sapiens
TTHTPPGVH

SEQ ID NO: 225896 - protein, 9 aa, Homo Sapiens
GVVMKMGMP

SEQ ID NO: 225897 - protein, 9 aa, Homo Sapiens
SAQPRRHCW

SEQ ID NO: 225898 - protein, 9 aa, Homo Sapiens
PEVSIATSQ

SEQ ID NO: 225899 - protein, 9 aa, Homo Sapiens
QSRFLQSQN

SEQ ID NO: 225900 - protein, 9 aa, Homo Sapiens
RPLAHSVAS

SEQ ID NO: 225901 - protein, 9 aa, Homo Sapiens
GLLLHHILR

SEQ ID NO: 225902 - protein, 9 aa, Homo Sapiens
SMRWRSSRR

SEQ ID NO: 225903 - protein, 9 aa, Homo Sapiens
CIVSLGVRH

SEQ ID NO: 225904 - protein, 9 aa, Homo Sapiens
KRNSYRMDQ

SEQ ID NO: 225905 - protein, 9 aa, Homo Sapiens
VSARSLPRP

SEQ ID NO: 225906 - protein, 9 aa, Homo Sapiens
WPLAPRKAP

SEQ ID NO: 225907 - protein, 9 aa, Homo Sapiens
MSICGPQGP

SEQ ID NO: 225908 - protein, 9 aa, Homo Sapiens
VAGASPLSE

SEQ ID NO: 225909 - protein, 9 aa, Homo Sapiens
TTNNNNHHQ

SEQ ID NO: 225910 - protein, 9 aa, Homo Sapiens
GLGPVVLGA

SEQ ID NO: 225911 - protein, 9 aa, Homo Sapiens
ATTANRAMS

SEQ ID NO: 225912 - protein, 9 aa, Homo Sapiens
VELYGPSCR

SEQ ID NO: 225913 - protein, 9 aa, Homo Sapiens
ASTHTSRNC

SEQ ID NO: 225914 - protein, 9 aa, Homo Sapiens
LSTTTRMVL

SEQ ID NO: 225915 - protein, 9 aa, Homo Sapiens
KDHWRSRHT

SEQ ID NO: 225916 - protein, 9 aa, Homo Sapiens
SPVVAAVVG

SEQ ID NO: 225917 - protein, 9 aa, Homo Sapiens
EMHYGHQAP

SEQ ID NO: 225918 - protein, 9 aa, Homo Sapiens
PIRRVSPGQ

SEQ ID NO: 225919 - protein, 9 aa, Homo Sapiens
YTLMSDCWI

SEQ ID NO: 225920 - protein, 9 aa, Homo Sapiens
MARAEPLDK

SEQ ID NO: 225921 - protein, 9 aa, Homo Sapiens
GVTQRVPGA

SEQ ID NO: 225922 - protein, 9 aa, Homo Sapiens
DSLRPVRLQ

SEQ ID NO: 225923 - protein, 9 aa, Homo Sapiens
DKEKKLYLV

SEQ ID NO: 225924 - protein, 9 aa, Homo Sapiens
LETTNNNNH

SEQ ID NO: 225925 - protein, 9 aa, Homo Sapiens
TPTPPPGRR

SEQ ID NO: 225926 - protein, 9 aa, Homo Sapiens
ILQERIELK

SEQ ID NO: 225927 - protein, 9 aa, Homo Sapiens
WSQPPPTRP

SEQ ID NO: 225928 - protein, 9 aa, Homo Sapiens
RLECPVSTQ

SEQ ID NO: 225929 - protein, 9 aa, Homo Sapiens
SGCSQEQSV

SEQ ID NO: 225930 - protein, 9 aa, Homo Sapiens
GRPPRSSPP

SEQ ID NO: 225931 - protein, 9 aa, Homo Sapiens
CSTMWSASG

SEQ ID NO: 225932 - protein, 9 aa, Homo Sapiens
MMGSNRKFG

SEQ ID NO: 225933 - protein, 9 aa, Homo Sapiens
FRLVVLCFL

SEQ ID NO: 225934 - protein, 9 aa, Homo Sapiens
HQMRTAPSV

SEQ ID NO: 225935 - protein, 9 aa, Homo Sapiens
GSLIFHKPS

SEQ ID NO: 225936 - protein, 9 aa, Homo Sapiens
AVPKLGVAP

SEQ ID NO: 225937 - protein, 9 aa, Homo Sapiens
ALLQEALLH

SEQ ID NO: 225938 - protein, 9 aa, Homo Sapiens
WSAEVFKEN

SEQ ID NO: 225939 - protein, 9 aa, Homo Sapiens
RALQEYQGA

SEQ ID NO: 225940 - protein, 9 aa, Homo Sapiens
MLDYLKNKK

SEQ ID NO: 225941 - protein, 9 aa, Homo Sapiens
PSRRAQRRC

SEQ ID NO: 225942 - protein, 9 aa, Homo Sapiens
NLFGLGIIG

SEQ ID NO: 225943 - protein, 9 aa, Homo Sapiens
KTSRGHPRT

SEQ ID NO: 225944 - protein, 9 aa, Homo Sapiens
SVSHNSVKA

SEQ ID NO: 225945 - protein, 9 aa, Homo Sapiens
KPLYRVSTG

SEQ ID NO: 225946 - protein, 9 aa, Homo Sapiens
QEIDPPTII

SEQ ID NO: 225947 - protein, 9 aa, Homo Sapiens
VSRLMQVGE

SEQ ID NO: 225948 - protein, 9 aa, Homo Sapiens
VSSVKLVWT

SEQ ID NO: 225949 - protein, 9 aa, Homo Sapiens
SCTTHSTSS

SEQ ID NO: 225950 - protein, 9 aa, Homo Sapiens
NHTNVRFVK

SEQ ID NO: 225951 - protein, 9 aa, Homo Sapiens
EQRLEALEK

SEQ ID NO: 225952 - protein, 9 aa, Homo Sapiens
RQPATRPTQ

SEQ ID NO: 225953 - protein, 9 aa, Homo Sapiens
SIRTPRGRA

SEQ ID NO: 225954 - protein, 9 aa, Homo Sapiens
PLPARTLAR

SEQ ID NO: 225955 - protein, 9 aa, Homo Sapiens
STAPTTPAT

SEQ ID NO: 225956 - protein, 9 aa, Homo Sapiens
HSEATQAEA

SEQ ID NO: 225957 - protein, 9 aa, Homo Sapiens
TRAWRTRCA

SEQ ID NO: 225958 - protein, 9 aa, Homo Sapiens
IPKFAIATL

SEQ ID NO: 225959 - protein, 9 aa, Homo Sapiens
KGKSYLALG

SEQ ID NO: 225960 - protein, 9 aa, Homo Sapiens
HVCSLKPKR

SEQ ID NO: 225961 - protein, 9 aa, Homo Sapiens
RVLQEAQRQ

SEQ ID NO: 225962 - protein, 9 aa, Homo Sapiens
GYLFRWAHF

SEQ ID NO: 225963 - protein, 9 aa, Homo Sapiens
GIRELDQKH

SEQ ID NO: 225964 - protein, 9 aa, Homo Sapiens
PGLRDWLSK

SEQ ID NO: 225965 - protein, 9 aa, Homo Sapiens
GVSRCSSCW

SEQ ID NO: 225966 - protein, 9 aa, Homo Sapiens
SKELKKLKT

SEQ ID NO: 225967 - protein, 9 aa, Homo Sapiens
QEAAENYRT

SEQ ID NO: 225968 - protein, 9 aa, Homo Sapiens
EAEGSFLTP

SEQ ID NO: 225969 - protein, 9 aa, Homo Sapiens
IQSNLQGVI

SEQ ID NO: 225970 - protein, 9 aa, Homo Sapiens
SHRPPSSCW

SEQ ID NO: 225971 - protein, 9 aa, Homo Sapiens
SCGTGSRRG

SEQ ID NO: 225972 - protein, 9 aa, Homo Sapiens
MYLSLSLAS

SEQ ID NO: 225973 - protein, 9 aa, Homo Sapiens
GSVDVVKQV

SEQ ID NO: 225974 - protein, 9 aa, Homo Sapiens
VVAHDVVEA

SEQ ID NO: 225975 - protein, 9 aa, Homo Sapiens
ASCRPTRSE

SEQ ID NO: 225976 - protein, 9 aa, Homo Sapiens
YRPLCALTF

SEQ ID NO: 225977 - protein, 9 aa, Homo Sapiens
ISRILRTSQ

SEQ ID NO: 225978 - protein, 9 aa, Homo Sapiens
ALLNVPNIF

SEQ ID NO: 225979 - protein, 9 aa, Homo Sapiens
MPSFGEFPG

SEQ ID NO: 225980 - protein, 9 aa, Homo Sapiens
TSCPPLLEA

SEQ ID NO: 225981 - protein, 9 aa, Homo Sapiens
AIATIKTKH

SEQ ID NO: 225982 - protein, 9 aa, Homo Sapiens
WLRKQNIWR

SEQ ID NO: 225983 - protein, 9 aa, Homo Sapiens
LGQNDADIN

SEQ ID NO: 225984 - protein, 9 aa, Homo Sapiens
RYWHYFRLL

SEQ ID NO: 225985 - protein, 9 aa, Homo Sapiens
AQCWPSDGL

SEQ ID NO: 225986 - protein, 9 aa, Homo Sapiens
APWAGHLLG

SEQ ID NO: 225987 - protein, 9 aa, Homo Sapiens
RKPRPLPPP

SEQ ID NO: 225988 - protein, 9 aa, Homo Sapiens
VGVLGAHHP

SEQ ID NO: 225989 - protein, 9 aa, Homo Sapiens
GAGSGIGCG

SEQ ID NO: 225990 - protein, 9 aa, Homo Sapiens
VTRFLNEHH

SEQ ID NO: 225991 - protein, 9 aa, Homo Sapiens
CCATIGWAW

SEQ ID NO: 225992 - protein, 9 aa, Homo Sapiens
KIYSCHCQP

SEQ ID NO: 225993 - protein, 9 aa, Homo Sapiens
KKEKKEKRR

SEQ ID NO: 225994 - protein, 9 aa, Homo Sapiens
WSLPRLVGC

SEQ ID NO: 225995 - protein, 9 aa, Homo Sapiens
TMGGLEPGH

SEQ ID NO: 225996 - protein, 9 aa, Homo Sapiens
HPKRFTPDA

SEQ ID NO: 225997 - protein, 9 aa, Homo Sapiens
SIDSLIDTF

SEQ ID NO: 225998 - protein, 9 aa, Homo Sapiens
SKKISFFFR

SEQ ID NO: 225999 - protein, 9 aa, Homo Sapiens
RRRWPLAPR

SEQ ID NO: 226000 - protein, 9 aa, Homo Sapiens
QSQQDDRSP

SEQ ID NO: 226001 - protein, 9 aa, Homo Sapiens
DKGWGRGTL

SEQ ID NO: 226002 - protein, 9 aa, Homo Sapiens
CTTHSTSSA

SEQ ID NO: 226003 - protein, 9 aa, Homo Sapiens
GRRRSHSWG

SEQ ID NO: 226004 - protein, 9 aa, Homo Sapiens
DIGPVTSIL

SEQ ID NO: 226005 - protein, 9 aa, Homo Sapiens
YVKEEMKKT

SEQ ID NO: 226006 - protein, 9 aa, Homo Sapiens
RAYEAAGSA

SEQ ID NO: 226007 - protein, 9 aa, Homo Sapiens
HEHFLMIKK

SEQ ID NO: 226008 - protein, 9 aa, Homo Sapiens
PLPPPLPPP

SEQ ID NO: 226009 - protein, 9 aa, Homo Sapiens
GAARPDDLT

SEQ ID NO: 226010 - protein, 9 aa, Homo Sapiens
APQGNCCQT

SEQ ID NO: 226011 - protein, 9 aa, Homo Sapiens
VLCVVRQVT

SEQ ID NO: 226012 - protein, 9 aa, Homo Sapiens
LVHWVTYIP

SEQ ID NO: 226013 - protein, 9 aa, Homo Sapiens
GVIMTGAYN

SEQ ID NO: 226014 - protein, 9 aa, Homo Sapiens
RLRTATARS

SEQ ID NO: 226015 - protein, 9 aa, Homo Sapiens
WAKSPLNQK

SEQ ID NO: 226016 - protein, 9 aa, Homo Sapiens
FLSGKLTAL

SEQ ID NO: 226017 - protein, 9 aa, Homo Sapiens
VGVSADLKG

SEQ ID NO: 226018 - protein, 9 aa, Homo Sapiens
EMPARLVLA

SEQ ID NO: 226019 - protein, 9 aa, Homo Sapiens
EKLALKEDL

SEQ ID NO: 226020 - protein, 9 aa, Homo Sapiens
FGNMASSWV

SEQ ID NO: 226021 - protein, 9 aa, Homo Sapiens
PVMDTVILY

SEQ ID NO: 226022 - protein, 9 aa, Homo Sapiens
SFHKLDFVL

SEQ ID NO: 226023 - protein, 9 aa, Homo Sapiens
RLLLPALLG

SEQ ID NO: 226024 - protein, 9 aa, Homo Sapiens
RKNGGGLKR

SEQ ID NO: 226025 - protein, 9 aa, Homo Sapiens
GGTVVGLLE

SEQ ID NO: 226026 - protein, 9 aa, Homo Sapiens
SGENGEIVC

SEQ ID NO: 226027 - protein, 9 aa, Homo Sapiens
CFEDYLEQK

SEQ ID NO: 226028 - protein, 9 aa, Homo Sapiens
FQEGETIMM

SEQ ID NO: 226029 - protein, 9 aa, Homo Sapiens
LLLLSPLDS

SEQ ID NO: 226030 - protein, 9 aa, Homo Sapiens
TEKQDILSN

SEQ ID NO: 226031 - protein, 9 aa, Homo Sapiens
RSRKASGIC

SEQ ID NO: 226032 - protein, 9 aa, Homo Sapiens
YDEWNFFPG

SEQ ID NO: 226033 - protein, 9 aa, Homo Sapiens
AITSHMHLK

SEQ ID NO: 226034 - protein, 9 aa, Homo Sapiens
TICNPLLYT

SEQ ID NO: 226035 - protein, 9 aa, Homo Sapiens
QNWSLLKDY

SEQ ID NO: 226036 - protein, 9 aa, Homo Sapiens
EEDDDDDDP

SEQ ID NO: 226037 - protein, 9 aa, Homo Sapiens
SGVLPQSYI

SEQ ID NO: 226038 - protein, 9 aa, Homo Sapiens
SPLFKIVDA

SEQ ID NO: 226039 - protein, 9 aa, Homo Sapiens
CSLEAVREE

SEQ ID NO: 226040 - protein, 9 aa, Homo Sapiens
QNTKSARES

SEQ ID NO: 226041 - protein, 9 aa, Homo Sapiens
WLQARRWPR

SEQ ID NO: 226042 - protein, 9 aa, Homo Sapiens
RILAVPVHT

SEQ ID NO: 226043 - protein, 9 aa, Homo Sapiens
EWGEQIVFN

SEQ ID NO: 226044 - protein, 9 aa, Homo Sapiens
REVCQQGGE

SEQ ID NO: 226045 - protein, 9 aa, Homo Sapiens
RSSPPSPPQ

SEQ ID NO: 226046 - protein, 9 aa, Homo Sapiens
FDTETLGGF

SEQ ID NO: 226047 - protein, 9 aa, Homo Sapiens
GIGLSFLFC

SEQ ID NO: 226048 - protein, 9 aa, Homo Sapiens
EANSGHQVP

SEQ ID NO: 226049 - protein, 9 aa, Homo Sapiens
EDVWWGPGT

SEQ ID NO: 226050 - protein, 9 aa, Homo Sapiens
ALDLPSAWD

SEQ ID NO: 226051 - protein, 9 aa, Homo Sapiens
HRTSQNHSK

SEQ ID NO: 226052 - protein, 9 aa, Homo Sapiens
ELIIKTVMH

SEQ ID NO: 226053 - protein, 9 aa, Homo Sapiens
QMARVTGVS

SEQ ID NO: 226054 - protein, 9 aa, Homo Sapiens
AAVVMRPGS

SEQ ID NO: 226055 - protein, 9 aa, Homo Sapiens
FSRVDATTV

SEQ ID NO: 226056 - protein, 9 aa, Homo Sapiens
DSILTEKTI

SEQ ID NO: 226057 - protein, 9 aa, Homo Sapiens
SGSTPTASE

SEQ ID NO: 226058 - protein, 9 aa, Homo Sapiens
EEIARHAAK

SEQ ID NO: 226059 - protein, 9 aa, Homo Sapiens
EPPVTNPVY

SEQ ID NO: 226060 - protein, 9 aa, Homo Sapiens
FKQVLITEG

SEQ ID NO: 226061 - protein, 9 aa, Homo Sapiens
LHPASGRAS

SEQ ID NO: 226062 - protein, 9 aa, Homo Sapiens
WNHMLLCTA

SEQ ID NO: 226063 - protein, 9 aa, Homo Sapiens
HSIIQVILI

SEQ ID NO: 226064 - protein, 9 aa, Homo Sapiens
DTERNLRPL

SEQ ID NO: 226065 - protein, 9 aa, Homo Sapiens
PAGVSLVGV

SEQ ID NO: 226066 - protein, 9 aa, Homo Sapiens
AVLSSSNVC

SEQ ID NO: 226067 - protein, 9 aa, Homo Sapiens
ETATDDTGG

SEQ ID NO: 226068 - protein, 9 aa, Homo Sapiens
HRALDVMAC

SEQ ID NO: 226069 - protein, 9 aa, Homo Sapiens
KSIFEALWD

SEQ ID NO: 226070 - protein, 9 aa, Homo Sapiens
RWIQNWSLL

SEQ ID NO: 226071 - protein, 9 aa, Homo Sapiens
STIVCHNQV

SEQ ID NO: 226072 - protein, 9 aa, Homo Sapiens
EEEEEEECA

SEQ ID NO: 226073 - protein, 9 aa, Homo Sapiens
ADPRLHPQL

SEQ ID NO: 226074 - protein, 9 aa, Homo Sapiens
GPQGPLPGC

SEQ ID NO: 226075 - protein, 9 aa, Homo Sapiens
MIEHTQKEL

SEQ ID NO: 226076 - protein, 9 aa, Homo Sapiens
LQPPHSAMG

SEQ ID NO: 226077 - protein, 9 aa, Homo Sapiens
RGAPRHPHR

SEQ ID NO: 226078 - protein, 9 aa, Homo Sapiens
LPKALYPGG

SEQ ID NO: 226079 - protein, 9 aa, Homo Sapiens
PRPPCSQRL

SEQ ID NO: 226080 - protein, 9 aa, Homo Sapiens
CLTWASSAT

SEQ ID NO: 226081 - protein, 9 aa, Homo Sapiens
HRDSEYIFS

SEQ ID NO: 226082 - protein, 9 aa, Homo Sapiens
KDYTTDNEH

SEQ ID NO: 226083 - protein, 9 aa, Homo Sapiens
PIFTTVRQL

SEQ ID NO: 226084 - protein, 9 aa, Homo Sapiens
LPKETFLVL

SEQ ID NO: 226085 - protein, 9 aa, Homo Sapiens
CGSAFCSGC

SEQ ID NO: 226086 - protein, 9 aa, Homo Sapiens
PLSIQTQGS

SEQ ID NO: 226087 - protein, 9 aa, Homo Sapiens
RMLKILDWL

SEQ ID NO: 226088 - protein, 9 aa, Homo Sapiens
GSWASLQSP

SEQ ID NO: 226089 - protein, 9 aa, Homo Sapiens
TVLWILPLV

SEQ ID NO: 226090 - protein, 9 aa, Homo Sapiens
YPRRSQERV

SEQ ID NO: 226091 - protein, 9 aa, Homo Sapiens
EMISATDHT

SEQ ID NO: 226092 - protein, 9 aa, Homo Sapiens
GVKPPMPTG

SEQ ID NO: 226093 - protein, 9 aa, Homo Sapiens
NPYECKQCW

SEQ ID NO: 226094 - protein, 9 aa, Homo Sapiens
SPDIQCDDP

SEQ ID NO: 226095 - protein, 9 aa, Homo Sapiens
QVKISHVEN

SEQ ID NO: 226096 - protein, 9 aa, Homo Sapiens
RRWALAQAG

SEQ ID NO: 226097 - protein, 9 aa, Homo Sapiens
MRTWIIPMG

SEQ ID NO: 226098 - protein, 9 aa, Homo Sapiens
QRPPYCDDT

SEQ ID NO: 226099 - protein, 9 aa, Homo Sapiens
LQVALHLDD

SEQ ID NO: 226100 - protein, 9 aa, Homo Sapiens
ERPGATRSL

SEQ ID NO: 226101 - protein, 9 aa, Homo Sapiens
KKSQLLILI

SEQ ID NO: 226102 - protein, 9 aa, Homo Sapiens
ALLIFVPDS

SEQ ID NO: 226103 - protein, 9 aa, Homo Sapiens
LQFKRRGSE

SEQ ID NO: 226104 - protein, 9 aa, Homo Sapiens
LKAPEDSSG

SEQ ID NO: 226105 - protein, 9 aa, Homo Sapiens
QDRGQFCLT

SEQ ID NO: 226106 - protein, 9 aa, Homo Sapiens
LFGQVFRPD

SEQ ID NO: 226107 - protein, 9 aa, Homo Sapiens
LPVLLADPV

SEQ ID NO: 226108 - protein, 9 aa, Homo Sapiens
FRCKLAAAI

SEQ ID NO: 226109 - protein, 9 aa, Homo Sapiens
LSKLNVEVA

SEQ ID NO: 226110 - protein, 9 aa, Homo Sapiens
LECYTKNEK

SEQ ID NO: 226111 - protein, 9 aa, Homo Sapiens
ELGEQECQA

SEQ ID NO: 226112 - protein, 9 aa, Homo Sapiens
PKSASVSVL

SEQ ID NO: 226113 - protein, 9 aa, Homo Sapiens
LTSVMSVAK

SEQ ID NO: 226114 - protein, 9 aa, Homo Sapiens
VIGGGGGGC

SEQ ID NO: 226115 - protein, 9 aa, Homo Sapiens
WTPLHVDAS

SEQ ID NO: 226116 - protein, 9 aa, Homo Sapiens
ACRKRQKRC

SEQ ID NO: 226117 - protein, 9 aa, Homo Sapiens
VQTMLRYLK

SEQ ID NO: 226118 - protein, 9 aa, Homo Sapiens
NCAIAHPYS

SEQ ID NO: 226119 - protein, 9 aa, Homo Sapiens
LMGIPAATN

SEQ ID NO: 226120 - protein, 9 aa, Homo Sapiens
GMTTEKQRQ

SEQ ID NO: 226121 - protein, 9 aa, Homo Sapiens
RIMSRGGVS

SEQ ID NO: 226122 - protein, 9 aa, Homo Sapiens
RVWRSSECM

SEQ ID NO: 226123 - protein, 9 aa, Homo Sapiens
HRMRPLVDR

SEQ ID NO: 226124 - protein, 9 aa, Homo Sapiens
ESRAGHGAG

SEQ ID NO: 226125 - protein, 9 aa, Homo Sapiens
LAAPGVHPG

SEQ ID NO: 226126 - protein, 9 aa, Homo Sapiens
DTIYQIMHS

SEQ ID NO: 226127 - protein, 9 aa, Homo Sapiens
PSSMRSRGE

SEQ ID NO: 226128 - protein, 9 aa, Homo Sapiens
NKKTHPCTM

SEQ ID NO: 226129 - protein, 9 aa, Homo Sapiens
FKILYLVIL

SEQ ID NO: 226130 - protein, 9 aa, Homo Sapiens
VPSSTSSSL

SEQ ID NO: 226131 - protein, 9 aa, Homo Sapiens
LENGMVAVR

SEQ ID NO: 226132 - protein, 9 aa, Homo Sapiens
CFSNGSWWA

SEQ ID NO: 226133 - protein, 9 aa, Homo Sapiens
PHVKRHAVN

SEQ ID NO: 226134 - protein, 9 aa, Homo Sapiens
YPVSTWSLP

SEQ ID NO: 226135 - protein, 9 aa, Homo Sapiens
QNRRDAEVW

SEQ ID NO: 226136 - protein, 9 aa, Homo Sapiens
CKKVILNVH

SEQ ID NO: 226137 - protein, 9 aa, Homo Sapiens
FKDVVVVFT

SEQ ID NO: 226138 - protein, 9 aa, Homo Sapiens
EKIVDMYKD

SEQ ID NO: 226139 - protein, 9 aa, Homo Sapiens
ADLPEGEKN

SEQ ID NO: 226140 - protein, 9 aa, Homo Sapiens
SDYFTHQNH

SEQ ID NO: 226141 - protein, 9 aa, Homo Sapiens
VNDLYWHVR

SEQ ID NO: 226142 - protein, 9 aa, Homo Sapiens
EKRYLQDTW

SEQ ID NO: 226143 - protein, 9 aa, Homo Sapiens
MYVDAAWGG

SEQ ID NO: 226144 - protein, 9 aa, Homo Sapiens
YHADDVKIF

SEQ ID NO: 226145 - protein, 9 aa, Homo Sapiens
TLGLELSER

SEQ ID NO: 226146 - protein, 9 aa, Homo Sapiens
VEHTPIWRP

SEQ ID NO: 226147 - protein, 9 aa, Homo Sapiens
QGAQGVGSG

SEQ ID NO: 226148 - protein, 9 aa, Homo Sapiens
RRPGSAWRP

SEQ ID NO: 226149 - protein, 9 aa, Homo Sapiens
RPLSLQCQS

SEQ ID NO: 226150 - protein, 9 aa, Homo Sapiens
ESKRIMRDL

SEQ ID NO: 226151 - protein, 9 aa, Homo Sapiens
SGQEFWPRQ

SEQ ID NO: 226152 - protein, 9 aa, Homo Sapiens
SSPVTFIHG

SEQ ID NO: 226153 - protein, 9 aa, Homo Sapiens
AVAVHHGKI

SEQ ID NO: 226154 - protein, 9 aa, Homo Sapiens
LVSDVPKSC

SEQ ID NO: 226155 - protein, 9 aa, Homo Sapiens
KLGVAPSSP

SEQ ID NO: 226156 - protein, 9 aa, Homo Sapiens
WIGNQRRKY

SEQ ID NO: 226157 - protein, 9 aa, Homo Sapiens
VAQTHQLRR

SEQ ID NO: 226158 - protein, 9 aa, Homo Sapiens
PTGGDGKTL

SEQ ID NO: 226159 - protein, 9 aa, Homo Sapiens
SSEVEDDEK

SEQ ID NO: 226160 - protein, 9 aa, Homo Sapiens
LKPRTSVED

SEQ ID NO: 226161 - protein, 9 aa, Homo Sapiens
FRWAHFQKN

SEQ ID NO: 226162 - protein, 9 aa, Homo Sapiens
TVSHCGHGA

SEQ ID NO: 226163 - protein, 9 aa, Homo Sapiens
QEVCMLFKD

SEQ ID NO: 226164 - protein, 9 aa, Homo Sapiens
NPLSRQPVR

SEQ ID NO: 226165 - protein, 9 aa, Homo Sapiens
HAVEEEAVG

SEQ ID NO: 226166 - protein, 9 aa, Homo Sapiens
PLLNPLIHS

SEQ ID NO: 226167 - protein, 9 aa, Homo Sapiens
MNCGKSFSC

SEQ ID NO: 226168 - protein, 9 aa, Homo Sapiens
VTLFYGMGF

SEQ ID NO: 226169 - protein, 9 aa, Homo Sapiens
WSLSEYTRT

SEQ ID NO: 226170 - protein, 9 aa, Homo Sapiens
LGASSCRRP

SEQ ID NO: 226171 - protein, 9 aa, Homo Sapiens
PAPHPYSLQ

SEQ ID NO: 226172 - protein, 9 aa, Homo Sapiens
HHKPKLCRL

SEQ ID NO: 226173 - protein, 9 aa, Homo Sapiens
CHWCKYHNL

SEQ ID NO: 226174 - protein, 9 aa, Homo Sapiens
NLTGLPPQR

SEQ ID NO: 226175 - protein, 9 aa, Homo Sapiens
KPRPLPPPP

SEQ ID NO: 226176 - protein, 9 aa, Homo Sapiens
ESDTPQIEA

SEQ ID NO: 226177 - protein, 9 aa, Homo Sapiens
CPISAQSLP

SEQ ID NO: 226178 - protein, 9 aa, Homo Sapiens
NPDTELQSE

SEQ ID NO: 226179 - protein, 9 aa, Homo Sapiens
APNCWHRDS

SEQ ID NO: 226180 - protein, 9 aa, Homo Sapiens
SVAAWPSRR

SEQ ID NO: 226181 - protein, 9 aa, Homo Sapiens
QNRGLRLIK

SEQ ID NO: 226182 - protein, 9 aa, Homo Sapiens
FSNVYPSVK

SEQ ID NO: 226183 - protein, 9 aa, Homo Sapiens
KKKKRTRII

SEQ ID NO: 226184 - protein, 9 aa, Homo Sapiens
ICITFYYFF

SEQ ID NO: 226185 - protein, 9 aa, Homo Sapiens
LYTLRIMSR

SEQ ID NO: 226186 - protein, 9 aa, Homo Sapiens
TLVPMPVCV

SEQ ID NO: 226187 - protein, 9 aa, Homo Sapiens
AASYGRRRS

SEQ ID NO: 226188 - protein, 9 aa, Homo Sapiens
EEMLDAELE

SEQ ID NO: 226189 - protein, 9 aa, Homo Sapiens
CSFKVPPVA

SEQ ID NO: 226190 - protein, 9 aa, Homo Sapiens
FEKFSGKEP

SEQ ID NO: 226191 - protein, 9 aa, Homo Sapiens
IDMKQALMM

SEQ ID NO: 226192 - protein, 9 aa, Homo Sapiens
LGEQECQAE

SEQ ID NO: 226193 - protein, 9 aa, Homo Sapiens
ASQPSSSVW

SEQ ID NO: 226194 - protein, 9 aa, Homo Sapiens
HEAESNIAL

SEQ ID NO: 226195 - protein, 9 aa, Homo Sapiens
PATGPTSSS

SEQ ID NO: 226196 - protein, 9 aa, Homo Sapiens
SVSVLSLII

SEQ ID NO: 226197 - protein, 9 aa, Homo Sapiens
TTVRKAKFC

SEQ ID NO: 226198 - protein, 9 aa, Homo Sapiens
LLPCTFLKN

SEQ ID NO: 226199 - protein, 9 aa, Homo Sapiens
GGRTPGIII

SEQ ID NO: 226200 - protein, 9 aa, Homo Sapiens
NAGIPQHHP

SEQ ID NO: 226201 - protein, 9 aa, Homo Sapiens
HHSFMESSQ

SEQ ID NO: 226202 - protein, 9 aa, Homo Sapiens
LLPPRSRAP

SEQ ID NO: 226203 - protein, 9 aa, Homo Sapiens
QTEPHTVLS

SEQ ID NO: 226204 - protein, 9 aa, Homo Sapiens
HRPSLFHRR

SEQ ID NO: 226205 - protein, 9 aa, Homo Sapiens
PRPQLLPPR

SEQ ID NO: 226206 - protein, 9 aa, Homo Sapiens
QRTHMPSYE

SEQ ID NO: 226207 - protein, 9 aa, Homo Sapiens
SSPSALPCA

SEQ ID NO: 226208 - protein, 9 aa, Homo Sapiens
STPAPWAGH

SEQ ID NO: 226209 - protein, 9 aa, Homo Sapiens
FGVVGKMRV

SEQ ID NO: 226210 - protein, 9 aa, Homo Sapiens
GRPSHPSTL

SEQ ID NO: 226211 - protein, 9 aa, Homo Sapiens
PSPWCLRRR

SEQ ID NO: 226212 - protein, 9 aa, Homo Sapiens
PFMTNGPLT

SEQ ID NO: 226213 - protein, 9 aa, Homo Sapiens
IPGRYLTGG

SEQ ID NO: 226214 - protein, 9 aa, Homo Sapiens
KQRKNQVFP

SEQ ID NO: 226215 - protein, 9 aa, Homo Sapiens
ETSASASQA

SEQ ID NO: 226216 - protein, 9 aa, Homo Sapiens
YILFLVLHF

SEQ ID NO: 226217 - protein, 9 aa, Homo Sapiens
SINPNPLQP

SEQ ID NO: 226218 - protein, 9 aa, Homo Sapiens
DFQKALLTL

SEQ ID NO: 226219 - protein, 9 aa, Homo Sapiens
TFASLNDCH

SEQ ID NO: 226220 - protein, 9 aa, Homo Sapiens
CKYHNLCTH

SEQ ID NO: 226221 - protein, 9 aa, Homo Sapiens
HQVYIRADI

SEQ ID NO: 226222 - protein, 9 aa, Homo Sapiens
IAWEYKMPG

SEQ ID NO: 226223 - protein, 9 aa, Homo Sapiens
RRQPPHHLV

SEQ ID NO: 226224 - protein, 9 aa, Homo Sapiens
SGLNAWNGF

SEQ ID NO: 226225 - protein, 9 aa, Homo Sapiens
FWVVFVLLW

SEQ ID NO: 226226 - protein, 9 aa, Homo Sapiens
KRGTGIGVH

SEQ ID NO: 226227 - protein, 9 aa, Homo Sapiens
VKEEMKKTT

SEQ ID NO: 226228 - protein, 9 aa, Homo Sapiens
RSTSSSGRM

SEQ ID NO: 226229 - protein, 9 aa, Homo Sapiens
NLVHMIEHT

SEQ ID NO: 226230 - protein, 9 aa, Homo Sapiens
ETPLALTYI

SEQ ID NO: 226231 - protein, 9 aa, Homo Sapiens
PGGRANVGA

SEQ ID NO: 226232 - protein, 9 aa, Homo Sapiens
TNQKKVLKV

SEQ ID NO: 226233 - protein, 9 aa, Homo Sapiens
VKCFEKNEA

SEQ ID NO: 226234 - protein, 9 aa, Homo Sapiens
PAHSPTPTS

SEQ ID NO: 226235 - protein, 9 aa, Homo Sapiens
IYVRPQLFS

SEQ ID NO: 226236 - protein, 9 aa, Homo Sapiens
DPIRTSMCQ

SEQ ID NO: 226237 - protein, 9 aa, Homo Sapiens
YPAPHPYSL

SEQ ID NO: 226238 - protein, 9 aa, Homo Sapiens
GIQKKTKCQ

SEQ ID NO: 226239 - protein, 9 aa, Homo Sapiens
LLPVGFLLI

SEQ ID NO: 226240 - protein, 9 aa, Homo Sapiens
RGRLPACLA

SEQ ID NO: 226241 - protein, 9 aa, Homo Sapiens
EEQLKLKDE

SEQ ID NO: 226242 - protein, 9 aa, Homo Sapiens
HKKTIQNEA

SEQ ID NO: 226243 - protein, 9 aa, Homo Sapiens
LCQCRCITD

SEQ ID NO: 226244 - protein, 9 aa, Homo Sapiens
PDGTKNMLE

SEQ ID NO: 226245 - protein, 9 aa, Homo Sapiens
SVLSLIITA

SEQ ID NO: 226246 - protein, 9 aa, Homo Sapiens
GGCGWASML

SEQ ID NO: 226247 - protein, 9 aa, Homo Sapiens
LLTKVNMDI

SEQ ID NO: 226248 - protein, 9 aa, Homo Sapiens
LVPLISLMI

SEQ ID NO: 226249 - protein, 9 aa, Homo Sapiens
NNKIPLLYL

SEQ ID NO: 226250 - protein, 9 aa, Homo Sapiens
SGTHQMRTA

SEQ ID NO: 226251 - protein, 9 aa, Homo Sapiens
ESCDLVVEN

SEQ ID NO: 226252 - protein, 9 aa, Homo Sapiens
SNRIRLHRL

SEQ ID NO: 226253 - protein, 9 aa, Homo Sapiens
VKYNGSCPR

SEQ ID NO: 226254 - protein, 9 aa, Homo Sapiens
ASGMPPSSP

SEQ ID NO: 226255 - protein, 9 aa, Homo Sapiens
PVLCSVSIC

SEQ ID NO: 226256 - protein, 9 aa, Homo Sapiens
ATQAPCMMT

SEQ ID NO: 226257 - protein, 9 aa, Homo Sapiens
WRWLRKQNI

SEQ ID NO: 226258 - protein, 9 aa, Homo Sapiens
EGDGQGRGR

SEQ ID NO: 226259 - protein, 9 aa, Homo Sapiens
IILKANETF

SEQ ID NO: 226260 - protein, 9 aa, Homo Sapiens
PQSSPFLAR

SEQ ID NO: 226261 - protein, 9 aa, Homo Sapiens
IVIELGTNS

SEQ ID NO: 226262 - protein, 9 aa, Homo Sapiens
RLISSPNNA

SEQ ID NO: 226263 - protein, 9 aa, Homo Sapiens
LVTTPVNPA

SEQ ID NO: 226264 - protein, 9 aa, Homo Sapiens
LVRFYIAEL

SEQ ID NO: 226265 - protein, 9 aa, Homo Sapiens
NSWSTWLSL

SEQ ID NO: 226266 - protein, 9 aa, Homo Sapiens
KETDNPVIP

SEQ ID NO: 226267 - protein, 9 aa, Homo Sapiens
IRRTRQADG

SEQ ID NO: 226268 - protein, 9 aa, Homo Sapiens
WCPTQPRRV

SEQ ID NO: 226269 - protein, 9 aa, Homo Sapiens
NGDNKTNQP

SEQ ID NO: 226270 - protein, 9 aa, Homo Sapiens
DIKVLGCPK

SEQ ID NO: 226271 - protein, 9 aa, Homo Sapiens
HAFFRSPHR

SEQ ID NO: 226272 - protein, 9 aa, Homo Sapiens
PQAAARRVG

SEQ ID NO: 226273 - protein, 9 aa, Homo Sapiens
CFRHAPPPR

SEQ ID NO: 226274 - protein, 9 aa, Homo Sapiens
VNLLLELDH

SEQ ID NO: 226275 - protein, 9 aa, Homo Sapiens
NLDDCANRP

SEQ ID NO: 226276 - protein, 9 aa, Homo Sapiens
VQREVWDTV

SEQ ID NO: 226277 - protein, 9 aa, Homo Sapiens
NGSCPREEW

SEQ ID NO: 226278 - protein, 9 aa, Homo Sapiens
FPPSRCESA

SEQ ID NO: 226279 - protein, 9 aa, Homo Sapiens
RYEDMKNHR

SEQ ID NO: 226280 - protein, 9 aa, Homo Sapiens
SWPARCDQA

SEQ ID NO: 226281 - protein, 9 aa, Homo Sapiens
TQGLCVVAH

SEQ ID NO: 226282 - protein, 9 aa, Homo Sapiens
MDNLGKETN

SEQ ID NO: 226283 - protein, 9 aa, Homo Sapiens
QQNHHSFME

SEQ ID NO: 226284 - protein, 9 aa, Homo Sapiens
EPLYGFHAH

SEQ ID NO: 226285 - protein, 9 aa, Homo Sapiens
QSTAAGLWT

SEQ ID NO: 226286 - protein, 9 aa, Homo Sapiens
PGSGYPWAG

SEQ ID NO: 226287 - protein, 9 aa, Homo Sapiens
TKGFLEKTM

SEQ ID NO: 226288 - protein, 9 aa, Homo Sapiens
APALPGPGV

SEQ ID NO: 226289 - protein, 9 aa, Homo Sapiens
PRTLEGCIS

SEQ ID NO: 226290 - protein, 9 aa, Homo Sapiens
KKQDPKGKG

SEQ ID NO: 226291 - protein, 9 aa, Homo Sapiens
GPGVHGLVV

SEQ ID NO: 226292 - protein, 9 aa, Homo Sapiens
VAVATVETE

SEQ ID NO: 226293 - protein, 9 aa, Homo Sapiens
PTVSTGGHT

SEQ ID NO: 226294 - protein, 9 aa, Homo Sapiens
LRYLKIMQL

SEQ ID NO: 226295 - protein, 9 aa, Homo Sapiens
IIGSLIFHK

SEQ ID NO: 226296 - protein, 9 aa, Homo Sapiens
ERHPREYLK

SEQ ID NO: 226297 - protein, 9 aa, Homo Sapiens
VLLLLLVPC

SEQ ID NO: 226298 - protein, 9 aa, Homo Sapiens
VCENRRGSL

SEQ ID NO: 226299 - protein, 9 aa, Homo Sapiens
RSSSSHNRG

SEQ ID NO: 226300 - protein, 9 aa, Homo Sapiens
APLRLWSWC

SEQ ID NO: 226301 - protein, 9 aa, Homo Sapiens
DHKPLVLQH

SEQ ID NO: 226302 - protein, 9 aa, Homo Sapiens
SCFCMAGTV

SEQ ID NO: 226303 - protein, 9 aa, Homo Sapiens
LGESMTSPI

SEQ ID NO: 226304 - protein, 9 aa, Homo Sapiens
APGGTVWPP

SEQ ID NO: 226305 - protein, 9 aa, Homo Sapiens
TSHSFRTAS

SEQ ID NO: 226306 - protein, 9 aa, Homo Sapiens
QVRRYCTAF

SEQ ID NO: 226307 - protein, 9 aa, Homo Sapiens
QERLDATRQ

SEQ ID NO: 226308 - protein, 9 aa, Homo Sapiens
PLALALSSR

SEQ ID NO: 226309 - protein, 9 aa, Homo Sapiens
RGLFGVVGK

SEQ ID NO: 226310 - protein, 9 aa, Homo Sapiens
SLASTSKCT

SEQ ID NO: 226311 - protein, 9 aa, Homo Sapiens
HLVRQDHQI

SEQ ID NO: 226312 - protein, 9 aa, Homo Sapiens
RSKSQRSWM

SEQ ID NO: 226313 - protein, 9 aa, Homo Sapiens
VVFPEHQQH

SEQ ID NO: 226314 - protein, 9 aa, Homo Sapiens
GSGHCLCRS

SEQ ID NO: 226315 - protein, 9 aa, Homo Sapiens
YYNVVICIT

SEQ ID NO: 226316 - protein, 9 aa, Homo Sapiens
AFETPEEKC

SEQ ID NO: 226317 - protein, 9 aa, Homo Sapiens
PDRDHHVSI

SEQ ID NO: 226318 - protein, 9 aa, Homo Sapiens
MWTATECWI

SEQ ID NO: 226319 - protein, 9 aa, Homo Sapiens
DPVLLKKKL

SEQ ID NO: 226320 - protein, 9 aa, Homo Sapiens
PPVTNPVYE

SEQ ID NO: 226321 - protein, 9 aa, Homo Sapiens
GCGFGGPGF

SEQ ID NO: 226322 - protein, 9 aa, Homo Sapiens
RLWSNFWGG

SEQ ID NO: 226323 - protein, 9 aa, Homo Sapiens
QLEWDEYAK

SEQ ID NO: 226324 - protein, 9 aa, Homo Sapiens
VKPPMPTGL

SEQ ID NO: 226325 - protein, 9 aa, Homo Sapiens
QMVTKLTRG

SEQ ID NO: 226326 - protein, 9 aa, Homo Sapiens
KMTVFATII

SEQ ID NO: 226327 - protein, 9 aa, Homo Sapiens
VIFHQGISQ

SEQ ID NO: 226328 - protein, 9 aa, Homo Sapiens
SSSQRYPEA

SEQ ID NO: 226329 - protein, 9 aa, Homo Sapiens
RIQMLLSRR

SEQ ID NO: 226330 - protein, 9 aa, Homo Sapiens
WILVSMTVC

SEQ ID NO: 226331 - protein, 9 aa, Homo Sapiens
PSATTANRA

SEQ ID NO: 226332 - protein, 9 aa, Homo Sapiens
SVELGSKPF

SEQ ID NO: 226333 - protein, 9 aa, Homo Sapiens
PGMPRPHGA

SEQ ID NO: 226334 - protein, 9 aa, Homo Sapiens
STLEVLRGI

SEQ ID NO: 226335 - protein, 9 aa, Homo Sapiens
STGTRRRRP

SEQ ID NO: 226336 - protein, 9 aa, Homo Sapiens
SQQDDRSPL

SEQ ID NO: 226337 - protein, 9 aa, Homo Sapiens
ATCTWTSAL

SEQ ID NO: 226338 - protein, 9 aa, Homo Sapiens
YEIIPQGVV

SEQ ID NO: 226339 - protein, 9 aa, Homo Sapiens
TGESDTPQI

SEQ ID NO: 226340 - protein, 9 aa, Homo Sapiens
TLPLEDVWW

SEQ ID NO: 226341 - protein, 9 aa, Homo Sapiens
RCRDETRRA

SEQ ID NO: 226342 - protein, 9 aa, Homo Sapiens
SKQNRGLRL

SEQ ID NO: 226343 - protein, 9 aa, Homo Sapiens
TPENSPKGA

SEQ ID NO: 226344 - protein, 9 aa, Homo Sapiens
MTSATGARW

SEQ ID NO: 226345 - protein, 9 aa, Homo Sapiens
CQNPEKLAL

SEQ ID NO: 226346 - protein, 9 aa, Homo Sapiens
PVNMDNLGK

SEQ ID NO: 226347 - protein, 9 aa, Homo Sapiens
IWLAAERSH

SEQ ID NO: 226348 - protein, 9 aa, Homo Sapiens
VTDLFPVLS

SEQ ID NO: 226349 - protein, 9 aa, Homo Sapiens
NYANCTWSI

SEQ ID NO: 226350 - protein, 9 aa, Homo Sapiens
LEKERKRLK

SEQ ID NO: 226351 - protein, 9 aa, Homo Sapiens
RSSQTTHRL

SEQ ID NO: 226352 - protein, 9 aa, Homo Sapiens
AQTLCSVKD

SEQ ID NO: 226353 - protein, 9 aa, Homo Sapiens
PVGRLLLPA

SEQ ID NO: 226354 - protein, 9 aa, Homo Sapiens
VLINNQTLQ

SEQ ID NO: 226355 - protein, 9 aa, Homo Sapiens
EDSVPHGAD

SEQ ID NO: 226356 - protein, 9 aa, Homo Sapiens
EDRVKCFEK

SEQ ID NO: 226357 - protein, 9 aa, Homo Sapiens
AQSLLRLEC

SEQ ID NO: 226358 - protein, 9 aa, Homo Sapiens
RWLSPGDLE

SEQ ID NO: 226359 - protein, 9 aa, Homo Sapiens
LKERLAELR

SEQ ID NO: 226360 - protein, 9 aa, Homo Sapiens
LSPLLGSCN

SEQ ID NO: 226361 - protein, 9 aa, Homo Sapiens
PQPGVFAIN

SEQ ID NO: 226362 - protein, 9 aa, Homo Sapiens
AGTLGESGS

SEQ ID NO: 226363 - protein, 9 aa, Homo Sapiens
RRPESCHDF

SEQ ID NO: 226364 - protein, 9 aa, Homo Sapiens
TAPDGTPPG

SEQ ID NO: 226365 - protein, 9 aa, Homo Sapiens
PPSGSRAEP

SEQ ID NO: 226366 - protein, 9 aa, Homo Sapiens
ALMTQQTYL

SEQ ID NO: 226367 - protein, 9 aa, Homo Sapiens
RKSDFCWCV

SEQ ID NO: 226368 - protein, 9 aa, Homo Sapiens
SVWNASRPP

SEQ ID NO: 226369 - protein, 9 aa, Homo Sapiens
PPAPPAALV

SEQ ID NO: 226370 - protein, 9 aa, Homo Sapiens
ECPEYSGPL

SEQ ID NO: 226371 - protein, 9 aa, Homo Sapiens
RITRAHTGW

SEQ ID NO: 226372 - protein, 9 aa, Homo Sapiens
DATTNTSLI

SEQ ID NO: 226373 - protein, 9 aa, Homo Sapiens
DGHPLWLWK

SEQ ID NO: 226374 - protein, 9 aa, Homo Sapiens
QGGQAPACL

SEQ ID NO: 226375 - protein, 9 aa, Homo Sapiens
LTEVQFDLV

SEQ ID NO: 226376 - protein, 9 aa, Homo Sapiens
QETEQGLVV

SEQ ID NO: 226377 - protein, 9 aa, Homo Sapiens
DRCDQHIDC

SEQ ID NO: 226378 - protein, 9 aa, Homo Sapiens
LYAMTGKQV

SEQ ID NO: 226379 - protein, 9 aa, Homo Sapiens
EDEDLPPGT

SEQ ID NO: 226380 - protein, 9 aa, Homo Sapiens
PGKTSRGHP

SEQ ID NO: 226381 - protein, 9 aa, Homo Sapiens
ICKKFSNPF

SEQ ID NO: 226382 - protein, 9 aa, Homo Sapiens
MKIPRQLPQ

SEQ ID NO: 226383 - protein, 9 aa, Homo Sapiens
AGVTSFGYR

SEQ ID NO: 226384 - protein, 9 aa, Homo Sapiens
ASVLREPAF

SEQ ID NO: 226385 - protein, 9 aa, Homo Sapiens
VDQHEVRYL

SEQ ID NO: 226386 - protein, 9 aa, Homo Sapiens
PTQRCLRGT

SEQ ID NO: 226387 - protein, 9 aa, Homo Sapiens
MAGQSQKAT

SEQ ID NO: 226388 - protein, 9 aa, Homo Sapiens
GGFGMCKYT

SEQ ID NO: 226389 - protein, 9 aa, Homo Sapiens
TMAVIIRDK

SEQ ID NO: 226390 - protein, 9 aa, Homo Sapiens
LEEIEEKTH

SEQ ID NO: 226391 - protein, 9 aa, Homo Sapiens
PPNTHPSPL

SEQ ID NO: 226392 - protein, 9 aa, Homo Sapiens
RRPRCSGWR

SEQ ID NO: 226393 - protein, 9 aa, Homo Sapiens
RRWCWRCPW

SEQ ID NO: 226394 - protein, 9 aa, Homo Sapiens
PPKTASSTR

SEQ ID NO: 226395 - protein, 9 aa, Homo Sapiens
YTVKSCDDF

SEQ ID NO: 226396 - protein, 9 aa, Homo Sapiens
SPNVGVTLD

SEQ ID NO: 226397 - protein, 9 aa, Homo Sapiens
ARAMLSVEL

SEQ ID NO: 226398 - protein, 9 aa, Homo Sapiens
TAAGWIGTG

SEQ ID NO: 226399 - protein, 9 aa, Homo Sapiens
PQQVQELGI

SEQ ID NO: 226400 - protein, 9 aa, Homo Sapiens
ENREFLSIT

SEQ ID NO: 226401 - protein, 9 aa, Homo Sapiens
VETEVEAME

SEQ ID NO: 226402 - protein, 9 aa, Homo Sapiens
WAGTWSKVL

SEQ ID NO: 226403 - protein, 9 aa, Homo Sapiens
GTTLRTTSP

SEQ ID NO: 226404 - protein, 9 aa, Homo Sapiens
QSLLRLECP

SEQ ID NO: 226405 - protein, 9 aa, Homo Sapiens
TAVPRGPYG

SEQ ID NO: 226406 - protein, 9 aa, Homo Sapiens
QEEMLNTEE

SEQ ID NO: 226407 - protein, 9 aa, Homo Sapiens
YKKTTRAYL

SEQ ID NO: 226408 - protein, 9 aa, Homo Sapiens
RRQTSIRYS

SEQ ID NO: 226409 - protein, 9 aa, Homo Sapiens
PAATSSLEA

SEQ ID NO: 226410 - protein, 9 aa, Homo Sapiens
VSNPSLITR

SEQ ID NO: 226411 - protein, 9 aa, Homo Sapiens
ETFGGWVCP

SEQ ID NO: 226412 - protein, 9 aa, Homo Sapiens
WVTEDPAPW

SEQ ID NO: 226413 - protein, 9 aa, Homo Sapiens
VAVGSAVWH

SEQ ID NO: 226414 - protein, 9 aa, Homo Sapiens
EDFWILVSM

SEQ ID NO: 226415 - protein, 9 aa, Homo Sapiens
YVYSTPLRR

SEQ ID NO: 226416 - protein, 9 aa, Homo Sapiens
WPTHLPSAP

SEQ ID NO: 226417 - protein, 9 aa, Homo Sapiens
FQERVRIEK

SEQ ID NO: 226418 - protein, 9 aa, Homo Sapiens
SSSRIPRRT

SEQ ID NO: 226419 - protein, 9 aa, Homo Sapiens
DELTALLQE

SEQ ID NO: 226420 - protein, 9 aa, Homo Sapiens
LQDAHTLDG

SEQ ID NO: 226421 - protein, 9 aa, Homo Sapiens
PASALLQPP

SEQ ID NO: 226422 - protein, 9 aa, Homo Sapiens
KRRGSEGTK

SEQ ID NO: 226423 - protein, 9 aa, Homo Sapiens
PNSWRAWGS

SEQ ID NO: 226424 - protein, 9 aa, Homo Sapiens
FMERESLIR

SEQ ID NO: 226425 - protein, 9 aa, Homo Sapiens
YITLCIVFP

SEQ ID NO: 226426 - protein, 9 aa, Homo Sapiens
GESGSRAAG

SEQ ID NO: 226427 - protein, 9 aa, Homo Sapiens
IKKHRAACL

SEQ ID NO: 226428 - protein, 9 aa, Homo Sapiens
GRAPNCWHR

SEQ ID NO: 226429 - protein, 9 aa, Homo Sapiens
TQRKTDSIE

SEQ ID NO: 226430 - protein, 9 aa, Homo Sapiens
LRWKPLLWL

SEQ ID NO: 226431 - protein, 9 aa, Homo Sapiens
RITTEAGQL

SEQ ID NO: 226432 - protein, 9 aa, Homo Sapiens
ARRSRVPRC

SEQ ID NO: 226433 - protein, 9 aa, Homo Sapiens
SYSWPRVPH

SEQ ID NO: 226434 - protein, 9 aa, Homo Sapiens
LRRLAATTL

SEQ ID NO: 226435 - protein, 9 aa, Homo Sapiens
LDTWESPKL

SEQ ID NO: 226436 - protein, 9 aa, Homo Sapiens
PRRQPPHHL

SEQ ID NO: 226437 - protein, 9 aa, Homo Sapiens
KRGHRRPRV

SEQ ID NO: 226438 - protein, 9 aa, Homo Sapiens
SVQFSKVLI

SEQ ID NO: 226439 - protein, 9 aa, Homo Sapiens
DEEEDGEDM

SEQ ID NO: 226440 - protein, 9 aa, Homo Sapiens
RKMYEEFLN

SEQ ID NO: 226441 - protein, 9 aa, Homo Sapiens
RRRKWGMTS

SEQ ID NO: 226442 - protein, 9 aa, Homo Sapiens
SLWPGLRDW

SEQ ID NO: 226443 - protein, 9 aa, Homo Sapiens
EHHGGEEVL

SEQ ID NO: 226444 - protein, 9 aa, Homo Sapiens
RNSSKNKIT

SEQ ID NO: 226445 - protein, 9 aa, Homo Sapiens
YFEASVKLR

SEQ ID NO: 226446 - protein, 9 aa, Homo Sapiens
AVCQVKKSN

SEQ ID NO: 226447 - protein, 9 aa, Homo Sapiens
SWETECDRV

SEQ ID NO: 226448 - protein, 9 aa, Homo Sapiens
PCHKHLMKR

SEQ ID NO: 226449 - protein, 9 aa, Homo Sapiens
LGVDGDSSS

SEQ ID NO: 226450 - protein, 9 aa, Homo Sapiens
FVEGFPWQK

SEQ ID NO: 226451 - protein, 9 aa, Homo Sapiens
VLDPRAQTL

SEQ ID NO: 226452 - protein, 9 aa, Homo Sapiens
GGGGTVVGL

SEQ ID NO: 226453 - protein, 9 aa, Homo Sapiens
MGKQNSKLW

SEQ ID NO: 226454 - protein, 9 aa, Homo Sapiens
LDKASANIF

SEQ ID NO: 226455 - protein, 9 aa, Homo Sapiens
KLTSTDGPG

SEQ ID NO: 226456 - protein, 9 aa, Homo Sapiens
KKAYPSEKS

SEQ ID NO: 226457 - protein, 9 aa, Homo Sapiens
GLVATVEAV

SEQ ID NO: 226458 - protein, 9 aa, Homo Sapiens
PPTKGACTA

SEQ ID NO: 226459 - protein, 9 aa, Homo Sapiens
LKRPILFLR

SEQ ID NO: 226460 - protein, 9 aa, Homo Sapiens
IEAIFQSME

SEQ ID NO: 226461 - protein, 9 aa, Homo Sapiens
THCTGARMG

SEQ ID NO: 226462 - protein, 9 aa, Homo Sapiens
ASGRNEPSR

SEQ ID NO: 226463 - protein, 9 aa, Homo Sapiens
TSGDFQKAL

SEQ ID NO: 226464 - protein, 9 aa, Homo Sapiens
LSAPRATLQ

SEQ ID NO: 226465 - protein, 9 aa, Homo Sapiens
YQLRTVRCI

SEQ ID NO: 226466 - protein, 9 aa, Homo Sapiens
LLNLCQRTE

SEQ ID NO: 226467 - protein, 9 aa, Homo Sapiens
FVLFRCSYQ

SEQ ID NO: 226468 - protein, 9 aa, Homo Sapiens
KLHAVAAST

SEQ ID NO: 226469 - protein, 9 aa, Homo Sapiens
TSDDELIIK

SEQ ID NO: 226470 - protein, 9 aa, Homo Sapiens
PLVPLISLM

SEQ ID NO: 226471 - protein, 9 aa, Homo Sapiens
AQCRPAWTA

SEQ ID NO: 226472 - protein, 9 aa, Homo Sapiens
ERGPIFTTV

SEQ ID NO: 226473 - protein, 9 aa, Homo Sapiens
GLRGHCAGA

SEQ ID NO: 226474 - protein, 9 aa, Homo Sapiens
VIPKTSTHC

SEQ ID NO: 226475 - protein, 9 aa, Homo Sapiens
HWQMYWLLF

SEQ ID NO: 226476 - protein, 9 aa, Homo Sapiens
EELCEGPEH

SEQ ID NO: 226477 - protein, 9 aa, Homo Sapiens
HTSSGSIKR

SEQ ID NO: 226478 - protein, 9 aa, Homo Sapiens
GGTQIQPLP

SEQ ID NO: 226479 - protein, 9 aa, Homo Sapiens
LLFTKTSLF

SEQ ID NO: 226480 - protein, 9 aa, Homo Sapiens
KRKKQTSIE

SEQ ID NO: 226481 - protein, 9 aa, Homo Sapiens
ESGRYVYST

SEQ ID NO: 226482 - protein, 9 aa, Homo Sapiens
IYRSSLSHL

SEQ ID NO: 226483 - protein, 9 aa, Homo Sapiens
NTHLLPLRV

SEQ ID NO: 226484 - protein, 9 aa, Homo Sapiens
ETEVAMEAK

SEQ ID NO: 226485 - protein, 9 aa, Homo Sapiens
WTAAGVSRC

SEQ ID NO: 226486 - protein, 9 aa, Homo Sapiens
EEHHTEPSS

SEQ ID NO: 226487 - protein, 9 aa, Homo Sapiens
PSTTTLSCP

SEQ ID NO: 226488 - protein, 9 aa, Homo Sapiens
KYLLKQALT

SEQ ID NO: 226489 - protein, 9 aa, Homo Sapiens
IFSSPPSVT

SEQ ID NO: 226490 - protein, 9 aa, Homo Sapiens
PLACLHLPS

SEQ ID NO: 226491 - protein, 9 aa, Homo Sapiens
QANIITGAP

SEQ ID NO: 226492 - protein, 9 aa, Homo Sapiens
GHPLWLWKA

SEQ ID NO: 226493 - protein, 9 aa, Homo Sapiens
RIDRLEDLS

SEQ ID NO: 226494 - protein, 9 aa, Homo Sapiens
EGTCFSEVQ

SEQ ID NO: 226495 - protein, 9 aa, Homo Sapiens
GMAVNKPAE

SEQ ID NO: 226496 - protein, 9 aa, Homo Sapiens
TNVKNVTKF

SEQ ID NO: 226497 - protein, 9 aa, Homo Sapiens
REAIFPFNI

SEQ ID NO: 226498 - protein, 9 aa, Homo Sapiens
RLSGQRPGP

SEQ ID NO: 226499 - protein, 9 aa, Homo Sapiens
EGIPAGSPS

SEQ ID NO: 226500 - protein, 9 aa, Homo Sapiens
VTSDDELII

SEQ ID NO: 226501 - protein, 9 aa, Homo Sapiens
TMYSFLLDF

SEQ ID NO: 226502 - protein, 9 aa, Homo Sapiens
SPLRPGAPG

SEQ ID NO: 226503 - protein, 9 aa, Homo Sapiens
PGTLRKSHT

SEQ ID NO: 226504 - protein, 9 aa, Homo Sapiens
ASRVWPSTT

SEQ ID NO: 226505 - protein, 9 aa, Homo Sapiens
SAQFLLLLQ

SEQ ID NO: 226506 - protein, 9 aa, Homo Sapiens
ALGLAPQAH

SEQ ID NO: 226507 - protein, 9 aa, Homo Sapiens
LQEALLHFG

SEQ ID NO: 226508 - protein, 9 aa, Homo Sapiens
VILYRSYCS

SEQ ID NO: 226509 - protein, 9 aa, Homo Sapiens
WYLCSSASS

SEQ ID NO: 226510 - protein, 9 aa, Homo Sapiens
EIKDWSKLH

SEQ ID NO: 226511 - protein, 9 aa, Homo Sapiens
AVPPPSSSS

SEQ ID NO: 226512 - protein, 9 aa, Homo Sapiens
LTEDKKNGI

SEQ ID NO: 226513 - protein, 9 aa, Homo Sapiens
TEVNSPPPS

SEQ ID NO: 226514 - protein, 9 aa, Homo Sapiens
VTLAAWNEK

SEQ ID NO: 226515 - protein, 9 aa, Homo Sapiens
SGCVWLLPL

SEQ ID NO: 226516 - protein, 9 aa, Homo Sapiens
ATASCGTGS

SEQ ID NO: 226517 - protein, 9 aa, Homo Sapiens
LLRFTKTCR

SEQ ID NO: 226518 - protein, 9 aa, Homo Sapiens
VEARHLEFR

SEQ ID NO: 226519 - protein, 9 aa, Homo Sapiens
LTWTWQWSV

SEQ ID NO: 226520 - protein, 9 aa, Homo Sapiens
CQEKYQLQV

SEQ ID NO: 226521 - protein, 9 aa, Homo Sapiens
QYGGTYNRV

SEQ ID NO: 226522 - protein, 9 aa, Homo Sapiens
IQFLDRQLS

SEQ ID NO: 226523 - protein, 9 aa, Homo Sapiens
EHFLMIKKH

SEQ ID NO: 226524 - protein, 9 aa, Homo Sapiens
APGGAATWR

SEQ ID NO: 226525 - protein, 9 aa, Homo Sapiens
IALHLRRSL

SEQ ID NO: 226526 - protein, 9 aa, Homo Sapiens
QTRPLWSRL

SEQ ID NO: 226527 - protein, 9 aa, Homo Sapiens
SGEGRMVQD

SEQ ID NO: 226528 - protein, 9 aa, Homo Sapiens
DRQLITQVM

SEQ ID NO: 226529 - protein, 9 aa, Homo Sapiens
PLWAALATR

SEQ ID NO: 226530 - protein, 9 aa, Homo Sapiens
NGCRKTFSQ

SEQ ID NO: 226531 - protein, 9 aa, Homo Sapiens
AAPISLHMS

SEQ ID NO: 226532 - protein, 9 aa, Homo Sapiens
KITKILSDT

SEQ ID NO: 226533 - protein, 9 aa, Homo Sapiens
VVAAYQPIL

SEQ ID NO: 226534 - protein, 9 aa, Homo Sapiens
RSGCVWLLP

SEQ ID NO: 226535 - protein, 9 aa, Homo Sapiens
PVSTWSLPR

SEQ ID NO: 226536 - protein, 9 aa, Homo Sapiens
KQILSDFRA

SEQ ID NO: 226537 - protein, 9 aa, Homo Sapiens
YLLKQALTT

SEQ ID NO: 226538 - protein, 9 aa, Homo Sapiens
STIGLALAR

SEQ ID NO: 226539 - protein, 9 aa, Homo Sapiens
TSTSLTFKS

SEQ ID NO: 226540 - protein, 9 aa, Homo Sapiens
SGKKIAFHI

SEQ ID NO: 226541 - protein, 9 aa, Homo Sapiens
PESLVRFYI

SEQ ID NO: 226542 - protein, 9 aa, Homo Sapiens
EFLSPQELG

SEQ ID NO: 226543 - protein, 9 aa, Homo Sapiens
LGVTLTFRA

SEQ ID NO: 226544 - protein, 9 aa, Homo Sapiens
SQPIYRSSL

SEQ ID NO: 226545 - protein, 9 aa, Homo Sapiens
KFLSLSADG

SEQ ID NO: 226546 - protein, 9 aa, Homo Sapiens
KGGERRRGC

SEQ ID NO: 226547 - protein, 9 aa, Homo Sapiens
TRPRRKPRP

SEQ ID NO: 226548 - protein, 9 aa, Homo Sapiens
DTRICPLPP

SEQ ID NO: 226549 - protein, 9 aa, Homo Sapiens
RGVVGPRGQ

SEQ ID NO: 226550 - protein, 9 aa, Homo Sapiens
TQNVTVNVR

SEQ ID NO: 226551 - protein, 9 aa, Homo Sapiens
SLGTRMGTL

SEQ ID NO: 226552 - protein, 9 aa, Homo Sapiens
SLHGQRLVF

SEQ ID NO: 226553 - protein, 9 aa, Homo Sapiens
YHGVSLLDP

SEQ ID NO: 226554 - protein, 9 aa, Homo Sapiens
PQDASARRR

SEQ ID NO: 226555 - protein, 9 aa, Homo Sapiens
GNERYNFPN

SEQ ID NO: 226556 - protein, 9 aa, Homo Sapiens
ITFYYFFSS

SEQ ID NO: 226557 - protein, 9 aa, Homo Sapiens
KLHNRVVPG

SEQ ID NO: 226558 - protein, 9 aa, Homo Sapiens
AAKDELPHV

SEQ ID NO: 226559 - protein, 9 aa, Homo Sapiens
RGGFLILGD

SEQ ID NO: 226560 - protein, 9 aa, Homo Sapiens
QDTAQRQEC

SEQ ID NO: 226561 - protein, 9 aa, Homo Sapiens
NLLRHLDFK

SEQ ID NO: 226562 - protein, 9 aa, Homo Sapiens
DRIKLDWAT

SEQ ID NO: 226563 - protein, 9 aa, Homo Sapiens
LKMTLLGQE

SEQ ID NO: 226564 - protein, 9 aa, Homo Sapiens
LRTVRCIQP

SEQ ID NO: 226565 - protein, 9 aa, Homo Sapiens
DGLRLRACW

SEQ ID NO: 226566 - protein, 9 aa, Homo Sapiens
SPLPPPLPP

SEQ ID NO: 226567 - protein, 9 aa, Homo Sapiens
IPGGNPAYS

SEQ ID NO: 226568 - protein, 9 aa, Homo Sapiens
PPGRRRSHS

SEQ ID NO: 226569 - protein, 9 aa, Homo Sapiens
QERAVAHMD

SEQ ID NO: 226570 - protein, 9 aa, Homo Sapiens
TPLPFSTVR

SEQ ID NO: 226571 - protein, 9 aa, Homo Sapiens
NVKVVQLLI

SEQ ID NO: 226572 - protein, 9 aa, Homo Sapiens
LVLDEAVGC

SEQ ID NO: 226573 - protein, 9 aa, Homo Sapiens
SDSELEQMS

SEQ ID NO: 226574 - protein, 9 aa, Homo Sapiens
LFGVVGKMR

SEQ ID NO: 226575 - protein, 9 aa, Homo Sapiens
LTLEVEVKV

SEQ ID NO: 226576 - protein, 9 aa, Homo Sapiens
GVCRPGRLG

SEQ ID NO: 226577 - protein, 9 aa, Homo Sapiens
HGVETIWDI

SEQ ID NO: 226578 - protein, 9 aa, Homo Sapiens
RRERIQMLL

SEQ ID NO: 226579 - protein, 9 aa, Homo Sapiens
VHFSAITKR

SEQ ID NO: 226580 - protein, 9 aa, Homo Sapiens
GAHCSWGLP

SEQ ID NO: 226581 - protein, 9 aa, Homo Sapiens
WIEGANNTG

SEQ ID NO: 226582 - protein, 9 aa, Homo Sapiens
REILPESLE

SEQ ID NO: 226583 - protein, 9 aa, Homo Sapiens
SKQTEIPYV

SEQ ID NO: 226584 - protein, 9 aa, Homo Sapiens
GFPINPNTL

SEQ ID NO: 226585 - protein, 9 aa, Homo Sapiens
NFRMTILPP

SEQ ID NO: 226586 - protein, 9 aa, Homo Sapiens
SCGGLRQSP

SEQ ID NO: 226587 - protein, 9 aa, Homo Sapiens
VAASTGMWT

SEQ ID NO: 226588 - protein, 9 aa, Homo Sapiens
KLHHSRSFS

SEQ ID NO: 226589 - protein, 9 aa, Homo Sapiens
ERVPKKKSK

SEQ ID NO: 226590 - protein, 9 aa, Homo Sapiens
YDVEIKVQN

SEQ ID NO: 226591 - protein, 9 aa, Homo Sapiens
CNKYGKSFR

SEQ ID NO: 226592 - protein, 9 aa, Homo Sapiens
PLKAPVRAL

SEQ ID NO: 226593 - protein, 9 aa, Homo Sapiens
FLNNYDAET

SEQ ID NO: 226594 - protein, 9 aa, Homo Sapiens
RFHLDAHGQ

SEQ ID NO: 226595 - protein, 9 aa, Homo Sapiens
RGPVFPPLI

SEQ ID NO: 226596 - protein, 9 aa, Homo Sapiens
VGSRPIKLH

SEQ ID NO: 226597 - protein, 9 aa, Homo Sapiens
QTEYVPLLN

SEQ ID NO: 226598 - protein, 9 aa, Homo Sapiens
NNALGQNDA

SEQ ID NO: 226599 - protein, 9 aa, Homo Sapiens
FPPLIPLLG

SEQ ID NO: 226600 - protein, 9 aa, Homo Sapiens
PQRGQGLFI

SEQ ID NO: 226601 - protein, 9 aa, Homo Sapiens
LDVCLDLPG

SEQ ID NO: 226602 - protein, 9 aa, Homo Sapiens
ASSAWGSAS

SEQ ID NO: 226603 - protein, 9 aa, Homo Sapiens
CPYEYEGGH

SEQ ID NO: 226604 - protein, 9 aa, Homo Sapiens
SQELGFTML

SEQ ID NO: 226605 - protein, 9 aa, Homo Sapiens
LRREQEERE

SEQ ID NO: 226606 - protein, 9 aa, Homo Sapiens
SKNLENFLS

SEQ ID NO: 226607 - protein, 9 aa, Homo Sapiens
VGITLTLSG

SEQ ID NO: 226608 - protein, 9 aa, Homo Sapiens
LDVVDMAIT

SEQ ID NO: 226609 - protein, 9 aa, Homo Sapiens
SSSRLIVKW

SEQ ID NO: 226610 - protein, 9 aa, Homo Sapiens
MLFTYFETI

SEQ ID NO: 226611 - protein, 9 aa, Homo Sapiens
LDPIMRKMQ

SEQ ID NO: 226612 - protein, 9 aa, Homo Sapiens
RFPPPLMIK

SEQ ID NO: 226613 - protein, 9 aa, Homo Sapiens
CSSQWSPAT

SEQ ID NO: 226614 - protein, 9 aa, Homo Sapiens
CDPQGVEEI

SEQ ID NO: 226615 - protein, 9 aa, Homo Sapiens
AGGFVIGRF

SEQ ID NO: 226616 - protein, 9 aa, Homo Sapiens
DTWESPKLH

SEQ ID NO: 226617 - protein, 9 aa, Homo Sapiens
QSHRVGPAQ

SEQ ID NO: 226618 - protein, 9 aa, Homo Sapiens
LLQQMCYPI

SEQ ID NO: 226619 - protein, 9 aa, Homo Sapiens
FLNKVSILE

SEQ ID NO: 226620 - protein, 9 aa, Homo Sapiens
PLALTYIVF

SEQ ID NO: 226621 - protein, 9 aa, Homo Sapiens
SALQAKSVG

SEQ ID NO: 226622 - protein, 9 aa, Homo Sapiens
RMPGPPWPT

SEQ ID NO: 226623 - protein, 9 aa, Homo Sapiens
WLSLWSHRP

SEQ ID NO: 226624 - protein, 9 aa, Homo Sapiens
EYNIQMYDH

SEQ ID NO: 226625 - protein, 9 aa, Homo Sapiens
SSTREDLQL

SEQ ID NO: 226626 - protein, 9 aa, Homo Sapiens
TLLLALAMG

SEQ ID NO: 226627 - protein, 9 aa, Homo Sapiens
AHLRFYTAR

SEQ ID NO: 226628 - protein, 9 aa, Homo Sapiens
TLISNTWIV

SEQ ID NO: 226629 - protein, 9 aa, Homo Sapiens
HRCLPILVQ

SEQ ID NO: 226630 - protein, 9 aa, Homo Sapiens
RQIGKILKV

SEQ ID NO: 226631 - protein, 9 aa, Homo Sapiens
CLMGLGGCR

SEQ ID NO: 226632 - protein, 9 aa, Homo Sapiens
HEFIPFRFA

SEQ ID NO: 226633 - protein, 9 aa, Homo Sapiens
KGEDVHSGP

SEQ ID NO: 226634 - protein, 9 aa, Homo Sapiens
LFKIVDASP

SEQ ID NO: 226635 - protein, 9 aa, Homo Sapiens
GVSTYNPQV

SEQ ID NO: 226636 - protein, 9 aa, Homo Sapiens
QHLWLSHRL

SEQ ID NO: 226637 - protein, 9 aa, Homo Sapiens
RRSGGRMRG

SEQ ID NO: 226638 - protein, 9 aa, Homo Sapiens
LEETFGGWV

SEQ ID NO: 226639 - protein, 9 aa, Homo Sapiens
YRVPEVILN

SEQ ID NO: 226640 - protein, 9 aa, Homo Sapiens
QQLHRVQER

SEQ ID NO: 226641 - protein, 9 aa, Homo Sapiens
PDRELWPWC

SEQ ID NO: 226642 - protein, 9 aa, Homo Sapiens
ITHTVALIG

SEQ ID NO: 226643 - protein, 9 aa, Homo Sapiens
ASCGTGSRR

SEQ ID NO: 226644 - protein, 9 aa, Homo Sapiens
DPQGVEEIR

SEQ ID NO: 226645 - protein, 9 aa, Homo Sapiens
THCPLTTPR

SEQ ID NO: 226646 - protein, 9 aa, Homo Sapiens
HGLTLEVEV

SEQ ID NO: 226647 - protein, 9 aa, Homo Sapiens
CRGSSKNNM

SEQ ID NO: 226648 - protein, 9 aa, Homo Sapiens
PLIPLLGDQ

SEQ ID NO: 226649 - protein, 9 aa, Homo Sapiens
PPPGWLPRL

SEQ ID NO: 226650 - protein, 9 aa, Homo Sapiens
VLDEAVGCQ

SEQ ID NO: 226651 - protein, 9 aa, Homo Sapiens
DTPCIWQPV

SEQ ID NO: 226652 - protein, 9 aa, Homo Sapiens
STVCAMDSL

SEQ ID NO: 226653 - protein, 9 aa, Homo Sapiens
PPRSRAPRR

SEQ ID NO: 226654 - protein, 9 aa, Homo Sapiens
GENGEIVCS

SEQ ID NO: 226655 - protein, 9 aa, Homo Sapiens
EFTPPSGDM

SEQ ID NO: 226656 - protein, 9 aa, Homo Sapiens
SWKTSGPCS

SEQ ID NO: 226657 - protein, 9 aa, Homo Sapiens
VHMIEHTQK

SEQ ID NO: 226658 - protein, 9 aa, Homo Sapiens
RELLEPLMT

SEQ ID NO: 226659 - protein, 9 aa, Homo Sapiens
ETLTTVHLE

SEQ ID NO: 226660 - protein, 9 aa, Homo Sapiens
VYTLQPLDH

SEQ ID NO: 226661 - protein, 9 aa, Homo Sapiens
EMAHRVGVR

SEQ ID NO: 226662 - protein, 9 aa, Homo Sapiens
AVGLHSLVH

SEQ ID NO: 226663 - protein, 9 aa, Homo Sapiens
SNRGSGSRP

SEQ ID NO: 226664 - protein, 9 aa, Homo Sapiens
SRYRAKRRN

SEQ ID NO: 226665 - protein, 9 aa, Homo Sapiens
SVMSVAKPL

SEQ ID NO: 226666 - protein, 9 aa, Homo Sapiens
PGWLPRLTR

SEQ ID NO: 226667 - protein, 9 aa, Homo Sapiens
LVAIMITRL

SEQ ID NO: 226668 - protein, 9 aa, Homo Sapiens
CGTEDSRRS

SEQ ID NO: 226669 - protein, 9 aa, Homo Sapiens
NFTKKTQLL

SEQ ID NO: 226670 - protein, 9 aa, Homo Sapiens
APRAAAFGK

SEQ ID NO: 226671 - protein, 9 aa, Homo Sapiens
KVHSEEEAT

SEQ ID NO: 226672 - protein, 9 aa, Homo Sapiens
KAGTGAQRV

SEQ ID NO: 226673 - protein, 9 aa, Homo Sapiens
RTSLRFHLD

SEQ ID NO: 226674 - protein, 9 aa, Homo Sapiens
PSPSTGDPA

SEQ ID NO: 226675 - protein, 9 aa, Homo Sapiens
LGTQCLVVL

SEQ ID NO: 226676 - protein, 9 aa, Homo Sapiens
SLVAASPTT

SEQ ID NO: 226677 - protein, 9 aa, Homo Sapiens
AEGSFLTPG

SEQ ID NO: 226678 - protein, 9 aa, Homo Sapiens
WGGGNKCVA

SEQ ID NO: 226679 - protein, 9 aa, Homo Sapiens
VSNGTSRRS

SEQ ID NO: 226680 - protein, 9 aa, Homo Sapiens
EVTMGGLEP

SEQ ID NO: 226681 - protein, 9 aa, Homo Sapiens
SPKRDMEKV

SEQ ID NO: 226682 - protein, 9 aa, Homo Sapiens
MVCCLKTSC

SEQ ID NO: 226683 - protein, 9 aa, Homo Sapiens
VEEKNQVVE

SEQ ID NO: 226684 - protein, 9 aa, Homo Sapiens
TAPGGAATW

SEQ ID NO: 226685 - protein, 9 aa, Homo Sapiens
DNFNQQEKK

SEQ ID NO: 226686 - protein, 9 aa, Homo Sapiens
LTTRPSRQL

SEQ ID NO: 226687 - protein, 9 aa, Homo Sapiens
CFCMAGTVR

SEQ ID NO: 226688 - protein, 9 aa, Homo Sapiens
RDGGEAGER

SEQ ID NO: 226689 - protein, 9 aa, Homo Sapiens
SGPSRCRQR

SEQ ID NO: 226690 - protein, 9 aa, Homo Sapiens
VIGNRESGS

SEQ ID NO: 226691 - protein, 9 aa, Homo Sapiens
VLPSKIDVR

SEQ ID NO: 226692 - protein, 9 aa, Homo Sapiens
CGTGSRRGC

SEQ ID NO: 226693 - protein, 9 aa, Homo Sapiens
AGAACWCLE

SEQ ID NO: 226694 - protein, 9 aa, Homo Sapiens
YDIKVEQVE

SEQ ID NO: 226695 - protein, 9 aa, Homo Sapiens
VREGINIFW

SEQ ID NO: 226696 - protein, 9 aa, Homo Sapiens
LSPVLALSF

SEQ ID NO: 226697 - protein, 9 aa, Homo Sapiens
HCLKFISAV

SEQ ID NO: 226698 - protein, 9 aa, Homo Sapiens
RLAGLPREY

SEQ ID NO: 226699 - protein, 9 aa, Homo Sapiens
EGHGDQELW

SEQ ID NO: 226700 - protein, 9 aa, Homo Sapiens
KKIAFHIKS

SEQ ID NO: 226701 - protein, 9 aa, Homo Sapiens
AELLRLGSR

SEQ ID NO: 226702 - protein, 9 aa, Homo Sapiens
GLAPQAHPG

SEQ ID NO: 226703 - protein, 9 aa, Homo Sapiens
LPPQRPGWA

SEQ ID NO: 226704 - protein, 9 aa, Homo Sapiens
CHYSQKSIF

SEQ ID NO: 226705 - protein, 9 aa, Homo Sapiens
YRNPNGTNP

SEQ ID NO: 226706 - protein, 9 aa, Homo Sapiens
HTLKEILRN

SEQ ID NO: 226707 - protein, 9 aa, Homo Sapiens
TPLHCVASC

SEQ ID NO: 226708 - protein, 9 aa, Homo Sapiens
PPSAQPRRH

SEQ ID NO: 226709 - protein, 9 aa, Homo Sapiens
DAGNEEIPQ

SEQ ID NO: 226710 - protein, 9 aa, Homo Sapiens
SALLQPPHS

SEQ ID NO: 226711 - protein, 9 aa, Homo Sapiens
RSGRRQPPH

SEQ ID NO: 226712 - protein, 9 aa, Homo Sapiens
TPLHVDASC

SEQ ID NO: 226713 - protein, 9 aa, Homo Sapiens
GDVDLEKPT

SEQ ID NO: 226714 - protein, 9 aa, Homo Sapiens
GVLARPQNG

SEQ ID NO: 226715 - protein, 9 aa, Homo Sapiens
RFNPGSSGW

SEQ ID NO: 226716 - protein, 9 aa, Homo Sapiens
CSPMLARTR

SEQ ID NO: 226717 - protein, 9 aa, Homo Sapiens
RQLPQMSKV

SEQ ID NO: 226718 - protein, 9 aa, Homo Sapiens
ARLAIEVLE

SEQ ID NO: 226719 - protein, 9 aa, Homo Sapiens
TREKVVLVF

SEQ ID NO: 226720 - protein, 9 aa, Homo Sapiens
DPAGCVCGV

SEQ ID NO: 226721 - protein, 9 aa, Homo Sapiens
ITAVEVGTV

SEQ ID NO: 226722 - protein, 9 aa, Homo Sapiens
GIDGVKPPM

SEQ ID NO: 226723 - protein, 9 aa, Homo Sapiens
GVAVDQEGC

SEQ ID NO: 226724 - protein, 9 aa, Homo Sapiens
DSTLEVLRG

SEQ ID NO: 226725 - protein, 9 aa, Homo Sapiens
PHSATATLQ

SEQ ID NO: 226726 - protein, 9 aa, Homo Sapiens
RVGARPPAP

SEQ ID NO: 226727 - protein, 9 aa, Homo Sapiens
SHKPHKRTR

SEQ ID NO: 226728 - protein, 9 aa, Homo Sapiens
DTVVARGAP

SEQ ID NO: 226729 - protein, 9 aa, Homo Sapiens
NHHSFMESS

SEQ ID NO: 226730 - protein, 9 aa, Homo Sapiens
IIILAVESQ

SEQ ID NO: 226731 - protein, 9 aa, Homo Sapiens
AHRAVAPST

SEQ ID NO: 226732 - protein, 9 aa, Homo Sapiens
TAPEVLVAV

SEQ ID NO: 226733 - protein, 9 aa, Homo Sapiens
HAHEFIPFR

SEQ ID NO: 226734 - protein, 9 aa, Homo Sapiens
ADILSIMLS

SEQ ID NO: 226735 - protein, 9 aa, Homo Sapiens
WSLPRLVEC

SEQ ID NO: 226736 - protein, 9 aa, Homo Sapiens
MQLTFHKMA

SEQ ID NO: 226737 - protein, 9 aa, Homo Sapiens
DMDDLVTLD

SEQ ID NO: 226738 - protein, 9 aa, Homo Sapiens
KSQMQSGMR

SEQ ID NO: 226739 - protein, 9 aa, Homo Sapiens
VPFLLAEAM

SEQ ID NO: 226740 - protein, 9 aa, Homo Sapiens
RWIGREKRS

SEQ ID NO: 226741 - protein, 9 aa, Homo Sapiens
FETPEEKCA

SEQ ID NO: 226742 - protein, 9 aa, Homo Sapiens
PPIAPPGMP

SEQ ID NO: 226743 - protein, 9 aa, Homo Sapiens
VWATPGHWG

SEQ ID NO: 226744 - protein, 9 aa, Homo Sapiens
ARRVGVPGT

SEQ ID NO: 226745 - protein, 9 aa, Homo Sapiens
LTFKDVVVV

SEQ ID NO: 226746 - protein, 9 aa, Homo Sapiens
VLLPPPRLA

SEQ ID NO: 226747 - protein, 9 aa, Homo Sapiens
KQDPKGKGH

SEQ ID NO: 226748 - protein, 9 aa, Homo Sapiens
APGMNIKET

SEQ ID NO: 226749 - protein, 9 aa, Homo Sapiens
SCDPLQIFT

SEQ ID NO: 226750 - protein, 9 aa, Homo Sapiens
EDLLYLRTS

SEQ ID NO: 226751 - protein, 9 aa, Homo Sapiens
ESCHDFHPE

SEQ ID NO: 226752 - protein, 9 aa, Homo Sapiens
LPSKIDVRQ

SEQ ID NO: 226753 - protein, 9 aa, Homo Sapiens
APTPPRRSS

SEQ ID NO: 226754 - protein, 9 aa, Homo Sapiens
PTRSSRLRS

SEQ ID NO: 226755 - protein, 9 aa, Homo Sapiens
VMSVAKPLV

SEQ ID NO: 226756 - protein, 9 aa, Homo Sapiens
APTHLWWSF

SEQ ID NO: 226757 - protein, 9 aa, Homo Sapiens
RPAWTAAGV

SEQ ID NO: 226758 - protein, 9 aa, Homo Sapiens
LHYLDNHGP

SEQ ID NO: 226759 - protein, 9 aa, Homo Sapiens
KHICKTWAQ

SEQ ID NO: 226760 - protein, 9 aa, Homo Sapiens
TPFTGSPSQ

SEQ ID NO: 226761 - protein, 9 aa, Homo Sapiens
QGSLQTSSS

SEQ ID NO: 226762 - protein, 9 aa, Homo Sapiens
CLMTVAEGI

SEQ ID NO: 226763 - protein, 9 aa, Homo Sapiens
MGLKDLEAH

SEQ ID NO: 226764 - protein, 9 aa, Homo Sapiens
LGGPEVPRK

SEQ ID NO: 226765 - protein, 9 aa, Homo Sapiens
TGAPGMNIK

SEQ ID NO: 226766 - protein, 9 aa, Homo Sapiens
ELWPWCFTT

SEQ ID NO: 226767 - protein, 9 aa, Homo Sapiens
VKPGWLKAT

SEQ ID NO: 226768 - protein, 9 aa, Homo Sapiens
AFGIVQGSL

SEQ ID NO: 226769 - protein, 9 aa, Homo Sapiens
SNSSSRLIV

SEQ ID NO: 226770 - protein, 9 aa, Homo Sapiens
AAPSSAPFG

SEQ ID NO: 226771 - protein, 9 aa, Homo Sapiens
PRTMAGPSA

SEQ ID NO: 226772 - protein, 9 aa, Homo Sapiens
AIALHLRRS

SEQ ID NO: 226773 - protein, 9 aa, Homo Sapiens
TMWSASGRN

SEQ ID NO: 226774 - protein, 9 aa, Homo Sapiens
ISMINREGI

SEQ ID NO: 226775 - protein, 9 aa, Homo Sapiens
EQLKLKDEV

SEQ ID NO: 226776 - protein, 9 aa, Homo Sapiens
LRWIGREKR

SEQ ID NO: 226777 - protein, 9 aa, Homo Sapiens
KQKRREGVK

SEQ ID NO: 226778 - protein, 9 aa, Homo Sapiens
STLTRSSPG

SEQ ID NO: 226779 - protein, 9 aa, Homo Sapiens
IVSVWRPHH

SEQ ID NO: 226780 - protein, 9 aa, Homo Sapiens
LSNSLTTLS

SEQ ID NO: 226781 - protein, 9 aa, Homo Sapiens
LAIGGTGGW

SEQ ID NO: 226782 - protein, 9 aa, Homo Sapiens
MRHKNIVRY

SEQ ID NO: 226783 - protein, 9 aa, Homo Sapiens
VISKKFGDM

SEQ ID NO: 226784 - protein, 9 aa, Homo Sapiens
PGRSPLRPG

SEQ ID NO: 226785 - protein, 9 aa, Homo Sapiens
PPPRMAARY

SEQ ID NO: 226786 - protein, 9 aa, Homo Sapiens
QVVWVIGGG

SEQ ID NO: 226787 - protein, 9 aa, Homo Sapiens
TMVCCLKTS

SEQ ID NO: 226788 - protein, 9 aa, Homo Sapiens
VAAAVPPPS

SEQ ID NO: 226789 - protein, 9 aa, Homo Sapiens
NPSVTDAQV

SEQ ID NO: 226790 - protein, 9 aa, Homo Sapiens
WPSSRRATK

SEQ ID NO: 226791 - protein, 9 aa, Homo Sapiens
AVGGPWATG

SEQ ID NO: 226792 - protein, 9 aa, Homo Sapiens
AQEALSDSL

SEQ ID NO: 226793 - protein, 9 aa, Homo Sapiens
EGSDLATRE

SEQ ID NO: 226794 - protein, 9 aa, Homo Sapiens
FIIQFLDRQ

SEQ ID NO: 226795 - protein, 9 aa, Homo Sapiens
LSADGASEI

SEQ ID NO: 226796 - protein, 9 aa, Homo Sapiens
KKFSNPFRY

SEQ ID NO: 226797 - protein, 9 aa, Homo Sapiens
DRPIRHHNS

SEQ ID NO: 226798 - protein, 9 aa, Homo Sapiens
GSMGKSSLA

SEQ ID NO: 226799 - protein, 9 aa, Homo Sapiens
LLKEEAHEF

SEQ ID NO: 226800 - protein, 9 aa, Homo Sapiens
GSEGTKVSA

SEQ ID NO: 226801 - protein, 9 aa, Homo Sapiens
NAALPGPPT

SEQ ID NO: 226802 - protein, 9 aa, Homo Sapiens
KTFNLKMTL

SEQ ID NO: 226803 - protein, 9 aa, Homo Sapiens
YILEKQRLL

SEQ ID NO: 226804 - protein, 9 aa, Homo Sapiens
LILGDLLLN

SEQ ID NO: 226805 - protein, 9 aa, Homo Sapiens
AERNEEDAV

SEQ ID NO: 226806 - protein, 9 aa, Homo Sapiens
QYNKNRQKV

SEQ ID NO: 226807 - protein, 9 aa, Homo Sapiens
ASRPPQATR

SEQ ID NO: 226808 - protein, 9 aa, Homo Sapiens
RGQGSRVER

SEQ ID NO: 226809 - protein, 9 aa, Homo Sapiens
GVTSFGYRC

SEQ ID NO: 226810 - protein, 9 aa, Homo Sapiens
EVHHKPKLC

SEQ ID NO: 226811 - protein, 9 aa, Homo Sapiens
PTPCSSQWS

SEQ ID NO: 226812 - protein, 9 aa, Homo Sapiens
FTLCRRYWL

SEQ ID NO: 226813 - protein, 9 aa, Homo Sapiens
KTMVCCLKT

SEQ ID NO: 226814 - protein, 9 aa, Homo Sapiens
NRKFGDPSA

SEQ ID NO: 226815 - protein, 9 aa, Homo Sapiens
GSGSMGKSS

SEQ ID NO: 226816 - protein, 9 aa, Homo Sapiens
PWGRPRGGP

SEQ ID NO: 226817 - protein, 9 aa, Homo Sapiens
QEQLQDLHS

SEQ ID NO: 226818 - protein, 9 aa, Homo Sapiens
FDLRLYILV

SEQ ID NO: 226819 - protein, 9 aa, Homo Sapiens
CEQLRGQRP

SEQ ID NO: 226820 - protein, 9 aa, Homo Sapiens
LRKLKQMLN

SEQ ID NO: 226821 - protein, 9 aa, Homo Sapiens
GRPLGCSGL

SEQ ID NO: 226822 - protein, 9 aa, Homo Sapiens
HQQMGYPKS

SEQ ID NO: 226823 - protein, 9 aa, Homo Sapiens
EGDFRVPPL

SEQ ID NO: 226824 - protein, 9 aa, Homo Sapiens
HGPTGSCCT

SEQ ID NO: 226825 - protein, 9 aa, Homo Sapiens
GVSGLVTSH

SEQ ID NO: 226826 - protein, 9 aa, Homo Sapiens
PEGEKNQLT

SEQ ID NO: 226827 - protein, 9 aa, Homo Sapiens
KDMTLYSLL

SEQ ID NO: 226828 - protein, 9 aa, Homo Sapiens
VFLAERNEE

SEQ ID NO: 226829 - protein, 9 aa, Homo Sapiens
QDRVNSDLE

SEQ ID NO: 226830 - protein, 9 aa, Homo Sapiens
LFFIPFLNS

SEQ ID NO: 226831 - protein, 9 aa, Homo Sapiens
KPYKCTKCD

SEQ ID NO: 226832 - protein, 9 aa, Homo Sapiens
VFLEYDRDL

SEQ ID NO: 226833 - protein, 9 aa, Homo Sapiens
LAPASRGPS

SEQ ID NO: 226834 - protein, 9 aa, Homo Sapiens
KEKSRSMLR

SEQ ID NO: 226835 - protein, 9 aa, Homo Sapiens
GMSRTPPRR

SEQ ID NO: 226836 - protein, 9 aa, Homo Sapiens
AEFVSLLCK

SEQ ID NO: 226837 - protein, 9 aa, Homo Sapiens
SHSCTTHST

SEQ ID NO: 226838 - protein, 9 aa, Homo Sapiens
RSMRINNNR

SEQ ID NO: 226839 - protein, 9 aa, Homo Sapiens
LSQIPASPG

SEQ ID NO: 226840 - protein, 9 aa, Homo Sapiens
RMIGCGAIL

SEQ ID NO: 226841 - protein, 9 aa, Homo Sapiens
NGMMSTASV

SEQ ID NO: 226842 - protein, 9 aa, Homo Sapiens
SRERQERHI

SEQ ID NO: 226843 - protein, 9 aa, Homo Sapiens
LKGVLGYKI

SEQ ID NO: 226844 - protein, 9 aa, Homo Sapiens
AIAEKNHAR

SEQ ID NO: 226845 - protein, 9 aa, Homo Sapiens
KFSGQRRRR

SEQ ID NO: 226846 - protein, 9 aa, Homo Sapiens
AAPGVHPGC

SEQ ID NO: 226847 - protein, 9 aa, Homo Sapiens
KDTEGDIVK

SEQ ID NO: 226848 - protein, 9 aa, Homo Sapiens
KKGLAIVLL

SEQ ID NO: 226849 - protein, 9 aa, Homo Sapiens
REKPMAYTS

SEQ ID NO: 226850 - protein, 9 aa, Homo Sapiens
GETIMMRCH

SEQ ID NO: 226851 - protein, 9 aa, Homo Sapiens
EDGDGDKDG

SEQ ID NO: 226852 - protein, 9 aa, Homo Sapiens
WVRSRPCAH

SEQ ID NO: 226853 - protein, 9 aa, Homo Sapiens
LATREKVVL

SEQ ID NO: 226854 - protein, 9 aa, Homo Sapiens
PVLLADPVA

SEQ ID NO: 226855 - protein, 9 aa, Homo Sapiens
KGDVFVVNG

SEQ ID NO: 226856 - protein, 9 aa, Homo Sapiens
TPGVDLSCI

SEQ ID NO: 226857 - protein, 9 aa, Homo Sapiens
HGPSARGAP

SEQ ID NO: 226858 - protein, 9 aa, Homo Sapiens
VTKELSTTT

SEQ ID NO: 226859 - protein, 9 aa, Homo Sapiens
STMWSASGR

SEQ ID NO: 226860 - protein, 9 aa, Homo Sapiens
MASLCWSTV

SEQ ID NO: 226861 - protein, 9 aa, Homo Sapiens
VHFLPRQFG

SEQ ID NO: 226862 - protein, 9 aa, Homo Sapiens
FICIREKGG

SEQ ID NO: 226863 - protein, 9 aa, Homo Sapiens
GRRWSWAMG

SEQ ID NO: 226864 - protein, 9 aa, Homo Sapiens
QLIEDIVCD

SEQ ID NO: 226865 - protein, 9 aa, Homo Sapiens
TDLFPVLST

SEQ ID NO: 226866 - protein, 9 aa, Homo Sapiens
ADYDLKSAG

SEQ ID NO: 226867 - protein, 9 aa, Homo Sapiens
SQHLPPLAS

SEQ ID NO: 226868 - protein, 9 aa, Homo Sapiens
VPAAPTSAC

SEQ ID NO: 226869 - protein, 9 aa, Homo Sapiens
HQKDTEGDI

SEQ ID NO: 226870 - protein, 9 aa, Homo Sapiens
FLVTRKTPW

SEQ ID NO: 226871 - protein, 9 aa, Homo Sapiens
LVLDVSSIS

SEQ ID NO: 226872 - protein, 9 aa, Homo Sapiens
EHVPAVHAP

SEQ ID NO: 226873 - protein, 9 aa, Homo Sapiens
AIDATGSRG

SEQ ID NO: 226874 - protein, 9 aa, Homo Sapiens
ISLPLRGFL

SEQ ID NO: 226875 - protein, 9 aa, Homo Sapiens
RIDPRNLGC

SEQ ID NO: 226876 - protein, 9 aa, Homo Sapiens
FLDQPHMLN

SEQ ID NO: 226877 - protein, 9 aa, Homo Sapiens
GRRRERSWA

SEQ ID NO: 226878 - protein, 9 aa, Homo Sapiens
CLERDLAPE

SEQ ID NO: 226879 - protein, 9 aa, Homo Sapiens
APAAFGVLA

SEQ ID NO: 226880 - protein, 9 aa, Homo Sapiens
LEKELPLYV

SEQ ID NO: 226881 - protein, 9 aa, Homo Sapiens
AATWPSSVL

SEQ ID NO: 226882 - protein, 9 aa, Homo Sapiens
ICNLAAITM

SEQ ID NO: 226883 - protein, 9 aa, Homo Sapiens
ASPSPFTHR

SEQ ID NO: 226884 - protein, 9 aa, Homo Sapiens
SGPCSLPLD

SEQ ID NO: 226885 - protein, 9 aa, Homo Sapiens
LRNVTLLPA

SEQ ID NO: 226886 - protein, 9 aa, Homo Sapiens
ERRGTTLRT

SEQ ID NO: 226887 - protein, 9 aa, Homo Sapiens
TDWVDDQRS

SEQ ID NO: 226888 - protein, 9 aa, Homo Sapiens
CETSGIRHL

SEQ ID NO: 226889 - protein, 9 aa, Homo Sapiens
PASPGTHPT

SEQ ID NO: 226890 - protein, 9 aa, Homo Sapiens
LLLPPPPPC

SEQ ID NO: 226891 - protein, 9 aa, Homo Sapiens
MKGLRRLAA

SEQ ID NO: 226892 - protein, 9 aa, Homo Sapiens
HPSCVLCVR

SEQ ID NO: 226893 - protein, 9 aa, Homo Sapiens
LKLTKFYFA

SEQ ID NO: 226894 - protein, 9 aa, Homo Sapiens
GQGLFILPL

SEQ ID NO: 226895 - protein, 9 aa, Homo Sapiens
QVHVFLDGV

SEQ ID NO: 226896 - protein, 9 aa, Homo Sapiens
RTIAECETR

SEQ ID NO: 226897 - protein, 9 aa, Homo Sapiens
ENIIAWEYK

SEQ ID NO: 226898 - protein, 9 aa, Homo Sapiens
MQLQDAKEQ

SEQ ID NO: 226899 - protein, 9 aa, Homo Sapiens
PVLCSPRVP

SEQ ID NO: 226900 - protein, 9 aa, Homo Sapiens
TTPSKKKLK

SEQ ID NO: 226901 - protein, 9 aa, Homo Sapiens
TTSPWPSPQ

SEQ ID NO: 226902 - protein, 9 aa, Homo Sapiens
VPVHTDAQG

SEQ ID NO: 226903 - protein, 9 aa, Homo Sapiens
SNSPQNGVL

SEQ ID NO: 226904 - protein, 9 aa, Homo Sapiens
RYAGNKYAK

SEQ ID NO: 226905 - protein, 9 aa, Homo Sapiens
CKCHECGKA

SEQ ID NO: 226906 - protein, 9 aa, Homo Sapiens
AWQELGTQQ

SEQ ID NO: 226907 - protein, 9 aa, Homo Sapiens
GQARDLRCP

SEQ ID NO: 226908 - protein, 9 aa, Homo Sapiens
RDGLSEDQV

SEQ ID NO: 226909 - protein, 9 aa, Homo Sapiens
MVFSRKYNQ

SEQ ID NO: 226910 - protein, 9 aa, Homo Sapiens
TLRCPQAAA

SEQ ID NO: 226911 - protein, 9 aa, Homo Sapiens
VSLSITTKK

SEQ ID NO: 226912 - protein, 9 aa, Homo Sapiens
SSGTPDCYY

SEQ ID NO: 226913 - protein, 9 aa, Homo Sapiens
GYLSGDWAK

SEQ ID NO: 226914 - protein, 9 aa, Homo Sapiens
SHLQRTHPK

SEQ ID NO: 226915 - protein, 9 aa, Homo Sapiens
SGVLDPRAQ

SEQ ID NO: 226916 - protein, 9 aa, Homo Sapiens
GPRLRTATA

SEQ ID NO: 226917 - protein, 9 aa, Homo Sapiens
SNKGNEHPP

SEQ ID NO: 226918 - protein, 9 aa, Homo Sapiens
QRVLQEAQR

SEQ ID NO: 226919 - protein, 9 aa, Homo Sapiens
GRGYRALQL

SEQ ID NO: 226920 - protein, 9 aa, Homo Sapiens
PSPPVRSTV

SEQ ID NO: 226921 - protein, 9 aa, Homo Sapiens
YPKSTMMEK

SEQ ID NO: 226922 - protein, 9 aa, Homo Sapiens
SELQDTNLQ

SEQ ID NO: 226923 - protein, 9 aa, Homo Sapiens
NCQTAICDP

SEQ ID NO: 226924 - protein, 9 aa, Homo Sapiens
CSAPPTKGA

SEQ ID NO: 226925 - protein, 9 aa, Homo Sapiens
DMSLSCTLV

SEQ ID NO: 226926 - protein, 9 aa, Homo Sapiens
TAAPISSGP

SEQ ID NO: 226927 - protein, 9 aa, Homo Sapiens
VKVIEKNSP

SEQ ID NO: 226928 - protein, 9 aa, Homo Sapiens
RGLGLLDLL

SEQ ID NO: 226929 - protein, 9 aa, Homo Sapiens
LFRPCLCLL

SEQ ID NO: 226930 - protein, 9 aa, Homo Sapiens
SPSSLLSPC

SEQ ID NO: 226931 - protein, 9 aa, Homo Sapiens
CDRVRQKLL

SEQ ID NO: 226932 - protein, 9 aa, Homo Sapiens
GDPEIDKKS

SEQ ID NO: 226933 - protein, 9 aa, Homo Sapiens
TKVLKPLSV

SEQ ID NO: 226934 - protein, 9 aa, Homo Sapiens
VRNSWAIGV

SEQ ID NO: 226935 - protein, 9 aa, Homo Sapiens
EVKPISKAP

SEQ ID NO: 226936 - protein, 9 aa, Homo Sapiens
WCKYHNLCT

SEQ ID NO: 226937 - protein, 9 aa, Homo Sapiens
SIPLVPLIS

SEQ ID NO: 226938 - protein, 9 aa, Homo Sapiens
IVCDGRLYA

SEQ ID NO: 226939 - protein, 9 aa, Homo Sapiens
ARLKGRNSH

SEQ ID NO: 226940 - protein, 9 aa, Homo Sapiens
EIDPPTIIK

SEQ ID NO: 226941 - protein, 9 aa, Homo Sapiens
DEDLPPGTR

SEQ ID NO: 226942 - protein, 9 aa, Homo Sapiens
FASGCVVLP

SEQ ID NO: 226943 - protein, 9 aa, Homo Sapiens
VDMYKDKKR

SEQ ID NO: 226944 - protein, 9 aa, Homo Sapiens
KTPKATVGA

SEQ ID NO: 226945 - protein, 9 aa, Homo Sapiens
KPPTRTSRS

SEQ ID NO: 226946 - protein, 9 aa, Homo Sapiens
ARFMPCTIW

SEQ ID NO: 226947 - protein, 9 aa, Homo Sapiens
QHQTGQAPH

SEQ ID NO: 226948 - protein, 9 aa, Homo Sapiens
ALFDMVSRA

SEQ ID NO: 226949 - protein, 9 aa, Homo Sapiens
AHDVVEAGE

SEQ ID NO: 226950 - protein, 9 aa, Homo Sapiens
TRRFRMRMR

SEQ ID NO: 226951 - protein, 9 aa, Homo Sapiens
LSVKGYLFR

SEQ ID NO: 226952 - protein, 9 aa, Homo Sapiens
GCFAMGAAT

SEQ ID NO: 226953 - protein, 9 aa, Homo Sapiens
SMTSPISSG

SEQ ID NO: 226954 - protein, 9 aa, Homo Sapiens
TELGVFAPD

SEQ ID NO: 226955 - protein, 9 aa, Homo Sapiens
CDDTHRSER

SEQ ID NO: 226956 - protein, 9 aa, Homo Sapiens
ESLPKETFL

SEQ ID NO: 226957 - protein, 9 aa, Homo Sapiens
SSEEAHRAE

SEQ ID NO: 226958 - protein, 9 aa, Homo Sapiens
RERIAILRG

SEQ ID NO: 226959 - protein, 9 aa, Homo Sapiens
ADMSIKMKP

SEQ ID NO: 226960 - protein, 9 aa, Homo Sapiens
EVAMEAKWE

SEQ ID NO: 226961 - protein, 9 aa, Homo Sapiens
SVLTLTVEE

SEQ ID NO: 226962 - protein, 9 aa, Homo Sapiens
HSYTRPMIC

SEQ ID NO: 226963 - protein, 9 aa, Homo Sapiens
AAPVCGARG

SEQ ID NO: 226964 - protein, 9 aa, Homo Sapiens
ETSMQNPDR

SEQ ID NO: 226965 - protein, 9 aa, Homo Sapiens
RRRPRPPLG

SEQ ID NO: 226966 - protein, 9 aa, Homo Sapiens
QGLGAQQAG

SEQ ID NO: 226967 - protein, 9 aa, Homo Sapiens
VDEAKKPFK

SEQ ID NO: 226968 - protein, 9 aa, Homo Sapiens
SPGTHPTLK

SEQ ID NO: 226969 - protein, 9 aa, Homo Sapiens
LLCQNPEKL

SEQ ID NO: 226970 - protein, 9 aa, Homo Sapiens
PPPAPATQA

SEQ ID NO: 226971 - protein, 9 aa, Homo Sapiens
EAAAPALPT

SEQ ID NO: 226972 - protein, 9 aa, Homo Sapiens
WGCVPFCGW

SEQ ID NO: 226973 - protein, 9 aa, Homo Sapiens
SRFWGLVTD

SEQ ID NO: 226974 - protein, 9 aa, Homo Sapiens
VNMDNLGKE

SEQ ID NO: 226975 - protein, 9 aa, Homo Sapiens
ALNTAHAYA

SEQ ID NO: 226976 - protein, 9 aa, Homo Sapiens
RMEGQPMRC

SEQ ID NO: 226977 - protein, 9 aa, Homo Sapiens
ARPLPPQSR

SEQ ID NO: 226978 - protein, 9 aa, Homo Sapiens
KLTLEFHTL

SEQ ID NO: 226979 - protein, 9 aa, Homo Sapiens
WTVRSVRRQ

SEQ ID NO: 226980 - protein, 9 aa, Homo Sapiens
IRNIDQEEQ

SEQ ID NO: 226981 - protein, 9 aa, Homo Sapiens
ECFQDGRLG

SEQ ID NO: 226982 - protein, 9 aa, Homo Sapiens
MIILPCLSW

SEQ ID NO: 226983 - protein, 9 aa, Homo Sapiens
EQVFSELSF

SEQ ID NO: 226984 - protein, 9 aa, Homo Sapiens
GITLTLSGM

SEQ ID NO: 226985 - protein, 9 aa, Homo Sapiens
CVDQWLKCQ

SEQ ID NO: 226986 - protein, 9 aa, Homo Sapiens
CNASIMCPL

SEQ ID NO: 226987 - protein, 9 aa, Homo Sapiens
LHNGKLFNI

SEQ ID NO: 226988 - protein, 9 aa, Homo Sapiens
YNVVICITF

SEQ ID NO: 226989 - protein, 9 aa, Homo Sapiens
HEVAGAVQQ

SEQ ID NO: 226990 - protein, 9 aa, Homo Sapiens
LPVAGDLTS

SEQ ID NO: 226991 - protein, 9 aa, Homo Sapiens
KRGKSQGGR

SEQ ID NO: 226992 - protein, 9 aa, Homo Sapiens
WMAAPKNRH

SEQ ID NO: 226993 - protein, 9 aa, Homo Sapiens
DMKNHRDSE

SEQ ID NO: 226994 - protein, 9 aa, Homo Sapiens
LHQPLPGQH

SEQ ID NO: 226995 - protein, 9 aa, Homo Sapiens
EEAHEFGNQ

SEQ ID NO: 226996 - protein, 9 aa, Homo Sapiens
PTGLRKARM

SEQ ID NO: 226997 - protein, 9 aa, Homo Sapiens
IFLIMLLVY

SEQ ID NO: 226998 - protein, 9 aa, Homo Sapiens
LFVVDTGLF

SEQ ID NO: 226999 - protein, 9 aa, Homo Sapiens
PVPAAPTSA

SEQ ID NO: 227000 - protein, 9 aa, Homo Sapiens
LFLLSTTWI

SEQ ID NO: 227001 - protein, 9 aa, Homo Sapiens
NAPHLQDYT

SEQ ID NO: 227002 - protein, 9 aa, Homo Sapiens
NFQYVGVSA

SEQ ID NO: 227003 - protein, 9 aa, Homo Sapiens
SAVWHTLGH

SEQ ID NO: 227004 - protein, 9 aa, Homo Sapiens
VSTRKNGGG

SEQ ID NO: 227005 - protein, 9 aa, Homo Sapiens
NSHYALELT

SEQ ID NO: 227006 - protein, 9 aa, Homo Sapiens
RGCSGRSRP

SEQ ID NO: 227007 - protein, 9 aa, Homo Sapiens
SKVKVMPHH

SEQ ID NO: 227008 - protein, 9 aa, Homo Sapiens
TNLLRHLDF

SEQ ID NO: 227009 - protein, 9 aa, Homo Sapiens
LPREYQQRN

SEQ ID NO: 227010 - protein, 9 aa, Homo Sapiens
VPQKRFRHL

SEQ ID NO: 227011 - protein, 9 aa, Homo Sapiens
MIKKHRAAC

SEQ ID NO: 227012 - protein, 9 aa, Homo Sapiens
AAKNYLLLP

SEQ ID NO: 227013 - protein, 9 aa, Homo Sapiens
TTHVQMGQA

SEQ ID NO: 227014 - protein, 9 aa, Homo Sapiens
VFAINRALG

SEQ ID NO: 227015 - protein, 9 aa, Homo Sapiens
VALQLPRAY

SEQ ID NO: 227016 - protein, 9 aa, Homo Sapiens
GSCNGTQVP

SEQ ID NO: 227017 - protein, 9 aa, Homo Sapiens
ASNSSSRLI

SEQ ID NO: 227018 - protein, 9 aa, Homo Sapiens
QERQGNKSH

SEQ ID NO: 227019 - protein, 9 aa, Homo Sapiens
HTQKELQKL

SEQ ID NO: 227020 - protein, 9 aa, Homo Sapiens
WDMGLEVFR

SEQ ID NO: 227021 - protein, 9 aa, Homo Sapiens
KTRTVSSPK

SEQ ID NO: 227022 - protein, 9 aa, Homo Sapiens
TWNPFRCKL

SEQ ID NO: 227023 - protein, 9 aa, Homo Sapiens
HDILDRITT

SEQ ID NO: 227024 - protein, 9 aa, Homo Sapiens
AWMMLNYRL

SEQ ID NO: 227025 - protein, 9 aa, Homo Sapiens
EQEEREQQL

SEQ ID NO: 227026 - protein, 9 aa, Homo Sapiens
HTTPDKGWG

SEQ ID NO: 227027 - protein, 9 aa, Homo Sapiens
DYELAMSTH

SEQ ID NO: 227028 - protein, 9 aa, Homo Sapiens
GVDVGLYIP

SEQ ID NO: 227029 - protein, 9 aa, Homo Sapiens
SPTTAASSP

SEQ ID NO: 227030 - protein, 9 aa, Homo Sapiens
LFRCSYQFL

SEQ ID NO: 227031 - protein, 9 aa, Homo Sapiens
FPLSCPPPH

SEQ ID NO: 227032 - protein, 9 aa, Homo Sapiens
MDAVAVHHG

SEQ ID NO: 227033 - protein, 9 aa, Homo Sapiens
PPQSSPFLA

SEQ ID NO: 227034 - protein, 9 aa, Homo Sapiens
GKLHRCGQC

SEQ ID NO: 227035 - protein, 9 aa, Homo Sapiens
LAGGAQAIS

SEQ ID NO: 227036 - protein, 9 aa, Homo Sapiens
SQQNHHSFM

SEQ ID NO: 227037 - protein, 9 aa, Homo Sapiens
VICYPLHYP

SEQ ID NO: 227038 - protein, 9 aa, Homo Sapiens
AVLELTCAD

SEQ ID NO: 227039 - protein, 9 aa, Homo Sapiens
EVNSPPPSP

SEQ ID NO: 227040 - protein, 9 aa, Homo Sapiens
SGGRTAAVG

SEQ ID NO: 227041 - protein, 9 aa, Homo Sapiens
MSRGGVSDH

SEQ ID NO: 227042 - protein, 9 aa, Homo Sapiens
DPEGAVAHT

SEQ ID NO: 227043 - protein, 9 aa, Homo Sapiens
SEEPSNGIS

SEQ ID NO: 227044 - protein, 9 aa, Homo Sapiens
SQHPGSSRT

SEQ ID NO: 227045 - protein, 9 aa, Homo Sapiens
GEVKLRPET

SEQ ID NO: 227046 - protein, 9 aa, Homo Sapiens
NAKKAAANF

SEQ ID NO: 227047 - protein, 9 aa, Homo Sapiens
VEPCINIGL

SEQ ID NO: 227048 - protein, 9 aa, Homo Sapiens
FQWLHSTAY

SEQ ID NO: 227049 - protein, 9 aa, Homo Sapiens
ELGSKPFTR

SEQ ID NO: 227050 - protein, 9 aa, Homo Sapiens
LEKKQDPKG

SEQ ID NO: 227051 - protein, 9 aa, Homo Sapiens
TSGKVCHGA

SEQ ID NO: 227052 - protein, 9 aa, Homo Sapiens
GMGFGVYLS

SEQ ID NO: 227053 - protein, 9 aa, Homo Sapiens
RLSQVAGAS

SEQ ID NO: 227054 - protein, 9 aa, Homo Sapiens
RHAFFRSPH

SEQ ID NO: 227055 - protein, 9 aa, Homo Sapiens
HFIPLQCHR

SEQ ID NO: 227056 - protein, 9 aa, Homo Sapiens
PVTEPPVTN

SEQ ID NO: 227057 - protein, 9 aa, Homo Sapiens
TLRIMSRGG

SEQ ID NO: 227058 - protein, 9 aa, Homo Sapiens
LQDTNLQQL

SEQ ID NO: 227059 - protein, 9 aa, Homo Sapiens
LAYLISARS

SEQ ID NO: 227060 - protein, 9 aa, Homo Sapiens
THKEGETPP

SEQ ID NO: 227061 - protein, 9 aa, Homo Sapiens
LTYIVFVLT

SEQ ID NO: 227062 - protein, 9 aa, Homo Sapiens
GDPFCRLFD

SEQ ID NO: 227063 - protein, 9 aa, Homo Sapiens
NVDFVDLKN

SEQ ID NO: 227064 - protein, 9 aa, Homo Sapiens
SKEVTENPN

SEQ ID NO: 227065 - protein, 9 aa, Homo Sapiens
KDQVGGTSF

SEQ ID NO: 227066 - protein, 9 aa, Homo Sapiens
VFSRLPGNC

SEQ ID NO: 227067 - protein, 9 aa, Homo Sapiens
IHVKHPHKI

SEQ ID NO: 227068 - protein, 9 aa, Homo Sapiens
CSPNVHFLP

SEQ ID NO: 227069 - protein, 9 aa, Homo Sapiens
TLRTSKELV

SEQ ID NO: 227070 - protein, 9 aa, Homo Sapiens
SRDRAMKES

SEQ ID NO: 227071 - protein, 9 aa, Homo Sapiens
LAGSVGVLA

SEQ ID NO: 227072 - protein, 9 aa, Homo Sapiens
GDNPEEITT

SEQ ID NO: 227073 - protein, 9 aa, Homo Sapiens
QSVLGRVFS

SEQ ID NO: 227074 - protein, 9 aa, Homo Sapiens
PVRALPMTC

SEQ ID NO: 227075 - protein, 9 aa, Homo Sapiens
VRPSYRQGY

SEQ ID NO: 227076 - protein, 9 aa, Homo Sapiens
IVSELQFTP

SEQ ID NO: 227077 - protein, 9 aa, Homo Sapiens
RCCFSPLKK

SEQ ID NO: 227078 - protein, 9 aa, Homo Sapiens
MSVKPSDMG

SEQ ID NO: 227079 - protein, 9 aa, Homo Sapiens
PPRSSPPSP

SEQ ID NO: 227080 - protein, 9 aa, Homo Sapiens
LVVVDFSLG

SEQ ID NO: 227081 - protein, 9 aa, Homo Sapiens
RRQDLRAPA

SEQ ID NO: 227082 - protein, 9 aa, Homo Sapiens
FSFNTPGKM

SEQ ID NO: 227083 - protein, 9 aa, Homo Sapiens
PLQPHFKEV

SEQ ID NO: 227084 - protein, 9 aa, Homo Sapiens
IQRVQAEER

SEQ ID NO: 227085 - protein, 9 aa, Homo Sapiens
QRIPTGGDG

SEQ ID NO: 227086 - protein, 9 aa, Homo Sapiens
HTNVVQAAI

SEQ ID NO: 227087 - protein, 9 aa, Homo Sapiens
STKWWPSTS

SEQ ID NO: 227088 - protein, 9 aa, Homo Sapiens
RKKLEMGLK

SEQ ID NO: 227089 - protein, 9 aa, Homo Sapiens
VAFSEIMGM

SEQ ID NO: 227090 - protein, 9 aa, Homo Sapiens
VLTDEKSLL

SEQ ID NO: 227091 - protein, 9 aa, Homo Sapiens
TEECTTIVC

SEQ ID NO: 227092 - protein, 9 aa, Homo Sapiens
TSQYSKCMH

SEQ ID NO: 227093 - protein, 9 aa, Homo Sapiens
TPIWRPGTE

SEQ ID NO: 227094 - protein, 9 aa, Homo Sapiens
DSKNIQDRV

SEQ ID NO: 227095 - protein, 9 aa, Homo Sapiens
ASLHHTLKE

SEQ ID NO: 227096 - protein, 9 aa, Homo Sapiens
ETNKQPPRR

SEQ ID NO: 227097 - protein, 9 aa, Homo Sapiens
RRCDPIRTS

SEQ ID NO: 227098 - protein, 9 aa, Homo Sapiens
LIIGAVILF

SEQ ID NO: 227099 - protein, 9 aa, Homo Sapiens
HGDVCKVLP

SEQ ID NO: 227100 - protein, 9 aa, Homo Sapiens
NNQTLQVII

SEQ ID NO: 227101 - protein, 9 aa, Homo Sapiens
KFNGVQMCV

SEQ ID NO: 227102 - protein, 9 aa, Homo Sapiens
LINEHKRKL

SEQ ID NO: 227103 - protein, 9 aa, Homo Sapiens
GPWMMCTAS

SEQ ID NO: 227104 - protein, 9 aa, Homo Sapiens
PKRAIVRDN

SEQ ID NO: 227105 - protein, 9 aa, Homo Sapiens
LVVILFVVD

SEQ ID NO: 227106 - protein, 9 aa, Homo Sapiens
TGEPFSQPI

SEQ ID NO: 227107 - protein, 9 aa, Homo Sapiens
PVEEIFIEE

SEQ ID NO: 227108 - protein, 9 aa, Homo Sapiens
LQTSNNNME

SEQ ID NO: 227109 - protein, 9 aa, Homo Sapiens
RIRAKQRAE

SEQ ID NO: 227110 - protein, 9 aa, Homo Sapiens
ELLRLGSRP

SEQ ID NO: 227111 - protein, 9 aa, Homo Sapiens
QSPPRTARG

SEQ ID NO: 227112 - protein, 9 aa, Homo Sapiens
VDGVTLLLV

SEQ ID NO: 227113 - protein, 9 aa, Homo Sapiens
VILNVHSKL

SEQ ID NO: 227114 - protein, 9 aa, Homo Sapiens
RAVRDLKKK

SEQ ID NO: 227115 - protein, 9 aa, Homo Sapiens
MLKSLHQFQ

SEQ ID NO: 227116 - protein, 9 aa, Homo Sapiens
GGSGRSTPR

SEQ ID NO: 227117 - protein, 9 aa, Homo Sapiens
GIPAGSPST

SEQ ID NO: 227118 - protein, 9 aa, Homo Sapiens
YPNMNQGDM

SEQ ID NO: 227119 - protein, 9 aa, Homo Sapiens
LASHQKAAR

SEQ ID NO: 227120 - protein, 9 aa, Homo Sapiens
RAEPQATRR

SEQ ID NO: 227121 - protein, 9 aa, Homo Sapiens
VRSRPCAHD

SEQ ID NO: 227122 - protein, 9 aa, Homo Sapiens
CHGALTCLC

SEQ ID NO: 227123 - protein, 9 aa, Homo Sapiens
AIVLLSQRI

SEQ ID NO: 227124 - protein, 9 aa, Homo Sapiens
FVKRLSGVI

SEQ ID NO: 227125 - protein, 9 aa, Homo Sapiens
EARLTLAGM

SEQ ID NO: 227126 - protein, 9 aa, Homo Sapiens
EHQRMHTGE

SEQ ID NO: 227127 - protein, 9 aa, Homo Sapiens
YYPSGPLDT

SEQ ID NO: 227128 - protein, 9 aa, Homo Sapiens
PAWKHFLSL

SEQ ID NO: 227129 - protein, 9 aa, Homo Sapiens
SSTAKGPPP

SEQ ID NO: 227130 - protein, 9 aa, Homo Sapiens
TLSSVAQTH

SEQ ID NO: 227131 - protein, 9 aa, Homo Sapiens
EFMASGPIQ

SEQ ID NO: 227132 - protein, 9 aa, Homo Sapiens
AITIMKVHR

SEQ ID NO: 227133 - protein, 9 aa, Homo Sapiens
VGVFLDYVN

SEQ ID NO: 227134 - protein, 9 aa, Homo Sapiens
WCLECALYF

SEQ ID NO: 227135 - protein, 9 aa, Homo Sapiens
APSPCTPRA

SEQ ID NO: 227136 - protein, 9 aa, Homo Sapiens
GFEGADCSV

SEQ ID NO: 227137 - protein, 9 aa, Homo Sapiens
REFLSITKI

SEQ ID NO: 227138 - protein, 9 aa, Homo Sapiens
AATGSSSSL

SEQ ID NO: 227139 - protein, 9 aa, Homo Sapiens
TWSKVLPDA

SEQ ID NO: 227140 - protein, 9 aa, Homo Sapiens
SGLRLGPSE

SEQ ID NO: 227141 - protein, 9 aa, Homo Sapiens
TCTSCFCMA

SEQ ID NO: 227142 - protein, 9 aa, Homo Sapiens
EGLYTLRIM

SEQ ID NO: 227143 - protein, 9 aa, Homo Sapiens
GPVVLGADG

SEQ ID NO: 227144 - protein, 9 aa, Homo Sapiens
KYHNLCTHD

SEQ ID NO: 227145 - protein, 9 aa, Homo Sapiens
QYLYAMTGK

SEQ ID NO: 227146 - protein, 9 aa, Homo Sapiens
SSATAATGP

SEQ ID NO: 227147 - protein, 9 aa, Homo Sapiens
RKGSRTGVS

SEQ ID NO: 227148 - protein, 9 aa, Homo Sapiens
YIISKMRGT

SEQ ID NO: 227149 - protein, 9 aa, Homo Sapiens
SQESSSPTE

SEQ ID NO: 227150 - protein, 9 aa, Homo Sapiens
APQAHPGFL

SEQ ID NO: 227151 - protein, 9 aa, Homo Sapiens
LARLKGRNS

SEQ ID NO: 227152 - protein, 9 aa, Homo Sapiens
LNTEVCSVG

SEQ ID NO: 227153 - protein, 9 aa, Homo Sapiens
LLKHQRVHC

SEQ ID NO: 227154 - protein, 9 aa, Homo Sapiens
ENKKKKKEK

SEQ ID NO: 227155 - protein, 9 aa, Homo Sapiens
RCERVVEEL

SEQ ID NO: 227156 - protein, 9 aa, Homo Sapiens
TTVTDVPFQ

SEQ ID NO: 227157 - protein, 9 aa, Homo Sapiens
RNPDRELWP

SEQ ID NO: 227158 - protein, 9 aa, Homo Sapiens
GGKRNAYLK

SEQ ID NO: 227159 - protein, 9 aa, Homo Sapiens
HTCFKRQGK

SEQ ID NO: 227160 - protein, 9 aa, Homo Sapiens
SWPAPTHLW

SEQ ID NO: 227161 - protein, 9 aa, Homo Sapiens
VPRCRTPQA

SEQ ID NO: 227162 - protein, 9 aa, Homo Sapiens
KTYLTITDT

SEQ ID NO: 227163 - protein, 9 aa, Homo Sapiens
LKRSKNLEN

SEQ ID NO: 227164 - protein, 9 aa, Homo Sapiens
RTVLWLLTA

SEQ ID NO: 227165 - protein, 9 aa, Homo Sapiens
EHWQMYWLL

SEQ ID NO: 227166 - protein, 9 aa, Homo Sapiens
ARDLRCPLT

SEQ ID NO: 227167 - protein, 9 aa, Homo Sapiens
KPLSVIMGV

SEQ ID NO: 227168 - protein, 9 aa, Homo Sapiens
QSQHSPSEL

SEQ ID NO: 227169 - protein, 9 aa, Homo Sapiens
KGTSLYDLL

SEQ ID NO: 227170 - protein, 9 aa, Homo Sapiens
WSPATGPTS

SEQ ID NO: 227171 - protein, 9 aa, Homo Sapiens
TGMWTLVIV

SEQ ID NO: 227172 - protein, 9 aa, Homo Sapiens
PVFSYSWPR

SEQ ID NO: 227173 - protein, 9 aa, Homo Sapiens
TSSSGLQGC

SEQ ID NO: 227174 - protein, 9 aa, Homo Sapiens
ELLSSTRED

SEQ ID NO: 227175 - protein, 9 aa, Homo Sapiens
RCLAQEDVM

SEQ ID NO: 227176 - protein, 9 aa, Homo Sapiens
GQLMSTERN

SEQ ID NO: 227177 - protein, 9 aa, Homo Sapiens
RLGRPLGCS

SEQ ID NO: 227178 - protein, 9 aa, Homo Sapiens
ARQPPGCSW

SEQ ID NO: 227179 - protein, 9 aa, Homo Sapiens
KMIDLSKGR

SEQ ID NO: 227180 - protein, 9 aa, Homo Sapiens
GPLTITHTV

SEQ ID NO: 227181 - protein, 9 aa, Homo Sapiens
VGNGLLMTP

SEQ ID NO: 227182 - protein, 9 aa, Homo Sapiens
EGYSRSVCS

SEQ ID NO: 227183 - protein, 9 aa, Homo Sapiens
AAVVGIGVP

SEQ ID NO: 227184 - protein, 9 aa, Homo Sapiens
CDLRRGCYL

SEQ ID NO: 227185 - protein, 9 aa, Homo Sapiens
LKHICKTWA

SEQ ID NO: 227186 - protein, 9 aa, Homo Sapiens
PEGRGLAAP

SEQ ID NO: 227187 - protein, 9 aa, Homo Sapiens
EVWATPGHW

SEQ ID NO: 227188 - protein, 9 aa, Homo Sapiens
SRGKLASGV

SEQ ID NO: 227189 - protein, 9 aa, Homo Sapiens
DSDSEVSED

SEQ ID NO: 227190 - protein, 9 aa, Homo Sapiens
PRLRKFYKE

SEQ ID NO: 227191 - protein, 9 aa, Homo Sapiens
TAALCRKDW

SEQ ID NO: 227192 - protein, 9 aa, Homo Sapiens
TTSISVCGQ

SEQ ID NO: 227193 - protein, 9 aa, Homo Sapiens
HLLDQGQCP

SEQ ID NO: 227194 - protein, 9 aa, Homo Sapiens
QRLEALEKI

SEQ ID NO: 227195 - protein, 9 aa, Homo Sapiens
PPTNAAATG

SEQ ID NO: 227196 - protein, 9 aa, Homo Sapiens
NLENFLSRK

SEQ ID NO: 227197 - protein, 9 aa, Homo Sapiens
PPATEFLSP

SEQ ID NO: 227198 - protein, 9 aa, Homo Sapiens
TTATTHTVT

SEQ ID NO: 227199 - protein, 9 aa, Homo Sapiens
VKNVTKFLV

SEQ ID NO: 227200 - protein, 9 aa, Homo Sapiens
EMKSHIEDG

SEQ ID NO: 227201 - protein, 9 aa, Homo Sapiens
RLRLFPNCS

SEQ ID NO: 227202 - protein, 9 aa, Homo Sapiens
RRALHQLKH

SEQ ID NO: 227203 - protein, 9 aa, Homo Sapiens
PYEDKVHVW

SEQ ID NO: 227204 - protein, 9 aa, Homo Sapiens
YFLFLQMLP

SEQ ID NO: 227205 - protein, 9 aa, Homo Sapiens
GREHFVYVE

SEQ ID NO: 227206 - protein, 9 aa, Homo Sapiens
FFAKLHHSR

SEQ ID NO: 227207 - protein, 9 aa, Homo Sapiens
EFLMGGMSR

SEQ ID NO: 227208 - protein, 9 aa, Homo Sapiens
IQILLVFMD

SEQ ID NO: 227209 - protein, 9 aa, Homo Sapiens
KQRAEGMTS

SEQ ID NO: 227210 - protein, 9 aa, Homo Sapiens
VNARLARSS

SEQ ID NO: 227211 - protein, 9 aa, Homo Sapiens
CHEAESNIA

SEQ ID NO: 227212 - protein, 9 aa, Homo Sapiens
DQHGDGLRL

SEQ ID NO: 227213 - protein, 9 aa, Homo Sapiens
FTFSPITPE

SEQ ID NO: 227214 - protein, 9 aa, Homo Sapiens
LCISRQLWW

SEQ ID NO: 227215 - protein, 9 aa, Homo Sapiens
KEQRVILDC

SEQ ID NO: 227216 - protein, 9 aa, Homo Sapiens
KEKITKILS

SEQ ID NO: 227217 - protein, 9 aa, Homo Sapiens
PTLTSQVSG

SEQ ID NO: 227218 - protein, 9 aa, Homo Sapiens
ELTSTRIDR

SEQ ID NO: 227219 - protein, 9 aa, Homo Sapiens
WQPTGTQQD

SEQ ID NO: 227220 - protein, 9 aa, Homo Sapiens
QGPSEKTNC

SEQ ID NO: 227221 - protein, 9 aa, Homo Sapiens
ENICPSDSG

SEQ ID NO: 227222 - protein, 9 aa, Homo Sapiens
RSIALTQVR

SEQ ID NO: 227223 - protein, 9 aa, Homo Sapiens
LWCRPSWKG

SEQ ID NO: 227224 - protein, 9 aa, Homo Sapiens
VENTWNPVM

SEQ ID NO: 227225 - protein, 9 aa, Homo Sapiens
TLDADGFFI

SEQ ID NO: 227226 - protein, 9 aa, Homo Sapiens
QLATRAPCT

SEQ ID NO: 227227 - protein, 9 aa, Homo Sapiens
QTLMRTWII

SEQ ID NO: 227228 - protein, 9 aa, Homo Sapiens
REPPPREAI

SEQ ID NO: 227229 - protein, 9 aa, Homo Sapiens
KRKMTFRLV

SEQ ID NO: 227230 - protein, 9 aa, Homo Sapiens
VGSRVGVRW

SEQ ID NO: 227231 - protein, 9 aa, Homo Sapiens
QQNRGPVTV

SEQ ID NO: 227232 - protein, 9 aa, Homo Sapiens
MKRWMRRVP

SEQ ID NO: 227233 - protein, 9 aa, Homo Sapiens
ALSVLLPPP

SEQ ID NO: 227234 - protein, 9 aa, Homo Sapiens
VVDLACTPT

SEQ ID NO: 227235 - protein, 9 aa, Homo Sapiens
DTPQIEAEK

SEQ ID NO: 227236 - protein, 9 aa, Homo Sapiens
CRSGRRQPP

SEQ ID NO: 227237 - protein, 9 aa, Homo Sapiens
NGLLCDPGV

SEQ ID NO: 227238 - protein, 9 aa, Homo Sapiens
GGRMRGTKS

SEQ ID NO: 227239 - protein, 9 aa, Homo Sapiens
PYSIPSMIL

SEQ ID NO: 227240 - protein, 9 aa, Homo Sapiens
FSRKYNQKE

SEQ ID NO: 227241 - protein, 9 aa, Homo Sapiens
KDKKRHEMP

SEQ ID NO: 227242 - protein, 9 aa, Homo Sapiens
ELKKLKTFH

SEQ ID NO: 227243 - protein, 9 aa, Homo Sapiens
LGLGAAPLP

SEQ ID NO: 227244 - protein, 9 aa, Homo Sapiens
ISFSQHART

SEQ ID NO: 227245 - protein, 9 aa, Homo Sapiens
VHCAAPACS

SEQ ID NO: 227246 - protein, 9 aa, Homo Sapiens
CRARVPGLL

SEQ ID NO: 227247 - protein, 9 aa, Homo Sapiens
QLAHFQDRG

SEQ ID NO: 227248 - protein, 9 aa, Homo Sapiens
LLEPLMTFE

SEQ ID NO: 227249 - protein, 9 aa, Homo Sapiens
MDVNLLCVP

SEQ ID NO: 227250 - protein, 9 aa, Homo Sapiens
SWIPQSAGT

SEQ ID NO: 227251 - protein, 9 aa, Homo Sapiens
VPIGLDFQY

SEQ ID NO: 227252 - protein, 9 aa, Homo Sapiens
KSRLARRWA

SEQ ID NO: 227253 - protein, 9 aa, Homo Sapiens
ATDRYHMPK

SEQ ID NO: 227254 - protein, 9 aa, Homo Sapiens
HRLRLRLPR

SEQ ID NO: 227255 - protein, 9 aa, Homo Sapiens
GLAAPGVHP

SEQ ID NO: 227256 - protein, 9 aa, Homo Sapiens
EELPRERKR

SEQ ID NO: 227257 - protein, 9 aa, Homo Sapiens
VLESGERGV

SEQ ID NO: 227258 - protein, 9 aa, Homo Sapiens
PSPQQRNWL

SEQ ID NO: 227259 - protein, 9 aa, Homo Sapiens
PRASLRATV

SEQ ID NO: 227260 - protein, 9 aa, Homo Sapiens
KISHVENDY

SEQ ID NO: 227261 - protein, 9 aa, Homo Sapiens
MCYPIWLIT

SEQ ID NO: 227262 - protein, 9 aa, Homo Sapiens
AYDRYMVIC

SEQ ID NO: 227263 - protein, 9 aa, Homo Sapiens
SYGKTFSSA

SEQ ID NO: 227264 - protein, 9 aa, Homo Sapiens
MGKSSLALR

SEQ ID NO: 227265 - protein, 9 aa, Homo Sapiens
EAPRPWMSP

SEQ ID NO: 227266 - protein, 9 aa, Homo Sapiens
ERQCLAREK

SEQ ID NO: 227267 - protein, 9 aa, Homo Sapiens
HLVQHRHIH

SEQ ID NO: 227268 - protein, 9 aa, Homo Sapiens
KEWKSQMQS

SEQ ID NO: 227269 - protein, 9 aa, Homo Sapiens
VWDTVVARG

SEQ ID NO: 227270 - protein, 9 aa, Homo Sapiens
GIKMTVFAT

SEQ ID NO: 227271 - protein, 9 aa, Homo Sapiens
FEASVKLRL

SEQ ID NO: 227272 - protein, 9 aa, Homo Sapiens
NVIVPIVND

SEQ ID NO: 227273 - protein, 9 aa, Homo Sapiens
LGKEANSGH

SEQ ID NO: 227274 - protein, 9 aa, Homo Sapiens
GVAGQVPVD

SEQ ID NO: 227275 - protein, 9 aa, Homo Sapiens
RLPHQSPGH

SEQ ID NO: 227276 - protein, 9 aa, Homo Sapiens
GADLDEAVV

SEQ ID NO: 227277 - protein, 9 aa, Homo Sapiens
DEDLIKVSD

SEQ ID NO: 227278 - protein, 9 aa, Homo Sapiens
MIPETNSRY

SEQ ID NO: 227279 - protein, 9 aa, Homo Sapiens
LSSTAKRCS

SEQ ID NO: 227280 - protein, 9 aa, Homo Sapiens
PRRSRPGFS

SEQ ID NO: 227281 - protein, 9 aa, Homo Sapiens
ALYPGGKEE

SEQ ID NO: 227282 - protein, 9 aa, Homo Sapiens
KLTTTSSTG

SEQ ID NO: 227283 - protein, 9 aa, Homo Sapiens
QLYLLDYFL

SEQ ID NO: 227284 - protein, 9 aa, Homo Sapiens
LCQAWFTNC

SEQ ID NO: 227285 - protein, 9 aa, Homo Sapiens
SALVLLAPA

SEQ ID NO: 227286 - protein, 9 aa, Homo Sapiens
SQHSPSELF

SEQ ID NO: 227287 - protein, 9 aa, Homo Sapiens
PARTLARLR

SEQ ID NO: 227288 - protein, 9 aa, Homo Sapiens
DADSWGSGA

SEQ ID NO: 227289 - protein, 9 aa, Homo Sapiens
ALLFHGLGE

SEQ ID NO: 227290 - protein, 9 aa, Homo Sapiens
PRWMRVWRS

SEQ ID NO: 227291 - protein, 9 aa, Homo Sapiens
HGGVFGVAE

SEQ ID NO: 227292 - protein, 9 aa, Homo Sapiens
KKLEKKQDP

SEQ ID NO: 227293 - protein, 9 aa, Homo Sapiens
AYLISAQSL

SEQ ID NO: 227294 - protein, 9 aa, Homo Sapiens
ERGPLDKTI

SEQ ID NO: 227295 - protein, 9 aa, Homo Sapiens
AREETGVST

SEQ ID NO: 227296 - protein, 9 aa, Homo Sapiens
LKQYSRDEG

SEQ ID NO: 227297 - protein, 9 aa, Homo Sapiens
EEHCLKFIS

SEQ ID NO: 227298 - protein, 9 aa, Homo Sapiens
FEAREETGV

SEQ ID NO: 227299 - protein, 9 aa, Homo Sapiens
TLNNGNLGR

SEQ ID NO: 227300 - protein, 9 aa, Homo Sapiens
RVLTTRPSR

SEQ ID NO: 227301 - protein, 9 aa, Homo Sapiens
CSGLPELFC

SEQ ID NO: 227302 - protein, 9 aa, Homo Sapiens
RGSFWCSCD

SEQ ID NO: 227303 - protein, 9 aa, Homo Sapiens
SAWDIRDYV

SEQ ID NO: 227304 - protein, 9 aa, Homo Sapiens
NGALEKGRL

SEQ ID NO: 227305 - protein, 9 aa, Homo Sapiens
KLYLLLAFG

SEQ ID NO: 227306 - protein, 9 aa, Homo Sapiens
CSEEELNSP

SEQ ID NO: 227307 - protein, 9 aa, Homo Sapiens
DHGEDVEHV

SEQ ID NO: 227308 - protein, 9 aa, Homo Sapiens
HYSCAAGAG

SEQ ID NO: 227309 - protein, 9 aa, Homo Sapiens
PSRDCSWRG

SEQ ID NO: 227310 - protein, 9 aa, Homo Sapiens
VEQKVHSEE

SEQ ID NO: 227311 - protein, 9 aa, Homo Sapiens
QRMSGEGRM

SEQ ID NO: 227312 - protein, 9 aa, Homo Sapiens
DQVKISHVE

SEQ ID NO: 227313 - protein, 9 aa, Homo Sapiens
NLAYLYEHG

SEQ ID NO: 227314 - protein, 9 aa, Homo Sapiens
AGVVLARLK

SEQ ID NO: 227315 - protein, 9 aa, Homo Sapiens
SEAGRYASQ

SEQ ID NO: 227316 - protein, 9 aa, Homo Sapiens
MTLLGQELW

SEQ ID NO: 227317 - protein, 9 aa, Homo Sapiens
QSFTIQDLV

SEQ ID NO: 227318 - protein, 9 aa, Homo Sapiens
GLLGQALEV

SEQ ID NO: 227319 - protein, 9 aa, Homo Sapiens
LEKMPQYQK

SEQ ID NO: 227320 - protein, 9 aa, Homo Sapiens
VAATAVASL

SEQ ID NO: 227321 - protein, 9 aa, Homo Sapiens
SENYREALG

SEQ ID NO: 227322 - protein, 9 aa, Homo Sapiens
RQGTGSGPR

SEQ ID NO: 227323 - protein, 9 aa, Homo Sapiens
GDGLRLRAC

SEQ ID NO: 227324 - protein, 9 aa, Homo Sapiens
GHGDQELWS

SEQ ID NO: 227325 - protein, 9 aa, Homo Sapiens
RVHAPEGRG

SEQ ID NO: 227326 - protein, 9 aa, Homo Sapiens
AFSEIMGMV

SEQ ID NO: 227327 - protein, 9 aa, Homo Sapiens
MEVLESGER

SEQ ID NO: 227328 - protein, 9 aa, Homo Sapiens
CPPLLEAFP

SEQ ID NO: 227329 - protein, 9 aa, Homo Sapiens
WRSSECMKD

SEQ ID NO: 227330 - protein, 9 aa, Homo Sapiens
MVSRAAEPG

SEQ ID NO: 227331 - protein, 9 aa, Homo Sapiens
ILGSVDQYL

SEQ ID NO: 227332 - protein, 9 aa, Homo Sapiens
ILPCLSWPA

SEQ ID NO: 227333 - protein, 9 aa, Homo Sapiens
SFFFRVGRG

SEQ ID NO: 227334 - protein, 9 aa, Homo Sapiens
QGVVMKMGM

SEQ ID NO: 227335 - protein, 9 aa, Homo Sapiens
SLYLMQKHT

SEQ ID NO: 227336 - protein, 9 aa, Homo Sapiens
PDAMPTHRN

SEQ ID NO: 227337 - protein, 9 aa, Homo Sapiens
MPILGHSLL

SEQ ID NO: 227338 - protein, 9 aa, Homo Sapiens
TLARLRAVP

SEQ ID NO: 227339 - protein, 9 aa, Homo Sapiens
SSLGDDPPG

SEQ ID NO: 227340 - protein, 9 aa, Homo Sapiens
LSPMASEVP

SEQ ID NO: 227341 - protein, 9 aa, Homo Sapiens
AAAGVQFGE

SEQ ID NO: 227342 - protein, 9 aa, Homo Sapiens
WHSNSPCPR

SEQ ID NO: 227343 - protein, 9 aa, Homo Sapiens
KGLSEDVII

SEQ ID NO: 227344 - protein, 9 aa, Homo Sapiens
SGYKIPLPV

SEQ ID NO: 227345 - protein, 9 aa, Homo Sapiens
NEYQRMTVR

SEQ ID NO: 227346 - protein, 9 aa, Homo Sapiens
SETSGDFQK

SEQ ID NO: 227347 - protein, 9 aa, Homo Sapiens
FLALGEVIR

SEQ ID NO: 227348 - protein, 9 aa, Homo Sapiens
SFYDSWSPN

SEQ ID NO: 227349 - protein, 9 aa, Homo Sapiens
KAPVRALPM

SEQ ID NO: 227350 - protein, 9 aa, Homo Sapiens
TESRISFSQ

SEQ ID NO: 227351 - protein, 9 aa, Homo Sapiens
AWTAAGVSR

SEQ ID NO: 227352 - protein, 9 aa, Homo Sapiens
PPIVNPDPL

SEQ ID NO: 227353 - protein, 9 aa, Homo Sapiens
WTATECWIF

SEQ ID NO: 227354 - protein, 9 aa, Homo Sapiens
YIWDATILE

SEQ ID NO: 227355 - protein, 9 aa, Homo Sapiens
PAHLRRYSY

SEQ ID NO: 227356 - protein, 9 aa, Homo Sapiens
PWAGHLLGQ

SEQ ID NO: 227357 - protein, 9 aa, Homo Sapiens
QGRGRGSSQ

SEQ ID NO: 227358 - protein, 9 aa, Homo Sapiens
ACSTAKATT

SEQ ID NO: 227359 - protein, 9 aa, Homo Sapiens
LLPSPPLPQ

SEQ ID NO: 227360 - protein, 9 aa, Homo Sapiens
SALSKLNVE

SEQ ID NO: 227361 - protein, 9 aa, Homo Sapiens
IDQVKISHV

SEQ ID NO: 227362 - protein, 9 aa, Homo Sapiens
WQWSVPIRE

SEQ ID NO: 227363 - protein, 9 aa, Homo Sapiens
SARLAIEVL

SEQ ID NO: 227364 - protein, 9 aa, Homo Sapiens
LNLFGLGII

SEQ ID NO: 227365 - protein, 9 aa, Homo Sapiens
CSPQGRRKR

SEQ ID NO: 227366 - protein, 9 aa, Homo Sapiens
FGDVASLKS

SEQ ID NO: 227367 - protein, 9 aa, Homo Sapiens
HPMSSGRIS

SEQ ID NO: 227368 - protein, 9 aa, Homo Sapiens
RWWMSAASY

SEQ ID NO: 227369 - protein, 9 aa, Homo Sapiens
SWPMTIPGR

SEQ ID NO: 227370 - protein, 9 aa, Homo Sapiens
EAQCYVVAA

SEQ ID NO: 227371 - protein, 9 aa, Homo Sapiens
LYRGHAYPV

SEQ ID NO: 227372 - protein, 9 aa, Homo Sapiens
ALYFKHLLD

SEQ ID NO: 227373 - protein, 9 aa, Homo Sapiens
WETVSAASS

SEQ ID NO: 227374 - protein, 9 aa, Homo Sapiens
ASYLGNVLA

SEQ ID NO: 227375 - protein, 9 aa, Homo Sapiens
EKMPQYQKE

SEQ ID NO: 227376 - protein, 9 aa, Homo Sapiens
SPLKEVHFV

SEQ ID NO: 227377 - protein, 9 aa, Homo Sapiens
YLVILQTGA

SEQ ID NO: 227378 - protein, 9 aa, Homo Sapiens
GLPYEDKVH

SEQ ID NO: 227379 - protein, 9 aa, Homo Sapiens
KTWTQFRNY

SEQ ID NO: 227380 - protein, 9 aa, Homo Sapiens
CRCPYEYEG

SEQ ID NO: 227381 - protein, 9 aa, Homo Sapiens
KKMKKRIMV

SEQ ID NO: 227382 - protein, 9 aa, Homo Sapiens
SHYMEVCES

SEQ ID NO: 227383 - protein, 9 aa, Homo Sapiens
WPSRRAQRR

SEQ ID NO: 227384 - protein, 9 aa, Homo Sapiens
GVYKKVWCT

SEQ ID NO: 227385 - protein, 9 aa, Homo Sapiens
ELDNTLNDI

SEQ ID NO: 227386 - protein, 9 aa, Homo Sapiens
MKMGMPEEH

SEQ ID NO: 227387 - protein, 9 aa, Homo Sapiens
TEHQRMHTG

SEQ ID NO: 227388 - protein, 9 aa, Homo Sapiens
WSASGRNEP

SEQ ID NO: 227389 - protein, 9 aa, Homo Sapiens
MIRKQILKF

SEQ ID NO: 227390 - protein, 9 aa, Homo Sapiens
RILRTSQGC

SEQ ID NO: 227391 - protein, 9 aa, Homo Sapiens
QKVHSEEEA

SEQ ID NO: 227392 - protein, 9 aa, Homo Sapiens
LHIVELAQL

SEQ ID NO: 227393 - protein, 9 aa, Homo Sapiens
WKRPMGLSR

SEQ ID NO: 227394 - protein, 9 aa, Homo Sapiens
LNKPYIYRP

SEQ ID NO: 227395 - protein, 9 aa, Homo Sapiens
GSASSSAHH

SEQ ID NO: 227396 - protein, 9 aa, Homo Sapiens
SWRAQSAPR

SEQ ID NO: 227397 - protein, 9 aa, Homo Sapiens
DDVVGSALD

SEQ ID NO: 227398 - protein, 9 aa, Homo Sapiens
SLASALSPD

SEQ ID NO: 227399 - protein, 9 aa, Homo Sapiens
LKNQNLSLM

SEQ ID NO: 227400 - protein, 9 aa, Homo Sapiens
CRPGRLGVA

SEQ ID NO: 227401 - protein, 9 aa, Homo Sapiens
QEKRIHFPA

SEQ ID NO: 227402 - protein, 9 aa, Homo Sapiens
TKHSLAGND

SEQ ID NO: 227403 - protein, 9 aa, Homo Sapiens
HTVLSHEPG

SEQ ID NO: 227404 - protein, 9 aa, Homo Sapiens
DRLPLPRLR

SEQ ID NO: 227405 - protein, 9 aa, Homo Sapiens
AVGSAVWHT

SEQ ID NO: 227406 - protein, 9 aa, Homo Sapiens
TEDIAQRAV

SEQ ID NO: 227407 - protein, 9 aa, Homo Sapiens
MQKNNGCFR

SEQ ID NO: 227408 - protein, 9 aa, Homo Sapiens
ITEKQDILS

SEQ ID NO: 227409 - protein, 9 aa, Homo Sapiens
AVAPSTHTP

SEQ ID NO: 227410 - protein, 9 aa, Homo Sapiens
QSAKSGSTA

SEQ ID NO: 227411 - protein, 9 aa, Homo Sapiens
TCQTDGTWS

SEQ ID NO: 227412 - protein, 9 aa, Homo Sapiens
SRLARRWAL

SEQ ID NO: 227413 - protein, 9 aa, Homo Sapiens
NFVQDPNNN

SEQ ID NO: 227414 - protein, 9 aa, Homo Sapiens
SRHCLCKAG

SEQ ID NO: 227415 - protein, 9 aa, Homo Sapiens
TLPPTNAAA

SEQ ID NO: 227416 - protein, 9 aa, Homo Sapiens
LLCTALLNV

SEQ ID NO: 227417 - protein, 9 aa, Homo Sapiens
WTRKVICIV

SEQ ID NO: 227418 - protein, 9 aa, Homo Sapiens
PAVNLATHN

SEQ ID NO: 227419 - protein, 9 aa, Homo Sapiens
LTLPPPEYS

SEQ ID NO: 227420 - protein, 9 aa, Homo Sapiens
DTSQYSKCM

SEQ ID NO: 227421 - protein, 9 aa, Homo Sapiens
PTCSPQGRR

SEQ ID NO: 227422 - protein, 9 aa, Homo Sapiens
TSAVEQPPS

SEQ ID NO: 227423 - protein, 9 aa, Homo Sapiens
ETKPSNFRD

SEQ ID NO: 227424 - protein, 9 aa, Homo Sapiens
SPLPTFGCR

SEQ ID NO: 227425 - protein, 9 aa, Homo Sapiens
KASAQSTAQ

SEQ ID NO: 227426 - protein, 9 aa, Homo Sapiens
GWQPEEQLV

SEQ ID NO: 227427 - protein, 9 aa, Homo Sapiens
QKHTSSGSI

SEQ ID NO: 227428 - protein, 9 aa, Homo Sapiens
LPEWGEQIV

SEQ ID NO: 227429 - protein, 9 aa, Homo Sapiens
AQQAGWQPE

SEQ ID NO: 227430 - protein, 9 aa, Homo Sapiens
ASPVLCSVS

SEQ ID NO: 227431 - protein, 9 aa, Homo Sapiens
PHCTNSHLD

SEQ ID NO: 227432 - protein, 9 aa, Homo Sapiens
RVSSLPRSP

SEQ ID NO: 227433 - protein, 9 aa, Homo Sapiens
TEGPYVPRS

SEQ ID NO: 227434 - protein, 9 aa, Homo Sapiens
MCKYTTPLT

SEQ ID NO: 227435 - protein, 9 aa, Homo Sapiens
TSLGLHGLL

SEQ ID NO: 227436 - protein, 9 aa, Homo Sapiens
HAHSPERRC

SEQ ID NO: 227437 - protein, 9 aa, Homo Sapiens
QVEQNGTMV

SEQ ID NO: 227438 - protein, 9 aa, Homo Sapiens
STFEQGIKA

SEQ ID NO: 227439 - protein, 9 aa, Homo Sapiens
ISLKKGLAI

SEQ ID NO: 227440 - protein, 9 aa, Homo Sapiens
VGGRKRGHR

SEQ ID NO: 227441 - protein, 9 aa, Homo Sapiens
GCSSPLPTF

SEQ ID NO: 227442 - protein, 9 aa, Homo Sapiens
DLKNGKFYV

SEQ ID NO: 227443 - protein, 9 aa, Homo Sapiens
KLMKYCHIK

SEQ ID NO: 227444 - protein, 9 aa, Homo Sapiens
PHKRTRSGC

SEQ ID NO: 227445 - protein, 9 aa, Homo Sapiens
KFSNPFRYR

SEQ ID NO: 227446 - protein, 9 aa, Homo Sapiens
RESRAGHGA

SEQ ID NO: 227447 - protein, 9 aa, Homo Sapiens
GGHTLAGQT

SEQ ID NO: 227448 - protein, 9 aa, Homo Sapiens
IFALESAQF

SEQ ID NO: 227449 - protein, 9 aa, Homo Sapiens
EKLCHYSQK

SEQ ID NO: 227450 - protein, 9 aa, Homo Sapiens
GVGSSRLGR

SEQ ID NO: 227451 - protein, 9 aa, Homo Sapiens
MTEECTTIV

SEQ ID NO: 227452 - protein, 9 aa, Homo Sapiens
KETTKRVHL

SEQ ID NO: 227453 - protein, 9 aa, Homo Sapiens
SPPRGRGRR

SEQ ID NO: 227454 - protein, 9 aa, Homo Sapiens
QVGTCIVNS

SEQ ID NO: 227455 - protein, 9 aa, Homo Sapiens
ATGPTSSSI

SEQ ID NO: 227456 - protein, 9 aa, Homo Sapiens
LNEDGVAGQ

SEQ ID NO: 227457 - protein, 9 aa, Homo Sapiens
HPVSSGTPD

SEQ ID NO: 227458 - protein, 9 aa, Homo Sapiens
KMKKRIMVH

SEQ ID NO: 227459 - protein, 9 aa, Homo Sapiens
LIRRTRQAD

SEQ ID NO: 227460 - protein, 9 aa, Homo Sapiens
KNIHQKDTE

SEQ ID NO: 227461 - protein, 9 aa, Homo Sapiens
QEMCPPGIT

SEQ ID NO: 227462 - protein, 9 aa, Homo Sapiens
LAVGGPWAT

SEQ ID NO: 227463 - protein, 9 aa, Homo Sapiens
DDELIIKTV

SEQ ID NO: 227464 - protein, 9 aa, Homo Sapiens
AQSQHSPSE

SEQ ID NO: 227465 - protein, 9 aa, Homo Sapiens
DTIGEKTDK

SEQ ID NO: 227466 - protein, 9 aa, Homo Sapiens
KGHRRKEIW

SEQ ID NO: 227467 - protein, 9 aa, Homo Sapiens
RPMGLSRPE

SEQ ID NO: 227468 - protein, 9 aa, Homo Sapiens
IACSEIFMD

SEQ ID NO: 227469 - protein, 9 aa, Homo Sapiens
GAQQAGWQP

SEQ ID NO: 227470 - protein, 9 aa, Homo Sapiens
AKLLVASIA

SEQ ID NO: 227471 - protein, 9 aa, Homo Sapiens
HCLKQYSRD

SEQ ID NO: 227472 - protein, 9 aa, Homo Sapiens
TTLAVLHTE

SEQ ID NO: 227473 - protein, 9 aa, Homo Sapiens
ILVARIPLP

SEQ ID NO: 227474 - protein, 9 aa, Homo Sapiens
HLLGQLHPR

SEQ ID NO: 227475 - protein, 9 aa, Homo Sapiens
CTASFAAFQ

SEQ ID NO: 227476 - protein, 9 aa, Homo Sapiens
HSVASTLAP

SEQ ID NO: 227477 - protein, 9 aa, Homo Sapiens
QSAQSQHSP

SEQ ID NO: 227478 - protein, 9 aa, Homo Sapiens
VTRKTPWVF

SEQ ID NO: 227479 - protein, 9 aa, Homo Sapiens
ALQGHGLLG

SEQ ID NO: 227480 - protein, 9 aa, Homo Sapiens
KGSAYGGGA

SEQ ID NO: 227481 - protein, 9 aa, Homo Sapiens
SISEESSDS

SEQ ID NO: 227482 - protein, 9 aa, Homo Sapiens
RCSSCWTPT

SEQ ID NO: 227483 - protein, 9 aa, Homo Sapiens
VGVTLDGPA

SEQ ID NO: 227484 - protein, 9 aa, Homo Sapiens
SWELWVEGK

SEQ ID NO: 227485 - protein, 9 aa, Homo Sapiens
STCQTDGTW

SEQ ID NO: 227486 - protein, 9 aa, Homo Sapiens
VQARDRATN

SEQ ID NO: 227487 - protein, 9 aa, Homo Sapiens
SGCVVLPVL

SEQ ID NO: 227488 - protein, 9 aa, Homo Sapiens
EPPYSIPSM

SEQ ID NO: 227489 - protein, 9 aa, Homo Sapiens
VLAQLRLVD

SEQ ID NO: 227490 - protein, 9 aa, Homo Sapiens
GFGNMASSW

SEQ ID NO: 227491 - protein, 9 aa, Homo Sapiens
QAIFSRARC

SEQ ID NO: 227492 - protein, 9 aa, Homo Sapiens
LELLEVIFH

SEQ ID NO: 227493 - protein, 9 aa, Homo Sapiens
ARSKIPMKF

SEQ ID NO: 227494 - protein, 9 aa, Homo Sapiens
GFLEKTMIF

SEQ ID NO: 227495 - protein, 9 aa, Homo Sapiens
MILTLMYIL

SEQ ID NO: 227496 - protein, 9 aa, Homo Sapiens
HRHIHTGEK

SEQ ID NO: 227497 - protein, 9 aa, Homo Sapiens
ETTKRVHLG

SEQ ID NO: 227498 - protein, 9 aa, Homo Sapiens
IILVARIPL

SEQ ID NO: 227499 - protein, 9 aa, Homo Sapiens
FTYSLSVIS

SEQ ID NO: 227500 - protein, 9 aa, Homo Sapiens
EDFQSDGDS

SEQ ID NO: 227501 - protein, 9 aa, Homo Sapiens
TDGTWSSPT

SEQ ID NO: 227502 - protein, 9 aa, Homo Sapiens
LFIIDSFEE

SEQ ID NO: 227503 - protein, 9 aa, Homo Sapiens
HGQRLVFCL

SEQ ID NO: 227504 - protein, 9 aa, Homo Sapiens
LLPEDTPPS

SEQ ID NO: 227505 - protein, 9 aa, Homo Sapiens
EHLKKLSVP

SEQ ID NO: 227506 - protein, 9 aa, Homo Sapiens
RLKGLGKEA

SEQ ID NO: 227507 - protein, 9 aa, Homo Sapiens
AWFTNCEDD

SEQ ID NO: 227508 - protein, 9 aa, Homo Sapiens
DEAVVLNED

SEQ ID NO: 227509 - protein, 9 aa, Homo Sapiens
QNSIWHNLS

SEQ ID NO: 227510 - protein, 9 aa, Homo Sapiens
ILKQSADFY

SEQ ID NO: 227511 - protein, 9 aa, Homo Sapiens
PRFCAFGAT

SEQ ID NO: 227512 - protein, 9 aa, Homo Sapiens
QKFIPFIDV

SEQ ID NO: 227513 - protein, 9 aa, Homo Sapiens
KGRMLKILD

SEQ ID NO: 227514 - protein, 9 aa, Homo Sapiens
LAPKAEVDV

SEQ ID NO: 227515 - protein, 9 aa, Homo Sapiens
WRSSRRQRM

SEQ ID NO: 227516 - protein, 9 aa, Homo Sapiens
SLWKRLKVF

SEQ ID NO: 227517 - protein, 9 aa, Homo Sapiens
SNRKFGDPS

SEQ ID NO: 227518 - protein, 9 aa, Homo Sapiens
SWNTMQWNN

SEQ ID NO: 227519 - protein, 9 aa, Homo Sapiens
LPHVPEHRC

SEQ ID NO: 227520 - protein, 9 aa, Homo Sapiens
KVDIEAIFQ

SEQ ID NO: 227521 - protein, 9 aa, Homo Sapiens
MGHGREEAI

SEQ ID NO: 227522 - protein, 9 aa, Homo Sapiens
VPTAPEVLV

SEQ ID NO: 227523 - protein, 9 aa, Homo Sapiens
KPTTPEKQI

SEQ ID NO: 227524 - protein, 9 aa, Homo Sapiens
WGADDTMHI

SEQ ID NO: 227525 - protein, 9 aa, Homo Sapiens
RMSGEGRMV

SEQ ID NO: 227526 - protein, 9 aa, Homo Sapiens
CSTSAGKRK

SEQ ID NO: 227527 - protein, 9 aa, Homo Sapiens
ISEELDNTL

SEQ ID NO: 227528 - protein, 9 aa, Homo Sapiens
SDSILTEKT

SEQ ID NO: 227529 - protein, 9 aa, Homo Sapiens
GFLLIISTV

SEQ ID NO: 227530 - protein, 9 aa, Homo Sapiens
LGGDTAPGG

SEQ ID NO: 227531 - protein, 9 aa, Homo Sapiens
AGGSTQNNT

SEQ ID NO: 227532 - protein, 9 aa, Homo Sapiens
THQSQGLGQ

SEQ ID NO: 227533 - protein, 9 aa, Homo Sapiens
SLSNLGQDL

SEQ ID NO: 227534 - protein, 9 aa, Homo Sapiens
LEEECGKNK

SEQ ID NO: 227535 - protein, 9 aa, Homo Sapiens
GISGCSQEQ

SEQ ID NO: 227536 - protein, 9 aa, Homo Sapiens
QLYCLTKIY

SEQ ID NO: 227537 - protein, 9 aa, Homo Sapiens
SYLALGDLC

SEQ ID NO: 227538 - protein, 9 aa, Homo Sapiens
HKGKKNAPV

SEQ ID NO: 227539 - protein, 9 aa, Homo Sapiens
YLRELLEPL

SEQ ID NO: 227540 - protein, 9 aa, Homo Sapiens
EFLNKVSIL

SEQ ID NO: 227541 - protein, 9 aa, Homo Sapiens
LVLQGRPEL

SEQ ID NO: 227542 - protein, 9 aa, Homo Sapiens
SHLDPPPPR

SEQ ID NO: 227543 - protein, 9 aa, Homo Sapiens
MVGDMTMVN

SEQ ID NO: 227544 - protein, 9 aa, Homo Sapiens
EQSHLLAAQ

SEQ ID NO: 227545 - protein, 9 aa, Homo Sapiens
PPHHLVPLF

SEQ ID NO: 227546 - protein, 9 aa, Homo Sapiens
ELEHLKLQE

SEQ ID NO: 227547 - protein, 9 aa, Homo Sapiens
PQATGLLKP

SEQ ID NO: 227548 - protein, 9 aa, Homo Sapiens
GMLIGYCPQ

SEQ ID NO: 227549 - protein, 9 aa, Homo Sapiens
EVIRGQGSR

SEQ ID NO: 227550 - protein, 9 aa, Homo Sapiens
HTGWISTSS

SEQ ID NO: 227551 - protein, 9 aa, Homo Sapiens
LKKTYENAQ

SEQ ID NO: 227552 - protein, 9 aa, Homo Sapiens
PRGSCALQP

SEQ ID NO: 227553 - protein, 9 aa, Homo Sapiens
MMEKRKMTF

SEQ ID NO: 227554 - protein, 9 aa, Homo Sapiens
QASVAAWPS

SEQ ID NO: 227555 - protein, 9 aa, Homo Sapiens
QETLTTVHL

SEQ ID NO: 227556 - protein, 9 aa, Homo Sapiens
LRVQARDRA

SEQ ID NO: 227557 - protein, 9 aa, Homo Sapiens
DEGVADEEG

SEQ ID NO: 227558 - protein, 9 aa, Homo Sapiens
PLPGQHLWL

SEQ ID NO: 227559 - protein, 9 aa, Homo Sapiens
NLCQRTERP

SEQ ID NO: 227560 - protein, 9 aa, Homo Sapiens
AGVANSLPR

SEQ ID NO: 227561 - protein, 9 aa, Homo Sapiens
RDCVAAAEP

SEQ ID NO: 227562 - protein, 9 aa, Homo Sapiens
TTQSWIPQS

SEQ ID NO: 227563 - protein, 9 aa, Homo Sapiens
IGLHGDSSP

SEQ ID NO: 227564 - protein, 9 aa, Homo Sapiens
GGGSYRKLF

SEQ ID NO: 227565 - protein, 9 aa, Homo Sapiens
TNHVSASRA

SEQ ID NO: 227566 - protein, 9 aa, Homo Sapiens
LHHTLKEIL

SEQ ID NO: 227567 - protein, 9 aa, Homo Sapiens
LLAEAMCVG

SEQ ID NO: 227568 - protein, 9 aa, Homo Sapiens
TYTKGTFQQ

SEQ ID NO: 227569 - protein, 9 aa, Homo Sapiens
RSRSTLSLS

SEQ ID NO: 227570 - protein, 9 aa, Homo Sapiens
NSHSLLNFL

SEQ ID NO: 227571 - protein, 9 aa, Homo Sapiens
NPPGNWKSH

SEQ ID NO: 227572 - protein, 9 aa, Homo Sapiens
AHHCQYKLT

SEQ ID NO: 227573 - protein, 9 aa, Homo Sapiens
VDFLQRLVE

SEQ ID NO: 227574 - protein, 9 aa, Homo Sapiens
FKIVDASPS

SEQ ID NO: 227575 - protein, 9 aa, Homo Sapiens
MGVEAVITL

SEQ ID NO: 227576 - protein, 9 aa, Homo Sapiens
LFCQAPSIR

SEQ ID NO: 227577 - protein, 9 aa, Homo Sapiens
FEPPMPPPA

SEQ ID NO: 227578 - protein, 9 aa, Homo Sapiens
MDQTFKILY

SEQ ID NO: 227579 - protein, 9 aa, Homo Sapiens
VVDFSLGGN

SEQ ID NO: 227580 - protein, 9 aa, Homo Sapiens
VPLSCPLAL

SEQ ID NO: 227581 - protein, 9 aa, Homo Sapiens
HIFYQDKNL

SEQ ID NO: 227582 - protein, 9 aa, Homo Sapiens
SGWLSKILR

SEQ ID NO: 227583 - protein, 9 aa, Homo Sapiens
GTKNMLEMI

SEQ ID NO: 227584 - protein, 9 aa, Homo Sapiens
LTSQVSGTT

SEQ ID NO: 227585 - protein, 9 aa, Homo Sapiens
SALNLKHGQ

SEQ ID NO: 227586 - protein, 9 aa, Homo Sapiens
PSLITRQML

SEQ ID NO: 227587 - protein, 9 aa, Homo Sapiens
QEYQGAVPC

SEQ ID NO: 227588 - protein, 9 aa, Homo Sapiens
RAEAITWLM

SEQ ID NO: 227589 - protein, 9 aa, Homo Sapiens
DGLPWGRPR

SEQ ID NO: 227590 - protein, 9 aa, Homo Sapiens
PRDIKAFQV

SEQ ID NO: 227591 - protein, 9 aa, Homo Sapiens
RREYCKSAL

SEQ ID NO: 227592 - protein, 9 aa, Homo Sapiens
VTSFGYRCA

SEQ ID NO: 227593 - protein, 9 aa, Homo Sapiens
NRHRKITSK

SEQ ID NO: 227594 - protein, 9 aa, Homo Sapiens
SMLSATSTP

SEQ ID NO: 227595 - protein, 9 aa, Homo Sapiens
VVTRWYRVP

SEQ ID NO: 227596 - protein, 9 aa, Homo Sapiens
WVNLLLELD

SEQ ID NO: 227597 - protein, 9 aa, Homo Sapiens
VGPLVHRRL

SEQ ID NO: 227598 - protein, 9 aa, Homo Sapiens
GTAGMLIGY

SEQ ID NO: 227599 - protein, 9 aa, Homo Sapiens
AAAITVVGV

SEQ ID NO: 227600 - protein, 9 aa, Homo Sapiens
EEERRRCEE

SEQ ID NO: 227601 - protein, 9 aa, Homo Sapiens
ATPQGSNSS

SEQ ID NO: 227602 - protein, 9 aa, Homo Sapiens
MASGGSGGC

SEQ ID NO: 227603 - protein, 9 aa, Homo Sapiens
LDDVGCVGI

SEQ ID NO: 227604 - protein, 9 aa, Homo Sapiens
FLQSQNLNC

SEQ ID NO: 227605 - protein, 9 aa, Homo Sapiens
SHSLLNFLS

SEQ ID NO: 227606 - protein, 9 aa, Homo Sapiens
DIEQHNAGV

SEQ ID NO: 227607 - protein, 9 aa, Homo Sapiens
NRAMSRQTQ

SEQ ID NO: 227608 - protein, 9 aa, Homo Sapiens
GTRRRRPPG

SEQ ID NO: 227609 - protein, 9 aa, Homo Sapiens
VGLGPPTCS

SEQ ID NO: 227610 - protein, 9 aa, Homo Sapiens
QDKNLHGFS

SEQ ID NO: 227611 - protein, 9 aa, Homo Sapiens
SFGEFPGFW

SEQ ID NO: 227612 - protein, 9 aa, Homo Sapiens
IQMLLSRRN

SEQ ID NO: 227613 - protein, 9 aa, Homo Sapiens
LKLTGTHTE

SEQ ID NO: 227614 - protein, 9 aa, Homo Sapiens
PCGWPALPR

SEQ ID NO: 227615 - protein, 9 aa, Homo Sapiens
VVYVSVSLI

SEQ ID NO: 227616 - protein, 9 aa, Homo Sapiens
DANLDRPPL

SEQ ID NO: 227617 - protein, 9 aa, Homo Sapiens
IKMIDLSKG

SEQ ID NO: 227618 - protein, 9 aa, Homo Sapiens
CQKPVTAKS

SEQ ID NO: 227619 - protein, 9 aa, Homo Sapiens
SNFLNPPGG

SEQ ID NO: 227620 - protein, 9 aa, Homo Sapiens
LHGLLALSS

SEQ ID NO: 227621 - protein, 9 aa, Homo Sapiens
PRRVASRVW

SEQ ID NO: 227622 - protein, 9 aa, Homo Sapiens
HRLSGQRPG

SEQ ID NO: 227623 - protein, 9 aa, Homo Sapiens
GSGYPWAGF

SEQ ID NO: 227624 - protein, 9 aa, Homo Sapiens
RFTGVFTFG

SEQ ID NO: 227625 - protein, 9 aa, Homo Sapiens
SSPWPSCKA

SEQ ID NO: 227626 - protein, 9 aa, Homo Sapiens
GSSKRQTNG

SEQ ID NO: 227627 - protein, 9 aa, Homo Sapiens
YEGSDLATR

SEQ ID NO: 227628 - protein, 9 aa, Homo Sapiens
PLIHSVKNS

SEQ ID NO: 227629 - protein, 9 aa, Homo Sapiens
NVCVIKDKQ

SEQ ID NO: 227630 - protein, 9 aa, Homo Sapiens
APGLSSPPL

SEQ ID NO: 227631 - protein, 9 aa, Homo Sapiens
RPAGAAPVC

SEQ ID NO: 227632 - protein, 9 aa, Homo Sapiens
TKRNWTEGC

SEQ ID NO: 227633 - protein, 9 aa, Homo Sapiens
SGSSSCKGC

SEQ ID NO: 227634 - protein, 9 aa, Homo Sapiens
VLPEGVGPR

SEQ ID NO: 227635 - protein, 9 aa, Homo Sapiens
VHGYRGSRH

SEQ ID NO: 227636 - protein, 9 aa, Homo Sapiens
SANIQQARK

SEQ ID NO: 227637 - protein, 9 aa, Homo Sapiens
SVWSSAATT

SEQ ID NO: 227638 - protein, 9 aa, Homo Sapiens
ATRRDAGLT

SEQ ID NO: 227639 - protein, 9 aa, Homo Sapiens
IRAARETRS

SEQ ID NO: 227640 - protein, 9 aa, Homo Sapiens
SSFVVDFNE

SEQ ID NO: 227641 - protein, 9 aa, Homo Sapiens
MKMNAKKAA

SEQ ID NO: 227642 - protein, 9 aa, Homo Sapiens
HPHPHPMSS

SEQ ID NO: 227643 - protein, 9 aa, Homo Sapiens
IDQEEQLKL

SEQ ID NO: 227644 - protein, 9 aa, Homo Sapiens
MYVCARISV

SEQ ID NO: 227645 - protein, 9 aa, Homo Sapiens
GSVGVLARP

SEQ ID NO: 227646 - protein, 9 aa, Homo Sapiens
EPGDPDAVV

SEQ ID NO: 227647 - protein, 9 aa, Homo Sapiens
KTSCFKLDL

SEQ ID NO: 227648 - protein, 9 aa, Homo Sapiens
LAHSVASTL

SEQ ID NO: 227649 - protein, 9 aa, Homo Sapiens
GGGGGCCCC

SEQ ID NO: 227650 - protein, 9 aa, Homo Sapiens
LCAEGHGDQ

SEQ ID NO: 227651 - protein, 9 aa, Homo Sapiens
PSSPVPQLP

SEQ ID NO: 227652 - protein, 9 aa, Homo Sapiens
STTWIFGVL

SEQ ID NO: 227653 - protein, 9 aa, Homo Sapiens
QTGAPGMNI

SEQ ID NO: 227654 - protein, 9 aa, Homo Sapiens
QRLQHQSLT

SEQ ID NO: 227655 - protein, 9 aa, Homo Sapiens
WCIGTVPIG

SEQ ID NO: 227656 - protein, 9 aa, Homo Sapiens
RAQSAPRRS

SEQ ID NO: 227657 - protein, 9 aa, Homo Sapiens
RSTPPRSWR

SEQ ID NO: 227658 - protein, 9 aa, Homo Sapiens
DEKMTGSQD

SEQ ID NO: 227659 - protein, 9 aa, Homo Sapiens
PPAPRRGPA

SEQ ID NO: 227660 - protein, 9 aa, Homo Sapiens
AESKDWEQA

SEQ ID NO: 227661 - protein, 9 aa, Homo Sapiens
ESFAPGTLY

SEQ ID NO: 227662 - protein, 9 aa, Homo Sapiens
KRKEVNGKS

SEQ ID NO: 227663 - protein, 9 aa, Homo Sapiens
YVSVSLIYW

SEQ ID NO: 227664 - protein, 9 aa, Homo Sapiens
LRPGAPGLL

SEQ ID NO: 227665 - protein, 9 aa, Homo Sapiens
VGDLECAAR

SEQ ID NO: 227666 - protein, 9 aa, Homo Sapiens
WVVFVLLWA

SEQ ID NO: 227667 - protein, 9 aa, Homo Sapiens
NEALGTESS

SEQ ID NO: 227668 - protein, 9 aa, Homo Sapiens
DMFPCGPWT

SEQ ID NO: 227669 - protein, 9 aa, Homo Sapiens
KRNQPKKPK

SEQ ID NO: 227670 - protein, 9 aa, Homo Sapiens
VDVPGNPSK

SEQ ID NO: 227671 - protein, 9 aa, Homo Sapiens
SAVEQPPSP

SEQ ID NO: 227672 - protein, 9 aa, Homo Sapiens
SLSEYTRTC

SEQ ID NO: 227673 - protein, 9 aa, Homo Sapiens
NKKMAMTVI

SEQ ID NO: 227674 - protein, 9 aa, Homo Sapiens
RKVTELRQA

SEQ ID NO: 227675 - protein, 9 aa, Homo Sapiens
VESEVGRPE

SEQ ID NO: 227676 - protein, 9 aa, Homo Sapiens
VRYRERIAI

SEQ ID NO: 227677 - protein, 9 aa, Homo Sapiens
QSTKQITFI

SEQ ID NO: 227678 - protein, 9 aa, Homo Sapiens
ETGKRPFID

SEQ ID NO: 227679 - protein, 9 aa, Homo Sapiens
APISSGPGA

SEQ ID NO: 227680 - protein, 9 aa, Homo Sapiens
VDHTVNENT

SEQ ID NO: 227681 - protein, 9 aa, Homo Sapiens
GGNPAYSFH

SEQ ID NO: 227682 - protein, 9 aa, Homo Sapiens
GNCEQLRGQ

SEQ ID NO: 227683 - protein, 9 aa, Homo Sapiens
SWAMGSRWA

SEQ ID NO: 227684 - protein, 9 aa, Homo Sapiens
RECSSTKAS

SEQ ID NO: 227685 - protein, 9 aa, Homo Sapiens
LLAPATPPF

SEQ ID NO: 227686 - protein, 9 aa, Homo Sapiens
RRMRHKNIV

SEQ ID NO: 227687 - protein, 9 aa, Homo Sapiens
SSTGTRRRR

SEQ ID NO: 227688 - protein, 9 aa, Homo Sapiens
DSSEIQLKA

SEQ ID NO: 227689 - protein, 9 aa, Homo Sapiens
KELGFCIHV

SEQ ID NO: 227690 - protein, 9 aa, Homo Sapiens
TSHNTLEFT

SEQ ID NO: 227691 - protein, 9 aa, Homo Sapiens
STHCTGARM

SEQ ID NO: 227692 - protein, 9 aa, Homo Sapiens
TKQEIDPPT

SEQ ID NO: 227693 - protein, 9 aa, Homo Sapiens
KELVSRHLC

SEQ ID NO: 227694 - protein, 9 aa, Homo Sapiens
PKAEVDVIA

SEQ ID NO: 227695 - protein, 9 aa, Homo Sapiens
QEGLCSLQH

SEQ ID NO: 227696 - protein, 9 aa, Homo Sapiens
TRKTPWVFI

SEQ ID NO: 227697 - protein, 9 aa, Homo Sapiens
ILAVPVHTD

SEQ ID NO: 227698 - protein, 9 aa, Homo Sapiens
ERSHDQRHW

SEQ ID NO: 227699 - protein, 9 aa, Homo Sapiens
KKTYENAQS

SEQ ID NO: 227700 - protein, 9 aa, Homo Sapiens
WRSKISGFD

SEQ ID NO: 227701 - protein, 9 aa, Homo Sapiens
AKRPWHEYE

SEQ ID NO: 227702 - protein, 9 aa, Homo Sapiens
PLLLGVTLT

SEQ ID NO: 227703 - protein, 9 aa, Homo Sapiens
VFGWVMFVA

SEQ ID NO: 227704 - protein, 9 aa, Homo Sapiens
NMEKVTLKK

SEQ ID NO: 227705 - protein, 9 aa, Homo Sapiens
ITRAHTGWA

SEQ ID NO: 227706 - protein, 9 aa, Homo Sapiens
WTSAGSAAG

SEQ ID NO: 227707 - protein, 9 aa, Homo Sapiens
DLLLNCCVC

SEQ ID NO: 227708 - protein, 9 aa, Homo Sapiens
QWLRLRLTK

SEQ ID NO: 227709 - protein, 9 aa, Homo Sapiens
PAQRAEPQQ

SEQ ID NO: 227710 - protein, 9 aa, Homo Sapiens
GPMQPSSTW

SEQ ID NO: 227711 - protein, 9 aa, Homo Sapiens
RIGSLILLT

SEQ ID NO: 227712 - protein, 9 aa, Homo Sapiens
VPREGHILI

SEQ ID NO: 227713 - protein, 9 aa, Homo Sapiens
GIYVRPQLF

SEQ ID NO: 227714 - protein, 9 aa, Homo Sapiens
ASETLRCPQ

SEQ ID NO: 227715 - protein, 9 aa, Homo Sapiens
LGPNKALFI

SEQ ID NO: 227716 - protein, 9 aa, Homo Sapiens
KEEEERLRL

SEQ ID NO: 227717 - protein, 9 aa, Homo Sapiens
HPNCQQQLP

SEQ ID NO: 227718 - protein, 9 aa, Homo Sapiens
TPSVMQLRL

SEQ ID NO: 227719 - protein, 9 aa, Homo Sapiens
HFVFSRLPG

SEQ ID NO: 227720 - protein, 9 aa, Homo Sapiens
PAPVGLRGF

SEQ ID NO: 227721 - protein, 9 aa, Homo Sapiens
VAAYQPILA

SEQ ID NO: 227722 - protein, 9 aa, Homo Sapiens
MTSWGTLWW

SEQ ID NO: 227723 - protein, 9 aa, Homo Sapiens
GEAGPGLRA

SEQ ID NO: 227724 - protein, 9 aa, Homo Sapiens
LWMKIFRSG

SEQ ID NO: 227725 - protein, 9 aa, Homo Sapiens
FFLCHFILF

SEQ ID NO: 227726 - protein, 9 aa, Homo Sapiens
WIDMKQALM

SEQ ID NO: 227727 - protein, 9 aa, Homo Sapiens
GSSSSLSVM

SEQ ID NO: 227728 - protein, 9 aa, Homo Sapiens
TITEHVPLG

SEQ ID NO: 227729 - protein, 9 aa, Homo Sapiens
VAATDAHYE

SEQ ID NO: 227730 - protein, 9 aa, Homo Sapiens
EGWTPLHVD

SEQ ID NO: 227731 - protein, 9 aa, Homo Sapiens
VDFSLGGNI

SEQ ID NO: 227732 - protein, 9 aa, Homo Sapiens
PPHVKRHAV

SEQ ID NO: 227733 - protein, 9 aa, Homo Sapiens
PVFPLPFNM

SEQ ID NO: 227734 - protein, 9 aa, Homo Sapiens
QTVDVEPCI

SEQ ID NO: 227735 - protein, 9 aa, Homo Sapiens
SLPEELPLP

SEQ ID NO: 227736 - protein, 9 aa, Homo Sapiens
LKGNRAENF

SEQ ID NO: 227737 - protein, 9 aa, Homo Sapiens
ELFSTYKEN

SEQ ID NO: 227738 - protein, 9 aa, Homo Sapiens
WCSCDTGYM

SEQ ID NO: 227739 - protein, 9 aa, Homo Sapiens
YRSLVHSAV

SEQ ID NO: 227740 - protein, 9 aa, Homo Sapiens
CIAAAITVV

SEQ ID NO: 227741 - protein, 9 aa, Homo Sapiens
RTTWGPARP

SEQ ID NO: 227742 - protein, 9 aa, Homo Sapiens
TSVMSVAKP

SEQ ID NO: 227743 - protein, 9 aa, Homo Sapiens
FQSSTLLFT

SEQ ID NO: 227744 - protein, 9 aa, Homo Sapiens
EKSVREKNS

SEQ ID NO: 227745 - protein, 9 aa, Homo Sapiens
TQNNTNVQM

SEQ ID NO: 227746 - protein, 9 aa, Homo Sapiens
PPLWAALAT

SEQ ID NO: 227747 - protein, 9 aa, Homo Sapiens
HSESASPST

SEQ ID NO: 227748 - protein, 9 aa, Homo Sapiens
LTEHQRMHT

SEQ ID NO: 227749 - protein, 9 aa, Homo Sapiens
EVEVLQEGE

SEQ ID NO: 227750 - protein, 9 aa, Homo Sapiens
YCKSALLLV

SEQ ID NO: 227751 - protein, 9 aa, Homo Sapiens
LDNIADNPQ

SEQ ID NO: 227752 - protein, 9 aa, Homo Sapiens
KCARRLAKK

SEQ ID NO: 227753 - protein, 9 aa, Homo Sapiens
IVCFTKILS

SEQ ID NO: 227754 - protein, 9 aa, Homo Sapiens
DNSPEVRQS

SEQ ID NO: 227755 - protein, 9 aa, Homo Sapiens
QAEVQEGHG

SEQ ID NO: 227756 - protein, 9 aa, Homo Sapiens
MLKILDWLL

SEQ ID NO: 227757 - protein, 9 aa, Homo Sapiens
RQDVLSNSD

SEQ ID NO: 227758 - protein, 9 aa, Homo Sapiens
GHLEGLGPV

SEQ ID NO: 227759 - protein, 9 aa, Homo Sapiens
MKLNGQLMS

SEQ ID NO: 227760 - protein, 9 aa, Homo Sapiens
GDRPIRHHN

SEQ ID NO: 227761 - protein, 9 aa, Homo Sapiens
PDWHWGAAA

SEQ ID NO: 227762 - protein, 9 aa, Homo Sapiens
LLNFLSGKL

SEQ ID NO: 227763 - protein, 9 aa, Homo Sapiens
VDECNDGNN

SEQ ID NO: 227764 - protein, 9 aa, Homo Sapiens
NPDSQWPPC

SEQ ID NO: 227765 - protein, 9 aa, Homo Sapiens
TALIHLSDF

SEQ ID NO: 227766 - protein, 9 aa, Homo Sapiens
GDNSWQPGG

SEQ ID NO: 227767 - protein, 9 aa, Homo Sapiens
ASCVRTLTW

SEQ ID NO: 227768 - protein, 9 aa, Homo Sapiens
TLSASSSSS

SEQ ID NO: 227769 - protein, 9 aa, Homo Sapiens
WKKSLNIRS

SEQ ID NO: 227770 - protein, 9 aa, Homo Sapiens
ARIPLPQRL

SEQ ID NO: 227771 - protein, 9 aa, Homo Sapiens
KAEVDVIAK

SEQ ID NO: 227772 - protein, 9 aa, Homo Sapiens
IWQPVMDTV

SEQ ID NO: 227773 - protein, 9 aa, Homo Sapiens
ELKKQMQHV

SEQ ID NO: 227774 - protein, 9 aa, Homo Sapiens
LVCETPCGC

SEQ ID NO: 227775 - protein, 9 aa, Homo Sapiens
HQVLRKLKQ

SEQ ID NO: 227776 - protein, 9 aa, Homo Sapiens
KQSQQSLSL

SEQ ID NO: 227777 - protein, 9 aa, Homo Sapiens
FFLHYGHHL

SEQ ID NO: 227778 - protein, 9 aa, Homo Sapiens
QAPSIRTPR

SEQ ID NO: 227779 - protein, 9 aa, Homo Sapiens
RKFYKEEKK

SEQ ID NO: 227780 - protein, 9 aa, Homo Sapiens
QRKESFQEN

SEQ ID NO: 227781 - protein, 9 aa, Homo Sapiens
RRAQRRCQP

SEQ ID NO: 227782 - protein, 9 aa, Homo Sapiens
LLPPATAPA

SEQ ID NO: 227783 - protein, 9 aa, Homo Sapiens
TAHRAVAPS

SEQ ID NO: 227784 - protein, 9 aa, Homo Sapiens
LGAHHPLAH

SEQ ID NO: 227785 - protein, 9 aa, Homo Sapiens
VPRKYWECK

SEQ ID NO: 227786 - protein, 9 aa, Homo Sapiens
DPPPPRPQL

SEQ ID NO: 227787 - protein, 9 aa, Homo Sapiens
HRGDAGPGD

SEQ ID NO: 227788 - protein, 9 aa, Homo Sapiens
VPRWMRVWR

SEQ ID NO: 227789 - protein, 9 aa, Homo Sapiens
WLKLTKFYF

SEQ ID NO: 227790 - protein, 9 aa, Homo Sapiens
DSVALNTAH

SEQ ID NO: 227791 - protein, 9 aa, Homo Sapiens
PQERYLLQA

SEQ ID NO: 227792 - protein, 9 aa, Homo Sapiens
ANIVLSGST

SEQ ID NO: 227793 - protein, 9 aa, Homo Sapiens
KHTEAKKAY

SEQ ID NO: 227794 - protein, 9 aa, Homo Sapiens
AQLGPAFIK

SEQ ID NO: 227795 - protein, 9 aa, Homo Sapiens
NFTSGTVIP

SEQ ID NO: 227796 - protein, 9 aa, Homo Sapiens
VLLVVEHVP

SEQ ID NO: 227797 - protein, 9 aa, Homo Sapiens
SSQWSPATG

SEQ ID NO: 227798 - protein, 9 aa, Homo Sapiens
QIKLYNPPT

SEQ ID NO: 227799 - protein, 9 aa, Homo Sapiens
GLLERLARP

SEQ ID NO: 227800 - protein, 9 aa, Homo Sapiens
VFLPSNGEK

SEQ ID NO: 227801 - protein, 9 aa, Homo Sapiens
DHGMEPGAD

SEQ ID NO: 227802 - protein, 9 aa, Homo Sapiens
FGEFPGFWF

SEQ ID NO: 227803 - protein, 9 aa, Homo Sapiens
DLNLWALCD

SEQ ID NO: 227804 - protein, 9 aa, Homo Sapiens
QNRVSVIIF

SEQ ID NO: 227805 - protein, 9 aa, Homo Sapiens
QERYLLQAV

SEQ ID NO: 227806 - protein, 9 aa, Homo Sapiens
DLGRGSKPV

SEQ ID NO: 227807 - protein, 9 aa, Homo Sapiens
LEHSHQIFV

SEQ ID NO: 227808 - protein, 9 aa, Homo Sapiens
LSKKERKVT

SEQ ID NO: 227809 - protein, 9 aa, Homo Sapiens
HMPSYEDRV

SEQ ID NO: 227810 - protein, 9 aa, Homo Sapiens
RAPHPPPAA

SEQ ID NO: 227811 - protein, 9 aa, Homo Sapiens
TEMAHRVGV

SEQ ID NO: 227812 - protein, 9 aa, Homo Sapiens
QNFWENLAL

SEQ ID NO: 227813 - protein, 9 aa, Homo Sapiens
ANSLPRSSS

SEQ ID NO: 227814 - protein, 9 aa, Homo Sapiens
VEEAPSIFW

SEQ ID NO: 227815 - protein, 9 aa, Homo Sapiens
YFRVPVFGW

SEQ ID NO: 227816 - protein, 9 aa, Homo Sapiens
GSSGCKVHQ

SEQ ID NO: 227817 - protein, 9 aa, Homo Sapiens
SGTKMKATH

SEQ ID NO: 227818 - protein, 9 aa, Homo Sapiens
FDSCLKYDH

SEQ ID NO: 227819 - protein, 9 aa, Homo Sapiens
NMSVADSYD

SEQ ID NO: 227820 - protein, 9 aa, Homo Sapiens
QTSHWCPTQ

SEQ ID NO: 227821 - protein, 9 aa, Homo Sapiens
AIFSRARCC

SEQ ID NO: 227822 - protein, 9 aa, Homo Sapiens
GAAEPPGSY

SEQ ID NO: 227823 - protein, 9 aa, Homo Sapiens
SLKMRNLHF

SEQ ID NO: 227824 - protein, 9 aa, Homo Sapiens
AASQRFPPP

SEQ ID NO: 227825 - protein, 9 aa, Homo Sapiens
SIQRACCAP

SEQ ID NO: 227826 - protein, 9 aa, Homo Sapiens
TVETEVEAM

SEQ ID NO: 227827 - protein, 9 aa, Homo Sapiens
LPVFPLPFN

SEQ ID NO: 227828 - protein, 9 aa, Homo Sapiens
TVIRRGENT

SEQ ID NO: 227829 - protein, 9 aa, Homo Sapiens
VLCVRCGQM

SEQ ID NO: 227830 - protein, 9 aa, Homo Sapiens
ASVAAWPSR

SEQ ID NO: 227831 - protein, 9 aa, Homo Sapiens
PGLDALVAT

SEQ ID NO: 227832 - protein, 9 aa, Homo Sapiens
PYECKQCWR

SEQ ID NO: 227833 - protein, 9 aa, Homo Sapiens
PSIFWMRRL

SEQ ID NO: 227834 - protein, 9 aa, Homo Sapiens
RLSKNEYVS

SEQ ID NO: 227835 - protein, 9 aa, Homo Sapiens
LLEIFALES

SEQ ID NO: 227836 - protein, 9 aa, Homo Sapiens
LGGCRDHCN

SEQ ID NO: 227837 - protein, 9 aa, Homo Sapiens
IPTIGWCWL

SEQ ID NO: 227838 - protein, 9 aa, Homo Sapiens
SPPGAPPCQ

SEQ ID NO: 227839 - protein, 9 aa, Homo Sapiens
LVAVASLPD

SEQ ID NO: 227840 - protein, 9 aa, Homo Sapiens
EQDGFGNMA

SEQ ID NO: 227841 - protein, 9 aa, Homo Sapiens
AFCRPTTVR

SEQ ID NO: 227842 - protein, 9 aa, Homo Sapiens
LPPAPKWRR

SEQ ID NO: 227843 - protein, 9 aa, Homo Sapiens
RTTCHSILS

SEQ ID NO: 227844 - protein, 9 aa, Homo Sapiens
SWNDEARVE

SEQ ID NO: 227845 - protein, 9 aa, Homo Sapiens
TKVSAHVCT

SEQ ID NO: 227846 - protein, 9 aa, Homo Sapiens
DLAGHYTHR

SEQ ID NO: 227847 - protein, 9 aa, Homo Sapiens
EKSNKKISV

SEQ ID NO: 227848 - protein, 9 aa, Homo Sapiens
GQPWPPTCS

SEQ ID NO: 227849 - protein, 9 aa, Homo Sapiens
CVAAAEPFL

SEQ ID NO: 227850 - protein, 9 aa, Homo Sapiens
AACWCLECA

SEQ ID NO: 227851 - protein, 9 aa, Homo Sapiens
RRCLMGLGG

SEQ ID NO: 227852 - protein, 9 aa, Homo Sapiens
EYAQRIPTG

SEQ ID NO: 227853 - protein, 9 aa, Homo Sapiens
TTVCQHNVR

SEQ ID NO: 227854 - protein, 9 aa, Homo Sapiens
VVSTKEVLM

SEQ ID NO: 227855 - protein, 9 aa, Homo Sapiens
LHRLILPMK

SEQ ID NO: 227856 - protein, 9 aa, Homo Sapiens
YAATPVGRF

SEQ ID NO: 227857 - protein, 9 aa, Homo Sapiens
ARCRDETRR

SEQ ID NO: 227858 - protein, 9 aa, Homo Sapiens
VTNPVYEAL

SEQ ID NO: 227859 - protein, 9 aa, Homo Sapiens
HQDVGVGFD

SEQ ID NO: 227860 - protein, 9 aa, Homo Sapiens
SPLALPASM

SEQ ID NO: 227861 - protein, 9 aa, Homo Sapiens
KKKRSVCNY

SEQ ID NO: 227862 - protein, 9 aa, Homo Sapiens
FLEYDRDLS

SEQ ID NO: 227863 - protein, 9 aa, Homo Sapiens
PAGRGAPRH

SEQ ID NO: 227864 - protein, 9 aa, Homo Sapiens
YVSLDSPTN

SEQ ID NO: 227865 - protein, 9 aa, Homo Sapiens
RCRQRCGPR

SEQ ID NO: 227866 - protein, 9 aa, Homo Sapiens
TTVEHTPIW

SEQ ID NO: 227867 - protein, 9 aa, Homo Sapiens
CEPGPPGPQ

SEQ ID NO: 227868 - protein, 9 aa, Homo Sapiens
QEAQRQVVL

SEQ ID NO: 227869 - protein, 9 aa, Homo Sapiens
VRLLHFFSG

SEQ ID NO: 227870 - protein, 9 aa, Homo Sapiens
LEDSSEIQL

SEQ ID NO: 227871 - protein, 9 aa, Homo Sapiens
GLPPQRPGW

SEQ ID NO: 227872 - protein, 9 aa, Homo Sapiens
KQNSKLWPE

SEQ ID NO: 227873 - protein, 9 aa, Homo Sapiens
ARRCGSATG

SEQ ID NO: 227874 - protein, 9 aa, Homo Sapiens
AHTQDVISD

SEQ ID NO: 227875 - protein, 9 aa, Homo Sapiens
TAVLPSFAA

SEQ ID NO: 227876 - protein, 9 aa, Homo Sapiens
LWKKSLNIR

SEQ ID NO: 227877 - protein, 9 aa, Homo Sapiens
SAPVDAGGH

SEQ ID NO: 227878 - protein, 9 aa, Homo Sapiens
AQCRGRPAR

SEQ ID NO: 227879 - protein, 9 aa, Homo Sapiens
PFECNKYGK

SEQ ID NO: 227880 - protein, 9 aa, Homo Sapiens
GRMRGTKST

SEQ ID NO: 227881 - protein, 9 aa, Homo Sapiens
TASCGTGSR

SEQ ID NO: 227882 - protein, 9 aa, Homo Sapiens
WEATQQVLC

SEQ ID NO: 227883 - protein, 9 aa, Homo Sapiens
AKATTCTWT

SEQ ID NO: 227884 - protein, 9 aa, Homo Sapiens
KIVDASPSP

SEQ ID NO: 227885 - protein, 9 aa, Homo Sapiens
SKVLIKLPD

SEQ ID NO: 227886 - protein, 9 aa, Homo Sapiens
VLCRVGARP

SEQ ID NO: 227887 - protein, 9 aa, Homo Sapiens
TSRRSGCVW

SEQ ID NO: 227888 - protein, 9 aa, Homo Sapiens
NTPTFPSSV

SEQ ID NO: 227889 - protein, 9 aa, Homo Sapiens
PHFKEVQSG

SEQ ID NO: 227890 - protein, 9 aa, Homo Sapiens
MDEVYTIPN

SEQ ID NO: 227891 - protein, 9 aa, Homo Sapiens
AVPPHVKRH

SEQ ID NO: 227892 - protein, 9 aa, Homo Sapiens
RSSTSCSTA

SEQ ID NO: 227893 - protein, 9 aa, Homo Sapiens
SRAVEGMLR

SEQ ID NO: 227894 - protein, 9 aa, Homo Sapiens
GQLYCLSSY

SEQ ID NO: 227895 - protein, 9 aa, Homo Sapiens
LLLLVPCAH

SEQ ID NO: 227896 - protein, 9 aa, Homo Sapiens
RREEKWLRR

SEQ ID NO: 227897 - protein, 9 aa, Homo Sapiens
KTTSQSQLS

SEQ ID NO: 227898 - protein, 9 aa, Homo Sapiens
LNPLIHSVK

SEQ ID NO: 227899 - protein, 9 aa, Homo Sapiens
DRRNLTKLF

SEQ ID NO: 227900 - protein, 9 aa, Homo Sapiens
RRLLVFRLV

SEQ ID NO: 227901 - protein, 9 aa, Homo Sapiens
AKWKTPTAT

SEQ ID NO: 227902 - protein, 9 aa, Homo Sapiens
VATASCGTG

SEQ ID NO: 227903 - protein, 9 aa, Homo Sapiens
VRIASIAVV

SEQ ID NO: 227904 - protein, 9 aa, Homo Sapiens
NDSRCGSGS

SEQ ID NO: 227905 - protein, 9 aa, Homo Sapiens
RERGGGCLP

SEQ ID NO: 227906 - protein, 9 aa, Homo Sapiens
GGQKQWIAI

SEQ ID NO: 227907 - protein, 9 aa, Homo Sapiens
KSPAWKHFL

SEQ ID NO: 227908 - protein, 9 aa, Homo Sapiens
SRKYNQKEF

SEQ ID NO: 227909 - protein, 9 aa, Homo Sapiens
DSNGAIFSL

SEQ ID NO: 227910 - protein, 9 aa, Homo Sapiens
NPEIITVGE

SEQ ID NO: 227911 - protein, 9 aa, Homo Sapiens
EAVEKYLTT

SEQ ID NO: 227912 - protein, 9 aa, Homo Sapiens
AVQGQVHVF

SEQ ID NO: 227913 - protein, 9 aa, Homo Sapiens
LKNQKYQEL

SEQ ID NO: 227914 - protein, 9 aa, Homo Sapiens
LNEHHGGEE

SEQ ID NO: 227915 - protein, 9 aa, Homo Sapiens
YYQTLNLMR

SEQ ID NO: 227916 - protein, 9 aa, Homo Sapiens
EPFLILRWL

SEQ ID NO: 227917 - protein, 9 aa, Homo Sapiens
SAASSAGSS

SEQ ID NO: 227918 - protein, 9 aa, Homo Sapiens
DFQYSHLQR

SEQ ID NO: 227919 - protein, 9 aa, Homo Sapiens
VEKKKKRTR

SEQ ID NO: 227920 - protein, 9 aa, Homo Sapiens
PPHSAMGPG

SEQ ID NO: 227921 - protein, 9 aa, Homo Sapiens
ATAVLLPCT

SEQ ID NO: 227922 - protein, 9 aa, Homo Sapiens
SVGIIKKMK

SEQ ID NO: 227923 - protein, 9 aa, Homo Sapiens
TKRAEAITW

SEQ ID NO: 227924 - protein, 9 aa, Homo Sapiens
MKEKINAVH

SEQ ID NO: 227925 - protein, 9 aa, Homo Sapiens
IDVVKVGLV

SEQ ID NO: 227926 - protein, 9 aa, Homo Sapiens
GVSGLSAAS

SEQ ID NO: 227927 - protein, 9 aa, Homo Sapiens
DSLSPVVLL

SEQ ID NO: 227928 - protein, 9 aa, Homo Sapiens
QVQGLIDEL

SEQ ID NO: 227929 - protein, 9 aa, Homo Sapiens
LIEDIVCDG

SEQ ID NO: 227930 - protein, 9 aa, Homo Sapiens
VLAHQPGPE

SEQ ID NO: 227931 - protein, 9 aa, Homo Sapiens
FQRDLPQER

SEQ ID NO: 227932 - protein, 9 aa, Homo Sapiens
ERVRIEKAY

SEQ ID NO: 227933 - protein, 9 aa, Homo Sapiens
ARWWMSAAS

SEQ ID NO: 227934 - protein, 9 aa, Homo Sapiens
KRGRTAPAE

SEQ ID NO: 227935 - protein, 9 aa, Homo Sapiens
AKTFKKDRL

SEQ ID NO: 227936 - protein, 9 aa, Homo Sapiens
CTQMYHYSC

SEQ ID NO: 227937 - protein, 9 aa, Homo Sapiens
STQSLPRLG

SEQ ID NO: 227938 - protein, 9 aa, Homo Sapiens
ERAAAALRA

SEQ ID NO: 227939 - protein, 9 aa, Homo Sapiens
QIVPSHKLT

SEQ ID NO: 227940 - protein, 9 aa, Homo Sapiens
GEEPYKCSE

SEQ ID NO: 227941 - protein, 9 aa, Homo Sapiens
EVARHHENS

SEQ ID NO: 227942 - protein, 9 aa, Homo Sapiens
ASGLSADSM

SEQ ID NO: 227943 - protein, 9 aa, Homo Sapiens
TYSPARGVV

SEQ ID NO: 227944 - protein, 9 aa, Homo Sapiens
GPTHIGKKP

SEQ ID NO: 227945 - protein, 9 aa, Homo Sapiens
SNGTMADLD

SEQ ID NO: 227946 - protein, 9 aa, Homo Sapiens
KILKLTLKM

SEQ ID NO: 227947 - protein, 9 aa, Homo Sapiens
PLNQKIRSS

SEQ ID NO: 227948 - protein, 9 aa, Homo Sapiens
GLALCPSAP

SEQ ID NO: 227949 - protein, 9 aa, Homo Sapiens
SGILSPMAS

SEQ ID NO: 227950 - protein, 9 aa, Homo Sapiens
AEPPYSIPS

SEQ ID NO: 227951 - protein, 9 aa, Homo Sapiens
TPGPWAAAW

SEQ ID NO: 227952 - protein, 9 aa, Homo Sapiens
AAPLSPLGL

SEQ ID NO: 227953 - protein, 9 aa, Homo Sapiens
LCWSTVAQT

SEQ ID NO: 227954 - protein, 9 aa, Homo Sapiens
TARGVTARS

SEQ ID NO: 227955 - protein, 9 aa, Homo Sapiens
FCIHVKHPH

SEQ ID NO: 227956 - protein, 9 aa, Homo Sapiens
LIKMIDLSK

SEQ ID NO: 227957 - protein, 9 aa, Homo Sapiens
WTWMTWCGW

SEQ ID NO: 227958 - protein, 9 aa, Homo Sapiens
TGVTSQAMA

SEQ ID NO: 227959 - protein, 9 aa, Homo Sapiens
GSYAVATAS

SEQ ID NO: 227960 - protein, 9 aa, Homo Sapiens
YCLSSYIKR

SEQ ID NO: 227961 - protein, 9 aa, Homo Sapiens
VHGLGLLLH

SEQ ID NO: 227962 - protein, 9 aa, Homo Sapiens
GVLGAHHPL

SEQ ID NO: 227963 - protein, 9 aa, Homo Sapiens
CVIKDKQTQ

SEQ ID NO: 227964 - protein, 9 aa, Homo Sapiens
SLPLSSSQV

SEQ ID NO: 227965 - protein, 9 aa, Homo Sapiens
KTASSTRMG

SEQ ID NO: 227966 - protein, 9 aa, Homo Sapiens
VGLHSLVHG

SEQ ID NO: 227967 - protein, 9 aa, Homo Sapiens
ILQTGAPGM

SEQ ID NO: 227968 - protein, 9 aa, Homo Sapiens
LAQLRLVDG

SEQ ID NO: 227969 - protein, 9 aa, Homo Sapiens
ALEKIRTTE

SEQ ID NO: 227970 - protein, 9 aa, Homo Sapiens
EGWWQLLGL

SEQ ID NO: 227971 - protein, 9 aa, Homo Sapiens
AAAPALPTS

SEQ ID NO: 227972 - protein, 9 aa, Homo Sapiens
PLVAIMITR

SEQ ID NO: 227973 - protein, 9 aa, Homo Sapiens
WQGRSIGTA

SEQ ID NO: 227974 - protein, 9 aa, Homo Sapiens
QGQLNKFES

SEQ ID NO: 227975 - protein, 9 aa, Homo Sapiens
ALGSPQSRW

SEQ ID NO: 227976 - protein, 9 aa, Homo Sapiens
SLMIEYSEP

SEQ ID NO: 227977 - protein, 9 aa, Homo Sapiens
WKGGERRRG

SEQ ID NO: 227978 - protein, 9 aa, Homo Sapiens
VLHFSLKGC

SEQ ID NO: 227979 - protein, 9 aa, Homo Sapiens
AKSVGVKTS

SEQ ID NO: 227980 - protein, 9 aa, Homo Sapiens
WSPRPPGAS

SEQ ID NO: 227981 - protein, 9 aa, Homo Sapiens
QTSIRYSPL

SEQ ID NO: 227982 - protein, 9 aa, Homo Sapiens
GRALLSVEL

SEQ ID NO: 227983 - protein, 9 aa, Homo Sapiens
RTTEEMLDA

SEQ ID NO: 227984 - protein, 9 aa, Homo Sapiens
FKWSELWKK

SEQ ID NO: 227985 - protein, 9 aa, Homo Sapiens
NREFLSITK

SEQ ID NO: 227986 - protein, 9 aa, Homo Sapiens
LVTSHSFRT

SEQ ID NO: 227987 - protein, 9 aa, Homo Sapiens
HRSSSWPAP

SEQ ID NO: 227988 - protein, 9 aa, Homo Sapiens
SHLTFNHDG

SEQ ID NO: 227989 - protein, 9 aa, Homo Sapiens
PAEFRAQLG

SEQ ID NO: 227990 - protein, 9 aa, Homo Sapiens
HGDSSPLQV

SEQ ID NO: 227991 - protein, 9 aa, Homo Sapiens
TTKLRQSLF

SEQ ID NO: 227992 - protein, 9 aa, Homo Sapiens
FTVDHGMEP

SEQ ID NO: 227993 - protein, 9 aa, Homo Sapiens
EKKRHCDRH

SEQ ID NO: 227994 - protein, 9 aa, Homo Sapiens
TQPGEEGAA

SEQ ID NO: 227995 - protein, 9 aa, Homo Sapiens
PGAAAGVQF

SEQ ID NO: 227996 - protein, 9 aa, Homo Sapiens
VEMDATPGV

SEQ ID NO: 227997 - protein, 9 aa, Homo Sapiens
VVILFVVDT

SEQ ID NO: 227998 - protein, 9 aa, Homo Sapiens
LLKVNDLYW

SEQ ID NO: 227999 - protein, 9 aa, Homo Sapiens
TPASCVRTL

SEQ ID NO: 228000 - protein, 9 aa, Homo Sapiens
RRCPRTPRA

SEQ ID NO: 228001 - protein, 9 aa, Homo Sapiens
YDNILNVGA

SEQ ID NO: 228002 - protein, 9 aa, Homo Sapiens
LKAIITMDT

SEQ ID NO: 228003 - protein, 9 aa, Homo Sapiens
KPSDMGNLD

SEQ ID NO: 228004 - protein, 9 aa, Homo Sapiens
MCVNYSDHM

SEQ ID NO: 228005 - protein, 9 aa, Homo Sapiens
PWWSQPPPT

SEQ ID NO: 228006 - protein, 9 aa, Homo Sapiens
HGLGLLLHH

SEQ ID NO: 228007 - protein, 9 aa, Homo Sapiens
TGETPYKCS

SEQ ID NO: 228008 - protein, 9 aa, Homo Sapiens
HSIPCLGLK

SEQ ID NO: 228009 - protein, 9 aa, Homo Sapiens
TSQNHSKCI

SEQ ID NO: 228010 - protein, 9 aa, Homo Sapiens
SVGVKTSRF

SEQ ID NO: 228011 - protein, 9 aa, Homo Sapiens
GIEASLSDC

SEQ ID NO: 228012 - protein, 9 aa, Homo Sapiens
VMGLNPKTK

SEQ ID NO: 228013 - protein, 9 aa, Homo Sapiens
VTWSSALCV

SEQ ID NO: 228014 - protein, 9 aa, Homo Sapiens
APASPGTHP

SEQ ID NO: 228015 - protein, 9 aa, Homo Sapiens
LQRVHLEEH

SEQ ID NO: 228016 - protein, 9 aa, Homo Sapiens
SRTLGLHVH

SEQ ID NO: 228017 - protein, 9 aa, Homo Sapiens
IIAWEYKMP

SEQ ID NO: 228018 - protein, 9 aa, Homo Sapiens
KNNGCFRSS

SEQ ID NO: 228019 - protein, 9 aa, Homo Sapiens
PRSWSSGGK

SEQ ID NO: 228020 - protein, 9 aa, Homo Sapiens
CLPAVTTCC

SEQ ID NO: 228021 - protein, 9 aa, Homo Sapiens
RFVKRLSGV

SEQ ID NO: 228022 - protein, 9 aa, Homo Sapiens
NFWVECQSK

SEQ ID NO: 228023 - protein, 9 aa, Homo Sapiens
HGVGRVLAV

SEQ ID NO: 228024 - protein, 9 aa, Homo Sapiens
GRGRRGSRR

SEQ ID NO: 228025 - protein, 9 aa, Homo Sapiens
TGKQVTRVP

SEQ ID NO: 228026 - protein, 9 aa, Homo Sapiens
TAALAAEVN

SEQ ID NO: 228027 - protein, 9 aa, Homo Sapiens
YKFLIVIGG

SEQ ID NO: 228028 - protein, 9 aa, Homo Sapiens
TQSQRKMKQ

SEQ ID NO: 228029 - protein, 9 aa, Homo Sapiens
GCGAPRSWG

SEQ ID NO: 228030 - protein, 9 aa, Homo Sapiens
LFLVLHFSL

SEQ ID NO: 228031 - protein, 9 aa, Homo Sapiens
PEGVGPRDI

SEQ ID NO: 228032 - protein, 9 aa, Homo Sapiens
HSLLFCGKP

SEQ ID NO: 228033 - protein, 9 aa, Homo Sapiens
RPESCHDFH

SEQ ID NO: 228034 - protein, 9 aa, Homo Sapiens
LARFVWGKL

SEQ ID NO: 228035 - protein, 9 aa, Homo Sapiens
CISVKDHRT

SEQ ID NO: 228036 - protein, 9 aa, Homo Sapiens
DNAPRAAAF

SEQ ID NO: 228037 - protein, 9 aa, Homo Sapiens
QMYLWPQLG

SEQ ID NO: 228038 - protein, 9 aa, Homo Sapiens
LRTPQPSGL

SEQ ID NO: 228039 - protein, 9 aa, Homo Sapiens
QRMTVRDIE

SEQ ID NO: 228040 - protein, 9 aa, Homo Sapiens
GTLSASSSS

SEQ ID NO: 228041 - protein, 9 aa, Homo Sapiens
IVGKSLWPG

SEQ ID NO: 228042 - protein, 9 aa, Homo Sapiens
FDCMNVLSV

SEQ ID NO: 228043 - protein, 9 aa, Homo Sapiens
PEPPRPHAS

SEQ ID NO: 228044 - protein, 9 aa, Homo Sapiens
VHLEATLEE

SEQ ID NO: 228045 - protein, 9 aa, Homo Sapiens
KRSCSASVS

SEQ ID NO: 228046 - protein, 9 aa, Homo Sapiens
CQLLQQMCY

SEQ ID NO: 228047 - protein, 9 aa, Homo Sapiens
EFLKTLKND

SEQ ID NO: 228048 - protein, 9 aa, Homo Sapiens
TVWPPTAAR

SEQ ID NO: 228049 - protein, 9 aa, Homo Sapiens
LQQDLDPCF

SEQ ID NO: 228050 - protein, 9 aa, Homo Sapiens
RHPQGPCPP

SEQ ID NO: 228051 - protein, 9 aa, Homo Sapiens
CKSRLARRW

SEQ ID NO: 228052 - protein, 9 aa, Homo Sapiens
ALGKPLYRV

SEQ ID NO: 228053 - protein, 9 aa, Homo Sapiens
RCWTGAVCG

SEQ ID NO: 228054 - protein, 9 aa, Homo Sapiens
SQVVLCISQ

SEQ ID NO: 228055 - protein, 9 aa, Homo Sapiens
AMGPGSHPL

SEQ ID NO: 228056 - protein, 9 aa, Homo Sapiens
ALLGFRLVL

SEQ ID NO: 228057 - protein, 9 aa, Homo Sapiens
CWCLECALY

SEQ ID NO: 228058 - protein, 9 aa, Homo Sapiens
LLSHKSCKL

SEQ ID NO: 228059 - protein, 9 aa, Homo Sapiens
SGMGVLSVE

SEQ ID NO: 228060 - protein, 9 aa, Homo Sapiens
GVIMAVLDE

SEQ ID NO: 228061 - protein, 9 aa, Homo Sapiens
PPKSPHSWK

SEQ ID NO: 228062 - protein, 9 aa, Homo Sapiens
GAAPLPPRA

SEQ ID NO: 228063 - protein, 9 aa, Homo Sapiens
EITAVEVGT

SEQ ID NO: 228064 - protein, 9 aa, Homo Sapiens
EPCDQLHIC

SEQ ID NO: 228065 - protein, 9 aa, Homo Sapiens
SPLKKVWNL

SEQ ID NO: 228066 - protein, 9 aa, Homo Sapiens
PGPQDLQVI

SEQ ID NO: 228067 - protein, 9 aa, Homo Sapiens
TSCSTAATA

SEQ ID NO: 228068 - protein, 9 aa, Homo Sapiens
KGLWRRGLG

SEQ ID NO: 228069 - protein, 9 aa, Homo Sapiens
NFLSGKLTA

SEQ ID NO: 228070 - protein, 9 aa, Homo Sapiens
AADDFSLKY

SEQ ID NO: 228071 - protein, 9 aa, Homo Sapiens
FTTVRQLVH

SEQ ID NO: 228072 - protein, 9 aa, Homo Sapiens
AHIKSVDDV

SEQ ID NO: 228073 - protein, 9 aa, Homo Sapiens
RRCYSRGSV

SEQ ID NO: 228074 - protein, 9 aa, Homo Sapiens
TSSSIQRAC

SEQ ID NO: 228075 - protein, 9 aa, Homo Sapiens
LTSTDGPGQ

SEQ ID NO: 228076 - protein, 9 aa, Homo Sapiens
DTIVRIASI

SEQ ID NO: 228077 - protein, 9 aa, Homo Sapiens
RKNQVFPCA

SEQ ID NO: 228078 - protein, 9 aa, Homo Sapiens
VRYVTENRD

SEQ ID NO: 228079 - protein, 9 aa, Homo Sapiens
DGGFGMCKY

SEQ ID NO: 228080 - protein, 9 aa, Homo Sapiens
GLFGVVGKM

SEQ ID NO: 228081 - protein, 9 aa, Homo Sapiens
QRAEGMTSL

SEQ ID NO: 228082 - protein, 9 aa, Homo Sapiens
RWALAQAGR

SEQ ID NO: 228083 - protein, 9 aa, Homo Sapiens
LLQTCLHAA

SEQ ID NO: 228084 - protein, 9 aa, Homo Sapiens
KLNTEVCSV

SEQ ID NO: 228085 - protein, 9 aa, Homo Sapiens
ALRPTDYLS

SEQ ID NO: 228086 - protein, 9 aa, Homo Sapiens
QLIFCASNG

SEQ ID NO: 228087 - protein, 9 aa, Homo Sapiens
QRSARLAIE

SEQ ID NO: 228088 - protein, 9 aa, Homo Sapiens
RQCGPCGSG

SEQ ID NO: 228089 - protein, 9 aa, Homo Sapiens
GALEKGRLH

SEQ ID NO: 228090 - protein, 9 aa, Homo Sapiens
KLNVEVACV

SEQ ID NO: 228091 - protein, 9 aa, Homo Sapiens
EHWEEAIFD

SEQ ID NO: 228092 - protein, 9 aa, Homo Sapiens
NGSDGVIMT

SEQ ID NO: 228093 - protein, 9 aa, Homo Sapiens
IGVHPHPHP

SEQ ID NO: 228094 - protein, 9 aa, Homo Sapiens
IGGGGGGCC

SEQ ID NO: 228095 - protein, 9 aa, Homo Sapiens
EARHLEFRK

SEQ ID NO: 228096 - protein, 9 aa, Homo Sapiens
APWWSQPPP

SEQ ID NO: 228097 - protein, 9 aa, Homo Sapiens
TRPAHKYYL

SEQ ID NO: 228098 - protein, 9 aa, Homo Sapiens
PPAPKWRRR

SEQ ID NO: 228099 - protein, 9 aa, Homo Sapiens
SAQENIVGI

SEQ ID NO: 228100 - protein, 9 aa, Homo Sapiens
PIKLHKSMW

SEQ ID NO: 228101 - protein, 9 aa, Homo Sapiens
RGGGDANLD

SEQ ID NO: 228102 - protein, 9 aa, Homo Sapiens
PKQHNCQSY

SEQ ID NO: 228103 - protein, 9 aa, Homo Sapiens
SRDTNRHRK

SEQ ID NO: 228104 - protein, 9 aa, Homo Sapiens
LVLASLQVA

SEQ ID NO: 228105 - protein, 9 aa, Homo Sapiens
LINNQTLQV

SEQ ID NO: 228106 - protein, 9 aa, Homo Sapiens
HHSRSGSIS

SEQ ID NO: 228107 - protein, 9 aa, Homo Sapiens
KGLKKMTLK

SEQ ID NO: 228108 - protein, 9 aa, Homo Sapiens
YEDFWILVS

SEQ ID NO: 228109 - protein, 9 aa, Homo Sapiens
GASLDPIMR

SEQ ID NO: 228110 - protein, 9 aa, Homo Sapiens
RHGHLDSPT

SEQ ID NO: 228111 - protein, 9 aa, Homo Sapiens
QIDIMATEM

SEQ ID NO: 228112 - protein, 9 aa, Homo Sapiens
GEQECQAEV

SEQ ID NO: 228113 - protein, 9 aa, Homo Sapiens
FLLSTTWIF

SEQ ID NO: 228114 - protein, 9 aa, Homo Sapiens
LLHQVLRKL

SEQ ID NO: 228115 - protein, 9 aa, Homo Sapiens
RKCNGQPIP

SEQ ID NO: 228116 - protein, 9 aa, Homo Sapiens
EGPPCIRTT

SEQ ID NO: 228117 - protein, 9 aa, Homo Sapiens
GTEYFRVPV

SEQ ID NO: 228118 - protein, 9 aa, Homo Sapiens
TPGQARAAQ

SEQ ID NO: 228119 - protein, 9 aa, Homo Sapiens
HPTGVRGLG

SEQ ID NO: 228120 - protein, 9 aa, Homo Sapiens
VYAATPVGR

SEQ ID NO: 228121 - protein, 9 aa, Homo Sapiens
ARPRARRGE

SEQ ID NO: 228122 - protein, 9 aa, Homo Sapiens
TVRDSDSEL

SEQ ID NO: 228123 - protein, 9 aa, Homo Sapiens
SPIERKVIE

SEQ ID NO: 228124 - protein, 9 aa, Homo Sapiens
VTCTHKEGE

SEQ ID NO: 228125 - protein, 9 aa, Homo Sapiens
PGVFAINRA

SEQ ID NO: 228126 - protein, 9 aa, Homo Sapiens
EETSMQNPD

SEQ ID NO: 228127 - protein, 9 aa, Homo Sapiens
ECDVNECFQ

SEQ ID NO: 228128 - protein, 9 aa, Homo Sapiens
MITQSRDCV

SEQ ID NO: 228129 - protein, 9 aa, Homo Sapiens
WNIEEYCRN

SEQ ID NO: 228130 - protein, 9 aa, Homo Sapiens
TDSYIISKM

SEQ ID NO: 228131 - protein, 9 aa, Homo Sapiens
PPLLEAFPL

SEQ ID NO: 228132 - protein, 9 aa, Homo Sapiens
PQAQVEWPQ

SEQ ID NO: 228133 - protein, 9 aa, Homo Sapiens
ARGWGRRWS

SEQ ID NO: 228134 - protein, 9 aa, Homo Sapiens
IVEQKVHSE

SEQ ID NO: 228135 - protein, 9 aa, Homo Sapiens
PVVAAVVGI

SEQ ID NO: 228136 - protein, 9 aa, Homo Sapiens
SGDMMSSGF

SEQ ID NO: 228137 - protein, 9 aa, Homo Sapiens
ELRPVMDKW

SEQ ID NO: 228138 - protein, 9 aa, Homo Sapiens
PHLNPNRTY

SEQ ID NO: 228139 - protein, 9 aa, Homo Sapiens
TLPKKLTST

SEQ ID NO: 228140 - protein, 9 aa, Homo Sapiens
PLPPRAPHP

SEQ ID NO: 228141 - protein, 9 aa, Homo Sapiens
TPRRQRSST

SEQ ID NO: 228142 - protein, 9 aa, Homo Sapiens
RCLHDTALA

SEQ ID NO: 228143 - protein, 9 aa, Homo Sapiens
QSPCPAPGP

SEQ ID NO: 228144 - protein, 9 aa, Homo Sapiens
GKEANSGHQ

SEQ ID NO: 228145 - protein, 9 aa, Homo Sapiens
FATIIGAFV

SEQ ID NO: 228146 - protein, 9 aa, Homo Sapiens
QRTLARKAV

SEQ ID NO: 228147 - protein, 9 aa, Homo Sapiens
QKRREGVKS

SEQ ID NO: 228148 - protein, 9 aa, Homo Sapiens
RALRIVCFT

SEQ ID NO: 228149 - protein, 9 aa, Homo Sapiens
ETGVSTYNP

SEQ ID NO: 228150 - protein, 9 aa, Homo Sapiens
GGEKEEDKK

SEQ ID NO: 228151 - protein, 9 aa, Homo Sapiens
VEDLYLFKL

SEQ ID NO: 228152 - protein, 9 aa, Homo Sapiens
RVGPAQCRP

SEQ ID NO: 228153 - protein, 9 aa, Homo Sapiens
KQMERQCLA

SEQ ID NO: 228154 - protein, 9 aa, Homo Sapiens
LQPHFKEVQ

SEQ ID NO: 228155 - protein, 9 aa, Homo Sapiens
DCSWRGQCN

SEQ ID NO: 228156 - protein, 9 aa, Homo Sapiens
FIFVLDIVS

SEQ ID NO: 228157 - protein, 9 aa, Homo Sapiens
LNVPNIFKR

SEQ ID NO: 228158 - protein, 9 aa, Homo Sapiens
EGSTVMRET

SEQ ID NO: 228159 - protein, 9 aa, Homo Sapiens
AGQEKDCWA

SEQ ID NO: 228160 - protein, 9 aa, Homo Sapiens
SAGAYTLLV

SEQ ID NO: 228161 - protein, 9 aa, Homo Sapiens
RLAYLISAR

SEQ ID NO: 228162 - protein, 9 aa, Homo Sapiens
TLEFHTLLR

SEQ ID NO: 228163 - protein, 9 aa, Homo Sapiens
RSGLFGQVF

SEQ ID NO: 228164 - protein, 9 aa, Homo Sapiens
DMVSRAAEP

SEQ ID NO: 228165 - protein, 9 aa, Homo Sapiens
QDGFGNMAS

SEQ ID NO: 228166 - protein, 9 aa, Homo Sapiens
LALKNQNLS

SEQ ID NO: 228167 - protein, 9 aa, Homo Sapiens
YHPRAFIFS

SEQ ID NO: 228168 - protein, 9 aa, Homo Sapiens
PDIQCDDPQ

SEQ ID NO: 228169 - protein, 9 aa, Homo Sapiens
ARQGTGSGP

SEQ ID NO: 228170 - protein, 9 aa, Homo Sapiens
AGTAGMLIG

SEQ ID NO: 228171 - protein, 9 aa, Homo Sapiens
PTRPRRKPR

SEQ ID NO: 228172 - protein, 9 aa, Homo Sapiens
KAEFVSLLC

SEQ ID NO: 228173 - protein, 9 aa, Homo Sapiens
SLQCQSLAL

SEQ ID NO: 228174 - protein, 9 aa, Homo Sapiens
WTNRPRSQH

SEQ ID NO: 228175 - protein, 9 aa, Homo Sapiens
GCPVSTRSL

SEQ ID NO: 228176 - protein, 9 aa, Homo Sapiens
RVKCFEKNE

SEQ ID NO: 228177 - protein, 9 aa, Homo Sapiens
YDLKSAGAS

SEQ ID NO: 228178 - protein, 9 aa, Homo Sapiens
TPNHTPWPA

SEQ ID NO: 228179 - protein, 9 aa, Homo Sapiens
HAVSEGTKT

SEQ ID NO: 228180 - protein, 9 aa, Homo Sapiens
PSDMGNLDD

SEQ ID NO: 228181 - protein, 9 aa, Homo Sapiens
RFPLGRVSW

SEQ ID NO: 228182 - protein, 9 aa, Homo Sapiens
CVEKDRQIG

SEQ ID NO: 228183 - protein, 9 aa, Homo Sapiens
GYPVSTWSL

SEQ ID NO: 228184 - protein, 9 aa, Homo Sapiens
WSFSTFGKE

SEQ ID NO: 228185 - protein, 9 aa, Homo Sapiens
FFNGALEKG

SEQ ID NO: 228186 - protein, 9 aa, Homo Sapiens
PECPPELYT

SEQ ID NO: 228187 - protein, 9 aa, Homo Sapiens
KSHLIVSVW

SEQ ID NO: 228188 - protein, 9 aa, Homo Sapiens
VRAPHAAHP

SEQ ID NO: 228189 - protein, 9 aa, Homo Sapiens
IMLPSLRSR

SEQ ID NO: 228190 - protein, 9 aa, Homo Sapiens
SRRQRMEAA

SEQ ID NO: 228191 - protein, 9 aa, Homo Sapiens
QAITSHMHL

SEQ ID NO: 228192 - protein, 9 aa, Homo Sapiens
LDPPKSPHS

SEQ ID NO: 228193 - protein, 9 aa, Homo Sapiens
LFAPDCYIH

SEQ ID NO: 228194 - protein, 9 aa, Homo Sapiens
LASHEEHWG

SEQ ID NO: 228195 - protein, 9 aa, Homo Sapiens
RKAPHCTNS

SEQ ID NO: 228196 - protein, 9 aa, Homo Sapiens
RYLFPALLF

SEQ ID NO: 228197 - protein, 9 aa, Homo Sapiens
FIIDSFEEL

SEQ ID NO: 228198 - protein, 9 aa, Homo Sapiens
GCVQVTFSP

SEQ ID NO: 228199 - protein, 9 aa, Homo Sapiens
ALSPDCRRR

SEQ ID NO: 228200 - protein, 9 aa, Homo Sapiens
CQSKGKIKE

SEQ ID NO: 228201 - protein, 9 aa, Homo Sapiens
PLVFNPDTE

SEQ ID NO: 228202 - protein, 9 aa, Homo Sapiens
AEVPQGAVI

SEQ ID NO: 228203 - protein, 9 aa, Homo Sapiens
CYSRGSVQR

SEQ ID NO: 228204 - protein, 9 aa, Homo Sapiens
TLTWTWQWS

SEQ ID NO: 228205 - protein, 9 aa, Homo Sapiens
MNKWDYMNT

SEQ ID NO: 228206 - protein, 9 aa, Homo Sapiens
ETPAVLELT

SEQ ID NO: 228207 - protein, 9 aa, Homo Sapiens
EEECGKNKQ

SEQ ID NO: 228208 - protein, 9 aa, Homo Sapiens
VQLHEGDFR

SEQ ID NO: 228209 - protein, 9 aa, Homo Sapiens
FTVAIIGSL

SEQ ID NO: 228210 - protein, 9 aa, Homo Sapiens
WRTNSSSTN

SEQ ID NO: 228211 - protein, 9 aa, Homo Sapiens
HTPSASREW

SEQ ID NO: 228212 - protein, 9 aa, Homo Sapiens
VELGSKPFT

SEQ ID NO: 228213 - protein, 9 aa, Homo Sapiens
PCCRLTWMS

SEQ ID NO: 228214 - protein, 9 aa, Homo Sapiens
TPPRRSSSF

SEQ ID NO: 228215 - protein, 9 aa, Homo Sapiens
RQPPHMRRQ

SEQ ID NO: 228216 - protein, 9 aa, Homo Sapiens
LVLLAPATP

SEQ ID NO: 228217 - protein, 9 aa, Homo Sapiens
LSFGYLSGD

SEQ ID NO: 228218 - protein, 9 aa, Homo Sapiens
TRADAHNTH

SEQ ID NO: 228219 - protein, 9 aa, Homo Sapiens
CLSEAWSKI

SEQ ID NO: 228220 - protein, 9 aa, Homo Sapiens
IVQCCLYEC

SEQ ID NO: 228221 - protein, 9 aa, Homo Sapiens
CCLRCCFSP

SEQ ID NO: 228222 - protein, 9 aa, Homo Sapiens
ASHVCSLKP

SEQ ID NO: 228223 - protein, 9 aa, Homo Sapiens
GFCIHVKHP

SEQ ID NO: 228224 - protein, 9 aa, Homo Sapiens
LGAQQAGWQ

SEQ ID NO: 228225 - protein, 9 aa, Homo Sapiens
KLTALIHLS

SEQ ID NO: 228226 - protein, 9 aa, Homo Sapiens
CLQTPRGLE

SEQ ID NO: 228227 - protein, 9 aa, Homo Sapiens
YGKTFSSAS

SEQ ID NO: 228228 - protein, 9 aa, Homo Sapiens
PPPAPSPCT

SEQ ID NO: 228229 - protein, 9 aa, Homo Sapiens
RVGGRKRGH

SEQ ID NO: 228230 - protein, 9 aa, Homo Sapiens
PCAATDREG

SEQ ID NO: 228231 - protein, 9 aa, Homo Sapiens
YLNLTASEN

SEQ ID NO: 228232 - protein, 9 aa, Homo Sapiens
DVPKSCRPW

SEQ ID NO: 228233 - protein, 9 aa, Homo Sapiens
QPATRPTQR

SEQ ID NO: 228234 - protein, 9 aa, Homo Sapiens
RIPWKGHNR

SEQ ID NO: 228235 - protein, 9 aa, Homo Sapiens
WLKCVCYQQ

SEQ ID NO: 228236 - protein, 9 aa, Homo Sapiens
QQQQQVSAH

SEQ ID NO: 228237 - protein, 9 aa, Homo Sapiens
AYDRYATIC

SEQ ID NO: 228238 - protein, 9 aa, Homo Sapiens
LAPRKAPHC

SEQ ID NO: 228239 - protein, 9 aa, Homo Sapiens
ADGQRVLQE

SEQ ID NO: 228240 - protein, 9 aa, Homo Sapiens
LWLWKASTE

SEQ ID NO: 228241 - protein, 9 aa, Homo Sapiens
WPPTCSPQG

SEQ ID NO: 228242 - protein, 9 aa, Homo Sapiens
RTANEKITP

SEQ ID NO: 228243 - protein, 9 aa, Homo Sapiens
FIEAVEKYL

SEQ ID NO: 228244 - protein, 9 aa, Homo Sapiens
QISTLVLDV

SEQ ID NO: 228245 - protein, 9 aa, Homo Sapiens
RLGRTQHQI

SEQ ID NO: 228246 - protein, 9 aa, Homo Sapiens
LGSLPLSSS

SEQ ID NO: 228247 - protein, 9 aa, Homo Sapiens
EVAGAVQQA

SEQ ID NO: 228248 - protein, 9 aa, Homo Sapiens
NVPLPPPQS

SEQ ID NO: 228249 - protein, 9 aa, Homo Sapiens
NWKKMMIGS

SEQ ID NO: 228250 - protein, 9 aa, Homo Sapiens
GYDVEIKVQ

SEQ ID NO: 228251 - protein, 9 aa, Homo Sapiens
PGRGGSTPA

SEQ ID NO: 228252 - protein, 9 aa, Homo Sapiens
CFKRQGKLH

SEQ ID NO: 228253 - protein, 9 aa, Homo Sapiens
MPGPPWPTH

SEQ ID NO: 228254 - protein, 9 aa, Homo Sapiens
SSLGTRMGT

SEQ ID NO: 228255 - protein, 9 aa, Homo Sapiens
KSGSGSGLN

SEQ ID NO: 228256 - protein, 9 aa, Homo Sapiens
GHMYNLVSR

SEQ ID NO: 228257 - protein, 9 aa, Homo Sapiens
RPFSSAPLK

SEQ ID NO: 228258 - protein, 9 aa, Homo Sapiens
PPSRPRSPA

SEQ ID NO: 228259 - protein, 9 aa, Homo Sapiens
MLPKLLCRQ

SEQ ID NO: 228260 - protein, 9 aa, Homo Sapiens
QQAGWQGLG

SEQ ID NO: 228261 - protein, 9 aa, Homo Sapiens
ESGKVYTLQ

SEQ ID NO: 228262 - protein, 9 aa, Homo Sapiens
PRTAHRAVA

SEQ ID NO: 228263 - protein, 9 aa, Homo Sapiens
RLLLVTQGL

SEQ ID NO: 228264 - protein, 9 aa, Homo Sapiens
GSNSSDSLE

SEQ ID NO: 228265 - protein, 9 aa, Homo Sapiens
SISLLRSHQ

SEQ ID NO: 228266 - protein, 9 aa, Homo Sapiens
DDFSLKYEN

SEQ ID NO: 228267 - protein, 9 aa, Homo Sapiens
AGLTRRVGG

SEQ ID NO: 228268 - protein, 9 aa, Homo Sapiens
QDLQVIKDS

SEQ ID NO: 228269 - protein, 9 aa, Homo Sapiens
PLGELVWGP

SEQ ID NO: 228270 - protein, 9 aa, Homo Sapiens
NASFTYLTT

SEQ ID NO: 228271 - protein, 9 aa, Homo Sapiens
LKLLVHWVT

SEQ ID NO: 228272 - protein, 9 aa, Homo Sapiens
WRAASCRPT

SEQ ID NO: 228273 - protein, 9 aa, Homo Sapiens
GSDTRICPL

SEQ ID NO: 228274 - protein, 9 aa, Homo Sapiens
AGRLNVMSQ

SEQ ID NO: 228275 - protein, 9 aa, Homo Sapiens
GIRHLLLRR

SEQ ID NO: 228276 - protein, 9 aa, Homo Sapiens
IGCRFPYFE

SEQ ID NO: 228277 - protein, 9 aa, Homo Sapiens
AGEAVQGQV

SEQ ID NO: 228278 - protein, 9 aa, Homo Sapiens
LCIVFPMTC

SEQ ID NO: 228279 - protein, 9 aa, Homo Sapiens
ERRCRYWGR

SEQ ID NO: 228280 - protein, 9 aa, Homo Sapiens
LMISIYNRR

SEQ ID NO: 228281 - protein, 9 aa, Homo Sapiens
IMQLMEKLC

SEQ ID NO: 228282 - protein, 9 aa, Homo Sapiens
TYCVWFVIF

SEQ ID NO: 228283 - protein, 9 aa, Homo Sapiens
SASSSPTPG

SEQ ID NO: 228284 - protein, 9 aa, Homo Sapiens
HMLNFNVPH

SEQ ID NO: 228285 - protein, 9 aa, Homo Sapiens
DLYEGQITA

SEQ ID NO: 228286 - protein, 9 aa, Homo Sapiens
GSKPPNSCV

SEQ ID NO: 228287 - protein, 9 aa, Homo Sapiens
RARAIEAQC

SEQ ID NO: 228288 - protein, 9 aa, Homo Sapiens
SLPDKKRNS

SEQ ID NO: 228289 - protein, 9 aa, Homo Sapiens
FLSTELGFT

SEQ ID NO: 228290 - protein, 9 aa, Homo Sapiens
ENKSGSSSC

SEQ ID NO: 228291 - protein, 9 aa, Homo Sapiens
CQAPSIRTP

SEQ ID NO: 228292 - protein, 9 aa, Homo Sapiens
ERYVPVFTI

SEQ ID NO: 228293 - protein, 9 aa, Homo Sapiens
REDGDGDKD

SEQ ID NO: 228294 - protein, 9 aa, Homo Sapiens
CVVAHDVVE

SEQ ID NO: 228295 - protein, 9 aa, Homo Sapiens
VSFVGQIST

SEQ ID NO: 228296 - protein, 9 aa, Homo Sapiens
ERQTVALKH

SEQ ID NO: 228297 - protein, 9 aa, Homo Sapiens
RERAAAALR

SEQ ID NO: 228298 - protein, 9 aa, Homo Sapiens
CVNYSDHMI

SEQ ID NO: 228299 - protein, 9 aa, Homo Sapiens
QCWPSDGLV

SEQ ID NO: 228300 - protein, 9 aa, Homo Sapiens
LRVTDFEVL

SEQ ID NO: 228301 - protein, 9 aa, Homo Sapiens
MYLLAYPQN

SEQ ID NO: 228302 - protein, 9 aa, Homo Sapiens
GRVWPSSRR

SEQ ID NO: 228303 - protein, 9 aa, Homo Sapiens
SKKKLKLAP

SEQ ID NO: 228304 - protein, 9 aa, Homo Sapiens
DGFFIQSNL

SEQ ID NO: 228305 - protein, 9 aa, Homo Sapiens
SIEEADILS

SEQ ID NO: 228306 - protein, 9 aa, Homo Sapiens
ALTCLPAVT

SEQ ID NO: 228307 - protein, 9 aa, Homo Sapiens
GGERRRGCS

SEQ ID NO: 228308 - protein, 9 aa, Homo Sapiens
VWERSKGAS

SEQ ID NO: 228309 - protein, 9 aa, Homo Sapiens
SCLALRHRL

SEQ ID NO: 228310 - protein, 9 aa, Homo Sapiens
CVQVSQEQW

SEQ ID NO: 228311 - protein, 9 aa, Homo Sapiens
HNSVKAKFS

SEQ ID NO: 228312 - protein, 9 aa, Homo Sapiens
SDGDSFNPT

SEQ ID NO: 228313 - protein, 9 aa, Homo Sapiens
NALIVFAIW

SEQ ID NO: 228314 - protein, 9 aa, Homo Sapiens
SASGILSPM

SEQ ID NO: 228315 - protein, 9 aa, Homo Sapiens
DIDEYKKTY

SEQ ID NO: 228316 - protein, 9 aa, Homo Sapiens
RSKKVSTRK

SEQ ID NO: 228317 - protein, 9 aa, Homo Sapiens
ICMTCCLLQ

SEQ ID NO: 228318 - protein, 9 aa, Homo Sapiens
NKIPLLYLN

SEQ ID NO: 228319 - protein, 9 aa, Homo Sapiens
SSGALSIRE

SEQ ID NO: 228320 - protein, 9 aa, Homo Sapiens
HQLKHQHEE

SEQ ID NO: 228321 - protein, 9 aa, Homo Sapiens
AMCVGHDQH

SEQ ID NO: 228322 - protein, 9 aa, Homo Sapiens
CRSTSSSGR

SEQ ID NO: 228323 - protein, 9 aa, Homo Sapiens
YKIWMYVDA

SEQ ID NO: 228324 - protein, 9 aa, Homo Sapiens
RSVHSGSHH

SEQ ID NO: 228325 - protein, 9 aa, Homo Sapiens
LSFPPAVQR

SEQ ID NO: 228326 - protein, 9 aa, Homo Sapiens
EEDGEDMDL

SEQ ID NO: 228327 - protein, 9 aa, Homo Sapiens
MCSEQTRLD

SEQ ID NO: 228328 - protein, 9 aa, Homo Sapiens
RPLHSHLSW

SEQ ID NO: 228329 - protein, 9 aa, Homo Sapiens
RIPTGGDGK

SEQ ID NO: 228330 - protein, 9 aa, Homo Sapiens
LPPATAPAS

SEQ ID NO: 228331 - protein, 9 aa, Homo Sapiens
GRTQHQING

SEQ ID NO: 228332 - protein, 9 aa, Homo Sapiens
PVTCTHKEG

SEQ ID NO: 228333 - protein, 9 aa, Homo Sapiens
LLLLLLIVL

SEQ ID NO: 228334 - protein, 9 aa, Homo Sapiens
QMYHYSCAA

SEQ ID NO: 228335 - protein, 9 aa, Homo Sapiens
SLKKTYENA

SEQ ID NO: 228336 - protein, 9 aa, Homo Sapiens
AVKTYSWQC

SEQ ID NO: 228337 - protein, 9 aa, Homo Sapiens
HNVRKDCLD

SEQ ID NO: 228338 - protein, 9 aa, Homo Sapiens
TSKGTSLYD

SEQ ID NO: 228339 - protein, 9 aa, Homo Sapiens
GETKREARV

SEQ ID NO: 228340 - protein, 9 aa, Homo Sapiens
LFSTYKENG

SEQ ID NO: 228341 - protein, 9 aa, Homo Sapiens
ADQAGIMGA

SEQ ID NO: 228342 - protein, 9 aa, Homo Sapiens
WGCTTGCCS

SEQ ID NO: 228343 - protein, 9 aa, Homo Sapiens
YYSCVHFLL

SEQ ID NO: 228344 - protein, 9 aa, Homo Sapiens
SQDISEGHQ

SEQ ID NO: 228345 - protein, 9 aa, Homo Sapiens
PVTPLRVQS

SEQ ID NO: 228346 - protein, 9 aa, Homo Sapiens
RIAALLQTC

SEQ ID NO: 228347 - protein, 9 aa, Homo Sapiens
RGRTAPAEV

SEQ ID NO: 228348 - protein, 9 aa, Homo Sapiens
KGLGKEANS

SEQ ID NO: 228349 - protein, 9 aa, Homo Sapiens
IQDRVNSDL

SEQ ID NO: 228350 - protein, 9 aa, Homo Sapiens
KAAANFRRC

SEQ ID NO: 228351 - protein, 9 aa, Homo Sapiens
RPALRPTDY

SEQ ID NO: 228352 - protein, 9 aa, Homo Sapiens
SGSGGRGHP

SEQ ID NO: 228353 - protein, 9 aa, Homo Sapiens
QLVGGQVGH

SEQ ID NO: 228354 - protein, 9 aa, Homo Sapiens
SHLHFIVEG

SEQ ID NO: 228355 - protein, 9 aa, Homo Sapiens
PPRAEVSQR

SEQ ID NO: 228356 - protein, 9 aa, Homo Sapiens
ASVARQPPG

SEQ ID NO: 228357 - protein, 9 aa, Homo Sapiens
SSKTFEKKG

SEQ ID NO: 228358 - protein, 9 aa, Homo Sapiens
ALALSSRDR

SEQ ID NO: 228359 - protein, 9 aa, Homo Sapiens
ARGLPHVTW

SEQ ID NO: 228360 - protein, 9 aa, Homo Sapiens
APDGTPPGC

SEQ ID NO: 228361 - protein, 9 aa, Homo Sapiens
NDYCVVVFG

SEQ ID NO: 228362 - protein, 9 aa, Homo Sapiens
RSRPTRGSS

SEQ ID NO: 228363 - protein, 9 aa, Homo Sapiens
LSSSRTSAG

SEQ ID NO: 228364 - protein, 9 aa, Homo Sapiens
THQNHGSSS

SEQ ID NO: 228365 - protein, 9 aa, Homo Sapiens
ADVLPELLG

SEQ ID NO: 228366 - protein, 9 aa, Homo Sapiens
DFQSDGDSF

SEQ ID NO: 228367 - protein, 9 aa, Homo Sapiens
AVLEKENTI

SEQ ID NO: 228368 - protein, 9 aa, Homo Sapiens
DAHYEVFLG

SEQ ID NO: 228369 - protein, 9 aa, Homo Sapiens
SLSSSRTSA

SEQ ID NO: 228370 - protein, 9 aa, Homo Sapiens
ASSGCGAPR

SEQ ID NO: 228371 - protein, 9 aa, Homo Sapiens
QDGPPRALQ

SEQ ID NO: 228372 - protein, 9 aa, Homo Sapiens
DKAFTRSST

SEQ ID NO: 228373 - protein, 9 aa, Homo Sapiens
RSRERQERH

SEQ ID NO: 228374 - protein, 9 aa, Homo Sapiens
LESAQFLLL

SEQ ID NO: 228375 - protein, 9 aa, Homo Sapiens
GMTSWGTLW

SEQ ID NO: 228376 - protein, 9 aa, Homo Sapiens
DPCSPRERP

SEQ ID NO: 228377 - protein, 9 aa, Homo Sapiens
LLKNQKYQE

SEQ ID NO: 228378 - protein, 9 aa, Homo Sapiens
VLKTKRYDI

SEQ ID NO: 228379 - protein, 9 aa, Homo Sapiens
CTKGFLEKT

SEQ ID NO: 228380 - protein, 9 aa, Homo Sapiens
MDTVILYRS

SEQ ID NO: 228381 - protein, 9 aa, Homo Sapiens
VHWDLSGSR

SEQ ID NO: 228382 - protein, 9 aa, Homo Sapiens
ICSQTGKKL

SEQ ID NO: 228383 - protein, 9 aa, Homo Sapiens
VPHWGPSWA

SEQ ID NO: 228384 - protein, 9 aa, Homo Sapiens
GADVPVATD

SEQ ID NO: 228385 - protein, 9 aa, Homo Sapiens
PTIGWCWLI

SEQ ID NO: 228386 - protein, 9 aa, Homo Sapiens
QDPHAGPSG

SEQ ID NO: 228387 - protein, 9 aa, Homo Sapiens
RNPTSLTGT

SEQ ID NO: 228388 - protein, 9 aa, Homo Sapiens
PSHHSRSGS

SEQ ID NO: 228389 - protein, 9 aa, Homo Sapiens
RPMICQYCK

SEQ ID NO: 228390 - protein, 9 aa, Homo Sapiens
VIVPIVNDI

SEQ ID NO: 228391 - protein, 9 aa, Homo Sapiens
PHSWSWPMT

SEQ ID NO: 228392 - protein, 9 aa, Homo Sapiens
SEIIWKCIG

SEQ ID NO: 228393 - protein, 9 aa, Homo Sapiens
IIGPESPSV

SEQ ID NO: 228394 - protein, 9 aa, Homo Sapiens
QHGDGLRLR

SEQ ID NO: 228395 - protein, 9 aa, Homo Sapiens
VRDSDSELE

SEQ ID NO: 228396 - protein, 9 aa, Homo Sapiens
QACQGRINS

SEQ ID NO: 228397 - protein, 9 aa, Homo Sapiens
DLKKSRLCM

SEQ ID NO: 228398 - protein, 9 aa, Homo Sapiens
KKNGIWEVM

SEQ ID NO: 228399 - protein, 9 aa, Homo Sapiens
EEKCARRLA

SEQ ID NO: 228400 - protein, 9 aa, Homo Sapiens
SKIPMKFKL

SEQ ID NO: 228401 - protein, 9 aa, Homo Sapiens
SSGGRTAAV

SEQ ID NO: 228402 - protein, 9 aa, Homo Sapiens
SQILEKMPQ

SEQ ID NO: 228403 - protein, 9 aa, Homo Sapiens
MPYVKTWMQ

SEQ ID NO: 228404 - protein, 9 aa, Homo Sapiens
VKKGAPGPC

SEQ ID NO: 228405 - protein, 9 aa, Homo Sapiens
NCGSAFCSG

SEQ ID NO: 228406 - protein, 9 aa, Homo Sapiens
RGWPGGRRT

SEQ ID NO: 228407 - protein, 9 aa, Homo Sapiens
SAGSSWTPG

SEQ ID NO: 228408 - protein, 9 aa, Homo Sapiens
SGPLQFKRR

SEQ ID NO: 228409 - protein, 9 aa, Homo Sapiens
LHLKHICKT

SEQ ID NO: 228410 - protein, 9 aa, Homo Sapiens
KELSTTTRM

SEQ ID NO: 228411 - protein, 9 aa, Homo Sapiens
DVKPMRKPR

SEQ ID NO: 228412 - protein, 9 aa, Homo Sapiens
LYRQANIIT

SEQ ID NO: 228413 - protein, 9 aa, Homo Sapiens
SDTRICPLP

SEQ ID NO: 228414 - protein, 9 aa, Homo Sapiens
ENGPFLSTE

SEQ ID NO: 228415 - protein, 9 aa, Homo Sapiens
CQGYCSFKC

SEQ ID NO: 228416 - protein, 9 aa, Homo Sapiens
AGVSRCSSC

SEQ ID NO: 228417 - protein, 9 aa, Homo Sapiens
WLLDVNNQL

SEQ ID NO: 228418 - protein, 9 aa, Homo Sapiens
QKRSKKVST

SEQ ID NO: 228419 - protein, 9 aa, Homo Sapiens
TAKRPWHEY

SEQ ID NO: 228420 - protein, 9 aa, Homo Sapiens
INLDDCANR

SEQ ID NO: 228421 - protein, 9 aa, Homo Sapiens
KNEYVSLDS

SEQ ID NO: 228422 - protein, 9 aa, Homo Sapiens
RVSPEPPRP

SEQ ID NO: 228423 - protein, 9 aa, Homo Sapiens
YSINFVQDP

SEQ ID NO: 228424 - protein, 9 aa, Homo Sapiens
AAWTRRPSI

SEQ ID NO: 228425 - protein, 9 aa, Homo Sapiens
RSSSRPGGA

SEQ ID NO: 228426 - protein, 9 aa, Homo Sapiens
GEEVQVPKF

SEQ ID NO: 228427 - protein, 9 aa, Homo Sapiens
RRGSEGTKV

SEQ ID NO: 228428 - protein, 9 aa, Homo Sapiens
LSEDQVLHR

SEQ ID NO: 228429 - protein, 9 aa, Homo Sapiens
RMGLMNANH

SEQ ID NO: 228430 - protein, 9 aa, Homo Sapiens
LHRRMRHKN

SEQ ID NO: 228431 - protein, 9 aa, Homo Sapiens
FTPDAMPTH

SEQ ID NO: 228432 - protein, 9 aa, Homo Sapiens
KYQLQVFMV

SEQ ID NO: 228433 - protein, 9 aa, Homo Sapiens
CIWQPVMDT

SEQ ID NO: 228434 - protein, 9 aa, Homo Sapiens
HSTSSASGL

SEQ ID NO: 228435 - protein, 9 aa, Homo Sapiens
WVAIYSDFQ

SEQ ID NO: 228436 - protein, 9 aa, Homo Sapiens
AVSEGTKTV

SEQ ID NO: 228437 - protein, 9 aa, Homo Sapiens
LRLRACWGP

SEQ ID NO: 228438 - protein, 9 aa, Homo Sapiens
LACSITVSF

SEQ ID NO: 228439 - protein, 9 aa, Homo Sapiens
LRARSRGLG

SEQ ID NO: 228440 - protein, 9 aa, Homo Sapiens
PTIIKGKRR

SEQ ID NO: 228441 - protein, 9 aa, Homo Sapiens
GLATEKSRW

SEQ ID NO: 228442 - protein, 9 aa, Homo Sapiens
LLLPVAGDL

SEQ ID NO: 228443 - protein, 9 aa, Homo Sapiens
TRMGSSLTS

SEQ ID NO: 228444 - protein, 9 aa, Homo Sapiens
EELLKKCSL

SEQ ID NO: 228445 - protein, 9 aa, Homo Sapiens
PAGRVPGQA

SEQ ID NO: 228446 - protein, 9 aa, Homo Sapiens
ASMKMNAKK

SEQ ID NO: 228447 - protein, 9 aa, Homo Sapiens
QCHCLPSPP

SEQ ID NO: 228448 - protein, 9 aa, Homo Sapiens
VKKSNTSQV

SEQ ID NO: 228449 - protein, 9 aa, Homo Sapiens
RDVGAGAVA

SEQ ID NO: 228450 - protein, 9 aa, Homo Sapiens
PVLRTPQPS

SEQ ID NO: 228451 - protein, 9 aa, Homo Sapiens
DVMDHLQSF

SEQ ID NO: 228452 - protein, 9 aa, Homo Sapiens
VESQKPIHS

SEQ ID NO: 228453 - protein, 9 aa, Homo Sapiens
VNFIVHKNR

SEQ ID NO: 228454 - protein, 9 aa, Homo Sapiens
EHTRPDRDH

SEQ ID NO: 228455 - protein, 9 aa, Homo Sapiens
VNDIIRKLD

SEQ ID NO: 228456 - protein, 9 aa, Homo Sapiens
GLKDLEAHI

SEQ ID NO: 228457 - protein, 9 aa, Homo Sapiens
VISRWDSPR

SEQ ID NO: 228458 - protein, 9 aa, Homo Sapiens
PETALKQYA

SEQ ID NO: 228459 - protein, 9 aa, Homo Sapiens
REQLKRPIL

SEQ ID NO: 228460 - protein, 9 aa, Homo Sapiens
RSPPTSCPP

SEQ ID NO: 228461 - protein, 9 aa, Homo Sapiens
SRARLALLV

SEQ ID NO: 228462 - protein, 9 aa, Homo Sapiens
NSPFGSSCL

SEQ ID NO: 228463 - protein, 9 aa, Homo Sapiens
GFHAHEFIP

SEQ ID NO: 228464 - protein, 9 aa, Homo Sapiens
SLRATVPRH

SEQ ID NO: 228465 - protein, 9 aa, Homo Sapiens
ATIGWAWGH

SEQ ID NO: 228466 - protein, 9 aa, Homo Sapiens
PPTAARPPS

SEQ ID NO: 228467 - protein, 9 aa, Homo Sapiens
RRWSWAMGS

SEQ ID NO: 228468 - protein, 9 aa, Homo Sapiens
CETPCGCYV

SEQ ID NO: 228469 - protein, 9 aa, Homo Sapiens
RPPGRCRTS

SEQ ID NO: 228470 - protein, 9 aa, Homo Sapiens
VVLTAYSLQ

SEQ ID NO: 228471 - protein, 9 aa, Homo Sapiens
ASEADEGVA

SEQ ID NO: 228472 - protein, 9 aa, Homo Sapiens
TLQQRHPQG

SEQ ID NO: 228473 - protein, 9 aa, Homo Sapiens
GKEETLASS

SEQ ID NO: 228474 - protein, 9 aa, Homo Sapiens
GHACECDVN

SEQ ID NO: 228475 - protein, 9 aa, Homo Sapiens
MEKMMDRIK

SEQ ID NO: 228476 - protein, 9 aa, Homo Sapiens
QDLARGLKR

SEQ ID NO: 228477 - protein, 9 aa, Homo Sapiens
LVRYWHYFR

SEQ ID NO: 228478 - protein, 9 aa, Homo Sapiens
YNPPTIHYP

SEQ ID NO: 228479 - protein, 9 aa, Homo Sapiens
MGLAQPASA

SEQ ID NO: 228480 - protein, 9 aa, Homo Sapiens
PDRQLITQV

SEQ ID NO: 228481 - protein, 9 aa, Homo Sapiens
VDISSHKPH

SEQ ID NO: 228482 - protein, 9 aa, Homo Sapiens
SVLGRVFSF

SEQ ID NO: 228483 - protein, 9 aa, Homo Sapiens
PLDKTIVEC

SEQ ID NO: 228484 - protein, 9 aa, Homo Sapiens
DPPQRTVLW

SEQ ID NO: 228485 - protein, 9 aa, Homo Sapiens
PSTGDPAGG

SEQ ID NO: 228486 - protein, 9 aa, Homo Sapiens
FIEEYLTGE

SEQ ID NO: 228487 - protein, 9 aa, Homo Sapiens
PLRVQSVLL

SEQ ID NO: 228488 - protein, 9 aa, Homo Sapiens
LARCAVPHA

SEQ ID NO: 228489 - protein, 9 aa, Homo Sapiens
LSPCNASIM

SEQ ID NO: 228490 - protein, 9 aa, Homo Sapiens
VPTPNHTPW

SEQ ID NO: 228491 - protein, 9 aa, Homo Sapiens
YNKGYKGLD

SEQ ID NO: 228492 - protein, 9 aa, Homo Sapiens
DLLGSGLRL

SEQ ID NO: 228493 - protein, 9 aa, Homo Sapiens
QGINDFLVS

SEQ ID NO: 228494 - protein, 9 aa, Homo Sapiens
IKVQVALGN

SEQ ID NO: 228495 - protein, 9 aa, Homo Sapiens
GGLLGKSDV

SEQ ID NO: 228496 - protein, 9 aa, Homo Sapiens
TPSSPLPPP

SEQ ID NO: 228497 - protein, 9 aa, Homo Sapiens
LRDWLSKKI

SEQ ID NO: 228498 - protein, 9 aa, Homo Sapiens
APTVLQGPS

SEQ ID NO: 228499 - protein, 9 aa, Homo Sapiens
SLTPLTTQS

SEQ ID NO: 228500 - protein, 9 aa, Homo Sapiens
VIRRGENTS

SEQ ID NO: 228501 - protein, 9 aa, Homo Sapiens
IDWILKTWH

SEQ ID NO: 228502 - protein, 9 aa, Homo Sapiens
SGLVIWEPM

SEQ ID NO: 228503 - protein, 9 aa, Homo Sapiens
VDARGGGPS

SEQ ID NO: 228504 - protein, 9 aa, Homo Sapiens
GTKVSAHVC

SEQ ID NO: 228505 - protein, 9 aa, Homo Sapiens
PGDPDAVVA

SEQ ID NO: 228506 - protein, 9 aa, Homo Sapiens
RAPRRRKWG

SEQ ID NO: 228507 - protein, 9 aa, Homo Sapiens
FRAVLVVLG

SEQ ID NO: 228508 - protein, 9 aa, Homo Sapiens
VANSLPRSS

SEQ ID NO: 228509 - protein, 9 aa, Homo Sapiens
IMHSCWHEL

SEQ ID NO: 228510 - protein, 9 aa, Homo Sapiens
KPQFPHLNP

SEQ ID NO: 228511 - protein, 9 aa, Homo Sapiens
GGKGFPINP

SEQ ID NO: 228512 - protein, 9 aa, Homo Sapiens
TFIHGVVLH

SEQ ID NO: 228513 - protein, 9 aa, Homo Sapiens
LVFALRAKL

SEQ ID NO: 228514 - protein, 9 aa, Homo Sapiens
LRGFLLHQP

SEQ ID NO: 228515 - protein, 9 aa, Homo Sapiens
PSLSVTLVD

SEQ ID NO: 228516 - protein, 9 aa, Homo Sapiens
RRRRRLLVF

SEQ ID NO: 228517 - protein, 9 aa, Homo Sapiens
PAKPPTRTS

SEQ ID NO: 228518 - protein, 9 aa, Homo Sapiens
QIMKRMCKQ

SEQ ID NO: 228519 - protein, 9 aa, Homo Sapiens
GFLILGDLL

SEQ ID NO: 228520 - protein, 9 aa, Homo Sapiens
IVNDIIRKL

SEQ ID NO: 228521 - protein, 9 aa, Homo Sapiens
LPSPPRGRG

SEQ ID NO: 228522 - protein, 9 aa, Homo Sapiens
YDIPAMYNN

SEQ ID NO: 228523 - protein, 9 aa, Homo Sapiens
WPRALRARR

SEQ ID NO: 228524 - protein, 9 aa, Homo Sapiens
ANLDRPPLQ

SEQ ID NO: 228525 - protein, 9 aa, Homo Sapiens
VGHGVWVGA

SEQ ID NO: 228526 - protein, 9 aa, Homo Sapiens
STTTLSCPP

SEQ ID NO: 228527 - protein, 9 aa, Homo Sapiens
SLTHRSHLH

SEQ ID NO: 228528 - protein, 9 aa, Homo Sapiens
ARIHALPDD

SEQ ID NO: 228529 - protein, 9 aa, Homo Sapiens
LPPRSRAPR

SEQ ID NO: 228530 - protein, 9 aa, Homo Sapiens
TDAHYEVFL

SEQ ID NO: 228531 - protein, 9 aa, Homo Sapiens
RTEEKDPCS

SEQ ID NO: 228532 - protein, 9 aa, Homo Sapiens
DWILKTWHH

SEQ ID NO: 228533 - protein, 9 aa, Homo Sapiens
TPWTRANAR

SEQ ID NO: 228534 - protein, 9 aa, Homo Sapiens
KRIMRDLRS

SEQ ID NO: 228535 - protein, 9 aa, Homo Sapiens
SAQSQHSPS

SEQ ID NO: 228536 - protein, 9 aa, Homo Sapiens
NAIRLHIVE

SEQ ID NO: 228537 - protein, 9 aa, Homo Sapiens
KCITECVRT

SEQ ID NO: 228538 - protein, 9 aa, Homo Sapiens
ITQDGWVAI

SEQ ID NO: 228539 - protein, 9 aa, Homo Sapiens
LHFIVEGSP

SEQ ID NO: 228540 - protein, 9 aa, Homo Sapiens
LVTIGGIFL

SEQ ID NO: 228541 - protein, 9 aa, Homo Sapiens
LAHFQDRGQ

SEQ ID NO: 228542 - protein, 9 aa, Homo Sapiens
VKIFHGSGV

SEQ ID NO: 228543 - protein, 9 aa, Homo Sapiens
YTVLWILPL

SEQ ID NO: 228544 - protein, 9 aa, Homo Sapiens
LALLIFVPD

SEQ ID NO: 228545 - protein, 9 aa, Homo Sapiens
TAQELKTLL

SEQ ID NO: 228546 - protein, 9 aa, Homo Sapiens
STWLSLWSH

SEQ ID NO: 228547 - protein, 9 aa, Homo Sapiens
QESTMECQK

SEQ ID NO: 228548 - protein, 9 aa, Homo Sapiens
LYSPADPRL

SEQ ID NO: 228549 - protein, 9 aa, Homo Sapiens
PPEPPSRKC

SEQ ID NO: 228550 - protein, 9 aa, Homo Sapiens
SHQKAARAQ

SEQ ID NO: 228551 - protein, 9 aa, Homo Sapiens
GQPQGSSGC

SEQ ID NO: 228552 - protein, 9 aa, Homo Sapiens
GCYSAPRWA

SEQ ID NO: 228553 - protein, 9 aa, Homo Sapiens
DLVHGALQG

SEQ ID NO: 228554 - protein, 9 aa, Homo Sapiens
WELHAKVEV

SEQ ID NO: 228555 - protein, 9 aa, Homo Sapiens
PDTAVLPSF

SEQ ID NO: 228556 - protein, 9 aa, Homo Sapiens
TSSGSIKRS

SEQ ID NO: 228557 - protein, 9 aa, Homo Sapiens
PEVPRKYWE

SEQ ID NO: 228558 - protein, 9 aa, Homo Sapiens
DGQLYCLSS

SEQ ID NO: 228559 - protein, 9 aa, Homo Sapiens
KSENKQRKK

SEQ ID NO: 228560 - protein, 9 aa, Homo Sapiens
TLTGGHHGS

SEQ ID NO: 228561 - protein, 9 aa, Homo Sapiens
TSTAPTTPA

SEQ ID NO: 228562 - protein, 9 aa, Homo Sapiens
QLHPRRRWP

SEQ ID NO: 228563 - protein, 9 aa, Homo Sapiens
PPSSSRTPR

SEQ ID NO: 228564 - protein, 9 aa, Homo Sapiens
QKALLTLAD

SEQ ID NO: 228565 - protein, 9 aa, Homo Sapiens
TSQATTTTT

SEQ ID NO: 228566 - protein, 9 aa, Homo Sapiens
APACLERDL

SEQ ID NO: 228567 - protein, 9 aa, Homo Sapiens
RQRSSTTPP

SEQ ID NO: 228568 - protein, 9 aa, Homo Sapiens
SHNTLEFTL

SEQ ID NO: 228569 - protein, 9 aa, Homo Sapiens
RWKPLLWLP

SEQ ID NO: 228570 - protein, 9 aa, Homo Sapiens
RKRNQPKKP

SEQ ID NO: 228571 - protein, 9 aa, Homo Sapiens
EAREETGVS

SEQ ID NO: 228572 - protein, 9 aa, Homo Sapiens
MDATPGVDL

SEQ ID NO: 228573 - protein, 9 aa, Homo Sapiens
LILLTSSPV

SEQ ID NO: 228574 - protein, 9 aa, Homo Sapiens
NPLQQAAEV

SEQ ID NO: 228575 - protein, 9 aa, Homo Sapiens
FPGFWFVEG

SEQ ID NO: 228576 - protein, 9 aa, Homo Sapiens
KLRQDRVQV

SEQ ID NO: 228577 - protein, 9 aa, Homo Sapiens
GKEVACESS

SEQ ID NO: 228578 - protein, 9 aa, Homo Sapiens
AGTWSKVLP

SEQ ID NO: 228579 - protein, 9 aa, Homo Sapiens
TINMLQIEF

SEQ ID NO: 228580 - protein, 9 aa, Homo Sapiens
LLIISTVAG

SEQ ID NO: 228581 - protein, 9 aa, Homo Sapiens
GYRALQLHL

SEQ ID NO: 228582 - protein, 9 aa, Homo Sapiens
SSRFPLGRV

SEQ ID NO: 228583 - protein, 9 aa, Homo Sapiens
LGMYRRPGQ

SEQ ID NO: 228584 - protein, 9 aa, Homo Sapiens
LVATTINLG

SEQ ID NO: 228585 - protein, 9 aa, Homo Sapiens
ADMDEVYTI

SEQ ID NO: 228586 - protein, 9 aa, Homo Sapiens
GFVIGRFLT

SEQ ID NO: 228587 - protein, 9 aa, Homo Sapiens
TACKCLLWK

SEQ ID NO: 228588 - protein, 9 aa, Homo Sapiens
ISAVLAAQK

SEQ ID NO: 228589 - protein, 9 aa, Homo Sapiens
YCETKHTEE

SEQ ID NO: 228590 - protein, 9 aa, Homo Sapiens
TSQGCALLV

SEQ ID NO: 228591 - protein, 9 aa, Homo Sapiens
GPIFTTVRQ

SEQ ID NO: 228592 - protein, 9 aa, Homo Sapiens
QILEKMPQY

SEQ ID NO: 228593 - protein, 9 aa, Homo Sapiens
RLDATRQAL

SEQ ID NO: 228594 - protein, 9 aa, Homo Sapiens
RADIGPVTS

SEQ ID NO: 228595 - protein, 9 aa, Homo Sapiens
LARSWNTMQ

SEQ ID NO: 228596 - protein, 9 aa, Homo Sapiens
EIITVGEDG

SEQ ID NO: 228597 - protein, 9 aa, Homo Sapiens
PAPEAPVQE

SEQ ID NO: 228598 - protein, 9 aa, Homo Sapiens
VSIDPRTAH

SEQ ID NO: 228599 - protein, 9 aa, Homo Sapiens
ILLQRNLLR

SEQ ID NO: 228600 - protein, 9 aa, Homo Sapiens
QELGTQQAG

SEQ ID NO: 228601 - protein, 9 aa, Homo Sapiens
DSNFLNPPG

SEQ ID NO: 228602 - protein, 9 aa, Homo Sapiens
TIQRTHMPS

SEQ ID NO: 228603 - protein, 9 aa, Homo Sapiens
ACRAGGPAG

SEQ ID NO: 228604 - protein, 9 aa, Homo Sapiens
QQEKKLGGQ

SEQ ID NO: 228605 - protein, 9 aa, Homo Sapiens
WKTSGPCSL

SEQ ID NO: 228606 - protein, 9 aa, Homo Sapiens
LSGILRKQH

SEQ ID NO: 228607 - protein, 9 aa, Homo Sapiens
VNMSKVETG

SEQ ID NO: 228608 - protein, 9 aa, Homo Sapiens
QKRCMRHAM

SEQ ID NO: 228609 - protein, 9 aa, Homo Sapiens
STRPAHKYY

SEQ ID NO: 228610 - protein, 9 aa, Homo Sapiens
KSVFVDFLI

SEQ ID NO: 228611 - protein, 9 aa, Homo Sapiens
PNMNQGDMM

SEQ ID NO: 228612 - protein, 9 aa, Homo Sapiens
ESASPSTLS

SEQ ID NO: 228613 - protein, 9 aa, Homo Sapiens
QPHFKEVQS

SEQ ID NO: 228614 - protein, 9 aa, Homo Sapiens
IMATEMAHR

SEQ ID NO: 228615 - protein, 9 aa, Homo Sapiens
QSPGHLGLF

SEQ ID NO: 228616 - protein, 9 aa, Homo Sapiens
YLYEHGLGI

SEQ ID NO: 228617 - protein, 9 aa, Homo Sapiens
KDFCPMDHK

SEQ ID NO: 228618 - protein, 9 aa, Homo Sapiens
CGPFIGKNR

SEQ ID NO: 228619 - protein, 9 aa, Homo Sapiens
LREKSRDTN

SEQ ID NO: 228620 - protein, 9 aa, Homo Sapiens
PTSLTGTTA

SEQ ID NO: 228621 - protein, 9 aa, Homo Sapiens
DSSPLQLLL

SEQ ID NO: 228622 - protein, 9 aa, Homo Sapiens
LSEAWSKIY

SEQ ID NO: 228623 - protein, 9 aa, Homo Sapiens
HWGAAEELA

SEQ ID NO: 228624 - protein, 9 aa, Homo Sapiens
KKLKTFHMK

SEQ ID NO: 228625 - protein, 9 aa, Homo Sapiens
DNIRELCIS

SEQ ID NO: 228626 - protein, 9 aa, Homo Sapiens
CCLSHHRPS

SEQ ID NO: 228627 - protein, 9 aa, Homo Sapiens
KRDLLGPLN

SEQ ID NO: 228628 - protein, 9 aa, Homo Sapiens
RNNPYRMWP

SEQ ID NO: 228629 - protein, 9 aa, Homo Sapiens
DLSYNHIQR

SEQ ID NO: 228630 - protein, 9 aa, Homo Sapiens
QGIPGRYLT

SEQ ID NO: 228631 - protein, 9 aa, Homo Sapiens
ILKTWHHLN

SEQ ID NO: 228632 - protein, 9 aa, Homo Sapiens
LNARAGRLN

SEQ ID NO: 228633 - protein, 9 aa, Homo Sapiens
GKLRQDRVQ

SEQ ID NO: 228634 - protein, 9 aa, Homo Sapiens
MRKMQTLMR

SEQ ID NO: 228635 - protein, 9 aa, Homo Sapiens
VNMDIPRES

SEQ ID NO: 228636 - protein, 9 aa, Homo Sapiens
KSVGVKTSR

SEQ ID NO: 228637 - protein, 9 aa, Homo Sapiens
APRATLQLR

SEQ ID NO: 228638 - protein, 9 aa, Homo Sapiens
GRSTPPRSW

SEQ ID NO: 228639 - protein, 9 aa, Homo Sapiens
LLCDPGVPI

SEQ ID NO: 228640 - protein, 9 aa, Homo Sapiens
GPNKALFIK

SEQ ID NO: 228641 - protein, 9 aa, Homo Sapiens
HPMYRSLVH

SEQ ID NO: 228642 - protein, 9 aa, Homo Sapiens
QLMSTERNS

SEQ ID NO: 228643 - protein, 9 aa, Homo Sapiens
GTWSKVLPD

SEQ ID NO: 228644 - protein, 9 aa, Homo Sapiens
TMAGPSASL

SEQ ID NO: 228645 - protein, 9 aa, Homo Sapiens
EDIVDFLQR

SEQ ID NO: 228646 - protein, 9 aa, Homo Sapiens
KRSSSFSKF

SEQ ID NO: 228647 - protein, 9 aa, Homo Sapiens
SNQAGGPEL

SEQ ID NO: 228648 - protein, 9 aa, Homo Sapiens
CAPGGTVWP

SEQ ID NO: 228649 - protein, 9 aa, Homo Sapiens
LNTAHAYAT

SEQ ID NO: 228650 - protein, 9 aa, Homo Sapiens
SLPKETFLV

SEQ ID NO: 228651 - protein, 9 aa, Homo Sapiens
VLATGLHLH

SEQ ID NO: 228652 - protein, 9 aa, Homo Sapiens
TGLHLHRQI

SEQ ID NO: 228653 - protein, 9 aa, Homo Sapiens
MCKLLKGIY

SEQ ID NO: 228654 - protein, 9 aa, Homo Sapiens
LNQRLQHQS

SEQ ID NO: 228655 - protein, 9 aa, Homo Sapiens
TASQESSSP

SEQ ID NO: 228656 - protein, 9 aa, Homo Sapiens
TPVNPAPTT

SEQ ID NO: 228657 - protein, 9 aa, Homo Sapiens
LALTYIVFV

SEQ ID NO: 228658 - protein, 9 aa, Homo Sapiens
PTLSTLQQR

SEQ ID NO: 228659 - protein, 9 aa, Homo Sapiens
AKFSGFEAS

SEQ ID NO: 228660 - protein, 9 aa, Homo Sapiens
PRALSVLLP

SEQ ID NO: 228661 - protein, 9 aa, Homo Sapiens
SSHLVQHRH

SEQ ID NO: 228662 - protein, 9 aa, Homo Sapiens
CMLFKDLSA

SEQ ID NO: 228663 - protein, 9 aa, Homo Sapiens
EEPSNGISS

SEQ ID NO: 228664 - protein, 9 aa, Homo Sapiens
MASLKKQYP

SEQ ID NO: 228665 - protein, 9 aa, Homo Sapiens
PVKVIEKNS

SEQ ID NO: 228666 - protein, 9 aa, Homo Sapiens
RISVCACVY

SEQ ID NO: 228667 - protein, 9 aa, Homo Sapiens
AGIPGWTNR

SEQ ID NO: 228668 - protein, 9 aa, Homo Sapiens
NLTSVMSVA

SEQ ID NO: 228669 - protein, 9 aa, Homo Sapiens
EGLLPCNLS

SEQ ID NO: 228670 - protein, 9 aa, Homo Sapiens
GGDLLLPPA

SEQ ID NO: 228671 - protein, 9 aa, Homo Sapiens
LKTHNCYHE

SEQ ID NO: 228672 - protein, 9 aa, Homo Sapiens
ANIIINGKG

SEQ ID NO: 228673 - protein, 9 aa, Homo Sapiens
KMNWKKMMI

SEQ ID NO: 228674 - protein, 9 aa, Homo Sapiens
RGKSQGGRI

SEQ ID NO: 228675 - protein, 9 aa, Homo Sapiens
EECSLEAVR

SEQ ID NO: 228676 - protein, 9 aa, Homo Sapiens
RPRRQPPHH

SEQ ID NO: 228677 - protein, 9 aa, Homo Sapiens
DEKSQIHSI

SEQ ID NO: 228678 - protein, 9 aa, Homo Sapiens
QEKLEATDR

SEQ ID NO: 228679 - protein, 9 aa, Homo Sapiens
CAGAACWCL

SEQ ID NO: 228680 - protein, 9 aa, Homo Sapiens
AWMQTNYDL

SEQ ID NO: 228681 - protein, 9 aa, Homo Sapiens
DRVNSDLEV

SEQ ID NO: 228682 - protein, 9 aa, Homo Sapiens
THLHKGDEG

SEQ ID NO: 228683 - protein, 9 aa, Homo Sapiens
KTNQPITLT

SEQ ID NO: 228684 - protein, 9 aa, Homo Sapiens
EKEPIFQKQ

SEQ ID NO: 228685 - protein, 9 aa, Homo Sapiens
ELVSVDRCA

SEQ ID NO: 228686 - protein, 9 aa, Homo Sapiens
GGGGSPRST

SEQ ID NO: 228687 - protein, 9 aa, Homo Sapiens
LKILDWLLR

SEQ ID NO: 228688 - protein, 9 aa, Homo Sapiens
DRNILTLST

SEQ ID NO: 228689 - protein, 9 aa, Homo Sapiens
CDFCVTAPR

SEQ ID NO: 228690 - protein, 9 aa, Homo Sapiens
CFTKILSLL

SEQ ID NO: 228691 - protein, 9 aa, Homo Sapiens
CTAFTREQI

SEQ ID NO: 228692 - protein, 9 aa, Homo Sapiens
QQQRRAPAG

SEQ ID NO: 228693 - protein, 9 aa, Homo Sapiens
LPEELPLPP

SEQ ID NO: 228694 - protein, 9 aa, Homo Sapiens
SGSMGKSSL

SEQ ID NO: 228695 - protein, 9 aa, Homo Sapiens
LGAGVVLAR

SEQ ID NO: 228696 - protein, 9 aa, Homo Sapiens
NGTSRRSGC

SEQ ID NO: 228697 - protein, 9 aa, Homo Sapiens
SLEEQLQHE

SEQ ID NO: 228698 - protein, 9 aa, Homo Sapiens
IKQVVNAII

SEQ ID NO: 228699 - protein, 9 aa, Homo Sapiens
TLCCATIGW

SEQ ID NO: 228700 - protein, 9 aa, Homo Sapiens
YTYCVWFVI

SEQ ID NO: 228701 - protein, 9 aa, Homo Sapiens
RQLSYFLGL

SEQ ID NO: 228702 - protein, 9 aa, Homo Sapiens
DKGLKKMTL

SEQ ID NO: 228703 - protein, 9 aa, Homo Sapiens
HLQRTHPKG

SEQ ID NO: 228704 - protein, 9 aa, Homo Sapiens
HMRSTLRKL

SEQ ID NO: 228705 - protein, 9 aa, Homo Sapiens
AKKKLEKKQ

SEQ ID NO: 228706 - protein, 9 aa, Homo Sapiens
QVHRHVDQH

SEQ ID NO: 228707 - protein, 9 aa, Homo Sapiens
DEAKKPFKQ

SEQ ID NO: 228708 - protein, 9 aa, Homo Sapiens
ASPRVVAAY

SEQ ID NO: 228709 - protein, 9 aa, Homo Sapiens
LRPVRLQKY

SEQ ID NO: 228710 - protein, 9 aa, Homo Sapiens
FVFSRLPGN

SEQ ID NO: 228711 - protein, 9 aa, Homo Sapiens
RRPRVHAPE

SEQ ID NO: 228712 - protein, 9 aa, Homo Sapiens
EHVPLGNLS

SEQ ID NO: 228713 - protein, 9 aa, Homo Sapiens
ARQLATRAP

SEQ ID NO: 228714 - protein, 9 aa, Homo Sapiens
RNPEEGGGP

SEQ ID NO: 228715 - protein, 9 aa, Homo Sapiens
RWDSPRKNQ

SEQ ID NO: 228716 - protein, 9 aa, Homo Sapiens
VKISHVEND

SEQ ID NO: 228717 - protein, 9 aa, Homo Sapiens
HLRFYTARL

SEQ ID NO: 228718 - protein, 9 aa, Homo Sapiens
IDAVDNKKT

SEQ ID NO: 228719 - protein, 9 aa, Homo Sapiens
GEKLDLSKL

SEQ ID NO: 228720 - protein, 9 aa, Homo Sapiens
GLGSQRLLL

SEQ ID NO: 228721 - protein, 9 aa, Homo Sapiens
CSRLVMCLR

SEQ ID NO: 228722 - protein, 9 aa, Homo Sapiens
YVCARISVC

SEQ ID NO: 228723 - protein, 9 aa, Homo Sapiens
QLVVVDFSL

SEQ ID NO: 228724 - protein, 9 aa, Homo Sapiens
STLRTLHAA

SEQ ID NO: 228725 - protein, 9 aa, Homo Sapiens
AHPNLLLTA

SEQ ID NO: 228726 - protein, 9 aa, Homo Sapiens
ENLRRMATD

SEQ ID NO: 228727 - protein, 9 aa, Homo Sapiens
APRSWPRPP

SEQ ID NO: 228728 - protein, 9 aa, Homo Sapiens
IQNEANFFF

SEQ ID NO: 228729 - protein, 9 aa, Homo Sapiens
WAGFPFAFP

SEQ ID NO: 228730 - protein, 9 aa, Homo Sapiens
PTAPASALL

SEQ ID NO: 228731 - protein, 9 aa, Homo Sapiens
SLNDCHEEK

SEQ ID NO: 228732 - protein, 9 aa, Homo Sapiens
TLVTVQRSP

SEQ ID NO: 228733 - protein, 9 aa, Homo Sapiens
GARIHALPD

SEQ ID NO: 228734 - protein, 9 aa, Homo Sapiens
GKPLHAPVG

SEQ ID NO: 228735 - protein, 9 aa, Homo Sapiens
SLFHRRRHQ

SEQ ID NO: 228736 - protein, 9 aa, Homo Sapiens
PAPATQAPC

SEQ ID NO: 228737 - protein, 9 aa, Homo Sapiens
SNSSGFAED

SEQ ID NO: 228738 - protein, 9 aa, Homo Sapiens
EQLWNQIQD

SEQ ID NO: 228739 - protein, 9 aa, Homo Sapiens
LGTTTHTPP

SEQ ID NO: 228740 - protein, 9 aa, Homo Sapiens
QKQSEMPAR

SEQ ID NO: 228741 - protein, 9 aa, Homo Sapiens
EVTENPNYA

SEQ ID NO: 228742 - protein, 9 aa, Homo Sapiens
FIHGVVLHS

SEQ ID NO: 228743 - protein, 9 aa, Homo Sapiens
RKRGHRRPR

SEQ ID NO: 228744 - protein, 9 aa, Homo Sapiens
EEDPMPIQI

SEQ ID NO: 228745 - protein, 9 aa, Homo Sapiens
ELQDTNLQQ

SEQ ID NO: 228746 - protein, 9 aa, Homo Sapiens
YRDSNGAIF

SEQ ID NO: 228747 - protein, 9 aa, Homo Sapiens
MTCCLLQAF

SEQ ID NO: 228748 - protein, 9 aa, Homo Sapiens
PEPSCLQAV

SEQ ID NO: 228749 - protein, 9 aa, Homo Sapiens
AVPRGPYGP

SEQ ID NO: 228750 - protein, 9 aa, Homo Sapiens
KLTKFYFAW

SEQ ID NO: 228751 - protein, 9 aa, Homo Sapiens
MSKVETGLH

SEQ ID NO: 228752 - protein, 9 aa, Homo Sapiens
PLYVRPIFL

SEQ ID NO: 228753 - protein, 9 aa, Homo Sapiens
CRRPRCSGW

SEQ ID NO: 228754 - protein, 9 aa, Homo Sapiens
DLYLFKLPA

SEQ ID NO: 228755 - protein, 9 aa, Homo Sapiens
GLLDLLRGW

SEQ ID NO: 228756 - protein, 9 aa, Homo Sapiens
GLAGGAQAI

SEQ ID NO: 228757 - protein, 9 aa, Homo Sapiens
EHWGAAEEL

SEQ ID NO: 228758 - protein, 9 aa, Homo Sapiens
SLKYENEVA

SEQ ID NO: 228759 - protein, 9 aa, Homo Sapiens
RLECYTKNE

SEQ ID NO: 228760 - protein, 9 aa, Homo Sapiens
RASLRATVP

SEQ ID NO: 228761 - protein, 9 aa, Homo Sapiens
GHTHTPLPF

SEQ ID NO: 228762 - protein, 9 aa, Homo Sapiens
TGRGDPFCR

SEQ ID NO: 228763 - protein, 9 aa, Homo Sapiens
FGFAKQLRV

SEQ ID NO: 228764 - protein, 9 aa, Homo Sapiens
ATDSVADTA

SEQ ID NO: 228765 - protein, 9 aa, Homo Sapiens
NAGHRTIAE

SEQ ID NO: 228766 - protein, 9 aa, Homo Sapiens
WRGWPGGRR

SEQ ID NO: 228767 - protein, 9 aa, Homo Sapiens
VGARPPAPR

SEQ ID NO: 228768 - protein, 9 aa, Homo Sapiens
RPDAPSRCI

SEQ ID NO: 228769 - protein, 9 aa, Homo Sapiens
TLMRTWIIP

SEQ ID NO: 228770 - protein, 9 aa, Homo Sapiens
HKEGETPPA

SEQ ID NO: 228771 - protein, 9 aa, Homo Sapiens
ALKEDLLYL

SEQ ID NO: 228772 - protein, 9 aa, Homo Sapiens
PSPPMRSPS

SEQ ID NO: 228773 - protein, 9 aa, Homo Sapiens
PKISQNMIP

SEQ ID NO: 228774 - protein, 9 aa, Homo Sapiens
VTMGGLEPG

SEQ ID NO: 228775 - protein, 9 aa, Homo Sapiens
KHSLAGNDR

SEQ ID NO: 228776 - protein, 9 aa, Homo Sapiens
HNWIDMKQA

SEQ ID NO: 228777 - protein, 9 aa, Homo Sapiens
LHDTALAHR

SEQ ID NO: 228778 - protein, 9 aa, Homo Sapiens
LWPWCFTTD

SEQ ID NO: 228779 - protein, 9 aa, Homo Sapiens
LSEYTRTCG

SEQ ID NO: 228780 - protein, 9 aa, Homo Sapiens
DTFFAKLHH

SEQ ID NO: 228781 - protein, 9 aa, Homo Sapiens
VDASPSPFT

SEQ ID NO: 228782 - protein, 9 aa, Homo Sapiens
GLLKKRNGM

SEQ ID NO: 228783 - protein, 9 aa, Homo Sapiens
GTTTHTPPG

SEQ ID NO: 228784 - protein, 9 aa, Homo Sapiens
LFQHAGQEK

SEQ ID NO: 228785 - protein, 9 aa, Homo Sapiens
HKRTRSGCC

SEQ ID NO: 228786 - protein, 9 aa, Homo Sapiens
LCRAYEAAG

SEQ ID NO: 228787 - protein, 9 aa, Homo Sapiens
QPRRVASRV

SEQ ID NO: 228788 - protein, 9 aa, Homo Sapiens
LRELLEPLM

SEQ ID NO: 228789 - protein, 9 aa, Homo Sapiens
SRAVRDLKK

SEQ ID NO: 228790 - protein, 9 aa, Homo Sapiens
AFLLTTTEQ

SEQ ID NO: 228791 - protein, 9 aa, Homo Sapiens
LRIGSLILL

SEQ ID NO: 228792 - protein, 9 aa, Homo Sapiens
ALCTLIKPF

SEQ ID NO: 228793 - protein, 9 aa, Homo Sapiens
HYHPSCVLC

SEQ ID NO: 228794 - protein, 9 aa, Homo Sapiens
MPEEHGIGV

SEQ ID NO: 228795 - protein, 9 aa, Homo Sapiens
RALRARRSR

SEQ ID NO: 228796 - protein, 9 aa, Homo Sapiens
AVLPSFAAK

SEQ ID NO: 228797 - protein, 9 aa, Homo Sapiens
DFGLATEKS

SEQ ID NO: 228798 - protein, 9 aa, Homo Sapiens
FGLPALEEM

SEQ ID NO: 228799 - protein, 9 aa, Homo Sapiens
LGKVFLPSN

SEQ ID NO: 228800 - protein, 9 aa, Homo Sapiens
SRAGHGAGA

SEQ ID NO: 228801 - protein, 9 aa, Homo Sapiens
VDFVDLKNG

SEQ ID NO: 228802 - protein, 9 aa, Homo Sapiens
ILRTSQGCA

SEQ ID NO: 228803 - protein, 9 aa, Homo Sapiens
MGMPEEHGI

SEQ ID NO: 228804 - protein, 9 aa, Homo Sapiens
ISDALIKCV

SEQ ID NO: 228805 - protein, 9 aa, Homo Sapiens
EYKEWKSQM

SEQ ID NO: 228806 - protein, 9 aa, Homo Sapiens
FYSKFNGVQ

SEQ ID NO: 228807 - protein, 9 aa, Homo Sapiens
DDPRRPSHS

SEQ ID NO: 228808 - protein, 9 aa, Homo Sapiens
KLLLPVAGD

SEQ ID NO: 228809 - protein, 9 aa, Homo Sapiens
KILDWLLRF

SEQ ID NO: 228810 - protein, 9 aa, Homo Sapiens
ISGVLDPRA

SEQ ID NO: 228811 - protein, 9 aa, Homo Sapiens
GTVAPTVLQ

SEQ ID NO: 228812 - protein, 9 aa, Homo Sapiens
EARRREEKW

SEQ ID NO: 228813 - protein, 9 aa, Homo Sapiens
TIGGIFLWM

SEQ ID NO: 228814 - protein, 9 aa, Homo Sapiens
VWPSTTTLS

SEQ ID NO: 228815 - protein, 9 aa, Homo Sapiens
YKKEEPIDT

SEQ ID NO: 228816 - protein, 9 aa, Homo Sapiens
ATLQLRFPI

SEQ ID NO: 228817 - protein, 9 aa, Homo Sapiens
TTTCSRRPL

SEQ ID NO: 228818 - protein, 9 aa, Homo Sapiens
HNAGVESVF

SEQ ID NO: 228819 - protein, 9 aa, Homo Sapiens
LLQTGEPFS

SEQ ID NO: 228820 - protein, 9 aa, Homo Sapiens
AGGFEDEDK

SEQ ID NO: 228821 - protein, 9 aa, Homo Sapiens
VERMGLMNA

SEQ ID NO: 228822 - protein, 9 aa, Homo Sapiens
VVRKTTSPK

SEQ ID NO: 228823 - protein, 9 aa, Homo Sapiens
TCTWTSALA

SEQ ID NO: 228824 - protein, 9 aa, Homo Sapiens
QPRALACWL

SEQ ID NO: 228825 - protein, 9 aa, Homo Sapiens
AAPISSGPG

SEQ ID NO: 228826 - protein, 9 aa, Homo Sapiens
KSIAAALKR

SEQ ID NO: 228827 - protein, 9 aa, Homo Sapiens
LLQDAGHAG

SEQ ID NO: 228828 - protein, 9 aa, Homo Sapiens
PDVPAVTSN

SEQ ID NO: 228829 - protein, 9 aa, Homo Sapiens
LTALIHLSD

SEQ ID NO: 228830 - protein, 9 aa, Homo Sapiens
HEVLVLDEA

SEQ ID NO: 228831 - protein, 9 aa, Homo Sapiens
HLEFRKHIK

SEQ ID NO: 228832 - protein, 9 aa, Homo Sapiens
QKPVTAKSK

SEQ ID NO: 228833 - protein, 9 aa, Homo Sapiens
DVLDKASAN

SEQ ID NO: 228834 - protein, 9 aa, Homo Sapiens
ELGTNSLKS

SEQ ID NO: 228835 - protein, 9 aa, Homo Sapiens
VPCPNLLPA

SEQ ID NO: 228836 - protein, 9 aa, Homo Sapiens
PMAYTSRMP

SEQ ID NO: 228837 - protein, 9 aa, Homo Sapiens
DYDIKVEQV

SEQ ID NO: 228838 - protein, 9 aa, Homo Sapiens
PCNLSLEVV

SEQ ID NO: 228839 - protein, 9 aa, Homo Sapiens
LITEGPYVP

SEQ ID NO: 228840 - protein, 9 aa, Homo Sapiens
LESPNLPAW

SEQ ID NO: 228841 - protein, 9 aa, Homo Sapiens
CPLALLIFV

SEQ ID NO: 228842 - protein, 9 aa, Homo Sapiens
ALLECPEYS

SEQ ID NO: 228843 - protein, 9 aa, Homo Sapiens
SYICIERGQ

SEQ ID NO: 228844 - protein, 9 aa, Homo Sapiens
PRGRGRRGS

SEQ ID NO: 228845 - protein, 9 aa, Homo Sapiens
LVAPRQTPG

SEQ ID NO: 228846 - protein, 9 aa, Homo Sapiens
CAGCRTQLV

SEQ ID NO: 228847 - protein, 9 aa, Homo Sapiens
VYVSVSLIY

SEQ ID NO: 228848 - protein, 9 aa, Homo Sapiens
CASCGTCPT

SEQ ID NO: 228849 - protein, 9 aa, Homo Sapiens
RLPDFNVIV

SEQ ID NO: 228850 - protein, 9 aa, Homo Sapiens
HYAISEGFL

SEQ ID NO: 228851 - protein, 9 aa, Homo Sapiens
LSSEVEDDE

SEQ ID NO: 228852 - protein, 9 aa, Homo Sapiens
GMGVLSVEI

SEQ ID NO: 228853 - protein, 9 aa, Homo Sapiens
LIKVSDRCD

SEQ ID NO: 228854 - protein, 9 aa, Homo Sapiens
NKCQVSHGH

SEQ ID NO: 228855 - protein, 9 aa, Homo Sapiens
TELGFTLLK

SEQ ID NO: 228856 - protein, 9 aa, Homo Sapiens
REGVKSENK

SEQ ID NO: 228857 - protein, 9 aa, Homo Sapiens
WIIPMGQTQ

SEQ ID NO: 228858 - protein, 9 aa, Homo Sapiens
PPQDASARR

SEQ ID NO: 228859 - protein, 9 aa, Homo Sapiens
LGVAPSSPT

SEQ ID NO: 228860 - protein, 9 aa, Homo Sapiens
LMQKHTSSG

SEQ ID NO: 228861 - protein, 9 aa, Homo Sapiens
REVLVEMYE

SEQ ID NO: 228862 - protein, 9 aa, Homo Sapiens
KWLLDVNNQ

SEQ ID NO: 228863 - protein, 9 aa, Homo Sapiens
ELQETQEHL

SEQ ID NO: 228864 - protein, 9 aa, Homo Sapiens
LAVPVHTDA

SEQ ID NO: 228865 - protein, 9 aa, Homo Sapiens
PSSPLPPPL

SEQ ID NO: 228866 - protein, 9 aa, Homo Sapiens
ITWLMWTAT

SEQ ID NO: 228867 - protein, 9 aa, Homo Sapiens
TAAGLWTLL

SEQ ID NO: 228868 - protein, 9 aa, Homo Sapiens
KRNAYLKEH

SEQ ID NO: 228869 - protein, 9 aa, Homo Sapiens
FEDYLEQKY

SEQ ID NO: 228870 - protein, 9 aa, Homo Sapiens
LKKMCAHLF

SEQ ID NO: 228871 - protein, 9 aa, Homo Sapiens
QLKHQHEEG

SEQ ID NO: 228872 - protein, 9 aa, Homo Sapiens
EEIALHRRM

SEQ ID NO: 228873 - protein, 9 aa, Homo Sapiens
HGALQGHGL

SEQ ID NO: 228874 - protein, 9 aa, Homo Sapiens
STTATTHTV

SEQ ID NO: 228875 - protein, 9 aa, Homo Sapiens
MSRQTQSQR

SEQ ID NO: 228876 - protein, 9 aa, Homo Sapiens
LYKPFGKEA

SEQ ID NO: 228877 - protein, 9 aa, Homo Sapiens
EREEIARHA

SEQ ID NO: 228878 - protein, 9 aa, Homo Sapiens
IIDSFEELQ

SEQ ID NO: 228879 - protein, 9 aa, Homo Sapiens
SSLLSPCNA

SEQ ID NO: 228880 - protein, 9 aa, Homo Sapiens
REKKDGEKT

SEQ ID NO: 228881 - protein, 9 aa, Homo Sapiens
LQRLVESDP

SEQ ID NO: 228882 - protein, 9 aa, Homo Sapiens
QLAAGEAVQ

SEQ ID NO: 228883 - protein, 9 aa, Homo Sapiens
TVRCIQPLL

SEQ ID NO: 228884 - protein, 9 aa, Homo Sapiens
GGGSPRSTQ

SEQ ID NO: 228885 - protein, 9 aa, Homo Sapiens
SNSLMAGQS

SEQ ID NO: 228886 - protein, 9 aa, Homo Sapiens
WNGSDGVIM

SEQ ID NO: 228887 - protein, 9 aa, Homo Sapiens
LWGSYTLRA

SEQ ID NO: 228888 - protein, 9 aa, Homo Sapiens
SIPDCRGPN

SEQ ID NO: 228889 - protein, 9 aa, Homo Sapiens
GSKRSSSSH

SEQ ID NO: 228890 - protein, 9 aa, Homo Sapiens
AKQRAEGMT

SEQ ID NO: 228891 - protein, 9 aa, Homo Sapiens
DGVTLLLVL

SEQ ID NO: 228892 - protein, 9 aa, Homo Sapiens
KSPHSWKTS

SEQ ID NO: 228893 - protein, 9 aa, Homo Sapiens
ILWSLGVVF

SEQ ID NO: 228894 - protein, 9 aa, Homo Sapiens
KKSRLCMSL

SEQ ID NO: 228895 - protein, 9 aa, Homo Sapiens
NFNQQEKKL

SEQ ID NO: 228896 - protein, 9 aa, Homo Sapiens
QRRQERWQM

SEQ ID NO: 228897 - protein, 9 aa, Homo Sapiens
PKALEQEQA

SEQ ID NO: 228898 - protein, 9 aa, Homo Sapiens
SLVHSAVDV

SEQ ID NO: 228899 - protein, 9 aa, Homo Sapiens
KVCMVYVLY

SEQ ID NO: 228900 - protein, 9 aa, Homo Sapiens
LETIKTYLT

SEQ ID NO: 228901 - protein, 9 aa, Homo Sapiens
SKDWEQAKD

SEQ ID NO: 228902 - protein, 9 aa, Homo Sapiens
GEFASPRVV

SEQ ID NO: 228903 - protein, 9 aa, Homo Sapiens
FTHQNHGSS

SEQ ID NO: 228904 - protein, 9 aa, Homo Sapiens
RLTVGKSHL

SEQ ID NO: 228905 - protein, 9 aa, Homo Sapiens
DMDLDDWEP

SEQ ID NO: 228906 - protein, 9 aa, Homo Sapiens
ICLACRKRQ

SEQ ID NO: 228907 - protein, 9 aa, Homo Sapiens
DNKKTHPCT

SEQ ID NO: 228908 - protein, 9 aa, Homo Sapiens
VICIVGKSL

SEQ ID NO: 228909 - protein, 9 aa, Homo Sapiens
SLLLAAVHA

SEQ ID NO: 228910 - protein, 9 aa, Homo Sapiens
GSRWALSGS

SEQ ID NO: 228911 - protein, 9 aa, Homo Sapiens
LLECPEYSG

SEQ ID NO: 228912 - protein, 9 aa, Homo Sapiens
EEELKKQMQ

SEQ ID NO: 228913 - protein, 9 aa, Homo Sapiens
SVQKTSGSG

SEQ ID NO: 228914 - protein, 9 aa, Homo Sapiens
QDVLSNSDF

SEQ ID NO: 228915 - protein, 9 aa, Homo Sapiens
TPVSGSRSP

SEQ ID NO: 228916 - protein, 9 aa, Homo Sapiens
CPRTMAGPS

SEQ ID NO: 228917 - protein, 9 aa, Homo Sapiens
RATSDSNPA

SEQ ID NO: 228918 - protein, 9 aa, Homo Sapiens
HPCTMLLPQ

SEQ ID NO: 228919 - protein, 9 aa, Homo Sapiens
MGVLSVEIS

SEQ ID NO: 228920 - protein, 9 aa, Homo Sapiens
AAASRLPRM

SEQ ID NO: 228921 - protein, 9 aa, Homo Sapiens
FKLKPLSNE

SEQ ID NO: 228922 - protein, 9 aa, Homo Sapiens
PRQSAADIL

SEQ ID NO: 228923 - protein, 9 aa, Homo Sapiens
SNNNMEKVT

SEQ ID NO: 228924 - protein, 9 aa, Homo Sapiens
GKMLKVEQE

SEQ ID NO: 228925 - protein, 9 aa, Homo Sapiens
TSPWPSPQQ

SEQ ID NO: 228926 - protein, 9 aa, Homo Sapiens
RMEKMMDRI

SEQ ID NO: 228927 - protein, 9 aa, Homo Sapiens
CGSTPPPPP

SEQ ID NO: 228928 - protein, 9 aa, Homo Sapiens
QPIPFQQPK

SEQ ID NO: 228929 - protein, 9 aa, Homo Sapiens
HTEAKKAYP

SEQ ID NO: 228930 - protein, 9 aa, Homo Sapiens
PHPWVSVAM

SEQ ID NO: 228931 - protein, 9 aa, Homo Sapiens
HQDYREVCQ

SEQ ID NO: 228932 - protein, 9 aa, Homo Sapiens
KTPEEVLKN

SEQ ID NO: 228933 - protein, 9 aa, Homo Sapiens
DKTLLVVLL

SEQ ID NO: 228934 - protein, 9 aa, Homo Sapiens
FYFAWMMLN

SEQ ID NO: 228935 - protein, 9 aa, Homo Sapiens
LPLYVRPIF

SEQ ID NO: 228936 - protein, 9 aa, Homo Sapiens
IVHKNRISY

SEQ ID NO: 228937 - protein, 9 aa, Homo Sapiens
AQGGGQLAA

SEQ ID NO: 228938 - protein, 9 aa, Homo Sapiens
PPLCSTSAG

SEQ ID NO: 228939 - protein, 9 aa, Homo Sapiens
MIDLSKGRM

SEQ ID NO: 228940 - protein, 9 aa, Homo Sapiens
IHSVKNSEV

SEQ ID NO: 228941 - protein, 9 aa, Homo Sapiens
GSPASPASP

SEQ ID NO: 228942 - protein, 9 aa, Homo Sapiens
RTVICMTCC

SEQ ID NO: 228943 - protein, 9 aa, Homo Sapiens
RYQGAAVAC

SEQ ID NO: 228944 - protein, 9 aa, Homo Sapiens
SPNVHFLPR

SEQ ID NO: 228945 - protein, 9 aa, Homo Sapiens
TPQAPSPAF

SEQ ID NO: 228946 - protein, 9 aa, Homo Sapiens
RDLLGPLNT

SEQ ID NO: 228947 - protein, 9 aa, Homo Sapiens
ASKRELELA

SEQ ID NO: 228948 - protein, 9 aa, Homo Sapiens
AQQRFHLVP

SEQ ID NO: 228949 - protein, 9 aa, Homo Sapiens
MAMTVIAGA

SEQ ID NO: 228950 - protein, 9 aa, Homo Sapiens
WCGTSQTYF

SEQ ID NO: 228951 - protein, 9 aa, Homo Sapiens
SAAYGLGVM

SEQ ID NO: 228952 - protein, 9 aa, Homo Sapiens
PGRSTPPRS

SEQ ID NO: 228953 - protein, 9 aa, Homo Sapiens
VVFVLLWAF

SEQ ID NO: 228954 - protein, 9 aa, Homo Sapiens
PAHQNRVSV

SEQ ID NO: 228955 - protein, 9 aa, Homo Sapiens
LDPRAQTLC

SEQ ID NO: 228956 - protein, 9 aa, Homo Sapiens
TRRDAGLTR

SEQ ID NO: 228957 - protein, 9 aa, Homo Sapiens
ESFPLSCPP

SEQ ID NO: 228958 - protein, 9 aa, Homo Sapiens
FAINRALGV

SEQ ID NO: 228959 - protein, 9 aa, Homo Sapiens
YQIMHSCWH

SEQ ID NO: 228960 - protein, 9 aa, Homo Sapiens
TPTPCSSQW

SEQ ID NO: 228961 - protein, 9 aa, Homo Sapiens
TPRTWQDRL

SEQ ID NO: 228962 - protein, 9 aa, Homo Sapiens
KKENKKKKK

SEQ ID NO: 228963 - protein, 9 aa, Homo Sapiens
SAEVFKEND

SEQ ID NO: 228964 - protein, 9 aa, Homo Sapiens
IALHRRMRH

SEQ ID NO: 228965 - protein, 9 aa, Homo Sapiens
QSLLRLAYL

SEQ ID NO: 228966 - protein, 9 aa, Homo Sapiens
YIYRPTSQG

SEQ ID NO: 228967 - protein, 9 aa, Homo Sapiens
DNYASLHHT

SEQ ID NO: 228968 - protein, 9 aa, Homo Sapiens
WMGSLLMAS

SEQ ID NO: 228969 - protein, 9 aa, Homo Sapiens
LSNLGQDLP

SEQ ID NO: 228970 - protein, 9 aa, Homo Sapiens
GQLQPPLCS

SEQ ID NO: 228971 - protein, 9 aa, Homo Sapiens
QSWIPQSAG

SEQ ID NO: 228972 - protein, 9 aa, Homo Sapiens
EGRGLAAPG

SEQ ID NO: 228973 - protein, 9 aa, Homo Sapiens
IYSCHCQPP

SEQ ID NO: 228974 - protein, 9 aa, Homo Sapiens
HTVDHCHSY

SEQ ID NO: 228975 - protein, 9 aa, Homo Sapiens
IRHQMTYRG

SEQ ID NO: 228976 - protein, 9 aa, Homo Sapiens
VSIATSQAT

SEQ ID NO: 228977 - protein, 9 aa, Homo Sapiens
RCALDNLPE

SEQ ID NO: 228978 - protein, 9 aa, Homo Sapiens
IDPRTAHRA

SEQ ID NO: 228979 - protein, 9 aa, Homo Sapiens
DWHWGAAAT

SEQ ID NO: 228980 - protein, 9 aa, Homo Sapiens
EATRGCLGN

SEQ ID NO: 228981 - protein, 9 aa, Homo Sapiens
FLSLPETAL

SEQ ID NO: 228982 - protein, 9 aa, Homo Sapiens
IEEQIKKKP

SEQ ID NO: 228983 - protein, 9 aa, Homo Sapiens
GKVFLPSNG

SEQ ID NO: 228984 - protein, 9 aa, Homo Sapiens
SLLRVAYLI

SEQ ID NO: 228985 - protein, 9 aa, Homo Sapiens
KVSAHVCTG

SEQ ID NO: 228986 - protein, 9 aa, Homo Sapiens
VHPHPHPMS

SEQ ID NO: 228987 - protein, 9 aa, Homo Sapiens
KFWTLTGRA

SEQ ID NO: 228988 - protein, 9 aa, Homo Sapiens
LTKFCNDHV

SEQ ID NO: 228989 - protein, 9 aa, Homo Sapiens
SCPREEWEM

SEQ ID NO: 228990 - protein, 9 aa, Homo Sapiens
CNLSLEVVM

SEQ ID NO: 228991 - protein, 9 aa, Homo Sapiens
SAWSLPRLV

SEQ ID NO: 228992 - protein, 9 aa, Homo Sapiens
SEIPPPAPA

SEQ ID NO: 228993 - protein, 9 aa, Homo Sapiens
NSGSQSGTK

SEQ ID NO: 228994 - protein, 9 aa, Homo Sapiens
IIGSGMGVL

SEQ ID NO: 228995 - protein, 9 aa, Homo Sapiens
KFAIATLPP

SEQ ID NO: 228996 - protein, 9 aa, Homo Sapiens
MPRTLEGCI

SEQ ID NO: 228997 - protein, 9 aa, Homo Sapiens
CIRALGLAP

SEQ ID NO: 228998 - protein, 9 aa, Homo Sapiens
YGKSFRLKA

SEQ ID NO: 228999 - protein, 9 aa, Homo Sapiens
CGPCGSGPS

SEQ ID NO: 229000 - protein, 9 aa, Homo Sapiens
GRKRGHRRP

SEQ ID NO: 229001 - protein, 9 aa, Homo Sapiens
KGRRSISLL

SEQ ID NO: 229002 - protein, 9 aa, Homo Sapiens
LQQLNQRLQ

SEQ ID NO: 229003 - protein, 9 aa, Homo Sapiens
QGPCPPPVT

SEQ ID NO: 229004 - protein, 9 aa, Homo Sapiens
WHWGAAATT

SEQ ID NO: 229005 - protein, 9 aa, Homo Sapiens
EIQLKAYFL

SEQ ID NO: 229006 - protein, 9 aa, Homo Sapiens
QDATTNTSL

SEQ ID NO: 229007 - protein, 9 aa, Homo Sapiens
HDRCDQHID

SEQ ID NO: 229008 - protein, 9 aa, Homo Sapiens
FNLKMTLLG

SEQ ID NO: 229009 - protein, 9 aa, Homo Sapiens
EPEPSCLQA

SEQ ID NO: 229010 - protein, 9 aa, Homo Sapiens
NKKHHESFP

SEQ ID NO: 229011 - protein, 9 aa, Homo Sapiens
KKKVNKGKQ

SEQ ID NO: 229012 - protein, 9 aa, Homo Sapiens
YSRGSVQRY

SEQ ID NO: 229013 - protein, 9 aa, Homo Sapiens
DQEGCIIVA

SEQ ID NO: 229014 - protein, 9 aa, Homo Sapiens
QPPSNRIRL

SEQ ID NO: 229015 - protein, 9 aa, Homo Sapiens
RLDGQLYCL

SEQ ID NO: 229016 - protein, 9 aa, Homo Sapiens
AGQVPVDDW

SEQ ID NO: 229017 - protein, 9 aa, Homo Sapiens
CWRSINSSL

SEQ ID NO: 229018 - protein, 9 aa, Homo Sapiens
VHVFLDGVG

SEQ ID NO: 229019 - protein, 9 aa, Homo Sapiens
TSASASQAN

SEQ ID NO: 229020 - protein, 9 aa, Homo Sapiens
VQLLQDAGH

SEQ ID NO: 229021 - protein, 9 aa, Homo Sapiens
DTCTSCFCM

SEQ ID NO: 229022 - protein, 9 aa, Homo Sapiens
HCWWPTGRP

SEQ ID NO: 229023 - protein, 9 aa, Homo Sapiens
LSLSLASTS

SEQ ID NO: 229024 - protein, 9 aa, Homo Sapiens
HSWVLQAII

SEQ ID NO: 229025 - protein, 9 aa, Homo Sapiens
IHFPALPCP

SEQ ID NO: 229026 - protein, 9 aa, Homo Sapiens
SPCPRSKSQ

SEQ ID NO: 229027 - protein, 9 aa, Homo Sapiens
YRERIAILR

SEQ ID NO: 229028 - protein, 9 aa, Homo Sapiens
QDILSNSLT

SEQ ID NO: 229029 - protein, 9 aa, Homo Sapiens
SAASATGAP

SEQ ID NO: 229030 - protein, 9 aa, Homo Sapiens
YSPARGVVG

SEQ ID NO: 229031 - protein, 9 aa, Homo Sapiens
GPWATGPSV

SEQ ID NO: 229032 - protein, 9 aa, Homo Sapiens
GLGIIGPES

SEQ ID NO: 229033 - protein, 9 aa, Homo Sapiens
TVLSHEPGS

SEQ ID NO: 229034 - protein, 9 aa, Homo Sapiens
WNRVDIACS

SEQ ID NO: 229035 - protein, 9 aa, Homo Sapiens
IVQREVWDT

SEQ ID NO: 229036 - protein, 9 aa, Homo Sapiens
KATTCTWTC

SEQ ID NO: 229037 - protein, 9 aa, Homo Sapiens
KGTFQQAAQ

SEQ ID NO: 229038 - protein, 9 aa, Homo Sapiens
LSYNHIQRI

SEQ ID NO: 229039 - protein, 9 aa, Homo Sapiens
SLYGKKLVK

SEQ ID NO: 229040 - protein, 9 aa, Homo Sapiens
SYRKLFESV

SEQ ID NO: 229041 - protein, 9 aa, Homo Sapiens
PLAHSVAST

SEQ ID NO: 229042 - protein, 9 aa, Homo Sapiens
SSIPQKDLK

SEQ ID NO: 229043 - protein, 9 aa, Homo Sapiens
HMIDRSECD

SEQ ID NO: 229044 - protein, 9 aa, Homo Sapiens
ESMTSPISS

SEQ ID NO: 229045 - protein, 9 aa, Homo Sapiens
WPAIFFMTT

SEQ ID NO: 229046 - protein, 9 aa, Homo Sapiens
LEHVAREIV

SEQ ID NO: 229047 - protein, 9 aa, Homo Sapiens
QRFHLVPSI

SEQ ID NO: 229048 - protein, 9 aa, Homo Sapiens
DIGEFILER

SEQ ID NO: 229049 - protein, 9 aa, Homo Sapiens
VMLKERLAE

SEQ ID NO: 229050 - protein, 9 aa, Homo Sapiens
GGVFGVAEE

SEQ ID NO: 229051 - protein, 9 aa, Homo Sapiens
NVNLAKFHK

SEQ ID NO: 229052 - protein, 9 aa, Homo Sapiens
GPAFIKTYE

SEQ ID NO: 229053 - protein, 9 aa, Homo Sapiens
NKYGKSFRL

SEQ ID NO: 229054 - protein, 9 aa, Homo Sapiens
HPRTGRHET

SEQ ID NO: 229055 - protein, 9 aa, Homo Sapiens
LLGQELWLT

SEQ ID NO: 229056 - protein, 9 aa, Homo Sapiens
NCCQTRSWR

SEQ ID NO: 229057 - protein, 9 aa, Homo Sapiens
IQRACCAPG

SEQ ID NO: 229058 - protein, 9 aa, Homo Sapiens
QLRFPIADL

SEQ ID NO: 229059 - protein, 9 aa, Homo Sapiens
RSHDQRHWR

SEQ ID NO: 229060 - protein, 9 aa, Homo Sapiens
PEHQQHEVA

SEQ ID NO: 229061 - protein, 9 aa, Homo Sapiens
QTSNNNMEK

SEQ ID NO: 229062 - protein, 9 aa, Homo Sapiens
EVMPRTLEG

SEQ ID NO: 229063 - protein, 9 aa, Homo Sapiens
PAELALKNQ

SEQ ID NO: 229064 - protein, 9 aa, Homo Sapiens
DLSCDSCVN

SEQ ID NO: 229065 - protein, 9 aa, Homo Sapiens
MIEYSEPWM

SEQ ID NO: 229066 - protein, 9 aa, Homo Sapiens
AQCYVVAAA

SEQ ID NO: 229067 - protein, 9 aa, Homo Sapiens
SIKRSCSAS

SEQ ID NO: 229068 - protein, 9 aa, Homo Sapiens
GESMTSPIS

SEQ ID NO: 229069 - protein, 9 aa, Homo Sapiens
CKQKRREGV

SEQ ID NO: 229070 - protein, 9 aa, Homo Sapiens
PCSLPTASG

SEQ ID NO: 229071 - protein, 9 aa, Homo Sapiens
AMGLAQPAS

SEQ ID NO: 229072 - protein, 9 aa, Homo Sapiens
VRPREEDNA

SEQ ID NO: 229073 - protein, 9 aa, Homo Sapiens
KVKVMPHHS

SEQ ID NO: 229074 - protein, 9 aa, Homo Sapiens
INPNPLQPH

SEQ ID NO: 229075 - protein, 9 aa, Homo Sapiens
GKSDVSDSW

SEQ ID NO: 229076 - protein, 9 aa, Homo Sapiens
PMRSPSRRC

SEQ ID NO: 229077 - protein, 9 aa, Homo Sapiens
IMGVEEEED

SEQ ID NO: 229078 - protein, 9 aa, Homo Sapiens
RELEGRDVG

SEQ ID NO: 229079 - protein, 9 aa, Homo Sapiens
CHFILFFIN

SEQ ID NO: 229080 - protein, 9 aa, Homo Sapiens
TGGDGKTLK

SEQ ID NO: 229081 - protein, 9 aa, Homo Sapiens
SGNPTRSSR

SEQ ID NO: 229082 - protein, 9 aa, Homo Sapiens
HPWVSVAMQ

SEQ ID NO: 229083 - protein, 9 aa, Homo Sapiens
YVKYNGSCP

SEQ ID NO: 229084 - protein, 9 aa, Homo Sapiens
KKILKLTLK

SEQ ID NO: 229085 - protein, 9 aa, Homo Sapiens
MSAHIKSVD

SEQ ID NO: 229086 - protein, 9 aa, Homo Sapiens
SASGDNSWQ

SEQ ID NO: 229087 - protein, 9 aa, Homo Sapiens
QAPACLERD

SEQ ID NO: 229088 - protein, 9 aa, Homo Sapiens
RRDAEVWFN

SEQ ID NO: 229089 - protein, 9 aa, Homo Sapiens
TEVEAMEET

SEQ ID NO: 229090 - protein, 9 aa, Homo Sapiens
WMSPATIAA

SEQ ID NO: 229091 - protein, 9 aa, Homo Sapiens
LAYARVTGH

SEQ ID NO: 229092 - protein, 9 aa, Homo Sapiens
LPSPPLPQA

SEQ ID NO: 229093 - protein, 9 aa, Homo Sapiens
MVAVRTVVH

SEQ ID NO: 229094 - protein, 9 aa, Homo Sapiens
KEVNGKSSE

SEQ ID NO: 229095 - protein, 9 aa, Homo Sapiens
YHPSCVLCV

SEQ ID NO: 229096 - protein, 9 aa, Homo Sapiens
CIRVCICIS

SEQ ID NO: 229097 - protein, 9 aa, Homo Sapiens
GRLPACLAL

SEQ ID NO: 229098 - protein, 9 aa, Homo Sapiens
TEIPYVTVL

SEQ ID NO: 229099 - protein, 9 aa, Homo Sapiens
WMQTNYDLL

SEQ ID NO: 229100 - protein, 9 aa, Homo Sapiens
RANRRKEGK

SEQ ID NO: 229101 - protein, 9 aa, Homo Sapiens
DMGNLDDFA

SEQ ID NO: 229102 - protein, 9 aa, Homo Sapiens
GATRSLVRR

SEQ ID NO: 229103 - protein, 9 aa, Homo Sapiens
PPPPAPSPC

SEQ ID NO: 229104 - protein, 9 aa, Homo Sapiens
DTTHVQMGQ

SEQ ID NO: 229105 - protein, 9 aa, Homo Sapiens
VDTCTSCFC

SEQ ID NO: 229106 - protein, 9 aa, Homo Sapiens
MEGIRGLGV

SEQ ID NO: 229107 - protein, 9 aa, Homo Sapiens
RLQRTLARK

SEQ ID NO: 229108 - protein, 9 aa, Homo Sapiens
RKLKQMLNN

SEQ ID NO: 229109 - protein, 9 aa, Homo Sapiens
RPRSHYMEV

SEQ ID NO: 229110 - protein, 9 aa, Homo Sapiens
WGPQWPAGP

SEQ ID NO: 229111 - protein, 9 aa, Homo Sapiens
QTSSSGLQG

SEQ ID NO: 229112 - protein, 9 aa, Homo Sapiens
ELEKWLLDV

SEQ ID NO: 229113 - protein, 9 aa, Homo Sapiens
PRHKKVILQ

SEQ ID NO: 229114 - protein, 9 aa, Homo Sapiens
HIEDGDIAG

SEQ ID NO: 229115 - protein, 9 aa, Homo Sapiens
HFSAITKRA

SEQ ID NO: 229116 - protein, 9 aa, Homo Sapiens
HLMKRYSTS

SEQ ID NO: 229117 - protein, 9 aa, Homo Sapiens
PQWQVVWVI

SEQ ID NO: 229118 - protein, 9 aa, Homo Sapiens
TPKTLLDDI

SEQ ID NO: 229119 - protein, 9 aa, Homo Sapiens
PMTIPGRST

SEQ ID NO: 229120 - protein, 9 aa, Homo Sapiens
QAGGPELYQ

SEQ ID NO: 229121 - protein, 9 aa, Homo Sapiens
LHLPSPPVR

SEQ ID NO: 229122 - protein, 9 aa, Homo Sapiens
SQLPPLSSL

SEQ ID NO: 229123 - protein, 9 aa, Homo Sapiens
GHLVRQDHQ

SEQ ID NO: 229124 - protein, 9 aa, Homo Sapiens
SLWSHRPPS

SEQ ID NO: 229125 - protein, 9 aa, Homo Sapiens
PMSLACSIT

SEQ ID NO: 229126 - protein, 9 aa, Homo Sapiens
IRGVMIVLG

SEQ ID NO: 229127 - protein, 9 aa, Homo Sapiens
VSHSCTTHS

SEQ ID NO: 229128 - protein, 9 aa, Homo Sapiens
GPPGPQDLQ

SEQ ID NO: 229129 - protein, 9 aa, Homo Sapiens
GLSAASPAG

SEQ ID NO: 229130 - protein, 9 aa, Homo Sapiens
MPPSSPSMA

SEQ ID NO: 229131 - protein, 9 aa, Homo Sapiens
LNFLSGKLT

SEQ ID NO: 229132 - protein, 9 aa, Homo Sapiens
KKETKVLKP

SEQ ID NO: 229133 - protein, 9 aa, Homo Sapiens
QQDDRSPLA

SEQ ID NO: 229134 - protein, 9 aa, Homo Sapiens
WSWCGTSQT

SEQ ID NO: 229135 - protein, 9 aa, Homo Sapiens
FGLSLEVAR

SEQ ID NO: 229136 - protein, 9 aa, Homo Sapiens
LKLLKNQKY

SEQ ID NO: 229137 - protein, 9 aa, Homo Sapiens
SSLPDKKRN

SEQ ID NO: 229138 - protein, 9 aa, Homo Sapiens
AMTVLPSKI

SEQ ID NO: 229139 - protein, 9 aa, Homo Sapiens
SEPFWMASR

SEQ ID NO: 229140 - protein, 9 aa, Homo Sapiens
AVAATDAHY

SEQ ID NO: 229141 - protein, 9 aa, Homo Sapiens
YSLSVISCF

SEQ ID NO: 229142 - protein, 9 aa, Homo Sapiens
VWGPPDQGV

SEQ ID NO: 229143 - protein, 9 aa, Homo Sapiens
KIFRSGPWM

SEQ ID NO: 229144 - protein, 9 aa, Homo Sapiens
LVVLCFLSA

SEQ ID NO: 229145 - protein, 9 aa, Homo Sapiens
RCGATSSRP

SEQ ID NO: 229146 - protein, 9 aa, Homo Sapiens
EDIVCDGRL

SEQ ID NO: 229147 - protein, 9 aa, Homo Sapiens
PPQAPPSGS

SEQ ID NO: 229148 - protein, 9 aa, Homo Sapiens
LDLPGTFIL

SEQ ID NO: 229149 - protein, 9 aa, Homo Sapiens
AAHKGKKNA

SEQ ID NO: 229150 - protein, 9 aa, Homo Sapiens
LQRLAYLIS

SEQ ID NO: 229151 - protein, 9 aa, Homo Sapiens
GTFQQAAQI

SEQ ID NO: 229152 - protein, 9 aa, Homo Sapiens
QDSKQAQLI

SEQ ID NO: 229153 - protein, 9 aa, Homo Sapiens
RTPGIIILA

SEQ ID NO: 229154 - protein, 9 aa, Homo Sapiens
PSTLSSSPN

SEQ ID NO: 229155 - protein, 9 aa, Homo Sapiens
VSGSGGRGH

SEQ ID NO: 229156 - protein, 9 aa, Homo Sapiens
TTLPFVRVT

SEQ ID NO: 229157 - protein, 9 aa, Homo Sapiens
SLGAAWGSL

SEQ ID NO: 229158 - protein, 9 aa, Homo Sapiens
PRLAPGGLR

SEQ ID NO: 229159 - protein, 9 aa, Homo Sapiens
GGLRQSPID

SEQ ID NO: 229160 - protein, 9 aa, Homo Sapiens
SRRGCAWYL

SEQ ID NO: 229161 - protein, 9 aa, Homo Sapiens
NTSLDLFQH

SEQ ID NO: 229162 - protein, 9 aa, Homo Sapiens
TGSCCTPTC

SEQ ID NO: 229163 - protein, 9 aa, Homo Sapiens
PPCAATDRE

SEQ ID NO: 229164 - protein, 9 aa, Homo Sapiens
RRWPRALRA

SEQ ID NO: 229165 - protein, 9 aa, Homo Sapiens
WWTPWSPLS

SEQ ID NO: 229166 - protein, 9 aa, Homo Sapiens
DRERARQGT

SEQ ID NO: 229167 - protein, 9 aa, Homo Sapiens
FHAHEFIPF

SEQ ID NO: 229168 - protein, 9 aa, Homo Sapiens
AASAPSLVA

SEQ ID NO: 229169 - protein, 9 aa, Homo Sapiens
TYKENGPFL

SEQ ID NO: 229170 - protein, 9 aa, Homo Sapiens
HEEKIRKVT

SEQ ID NO: 229171 - protein, 9 aa, Homo Sapiens
PETYQVRLQ

SEQ ID NO: 229172 - protein, 9 aa, Homo Sapiens
NVVDSFFVI

SEQ ID NO: 229173 - protein, 9 aa, Homo Sapiens
LFREDYKQA

SEQ ID NO: 229174 - protein, 9 aa, Homo Sapiens
KLKKMCAHL

SEQ ID NO: 229175 - protein, 9 aa, Homo Sapiens
ISRGEGNHH

SEQ ID NO: 229176 - protein, 9 aa, Homo Sapiens
RLHPQLPTP

SEQ ID NO: 229177 - protein, 9 aa, Homo Sapiens
NIIETKPSN

SEQ ID NO: 229178 - protein, 9 aa, Homo Sapiens
VLLKWTEYT

SEQ ID NO: 229179 - protein, 9 aa, Homo Sapiens
EEFLNKVSI

SEQ ID NO: 229180 - protein, 9 aa, Homo Sapiens
KRHCDRHLI

SEQ ID NO: 229181 - protein, 9 aa, Homo Sapiens
QQVQELGIP

SEQ ID NO: 229182 - protein, 9 aa, Homo Sapiens
VKWQEEEGL

SEQ ID NO: 229183 - protein, 9 aa, Homo Sapiens
LPRLRLFPN

SEQ ID NO: 229184 - protein, 9 aa, Homo Sapiens
TPCGCYVLH

SEQ ID NO: 229185 - protein, 9 aa, Homo Sapiens
TCGPSTPAM

SEQ ID NO: 229186 - protein, 9 aa, Homo Sapiens
SGLDPNTMY

SEQ ID NO: 229187 - protein, 9 aa, Homo Sapiens
APKAEVDVI

SEQ ID NO: 229188 - protein, 9 aa, Homo Sapiens
PRMIGCGAI

SEQ ID NO: 229189 - protein, 9 aa, Homo Sapiens
KQELMVFQS

SEQ ID NO: 229190 - protein, 9 aa, Homo Sapiens
LSLLLAAVH

SEQ ID NO: 229191 - protein, 9 aa, Homo Sapiens
GPLVHRRLA

SEQ ID NO: 229192 - protein, 9 aa, Homo Sapiens
LFLAVGGPW

SEQ ID NO: 229193 - protein, 9 aa, Homo Sapiens
ATICNPLLY

SEQ ID NO: 229194 - protein, 9 aa, Homo Sapiens
PGGGTIQPQ

SEQ ID NO: 229195 - protein, 9 aa, Homo Sapiens
EHVAREIVE

SEQ ID NO: 229196 - protein, 9 aa, Homo Sapiens
PLPGCPASP

SEQ ID NO: 229197 - protein, 9 aa, Homo Sapiens
GSTLRTLHA

SEQ ID NO: 229198 - protein, 9 aa, Homo Sapiens
KLHKSMWKD

SEQ ID NO: 229199 - protein, 9 aa, Homo Sapiens
YISVYPGYD

SEQ ID NO: 229200 - protein, 9 aa, Homo Sapiens
GVQFGEVEL

SEQ ID NO: 229201 - protein, 9 aa, Homo Sapiens
CLALRHRLS

SEQ ID NO: 229202 - protein, 9 aa, Homo Sapiens
LRAKLLLPV

SEQ ID NO: 229203 - protein, 9 aa, Homo Sapiens
SWRAWGSPS

SEQ ID NO: 229204 - protein, 9 aa, Homo Sapiens
KLWPEVLQD

SEQ ID NO: 229205 - protein, 9 aa, Homo Sapiens
RRRRRNSTS

SEQ ID NO: 229206 - protein, 9 aa, Homo Sapiens
RVCICISVH

SEQ ID NO: 229207 - protein, 9 aa, Homo Sapiens
CLRMGNERY

SEQ ID NO: 229208 - protein, 9 aa, Homo Sapiens
HRSPPTSCP

SEQ ID NO: 229209 - protein, 9 aa, Homo Sapiens
PKKLTSTDG

SEQ ID NO: 229210 - protein, 9 aa, Homo Sapiens
GPSASLHPA

SEQ ID NO: 229211 - protein, 9 aa, Homo Sapiens
VEVLQEGEA

SEQ ID NO: 229212 - protein, 9 aa, Homo Sapiens
PTRGSSSRR

SEQ ID NO: 229213 - protein, 9 aa, Homo Sapiens
LEWDEYAKH

SEQ ID NO: 229214 - protein, 9 aa, Homo Sapiens
THVLTPKTL

SEQ ID NO: 229215 - protein, 9 aa, Homo Sapiens
ICAWDLEQM

SEQ ID NO: 229216 - protein, 9 aa, Homo Sapiens
PLISLKKGL

SEQ ID NO: 229217 - protein, 9 aa, Homo Sapiens
SYRQYGVYR

SEQ ID NO: 229218 - protein, 9 aa, Homo Sapiens
RATLQLRFP

SEQ ID NO: 229219 - protein, 9 aa, Homo Sapiens
PPRSSTSCS

SEQ ID NO: 229220 - protein, 9 aa, Homo Sapiens
WDIIIDPNL

SEQ ID NO: 229221 - protein, 9 aa, Homo Sapiens
KYQGLCPQC

SEQ ID NO: 229222 - protein, 9 aa, Homo Sapiens
QNGTMVGAG

SEQ ID NO: 229223 - protein, 9 aa, Homo Sapiens
CKARTSASR

SEQ ID NO: 229224 - protein, 9 aa, Homo Sapiens
EREILPESL

SEQ ID NO: 229225 - protein, 9 aa, Homo Sapiens
ILEKMPQYQ

SEQ ID NO: 229226 - protein, 9 aa, Homo Sapiens
CGWASMLAC

SEQ ID NO: 229227 - protein, 9 aa, Homo Sapiens
LRACRAGGP

SEQ ID NO: 229228 - protein, 9 aa, Homo Sapiens
PLRAYRTSS

SEQ ID NO: 229229 - protein, 9 aa, Homo Sapiens
GVDGDSSSE

SEQ ID NO: 229230 - protein, 9 aa, Homo Sapiens
RSHSWGPMQ

SEQ ID NO: 229231 - protein, 9 aa, Homo Sapiens
HLDPPPPRP

SEQ ID NO: 229232 - protein, 9 aa, Homo Sapiens
ERYLLQAVG

SEQ ID NO: 229233 - protein, 9 aa, Homo Sapiens
SPSALPCAQ

SEQ ID NO: 229234 - protein, 9 aa, Homo Sapiens
DALVATTIN

SEQ ID NO: 229235 - protein, 9 aa, Homo Sapiens
ETSGDFQKA

SEQ ID NO: 229236 - protein, 9 aa, Homo Sapiens
APLPPRAPH

SEQ ID NO: 229237 - protein, 9 aa, Homo Sapiens
VHVWQLYGV

SEQ ID NO: 229238 - protein, 9 aa, Homo Sapiens
TEKLREMTI

SEQ ID NO: 229239 - protein, 9 aa, Homo Sapiens
GCSPMLART

SEQ ID NO: 229240 - protein, 9 aa, Homo Sapiens
ANPGPQDTV

SEQ ID NO: 229241 - protein, 9 aa, Homo Sapiens
ALAMGLAQP

SEQ ID NO: 229242 - protein, 9 aa, Homo Sapiens
DLDDVITDI

SEQ ID NO: 229243 - protein, 9 aa, Homo Sapiens
QGTGSGPRV

SEQ ID NO: 229244 - protein, 9 aa, Homo Sapiens
LTPKTLLDD

SEQ ID NO: 229245 - protein, 9 aa, Homo Sapiens
ECKHLRWIG

SEQ ID NO: 229246 - protein, 9 aa, Homo Sapiens
AWLLLLLSP

SEQ ID NO: 229247 - protein, 9 aa, Homo Sapiens
TEFLSPQEL

SEQ ID NO: 229248 - protein, 9 aa, Homo Sapiens
SLTLGLELS

SEQ ID NO: 229249 - protein, 9 aa, Homo Sapiens
WKLLSETGK

SEQ ID NO: 229250 - protein, 9 aa, Homo Sapiens
IVQDGPPRA

SEQ ID NO: 229251 - protein, 9 aa, Homo Sapiens
MDLDDWEPD

SEQ ID NO: 229252 - protein, 9 aa, Homo Sapiens
STQSFPSLG

SEQ ID NO: 229253 - protein, 9 aa, Homo Sapiens
PVGKQQMMD

SEQ ID NO: 229254 - protein, 9 aa, Homo Sapiens
GEDMDLDDW

SEQ ID NO: 229255 - protein, 9 aa, Homo Sapiens
VVTLFYGMG

SEQ ID NO: 229256 - protein, 9 aa, Homo Sapiens
RSRPGFSPR

SEQ ID NO: 229257 - protein, 9 aa, Homo Sapiens
SRPFSSAPL

SEQ ID NO: 229258 - protein, 9 aa, Homo Sapiens
IIDNFNQQE

SEQ ID NO: 229259 - protein, 9 aa, Homo Sapiens
GLSVLQSFR

SEQ ID NO: 229260 - protein, 9 aa, Homo Sapiens
LGAAPLPPR

SEQ ID NO: 229261 - protein, 9 aa, Homo Sapiens
EEELNSPGR

SEQ ID NO: 229262 - protein, 9 aa, Homo Sapiens
DLYHSEEEE

SEQ ID NO: 229263 - protein, 9 aa, Homo Sapiens
ARASYSPAH

SEQ ID NO: 229264 - protein, 9 aa, Homo Sapiens
LAEDHPRIL

SEQ ID NO: 229265 - protein, 9 aa, Homo Sapiens
KANLNTLDR

SEQ ID NO: 229266 - protein, 9 aa, Homo Sapiens
MNQGDMMGT

SEQ ID NO: 229267 - protein, 9 aa, Homo Sapiens
ANDRPSMRS

SEQ ID NO: 229268 - protein, 9 aa, Homo Sapiens
WEGTCFSEV

SEQ ID NO: 229269 - protein, 9 aa, Homo Sapiens
YLGNVLAEL

SEQ ID NO: 229270 - protein, 9 aa, Homo Sapiens
RPRARRGEP

SEQ ID NO: 229271 - protein, 9 aa, Homo Sapiens
ELWKKSLNI

SEQ ID NO: 229272 - protein, 9 aa, Homo Sapiens
TLPPPEYSL

SEQ ID NO: 229273 - protein, 9 aa, Homo Sapiens
LFTIKQSMV

SEQ ID NO: 229274 - protein, 9 aa, Homo Sapiens
RMCKQKRRE

SEQ ID NO: 229275 - protein, 9 aa, Homo Sapiens
VAFQILAKP

SEQ ID NO: 229276 - protein, 9 aa, Homo Sapiens
ALSPELGIK

SEQ ID NO: 229277 - protein, 9 aa, Homo Sapiens
HLEAATQQN

SEQ ID NO: 229278 - protein, 9 aa, Homo Sapiens
PPQRPGWAP

SEQ ID NO: 229279 - protein, 9 aa, Homo Sapiens
AITKRAEAI

SEQ ID NO: 229280 - protein, 9 aa, Homo Sapiens
PSMILPDPS

SEQ ID NO: 229281 - protein, 9 aa, Homo Sapiens
ALPHLPVAS

SEQ ID NO: 229282 - protein, 9 aa, Homo Sapiens
NIVLSGSTT

SEQ ID NO: 229283 - protein, 9 aa, Homo Sapiens
VWWGPGTRS

SEQ ID NO: 229284 - protein, 9 aa, Homo Sapiens
LPPEPGDPD

SEQ ID NO: 229285 - protein, 9 aa, Homo Sapiens
QFDLVSRGF

SEQ ID NO: 229286 - protein, 9 aa, Homo Sapiens
KTLLGQLPP

SEQ ID NO: 229287 - protein, 9 aa, Homo Sapiens
SSAPFGASL

SEQ ID NO: 229288 - protein, 9 aa, Homo Sapiens
FQILAKPEC

SEQ ID NO: 229289 - protein, 9 aa, Homo Sapiens
CSTAKATTC

SEQ ID NO: 229290 - protein, 9 aa, Homo Sapiens
GLHVHGSVD

SEQ ID NO: 229291 - protein, 9 aa, Homo Sapiens
PIYPNHRER

SEQ ID NO: 229292 - protein, 9 aa, Homo Sapiens
NSIEGKVRK

SEQ ID NO: 229293 - protein, 9 aa, Homo Sapiens
THLSLIYTV

SEQ ID NO: 229294 - protein, 9 aa, Homo Sapiens
SDSWPEQHH

SEQ ID NO: 229295 - protein, 9 aa, Homo Sapiens
RHCLCKAGV

SEQ ID NO: 229296 - protein, 9 aa, Homo Sapiens
SWTPGRRGG

SEQ ID NO: 229297 - protein, 9 aa, Homo Sapiens
RAGGPAGWA

SEQ ID NO: 229298 - protein, 9 aa, Homo Sapiens
LAGNDRHPV

SEQ ID NO: 229299 - protein, 9 aa, Homo Sapiens
RAMTKNTSM

SEQ ID NO: 229300 - protein, 9 aa, Homo Sapiens
WAGHLLGQL

SEQ ID NO: 229301 - protein, 9 aa, Homo Sapiens
KYCHIKHAW

SEQ ID NO: 229302 - protein, 9 aa, Homo Sapiens
DTAEIFHSV

SEQ ID NO: 229303 - protein, 9 aa, Homo Sapiens
LRPLARRCG

SEQ ID NO: 229304 - protein, 9 aa, Homo Sapiens
WGPARPLPP

SEQ ID NO: 229305 - protein, 9 aa, Homo Sapiens
IDPRNLGCS

SEQ ID NO: 229306 - protein, 9 aa, Homo Sapiens
TPVGRFTAH

SEQ ID NO: 229307 - protein, 9 aa, Homo Sapiens
PGWTNRPRS

SEQ ID NO: 229308 - protein, 9 aa, Homo Sapiens
LPHVGVTQR

SEQ ID NO: 229309 - protein, 9 aa, Homo Sapiens
AAANFRRCC

SEQ ID NO: 229310 - protein, 9 aa, Homo Sapiens
DAPEQFIGQ

SEQ ID NO: 229311 - protein, 9 aa, Homo Sapiens
GSEVDRIIL

SEQ ID NO: 229312 - protein, 9 aa, Homo Sapiens
APSVWNASR

SEQ ID NO: 229313 - protein, 9 aa, Homo Sapiens
SILYRNPNG

SEQ ID NO: 229314 - protein, 9 aa, Homo Sapiens
KRRQEEMLN

SEQ ID NO: 229315 - protein, 9 aa, Homo Sapiens
RQRCGPRGW

SEQ ID NO: 229316 - protein, 9 aa, Homo Sapiens
AFKHYPINM

SEQ ID NO: 229317 - protein, 9 aa, Homo Sapiens
RPRLSGMLM

SEQ ID NO: 229318 - protein, 9 aa, Homo Sapiens
GCRFPYFEA

SEQ ID NO: 229319 - protein, 9 aa, Homo Sapiens
TKYLNLTAS

SEQ ID NO: 229320 - protein, 9 aa, Homo Sapiens
PNESPKDIP

SEQ ID NO: 229321 - protein, 9 aa, Homo Sapiens
MNWKKMMIG

SEQ ID NO: 229322 - protein, 9 aa, Homo Sapiens
PLPRLRLFP

SEQ ID NO: 229323 - protein, 9 aa, Homo Sapiens
IVPIVNDII

SEQ ID NO: 229324 - protein, 9 aa, Homo Sapiens
PEQDGFGNM

SEQ ID NO: 229325 - protein, 9 aa, Homo Sapiens
ATQAEAAAV

SEQ ID NO: 229326 - protein, 9 aa, Homo Sapiens
ASLRATVPR

SEQ ID NO: 229327 - protein, 9 aa, Homo Sapiens
EPPSRKCSG

SEQ ID NO: 229328 - protein, 9 aa, Homo Sapiens
MHGWTALMQ

SEQ ID NO: 229329 - protein, 9 aa, Homo Sapiens
GGVFLMVGI

SEQ ID NO: 229330 - protein, 9 aa, Homo Sapiens
APPETYQQG

SEQ ID NO: 229331 - protein, 9 aa, Homo Sapiens
PAQCRPAWT

SEQ ID NO: 229332 - protein, 9 aa, Homo Sapiens
IDATGSRGA

SEQ ID NO: 229333 - protein, 9 aa, Homo Sapiens
FLDRQLSYF

SEQ ID NO: 229334 - protein, 9 aa, Homo Sapiens
PCAHDAHRK

SEQ ID NO: 229335 - protein, 9 aa, Homo Sapiens
RCPLTAPLA

SEQ ID NO: 229336 - protein, 9 aa, Homo Sapiens
QALEVLGAF

SEQ ID NO: 229337 - protein, 9 aa, Homo Sapiens
TSASRSAAS

SEQ ID NO: 229338 - protein, 9 aa, Homo Sapiens
NVVGSSGIC

SEQ ID NO: 229339 - protein, 9 aa, Homo Sapiens
SEAWMQTNY

SEQ ID NO: 229340 - protein, 9 aa, Homo Sapiens
NENSSEQLG

SEQ ID NO: 229341 - protein, 9 aa, Homo Sapiens
LVQHRHIHT

SEQ ID NO: 229342 - protein, 9 aa, Homo Sapiens
AWSKIYSCH

SEQ ID NO: 229343 - protein, 9 aa, Homo Sapiens
DKASANIFH

SEQ ID NO: 229344 - protein, 9 aa, Homo Sapiens
YLHSCDPPS

SEQ ID NO: 229345 - protein, 9 aa, Homo Sapiens
GHCTSSSRT

SEQ ID NO: 229346 - protein, 9 aa, Homo Sapiens
GMVWKRLND

SEQ ID NO: 229347 - protein, 9 aa, Homo Sapiens
AKTDSYIIS

SEQ ID NO: 229348 - protein, 9 aa, Homo Sapiens
SQLLILILA

SEQ ID NO: 229349 - protein, 9 aa, Homo Sapiens
SGGQKQWIA

SEQ ID NO: 229350 - protein, 9 aa, Homo Sapiens
YLGNRLRLQ

SEQ ID NO: 229351 - protein, 9 aa, Homo Sapiens
PRYTVKSCD

SEQ ID NO: 229352 - protein, 9 aa, Homo Sapiens
RFCAFGATH

SEQ ID NO: 229353 - protein, 9 aa, Homo Sapiens
PMTSATGAR

SEQ ID NO: 229354 - protein, 9 aa, Homo Sapiens
GTNSLKSSG

SEQ ID NO: 229355 - protein, 9 aa, Homo Sapiens
TKPDRQLIT

SEQ ID NO: 229356 - protein, 9 aa, Homo Sapiens
SNVYPSVKP

SEQ ID NO: 229357 - protein, 9 aa, Homo Sapiens
CCRGSSKNN

SEQ ID NO: 229358 - protein, 9 aa, Homo Sapiens
PSRCRQRCG

SEQ ID NO: 229359 - protein, 9 aa, Homo Sapiens
FFVPMSLAC

SEQ ID NO: 229360 - protein, 9 aa, Homo Sapiens
TTRCRRPRC

SEQ ID NO: 229361 - protein, 9 aa, Homo Sapiens
VTLMISIYN

SEQ ID NO: 229362 - protein, 9 aa, Homo Sapiens
QRFPPPLMI

SEQ ID NO: 229363 - protein, 9 aa, Homo Sapiens
PLGLALCPS

SEQ ID NO: 229364 - protein, 9 aa, Homo Sapiens
IMEEESKTG

SEQ ID NO: 229365 - protein, 9 aa, Homo Sapiens
KTPASSTAA

SEQ ID NO: 229366 - protein, 9 aa, Homo Sapiens
KRKIQKRSK

SEQ ID NO: 229367 - protein, 9 aa, Homo Sapiens
LEPLMTFEL

SEQ ID NO: 229368 - protein, 9 aa, Homo Sapiens
GRHHPSQLC

SEQ ID NO: 229369 - protein, 9 aa, Homo Sapiens
FVFDNTEDI

SEQ ID NO: 229370 - protein, 9 aa, Homo Sapiens
VDVWERSKG

SEQ ID NO: 229371 - protein, 9 aa, Homo Sapiens
CDINFDDCQ

SEQ ID NO: 229372 - protein, 9 aa, Homo Sapiens
VKAGFAGED

SEQ ID NO: 229373 - protein, 9 aa, Homo Sapiens
QKIKSGDED

SEQ ID NO: 229374 - protein, 9 aa, Homo Sapiens
IQYAKTDSY

SEQ ID NO: 229375 - protein, 9 aa, Homo Sapiens
ADIMLPSLR

SEQ ID NO: 229376 - protein, 9 aa, Homo Sapiens
TGLLKPKIS

SEQ ID NO: 229377 - protein, 9 aa, Homo Sapiens
GAWQVFERW

SEQ ID NO: 229378 - protein, 9 aa, Homo Sapiens
DQRSENYRE

SEQ ID NO: 229379 - protein, 9 aa, Homo Sapiens
GPGCVYAAT

SEQ ID NO: 229380 - protein, 9 aa, Homo Sapiens
EWPSQVVLC

SEQ ID NO: 229381 - protein, 9 aa, Homo Sapiens
GLGLLDLLR

SEQ ID NO: 229382 - protein, 9 aa, Homo Sapiens
SPVQHQTGQ

SEQ ID NO: 229383 - protein, 9 aa, Homo Sapiens
SIQTQGSSH

SEQ ID NO: 229384 - protein, 9 aa, Homo Sapiens
VTQRVPGAS

SEQ ID NO: 229385 - protein, 9 aa, Homo Sapiens
MIPQMARVT

SEQ ID NO: 229386 - protein, 9 aa, Homo Sapiens
TLEKCGYNK

SEQ ID NO: 229387 - protein, 9 aa, Homo Sapiens
FPPMEFPAP

SEQ ID NO: 229388 - protein, 9 aa, Homo Sapiens
TPPFGLIPR

SEQ ID NO: 229389 - protein, 9 aa, Homo Sapiens
EKLEATDRY

SEQ ID NO: 229390 - protein, 9 aa, Homo Sapiens
IGWAWGHPC

SEQ ID NO: 229391 - protein, 9 aa, Homo Sapiens
MRRGPPFPH

SEQ ID NO: 229392 - protein, 9 aa, Homo Sapiens
PTLPKKLTS

SEQ ID NO: 229393 - protein, 9 aa, Homo Sapiens
QAEAAAVVA

SEQ ID NO: 229394 - protein, 9 aa, Homo Sapiens
HGRPIYPNH

SEQ ID NO: 229395 - protein, 9 aa, Homo Sapiens
VFFNTTGCL

SEQ ID NO: 229396 - protein, 9 aa, Homo Sapiens
EQILQERIE

SEQ ID NO: 229397 - protein, 9 aa, Homo Sapiens
KQKEKITKI

SEQ ID NO: 229398 - protein, 9 aa, Homo Sapiens
RWQQQRMPD

SEQ ID NO: 229399 - protein, 9 aa, Homo Sapiens
VMSHRSSSW

SEQ ID NO: 229400 - protein, 9 aa, Homo Sapiens
LHSYQLEGV

SEQ ID NO: 229401 - protein, 9 aa, Homo Sapiens
NGFSNLVRL

SEQ ID NO: 229402 - protein, 9 aa, Homo Sapiens
LVARIPLPQ

SEQ ID NO: 229403 - protein, 9 aa, Homo Sapiens
KTCRKPALL

SEQ ID NO: 229404 - protein, 9 aa, Homo Sapiens
MMAAVKTYS

SEQ ID NO: 229405 - protein, 9 aa, Homo Sapiens
CTLALWPIS

SEQ ID NO: 229406 - protein, 9 aa, Homo Sapiens
CDSCVNSDY

SEQ ID NO: 229407 - protein, 9 aa, Homo Sapiens
EVDRIILKA

SEQ ID NO: 229408 - protein, 9 aa, Homo Sapiens
TVRLLHFFS

SEQ ID NO: 229409 - protein, 9 aa, Homo Sapiens
GLRVKGLWR

SEQ ID NO: 229410 - protein, 9 aa, Homo Sapiens
LTAPLACLH

SEQ ID NO: 229411 - protein, 9 aa, Homo Sapiens
EFMERESLI

SEQ ID NO: 229412 - protein, 9 aa, Homo Sapiens
VLFIREKYM

SEQ ID NO: 229413 - protein, 9 aa, Homo Sapiens
IFLGIFSGC

SEQ ID NO: 229414 - protein, 9 aa, Homo Sapiens
RANPGPQDT

SEQ ID NO: 229415 - protein, 9 aa, Homo Sapiens
GQSVVSESL

SEQ ID NO: 229416 - protein, 9 aa, Homo Sapiens
KRPMGLSRP

SEQ ID NO: 229417 - protein, 9 aa, Homo Sapiens
SVRSGLFGQ

SEQ ID NO: 229418 - protein, 9 aa, Homo Sapiens
KPMRKPRIP

SEQ ID NO: 229419 - protein, 9 aa, Homo Sapiens
ITSHMHLKC

SEQ ID NO: 229420 - protein, 9 aa, Homo Sapiens
PLRGFLLHQ

SEQ ID NO: 229421 - protein, 9 aa, Homo Sapiens
PSLGGCPLS

SEQ ID NO: 229422 - protein, 9 aa, Homo Sapiens
CMPVGGQTS

SEQ ID NO: 229423 - protein, 9 aa, Homo Sapiens
EIFHSVDAR

SEQ ID NO: 229424 - protein, 9 aa, Homo Sapiens
VDLKNGKFY

SEQ ID NO: 229425 - protein, 9 aa, Homo Sapiens
SASSLSSSR

SEQ ID NO: 229426 - protein, 9 aa, Homo Sapiens
NGIHHFFCD

SEQ ID NO: 229427 - protein, 9 aa, Homo Sapiens
TCRKPALLE

SEQ ID NO: 229428 - protein, 9 aa, Homo Sapiens
FMMLYKKKA

SEQ ID NO: 229429 - protein, 9 aa, Homo Sapiens
LAYLYEHGL

SEQ ID NO: 229430 - protein, 9 aa, Homo Sapiens
PRVKDRSAD

SEQ ID NO: 229431 - protein, 9 aa, Homo Sapiens
SESISEESS

SEQ ID NO: 229432 - protein, 9 aa, Homo Sapiens
CVNSIEGKV

SEQ ID NO: 229433 - protein, 9 aa, Homo Sapiens
PLSDSILTE

SEQ ID NO: 229434 - protein, 9 aa, Homo Sapiens
IALGGCSSP

SEQ ID NO: 229435 - protein, 9 aa, Homo Sapiens
QGSWASLQS

SEQ ID NO: 229436 - protein, 9 aa, Homo Sapiens
IRRVSPGQG

SEQ ID NO: 229437 - protein, 9 aa, Homo Sapiens
DWTREEVVT

SEQ ID NO: 229438 - protein, 9 aa, Homo Sapiens
LLRGWGQHT

SEQ ID NO: 229439 - protein, 9 aa, Homo Sapiens
VNLATHNKN

SEQ ID NO: 229440 - protein, 9 aa, Homo Sapiens
AAAQAAQQR

SEQ ID NO: 229441 - protein, 9 aa, Homo Sapiens
NPSHHSRSG

SEQ ID NO: 229442 - protein, 9 aa, Homo Sapiens
LLRRGQLGA

SEQ ID NO: 229443 - protein, 9 aa, Homo Sapiens
EAVDCGNTE

SEQ ID NO: 229444 - protein, 9 aa, Homo Sapiens
LWQSPCPAP

SEQ ID NO: 229445 - protein, 9 aa, Homo Sapiens
RQADIMLPS

SEQ ID NO: 229446 - protein, 9 aa, Homo Sapiens
LPCAQPTVS

SEQ ID NO: 229447 - protein, 9 aa, Homo Sapiens
LESLKGNRA

SEQ ID NO: 229448 - protein, 9 aa, Homo Sapiens
ATFSACSTA

SEQ ID NO: 229449 - protein, 9 aa, Homo Sapiens
WNNKKMAMT

SEQ ID NO: 229450 - protein, 9 aa, Homo Sapiens
SPARSPAPR

SEQ ID NO: 229451 - protein, 9 aa, Homo Sapiens
SQSGTKMKA

SEQ ID NO: 229452 - protein, 9 aa, Homo Sapiens
TQTAISQTI

SEQ ID NO: 229453 - protein, 9 aa, Homo Sapiens
RSLQRLAYL

SEQ ID NO: 229454 - protein, 9 aa, Homo Sapiens
FGQREGTYN

SEQ ID NO: 229455 - protein, 9 aa, Homo Sapiens
PSRPRSPAS

SEQ ID NO: 229456 - protein, 9 aa, Homo Sapiens
AEGRPQNMS

SEQ ID NO: 229457 - protein, 9 aa, Homo Sapiens
CFKEKSRSM

SEQ ID NO: 229458 - protein, 9 aa, Homo Sapiens
GLEVFRAHI

SEQ ID NO: 229459 - protein, 9 aa, Homo Sapiens
ISSPNNAGL

SEQ ID NO: 229460 - protein, 9 aa, Homo Sapiens
MEGQPMRCL

SEQ ID NO: 229461 - protein, 9 aa, Homo Sapiens
RFTPDAMPT

SEQ ID NO: 229462 - protein, 9 aa, Homo Sapiens
WTPWRKSGS

SEQ ID NO: 229463 - protein, 9 aa, Homo Sapiens
VLCSVSICT

SEQ ID NO: 229464 - protein, 9 aa, Homo Sapiens
PPREAIFPF

SEQ ID NO: 229465 - protein, 9 aa, Homo Sapiens
TMVGAGELS

SEQ ID NO: 229466 - protein, 9 aa, Homo Sapiens
IMKRMCKQK

SEQ ID NO: 229467 - protein, 9 aa, Homo Sapiens
RDLRCPLTA

SEQ ID NO: 229468 - protein, 9 aa, Homo Sapiens
VVGIGVPIM

SEQ ID NO: 229469 - protein, 9 aa, Homo Sapiens
RGPGLVAGV

SEQ ID NO: 229470 - protein, 9 aa, Homo Sapiens
AARGRCGTW

SEQ ID NO: 229471 - protein, 9 aa, Homo Sapiens
AVAASTGMW

SEQ ID NO: 229472 - protein, 9 aa, Homo Sapiens
CRKPALLEP

SEQ ID NO: 229473 - protein, 9 aa, Homo Sapiens
NGGTQIQPL

SEQ ID NO: 229474 - protein, 9 aa, Homo Sapiens
AAGMTLAAV

SEQ ID NO: 229475 - protein, 9 aa, Homo Sapiens
SPKDIPAHE

SEQ ID NO: 229476 - protein, 9 aa, Homo Sapiens
STHTPSASR

SEQ ID NO: 229477 - protein, 9 aa, Homo Sapiens
GRTAAVGKA

SEQ ID NO: 229478 - protein, 9 aa, Homo Sapiens
GPAQRAEPQ

SEQ ID NO: 229479 - protein, 9 aa, Homo Sapiens
EQNRSSEEA

SEQ ID NO: 229480 - protein, 9 aa, Homo Sapiens
NLHFHILTW

SEQ ID NO: 229481 - protein, 9 aa, Homo Sapiens
PWAGFPFAF

SEQ ID NO: 229482 - protein, 9 aa, Homo Sapiens
DAVEPGGCG

SEQ ID NO: 229483 - protein, 9 aa, Homo Sapiens
VGSALDCFS

SEQ ID NO: 229484 - protein, 9 aa, Homo Sapiens
FFVIFLESP

SEQ ID NO: 229485 - protein, 9 aa, Homo Sapiens
LQQNRGPVT

SEQ ID NO: 229486 - protein, 9 aa, Homo Sapiens
YSGPPQGQA

SEQ ID NO: 229487 - protein, 9 aa, Homo Sapiens
MAPEIFTRV

SEQ ID NO: 229488 - protein, 9 aa, Homo Sapiens
FCIFSSPPS

SEQ ID NO: 229489 - protein, 9 aa, Homo Sapiens
SPSRRCPRT

SEQ ID NO: 229490 - protein, 9 aa, Homo Sapiens
KCFLNLSQM

SEQ ID NO: 229491 - protein, 9 aa, Homo Sapiens
GGRILLQRN

SEQ ID NO: 229492 - protein, 9 aa, Homo Sapiens
LLLHHILRH

SEQ ID NO: 229493 - protein, 9 aa, Homo Sapiens
VIAEEEPPR

SEQ ID NO: 229494 - protein, 9 aa, Homo Sapiens
QDLSSPRPS

SEQ ID NO: 229495 - protein, 9 aa, Homo Sapiens
EIDDFLKQM

SEQ ID NO: 229496 - protein, 9 aa, Homo Sapiens
QSCPSPAVK

SEQ ID NO: 229497 - protein, 9 aa, Homo Sapiens
KLTGTHTED

SEQ ID NO: 229498 - protein, 9 aa, Homo Sapiens
GWRLPKAQS

SEQ ID NO: 229499 - protein, 9 aa, Homo Sapiens
MDRIKLDWA

SEQ ID NO: 229500 - protein, 9 aa, Homo Sapiens
IMGMVWKRL

SEQ ID NO: 229501 - protein, 9 aa, Homo Sapiens
PSSTSSSLT

SEQ ID NO: 229502 - protein, 9 aa, Homo Sapiens
LNPPGCALP

SEQ ID NO: 229503 - protein, 9 aa, Homo Sapiens
PHGVKRRHH

SEQ ID NO: 229504 - protein, 9 aa, Homo Sapiens
PPDGCYQYN

SEQ ID NO: 229505 - protein, 9 aa, Homo Sapiens
DAWQELGTQ

SEQ ID NO: 229506 - protein, 9 aa, Homo Sapiens
PYKCQLCYC

SEQ ID NO: 229507 - protein, 9 aa, Homo Sapiens
TLLVVARDH

SEQ ID NO: 229508 - protein, 9 aa, Homo Sapiens
ARKQMERQC

SEQ ID NO: 229509 - protein, 9 aa, Homo Sapiens
QERHIQVTL

SEQ ID NO: 229510 - protein, 9 aa, Homo Sapiens
PKRPKILKY

SEQ ID NO: 229511 - protein, 9 aa, Homo Sapiens
STAASIPDC

SEQ ID NO: 229512 - protein, 9 aa, Homo Sapiens
KSPLNQKIR

SEQ ID NO: 229513 - protein, 9 aa, Homo Sapiens
RDPGGRPSH

SEQ ID NO: 229514 - protein, 9 aa, Homo Sapiens
HNGVSLHEL

SEQ ID NO: 229515 - protein, 9 aa, Homo Sapiens
VDLKKSRLC

SEQ ID NO: 229516 - protein, 9 aa, Homo Sapiens
GWQGLGAQQ

SEQ ID NO: 229517 - protein, 9 aa, Homo Sapiens
LKVTLTQGP

SEQ ID NO: 229518 - protein, 9 aa, Homo Sapiens
DCGPFIGKN

SEQ ID NO: 229519 - protein, 9 aa, Homo Sapiens
SAGTAGMLI

SEQ ID NO: 229520 - protein, 9 aa, Homo Sapiens
YLFPALLFH

SEQ ID NO: 229521 - protein, 9 aa, Homo Sapiens
KGFGKDMTL

SEQ ID NO: 229522 - protein, 9 aa, Homo Sapiens
VQMCVDART

SEQ ID NO: 229523 - protein, 9 aa, Homo Sapiens
LGSGLRLGP

SEQ ID NO: 229524 - protein, 9 aa, Homo Sapiens
SCFSNGSWW

SEQ ID NO: 229525 - protein, 9 aa, Homo Sapiens
IDDFLKQMT

SEQ ID NO: 229526 - protein, 9 aa, Homo Sapiens
RAPNCWHRD

SEQ ID NO: 229527 - protein, 9 aa, Homo Sapiens
VDATTVTDV

SEQ ID NO: 229528 - protein, 9 aa, Homo Sapiens
NQMKTAEGH

SEQ ID NO: 229529 - protein, 9 aa, Homo Sapiens
MCLRNAHSI

SEQ ID NO: 229530 - protein, 9 aa, Homo Sapiens
LCMGLKSWI

SEQ ID NO: 229531 - protein, 9 aa, Homo Sapiens
MGPGSHPLC

SEQ ID NO: 229532 - protein, 9 aa, Homo Sapiens
CPLPPTRPR

SEQ ID NO: 229533 - protein, 9 aa, Homo Sapiens
LRCSAPPTK

SEQ ID NO: 229534 - protein, 9 aa, Homo Sapiens
SLTSRLWPH

SEQ ID NO: 229535 - protein, 9 aa, Homo Sapiens
QPWYIHALC

SEQ ID NO: 229536 - protein, 9 aa, Homo Sapiens
KVSTRKNGG

SEQ ID NO: 229537 - protein, 9 aa, Homo Sapiens
CFTGFLGMV

SEQ ID NO: 229538 - protein, 9 aa, Homo Sapiens
RTHMPSYED

SEQ ID NO: 229539 - protein, 9 aa, Homo Sapiens
REGHILIFT

SEQ ID NO: 229540 - protein, 9 aa, Homo Sapiens
WTGAVCGPG

SEQ ID NO: 229541 - protein, 9 aa, Homo Sapiens
HTICVKTHE

SEQ ID NO: 229542 - protein, 9 aa, Homo Sapiens
ARLGRTQHQ

SEQ ID NO: 229543 - protein, 9 aa, Homo Sapiens
TSQCHCLPS

SEQ ID NO: 229544 - protein, 9 aa, Homo Sapiens
DDLVTLDGQ

SEQ ID NO: 229545 - protein, 9 aa, Homo Sapiens
GLVTTPVNP

SEQ ID NO: 229546 - protein, 9 aa, Homo Sapiens
SLDLPVAGV

SEQ ID NO: 229547 - protein, 9 aa, Homo Sapiens
RRNPPPRGR

SEQ ID NO: 229548 - protein, 9 aa, Homo Sapiens
GCKVHQWVD

SEQ ID NO: 229549 - protein, 9 aa, Homo Sapiens
VCMVYVLYK

SEQ ID NO: 229550 - protein, 9 aa, Homo Sapiens
KPCKCHECG

SEQ ID NO: 229551 - protein, 9 aa, Homo Sapiens
VTDFEVLST

SEQ ID NO: 229552 - protein, 9 aa, Homo Sapiens
VPLFIWTPW

SEQ ID NO: 229553 - protein, 9 aa, Homo Sapiens
GAVVWPSVP

SEQ ID NO: 229554 - protein, 9 aa, Homo Sapiens
KTWQRRLRA

SEQ ID NO: 229555 - protein, 9 aa, Homo Sapiens
KEVLKTKRY

SEQ ID NO: 229556 - protein, 9 aa, Homo Sapiens
VADEEGEEN

SEQ ID NO: 229557 - protein, 9 aa, Homo Sapiens
VRFEPGKTS

SEQ ID NO: 229558 - protein, 9 aa, Homo Sapiens
GEFPGFWFV

SEQ ID NO: 229559 - protein, 9 aa, Homo Sapiens
LAERNEEDA

SEQ ID NO: 229560 - protein, 9 aa, Homo Sapiens
VGLQFLQRH

SEQ ID NO: 229561 - protein, 9 aa, Homo Sapiens
FKMVDVGGR

SEQ ID NO: 229562 - protein, 9 aa, Homo Sapiens
QARDLRCPL

SEQ ID NO: 229563 - protein, 9 aa, Homo Sapiens
AGDLTSLGL

SEQ ID NO: 229564 - protein, 9 aa, Homo Sapiens
PYIYRPTSQ

SEQ ID NO: 229565 - protein, 9 aa, Homo Sapiens
GTIQPQATG

SEQ ID NO: 229566 - protein, 9 aa, Homo Sapiens
KKSNTSQVK

SEQ ID NO: 229567 - protein, 9 aa, Homo Sapiens
ADLDNIADN

SEQ ID NO: 229568 - protein, 9 aa, Homo Sapiens
YNHIQRIPK

SEQ ID NO: 229569 - protein, 9 aa, Homo Sapiens
CYTGSHQLA

SEQ ID NO: 229570 - protein, 9 aa, Homo Sapiens
VVVAVATVE

SEQ ID NO: 229571 - protein, 9 aa, Homo Sapiens
LISLMIEYS

SEQ ID NO: 229572 - protein, 9 aa, Homo Sapiens
AQMFLFSEF

SEQ ID NO: 229573 - protein, 9 aa, Homo Sapiens
VGAGAVAVD

SEQ ID NO: 229574 - protein, 9 aa, Homo Sapiens
IAFHIKSIA

SEQ ID NO: 229575 - protein, 9 aa, Homo Sapiens
LKQVQLEWD

SEQ ID NO: 229576 - protein, 9 aa, Homo Sapiens
VYPSVKPGW

SEQ ID NO: 229577 - protein, 9 aa, Homo Sapiens
LRMGNERYN

SEQ ID NO: 229578 - protein, 9 aa, Homo Sapiens
LPHLPVASC

SEQ ID NO: 229579 - protein, 9 aa, Homo Sapiens
VSTGGHTHT

SEQ ID NO: 229580 - protein, 9 aa, Homo Sapiens
SSGLQGCVQ

SEQ ID NO: 229581 - protein, 9 aa, Homo Sapiens
APGTLYKPF

SEQ ID NO: 229582 - protein, 9 aa, Homo Sapiens
IMWLTMSST

SEQ ID NO: 229583 - protein, 9 aa, Homo Sapiens
VELSRKVTE

SEQ ID NO: 229584 - protein, 9 aa, Homo Sapiens
TVTDVPFQR

SEQ ID NO: 229585 - protein, 9 aa, Homo Sapiens
KSHTLQQAL

SEQ ID NO: 229586 - protein, 9 aa, Homo Sapiens
VPHATHRDA

SEQ ID NO: 229587 - protein, 9 aa, Homo Sapiens
IVEALCGMT

SEQ ID NO: 229588 - protein, 9 aa, Homo Sapiens
NRSPHSWSW

SEQ ID NO: 229589 - protein, 9 aa, Homo Sapiens
TTNQKKVLK

SEQ ID NO: 229590 - protein, 9 aa, Homo Sapiens
VFGVAEELS

SEQ ID NO: 229591 - protein, 9 aa, Homo Sapiens
LSCPPPHRC

SEQ ID NO: 229592 - protein, 9 aa, Homo Sapiens
LSVELGPEK

SEQ ID NO: 229593 - protein, 9 aa, Homo Sapiens
GVLDPRAQT

SEQ ID NO: 229594 - protein, 9 aa, Homo Sapiens
RSLSKKERK

SEQ ID NO: 229595 - protein, 9 aa, Homo Sapiens
SKFNGVQMC

SEQ ID NO: 229596 - protein, 9 aa, Homo Sapiens
ALQHHSKVQ

SEQ ID NO: 229597 - protein, 9 aa, Homo Sapiens
VGAQEAVQE

SEQ ID NO: 229598 - protein, 9 aa, Homo Sapiens
AACAGIPGW

SEQ ID NO: 229599 - protein, 9 aa, Homo Sapiens
QIILKGSVQ

SEQ ID NO: 229600 - protein, 9 aa, Homo Sapiens
SPGLELVFA

SEQ ID NO: 229601 - protein, 9 aa, Homo Sapiens
ALLEPFLIL

SEQ ID NO: 229602 - protein, 9 aa, Homo Sapiens
KYNGSCPRE

SEQ ID NO: 229603 - protein, 9 aa, Homo Sapiens
RWPLAPRKA

SEQ ID NO: 229604 - protein, 9 aa, Homo Sapiens
SWKQSQQSL

SEQ ID NO: 229605 - protein, 9 aa, Homo Sapiens
QISDALIKC

SEQ ID NO: 229606 - protein, 9 aa, Homo Sapiens
WPQLGNLLQ

SEQ ID NO: 229607 - protein, 9 aa, Homo Sapiens
APFFVPMSL

SEQ ID NO: 229608 - protein, 9 aa, Homo Sapiens
TWSLPRLVE

SEQ ID NO: 229609 - protein, 9 aa, Homo Sapiens
LPSIWYENL

SEQ ID NO: 229610 - protein, 9 aa, Homo Sapiens
FLCHFILFF

SEQ ID NO: 229611 - protein, 9 aa, Homo Sapiens
YVLYKTLTP

SEQ ID NO: 229612 - protein, 9 aa, Homo Sapiens
GPLGFFGLL

SEQ ID NO: 229613 - protein, 9 aa, Homo Sapiens
GLDTWESPK

SEQ ID NO: 229614 - protein, 9 aa, Homo Sapiens
PGLSGHGEP

SEQ ID NO: 229615 - protein, 9 aa, Homo Sapiens
TNAPGVFRV

SEQ ID NO: 229616 - protein, 9 aa, Homo Sapiens
QLRVFLSLM

SEQ ID NO: 229617 - protein, 9 aa, Homo Sapiens
SVVRVLFIR

SEQ ID NO: 229618 - protein, 9 aa, Homo Sapiens
PAWTAAGVS

SEQ ID NO: 229619 - protein, 9 aa, Homo Sapiens
PVQHQTGQA

SEQ ID NO: 229620 - protein, 9 aa, Homo Sapiens
DPEVFFNTT

SEQ ID NO: 229621 - protein, 9 aa, Homo Sapiens
KRGNKDLRT

SEQ ID NO: 229622 - protein, 9 aa, Homo Sapiens
ELKHVLAHQ

SEQ ID NO: 229623 - protein, 9 aa, Homo Sapiens
WEQAKDNKA

SEQ ID NO: 229624 - protein, 9 aa, Homo Sapiens
LTTTCSRRP

SEQ ID NO: 229625 - protein, 9 aa, Homo Sapiens
FRHAPPPRM

SEQ ID NO: 229626 - protein, 9 aa, Homo Sapiens
VRSSGSALA

SEQ ID NO: 229627 - protein, 9 aa, Homo Sapiens
FFELDVMDH

SEQ ID NO: 229628 - protein, 9 aa, Homo Sapiens
PKSPHSWKT

SEQ ID NO: 229629 - protein, 9 aa, Homo Sapiens
ALEEMEGIR

SEQ ID NO: 229630 - protein, 9 aa, Homo Sapiens
PEEFSVEEA

SEQ ID NO: 229631 - protein, 9 aa, Homo Sapiens
IGRSKELTI

SEQ ID NO: 229632 - protein, 9 aa, Homo Sapiens
CFSPLKKVW

SEQ ID NO: 229633 - protein, 9 aa, Homo Sapiens
SKSQRSWMV

SEQ ID NO: 229634 - protein, 9 aa, Homo Sapiens
SMILPDPSV

SEQ ID NO: 229635 - protein, 9 aa, Homo Sapiens
GSAVWHTLG

SEQ ID NO: 229636 - protein, 9 aa, Homo Sapiens
AGAAAAAAQ

SEQ ID NO: 229637 - protein, 9 aa, Homo Sapiens
YLWPQLGNL

SEQ ID NO: 229638 - protein, 9 aa, Homo Sapiens
SLLKEEAHE

SEQ ID NO: 229639 - protein, 9 aa, Homo Sapiens
FVPDSVLFR

SEQ ID NO: 229640 - protein, 9 aa, Homo Sapiens
LACRKRQKR

SEQ ID NO: 229641 - protein, 9 aa, Homo Sapiens
VCVAYATEV

SEQ ID NO: 229642 - protein, 9 aa, Homo Sapiens
VVTAGHCTS

SEQ ID NO: 229643 - protein, 9 aa, Homo Sapiens
AGNDRHPVA

SEQ ID NO: 229644 - protein, 9 aa, Homo Sapiens
RRDTTHVQM

SEQ ID NO: 229645 - protein, 9 aa, Homo Sapiens
AFNEQPIIF

SEQ ID NO: 229646 - protein, 9 aa, Homo Sapiens
ECLACRGAT

SEQ ID NO: 229647 - protein, 9 aa, Homo Sapiens
DSYIISKMR

SEQ ID NO: 229648 - protein, 9 aa, Homo Sapiens
LDRITTEAG

SEQ ID NO: 229649 - protein, 9 aa, Homo Sapiens
NLRPLSLQC

SEQ ID NO: 229650 - protein, 9 aa, Homo Sapiens
NKHPMYRSL

SEQ ID NO: 229651 - protein, 9 aa, Homo Sapiens
ASLKSFDSL

SEQ ID NO: 229652 - protein, 9 aa, Homo Sapiens
GQRPAPRTC

SEQ ID NO: 229653 - protein, 9 aa, Homo Sapiens
MILPDPSVK

SEQ ID NO: 229654 - protein, 9 aa, Homo Sapiens
VLTPKTLLD

SEQ ID NO: 229655 - protein, 9 aa, Homo Sapiens
SLDLFQHAG

SEQ ID NO: 229656 - protein, 9 aa, Homo Sapiens
IANSNPPVR

SEQ ID NO: 229657 - protein, 9 aa, Homo Sapiens
GRLLLPALL

SEQ ID NO: 229658 - protein, 9 aa, Homo Sapiens
LFHLLLSHK

SEQ ID NO: 229659 - protein, 9 aa, Homo Sapiens
PSRLEHVAR

SEQ ID NO: 229660 - protein, 9 aa, Homo Sapiens
VRKAKFCIF

SEQ ID NO: 229661 - protein, 9 aa, Homo Sapiens
LFPVLSTSS

SEQ ID NO: 229662 - protein, 9 aa, Homo Sapiens
ASGTLLSGD

SEQ ID NO: 229663 - protein, 9 aa, Homo Sapiens
LPLLLSKTS

SEQ ID NO: 229664 - protein, 9 aa, Homo Sapiens
AAWQGNVKV

SEQ ID NO: 229665 - protein, 9 aa, Homo Sapiens
DGVIMTGAY

SEQ ID NO: 229666 - protein, 9 aa, Homo Sapiens
RRSHRKRNQ

SEQ ID NO: 229667 - protein, 9 aa, Homo Sapiens
DDLNLWALC

SEQ ID NO: 229668 - protein, 9 aa, Homo Sapiens
ILRHEVLVL

SEQ ID NO: 229669 - protein, 9 aa, Homo Sapiens
WSRLSLLAP

SEQ ID NO: 229670 - protein, 9 aa, Homo Sapiens
INEHKRKLE

SEQ ID NO: 229671 - protein, 9 aa, Homo Sapiens
IESEREKSV

SEQ ID NO: 229672 - protein, 9 aa, Homo Sapiens
KVNMDIPRE

SEQ ID NO: 229673 - protein, 9 aa, Homo Sapiens
FEQGIKAYH

SEQ ID NO: 229674 - protein, 9 aa, Homo Sapiens
AKVCMVYVL

SEQ ID NO: 229675 - protein, 9 aa, Homo Sapiens
ATLSELHYD

SEQ ID NO: 229676 - protein, 9 aa, Homo Sapiens
SLLNFLSGK

SEQ ID NO: 229677 - protein, 9 aa, Homo Sapiens
LCFPRGMAF

SEQ ID NO: 229678 - protein, 9 aa, Homo Sapiens
TGRNARNCP

SEQ ID NO: 229679 - protein, 9 aa, Homo Sapiens
PWLRQKPLN

SEQ ID NO: 229680 - protein, 9 aa, Homo Sapiens
AARKKLEMG

SEQ ID NO: 229681 - protein, 9 aa, Homo Sapiens
SIPQKDLKI

SEQ ID NO: 229682 - protein, 9 aa, Homo Sapiens
GRSPLRPGA

SEQ ID NO: 229683 - protein, 9 aa, Homo Sapiens
TFHKMAFDY

SEQ ID NO: 229684 - protein, 9 aa, Homo Sapiens
GRARPRARR

SEQ ID NO: 229685 - protein, 9 aa, Homo Sapiens
RPRSPASPA

SEQ ID NO: 229686 - protein, 9 aa, Homo Sapiens
RLVSYPRRS

SEQ ID NO: 229687 - protein, 9 aa, Homo Sapiens
HRYDEWNFF

SEQ ID NO: 229688 - protein, 9 aa, Homo Sapiens
SRWALSGST

SEQ ID NO: 229689 - protein, 9 aa, Homo Sapiens
CHDFHPEEN

SEQ ID NO: 229690 - protein, 9 aa, Homo Sapiens
PELSQIPAS

SEQ ID NO: 229691 - protein, 9 aa, Homo Sapiens
DYTLGKFAS

SEQ ID NO: 229692 - protein, 9 aa, Homo Sapiens
VGIPSAFLE

SEQ ID NO: 229693 - protein, 9 aa, Homo Sapiens
DFWILVSMT

SEQ ID NO: 229694 - protein, 9 aa, Homo Sapiens
QVESEVGRP

SEQ ID NO: 229695 - protein, 9 aa, Homo Sapiens
WSCVTRGAS

SEQ ID NO: 229696 - protein, 9 aa, Homo Sapiens
PRRSHCLTW

SEQ ID NO: 229697 - protein, 9 aa, Homo Sapiens
GIGVCSGNG

SEQ ID NO: 229698 - protein, 9 aa, Homo Sapiens
LVNDNTDPA

SEQ ID NO: 229699 - protein, 9 aa, Homo Sapiens
LSQMQKNNG

SEQ ID NO: 229700 - protein, 9 aa, Homo Sapiens
TQKELQKLR

SEQ ID NO: 229701 - protein, 9 aa, Homo Sapiens
DVAIDATGS

SEQ ID NO: 229702 - protein, 9 aa, Homo Sapiens
PLHAPVGFS

SEQ ID NO: 229703 - protein, 9 aa, Homo Sapiens
TGGLWAWKA

SEQ ID NO: 229704 - protein, 9 aa, Homo Sapiens
HTPIWRPGT

SEQ ID NO: 229705 - protein, 9 aa, Homo Sapiens
SANIFHSGC

SEQ ID NO: 229706 - protein, 9 aa, Homo Sapiens
YKHDDTALT

SEQ ID NO: 229707 - protein, 9 aa, Homo Sapiens
EKWLLDVNN

SEQ ID NO: 229708 - protein, 9 aa, Homo Sapiens
FATLSELHY

SEQ ID NO: 229709 - protein, 9 aa, Homo Sapiens
SFLTPGMPD

SEQ ID NO: 229710 - protein, 9 aa, Homo Sapiens
PLLEAFPLP

SEQ ID NO: 229711 - protein, 9 aa, Homo Sapiens
GLFILPLLL

SEQ ID NO: 229712 - protein, 9 aa, Homo Sapiens
MDIPRESGV

SEQ ID NO: 229713 - protein, 9 aa, Homo Sapiens
PPSTMCPAP

SEQ ID NO: 229714 - protein, 9 aa, Homo Sapiens
IVLLLKPDK

SEQ ID NO: 229715 - protein, 9 aa, Homo Sapiens
MGLLWEPAG

SEQ ID NO: 229716 - protein, 9 aa, Homo Sapiens
STGMWTLVI

SEQ ID NO: 229717 - protein, 9 aa, Homo Sapiens
IPLDHQDVG

SEQ ID NO: 229718 - protein, 9 aa, Homo Sapiens
THRSHLHEI

SEQ ID NO: 229719 - protein, 9 aa, Homo Sapiens
VILAIALHL

SEQ ID NO: 229720 - protein, 9 aa, Homo Sapiens
PRLPTGLYC

SEQ ID NO: 229721 - protein, 9 aa, Homo Sapiens
QCRKTTATL

SEQ ID NO: 229722 - protein, 9 aa, Homo Sapiens
GLVTSHSFR

SEQ ID NO: 229723 - protein, 9 aa, Homo Sapiens
ATLISNTWI

SEQ ID NO: 229724 - protein, 9 aa, Homo Sapiens
KLREMTIII

SEQ ID NO: 229725 - protein, 9 aa, Homo Sapiens
GRRQPPHWL

SEQ ID NO: 229726 - protein, 9 aa, Homo Sapiens
LYFLVTRKT

SEQ ID NO: 229727 - protein, 9 aa, Homo Sapiens
PPRLECPIS

SEQ ID NO: 229728 - protein, 9 aa, Homo Sapiens
NTTLCQGPL

SEQ ID NO: 229729 - protein, 9 aa, Homo Sapiens
PPGASSGWA

SEQ ID NO: 229730 - protein, 9 aa, Homo Sapiens
VTLVMFAWY

SEQ ID NO: 229731 - protein, 9 aa, Homo Sapiens
IPENSEFPL

SEQ ID NO: 229732 - protein, 9 aa, Homo Sapiens
QKGQLEDLG

SEQ ID NO: 229733 - protein, 9 aa, Homo Sapiens
KEEDKKVRR

SEQ ID NO: 229734 - protein, 9 aa, Homo Sapiens
APWLWPAPC

SEQ ID NO: 229735 - protein, 9 aa, Homo Sapiens
TSFSHAPPV

SEQ ID NO: 229736 - protein, 9 aa, Homo Sapiens
VLFRCSYQF

SEQ ID NO: 229737 - protein, 9 aa, Homo Sapiens
ATRPTQRCL

SEQ ID NO: 229738 - protein, 9 aa, Homo Sapiens
ACLINEHKR

SEQ ID NO: 229739 - protein, 9 aa, Homo Sapiens
KQSEMPARL

SEQ ID NO: 229740 - protein, 9 aa, Homo Sapiens
ECQAEVQEG

SEQ ID NO: 229741 - protein, 9 aa, Homo Sapiens
YVSWTSAGS

SEQ ID NO: 229742 - protein, 9 aa, Homo Sapiens
LHEGDFRVP

SEQ ID NO: 229743 - protein, 9 aa, Homo Sapiens
WQVFERWME

SEQ ID NO: 229744 - protein, 9 aa, Homo Sapiens
TGGLTLRNF

SEQ ID NO: 229745 - protein, 9 aa, Homo Sapiens
HCLTWASSA

SEQ ID NO: 229746 - protein, 9 aa, Homo Sapiens
EADMAITMA

SEQ ID NO: 229747 - protein, 9 aa, Homo Sapiens
LNVMSQNPY

SEQ ID NO: 229748 - protein, 9 aa, Homo Sapiens
EKGRLHEWV

SEQ ID NO: 229749 - protein, 9 aa, Homo Sapiens
LRHEVLVLD

SEQ ID NO: 229750 - protein, 9 aa, Homo Sapiens
PPTCYSRMW

SEQ ID NO: 229751 - protein, 9 aa, Homo Sapiens
GWNEALGTE

SEQ ID NO: 229752 - protein, 9 aa, Homo Sapiens
SPAGTATRN

SEQ ID NO: 229753 - protein, 9 aa, Homo Sapiens
QRYPEAAAP

SEQ ID NO: 229754 - protein, 9 aa, Homo Sapiens
FEHLSHIGV

SEQ ID NO: 229755 - protein, 9 aa, Homo Sapiens
VNHHQQMGY

SEQ ID NO: 229756 - protein, 9 aa, Homo Sapiens
LSLPETALK

SEQ ID NO: 229757 - protein, 9 aa, Homo Sapiens
HEEHWGAAE

SEQ ID NO: 229758 - protein, 9 aa, Homo Sapiens
PWAGGGIQR

SEQ ID NO: 229759 - protein, 9 aa, Homo Sapiens
AAGTWRGRR

SEQ ID NO: 229760 - protein, 9 aa, Homo Sapiens
SSGSIKRSC

SEQ ID NO: 229761 - protein, 9 aa, Homo Sapiens
IPCLGLKKH

SEQ ID NO: 229762 - protein, 9 aa, Homo Sapiens
TRCRRPRCS

SEQ ID NO: 229763 - protein, 9 aa, Homo Sapiens
NEEDAVNDV

SEQ ID NO: 229764 - protein, 9 aa, Homo Sapiens
CTGEHYYSC

SEQ ID NO: 229765 - protein, 9 aa, Homo Sapiens
NSVKAKFSG

SEQ ID NO: 229766 - protein, 9 aa, Homo Sapiens
WSSALCVRP

SEQ ID NO: 229767 - protein, 9 aa, Homo Sapiens
PLKKVWNLQ

SEQ ID NO: 229768 - protein, 9 aa, Homo Sapiens
VQFDLVSRG

SEQ ID NO: 229769 - protein, 9 aa, Homo Sapiens
AAPLLLPRR

SEQ ID NO: 229770 - protein, 9 aa, Homo Sapiens
DLEQMVTKL

SEQ ID NO: 229771 - protein, 9 aa, Homo Sapiens
MMLYKKKAH

SEQ ID NO: 229772 - protein, 9 aa, Homo Sapiens
YASLHHTLK

SEQ ID NO: 229773 - protein, 9 aa, Homo Sapiens
KIDVRQEYP

SEQ ID NO: 229774 - protein, 9 aa, Homo Sapiens
CCRPAVLLL

SEQ ID NO: 229775 - protein, 9 aa, Homo Sapiens
MDLWVPVRQ

SEQ ID NO: 229776 - protein, 9 aa, Homo Sapiens
GPGPPTRAG

SEQ ID NO: 229777 - protein, 9 aa, Homo Sapiens
LVAATAVAS

SEQ ID NO: 229778 - protein, 9 aa, Homo Sapiens
TMEDSESVQ

SEQ ID NO: 229779 - protein, 9 aa, Homo Sapiens
PWYIHALCT

SEQ ID NO: 229780 - protein, 9 aa, Homo Sapiens
HVQMGQAEN

SEQ ID NO: 229781 - protein, 9 aa, Homo Sapiens
VVVDFSLGG

SEQ ID NO: 229782 - protein, 9 aa, Homo Sapiens
PMEFPAPRG

SEQ ID NO: 229783 - protein, 9 aa, Homo Sapiens
YWKGGERRR

SEQ ID NO: 229784 - protein, 9 aa, Homo Sapiens
MGPWHLCMG

SEQ ID NO: 229785 - protein, 9 aa, Homo Sapiens
LVSVIFLSV

SEQ ID NO: 229786 - protein, 9 aa, Homo Sapiens
ECKQNFWEN

SEQ ID NO: 229787 - protein, 9 aa, Homo Sapiens
PAPWWSQPP

SEQ ID NO: 229788 - protein, 9 aa, Homo Sapiens
TRAPCTSVT

SEQ ID NO: 229789 - protein, 9 aa, Homo Sapiens
DIVDFLQRL

SEQ ID NO: 229790 - protein, 9 aa, Homo Sapiens
SSLTSQLMT

SEQ ID NO: 229791 - protein, 9 aa, Homo Sapiens
NMESVFDCS

SEQ ID NO: 229792 - protein, 9 aa, Homo Sapiens
DATRQALSE

SEQ ID NO: 229793 - protein, 9 aa, Homo Sapiens
HVFLDGVGV

SEQ ID NO: 229794 - protein, 9 aa, Homo Sapiens
FGLAGLLPV

SEQ ID NO: 229795 - protein, 9 aa, Homo Sapiens
DPAGGGCLQ

SEQ ID NO: 229796 - protein, 9 aa, Homo Sapiens
GPAGRVPGQ

SEQ ID NO: 229797 - protein, 9 aa, Homo Sapiens
NLSPGVVTD

SEQ ID NO: 229798 - protein, 9 aa, Homo Sapiens
HRRRGAPGG

SEQ ID NO: 229799 - protein, 9 aa, Homo Sapiens
IREKGGEQA

SEQ ID NO: 229800 - protein, 9 aa, Homo Sapiens
ALEKGRLHE

SEQ ID NO: 229801 - protein, 9 aa, Homo Sapiens
YKCQLCYCE

SEQ ID NO: 229802 - protein, 9 aa, Homo Sapiens
NDLQVADEQ

SEQ ID NO: 229803 - protein, 9 aa, Homo Sapiens
FYQDKNLHG

SEQ ID NO: 229804 - protein, 9 aa, Homo Sapiens
PWVSVAMQF

SEQ ID NO: 229805 - protein, 9 aa, Homo Sapiens
CFWSIPLVP

SEQ ID NO: 229806 - protein, 9 aa, Homo Sapiens
SCCTPTCAP

SEQ ID NO: 229807 - protein, 9 aa, Homo Sapiens
IIAPSRGSR

SEQ ID NO: 229808 - protein, 9 aa, Homo Sapiens
YIVLDYFLF

SEQ ID NO: 229809 - protein, 9 aa, Homo Sapiens
PLPPPPSWN

SEQ ID NO: 229810 - protein, 9 aa, Homo Sapiens
KALIVIRYL

SEQ ID NO: 229811 - protein, 9 aa, Homo Sapiens
VPVRQSTSQ

SEQ ID NO: 229812 - protein, 9 aa, Homo Sapiens
GSSGICFQE

SEQ ID NO: 229813 - protein, 9 aa, Homo Sapiens
MEKLCHYSQ

SEQ ID NO: 229814 - protein, 9 aa, Homo Sapiens
GNKSHPPEA

SEQ ID NO: 229815 - protein, 9 aa, Homo Sapiens
PGVHGLVVL

SEQ ID NO: 229816 - protein, 9 aa, Homo Sapiens
RRPGPPQAP

SEQ ID NO: 229817 - protein, 9 aa, Homo Sapiens
SPSTKWWPS

SEQ ID NO: 229818 - protein, 9 aa, Homo Sapiens
RGSCTGRAP

SEQ ID NO: 229819 - protein, 9 aa, Homo Sapiens
SWSPNSVQK

SEQ ID NO: 229820 - protein, 9 aa, Homo Sapiens
CTSCFCMAG

SEQ ID NO: 229821 - protein, 9 aa, Homo Sapiens
PYAEVKPIS

SEQ ID NO: 229822 - protein, 9 aa, Homo Sapiens
GNQRRKYRL

SEQ ID NO: 229823 - protein, 9 aa, Homo Sapiens
PRSRAPRRR

SEQ ID NO: 229824 - protein, 9 aa, Homo Sapiens
YRPTSQGER

SEQ ID NO: 229825 - protein, 9 aa, Homo Sapiens
SPHSWSWPM

SEQ ID NO: 229826 - protein, 9 aa, Homo Sapiens
EELNSPGRG

SEQ ID NO: 229827 - protein, 9 aa, Homo Sapiens
IYMLTHKSF

SEQ ID NO: 229828 - protein, 9 aa, Homo Sapiens
FYTARLAPG

SEQ ID NO: 229829 - protein, 9 aa, Homo Sapiens
DGSLKSNIL

SEQ ID NO: 229830 - protein, 9 aa, Homo Sapiens
IKTKHTIQF

SEQ ID NO: 229831 - protein, 9 aa, Homo Sapiens
GGQTSHWCP

SEQ ID NO: 229832 - protein, 9 aa, Homo Sapiens
KEYAQRIPT

SEQ ID NO: 229833 - protein, 9 aa, Homo Sapiens
SLRFHLDAH

SEQ ID NO: 229834 - protein, 9 aa, Homo Sapiens
ISKELRPVM

SEQ ID NO: 229835 - protein, 9 aa, Homo Sapiens
SCWRPLAQR

SEQ ID NO: 229836 - protein, 9 aa, Homo Sapiens
TAKGPPPPE

SEQ ID NO: 229837 - protein, 9 aa, Homo Sapiens
ITEGPYVPR

SEQ ID NO: 229838 - protein, 9 aa, Homo Sapiens
PGPPTQLMD

SEQ ID NO: 229839 - protein, 9 aa, Homo Sapiens
ERNLRPLSL

SEQ ID NO: 229840 - protein, 9 aa, Homo Sapiens
TQNSVTAPS

SEQ ID NO: 229841 - protein, 9 aa, Homo Sapiens
ESNKGNEHP

SEQ ID NO: 229842 - protein, 9 aa, Homo Sapiens
PAGGSTQNN

SEQ ID NO: 229843 - protein, 9 aa, Homo Sapiens
KQVQLEWDE

SEQ ID NO: 229844 - protein, 9 aa, Homo Sapiens
KIIKKKRSV

SEQ ID NO: 229845 - protein, 9 aa, Homo Sapiens
WRVAAAGTW

SEQ ID NO: 229846 - protein, 9 aa, Homo Sapiens
LIVIRYLSK

SEQ ID NO: 229847 - protein, 9 aa, Homo Sapiens
HICDASQGL

SEQ ID NO: 229848 - protein, 9 aa, Homo Sapiens
EGHGSHHQG

SEQ ID NO: 229849 - protein, 9 aa, Homo Sapiens
RVTSVSSVK

SEQ ID NO: 229850 - protein, 9 aa, Homo Sapiens
AADQSFTIQ

SEQ ID NO: 229851 - protein, 9 aa, Homo Sapiens
ANLNTLDRY

SEQ ID NO: 229852 - protein, 9 aa, Homo Sapiens
FHIKSPKRP

SEQ ID NO: 229853 - protein, 9 aa, Homo Sapiens
GRLHEWVKR

SEQ ID NO: 229854 - protein, 9 aa, Homo Sapiens
EKDRQIGKI

SEQ ID NO: 229855 - protein, 9 aa, Homo Sapiens
HEALLEAVD

SEQ ID NO: 229856 - protein, 9 aa, Homo Sapiens
EQVSSLGDD

SEQ ID NO: 229857 - protein, 9 aa, Homo Sapiens
AYVKYNGSC

SEQ ID NO: 229858 - protein, 9 aa, Homo Sapiens
YQDKNLHGF

SEQ ID NO: 229859 - protein, 9 aa, Homo Sapiens
EAYYQTLNL

SEQ ID NO: 229860 - protein, 9 aa, Homo Sapiens
VQGLIDELT

SEQ ID NO: 229861 - protein, 9 aa, Homo Sapiens
FQRTTCHSI

SEQ ID NO: 229862 - protein, 9 aa, Homo Sapiens
LLHNGKLFN

SEQ ID NO: 229863 - protein, 9 aa, Homo Sapiens
LQGRPELSF

SEQ ID NO: 229864 - protein, 9 aa, Homo Sapiens
LYLMQKHTS

SEQ ID NO: 229865 - protein, 9 aa, Homo Sapiens
NPAHARARA

SEQ ID NO: 229866 - protein, 9 aa, Homo Sapiens
RAKQRAEGM

SEQ ID NO: 229867 - protein, 9 aa, Homo Sapiens
FPINPNTLK

SEQ ID NO: 229868 - protein, 9 aa, Homo Sapiens
DKKNGIWEV

SEQ ID NO: 229869 - protein, 9 aa, Homo Sapiens
CPVSTRSLL

SEQ ID NO: 229870 - protein, 9 aa, Homo Sapiens
VTSWTVDAS

SEQ ID NO: 229871 - protein, 9 aa, Homo Sapiens
IGDFGLATE

SEQ ID NO: 229872 - protein, 9 aa, Homo Sapiens
DLSLHPDGT

SEQ ID NO: 229873 - protein, 9 aa, Homo Sapiens
VTDAQVSNG

SEQ ID NO: 229874 - protein, 9 aa, Homo Sapiens
RCIQPLLDG

SEQ ID NO: 229875 - protein, 9 aa, Homo Sapiens
PRPLPPPPS

SEQ ID NO: 229876 - protein, 9 aa, Homo Sapiens
YTHRQCCCD

SEQ ID NO: 229877 - protein, 9 aa, Homo Sapiens
ESEREKSVR

SEQ ID NO: 229878 - protein, 9 aa, Homo Sapiens
SRLDTEELW

SEQ ID NO: 229879 - protein, 9 aa, Homo Sapiens
LQNVGHKSG

SEQ ID NO: 229880 - protein, 9 aa, Homo Sapiens
PRKAPHCTN

SEQ ID NO: 229881 - protein, 9 aa, Homo Sapiens
YLFRWAHFQ

SEQ ID NO: 229882 - protein, 9 aa, Homo Sapiens
FFFLLLEKS

SEQ ID NO: 229883 - protein, 9 aa, Homo Sapiens
SALALPHLP

SEQ ID NO: 229884 - protein, 9 aa, Homo Sapiens
SVMSSPSWR

SEQ ID NO: 229885 - protein, 9 aa, Homo Sapiens
SQAQMYLWP

SEQ ID NO: 229886 - protein, 9 aa, Homo Sapiens
HPRILQASV

SEQ ID NO: 229887 - protein, 9 aa, Homo Sapiens
SEEEATRGC

SEQ ID NO: 229888 - protein, 9 aa, Homo Sapiens
NENTFLWFT

SEQ ID NO: 229889 - protein, 9 aa, Homo Sapiens
TRWYRVPEV

SEQ ID NO: 229890 - protein, 9 aa, Homo Sapiens
SCTGRAPNC

SEQ ID NO: 229891 - protein, 9 aa, Homo Sapiens
TPWRKSGSG

SEQ ID NO: 229892 - protein, 9 aa, Homo Sapiens
TALAHRAAT

SEQ ID NO: 229893 - protein, 9 aa, Homo Sapiens
FWMRRLEER

SEQ ID NO: 229894 - protein, 9 aa, Homo Sapiens
KQHNCQSYG

SEQ ID NO: 229895 - protein, 9 aa, Homo Sapiens
QSQGLGQPW

SEQ ID NO: 229896 - protein, 9 aa, Homo Sapiens
PVSYTAPIM

SEQ ID NO: 229897 - protein, 9 aa, Homo Sapiens
PSPPLPQAQ

SEQ ID NO: 229898 - protein, 9 aa, Homo Sapiens
THNCYHEGK

SEQ ID NO: 229899 - protein, 9 aa, Homo Sapiens
TCWLLCGTE

SEQ ID NO: 229900 - protein, 9 aa, Homo Sapiens
ALKKRRIQS

SEQ ID NO: 229901 - protein, 9 aa, Homo Sapiens
TMDTAGMIL

SEQ ID NO: 229902 - protein, 9 aa, Homo Sapiens
PQGPCPPPV

SEQ ID NO: 229903 - protein, 9 aa, Homo Sapiens
PPQSPCRLR

SEQ ID NO: 229904 - protein, 9 aa, Homo Sapiens
LAGMGTQQA

SEQ ID NO: 229905 - protein, 9 aa, Homo Sapiens
YRTQDGTTQ

SEQ ID NO: 229906 - protein, 9 aa, Homo Sapiens
SWNYRQPVD

SEQ ID NO: 229907 - protein, 9 aa, Homo Sapiens
ADEGVADEE

SEQ ID NO: 229908 - protein, 9 aa, Homo Sapiens
HALVTIGGI

SEQ ID NO: 229909 - protein, 9 aa, Homo Sapiens
PDIEIWERI

SEQ ID NO: 229910 - protein, 9 aa, Homo Sapiens
QDFFFELDV

SEQ ID NO: 229911 - protein, 9 aa, Homo Sapiens
ASPSTLSSS

SEQ ID NO: 229912 - protein, 9 aa, Homo Sapiens
SGSTASRAS

SEQ ID NO: 229913 - protein, 9 aa, Homo Sapiens
KDRGWWISN

SEQ ID NO: 229914 - protein, 9 aa, Homo Sapiens
PAVLEKENT

SEQ ID NO: 229915 - protein, 9 aa, Homo Sapiens
QWPPCAATD

SEQ ID NO: 229916 - protein, 9 aa, Homo Sapiens
GGSRGAETV

SEQ ID NO: 229917 - protein, 9 aa, Homo Sapiens
RAAGPVSCR

SEQ ID NO: 229918 - protein, 9 aa, Homo Sapiens
HPFLLLDTT

SEQ ID NO: 229919 - protein, 9 aa, Homo Sapiens
ILKSCTQRK

SEQ ID NO: 229920 - protein, 9 aa, Homo Sapiens
LAFQQACYN

SEQ ID NO: 229921 - protein, 9 aa, Homo Sapiens
EALSDSLQL

SEQ ID NO: 229922 - protein, 9 aa, Homo Sapiens
HHILRHEVL

SEQ ID NO: 229923 - protein, 9 aa, Homo Sapiens
ACIAAAITV

SEQ ID NO: 229924 - protein, 9 aa, Homo Sapiens
DGQPDEQGL

SEQ ID NO: 229925 - protein, 9 aa, Homo Sapiens
WDYRGLPLH

SEQ ID NO: 229926 - protein, 9 aa, Homo Sapiens
RGVLQWDRK

SEQ ID NO: 229927 - protein, 9 aa, Homo Sapiens
LKYQGLCPQ

SEQ ID NO: 229928 - protein, 9 aa, Homo Sapiens
ASKQVCNDV

SEQ ID NO: 229929 - protein, 9 aa, Homo Sapiens
HSLSELEHL

SEQ ID NO: 229930 - protein, 9 aa, Homo Sapiens
VLRLLRALC

SEQ ID NO: 229931 - protein, 9 aa, Homo Sapiens
EDSESISEE

SEQ ID NO: 229932 - protein, 9 aa, Homo Sapiens
QQEIKDWSK

SEQ ID NO: 229933 - protein, 9 aa, Homo Sapiens
VSVDRCALD

SEQ ID NO: 229934 - protein, 9 aa, Homo Sapiens
VCSLKPKRV

SEQ ID NO: 229935 - protein, 9 aa, Homo Sapiens
TPAPWAGHL

SEQ ID NO: 229936 - protein, 9 aa, Homo Sapiens
QLEDLGKML

SEQ ID NO: 229937 - protein, 9 aa, Homo Sapiens
GIGFTLCRR

SEQ ID NO: 229938 - protein, 9 aa, Homo Sapiens
KVDRERARQ

SEQ ID NO: 229939 - protein, 9 aa, Homo Sapiens
PAGSALGGG

SEQ ID NO: 229940 - protein, 9 aa, Homo Sapiens
IFTTVRQLV

SEQ ID NO: 229941 - protein, 9 aa, Homo Sapiens
PNLLPAPSA

SEQ ID NO: 229942 - protein, 9 aa, Homo Sapiens
RQPVRPSYR

SEQ ID NO: 229943 - protein, 9 aa, Homo Sapiens
FLLLEKSFL

SEQ ID NO: 229944 - protein, 9 aa, Homo Sapiens
SHHSRSGSI

SEQ ID NO: 229945 - protein, 9 aa, Homo Sapiens
LQETQEHLE

SEQ ID NO: 229946 - protein, 9 aa, Homo Sapiens
WGQRDVSVV

SEQ ID NO: 229947 - protein, 9 aa, Homo Sapiens
PRATLQLRF

SEQ ID NO: 229948 - protein, 9 aa, Homo Sapiens
LEKSFLFFI

SEQ ID NO: 229949 - protein, 9 aa, Homo Sapiens
GIPLDIPVD

SEQ ID NO: 229950 - protein, 9 aa, Homo Sapiens
FTNCEDDIT

SEQ ID NO: 229951 - protein, 9 aa, Homo Sapiens
HTLAGQTSP

SEQ ID NO: 229952 - protein, 9 aa, Homo Sapiens
AKCFENKIG

SEQ ID NO: 229953 - protein, 9 aa, Homo Sapiens
VADEQYQRL

SEQ ID NO: 229954 - protein, 9 aa, Homo Sapiens
NEDQEVCML

SEQ ID NO: 229955 - protein, 9 aa, Homo Sapiens
WLRLRLTKL

SEQ ID NO: 229956 - protein, 9 aa, Homo Sapiens
PVGGQTSHW

SEQ ID NO: 229957 - protein, 9 aa, Homo Sapiens
RLVGCPVSA

SEQ ID NO: 229958 - protein, 9 aa, Homo Sapiens
TNRPRSQHL

SEQ ID NO: 229959 - protein, 9 aa, Homo Sapiens
ITKIHQSVV

SEQ ID NO: 229960 - protein, 9 aa, Homo Sapiens
FWTLTGRAL

SEQ ID NO: 229961 - protein, 9 aa, Homo Sapiens
ARAPRSWPR

SEQ ID NO: 229962 - protein, 9 aa, Homo Sapiens
VLLGERGLV

SEQ ID NO: 229963 - protein, 9 aa, Homo Sapiens
PAPRRPRCS

SEQ ID NO: 229964 - protein, 9 aa, Homo Sapiens
LLGSPMCSE

SEQ ID NO: 229965 - protein, 9 aa, Homo Sapiens
LEVFRAHII

SEQ ID NO: 229966 - protein, 9 aa, Homo Sapiens
VVAAMEETE

SEQ ID NO: 229967 - protein, 9 aa, Homo Sapiens
VKAFSSSSH

SEQ ID NO: 229968 - protein, 9 aa, Homo Sapiens
KMYEEFLNK

SEQ ID NO: 229969 - protein, 9 aa, Homo Sapiens
SDADSWGSG

SEQ ID NO: 229970 - protein, 9 aa, Homo Sapiens
PQRTVLWLL

SEQ ID NO: 229971 - protein, 9 aa, Homo Sapiens
YRSYCSTRQ

SEQ ID NO: 229972 - protein, 9 aa, Homo Sapiens
QSQNLNCIA

SEQ ID NO: 229973 - protein, 9 aa, Homo Sapiens
FLIFSHMLA

SEQ ID NO: 229974 - protein, 9 aa, Homo Sapiens
ILTLMYILE

SEQ ID NO: 229975 - protein, 9 aa, Homo Sapiens
LSAPTAPAS

SEQ ID NO: 229976 - protein, 9 aa, Homo Sapiens
PWHSNSPCP

SEQ ID NO: 229977 - protein, 9 aa, Homo Sapiens
KMYHPRAFI

SEQ ID NO: 229978 - protein, 9 aa, Homo Sapiens
KHVKFWTLT

SEQ ID NO: 229979 - protein, 9 aa, Homo Sapiens
IEMVGDMTM

SEQ ID NO: 229980 - protein, 9 aa, Homo Sapiens
ASHEEHWGA

SEQ ID NO: 229981 - protein, 9 aa, Homo Sapiens
LRIVCFTKI

SEQ ID NO: 229982 - protein, 9 aa, Homo Sapiens
APPAALVSW

SEQ ID NO: 229983 - protein, 9 aa, Homo Sapiens
AISQTIIRL

SEQ ID NO: 229984 - protein, 9 aa, Homo Sapiens
QKMLDYLKN

SEQ ID NO: 229985 - protein, 9 aa, Homo Sapiens
ALHLDDLSG

SEQ ID NO: 229986 - protein, 9 aa, Homo Sapiens
GGPWATGPS

SEQ ID NO: 229987 - protein, 9 aa, Homo Sapiens
FHLLLSHKS

SEQ ID NO: 229988 - protein, 9 aa, Homo Sapiens
ILDWLLRFT

SEQ ID NO: 229989 - protein, 9 aa, Homo Sapiens
RNGMRFQLA

SEQ ID NO: 229990 - protein, 9 aa, Homo Sapiens
PDGCYQYNT

SEQ ID NO: 229991 - protein, 9 aa, Homo Sapiens
PPFVELLLN

SEQ ID NO: 229992 - protein, 9 aa, Homo Sapiens
LYTLMSDCW

SEQ ID NO: 229993 - protein, 9 aa, Homo Sapiens
PVRPSYRQG

SEQ ID NO: 229994 - protein, 9 aa, Homo Sapiens
WQGLGAQQA

SEQ ID NO: 229995 - protein, 9 aa, Homo Sapiens
RCCLPCLLF

SEQ ID NO: 229996 - protein, 9 aa, Homo Sapiens
SRLPEWGEQ

SEQ ID NO: 229997 - protein, 9 aa, Homo Sapiens
SGLVTSHSF

SEQ ID NO: 229998 - protein, 9 aa, Homo Sapiens
VKGDVFVVN

SEQ ID NO: 229999 - protein, 9 aa, Homo Sapiens
VSHGHPLAL

SEQ ID NO: 230000 - protein, 9 aa, Homo Sapiens
ALRARRSRV

SEQ ID NO: 230001 - protein, 9 aa, Homo Sapiens
PCGPWTRNP

SEQ ID NO: 230002 - protein, 9 aa, Homo Sapiens
PKFLSLSAD

SEQ ID NO: 230003 - protein, 9 aa, Homo Sapiens
VTLDGPADP

SEQ ID NO: 230004 - protein, 9 aa, Homo Sapiens
YIGPLTITH

SEQ ID NO: 230005 - protein, 9 aa, Homo Sapiens
RASQPSSSV

SEQ ID NO: 230006 - protein, 9 aa, Homo Sapiens
EETEVAMEA

SEQ ID NO: 230007 - protein, 9 aa, Homo Sapiens
VFWNHSLAI

SEQ ID NO: 230008 - protein, 9 aa, Homo Sapiens
HRDSAGPAS

SEQ ID NO: 230009 - protein, 9 aa, Homo Sapiens
VTSVSSVKL

SEQ ID NO: 230010 - protein, 9 aa, Homo Sapiens
NFYCDIPPC

SEQ ID NO: 230011 - protein, 9 aa, Homo Sapiens
GHEGPGGSV

SEQ ID NO: 230012 - protein, 9 aa, Homo Sapiens
TQDGWVAIY

SEQ ID NO: 230013 - protein, 9 aa, Homo Sapiens
SGYSTLTRS

SEQ ID NO: 230014 - protein, 9 aa, Homo Sapiens
VRFLEQQTA

SEQ ID NO: 230015 - protein, 9 aa, Homo Sapiens
RRGPPFPHL

SEQ ID NO: 230016 - protein, 9 aa, Homo Sapiens
GAQTGCMSI

SEQ ID NO: 230017 - protein, 9 aa, Homo Sapiens
SSLPRSPPR

SEQ ID NO: 230018 - protein, 9 aa, Homo Sapiens
VFLRCIANS

SEQ ID NO: 230019 - protein, 9 aa, Homo Sapiens
TVAGYDMVA

SEQ ID NO: 230020 - protein, 9 aa, Homo Sapiens
LRPLHSHLS

SEQ ID NO: 230021 - protein, 9 aa, Homo Sapiens
SVLLQDTHF

SEQ ID NO: 230022 - protein, 9 aa, Homo Sapiens
VKLPEVKLP

SEQ ID NO: 230023 - protein, 9 aa, Homo Sapiens
AQRKSQSWC

SEQ ID NO: 230024 - protein, 9 aa, Homo Sapiens
RTSAGCASS

SEQ ID NO: 230025 - protein, 9 aa, Homo Sapiens
LCPAEDERR

SEQ ID NO: 230026 - protein, 9 aa, Homo Sapiens
VDMVFSRKY

SEQ ID NO: 230027 - protein, 9 aa, Homo Sapiens
TPTATWMGS

SEQ ID NO: 230028 - protein, 9 aa, Homo Sapiens
AHSPTPTSA

SEQ ID NO: 230029 - protein, 9 aa, Homo Sapiens
SQPPPTRPR

SEQ ID NO: 230030 - protein, 9 aa, Homo Sapiens
FNRGKWVNL

SEQ ID NO: 230031 - protein, 9 aa, Homo Sapiens
DNHPKGREE

SEQ ID NO: 230032 - protein, 9 aa, Homo Sapiens
IYRKSGTHQ

SEQ ID NO: 230033 - protein, 9 aa, Homo Sapiens
VEGSPGSRR

SEQ ID NO: 230034 - protein, 9 aa, Homo Sapiens
SLSLASTSK

SEQ ID NO: 230035 - protein, 9 aa, Homo Sapiens
TLARKAVAR

SEQ ID NO: 230036 - protein, 9 aa, Homo Sapiens
KELHQARRD

SEQ ID NO: 230037 - protein, 9 aa, Homo Sapiens
EVEAMEETG

SEQ ID NO: 230038 - protein, 9 aa, Homo Sapiens
IAQELTDRV

SEQ ID NO: 230039 - protein, 9 aa, Homo Sapiens
RRSRPGFSP

SEQ ID NO: 230040 - protein, 9 aa, Homo Sapiens
WLKCQDSKQ

SEQ ID NO: 230041 - protein, 9 aa, Homo Sapiens
GILRKQHLL

SEQ ID NO: 230042 - protein, 9 aa, Homo Sapiens
STYKENGPF

SEQ ID NO: 230043 - protein, 9 aa, Homo Sapiens
TPTLPKKLT

SEQ ID NO: 230044 - protein, 9 aa, Homo Sapiens
ALSVPLSCP

SEQ ID NO: 230045 - protein, 9 aa, Homo Sapiens
LCSTMWSAS

SEQ ID NO: 230046 - protein, 9 aa, Homo Sapiens
APGMPRPHG

SEQ ID NO: 230047 - protein, 9 aa, Homo Sapiens
KEREDWGIG

SEQ ID NO: 230048 - protein, 9 aa, Homo Sapiens
AWPSRRAQR

SEQ ID NO: 230049 - protein, 9 aa, Homo Sapiens
MAAPKNRHT

SEQ ID NO: 230050 - protein, 9 aa, Homo Sapiens
LRLECPIST

SEQ ID NO: 230051 - protein, 9 aa, Homo Sapiens
PPLPQAQVE

SEQ ID NO: 230052 - protein, 9 aa, Homo Sapiens
SVYPGYDVE

SEQ ID NO: 230053 - protein, 9 aa, Homo Sapiens
EEAAASRLP

SEQ ID NO: 230054 - protein, 9 aa, Homo Sapiens
WWPSTSMRA

SEQ ID NO: 230055 - protein, 9 aa, Homo Sapiens
GWTNRPRSQ

SEQ ID NO: 230056 - protein, 9 aa, Homo Sapiens
FSNAMCKLL

SEQ ID NO: 230057 - protein, 9 aa, Homo Sapiens
AGTWRGRRR

SEQ ID NO: 230058 - protein, 9 aa, Homo Sapiens
LRLECPISA

SEQ ID NO: 230059 - protein, 9 aa, Homo Sapiens
DPFYTNDRN

SEQ ID NO: 230060 - protein, 9 aa, Homo Sapiens
TQLINPLQQ

SEQ ID NO: 230061 - protein, 9 aa, Homo Sapiens
LCFLSALNL

SEQ ID NO: 230062 - protein, 9 aa, Homo Sapiens
RCVPSRWQC

SEQ ID NO: 230063 - protein, 9 aa, Homo Sapiens
GIQRNLSAS

SEQ ID NO: 230064 - protein, 9 aa, Homo Sapiens
KMNAKKAAA

SEQ ID NO: 230065 - protein, 9 aa, Homo Sapiens
KSNILKSAR

SEQ ID NO: 230066 - protein, 9 aa, Homo Sapiens
AYEAAGSAL

SEQ ID NO: 230067 - protein, 9 aa, Homo Sapiens
FGYLSGDWA

SEQ ID NO: 230068 - protein, 9 aa, Homo Sapiens
QHEVAGAVQ

SEQ ID NO: 230069 - protein, 9 aa, Homo Sapiens
PTPPPGPQP

SEQ ID NO: 230070 - protein, 9 aa, Homo Sapiens
QRTVLWLLT

SEQ ID NO: 230071 - protein, 9 aa, Homo Sapiens
RDTRHSTRP

SEQ ID NO: 230072 - protein, 9 aa, Homo Sapiens
SRVPRCRTP

SEQ ID NO: 230073 - protein, 9 aa, Homo Sapiens
EQRTDIFGV

SEQ ID NO: 230074 - protein, 9 aa, Homo Sapiens
NHGSSSNPL

SEQ ID NO: 230075 - protein, 9 aa, Homo Sapiens
VGTCIVNSE

SEQ ID NO: 230076 - protein, 9 aa, Homo Sapiens
TRRQISHTS

SEQ ID NO: 230077 - protein, 9 aa, Homo Sapiens
GFPVSAQSL

SEQ ID NO: 230078 - protein, 9 aa, Homo Sapiens
LQDLHSHFS

SEQ ID NO: 230079 - protein, 9 aa, Homo Sapiens
SLTTDWRKS

SEQ ID NO: 230080 - protein, 9 aa, Homo Sapiens
TFLKNLKAV

SEQ ID NO: 230081 - protein, 9 aa, Homo Sapiens
QKKGRRSIS

SEQ ID NO: 230082 - protein, 9 aa, Homo Sapiens
GCQGYCSFK

SEQ ID NO: 230083 - protein, 9 aa, Homo Sapiens
YVVTRWYRV

SEQ ID NO: 230084 - protein, 9 aa, Homo Sapiens
EIRYRVVAL

SEQ ID NO: 230085 - protein, 9 aa, Homo Sapiens
SAPRGPGMP

SEQ ID NO: 230086 - protein, 9 aa, Homo Sapiens
PHVPEHRCL

SEQ ID NO: 230087 - protein, 9 aa, Homo Sapiens
TLSPLKEVH

SEQ ID NO: 230088 - protein, 9 aa, Homo Sapiens
MADYDLKSA

SEQ ID NO: 230089 - protein, 9 aa, Homo Sapiens
RAVAPSTHT

SEQ ID NO: 230090 - protein, 9 aa, Homo Sapiens
KLALKEDLL

SEQ ID NO: 230091 - protein, 9 aa, Homo Sapiens
SLSLQQWKR

SEQ ID NO: 230092 - protein, 9 aa, Homo Sapiens
IFQKYLAPS

SEQ ID NO: 230093 - protein, 9 aa, Homo Sapiens
DADGFFIQS

SEQ ID NO: 230094 - protein, 9 aa, Homo Sapiens
CQELQRVHL

SEQ ID NO: 230095 - protein, 9 aa, Homo Sapiens
IQTQGSSHE

SEQ ID NO: 230096 - protein, 9 aa, Homo Sapiens
QQSLSLQQW

SEQ ID NO: 230097 - protein, 9 aa, Homo Sapiens
GGCRDHCNV

SEQ ID NO: 230098 - protein, 9 aa, Homo Sapiens
TVDVEPCIN

SEQ ID NO: 230099 - protein, 9 aa, Homo Sapiens
GRPAGAAPV

SEQ ID NO: 230100 - protein, 9 aa, Homo Sapiens
PGIDRRSLA

SEQ ID NO: 230101 - protein, 9 aa, Homo Sapiens
VCNDVDECN

SEQ ID NO: 230102 - protein, 9 aa, Homo Sapiens
SGKVCHGAL

SEQ ID NO: 230103 - protein, 9 aa, Homo Sapiens
PRRGRLPAC

SEQ ID NO: 230104 - protein, 9 aa, Homo Sapiens
QGVEEIRQA

SEQ ID NO: 230105 - protein, 9 aa, Homo Sapiens
TSWTEKKQC

SEQ ID NO: 230106 - protein, 9 aa, Homo Sapiens
CPVSARSLP

SEQ ID NO: 230107 - protein, 9 aa, Homo Sapiens
AMALEQEIP

SEQ ID NO: 230108 - protein, 9 aa, Homo Sapiens
LFFINALIL

SEQ ID NO: 230109 - protein, 9 aa, Homo Sapiens
ALGGGAPRA

SEQ ID NO: 230110 - protein, 9 aa, Homo Sapiens
ISQNMIPQM

SEQ ID NO: 230111 - protein, 9 aa, Homo Sapiens
APGVFRVAS

SEQ ID NO: 230112 - protein, 9 aa, Homo Sapiens
IHSIPCLGL

SEQ ID NO: 230113 - protein, 9 aa, Homo Sapiens
KNLGKVFLP

SEQ ID NO: 230114 - protein, 9 aa, Homo Sapiens
SKLNVEVAC

SEQ ID NO: 230115 - protein, 9 aa, Homo Sapiens
RLSEAGRYA

SEQ ID NO: 230116 - protein, 9 aa, Homo Sapiens
QGQVHVFLD

SEQ ID NO: 230117 - protein, 9 aa, Homo Sapiens
ERARQGTGS

SEQ ID NO: 230118 - protein, 9 aa, Homo Sapiens
WSAVPPHVK

SEQ ID NO: 230119 - protein, 9 aa, Homo Sapiens
LATEKSRWS

SEQ ID NO: 230120 - protein, 9 aa, Homo Sapiens
KMIGAFKHY

SEQ ID NO: 230121 - protein, 9 aa, Homo Sapiens
SRKVADGLI

SEQ ID NO: 230122 - protein, 9 aa, Homo Sapiens
HNTLEFTLE

SEQ ID NO: 230123 - protein, 9 aa, Homo Sapiens
CVTRGASTC

SEQ ID NO: 230124 - protein, 9 aa, Homo Sapiens
SRNPEEGGG

SEQ ID NO: 230125 - protein, 9 aa, Homo Sapiens
ETPEEKCAR

SEQ ID NO: 230126 - protein, 9 aa, Homo Sapiens
ILAVESQKP

SEQ ID NO: 230127 - protein, 9 aa, Homo Sapiens
AMMAITIMK

SEQ ID NO: 230128 - protein, 9 aa, Homo Sapiens
FAPDCYIHN

SEQ ID NO: 230129 - protein, 9 aa, Homo Sapiens
APAAAPPPA

SEQ ID NO: 230130 - protein, 9 aa, Homo Sapiens
VCGVAYRLP

SEQ ID NO: 230131 - protein, 9 aa, Homo Sapiens
PWPSCKART

SEQ ID NO: 230132 - protein, 9 aa, Homo Sapiens
PYVKTWMQG

SEQ ID NO: 230133 - protein, 9 aa, Homo Sapiens
SRCQRAIPS

SEQ ID NO: 230134 - protein, 9 aa, Homo Sapiens
RRWQQQRMP

SEQ ID NO: 230135 - protein, 9 aa, Homo Sapiens
GRSRPTRGS

SEQ ID NO: 230136 - protein, 9 aa, Homo Sapiens
TLWIEGANN

SEQ ID NO: 230137 - protein, 9 aa, Homo Sapiens
NVEVACVAV

SEQ ID NO: 230138 - protein, 9 aa, Homo Sapiens
AAFQVVQTM

SEQ ID NO: 230139 - protein, 9 aa, Homo Sapiens
SLYSPADPR

SEQ ID NO: 230140 - protein, 9 aa, Homo Sapiens
AEVDVIAKA

SEQ ID NO: 230141 - protein, 9 aa, Homo Sapiens
PLPPCSLPT

SEQ ID NO: 230142 - protein, 9 aa, Homo Sapiens
LTDEKSLLE

SEQ ID NO: 230143 - protein, 9 aa, Homo Sapiens
GAEKEPIFQ

SEQ ID NO: 230144 - protein, 9 aa, Homo Sapiens
SRWDSPRKN

SEQ ID NO: 230145 - protein, 9 aa, Homo Sapiens
PRALRARRS

SEQ ID NO: 230146 - protein, 9 aa, Homo Sapiens
RDRQMPSFG

SEQ ID NO: 230147 - protein, 9 aa, Homo Sapiens
RQPPGCSWR

SEQ ID NO: 230148 - protein, 9 aa, Homo Sapiens
ASAPSLVAA

SEQ ID NO: 230149 - protein, 9 aa, Homo Sapiens
RACGNWRVP

SEQ ID NO: 230150 - protein, 9 aa, Homo Sapiens
PESREYWRW

SEQ ID NO: 230151 - protein, 9 aa, Homo Sapiens
KSISWDPVN

SEQ ID NO: 230152 - protein, 9 aa, Homo Sapiens
KEEPIDTSQ

SEQ ID NO: 230153 - protein, 9 aa, Homo Sapiens
YVEARHLEF

SEQ ID NO: 230154 - protein, 9 aa, Homo Sapiens
DLVTLDGQN

SEQ ID NO: 230155 - protein, 9 aa, Homo Sapiens
IKCVQVSQE

SEQ ID NO: 230156 - protein, 9 aa, Homo Sapiens
VKLRPETRK

SEQ ID NO: 230157 - protein, 9 aa, Homo Sapiens
LLLLLIVLC

SEQ ID NO: 230158 - protein, 9 aa, Homo Sapiens
CGMTTEKQR

SEQ ID NO: 230159 - protein, 9 aa, Homo Sapiens
ALDCFSFQE

SEQ ID NO: 230160 - protein, 9 aa, Homo Sapiens
KKKANLNTL

SEQ ID NO: 230161 - protein, 9 aa, Homo Sapiens
SEREILPES

SEQ ID NO: 230162 - protein, 9 aa, Homo Sapiens
LGYVASLEA

SEQ ID NO: 230163 - protein, 9 aa, Homo Sapiens
LTSRLWPHS

SEQ ID NO: 230164 - protein, 9 aa, Homo Sapiens
LGMVTGAGA

SEQ ID NO: 230165 - protein, 9 aa, Homo Sapiens
LARRWALAQ

SEQ ID NO: 230166 - protein, 9 aa, Homo Sapiens
PVSAQSLLR

SEQ ID NO: 230167 - protein, 9 aa, Homo Sapiens
RHLLLRRGQ

SEQ ID NO: 230168 - protein, 9 aa, Homo Sapiens
FGASLDPIM

SEQ ID NO: 230169 - protein, 9 aa, Homo Sapiens
LWNQIQDAR

SEQ ID NO: 230170 - protein, 9 aa, Homo Sapiens
LRGTSSPAR

SEQ ID NO: 230171 - protein, 9 aa, Homo Sapiens
PLQCHRKSD

SEQ ID NO: 230172 - protein, 9 aa, Homo Sapiens
AASMKMNAK

SEQ ID NO: 230173 - protein, 9 aa, Homo Sapiens
MMRCHSWKD

SEQ ID NO: 230174 - protein, 9 aa, Homo Sapiens
YLLQAVGLH

SEQ ID NO: 230175 - protein, 9 aa, Homo Sapiens
VNVHDIRWN

SEQ ID NO: 230176 - protein, 9 aa, Homo Sapiens
IVIRYLSKL

SEQ ID NO: 230177 - protein, 9 aa, Homo Sapiens
KDLFYIVLD

SEQ ID NO: 230178 - protein, 9 aa, Homo Sapiens
AKLRLVEFS

SEQ ID NO: 230179 - protein, 9 aa, Homo Sapiens
TEYFRVPVF

SEQ ID NO: 230180 - protein, 9 aa, Homo Sapiens
QPVSLASAL

SEQ ID NO: 230181 - protein, 9 aa, Homo Sapiens
LSNSSAIPL

SEQ ID NO: 230182 - protein, 9 aa, Homo Sapiens
VIELGTNSL

SEQ ID NO: 230183 - protein, 9 aa, Homo Sapiens
ACANSWSTW

SEQ ID NO: 230184 - protein, 9 aa, Homo Sapiens
EGINIFWMA

SEQ ID NO: 230185 - protein, 9 aa, Homo Sapiens
GIPGRYLTG

SEQ ID NO: 230186 - protein, 9 aa, Homo Sapiens
QMHVEDPGP

SEQ ID NO: 230187 - protein, 9 aa, Homo Sapiens
EDDDDDDPT

SEQ ID NO: 230188 - protein, 9 aa, Homo Sapiens
HSPTPTSAL

SEQ ID NO: 230189 - protein, 9 aa, Homo Sapiens
LVHGLTLEV

SEQ ID NO: 230190 - protein, 9 aa, Homo Sapiens
YSPADPRLH

SEQ ID NO: 230191 - protein, 9 aa, Homo Sapiens
LLHQPLPGQ

SEQ ID NO: 230192 - protein, 9 aa, Homo Sapiens
LPGQHLWLS

SEQ ID NO: 230193 - protein, 9 aa, Homo Sapiens
DIAQRAVEL

SEQ ID NO: 230194 - protein, 9 aa, Homo Sapiens
AIGGTGGWS

SEQ ID NO: 230195 - protein, 9 aa, Homo Sapiens
RIKLDWATA

SEQ ID NO: 230196 - protein, 9 aa, Homo Sapiens
LWTLLGDPV

SEQ ID NO: 230197 - protein, 9 aa, Homo Sapiens
QSLSLQQWK

SEQ ID NO: 230198 - protein, 9 aa, Homo Sapiens
PRLLNLCQR

SEQ ID NO: 230199 - protein, 9 aa, Homo Sapiens
HWEEAIFDK

SEQ ID NO: 230200 - protein, 9 aa, Homo Sapiens
ENKTYSVPA

SEQ ID NO: 230201 - protein, 9 aa, Homo Sapiens
LYWKGGERR

SEQ ID NO: 230202 - protein, 9 aa, Homo Sapiens
ASGVSLLWV

SEQ ID NO: 230203 - protein, 9 aa, Homo Sapiens
TSQIDAQQR

SEQ ID NO: 230204 - protein, 9 aa, Homo Sapiens
GCQELQRVH

SEQ ID NO: 230205 - protein, 9 aa, Homo Sapiens
LTFKSVFTR

SEQ ID NO: 230206 - protein, 9 aa, Homo Sapiens
QEPAAMTQM

SEQ ID NO: 230207 - protein, 9 aa, Homo Sapiens
HVTWSSALC

SEQ ID NO: 230208 - protein, 9 aa, Homo Sapiens
RACRAGGPA

SEQ ID NO: 230209 - protein, 9 aa, Homo Sapiens
RGPVTVQTA

SEQ ID NO: 230210 - protein, 9 aa, Homo Sapiens
GGRANVGAT

SEQ ID NO: 230211 - protein, 9 aa, Homo Sapiens
AVAHTQDVI

SEQ ID NO: 230212 - protein, 9 aa, Homo Sapiens
EPNAGHRTI

SEQ ID NO: 230213 - protein, 9 aa, Homo Sapiens
DHWRSRHTI

SEQ ID NO: 230214 - protein, 9 aa, Homo Sapiens
TSASMLSAT

SEQ ID NO: 230215 - protein, 9 aa, Homo Sapiens
VLLAPATPP

SEQ ID NO: 230216 - protein, 9 aa, Homo Sapiens
FTCETSGIR

SEQ ID NO: 230217 - protein, 9 aa, Homo Sapiens
MRDLRSCVA

SEQ ID NO: 230218 - protein, 9 aa, Homo Sapiens
PQMSKVKVM

SEQ ID NO: 230219 - protein, 9 aa, Homo Sapiens
TVRRKKKET

SEQ ID NO: 230220 - protein, 9 aa, Homo Sapiens
SVHSGSHHS

SEQ ID NO: 230221 - protein, 9 aa, Homo Sapiens
GKLTALIHL

SEQ ID NO: 230222 - protein, 9 aa, Homo Sapiens
TVISKKFGD

SEQ ID NO: 230223 - protein, 9 aa, Homo Sapiens
LLRARAIEA

SEQ ID NO: 230224 - protein, 9 aa, Homo Sapiens
GGGVGDLEC

SEQ ID NO: 230225 - protein, 9 aa, Homo Sapiens
PALLLQPRR

SEQ ID NO: 230226 - protein, 9 aa, Homo Sapiens
KFFGGKQED

SEQ ID NO: 230227 - protein, 9 aa, Homo Sapiens
YPPLSVITR

SEQ ID NO: 230228 - protein, 9 aa, Homo Sapiens
VRWGADDTM

SEQ ID NO: 230229 - protein, 9 aa, Homo Sapiens
APRALQAGG

SEQ ID NO: 230230 - protein, 9 aa, Homo Sapiens
YSRSVCSRS

SEQ ID NO: 230231 - protein, 9 aa, Homo Sapiens
PDYCVHNES

SEQ ID NO: 230232 - protein, 9 aa, Homo Sapiens
HLSPHLNQI

SEQ ID NO: 230233 - protein, 9 aa, Homo Sapiens
PVHTDAQGR

SEQ ID NO: 230234 - protein, 9 aa, Homo Sapiens
GGSTQNNTN

SEQ ID NO: 230235 - protein, 9 aa, Homo Sapiens
SPYVSWTSA

SEQ ID NO: 230236 - protein, 9 aa, Homo Sapiens
VMDTVILYR

SEQ ID NO: 230237 - protein, 9 aa, Homo Sapiens
EWINKKHHE

SEQ ID NO: 230238 - protein, 9 aa, Homo Sapiens
YGMGFGVYL

SEQ ID NO: 230239 - protein, 9 aa, Homo Sapiens
KLLEIFALE

SEQ ID NO: 230240 - protein, 9 aa, Homo Sapiens
PWDTERNLR

SEQ ID NO: 230241 - protein, 9 aa, Homo Sapiens
EECTTIVCP

SEQ ID NO: 230242 - protein, 9 aa, Homo Sapiens
HSCTTHSTS

SEQ ID NO: 230243 - protein, 9 aa, Homo Sapiens
MRSPSRRCP

SEQ ID NO: 230244 - protein, 9 aa, Homo Sapiens
ESSEREILP

SEQ ID NO: 230245 - protein, 9 aa, Homo Sapiens
HVDASCGYL

SEQ ID NO: 230246 - protein, 9 aa, Homo Sapiens
VKIHVKMEI

SEQ ID NO: 230247 - protein, 9 aa, Homo Sapiens
KGHGDVCKV

SEQ ID NO: 230248 - protein, 9 aa, Homo Sapiens
ISQTIIRLL

SEQ ID NO: 230249 - protein, 9 aa, Homo Sapiens
VFRVASRSP

SEQ ID NO: 230250 - protein, 9 aa, Homo Sapiens
PRALACWLR

SEQ ID NO: 230251 - protein, 9 aa, Homo Sapiens
ELCQAWFTN

SEQ ID NO: 230252 - protein, 9 aa, Homo Sapiens
RYDEWNFFP

SEQ ID NO: 230253 - protein, 9 aa, Homo Sapiens
SGGKLCQCR

SEQ ID NO: 230254 - protein, 9 aa, Homo Sapiens
MFGKLYLLL

SEQ ID NO: 230255 - protein, 9 aa, Homo Sapiens
GSSRLGRPL

SEQ ID NO: 230256 - protein, 9 aa, Homo Sapiens
QDYREVCQQ

SEQ ID NO: 230257 - protein, 9 aa, Homo Sapiens
DLGHMYNLV

SEQ ID NO: 230258 - protein, 9 aa, Homo Sapiens
KSHPPEAKL

SEQ ID NO: 230259 - protein, 9 aa, Homo Sapiens
TPLALTYIV

SEQ ID NO: 230260 - protein, 9 aa, Homo Sapiens
LQTGAPGMN

SEQ ID NO: 230261 - protein, 9 aa, Homo Sapiens
PGQAAKDEL

SEQ ID NO: 230262 - protein, 9 aa, Homo Sapiens
HARTEISVG

SEQ ID NO: 230263 - protein, 9 aa, Homo Sapiens
PKTDPRAAD

SEQ ID NO: 230264 - protein, 9 aa, Homo Sapiens
LPLRVTDFE

SEQ ID NO: 230265 - protein, 9 aa, Homo Sapiens
KIGARIHAL

SEQ ID NO: 230266 - protein, 9 aa, Homo Sapiens
IRELDQKHG

SEQ ID NO: 230267 - protein, 9 aa, Homo Sapiens
PHRMRPLVD

SEQ ID NO: 230268 - protein, 9 aa, Homo Sapiens
VSHCGHGAE

SEQ ID NO: 230269 - protein, 9 aa, Homo Sapiens
QLLPPATAP

SEQ ID NO: 230270 - protein, 9 aa, Homo Sapiens
EKRIHFPAL

SEQ ID NO: 230271 - protein, 9 aa, Homo Sapiens
MSTHLHKGD

SEQ ID NO: 230272 - protein, 9 aa, Homo Sapiens
WLLTANGQY

SEQ ID NO: 230273 - protein, 9 aa, Homo Sapiens
GLLKTHNCY

SEQ ID NO: 230274 - protein, 9 aa, Homo Sapiens
GEKPCKCHE

SEQ ID NO: 230275 - protein, 9 aa, Homo Sapiens
KVNDLYWHV

SEQ ID NO: 230276 - protein, 9 aa, Homo Sapiens
ECTTIVCPD

SEQ ID NO: 230277 - protein, 9 aa, Homo Sapiens
GQHLWLSHR

SEQ ID NO: 230278 - protein, 9 aa, Homo Sapiens
PPHSATATL

SEQ ID NO: 230279 - protein, 9 aa, Homo Sapiens
LGLLMVLAQ

SEQ ID NO: 230280 - protein, 9 aa, Homo Sapiens
DPWAGGGIQ

SEQ ID NO: 230281 - protein, 9 aa, Homo Sapiens
STSPRRPGS

SEQ ID NO: 230282 - protein, 9 aa, Homo Sapiens
EDFWEVDPI

SEQ ID NO: 230283 - protein, 9 aa, Homo Sapiens
ERGGGCLPP

SEQ ID NO: 230284 - protein, 9 aa, Homo Sapiens
EVGVLDYDK

SEQ ID NO: 230285 - protein, 9 aa, Homo Sapiens
QPWSPTCPQ

SEQ ID NO: 230286 - protein, 9 aa, Homo Sapiens
GLTFKDVVV

SEQ ID NO: 230287 - protein, 9 aa, Homo Sapiens
SRSAASAPS

SEQ ID NO: 230288 - protein, 9 aa, Homo Sapiens
LWSNFWGGS

SEQ ID NO: 230289 - protein, 9 aa, Homo Sapiens
RGHAYPVWD

SEQ ID NO: 230290 - protein, 9 aa, Homo Sapiens
MQKPPSPDI

SEQ ID NO: 230291 - protein, 9 aa, Homo Sapiens
PDGLPWGRP

SEQ ID NO: 230292 - protein, 9 aa, Homo Sapiens
ALHRRMRHK

SEQ ID NO: 230293 - protein, 9 aa, Homo Sapiens
CLYECGGQR

SEQ ID NO: 230294 - protein, 9 aa, Homo Sapiens
APLPRRSRP

SEQ ID NO: 230295 - protein, 9 aa, Homo Sapiens
EREDWGIGS

SEQ ID NO: 230296 - protein, 9 aa, Homo Sapiens
PHPTGVRGL

SEQ ID NO: 230297 - protein, 9 aa, Homo Sapiens
ACLALRRRR

SEQ ID NO: 230298 - protein, 9 aa, Homo Sapiens
CWRAFSQRS

SEQ ID NO: 230299 - protein, 9 aa, Homo Sapiens
KSWISVPCP

SEQ ID NO: 230300 - protein, 9 aa, Homo Sapiens
RHSSVLATG

SEQ ID NO: 230301 - protein, 9 aa, Homo Sapiens
HGRGNARSS

SEQ ID NO: 230302 - protein, 9 aa, Homo Sapiens
SRGPRLSQV

SEQ ID NO: 230303 - protein, 9 aa, Homo Sapiens
RDLKKKLLP

SEQ ID NO: 230304 - protein, 9 aa, Homo Sapiens
QGTAAGAAY

SEQ ID NO: 230305 - protein, 9 aa, Homo Sapiens
KSWETECDR

SEQ ID NO: 230306 - protein, 9 aa, Homo Sapiens
PSQVVLCIS

SEQ ID NO: 230307 - protein, 9 aa, Homo Sapiens
MRVSALQEA

SEQ ID NO: 230308 - protein, 9 aa, Homo Sapiens
AAPKNRHTI

SEQ ID NO: 230309 - protein, 9 aa, Homo Sapiens
QRRCQPHQA

SEQ ID NO: 230310 - protein, 9 aa, Homo Sapiens
EPPMPPPAN

SEQ ID NO: 230311 - protein, 9 aa, Homo Sapiens
SLKSNILKS

SEQ ID NO: 230312 - protein, 9 aa, Homo Sapiens
LISAQSLLR

SEQ ID NO: 230313 - protein, 9 aa, Homo Sapiens
LFDMVSRAA

SEQ ID NO: 230314 - protein, 9 aa, Homo Sapiens
SEMPARLVL

SEQ ID NO: 230315 - protein, 9 aa, Homo Sapiens
KGFLEKTMI

SEQ ID NO: 230316 - protein, 9 aa, Homo Sapiens
HWVTYIPSK

SEQ ID NO: 230317 - protein, 9 aa, Homo Sapiens
KCGYNKGYK

SEQ ID NO: 230318 - protein, 9 aa, Homo Sapiens
WLSNSSAIP

SEQ ID NO: 230319 - protein, 9 aa, Homo Sapiens
REKKRHCDR

SEQ ID NO: 230320 - protein, 9 aa, Homo Sapiens
LGSPMCSEQ

SEQ ID NO: 230321 - protein, 9 aa, Homo Sapiens
SPRGRERRG

SEQ ID NO: 230322 - protein, 9 aa, Homo Sapiens
ELAPGASDH

SEQ ID NO: 230323 - protein, 9 aa, Homo Sapiens
VQEGHGSHH

SEQ ID NO: 230324 - protein, 9 aa, Homo Sapiens
RVPRLRKFY

SEQ ID NO: 230325 - protein, 9 aa, Homo Sapiens
RVPGLLERL

SEQ ID NO: 230326 - protein, 9 aa, Homo Sapiens
HPHPMSSGR

SEQ ID NO: 230327 - protein, 9 aa, Homo Sapiens
ILRWEGTCF

SEQ ID NO: 230328 - protein, 9 aa, Homo Sapiens
PPQGQARDL

SEQ ID NO: 230329 - protein, 9 aa, Homo Sapiens
RVVALKQAS

SEQ ID NO: 230330 - protein, 9 aa, Homo Sapiens
LSVMSSPSW

SEQ ID NO: 230331 - protein, 9 aa, Homo Sapiens
DGLIKVQVA

SEQ ID NO: 230332 - protein, 9 aa, Homo Sapiens
CGYNKGYKG

SEQ ID NO: 230333 - protein, 9 aa, Homo Sapiens
PREEDNAAI

SEQ ID NO: 230334 - protein, 9 aa, Homo Sapiens
YQDPHAGPS

SEQ ID NO: 230335 - protein, 9 aa, Homo Sapiens
ASSAGSSWT

SEQ ID NO: 230336 - protein, 9 aa, Homo Sapiens
SNKKISVLS

SEQ ID NO: 230337 - protein, 9 aa, Homo Sapiens
EKNHARVLG

SEQ ID NO: 230338 - protein, 9 aa, Homo Sapiens
YLISARSLL

SEQ ID NO: 230339 - protein, 9 aa, Homo Sapiens
EFFRKLSMD

SEQ ID NO: 230340 - protein, 9 aa, Homo Sapiens
PAGRRSGGR

SEQ ID NO: 230341 - protein, 9 aa, Homo Sapiens
RDSAGPASA

SEQ ID NO: 230342 - protein, 9 aa, Homo Sapiens
TSPPPPAPS

SEQ ID NO: 230343 - protein, 9 aa, Homo Sapiens
RALQQNRGP

SEQ ID NO: 230344 - protein, 9 aa, Homo Sapiens
FGKWTLSSV

SEQ ID NO: 230345 - protein, 9 aa, Homo Sapiens
YWECKHLRW

SEQ ID NO: 230346 - protein, 9 aa, Homo Sapiens
YVPVFTIHL

SEQ ID NO: 230347 - protein, 9 aa, Homo Sapiens
VLAAGPTSS

SEQ ID NO: 230348 - protein, 9 aa, Homo Sapiens
ESGERGVLQ

SEQ ID NO: 230349 - protein, 9 aa, Homo Sapiens
SVLQSFRLL

SEQ ID NO: 230350 - protein, 9 aa, Homo Sapiens
ACAGCRTQL

SEQ ID NO: 230351 - protein, 9 aa, Homo Sapiens
ELRQAPRTT

SEQ ID NO: 230352 - protein, 9 aa, Homo Sapiens
WDTERNLRP

SEQ ID NO: 230353 - protein, 9 aa, Homo Sapiens
PVTFIHGVV

SEQ ID NO: 230354 - protein, 9 aa, Homo Sapiens
PGLLERLAR

SEQ ID NO: 230355 - protein, 9 aa, Homo Sapiens
QVRYLEKEE

SEQ ID NO: 230356 - protein, 9 aa, Homo Sapiens
LPRELSPWE

SEQ ID NO: 230357 - protein, 9 aa, Homo Sapiens
CITFYYFFS

SEQ ID NO: 230358 - protein, 9 aa, Homo Sapiens
GAGLSTSPA

SEQ ID NO: 230359 - protein, 9 aa, Homo Sapiens
ESLIRRTRQ

SEQ ID NO: 230360 - protein, 9 aa, Homo Sapiens
EAWSKIYSC

SEQ ID NO: 230361 - protein, 9 aa, Homo Sapiens
HKLQHELEE

SEQ ID NO: 230362 - protein, 9 aa, Homo Sapiens
NYSDHMIDR

SEQ ID NO: 230363 - protein, 9 aa, Homo Sapiens
YTLRVQARD

SEQ ID NO: 230364 - protein, 9 aa, Homo Sapiens
TGLRKRGRS

SEQ ID NO: 230365 - protein, 9 aa, Homo Sapiens
RWQAECFQD

SEQ ID NO: 230366 - protein, 9 aa, Homo Sapiens
LLLPALLGF

SEQ ID NO: 230367 - protein, 9 aa, Homo Sapiens
LPDKKRNSY

SEQ ID NO: 230368 - protein, 9 aa, Homo Sapiens
KAIITMDTA

SEQ ID NO: 230369 - protein, 9 aa, Homo Sapiens
LKKSRLCMS

SEQ ID NO: 230370 - protein, 9 aa, Homo Sapiens
KIPRQLPQM

SEQ ID NO: 230371 - protein, 9 aa, Homo Sapiens
RRRREYCKS

SEQ ID NO: 230372 - protein, 9 aa, Homo Sapiens
SAAWTRRPS

SEQ ID NO: 230373 - protein, 9 aa, Homo Sapiens
FSQDSKLTT

SEQ ID NO: 230374 - protein, 9 aa, Homo Sapiens
QMQSGMRNK

SEQ ID NO: 230375 - protein, 9 aa, Homo Sapiens
MTCQSCVNS

SEQ ID NO: 230376 - protein, 9 aa, Homo Sapiens
YVGITLTLS

SEQ ID NO: 230377 - protein, 9 aa, Homo Sapiens
FLQIIWLKL

SEQ ID NO: 230378 - protein, 9 aa, Homo Sapiens
TTTLSCPPR

SEQ ID NO: 230379 - protein, 9 aa, Homo Sapiens
VSQVFLLFS

SEQ ID NO: 230380 - protein, 9 aa, Homo Sapiens
RSQHGPGWT

SEQ ID NO: 230381 - protein, 9 aa, Homo Sapiens
VKDLRGKKT

SEQ ID NO: 230382 - protein, 9 aa, Homo Sapiens
GLFEELLEA

SEQ ID NO: 230383 - protein, 9 aa, Homo Sapiens
SDKLRWRMN

SEQ ID NO: 230384 - protein, 9 aa, Homo Sapiens
QLQVFMVIG

SEQ ID NO: 230385 - protein, 9 aa, Homo Sapiens
ELKTLLGQL

SEQ ID NO: 230386 - protein, 9 aa, Homo Sapiens
PELSFALVD

SEQ ID NO: 230387 - protein, 9 aa, Homo Sapiens
PPSPPSPSS

SEQ ID NO: 230388 - protein, 9 aa, Homo Sapiens
GGIQRNLSA

SEQ ID NO: 230389 - protein, 9 aa, Homo Sapiens
PPLASEAVM

SEQ ID NO: 230390 - protein, 9 aa, Homo Sapiens
NKLKKMCAH

SEQ ID NO: 230391 - protein, 9 aa, Homo Sapiens
PPQRTVLWL

SEQ ID NO: 230392 - protein, 9 aa, Homo Sapiens
NKMTSLNSA

SEQ ID NO: 230393 - protein, 9 aa, Homo Sapiens
GCRDHCNVD

SEQ ID NO: 230394 - protein, 9 aa, Homo Sapiens
CSLQHQEKQ

SEQ ID NO: 230395 - protein, 9 aa, Homo Sapiens
EAFPLPRAS

SEQ ID NO: 230396 - protein, 9 aa, Homo Sapiens
QLLPPRSRA

SEQ ID NO: 230397 - protein, 9 aa, Homo Sapiens
GQPHKINPS

SEQ ID NO: 230398 - protein, 9 aa, Homo Sapiens
RSMLREWYA

SEQ ID NO: 230399 - protein, 9 aa, Homo Sapiens
QCHRKSDFC

SEQ ID NO: 230400 - protein, 9 aa, Homo Sapiens
LKTLKNDRN

SEQ ID NO: 230401 - protein, 9 aa, Homo Sapiens
ASSTAAPIS

SEQ ID NO: 230402 - protein, 9 aa, Homo Sapiens
AAAALRAVG

SEQ ID NO: 230403 - protein, 9 aa, Homo Sapiens
VAGAWQVFE

SEQ ID NO: 230404 - protein, 9 aa, Homo Sapiens
KCLLWKRKY

SEQ ID NO: 230405 - protein, 9 aa, Homo Sapiens
PLPPCTALV

SEQ ID NO: 230406 - protein, 9 aa, Homo Sapiens
GQLNKFESL

SEQ ID NO: 230407 - protein, 9 aa, Homo Sapiens
WGLVSDVPK

SEQ ID NO: 230408 - protein, 9 aa, Homo Sapiens
QIQEEMMQD

SEQ ID NO: 230409 - protein, 9 aa, Homo Sapiens
MLLCTALLN

SEQ ID NO: 230410 - protein, 9 aa, Homo Sapiens
IIKCEQNTL

SEQ ID NO: 230411 - protein, 9 aa, Homo Sapiens
FSKGCVLNQ

SEQ ID NO: 230412 - protein, 9 aa, Homo Sapiens
VCGPGFSAG

SEQ ID NO: 230413 - protein, 9 aa, Homo Sapiens
IEAGKEVEV

SEQ ID NO: 230414 - protein, 9 aa, Homo Sapiens
SRAPRRRKW

SEQ ID NO: 230415 - protein, 9 aa, Homo Sapiens
YYDYIWDAT

SEQ ID NO: 230416 - protein, 9 aa, Homo Sapiens
LHFSLKGCF

SEQ ID NO: 230417 - protein, 9 aa, Homo Sapiens
LWLLTANGQ

SEQ ID NO: 230418 - protein, 9 aa, Homo Sapiens
WLSKKISFF

SEQ ID NO: 230419 - protein, 9 aa, Homo Sapiens
VVLGLLADV

SEQ ID NO: 230420 - protein, 9 aa, Homo Sapiens
EIPYVTVLD

SEQ ID NO: 230421 - protein, 9 aa, Homo Sapiens
SWTCSQTRP

SEQ ID NO: 230422 - protein, 9 aa, Homo Sapiens
HFVMDGSFI

SEQ ID NO: 230423 - protein, 9 aa, Homo Sapiens
GFGLRGLQK

SEQ ID NO: 230424 - protein, 9 aa, Homo Sapiens
RHPSLGGCP

SEQ ID NO: 230425 - protein, 9 aa, Homo Sapiens
VENICKKFS

SEQ ID NO: 230426 - protein, 9 aa, Homo Sapiens
LVSCFQERV

SEQ ID NO: 230427 - protein, 9 aa, Homo Sapiens
SSKHNRWEP

SEQ ID NO: 230428 - protein, 9 aa, Homo Sapiens
DSGENGEIV

SEQ ID NO: 230429 - protein, 9 aa, Homo Sapiens
TLTRSSPGL

SEQ ID NO: 230430 - protein, 9 aa, Homo Sapiens
ASVDMVFSR

SEQ ID NO: 230431 - protein, 9 aa, Homo Sapiens
VWKMNWKKM

SEQ ID NO: 230432 - protein, 9 aa, Homo Sapiens
VRVSVKLHN

SEQ ID NO: 230433 - protein, 9 aa, Homo Sapiens
CSVGPLSKR

SEQ ID NO: 230434 - protein, 9 aa, Homo Sapiens
AVPCQDLGI

SEQ ID NO: 230435 - protein, 9 aa, Homo Sapiens
LSTSSFCCC

SEQ ID NO: 230436 - protein, 9 aa, Homo Sapiens
DSRCGSGSP

SEQ ID NO: 230437 - protein, 9 aa, Homo Sapiens
DQSFTIQDL

SEQ ID NO: 230438 - protein, 9 aa, Homo Sapiens
SRSARVPPS

SEQ ID NO: 230439 - protein, 9 aa, Homo Sapiens
KDHRTSQNH

SEQ ID NO: 230440 - protein, 9 aa, Homo Sapiens
QPAGVSLVG

SEQ ID NO: 230441 - protein, 9 aa, Homo Sapiens
KLFLIFSHM

SEQ ID NO: 230442 - protein, 9 aa, Homo Sapiens
SQKSIFEAL

SEQ ID NO: 230443 - protein, 9 aa, Homo Sapiens
QPLPGQHLW

SEQ ID NO: 230444 - protein, 9 aa, Homo Sapiens
AGDDAPGLS

SEQ ID NO: 230445 - protein, 9 aa, Homo Sapiens
GWSSKHNRW

SEQ ID NO: 230446 - protein, 9 aa, Homo Sapiens
LQRNLLRLQ

SEQ ID NO: 230447 - protein, 9 aa, Homo Sapiens
RLFPNCSAQ

SEQ ID NO: 230448 - protein, 9 aa, Homo Sapiens
PSSSVWSSA

SEQ ID NO: 230449 - protein, 9 aa, Homo Sapiens
PEEAVAQVE

SEQ ID NO: 230450 - protein, 9 aa, Homo Sapiens
RCNPCCRLT

SEQ ID NO: 230451 - protein, 9 aa, Homo Sapiens
PADWTREEV

SEQ ID NO: 230452 - protein, 9 aa, Homo Sapiens
FSTVRLLHF

SEQ ID NO: 230453 - protein, 9 aa, Homo Sapiens
WVYSHNGVS

SEQ ID NO: 230454 - protein, 9 aa, Homo Sapiens
HQAGARLDV

SEQ ID NO: 230455 - protein, 9 aa, Homo Sapiens
IGWCWLIRV

SEQ ID NO: 230456 - protein, 9 aa, Homo Sapiens
VLVLDEAVG

SEQ ID NO: 230457 - protein, 9 aa, Homo Sapiens
LLSPLLGSC

SEQ ID NO: 230458 - protein, 9 aa, Homo Sapiens
NFKWSELWK

SEQ ID NO: 230459 - protein, 9 aa, Homo Sapiens
HSPVPRLPR

SEQ ID NO: 230460 - protein, 9 aa, Homo Sapiens
STGDPAGGG

SEQ ID NO: 230461 - protein, 9 aa, Homo Sapiens
RVPHWGPSW

SEQ ID NO: 230462 - protein, 9 aa, Homo Sapiens
LEERWENKL

SEQ ID NO: 230463 - protein, 9 aa, Homo Sapiens
CSINSVHDE

SEQ ID NO: 230464 - protein, 9 aa, Homo Sapiens
VSWTSAGSA

SEQ ID NO: 230465 - protein, 9 aa, Homo Sapiens
GERGLVATV

SEQ ID NO: 230466 - protein, 9 aa, Homo Sapiens
ITEHVPLGN

SEQ ID NO: 230467 - protein, 9 aa, Homo Sapiens
TSGEPWDTE

SEQ ID NO: 230468 - protein, 9 aa, Homo Sapiens
WGSYTLRAG

SEQ ID NO: 230469 - protein, 9 aa, Homo Sapiens
ELALKNQNL

SEQ ID NO: 230470 - protein, 9 aa, Homo Sapiens
SPAFSVGLG

SEQ ID NO: 230471 - protein, 9 aa, Homo Sapiens
SRLVMCLRN

SEQ ID NO: 230472 - protein, 9 aa, Homo Sapiens
GTSFYDSWS

SEQ ID NO: 230473 - protein, 9 aa, Homo Sapiens
SWCGTSQTY

SEQ ID NO: 230474 - protein, 9 aa, Homo Sapiens
DVEIKVQNI

SEQ ID NO: 230475 - protein, 9 aa, Homo Sapiens
HRAVAPSTH

SEQ ID NO: 230476 - protein, 9 aa, Homo Sapiens
CQFMDNMSG

SEQ ID NO: 230477 - protein, 9 aa, Homo Sapiens
PPPSPPSPS

SEQ ID NO: 230478 - protein, 9 aa, Homo Sapiens
TSALTCLPA

SEQ ID NO: 230479 - protein, 9 aa, Homo Sapiens
MGLNPKTKY

SEQ ID NO: 230480 - protein, 9 aa, Homo Sapiens
PKRSARAPR

SEQ ID NO: 230481 - protein, 9 aa, Homo Sapiens
ILNSKQFIK

SEQ ID NO: 230482 - protein, 9 aa, Homo Sapiens
TEVAMEAKW

SEQ ID NO: 230483 - protein, 9 aa, Homo Sapiens
RAASCRPTR

SEQ ID NO: 230484 - protein, 9 aa, Homo Sapiens
KWGPEVSDT

SEQ ID NO: 230485 - protein, 9 aa, Homo Sapiens
AVLLVVEHV

SEQ ID NO: 230486 - protein, 9 aa, Homo Sapiens
QMTYRGERP

SEQ ID NO: 230487 - protein, 9 aa, Homo Sapiens
VLSRSSPKR

SEQ ID NO: 230488 - protein, 9 aa, Homo Sapiens
LSCWTWMTW

SEQ ID NO: 230489 - protein, 9 aa, Homo Sapiens
LCAGPGPPT

SEQ ID NO: 230490 - protein, 9 aa, Homo Sapiens
IQQPQTTVT

SEQ ID NO: 230491 - protein, 9 aa, Homo Sapiens
KKRGKSQGG

SEQ ID NO: 230492 - protein, 9 aa, Homo Sapiens
AAGVSRCSS

SEQ ID NO: 230493 - protein, 9 aa, Homo Sapiens
YFAWMMLNY

SEQ ID NO: 230494 - protein, 9 aa, Homo Sapiens
MDGQPDEQG

SEQ ID NO: 230495 - protein, 9 aa, Homo Sapiens
LGKPLHAPV

SEQ ID NO: 230496 - protein, 9 aa, Homo Sapiens
SLALLLTTT

SEQ ID NO: 230497 - protein, 9 aa, Homo Sapiens
EKESPCGLS

SEQ ID NO: 230498 - protein, 9 aa, Homo Sapiens
LGTRMGTLC

SEQ ID NO: 230499 - protein, 9 aa, Homo Sapiens
FGLGIIGPE

SEQ ID NO: 230500 - protein, 9 aa, Homo Sapiens
PCLELLEVI

SEQ ID NO: 230501 - protein, 9 aa, Homo Sapiens
TSRGHPRTG

SEQ ID NO: 230502 - protein, 9 aa, Homo Sapiens
TQLMDSSAV

SEQ ID NO: 230503 - protein, 9 aa, Homo Sapiens
YSKFNGVQM

SEQ ID NO: 230504 - protein, 9 aa, Homo Sapiens
GGGTIQPQA

SEQ ID NO: 230505 - protein, 9 aa, Homo Sapiens
RLLDLSYNH

SEQ ID NO: 230506 - protein, 9 aa, Homo Sapiens
LDDIIKCEQ

SEQ ID NO: 230507 - protein, 9 aa, Homo Sapiens
ESFNGMMST

SEQ ID NO: 230508 - protein, 9 aa, Homo Sapiens
TGPTSSSIQ

SEQ ID NO: 230509 - protein, 9 aa, Homo Sapiens
DRHPVALRT

SEQ ID NO: 230510 - protein, 9 aa, Homo Sapiens
KKVNKGKQK

SEQ ID NO: 230511 - protein, 9 aa, Homo Sapiens
AKQIVRKIT

SEQ ID NO: 230512 - protein, 9 aa, Homo Sapiens
ATSAVEQPP

SEQ ID NO: 230513 - protein, 9 aa, Homo Sapiens
YSQDISEGH

SEQ ID NO: 230514 - protein, 9 aa, Homo Sapiens
LPTGLYCFP

SEQ ID NO: 230515 - protein, 9 aa, Homo Sapiens
QGISQVHHM

SEQ ID NO: 230516 - protein, 9 aa, Homo Sapiens
PPLSSLGTR

SEQ ID NO: 230517 - protein, 9 aa, Homo Sapiens
ILSNSLTTL

SEQ ID NO: 230518 - protein, 9 aa, Homo Sapiens
TSPPAGAVV

SEQ ID NO: 230519 - protein, 9 aa, Homo Sapiens
QAWFTNCED

SEQ ID NO: 230520 - protein, 9 aa, Homo Sapiens
ADSWGSGAA

SEQ ID NO: 230521 - protein, 9 aa, Homo Sapiens
VRPQLFSPY

SEQ ID NO: 230522 - protein, 9 aa, Homo Sapiens
HLAPKAEVD

SEQ ID NO: 230523 - protein, 9 aa, Homo Sapiens
VRRQHCYPP

SEQ ID NO: 230524 - protein, 9 aa, Homo Sapiens
PCAQPTVST

SEQ ID NO: 230525 - protein, 9 aa, Homo Sapiens
KWVNLLLEL

SEQ ID NO: 230526 - protein, 9 aa, Homo Sapiens
ASCARPAPR

SEQ ID NO: 230527 - protein, 9 aa, Homo Sapiens
MISIYNRRT

SEQ ID NO: 230528 - protein, 9 aa, Homo Sapiens
ALKDLVFDL

SEQ ID NO: 230529 - protein, 9 aa, Homo Sapiens
RCRTSRQAT

SEQ ID NO: 230530 - protein, 9 aa, Homo Sapiens
LFTVAIIGS

SEQ ID NO: 230531 - protein, 9 aa, Homo Sapiens
LCRRYWLDL

SEQ ID NO: 230532 - protein, 9 aa, Homo Sapiens
GCRKTFSQS

SEQ ID NO: 230533 - protein, 9 aa, Homo Sapiens
PMPPPANPQ

SEQ ID NO: 230534 - protein, 9 aa, Homo Sapiens
YPEAAAPAL

SEQ ID NO: 230535 - protein, 9 aa, Homo Sapiens
HTVNENTFL

SEQ ID NO: 230536 - protein, 9 aa, Homo Sapiens
SHSSPADWT

SEQ ID NO: 230537 - protein, 9 aa, Homo Sapiens
PREAIFPFN

SEQ ID NO: 230538 - protein, 9 aa, Homo Sapiens
RMGSSLTSQ

SEQ ID NO: 230539 - protein, 9 aa, Homo Sapiens
PCPPPVTPL

SEQ ID NO: 230540 - protein, 9 aa, Homo Sapiens
LAFGIVQGS

SEQ ID NO: 230541 - protein, 9 aa, Homo Sapiens
NPSKEASSV

SEQ ID NO: 230542 - protein, 9 aa, Homo Sapiens
IPQPWSPTC

SEQ ID NO: 230543 - protein, 9 aa, Homo Sapiens
IGRFLTGIK

SEQ ID NO: 230544 - protein, 9 aa, Homo Sapiens
LGRHHPSQL

SEQ ID NO: 230545 - protein, 9 aa, Homo Sapiens
DVVVQQRHL

SEQ ID NO: 230546 - protein, 9 aa, Homo Sapiens
AENFTKTSG

SEQ ID NO: 230547 - protein, 9 aa, Homo Sapiens
FLKTLKNDR

SEQ ID NO: 230548 - protein, 9 aa, Homo Sapiens
DRPVCEGTR

SEQ ID NO: 230549 - protein, 9 aa, Homo Sapiens
CSITVSFVG

SEQ ID NO: 230550 - protein, 9 aa, Homo Sapiens
DQVEMADYD

SEQ ID NO: 230551 - protein, 9 aa, Homo Sapiens
LEGVVFPCQ

SEQ ID NO: 230552 - protein, 9 aa, Homo Sapiens
GNMASSWVT

SEQ ID NO: 230553 - protein, 9 aa, Homo Sapiens
VNGPASETA

SEQ ID NO: 230554 - protein, 9 aa, Homo Sapiens
QTGEPFSQP

SEQ ID NO: 230555 - protein, 9 aa, Homo Sapiens
DAEPPYSIP

SEQ ID NO: 230556 - protein, 9 aa, Homo Sapiens
AQAGAGLHV

SEQ ID NO: 230557 - protein, 9 aa, Homo Sapiens
EHGQSPIER

SEQ ID NO: 230558 - protein, 9 aa, Homo Sapiens
LLGGHDSPG

SEQ ID NO: 230559 - protein, 9 aa, Homo Sapiens
PISAQSLPS

SEQ ID NO: 230560 - protein, 9 aa, Homo Sapiens
LKDIGEFIL

SEQ ID NO: 230561 - protein, 9 aa, Homo Sapiens
LQTPRGLEM

SEQ ID NO: 230562 - protein, 9 aa, Homo Sapiens
SQQSLSLQQ

SEQ ID NO: 230563 - protein, 9 aa, Homo Sapiens
LIPRLPTGL

SEQ ID NO: 230564 - protein, 9 aa, Homo Sapiens
LIDTFMGFI

SEQ ID NO: 230565 - protein, 9 aa, Homo Sapiens
TLKNDRNGD

SEQ ID NO: 230566 - protein, 9 aa, Homo Sapiens
AAFVLFRCS

SEQ ID NO: 230567 - protein, 9 aa, Homo Sapiens
SELEQMSIG

SEQ ID NO: 230568 - protein, 9 aa, Homo Sapiens
SGLSAASPA

SEQ ID NO: 230569 - protein, 9 aa, Homo Sapiens
ALKNQNLSL

SEQ ID NO: 230570 - protein, 9 aa, Homo Sapiens
KQNRGLRLI

SEQ ID NO: 230571 - protein, 9 aa, Homo Sapiens
AQPTNHVSA

SEQ ID NO: 230572 - protein, 9 aa, Homo Sapiens
WSPNSVQKT

SEQ ID NO: 230573 - protein, 9 aa, Homo Sapiens
GMLRIGSLI

SEQ ID NO: 230574 - protein, 9 aa, Homo Sapiens
PTSSPSSTP

SEQ ID NO: 230575 - protein, 9 aa, Homo Sapiens
KIMGVEEEE

SEQ ID NO: 230576 - protein, 9 aa, Homo Sapiens
KLDKSRLEC

SEQ ID NO: 230577 - protein, 9 aa, Homo Sapiens
PQNPWLRQK

SEQ ID NO: 230578 - protein, 9 aa, Homo Sapiens
ELWVEGKLL

SEQ ID NO: 230579 - protein, 9 aa, Homo Sapiens
DPTIQRVQA

SEQ ID NO: 230580 - protein, 9 aa, Homo Sapiens
NGVSLHELL

SEQ ID NO: 230581 - protein, 9 aa, Homo Sapiens
SLSADGASE

SEQ ID NO: 230582 - protein, 9 aa, Homo Sapiens
WQELGTQQA

SEQ ID NO: 230583 - protein, 9 aa, Homo Sapiens
ITQVMLYSQ

SEQ ID NO: 230584 - protein, 9 aa, Homo Sapiens
QVSGMVESY

SEQ ID NO: 230585 - protein, 9 aa, Homo Sapiens
RLHRLILPM

SEQ ID NO: 230586 - protein, 9 aa, Homo Sapiens
HVLGAGVVL

SEQ ID NO: 230587 - protein, 9 aa, Homo Sapiens
LLGTRCQLG

SEQ ID NO: 230588 - protein, 9 aa, Homo Sapiens
LRKSRPHSE

SEQ ID NO: 230589 - protein, 9 aa, Homo Sapiens
GLPELFCQA

SEQ ID NO: 230590 - protein, 9 aa, Homo Sapiens
RDLRSCVAA

SEQ ID NO: 230591 - protein, 9 aa, Homo Sapiens
LAPKTTLPG

SEQ ID NO: 230592 - protein, 9 aa, Homo Sapiens
LLLLLSPLD

SEQ ID NO: 230593 - protein, 9 aa, Homo Sapiens
LEEELKKQM

SEQ ID NO: 230594 - protein, 9 aa, Homo Sapiens
IIKKMKKRI

SEQ ID NO: 230595 - protein, 9 aa, Homo Sapiens
VRYWHYFRL

SEQ ID NO: 230596 - protein, 9 aa, Homo Sapiens
TLCQGPLGF

SEQ ID NO: 230597 - protein, 9 aa, Homo Sapiens
HVSASRAVE

SEQ ID NO: 230598 - protein, 9 aa, Homo Sapiens
DSVRSGLFG

SEQ ID NO: 230599 - protein, 9 aa, Homo Sapiens
PTHIGKKPY

SEQ ID NO: 230600 - protein, 9 aa, Homo Sapiens
LPPTNAAAT

SEQ ID NO: 230601 - protein, 9 aa, Homo Sapiens
VVEHVPAVH

SEQ ID NO: 230602 - protein, 9 aa, Homo Sapiens
QCWRAFSQR

SEQ ID NO: 230603 - protein, 9 aa, Homo Sapiens
QILAKPECN

SEQ ID NO: 230604 - protein, 9 aa, Homo Sapiens
GTVDTIGEK

SEQ ID NO: 230605 - protein, 9 aa, Homo Sapiens
SQSTKQITF

SEQ ID NO: 230606 - protein, 9 aa, Homo Sapiens
ERIQMLLSR

SEQ ID NO: 230607 - protein, 9 aa, Homo Sapiens
WPSNRLVLL

SEQ ID NO: 230608 - protein, 9 aa, Homo Sapiens
KLLCRQMLP

SEQ ID NO: 230609 - protein, 9 aa, Homo Sapiens
FSNPFRYRM

SEQ ID NO: 230610 - protein, 9 aa, Homo Sapiens
WMMLNYRLM

SEQ ID NO: 230611 - protein, 9 aa, Homo Sapiens
GPWETPSMS

SEQ ID NO: 230612 - protein, 9 aa, Homo Sapiens
NSLNQGIPG

SEQ ID NO: 230613 - protein, 9 aa, Homo Sapiens
EIMGMVWKR

SEQ ID NO: 230614 - protein, 9 aa, Homo Sapiens
KMMDRIKLD

SEQ ID NO: 230615 - protein, 9 aa, Homo Sapiens
SERGPLDKT

SEQ ID NO: 230616 - protein, 9 aa, Homo Sapiens
NQPKKPKPE

SEQ ID NO: 230617 - protein, 9 aa, Homo Sapiens
MQTLMRTWI

SEQ ID NO: 230618 - protein, 9 aa, Homo Sapiens
TDSRRTVPS

SEQ ID NO: 230619 - protein, 9 aa, Homo Sapiens
VHGPTGSCC

SEQ ID NO: 230620 - protein, 9 aa, Homo Sapiens
GSHQLASGC

SEQ ID NO: 230621 - protein, 9 aa, Homo Sapiens
NLWKIIKKK

SEQ ID NO: 230622 - protein, 9 aa, Homo Sapiens
MSDLAENDE

SEQ ID NO: 230623 - protein, 9 aa, Homo Sapiens
DQTRRQISH

SEQ ID NO: 230624 - protein, 9 aa, Homo Sapiens
LMVFQSKDV

SEQ ID NO: 230625 - protein, 9 aa, Homo Sapiens
TSLTFKSVF

SEQ ID NO: 230626 - protein, 9 aa, Homo Sapiens
QSVDRSVHS

SEQ ID NO: 230627 - protein, 9 aa, Homo Sapiens
KVTLMINLY

SEQ ID NO: 230628 - protein, 9 aa, Homo Sapiens
CAARRQFQQ

SEQ ID NO: 230629 - protein, 9 aa, Homo Sapiens
PHSETEEMG

SEQ ID NO: 230630 - protein, 9 aa, Homo Sapiens
QRNLSASVI

SEQ ID NO: 230631 - protein, 9 aa, Homo Sapiens
LEKQRLLLF

SEQ ID NO: 230632 - protein, 9 aa, Homo Sapiens
ENALIVFAI

SEQ ID NO: 230633 - protein, 9 aa, Homo Sapiens
CQRRDTTHV

SEQ ID NO: 230634 - protein, 9 aa, Homo Sapiens
SVYCLQTPR

SEQ ID NO: 230635 - protein, 9 aa, Homo Sapiens
NGVQMCVDA

SEQ ID NO: 230636 - protein, 9 aa, Homo Sapiens
ASDHVTMPV

SEQ ID NO: 230637 - protein, 9 aa, Homo Sapiens
TFSPITPET

SEQ ID NO: 230638 - protein, 9 aa, Homo Sapiens
TNSSSTNSS

SEQ ID NO: 230639 - protein, 9 aa, Homo Sapiens
RQYRCKDCD

SEQ ID NO: 230640 - protein, 9 aa, Homo Sapiens
HKHLMKRYS

SEQ ID NO: 230641 - protein, 9 aa, Homo Sapiens
SIGTAKLRL

SEQ ID NO: 230642 - protein, 9 aa, Homo Sapiens
LTDRVGEGR

SEQ ID NO: 230643 - protein, 9 aa, Homo Sapiens
SIFWMRRLE

SEQ ID NO: 230644 - protein, 9 aa, Homo Sapiens
LKQLQIKLY

SEQ ID NO: 230645 - protein, 9 aa, Homo Sapiens
MHERVPKKK

SEQ ID NO: 230646 - protein, 9 aa, Homo Sapiens
RMWALSQEI

SEQ ID NO: 230647 - protein, 9 aa, Homo Sapiens
TEKTITVLD

SEQ ID NO: 230648 - protein, 9 aa, Homo Sapiens
IALTQVRYL

SEQ ID NO: 230649 - protein, 9 aa, Homo Sapiens
WTPTPCSSQ

SEQ ID NO: 230650 - protein, 9 aa, Homo Sapiens
PLPQRLFRM

SEQ ID NO: 230651 - protein, 9 aa, Homo Sapiens
LTSTNSDQL

SEQ ID NO: 230652 - protein, 9 aa, Homo Sapiens
SRPCAHDAH

SEQ ID NO: 230653 - protein, 9 aa, Homo Sapiens
LHRVQERQR

SEQ ID NO: 230654 - protein, 9 aa, Homo Sapiens
ARVPPSTMC

SEQ ID NO: 230655 - protein, 9 aa, Homo Sapiens
ISYEEFQVL

SEQ ID NO: 230656 - protein, 9 aa, Homo Sapiens
FVQPCTCPP

SEQ ID NO: 230657 - protein, 9 aa, Homo Sapiens
SSPSWRAQS

SEQ ID NO: 230658 - protein, 9 aa, Homo Sapiens
DGVKPPMPT

SEQ ID NO: 230659 - protein, 9 aa, Homo Sapiens
LCSTISCPP

SEQ ID NO: 230660 - protein, 9 aa, Homo Sapiens
LVGDVVHPQ

SEQ ID NO: 230661 - protein, 9 aa, Homo Sapiens
QRPAQSVNR

SEQ ID NO: 230662 - protein, 9 aa, Homo Sapiens
QAQGGGQLA

SEQ ID NO: 230663 - protein, 9 aa, Homo Sapiens
TFWNHMLLC

SEQ ID NO: 230664 - protein, 9 aa, Homo Sapiens
VESVGWNEA

SEQ ID NO: 230665 - protein, 9 aa, Homo Sapiens
GDVCKVLPR

SEQ ID NO: 230666 - protein, 9 aa, Homo Sapiens
MMPLDVNQL

SEQ ID NO: 230667 - protein, 9 aa, Homo Sapiens
YLTLAVKNS

SEQ ID NO: 230668 - protein, 9 aa, Homo Sapiens
WARNPTSLT

SEQ ID NO: 230669 - protein, 9 aa, Homo Sapiens
AQAAQQRFH

SEQ ID NO: 230670 - protein, 9 aa, Homo Sapiens
ASPSDCPPA

SEQ ID NO: 230671 - protein, 9 aa, Homo Sapiens
IKCEQNTLL

SEQ ID NO: 230672 - protein, 9 aa, Homo Sapiens
LSLSADGAS

SEQ ID NO: 230673 - protein, 9 aa, Homo Sapiens
GRHETVHGS

SEQ ID NO: 230674 - protein, 9 aa, Homo Sapiens
VAIYSDFQT

SEQ ID NO: 230675 - protein, 9 aa, Homo Sapiens
ATSDSNPAG

SEQ ID NO: 230676 - protein, 9 aa, Homo Sapiens
IGDRSQHGP

SEQ ID NO: 230677 - protein, 9 aa, Homo Sapiens
RAVAHMDER

SEQ ID NO: 230678 - protein, 9 aa, Homo Sapiens
DVEPCINIG

SEQ ID NO: 230679 - protein, 9 aa, Homo Sapiens
ECPPELYTL

SEQ ID NO: 230680 - protein, 9 aa, Homo Sapiens
ASSCRRPSS

SEQ ID NO: 230681 - protein, 9 aa, Homo Sapiens
WGEEVQVPK

SEQ ID NO: 230682 - protein, 9 aa, Homo Sapiens
SSPPSPPQR

SEQ ID NO: 230683 - protein, 9 aa, Homo Sapiens
TKFLVANQI

SEQ ID NO: 230684 - protein, 9 aa, Homo Sapiens
MILVCETPC

SEQ ID NO: 230685 - protein, 9 aa, Homo Sapiens
GTHTEDWQP

SEQ ID NO: 230686 - protein, 9 aa, Homo Sapiens
SLGFPVSAQ

SEQ ID NO: 230687 - protein, 9 aa, Homo Sapiens
SRDGLSEDQ

SEQ ID NO: 230688 - protein, 9 aa, Homo Sapiens
LLRLECPIS

SEQ ID NO: 230689 - protein, 9 aa, Homo Sapiens
LRTATARSL

SEQ ID NO: 230690 - protein, 9 aa, Homo Sapiens
ALLGSPMCS

SEQ ID NO: 230691 - protein, 9 aa, Homo Sapiens
RCHLWGSYT

SEQ ID NO: 230692 - protein, 9 aa, Homo Sapiens
CSLKPKRVG

SEQ ID NO: 230693 - protein, 9 aa, Homo Sapiens
PGRRRSHSW

SEQ ID NO: 230694 - protein, 9 aa, Homo Sapiens
SSTRMGSSL

SEQ ID NO: 230695 - protein, 9 aa, Homo Sapiens
RTAAVGKAR

SEQ ID NO: 230696 - protein, 9 aa, Homo Sapiens
RIHGPTHIG

SEQ ID NO: 230697 - protein, 9 aa, Homo Sapiens
VPGLLERLA

SEQ ID NO: 230698 - protein, 9 aa, Homo Sapiens
SLQQWKRPM

SEQ ID NO: 230699 - protein, 9 aa, Homo Sapiens
APSPVQHQT

SEQ ID NO: 230700 - protein, 9 aa, Homo Sapiens
AVWHTLGHA

SEQ ID NO: 230701 - protein, 9 aa, Homo Sapiens
LACLHLPSP

SEQ ID NO: 230702 - protein, 9 aa, Homo Sapiens
SGEEAPRPW

SEQ ID NO: 230703 - protein, 9 aa, Homo Sapiens
HLDSPTFHL

SEQ ID NO: 230704 - protein, 9 aa, Homo Sapiens
SPQELGFSS

SEQ ID NO: 230705 - protein, 9 aa, Homo Sapiens
IGNQRRKYR

SEQ ID NO: 230706 - protein, 9 aa, Homo Sapiens
HCTNSHLDP

SEQ ID NO: 230707 - protein, 9 aa, Homo Sapiens
FMKKTINML

SEQ ID NO: 230708 - protein, 9 aa, Homo Sapiens
VNSPPPSPP

SEQ ID NO: 230709 - protein, 9 aa, Homo Sapiens
HTEDWQPTG

SEQ ID NO: 230710 - protein, 9 aa, Homo Sapiens
RVKDRSADQ

SEQ ID NO: 230711 - protein, 9 aa, Homo Sapiens
KMLDYLKNK

SEQ ID NO: 230712 - protein, 9 aa, Homo Sapiens
EVLESGERG

SEQ ID NO: 230713 - protein, 9 aa, Homo Sapiens
EAVHFSAIT

SEQ ID NO: 230714 - protein, 9 aa, Homo Sapiens
KSQRSWMVL

SEQ ID NO: 230715 - protein, 9 aa, Homo Sapiens
RGDDTPCIW

SEQ ID NO: 230716 - protein, 9 aa, Homo Sapiens
MPPPANPQL

SEQ ID NO: 230717 - protein, 9 aa, Homo Sapiens
GSKAEDPVL

SEQ ID NO: 230718 - protein, 9 aa, Homo Sapiens
PSASREWIR

SEQ ID NO: 230719 - protein, 9 aa, Homo Sapiens
GTMVGAGEL

SEQ ID NO: 230720 - protein, 9 aa, Homo Sapiens
NSKLWPEVL

SEQ ID NO: 230721 - protein, 9 aa, Homo Sapiens
SLSGILRKQ

SEQ ID NO: 230722 - protein, 9 aa, Homo Sapiens
TGGRGFKAY

SEQ ID NO: 230723 - protein, 9 aa, Homo Sapiens
NVTKFLVAN

SEQ ID NO: 230724 - protein, 9 aa, Homo Sapiens
GAAWAPGAP

SEQ ID NO: 230725 - protein, 9 aa, Homo Sapiens
HERVPKKKS

SEQ ID NO: 230726 - protein, 9 aa, Homo Sapiens
LVANQILKD

SEQ ID NO: 230727 - protein, 9 aa, Homo Sapiens
VAMQFLRVT

SEQ ID NO: 230728 - protein, 9 aa, Homo Sapiens
LPELFCQAP

SEQ ID NO: 230729 - protein, 9 aa, Homo Sapiens
MHVEDPGPP

SEQ ID NO: 230730 - protein, 9 aa, Homo Sapiens
PFSTVRLLH

SEQ ID NO: 230731 - protein, 9 aa, Homo Sapiens
NEDLGHMYN

SEQ ID NO: 230732 - protein, 9 aa, Homo Sapiens
CVHGPTGSC

SEQ ID NO: 230733 - protein, 9 aa, Homo Sapiens
DREPPPREA

SEQ ID NO: 230734 - protein, 9 aa, Homo Sapiens
LFEYINQGG

SEQ ID NO: 230735 - protein, 9 aa, Homo Sapiens
PEEVLKNIY

SEQ ID NO: 230736 - protein, 9 aa, Homo Sapiens
SELHYDKLH

SEQ ID NO: 230737 - protein, 9 aa, Homo Sapiens
SGWRVAAAG

SEQ ID NO: 230738 - protein, 9 aa, Homo Sapiens
LHEGSHTGE

SEQ ID NO: 230739 - protein, 9 aa, Homo Sapiens
IKVEQVEFS

SEQ ID NO: 230740 - protein, 9 aa, Homo Sapiens
KVVLGLLAD

SEQ ID NO: 230741 - protein, 9 aa, Homo Sapiens
LKFISAVLA

SEQ ID NO: 230742 - protein, 9 aa, Homo Sapiens
QHRHIHTGE

SEQ ID NO: 230743 - protein, 9 aa, Homo Sapiens
GAVAVDLVH

SEQ ID NO: 230744 - protein, 9 aa, Homo Sapiens
SPWPSCKAR

SEQ ID NO: 230745 - protein, 9 aa, Homo Sapiens
RLIVKWNPP

SEQ ID NO: 230746 - protein, 9 aa, Homo Sapiens
NVSGLDPNT

SEQ ID NO: 230747 - protein, 9 aa, Homo Sapiens
ICIERGQAF

SEQ ID NO: 230748 - protein, 9 aa, Homo Sapiens
LFHGLGEGS

SEQ ID NO: 230749 - protein, 9 aa, Homo Sapiens
IVGIPSAFL

SEQ ID NO: 230750 - protein, 9 aa, Homo Sapiens
SSHKPHKRT

SEQ ID NO: 230751 - protein, 9 aa, Homo Sapiens
ANTGPPRES

SEQ ID NO: 230752 - protein, 9 aa, Homo Sapiens
IELGTNSLK

SEQ ID NO: 230753 - protein, 9 aa, Homo Sapiens
GELVWGPPD

SEQ ID NO: 230754 - protein, 9 aa, Homo Sapiens
GFSFFPASA

SEQ ID NO: 230755 - protein, 9 aa, Homo Sapiens
EEVVDLACT

SEQ ID NO: 230756 - protein, 9 aa, Homo Sapiens
SPEVRQSAA

SEQ ID NO: 230757 - protein, 9 aa, Homo Sapiens
EEKELMEHL

SEQ ID NO: 230758 - protein, 9 aa, Homo Sapiens
SLVNLLVGI

SEQ ID NO: 230759 - protein, 9 aa, Homo Sapiens
FDHMGHGRE

SEQ ID NO: 230760 - protein, 9 aa, Homo Sapiens
QLRTVRCIQ

SEQ ID NO: 230761 - protein, 9 aa, Homo Sapiens
HIHTGEKPY

SEQ ID NO: 230762 - protein, 9 aa, Homo Sapiens
VTVNVRNSE

SEQ ID NO: 230763 - protein, 9 aa, Homo Sapiens
RGDAGPGDA

SEQ ID NO: 230764 - protein, 9 aa, Homo Sapiens
LYLVILQTG

SEQ ID NO: 230765 - protein, 9 aa, Homo Sapiens
GRRMFPPSR

SEQ ID NO: 230766 - protein, 9 aa, Homo Sapiens
GVVFPEHQQ

SEQ ID NO: 230767 - protein, 9 aa, Homo Sapiens
WAGGGIQRN

SEQ ID NO: 230768 - protein, 9 aa, Homo Sapiens
LTWASSATA

SEQ ID NO: 230769 - protein, 9 aa, Homo Sapiens
VRIEKAYAQ

SEQ ID NO: 230770 - protein, 9 aa, Homo Sapiens
VFPCQPSRG

SEQ ID NO: 230771 - protein, 9 aa, Homo Sapiens
ASGLVIWEP

SEQ ID NO: 230772 - protein, 9 aa, Homo Sapiens
ASGGSGGCQ

SEQ ID NO: 230773 - protein, 9 aa, Homo Sapiens
DVSDSWPEQ

SEQ ID NO: 230774 - protein, 9 aa, Homo Sapiens
TRIDRLEDL

SEQ ID NO: 230775 - protein, 9 aa, Homo Sapiens
PCTSVTSTS

SEQ ID NO: 230776 - protein, 9 aa, Homo Sapiens
RLAIEVLER

SEQ ID NO: 230777 - protein, 9 aa, Homo Sapiens
RGRGSSQAE

SEQ ID NO: 230778 - protein, 9 aa, Homo Sapiens
DTNLQQLVS

SEQ ID NO: 230779 - protein, 9 aa, Homo Sapiens
AVRDLKKKL

SEQ ID NO: 230780 - protein, 9 aa, Homo Sapiens
GVANSLPRS

SEQ ID NO: 230781 - protein, 9 aa, Homo Sapiens
GLAICKMYH

SEQ ID NO: 230782 - protein, 9 aa, Homo Sapiens
LKQSADFYQ

SEQ ID NO: 230783 - protein, 9 aa, Homo Sapiens
QAMFNLAYL

SEQ ID NO: 230784 - protein, 9 aa, Homo Sapiens
KTDSYIISK

SEQ ID NO: 230785 - protein, 9 aa, Homo Sapiens
MSRTPPRRV

SEQ ID NO: 230786 - protein, 9 aa, Homo Sapiens
PRRWQQQRM

SEQ ID NO: 230787 - protein, 9 aa, Homo Sapiens
FPLVSLKEP

SEQ ID NO: 230788 - protein, 9 aa, Homo Sapiens
WAPSRSTCP

SEQ ID NO: 230789 - protein, 9 aa, Homo Sapiens
CLRCCFSPL

SEQ ID NO: 230790 - protein, 9 aa, Homo Sapiens
MLRIGSLIL

SEQ ID NO: 230791 - protein, 9 aa, Homo Sapiens
PRPALRPTD

SEQ ID NO: 230792 - protein, 9 aa, Homo Sapiens
QTGCMSICG

SEQ ID NO: 230793 - protein, 9 aa, Homo Sapiens
KKGNFQRTT

SEQ ID NO: 230794 - protein, 9 aa, Homo Sapiens
MCAHLFTAT

SEQ ID NO: 230795 - protein, 9 aa, Homo Sapiens
LGHSLLFCG

SEQ ID NO: 230796 - protein, 9 aa, Homo Sapiens
HLLEFQTPL

SEQ ID NO: 230797 - protein, 9 aa, Homo Sapiens
TVHLEATLE

SEQ ID NO: 230798 - protein, 9 aa, Homo Sapiens
HVSTTATTH

SEQ ID NO: 230799 - protein, 9 aa, Homo Sapiens
TVIPKTSTH

SEQ ID NO: 230800 - protein, 9 aa, Homo Sapiens
RRGGTCASS

SEQ ID NO: 230801 - protein, 9 aa, Homo Sapiens
LELERRFIF

SEQ ID NO: 230802 - protein, 9 aa, Homo Sapiens
TQVMLYSQG

SEQ ID NO: 230803 - protein, 9 aa, Homo Sapiens
ASSPPGRTA

SEQ ID NO: 230804 - protein, 9 aa, Homo Sapiens
FESLELCRP

SEQ ID NO: 230805 - protein, 9 aa, Homo Sapiens
SSTPPSRPR

SEQ ID NO: 230806 - protein, 9 aa, Homo Sapiens
MGSSLTSQL

SEQ ID NO: 230807 - protein, 9 aa, Homo Sapiens
LRSMRINNN

SEQ ID NO: 230808 - protein, 9 aa, Homo Sapiens
PHWLQARRW

SEQ ID NO: 230809 - protein, 9 aa, Homo Sapiens
GHILIFTCE

SEQ ID NO: 230810 - protein, 9 aa, Homo Sapiens
HLMIDQLMS

SEQ ID NO: 230811 - protein, 9 aa, Homo Sapiens
KTLLVVLLL

SEQ ID NO: 230812 - protein, 9 aa, Homo Sapiens
PAPKWRRRI

SEQ ID NO: 230813 - protein, 9 aa, Homo Sapiens
ESLVRFYIA

SEQ ID NO: 230814 - protein, 9 aa, Homo Sapiens
LTCADTFLF

SEQ ID NO: 230815 - protein, 9 aa, Homo Sapiens
LTLISRNSR

SEQ ID NO: 230816 - protein, 9 aa, Homo Sapiens
KALFIKEWH

SEQ ID NO: 230817 - protein, 9 aa, Homo Sapiens
HGEATQDPP

SEQ ID NO: 230818 - protein, 9 aa, Homo Sapiens
KKCSLYGKK

SEQ ID NO: 230819 - protein, 9 aa, Homo Sapiens
GPLGELVWG

SEQ ID NO: 230820 - protein, 9 aa, Homo Sapiens
LVGVHSSPN

SEQ ID NO: 230821 - protein, 9 aa, Homo Sapiens
PGLLPSPPL

SEQ ID NO: 230822 - protein, 9 aa, Homo Sapiens
SVLLLGVPQ

SEQ ID NO: 230823 - protein, 9 aa, Homo Sapiens
DAMPTHRNL

SEQ ID NO: 230824 - protein, 9 aa, Homo Sapiens
QDLCWELHA

SEQ ID NO: 230825 - protein, 9 aa, Homo Sapiens
VPSHKLTLE

SEQ ID NO: 230826 - protein, 9 aa, Homo Sapiens
WPRVPHWGP

SEQ ID NO: 230827 - protein, 9 aa, Homo Sapiens
ECSSTKASV

SEQ ID NO: 230828 - protein, 9 aa, Homo Sapiens
RGRCGTWAW

SEQ ID NO: 230829 - protein, 9 aa, Homo Sapiens
VLHISRGEG

SEQ ID NO: 230830 - protein, 9 aa, Homo Sapiens
RALACWLRP

SEQ ID NO: 230831 - protein, 9 aa, Homo Sapiens
VLWLLTANG

SEQ ID NO: 230832 - protein, 9 aa, Homo Sapiens
NPSLITRQM

SEQ ID NO: 230833 - protein, 9 aa, Homo Sapiens
SSTHCTGAR

SEQ ID NO: 230834 - protein, 9 aa, Homo Sapiens
VDSLYLMQK

SEQ ID NO: 230835 - protein, 9 aa, Homo Sapiens
RVPGASNGL

SEQ ID NO: 230836 - protein, 9 aa, Homo Sapiens
TLQLRFPIA

SEQ ID NO: 230837 - protein, 9 aa, Homo Sapiens
HVCTGEHYY

SEQ ID NO: 230838 - protein, 9 aa, Homo Sapiens
CVVIEMVTA

SEQ ID NO: 230839 - protein, 9 aa, Homo Sapiens
AGMGTQQAR

SEQ ID NO: 230840 - protein, 9 aa, Homo Sapiens
QDILNGGSS

SEQ ID NO: 230841 - protein, 9 aa, Homo Sapiens
RHAPPPRMA

SEQ ID NO: 230842 - protein, 9 aa, Homo Sapiens
MVSPSNSLM

SEQ ID NO: 230843 - protein, 9 aa, Homo Sapiens
ASERGPLDK

SEQ ID NO: 230844 - protein, 9 aa, Homo Sapiens
VQHRHIHTG

SEQ ID NO: 230845 - protein, 9 aa, Homo Sapiens
TPGRRGGTC

SEQ ID NO: 230846 - protein, 9 aa, Homo Sapiens
AYVRATLFA

SEQ ID NO: 230847 - protein, 9 aa, Homo Sapiens
KILRWEGTC

SEQ ID NO: 230848 - protein, 9 aa, Homo Sapiens
SGGAWSMPR

SEQ ID NO: 230849 - protein, 9 aa, Homo Sapiens
GFGKDMTLY

SEQ ID NO: 230850 - protein, 9 aa, Homo Sapiens
VEDFWEVDP

SEQ ID NO: 230851 - protein, 9 aa, Homo Sapiens
SPPLPQAQV

SEQ ID NO: 230852 - protein, 9 aa, Homo Sapiens
KKLMKYCHI

SEQ ID NO: 230853 - protein, 9 aa, Homo Sapiens
KENTIILQE

SEQ ID NO: 230854 - protein, 9 aa, Homo Sapiens
YQFPMVPGE

SEQ ID NO: 230855 - protein, 9 aa, Homo Sapiens
MGLMNANHV

SEQ ID NO: 230856 - protein, 9 aa, Homo Sapiens
EPCINIGLR

SEQ ID NO: 230857 - protein, 9 aa, Homo Sapiens
VEDPAGCVC

SEQ ID NO: 230858 - protein, 9 aa, Homo Sapiens
PAGAVVWPS

SEQ ID NO: 230859 - protein, 9 aa, Homo Sapiens
WWTRKVICI

SEQ ID NO: 230860 - protein, 9 aa, Homo Sapiens
DQDRRIVLK

SEQ ID NO: 230861 - protein, 9 aa, Homo Sapiens
ALALLFLLS

SEQ ID NO: 230862 - protein, 9 aa, Homo Sapiens
FDGEEWKKS

SEQ ID NO: 230863 - protein, 9 aa, Homo Sapiens
SAQPTNHVS

SEQ ID NO: 230864 - protein, 9 aa, Homo Sapiens
SCVNSIEGK

SEQ ID NO: 230865 - protein, 9 aa, Homo Sapiens
LYFKHLLDQ

SEQ ID NO: 230866 - protein, 9 aa, Homo Sapiens
PNPLQPHFK

SEQ ID NO: 230867 - protein, 9 aa, Homo Sapiens
GTVVGLLEV

SEQ ID NO: 230868 - protein, 9 aa, Homo Sapiens
PRNGPWETP

SEQ ID NO: 230869 - protein, 9 aa, Homo Sapiens
DPHAGPSGC

SEQ ID NO: 230870 - protein, 9 aa, Homo Sapiens
HQRIHTGEE

SEQ ID NO: 230871 - protein, 9 aa, Homo Sapiens
LHFHILTWP

SEQ ID NO: 230872 - protein, 9 aa, Homo Sapiens
ARPADHIPP

SEQ ID NO: 230873 - protein, 9 aa, Homo Sapiens
WALAQAGRG

SEQ ID NO: 230874 - protein, 9 aa, Homo Sapiens
IAILRGNHE

SEQ ID NO: 230875 - protein, 9 aa, Homo Sapiens
HTSHNTLEF

SEQ ID NO: 230876 - protein, 9 aa, Homo Sapiens
VASTLAPAS

SEQ ID NO: 230877 - protein, 9 aa, Homo Sapiens
KLPEVKLPE

SEQ ID NO: 230878 - protein, 9 aa, Homo Sapiens
SSPSSTPPS

SEQ ID NO: 230879 - protein, 9 aa, Homo Sapiens
IGPPGHPGP

SEQ ID NO: 230880 - protein, 9 aa, Homo Sapiens
GDKDGPAQQ

SEQ ID NO: 230881 - protein, 9 aa, Homo Sapiens
CLRNAHSIP

SEQ ID NO: 230882 - protein, 9 aa, Homo Sapiens
SPRHKKVIL

SEQ ID NO: 230883 - protein, 9 aa, Homo Sapiens
KKDKKENKK

SEQ ID NO: 230884 - protein, 9 aa, Homo Sapiens
FCRPTTVRK

SEQ ID NO: 230885 - protein, 9 aa, Homo Sapiens
ESERFNPGS

SEQ ID NO: 230886 - protein, 9 aa, Homo Sapiens
PFIGKNRMF

SEQ ID NO: 230887 - protein, 9 aa, Homo Sapiens
LLHYLDNHG

SEQ ID NO: 230888 - protein, 9 aa, Homo Sapiens
RELCISRQL

SEQ ID NO: 230889 - protein, 9 aa, Homo Sapiens
ISILDVCLD

SEQ ID NO: 230890 - protein, 9 aa, Homo Sapiens
KIIDWILKT

SEQ ID NO: 230891 - protein, 9 aa, Homo Sapiens
HPLCSTMWS

SEQ ID NO: 230892 - protein, 9 aa, Homo Sapiens
DRDHHVSIV

SEQ ID NO: 230893 - protein, 9 aa, Homo Sapiens
LSLHPDGTK

SEQ ID NO: 230894 - protein, 9 aa, Homo Sapiens
RPGWAPCGW

SEQ ID NO: 230895 - protein, 9 aa, Homo Sapiens
EPGLSGLPG

SEQ ID NO: 230896 - protein, 9 aa, Homo Sapiens
PRAPHPPPA

SEQ ID NO: 230897 - protein, 9 aa, Homo Sapiens
ICDPDCKNH

SEQ ID NO: 230898 - protein, 9 aa, Homo Sapiens
TLRTLHAAR

SEQ ID NO: 230899 - protein, 9 aa, Homo Sapiens
KMTSLNSAT

SEQ ID NO: 230900 - protein, 9 aa, Homo Sapiens
GIHLHSYQL

SEQ ID NO: 230901 - protein, 9 aa, Homo Sapiens
LATSAVEQP

SEQ ID NO: 230902 - protein, 9 aa, Homo Sapiens
LQAKSVGVK

SEQ ID NO: 230903 - protein, 9 aa, Homo Sapiens
STKYLNLTA

SEQ ID NO: 230904 - protein, 9 aa, Homo Sapiens
GEEWKKSQL

SEQ ID NO: 230905 - protein, 9 aa, Homo Sapiens
ADGLIKVQV

SEQ ID NO: 230906 - protein, 9 aa, Homo Sapiens
TRATHTKPC

SEQ ID NO: 230907 - protein, 9 aa, Homo Sapiens
IHGVVLHSI

SEQ ID NO: 230908 - protein, 9 aa, Homo Sapiens
SMFGKLYLL

SEQ ID NO: 230909 - protein, 9 aa, Homo Sapiens
MDSLRPVRL

SEQ ID NO: 230910 - protein, 9 aa, Homo Sapiens
RERARQGTG

SEQ ID NO: 230911 - protein, 9 aa, Homo Sapiens
DTVILYRSY

SEQ ID NO: 230912 - protein, 9 aa, Homo Sapiens
VAPSTHTPS

SEQ ID NO: 230913 - protein, 9 aa, Homo Sapiens
LLNVPNIFK

SEQ ID NO: 230914 - protein, 9 aa, Homo Sapiens
HCTSSSRTY

SEQ ID NO: 230915 - protein, 9 aa, Homo Sapiens
LPARTLARL

SEQ ID NO: 230916 - protein, 9 aa, Homo Sapiens
VKVMPHHSL

SEQ ID NO: 230917 - protein, 9 aa, Homo Sapiens
RGRGRRGSR

SEQ ID NO: 230918 - protein, 9 aa, Homo Sapiens
EAKKPFKQV

SEQ ID NO: 230919 - protein, 9 aa, Homo Sapiens
IGLDFQYSH

SEQ ID NO: 230920 - protein, 9 aa, Homo Sapiens
PDKKRNSYR

SEQ ID NO: 230921 - protein, 9 aa, Homo Sapiens
APTPSSPLP

SEQ ID NO: 230922 - protein, 9 aa, Homo Sapiens
KTWMQGISK

SEQ ID NO: 230923 - protein, 9 aa, Homo Sapiens
TVDTCTSCF

SEQ ID NO: 230924 - protein, 9 aa, Homo Sapiens
VFAIWLAPS

SEQ ID NO: 230925 - protein, 9 aa, Homo Sapiens
PGLRARSRG

SEQ ID NO: 230926 - protein, 9 aa, Homo Sapiens
GWAWGHPCE

SEQ ID NO: 230927 - protein, 9 aa, Homo Sapiens
PGASSGWAG

SEQ ID NO: 230928 - protein, 9 aa, Homo Sapiens
SVGLGASSC

SEQ ID NO: 230929 - protein, 9 aa, Homo Sapiens
GKSQGGRIL

SEQ ID NO: 230930 - protein, 9 aa, Homo Sapiens
GAPPCQSAE

SEQ ID NO: 230931 - protein, 9 aa, Homo Sapiens
CKKYKIWMY

SEQ ID NO: 230932 - protein, 9 aa, Homo Sapiens
VGKQQMMDV

SEQ ID NO: 230933 - protein, 9 aa, Homo Sapiens
LSPQELGFS

SEQ ID NO: 230934 - protein, 9 aa, Homo Sapiens
NHIQRIPKD

SEQ ID NO: 230935 - protein, 9 aa, Homo Sapiens
GVVLSPWCL

SEQ ID NO: 230936 - protein, 9 aa, Homo Sapiens
TVAQMDDNN

SEQ ID NO: 230937 - protein, 9 aa, Homo Sapiens
SLILHEGSH

SEQ ID NO: 230938 - protein, 9 aa, Homo Sapiens
PGVHPGCQG

SEQ ID NO: 230939 - protein, 9 aa, Homo Sapiens
WTRNPRQPA

SEQ ID NO: 230940 - protein, 9 aa, Homo Sapiens
RVWPSTTTL

SEQ ID NO: 230941 - protein, 9 aa, Homo Sapiens
PTATPAAVV

SEQ ID NO: 230942 - protein, 9 aa, Homo Sapiens
GSPLFKIVD

SEQ ID NO: 230943 - protein, 9 aa, Homo Sapiens
SKNAPHLQD

SEQ ID NO: 230944 - protein, 9 aa, Homo Sapiens
AVITLLEAT

SEQ ID NO: 230945 - protein, 9 aa, Homo Sapiens
QTVTSGKVC

SEQ ID NO: 230946 - protein, 9 aa, Homo Sapiens
LSQVAGASP

SEQ ID NO: 230947 - protein, 9 aa, Homo Sapiens
LSLMIRKQI

SEQ ID NO: 230948 - protein, 9 aa, Homo Sapiens
RWPSATTAN

SEQ ID NO: 230949 - protein, 9 aa, Homo Sapiens
FPVSAQSLL

SEQ ID NO: 230950 - protein, 9 aa, Homo Sapiens
CVWFVIFLA

SEQ ID NO: 230951 - protein, 9 aa, Homo Sapiens
QVEMADYDL

SEQ ID NO: 230952 - protein, 9 aa, Homo Sapiens
VLDFFSRSH

SEQ ID NO: 230953 - protein, 9 aa, Homo Sapiens
PASHVCSLK

SEQ ID NO: 230954 - protein, 9 aa, Homo Sapiens
FQKALLTLA

SEQ ID NO: 230955 - protein, 9 aa, Homo Sapiens
AEFRAQLGP

SEQ ID NO: 230956 - protein, 9 aa, Homo Sapiens
FTTARNLLT

SEQ ID NO: 230957 - protein, 9 aa, Homo Sapiens
EWCIGTVPI

SEQ ID NO: 230958 - protein, 9 aa, Homo Sapiens
SRCESAAWT

SEQ ID NO: 230959 - protein, 9 aa, Homo Sapiens
LAEQRTDIF

SEQ ID NO: 230960 - protein, 9 aa, Homo Sapiens
SRDEGFMTQ

SEQ ID NO: 230961 - protein, 9 aa, Homo Sapiens
PSHSPPSLA

SEQ ID NO: 230962 - protein, 9 aa, Homo Sapiens
RGLGRPPRS

SEQ ID NO: 230963 - protein, 9 aa, Homo Sapiens
CGCPHTTPD

SEQ ID NO: 230964 - protein, 9 aa, Homo Sapiens
VVSAASATG

SEQ ID NO: 230965 - protein, 9 aa, Homo Sapiens
IIPMGQTQP
